United States Patent 7,691,997 (FUNCTIONAL AND HYPERFUNCTIONAL SIRNA) - sequence listing, part 37

SEQ ID NO: 1502385 - RNA, 19 nt, Homo sapiens
aaugagacccacucugaua

SEQ ID NO: 1502386 - RNA, 19 nt, Homo sapiens
ggacgaagaaagugaacug

SEQ ID NO: 1502387 - RNA, 19 nt, Homo sapiens
gaaauuuacaggaaguaca

SEQ ID NO: 1502388 - RNA, 19 nt, Homo sapiens
cugcagaaauuaacuugug

SEQ ID NO: 1502389 - RNA, 19 nt, Homo sapiens
ucagcuacaugaggaauga

SEQ ID NO: 1502390 - RNA, 19 nt, Homo sapiens
gcagaaaguggaaccagau

SEQ ID NO: 1502391 - RNA, 19 nt, Homo sapiens
caagugauugcuuuccuuu

SEQ ID NO: 1502392 - RNA, 19 nt, Homo sapiens
gagaagcugcuauuucagu

SEQ ID NO: 1502393 - RNA, 19 nt, Homo sapiens
gcacucuacagaugaagaa

SEQ ID NO: 1502394 - RNA, 19 nt, Homo sapiens
gggcuuuccuugauguuag

SEQ ID NO: 1502395 - RNA, 19 nt, Homo sapiens
caggguacaugcaucugaa

SEQ ID NO: 1502396 - RNA, 19 nt, Homo sapiens
guacagaaagcugaucgaa

SEQ ID NO: 1502397 - RNA, 19 nt, Homo sapiens
aggcgagaauuuauacaaa

SEQ ID NO: 1502398 - RNA, 19 nt, Homo sapiens
gagcuggaccgccugguau

SEQ ID NO: 1502399 - RNA, 19 nt, Homo sapiens
gcacacucugcagaaauua

SEQ ID NO: 1502400 - RNA, 19 nt, Homo sapiens
gacccacucugauagaucu

SEQ ID NO: 1502401 - RNA, 19 nt, Homo sapiens
acaaugcugucuugaccaa

SEQ ID NO: 1502402 - RNA, 19 nt, Homo sapiens
gcugagcucuggcgguaca

SEQ ID NO: 1502403 - RNA, 19 nt, Homo sapiens
guuccuggauggacgaaga

SEQ ID NO: 1502404 - RNA, 19 nt, Homo sapiens
ugcaggaaauuuacaggaa

SEQ ID NO: 1502405 - RNA, 19 nt, Homo sapiens
gcuugagcuucuucuuaaa

SEQ ID NO: 1502406 - RNA, 19 nt, Homo sapiens
gcuauuuugucaucguuua

SEQ ID NO: 1502407 - RNA, 19 nt, Homo sapiens
guccagggcugcucuuguc

SEQ ID NO: 1502408 - RNA, 19 nt, Homo sapiens
gcagaaauuaacuugugaa

SEQ ID NO: 1502409 - RNA, 19 nt, Homo sapiens
gggcaaacgccuggauuau

SEQ ID NO: 1502410 - RNA, 19 nt, Homo sapiens
gagaacuugugugagaaug

SEQ ID NO: 1502411 - RNA, 19 nt, Homo sapiens
gaucucagagcucaacauc

SEQ ID NO: 1502412 - RNA, 19 nt, Homo sapiens
aucaggagcucauucauca

SEQ ID NO: 1502413 - RNA, 19 nt, Homo sapiens
ucucuuagaacuacacuug

SEQ ID NO: 1502414 - RNA, 19 nt, Homo sapiens
ugggagcacuuugaacuug

SEQ ID NO: 1502415 - RNA, 19 nt, Homo sapiens
ugagcacucuacagaugaa

SEQ ID NO: 1502416 - RNA, 19 nt, Homo sapiens
gaagcugcuauuucaguga

SEQ ID NO: 1502417 - RNA, 19 nt, Homo sapiens
ggccuccugucuugucuga

SEQ ID NO: 1502418 - RNA, 19 nt, Homo sapiens
gagacccacucugauagau

SEQ ID NO: 1502419 - RNA, 19 nt, Homo sapiens
ggauggacgaagaaaguga

SEQ ID NO: 1502420 - RNA, 19 nt, Homo sapiens
aaagcgcuauguuuaccaa

SEQ ID NO: 1502421 - RNA, 19 nt, Homo sapiens
gaaggcuccagguggcuuu

SEQ ID NO: 1502422 - RNA, 19 nt, Homo sapiens
caggaaauuuacaggaagu

SEQ ID NO: 1502423 - RNA, 19 nt, Homo sapiens
ggcgagaauuuauacaaac

SEQ ID NO: 1502424 - RNA, 19 nt, Homo sapiens
gguacaugcaucugaaguu

SEQ ID NO: 1502425 - RNA, 19 nt, Homo sapiens
gauggacgaagaaagugaa

SEQ ID NO: 1502426 - RNA, 19 nt, Homo sapiens
ggugaacuucuucuuugaa

SEQ ID NO: 1502427 - RNA, 19 nt, Homo sapiens
uugcuuuccuuuccucauu

SEQ ID NO: 1502428 - RNA, 19 nt, Homo sapiens
cccugaaccucaacuacaa

SEQ ID NO: 1502429 - RNA, 19 nt, Homo sapiens
gcuguuugguauguuaaga

SEQ ID NO: 1502430 - RNA, 19 nt, Homo sapiens
ggaaguacagaaagcugau

SEQ ID NO: 1502431 - RNA, 19 nt, Homo sapiens
caucaaaugccacguucau

SEQ ID NO: 1502432 - RNA, 19 nt, Homo sapiens
ggaccaucaacaucaaaug

SEQ ID NO: 1502433 - RNA, 19 nt, Homo sapiens
ucaccuugcugucuacaac

SEQ ID NO: 1502434 - RNA, 19 nt, Homo sapiens
gagaaacacuucaaaugua

SEQ ID NO: 1502435 - RNA, 19 nt, Homo sapiens
ggagagagcucacaaagau

SEQ ID NO: 1502436 - RNA, 19 nt, Homo sapiens
uaacagagcuucacaccuu

SEQ ID NO: 1502437 - RNA, 19 nt, Homo sapiens
aauagaagcucauacguua

SEQ ID NO: 1502438 - RNA, 19 nt, Homo sapiens
gaaaggagacaaagaauau

SEQ ID NO: 1502439 - RNA, 19 nt, Homo sapiens
ggagagaagucuuucaaau

SEQ ID NO: 1502440 - RNA, 19 nt, Homo sapiens
agagagagcuuucaaaugu

SEQ ID NO: 1502441 - RNA, 19 nt, Homo sapiens
ggucauaccuuacucaaca

SEQ ID NO: 1502442 - RNA, 19 nt, Homo sapiens
gcucauaccuuacucaaca

SEQ ID NO: 1502443 - RNA, 19 nt, Homo sapiens
agagaaaccuuacaaaugu

SEQ ID NO: 1502444 - RNA, 19 nt, Homo sapiens
gagagaaaccuuacaaaug

SEQ ID NO: 1502445 - RNA, 19 nt, Homo sapiens
gagagaagccuuucaagug

SEQ ID NO: 1502446 - RNA, 19 nt, Homo sapiens
caacaucagagaauucaua

SEQ ID NO: 1502447 - RNA, 19 nt, Homo sapiens
gagcaaggcauacaagauu

SEQ ID NO: 1502448 - RNA, 19 nt, Homo sapiens
gagaagccuuucaagugua

SEQ ID NO: 1502449 - RNA, 19 nt, Homo sapiens
ucucaaagcuuacucaaca

SEQ ID NO: 1502450 - RNA, 19 nt, Homo sapiens
aaccaugacucagauauua

SEQ ID NO: 1502451 - RNA, 19 nt, Homo sapiens
agagaagucuuucaaaugu

SEQ ID NO: 1502452 - RNA, 19 nt, Homo sapiens
gagagaaacacuucaaaug

SEQ ID NO: 1502453 - RNA, 19 nt, Homo sapiens
uagaaacccugcaagugua

SEQ ID NO: 1502454 - RNA, 19 nt, Homo sapiens
gcucacaccuuacucaaca

SEQ ID NO: 1502455 - RNA, 19 nt, Homo sapiens
gcucaacccuuacucaaca

SEQ ID NO: 1502456 - RNA, 19 nt, Homo sapiens
gcucacaccuuacucaaca

SEQ ID NO: 1502457 - RNA, 19 nt, Homo sapiens
gcucacaccuuacucaaca

SEQ ID NO: 1502458 - RNA, 19 nt, Homo sapiens
gagagaagucuuucaaaug

SEQ ID NO: 1502459 - RNA, 19 nt, Homo sapiens
aacagaggcucauaccuua

SEQ ID NO: 1502460 - RNA, 19 nt, Homo sapiens
uaacaagaguucacaccuu

SEQ ID NO: 1502461 - RNA, 19 nt, Homo sapiens
ggagagaaaccuuacaaau

SEQ ID NO: 1502462 - RNA, 19 nt, Homo sapiens
ggagagagagcuuucaaau

SEQ ID NO: 1502463 - RNA, 19 nt, Homo sapiens
gagaugugauguuggagaa

SEQ ID NO: 1502464 - RNA, 19 nt, Homo sapiens
aacagacgcucaacccuua

SEQ ID NO: 1502465 - RNA, 19 nt, Homo sapiens
caacaucagagaauccaua

SEQ ID NO: 1502466 - RNA, 19 nt, Homo sapiens
caacaucagagaauccaua

SEQ ID NO: 1502467 - RNA, 19 nt, Homo sapiens
uaacagaggcucauaccuu

SEQ ID NO: 1502468 - RNA, 19 nt, Homo sapiens
caacaucagagaauccaua

SEQ ID NO: 1502469 - RNA, 19 nt, Homo sapiens
gacccauucucaaagcuua

SEQ ID NO: 1502470 - RNA, 19 nt, Homo sapiens
accaggagcucacaccuua

SEQ ID NO: 1502471 - RNA, 19 nt, Homo sapiens
uaccaauccucaaagcuua

SEQ ID NO: 1502472 - RNA, 19 nt, Homo sapiens
guagaaacccugcaagugu

SEQ ID NO: 1502473 - RNA, 19 nt, Homo sapiens
agaaagaacuaaggugcua

SEQ ID NO: 1502474 - RNA, 19 nt, Homo sapiens
gaaauggaacucuuaacau

SEQ ID NO: 1502475 - RNA, 19 nt, Homo sapiens
aagcaacacugggaagaua

SEQ ID NO: 1502476 - RNA, 19 nt, Homo sapiens
agaaaucccauauguguaa

SEQ ID NO: 1502477 - RNA, 19 nt, Homo sapiens
cuaaagggacauaagauaa

SEQ ID NO: 1502478 - RNA, 19 nt, Homo sapiens
ugaaaggagacaaagaaua

SEQ ID NO: 1502479 - RNA, 19 nt, Homo sapiens
gccaauauuugacaacuag

SEQ ID NO: 1502480 - RNA, 19 nt, Homo sapiens
ucccauauguguaaugauu

SEQ ID NO: 1502481 - RNA, 19 nt, Homo sapiens
uaaagaauguggcaaagcu

SEQ ID NO: 1502482 - RNA, 19 nt, Homo sapiens
uaaagaauguggcaaagcu

SEQ ID NO: 1502483 - RNA, 19 nt, Homo sapiens
ggagagaaacacuucaaau

SEQ ID NO: 1502484 - RNA, 19 nt, Homo sapiens
agagaagccuuucaagugu

SEQ ID NO: 1502485 - RNA, 19 nt, Homo sapiens
caacuagucauaacaaaca

SEQ ID NO: 1502486 - RNA, 19 nt, Homo sapiens
gaaaaucaauacuggauag

SEQ ID NO: 1502487 - RNA, 19 nt, Homo sapiens
cgacaucaaagaauccaua

SEQ ID NO: 1502488 - RNA, 19 nt, Homo sapiens
guucacaccuugcucaaca

SEQ ID NO: 1502489 - RNA, 19 nt, Homo sapiens
acagaaccauguauuccua

SEQ ID NO: 1502490 - RNA, 19 nt, Homo sapiens
gacaacuagucauaacaaa

SEQ ID NO: 1502491 - RNA, 19 nt, Homo sapiens
ggagagaagccuuucaagu

SEQ ID NO: 1502492 - RNA, 19 nt, Homo sapiens
agaagucuuucaaauguga

SEQ ID NO: 1502493 - RNA, 19 nt, Homo sapiens
gagagagagcuuucaaaug

SEQ ID NO: 1502494 - RNA, 19 nt, Homo sapiens
uaaagaacguggcaaagcu

SEQ ID NO: 1502495 - RNA, 19 nt, Homo sapiens
ggauguggccauagaauuc

SEQ ID NO: 1502496 - RNA, 19 nt, Homo sapiens
ggagacaaagaauauagaa

SEQ ID NO: 1502497 - RNA, 19 nt, Homo sapiens
ugaaacuucugacccauuc

SEQ ID NO: 1502498 - RNA, 19 nt, Homo sapiens
gaaccauguauuccuauga

SEQ ID NO: 1502499 - RNA, 19 nt, Homo sapiens
ucagggauguggccauaga

SEQ ID NO: 1502500 - RNA, 19 nt, Homo sapiens
caacaccagagaauccaua

SEQ ID NO: 1502501 - RNA, 19 nt, Homo sapiens
agagagcuuucaaauguga

SEQ ID NO: 1502502 - RNA, 19 nt, Homo sapiens
gagagagcuuucaaaugug

SEQ ID NO: 1502503 - RNA, 19 nt, Homo sapiens
gagaagucuuucaaaugug

SEQ ID NO: 1502504 - RNA, 19 nt, Homo sapiens
uaauagaagcucauacguu

SEQ ID NO: 1502505 - RNA, 19 nt, Homo sapiens
ggacaaaaggaauguuaua

SEQ ID NO: 1502506 - RNA, 19 nt, Homo sapiens
uggcaaagcuuuuaacaga

SEQ ID NO: 1502507 - RNA, 19 nt, Homo sapiens
agagaaacacuucaaaugu

SEQ ID NO: 1502508 - RNA, 19 nt, Homo sapiens
uggcaaagcuuuuaacaga

SEQ ID NO: 1502509 - RNA, 19 nt, Homo sapiens
uggcaaagcuuuuaacaga

SEQ ID NO: 1502510 - RNA, 19 nt, Homo sapiens
gggcuuacaucuuggacau

SEQ ID NO: 1502511 - RNA, 19 nt, Homo sapiens
ucuaaagggacauaagaua

SEQ ID NO: 1502512 - RNA, 19 nt, Homo sapiens
gcuagcacuuccguaaauu

SEQ ID NO: 1502513 - RNA, 19 nt, Homo sapiens
uaaugaauguggugaaacu

SEQ ID NO: 1502514 - RNA, 19 nt, Homo sapiens
guaaacaucauaguacuca

SEQ ID NO: 1502515 - RNA, 19 nt, Homo sapiens
caucagagaauucauacug

SEQ ID NO: 1502516 - RNA, 19 nt, Homo sapiens
caacaucagagaguccaua

SEQ ID NO: 1502517 - RNA, 19 nt, Homo sapiens
caucaaagaauccauacug

SEQ ID NO: 1502518 - RNA, 19 nt, Homo sapiens
agaagccuuucaaguguaa

SEQ ID NO: 1502519 - RNA, 19 nt, Homo sapiens
ccuuacaacucuaaugaau

SEQ ID NO: 1502520 - RNA, 19 nt, Homo sapiens
cuauguagccaauauuuga

SEQ ID NO: 1502521 - RNA, 19 nt, Homo sapiens
gaaaucccauauguguaau

SEQ ID NO: 1502522 - RNA, 19 nt, Homo sapiens
auauagagaugugauguug

SEQ ID NO: 1502523 - RNA, 19 nt, Homo sapiens
ugaagaauguggcaaagcu

SEQ ID NO: 1502524 - RNA, 19 nt, Homo sapiens
gagcuucacaccuuacuca

SEQ ID NO: 1502525 - RNA, 19 nt, Homo sapiens
uaaggaauguggcaaagcu

SEQ ID NO: 1502526 - RNA, 19 nt, Homo sapiens
uaaggaauguggcaaagcu

SEQ ID NO: 1502527 - RNA, 19 nt, Homo sapiens
gaacguggcaaagcuuuua

SEQ ID NO: 1502528 - RNA, 19 nt, Homo sapiens
gauagaaaucccauaugug

SEQ ID NO: 1502529 - RNA, 19 nt, Homo sapiens
cgagaaauggaacucuuaa

SEQ ID NO: 1502530 - RNA, 19 nt, Homo sapiens
gcuuacaucuuggacauca

SEQ ID NO: 1502531 - RNA, 19 nt, Homo sapiens
caucuaaagggacauaaga

SEQ ID NO: 1502532 - RNA, 19 nt, Homo sapiens
auagagaugugauguugga

SEQ ID NO: 1502533 - RNA, 19 nt, Homo sapiens
acauuuaacugugaaagga

SEQ ID NO: 1502534 - RNA, 19 nt, Homo sapiens
ugacaguccuugcucauua

SEQ ID NO: 1502535 - RNA, 19 nt, Homo sapiens
gcagacagaucaugggaaa

SEQ ID NO: 1502536 - RNA, 19 nt, Homo sapiens
guacagaucugcuucucaa

SEQ ID NO: 1502537 - RNA, 19 nt, Homo sapiens
ugagagaccugguugauga

SEQ ID NO: 1502538 - RNA, 19 nt, Homo sapiens
gaagacacaccguuaauga

SEQ ID NO: 1502539 - RNA, 19 nt, Homo sapiens
gaaacugucaccacgauaa

SEQ ID NO: 1502540 - RNA, 19 nt, Homo sapiens
ccuaacaacugaugaucua

SEQ ID NO: 1502541 - RNA, 19 nt, Homo sapiens
gaugauaguccucaacaaa

SEQ ID NO: 1502542 - RNA, 19 nt, Homo sapiens
gauaaauagucaccacaga

SEQ ID NO: 1502543 - RNA, 19 nt, Homo sapiens
uagaaacaauccacuuuga

SEQ ID NO: 1502544 - RNA, 19 nt, Homo sapiens
gggcaaggauaacuuuguu

SEQ ID NO: 1502545 - RNA, 19 nt, Homo sapiens
aagauaagcuguacagauc

SEQ ID NO: 1502546 - RNA, 19 nt, Homo sapiens
ucaggaaucuucaguaucu

SEQ ID NO: 1502547 - RNA, 19 nt, Homo sapiens
gaaacaauccacuuugaag

SEQ ID NO: 1502548 - RNA, 19 nt, Homo sapiens
ggaaagcaauguggugaca

SEQ ID NO: 1502549 - RNA, 19 nt, Homo sapiens
gcaauguggugacaaaauu

SEQ ID NO: 1502550 - RNA, 19 nt, Homo sapiens
aaagcaauguggugacaaa

SEQ ID NO: 1502551 - RNA, 19 nt, Homo sapiens
caagaaaugccguggaaga

SEQ ID NO: 1502552 - RNA, 19 nt, Homo sapiens
acacaccguuaaugacaua

SEQ ID NO: 1502553 - RNA, 19 nt, Homo sapiens
gcaacuauauuuacaaacc

SEQ ID NO: 1502554 - RNA, 19 nt, Homo sapiens
guagaagacacaccguuaa

SEQ ID NO: 1502555 - RNA, 19 nt, Homo sapiens
gaauagaaacaauccacuu

SEQ ID NO: 1502556 - RNA, 19 nt, Homo sapiens
cauuggacauugagaagaa

SEQ ID NO: 1502557 - RNA, 19 nt, Homo sapiens
agaaggcuuugcaccauuu

SEQ ID NO: 1502558 - RNA, 19 nt, Homo sapiens
ccuguuauacgcucaaaua

SEQ ID NO: 1502559 - RNA, 19 nt, Homo sapiens
cccagcagauggaucauuu

SEQ ID NO: 1502560 - RNA, 19 nt, Homo sapiens
gaccacagauccaaaagaa

SEQ ID NO: 1502561 - RNA, 19 nt, Homo sapiens
gcagauggaucauuuucuu

SEQ ID NO: 1502562 - RNA, 19 nt, Homo sapiens
gauaagcuguacagaucug

SEQ ID NO: 1502563 - RNA, 19 nt, Homo sapiens
ucucaggaaucuucaguau

SEQ ID NO: 1502564 - RNA, 19 nt, Homo sapiens
cccguuaacucugaugaua

SEQ ID NO: 1502565 - RNA, 19 nt, Homo sapiens
ccaugagccuaacaacuga

SEQ ID NO: 1502566 - RNA, 19 nt, Homo sapiens
aguccuugcucauuagaua

SEQ ID NO: 1502567 - RNA, 19 nt, Homo sapiens
cagaaggcuuugcaccauu

SEQ ID NO: 1502568 - RNA, 19 nt, Homo sapiens
guggaagacuggguucauu

SEQ ID NO: 1502569 - RNA, 19 nt, Homo sapiens
aacaagaaaugccguggaa

SEQ ID NO: 1502570 - RNA, 19 nt, Homo sapiens
guugaagcccugaaacaaa

SEQ ID NO: 1502571 - RNA, 19 nt, Homo sapiens
caacugaugaucuauuaag

SEQ ID NO: 1502572 - RNA, 19 nt, Homo sapiens
gauggcucguuucacuaua

SEQ ID NO: 1502573 - RNA, 19 nt, Homo sapiens
gaagaagccauggcgaaau

SEQ ID NO: 1502574 - RNA, 19 nt, Homo sapiens
ucaccacgauaaauaguca

SEQ ID NO: 1502575 - RNA, 19 nt, Homo sapiens
guacugaagaauuaccaaa

SEQ ID NO: 1502576 - RNA, 19 nt, Homo sapiens
uguagaagacacaccguua

SEQ ID NO: 1502577 - RNA, 19 nt, Homo sapiens
gcucuacaggcuuauauug

SEQ ID NO: 1502578 - RNA, 19 nt, Homo sapiens
uugaagcccugaaacaaau

SEQ ID NO: 1502579 - RNA, 19 nt, Homo sapiens
aaagauaagcuguacagau

SEQ ID NO: 1502580 - RNA, 19 nt, Homo sapiens
aaacaauccacuuugaaga

SEQ ID NO: 1502581 - RNA, 19 nt, Homo sapiens
gggcaaagagugcuaaagg

SEQ ID NO: 1502582 - RNA, 19 nt, Homo sapiens
aagaagccauggcgaaauc

SEQ ID NO: 1502583 - RNA, 19 nt, Homo sapiens
ugagaagaauccacauuuu

SEQ ID NO: 1502584 - RNA, 19 nt, Homo sapiens
cuacaggcuuauauugaug

SEQ ID NO: 1502585 - RNA, 19 nt, Homo sapiens
gaaggcuuugcaccauuua

SEQ ID NO: 1502586 - RNA, 19 nt, Homo sapiens
uaauucugauggcucguuu

SEQ ID NO: 1502587 - RNA, 19 nt, Homo sapiens
ucuacaggcuuauauugau

SEQ ID NO: 1502588 - RNA, 19 nt, Homo sapiens
ucagaaggcuuugcaccau

SEQ ID NO: 1502589 - RNA, 19 nt, Homo sapiens
gacaguccuugcucauuag

SEQ ID NO: 1502590 - RNA, 19 nt, Homo sapiens
gcucguuucacuauaaaga

SEQ ID NO: 1502591 - RNA, 19 nt, Homo sapiens
gaauuaccaaaguccauga

SEQ ID NO: 1502592 - RNA, 19 nt, Homo sapiens
ugaagaagccauggcgaaa

SEQ ID NO: 1502593 - RNA, 19 nt, Homo sapiens
gcacucaaacuucauaucc

SEQ ID NO: 1502594 - RNA, 19 nt, Homo sapiens
agucaccacagaacaaaua

SEQ ID NO: 1502595 - RNA, 19 nt, Homo sapiens
gaaaaugugaagaggaaaa

SEQ ID NO: 1502596 - RNA, 19 nt, Homo sapiens
caaacuucauauccuguag

SEQ ID NO: 1502597 - RNA, 19 nt, Homo sapiens
cuaaauuacaguugaagga

SEQ ID NO: 1502598 - RNA, 19 nt, Homo sapiens
cguuaacucugaugauagu

SEQ ID NO: 1502599 - RNA, 19 nt, Homo sapiens
ugaaaaccuugaucacaaa

SEQ ID NO: 1502600 - RNA, 19 nt, Homo sapiens
aaucuccuguucccguuaa

SEQ ID NO: 1502601 - RNA, 19 nt, Homo sapiens
cuuuguuacuccuguuaua

SEQ ID NO: 1502602 - RNA, 19 nt, Homo sapiens
uugagaagaauccacauuu

SEQ ID NO: 1502603 - RNA, 19 nt, Homo sapiens
gaagacuggguucauugga

SEQ ID NO: 1502604 - RNA, 19 nt, Homo sapiens
acuaauaugucacaguucu

SEQ ID NO: 1502605 - RNA, 19 nt, Homo sapiens
aaacugucaccacgauaaa

SEQ ID NO: 1502606 - RNA, 19 nt, Homo sapiens
ucugauggcucguuucacu

SEQ ID NO: 1502607 - RNA, 19 nt, Homo sapiens
caaggacccuacacuucca

SEQ ID NO: 1502608 - RNA, 19 nt, Homo sapiens
agaaacaauccacuuugaa

SEQ ID NO: 1502609 - RNA, 19 nt, Homo sapiens
aaagcacucaaacuucaua

SEQ ID NO: 1502610 - RNA, 19 nt, Homo sapiens
auaaauagucaccacagaa

SEQ ID NO: 1502611 - RNA, 19 nt, Homo sapiens
ugauaguccucaacaaacu

SEQ ID NO: 1502612 - RNA, 19 nt, Homo sapiens
gcucauuagauaaacuuga

SEQ ID NO: 1502613 - RNA, 19 nt, Homo sapiens
ggaagacuggguucauugg

SEQ ID NO: 1502614 - RNA, 19 nt, Homo sapiens
ucaaacuucauauccugua

SEQ ID NO: 1502615 - RNA, 19 nt, Homo sapiens
ccgaaaaugugaagaggaa

SEQ ID NO: 1502616 - RNA, 19 nt, Homo sapiens
auuacuaggucacuucaga

SEQ ID NO: 1502617 - RNA, 19 nt, Homo sapiens
ccacagauccaaaagaaga

SEQ ID NO: 1502618 - RNA, 19 nt, Homo sapiens
gauaaucagagcuguacuc

SEQ ID NO: 1502619 - RNA, 19 nt, Homo sapiens
acugaagaauuaccaaagu

SEQ ID NO: 1502620 - RNA, 19 nt, Homo sapiens
gaaggccaagagaaaucua

SEQ ID NO: 1502621 - RNA, 19 nt, Homo sapiens
uuaaugacauagacuccau

SEQ ID NO: 1502622 - RNA, 19 nt, Homo sapiens
agacacaccguuaaugaca

SEQ ID NO: 1502623 - RNA, 19 nt, Homo sapiens
uaaauagucaccacagaac

SEQ ID NO: 1502624 - RNA, 19 nt, Homo sapiens
acaaaccaaacaaugcuuu

SEQ ID NO: 1502625 - RNA, 19 nt, Homo sapiens
acugucaccacgauaaaua

SEQ ID NO: 1502626 - RNA, 19 nt, Homo sapiens
cuauaaagauaagcuguac

SEQ ID NO: 1502627 - RNA, 19 nt, Homo sapiens
ugaauugcuuaucuugaag

SEQ ID NO: 1502628 - RNA, 19 nt, Homo sapiens
uagaagacacaccguuaau

SEQ ID NO: 1502629 - RNA, 19 nt, Homo sapiens
aacaauccacuuugaagaa

SEQ ID NO: 1502630 - RNA, 19 nt, Homo sapiens
gagaccugguugaugauac

SEQ ID NO: 1502631 - RNA, 19 nt, Homo sapiens
guaugauuccuauuacuag

SEQ ID NO: 1502632 - RNA, 19 nt, Homo sapiens
guugaaggaaaguaugauu

SEQ ID NO: 1502633 - RNA, 19 nt, Homo sapiens
gauaguccucaacaaacuu

SEQ ID NO: 1502634 - RNA, 19 nt, Homo sapiens
cgacuuugccagagacuua

SEQ ID NO: 1502635 - RNA, 19 nt, Homo sapiens
ggaagauucucccgacgau

SEQ ID NO: 1502636 - RNA, 19 nt, Homo sapiens
gaugaucuguuucaacucu

SEQ ID NO: 1502637 - RNA, 19 nt, Homo sapiens
agagacagaugaauuaugg

SEQ ID NO: 1502638 - RNA, 19 nt, Homo sapiens
gaaaacaggcugccaagaa

SEQ ID NO: 1502639 - RNA, 19 nt, Homo sapiens
ucgagagacagaugaauua

SEQ ID NO: 1502640 - RNA, 19 nt, Homo sapiens
gcacagagaaagacaaugc

SEQ ID NO: 1502641 - RNA, 19 nt, Homo sapiens
ucacagcccugagcacaga

SEQ ID NO: 1502642 - RNA, 19 nt, Homo sapiens
ccaaggcaauucgagacua

SEQ ID NO: 1502643 - RNA, 19 nt, Homo sapiens
acgcuaagaugccggugua

SEQ ID NO: 1502644 - RNA, 19 nt, Homo sapiens
caggaaagccagucagaga

SEQ ID NO: 1502645 - RNA, 19 nt, Homo sapiens
aagauucucccgacgauaa

SEQ ID NO: 1502646 - RNA, 19 nt, Homo sapiens
gagacuggaaucagaaaga

SEQ ID NO: 1502647 - RNA, 19 nt, Homo sapiens
aaaacaggcugccaagaaa

SEQ ID NO: 1502648 - RNA, 19 nt, Homo sapiens
ggcggagacuggaaucaga

SEQ ID NO: 1502649 - RNA, 19 nt, Homo sapiens
gagaaauauuugcagaaac

SEQ ID NO: 1502650 - RNA, 19 nt, Homo sapiens
caagacgccuuaugaugcu

SEQ ID NO: 1502651 - RNA, 19 nt, Homo sapiens
gccaagacgccuuaugaug

SEQ ID NO: 1502652 - RNA, 19 nt, Homo sapiens
cacaggagcacgagucuug

SEQ ID NO: 1502653 - RNA, 19 nt, Homo sapiens
gagagacagaugaauuaug

SEQ ID NO: 1502654 - RNA, 19 nt, Homo sapiens
gacgcagagugaacgcuaa

SEQ ID NO: 1502655 - RNA, 19 nt, Homo sapiens
caaggcaauucgagacuac

SEQ ID NO: 1502656 - RNA, 19 nt, Homo sapiens
gaagauucucccgacgaua

SEQ ID NO: 1502657 - RNA, 19 nt, Homo sapiens
gcagagugaacgcuaagau

SEQ ID NO: 1502658 - RNA, 19 nt, Homo sapiens
gggcuucggcucagaaauc

SEQ ID NO: 1502659 - RNA, 19 nt, Homo sapiens
ggacaaaacccgaaaacag

SEQ ID NO: 1502660 - RNA, 19 nt, Homo sapiens
gcugauggccaaggcaauu

SEQ ID NO: 1502661 - RNA, 19 nt, Homo sapiens
uggccaagacgccuuauga

SEQ ID NO: 1502662 - RNA, 19 nt, Homo sapiens
ggaugcaggccaacuacga

SEQ ID NO: 1502663 - RNA, 19 nt, Homo sapiens
gcccagagccgagagaaag

SEQ ID NO: 1502664 - RNA, 19 nt, Homo sapiens
gagacuacaagggaagauu

SEQ ID NO: 1502665 - RNA, 19 nt, Homo sapiens
cagagugaacgcuaagaug

SEQ ID NO: 1502666 - RNA, 19 nt, Homo sapiens
acgaucugcuguccgcuuu

SEQ ID NO: 1502667 - RNA, 19 nt, Homo sapiens
gcggagacuggaaucagaa

SEQ ID NO: 1502668 - RNA, 19 nt, Homo sapiens
gcgaguagugaccacgaaa

SEQ ID NO: 1502669 - RNA, 19 nt, Homo sapiens
cgagagacagaugaauuau

SEQ ID NO: 1502670 - RNA, 19 nt, Homo sapiens
cccaggagcccaucucaca

SEQ ID NO: 1502671 - RNA, 19 nt, Homo sapiens
ggccaagacgccuuaugau

SEQ ID NO: 1502672 - RNA, 19 nt, Homo sapiens
aauuauggaggauucauug

SEQ ID NO: 1502673 - RNA, 19 nt, Homo sapiens
gaugcaggccaacuacgau

SEQ ID NO: 1502674 - RNA, 19 nt, Homo sapiens
agacggacagcacgcagaa

SEQ ID NO: 1502675 - RNA, 19 nt, Homo sapiens
ggccgacagacaaagauga

SEQ ID NO: 1502676 - RNA, 19 nt, Homo sapiens
gaucugcuguccgcuuuug

SEQ ID NO: 1502677 - RNA, 19 nt, Homo sapiens
gaaucagaaagacggugaa

SEQ ID NO: 1502678 - RNA, 19 nt, Homo sapiens
gaagagaaagcauacauua

SEQ ID NO: 1502679 - RNA, 19 nt, Homo sapiens
gaacauuggagaauucaua

SEQ ID NO: 1502680 - RNA, 19 nt, Homo sapiens
gagagaagccucacaaaug

SEQ ID NO: 1502681 - RNA, 19 nt, Homo sapiens
gaacuucaggcacaaauuu

SEQ ID NO: 1502682 - RNA, 19 nt, Homo sapiens
agagaaaccuuacaaaugu

SEQ ID NO: 1502683 - RNA, 19 nt, Homo sapiens
agagaaaccuuacaaaugu

SEQ ID NO: 1502684 - RNA, 19 nt, Homo sapiens
agagaaaccuuacaaaugu

SEQ ID NO: 1502685 - RNA, 19 nt, Homo sapiens
gagagaaaccuuacaaaug

SEQ ID NO: 1502686 - RNA, 19 nt, Homo sapiens
gagagaaaccuuacaaaug

SEQ ID NO: 1502687 - RNA, 19 nt, Homo sapiens
acacauagcugaagaagag

SEQ ID NO: 1502688 - RNA, 19 nt, Homo sapiens
gaacugauaugagaacaca

SEQ ID NO: 1502689 - RNA, 19 nt, Homo sapiens
ggcaaggucuucaaucaaa

SEQ ID NO: 1502690 - RNA, 19 nt, Homo sapiens
gacagaagccuuacaaaug

SEQ ID NO: 1502691 - RNA, 19 nt, Homo sapiens
ucacaaauguaacgaaugu

SEQ ID NO: 1502692 - RNA, 19 nt, Homo sapiens
ggacagaagccuuacaaau

SEQ ID NO: 1502693 - RNA, 19 nt, Homo sapiens
gaauaugaauguagugaag

SEQ ID NO: 1502694 - RNA, 19 nt, Homo sapiens
ggagagagcccuugauucu

SEQ ID NO: 1502695 - RNA, 19 nt, Homo sapiens
ccaaacuggucucgaaauu

SEQ ID NO: 1502696 - RNA, 19 nt, Homo sapiens
caugaggaauggacgaaua

SEQ ID NO: 1502697 - RNA, 19 nt, Homo sapiens
agagagaccuuacaagugu

SEQ ID NO: 1502698 - RNA, 19 nt, Homo sapiens
gggcgcaaauuauaccuaa

SEQ ID NO: 1502699 - RNA, 19 nt, Homo sapiens
ggagagaaaccuuacaaau

SEQ ID NO: 1502700 - RNA, 19 nt, Homo sapiens
ggagagaaaccuuacaaau

SEQ ID NO: 1502701 - RNA, 19 nt, Homo sapiens
gcagagaaaccuuacaaau

SEQ ID NO: 1502702 - RNA, 19 nt, Homo sapiens
cagagaagcccuacaaaug

SEQ ID NO: 1502703 - RNA, 19 nt, Homo sapiens
acagaagccuuacaaaugu

SEQ ID NO: 1502704 - RNA, 19 nt, Homo sapiens
guagaacauuggagaauuc

SEQ ID NO: 1502705 - RNA, 19 nt, Homo sapiens
gagaacacauagcugaaga

SEQ ID NO: 1502706 - RNA, 19 nt, Homo sapiens
cgacaucaaagaauucaua

SEQ ID NO: 1502707 - RNA, 19 nt, Homo sapiens
ggacagagggcuuuauaca

SEQ ID NO: 1502708 - RNA, 19 nt, Homo sapiens
ggagagagaccuuacaagu

SEQ ID NO: 1502709 - RNA, 19 nt, Homo sapiens
aaacagucaugcuauguga

SEQ ID NO: 1502710 - RNA, 19 nt, Homo sapiens
agagaagccucacaaaugu

SEQ ID NO: 1502711 - RNA, 19 nt, Homo sapiens
cagagaaaccuuacaaaug

SEQ ID NO: 1502712 - RNA, 19 nt, Homo sapiens
gcagaaaacaagccuauua

SEQ ID NO: 1502713 - RNA, 19 nt, Homo sapiens
gguuggaacugauaugaga

SEQ ID NO: 1502714 - RNA, 19 nt, Homo sapiens
guacagagaagcccuacaa

SEQ ID NO: 1502715 - RNA, 19 nt, Homo sapiens
ggccaaguauucgguauuu

SEQ ID NO: 1502716 - RNA, 19 nt, Homo sapiens
ggagagaagccucacaaau

SEQ ID NO: 1502717 - RNA, 19 nt, Homo sapiens
ggaagggaaugugucagaa

SEQ ID NO: 1502718 - RNA, 19 nt, Homo sapiens
gauuaacccuugagucaca

SEQ ID NO: 1502719 - RNA, 19 nt, Homo sapiens
agucacaucugucugaauu

SEQ ID NO: 1502720 - RNA, 19 nt, Homo sapiens
gagaaagcauacauuagag

SEQ ID NO: 1502721 - RNA, 19 nt, Homo sapiens
aaacuggucucgaaauucu

SEQ ID NO: 1502722 - RNA, 19 nt, Homo sapiens
agagaaagcauacauuaga

SEQ ID NO: 1502723 - RNA, 19 nt, Homo sapiens
gagagagaccuuacaagug

SEQ ID NO: 1502724 - RNA, 19 nt, Homo sapiens
gggaggagcuguguauugg

SEQ ID NO: 1502725 - RNA, 19 nt, Homo sapiens
cagggacgcuugacauuca

SEQ ID NO: 1502726 - RNA, 19 nt, Homo sapiens
gcaagaacuucaggcacaa

SEQ ID NO: 1502727 - RNA, 19 nt, Homo sapiens
uagugaagauggugaaguu

SEQ ID NO: 1502728 - RNA, 19 nt, Homo sapiens
ggcaaaaucuuuaguuaga

SEQ ID NO: 1502729 - RNA, 19 nt, Homo sapiens
uaaugaaugugacaaaguc

SEQ ID NO: 1502730 - RNA, 19 nt, Homo sapiens
ggacuuacuacccaucuug

SEQ ID NO: 1502731 - RNA, 19 nt, Homo sapiens
uaacgaauguggcaaagcu

SEQ ID NO: 1502732 - RNA, 19 nt, Homo sapiens
gcaauucacaccuuguaga

SEQ ID NO: 1502733 - RNA, 19 nt, Homo sapiens
ggucuucagucgcaauuca

SEQ ID NO: 1502734 - RNA, 19 nt, Homo sapiens
caugcuaugugaugaagaa

SEQ ID NO: 1502735 - RNA, 19 nt, Homo sapiens
ucuuuagucugcuuucaua

SEQ ID NO: 1502736 - RNA, 19 nt, Homo sapiens
gaaggaaaauuuacagaag

SEQ ID NO: 1502737 - RNA, 19 nt, Homo sapiens
gaauguggcaaggucuuua

SEQ ID NO: 1502738 - RNA, 19 nt, Homo sapiens
uauaaacagucaugcuaug

SEQ ID NO: 1502739 - RNA, 19 nt, Homo sapiens
ccaaguauucgguauuuau

SEQ ID NO: 1502740 - RNA, 19 nt, Homo sapiens
guggcaaggucuucaauca

SEQ ID NO: 1502741 - RNA, 19 nt, Homo sapiens
caucaaagaauucauacug

SEQ ID NO: 1502742 - RNA, 19 nt, Homo sapiens
aagcauacauuagaggaaa

SEQ ID NO: 1502743 - RNA, 19 nt, Homo sapiens
aaccaucguuccucaguuu

SEQ ID NO: 1502744 - RNA, 19 nt, Homo sapiens
gaaugaauguggcaaaauc

SEQ ID NO: 1502745 - RNA, 19 nt, Homo sapiens
gaauucacugcguaccuua

SEQ ID NO: 1502746 - RNA, 19 nt, Homo sapiens
cuuccugaccuaaguauua

SEQ ID NO: 1502747 - RNA, 19 nt, Homo sapiens
gccaaguauucgguauuua

SEQ ID NO: 1502748 - RNA, 19 nt, Homo sapiens
caucagagaauucauacug

SEQ ID NO: 1502749 - RNA, 19 nt, Homo sapiens
cggcaucaaauaauucaua

SEQ ID NO: 1502750 - RNA, 19 nt, Homo sapiens
gagaagccucacaaaugua

SEQ ID NO: 1502751 - RNA, 19 nt, Homo sapiens
uguccaaacuggucucgaa

SEQ ID NO: 1502752 - RNA, 19 nt, Homo sapiens
gaaugugacaagguguuua

SEQ ID NO: 1502753 - RNA, 19 nt, Homo sapiens
cacaagaagagaaagcaua

SEQ ID NO: 1502754 - RNA, 19 nt, Homo sapiens
ggauugacuuauaaacagu

SEQ ID NO: 1502755 - RNA, 19 nt, Homo sapiens
uaucauaaauguggcaaag

SEQ ID NO: 1502756 - RNA, 19 nt, Homo sapiens
uaaccaaccaucagagaau

SEQ ID NO: 1502757 - RNA, 19 nt, Homo sapiens
gcacggcaucaaauaauuc

SEQ ID NO: 1502758 - RNA, 19 nt, Homo sapiens
ccucacaaauguaacgaau

SEQ ID NO: 1502759 - RNA, 19 nt, Homo sapiens
gcacgacaucaaagaauuc

SEQ ID NO: 1502760 - RNA, 19 nt, Homo sapiens
gugacaagguguuuaaucg

SEQ ID NO: 1502761 - RNA, 19 nt, Homo sapiens
uguagaacauuggagaauu

SEQ ID NO: 1502762 - RNA, 19 nt, Homo sapiens
agagaagcccuacaaaugu

SEQ ID NO: 1502763 - RNA, 19 nt, Homo sapiens
acaaauguagugaauguga

SEQ ID NO: 1502764 - RNA, 19 nt, Homo sapiens
caauucacaccuuguagaa

SEQ ID NO: 1502765 - RNA, 19 nt, Homo sapiens
ugacucauccagagcaauu

SEQ ID NO: 1502766 - RNA, 19 nt, Homo sapiens
gaauguggcaaaaucuuua

SEQ ID NO: 1502767 - RNA, 19 nt, Homo sapiens
ccuuacagauggaaugaau

SEQ ID NO: 1502768 - RNA, 19 nt, Homo sapiens
guaaugaaugugacaaagu

SEQ ID NO: 1502769 - RNA, 19 nt, Homo sapiens
caaacgugcugggauuaca

SEQ ID NO: 1502770 - RNA, 19 nt, Homo sapiens
ggcaucaaauaauucauag

SEQ ID NO: 1502771 - RNA, 19 nt, Homo sapiens
guaaugaguguggcaagaa

SEQ ID NO: 1502772 - RNA, 19 nt, Homo sapiens
gaacacauagcugaagaag

SEQ ID NO: 1502773 - RNA, 19 nt, Homo sapiens
caggaguguugccauguug

SEQ ID NO: 1502774 - RNA, 19 nt, Homo sapiens
uccuagaggugguucauga

SEQ ID NO: 1502775 - RNA, 19 nt, Homo sapiens
aauaagugguuggaacuga

SEQ ID NO: 1502776 - RNA, 19 nt, Homo sapiens
cacuacgccuggccaagua

SEQ ID NO: 1502777 - RNA, 19 nt, Homo sapiens
ucugcaaagucaaguuaaa

SEQ ID NO: 1502778 - RNA, 19 nt, Homo sapiens
guacaaggaucuacuauga

SEQ ID NO: 1502779 - RNA, 19 nt, Homo sapiens
gagaaagacauuccaaaua

SEQ ID NO: 1502780 - RNA, 19 nt, Homo sapiens
agaaauugcugacggaaua

SEQ ID NO: 1502781 - RNA, 19 nt, Homo sapiens
gaagugauuuggaagagaa

SEQ ID NO: 1502782 - RNA, 19 nt, Homo sapiens
cauauuggcugucaucaaa

SEQ ID NO: 1502783 - RNA, 19 nt, Homo sapiens
gagagaagcccuaugauug

SEQ ID NO: 1502784 - RNA, 19 nt, Homo sapiens
gaaagaagcaagaaggaaa

SEQ ID NO: 1502785 - RNA, 19 nt, Homo sapiens
ccagagagccaaccacuua

SEQ ID NO: 1502786 - RNA, 19 nt, Homo sapiens
ggccagagcagaaaucuua

SEQ ID NO: 1502787 - RNA, 19 nt, Homo sapiens
gagagaagcccugugaaua

SEQ ID NO: 1502788 - RNA, 19 nt, Homo sapiens
gcagaaagguaaagugaca

SEQ ID NO: 1502789 - RNA, 19 nt, Homo sapiens
gaagagaaauccuaaaaug

SEQ ID NO: 1502790 - RNA, 19 nt, Homo sapiens
gauagaagcauggaacaua

SEQ ID NO: 1502791 - RNA, 19 nt, Homo sapiens
ggaaaggccuucagaugca

SEQ ID NO: 1502792 - RNA, 19 nt, Homo sapiens
cagcagauguucuccauga

SEQ ID NO: 1502793 - RNA, 19 nt, Homo sapiens
guauguaacuggaauuaug

SEQ ID NO: 1502794 - RNA, 19 nt, Homo sapiens
gaaagcaccagaagugauu

SEQ ID NO: 1502795 - RNA, 19 nt, Homo sapiens
gagcagaaaucuuacuauc

SEQ ID NO: 1502796 - RNA, 19 nt, Homo sapiens
uugaagaacugcagaaauu

SEQ ID NO: 1502797 - RNA, 19 nt, Homo sapiens
agacagaccuccacaagga

SEQ ID NO: 1502798 - RNA, 19 nt, Homo sapiens
ggacaaaaguguuucugua

SEQ ID NO: 1502799 - RNA, 19 nt, Homo sapiens
gaaugaaacccuaugaaug

SEQ ID NO: 1502800 - RNA, 19 nt, Homo sapiens
gaaauugcugugguuauua

SEQ ID NO: 1502801 - RNA, 19 nt, Homo sapiens
ggagagaagcccuaugauu

SEQ ID NO: 1502802 - RNA, 19 nt, Homo sapiens
ggaaagacgccuugauuca

SEQ ID NO: 1502803 - RNA, 19 nt, Homo sapiens
ugaacuugcugcugugaua

SEQ ID NO: 1502804 - RNA, 19 nt, Homo sapiens
gagccaugcuggaauuuga

SEQ ID NO: 1502805 - RNA, 19 nt, Homo sapiens
ucacuugcuuguccuauaa

SEQ ID NO: 1502806 - RNA, 19 nt, Homo sapiens
ggacauguauuuccuccau

SEQ ID NO: 1502807 - RNA, 19 nt, Homo sapiens
ugaaauugcugugguuauu

SEQ ID NO: 1502808 - RNA, 19 nt, Homo sapiens
uuacccagcuuuccaguuu

SEQ ID NO: 1502809 - RNA, 19 nt, Homo sapiens
cagguaaucauguuaguua

SEQ ID NO: 1502810 - RNA, 19 nt, Homo sapiens
ggaaugaaacccuaugaau

SEQ ID NO: 1502811 - RNA, 19 nt, Homo sapiens
ggagaaagacauuccaaau

SEQ ID NO: 1502812 - RNA, 19 nt, Homo sapiens
gagaaacccuaugagugua

SEQ ID NO: 1502813 - RNA, 19 nt, Homo sapiens
ggauguggcugugaccuuu

SEQ ID NO: 1502814 - RNA, 19 nt, Homo sapiens
gggagaagcccuaugaaug

SEQ ID NO: 1502815 - RNA, 19 nt, Homo sapiens
guauuuaucuucagucucu

SEQ ID NO: 1502816 - RNA, 19 nt, Homo sapiens
gaacugugcugggaaggau

SEQ ID NO: 1502817 - RNA, 19 nt, Homo sapiens
aaagagccaugcuggaauu

SEQ ID NO: 1502818 - RNA, 19 nt, Homo sapiens
ugucaauggucuacucaua

SEQ ID NO: 1502819 - RNA, 19 nt, Homo sapiens
gacuaugacuguguccuua

SEQ ID NO: 1502820 - RNA, 19 nt, Homo sapiens
ggaagacgaugugaagaca

SEQ ID NO: 1502821 - RNA, 19 nt, Homo sapiens
caccagaagugauuuggaa

SEQ ID NO: 1502822 - RNA, 19 nt, Homo sapiens
ggaaaugaaagaagcaaga

SEQ ID NO: 1502823 - RNA, 19 nt, Homo sapiens
uaaaggacacccuagguuu

SEQ ID NO: 1502824 - RNA, 19 nt, Homo sapiens
gaagugguaucucguucga

SEQ ID NO: 1502825 - RNA, 19 nt, Homo sapiens
ggucaucaguauuauguuc

SEQ ID NO: 1502826 - RNA, 19 nt, Homo sapiens
gagaagcccugugaauaca

SEQ ID NO: 1502827 - RNA, 19 nt, Homo sapiens
gaauacagcaaggccuuua

SEQ ID NO: 1502828 - RNA, 19 nt, Homo sapiens
ggagaugcccuacaagugu

SEQ ID NO: 1502829 - RNA, 19 nt, Homo sapiens
ggacaaaccccuacaaaug

SEQ ID NO: 1502830 - RNA, 19 nt, Homo sapiens
agaagugucuggguuguuu

SEQ ID NO: 1502831 - RNA, 19 nt, Homo sapiens
gcuuccagcucuuuccaua

SEQ ID NO: 1502832 - RNA, 19 nt, Homo sapiens
ucaauggucuacucauaug

SEQ ID NO: 1502833 - RNA, 19 nt, Homo sapiens
agaagaguguagggaauua

SEQ ID NO: 1502834 - RNA, 19 nt, Homo sapiens
ggagagaagcccugugaau

SEQ ID NO: 1502835 - RNA, 19 nt, Homo sapiens
gaaacccuaugaaugcaau

SEQ ID NO: 1502836 - RNA, 19 nt, Homo sapiens
aaagacgccuugauucaug

SEQ ID NO: 1502837 - RNA, 19 nt, Homo sapiens
gaagaacugcagaaauuca

SEQ ID NO: 1502838 - RNA, 19 nt, Homo sapiens
gaaaugaaagaagcaagaa

SEQ ID NO: 1502839 - RNA, 19 nt, Homo sapiens
gaaggcugcauguauugua

SEQ ID NO: 1502840 - RNA, 19 nt, Homo sapiens
gugcaaagaaugugagaaa

SEQ ID NO: 1502841 - RNA, 19 nt, Homo sapiens
caaagaaugucaggaaacu

SEQ ID NO: 1502842 - RNA, 19 nt, Homo sapiens
ccaaaggguccauacauga

SEQ ID NO: 1502843 - RNA, 19 nt, Homo sapiens
uaucuucagucucuuguug

SEQ ID NO: 1502844 - RNA, 19 nt, Homo sapiens
gucauauggugaucuagua

SEQ ID NO: 1502845 - RNA, 19 nt, Homo sapiens
guagaccucacaauucuuu

SEQ ID NO: 1502846 - RNA, 19 nt, Homo sapiens
ggacagagugcacaguuuc

SEQ ID NO: 1502847 - RNA, 19 nt, Homo sapiens
ggagagaaacccuaugagu

SEQ ID NO: 1502848 - RNA, 19 nt, Homo sapiens
guucugaaguuuauggaau

SEQ ID NO: 1502849 - RNA, 19 nt, Homo sapiens
caggagcuguggauaguga

SEQ ID NO: 1502850 - RNA, 19 nt, Homo sapiens
gaacuacaacaccgaagga

SEQ ID NO: 1502851 - RNA, 19 nt, Homo sapiens
gaaagacgccuugauucau

SEQ ID NO: 1502852 - RNA, 19 nt, Homo sapiens
gguacuuuauuggugauua

SEQ ID NO: 1502853 - RNA, 19 nt, Homo sapiens
ggucacagaggcagaugua

SEQ ID NO: 1502854 - RNA, 19 nt, Homo sapiens
ggagaaaccccucuagaaa

SEQ ID NO: 1502855 - RNA, 19 nt, Homo sapiens
gacccacacuguaggaaga

SEQ ID NO: 1502856 - RNA, 19 nt, Homo sapiens
ggagaagcccuaugaaugc

SEQ ID NO: 1502857 - RNA, 19 nt, Homo sapiens
caacagagugaucagaaga

SEQ ID NO: 1502858 - RNA, 19 nt, Homo sapiens
gaacaacagagugaucaga

SEQ ID NO: 1502859 - RNA, 19 nt, Homo sapiens
uggccugucuuuauuugua

SEQ ID NO: 1502860 - RNA, 19 nt, Homo sapiens
acauguauuuccuccauuu

SEQ ID NO: 1502861 - RNA, 19 nt, Homo sapiens
uaaacaagccaucucacaa

SEQ ID NO: 1502862 - RNA, 19 nt, Homo sapiens
caagagaguuggagaaacc

SEQ ID NO: 1502863 - RNA, 19 nt, Homo sapiens
gaaaucuuacuaucugaga

SEQ ID NO: 1502864 - RNA, 19 nt, Homo sapiens
gagaacucaugcuggagaa

SEQ ID NO: 1502865 - RNA, 19 nt, Homo sapiens
uuugucagcucuuucuuaa

SEQ ID NO: 1502866 - RNA, 19 nt, Homo sapiens
ggacgcagcgcagauguug

SEQ ID NO: 1502867 - RNA, 19 nt, Homo sapiens
cagauguucuccaugaaug

SEQ ID NO: 1502868 - RNA, 19 nt, Homo sapiens
ggaaaugcagaaagguaaa

SEQ ID NO: 1502869 - RNA, 19 nt, Homo sapiens
ugaaguuuauggaauggaa

SEQ ID NO: 1502870 - RNA, 19 nt, Homo sapiens
gcuuaccucuagccaauug

SEQ ID NO: 1502871 - RNA, 19 nt, Homo sapiens
caacaucagagaacucaug

SEQ ID NO: 1502872 - RNA, 19 nt, Homo sapiens
ggaaagguuuuaacaggaa

SEQ ID NO: 1502873 - RNA, 19 nt, Homo sapiens
ucugguauuucucauauug

SEQ ID NO: 1502874 - RNA, 19 nt, Homo sapiens
caacaccgaaggaaaugaa

SEQ ID NO: 1502875 - RNA, 19 nt, Homo sapiens
cuggaaggcugcauguauu

SEQ ID NO: 1502876 - RNA, 19 nt, Homo sapiens
aagaaugucaggaaacuuu

SEQ ID NO: 1502877 - RNA, 19 nt, Homo sapiens
ggaagccugugugucuuga

SEQ ID NO: 1502878 - RNA, 19 nt, Homo sapiens
gaacugacccugcaaacag

SEQ ID NO: 1502879 - RNA, 19 nt, Homo sapiens
ggccaucacugccuucaug

SEQ ID NO: 1502880 - RNA, 19 nt, Homo sapiens
acaagaagcugggcuguca

SEQ ID NO: 1502881 - RNA, 19 nt, Homo sapiens
gagccacccuggacaaaca

SEQ ID NO: 1502882 - RNA, 19 nt, Homo sapiens
ccaaguaaauuuucccuuu

SEQ ID NO: 1502883 - RNA, 19 nt, Homo sapiens
ccagaaggcaucacccaaa

SEQ ID NO: 1502884 - RNA, 19 nt, Homo sapiens
gcacaugcgcucacacaca

SEQ ID NO: 1502885 - RNA, 19 nt, Homo sapiens
cacagcagguguccaggaa

SEQ ID NO: 1502886 - RNA, 19 nt, Homo sapiens
caacccagacgacgagaug

SEQ ID NO: 1502887 - RNA, 19 nt, Homo sapiens
cgacaaacacccagaucug

SEQ ID NO: 1502888 - RNA, 19 nt, Homo sapiens
ccauugaccuccucguuuu

SEQ ID NO: 1502889 - RNA, 19 nt, Homo sapiens
caucaccacggaacaaaga

SEQ ID NO: 1502890 - RNA, 19 nt, Homo sapiens
gacaaacacccagaucugu

SEQ ID NO: 1502891 - RNA, 19 nt, Homo sapiens
ccacggaacaaagaacuga

SEQ ID NO: 1502892 - RNA, 19 nt, Homo sapiens
cagaaggcaucacccaaaa

SEQ ID NO: 1502893 - RNA, 19 nt, Homo sapiens
agaagacccucagcuccuu

SEQ ID NO: 1502894 - RNA, 19 nt, Homo sapiens
gcaggaccucgucaucgaa

SEQ ID NO: 1502895 - RNA, 19 nt, Homo sapiens
aaagaacugacccugcaaa

SEQ ID NO: 1502896 - RNA, 19 nt, Homo sapiens
gcucaaccgccacaagaag

SEQ ID NO: 1502897 - RNA, 19 nt, Homo sapiens
ccaccuguccugugugcaa

SEQ ID NO: 1502898 - RNA, 19 nt, Homo sapiens
cccauugaccuccucguuu

SEQ ID NO: 1502899 - RNA, 19 nt, Homo sapiens
ugcaggaccucgucaucga

SEQ ID NO: 1502900 - RNA, 19 nt, Homo sapiens
aagcucaaccgccacaaga

SEQ ID NO: 1502901 - RNA, 19 nt, Homo sapiens
caaagaacugacccugcaa

SEQ ID NO: 1502902 - RNA, 19 nt, Homo sapiens
uguccugugugcaagaaga

SEQ ID NO: 1502903 - RNA, 19 nt, Homo sapiens
gaacauagacuugcacuug

SEQ ID NO: 1502904 - RNA, 19 nt, Homo sapiens
caauuaaacugcccuggaa

SEQ ID NO: 1502905 - RNA, 19 nt, Homo sapiens
guccagagcugaacauaga

SEQ ID NO: 1502906 - RNA, 19 nt, Homo sapiens
guaaacagccaccuucuug

SEQ ID NO: 1502907 - RNA, 19 nt, Homo sapiens
gggcacagcuacacacuca

SEQ ID NO: 1502908 - RNA, 19 nt, Homo sapiens
ucucagagcucuccuaucu

SEQ ID NO: 1502909 - RNA, 19 nt, Homo sapiens
ccuaagggcuucucucuca

SEQ ID NO: 1502910 - RNA, 19 nt, Homo sapiens
gaugucaccuggaguguca

SEQ ID NO: 1502911 - RNA, 19 nt, Homo sapiens
ccagaacgcuauagcuaug

SEQ ID NO: 1502912 - RNA, 19 nt, Homo sapiens
gaccugggcuccgugguuu

SEQ ID NO: 1502913 - RNA, 19 nt, Homo sapiens
ggaugaggcugacuaugag

SEQ ID NO: 1502914 - RNA, 19 nt, Homo sapiens
caaagugaccugugacauc

SEQ ID NO: 1502915 - RNA, 19 nt, Homo sapiens
cucaggaccucuaauuuga

SEQ ID NO: 1502916 - RNA, 19 nt, Homo sapiens
cauuguaucucugaucuug

SEQ ID NO: 1502917 - RNA, 19 nt, Homo sapiens
ucugaggccuaaaccauuu

SEQ ID NO: 1502918 - RNA, 19 nt, Homo sapiens
cgacagaggccuccugauc

SEQ ID NO: 1502919 - RNA, 19 nt, Homo sapiens
uggaugaggcugacuauga

SEQ ID NO: 1502920 - RNA, 19 nt, Homo sapiens
gggcugggccuguaucuca

SEQ ID NO: 1502921 - RNA, 19 nt, Homo sapiens
gcuacacacucaccaaagg

SEQ ID NO: 1502922 - RNA, 19 nt, Homo sapiens
ucucaggaccucuaauuug

SEQ ID NO: 1502923 - RNA, 19 nt, Homo sapiens
gcaccuccagcucuucaaa

SEQ ID NO: 1502924 - RNA, 19 nt, Homo sapiens
acagccaccuucuuggaaa

SEQ ID NO: 1502925 - RNA, 19 nt, Homo sapiens
acacacuucuuuggccuaa

SEQ ID NO: 1502926 - RNA, 19 nt, Homo sapiens
ggaggacgaccaucucuac

SEQ ID NO: 1502927 - RNA, 19 nt, Homo sapiens
augagugccuggacuacua

SEQ ID NO: 1502928 - RNA, 19 nt, Homo sapiens
gcacauuguaucucugauc

SEQ ID NO: 1502929 - RNA, 19 nt, Homo sapiens
aaacagccaccuucuugga

SEQ ID NO: 1502930 - RNA, 19 nt, Homo sapiens
gcucugaggccuaaaccau

SEQ ID NO: 1502931 - RNA, 19 nt, Homo sapiens
aaggcaaagugaccuguga

SEQ ID NO: 1502932 - RNA, 19 nt, Homo sapiens
gacugucacucuagcaucu

SEQ ID NO: 1502933 - RNA, 19 nt, Homo sapiens
cgucggcagucaagcaguu

SEQ ID NO: 1502934 - RNA, 19 nt, Homo sapiens
acauagacuugcacuugga

SEQ ID NO: 1502935 - RNA, 19 nt, Homo sapiens
caaccaaccugggcuucag

SEQ ID NO: 1502936 - RNA, 19 nt, Homo sapiens
cacauuguaucucugaucu

SEQ ID NO: 1502937 - RNA, 19 nt, Homo sapiens
cagcuacacacucaccaaa

SEQ ID NO: 1502938 - RNA, 19 nt, Homo sapiens
auaccaaggccuacuguug

SEQ ID NO: 1502939 - RNA, 19 nt, Homo sapiens
gacuugcacuuggauguca

SEQ ID NO: 1502940 - RNA, 19 nt, Homo sapiens
gaagggaggggcacagcua

SEQ ID NO: 1502941 - RNA, 19 nt, Homo sapiens
ucucucaggaccucuaauu

SEQ ID NO: 1502942 - RNA, 19 nt, Homo sapiens
cugcccagcuucaauuuac

SEQ ID NO: 1502943 - RNA, 19 nt, Homo sapiens
gcccugcccagcuucaauu

SEQ ID NO: 1502944 - RNA, 19 nt, Homo sapiens
ugucacaggugcacacacu

SEQ ID NO: 1502945 - RNA, 19 nt, Homo sapiens
gggaggacgaccaucucua

SEQ ID NO: 1502946 - RNA, 19 nt, Homo sapiens
acagaggccuccugaucca

SEQ ID NO: 1502947 - RNA, 19 nt, Homo sapiens
gcaaagugaccugugacau

SEQ ID NO: 1502948 - RNA, 19 nt, Homo sapiens
ccucuaauuugaccacaac

SEQ ID NO: 1502949 - RNA, 19 nt, Homo sapiens
ucccagcacacacuucuuu

SEQ ID NO: 1502950 - RNA, 19 nt, Homo sapiens
uauggcaccuccagcucuu

SEQ ID NO: 1502951 - RNA, 19 nt, Homo sapiens
uggccuuucugcuggauga

SEQ ID NO: 1502952 - RNA, 19 nt, Homo sapiens
acacuucuuuggccuaagg

SEQ ID NO: 1502953 - RNA, 19 nt, Homo sapiens
cuccagaacgcuauagcua

SEQ ID NO: 1502954 - RNA, 19 nt, Homo sapiens
cuaauuugaccacaaccaa

SEQ ID NO: 1502955 - RNA, 19 nt, Homo sapiens
ugugggcucugaggccuaa

SEQ ID NO: 1502956 - RNA, 19 nt, Homo sapiens
ucacaugggaguguuaugg

SEQ ID NO: 1502957 - RNA, 19 nt, Homo sapiens
ugaguuuccuucccagacu

SEQ ID NO: 1502958 - RNA, 19 nt, Homo sapiens
guucucagagcucuccuau

SEQ ID NO: 1502959 - RNA, 19 nt, Homo sapiens
ggucuguccuugucccuuu

SEQ ID NO: 1502960 - RNA, 19 nt, Homo sapiens
ucgcaaacauuaaggaaga

SEQ ID NO: 1502961 - RNA, 19 nt, Homo sapiens
ccacucagccuucgagaug

SEQ ID NO: 1502962 - RNA, 19 nt, Homo sapiens
gauggaggaggaagaggua

SEQ ID NO: 1502963 - RNA, 19 nt, Homo sapiens
ggaagaaaggagccaagga

SEQ ID NO: 1502964 - RNA, 19 nt, Homo sapiens
gaauggaggagggaaguug

SEQ ID NO: 1502965 - RNA, 19 nt, Homo sapiens
gaggagggaaguugaagga

SEQ ID NO: 1502966 - RNA, 19 nt, Homo sapiens
caccaucaccucuuuggaa

SEQ ID NO: 1502967 - RNA, 19 nt, Homo sapiens
aggaagagguagacagcaa

SEQ ID NO: 1502968 - RNA, 19 nt, Homo sapiens
cgacaccagugcuccaucu

SEQ ID NO: 1502969 - RNA, 19 nt, Homo sapiens
caucaccucuuuggaacug

SEQ ID NO: 1502970 - RNA, 19 nt, Homo sapiens
uggacaccaucaccucuuu

SEQ ID NO: 1502971 - RNA, 19 nt, Homo sapiens
ucgagaggguggccaagga

SEQ ID NO: 1502972 - RNA, 19 nt, Homo sapiens
ccucagcgccuccuguuuc

SEQ ID NO: 1502973 - RNA, 19 nt, Homo sapiens
ccagagugcggcaaagguu

SEQ ID NO: 1502974 - RNA, 19 nt, Homo sapiens
cgacagccaagaccacuca

SEQ ID NO: 1502975 - RNA, 19 nt, Homo sapiens
ggacaccaucaccucuuug

SEQ ID NO: 1502976 - RNA, 19 nt, Homo sapiens
gucugucugugaauaaaug

SEQ ID NO: 1502977 - RNA, 19 nt, Homo sapiens
cccaacaugugucuuaagg

SEQ ID NO: 1502978 - RNA, 19 nt, Homo sapiens
uucacgcccuugacacuaa

SEQ ID NO: 1502979 - RNA, 19 nt, Homo sapiens
cagagugcggcaaagguuu

SEQ ID NO: 1502980 - RNA, 19 nt, Homo sapiens
uaaggcaggacgacuugga

SEQ ID NO: 1502981 - RNA, 19 nt, Homo sapiens
gaaggccgagcaggaggaa

SEQ ID NO: 1502982 - RNA, 19 nt, Homo sapiens
ccagugagcaaaggucugu

SEQ ID NO: 1502983 - RNA, 19 nt, Homo sapiens
ucaaggcgcacccgugucu

SEQ ID NO: 1502984 - RNA, 19 nt, Homo sapiens
ggagaaaccuuaugaaugu

SEQ ID NO: 1502985 - RNA, 19 nt, Homo sapiens
gaagaagacugccggagua

SEQ ID NO: 1502986 - RNA, 19 nt, Homo sapiens
gagaaacccuauaaaugua

SEQ ID NO: 1502987 - RNA, 19 nt, Homo sapiens
gagaaacccuauaaaugua

SEQ ID NO: 1502988 - RNA, 19 nt, Homo sapiens
gagaagcccuauaaaugua

SEQ ID NO: 1502989 - RNA, 19 nt, Homo sapiens
gagaaauccugucaaugua

SEQ ID NO: 1502990 - RNA, 19 nt, Homo sapiens
ggagauagaccuuauaaau

SEQ ID NO: 1502991 - RNA, 19 nt, Homo sapiens
gagagaagcccuauaaaug

SEQ ID NO: 1502992 - RNA, 19 nt, Homo sapiens
gagaaacccuauaagugua

SEQ ID NO: 1502993 - RNA, 19 nt, Homo sapiens
ugagaaaccucuugaaugu

SEQ ID NO: 1502994 - RNA, 19 nt, Homo sapiens
gagaagccauauaaaugua

SEQ ID NO: 1502995 - RNA, 19 nt, Homo sapiens
gauacgagcuauuugagaa

SEQ ID NO: 1502996 - RNA, 19 nt, Homo sapiens
uaaagaagguagucaaugu

SEQ ID NO: 1502997 - RNA, 19 nt, Homo sapiens
ucaagaaccuggcaucuau

SEQ ID NO: 1502998 - RNA, 19 nt, Homo sapiens
agaaaccucuugaauguaa

SEQ ID NO: 1502999 - RNA, 19 nt, Homo sapiens
gagagaaacccuauaaaug

SEQ ID NO: 1503000 - RNA, 19 nt, Homo sapiens
gagagaaacccuauaaaug

SEQ ID NO: 1503001 - RNA, 19 nt, Homo sapiens
gguaaagccuucagauguu

SEQ ID NO: 1503002 - RNA, 19 nt, Homo sapiens
agacggaccuuauaaaugu

SEQ ID NO: 1503003 - RNA, 19 nt, Homo sapiens
gagaaacccuaugaaugua

SEQ ID NO: 1503004 - RNA, 19 nt, Homo sapiens
caacggagauagaccuuau

SEQ ID NO: 1503005 - RNA, 19 nt, Homo sapiens
gggaaagccuucaguuguu

SEQ ID NO: 1503006 - RNA, 19 nt, Homo sapiens
ggagagaaacccuauaaau

SEQ ID NO: 1503007 - RNA, 19 nt, Homo sapiens
ggagagaaacccuauaaau

SEQ ID NO: 1503008 - RNA, 19 nt, Homo sapiens
gagaaacccuacgaaugua

SEQ ID NO: 1503009 - RNA, 19 nt, Homo sapiens
gagaaacccuaugcaugua

SEQ ID NO: 1503010 - RNA, 19 nt, Homo sapiens
gcgggaaggccuuuauuua

SEQ ID NO: 1503011 - RNA, 19 nt, Homo sapiens
gaaacccuaugaauguaaa

SEQ ID NO: 1503012 - RNA, 19 nt, Homo sapiens
gagauagaccuuauaaaug

SEQ ID NO: 1503013 - RNA, 19 nt, Homo sapiens
gggaaggccuuuauuuauc

SEQ ID NO: 1503014 - RNA, 19 nt, Homo sapiens
ggagagaagcccuauaaau

SEQ ID NO: 1503015 - RNA, 19 nt, Homo sapiens
gagagaaacccuaugaaug

SEQ ID NO: 1503016 - RNA, 19 nt, Homo sapiens
gagagaaacccuauaagug

SEQ ID NO: 1503017 - RNA, 19 nt, Homo sapiens
uaacacacaugauaacaca

SEQ ID NO: 1503018 - RNA, 19 nt, Homo sapiens
gcucuuaguuguuccaguu

SEQ ID NO: 1503019 - RNA, 19 nt, Homo sapiens
ggacacaugagaaugcaua

SEQ ID NO: 1503020 - RNA, 19 nt, Homo sapiens
ucuaacagaugcuuucaaa

SEQ ID NO: 1503021 - RNA, 19 nt, Homo sapiens
gagagaaacccuacgaaug

SEQ ID NO: 1503022 - RNA, 19 nt, Homo sapiens
gaagagagaaauccuguca

SEQ ID NO: 1503023 - RNA, 19 nt, Homo sapiens
ggagagaaacccuaugaau

SEQ ID NO: 1503024 - RNA, 19 nt, Homo sapiens
ggagagaaacccuauaagu

SEQ ID NO: 1503025 - RNA, 19 nt, Homo sapiens
gggaagacccgaauguuga

SEQ ID NO: 1503026 - RNA, 19 nt, Homo sapiens
caauuauccucuagauuug

SEQ ID NO: 1503027 - RNA, 19 nt, Homo sapiens
gaaaagcccuaugaaugua

SEQ ID NO: 1503028 - RNA, 19 nt, Homo sapiens
gaaaagcucuuaguuguuc

SEQ ID NO: 1503029 - RNA, 19 nt, Homo sapiens
gaaauccugucaauguaag

SEQ ID NO: 1503030 - RNA, 19 nt, Homo sapiens
gggagaaaccuuaugaaug

SEQ ID NO: 1503031 - RNA, 19 nt, Homo sapiens
ucaagaccauccuggcuaa

SEQ ID NO: 1503032 - RNA, 19 nt, Homo sapiens
ggaaaagccuucagugugu

SEQ ID NO: 1503033 - RNA, 19 nt, Homo sapiens
agagaaacccuauaaaugu

SEQ ID NO: 1503034 - RNA, 19 nt, Homo sapiens
agagaaacccuauaaaugu

SEQ ID NO: 1503035 - RNA, 19 nt, Homo sapiens
aaagcgagauacaagauga

SEQ ID NO: 1503036 - RNA, 19 nt, Homo sapiens
ggagacggaccuuauaaau

SEQ ID NO: 1503037 - RNA, 19 nt, Homo sapiens
uaaagaaugugggaaaucu

SEQ ID NO: 1503038 - RNA, 19 nt, Homo sapiens
ggaaagccuucaguuguuc

SEQ ID NO: 1503039 - RNA, 19 nt, Homo sapiens
agagagaaauccugucaau

SEQ ID NO: 1503040 - RNA, 19 nt, Homo sapiens
gagaaaccuuaugaaugua

SEQ ID NO: 1503041 - RNA, 19 nt, Homo sapiens
caauuuaguagcaguagua

SEQ ID NO: 1503042 - RNA, 19 nt, Homo sapiens
agagaaauccugucaaugu

SEQ ID NO: 1503043 - RNA, 19 nt, Homo sapiens
agagaaacccuaugaaugu

SEQ ID NO: 1503044 - RNA, 19 nt, Homo sapiens
gagacucugugaagguaaa

SEQ ID NO: 1503045 - RNA, 19 nt, Homo sapiens
agauagaccuuauaaaugc

SEQ ID NO: 1503046 - RNA, 19 nt, Homo sapiens
gagaaaagcccuaugaaug

SEQ ID NO: 1503047 - RNA, 19 nt, Homo sapiens
cgaaaucuaagaagccaua

SEQ ID NO: 1503048 - RNA, 19 nt, Homo sapiens
gcaggagaauggcauaaac

SEQ ID NO: 1503049 - RNA, 19 nt, Homo sapiens
gaauguaaacaauguggaa

SEQ ID NO: 1503050 - RNA, 19 nt, Homo sapiens
gagacggaccuuauaaaug

SEQ ID NO: 1503051 - RNA, 19 nt, Homo sapiens
ggagagaaacccuacgaau

SEQ ID NO: 1503052 - RNA, 19 nt, Homo sapiens
agagaaacccuacgaaugu

SEQ ID NO: 1503053 - RNA, 19 nt, Homo sapiens
gaagcccuauaaauguaaa

SEQ ID NO: 1503054 - RNA, 19 nt, Homo sapiens
acgaguacaugaaagaauu

SEQ ID NO: 1503055 - RNA, 19 nt, Homo sapiens
caaccgcaauuuaguagca

SEQ ID NO: 1503056 - RNA, 19 nt, Homo sapiens
gaauguaagcaauguggaa

SEQ ID NO: 1503057 - RNA, 19 nt, Homo sapiens
gaauguaagcaauguggaa

SEQ ID NO: 1503058 - RNA, 19 nt, Homo sapiens
gguagucaaugugcagaaa

SEQ ID NO: 1503059 - RNA, 19 nt, Homo sapiens
cuucacaguuccuuucaaa

SEQ ID NO: 1503060 - RNA, 19 nt, Homo sapiens
agagaaacccuauaagugu

SEQ ID NO: 1503061 - RNA, 19 nt, Homo sapiens
guaaagccuucagauguuc

SEQ ID NO: 1503062 - RNA, 19 nt, Homo sapiens
gccuuuaguuguucuaguu

SEQ ID NO: 1503063 - RNA, 19 nt, Homo sapiens
gaacucacacuggagagaa

SEQ ID NO: 1503064 - RNA, 19 nt, Homo sapiens
ccaccuccauucaaauuca

SEQ ID NO: 1503065 - RNA, 19 nt, Homo sapiens
gaacucacacuggagagaa

SEQ ID NO: 1503066 - RNA, 19 nt, Homo sapiens
ugagaaugcacaaucgaua

SEQ ID NO: 1503067 - RNA, 19 nt, Homo sapiens
ggaaggccuuuauuuaucc

SEQ ID NO: 1503068 - RNA, 19 nt, Homo sapiens
gaaacccuacgaauguaaa

SEQ ID NO: 1503069 - RNA, 19 nt, Homo sapiens
guucuaacacacaugauaa

SEQ ID NO: 1503070 - RNA, 19 nt, Homo sapiens
ccauaugaguguacuaucu

SEQ ID NO: 1503071 - RNA, 19 nt, Homo sapiens
ggaagacccgaauguugaa

SEQ ID NO: 1503072 - RNA, 19 nt, Homo sapiens
gaaacccuaugcauguaag

SEQ ID NO: 1503073 - RNA, 19 nt, Homo sapiens
agagaaacccuaugcaugu

SEQ ID NO: 1503074 - RNA, 19 nt, Homo sapiens
ggagagaaacccuaugcau

SEQ ID NO: 1503075 - RNA, 19 nt, Homo sapiens
ucucaucccuuacuagaca

SEQ ID NO: 1503076 - RNA, 19 nt, Homo sapiens
uaucaaccgcaauuuagua

SEQ ID NO: 1503077 - RNA, 19 nt, Homo sapiens
gaaagcgagauacaagaug

SEQ ID NO: 1503078 - RNA, 19 nt, Homo sapiens
cgggaaggccuuuauuuau

SEQ ID NO: 1503079 - RNA, 19 nt, Homo sapiens
gaaacccuauaaguguaaa

SEQ ID NO: 1503080 - RNA, 19 nt, Homo sapiens
agagaagcccuauaaaugu

SEQ ID NO: 1503081 - RNA, 19 nt, Homo sapiens
ugagaagccauauaaaugu

SEQ ID NO: 1503082 - RNA, 19 nt, Homo sapiens
auagucagguaccacauaa

SEQ ID NO: 1503083 - RNA, 19 nt, Homo sapiens
gagaaaccucuugaaugua

SEQ ID NO: 1503084 - RNA, 19 nt, Homo sapiens
ggaaauacaugacuaguuu

SEQ ID NO: 1503085 - RNA, 19 nt, Homo sapiens
gaauagacauuucuccaaa

SEQ ID NO: 1503086 - RNA, 19 nt, Homo sapiens
gaggacaggucuacaagua

SEQ ID NO: 1503087 - RNA, 19 nt, Homo sapiens
ugaaagagcucauaaugga

SEQ ID NO: 1503088 - RNA, 19 nt, Homo sapiens
gggaugagaugaauauauu

SEQ ID NO: 1503089 - RNA, 19 nt, Homo sapiens
ggccagagguguaauguuu

SEQ ID NO: 1503090 - RNA, 19 nt, Homo sapiens
ggauggaccuuauaaaugu

SEQ ID NO: 1503091 - RNA, 19 nt, Homo sapiens
gaaauacugucaaggaugu

SEQ ID NO: 1503092 - RNA, 19 nt, Homo sapiens
guucggagcugaagaagaa

SEQ ID NO: 1503093 - RNA, 19 nt, Homo sapiens
ggagaaacccuaugaaugu

SEQ ID NO: 1503094 - RNA, 19 nt, Homo sapiens
gaaaggacuugaauagaca

SEQ ID NO: 1503095 - RNA, 19 nt, Homo sapiens
gaagacacaugauaaagca

SEQ ID NO: 1503096 - RNA, 19 nt, Homo sapiens
gaagacacaugauuaagca

SEQ ID NO: 1503097 - RNA, 19 nt, Homo sapiens
caaagaagauacccagaug

SEQ ID NO: 1503098 - RNA, 19 nt, Homo sapiens
ggaaaggacuugaauagac

SEQ ID NO: 1503099 - RNA, 19 nt, Homo sapiens
ggagauaaaccuuacguaa

SEQ ID NO: 1503100 - RNA, 19 nt, Homo sapiens
gaagagggacucagugaaa

SEQ ID NO: 1503101 - RNA, 19 nt, Homo sapiens
gaagauggaggccuuguaa

SEQ ID NO: 1503102 - RNA, 19 nt, Homo sapiens
ggagagaaaccauauaaau

SEQ ID NO: 1503103 - RNA, 19 nt, Homo sapiens
gagauaaaccuuacguaaa

SEQ ID NO: 1503104 - RNA, 19 nt, Homo sapiens
gagagaagcccuaugaaug

SEQ ID NO: 1503105 - RNA, 19 nt, Homo sapiens
gagaaacccuaugaaugua

SEQ ID NO: 1503106 - RNA, 19 nt, Homo sapiens
uaacaaugcucgacaucuu

SEQ ID NO: 1503107 - RNA, 19 nt, Homo sapiens
ucaaggauguggaauguug

SEQ ID NO: 1503108 - RNA, 19 nt, Homo sapiens
ggagauggaccuuauaaau

SEQ ID NO: 1503109 - RNA, 19 nt, Homo sapiens
ggagauggaccuuauaaau

SEQ ID NO: 1503110 - RNA, 19 nt, Homo sapiens
gagaagcccuaugaaugua

SEQ ID NO: 1503111 - RNA, 19 nt, Homo sapiens
ggagauggaccuuauaaau

SEQ ID NO: 1503112 - RNA, 19 nt, Homo sapiens
caucagaucucaccuugga

SEQ ID NO: 1503113 - RNA, 19 nt, Homo sapiens
gagagaaaccauauaaaug

SEQ ID NO: 1503114 - RNA, 19 nt, Homo sapiens
ggacuugaauagacauuuc

SEQ ID NO: 1503115 - RNA, 19 nt, Homo sapiens
ggacaggucuacaaguauc

SEQ ID NO: 1503116 - RNA, 19 nt, Homo sapiens
gggaaagcauucaauuaug

SEQ ID NO: 1503117 - RNA, 19 nt, Homo sapiens
gagagaaacccuaugaaug

SEQ ID NO: 1503118 - RNA, 19 nt, Homo sapiens
gagagaaacccuaugaaug

SEQ ID NO: 1503119 - RNA, 19 nt, Homo sapiens
gagauggaccuuauaaaug

SEQ ID NO: 1503120 - RNA, 19 nt, Homo sapiens
gagauggaccuuauaaaug

SEQ ID NO: 1503121 - RNA, 19 nt, Homo sapiens
gagauggaccuuauaaaug

SEQ ID NO: 1503122 - RNA, 19 nt, Homo sapiens
caucauucaucccuuagua

SEQ ID NO: 1503123 - RNA, 19 nt, Homo sapiens
ucauuucucuuccaaguuu

SEQ ID NO: 1503124 - RNA, 19 nt, Homo sapiens
gggaaagccuucaguucuu

SEQ ID NO: 1503125 - RNA, 19 nt, Homo sapiens
ucaggaauauggagagaaa

SEQ ID NO: 1503126 - RNA, 19 nt, Homo sapiens
uagcaucucauuaggauua

SEQ ID NO: 1503127 - RNA, 19 nt, Homo sapiens
gggauuaguuuccugauag

SEQ ID NO: 1503128 - RNA, 19 nt, Homo sapiens
ggaauuaacugagacuuuu

SEQ ID NO: 1503129 - RNA, 19 nt, Homo sapiens
uauggaaagucuucaguuu

SEQ ID NO: 1503130 - RNA, 19 nt, Homo sapiens
ggaaagccuucaguucuug

SEQ ID NO: 1503131 - RNA, 19 nt, Homo sapiens
caagaaauacugucaagga

SEQ ID NO: 1503132 - RNA, 19 nt, Homo sapiens
guucgaagacacaugauua

SEQ ID NO: 1503133 - RNA, 19 nt, Homo sapiens
guaagaccaugugaaugua

SEQ ID NO: 1503134 - RNA, 19 nt, Homo sapiens
ggagagaaacccuaugaau

SEQ ID NO: 1503135 - RNA, 19 nt, Homo sapiens
ggagagaaacccuaugaau

SEQ ID NO: 1503136 - RNA, 19 nt, Homo sapiens
ccaauaagcacguaacaau

SEQ ID NO: 1503137 - RNA, 19 nt, Homo sapiens
ggaaagucuucaugcauca

SEQ ID NO: 1503138 - RNA, 19 nt, Homo sapiens
agauaaaccuuacguaaag

SEQ ID NO: 1503139 - RNA, 19 nt, Homo sapiens
gaggaaaggacuugaauag

SEQ ID NO: 1503140 - RNA, 19 nt, Homo sapiens
agauggaccuuauaaaugu

SEQ ID NO: 1503141 - RNA, 19 nt, Homo sapiens
agauggaccuuauaaaugu

SEQ ID NO: 1503142 - RNA, 19 nt, Homo sapiens
ggagagaagcccuaugaau

SEQ ID NO: 1503143 - RNA, 19 nt, Homo sapiens
agauggaccuuauaaaugu

SEQ ID NO: 1503144 - RNA, 19 nt, Homo sapiens
gauguggaauguuggagaa

SEQ ID NO: 1503145 - RNA, 19 nt, Homo sapiens
gaaacccuaugaauguaau

SEQ ID NO: 1503146 - RNA, 19 nt, Homo sapiens
agacauacauagcaucuca

SEQ ID NO: 1503147 - RNA, 19 nt, Homo sapiens
gaccagagcauugaagauu

SEQ ID NO: 1503148 - RNA, 19 nt, Homo sapiens
ggaggaaaggacuugaaua

SEQ ID NO: 1503149 - RNA, 19 nt, Homo sapiens
uuagaaaccuggccugugu

SEQ ID NO: 1503150 - RNA, 19 nt, Homo sapiens
ggauguggcugugaacuuc

SEQ ID NO: 1503151 - RNA, 19 nt, Homo sapiens
acacaaaccauaugacuau

SEQ ID NO: 1503152 - RNA, 19 nt, Homo sapiens
gagaugacacuuuggaguu

SEQ ID NO: 1503153 - RNA, 19 nt, Homo sapiens
gauauugagaugacacuuu

SEQ ID NO: 1503154 - RNA, 19 nt, Homo sapiens
gggagaaacccuaugaaug

SEQ ID NO: 1503155 - RNA, 19 nt, Homo sapiens
ccauauaaaugucaggaau

SEQ ID NO: 1503156 - RNA, 19 nt, Homo sapiens
ggaauguacagugguauaa

SEQ ID NO: 1503157 - RNA, 19 nt, Homo sapiens
ggagaacauugugcacuau

SEQ ID NO: 1503158 - RNA, 19 nt, Homo sapiens
auacccagauggccaauaa

SEQ ID NO: 1503159 - RNA, 19 nt, Homo sapiens
gcuaagacacaauccaauu

SEQ ID NO: 1503160 - RNA, 19 nt, Homo sapiens
gcagugagaagauagcuau

SEQ ID NO: 1503161 - RNA, 19 nt, Homo sapiens
cuacaaguaucuacauauc

SEQ ID NO: 1503162 - RNA, 19 nt, Homo sapiens
agagaaacccuaugaaugu

SEQ ID NO: 1503163 - RNA, 19 nt, Homo sapiens
gggauggaccuuauaaaug

SEQ ID NO: 1503164 - RNA, 19 nt, Homo sapiens
agagaaacccuaugaaugu

SEQ ID NO: 1503165 - RNA, 19 nt, Homo sapiens
cauagcaucucauuaggau

SEQ ID NO: 1503166 - RNA, 19 nt, Homo sapiens
gauggaggccuuguaauug

SEQ ID NO: 1503167 - RNA, 19 nt, Homo sapiens
ggagugggcuuugcuggau

SEQ ID NO: 1503168 - RNA, 19 nt, Homo sapiens
gauggaccuuauaaaugua

SEQ ID NO: 1503169 - RNA, 19 nt, Homo sapiens
gauaaaccuuacguaaaga

SEQ ID NO: 1503170 - RNA, 19 nt, Homo sapiens
gaucucaccuuggacacaa

SEQ ID NO: 1503171 - RNA, 19 nt, Homo sapiens
ucccaaaccaugagaaaua

SEQ ID NO: 1503172 - RNA, 19 nt, Homo sapiens
gcuuugcccuucaccauga

SEQ ID NO: 1503173 - RNA, 19 nt, Homo sapiens
gugggaaagcauucaauua

SEQ ID NO: 1503174 - RNA, 19 nt, Homo sapiens
uaaagaaugugggaaagca

SEQ ID NO: 1503175 - RNA, 19 nt, Homo sapiens
ugagaaacccuaugcaugu

SEQ ID NO: 1503176 - RNA, 19 nt, Homo sapiens
caccucagauucauauguu

SEQ ID NO: 1503177 - RNA, 19 nt, Homo sapiens
auacaugacuaguuugguu

SEQ ID NO: 1503178 - RNA, 19 nt, Homo sapiens
gguaaaaccuucaguucuu

SEQ ID NO: 1503179 - RNA, 19 nt, Homo sapiens
gaacucauacuggagagaa

SEQ ID NO: 1503180 - RNA, 19 nt, Homo sapiens
gaauguaagcaauguggaa

SEQ ID NO: 1503181 - RNA, 19 nt, Homo sapiens
cauugaagauugguacaaa

SEQ ID NO: 1503182 - RNA, 19 nt, Homo sapiens
ucagauacaugaaagaacu

SEQ ID NO: 1503183 - RNA, 19 nt, Homo sapiens
uggagaacauugugcacua

SEQ ID NO: 1503184 - RNA, 19 nt, Homo sapiens
gaaagcgacuucuuaaaua

SEQ ID NO: 1503185 - RNA, 19 nt, Homo sapiens
gaaagaagguagucaguuu

SEQ ID NO: 1503186 - RNA, 19 nt, Homo sapiens
gaacgaccaugcccacuua

SEQ ID NO: 1503187 - RNA, 19 nt, Homo sapiens
ccaaguagcugggauuaua

SEQ ID NO: 1503188 - RNA, 19 nt, Homo sapiens
ggagacagauggaugcaua

SEQ ID NO: 1503189 - RNA, 19 nt, Homo sapiens
gaaggcauaugaaguguaa

SEQ ID NO: 1503190 - RNA, 19 nt, Homo sapiens
gagaaacccuauaaaugua

SEQ ID NO: 1503191 - RNA, 19 nt, Homo sapiens
gagaaacccuauaaaugua

SEQ ID NO: 1503192 - RNA, 19 nt, Homo sapiens
gcuaagaagucauauggua

SEQ ID NO: 1503193 - RNA, 19 nt, Homo sapiens
ggaaauggcuguccuggau

SEQ ID NO: 1503194 - RNA, 19 nt, Homo sapiens
gaaauggaccuuauaaaug

SEQ ID NO: 1503195 - RNA, 19 nt, Homo sapiens
ggagagaaaucauaugaau

SEQ ID NO: 1503196 - RNA, 19 nt, Homo sapiens
gagaugagauaauucugua

SEQ ID NO: 1503197 - RNA, 19 nt, Homo sapiens
ucacaaauauggagagaaa

SEQ ID NO: 1503198 - RNA, 19 nt, Homo sapiens
ggagaaacccuauaaaugu

SEQ ID NO: 1503199 - RNA, 19 nt, Homo sapiens
ggaaauggaccuuauaaau

SEQ ID NO: 1503200 - RNA, 19 nt, Homo sapiens
gagaguaacccuauguaua

SEQ ID NO: 1503201 - RNA, 19 nt, Homo sapiens
ggagaaacccuaugaaugu

SEQ ID NO: 1503202 - RNA, 19 nt, Homo sapiens
ggagaaagcuaagaaguca

SEQ ID NO: 1503203 - RNA, 19 nt, Homo sapiens
gaaagccugaugcaaauua

SEQ ID NO: 1503204 - RNA, 19 nt, Homo sapiens
ggaaagcgacuucuuaaau

SEQ ID NO: 1503205 - RNA, 19 nt, Homo sapiens
agagaaaccuuaugaaugu

SEQ ID NO: 1503206 - RNA, 19 nt, Homo sapiens
gagagaaacccuauaaaug

SEQ ID NO: 1503207 - RNA, 19 nt, Homo sapiens
gguaaagccuucaguuguu

SEQ ID NO: 1503208 - RNA, 19 nt, Homo sapiens
gguaaagccuucaguuguu

SEQ ID NO: 1503209 - RNA, 19 nt, Homo sapiens
gguaaagccuucaguuguu

SEQ ID NO: 1503210 - RNA, 19 nt, Homo sapiens
gguaaagccuucaguuguu

SEQ ID NO: 1503211 - RNA, 19 nt, Homo sapiens
gauacucccuuauguguga

SEQ ID NO: 1503212 - RNA, 19 nt, Homo sapiens
gaagacauaugauaaugca

SEQ ID NO: 1503213 - RNA, 19 nt, Homo sapiens
gagagaaacccuaugauug

SEQ ID NO: 1503214 - RNA, 19 nt, Homo sapiens
gcaaccauuuagacucuua

SEQ ID NO: 1503215 - RNA, 19 nt, Homo sapiens
gagaaacccuaugaaugua

SEQ ID NO: 1503216 - RNA, 19 nt, Homo sapiens
gagaaacccuaugaaugua

SEQ ID NO: 1503217 - RNA, 19 nt, Homo sapiens
gagaaacccuaugaaugua

SEQ ID NO: 1503218 - RNA, 19 nt, Homo sapiens
gagaaacccuaugaaugua

SEQ ID NO: 1503219 - RNA, 19 nt, Homo sapiens
gagaaacccuaugaaugua

SEQ ID NO: 1503220 - RNA, 19 nt, Homo sapiens
gagaaacccuaugauugua

SEQ ID NO: 1503221 - RNA, 19 nt, Homo sapiens
gagaaacccuaugaaugua

SEQ ID NO: 1503222 - RNA, 19 nt, Homo sapiens
gaacauugaagaucacaaa

SEQ ID NO: 1503223 - RNA, 19 nt, Homo sapiens
gguaaggccuucaguuguu

SEQ ID NO: 1503224 - RNA, 19 nt, Homo sapiens
ggagagaaacccuaugauu

SEQ ID NO: 1503225 - RNA, 19 nt, Homo sapiens
ggagagaaacccuauaaau

SEQ ID NO: 1503226 - RNA, 19 nt, Homo sapiens
gagacaggguuucaucauu

SEQ ID NO: 1503227 - RNA, 19 nt, Homo sapiens
acacugagaugagauaauu

SEQ ID NO: 1503228 - RNA, 19 nt, Homo sapiens
cuagggagguacuguauaa

SEQ ID NO: 1503229 - RNA, 19 nt, Homo sapiens
ggaaaacccuauaaaugua

SEQ ID NO: 1503230 - RNA, 19 nt, Homo sapiens
gagagaaaccuuaugaaug

SEQ ID NO: 1503231 - RNA, 19 nt, Homo sapiens
gggaaagccugaugcaaau

SEQ ID NO: 1503232 - RNA, 19 nt, Homo sapiens
gguaaagccuucaaguguu

SEQ ID NO: 1503233 - RNA, 19 nt, Homo sapiens
gaaacccuaugaauguaaa

SEQ ID NO: 1503234 - RNA, 19 nt, Homo sapiens
gaaacccuaugaauguaaa

SEQ ID NO: 1503235 - RNA, 19 nt, Homo sapiens
gaaacccuaugaauguaaa

SEQ ID NO: 1503236 - RNA, 19 nt, Homo sapiens
gaaacccuaugaauguaaa

SEQ ID NO: 1503237 - RNA, 19 nt, Homo sapiens
gaaacccuaugaauguaaa

SEQ ID NO: 1503238 - RNA, 19 nt, Homo sapiens
gaaacccuaugaauguaaa

SEQ ID NO: 1503239 - RNA, 19 nt, Homo sapiens
gaaacccuaugaauguaaa

SEQ ID NO: 1503240 - RNA, 19 nt, Homo sapiens
gauagaaccauauaaccua

SEQ ID NO: 1503241 - RNA, 19 nt, Homo sapiens
aaacuucaaucucauguug

SEQ ID NO: 1503242 - RNA, 19 nt, Homo sapiens
agagaaaccuuaugagugu

SEQ ID NO: 1503243 - RNA, 19 nt, Homo sapiens
caagaaaccuuuguuaacu

SEQ ID NO: 1503244 - RNA, 19 nt, Homo sapiens
guacacaaguugaauugau

SEQ ID NO: 1503245 - RNA, 19 nt, Homo sapiens
cauaugcccuauaaaugua

SEQ ID NO: 1503246 - RNA, 19 nt, Homo sapiens
gagagaaacccuaugaaug

SEQ ID NO: 1503247 - RNA, 19 nt, Homo sapiens
gagagaaacccuaugaaug

SEQ ID NO: 1503248 - RNA, 19 nt, Homo sapiens
gagagaaacccuaugaaug

SEQ ID NO: 1503249 - RNA, 19 nt, Homo sapiens
gagagaaacccuaugaaug

SEQ ID NO: 1503250 - RNA, 19 nt, Homo sapiens
gagagaaacccuaugaaug

SEQ ID NO: 1503251 - RNA, 19 nt, Homo sapiens
aacaaaugcucaugugaua

SEQ ID NO: 1503252 - RNA, 19 nt, Homo sapiens
ggagaaaccaucagucaga

SEQ ID NO: 1503253 - RNA, 19 nt, Homo sapiens
uaagcaauauggcaaaguu

SEQ ID NO: 1503254 - RNA, 19 nt, Homo sapiens
gggagaaacccuauaaaug

SEQ ID NO: 1503255 - RNA, 19 nt, Homo sapiens
ggagagaaaccuuaugaau

SEQ ID NO: 1503256 - RNA, 19 nt, Homo sapiens
gaacaaacucacacuggaa

SEQ ID NO: 1503257 - RNA, 19 nt, Homo sapiens
gaccaugcccacuuaauuu

SEQ ID NO: 1503258 - RNA, 19 nt, Homo sapiens
gaguaacccuauguauaua

SEQ ID NO: 1503259 - RNA, 19 nt, Homo sapiens
gguaaggcguuuaguuguu

SEQ ID NO: 1503260 - RNA, 19 nt, Homo sapiens
gagguacuguauaaaugua

SEQ ID NO: 1503261 - RNA, 19 nt, Homo sapiens
guaaagccuucaaguguuc

SEQ ID NO: 1503262 - RNA, 19 nt, Homo sapiens
gaauguaaacaauguggua

SEQ ID NO: 1503263 - RNA, 19 nt, Homo sapiens
gaauguaaacaauguggua

SEQ ID NO: 1503264 - RNA, 19 nt, Homo sapiens
agacaggguuucaucauug

SEQ ID NO: 1503265 - RNA, 19 nt, Homo sapiens
agaagaacauugaagauca

SEQ ID NO: 1503266 - RNA, 19 nt, Homo sapiens
ccaauugagaguauucuua

SEQ ID NO: 1503267 - RNA, 19 nt, Homo sapiens
gggagguacuguauaaaug

SEQ ID NO: 1503268 - RNA, 19 nt, Homo sapiens
aaagugagauauagcaaug

SEQ ID NO: 1503269 - RNA, 19 nt, Homo sapiens
ggagagaaacccuaugaau

SEQ ID NO: 1503270 - RNA, 19 nt, Homo sapiens
gcaagaaaccuuuguuaac

SEQ ID NO: 1503271 - RNA, 19 nt, Homo sapiens
ggagagaaacccuaugaau

SEQ ID NO: 1503272 - RNA, 19 nt, Homo sapiens
ggagagaaacccuaugaau

SEQ ID NO: 1503273 - RNA, 19 nt, Homo sapiens
ggagagaaacccuaugaau

SEQ ID NO: 1503274 - RNA, 19 nt, Homo sapiens
ggagagaaacccuaugaau

SEQ ID NO: 1503275 - RNA, 19 nt, Homo sapiens
cugcuugacugccauauuu

SEQ ID NO: 1503276 - RNA, 19 nt, Homo sapiens
gagaaacccuauaagacau

SEQ ID NO: 1503277 - RNA, 19 nt, Homo sapiens
gaauguaaacaguguggua

SEQ ID NO: 1503278 - RNA, 19 nt, Homo sapiens
gaauguaaacaguguggua

SEQ ID NO: 1503279 - RNA, 19 nt, Homo sapiens
gaauguaaacaguguggua

SEQ ID NO: 1503280 - RNA, 19 nt, Homo sapiens
gaauguaaacaguguggua

SEQ ID NO: 1503281 - RNA, 19 nt, Homo sapiens
gcugugauuugaauaauag

SEQ ID NO: 1503282 - RNA, 19 nt, Homo sapiens
ucgaauacaugaaagaguu

SEQ ID NO: 1503283 - RNA, 19 nt, Homo sapiens
ugacucaccucaucucuag

SEQ ID NO: 1503284 - RNA, 19 nt, Homo sapiens
ggagaagccuuauaaaugu

SEQ ID NO: 1503285 - RNA, 19 nt, Homo sapiens
gagaaacccuauaaaugua

SEQ ID NO: 1503286 - RNA, 19 nt, Homo sapiens
ggacagaaaccauauaaau

SEQ ID NO: 1503287 - RNA, 19 nt, Homo sapiens
gcucauucaucucuuaaua

SEQ ID NO: 1503288 - RNA, 19 nt, Homo sapiens
gagaaaccguauaaaugua

SEQ ID NO: 1503289 - RNA, 19 nt, Homo sapiens
gagaaaccauaucaaugua

SEQ ID NO: 1503290 - RNA, 19 nt, Homo sapiens
agagaaaccuuaugaaugu

SEQ ID NO: 1503291 - RNA, 19 nt, Homo sapiens
gagagaaacccuauaaaug

SEQ ID NO: 1503292 - RNA, 19 nt, Homo sapiens
gagagaaaccguauaaaug

SEQ ID NO: 1503293 - RNA, 19 nt, Homo sapiens
gagagaaacccuauaaaug

SEQ ID NO: 1503294 - RNA, 19 nt, Homo sapiens
ucaagaauauggacagaaa

SEQ ID NO: 1503295 - RNA, 19 nt, Homo sapiens
gagaagagaagccguauga

SEQ ID NO: 1503296 - RNA, 19 nt, Homo sapiens
guagagaugugaugcaaga

SEQ ID NO: 1503297 - RNA, 19 nt, Homo sapiens
gggagaagccuuauaaaug

SEQ ID NO: 1503298 - RNA, 19 nt, Homo sapiens
gagaaacccuaugaaugua

SEQ ID NO: 1503299 - RNA, 19 nt, Homo sapiens
gaaagaacccacucuagga

SEQ ID NO: 1503300 - RNA, 19 nt, Homo sapiens
ggagagaaacccuauaaau

SEQ ID NO: 1503301 - RNA, 19 nt, Homo sapiens
ggagagaaaccguauaaau

SEQ ID NO: 1503302 - RNA, 19 nt, Homo sapiens
ggagagaaacccuauaaau

SEQ ID NO: 1503303 - RNA, 19 nt, Homo sapiens
gaagccauaugaauguaaa

SEQ ID NO: 1503304 - RNA, 19 nt, Homo sapiens
ggagaaaccuaagaauugu

SEQ ID NO: 1503305 - RNA, 19 nt, Homo sapiens
gagagaaaccuuaugaaug

SEQ ID NO: 1503306 - RNA, 19 nt, Homo sapiens
gaagagaagccguaugaau

SEQ ID NO: 1503307 - RNA, 19 nt, Homo sapiens
gagaaacccuaugcaugua

SEQ ID NO: 1503308 - RNA, 19 nt, Homo sapiens
gagaagccuuauaaaugua

SEQ ID NO: 1503309 - RNA, 19 nt, Homo sapiens
uggaagggcucacugcaua

SEQ ID NO: 1503310 - RNA, 19 nt, Homo sapiens
ccucacagcuucaaauuca

SEQ ID NO: 1503311 - RNA, 19 nt, Homo sapiens
gugggaaaguauuaucuua

SEQ ID NO: 1503312 - RNA, 19 nt, Homo sapiens
gagagaaacccuaugaaug

SEQ ID NO: 1503313 - RNA, 19 nt, Homo sapiens
gagagaaacccuaugaaug

SEQ ID NO: 1503314 - RNA, 19 nt, Homo sapiens
cagaugacaugcugaagaa

SEQ ID NO: 1503315 - RNA, 19 nt, Homo sapiens
uaaagaaggucaucagcau

SEQ ID NO: 1503316 - RNA, 19 nt, Homo sapiens
ggagagaaaccuuaugaau

SEQ ID NO: 1503317 - RNA, 19 nt, Homo sapiens
agagaaaccuuacgagugu

SEQ ID NO: 1503318 - RNA, 19 nt, Homo sapiens
ggagagaaaccauaucaau

SEQ ID NO: 1503319 - RNA, 19 nt, Homo sapiens
gcagauccuucaacuguuc

SEQ ID NO: 1503320 - RNA, 19 nt, Homo sapiens
uaucuuaucuuaccagcuu

SEQ ID NO: 1503321 - RNA, 19 nt, Homo sapiens
gggaaaguauuaucuuauc

SEQ ID NO: 1503322 - RNA, 19 nt, Homo sapiens
ggagagaaacccuaugaau

SEQ ID NO: 1503323 - RNA, 19 nt, Homo sapiens
ggagagaaacccuaugaau

SEQ ID NO: 1503324 - RNA, 19 nt, Homo sapiens
gagaaacccuauaaaugca

SEQ ID NO: 1503325 - RNA, 19 nt, Homo sapiens
gagaagccauaugaaugua

SEQ ID NO: 1503326 - RNA, 19 nt, Homo sapiens
gagaagccauaugaaugua

SEQ ID NO: 1503327 - RNA, 19 nt, Homo sapiens
ggagaagccauaugaaugu

SEQ ID NO: 1503328 - RNA, 19 nt, Homo sapiens
ggagaagccauaugaaugu

SEQ ID NO: 1503329 - RNA, 19 nt, Homo sapiens
ggagauggaccuuauaagu

SEQ ID NO: 1503330 - RNA, 19 nt, Homo sapiens
gagagaaaccauaucaaug

SEQ ID NO: 1503331 - RNA, 19 nt, Homo sapiens
gagaagccguaugaaugua

SEQ ID NO: 1503332 - RNA, 19 nt, Homo sapiens
gacagaaaccauauaaaug

SEQ ID NO: 1503333 - RNA, 19 nt, Homo sapiens
agagaaacccuauaaaugu

SEQ ID NO: 1503334 - RNA, 19 nt, Homo sapiens
gagauggaccuuauaagug

SEQ ID NO: 1503335 - RNA, 19 nt, Homo sapiens
gcauaugaguaucaagaau

SEQ ID NO: 1503336 - RNA, 19 nt, Homo sapiens
ggaugugccucgcgacuuc

SEQ ID NO: 1503337 - RNA, 19 nt, Homo sapiens
gagaaaccuuaugaaugua

SEQ ID NO: 1503338 - RNA, 19 nt, Homo sapiens
gggaaagccuucagaucug

SEQ ID NO: 1503339 - RNA, 19 nt, Homo sapiens
gggaaagccuucagcucuu

SEQ ID NO: 1503340 - RNA, 19 nt, Homo sapiens
gaaguaggcagugcucauu

SEQ ID NO: 1503341 - RNA, 19 nt, Homo sapiens
agagaaacccuaugaaugu

SEQ ID NO: 1503342 - RNA, 19 nt, Homo sapiens
ccaguucacuucaaacaca

SEQ ID NO: 1503343 - RNA, 19 nt, Homo sapiens
gggagaagccauaugaaug

SEQ ID NO: 1503344 - RNA, 19 nt, Homo sapiens
gggagaagccauaugaaug

SEQ ID NO: 1503345 - RNA, 19 nt, Homo sapiens
gcauucaagugucccaguu

SEQ ID NO: 1503346 - RNA, 19 nt, Homo sapiens
ggaaagccuucagcucuuc

SEQ ID NO: 1503347 - RNA, 19 nt, Homo sapiens
ggagugggcuuugcuggau

SEQ ID NO: 1503348 - RNA, 19 nt, Homo sapiens
ugacccagguuccagauga

SEQ ID NO: 1503349 - RNA, 19 nt, Homo sapiens
acacaaggcauaugaguau

SEQ ID NO: 1503350 - RNA, 19 nt, Homo sapiens
gaaaggaugcacagagaag

SEQ ID NO: 1503351 - RNA, 19 nt, Homo sapiens
gaagccauaugaauguaag

SEQ ID NO: 1503352 - RNA, 19 nt, Homo sapiens
ggaguaaaaucaugcgaaa

SEQ ID NO: 1503353 - RNA, 19 nt, Homo sapiens
agagaaaccguauaaaugu

SEQ ID NO: 1503354 - RNA, 19 nt, Homo sapiens
agauggaccuuauaagugu

SEQ ID NO: 1503355 - RNA, 19 nt, Homo sapiens
gaaacccuaugaauguaag

SEQ ID NO: 1503356 - RNA, 19 nt, Homo sapiens
uaucuuaccagcuuucaaa

SEQ ID NO: 1503357 - RNA, 19 nt, Homo sapiens
agagaaaccauaucaaugu

SEQ ID NO: 1503358 - RNA, 19 nt, Homo sapiens
caguguguauggagaagua

SEQ ID NO: 1503359 - RNA, 19 nt, Homo sapiens
aagagaagccguaugaaug

SEQ ID NO: 1503360 - RNA, 19 nt, Homo sapiens
gaacucacacuggagagaa

SEQ ID NO: 1503361 - RNA, 19 nt, Homo sapiens
uaaacauugugggaaagua

SEQ ID NO: 1503362 - RNA, 19 nt, Homo sapiens
gaacucacacuggagagaa

SEQ ID NO: 1503363 - RNA, 19 nt, Homo sapiens
ucaacugucucuccucugu

SEQ ID NO: 1503364 - RNA, 19 nt, Homo sapiens
uagauguucuucacaacuu

SEQ ID NO: 1503365 - RNA, 19 nt, Homo sapiens
ggaaaagccuucagaucug

SEQ ID NO: 1503366 - RNA, 19 nt, Homo sapiens
aaugcacacuggagagaua

SEQ ID NO: 1503367 - RNA, 19 nt, Homo sapiens
aggagaaaccuaagaauug

SEQ ID NO: 1503368 - RNA, 19 nt, Homo sapiens
caacauagugagacucugu

SEQ ID NO: 1503369 - RNA, 19 nt, Homo sapiens
gaaaggcaagaaaugaugu

SEQ ID NO: 1503370 - RNA, 19 nt, Homo sapiens
gaaacccuaugcauguaag

SEQ ID NO: 1503371 - RNA, 19 nt, Homo sapiens
agagaaacccuaugcaugu

SEQ ID NO: 1503372 - RNA, 19 nt, Homo sapiens
ggagagaaacccuaugcau

SEQ ID NO: 1503373 - RNA, 19 nt, Homo sapiens
ccauaugaauguaaggaau

SEQ ID NO: 1503374 - RNA, 19 nt, Homo sapiens
ccauaugaauguaaacagu

SEQ ID NO: 1503375 - RNA, 19 nt, Homo sapiens
ccauaucaauguaaacagu

SEQ ID NO: 1503376 - RNA, 19 nt, Homo sapiens
cuucaaagacacaggauaa

SEQ ID NO: 1503377 - RNA, 19 nt, Homo sapiens
gacacaaggcauaugagua

SEQ ID NO: 1503378 - RNA, 19 nt, Homo sapiens
gagaaacccuaugaaugca

SEQ ID NO: 1503379 - RNA, 19 nt, Homo sapiens
caauguaaacaguguggua

SEQ ID NO: 1503380 - RNA, 19 nt, Homo sapiens
ugggaaagccuugauguuu

SEQ ID NO: 1503381 - RNA, 19 nt, Homo sapiens
gauggaccuuauaagugua

SEQ ID NO: 1503382 - RNA, 19 nt, Homo sapiens
gagaugugaugcaagaaac

SEQ ID NO: 1503383 - RNA, 19 nt, Homo sapiens
auucaaaccuucaaagaca

SEQ ID NO: 1503384 - RNA, 19 nt, Homo sapiens
gagaacaccuccagaaaua

SEQ ID NO: 1503385 - RNA, 19 nt, Homo sapiens
gagaaacccuauaaaugua

SEQ ID NO: 1503386 - RNA, 19 nt, Homo sapiens
aaacagagcugaaaucaag

SEQ ID NO: 1503387 - RNA, 19 nt, Homo sapiens
gaaagcauguugugcagaa

SEQ ID NO: 1503388 - RNA, 19 nt, Homo sapiens
acacgugacucaaguauuu

SEQ ID NO: 1503389 - RNA, 19 nt, Homo sapiens
caaguauaauccugucuua

SEQ ID NO: 1503390 - RNA, 19 nt, Homo sapiens
ccugaacucucguaucuua

SEQ ID NO: 1503391 - RNA, 19 nt, Homo sapiens
gagagaaacccuauaaaug

SEQ ID NO: 1503392 - RNA, 19 nt, Homo sapiens
gagagaaacugcgaaucua

SEQ ID NO: 1503393 - RNA, 19 nt, Homo sapiens
gaagaagcccuacgaaugu

SEQ ID NO: 1503394 - RNA, 19 nt, Homo sapiens
gaacuuggcauucauagau

SEQ ID NO: 1503395 - RNA, 19 nt, Homo sapiens
ggagagaaacccuauaaau

SEQ ID NO: 1503396 - RNA, 19 nt, Homo sapiens
gagaagcccugugaaugaa

SEQ ID NO: 1503397 - RNA, 19 nt, Homo sapiens
gagccacacuggagagaaa

SEQ ID NO: 1503398 - RNA, 19 nt, Homo sapiens
gagagaaaccguaugaaug

SEQ ID NO: 1503399 - RNA, 19 nt, Homo sapiens
caagaaggauugucaaacu

SEQ ID NO: 1503400 - RNA, 19 nt, Homo sapiens
cuacgaaugugaagaaugu

SEQ ID NO: 1503401 - RNA, 19 nt, Homo sapiens
acagggagauuccauaaga

SEQ ID NO: 1503402 - RNA, 19 nt, Homo sapiens
gagaacaucuucccugaac

SEQ ID NO: 1503403 - RNA, 19 nt, Homo sapiens
gaagguaaagucuacagaa

SEQ ID NO: 1503404 - RNA, 19 nt, Homo sapiens
ggagagaaaccguaugaau

SEQ ID NO: 1503405 - RNA, 19 nt, Homo sapiens
aaaggaagguggaaaauuu

SEQ ID NO: 1503406 - RNA, 19 nt, Homo sapiens
gaacacugugcaucauaua

SEQ ID NO: 1503407 - RNA, 19 nt, Homo sapiens
gaaaugaggaaccacucua

SEQ ID NO: 1503408 - RNA, 19 nt, Homo sapiens
agauauuccuuacaccuua

SEQ ID NO: 1503409 - RNA, 19 nt, Homo sapiens
gauauuccuuacaccuuaa

SEQ ID NO: 1503410 - RNA, 19 nt, Homo sapiens
ucaagaccauccuggcuaa

SEQ ID NO: 1503411 - RNA, 19 nt, Homo sapiens
ucucguaucuuacagaaau

SEQ ID NO: 1503412 - RNA, 19 nt, Homo sapiens
agagaaacccuauaaaugu

SEQ ID NO: 1503413 - RNA, 19 nt, Homo sapiens
gagcugaaaucaagcacau

SEQ ID NO: 1503414 - RNA, 19 nt, Homo sapiens
gagaaacugcgaaucuaaa

SEQ ID NO: 1503415 - RNA, 19 nt, Homo sapiens
ggagagaaacugcgaaucu

SEQ ID NO: 1503416 - RNA, 19 nt, Homo sapiens
gacuguaccuaacauguga

SEQ ID NO: 1503417 - RNA, 19 nt, Homo sapiens
ugagaagcccugugaauga

SEQ ID NO: 1503418 - RNA, 19 nt, Homo sapiens
agaagaagcccuacgaaug

SEQ ID NO: 1503419 - RNA, 19 nt, Homo sapiens
aauccugucuuaaacgaua

SEQ ID NO: 1503420 - RNA, 19 nt, Homo sapiens
ucccagcacuccacauuaa

SEQ ID NO: 1503421 - RNA, 19 nt, Homo sapiens
gaguagacauuuguucuca

SEQ ID NO: 1503422 - RNA, 19 nt, Homo sapiens
ucauugcacuggagagaaa

SEQ ID NO: 1503423 - RNA, 19 nt, Homo sapiens
ggacccagcucagaggaau

SEQ ID NO: 1503424 - RNA, 19 nt, Homo sapiens
aagguaaagucuacagaaa

SEQ ID NO: 1503425 - RNA, 19 nt, Homo sapiens
cauaagacaauguauccua

SEQ ID NO: 1503426 - RNA, 19 nt, Homo sapiens
caucuugaguagacauuug

SEQ ID NO: 1503427 - RNA, 19 nt, Homo sapiens
gguaaagucuacagaaagc

SEQ ID NO: 1503428 - RNA, 19 nt, Homo sapiens
gaugagaagcccugugaau

SEQ ID NO: 1503429 - RNA, 19 nt, Homo sapiens
gcgagaacaccuccagaaa

SEQ ID NO: 1503430 - RNA, 19 nt, Homo sapiens
gcacuccacauuaagagaa

SEQ ID NO: 1503431 - RNA, 19 nt, Homo sapiens
uuuaaacacuuaccacuca

SEQ ID NO: 1503432 - RNA, 19 nt, Homo sapiens
agaccucuuuaaacacuua

SEQ ID NO: 1503433 - RNA, 19 nt, Homo sapiens
guaugaaugugggaaaugu

SEQ ID NO: 1503434 - RNA, 19 nt, Homo sapiens
guauaauccugucuuaaac

SEQ ID NO: 1503435 - RNA, 19 nt, Homo sapiens
acacuuaccacucauguug

SEQ ID NO: 1503436 - RNA, 19 nt, Homo sapiens
ccuuacaccuuaauaaaca

SEQ ID NO: 1503437 - RNA, 19 nt, Homo sapiens
agagaaaccguaugaaugu

SEQ ID NO: 1503438 - RNA, 19 nt, Homo sapiens
agacaaacaagaaggauug

SEQ ID NO: 1503439 - RNA, 19 nt, Homo sapiens
agacguggcugugaacuuc

SEQ ID NO: 1503440 - RNA, 19 nt, Homo sapiens
ucacagggagauuccauaa

SEQ ID NO: 1503441 - RNA, 19 nt, Homo sapiens
gaacaucuucccugaacuc

SEQ ID NO: 1503442 - RNA, 19 nt, Homo sapiens
ccagaaauaacucaauuca

SEQ ID NO: 1503443 - RNA, 19 nt, Homo sapiens
gagacuccuuacggaaaua

SEQ ID NO: 1503444 - RNA, 19 nt, Homo sapiens
ucaaauucaugguucauac

SEQ ID NO: 1503445 - RNA, 19 nt, Homo sapiens
gaacaccuccagaaauaac

SEQ ID NO: 1503446 - RNA, 19 nt, Homo sapiens
cgagaacaccuccagaaau

SEQ ID NO: 1503447 - RNA, 19 nt, Homo sapiens
ggagauuccauaagacaau

SEQ ID NO: 1503448 - RNA, 19 nt, Homo sapiens
ugaaucuccuguuagcauu

SEQ ID NO: 1503449 - RNA, 19 nt, Homo sapiens
ccgcagagacaaacaagaa

SEQ ID NO: 1503450 - RNA, 19 nt, Homo sapiens
gagauuccauaagacaaug

SEQ ID NO: 1503451 - RNA, 19 nt, Homo sapiens
gaagaaugugggaaaguca

SEQ ID NO: 1503452 - RNA, 19 nt, Homo sapiens
gcagaagaagcccuacgaa

SEQ ID NO: 1503453 - RNA, 19 nt, Homo sapiens
agaacacugugcaucauau

SEQ ID NO: 1503454 - RNA, 19 nt, Homo sapiens
gaagcccugugaaugaaag

SEQ ID NO: 1503455 - RNA, 19 nt, Homo sapiens
gaaacccuauaaauguaag

SEQ ID NO: 1503456 - RNA, 19 nt, Homo sapiens
ugaagaaugugggaaaguc

SEQ ID NO: 1503457 - RNA, 19 nt, Homo sapiens
gagaaaccguaugaaugug

SEQ ID NO: 1503458 - RNA, 19 nt, Homo sapiens
aggaaccacucuaaaccua

SEQ ID NO: 1503459 - RNA, 19 nt, Homo sapiens
gagacaaacaagaaggauu

SEQ ID NO: 1503460 - RNA, 19 nt, Homo sapiens
cuccagaaauaacucaauu

SEQ ID NO: 1503461 - RNA, 19 nt, Homo sapiens
cagagacuccuuacggaaa

SEQ ID NO: 1503462 - RNA, 19 nt, Homo sapiens
ucuaggaacuuggcauuca

SEQ ID NO: 1503463 - RNA, 19 nt, Homo sapiens
uuaagacucacaaagauga

SEQ ID NO: 1503464 - RNA, 19 nt, Homo sapiens
cagaacacugugcaucaua

SEQ ID NO: 1503465 - RNA, 19 nt, Homo sapiens
agagaaacugcgaaucuaa

SEQ ID NO: 1503466 - RNA, 19 nt, Homo sapiens
ucgcagacguggcugugaa

SEQ ID NO: 1503467 - RNA, 19 nt, Homo sapiens
cgugaagacggaucccuua

SEQ ID NO: 1503468 - RNA, 19 nt, Homo sapiens
aaacaacgaagacgaugga

SEQ ID NO: 1503469 - RNA, 19 nt, Homo sapiens
ggaaaauucuaggaacuug

SEQ ID NO: 1503470 - RNA, 19 nt, Homo sapiens
ucccugaacucucguaucu

SEQ ID NO: 1503471 - RNA, 19 nt, Homo sapiens
gaaaggaagguggaaaauu

SEQ ID NO: 1503472 - RNA, 19 nt, Homo sapiens
uaacacgugacucaaguau

SEQ ID NO: 1503473 - RNA, 19 nt, Homo sapiens
ccuaacacgugacucaagu

SEQ ID NO: 1503474 - RNA, 19 nt, Homo sapiens
uugugaagaucaugaaaug

SEQ ID NO: 1503475 - RNA, 19 nt, Homo sapiens
agccggauauucuuccuaa

SEQ ID NO: 1503476 - RNA, 19 nt, Homo sapiens
cagaagaagcccuacgaau

SEQ ID NO: 1503477 - RNA, 19 nt, Homo sapiens
gaggcuacaacuggaauaa

SEQ ID NO: 1503478 - RNA, 19 nt, Homo sapiens
gucaggagaucaagaccau

SEQ ID NO: 1503479 - RNA, 19 nt, Homo sapiens
ucagcguggucucaaauuc

SEQ ID NO: 1503480 - RNA, 19 nt, Homo sapiens
gagagaaaacccauaaaug

SEQ ID NO: 1503481 - RNA, 19 nt, Homo sapiens
caaauuccgguucacacaa

SEQ ID NO: 1503482 - RNA, 19 nt, Homo sapiens
gcaccagcggaauccauuu

SEQ ID NO: 1503483 - RNA, 19 nt, Homo sapiens
aaaugaggaaccacucuaa

SEQ ID NO: 1503484 - RNA, 19 nt, Homo sapiens
ggagaaaucuuaugaaugu

SEQ ID NO: 1503485 - RNA, 19 nt, Homo sapiens
gaaagagacuuagugagua

SEQ ID NO: 1503486 - RNA, 19 nt, Homo sapiens
gaauaacugucuacuguuu

SEQ ID NO: 1503487 - RNA, 19 nt, Homo sapiens
gagaaacccuauauuugua

SEQ ID NO: 1503488 - RNA, 19 nt, Homo sapiens
gggaaggccuuuagaauga

SEQ ID NO: 1503489 - RNA, 19 nt, Homo sapiens
caacugcucuuccuacuga

SEQ ID NO: 1503490 - RNA, 19 nt, Homo sapiens
gaaggcaaaucuuacugua

SEQ ID NO: 1503491 - RNA, 19 nt, Homo sapiens
ggaauucacucagaagaaa

SEQ ID NO: 1503492 - RNA, 19 nt, Homo sapiens
gagacaagauacacaauga

SEQ ID NO: 1503493 - RNA, 19 nt, Homo sapiens
gaggagaaacccuauauuu

SEQ ID NO: 1503494 - RNA, 19 nt, Homo sapiens
gaaaagcccuauauuugua

SEQ ID NO: 1503495 - RNA, 19 nt, Homo sapiens
uaaaguaccauacggaaua

SEQ ID NO: 1503496 - RNA, 19 nt, Homo sapiens
gaagucaaaucccauaauc

SEQ ID NO: 1503497 - RNA, 19 nt, Homo sapiens
gaaagcaacccucacugua

SEQ ID NO: 1503498 - RNA, 19 nt, Homo sapiens
ggagaaacccuauauuugu

SEQ ID NO: 1503499 - RNA, 19 nt, Homo sapiens
gcacagucauuuggauaua

SEQ ID NO: 1503500 - RNA, 19 nt, Homo sapiens
ggagaaaucguaugaaugu

SEQ ID NO: 1503501 - RNA, 19 nt, Homo sapiens
ggagagaaaccauauaaau

SEQ ID NO: 1503502 - RNA, 19 nt, Homo sapiens
gaagagcaaccaauauuga

SEQ ID NO: 1503503 - RNA, 19 nt, Homo sapiens
gagaaaucauuccuucaaa

SEQ ID NO: 1503504 - RNA, 19 nt, Homo sapiens
gaaaagacauuuacucuag

SEQ ID NO: 1503505 - RNA, 19 nt, Homo sapiens
gaccaaaccugaugugauc

SEQ ID NO: 1503506 - RNA, 19 nt, Homo sapiens
gcacaucagagaacacaua

SEQ ID NO: 1503507 - RNA, 19 nt, Homo sapiens
gaaguauucuagaucaguu

SEQ ID NO: 1503508 - RNA, 19 nt, Homo sapiens
gagagaaaccauauaaaug

SEQ ID NO: 1503509 - RNA, 19 nt, Homo sapiens
ucagaagacucuauauaug

SEQ ID NO: 1503510 - RNA, 19 nt, Homo sapiens
cggaauaacugucuacugu

SEQ ID NO: 1503511 - RNA, 19 nt, Homo sapiens
gaugugguuucuuauauga

SEQ ID NO: 1503512 - RNA, 19 nt, Homo sapiens
ccagaaauccuaugaaugu

SEQ ID NO: 1503513 - RNA, 19 nt, Homo sapiens
ccacuuccguagccuauaa

SEQ ID NO: 1503514 - RNA, 19 nt, Homo sapiens
agacaaaucucaaucuaca

SEQ ID NO: 1503515 - RNA, 19 nt, Homo sapiens
gguaagucuuucaguuaua

SEQ ID NO: 1503516 - RNA, 19 nt, Homo sapiens
gguaaaucauucagucaaa

SEQ ID NO: 1503517 - RNA, 19 nt, Homo sapiens
gcucagaagacucuauaua

SEQ ID NO: 1503518 - RNA, 19 nt, Homo sapiens
gagaaaccauaugaaugua

SEQ ID NO: 1503519 - RNA, 19 nt, Homo sapiens
ggagagaaaccauaugaau

SEQ ID NO: 1503520 - RNA, 19 nt, Homo sapiens
guacaucagagaacucaua

SEQ ID NO: 1503521 - RNA, 19 nt, Homo sapiens
ggaaguccuuucaccagaa

SEQ ID NO: 1503522 - RNA, 19 nt, Homo sapiens
gcaguuaguuguuacuuac

SEQ ID NO: 1503523 - RNA, 19 nt, Homo sapiens
guauuaaucuccauaagag

SEQ ID NO: 1503524 - RNA, 19 nt, Homo sapiens
agucauaucucauucauca

SEQ ID NO: 1503525 - RNA, 19 nt, Homo sapiens
gaagucauaucucauucau

SEQ ID NO: 1503526 - RNA, 19 nt, Homo sapiens
gaagacaacacucucucua

SEQ ID NO: 1503527 - RNA, 19 nt, Homo sapiens
aaaucuaccuccugaauau

SEQ ID NO: 1503528 - RNA, 19 nt, Homo sapiens
agaaggaaaucauaucuca

SEQ ID NO: 1503529 - RNA, 19 nt, Homo sapiens
gaagagccauggacaucau

SEQ ID NO: 1503530 - RNA, 19 nt, Homo sapiens
ggaaaggaaugagaagaca

SEQ ID NO: 1503531 - RNA, 19 nt, Homo sapiens
ggccagaaauccuaugaau

SEQ ID NO: 1503532 - RNA, 19 nt, Homo sapiens
caagaaagagacuuaguga

SEQ ID NO: 1503533 - RNA, 19 nt, Homo sapiens
gagagaaaccauaugaaug

SEQ ID NO: 1503534 - RNA, 19 nt, Homo sapiens
agucauaccucauugauca

SEQ ID NO: 1503535 - RNA, 19 nt, Homo sapiens
uauaauacaugcagagaca

SEQ ID NO: 1503536 - RNA, 19 nt, Homo sapiens
agacagcccucacugauca

SEQ ID NO: 1503537 - RNA, 19 nt, Homo sapiens
ggaaaucauaucucauuga

SEQ ID NO: 1503538 - RNA, 19 nt, Homo sapiens
gaaaacccaucuguauaua

SEQ ID NO: 1503539 - RNA, 19 nt, Homo sapiens
gaucagugucuuucaauga

SEQ ID NO: 1503540 - RNA, 19 nt, Homo sapiens
ucauugcacucuguaauaa

SEQ ID NO: 1503541 - RNA, 19 nt, Homo sapiens
gacauuuacucuaggcaaa

SEQ ID NO: 1503542 - RNA, 19 nt, Homo sapiens
gaggcuaacaugacugaua

SEQ ID NO: 1503543 - RNA, 19 nt, Homo sapiens
gcaagaaagagacuuagug

SEQ ID NO: 1503544 - RNA, 19 nt, Homo sapiens
gacaagauacacaaugauu

SEQ ID NO: 1503545 - RNA, 19 nt, Homo sapiens
gugguaagucuuucaguua

SEQ ID NO: 1503546 - RNA, 19 nt, Homo sapiens
ggaaugagaagacagaagu

SEQ ID NO: 1503547 - RNA, 19 nt, Homo sapiens
gagaaaccauaugagugua

SEQ ID NO: 1503548 - RNA, 19 nt, Homo sapiens
ggagagaaaccauaugagu

SEQ ID NO: 1503549 - RNA, 19 nt, Homo sapiens
gaaagugcuuccgccagaa

SEQ ID NO: 1503550 - RNA, 19 nt, Homo sapiens
gaaaguccuuccgccagaa

SEQ ID NO: 1503551 - RNA, 19 nt, Homo sapiens
agacaacccuugcucuuca

SEQ ID NO: 1503552 - RNA, 19 nt, Homo sapiens
caccagaaggcaaaucuua

SEQ ID NO: 1503553 - RNA, 19 nt, Homo sapiens
aggaaugccuucagauuga

SEQ ID NO: 1503554 - RNA, 19 nt, Homo sapiens
aaagagacuuagugaguau

SEQ ID NO: 1503555 - RNA, 19 nt, Homo sapiens
gaucaucaccgaacucaca

SEQ ID NO: 1503556 - RNA, 19 nt, Homo sapiens
gaaaccauaugaguguaau

SEQ ID NO: 1503557 - RNA, 19 nt, Homo sapiens
caucaucaaagaacucaua

SEQ ID NO: 1503558 - RNA, 19 nt, Homo sapiens
guaggaaugccuucagauu

SEQ ID NO: 1503559 - RNA, 19 nt, Homo sapiens
gaaauucaaggaacaccaa

SEQ ID NO: 1503560 - RNA, 19 nt, Homo sapiens
ccuacugacucaaauaguu

SEQ ID NO: 1503561 - RNA, 19 nt, Homo sapiens
cuacaucagagaauucaua

SEQ ID NO: 1503562 - RNA, 19 nt, Homo sapiens
ggaaggccuuuagaaugaa

SEQ ID NO: 1503563 - RNA, 19 nt, Homo sapiens
gggaaaagcccuauauuug

SEQ ID NO: 1503564 - RNA, 19 nt, Homo sapiens
gccagagcuuucagucaua

SEQ ID NO: 1503565 - RNA, 19 nt, Homo sapiens
gaacuauauuucucauugc

SEQ ID NO: 1503566 - RNA, 19 nt, Homo sapiens
gcagagacaagauacacaa

SEQ ID NO: 1503567 - RNA, 19 nt, Homo sapiens
agacaacacucucucuaca

SEQ ID NO: 1503568 - RNA, 19 nt, Homo sapiens
ccagagcuuucagucauaa

SEQ ID NO: 1503569 - RNA, 19 nt, Homo sapiens
gaaaccucauuguccauca

SEQ ID NO: 1503570 - RNA, 19 nt, Homo sapiens
ggagaaaacccaucuguau

SEQ ID NO: 1503571 - RNA, 19 nt, Homo sapiens
caaaucccauaaucaaagu

SEQ ID NO: 1503572 - RNA, 19 nt, Homo sapiens
uaauggauaugggaaauca

SEQ ID NO: 1503573 - RNA, 19 nt, Homo sapiens
uaaucuaaauccugcaaga

SEQ ID NO: 1503574 - RNA, 19 nt, Homo sapiens
gcauguggcaguaguguau

SEQ ID NO: 1503575 - RNA, 19 nt, Homo sapiens
aaaguaccauacggaauaa

SEQ ID NO: 1503576 - RNA, 19 nt, Homo sapiens
ugcaauaaaugaugugguu

SEQ ID NO: 1503577 - RNA, 19 nt, Homo sapiens
agagaaaccauaugaaugu

SEQ ID NO: 1503578 - RNA, 19 nt, Homo sapiens
caagaagaggcuaacauga

SEQ ID NO: 1503579 - RNA, 19 nt, Homo sapiens
gaacucauacgggagagaa

SEQ ID NO: 1503580 - RNA, 19 nt, Homo sapiens
gaagucagagacaagaaga

SEQ ID NO: 1503581 - RNA, 19 nt, Homo sapiens
caaucuacaucagagaauu

SEQ ID NO: 1503582 - RNA, 19 nt, Homo sapiens
gaagucauaccucauugau

SEQ ID NO: 1503583 - RNA, 19 nt, Homo sapiens
guaugaaugucugcaaugu

SEQ ID NO: 1503584 - RNA, 19 nt, Homo sapiens
ggaaaggccuucaguugua

SEQ ID NO: 1503585 - RNA, 19 nt, Homo sapiens
agucagaacucacaauuua

SEQ ID NO: 1503586 - RNA, 19 nt, Homo sapiens
acuaagagcucacaacuuu

SEQ ID NO: 1503587 - RNA, 19 nt, Homo sapiens
gcucagcacuuacuaauca

SEQ ID NO: 1503588 - RNA, 19 nt, Homo sapiens
gggaaggccuuuaguuauu

SEQ ID NO: 1503589 - RNA, 19 nt, Homo sapiens
gaauacaugcccacauuua

SEQ ID NO: 1503590 - RNA, 19 nt, Homo sapiens
gcucauaccuuucucaaca

SEQ ID NO: 1503591 - RNA, 19 nt, Homo sapiens
acucagaacucacaacuuu

SEQ ID NO: 1503592 - RNA, 19 nt, Homo sapiens
gagaaacccuaugauugua

SEQ ID NO: 1503593 - RNA, 19 nt, Homo sapiens
gagaaacccuaugaaugua

SEQ ID NO: 1503594 - RNA, 19 nt, Homo sapiens
caacugggauauccaaaug

SEQ ID NO: 1503595 - RNA, 19 nt, Homo sapiens
uaagaaacccuaugaaugu

SEQ ID NO: 1503596 - RNA, 19 nt, Homo sapiens
caacagacauuccuuacuc

SEQ ID NO: 1503597 - RNA, 19 nt, Homo sapiens
gggaaggccuuuacucaga

SEQ ID NO: 1503598 - RNA, 19 nt, Homo sapiens
caacaucagagaauucaua

SEQ ID NO: 1503599 - RNA, 19 nt, Homo sapiens
caacaucagagaauucaua

SEQ ID NO: 1503600 - RNA, 19 nt, Homo sapiens
caagugaucuccuuauugg

SEQ ID NO: 1503601 - RNA, 19 nt, Homo sapiens
ccagaauguuguaaucaua

SEQ ID NO: 1503602 - RNA, 19 nt, Homo sapiens
gaaaagcccuauaacugua

SEQ ID NO: 1503603 - RNA, 19 nt, Homo sapiens
guaagaaacccuaugaaug

SEQ ID NO: 1503604 - RNA, 19 nt, Homo sapiens
gaagacagacccuaugaau

SEQ ID NO: 1503605 - RNA, 19 nt, Homo sapiens
caucagagaauucauauug

SEQ ID NO: 1503606 - RNA, 19 nt, Homo sapiens
ggaaggccuuuaguuauug

SEQ ID NO: 1503607 - RNA, 19 nt, Homo sapiens
guucagaucuggaaucgau

SEQ ID NO: 1503608 - RNA, 19 nt, Homo sapiens
ggaaggccuuuacucagaa

SEQ ID NO: 1503609 - RNA, 19 nt, Homo sapiens
gagaugugauguuggagaa

SEQ ID NO: 1503610 - RNA, 19 nt, Homo sapiens
cuaaccaucugcaauacua

SEQ ID NO: 1503611 - RNA, 19 nt, Homo sapiens
caacaucagagaauccaua

SEQ ID NO: 1503612 - RNA, 19 nt, Homo sapiens
ugagaaacccuuugaaugu

SEQ ID NO: 1503613 - RNA, 19 nt, Homo sapiens
ugagaaacccuaugaaugu

SEQ ID NO: 1503614 - RNA, 19 nt, Homo sapiens
gggaaauucuuuaguugug

SEQ ID NO: 1503615 - RNA, 19 nt, Homo sapiens
agacagacccuaugaaugu

SEQ ID NO: 1503616 - RNA, 19 nt, Homo sapiens
caagaggccuguguucaga

SEQ ID NO: 1503617 - RNA, 19 nt, Homo sapiens
gaacuacggcaaucugguu

SEQ ID NO: 1503618 - RNA, 19 nt, Homo sapiens
agacuaaccaucugcaaua

SEQ ID NO: 1503619 - RNA, 19 nt, Homo sapiens
gugggaaggccuuuaguua

SEQ ID NO: 1503620 - RNA, 19 nt, Homo sapiens
auacagagaugugauguug

SEQ ID NO: 1503621 - RNA, 19 nt, Homo sapiens
gaaaccaaguuauuaucuc

SEQ ID NO: 1503622 - RNA, 19 nt, Homo sapiens
ccuaagcuguugaucauga

SEQ ID NO: 1503623 - RNA, 19 nt, Homo sapiens
gcucacagcuucgucaaca

SEQ ID NO: 1503624 - RNA, 19 nt, Homo sapiens
gagaaacccuuugaauguc

SEQ ID NO: 1503625 - RNA, 19 nt, Homo sapiens
cagcaugcacgaauucaua

SEQ ID NO: 1503626 - RNA, 19 nt, Homo sapiens
uaaagagugugggaaauuc

SEQ ID NO: 1503627 - RNA, 19 nt, Homo sapiens
guaaagagugugggaaauu

SEQ ID NO: 1503628 - RNA, 19 nt, Homo sapiens
gugagaaacccuaugauug

SEQ ID NO: 1503629 - RNA, 19 nt, Homo sapiens
gguaagaaacccuaugaau

SEQ ID NO: 1503630 - RNA, 19 nt, Homo sapiens
cugaauacaugcccacauu

SEQ ID NO: 1503631 - RNA, 19 nt, Homo sapiens
gaaagagcccuggaugguu

SEQ ID NO: 1503632 - RNA, 19 nt, Homo sapiens
ucagugauguguccauaga

SEQ ID NO: 1503633 - RNA, 19 nt, Homo sapiens
ucagugauguucagugaug

SEQ ID NO: 1503634 - RNA, 19 nt, Homo sapiens
ugagaaacccuaugauugu

SEQ ID NO: 1503635 - RNA, 19 nt, Homo sapiens
ggugagaaacccuaugauu

SEQ ID NO: 1503636 - RNA, 19 nt, Homo sapiens
gaaaggccuucaguuguag

SEQ ID NO: 1503637 - RNA, 19 nt, Homo sapiens
ggaaagagcccuggauggu

SEQ ID NO: 1503638 - RNA, 19 nt, Homo sapiens
gcauuuaaguuuccuaagc

SEQ ID NO: 1503639 - RNA, 19 nt, Homo sapiens
caucagggaauucauacua

SEQ ID NO: 1503640 - RNA, 19 nt, Homo sapiens
gaauuggcuucuuucacuu

SEQ ID NO: 1503641 - RNA, 19 nt, Homo sapiens
gacagacccuaugaaugua

SEQ ID NO: 1503642 - RNA, 19 nt, Homo sapiens
caaaucuuauugaccauca

SEQ ID NO: 1503643 - RNA, 19 nt, Homo sapiens
aguuguagcucauaccuuu

SEQ ID NO: 1503644 - RNA, 19 nt, Homo sapiens
gagauaaugggacuuacaa

SEQ ID NO: 1503645 - RNA, 19 nt, Homo sapiens
acagagaugugauguugga

SEQ ID NO: 1503646 - RNA, 19 nt, Homo sapiens
ucagagaauucauacagau

SEQ ID NO: 1503647 - RNA, 19 nt, Homo sapiens
cagcaucagagaauucaua

SEQ ID NO: 1503648 - RNA, 19 nt, Homo sapiens
gaaacccuaugauuguaag

SEQ ID NO: 1503649 - RNA, 19 nt, Homo sapiens
gaaacccuaugaauguaag

SEQ ID NO: 1503650 - RNA, 19 nt, Homo sapiens
gaaacccuaugaauguaag

SEQ ID NO: 1503651 - RNA, 19 nt, Homo sapiens
gugggaaauucuuuaguug

SEQ ID NO: 1503652 - RNA, 19 nt, Homo sapiens
ugugggaaauucuuuaguu

SEQ ID NO: 1503653 - RNA, 19 nt, Homo sapiens
caaagcauggccuugagua

SEQ ID NO: 1503654 - RNA, 19 nt, Homo sapiens
uaaugggacuuacaaagca

SEQ ID NO: 1503655 - RNA, 19 nt, Homo sapiens
ggacuuauacagagaugug

SEQ ID NO: 1503656 - RNA, 19 nt, Homo sapiens
gugagaaacccuuugaaug

SEQ ID NO: 1503657 - RNA, 19 nt, Homo sapiens
gugagaaacccuaugaaug

SEQ ID NO: 1503658 - RNA, 19 nt, Homo sapiens
aagaaacccuaugaaugua

SEQ ID NO: 1503659 - RNA, 19 nt, Homo sapiens
guucagugauguguccaua

SEQ ID NO: 1503660 - RNA, 19 nt, Homo sapiens
caaggaagacuaaccaucu

SEQ ID NO: 1503661 - RNA, 19 nt, Homo sapiens
guggaaaggccuucaguug

SEQ ID NO: 1503662 - RNA, 19 nt, Homo sapiens
gauaaugggacuuacaaag

SEQ ID NO: 1503663 - RNA, 19 nt, Homo sapiens
caucagagaauucauacug

SEQ ID NO: 1503664 - RNA, 19 nt, Homo sapiens
gauccucccucccugucaa

SEQ ID NO: 1503665 - RNA, 19 nt, Homo sapiens
ggugagaaacccuuugaau

SEQ ID NO: 1503666 - RNA, 19 nt, Homo sapiens
ggugagaaacccuaugaau

SEQ ID NO: 1503667 - RNA, 19 nt, Homo sapiens
gaauguaagaaauguggaa

SEQ ID NO: 1503668 - RNA, 19 nt, Homo sapiens
ggagauguuuuggaauaua

SEQ ID NO: 1503669 - RNA, 19 nt, Homo sapiens
ucagagggacuuauacaga

SEQ ID NO: 1503670 - RNA, 19 nt, Homo sapiens
cagggaauucauacuaaua

SEQ ID NO: 1503671 - RNA, 19 nt, Homo sapiens
gaaacccuuugaaugucuu

SEQ ID NO: 1503672 - RNA, 19 nt, Homo sapiens
gagaauccauaccgguaag

SEQ ID NO: 1503673 - RNA, 19 nt, Homo sapiens
ucagagaauucauauuggu

SEQ ID NO: 1503674 - RNA, 19 nt, Homo sapiens
agaacggccucaaggaaga

SEQ ID NO: 1503675 - RNA, 19 nt, Homo sapiens
gaugugugaaaccaaguua

SEQ ID NO: 1503676 - RNA, 19 nt, Homo sapiens
gcacuuacuaaucaucaga

SEQ ID NO: 1503677 - RNA, 19 nt, Homo sapiens
gaauguaaggaauguggaa

SEQ ID NO: 1503678 - RNA, 19 nt, Homo sapiens
gugugaaaccaaguuauua

SEQ ID NO: 1503679 - RNA, 19 nt, Homo sapiens
ucagggaauucauacuaau

SEQ ID NO: 1503680 - RNA, 19 nt, Homo sapiens
gaagccaccuugcaaaaca

SEQ ID NO: 1503681 - RNA, 19 nt, Homo sapiens
ucaagugaucuccuuauug

SEQ ID NO: 1503682 - RNA, 19 nt, Homo sapiens
cgucaucagggaauucaua

SEQ ID NO: 1503683 - RNA, 19 nt, Homo sapiens
ggagauaaugggacuuaca

SEQ ID NO: 1503684 - RNA, 19 nt, Homo sapiens
cagagaaacuucagaaaua

SEQ ID NO: 1503685 - RNA, 19 nt, Homo sapiens
gaucuacucucacaauaua

SEQ ID NO: 1503686 - RNA, 19 nt, Homo sapiens
ugagaaggcuuaugaauau

SEQ ID NO: 1503687 - RNA, 19 nt, Homo sapiens
gagaauagcauauagagaa

SEQ ID NO: 1503688 - RNA, 19 nt, Homo sapiens
aacaaucgcucaacucuua

SEQ ID NO: 1503689 - RNA, 19 nt, Homo sapiens
ggagaaacccuaugaaugu

SEQ ID NO: 1503690 - RNA, 19 nt, Homo sapiens
guaaagaucuacucucaca

SEQ ID NO: 1503691 - RNA, 19 nt, Homo sapiens
gagaaacccuaucagugua

SEQ ID NO: 1503692 - RNA, 19 nt, Homo sapiens
ggaaggccuuugcuuguuu

SEQ ID NO: 1503693 - RNA, 19 nt, Homo sapiens
gagaaacccuaugaaugua

SEQ ID NO: 1503694 - RNA, 19 nt, Homo sapiens
gagaaacccuaugaaugua

SEQ ID NO: 1503695 - RNA, 19 nt, Homo sapiens
ccagagaacucauacuaau

SEQ ID NO: 1503696 - RNA, 19 nt, Homo sapiens
ggcaaagcauucaauaauu

SEQ ID NO: 1503697 - RNA, 19 nt, Homo sapiens
ucacuuguguuucugauuu

SEQ ID NO: 1503698 - RNA, 19 nt, Homo sapiens
gagaaguccuuugaaugua

SEQ ID NO: 1503699 - RNA, 19 nt, Homo sapiens
gcagagagcccaucuuagu

SEQ ID NO: 1503700 - RNA, 19 nt, Homo sapiens
ugacaaacccuaugaaugu

SEQ ID NO: 1503701 - RNA, 19 nt, Homo sapiens
gagaacacauacuaaugaa

SEQ ID NO: 1503702 - RNA, 19 nt, Homo sapiens
caacaucagagaacacaua

SEQ ID NO: 1503703 - RNA, 19 nt, Homo sapiens
gcucaacacuuacucaaca

SEQ ID NO: 1503704 - RNA, 19 nt, Homo sapiens
uuacuuggcuuucaaacuu

SEQ ID NO: 1503705 - RNA, 19 nt, Homo sapiens
gugagaaggcuuaugaaua

SEQ ID NO: 1503706 - RNA, 19 nt, Homo sapiens
gcagagaaacuucagaaau

SEQ ID NO: 1503707 - RNA, 19 nt, Homo sapiens
gacaaacccuaugaaugua

SEQ ID NO: 1503708 - RNA, 19 nt, Homo sapiens
ggugagaaguccuuugaau

SEQ ID NO: 1503709 - RNA, 19 nt, Homo sapiens
caucagagaacacauacua

SEQ ID NO: 1503710 - RNA, 19 nt, Homo sapiens
gagaaggcuuaugaauaua

SEQ ID NO: 1503711 - RNA, 19 nt, Homo sapiens
ugagaaacccuaugaaugu

SEQ ID NO: 1503712 - RNA, 19 nt, Homo sapiens
ugagaaacccuuugaaugu

SEQ ID NO: 1503713 - RNA, 19 nt, Homo sapiens
uaaagaaugugggaagguu

SEQ ID NO: 1503714 - RNA, 19 nt, Homo sapiens
guucagcucuuauucaaca

SEQ ID NO: 1503715 - RNA, 19 nt, Homo sapiens
ggaaggcuuucacuugugu

SEQ ID NO: 1503716 - RNA, 19 nt, Homo sapiens
ugagagacuuuacgaaugu

SEQ ID NO: 1503717 - RNA, 19 nt, Homo sapiens
gaaagcccgauauguguaa

SEQ ID NO: 1503718 - RNA, 19 nt, Homo sapiens
gaaaugugggaaacacuuu

SEQ ID NO: 1503719 - RNA, 19 nt, Homo sapiens
gaaugucaguaaugcaaga

SEQ ID NO: 1503720 - RNA, 19 nt, Homo sapiens
caugaagggacaaaucuua

SEQ ID NO: 1503721 - RNA, 19 nt, Homo sapiens
gaaacccuaugaauguaau

SEQ ID NO: 1503722 - RNA, 19 nt, Homo sapiens
gaugagagacuuuacgaau

SEQ ID NO: 1503723 - RNA, 19 nt, Homo sapiens
caacaucaaagaauuccua

SEQ ID NO: 1503724 - RNA, 19 nt, Homo sapiens
aagcagagagcccaucuua

SEQ ID NO: 1503725 - RNA, 19 nt, Homo sapiens
gaauguaaggaauguguaa

SEQ ID NO: 1503726 - RNA, 19 nt, Homo sapiens
ucagagaauucacaaagga

SEQ ID NO: 1503727 - RNA, 19 nt, Homo sapiens
gaaacccuaugaauguaau

SEQ ID NO: 1503728 - RNA, 19 nt, Homo sapiens
agaaguccuuugaauguaa

SEQ ID NO: 1503729 - RNA, 19 nt, Homo sapiens
gggaaggcauuuaacaauc

SEQ ID NO: 1503730 - RNA, 19 nt, Homo sapiens
guguaaagaucuacucuca

SEQ ID NO: 1503731 - RNA, 19 nt, Homo sapiens
gugcacaucuuacucaaca

SEQ ID NO: 1503732 - RNA, 19 nt, Homo sapiens
gagaaacccuuugaauguc

SEQ ID NO: 1503733 - RNA, 19 nt, Homo sapiens
ggccuuugcuuguuuccua

SEQ ID NO: 1503734 - RNA, 19 nt, Homo sapiens
gggagaaacccuaugaaug

SEQ ID NO: 1503735 - RNA, 19 nt, Homo sapiens
gagaaaccauaugagugua

SEQ ID NO: 1503736 - RNA, 19 nt, Homo sapiens
ggugagaagccuaaugaaa

SEQ ID NO: 1503737 - RNA, 19 nt, Homo sapiens
gggaaggccuuugcuuguu

SEQ ID NO: 1503738 - RNA, 19 nt, Homo sapiens
ccuaugaguuuaaggaaug

SEQ ID NO: 1503739 - RNA, 19 nt, Homo sapiens
gaauguaaagaauguggua

SEQ ID NO: 1503740 - RNA, 19 nt, Homo sapiens
caacaccagagaacucaua

SEQ ID NO: 1503741 - RNA, 19 nt, Homo sapiens
uaaggaauguggcaaagca

SEQ ID NO: 1503742 - RNA, 19 nt, Homo sapiens
gggcgcaucuuacucaaca

SEQ ID NO: 1503743 - RNA, 19 nt, Homo sapiens
caaacccuaugaauguaaa

SEQ ID NO: 1503744 - RNA, 19 nt, Homo sapiens
gugaaacccuaugaaugua

SEQ ID NO: 1503745 - RNA, 19 nt, Homo sapiens
ggaaggcauuuaacaaucg

SEQ ID NO: 1503746 - RNA, 19 nt, Homo sapiens
gaagggacaaaucuuaugu

SEQ ID NO: 1503747 - RNA, 19 nt, Homo sapiens
ggagagaaacccuaucagu

SEQ ID NO: 1503748 - RNA, 19 nt, Homo sapiens
gaaacccuaucaguguaaa

SEQ ID NO: 1503749 - RNA, 19 nt, Homo sapiens
uuacgaauguacagaaugu

SEQ ID NO: 1503750 - RNA, 19 nt, Homo sapiens
ugagaaguccuuugaaugu

SEQ ID NO: 1503751 - RNA, 19 nt, Homo sapiens
uaaugcacaucuaaugaga

SEQ ID NO: 1503752 - RNA, 19 nt, Homo sapiens
agagaacacauacuaauga

SEQ ID NO: 1503753 - RNA, 19 nt, Homo sapiens
aagaucuacucucacaaua

SEQ ID NO: 1503754 - RNA, 19 nt, Homo sapiens
cgauauguguaaagaucua

SEQ ID NO: 1503755 - RNA, 19 nt, Homo sapiens
guacaggugagaagccuaa

SEQ ID NO: 1503756 - RNA, 19 nt, Homo sapiens
uaacaucaccaaauucaca

SEQ ID NO: 1503757 - RNA, 19 nt, Homo sapiens
gaauguaggaaggccuuua

SEQ ID NO: 1503758 - RNA, 19 nt, Homo sapiens
gaaacccuaugaauguaag

SEQ ID NO: 1503759 - RNA, 19 nt, Homo sapiens
cauaaugcacaucuaauga

SEQ ID NO: 1503760 - RNA, 19 nt, Homo sapiens
caccagagaacucauacua

SEQ ID NO: 1503761 - RNA, 19 nt, Homo sapiens
caacucuuauucagcauca

SEQ ID NO: 1503762 - RNA, 19 nt, Homo sapiens
gugagaaacccuaugaaug

SEQ ID NO: 1503763 - RNA, 19 nt, Homo sapiens
gugagaaacccuuugaaug

SEQ ID NO: 1503764 - RNA, 19 nt, Homo sapiens
gugagaaacccuaugaguu

SEQ ID NO: 1503765 - RNA, 19 nt, Homo sapiens
gcacaucuaaugagacauc

SEQ ID NO: 1503766 - RNA, 19 nt, Homo sapiens
caucaaagaauucauacug

SEQ ID NO: 1503767 - RNA, 19 nt, Homo sapiens
cauuauacuuucaccaguu

SEQ ID NO: 1503768 - RNA, 19 nt, Homo sapiens
gcaucagaauuuauaugga

SEQ ID NO: 1503769 - RNA, 19 nt, Homo sapiens
gugagaagccuaaugaaag

SEQ ID NO: 1503770 - RNA, 19 nt, Homo sapiens
gaaugcagcaaggccuuua

SEQ ID NO: 1503771 - RNA, 19 nt, Homo sapiens
caaaggagagaaacccuau

SEQ ID NO: 1503772 - RNA, 19 nt, Homo sapiens
aaucagagaauucacacua

SEQ ID NO: 1503773 - RNA, 19 nt, Homo sapiens
gaaggccuuugcuuguuuc

SEQ ID NO: 1503774 - RNA, 19 nt, Homo sapiens
agagaaacccuaucagugu

SEQ ID NO: 1503775 - RNA, 19 nt, Homo sapiens
ugagaaaccauaugagugu

SEQ ID NO: 1503776 - RNA, 19 nt, Homo sapiens
uggcaaagcauucaauaau

SEQ ID NO: 1503777 - RNA, 19 nt, Homo sapiens
caucaaagaauuccuacug

SEQ ID NO: 1503778 - RNA, 19 nt, Homo sapiens
gagagacuuuacgaaugua

SEQ ID NO: 1503779 - RNA, 19 nt, Homo sapiens
aaugagacaucagagaauu

SEQ ID NO: 1503780 - RNA, 19 nt, Homo sapiens
cauaugaguguaaguaaug

SEQ ID NO: 1503781 - RNA, 19 nt, Homo sapiens
ccauaugaguguaaguaau

SEQ ID NO: 1503782 - RNA, 19 nt, Homo sapiens
gaaaccauaugaguguaag

SEQ ID NO: 1503783 - RNA, 19 nt, Homo sapiens
caggugagaagccuaauga

SEQ ID NO: 1503784 - RNA, 19 nt, Homo sapiens
gcaucgcucuguccaguua

SEQ ID NO: 1503785 - RNA, 19 nt, Homo sapiens
gaaguuaucaacccucuga

SEQ ID NO: 1503786 - RNA, 19 nt, Homo sapiens
gaaauugucggaauaugug

SEQ ID NO: 1503787 - RNA, 19 nt, Homo sapiens
gccacuaucuggaaaauua

SEQ ID NO: 1503788 - RNA, 19 nt, Homo sapiens
caagugacaagcaaaguaa

SEQ ID NO: 1503789 - RNA, 19 nt, Homo sapiens
cgaaagcauuauaacugua

SEQ ID NO: 1503790 - RNA, 19 nt, Homo sapiens
gaagaacuugguugcgaua

SEQ ID NO: 1503791 - RNA, 19 nt, Homo sapiens
cggaauaugugcucucuuc

SEQ ID NO: 1503792 - RNA, 19 nt, Homo sapiens
aaauagugcugaacagaau

SEQ ID NO: 1503793 - RNA, 19 nt, Homo sapiens
ugacacuacuucaagagaa

SEQ ID NO: 1503794 - RNA, 19 nt, Homo sapiens
caaauagugcugaacagaa

SEQ ID NO: 1503795 - RNA, 19 nt, Homo sapiens
ggacuggaaggcuaugaaa

SEQ ID NO: 1503796 - RNA, 19 nt, Homo sapiens
gacaagcaaaguaaaugua

SEQ ID NO: 1503797 - RNA, 19 nt, Homo sapiens
uuucagaagucaagaguau

SEQ ID NO: 1503798 - RNA, 19 nt, Homo sapiens
ggucugagauguccaagcu

SEQ ID NO: 1503799 - RNA, 19 nt, Homo sapiens
ccaugaggaugaaagaaau

SEQ ID NO: 1503800 - RNA, 19 nt, Homo sapiens
aauaugugcucucuucaug

SEQ ID NO: 1503801 - RNA, 19 nt, Homo sapiens
ccucugcauuccagucaua

SEQ ID NO: 1503802 - RNA, 19 nt, Homo sapiens
ucaagugacaagcaaagua

SEQ ID NO: 1503803 - RNA, 19 nt, Homo sapiens
ucgaaagcauuauaacugu

SEQ ID NO: 1503804 - RNA, 19 nt, Homo sapiens
ucaacccucugauagaaga

SEQ ID NO: 1503805 - RNA, 19 nt, Homo sapiens
uaacuguaacguucuuuga

SEQ ID NO: 1503806 - RNA, 19 nt, Homo sapiens
uaacguucuuugaguuugu

SEQ ID NO: 1503807 - RNA, 19 nt, Homo sapiens
guaacguucuuugaguuug

SEQ ID NO: 1503808 - RNA, 19 nt, Homo sapiens
caagggaagcagcguuuga

SEQ ID NO: 1503809 - RNA, 19 nt, Homo sapiens
guggaagccugcagagcaa

SEQ ID NO: 1503810 - RNA, 19 nt, Homo sapiens
ucagaagucaagaguauau

SEQ ID NO: 1503811 - RNA, 19 nt, Homo sapiens
uaccaauccugcaacuuga

SEQ ID NO: 1503812 - RNA, 19 nt, Homo sapiens
ucuuugaguuugugauuga

SEQ ID NO: 1503813 - RNA, 19 nt, Homo sapiens
gaauaugugcucucuucau

SEQ ID NO: 1503814 - RNA, 19 nt, Homo sapiens
ugaaauugucggaauaugu

SEQ ID NO: 1503815 - RNA, 19 nt, Homo sapiens
cugacugccucugaaguua

SEQ ID NO: 1503816 - RNA, 19 nt, Homo sapiens
ggguggaccucgauauuuu

SEQ ID NO: 1503817 - RNA, 19 nt, Homo sapiens
gugcugaacagaauaagau

SEQ ID NO: 1503818 - RNA, 19 nt, Homo sapiens
aagcaucacagaaguagaa

SEQ ID NO: 1503819 - RNA, 19 nt, Homo sapiens
gcauuccagucauaccaau

SEQ ID NO: 1503820 - RNA, 19 nt, Homo sapiens
ucuuaggcauuucaaguga

SEQ ID NO: 1503821 - RNA, 19 nt, Homo sapiens
gggagccaguggacgaaga

SEQ ID NO: 1503822 - RNA, 19 nt, Homo sapiens
ucaauuaccagcaguuucu

SEQ ID NO: 1503823 - RNA, 19 nt, Homo sapiens
cgucuccgccacccacuua

SEQ ID NO: 1503824 - RNA, 19 nt, Homo sapiens
acuugaaauugucggaaua

SEQ ID NO: 1503825 - RNA, 19 nt, Homo sapiens
gaggaugaaagaaauuauc

SEQ ID NO: 1503826 - RNA, 19 nt, Homo sapiens
auaccaauccugcaacuug

SEQ ID NO: 1503827 - RNA, 19 nt, Homo sapiens
ucaaauagugcugaacaga

SEQ ID NO: 1503828 - RNA, 19 nt, Homo sapiens
cuagagcccaugaggauga

SEQ ID NO: 1503829 - RNA, 19 nt, Homo sapiens
aauugagacugaugaaaca

SEQ ID NO: 1503830 - RNA, 19 nt, Homo sapiens
gucgaaagcauuauaacug

SEQ ID NO: 1503831 - RNA, 19 nt, Homo sapiens
caaaguaaaggaugguuuu

SEQ ID NO: 1503832 - RNA, 19 nt, Homo sapiens
ugacaagcaaaguaaaugu

SEQ ID NO: 1503833 - RNA, 19 nt, Homo sapiens
gugcucucuucaugucaua

SEQ ID NO: 1503834 - RNA, 19 nt, Homo sapiens
uaugugcucucuucauguc

SEQ ID NO: 1503835 - RNA, 19 nt, Homo sapiens
uaucaaauagugcugaaca

SEQ ID NO: 1503836 - RNA, 19 nt, Homo sapiens
gcauuauaacuguaacguu

SEQ ID NO: 1503837 - RNA, 19 nt, Homo sapiens
caggguggaccucgauauu

SEQ ID NO: 1503838 - RNA, 19 nt, Homo sapiens
cccaugaggaugaaagaaa

SEQ ID NO: 1503839 - RNA, 19 nt, Homo sapiens
ugaaacaucaauacuagag

SEQ ID NO: 1503840 - RNA, 19 nt, Homo sapiens
cauuucaagugacaagcaa

SEQ ID NO: 1503841 - RNA, 19 nt, Homo sapiens
caucaauuaccagcaguuu

SEQ ID NO: 1503842 - RNA, 19 nt, Homo sapiens
gacacuacuucaagagaac

SEQ ID NO: 1503843 - RNA, 19 nt, Homo sapiens
ggaauaugugcucucuuca

SEQ ID NO: 1503844 - RNA, 19 nt, Homo sapiens
ggaaggcuaugaaaagaac

SEQ ID NO: 1503845 - RNA, 19 nt, Homo sapiens
acaaaguaaaggaugguuu

SEQ ID NO: 1503846 - RNA, 19 nt, Homo sapiens
guucuuugaguuugugauu

SEQ ID NO: 1503847 - RNA, 19 nt, Homo sapiens
gauugcucccggcagaaua

SEQ ID NO: 1503848 - RNA, 19 nt, Homo sapiens
gacugccucugaaguuauc

SEQ ID NO: 1503849 - RNA, 19 nt, Homo sapiens
gcucucuucaugucauauu

SEQ ID NO: 1503850 - RNA, 19 nt, Homo sapiens
aaauugagacugaugaaac

SEQ ID NO: 1503851 - RNA, 19 nt, Homo sapiens
gcaacuugauuuucagaag

SEQ ID NO: 1503852 - RNA, 19 nt, Homo sapiens
guccaguuauuccaguuuc

SEQ ID NO: 1503853 - RNA, 19 nt, Homo sapiens
gcaagggaagcagcguuug

SEQ ID NO: 1503854 - RNA, 19 nt, Homo sapiens
gcaguuucuccgccacuau

SEQ ID NO: 1503855 - RNA, 19 nt, Homo sapiens
ucaauacuagagcccauga

SEQ ID NO: 1503856 - RNA, 19 nt, Homo sapiens
uguaacguucuuugaguuu

SEQ ID NO: 1503857 - RNA, 19 nt, Homo sapiens
cuguaacguucuuugaguu

SEQ ID NO: 1503858 - RNA, 19 nt, Homo sapiens
acuguaacguucuuugagu

SEQ ID NO: 1503859 - RNA, 19 nt, Homo sapiens
ucugggagcagccgaguug

SEQ ID NO: 1503860 - RNA, 19 nt, Homo sapiens
cagcguuugaugccgaaua

SEQ ID NO: 1503861 - RNA, 19 nt, Homo sapiens
gugacaagcaaaguaaaug

SEQ ID NO: 1503862 - RNA, 19 nt, Homo sapiens
agaacuugguugcgauaag

SEQ ID NO: 1503863 - RNA, 19 nt, Homo sapiens
gcauuucaagugacaagca

SEQ ID NO: 1503864 - RNA, 19 nt, Homo sapiens
ugaguuauuaggacuggaa

SEQ ID NO: 1503865 - RNA, 19 nt, Homo sapiens
caugaggaugaaagaaauu

SEQ ID NO: 1503866 - RNA, 19 nt, Homo sapiens
uacuagagcccaugaggau

SEQ ID NO: 1503867 - RNA, 19 nt, Homo sapiens
ccacccacuuagcguuuua

SEQ ID NO: 1503868 - RNA, 19 nt, Homo sapiens
ugacugccucugaaguuau

SEQ ID NO: 1503869 - RNA, 19 nt, Homo sapiens
gcccacagguuuccagaug

SEQ ID NO: 1503870 - RNA, 19 nt, Homo sapiens
ccaaagcaauaucuauguc

SEQ ID NO: 1503871 - RNA, 19 nt, Homo sapiens
caacguugacuacuucuuc

SEQ ID NO: 1503872 - RNA, 19 nt, Homo sapiens
ccaaagacaagcucugugu

SEQ ID NO: 1503873 - RNA, 19 nt, Homo sapiens
gccagucagcccuguauaa

SEQ ID NO: 1503874 - RNA, 19 nt, Homo sapiens
guccaacguugacuacuuc

SEQ ID NO: 1503875 - RNA, 19 nt, Homo sapiens
gagcugcuguccuuugacu

SEQ ID NO: 1503876 - RNA, 19 nt, Homo sapiens
caagacggccagagcuuug

SEQ ID NO: 1503877 - RNA, 19 nt, Homo sapiens
aagcacauuugaccuuuca

SEQ ID NO: 1503878 - RNA, 19 nt, Homo sapiens
uguccaacguugacuacuu

SEQ ID NO: 1503879 - RNA, 19 nt, Homo sapiens
ccaagacggccagagcuuu

SEQ ID NO: 1503880 - RNA, 19 nt, Homo sapiens
uuaaagcacauuugaccuu

SEQ ID NO: 1503881 - RNA, 19 nt, Homo sapiens
cauucugucuggcaagaga

SEQ ID NO: 1503882 - RNA, 19 nt, Homo sapiens
cagcaguggugggaacuca

SEQ ID NO: 1503883 - RNA, 19 nt, Homo sapiens
gacuacagcgugccugaga

SEQ ID NO: 1503884 - RNA, 19 nt, Homo sapiens
caagcucugugucauccau

SEQ ID NO: 1503885 - RNA, 19 nt, Homo sapiens
gacuacuucuucaacuuca

SEQ ID NO: 1503886 - RNA, 19 nt, Homo sapiens
ugacuacuucuucaacuuc

SEQ ID NO: 1503887 - RNA, 19 nt, Homo sapiens
agucagcccuguauaagcu

SEQ ID NO: 1503888 - RNA, 19 nt, Homo sapiens
cgcauuaaagcacauuuga

SEQ ID NO: 1503889 - RNA, 19 nt, Homo sapiens
caagguggccgaggucaag

SEQ ID NO: 1503890 - RNA, 19 nt, Homo sapiens
cgacggccaagaagggaaa

SEQ ID NO: 1503891 - RNA, 19 nt, Homo sapiens
ggaacucagccgaugacau

SEQ ID NO: 1503892 - RNA, 19 nt, Homo sapiens
ccagucagcccuguauaag

SEQ ID NO: 1503893 - RNA, 19 nt, Homo sapiens
ccauagagcuguccugguu

SEQ ID NO: 1503894 - RNA, 19 nt, Homo sapiens
ggagaaagagaaacagaaa

SEQ ID NO: 1503895 - RNA, 19 nt, Homo sapiens
ggaggaaggccgacugaaa

SEQ ID NO: 1503896 - RNA, 19 nt, Homo sapiens
gagcugcccuucaggucua

SEQ ID NO: 1503897 - RNA, 19 nt, Homo sapiens
gcagaaagagagacaaaga

SEQ ID NO: 1503898 - RNA, 19 nt, Homo sapiens
ggacuucgcucgcuuacac

SEQ ID NO: 1503899 - RNA, 19 nt, Homo sapiens
agacagaaauagaaacaga

SEQ ID NO: 1503900 - RNA, 19 nt, Homo sapiens
gaaggccgacugaaagaaa

SEQ ID NO: 1503901 - RNA, 19 nt, Homo sapiens
gacaaagacagaaauagaa

SEQ ID NO: 1503902 - RNA, 19 nt, Homo sapiens
ggcagacgcuuccucuuug

SEQ ID NO: 1503903 - RNA, 19 nt, Homo sapiens
acauagagaccaacagaua

SEQ ID NO: 1503904 - RNA, 19 nt, Homo sapiens
aguccgagcucaauaaaug

SEQ ID NO: 1503905 - RNA, 19 nt, Homo sapiens
ccucuuugcugcuugcuuu

SEQ ID NO: 1503906 - RNA, 19 nt, Homo sapiens
gcgccaaccucgaagacaa

SEQ ID NO: 1503907 - RNA, 19 nt, Homo sapiens
gcguagagcccuucuccua

SEQ ID NO: 1503908 - RNA, 19 nt, Homo sapiens
gaaagaaagacggagaaga

SEQ ID NO: 1503909 - RNA, 19 nt, Homo sapiens
agacaaagacagaaauaga

SEQ ID NO: 1503910 - RNA, 19 nt, Homo sapiens
gauugaggacgaugcauuu

SEQ ID NO: 1503911 - RNA, 19 nt, Homo sapiens
ccacgcagccaaucgcuuu

SEQ ID NO: 1503912 - RNA, 19 nt, Homo sapiens
aaagagagacaaagacaga

SEQ ID NO: 1503913 - RNA, 19 nt, Homo sapiens
caccuaagccuggccaaua

SEQ ID NO: 1503914 - RNA, 19 nt, Homo sapiens
gccggcagcuuccugagaa

SEQ ID NO: 1503915 - RNA, 19 nt, Homo sapiens
aaagaaacaggcagaaaga

SEQ ID NO: 1503916 - RNA, 19 nt, Homo sapiens
gaggaaggccgacugaaag

SEQ ID NO: 1503917 - RNA, 19 nt, Homo sapiens
ccacacgucuaggccuuaa

SEQ ID NO: 1503918 - RNA, 19 nt, Homo sapiens
cggcagacgcuuccucuuu

SEQ ID NO: 1503919 - RNA, 19 nt, Homo sapiens
aaagaaagacggagaagag

SEQ ID NO: 1503920 - RNA, 19 nt, Homo sapiens
agaaagacagggagaaaga

SEQ ID NO: 1503921 - RNA, 19 nt, Homo sapiens
ucacacacauagagaccaa

SEQ ID NO: 1503922 - RNA, 19 nt, Homo sapiens
gagaagcgggugccucaga

SEQ ID NO: 1503923 - RNA, 19 nt, Homo sapiens
ucacauacacucacacaca

SEQ ID NO: 1503924 - RNA, 19 nt, Homo sapiens
acacacacacacucacaua

SEQ ID NO: 1503925 - RNA, 19 nt, Homo sapiens
ggaggaggcaaagaaacua

SEQ ID NO: 1503926 - RNA, 19 nt, Homo sapiens
gauagacagcuaccuaaag

SEQ ID NO: 1503927 - RNA, 19 nt, Homo sapiens
gcauuccuuucccauucua

SEQ ID NO: 1503928 - RNA, 19 nt, Homo sapiens
cagauagacagcuaccuaa

SEQ ID NO: 1503929 - RNA, 19 nt, Homo sapiens
acagauagacagcuaccua

SEQ ID NO: 1503930 - RNA, 19 nt, Homo sapiens
gcgcugcuccugcucuaaa

SEQ ID NO: 1503931 - RNA, 19 nt, Homo sapiens
gggagaaagagaaacagaa

SEQ ID NO: 1503932 - RNA, 19 nt, Homo sapiens
agaaacagacuaacacaca

SEQ ID NO: 1503933 - RNA, 19 nt, Homo sapiens
ggacacacacacacucaca

SEQ ID NO: 1503934 - RNA, 19 nt, Homo sapiens
uggcauuccuuucccauuc

SEQ ID NO: 1503935 - RNA, 19 nt, Homo sapiens
agagacaaagacagaaaua

SEQ ID NO: 1503936 - RNA, 19 nt, Homo sapiens
ggugggaggaggcaaagaa

SEQ ID NO: 1503937 - RNA, 19 nt, Homo sapiens
acacauagagaccaacaga

SEQ ID NO: 1503938 - RNA, 19 nt, Homo sapiens
ggaggugggaggaggcaaa

SEQ ID NO: 1503939 - RNA, 19 nt, Homo sapiens
accuaagccuggccaauaa

SEQ ID NO: 1503940 - RNA, 19 nt, Homo sapiens
caucgaggacaaugagauu

SEQ ID NO: 1503941 - RNA, 19 nt, Homo sapiens
gagagacaaagacagaaau

SEQ ID NO: 1503942 - RNA, 19 nt, Homo sapiens
agaaacaggcagaaagaga

SEQ ID NO: 1503943 - RNA, 19 nt, Homo sapiens
ggagccuggugcccuucua

SEQ ID NO: 1503944 - RNA, 19 nt, Homo sapiens
caaccucgaagacaacuca

SEQ ID NO: 1503945 - RNA, 19 nt, Homo sapiens
ggaccaacuggccauccua

SEQ ID NO: 1503946 - RNA, 19 nt, Homo sapiens
cacauacacucacacacau

SEQ ID NO: 1503947 - RNA, 19 nt, Homo sapiens
ggaaggccgacugaaagaa

SEQ ID NO: 1503948 - RNA, 19 nt, Homo sapiens
gaaaauuagacaccaaaga

SEQ ID NO: 1503949 - RNA, 19 nt, Homo sapiens
agacagggagaaagagaaa

SEQ ID NO: 1503950 - RNA, 19 nt, Homo sapiens
gcaggagacaagaaaucaa

SEQ ID NO: 1503951 - RNA, 19 nt, Homo sapiens
caacuccuucuccgugauu

SEQ ID NO: 1503952 - RNA, 19 nt, Homo sapiens
ccugaaagacugacagcaa

SEQ ID NO: 1503953 - RNA, 19 nt, Homo sapiens
cuucaggucuaaagcaaca

SEQ ID NO: 1503954 - RNA, 19 nt, Homo sapiens
agaaagagagacaaagaca

SEQ ID NO: 1503955 - RNA, 19 nt, Homo sapiens
gagacaagaaaucaagaca

SEQ ID NO: 1503956 - RNA, 19 nt, Homo sapiens
uaaagcaacaucuggacau

SEQ ID NO: 1503957 - RNA, 19 nt, Homo sapiens
accaacagauagacagcua

SEQ ID NO: 1503958 - RNA, 19 nt, Homo sapiens
gcagacgcuuccucuuugc

SEQ ID NO: 1503959 - RNA, 19 nt, Homo sapiens
ugcaguaccucuucaucga

SEQ ID NO: 1503960 - RNA, 19 nt, Homo sapiens
gggcaggagacaagaaauc

SEQ ID NO: 1503961 - RNA, 19 nt, Homo sapiens
caccaaagacauacgaaca

SEQ ID NO: 1503962 - RNA, 19 nt, Homo sapiens
acagaaagacagggagaaa

SEQ ID NO: 1503963 - RNA, 19 nt, Homo sapiens
aaauacagagacagaaaga

SEQ ID NO: 1503964 - RNA, 19 nt, Homo sapiens
aaacagacuaacacacaga

SEQ ID NO: 1503965 - RNA, 19 nt, Homo sapiens
gcuggucccucugaaagca

SEQ ID NO: 1503966 - RNA, 19 nt, Homo sapiens
ugggacggcuccauguuuc

SEQ ID NO: 1503967 - RNA, 19 nt, Homo sapiens
cuaccuaaagccugaaaga

SEQ ID NO: 1503968 - RNA, 19 nt, Homo sapiens
acacucacauacacucaca

SEQ ID NO: 1503969 - RNA, 19 nt, Homo sapiens
gaaagacagggagaaagag

SEQ ID NO: 1503970 - RNA, 19 nt, Homo sapiens
auagacagcuaccuaaagc

SEQ ID NO: 1503971 - RNA, 19 nt, Homo sapiens
auacagagacagaaagaca

SEQ ID NO: 1503972 - RNA, 19 nt, Homo sapiens
cauagagaccaacagauag

SEQ ID NO: 1503973 - RNA, 19 nt, Homo sapiens
gagacaaagacagaaauag

SEQ ID NO: 1503974 - RNA, 19 nt, Homo sapiens
agagagacaaagacagaaa

SEQ ID NO: 1503975 - RNA, 19 nt, Homo sapiens
gacgaguccgagcucaaua

SEQ ID NO: 1503976 - RNA, 19 nt, Homo sapiens
agacugacagcaacacaga

SEQ ID NO: 1503977 - RNA, 19 nt, Homo sapiens
gggaggaggcaaagaaacu

SEQ ID NO: 1503978 - RNA, 19 nt, Homo sapiens
aaagacagggagaaagaga

SEQ ID NO: 1503979 - RNA, 19 nt, Homo sapiens
cgaguccgagcucaauaaa

SEQ ID NO: 1503980 - RNA, 19 nt, Homo sapiens
acacacacacucacauaca

SEQ ID NO: 1503981 - RNA, 19 nt, Homo sapiens
ggcuccaucucuaagaaug

SEQ ID NO: 1503982 - RNA, 19 nt, Homo sapiens
aaacaggcagaaagagaga

SEQ ID NO: 1503983 - RNA, 19 nt, Homo sapiens
ggguugauggcauuccuuu

SEQ ID NO: 1503984 - RNA, 19 nt, Homo sapiens
aaagcaacaucuggacauc

SEQ ID NO: 1503985 - RNA, 19 nt, Homo sapiens
cuaccagcaucacgagauc

SEQ ID NO: 1503986 - RNA, 19 nt, Homo sapiens
ugauugaggacgaugcauu

SEQ ID NO: 1503987 - RNA, 19 nt, Homo sapiens
ggcaggagacaagaaauca

SEQ ID NO: 1503988 - RNA, 19 nt, Homo sapiens
ggccuuaagcccacuucuu

SEQ ID NO: 1503989 - RNA, 19 nt, Homo sapiens
gcucaucgccagggaccaa

SEQ ID NO: 1503990 - RNA, 19 nt, Homo sapiens
ccaggcagcaggacacaca

SEQ ID NO: 1503991 - RNA, 19 nt, Homo sapiens
agaggacuucgcucgcuua

SEQ ID NO: 1503992 - RNA, 19 nt, Homo sapiens
agauagacagcuaccuaaa

SEQ ID NO: 1503993 - RNA, 19 nt, Homo sapiens
gagcacuccuaucuucuua

SEQ ID NO: 1503994 - RNA, 19 nt, Homo sapiens
ccucugaccuuccuccuua

SEQ ID NO: 1503995 - RNA, 19 nt, Homo sapiens
gccaggaauuugccuauuu

SEQ ID NO: 1503996 - RNA, 19 nt, Homo sapiens
caccauuccuggcuaauuu

SEQ ID NO: 1503997 - RNA, 19 nt, Homo sapiens
ggacaucucugcgcaccuu

SEQ ID NO: 1503998 - RNA, 19 nt, Homo sapiens
gcaagcaucuccucaucuc

SEQ ID NO: 1503999 - RNA, 19 nt, Homo sapiens
acuccuaucuucuuacuuu

SEQ ID NO: 1504000 - RNA, 19 nt, Homo sapiens
ccacucaccuccugacugu

SEQ ID NO: 1504001 - RNA, 19 nt, Homo sapiens
caugagcacuccuaucuuc

SEQ ID NO: 1504002 - RNA, 19 nt, Homo sapiens
auaauucucuccucucuug

SEQ ID NO: 1504003 - RNA, 19 nt, Homo sapiens
caucucaaauucacuccua

SEQ ID NO: 1504004 - RNA, 19 nt, Homo sapiens
uguaauaaauggucacugu

SEQ ID NO: 1504005 - RNA, 19 nt, Homo sapiens
cccagaaucucaucucuau

SEQ ID NO: 1504006 - RNA, 19 nt, Homo sapiens
ccacggaggccaggaauuu

SEQ ID NO: 1504007 - RNA, 19 nt, Homo sapiens
gcuugacuuugcacauuua

SEQ ID NO: 1504008 - RNA, 19 nt, Homo sapiens
ggucaacacccucuuccua

SEQ ID NO: 1504009 - RNA, 19 nt, Homo sapiens
guuccuggcuuguaacaga

SEQ ID NO: 1504010 - RNA, 19 nt, Homo sapiens
cagaaacucauuacacauu

SEQ ID NO: 1504011 - RNA, 19 nt, Homo sapiens
cagcuugacuuugcacauu

SEQ ID NO: 1504012 - RNA, 19 nt, Homo sapiens
ccaggaauuugccuauuuc

SEQ ID NO: 1504013 - RNA, 19 nt, Homo sapiens
agucugauguguguaauaa

SEQ ID NO: 1504014 - RNA, 19 nt, Homo sapiens
ucucuccugucaaauauaa

SEQ ID NO: 1504015 - RNA, 19 nt, Homo sapiens
uaccaggccucauuuacuu

SEQ ID NO: 1504016 - RNA, 19 nt, Homo sapiens
ccaaagugcugggauuaca

SEQ ID NO: 1504017 - RNA, 19 nt, Homo sapiens
ggaagccucaggacaagaa

SEQ ID NO: 1504018 - RNA, 19 nt, Homo sapiens
ccuggugggugccauguuu

SEQ ID NO: 1504019 - RNA, 19 nt, Homo sapiens
ggccucauuuacuuauuaa

SEQ ID NO: 1504020 - RNA, 19 nt, Homo sapiens
aacagaaacucauuacaca

SEQ ID NO: 1504021 - RNA, 19 nt, Homo sapiens
aggccucauuuacuuauua

SEQ ID NO: 1504022 - RNA, 19 nt, Homo sapiens
gcucagcuaugucaauggu

SEQ ID NO: 1504023 - RNA, 19 nt, Homo sapiens
aauccuggcucacugcaaa

SEQ ID NO: 1504024 - RNA, 19 nt, Homo sapiens
caccacagcuugacuuugc

SEQ ID NO: 1504025 - RNA, 19 nt, Homo sapiens
gcacuccuaucuucuuacu

SEQ ID NO: 1504026 - RNA, 19 nt, Homo sapiens
ccgaguagcugggauuaca

SEQ ID NO: 1504027 - RNA, 19 nt, Homo sapiens
gucgugaccuccaaacaug

SEQ ID NO: 1504028 - RNA, 19 nt, Homo sapiens
gcaagauccugcccuucca

SEQ ID NO: 1504029 - RNA, 19 nt, Homo sapiens
gccuuugucuguccuguga

SEQ ID NO: 1504030 - RNA, 19 nt, Homo sapiens
uaacagaaacucauuacac

SEQ ID NO: 1504031 - RNA, 19 nt, Homo sapiens
guccucagcuccuagaaca

SEQ ID NO: 1504032 - RNA, 19 nt, Homo sapiens
uauggucucucuccuguca

SEQ ID NO: 1504033 - RNA, 19 nt, Homo sapiens
ggaguguaguggugcaauc

SEQ ID NO: 1504034 - RNA, 19 nt, Homo sapiens
gcccucaccugacuuugug

SEQ ID NO: 1504035 - RNA, 19 nt, Homo sapiens
ccaaacaugagcacuccua

SEQ ID NO: 1504036 - RNA, 19 nt, Homo sapiens
aacaguuccuggcuuguaa

SEQ ID NO: 1504037 - RNA, 19 nt, Homo sapiens
aaagacagcccggacacua

SEQ ID NO: 1504038 - RNA, 19 nt, Homo sapiens
uaauaaauggucacuguca

SEQ ID NO: 1504039 - RNA, 19 nt, Homo sapiens
gugcucagcuaugucaaug

SEQ ID NO: 1504040 - RNA, 19 nt, Homo sapiens
cuagagaggcggacauugu

SEQ ID NO: 1504041 - RNA, 19 nt, Homo sapiens
aaauaauucucuccucucu

SEQ ID NO: 1504042 - RNA, 19 nt, Homo sapiens
gacuuugcacauuuacuua

SEQ ID NO: 1504043 - RNA, 19 nt, Homo sapiens
ugacuuugcacauuuacuu

SEQ ID NO: 1504044 - RNA, 19 nt, Homo sapiens
ccucugggcccuagacuug

SEQ ID NO: 1504045 - RNA, 19 nt, Homo sapiens
ggccaggaauuugccuauu

SEQ ID NO: 1504046 - RNA, 19 nt, Homo sapiens
gcccuagacuuggcucaga

SEQ ID NO: 1504047 - RNA, 19 nt, Homo sapiens
ucucucuccugucaaauau

SEQ ID NO: 1504048 - RNA, 19 nt, Homo sapiens
gcuacagccugguguucga

SEQ ID NO: 1504049 - RNA, 19 nt, Homo sapiens
aauaaauggucacugucaa

SEQ ID NO: 1504050 - RNA, 19 nt, Homo sapiens
cuuagcacgucaccaaaga

SEQ ID NO: 1504051 - RNA, 19 nt, Homo sapiens
cccagucucuccugaagug

SEQ ID NO: 1504052 - RNA, 19 nt, Homo sapiens
ggugucuccuucuaucuca

SEQ ID NO: 1504053 - RNA, 19 nt, Homo sapiens
gcacgucaccaaagacacu

SEQ ID NO: 1504054 - RNA, 19 nt, Homo sapiens
uagagaggcggacauuguu

SEQ ID NO: 1504055 - RNA, 19 nt, Homo sapiens
guaccaggccucauuuacu

SEQ ID NO: 1504056 - RNA, 19 nt, Homo sapiens
caccaccauuccuggcuaa

SEQ ID NO: 1504057 - RNA, 19 nt, Homo sapiens
uuaccgagacuccaucuuc

SEQ ID NO: 1504058 - RNA, 19 nt, Homo sapiens
ucucgucugucucugucua

SEQ ID NO: 1504059 - RNA, 19 nt, Homo sapiens
auaaauggucacugucaaa

SEQ ID NO: 1504060 - RNA, 19 nt, Homo sapiens
ugauguguguaauaaaugg

SEQ ID NO: 1504061 - RNA, 19 nt, Homo sapiens
aaacucugccucccagguu

SEQ ID NO: 1504062 - RNA, 19 nt, Homo sapiens
ggcauaagccacuguacca

SEQ ID NO: 1504063 - RNA, 19 nt, Homo sapiens
uggccaggcuagucucgaa

SEQ ID NO: 1504064 - RNA, 19 nt, Homo sapiens
caagaagaggcaagcaucu

SEQ ID NO: 1504065 - RNA, 19 nt, Homo sapiens
ucucuccucucuugguuuc

SEQ ID NO: 1504066 - RNA, 19 nt, Homo sapiens
gagcuuaccgagacuccau

SEQ ID NO: 1504067 - RNA, 19 nt, Homo sapiens
caacacccucuuccuacga

SEQ ID NO: 1504068 - RNA, 19 nt, Homo sapiens
gacaagaagaggcaagcau

SEQ ID NO: 1504069 - RNA, 19 nt, Homo sapiens
ccaccauuccuggcuaauu

SEQ ID NO: 1504070 - RNA, 19 nt, Homo sapiens
ccucccagguucaagagau

SEQ ID NO: 1504071 - RNA, 19 nt, Homo sapiens
caaacaugagcacuccuau

SEQ ID NO: 1504072 - RNA, 19 nt, Homo sapiens
aggcaagcaucuccucauc

SEQ ID NO: 1504073 - RNA, 19 nt, Homo sapiens
uaaauggucacugucaaag

SEQ ID NO: 1504074 - RNA, 19 nt, Homo sapiens
gaagcagacaccucucacu

SEQ ID NO: 1504075 - RNA, 19 nt, Homo sapiens
gucucucuccugucaaaua

SEQ ID NO: 1504076 - RNA, 19 nt, Homo sapiens
cuccuaucuucuuacuuua

SEQ ID NO: 1504077 - RNA, 19 nt, Homo sapiens
aacaugagcacuccuaucu

SEQ ID NO: 1504078 - RNA, 19 nt, Homo sapiens
gauggucaacacccucuuc

SEQ ID NO: 1504079 - RNA, 19 nt, Homo sapiens
uggucucucuccugucaaa

SEQ ID NO: 1504080 - RNA, 19 nt, Homo sapiens
ccaguagccuccccacuuc

SEQ ID NO: 1504081 - RNA, 19 nt, Homo sapiens
ccaggccucauuuacuuau

SEQ ID NO: 1504082 - RNA, 19 nt, Homo sapiens
uacuagaggcugagcagaa

SEQ ID NO: 1504083 - RNA, 19 nt, Homo sapiens
gaaagcaugugaucaauug

SEQ ID NO: 1504084 - RNA, 19 nt, Homo sapiens
gcaaacacaugcagacauu

SEQ ID NO: 1504085 - RNA, 19 nt, Homo sapiens
aaagagcccuggaauauaa

SEQ ID NO: 1504086 - RNA, 19 nt, Homo sapiens
ggauuaacaucucuaguaa

SEQ ID NO: 1504087 - RNA, 19 nt, Homo sapiens
gaagaacauuguaguagaa

SEQ ID NO: 1504088 - RNA, 19 nt, Homo sapiens
ggagagaaaucuuacaaau

SEQ ID NO: 1504089 - RNA, 19 nt, Homo sapiens
ggaaagugauguuagagaa

SEQ ID NO: 1504090 - RNA, 19 nt, Homo sapiens
caucaguggugaagaaaua

SEQ ID NO: 1504091 - RNA, 19 nt, Homo sapiens
ggaaaccucugaagcaguu

SEQ ID NO: 1504092 - RNA, 19 nt, Homo sapiens
ggaaagcauuuauacuuga

SEQ ID NO: 1504093 - RNA, 19 nt, Homo sapiens
uaacagaugcuccauagua

SEQ ID NO: 1504094 - RNA, 19 nt, Homo sapiens
ccacagacauuaaccuauu

SEQ ID NO: 1504095 - RNA, 19 nt, Homo sapiens
gagcuggucugugauuaua

SEQ ID NO: 1504096 - RNA, 19 nt, Homo sapiens
gaagagacuuuuaugguua

SEQ ID NO: 1504097 - RNA, 19 nt, Homo sapiens
gaagaagaacauuguagua

SEQ ID NO: 1504098 - RNA, 19 nt, Homo sapiens
agagaaaccuuacaaaugu

SEQ ID NO: 1504099 - RNA, 19 nt, Homo sapiens
cuacaaaugugaagaaugu

SEQ ID NO: 1504100 - RNA, 19 nt, Homo sapiens
gagagaaaccuuacaaaug

SEQ ID NO: 1504101 - RNA, 19 nt, Homo sapiens
cuacaaaugugaagaaugu

SEQ ID NO: 1504102 - RNA, 19 nt, Homo sapiens
cuacaaaugugaagaaugu

SEQ ID NO: 1504103 - RNA, 19 nt, Homo sapiens
gagaauuccuaccaaugua

SEQ ID NO: 1504104 - RNA, 19 nt, Homo sapiens
gggcagagcaggacauuaa

SEQ ID NO: 1504105 - RNA, 19 nt, Homo sapiens
ccaguuauauguucucauu

SEQ ID NO: 1504106 - RNA, 19 nt, Homo sapiens
aaacaucaguggugaagaa

SEQ ID NO: 1504107 - RNA, 19 nt, Homo sapiens
ccagagaguucauacuaaa

SEQ ID NO: 1504108 - RNA, 19 nt, Homo sapiens
gagagaaacccuacaaaug

SEQ ID NO: 1504109 - RNA, 19 nt, Homo sapiens
gagagaaacccuacaaaug

SEQ ID NO: 1504110 - RNA, 19 nt, Homo sapiens
cuacaaaugugacgaaugu

SEQ ID NO: 1504111 - RNA, 19 nt, Homo sapiens
gagagaaacccuacaaaug

SEQ ID NO: 1504112 - RNA, 19 nt, Homo sapiens
gagagaaacccuacaaaug

SEQ ID NO: 1504113 - RNA, 19 nt, Homo sapiens
gagagaaacccuacaaaug

SEQ ID NO: 1504114 - RNA, 19 nt, Homo sapiens
gagagaaacccuacaaaug

SEQ ID NO: 1504115 - RNA, 19 nt, Homo sapiens
gcucacaccuucacaggaa

SEQ ID NO: 1504116 - RNA, 19 nt, Homo sapiens
agagaaaucuuacaaaugg

SEQ ID NO: 1504117 - RNA, 19 nt, Homo sapiens
gcaaagccuucaacugguu

SEQ ID NO: 1504118 - RNA, 19 nt, Homo sapiens
uaugugagcuggucuguga

SEQ ID NO: 1504119 - RNA, 19 nt, Homo sapiens
gagacaggguuucauaaug

SEQ ID NO: 1504120 - RNA, 19 nt, Homo sapiens
gaacauuguaguagaauug

SEQ ID NO: 1504121 - RNA, 19 nt, Homo sapiens
acaccuaacucaacauaaa

SEQ ID NO: 1504122 - RNA, 19 nt, Homo sapiens
gauaagacauacuagaaag

SEQ ID NO: 1504123 - RNA, 19 nt, Homo sapiens
gcucacaucuuacucaaca

SEQ ID NO: 1504124 - RNA, 19 nt, Homo sapiens
cuagaaaugugaagaaugu

SEQ ID NO: 1504125 - RNA, 19 nt, Homo sapiens
ggaagaaugugguaaagac

SEQ ID NO: 1504126 - RNA, 19 nt, Homo sapiens
ucaaacuccugaccucaua

SEQ ID NO: 1504127 - RNA, 19 nt, Homo sapiens
gagaaacccuacaaaugug

SEQ ID NO: 1504128 - RNA, 19 nt, Homo sapiens
gagaaacccuacaaaugug

SEQ ID NO: 1504129 - RNA, 19 nt, Homo sapiens
gagaaacccuacaaaugug

SEQ ID NO: 1504130 - RNA, 19 nt, Homo sapiens
gagaaacccuacaaaugug

SEQ ID NO: 1504131 - RNA, 19 nt, Homo sapiens
gagaaacccuacaaaugug

SEQ ID NO: 1504132 - RNA, 19 nt, Homo sapiens
gagaaacccuacaaaugug

SEQ ID NO: 1504133 - RNA, 19 nt, Homo sapiens
gaaaagagcccuggaauau

SEQ ID NO: 1504134 - RNA, 19 nt, Homo sapiens
aauacaugcucacaucuua

SEQ ID NO: 1504135 - RNA, 19 nt, Homo sapiens
ggagagaaaccuuacaaau

SEQ ID NO: 1504136 - RNA, 19 nt, Homo sapiens
gagcaggacauuaaagauu

SEQ ID NO: 1504137 - RNA, 19 nt, Homo sapiens
aaagagacaugagauggua

SEQ ID NO: 1504138 - RNA, 19 nt, Homo sapiens
ccaaguagcugggauuaca

SEQ ID NO: 1504139 - RNA, 19 nt, Homo sapiens
guagagacaggguuucaua

SEQ ID NO: 1504140 - RNA, 19 nt, Homo sapiens
guaaggcacugaugcuuca

SEQ ID NO: 1504141 - RNA, 19 nt, Homo sapiens
gaacuccugugacugugaa

SEQ ID NO: 1504142 - RNA, 19 nt, Homo sapiens
uaccaguccucaacucuua

SEQ ID NO: 1504143 - RNA, 19 nt, Homo sapiens
aaacacaugcagacauuua

SEQ ID NO: 1504144 - RNA, 19 nt, Homo sapiens
auacagaugugaagaaugu

SEQ ID NO: 1504145 - RNA, 19 nt, Homo sapiens
caccacaucuggcugaauu

SEQ ID NO: 1504146 - RNA, 19 nt, Homo sapiens
ccucaacucuuacuaaaca

SEQ ID NO: 1504147 - RNA, 19 nt, Homo sapiens
ggagagaaacccuacaaau

SEQ ID NO: 1504148 - RNA, 19 nt, Homo sapiens
ggagagaaacccuacaaau

SEQ ID NO: 1504149 - RNA, 19 nt, Homo sapiens
ggagagaaacccuacaaau

SEQ ID NO: 1504150 - RNA, 19 nt, Homo sapiens
ggagagaaacccuacaaau

SEQ ID NO: 1504151 - RNA, 19 nt, Homo sapiens
ggagagaaacccuacaaau

SEQ ID NO: 1504152 - RNA, 19 nt, Homo sapiens
ggagagaaacccuacaaau

SEQ ID NO: 1504153 - RNA, 19 nt, Homo sapiens
ccauaaguauuccugcuaa

SEQ ID NO: 1504154 - RNA, 19 nt, Homo sapiens
uagggaagcuuuauaaguc

SEQ ID NO: 1504155 - RNA, 19 nt, Homo sapiens
cuauagcccuuuaguuauu

SEQ ID NO: 1504156 - RNA, 19 nt, Homo sapiens
agacaggguuucauaaugu

SEQ ID NO: 1504157 - RNA, 19 nt, Homo sapiens
guagguaagguaaguuaua

SEQ ID NO: 1504158 - RNA, 19 nt, Homo sapiens
aaacauacaugacaguucu

SEQ ID NO: 1504159 - RNA, 19 nt, Homo sapiens
gaaaauguauucucugcuu

SEQ ID NO: 1504160 - RNA, 19 nt, Homo sapiens
ucagugaaguguuauuaug

SEQ ID NO: 1504161 - RNA, 19 nt, Homo sapiens
cuacaaaugugaagaaugc

SEQ ID NO: 1504162 - RNA, 19 nt, Homo sapiens
gaguuuguguguaugaauu

SEQ ID NO: 1504163 - RNA, 19 nt, Homo sapiens
gacaggguuucauaaugua

SEQ ID NO: 1504164 - RNA, 19 nt, Homo sapiens
gagagaaaucuuacaaaug

SEQ ID NO: 1504165 - RNA, 19 nt, Homo sapiens
ccucaacccuuacuaaaca

SEQ ID NO: 1504166 - RNA, 19 nt, Homo sapiens
cuacaaaugugaggaaugu

SEQ ID NO: 1504167 - RNA, 19 nt, Homo sapiens
acacacaggauaauucaua

SEQ ID NO: 1504168 - RNA, 19 nt, Homo sapiens
gcacaaagaacaugauaac

SEQ ID NO: 1504169 - RNA, 19 nt, Homo sapiens
gcugaaucuugcugaauuu

SEQ ID NO: 1504170 - RNA, 19 nt, Homo sapiens
uccaucaccucuaguauuu

SEQ ID NO: 1504171 - RNA, 19 nt, Homo sapiens
gagaaauccuagaaaugug

SEQ ID NO: 1504172 - RNA, 19 nt, Homo sapiens
guugagaaauccuagaaau

SEQ ID NO: 1504173 - RNA, 19 nt, Homo sapiens
caucaccucuaguauuuau

SEQ ID NO: 1504174 - RNA, 19 nt, Homo sapiens
caucagauaugagagauuc

SEQ ID NO: 1504175 - RNA, 19 nt, Homo sapiens
agaagaacauuguaguaga

SEQ ID NO: 1504176 - RNA, 19 nt, Homo sapiens
caggaaagcauuuauacuu

SEQ ID NO: 1504177 - RNA, 19 nt, Homo sapiens
gagagaaaccauacagaug

SEQ ID NO: 1504178 - RNA, 19 nt, Homo sapiens
cagcaggguuuguauagga

SEQ ID NO: 1504179 - RNA, 19 nt, Homo sapiens
ggucugugauuauaagaau

SEQ ID NO: 1504180 - RNA, 19 nt, Homo sapiens
cuaaguagcugggauuaca

SEQ ID NO: 1504181 - RNA, 19 nt, Homo sapiens
gagaaaccauacagaugug

SEQ ID NO: 1504182 - RNA, 19 nt, Homo sapiens
ggagagaaaccauacagau

SEQ ID NO: 1504183 - RNA, 19 nt, Homo sapiens
gggaaggccuuuagacuua

SEQ ID NO: 1504184 - RNA, 19 nt, Homo sapiens
caauggagaugacaaauuu

SEQ ID NO: 1504185 - RNA, 19 nt, Homo sapiens
gggaagaccuuuagauuug

SEQ ID NO: 1504186 - RNA, 19 nt, Homo sapiens
gaaauaaaccucaguuguu

SEQ ID NO: 1504187 - RNA, 19 nt, Homo sapiens
agucauagcuaucaacuua

SEQ ID NO: 1504188 - RNA, 19 nt, Homo sapiens
cgaguucguucucaaauua

SEQ ID NO: 1504189 - RNA, 19 nt, Homo sapiens
guacagagaugugauguug

SEQ ID NO: 1504190 - RNA, 19 nt, Homo sapiens
gaacaucagagacuucaua

SEQ ID NO: 1504191 - RNA, 19 nt, Homo sapiens
gggaaggccuuuagucgua

SEQ ID NO: 1504192 - RNA, 19 nt, Homo sapiens
gggaagaccuuucgaguuc

SEQ ID NO: 1504193 - RNA, 19 nt, Homo sapiens
gaaaauagauucugaugug

SEQ ID NO: 1504194 - RNA, 19 nt, Homo sapiens
gaaaucaguuuauccaaag

SEQ ID NO: 1504195 - RNA, 19 nt, Homo sapiens
gaaaagcccuauaaaugua

SEQ ID NO: 1504196 - RNA, 19 nt, Homo sapiens
caacagggacuuaaagaaa

SEQ ID NO: 1504197 - RNA, 19 nt, Homo sapiens
ggaauuacugccuuuauaa

SEQ ID NO: 1504198 - RNA, 19 nt, Homo sapiens
gaagaacucaugcagguaa

SEQ ID NO: 1504199 - RNA, 19 nt, Homo sapiens
gauuagaacuuacucaaca

SEQ ID NO: 1504200 - RNA, 19 nt, Homo sapiens
caucagagauuucauacug

SEQ ID NO: 1504201 - RNA, 19 nt, Homo sapiens
agacuuaauucacaccuua

SEQ ID NO: 1504202 - RNA, 19 nt, Homo sapiens
gaacacagaagaacucaug

SEQ ID NO: 1504203 - RNA, 19 nt, Homo sapiens
uaagaaacccuaugaaugu

SEQ ID NO: 1504204 - RNA, 19 nt, Homo sapiens
gaaguucugucaauguguu

SEQ ID NO: 1504205 - RNA, 19 nt, Homo sapiens
guaagaaacccuaugaaug

SEQ ID NO: 1504206 - RNA, 19 nt, Homo sapiens
gcauaagaccaagaaauua

SEQ ID NO: 1504207 - RNA, 19 nt, Homo sapiens
gcuauagacuucucucaga

SEQ ID NO: 1504208 - RNA, 19 nt, Homo sapiens
caacuuacccgucaucaga

SEQ ID NO: 1504209 - RNA, 19 nt, Homo sapiens
guuaugggcugaauguuug

SEQ ID NO: 1504210 - RNA, 19 nt, Homo sapiens
gaaaugaguggcagaacaa

SEQ ID NO: 1504211 - RNA, 19 nt, Homo sapiens
ccaaagagaguauaauaga

SEQ ID NO: 1504212 - RNA, 19 nt, Homo sapiens
gagcaguucuugugagugu

SEQ ID NO: 1504213 - RNA, 19 nt, Homo sapiens
gagaaaccauaugaaugua

SEQ ID NO: 1504214 - RNA, 19 nt, Homo sapiens
ggagagaaaccauaugaau

SEQ ID NO: 1504215 - RNA, 19 nt, Homo sapiens
uggaauuacugccuuuaua

SEQ ID NO: 1504216 - RNA, 19 nt, Homo sapiens
ccaaggugaugguauuuga

SEQ ID NO: 1504217 - RNA, 19 nt, Homo sapiens
ccucuuaguucucauuaaa

SEQ ID NO: 1504218 - RNA, 19 nt, Homo sapiens
gagaaacccuaugagugua

SEQ ID NO: 1504219 - RNA, 19 nt, Homo sapiens
gagaaacccuaugagugua

SEQ ID NO: 1504220 - RNA, 19 nt, Homo sapiens
ggacauucaugaaaucagu

SEQ ID NO: 1504221 - RNA, 19 nt, Homo sapiens
ggauguggcuauagacuuc

SEQ ID NO: 1504222 - RNA, 19 nt, Homo sapiens
gagaugugauguuggagaa

SEQ ID NO: 1504223 - RNA, 19 nt, Homo sapiens
gcaauggagaugacaaauu

SEQ ID NO: 1504224 - RNA, 19 nt, Homo sapiens
gaaaccauaugaauguaag

SEQ ID NO: 1504225 - RNA, 19 nt, Homo sapiens
ggcauaagaccaagaaauu

SEQ ID NO: 1504226 - RNA, 19 nt, Homo sapiens
gaugugauguuggagaauu

SEQ ID NO: 1504227 - RNA, 19 nt, Homo sapiens
gaaccaggcuaaagaaacg

SEQ ID NO: 1504228 - RNA, 19 nt, Homo sapiens
ugagaaacccuaugaaugu

SEQ ID NO: 1504229 - RNA, 19 nt, Homo sapiens
gagagaaaccauaugaaug

SEQ ID NO: 1504230 - RNA, 19 nt, Homo sapiens
ucacuuacauuucaugaag

SEQ ID NO: 1504231 - RNA, 19 nt, Homo sapiens
ccacucaucacuuacauuu

SEQ ID NO: 1504232 - RNA, 19 nt, Homo sapiens
ggaaggccuuuagacuuaa

SEQ ID NO: 1504233 - RNA, 19 nt, Homo sapiens
gaccuuagaauacaucaaa

SEQ ID NO: 1504234 - RNA, 19 nt, Homo sapiens
agaaagaucuaucagucaa

SEQ ID NO: 1504235 - RNA, 19 nt, Homo sapiens
ccacuacucuacuaucugu

SEQ ID NO: 1504236 - RNA, 19 nt, Homo sapiens
gaacaucagagaauucaca

SEQ ID NO: 1504237 - RNA, 19 nt, Homo sapiens
ugagaaaugugggaaaguu

SEQ ID NO: 1504238 - RNA, 19 nt, Homo sapiens
ggacuuaaagaaagaucua

SEQ ID NO: 1504239 - RNA, 19 nt, Homo sapiens
gaaaaggacauucaugaaa

SEQ ID NO: 1504240 - RNA, 19 nt, Homo sapiens
gagaaggcuuuuaguuaua

SEQ ID NO: 1504241 - RNA, 19 nt, Homo sapiens
guucagggauguggcuaua

SEQ ID NO: 1504242 - RNA, 19 nt, Homo sapiens
gguaagaaacccuaugaau

SEQ ID NO: 1504243 - RNA, 19 nt, Homo sapiens
gaagucagcagucuacagu

SEQ ID NO: 1504244 - RNA, 19 nt, Homo sapiens
cagcauauacuuaucauca

SEQ ID NO: 1504245 - RNA, 19 nt, Homo sapiens
caacuuaaucgacaucaga

SEQ ID NO: 1504246 - RNA, 19 nt, Homo sapiens
gaaugugggaaguccuuua

SEQ ID NO: 1504247 - RNA, 19 nt, Homo sapiens
agauuugguuucuaccuua

SEQ ID NO: 1504248 - RNA, 19 nt, Homo sapiens
gaaugugggaagaccuuua

SEQ ID NO: 1504249 - RNA, 19 nt, Homo sapiens
gaaacccuaugaaugucaa

SEQ ID NO: 1504250 - RNA, 19 nt, Homo sapiens
ggaggaaauuaggucauga

SEQ ID NO: 1504251 - RNA, 19 nt, Homo sapiens
acucaucacuuacauuuca

SEQ ID NO: 1504252 - RNA, 19 nt, Homo sapiens
ggagaugacaaauuuggaa

SEQ ID NO: 1504253 - RNA, 19 nt, Homo sapiens
guggauuucuuaauaggaa

SEQ ID NO: 1504254 - RNA, 19 nt, Homo sapiens
uagcaacagcauauacuua

SEQ ID NO: 1504255 - RNA, 19 nt, Homo sapiens
ugagaaacccuaugagugu

SEQ ID NO: 1504256 - RNA, 19 nt, Homo sapiens
ucagggauguggcuauaga

SEQ ID NO: 1504257 - RNA, 19 nt, Homo sapiens
gaaacccuaugaguguaaa

SEQ ID NO: 1504258 - RNA, 19 nt, Homo sapiens
ugagaaacccuaugagugu

SEQ ID NO: 1504259 - RNA, 19 nt, Homo sapiens
gcagaaccaggcuaaagaa

SEQ ID NO: 1504260 - RNA, 19 nt, Homo sapiens
caucauugccuuuccacua

SEQ ID NO: 1504261 - RNA, 19 nt, Homo sapiens
caucagagacuucauacug

SEQ ID NO: 1504262 - RNA, 19 nt, Homo sapiens
gagagaauucauacaggua

SEQ ID NO: 1504263 - RNA, 19 nt, Homo sapiens
acagagaugugauguugga

SEQ ID NO: 1504264 - RNA, 19 nt, Homo sapiens
ccaaaacugugagaaauaa

SEQ ID NO: 1504265 - RNA, 19 nt, Homo sapiens
gcaagaagucagcagucua

SEQ ID NO: 1504266 - RNA, 19 nt, Homo sapiens
caacagcauauacuuauca

SEQ ID NO: 1504267 - RNA, 19 nt, Homo sapiens
gcaacagcauauacuuauc

SEQ ID NO: 1504268 - RNA, 19 nt, Homo sapiens
gaaauuguacagagaugug

SEQ ID NO: 1504269 - RNA, 19 nt, Homo sapiens
agaauaauccugcggaaga

SEQ ID NO: 1504270 - RNA, 19 nt, Homo sapiens
cuaugaaugucaagaaugu

SEQ ID NO: 1504271 - RNA, 19 nt, Homo sapiens
gagaaaugugggaaaguuu

SEQ ID NO: 1504272 - RNA, 19 nt, Homo sapiens
gaagaugcaauggagauga

SEQ ID NO: 1504273 - RNA, 19 nt, Homo sapiens
agagaaaccauaugaaugu

SEQ ID NO: 1504274 - RNA, 19 nt, Homo sapiens
gaaaauucauacuggugua

SEQ ID NO: 1504275 - RNA, 19 nt, Homo sapiens
gaaacccuaugaauguaag

SEQ ID NO: 1504276 - RNA, 19 nt, Homo sapiens
ucagagaauucacaauagu

SEQ ID NO: 1504277 - RNA, 19 nt, Homo sapiens
caucaaagaauucauacug

SEQ ID NO: 1504278 - RNA, 19 nt, Homo sapiens
uaguguagaccuuagaaua

SEQ ID NO: 1504279 - RNA, 19 nt, Homo sapiens
gugaagcccuacgaaugua

SEQ ID NO: 1504280 - RNA, 19 nt, Homo sapiens
cauguaaggugugugagaa

SEQ ID NO: 1504281 - RNA, 19 nt, Homo sapiens
aagaaacccuaugaaugua

SEQ ID NO: 1504282 - RNA, 19 nt, Homo sapiens
gugagaaacccuaugaaug

SEQ ID NO: 1504283 - RNA, 19 nt, Homo sapiens
gaagagaaaugaagaauga

SEQ ID NO: 1504284 - RNA, 19 nt, Homo sapiens
ggaaggcaaugaaauauaa

SEQ ID NO: 1504285 - RNA, 19 nt, Homo sapiens
gaccaaaguugucucauuu

SEQ ID NO: 1504286 - RNA, 19 nt, Homo sapiens
gcacuuaucccaagacaaa

SEQ ID NO: 1504287 - RNA, 19 nt, Homo sapiens
caaaucaucuucagcaaug

SEQ ID NO: 1504288 - RNA, 19 nt, Homo sapiens
gagagaagaugucaaaugg

SEQ ID NO: 1504289 - RNA, 19 nt, Homo sapiens
gcagauugcuccuaccaaa

SEQ ID NO: 1504290 - RNA, 19 nt, Homo sapiens
gagcugaccugcaguacaa

SEQ ID NO: 1504291 - RNA, 19 nt, Homo sapiens
ggaacugaauacuugauuu

SEQ ID NO: 1504292 - RNA, 19 nt, Homo sapiens
gaugcauucuccaugauua

SEQ ID NO: 1504293 - RNA, 19 nt, Homo sapiens
cagcaggacuucaguauag

SEQ ID NO: 1504294 - RNA, 19 nt, Homo sapiens
gaaguacacugcaacacau

SEQ ID NO: 1504295 - RNA, 19 nt, Homo sapiens
gggaggaccauccaucuua

SEQ ID NO: 1504296 - RNA, 19 nt, Homo sapiens
ucacauguggcaucaauua

SEQ ID NO: 1504297 - RNA, 19 nt, Homo sapiens
caacacauccacuucauga

SEQ ID NO: 1504298 - RNA, 19 nt, Homo sapiens
gauugaagcuuacuuucug

SEQ ID NO: 1504299 - RNA, 19 nt, Homo sapiens
uuacagcacugaccucuau

SEQ ID NO: 1504300 - RNA, 19 nt, Homo sapiens
caaaucacccagucaguaa

SEQ ID NO: 1504301 - RNA, 19 nt, Homo sapiens
ugggugacauauucaauua

SEQ ID NO: 1504302 - RNA, 19 nt, Homo sapiens
ugaccaaaguugucucauu

SEQ ID NO: 1504303 - RNA, 19 nt, Homo sapiens
cuaaugaugaugcuacuua

SEQ ID NO: 1504304 - RNA, 19 nt, Homo sapiens
gaacugaauacuugauuuc

SEQ ID NO: 1504305 - RNA, 19 nt, Homo sapiens
ggaggaccauccaucuuau

SEQ ID NO: 1504306 - RNA, 19 nt, Homo sapiens
ccacagacuucaacacauc

SEQ ID NO: 1504307 - RNA, 19 nt, Homo sapiens
aacgugagcuggacuauug

SEQ ID NO: 1504308 - RNA, 19 nt, Homo sapiens
gaagagugacgauccaaga

SEQ ID NO: 1504309 - RNA, 19 nt, Homo sapiens
gaaguccgaggcagcaaua

SEQ ID NO: 1504310 - RNA, 19 nt, Homo sapiens
gaugauggcuuggaaguac

SEQ ID NO: 1504311 - RNA, 19 nt, Homo sapiens
agaaaugaauccagaaagu

SEQ ID NO: 1504312 - RNA, 19 nt, Homo sapiens
gcagcaauaugucauguac

SEQ ID NO: 1504313 - RNA, 19 nt, Homo sapiens
gggaaggcaaugaaauaua

SEQ ID NO: 1504314 - RNA, 19 nt, Homo sapiens
gcuagaaggguugcaguua

SEQ ID NO: 1504315 - RNA, 19 nt, Homo sapiens
guguggaacugaauacuug

SEQ ID NO: 1504316 - RNA, 19 nt, Homo sapiens
ccacucauauuguaauuac

SEQ ID NO: 1504317 - RNA, 19 nt, Homo sapiens
gaaauguucacucccagaa

SEQ ID NO: 1504318 - RNA, 19 nt, Homo sapiens
ggaaguacacugcaacaca

SEQ ID NO: 1504319 - RNA, 19 nt, Homo sapiens
ugacuacuauguggucuuu

SEQ ID NO: 1504320 - RNA, 19 nt, Homo sapiens
cuagaaggguugcaguuau

SEQ ID NO: 1504321 - RNA, 19 nt, Homo sapiens
caucacauguggcaucaau

SEQ ID NO: 1504322 - RNA, 19 nt, Homo sapiens
gagugacgauccaagaaga

SEQ ID NO: 1504323 - RNA, 19 nt, Homo sapiens
uuggagaucugcuauguga

SEQ ID NO: 1504324 - RNA, 19 nt, Homo sapiens
gaagaacaacucugacucu

SEQ ID NO: 1504325 - RNA, 19 nt, Homo sapiens
caugagagaagaugucaaa

SEQ ID NO: 1504326 - RNA, 19 nt, Homo sapiens
ugagaacccuggaaacaag

SEQ ID NO: 1504327 - RNA, 19 nt, Homo sapiens
gcacagcaguuggagaucu

SEQ ID NO: 1504328 - RNA, 19 nt, Homo sapiens
ucaaacccauguugcaguu

SEQ ID NO: 1504329 - RNA, 19 nt, Homo sapiens
uagaaggguugcaguuaug

SEQ ID NO: 1504330 - RNA, 19 nt, Homo sapiens
ggaagagaaaugaagaaug

SEQ ID NO: 1504331 - RNA, 19 nt, Homo sapiens
ucaaaucacccagucagua

SEQ ID NO: 1504332 - RNA, 19 nt, Homo sapiens
caauuacacagugacauua

SEQ ID NO: 1504333 - RNA, 19 nt, Homo sapiens
cacuuggaauggugauuua

SEQ ID NO: 1504334 - RNA, 19 nt, Homo sapiens
aaaacaggauugaagcuua

SEQ ID NO: 1504335 - RNA, 19 nt, Homo sapiens
gcaaaucaucuucagcaau

SEQ ID NO: 1504336 - RNA, 19 nt, Homo sapiens
gaaaugaauccagaaaguc

SEQ ID NO: 1504337 - RNA, 19 nt, Homo sapiens
ucaguaacuugcucuggaa

SEQ ID NO: 1504338 - RNA, 19 nt, Homo sapiens
ggucugacaguaacucaaa

SEQ ID NO: 1504339 - RNA, 19 nt, Homo sapiens
gauuagagauggaaaagau

SEQ ID NO: 1504340 - RNA, 19 nt, Homo sapiens
ucaauuacacagugacauu

SEQ ID NO: 1504341 - RNA, 19 nt, Homo sapiens
caacaucacaguguauuca

SEQ ID NO: 1504342 - RNA, 19 nt, Homo sapiens
ugagagaagaugucaaaug

SEQ ID NO: 1504343 - RNA, 19 nt, Homo sapiens
gauaacaaacgcccucauc

SEQ ID NO: 1504344 - RNA, 19 nt, Homo sapiens
aaugaagaaugacaaagug

SEQ ID NO: 1504345 - RNA, 19 nt, Homo sapiens
cuaccaaaguuauuucucu

SEQ ID NO: 1504346 - RNA, 19 nt, Homo sapiens
ccuuuggccuuuagaagaa

SEQ ID NO: 1504347 - RNA, 19 nt, Homo sapiens
gagaaaugaagaaugacaa

SEQ ID NO: 1504348 - RNA, 19 nt, Homo sapiens
cacaguguauucauucaau

SEQ ID NO: 1504349 - RNA, 19 nt, Homo sapiens
gagugaugauggcuuggaa

SEQ ID NO: 1504350 - RNA, 19 nt, Homo sapiens
ggccucaguuucugugaug

SEQ ID NO: 1504351 - RNA, 19 nt, Homo sapiens
ugaccucuauggcuccaaa

SEQ ID NO: 1504352 - RNA, 19 nt, Homo sapiens
ucaaauggagagccucaaa

SEQ ID NO: 1504353 - RNA, 19 nt, Homo sapiens
gagggaagagaaaugaaga

SEQ ID NO: 1504354 - RNA, 19 nt, Homo sapiens
ggaauggugauuuauagag

SEQ ID NO: 1504355 - RNA, 19 nt, Homo sapiens
aaacaggauugaagcuuac

SEQ ID NO: 1504356 - RNA, 19 nt, Homo sapiens
uaacaaggcagggcaaagu

SEQ ID NO: 1504357 - RNA, 19 nt, Homo sapiens
cagguggcgugacaucuau

SEQ ID NO: 1504358 - RNA, 19 nt, Homo sapiens
ccagcaggacuucaguaua

SEQ ID NO: 1504359 - RNA, 19 nt, Homo sapiens
gauuucacauccacacaca

SEQ ID NO: 1504360 - RNA, 19 nt, Homo sapiens
caaccggucugacaguaac

SEQ ID NO: 1504361 - RNA, 19 nt, Homo sapiens
acauaaaucucucauaccu

SEQ ID NO: 1504362 - RNA, 19 nt, Homo sapiens
ggauugaagcuuacuuucu

SEQ ID NO: 1504363 - RNA, 19 nt, Homo sapiens
ggauguauacacugugaug

SEQ ID NO: 1504364 - RNA, 19 nt, Homo sapiens
gcuccuaccaaaguuauuu

SEQ ID NO: 1504365 - RNA, 19 nt, Homo sapiens
guaaugaugcuggaucuag

SEQ ID NO: 1504366 - RNA, 19 nt, Homo sapiens
gggagcaucugggaaagca

SEQ ID NO: 1504367 - RNA, 19 nt, Homo sapiens
caguauagguuggaaagca

SEQ ID NO: 1504368 - RNA, 19 nt, Homo sapiens
gaaaugaagaaugacaaag

SEQ ID NO: 1504369 - RNA, 19 nt, Homo sapiens
ggucucaccaguugcuaaa

SEQ ID NO: 1504370 - RNA, 19 nt, Homo sapiens
gcaaugacccugaaaacug

SEQ ID NO: 1504371 - RNA, 19 nt, Homo sapiens
gcgauccacuaaugaugau

SEQ ID NO: 1504372 - RNA, 19 nt, Homo sapiens
gugccgaacuguaugaaac

SEQ ID NO: 1504373 - RNA, 19 nt, Homo sapiens
ccacacacaccacagacuu

SEQ ID NO: 1504374 - RNA, 19 nt, Homo sapiens
ggcaucaauuacacaguga

SEQ ID NO: 1504375 - RNA, 19 nt, Homo sapiens
gaccugcaguacaacuuuc

SEQ ID NO: 1504376 - RNA, 19 nt, Homo sapiens
uaugggagcaucugggaaa

SEQ ID NO: 1504377 - RNA, 19 nt, Homo sapiens
ucagguggcgugacaucua

SEQ ID NO: 1504378 - RNA, 19 nt, Homo sapiens
gagaaaugaauccagaaag

SEQ ID NO: 1504379 - RNA, 19 nt, Homo sapiens
aagcuuacuuucuguccaa

SEQ ID NO: 1504380 - RNA, 19 nt, Homo sapiens
caggauugaagcuuacuuu

SEQ ID NO: 1504381 - RNA, 19 nt, Homo sapiens
cuaauggcauccggaucua

SEQ ID NO: 1504382 - RNA, 19 nt, Homo sapiens
ggaugcauucuccaugauu

SEQ ID NO: 1504383 - RNA, 19 nt, Homo sapiens
gaaauccagucaacucaua

SEQ ID NO: 1504384 - RNA, 19 nt, Homo sapiens
ggaagauguuguuauguua

SEQ ID NO: 1504385 - RNA, 19 nt, Homo sapiens
gaacugagguuaugauugg

SEQ ID NO: 1504386 - RNA, 19 nt, Homo sapiens
ugacagacauugaaaguaa

SEQ ID NO: 1504387 - RNA, 19 nt, Homo sapiens
ggacagcacuuuaccuuug

SEQ ID NO: 1504388 - RNA, 19 nt, Homo sapiens
gaaugaaacucucagauca

SEQ ID NO: 1504389 - RNA, 19 nt, Homo sapiens
gaaaggcgcaucgugauua

SEQ ID NO: 1504390 - RNA, 19 nt, Homo sapiens
gaaaguaaacagagauuug

SEQ ID NO: 1504391 - RNA, 19 nt, Homo sapiens
auagaucacugcagcauua

SEQ ID NO: 1504392 - RNA, 19 nt, Homo sapiens
cuacagagaugcacugaga

SEQ ID NO: 1504393 - RNA, 19 nt, Homo sapiens
gaaagggugucucagaauc

SEQ ID NO: 1504394 - RNA, 19 nt, Homo sapiens
ggguuucucugauguauuu

SEQ ID NO: 1504395 - RNA, 19 nt, Homo sapiens
gaguagaaaucuuacagaa

SEQ ID NO: 1504396 - RNA, 19 nt, Homo sapiens
gcaaauacuccuguaaauu

SEQ ID NO: 1504397 - RNA, 19 nt, Homo sapiens
uaacuggacucccaacaau

SEQ ID NO: 1504398 - RNA, 19 nt, Homo sapiens
gugauuaucucgagcaaau

SEQ ID NO: 1504399 - RNA, 19 nt, Homo sapiens
guuuaugcauccuuaguua

SEQ ID NO: 1504400 - RNA, 19 nt, Homo sapiens
gauuaucucgagcaaauua

SEQ ID NO: 1504401 - RNA, 19 nt, Homo sapiens
gaaauucccagaggacuuu

SEQ ID NO: 1504402 - RNA, 19 nt, Homo sapiens
gaaaugucaugccucugaa

SEQ ID NO: 1504403 - RNA, 19 nt, Homo sapiens
gaucagcugcucuucuaua

SEQ ID NO: 1504404 - RNA, 19 nt, Homo sapiens
agacagaaccuuugacuug

SEQ ID NO: 1504405 - RNA, 19 nt, Homo sapiens
ccagucaacucauaucuuc

SEQ ID NO: 1504406 - RNA, 19 nt, Homo sapiens
ccgcauagcucgaccuuca

SEQ ID NO: 1504407 - RNA, 19 nt, Homo sapiens
gagaugcacugagauacaa

SEQ ID NO: 1504408 - RNA, 19 nt, Homo sapiens
ugaacaaccuaccaaguga

SEQ ID NO: 1504409 - RNA, 19 nt, Homo sapiens
aaacagagauuuggauucu

SEQ ID NO: 1504410 - RNA, 19 nt, Homo sapiens
uaaguuggccuccugaauu

SEQ ID NO: 1504411 - RNA, 19 nt, Homo sapiens
gcucaagcgugaugaaaca

SEQ ID NO: 1504412 - RNA, 19 nt, Homo sapiens
ccucgauaaucucuuaaua

SEQ ID NO: 1504413 - RNA, 19 nt, Homo sapiens
guagcuagggccuuucuua

SEQ ID NO: 1504414 - RNA, 19 nt, Homo sapiens
gagcaaauuaagcacuuua

SEQ ID NO: 1504415 - RNA, 19 nt, Homo sapiens
ggcaaauacuccuguaaau

SEQ ID NO: 1504416 - RNA, 19 nt, Homo sapiens
uggaagauguuguuauguu

SEQ ID NO: 1504417 - RNA, 19 nt, Homo sapiens
caaggcaaauccagacaga

SEQ ID NO: 1504418 - RNA, 19 nt, Homo sapiens
cuaaggaacuggaaaauga

SEQ ID NO: 1504419 - RNA, 19 nt, Homo sapiens
cuaaugauuuccuccuaaa

SEQ ID NO: 1504420 - RNA, 19 nt, Homo sapiens
caauuaauccuucuagugu

SEQ ID NO: 1504421 - RNA, 19 nt, Homo sapiens
uggaucagcugcucuucua

SEQ ID NO: 1504422 - RNA, 19 nt, Homo sapiens
uuaguuaccuucccugguu

SEQ ID NO: 1504423 - RNA, 19 nt, Homo sapiens
cagcuuaucugccgaggau

SEQ ID NO: 1504424 - RNA, 19 nt, Homo sapiens
gcacgauuguaguggugua

SEQ ID NO: 1504425 - RNA, 19 nt, Homo sapiens
gagguuaugauugguaaua

SEQ ID NO: 1504426 - RNA, 19 nt, Homo sapiens
guagugguguauagucuug

SEQ ID NO: 1504427 - RNA, 19 nt, Homo sapiens
auacagaugucuuuaccuu

SEQ ID NO: 1504428 - RNA, 19 nt, Homo sapiens
gccauuaaccuccagcuuu

SEQ ID NO: 1504429 - RNA, 19 nt, Homo sapiens
gaaacucucagaucacugu

SEQ ID NO: 1504430 - RNA, 19 nt, Homo sapiens
ugaaaugucaugccucuga

SEQ ID NO: 1504431 - RNA, 19 nt, Homo sapiens
gcuagggccuuucuuagag

SEQ ID NO: 1504432 - RNA, 19 nt, Homo sapiens
ucagaucacuguauaacca

SEQ ID NO: 1504433 - RNA, 19 nt, Homo sapiens
cagauuacuuggcuaagga

SEQ ID NO: 1504434 - RNA, 19 nt, Homo sapiens
gacagacauugaaaguaaa

SEQ ID NO: 1504435 - RNA, 19 nt, Homo sapiens
acucucagaucacuguaua

SEQ ID NO: 1504436 - RNA, 19 nt, Homo sapiens
gaucacugcagcauuaaga

SEQ ID NO: 1504437 - RNA, 19 nt, Homo sapiens
ccugauaccuguuacucaa

SEQ ID NO: 1504438 - RNA, 19 nt, Homo sapiens
cacauuagaaucaccauuu

SEQ ID NO: 1504439 - RNA, 19 nt, Homo sapiens
gcucuucuauacccaaugu

SEQ ID NO: 1504440 - RNA, 19 nt, Homo sapiens
caacaauacccgagaguag

SEQ ID NO: 1504441 - RNA, 19 nt, Homo sapiens
gugcauuccuacuucauug

SEQ ID NO: 1504442 - RNA, 19 nt, Homo sapiens
guaaacagagauuuggauu

SEQ ID NO: 1504443 - RNA, 19 nt, Homo sapiens
agaagggucugaacaccaa

SEQ ID NO: 1504444 - RNA, 19 nt, Homo sapiens
aagaagcagucuacagcua

SEQ ID NO: 1504445 - RNA, 19 nt, Homo sapiens
acaaaucauuggaagaugu

SEQ ID NO: 1504446 - RNA, 19 nt, Homo sapiens
uggccucgauaaucucuua

SEQ ID NO: 1504447 - RNA, 19 nt, Homo sapiens
gcacuuuaccuuuguacug

SEQ ID NO: 1504448 - RNA, 19 nt, Homo sapiens
acucauaucuuccugucuu

SEQ ID NO: 1504449 - RNA, 19 nt, Homo sapiens
gcacuugugucugauaaaa

SEQ ID NO: 1504450 - RNA, 19 nt, Homo sapiens
caagcgugaugaaacaguu

SEQ ID NO: 1504451 - RNA, 19 nt, Homo sapiens
gcacuuuaacugccuguau

SEQ ID NO: 1504452 - RNA, 19 nt, Homo sapiens
gcagauuacuuggcuaagg

SEQ ID NO: 1504453 - RNA, 19 nt, Homo sapiens
guacugacagacauugaaa

SEQ ID NO: 1504454 - RNA, 19 nt, Homo sapiens
gauguggucucggccuuga

SEQ ID NO: 1504455 - RNA, 19 nt, Homo sapiens
acaacaugcugcagcugua

SEQ ID NO: 1504456 - RNA, 19 nt, Homo sapiens
ggcacuguucuaaauauua

SEQ ID NO: 1504457 - RNA, 19 nt, Homo sapiens
acagagaugcacugagaua

SEQ ID NO: 1504458 - RNA, 19 nt, Homo sapiens
uuuaagaacugagguuaug

SEQ ID NO: 1504459 - RNA, 19 nt, Homo sapiens
ugccauaccugauuggaau

SEQ ID NO: 1504460 - RNA, 19 nt, Homo sapiens
gcagcuguaugccaguaug

SEQ ID NO: 1504461 - RNA, 19 nt, Homo sapiens
gagugugcauuccuacuuc

SEQ ID NO: 1504462 - RNA, 19 nt, Homo sapiens
aaaggcaaauacuccugua

SEQ ID NO: 1504463 - RNA, 19 nt, Homo sapiens
gaauuuaagaacugagguu

SEQ ID NO: 1504464 - RNA, 19 nt, Homo sapiens
cuacuagugaugguuauua

SEQ ID NO: 1504465 - RNA, 19 nt, Homo sapiens
acuaaugauuuccuccuaa

SEQ ID NO: 1504466 - RNA, 19 nt, Homo sapiens
ucucugauguauuugaaga

SEQ ID NO: 1504467 - RNA, 19 nt, Homo sapiens
uggaguagcuagggccuuu

SEQ ID NO: 1504468 - RNA, 19 nt, Homo sapiens
gacagcacuuuaccuuugu

SEQ ID NO: 1504469 - RNA, 19 nt, Homo sapiens
uugaaagggugucucagaa

SEQ ID NO: 1504470 - RNA, 19 nt, Homo sapiens
gcacaggcugcuuuguuug

SEQ ID NO: 1504471 - RNA, 19 nt, Homo sapiens
guaacuggacucccaacaa

SEQ ID NO: 1504472 - RNA, 19 nt, Homo sapiens
uaggcacuguucuaaauau

SEQ ID NO: 1504473 - RNA, 19 nt, Homo sapiens
guuuaccauuccauaagua

SEQ ID NO: 1504474 - RNA, 19 nt, Homo sapiens
acagaugucuuuaccuuuu

SEQ ID NO: 1504475 - RNA, 19 nt, Homo sapiens
ugucuuuccuucugaauag

SEQ ID NO: 1504476 - RNA, 19 nt, Homo sapiens
auacagaaauccagucaac

SEQ ID NO: 1504477 - RNA, 19 nt, Homo sapiens
aaguuggccuccugaauug

SEQ ID NO: 1504478 - RNA, 19 nt, Homo sapiens
ugaaugaaacucucagauc

SEQ ID NO: 1504479 - RNA, 19 nt, Homo sapiens
cacuuuaccuuuguacuga

SEQ ID NO: 1504480 - RNA, 19 nt, Homo sapiens
cgaauccugugguauugug

SEQ ID NO: 1504481 - RNA, 19 nt, Homo sapiens
ccaguuuaccauuccauaa

SEQ ID NO: 1504482 - RNA, 19 nt, Homo sapiens
ggaagggguuucucugaug

SEQ ID NO: 1504483 - RNA, 19 nt, Homo sapiens
ggacaucucuguuguguaa

SEQ ID NO: 1504484 - RNA, 19 nt, Homo sapiens
gcucaacccuuuagcuuua

SEQ ID NO: 1504485 - RNA, 19 nt, Homo sapiens
gaccauaggugaugauauu

SEQ ID NO: 1504486 - RNA, 19 nt, Homo sapiens
guaaagaaaugccacagaa

SEQ ID NO: 1504487 - RNA, 19 nt, Homo sapiens
ccagaggguuuguuuauuu

SEQ ID NO: 1504488 - RNA, 19 nt, Homo sapiens
ucagugagcucaacccuuu

SEQ ID NO: 1504489 - RNA, 19 nt, Homo sapiens
aaacgaagaugucuauuuc

SEQ ID NO: 1504490 - RNA, 19 nt, Homo sapiens
gguaguggaugaauaugua

SEQ ID NO: 1504491 - RNA, 19 nt, Homo sapiens
gaaaauaucucuucuaagg

SEQ ID NO: 1504492 - RNA, 19 nt, Homo sapiens
gauggaauccuuaacauuu

SEQ ID NO: 1504493 - RNA, 19 nt, Homo sapiens
gaccagcugucuuugauuu

SEQ ID NO: 1504494 - RNA, 19 nt, Homo sapiens
caccagagauccuaaagaa

SEQ ID NO: 1504495 - RNA, 19 nt, Homo sapiens
gaacagagggccaugcuau

SEQ ID NO: 1504496 - RNA, 19 nt, Homo sapiens
caaagagacuguauggaau

SEQ ID NO: 1504497 - RNA, 19 nt, Homo sapiens
guggaaagcucaccagaga

SEQ ID NO: 1504498 - RNA, 19 nt, Homo sapiens
gaaaguagaaguucauaag

SEQ ID NO: 1504499 - RNA, 19 nt, Homo sapiens
gcaaguagaaacaaacaaa

SEQ ID NO: 1504500 - RNA, 19 nt, Homo sapiens
gaagacaugaugauugaaa

SEQ ID NO: 1504501 - RNA, 19 nt, Homo sapiens
aaagauaaguccacaguca

SEQ ID NO: 1504502 - RNA, 19 nt, Homo sapiens
uaaugaagaccgaaagaua

SEQ ID NO: 1504503 - RNA, 19 nt, Homo sapiens
ggagaacacauucaaauca

SEQ ID NO: 1504504 - RNA, 19 nt, Homo sapiens
caacugcaguggaugauuc

SEQ ID NO: 1504505 - RNA, 19 nt, Homo sapiens
caaacgaagaugucuauuu

SEQ ID NO: 1504506 - RNA, 19 nt, Homo sapiens
guaaggauuucugaggaua

SEQ ID NO: 1504507 - RNA, 19 nt, Homo sapiens
ucaaagagacuguauggaa

SEQ ID NO: 1504508 - RNA, 19 nt, Homo sapiens
gcuauuguaugccgagaaa

SEQ ID NO: 1504509 - RNA, 19 nt, Homo sapiens
ggaugaauauguagaugga

SEQ ID NO: 1504510 - RNA, 19 nt, Homo sapiens
agacauaaaugguucuuca

SEQ ID NO: 1504511 - RNA, 19 nt, Homo sapiens
aaagauacaugggaugauu

SEQ ID NO: 1504512 - RNA, 19 nt, Homo sapiens
ggaaauauuggaauuguuc

SEQ ID NO: 1504513 - RNA, 19 nt, Homo sapiens
ucgaagacaugaugauuga

SEQ ID NO: 1504514 - RNA, 19 nt, Homo sapiens
ccagagauccuaaagaaug

SEQ ID NO: 1504515 - RNA, 19 nt, Homo sapiens
caacagaagauuugcaaga

SEQ ID NO: 1504516 - RNA, 19 nt, Homo sapiens
gugacuauauguuagcuuu

SEQ ID NO: 1504517 - RNA, 19 nt, Homo sapiens
gagagugaguuacguaucu

SEQ ID NO: 1504518 - RNA, 19 nt, Homo sapiens
agacaccaguucccucaua

SEQ ID NO: 1504519 - RNA, 19 nt, Homo sapiens
gaacacauucaaaucaguu

SEQ ID NO: 1504520 - RNA, 19 nt, Homo sapiens
gaggaguuauugaagcaaa

SEQ ID NO: 1504521 - RNA, 19 nt, Homo sapiens
caacuagacauaaaugguu

SEQ ID NO: 1504522 - RNA, 19 nt, Homo sapiens
gaggaacacuggacaucga

SEQ ID NO: 1504523 - RNA, 19 nt, Homo sapiens
caaaucagagcucaacuug

SEQ ID NO: 1504524 - RNA, 19 nt, Homo sapiens
gaacuuguuggagcucuua

SEQ ID NO: 1504525 - RNA, 19 nt, Homo sapiens
cagagauccuaaagaauga

SEQ ID NO: 1504526 - RNA, 19 nt, Homo sapiens
gaugauauuugggaugaga

SEQ ID NO: 1504527 - RNA, 19 nt, Homo sapiens
caccaagacuuacuagugu

SEQ ID NO: 1504528 - RNA, 19 nt, Homo sapiens
gaguauaucaucucuccua

SEQ ID NO: 1504529 - RNA, 19 nt, Homo sapiens
ugacacauccucaaacgaa

SEQ ID NO: 1504530 - RNA, 19 nt, Homo sapiens
gaaacaggaaguugaagug

SEQ ID NO: 1504531 - RNA, 19 nt, Homo sapiens
gaggguuuguuuauuucua

SEQ ID NO: 1504532 - RNA, 19 nt, Homo sapiens
ggaaagcucaccagagauc

SEQ ID NO: 1504533 - RNA, 19 nt, Homo sapiens
guaaauggaacgaaaguag

SEQ ID NO: 1504534 - RNA, 19 nt, Homo sapiens
gugaugauauuugggauga

SEQ ID NO: 1504535 - RNA, 19 nt, Homo sapiens
uuacguaucuuggaugaga

SEQ ID NO: 1504536 - RNA, 19 nt, Homo sapiens
gauaugucaugccagaaug

SEQ ID NO: 1504537 - RNA, 19 nt, Homo sapiens
gagcucaacuuggcaaugg

SEQ ID NO: 1504538 - RNA, 19 nt, Homo sapiens
ugguauaucuucuuuagug

SEQ ID NO: 1504539 - RNA, 19 nt, Homo sapiens
caacaacugcaguggauga

SEQ ID NO: 1504540 - RNA, 19 nt, Homo sapiens
caucaugucuugagaacag

SEQ ID NO: 1504541 - RNA, 19 nt, Homo sapiens
gagaacacauucaaaucag

SEQ ID NO: 1504542 - RNA, 19 nt, Homo sapiens
uaucaucucuccuagucaa

SEQ ID NO: 1504543 - RNA, 19 nt, Homo sapiens
cuaaacugcuuggagagua

SEQ ID NO: 1504544 - RNA, 19 nt, Homo sapiens
cauaaaugguucuucagau

SEQ ID NO: 1504545 - RNA, 19 nt, Homo sapiens
gcugguuucugaucgauau

SEQ ID NO: 1504546 - RNA, 19 nt, Homo sapiens
gguauaucuucuuuaguga

SEQ ID NO: 1504547 - RNA, 19 nt, Homo sapiens
uauaucaucucuccuaguc

SEQ ID NO: 1504548 - RNA, 19 nt, Homo sapiens
agacaagcgucaagaaucu

SEQ ID NO: 1504549 - RNA, 19 nt, Homo sapiens
aaugaagaccgaaagauaa

SEQ ID NO: 1504550 - RNA, 19 nt, Homo sapiens
acaggaaguugaaguguuc

SEQ ID NO: 1504551 - RNA, 19 nt, Homo sapiens
gaagcaaaauaguaucuug

SEQ ID NO: 1504552 - RNA, 19 nt, Homo sapiens
caaagacaagcgucaagaa

SEQ ID NO: 1504553 - RNA, 19 nt, Homo sapiens
uaaacugcuuggagaguau

SEQ ID NO: 1504554 - RNA, 19 nt, Homo sapiens
gagaacugguuaccucuac

SEQ ID NO: 1504555 - RNA, 19 nt, Homo sapiens
ugacagaacuggguuaucc

SEQ ID NO: 1504556 - RNA, 19 nt, Homo sapiens
agagggccaugcuauugua

SEQ ID NO: 1504557 - RNA, 19 nt, Homo sapiens
guagauggaauccuuaaca

SEQ ID NO: 1504558 - RNA, 19 nt, Homo sapiens
uacccagacuuuggaaaua

SEQ ID NO: 1504559 - RNA, 19 nt, Homo sapiens
ggaccuggaggaacuauca

SEQ ID NO: 1504560 - RNA, 19 nt, Homo sapiens
ggugagaccaguagaggaa

SEQ ID NO: 1504561 - RNA, 19 nt, Homo sapiens
ggcuaucccuuguucuuug

SEQ ID NO: 1504562 - RNA, 19 nt, Homo sapiens
aacagaagauuugcaagaa

SEQ ID NO: 1504563 - RNA, 19 nt, Homo sapiens
gaacccaacaacagucaga

SEQ ID NO: 1504564 - RNA, 19 nt, Homo sapiens
cuucaggccuuguaaaugg

SEQ ID NO: 1504565 - RNA, 19 nt, Homo sapiens
cagaugcugugccgaacaa

SEQ ID NO: 1504566 - RNA, 19 nt, Homo sapiens
cuaacagucuacuuugaug

SEQ ID NO: 1504567 - RNA, 19 nt, Homo sapiens
gcacaaacaggacucaaaa

SEQ ID NO: 1504568 - RNA, 19 nt, Homo sapiens
gguuaccucuacaggcuaa

SEQ ID NO: 1504569 - RNA, 19 nt, Homo sapiens
ccugguauaucuucuuuag

SEQ ID NO: 1504570 - RNA, 19 nt, Homo sapiens
cagaggguuuguuuauuuc

SEQ ID NO: 1504571 - RNA, 19 nt, Homo sapiens
gaaguugugcgguuugaag

SEQ ID NO: 1504572 - RNA, 19 nt, Homo sapiens
gcagggauucgucagaguu

SEQ ID NO: 1504573 - RNA, 19 nt, Homo sapiens
gauuggaccuggaggaacu

SEQ ID NO: 1504574 - RNA, 19 nt, Homo sapiens
cagccgugcuauuacauug

SEQ ID NO: 1504575 - RNA, 19 nt, Homo sapiens
gaauucuguaccucucuua

SEQ ID NO: 1504576 - RNA, 19 nt, Homo sapiens
uaaauggaacgaaaguaga

SEQ ID NO: 1504577 - RNA, 19 nt, Homo sapiens
aaagagagugaguuacgua

SEQ ID NO: 1504578 - RNA, 19 nt, Homo sapiens
aagagcaacuaucaccaaa

SEQ ID NO: 1504579 - RNA, 19 nt, Homo sapiens
gaaguguucuacccagacu

SEQ ID NO: 1504580 - RNA, 19 nt, Homo sapiens
ggugguaucgggucauuau

SEQ ID NO: 1504581 - RNA, 19 nt, Homo sapiens
agaaauucauugucuacug

SEQ ID NO: 1504582 - RNA, 19 nt, Homo sapiens
cuacauuccucgaaguaca

SEQ ID NO: 1504583 - RNA, 19 nt, Homo sapiens
gaacaaagaguuucacuga

SEQ ID NO: 1504584 - RNA, 19 nt, Homo sapiens
ccaauuggcuauaucuuua

SEQ ID NO: 1504585 - RNA, 19 nt, Homo sapiens
gcacagaguugguuacaga

SEQ ID NO: 1504586 - RNA, 19 nt, Homo sapiens
ggauaaagaucuauacaug

SEQ ID NO: 1504587 - RNA, 19 nt, Homo sapiens
acaaagaguuucacugaua

SEQ ID NO: 1504588 - RNA, 19 nt, Homo sapiens
ccacuuugaucuucuauaa

SEQ ID NO: 1504589 - RNA, 19 nt, Homo sapiens
ccagaaggcugcuguggua

SEQ ID NO: 1504590 - RNA, 19 nt, Homo sapiens
gaagagagacccugaagug

SEQ ID NO: 1504591 - RNA, 19 nt, Homo sapiens
guuacgggauuauaucuua

SEQ ID NO: 1504592 - RNA, 19 nt, Homo sapiens
guaaacgagucacuguaua

SEQ ID NO: 1504593 - RNA, 19 nt, Homo sapiens
ucgaagggcucuccugaua

SEQ ID NO: 1504594 - RNA, 19 nt, Homo sapiens
ugaagaagcugagauccua

SEQ ID NO: 1504595 - RNA, 19 nt, Homo sapiens
gcaaugauaaccuuuagaa

SEQ ID NO: 1504596 - RNA, 19 nt, Homo sapiens
gaagcaaugauaaccuuua

SEQ ID NO: 1504597 - RNA, 19 nt, Homo sapiens
ugagaaugcugccuuuaaa

SEQ ID NO: 1504598 - RNA, 19 nt, Homo sapiens
aagagcagaugcacacuua

SEQ ID NO: 1504599 - RNA, 19 nt, Homo sapiens
gaagaugaaauacagguuu

SEQ ID NO: 1504600 - RNA, 19 nt, Homo sapiens
caaagaguuucacugauau

SEQ ID NO: 1504601 - RNA, 19 nt, Homo sapiens
gaaagucucucccauucag

SEQ ID NO: 1504602 - RNA, 19 nt, Homo sapiens
caaguucugugaauagcua

SEQ ID NO: 1504603 - RNA, 19 nt, Homo sapiens
gacagaagguccagaaagu

SEQ ID NO: 1504604 - RNA, 19 nt, Homo sapiens
auaagcagcuguacucaaa

SEQ ID NO: 1504605 - RNA, 19 nt, Homo sapiens
cagaaagucucucccauuc

SEQ ID NO: 1504606 - RNA, 19 nt, Homo sapiens
uagaguaacuacagaguga

SEQ ID NO: 1504607 - RNA, 19 nt, Homo sapiens
ucauucagcugagguauaa

SEQ ID NO: 1504608 - RNA, 19 nt, Homo sapiens
ugaagaaccuuuucgauaa

SEQ ID NO: 1504609 - RNA, 19 nt, Homo sapiens
gcuagaggaggaaacauua

SEQ ID NO: 1504610 - RNA, 19 nt, Homo sapiens
ccacaaucauagcaaguaa

SEQ ID NO: 1504611 - RNA, 19 nt, Homo sapiens
gcaggagaccacaaucaua

SEQ ID NO: 1504612 - RNA, 19 nt, Homo sapiens
ccacauggacucagacaaa

SEQ ID NO: 1504613 - RNA, 19 nt, Homo sapiens
cuacaccucuucccagaaa

SEQ ID NO: 1504614 - RNA, 19 nt, Homo sapiens
guaggaagaugaaauacag

SEQ ID NO: 1504615 - RNA, 19 nt, Homo sapiens
gauaauguuuggacuugga

SEQ ID NO: 1504616 - RNA, 19 nt, Homo sapiens
gaagggcucuccugauacu

SEQ ID NO: 1504617 - RNA, 19 nt, Homo sapiens
gcagagaggacggaaguuu

SEQ ID NO: 1504618 - RNA, 19 nt, Homo sapiens
guaccuaccuaaauacuac

SEQ ID NO: 1504619 - RNA, 19 nt, Homo sapiens
gaggaaacauuagaagcaa

SEQ ID NO: 1504620 - RNA, 19 nt, Homo sapiens
caaagaccaccaagaggua

SEQ ID NO: 1504621 - RNA, 19 nt, Homo sapiens
gguccugacuguucugcua

SEQ ID NO: 1504622 - RNA, 19 nt, Homo sapiens
gcagaugccuacaccucuu

SEQ ID NO: 1504623 - RNA, 19 nt, Homo sapiens
ugacggaacuggagcaucu

SEQ ID NO: 1504624 - RNA, 19 nt, Homo sapiens
ugaguaggaagaugaaaua

SEQ ID NO: 1504625 - RNA, 19 nt, Homo sapiens
ggacuuggacuaaagcaau

SEQ ID NO: 1504626 - RNA, 19 nt, Homo sapiens
guuuaaagaccuuccauuu

SEQ ID NO: 1504627 - RNA, 19 nt, Homo sapiens
gcaagagggugaggauaca

SEQ ID NO: 1504628 - RNA, 19 nt, Homo sapiens
ggaagucauccacaacaaa

SEQ ID NO: 1504629 - RNA, 19 nt, Homo sapiens
ucacugauauucgaguuug

SEQ ID NO: 1504630 - RNA, 19 nt, Homo sapiens
gagauuucauuggaacaaa

SEQ ID NO: 1504631 - RNA, 19 nt, Homo sapiens
ggaggaaacauuagaagca

SEQ ID NO: 1504632 - RNA, 19 nt, Homo sapiens
gaacaggggugccuuuucu

SEQ ID NO: 1504633 - RNA, 19 nt, Homo sapiens
gcuauggguuugagaaugg

SEQ ID NO: 1504634 - RNA, 19 nt, Homo sapiens
ccaugagacagauuaauaa

SEQ ID NO: 1504635 - RNA, 19 nt, Homo sapiens
aaacagaagaugagaacaa

SEQ ID NO: 1504636 - RNA, 19 nt, Homo sapiens
uguauaagcuagcauuuac

SEQ ID NO: 1504637 - RNA, 19 nt, Homo sapiens
ccaaagugcugggauuaca

SEQ ID NO: 1504638 - RNA, 19 nt, Homo sapiens
ggcaucaccucccuucaga

SEQ ID NO: 1504639 - RNA, 19 nt, Homo sapiens
cagcuguacucaaauguuc

SEQ ID NO: 1504640 - RNA, 19 nt, Homo sapiens
gcagauacaggugauaaau

SEQ ID NO: 1504641 - RNA, 19 nt, Homo sapiens
gaaaaccauugauuaagug

SEQ ID NO: 1504642 - RNA, 19 nt, Homo sapiens
gaguuucacugauauucga

SEQ ID NO: 1504643 - RNA, 19 nt, Homo sapiens
ccagaaagucucucccauu

SEQ ID NO: 1504644 - RNA, 19 nt, Homo sapiens
ccagccaccaucauauuua

SEQ ID NO: 1504645 - RNA, 19 nt, Homo sapiens
gaugagaacaagcagaguu

SEQ ID NO: 1504646 - RNA, 19 nt, Homo sapiens
gacuuggacuaaagcaauu

SEQ ID NO: 1504647 - RNA, 19 nt, Homo sapiens
uaaacgagucacuguauau

SEQ ID NO: 1504648 - RNA, 19 nt, Homo sapiens
aaacgagucacuguauaua

SEQ ID NO: 1504649 - RNA, 19 nt, Homo sapiens
gaagaaccuuuucgauaau

SEQ ID NO: 1504650 - RNA, 19 nt, Homo sapiens
guauugugaucaugagaau

SEQ ID NO: 1504651 - RNA, 19 nt, Homo sapiens
gaagagcagaugcacacuu

SEQ ID NO: 1504652 - RNA, 19 nt, Homo sapiens
cugaagagauagaacacaa

SEQ ID NO: 1504653 - RNA, 19 nt, Homo sapiens
uggccucacucaaacagua

SEQ ID NO: 1504654 - RNA, 19 nt, Homo sapiens
guggggaaauuguuuauaa

SEQ ID NO: 1504655 - RNA, 19 nt, Homo sapiens
caucaccucccuucagaaa

SEQ ID NO: 1504656 - RNA, 19 nt, Homo sapiens
ggaaaaccaaguacuaaaa

SEQ ID NO: 1504657 - RNA, 19 nt, Homo sapiens
gaaugcugccuuuaaagau

SEQ ID NO: 1504658 - RNA, 19 nt, Homo sapiens
gagcuauggcccugugauu

SEQ ID NO: 1504659 - RNA, 19 nt, Homo sapiens
gguauaagcagcuguacuc

SEQ ID NO: 1504660 - RNA, 19 nt, Homo sapiens
cuaccuaaauacuacaugu

SEQ ID NO: 1504661 - RNA, 19 nt, Homo sapiens
ucaugagaaugcugccuuu

SEQ ID NO: 1504662 - RNA, 19 nt, Homo sapiens
acgagucacuguauauaug

SEQ ID NO: 1504663 - RNA, 19 nt, Homo sapiens
gaagagauagaacacaaac

SEQ ID NO: 1504664 - RNA, 19 nt, Homo sapiens
gcauggaauuuuauacuug

SEQ ID NO: 1504665 - RNA, 19 nt, Homo sapiens
aagcagcuguacucaaaug

SEQ ID NO: 1504666 - RNA, 19 nt, Homo sapiens
ucgauaauguuuggacuug

SEQ ID NO: 1504667 - RNA, 19 nt, Homo sapiens
gccagugaguagcauagaa

SEQ ID NO: 1504668 - RNA, 19 nt, Homo sapiens
ucaaccacauggacucaga

SEQ ID NO: 1504669 - RNA, 19 nt, Homo sapiens
gcuccacuuugaucuucua

SEQ ID NO: 1504670 - RNA, 19 nt, Homo sapiens
guggcaaguucugugaaua

SEQ ID NO: 1504671 - RNA, 19 nt, Homo sapiens
gacaccaugagacagauua

SEQ ID NO: 1504672 - RNA, 19 nt, Homo sapiens
ggacuuagggaaccucaag

SEQ ID NO: 1504673 - RNA, 19 nt, Homo sapiens
gaagucauccacaacaaac

SEQ ID NO: 1504674 - RNA, 19 nt, Homo sapiens
cagcagaauguauaagcua

SEQ ID NO: 1504675 - RNA, 19 nt, Homo sapiens
cagaagguauauguuuaug

SEQ ID NO: 1504676 - RNA, 19 nt, Homo sapiens
ggaaacauuagaagcaagu

SEQ ID NO: 1504677 - RNA, 19 nt, Homo sapiens
gagccaccauguugcagau

SEQ ID NO: 1504678 - RNA, 19 nt, Homo sapiens
aaucagaaaguccagauga

SEQ ID NO: 1504679 - RNA, 19 nt, Homo sapiens
gagauagaacacaaacaug

SEQ ID NO: 1504680 - RNA, 19 nt, Homo sapiens
caacauugcacaggaagau

SEQ ID NO: 1504681 - RNA, 19 nt, Homo sapiens
cauggacucagacaaauug

SEQ ID NO: 1504682 - RNA, 19 nt, Homo sapiens
agaaugcugccuuuaaaga

SEQ ID NO: 1504683 - RNA, 19 nt, Homo sapiens
ucaaguacgugcuaaugaa

SEQ ID NO: 1504684 - RNA, 19 nt, Homo sapiens
ccaaggauguggacagaga

SEQ ID NO: 1504685 - RNA, 19 nt, Homo sapiens
ggacaggaccaucgacuau

SEQ ID NO: 1504686 - RNA, 19 nt, Homo sapiens
caacaagaaaucucacuga

SEQ ID NO: 1504687 - RNA, 19 nt, Homo sapiens
gaaggaggccgacaaggau

SEQ ID NO: 1504688 - RNA, 19 nt, Homo sapiens
ggaacacacucaaguacgu

SEQ ID NO: 1504689 - RNA, 19 nt, Homo sapiens
caggaugggucuucaacaa

SEQ ID NO: 1504690 - RNA, 19 nt, Homo sapiens
ccuucaagcugauccagua

SEQ ID NO: 1504691 - RNA, 19 nt, Homo sapiens
caacaaaggguucuucaac

SEQ ID NO: 1504692 - RNA, 19 nt, Homo sapiens
acaggaccaucgacuauga

SEQ ID NO: 1504693 - RNA, 19 nt, Homo sapiens
ggaguacaagggagucuuu

SEQ ID NO: 1504694 - RNA, 19 nt, Homo sapiens
caucgacuaugaggaguuu

SEQ ID NO: 1504695 - RNA, 19 nt, Homo sapiens
ccugagaguuugugacaug

SEQ ID NO: 1504696 - RNA, 19 nt, Homo sapiens
cgaccuguccugagaguuu

SEQ ID NO: 1504697 - RNA, 19 nt, Homo sapiens
acaaaggguucuucaacug

SEQ ID NO: 1504698 - RNA, 19 nt, Homo sapiens
caagggagucuuugagaug

SEQ ID NO: 1504699 - RNA, 19 nt, Homo sapiens
cugagcagaucaaggagua

SEQ ID NO: 1504700 - RNA, 19 nt, Homo sapiens
cggagcagaugaugaagga

SEQ ID NO: 1504701 - RNA, 19 nt, Homo sapiens
ugaaggaggccgacaagga

SEQ ID NO: 1504702 - RNA, 19 nt, Homo sapiens
ccucaugcauuuguucauu

SEQ ID NO: 1504703 - RNA, 19 nt, Homo sapiens
ggccaaggauguggacaga

SEQ ID NO: 1504704 - RNA, 19 nt, Homo sapiens
ggcaagggcuacauugacu

SEQ ID NO: 1504705 - RNA, 19 nt, Homo sapiens
cauucgaccuguccugaga

SEQ ID NO: 1504706 - RNA, 19 nt, Homo sapiens
ucaugagccugcuggguau

SEQ ID NO: 1504707 - RNA, 19 nt, Homo sapiens
acaagggagucuuugagau

SEQ ID NO: 1504708 - RNA, 19 nt, Homo sapiens
cggcugagcagaucaagga

SEQ ID NO: 1504709 - RNA, 19 nt, Homo sapiens
gaugguuuccuggcacuaa

SEQ ID NO: 1504710 - RNA, 19 nt, Homo sapiens
gaccuguccugagaguuug

SEQ ID NO: 1504711 - RNA, 19 nt, Homo sapiens
guacaagggagucuuugag

SEQ ID NO: 1504712 - RNA, 19 nt, Homo sapiens
uaaauguuccagcccgaaa

SEQ ID NO: 1504713 - RNA, 19 nt, Homo sapiens
gggacaggaccaucgacua

SEQ ID NO: 1504714 - RNA, 19 nt, Homo sapiens
acacucaaguacgugcuaa

SEQ ID NO: 1504715 - RNA, 19 nt, Homo sapiens
gggagucuuugagauguuc

SEQ ID NO: 1504716 - RNA, 19 nt, Homo sapiens
agcggugccucaugcauuu

SEQ ID NO: 1504717 - RNA, 19 nt, Homo sapiens
gaugaaggaggccgacaag

SEQ ID NO: 1504718 - RNA, 19 nt, Homo sapiens
gagggcaagggcuacauug

SEQ ID NO: 1504719 - RNA, 19 nt, Homo sapiens
aacaaaggguucuucaacu

SEQ ID NO: 1504720 - RNA, 19 nt, Homo sapiens
gacaacaaaggguucuuca

SEQ ID NO: 1504721 - RNA, 19 nt, Homo sapiens
ucaagcugauccaguaggu

SEQ ID NO: 1504722 - RNA, 19 nt, Homo sapiens
ggucaagcggugccucaug

SEQ ID NO: 1504723 - RNA, 19 nt, Homo sapiens
gggaguccuucaagcugau

SEQ ID NO: 1504724 - RNA, 19 nt, Homo sapiens
gaguuuguggccaugauga

SEQ ID NO: 1504725 - RNA, 19 nt, Homo sapiens
aggcggagcagaugaugaa

SEQ ID NO: 1504726 - RNA, 19 nt, Homo sapiens
uggcacuaaugggaguuua

SEQ ID NO: 1504727 - RNA, 19 nt, Homo sapiens
uacaagggagucuuugaga

SEQ ID NO: 1504728 - RNA, 19 nt, Homo sapiens
gagcagaucaaggaguaca

SEQ ID NO: 1504729 - RNA, 19 nt, Homo sapiens
acaagaaaucucacugaca

SEQ ID NO: 1504730 - RNA, 19 nt, Homo sapiens
cggcauuccgugucuuuga

SEQ ID NO: 1504731 - RNA, 19 nt, Homo sapiens
aagggagucuuugagaugu

SEQ ID NO: 1504732 - RNA, 19 nt, Homo sapiens
ggaguuuguggccaugaug

SEQ ID NO: 1504733 - RNA, 19 nt, Homo sapiens
gggcaagggcuacauugac

SEQ ID NO: 1504734 - RNA, 19 nt, Homo sapiens
gacaggaccaucgacuaug

SEQ ID NO: 1504735 - RNA, 19 nt, Homo sapiens
gcagaucaaggaguacaag

SEQ ID NO: 1504736 - RNA, 19 nt, Homo sapiens
gcacuuaacuguuuacaaa

SEQ ID NO: 1504737 - RNA, 19 nt, Homo sapiens
ggucagcacuuaacuguuu

SEQ ID NO: 1504738 - RNA, 19 nt, Homo sapiens
ccacaaggguacagcauua

SEQ ID NO: 1504739 - RNA, 19 nt, Homo sapiens
ggacuaacauuucuggauu

SEQ ID NO: 1504740 - RNA, 19 nt, Homo sapiens
ccaaggagcugcuauguuc

SEQ ID NO: 1504741 - RNA, 19 nt, Homo sapiens
caacauguaucccuuuaga

SEQ ID NO: 1504742 - RNA, 19 nt, Homo sapiens
ggaagcauaucccgugaaa

SEQ ID NO: 1504743 - RNA, 19 nt, Homo sapiens
gagcugcuauguucuauga

SEQ ID NO: 1504744 - RNA, 19 nt, Homo sapiens
caccacaccuggcuaauuu

SEQ ID NO: 1504745 - RNA, 19 nt, Homo sapiens
gaagagcucccagaagaua

SEQ ID NO: 1504746 - RNA, 19 nt, Homo sapiens
caaaggagcugaggucaag

SEQ ID NO: 1504747 - RNA, 19 nt, Homo sapiens
uggaagagcucccagaaga

SEQ ID NO: 1504748 - RNA, 19 nt, Homo sapiens
uaacauuucuggauuugug

SEQ ID NO: 1504749 - RNA, 19 nt, Homo sapiens
ggccugcgcuggaagcaua

SEQ ID NO: 1504750 - RNA, 19 nt, Homo sapiens
ugacauagcuuaaguuuuc

SEQ ID NO: 1504751 - RNA, 19 nt, Homo sapiens
acacaugcauacacacaua

SEQ ID NO: 1504752 - RNA, 19 nt, Homo sapiens
cagccaaaccuuacuauuu

SEQ ID NO: 1504753 - RNA, 19 nt, Homo sapiens
ccaaguagcugggauuaca

SEQ ID NO: 1504754 - RNA, 19 nt, Homo sapiens
ugaaauaaccacuccguuu

SEQ ID NO: 1504755 - RNA, 19 nt, Homo sapiens
gaccagaguccgugaauga

SEQ ID NO: 1504756 - RNA, 19 nt, Homo sapiens
gaaaaguguuagugccuua

SEQ ID NO: 1504757 - RNA, 19 nt, Homo sapiens
caacagacaagauggaaga

SEQ ID NO: 1504758 - RNA, 19 nt, Homo sapiens
cccaggaugugaccuauuu

SEQ ID NO: 1504759 - RNA, 19 nt, Homo sapiens
gugcugcucugaugacuug

SEQ ID NO: 1504760 - RNA, 19 nt, Homo sapiens
ccagaaccaucuacacguu

SEQ ID NO: 1504761 - RNA, 19 nt, Homo sapiens
cacuggaucugaaguauga

SEQ ID NO: 1504762 - RNA, 19 nt, Homo sapiens
caguuuggauggcacguua

SEQ ID NO: 1504763 - RNA, 19 nt, Homo sapiens
gacuaacauuucuggauuu

SEQ ID NO: 1504764 - RNA, 19 nt, Homo sapiens
ggagugcagugguacaauc

SEQ ID NO: 1504765 - RNA, 19 nt, Homo sapiens
gaaauucccagaccuguac

SEQ ID NO: 1504766 - RNA, 19 nt, Homo sapiens
gcgagggaaucagaaauug

SEQ ID NO: 1504767 - RNA, 19 nt, Homo sapiens
uaucaucagcaucaucuua

SEQ ID NO: 1504768 - RNA, 19 nt, Homo sapiens
gaaggucacagccaggauu

SEQ ID NO: 1504769 - RNA, 19 nt, Homo sapiens
gggauccacuacucaagaa

SEQ ID NO: 1504770 - RNA, 19 nt, Homo sapiens
gcucugcuguucacugguu

SEQ ID NO: 1504771 - RNA, 19 nt, Homo sapiens
gaaccaaggagcugcuaug

SEQ ID NO: 1504772 - RNA, 19 nt, Homo sapiens
gguauauguuguucuuaug

SEQ ID NO: 1504773 - RNA, 19 nt, Homo sapiens
guuagugccuuaggugaaa

SEQ ID NO: 1504774 - RNA, 19 nt, Homo sapiens
ccaaagugcugggauuaca

SEQ ID NO: 1504775 - RNA, 19 nt, Homo sapiens
gcuguucacugguuguaug

SEQ ID NO: 1504776 - RNA, 19 nt, Homo sapiens
ucauggcacuguacgguuu

SEQ ID NO: 1504777 - RNA, 19 nt, Homo sapiens
aaggguggcuguccucaaa

SEQ ID NO: 1504778 - RNA, 19 nt, Homo sapiens
gagcuguguugcuuuaaag

SEQ ID NO: 1504779 - RNA, 19 nt, Homo sapiens
ccaaugccuucuagauuca

SEQ ID NO: 1504780 - RNA, 19 nt, Homo sapiens
gcugcuauguucuaugaug

SEQ ID NO: 1504781 - RNA, 19 nt, Homo sapiens
ggagaagcauuuggaaagg

SEQ ID NO: 1504782 - RNA, 19 nt, Homo sapiens
ucacagccaggauuucuaa

SEQ ID NO: 1504783 - RNA, 19 nt, Homo sapiens
acacccaccugaauauaga

SEQ ID NO: 1504784 - RNA, 19 nt, Homo sapiens
gagaggaagaacaaacaaa

SEQ ID NO: 1504785 - RNA, 19 nt, Homo sapiens
acacacacaugcauacaca

SEQ ID NO: 1504786 - RNA, 19 nt, Homo sapiens
gaugagcguagcugaguuu

SEQ ID NO: 1504787 - RNA, 19 nt, Homo sapiens
cuaguuaggcccagauaaa

SEQ ID NO: 1504788 - RNA, 19 nt, Homo sapiens
gucauuaagucauucacaa

SEQ ID NO: 1504789 - RNA, 19 nt, Homo sapiens
ucuaugaugugccugaaga

SEQ ID NO: 1504790 - RNA, 19 nt, Homo sapiens
uuaaauggcagaacuggaa

SEQ ID NO: 1504791 - RNA, 19 nt, Homo sapiens
gagcguagcugaguuuuca

SEQ ID NO: 1504792 - RNA, 19 nt, Homo sapiens
ucuuuaggcugagcuauaa

SEQ ID NO: 1504793 - RNA, 19 nt, Homo sapiens
uaaccacuccguuucuauu

SEQ ID NO: 1504794 - RNA, 19 nt, Homo sapiens
gcaaaggagcugaggucaa

SEQ ID NO: 1504795 - RNA, 19 nt, Homo sapiens
gugcugccaucgcuucuga

SEQ ID NO: 1504796 - RNA, 19 nt, Homo sapiens
cgguauauguuguucuuau

SEQ ID NO: 1504797 - RNA, 19 nt, Homo sapiens
ugaacaaccuuggcucugu

SEQ ID NO: 1504798 - RNA, 19 nt, Homo sapiens
ggaguaggacaguaacaug

SEQ ID NO: 1504799 - RNA, 19 nt, Homo sapiens
gacccaguuuguuggagua

SEQ ID NO: 1504800 - RNA, 19 nt, Homo sapiens
ugaugugccugaagaaaca

SEQ ID NO: 1504801 - RNA, 19 nt, Homo sapiens
gauauccuacugcuuguug

SEQ ID NO: 1504802 - RNA, 19 nt, Homo sapiens
ugacgcugcucucccagaa

SEQ ID NO: 1504803 - RNA, 19 nt, Homo sapiens
ugcuauaccucaugccuuu

SEQ ID NO: 1504804 - RNA, 19 nt, Homo sapiens
cuacuaacgguauauguug

SEQ ID NO: 1504805 - RNA, 19 nt, Homo sapiens
ccacuccguuucuauucuu

SEQ ID NO: 1504806 - RNA, 19 nt, Homo sapiens
caucuuagacuuguaugaa

SEQ ID NO: 1504807 - RNA, 19 nt, Homo sapiens
gaacuggaaaagcuucuua

SEQ ID NO: 1504808 - RNA, 19 nt, Homo sapiens
ccgaauaccuggauuaccu

SEQ ID NO: 1504809 - RNA, 19 nt, Homo sapiens
caacugcuccaccuucuag

SEQ ID NO: 1504810 - RNA, 19 nt, Homo sapiens
uagcuuaaguuuuccagua

SEQ ID NO: 1504811 - RNA, 19 nt, Homo sapiens
ggaagaacaaacaaacuac

SEQ ID NO: 1504812 - RNA, 19 nt, Homo sapiens
acaguaacauggcaggaau

SEQ ID NO: 1504813 - RNA, 19 nt, Homo sapiens
caccugaauucuccaagga

SEQ ID NO: 1504814 - RNA, 19 nt, Homo sapiens
aauaaccacuccguuucua

SEQ ID NO: 1504815 - RNA, 19 nt, Homo sapiens
ggagaggaagaacaaacaa

SEQ ID NO: 1504816 - RNA, 19 nt, Homo sapiens
agagcuguguugcuuuaaa

SEQ ID NO: 1504817 - RNA, 19 nt, Homo sapiens
accaaugccuucuagauuc

SEQ ID NO: 1504818 - RNA, 19 nt, Homo sapiens
ccaguuuguuggaguagga

SEQ ID NO: 1504819 - RNA, 19 nt, Homo sapiens
agcaacauguaucccuuua

SEQ ID NO: 1504820 - RNA, 19 nt, Homo sapiens
gucagcacuuaacuguuua

SEQ ID NO: 1504821 - RNA, 19 nt, Homo sapiens
cagcaucaucuuagacuug

SEQ ID NO: 1504822 - RNA, 19 nt, Homo sapiens
acacacacacacaugcaua

SEQ ID NO: 1504823 - RNA, 19 nt, Homo sapiens
ggcgagggaaucagaaauu

SEQ ID NO: 1504824 - RNA, 19 nt, Homo sapiens
gaagaggaggcgagggaau

SEQ ID NO: 1504825 - RNA, 19 nt, Homo sapiens
ggaagagcucccagaagau

SEQ ID NO: 1504826 - RNA, 19 nt, Homo sapiens
acauugaaccaccuucuuu

SEQ ID NO: 1504827 - RNA, 19 nt, Homo sapiens
agccaaaccuuacuauuuu

SEQ ID NO: 1504828 - RNA, 19 nt, Homo sapiens
aggaagaacaaacaaacua

SEQ ID NO: 1504829 - RNA, 19 nt, Homo sapiens
gaauaccuggauuaccuuu

SEQ ID NO: 1504830 - RNA, 19 nt, Homo sapiens
cagugaggcuuguccagau

SEQ ID NO: 1504831 - RNA, 19 nt, Homo sapiens
caaggguacagcauuaaau

SEQ ID NO: 1504832 - RNA, 19 nt, Homo sapiens
aaacaagacccuauuucca

SEQ ID NO: 1504833 - RNA, 19 nt, Homo sapiens
ggugaaagcaacauguauc

SEQ ID NO: 1504834 - RNA, 19 nt, Homo sapiens
ucuaaacuccaucuccuuu

SEQ ID NO: 1504835 - RNA, 19 nt, Homo sapiens
ugaaguaugagguggcauu

SEQ ID NO: 1504836 - RNA, 19 nt, Homo sapiens
gcacuuaacuguuuacaaa

SEQ ID NO: 1504837 - RNA, 19 nt, Homo sapiens
ggucagcacuuaacuguuu

SEQ ID NO: 1504838 - RNA, 19 nt, Homo sapiens
ccacaaggguacagcauua

SEQ ID NO: 1504839 - RNA, 19 nt, Homo sapiens
ggacuaacauuucuggauu

SEQ ID NO: 1504840 - RNA, 19 nt, Homo sapiens
ccaaggagcugcuauguuc

SEQ ID NO: 1504841 - RNA, 19 nt, Homo sapiens
caacauguaucccuuuaga

SEQ ID NO: 1504842 - RNA, 19 nt, Homo sapiens
ggaagcauaucccgugaaa

SEQ ID NO: 1504843 - RNA, 19 nt, Homo sapiens
gagcugcuauguucuauga

SEQ ID NO: 1504844 - RNA, 19 nt, Homo sapiens
caccacaccuggcuaauuu

SEQ ID NO: 1504845 - RNA, 19 nt, Homo sapiens
gaagagcucccagaagaua

SEQ ID NO: 1504846 - RNA, 19 nt, Homo sapiens
caaaggagcugaggucaag

SEQ ID NO: 1504847 - RNA, 19 nt, Homo sapiens
uggaagagcucccagaaga

SEQ ID NO: 1504848 - RNA, 19 nt, Homo sapiens
uaacauuucuggauuugug

SEQ ID NO: 1504849 - RNA, 19 nt, Homo sapiens
ggccugcgcuggaagcaua

SEQ ID NO: 1504850 - RNA, 19 nt, Homo sapiens
ugacauagcuuaaguuuuc

SEQ ID NO: 1504851 - RNA, 19 nt, Homo sapiens
acacaugcauacacacaua

SEQ ID NO: 1504852 - RNA, 19 nt, Homo sapiens
cagccaaaccuuacuauuu

SEQ ID NO: 1504853 - RNA, 19 nt, Homo sapiens
ccaaguagcugggauuaca

SEQ ID NO: 1504854 - RNA, 19 nt, Homo sapiens
ugaaauaaccacuccguuu

SEQ ID NO: 1504855 - RNA, 19 nt, Homo sapiens
gaaaaguguuagugccuua

SEQ ID NO: 1504856 - RNA, 19 nt, Homo sapiens
caacagacaagauggaaga

SEQ ID NO: 1504857 - RNA, 19 nt, Homo sapiens
cccaggaugugaccuauuu

SEQ ID NO: 1504858 - RNA, 19 nt, Homo sapiens
gugcugcucugaugacuug

SEQ ID NO: 1504859 - RNA, 19 nt, Homo sapiens
ccagaaccaucuacacguu

SEQ ID NO: 1504860 - RNA, 19 nt, Homo sapiens
cacuggaucugaaguauga

SEQ ID NO: 1504861 - RNA, 19 nt, Homo sapiens
caguuuggauggcacguua

SEQ ID NO: 1504862 - RNA, 19 nt, Homo sapiens
gacuaacauuucuggauuu

SEQ ID NO: 1504863 - RNA, 19 nt, Homo sapiens
ggagugcagugguacaauc

SEQ ID NO: 1504864 - RNA, 19 nt, Homo sapiens
gaaauucccagaccuguac

SEQ ID NO: 1504865 - RNA, 19 nt, Homo sapiens
gcgagggaaucagaaauug

SEQ ID NO: 1504866 - RNA, 19 nt, Homo sapiens
uaucaucagcaucaucuua

SEQ ID NO: 1504867 - RNA, 19 nt, Homo sapiens
gaaggucacagccaggauu

SEQ ID NO: 1504868 - RNA, 19 nt, Homo sapiens
gggauccacuacucaagaa

SEQ ID NO: 1504869 - RNA, 19 nt, Homo sapiens
gcucugcuguucacugguu

SEQ ID NO: 1504870 - RNA, 19 nt, Homo sapiens
gaaccaaggagcugcuaug

SEQ ID NO: 1504871 - RNA, 19 nt, Homo sapiens
gguauauguuguucuuaug

SEQ ID NO: 1504872 - RNA, 19 nt, Homo sapiens
guuagugccuuaggugaaa

SEQ ID NO: 1504873 - RNA, 19 nt, Homo sapiens
ccaaagugcugggauuaca

SEQ ID NO: 1504874 - RNA, 19 nt, Homo sapiens
gcuguucacugguuguaug

SEQ ID NO: 1504875 - RNA, 19 nt, Homo sapiens
ucauggcacuguacgguuu

SEQ ID NO: 1504876 - RNA, 19 nt, Homo sapiens
aaggguggcuguccucaaa

SEQ ID NO: 1504877 - RNA, 19 nt, Homo sapiens
gagcuguguugcuuuaaag

SEQ ID NO: 1504878 - RNA, 19 nt, Homo sapiens
ccaaugccuucuagauuca

SEQ ID NO: 1504879 - RNA, 19 nt, Homo sapiens
gcugcuauguucuaugaug

SEQ ID NO: 1504880 - RNA, 19 nt, Homo sapiens
ggagaagcauuuggaaagg

SEQ ID NO: 1504881 - RNA, 19 nt, Homo sapiens
ucacagccaggauuucuaa

SEQ ID NO: 1504882 - RNA, 19 nt, Homo sapiens
acacccaccugaauauaga

SEQ ID NO: 1504883 - RNA, 19 nt, Homo sapiens
gagaggaagaacaaacaaa

SEQ ID NO: 1504884 - RNA, 19 nt, Homo sapiens
acacacacaugcauacaca

SEQ ID NO: 1504885 - RNA, 19 nt, Homo sapiens
gaugagcguagcugaguuu

SEQ ID NO: 1504886 - RNA, 19 nt, Homo sapiens
cuaguuaggcccagauaaa

SEQ ID NO: 1504887 - RNA, 19 nt, Homo sapiens
gucauuaagucauucacaa

SEQ ID NO: 1504888 - RNA, 19 nt, Homo sapiens
uuaaauggcagaacuggaa

SEQ ID NO: 1504889 - RNA, 19 nt, Homo sapiens
ucuaugaugugccugaaga

SEQ ID NO: 1504890 - RNA, 19 nt, Homo sapiens
gagcguagcugaguuuuca

SEQ ID NO: 1504891 - RNA, 19 nt, Homo sapiens
ucuuuaggcugagcuauaa

SEQ ID NO: 1504892 - RNA, 19 nt, Homo sapiens
uaaccacuccguuucuauu

SEQ ID NO: 1504893 - RNA, 19 nt, Homo sapiens
gcaaaggagcugaggucaa

SEQ ID NO: 1504894 - RNA, 19 nt, Homo sapiens
gugcugccaucgcuucuga

SEQ ID NO: 1504895 - RNA, 19 nt, Homo sapiens
cgguauauguuguucuuau

SEQ ID NO: 1504896 - RNA, 19 nt, Homo sapiens
ugaugugccugaagaaaca

SEQ ID NO: 1504897 - RNA, 19 nt, Homo sapiens
ugaacaaccuuggcucugu

SEQ ID NO: 1504898 - RNA, 19 nt, Homo sapiens
ggaguaggacaguaacaug

SEQ ID NO: 1504899 - RNA, 19 nt, Homo sapiens
gacccaguuuguuggagua

SEQ ID NO: 1504900 - RNA, 19 nt, Homo sapiens
gauauccuacugcuuguug

SEQ ID NO: 1504901 - RNA, 19 nt, Homo sapiens
ugacgcugcucucccagaa

SEQ ID NO: 1504902 - RNA, 19 nt, Homo sapiens
ugcuauaccucaugccuuu

SEQ ID NO: 1504903 - RNA, 19 nt, Homo sapiens
cuacuaacgguauauguug

SEQ ID NO: 1504904 - RNA, 19 nt, Homo sapiens
ccacuccguuucuauucuu

SEQ ID NO: 1504905 - RNA, 19 nt, Homo sapiens
caucuuagacuuguaugaa

SEQ ID NO: 1504906 - RNA, 19 nt, Homo sapiens
gaacuggaaaagcuucuua

SEQ ID NO: 1504907 - RNA, 19 nt, Homo sapiens
ccgaauaccuggauuaccu

SEQ ID NO: 1504908 - RNA, 19 nt, Homo sapiens
caacugcuccaccuucuag

SEQ ID NO: 1504909 - RNA, 19 nt, Homo sapiens
uagcuuaaguuuuccagua

SEQ ID NO: 1504910 - RNA, 19 nt, Homo sapiens
ggaagaacaaacaaacuac

SEQ ID NO: 1504911 - RNA, 19 nt, Homo sapiens
acaguaacauggcaggaau

SEQ ID NO: 1504912 - RNA, 19 nt, Homo sapiens
caccugaauucuccaagga

SEQ ID NO: 1504913 - RNA, 19 nt, Homo sapiens
aauaaccacuccguuucua

SEQ ID NO: 1504914 - RNA, 19 nt, Homo sapiens
ggagaggaagaacaaacaa

SEQ ID NO: 1504915 - RNA, 19 nt, Homo sapiens
agagcuguguugcuuuaaa

SEQ ID NO: 1504916 - RNA, 19 nt, Homo sapiens
accaaugccuucuagauuc

SEQ ID NO: 1504917 - RNA, 19 nt, Homo sapiens
ccaguuuguuggaguagga

SEQ ID NO: 1504918 - RNA, 19 nt, Homo sapiens
agcaacauguaucccuuua

SEQ ID NO: 1504919 - RNA, 19 nt, Homo sapiens
gucagcacuuaacuguuua

SEQ ID NO: 1504920 - RNA, 19 nt, Homo sapiens
cagcaucaucuuagacuug

SEQ ID NO: 1504921 - RNA, 19 nt, Homo sapiens
acacacacacacaugcaua

SEQ ID NO: 1504922 - RNA, 19 nt, Homo sapiens
ggcgagggaaucagaaauu

SEQ ID NO: 1504923 - RNA, 19 nt, Homo sapiens
gaagaggaggcgagggaau

SEQ ID NO: 1504924 - RNA, 19 nt, Homo sapiens
ggaagagcucccagaagau

SEQ ID NO: 1504925 - RNA, 19 nt, Homo sapiens
acauugaaccaccuucuuu

SEQ ID NO: 1504926 - RNA, 19 nt, Homo sapiens
agccaaaccuuacuauuuu

SEQ ID NO: 1504927 - RNA, 19 nt, Homo sapiens
aggaagaacaaacaaacua

SEQ ID NO: 1504928 - RNA, 19 nt, Homo sapiens
cagugaggcuuguccagau

SEQ ID NO: 1504929 - RNA, 19 nt, Homo sapiens
caaggguacagcauuaaau

SEQ ID NO: 1504930 - RNA, 19 nt, Homo sapiens
gaauaccuggauuaccuuu

SEQ ID NO: 1504931 - RNA, 19 nt, Homo sapiens
aaacaagacccuauuucca

SEQ ID NO: 1504932 - RNA, 19 nt, Homo sapiens
ggugaaagcaacauguauc

SEQ ID NO: 1504933 - RNA, 19 nt, Homo sapiens
ucuaaacuccaucuccuuu

SEQ ID NO: 1504934 - RNA, 19 nt, Homo sapiens
ggcaaaggcacuuguccaa

SEQ ID NO: 1504935 - RNA, 19 nt, Homo sapiens
ugaaguaugagguggcauu

SEQ ID NO: 1504936 - RNA, 19 nt, Homo sapiens
gcacuuaacuguuuacaaa

SEQ ID NO: 1504937 - RNA, 19 nt, Homo sapiens
ggucagcacuuaacuguuu

SEQ ID NO: 1504938 - RNA, 19 nt, Homo sapiens
ccacaaggguacagcauua

SEQ ID NO: 1504939 - RNA, 19 nt, Homo sapiens
ggacuaacauuucuggauu

SEQ ID NO: 1504940 - RNA, 19 nt, Homo sapiens
ccaaggagcugcuauguuc

SEQ ID NO: 1504941 - RNA, 19 nt, Homo sapiens
caacauguaucccuuuaga

SEQ ID NO: 1504942 - RNA, 19 nt, Homo sapiens
ggaagcauaucccgugaaa

SEQ ID NO: 1504943 - RNA, 19 nt, Homo sapiens
gagcugcuauguucuauga

SEQ ID NO: 1504944 - RNA, 19 nt, Homo sapiens
caccacaccuggcuaauuu

SEQ ID NO: 1504945 - RNA, 19 nt, Homo sapiens
gaagagcucccagaagaua

SEQ ID NO: 1504946 - RNA, 19 nt, Homo sapiens
caaaggagcugaggucaag

SEQ ID NO: 1504947 - RNA, 19 nt, Homo sapiens
uggaagagcucccagaaga

SEQ ID NO: 1504948 - RNA, 19 nt, Homo sapiens
uaacauuucuggauuugug

SEQ ID NO: 1504949 - RNA, 19 nt, Homo sapiens
ggccugcgcuggaagcaua

SEQ ID NO: 1504950 - RNA, 19 nt, Homo sapiens
ugacauagcuuaaguuuuc

SEQ ID NO: 1504951 - RNA, 19 nt, Homo sapiens
acacaugcauacacacaua

SEQ ID NO: 1504952 - RNA, 19 nt, Homo sapiens
cagccaaaccuuacuauuu

SEQ ID NO: 1504953 - RNA, 19 nt, Homo sapiens
ccaaguagcugggauuaca

SEQ ID NO: 1504954 - RNA, 19 nt, Homo sapiens
ugaaauaaccacuccguuu

SEQ ID NO: 1504955 - RNA, 19 nt, Homo sapiens
gaccagaguccgugaauga

SEQ ID NO: 1504956 - RNA, 19 nt, Homo sapiens
gaaaaguguuagugccuua

SEQ ID NO: 1504957 - RNA, 19 nt, Homo sapiens
caacagacaagauggaaga

SEQ ID NO: 1504958 - RNA, 19 nt, Homo sapiens
cccaggaugugaccuauuu

SEQ ID NO: 1504959 - RNA, 19 nt, Homo sapiens
gugcugcucugaugacuug

SEQ ID NO: 1504960 - RNA, 19 nt, Homo sapiens
ccagaaccaucuacacguu

SEQ ID NO: 1504961 - RNA, 19 nt, Homo sapiens
cacuggaucugaaguauga

SEQ ID NO: 1504962 - RNA, 19 nt, Homo sapiens
caguuuggauggcacguua

SEQ ID NO: 1504963 - RNA, 19 nt, Homo sapiens
gacuaacauuucuggauuu

SEQ ID NO: 1504964 - RNA, 19 nt, Homo sapiens
ggagugcagugguacaauc

SEQ ID NO: 1504965 - RNA, 19 nt, Homo sapiens
gaaauucccagaccuguac

SEQ ID NO: 1504966 - RNA, 19 nt, Homo sapiens
gcgagggaaucagaaauug

SEQ ID NO: 1504967 - RNA, 19 nt, Homo sapiens
uaucaucagcaucaucuua

SEQ ID NO: 1504968 - RNA, 19 nt, Homo sapiens
gaaggucacagccaggauu

SEQ ID NO: 1504969 - RNA, 19 nt, Homo sapiens
gggauccacuacucaagaa

SEQ ID NO: 1504970 - RNA, 19 nt, Homo sapiens
gcucugcuguucacugguu

SEQ ID NO: 1504971 - RNA, 19 nt, Homo sapiens
gaaccaaggagcugcuaug

SEQ ID NO: 1504972 - RNA, 19 nt, Homo sapiens
gguauauguuguucuuaug

SEQ ID NO: 1504973 - RNA, 19 nt, Homo sapiens
guuagugccuuaggugaaa

SEQ ID NO: 1504974 - RNA, 19 nt, Homo sapiens
ccaaagugcugggauuaca

SEQ ID NO: 1504975 - RNA, 19 nt, Homo sapiens
gcuguucacugguuguaug

SEQ ID NO: 1504976 - RNA, 19 nt, Homo sapiens
ucauggcacuguacgguuu

SEQ ID NO: 1504977 - RNA, 19 nt, Homo sapiens
aaggguggcuguccucaaa

SEQ ID NO: 1504978 - RNA, 19 nt, Homo sapiens
gagcuguguugcuuuaaag

SEQ ID NO: 1504979 - RNA, 19 nt, Homo sapiens
ccaaugccuucuagauuca

SEQ ID NO: 1504980 - RNA, 19 nt, Homo sapiens
gcugcuauguucuaugaug

SEQ ID NO: 1504981 - RNA, 19 nt, Homo sapiens
ggagaagcauuuggaaagg

SEQ ID NO: 1504982 - RNA, 19 nt, Homo sapiens
ucacagccaggauuucuaa

SEQ ID NO: 1504983 - RNA, 19 nt, Homo sapiens
acacccaccugaauauaga

SEQ ID NO: 1504984 - RNA, 19 nt, Homo sapiens
gagaggaagaacaaacaaa

SEQ ID NO: 1504985 - RNA, 19 nt, Homo sapiens
acacacacaugcauacaca

SEQ ID NO: 1504986 - RNA, 19 nt, Homo sapiens
gaugagcguagcugaguuu

SEQ ID NO: 1504987 - RNA, 19 nt, Homo sapiens
cuaguuaggcccagauaaa

SEQ ID NO: 1504988 - RNA, 19 nt, Homo sapiens
gucauuaagucauucacaa

SEQ ID NO: 1504989 - RNA, 19 nt, Homo sapiens
ucuaugaugugccugaaga

SEQ ID NO: 1504990 - RNA, 19 nt, Homo sapiens
uuaaauggcagaacuggaa

SEQ ID NO: 1504991 - RNA, 19 nt, Homo sapiens
gagcguagcugaguuuuca

SEQ ID NO: 1504992 - RNA, 19 nt, Homo sapiens
ucuuuaggcugagcuauaa

SEQ ID NO: 1504993 - RNA, 19 nt, Homo sapiens
uaaccacuccguuucuauu

SEQ ID NO: 1504994 - RNA, 19 nt, Homo sapiens
gcaaaggagcugaggucaa

SEQ ID NO: 1504995 - RNA, 19 nt, Homo sapiens
cgguauauguuguucuuau

SEQ ID NO: 1504996 - RNA, 19 nt, Homo sapiens
ugaacaaccuuggcucugu

SEQ ID NO: 1504997 - RNA, 19 nt, Homo sapiens
ggaguaggacaguaacaug

SEQ ID NO: 1504998 - RNA, 19 nt, Homo sapiens
gacccaguuuguuggagua

SEQ ID NO: 1504999 - RNA, 19 nt, Homo sapiens
ugaugugccugaagaaaca

SEQ ID NO: 1505000 - RNA, 19 nt, Homo sapiens
gauauccuacugcuuguug

SEQ ID NO: 1505001 - RNA, 19 nt, Homo sapiens
ugacgcugcucucccagaa

SEQ ID NO: 1505002 - RNA, 19 nt, Homo sapiens
ugcuauaccucaugccuuu

SEQ ID NO: 1505003 - RNA, 19 nt, Homo sapiens
cuacuaacgguauauguug

SEQ ID NO: 1505004 - RNA, 19 nt, Homo sapiens
ccacuccguuucuauucuu

SEQ ID NO: 1505005 - RNA, 19 nt, Homo sapiens
caucuuagacuuguaugaa

SEQ ID NO: 1505006 - RNA, 19 nt, Homo sapiens
gaacuggaaaagcuucuua

SEQ ID NO: 1505007 - RNA, 19 nt, Homo sapiens
ccgaauaccuggauuaccu

SEQ ID NO: 1505008 - RNA, 19 nt, Homo sapiens
caacugcuccaccuucuag

SEQ ID NO: 1505009 - RNA, 19 nt, Homo sapiens
uagcuuaaguuuuccagua

SEQ ID NO: 1505010 - RNA, 19 nt, Homo sapiens
ggaagaacaaacaaacuac

SEQ ID NO: 1505011 - RNA, 19 nt, Homo sapiens
acaguaacauggcaggaau

SEQ ID NO: 1505012 - RNA, 19 nt, Homo sapiens
caccugaauucuccaagga

SEQ ID NO: 1505013 - RNA, 19 nt, Homo sapiens
aauaaccacuccguuucua

SEQ ID NO: 1505014 - RNA, 19 nt, Homo sapiens
ggagaggaagaacaaacaa

SEQ ID NO: 1505015 - RNA, 19 nt, Homo sapiens
agagcuguguugcuuuaaa

SEQ ID NO: 1505016 - RNA, 19 nt, Homo sapiens
accaaugccuucuagauuc

SEQ ID NO: 1505017 - RNA, 19 nt, Homo sapiens
ccaguuuguuggaguagga

SEQ ID NO: 1505018 - RNA, 19 nt, Homo sapiens
agcaacauguaucccuuua

SEQ ID NO: 1505019 - RNA, 19 nt, Homo sapiens
gucagcacuuaacuguuua

SEQ ID NO: 1505020 - RNA, 19 nt, Homo sapiens
cagcaucaucuuagacuug

SEQ ID NO: 1505021 - RNA, 19 nt, Homo sapiens
acacacacacacaugcaua

SEQ ID NO: 1505022 - RNA, 19 nt, Homo sapiens
ggcgagggaaucagaaauu

SEQ ID NO: 1505023 - RNA, 19 nt, Homo sapiens
gaagaggaggcgagggaau

SEQ ID NO: 1505024 - RNA, 19 nt, Homo sapiens
ggaagagcucccagaagau

SEQ ID NO: 1505025 - RNA, 19 nt, Homo sapiens
acauugaaccaccuucuuu

SEQ ID NO: 1505026 - RNA, 19 nt, Homo sapiens
agccaaaccuuacuauuuu

SEQ ID NO: 1505027 - RNA, 19 nt, Homo sapiens
aggaagaacaaacaaacua

SEQ ID NO: 1505028 - RNA, 19 nt, Homo sapiens
cagugaggcuuguccagau

SEQ ID NO: 1505029 - RNA, 19 nt, Homo sapiens
caaggguacagcauuaaau

SEQ ID NO: 1505030 - RNA, 19 nt, Homo sapiens
gaauaccuggauuaccuuu

SEQ ID NO: 1505031 - RNA, 19 nt, Homo sapiens
aaacaagacccuauuucca

SEQ ID NO: 1505032 - RNA, 19 nt, Homo sapiens
ggugaaagcaacauguauc

SEQ ID NO: 1505033 - RNA, 19 nt, Homo sapiens
ucuaaacuccaucuccuuu

SEQ ID NO: 1505034 - RNA, 19 nt, Homo sapiens
ggcaaaggcacuuguccaa

SEQ ID NO: 1505035 - RNA, 19 nt, Homo sapiens
ugaaguaugagguggcauu

SEQ ID NO: 1505036 - RNA, 19 nt, Homo sapiens
gcaaucaucuaguaucuaa

SEQ ID NO: 1505037 - RNA, 19 nt, Homo sapiens
caacaugucucccugauga

SEQ ID NO: 1505038 - RNA, 19 nt, Homo sapiens
gaaccuagggccauucuua

SEQ ID NO: 1505039 - RNA, 19 nt, Homo sapiens
ggaaugagccagaauuuau

SEQ ID NO: 1505040 - RNA, 19 nt, Homo sapiens
caagauggauugaaagaug

SEQ ID NO: 1505041 - RNA, 19 nt, Homo sapiens
caaggagucuuacccagua

SEQ ID NO: 1505042 - RNA, 19 nt, Homo sapiens
gaugcaagauggauugaaa

SEQ ID NO: 1505043 - RNA, 19 nt, Homo sapiens
gaaggagucucuuaaggau

SEQ ID NO: 1505044 - RNA, 19 nt, Homo sapiens
gcucuuaacuacuacacua

SEQ ID NO: 1505045 - RNA, 19 nt, Homo sapiens
ggacaugacaccacaacua

SEQ ID NO: 1505046 - RNA, 19 nt, Homo sapiens
gcaugucacuggagcaauu

SEQ ID NO: 1505047 - RNA, 19 nt, Homo sapiens
ggauugaaaugucuuaaca

SEQ ID NO: 1505048 - RNA, 19 nt, Homo sapiens
ggaugaugcugaacaaaug

SEQ ID NO: 1505049 - RNA, 19 nt, Homo sapiens
cgacaaacccauuaccuuu

SEQ ID NO: 1505050 - RNA, 19 nt, Homo sapiens
gagaauuguuccauauguu

SEQ ID NO: 1505051 - RNA, 19 nt, Homo sapiens
caaaguacccugagcauca

SEQ ID NO: 1505052 - RNA, 19 nt, Homo sapiens
gcugagaauuguuccauau

SEQ ID NO: 1505053 - RNA, 19 nt, Homo sapiens
ggaaggagucucuuaagga

SEQ ID NO: 1505054 - RNA, 19 nt, Homo sapiens
acaguacccuggacucaua

SEQ ID NO: 1505055 - RNA, 19 nt, Homo sapiens
aaaccuggcuucaacauca

SEQ ID NO: 1505056 - RNA, 19 nt, Homo sapiens
ggggaugggucuucuauua

SEQ ID NO: 1505057 - RNA, 19 nt, Homo sapiens
gcagagaugcugagaugaa

SEQ ID NO: 1505058 - RNA, 19 nt, Homo sapiens
gagaagagcagacacaaag

SEQ ID NO: 1505059 - RNA, 19 nt, Homo sapiens
uuaacacacucaugucuuu

SEQ ID NO: 1505060 - RNA, 19 nt, Homo sapiens
ucuccaagcugaagugaaa

SEQ ID NO: 1505061 - RNA, 19 nt, Homo sapiens
cuaaacaggcacaggauua

SEQ ID NO: 1505062 - RNA, 19 nt, Homo sapiens
gcagcuauguuuggauuga

SEQ ID NO: 1505063 - RNA, 19 nt, Homo sapiens
ugaaaugucuuaacacacu

SEQ ID NO: 1505064 - RNA, 19 nt, Homo sapiens
uaaaagaguuugaggugua

SEQ ID NO: 1505065 - RNA, 19 nt, Homo sapiens
caagacagcucagagucaa

SEQ ID NO: 1505066 - RNA, 19 nt, Homo sapiens
gagccagaauuuaucuuug

SEQ ID NO: 1505067 - RNA, 19 nt, Homo sapiens
aaagcaguguucaaccuua

SEQ ID NO: 1505068 - RNA, 19 nt, Homo sapiens
guagcacgauuauaguuau

SEQ ID NO: 1505069 - RNA, 19 nt, Homo sapiens
aggagucucuuaaggauaa

SEQ ID NO: 1505070 - RNA, 19 nt, Homo sapiens
gguagcacgauuauaguua

SEQ ID NO: 1505071 - RNA, 19 nt, Homo sapiens
ucaagcagcagauuuaaga

SEQ ID NO: 1505072 - RNA, 19 nt, Homo sapiens
gguacagaauccugccaua

SEQ ID NO: 1505073 - RNA, 19 nt, Homo sapiens
gcaugucucugcugcuguu

SEQ ID NO: 1505074 - RNA, 19 nt, Homo sapiens
ugagagaggcgcauuguug

SEQ ID NO: 1505075 - RNA, 19 nt, Homo sapiens
acucaugucuuuaacaguu

SEQ ID NO: 1505076 - RNA, 19 nt, Homo sapiens
ggccaaaucuuuucuaaau

SEQ ID NO: 1505077 - RNA, 19 nt, Homo sapiens
acaccuuccuccaauuuaa

SEQ ID NO: 1505078 - RNA, 19 nt, Homo sapiens
ccaccagacuccaggauuc

SEQ ID NO: 1505079 - RNA, 19 nt, Homo sapiens
gagggaaguugugggacua

SEQ ID NO: 1505080 - RNA, 19 nt, Homo sapiens
gcuuuaaugcugaaccuua

SEQ ID NO: 1505081 - RNA, 19 nt, Homo sapiens
cagagaugcugagaugaaa

SEQ ID NO: 1505082 - RNA, 19 nt, Homo sapiens
gacccuggaugguucuaaa

SEQ ID NO: 1505083 - RNA, 19 nt, Homo sapiens
ugagaauuguuccauaugu

SEQ ID NO: 1505084 - RNA, 19 nt, Homo sapiens
ugaaagaugacauuagaga

SEQ ID NO: 1505085 - RNA, 19 nt, Homo sapiens
guucagccuuucucaauca

SEQ ID NO: 1505086 - RNA, 19 nt, Homo sapiens
cccauuaccuuuccagaug

SEQ ID NO: 1505087 - RNA, 19 nt, Homo sapiens
caaugugcaucaaggaaug

SEQ ID NO: 1505088 - RNA, 19 nt, Homo sapiens
ggaugguucuaaauggaaa

SEQ ID NO: 1505089 - RNA, 19 nt, Homo sapiens
cagcaacaacuuaagcuuu

SEQ ID NO: 1505090 - RNA, 19 nt, Homo sapiens
acaagauacuacucagaaa

SEQ ID NO: 1505091 - RNA, 19 nt, Homo sapiens
gaaagcaguguucaaccuu

SEQ ID NO: 1505092 - RNA, 19 nt, Homo sapiens
guaaaugguagaacuagga

SEQ ID NO: 1505093 - RNA, 19 nt, Homo sapiens
ccacgcaccuaguuguuca

SEQ ID NO: 1505094 - RNA, 19 nt, Homo sapiens
cuucaucucugguaaaugg

SEQ ID NO: 1505095 - RNA, 19 nt, Homo sapiens
gaaauacuaguguuaugca

SEQ ID NO: 1505096 - RNA, 19 nt, Homo sapiens
ugauugggcauuuguagua

SEQ ID NO: 1505097 - RNA, 19 nt, Homo sapiens
gaaagaugacauuagagau

SEQ ID NO: 1505098 - RNA, 19 nt, Homo sapiens
gaaaagacaagaucccaaa

SEQ ID NO: 1505099 - RNA, 19 nt, Homo sapiens
caucuaguaucuaaagaag

SEQ ID NO: 1505100 - RNA, 19 nt, Homo sapiens
ggauugaaagaugacauua

SEQ ID NO: 1505101 - RNA, 19 nt, Homo sapiens
gggaaguugugggacuaua

SEQ ID NO: 1505102 - RNA, 19 nt, Homo sapiens
gaccggaaggagucucuua

SEQ ID NO: 1505103 - RNA, 19 nt, Homo sapiens
acacuacagcaacaacuua

SEQ ID NO: 1505104 - RNA, 19 nt, Homo sapiens
agugugcucuuaacuacua

SEQ ID NO: 1505105 - RNA, 19 nt, Homo sapiens
caagaaaugggacucuaga

SEQ ID NO: 1505106 - RNA, 19 nt, Homo sapiens
ucucaggacuaucuaaaca

SEQ ID NO: 1505107 - RNA, 19 nt, Homo sapiens
ugucaauaaucucugguuu

SEQ ID NO: 1505108 - RNA, 19 nt, Homo sapiens
uugcauguguuaacucauu

SEQ ID NO: 1505109 - RNA, 19 nt, Homo sapiens
gaagagcagacacaaagca

SEQ ID NO: 1505110 - RNA, 19 nt, Homo sapiens
ccuagggccauucuuauuu

SEQ ID NO: 1505111 - RNA, 19 nt, Homo sapiens
ugucaagauucuccugaaa

SEQ ID NO: 1505112 - RNA, 19 nt, Homo sapiens
gaaugagccagaauuuauc

SEQ ID NO: 1505113 - RNA, 19 nt, Homo sapiens
guacagaauccugccauau

SEQ ID NO: 1505114 - RNA, 19 nt, Homo sapiens
gggaacaccugagccagau

SEQ ID NO: 1505115 - RNA, 19 nt, Homo sapiens
guuggacccuuuacgaugu

SEQ ID NO: 1505116 - RNA, 19 nt, Homo sapiens
cuacuacacuacagcaaca

SEQ ID NO: 1505117 - RNA, 19 nt, Homo sapiens
aagauggauugaaagauga

SEQ ID NO: 1505118 - RNA, 19 nt, Homo sapiens
gagaugaaaucagggaacu

SEQ ID NO: 1505119 - RNA, 19 nt, Homo sapiens
caccaaagacuucucugaa

SEQ ID NO: 1505120 - RNA, 19 nt, Homo sapiens
acuaggagcugagaauugu

SEQ ID NO: 1505121 - RNA, 19 nt, Homo sapiens
agccagaauuuaucuuuga

SEQ ID NO: 1505122 - RNA, 19 nt, Homo sapiens
gcagcagauuuaagacauc

SEQ ID NO: 1505123 - RNA, 19 nt, Homo sapiens
aggaggagauggacgauca

SEQ ID NO: 1505124 - RNA, 19 nt, Homo sapiens
gugcaaagguacagaaucc

SEQ ID NO: 1505125 - RNA, 19 nt, Homo sapiens
gcaccgguaguaaacauau

SEQ ID NO: 1505126 - RNA, 19 nt, Homo sapiens
ucuuugcaaucaucuagua

SEQ ID NO: 1505127 - RNA, 19 nt, Homo sapiens
gggcauuuguaguagucua

SEQ ID NO: 1505128 - RNA, 19 nt, Homo sapiens
ggauuugauugggcauuug

SEQ ID NO: 1505129 - RNA, 19 nt, Homo sapiens
gugaggaggccuucaugaa

SEQ ID NO: 1505130 - RNA, 19 nt, Homo sapiens
acagaauccugccauaugg

SEQ ID NO: 1505131 - RNA, 19 nt, Homo sapiens
cuagggccauucuuauuuc

SEQ ID NO: 1505132 - RNA, 19 nt, Homo sapiens
uaacacacucaugucuuua

SEQ ID NO: 1505133 - RNA, 19 nt, Homo sapiens
caaugcagcuauguuugga

SEQ ID NO: 1505134 - RNA, 19 nt, Homo sapiens
ugaagcagaucuccaagcu

SEQ ID NO: 1505135 - RNA, 19 nt, Homo sapiens
cuucaucaguucacagaga

SEQ ID NO: 1505136 - RNA, 19 nt, Homo sapiens
cauggacgccgaacucauc

SEQ ID NO: 1505137 - RNA, 19 nt, Homo sapiens
agagcgaguucgacugcuu

SEQ ID NO: 1505138 - RNA, 19 nt, Homo sapiens
gaaaggaucacaccauuua

SEQ ID NO: 1505139 - RNA, 19 nt, Homo sapiens
gaacuuaacucacaucaca

SEQ ID NO: 1505140 - RNA, 19 nt, Homo sapiens
gcaaaggccugccagauga

SEQ ID NO: 1505141 - RNA, 19 nt, Homo sapiens
ccagggaacugaugaauuu

SEQ ID NO: 1505142 - RNA, 19 nt, Homo sapiens
ccaaaggccugaagacaaa

SEQ ID NO: 1505143 - RNA, 19 nt, Homo sapiens
gugcuuggcuccuuguuua

SEQ ID NO: 1505144 - RNA, 19 nt, Homo sapiens
agaagaagcugaugaagga

SEQ ID NO: 1505145 - RNA, 19 nt, Homo sapiens
ugacaucucugcuguuuau

SEQ ID NO: 1505146 - RNA, 19 nt, Homo sapiens
aaagcgaccuugagacaua

SEQ ID NO: 1505147 - RNA, 19 nt, Homo sapiens
ggacguaguugacacuugu

SEQ ID NO: 1505148 - RNA, 19 nt, Homo sapiens
gggaaaggaucacaccauu

SEQ ID NO: 1505149 - RNA, 19 nt, Homo sapiens
uagaagaacuuaacucaca

SEQ ID NO: 1505150 - RNA, 19 nt, Homo sapiens
gccuagaagucaucaauuu

SEQ ID NO: 1505151 - RNA, 19 nt, Homo sapiens
caagagcuuuguagaagaa

SEQ ID NO: 1505152 - RNA, 19 nt, Homo sapiens
ggagcaagccacugccuua

SEQ ID NO: 1505153 - RNA, 19 nt, Homo sapiens
gaaagugcccuccaacugu

SEQ ID NO: 1505154 - RNA, 19 nt, Homo sapiens
gcaagaagaagcugaugaa

SEQ ID NO: 1505155 - RNA, 19 nt, Homo sapiens
gcaagccacugccuuaugg

SEQ ID NO: 1505156 - RNA, 19 nt, Homo sapiens
acaccaagcuggaggagaa

SEQ ID NO: 1505157 - RNA, 19 nt, Homo sapiens
ggacuuacagcuccaaaga

SEQ ID NO: 1505158 - RNA, 19 nt, Homo sapiens
ggaagaaguucagcaccuu

SEQ ID NO: 1505159 - RNA, 19 nt, Homo sapiens
ggacagguaucuuuuguug

SEQ ID NO: 1505160 - RNA, 19 nt, Homo sapiens
gaagggaugggacguaguu

SEQ ID NO: 1505161 - RNA, 19 nt, Homo sapiens
gagagcagauggacugaag

SEQ ID NO: 1505162 - RNA, 19 nt, Homo sapiens
ggaaaggaucacaccauuu

SEQ ID NO: 1505163 - RNA, 19 nt, Homo sapiens
ggaaaggccuagaagucau

SEQ ID NO: 1505164 - RNA, 19 nt, Homo sapiens
ggaaagugcccuccaacug

SEQ ID NO: 1505165 - RNA, 19 nt, Homo sapiens
uaacucacaucacaauaag

SEQ ID NO: 1505166 - RNA, 19 nt, Homo sapiens
caacucagccagugacaug

SEQ ID NO: 1505167 - RNA, 19 nt, Homo sapiens
gaucuccugugaagcagaa

SEQ ID NO: 1505168 - RNA, 19 nt, Homo sapiens
uagaacagcugcgggagaa

SEQ ID NO: 1505169 - RNA, 19 nt, Homo sapiens
gagaucaauuauccugaga

SEQ ID NO: 1505170 - RNA, 19 nt, Homo sapiens
auucagauccuacuccuua

SEQ ID NO: 1505171 - RNA, 19 nt, Homo sapiens
guaccaggccaucaugaaa

SEQ ID NO: 1505172 - RNA, 19 nt, Homo sapiens
ucaagagcuuuguagaaga

SEQ ID NO: 1505173 - RNA, 19 nt, Homo sapiens
gaucaauuauccugagaac

SEQ ID NO: 1505174 - RNA, 19 nt, Homo sapiens
gcacuacuccaugcagaaa

SEQ ID NO: 1505175 - RNA, 19 nt, Homo sapiens
caacuguggauuacaauuc

SEQ ID NO: 1505176 - RNA, 19 nt, Homo sapiens
ggaucacaccauuuacuaa

SEQ ID NO: 1505177 - RNA, 19 nt, Homo sapiens
ccuacaaccucaaagacuu

SEQ ID NO: 1505178 - RNA, 19 nt, Homo sapiens
gugcagagccacagguuug

SEQ ID NO: 1505179 - RNA, 19 nt, Homo sapiens
cuuggcuccuuguuuauua

SEQ ID NO: 1505180 - RNA, 19 nt, Homo sapiens
ucaauuauccugagaacuc

SEQ ID NO: 1505181 - RNA, 19 nt, Homo sapiens
ccacagguuugacaucucu

SEQ ID NO: 1505182 - RNA, 19 nt, Homo sapiens
gaauuucaagagcuuugua

SEQ ID NO: 1505183 - RNA, 19 nt, Homo sapiens
gaaccaacagggaaaggau

SEQ ID NO: 1505184 - RNA, 19 nt, Homo sapiens
gggacccuuucuauucuaa

SEQ ID NO: 1505185 - RNA, 19 nt, Homo sapiens
gauuacaauucagauccua

SEQ ID NO: 1505186 - RNA, 19 nt, Homo sapiens
gaucacaccauuuacuaag

SEQ ID NO: 1505187 - RNA, 19 nt, Homo sapiens
cuacagagaggauuuacug

SEQ ID NO: 1505188 - RNA, 19 nt, Homo sapiens
gaaggacagccugcaguga

SEQ ID NO: 1505189 - RNA, 19 nt, Homo sapiens
acuuacagcuccaaagaga

SEQ ID NO: 1505190 - RNA, 19 nt, Homo sapiens
ccagagugcuuggcuccuu

SEQ ID NO: 1505191 - RNA, 19 nt, Homo sapiens
uuugacaucucugcuguuu

SEQ ID NO: 1505192 - RNA, 19 nt, Homo sapiens
gggacguaguugacacuug

SEQ ID NO: 1505193 - RNA, 19 nt, Homo sapiens
gaaaggccuagaagucauc

SEQ ID NO: 1505194 - RNA, 19 nt, Homo sapiens
cacaagagaagaaaugcaa

SEQ ID NO: 1505195 - RNA, 19 nt, Homo sapiens
guuucuggcuuccacaaga

SEQ ID NO: 1505196 - RNA, 19 nt, Homo sapiens
gaaaugcaaacccgucaac

SEQ ID NO: 1505197 - RNA, 19 nt, Homo sapiens
aagagaagcggcugaagga

SEQ ID NO: 1505198 - RNA, 19 nt, Homo sapiens
uaucccaacuggaagaagu

SEQ ID NO: 1505199 - RNA, 19 nt, Homo sapiens
gugggacccuuucuauucu

SEQ ID NO: 1505200 - RNA, 19 nt, Homo sapiens
ggacaggcggcagcgauau

SEQ ID NO: 1505201 - RNA, 19 nt, Homo sapiens
acauaggcccugggacuua

SEQ ID NO: 1505202 - RNA, 19 nt, Homo sapiens
acucacaucacaauaagaa

SEQ ID NO: 1505203 - RNA, 19 nt, Homo sapiens
gcuccuacaaccucaaaga

SEQ ID NO: 1505204 - RNA, 19 nt, Homo sapiens
ugugggacccuuucuauuc

SEQ ID NO: 1505205 - RNA, 19 nt, Homo sapiens
uaaagccacaugcgaagga

SEQ ID NO: 1505206 - RNA, 19 nt, Homo sapiens
gaagaacuuaacucacauc

SEQ ID NO: 1505207 - RNA, 19 nt, Homo sapiens
gagcaagccacugccuuau

SEQ ID NO: 1505208 - RNA, 19 nt, Homo sapiens
gcaccuacuucuucaaaag

SEQ ID NO: 1505209 - RNA, 19 nt, Homo sapiens
gaacagcugcgggagaaac

SEQ ID NO: 1505210 - RNA, 19 nt, Homo sapiens
uguugcaggagaucaauua

SEQ ID NO: 1505211 - RNA, 19 nt, Homo sapiens
uguagaagaacuuaacuca

SEQ ID NO: 1505212 - RNA, 19 nt, Homo sapiens
uucaagagcuuuguagaag

SEQ ID NO: 1505213 - RNA, 19 nt, Homo sapiens
cgauaucgaucccuauucc

SEQ ID NO: 1505214 - RNA, 19 nt, Homo sapiens
cccaaaggccugaagacaa

SEQ ID NO: 1505215 - RNA, 19 nt, Homo sapiens
ugaaagagaagcggcugaa

SEQ ID NO: 1505216 - RNA, 19 nt, Homo sapiens
gccuggaaccggucucauu

SEQ ID NO: 1505217 - RNA, 19 nt, Homo sapiens
ggaguggggugucuuagag

SEQ ID NO: 1505218 - RNA, 19 nt, Homo sapiens
aaaucaggcuguuuuguug

SEQ ID NO: 1505219 - RNA, 19 nt, Homo sapiens
agaagaacuuaacucacau

SEQ ID NO: 1505220 - RNA, 19 nt, Homo sapiens
gagcuuuguagaagaacuu

SEQ ID NO: 1505221 - RNA, 19 nt, Homo sapiens
ggccuagaagucaucaauu

SEQ ID NO: 1505222 - RNA, 19 nt, Homo sapiens
uggaaaggccuagaaguca

SEQ ID NO: 1505223 - RNA, 19 nt, Homo sapiens
caagagaagaaaugcaaac

SEQ ID NO: 1505224 - RNA, 19 nt, Homo sapiens
uuucaagagcuuuguagaa

SEQ ID NO: 1505225 - RNA, 19 nt, Homo sapiens
gaaagagaagcggcugaag

SEQ ID NO: 1505226 - RNA, 19 nt, Homo sapiens
gcguuauucuacccaagug

SEQ ID NO: 1505227 - RNA, 19 nt, Homo sapiens
ugcaggagaucaauuaucc

SEQ ID NO: 1505228 - RNA, 19 nt, Homo sapiens
ggacagcuggggacaggua

SEQ ID NO: 1505229 - RNA, 19 nt, Homo sapiens
ucagauccuacuccuuaaa

SEQ ID NO: 1505230 - RNA, 19 nt, Homo sapiens
ugcaaaggccugccagaug

SEQ ID NO: 1505231 - RNA, 19 nt, Homo sapiens
caaaagcgaccuugagaca

SEQ ID NO: 1505232 - RNA, 19 nt, Homo sapiens
cggcaccuacuucuucaaa

SEQ ID NO: 1505233 - RNA, 19 nt, Homo sapiens
ccaaagagaccugcuucag

SEQ ID NO: 1505234 - RNA, 19 nt, Homo sapiens
gcccaaaggccugaagaca

SEQ ID NO: 1505235 - RNA, 19 nt, Homo sapiens
aggaucacaccauuuacua

SEQ ID NO: 1505236 - RNA, 19 nt, Homo sapiens
accaggccaucaugaaaga

SEQ ID NO: 1505237 - RNA, 19 nt, Homo sapiens
gcuuggcuccuuguuuauu

SEQ ID NO: 1505238 - RNA, 19 nt, Homo sapiens
caccuuggcuucuucuaua

SEQ ID NO: 1505239 - RNA, 19 nt, Homo sapiens
gauggaaccuucucuucuu

SEQ ID NO: 1505240 - RNA, 19 nt, Homo sapiens
gaaagugucugggcuucuu

SEQ ID NO: 1505241 - RNA, 19 nt, Homo sapiens
auaugugccucauguaaua

SEQ ID NO: 1505242 - RNA, 19 nt, Homo sapiens
auaaauaugugccucaugu

SEQ ID NO: 1505243 - RNA, 19 nt, Homo sapiens
ggaagcauuguaaggauuu

SEQ ID NO: 1505244 - RNA, 19 nt, Homo sapiens
gauguaaggaagcauugua

SEQ ID NO: 1505245 - RNA, 19 nt, Homo sapiens
gaagcaaugcccaccgaaa

SEQ ID NO: 1505246 - RNA, 19 nt, Homo sapiens
ccuguuaaaugucaagaga

SEQ ID NO: 1505247 - RNA, 19 nt, Homo sapiens
aaauaugugccucauguaa

SEQ ID NO: 1505248 - RNA, 19 nt, Homo sapiens
gcacaguuucugccucauu

SEQ ID NO: 1505249 - RNA, 19 nt, Homo sapiens
aaggauggacuggauauua

SEQ ID NO: 1505250 - RNA, 19 nt, Homo sapiens
aaacagaaguaaggaugga

SEQ ID NO: 1505251 - RNA, 19 nt, Homo sapiens
uaaggaagcauuguaagga

SEQ ID NO: 1505252 - RNA, 19 nt, Homo sapiens
agagacaugugcacccaaa

SEQ ID NO: 1505253 - RNA, 19 nt, Homo sapiens
cagcuaaggcccauccauu

SEQ ID NO: 1505254 - RNA, 19 nt, Homo sapiens
caagauguaaggaagcauu

SEQ ID NO: 1505255 - RNA, 19 nt, Homo sapiens
gcuaaggcccauccauuuc

SEQ ID NO: 1505256 - RNA, 19 nt, Homo sapiens
guaaggauggacuggauau

SEQ ID NO: 1505257 - RNA, 19 nt, Homo sapiens
gaaaggcaccaucauucca

SEQ ID NO: 1505258 - RNA, 19 nt, Homo sapiens
gcccauccauuucccaaag

SEQ ID NO: 1505259 - RNA, 19 nt, Homo sapiens
uaaauaugugccucaugua

SEQ ID NO: 1505260 - RNA, 19 nt, Homo sapiens
guuccacccugacaaguag

SEQ ID NO: 1505261 - RNA, 19 nt, Homo sapiens
guaauaaaugugucugcuu

SEQ ID NO: 1505262 - RNA, 19 nt, Homo sapiens
ggacuggauauuaccauca

SEQ ID NO: 1505263 - RNA, 19 nt, Homo sapiens
caauaaauaugugccucau

SEQ ID NO: 1505264 - RNA, 19 nt, Homo sapiens
cacaguuucugccucauuc

SEQ ID NO: 1505265 - RNA, 19 nt, Homo sapiens
ccgaaaggcaccaucauuc

SEQ ID NO: 1505266 - RNA, 19 nt, Homo sapiens
guaaggaagcauuguaagg

SEQ ID NO: 1505267 - RNA, 19 nt, Homo sapiens
uggcucaccuguuccuaga

SEQ ID NO: 1505268 - RNA, 19 nt, Homo sapiens
agaggcuggugcacaguuu

SEQ ID NO: 1505269 - RNA, 19 nt, Homo sapiens
gguuccacccugacaagua

SEQ ID NO: 1505270 - RNA, 19 nt, Homo sapiens
gacuggauauuaccaucau

SEQ ID NO: 1505271 - RNA, 19 nt, Homo sapiens
gggcuucucuccuguuuuc

SEQ ID NO: 1505272 - RNA, 19 nt, Homo sapiens
gaagcauuguaaggauuuc

SEQ ID NO: 1505273 - RNA, 19 nt, Homo sapiens
aggaagcauuguaaggauu

SEQ ID NO: 1505274 - RNA, 19 nt, Homo sapiens
aaggaagcauuguaaggau

SEQ ID NO: 1505275 - RNA, 19 nt, Homo sapiens
ccucuucccuccagcucuu

SEQ ID NO: 1505276 - RNA, 19 nt, Homo sapiens
aggauggacuggauauuac

SEQ ID NO: 1505277 - RNA, 19 nt, Homo sapiens
ccaccuuggcuucuucuau

SEQ ID NO: 1505278 - RNA, 19 nt, Homo sapiens
cagauggaaccuucucuuc

SEQ ID NO: 1505279 - RNA, 19 nt, Homo sapiens
gccucuggcucaccuguuc

SEQ ID NO: 1505280 - RNA, 19 nt, Homo sapiens
cauaccaccuuggcuucuu

SEQ ID NO: 1505281 - RNA, 19 nt, Homo sapiens
gaaccuucucuucuuccuu

SEQ ID NO: 1505282 - RNA, 19 nt, Homo sapiens
aaguaaggauggacuggau

SEQ ID NO: 1505283 - RNA, 19 nt, Homo sapiens
ccucauguaauaaaugugu

SEQ ID NO: 1505284 - RNA, 19 nt, Homo sapiens
ugccucauguaauaaaugu

SEQ ID NO: 1505285 - RNA, 19 nt, Homo sapiens
caucuccuccugcccaaga

SEQ ID NO: 1505286 - RNA, 19 nt, Homo sapiens
ccagauggaaccuucucuu

SEQ ID NO: 1505287 - RNA, 19 nt, Homo sapiens
ccaccgaaaggcaccauca

SEQ ID NO: 1505288 - RNA, 19 nt, Homo sapiens
gcccagcagcagcaaguga

SEQ ID NO: 1505289 - RNA, 19 nt, Homo sapiens
aauaugugccucauguaau

SEQ ID NO: 1505290 - RNA, 19 nt, Homo sapiens
gcauuguaaggauuucuuc

SEQ ID NO: 1505291 - RNA, 19 nt, Homo sapiens
ggaaagaguugcugaggua

SEQ ID NO: 1505292 - RNA, 19 nt, Homo sapiens
guaaagaacccauagaaga

SEQ ID NO: 1505293 - RNA, 19 nt, Homo sapiens
gcauggagcuguuuauagu

SEQ ID NO: 1505294 - RNA, 19 nt, Homo sapiens
gcucaaaugugaacugaug

SEQ ID NO: 1505295 - RNA, 19 nt, Homo sapiens
uggagaagcucaaauguga

SEQ ID NO: 1505296 - RNA, 19 nt, Homo sapiens
gaauaaggauaaagagaca

SEQ ID NO: 1505297 - RNA, 19 nt, Homo sapiens
gcaauggccuacuaaaucu

SEQ ID NO: 1505298 - RNA, 19 nt, Homo sapiens
gcugauuccuauuuguuua

SEQ ID NO: 1505299 - RNA, 19 nt, Homo sapiens
caagaugguuucagcagaa

SEQ ID NO: 1505300 - RNA, 19 nt, Homo sapiens
ggaaacgcaguuauugaua

SEQ ID NO: 1505301 - RNA, 19 nt, Homo sapiens
gaagacaaccaaucgagaa

SEQ ID NO: 1505302 - RNA, 19 nt, Homo sapiens
gggcuggacugaauaagga

SEQ ID NO: 1505303 - RNA, 19 nt, Homo sapiens
gaauacagaccauggauca

SEQ ID NO: 1505304 - RNA, 19 nt, Homo sapiens
gcaccaagcacuucaggaa

SEQ ID NO: 1505305 - RNA, 19 nt, Homo sapiens
aaacggcaauggccuacua

SEQ ID NO: 1505306 - RNA, 19 nt, Homo sapiens
gcaaauugacccggcuuua

SEQ ID NO: 1505307 - RNA, 19 nt, Homo sapiens
gaagaaggcagagaguaaa

SEQ ID NO: 1505308 - RNA, 19 nt, Homo sapiens
ucagaggacuggcaaagga

SEQ ID NO: 1505309 - RNA, 19 nt, Homo sapiens
ggauaaagagacagaagaa

SEQ ID NO: 1505310 - RNA, 19 nt, Homo sapiens
ccaaagagcacauggaaag

SEQ ID NO: 1505311 - RNA, 19 nt, Homo sapiens
gaguaaagaacccauagaa

SEQ ID NO: 1505312 - RNA, 19 nt, Homo sapiens
gaagagacccaggagaaga

SEQ ID NO: 1505313 - RNA, 19 nt, Homo sapiens
cagcagaaaucagugagaa

SEQ ID NO: 1505314 - RNA, 19 nt, Homo sapiens
gaaggcagagaguaaagaa

SEQ ID NO: 1505315 - RNA, 19 nt, Homo sapiens
gaagaagcaccaagcacuu

SEQ ID NO: 1505316 - RNA, 19 nt, Homo sapiens
cagaagagacccaggagaa

SEQ ID NO: 1505317 - RNA, 19 nt, Homo sapiens
gguagcaccugaagaaagg

SEQ ID NO: 1505318 - RNA, 19 nt, Homo sapiens
ggaaagaggagaugcuucu

SEQ ID NO: 1505319 - RNA, 19 nt, Homo sapiens
ggcaauggccuacuaaauc

SEQ ID NO: 1505320 - RNA, 19 nt, Homo sapiens
agaagaaggcagagaguaa

SEQ ID NO: 1505321 - RNA, 19 nt, Homo sapiens
caguauuccuguugauauu

SEQ ID NO: 1505322 - RNA, 19 nt, Homo sapiens
gagaagaaggcagagagua

SEQ ID NO: 1505323 - RNA, 19 nt, Homo sapiens
gaaggguccaacucugaua

SEQ ID NO: 1505324 - RNA, 19 nt, Homo sapiens
cagcagcagugccaugaga

SEQ ID NO: 1505325 - RNA, 19 nt, Homo sapiens
gagcugauuccuauuuguu

SEQ ID NO: 1505326 - RNA, 19 nt, Homo sapiens
gaccauggaucaccagaac

SEQ ID NO: 1505327 - RNA, 19 nt, Homo sapiens
cgagaguagugaauacaga

SEQ ID NO: 1505328 - RNA, 19 nt, Homo sapiens
caaauugacccggcuuuau

SEQ ID NO: 1505329 - RNA, 19 nt, Homo sapiens
guggaaaacuucuuuguga

SEQ ID NO: 1505330 - RNA, 19 nt, Homo sapiens
aaauugacccggcuuuauu

SEQ ID NO: 1505331 - RNA, 19 nt, Homo sapiens
aaagcaggaugguuacaga

SEQ ID NO: 1505332 - RNA, 19 nt, Homo sapiens
gcagaaaucagugagaauc

SEQ ID NO: 1505333 - RNA, 19 nt, Homo sapiens
uguggacucuugaccagua

SEQ ID NO: 1505334 - RNA, 19 nt, Homo sapiens
uaaagaacccauagaagag

SEQ ID NO: 1505335 - RNA, 19 nt, Homo sapiens
uagcaauggugucgagaug

SEQ ID NO: 1505336 - RNA, 19 nt, Homo sapiens
ugaccaguauuccuguuga

SEQ ID NO: 1505337 - RNA, 19 nt, Homo sapiens
uuuacaaccugcauaaugu

SEQ ID NO: 1505338 - RNA, 19 nt, Homo sapiens
gauaaagagacagaagaaa

SEQ ID NO: 1505339 - RNA, 19 nt, Homo sapiens
gcaggaugguuacagaaac

SEQ ID NO: 1505340 - RNA, 19 nt, Homo sapiens
guucagaugaugacaguga

SEQ ID NO: 1505341 - RNA, 19 nt, Homo sapiens
cagagcugauuccuauuug

SEQ ID NO: 1505342 - RNA, 19 nt, Homo sapiens
caggaaagccagccaggaa

SEQ ID NO: 1505343 - RNA, 19 nt, Homo sapiens
ugcauaauguggacucuug

SEQ ID NO: 1505344 - RNA, 19 nt, Homo sapiens
ccaggaaacgcaguuauug

SEQ ID NO: 1505345 - RNA, 19 nt, Homo sapiens
gcacuucaggaauggguuu

SEQ ID NO: 1505346 - RNA, 19 nt, Homo sapiens
ccauuuacaaccugcauaa

SEQ ID NO: 1505347 - RNA, 19 nt, Homo sapiens
uggcaaaggagcaaauuga

SEQ ID NO: 1505348 - RNA, 19 nt, Homo sapiens
ggaggcauauuuuagaaga

SEQ ID NO: 1505349 - RNA, 19 nt, Homo sapiens
gccaggaaacgcaguuauu

SEQ ID NO: 1505350 - RNA, 19 nt, Homo sapiens
gcacugccaagaucagaau

SEQ ID NO: 1505351 - RNA, 19 nt, Homo sapiens
uauagugucuaccauuuac

SEQ ID NO: 1505352 - RNA, 19 nt, Homo sapiens
gauggcccuuggacugaaa

SEQ ID NO: 1505353 - RNA, 19 nt, Homo sapiens
ccaguauuccuguugauau

SEQ ID NO: 1505354 - RNA, 19 nt, Homo sapiens
caggaaacgcaguuauuga

SEQ ID NO: 1505355 - RNA, 19 nt, Homo sapiens
ggaaaacuucuuugugaaa

SEQ ID NO: 1505356 - RNA, 19 nt, Homo sapiens
caggaugguuacagaaaca

SEQ ID NO: 1505357 - RNA, 19 nt, Homo sapiens
auggaaagcaggaugguua

SEQ ID NO: 1505358 - RNA, 19 nt, Homo sapiens
cuacuaaaucucaaacaga

SEQ ID NO: 1505359 - RNA, 19 nt, Homo sapiens
uaaagagacagaagaaagg

SEQ ID NO: 1505360 - RNA, 19 nt, Homo sapiens
auggagcuguuuauaguuu

SEQ ID NO: 1505361 - RNA, 19 nt, Homo sapiens
gggcgagaguagugaauac

SEQ ID NO: 1505362 - RNA, 19 nt, Homo sapiens
gagaguaaagaacccauag

SEQ ID NO: 1505363 - RNA, 19 nt, Homo sapiens
accaagcacuucaggaaug

SEQ ID NO: 1505364 - RNA, 19 nt, Homo sapiens
aagcucaaaugugaacuga

SEQ ID NO: 1505365 - RNA, 19 nt, Homo sapiens
gacugaauaaggauaaaga

SEQ ID NO: 1505366 - RNA, 19 nt, Homo sapiens
ggagaagaaggcagagagu

SEQ ID NO: 1505367 - RNA, 19 nt, Homo sapiens
gaugguuacagaaacagaa

SEQ ID NO: 1505368 - RNA, 19 nt, Homo sapiens
ccauggaucaccagaacaa

SEQ ID NO: 1505369 - RNA, 19 nt, Homo sapiens
gacaaccaaucgagaagcu

SEQ ID NO: 1505370 - RNA, 19 nt, Homo sapiens
gaccaguauuccuguugau

SEQ ID NO: 1505371 - RNA, 19 nt, Homo sapiens
ggagaagcucaaaugugaa

SEQ ID NO: 1505372 - RNA, 19 nt, Homo sapiens
gagaaucggaaacggcaau

SEQ ID NO: 1505373 - RNA, 19 nt, Homo sapiens
gaagcucaaaugugaacug

SEQ ID NO: 1505374 - RNA, 19 nt, Homo sapiens
ggaaagccagccaggaaac

SEQ ID NO: 1505375 - RNA, 19 nt, Homo sapiens
auaaagagacagaagaaag

SEQ ID NO: 1505376 - RNA, 19 nt, Homo sapiens
gaaagcaggaugguuacag

SEQ ID NO: 1505377 - RNA, 19 nt, Homo sapiens
gagaagcucaaaugugaac

SEQ ID NO: 1505378 - RNA, 19 nt, Homo sapiens
gcagcagugccaugagaug

SEQ ID NO: 1505379 - RNA, 19 nt, Homo sapiens
ggacucuugaccaguauuc

SEQ ID NO: 1505380 - RNA, 19 nt, Homo sapiens
ggagcuguuuauaguuugg

SEQ ID NO: 1505381 - RNA, 19 nt, Homo sapiens
aaacuucuuugugaaaugc

SEQ ID NO: 1505382 - RNA, 19 nt, Homo sapiens
ccaagcacuucaggaaugg

SEQ ID NO: 1505383 - RNA, 19 nt, Homo sapiens
ccuacuaaaucucaaacag

SEQ ID NO: 1505384 - RNA, 19 nt, Homo sapiens
gcauaauguggacucuuga

SEQ ID NO: 1505385 - RNA, 19 nt, Homo sapiens
gauuccguccucaaaggua

SEQ ID NO: 1505386 - RNA, 19 nt, Homo sapiens
ucagagggcgagaguagug

SEQ ID NO: 1505387 - RNA, 19 nt, Homo sapiens
ugaugacagugaagaagca

SEQ ID NO: 1505388 - RNA, 19 nt, Homo sapiens
uaguucagaugaugacagu

SEQ ID NO: 1505389 - RNA, 19 nt, Homo sapiens
gaggagccagugcgggaaa

SEQ ID NO: 1505390 - RNA, 19 nt, Homo sapiens
cggcaauggccuacuaaau

SEQ ID NO: 1505391 - RNA, 19 nt, Homo sapiens
gcaauaaguuuguguguaa

SEQ ID NO: 1505392 - RNA, 19 nt, Homo sapiens
gaaccagaaugcaaacuua

SEQ ID NO: 1505393 - RNA, 19 nt, Homo sapiens
ugaagaagcugcugaagua

SEQ ID NO: 1505394 - RNA, 19 nt, Homo sapiens
gaggaacucuguuagaaua

SEQ ID NO: 1505395 - RNA, 19 nt, Homo sapiens
gaagaggaaugauacugua

SEQ ID NO: 1505396 - RNA, 19 nt, Homo sapiens
ggauuggucuccauauuaa

SEQ ID NO: 1505397 - RNA, 19 nt, Homo sapiens
gcgauacuccuacauauua

SEQ ID NO: 1505398 - RNA, 19 nt, Homo sapiens
ggaguuaccuuaugguuuc

SEQ ID NO: 1505399 - RNA, 19 nt, Homo sapiens
caucagaaauagcaacuuu

SEQ ID NO: 1505400 - RNA, 19 nt, Homo sapiens
gaagaagcauccuauaguc

SEQ ID NO: 1505401 - RNA, 19 nt, Homo sapiens
uggaaggucuuuaauguaa

SEQ ID NO: 1505402 - RNA, 19 nt, Homo sapiens
gaaauucauucagcuagaa

SEQ ID NO: 1505403 - RNA, 19 nt, Homo sapiens
gcaaauagaaccacaagau

SEQ ID NO: 1505404 - RNA, 19 nt, Homo sapiens
gaaaugcuccacgcaguua

SEQ ID NO: 1505405 - RNA, 19 nt, Homo sapiens
gaaccaaggacaucagaaa

SEQ ID NO: 1505406 - RNA, 19 nt, Homo sapiens
ggaauggucuuuggagaga

SEQ ID NO: 1505407 - RNA, 19 nt, Homo sapiens
caaagaaacagaagacuau

SEQ ID NO: 1505408 - RNA, 19 nt, Homo sapiens
gagcaggacagucucaaua

SEQ ID NO: 1505409 - RNA, 19 nt, Homo sapiens
ggcaaacgcuuacaccuau

SEQ ID NO: 1505410 - RNA, 19 nt, Homo sapiens
agagugagauuccaagaaa

SEQ ID NO: 1505411 - RNA, 19 nt, Homo sapiens
gcaaauacccaacaucaca

SEQ ID NO: 1505412 - RNA, 19 nt, Homo sapiens
gaacuccguuugccacuuc

SEQ ID NO: 1505413 - RNA, 19 nt, Homo sapiens
cauggaaggucuuuaaugu

SEQ ID NO: 1505414 - RNA, 19 nt, Homo sapiens
caggagauauugcaccuuu

SEQ ID NO: 1505415 - RNA, 19 nt, Homo sapiens
caagaucucucuccugaag

SEQ ID NO: 1505416 - RNA, 19 nt, Homo sapiens
gaagauaccaccaggacuu

SEQ ID NO: 1505417 - RNA, 19 nt, Homo sapiens
gacauggagucaccuguuu

SEQ ID NO: 1505418 - RNA, 19 nt, Homo sapiens
aagauucccuuuccuauga

SEQ ID NO: 1505419 - RNA, 19 nt, Homo sapiens
ggagauauugcaccuuuaa

SEQ ID NO: 1505420 - RNA, 19 nt, Homo sapiens
ccuauuauguucugagauu

SEQ ID NO: 1505421 - RNA, 19 nt, Homo sapiens
gcaaauaucaaucuaagca

SEQ ID NO: 1505422 - RNA, 19 nt, Homo sapiens
gaggugaaguugagcaguu

SEQ ID NO: 1505423 - RNA, 19 nt, Homo sapiens
ccaaagagucagagaguaa

SEQ ID NO: 1505424 - RNA, 19 nt, Homo sapiens
ucacauaugcuguugauga

SEQ ID NO: 1505425 - RNA, 19 nt, Homo sapiens
gcaguuaacauaagcaaau

SEQ ID NO: 1505426 - RNA, 19 nt, Homo sapiens
ggagagagcauauccaucu

SEQ ID NO: 1505427 - RNA, 19 nt, Homo sapiens
agacagagccguugauuuc

SEQ ID NO: 1505428 - RNA, 19 nt, Homo sapiens
gcaggacagucucaauaau

SEQ ID NO: 1505429 - RNA, 19 nt, Homo sapiens
ggacuucuauuacacuaag

SEQ ID NO: 1505430 - RNA, 19 nt, Homo sapiens
cuagaacgauuguaucaug

SEQ ID NO: 1505431 - RNA, 19 nt, Homo sapiens
cauaugcuguugaugauga

SEQ ID NO: 1505432 - RNA, 19 nt, Homo sapiens
ggaucaagaugaaguugga

SEQ ID NO: 1505433 - RNA, 19 nt, Homo sapiens
gcaaaucuuucugccauuc

SEQ ID NO: 1505434 - RNA, 19 nt, Homo sapiens
ccaaggacaucagaaauag

SEQ ID NO: 1505435 - RNA, 19 nt, Homo sapiens
guacugacuuugcagacaa

SEQ ID NO: 1505436 - RNA, 19 nt, Homo sapiens
guugugggcuugauuuaga

SEQ ID NO: 1505437 - RNA, 19 nt, Homo sapiens
cuugggagcuguguaauuu

SEQ ID NO: 1505438 - RNA, 19 nt, Homo sapiens
caacauggacuucuauuac

SEQ ID NO: 1505439 - RNA, 19 nt, Homo sapiens
ggaggaggacuacgagaaa

SEQ ID NO: 1505440 - RNA, 19 nt, Homo sapiens
guacuuugcugagugaaau

SEQ ID NO: 1505441 - RNA, 19 nt, Homo sapiens
gaaugauacuguaggagau

SEQ ID NO: 1505442 - RNA, 19 nt, Homo sapiens
gcacagagucaaguaaaga

SEQ ID NO: 1505443 - RNA, 19 nt, Homo sapiens
caggacagucucaauaaua

SEQ ID NO: 1505444 - RNA, 19 nt, Homo sapiens
uaacuugggagcuguguaa

SEQ ID NO: 1505445 - RNA, 19 nt, Homo sapiens
gaacucuguuagaauaauc

SEQ ID NO: 1505446 - RNA, 19 nt, Homo sapiens
gauagagauugcagagguu

SEQ ID NO: 1505447 - RNA, 19 nt, Homo sapiens
gaagauucccuuuccuaug

SEQ ID NO: 1505448 - RNA, 19 nt, Homo sapiens
aggacagucucaauaauaa

SEQ ID NO: 1505449 - RNA, 19 nt, Homo sapiens
augcaaagcuuccugaaau

SEQ ID NO: 1505450 - RNA, 19 nt, Homo sapiens
uaacuugauuagccagaaa

SEQ ID NO: 1505451 - RNA, 19 nt, Homo sapiens
gcgggagacuuucuaaaca

SEQ ID NO: 1505452 - RNA, 19 nt, Homo sapiens
gauagcagcuguggagaag

SEQ ID NO: 1505453 - RNA, 19 nt, Homo sapiens
caaacgcuuacaccuauua

SEQ ID NO: 1505454 - RNA, 19 nt, Homo sapiens
ggaucuaccucuccuagca

SEQ ID NO: 1505455 - RNA, 19 nt, Homo sapiens
ccguauaccuccugcauug

SEQ ID NO: 1505456 - RNA, 19 nt, Homo sapiens
caagaacagugggaaacaa

SEQ ID NO: 1505457 - RNA, 19 nt, Homo sapiens
gcaaacgcuuacaccuauu

SEQ ID NO: 1505458 - RNA, 19 nt, Homo sapiens
cagugucauucuuuaguua

SEQ ID NO: 1505459 - RNA, 19 nt, Homo sapiens
cggaggaacucuguuagaa

SEQ ID NO: 1505460 - RNA, 19 nt, Homo sapiens
cagacaacauggacuucua

SEQ ID NO: 1505461 - RNA, 19 nt, Homo sapiens
gaggaaugauacuguagga

SEQ ID NO: 1505462 - RNA, 19 nt, Homo sapiens
caaaggaugcucuaaugga

SEQ ID NO: 1505463 - RNA, 19 nt, Homo sapiens
gcagcagccugaucuuaca

SEQ ID NO: 1505464 - RNA, 19 nt, Homo sapiens
gaggaaagaacuccguuug

SEQ ID NO: 1505465 - RNA, 19 nt, Homo sapiens
ugaagacccuaagguguuu

SEQ ID NO: 1505466 - RNA, 19 nt, Homo sapiens
aaucauaccuuccauagac

SEQ ID NO: 1505467 - RNA, 19 nt, Homo sapiens
caaauagaaccacaagaug

SEQ ID NO: 1505468 - RNA, 19 nt, Homo sapiens
gaauaaaccaguacuuugc

SEQ ID NO: 1505469 - RNA, 19 nt, Homo sapiens
ggaacucuguuagaauaau

SEQ ID NO: 1505470 - RNA, 19 nt, Homo sapiens
uggaggaacugcauuauac

SEQ ID NO: 1505471 - RNA, 19 nt, Homo sapiens
aaugugcucuguggaaaua

SEQ ID NO: 1505472 - RNA, 19 nt, Homo sapiens
gagaaugugcucuguggaa

SEQ ID NO: 1505473 - RNA, 19 nt, Homo sapiens
gaaacaaaauggaaaacug

SEQ ID NO: 1505474 - RNA, 19 nt, Homo sapiens
ugaaguaaaugcuaaugag

SEQ ID NO: 1505475 - RNA, 19 nt, Homo sapiens
cagcgauacuccuacauau

SEQ ID NO: 1505476 - RNA, 19 nt, Homo sapiens
gcuuacaccuauuauguuc

SEQ ID NO: 1505477 - RNA, 19 nt, Homo sapiens
cagaccaacuugagaacaa

SEQ ID NO: 1505478 - RNA, 19 nt, Homo sapiens
guggagaagucccaggaaa

SEQ ID NO: 1505479 - RNA, 19 nt, Homo sapiens
guuuaaaucuguccguuag

SEQ ID NO: 1505480 - RNA, 19 nt, Homo sapiens
ucacaggccuagagaccaa

SEQ ID NO: 1505481 - RNA, 19 nt, Homo sapiens
agaauaauccacacaguga

SEQ ID NO: 1505482 - RNA, 19 nt, Homo sapiens
gagaucauccugcccaaau

SEQ ID NO: 1505483 - RNA, 19 nt, Homo sapiens
aaacuugucucggcacaga

SEQ ID NO: 1505484 - RNA, 19 nt, Homo sapiens
agaagcugcugaaguaaau

SEQ ID NO: 1505485 - RNA, 19 nt, Homo sapiens
guguaguggucuaacauuu

SEQ ID NO: 1505486 - RNA, 19 nt, Homo sapiens
ggucauagaaguugcuuuc

SEQ ID NO: 1505487 - RNA, 19 nt, Homo sapiens
gguacacugagcagaauua

SEQ ID NO: 1505488 - RNA, 19 nt, Homo sapiens
gaacugaagcacuggaucu

SEQ ID NO: 1505489 - RNA, 19 nt, Homo sapiens
ggagucaccuguuuguacu

SEQ ID NO: 1505490 - RNA, 19 nt, Homo sapiens
uaaagaagaggaaugauac

SEQ ID NO: 1505491 - RNA, 19 nt, Homo sapiens
gaacagggguuacugagaa

SEQ ID NO: 1505492 - RNA, 19 nt, Homo sapiens
gaucagaagguccagauga

SEQ ID NO: 1505493 - RNA, 19 nt, Homo sapiens
ucaaggaggccauuaagaa

SEQ ID NO: 1505494 - RNA, 19 nt, Homo sapiens
caagaaggcccagaggaua

SEQ ID NO: 1505495 - RNA, 19 nt, Homo sapiens
caaggaggccauuaagaaa

SEQ ID NO: 1505496 - RNA, 19 nt, Homo sapiens
cgaccagguugagucauua

SEQ ID NO: 1505497 - RNA, 19 nt, Homo sapiens
gcgaccagguugagucauu

SEQ ID NO: 1505498 - RNA, 19 nt, Homo sapiens
gaggaaaagugucacauug

SEQ ID NO: 1505499 - RNA, 19 nt, Homo sapiens
agaaggagauguggcaaug

SEQ ID NO: 1505500 - RNA, 19 nt, Homo sapiens
guggaagccugucgcaaga

SEQ ID NO: 1505501 - RNA, 19 nt, Homo sapiens
gcaucaaggaggccauuaa

SEQ ID NO: 1505502 - RNA, 19 nt, Homo sapiens
gggagaaggcccagaagga

SEQ ID NO: 1505503 - RNA, 19 nt, Homo sapiens
guggcaaugugauuccuuu

SEQ ID NO: 1505504 - RNA, 19 nt, Homo sapiens
caccacauccugaaacuga

SEQ ID NO: 1505505 - RNA, 19 nt, Homo sapiens
cccaacagcucccuugauc

SEQ ID NO: 1505506 - RNA, 19 nt, Homo sapiens
ugguggagcuggcggauga

SEQ ID NO: 1505507 - RNA, 19 nt, Homo sapiens
gaaggaggaagagcaguug

SEQ ID NO: 1505508 - RNA, 19 nt, Homo sapiens
gaagaugccuggggagaga

SEQ ID NO: 1505509 - RNA, 19 nt, Homo sapiens
gcaaugugauuccuuuugu

SEQ ID NO: 1505510 - RNA, 19 nt, Homo sapiens
ggagucacgugcacaagac

SEQ ID NO: 1505511 - RNA, 19 nt, Homo sapiens
gugcugacccgucucaaga

SEQ ID NO: 1505512 - RNA, 19 nt, Homo sapiens
gagauguggcaaugugauu

SEQ ID NO: 1505513 - RNA, 19 nt, Homo sapiens
caacagcucccuugaucag

SEQ ID NO: 1505514 - RNA, 19 nt, Homo sapiens
aaggagauguggcaaugug

SEQ ID NO: 1505515 - RNA, 19 nt, Homo sapiens
ucaagaaggcccagaggau

SEQ ID NO: 1505516 - RNA, 19 nt, Homo sapiens
gcccuuggccuccagcaaa

SEQ ID NO: 1505517 - RNA, 19 nt, Homo sapiens
ggaaaagugucacauugag

SEQ ID NO: 1505518 - RNA, 19 nt, Homo sapiens
gagaaggagcagcgcaaga

SEQ ID NO: 1505519 - RNA, 19 nt, Homo sapiens
ucaaccaccugagggagaa

SEQ ID NO: 1505520 - RNA, 19 nt, Homo sapiens
gaagaugcgcaaaagaauu

SEQ ID NO: 1505521 - RNA, 19 nt, Homo sapiens
gaaacugaaagccgagaag

SEQ ID NO: 1505522 - RNA, 19 nt, Homo sapiens
uugaucagaugguacuaga

SEQ ID NO: 1505523 - RNA, 19 nt, Homo sapiens
gaagcgcucggaucagaag

SEQ ID NO: 1505524 - RNA, 19 nt, Homo sapiens
ccacucggcagacaucuag

SEQ ID NO: 1505525 - RNA, 19 nt, Homo sapiens
ccucggagcggucuucugu

SEQ ID NO: 1505526 - RNA, 19 nt, Homo sapiens
caaggacgccuggcuuaca

SEQ ID NO: 1505527 - RNA, 19 nt, Homo sapiens
ccacauccugaaacugaaa

SEQ ID NO: 1505528 - RNA, 19 nt, Homo sapiens
caagaccacuagggacaag

SEQ ID NO: 1505529 - RNA, 19 nt, Homo sapiens
gccgaagccugagcgaugu

SEQ ID NO: 1505530 - RNA, 19 nt, Homo sapiens
ggagauguggcaaugugau

SEQ ID NO: 1505531 - RNA, 19 nt, Homo sapiens
ggagcuggcggaugagaag

SEQ ID NO: 1505532 - RNA, 19 nt, Homo sapiens
ugagggagaaggcccagaa

SEQ ID NO: 1505533 - RNA, 19 nt, Homo sapiens
gcugacccgucucaagaag

SEQ ID NO: 1505534 - RNA, 19 nt, Homo sapiens
caaugugauuccuuuugua

SEQ ID NO: 1505535 - RNA, 19 nt, Homo sapiens
acagcucccuugaucagau

SEQ ID NO: 1505536 - RNA, 19 nt, Homo sapiens
agacagcagcgaccagguu

SEQ ID NO: 1505537 - RNA, 19 nt, Homo sapiens
gagagagcgccucccaaca

SEQ ID NO: 1505538 - RNA, 19 nt, Homo sapiens
agggaaagacccaaacuuc

SEQ ID NO: 1505539 - RNA, 19 nt, Homo sapiens
caucaaggaggccauuaag

SEQ ID NO: 1505540 - RNA, 19 nt, Homo sapiens
ggaggaaaagugucacauu

SEQ ID NO: 1505541 - RNA, 19 nt, Homo sapiens
gaaagccgagaaggaggaa

SEQ ID NO: 1505542 - RNA, 19 nt, Homo sapiens
gcagcugucccuggaacaa

SEQ ID NO: 1505543 - RNA, 19 nt, Homo sapiens
gaagagcaagcuggaagag

SEQ ID NO: 1505544 - RNA, 19 nt, Homo sapiens
gaaggagauguggcaaugu

SEQ ID NO: 1505545 - RNA, 19 nt, Homo sapiens
cagcucccuugaucagaug

SEQ ID NO: 1505546 - RNA, 19 nt, Homo sapiens
agaaggaggaagagcaguu

SEQ ID NO: 1505547 - RNA, 19 nt, Homo sapiens
ccagcggucccaggagaua

SEQ ID NO: 1505548 - RNA, 19 nt, Homo sapiens
cccggaagguccucaugga

SEQ ID NO: 1505549 - RNA, 19 nt, Homo sapiens
cacccgcacuguucguuca

SEQ ID NO: 1505550 - RNA, 19 nt, Homo sapiens
gggaaagccgguggaagga

SEQ ID NO: 1505551 - RNA, 19 nt, Homo sapiens
aaaccaccacauccugaaa

SEQ ID NO: 1505552 - RNA, 19 nt, Homo sapiens
gcagaggaggcugguggaa

SEQ ID NO: 1505553 - RNA, 19 nt, Homo sapiens
ugaagagcaagcuggaaga

SEQ ID NO: 1505554 - RNA, 19 nt, Homo sapiens
gcagccagaaggagaugug

SEQ ID NO: 1505555 - RNA, 19 nt, Homo sapiens
ggaagaugcgcaaaagaau

SEQ ID NO: 1505556 - RNA, 19 nt, Homo sapiens
cagaggaacagaggaagau

SEQ ID NO: 1505557 - RNA, 19 nt, Homo sapiens
ucagaggaacagaggaaga

SEQ ID NO: 1505558 - RNA, 19 nt, Homo sapiens
cgggacagccagaggaaga

SEQ ID NO: 1505559 - RNA, 19 nt, Homo sapiens
gcacauucaggguagaaaa

SEQ ID NO: 1505560 - RNA, 19 nt, Homo sapiens
cgcaagaggcaccuacaug

SEQ ID NO: 1505561 - RNA, 19 nt, Homo sapiens
gcagagcaccgaaaacagu

SEQ ID NO: 1505562 - RNA, 19 nt, Homo sapiens
ggacaacccucacugauua

SEQ ID NO: 1505563 - RNA, 19 nt, Homo sapiens
gcaauaaggugccaugaaa

SEQ ID NO: 1505564 - RNA, 19 nt, Homo sapiens
gagcaaagauugaauuauc

SEQ ID NO: 1505565 - RNA, 19 nt, Homo sapiens
gcaggaagauugcgagaaa

SEQ ID NO: 1505566 - RNA, 19 nt, Homo sapiens
gcuaauugaucccauauuu

SEQ ID NO: 1505567 - RNA, 19 nt, Homo sapiens
uggcauuacugauaaguua

SEQ ID NO: 1505568 - RNA, 19 nt, Homo sapiens
caucaugccugccaacuga

SEQ ID NO: 1505569 - RNA, 19 nt, Homo sapiens
gcacucaucaggcuaauug

SEQ ID NO: 1505570 - RNA, 19 nt, Homo sapiens
gugaggaccugauagaguu

SEQ ID NO: 1505571 - RNA, 19 nt, Homo sapiens
ugacuaagaggcugcaaua

SEQ ID NO: 1505572 - RNA, 19 nt, Homo sapiens
gcaacagaaucaaacacaa

SEQ ID NO: 1505573 - RNA, 19 nt, Homo sapiens
ccaaagcucagcacaguuu

SEQ ID NO: 1505574 - RNA, 19 nt, Homo sapiens
gaaacuggaggcccaauau

SEQ ID NO: 1505575 - RNA, 19 nt, Homo sapiens
cuaagaggcugcaauaagg

SEQ ID NO: 1505576 - RNA, 19 nt, Homo sapiens
uauuuaaccucaaggagaa

SEQ ID NO: 1505577 - RNA, 19 nt, Homo sapiens
uuaaggaccuaccacauca

SEQ ID NO: 1505578 - RNA, 19 nt, Homo sapiens
gagacaagcagcacuguuc

SEQ ID NO: 1505579 - RNA, 19 nt, Homo sapiens
gcaauaaaggcuaaucuac

SEQ ID NO: 1505580 - RNA, 19 nt, Homo sapiens
aaacuguacucaccugugu

SEQ ID NO: 1505581 - RNA, 19 nt, Homo sapiens
gaaccuccacccugcauau

SEQ ID NO: 1505582 - RNA, 19 nt, Homo sapiens
uaaaggcuaaucuaccaua

SEQ ID NO: 1505583 - RNA, 19 nt, Homo sapiens
gcagaggacaugacagugu

SEQ ID NO: 1505584 - RNA, 19 nt, Homo sapiens
cacaagggcucagaaguca

SEQ ID NO: 1505585 - RNA, 19 nt, Homo sapiens
cagcaacccuuggccagaa

SEQ ID NO: 1505586 - RNA, 19 nt, Homo sapiens
gaauuauccuucuguucuc

SEQ ID NO: 1505587 - RNA, 19 nt, Homo sapiens
aauaaaggcuaaucuacca

SEQ ID NO: 1505588 - RNA, 19 nt, Homo sapiens
aaaggcuaaucuaccauaa

SEQ ID NO: 1505589 - RNA, 19 nt, Homo sapiens
cccaauaucuaaccugcaa

SEQ ID NO: 1505590 - RNA, 19 nt, Homo sapiens
caggcuaauugaucccaua

SEQ ID NO: 1505591 - RNA, 19 nt, Homo sapiens
ggaccuaccacaucaacau

SEQ ID NO: 1505592 - RNA, 19 nt, Homo sapiens
ggcaauaaaggcuaaucua

SEQ ID NO: 1505593 - RNA, 19 nt, Homo sapiens
ugaggcauauuuccuagau

SEQ ID NO: 1505594 - RNA, 19 nt, Homo sapiens
gaagauugcgagaaaggau

SEQ ID NO: 1505595 - RNA, 19 nt, Homo sapiens
uaucuaaccugcaaaucgu

SEQ ID NO: 1505596 - RNA, 19 nt, Homo sapiens
gcauauuuccuagaucauu

SEQ ID NO: 1505597 - RNA, 19 nt, Homo sapiens
aauauucacuuacgugucu

SEQ ID NO: 1505598 - RNA, 19 nt, Homo sapiens
ugaauuauccuucuguucu

SEQ ID NO: 1505599 - RNA, 19 nt, Homo sapiens
guccagggaugcugugugu

SEQ ID NO: 1505600 - RNA, 19 nt, Homo sapiens
caacagaaucaaacacaag

SEQ ID NO: 1505601 - RNA, 19 nt, Homo sapiens
gggauagucuguucaucag

SEQ ID NO: 1505602 - RNA, 19 nt, Homo sapiens
ccaagcagcguguucugaa

SEQ ID NO: 1505603 - RNA, 19 nt, Homo sapiens
aggcauauuuccuagauca

SEQ ID NO: 1505604 - RNA, 19 nt, Homo sapiens
cauaagaagagacaaucaa

SEQ ID NO: 1505605 - RNA, 19 nt, Homo sapiens
acaugacaguguggcauua

SEQ ID NO: 1505606 - RNA, 19 nt, Homo sapiens
aaggugccaugaaaucaaa

SEQ ID NO: 1505607 - RNA, 19 nt, Homo sapiens
aguguggcauuacugauaa

SEQ ID NO: 1505608 - RNA, 19 nt, Homo sapiens
agaguuggaucagugacua

SEQ ID NO: 1505609 - RNA, 19 nt, Homo sapiens
gauagaguuggaucaguga

SEQ ID NO: 1505610 - RNA, 19 nt, Homo sapiens
ugggauucaugauauuuga

SEQ ID NO: 1505611 - RNA, 19 nt, Homo sapiens
uuaggaagguauugagaag

SEQ ID NO: 1505612 - RNA, 19 nt, Homo sapiens
gacaugacaguguggcauu

SEQ ID NO: 1505613 - RNA, 19 nt, Homo sapiens
gaugaggagaggaaucaga

SEQ ID NO: 1505614 - RNA, 19 nt, Homo sapiens
caagcagcguguucugaag

SEQ ID NO: 1505615 - RNA, 19 nt, Homo sapiens
ggaagguauugagaagcaa

SEQ ID NO: 1505616 - RNA, 19 nt, Homo sapiens
cuagagcaaagauugaauu

SEQ ID NO: 1505617 - RNA, 19 nt, Homo sapiens
ggugaggaccugauagagu

SEQ ID NO: 1505618 - RNA, 19 nt, Homo sapiens
gggaugaggagaggaauca

SEQ ID NO: 1505619 - RNA, 19 nt, Homo sapiens
caaaagcgcaacagaauca

SEQ ID NO: 1505620 - RNA, 19 nt, Homo sapiens
cagcguguucugaaguaua

SEQ ID NO: 1505621 - RNA, 19 nt, Homo sapiens
uaaggugccaugaaaucaa

SEQ ID NO: 1505622 - RNA, 19 nt, Homo sapiens
caauaucuaaccugcaaau

SEQ ID NO: 1505623 - RNA, 19 nt, Homo sapiens
gggcucagaagucaucaug

SEQ ID NO: 1505624 - RNA, 19 nt, Homo sapiens
acacaagggcucagaaguc

SEQ ID NO: 1505625 - RNA, 19 nt, Homo sapiens
ucugaaguauaucuuggaa

SEQ ID NO: 1505626 - RNA, 19 nt, Homo sapiens
gcccuugguugcacucauc

SEQ ID NO: 1505627 - RNA, 19 nt, Homo sapiens
gcagcguguucugaaguau

SEQ ID NO: 1505628 - RNA, 19 nt, Homo sapiens
ccuccacuuugcccucuuu

SEQ ID NO: 1505629 - RNA, 19 nt, Homo sapiens
caauaaggugccaugaaau

SEQ ID NO: 1505630 - RNA, 19 nt, Homo sapiens
uggacaacccucacugauu

SEQ ID NO: 1505631 - RNA, 19 nt, Homo sapiens
caagggcucagaagucauc

SEQ ID NO: 1505632 - RNA, 19 nt, Homo sapiens
uuccugggauucaugauau

SEQ ID NO: 1505633 - RNA, 19 nt, Homo sapiens
cugauuaccugcccuuggu

SEQ ID NO: 1505634 - RNA, 19 nt, Homo sapiens
aggcuaaucuaccauaaaa

SEQ ID NO: 1505635 - RNA, 19 nt, Homo sapiens
guuuggcaauaaaggcuaa

SEQ ID NO: 1505636 - RNA, 19 nt, Homo sapiens
gguauugagaagcaagaaa

SEQ ID NO: 1505637 - RNA, 19 nt, Homo sapiens
aggaagguauugagaagca

SEQ ID NO: 1505638 - RNA, 19 nt, Homo sapiens
caaacacaagggcucagaa

SEQ ID NO: 1505639 - RNA, 19 nt, Homo sapiens
ggaaccuccacccugcaua

SEQ ID NO: 1505640 - RNA, 19 nt, Homo sapiens
aauaaggugccaugaaauc

SEQ ID NO: 1505641 - RNA, 19 nt, Homo sapiens
uguguacaaugcaggaaga

SEQ ID NO: 1505642 - RNA, 19 nt, Homo sapiens
agaaacuggaggcccaaua

SEQ ID NO: 1505643 - RNA, 19 nt, Homo sapiens
ggaagauugcgagaaagga

SEQ ID NO: 1505644 - RNA, 19 nt, Homo sapiens
gaaacugcagaggacauga

SEQ ID NO: 1505645 - RNA, 19 nt, Homo sapiens
agcuuuaggucaacacuug

SEQ ID NO: 1505646 - RNA, 19 nt, Homo sapiens
gccaugaaaucaaaaucaa

SEQ ID NO: 1505647 - RNA, 19 nt, Homo sapiens
acuaagaggcugcaauaag

SEQ ID NO: 1505648 - RNA, 19 nt, Homo sapiens
gaggagaggaaucagaaac

SEQ ID NO: 1505649 - RNA, 19 nt, Homo sapiens
uuccaaagcucagcacagu

SEQ ID NO: 1505650 - RNA, 19 nt, Homo sapiens
ccauaaaacucuugaagcu

SEQ ID NO: 1505651 - RNA, 19 nt, Homo sapiens
caacugaggcauauuuccu

SEQ ID NO: 1505652 - RNA, 19 nt, Homo sapiens
ugggauagucuguucauca

SEQ ID NO: 1505653 - RNA, 19 nt, Homo sapiens
gacuaagaggcugcaauaa

SEQ ID NO: 1505654 - RNA, 19 nt, Homo sapiens
cuggaggcccaauaucuaa

SEQ ID NO: 1505655 - RNA, 19 nt, Homo sapiens
cguaagcuuuuguuaaguu

SEQ ID NO: 1505656 - RNA, 19 nt, Homo sapiens
agcagcguguucugaagua

SEQ ID NO: 1505657 - RNA, 19 nt, Homo sapiens
gauugaauuauccuucugu

SEQ ID NO: 1505658 - RNA, 19 nt, Homo sapiens
gaguuggaucagugacuaa

SEQ ID NO: 1505659 - RNA, 19 nt, Homo sapiens
guggugaggaccugauaga

SEQ ID NO: 1505660 - RNA, 19 nt, Homo sapiens
guauugagaagcaagaaac

SEQ ID NO: 1505661 - RNA, 19 nt, Homo sapiens
ucugugggauagucuguuc

SEQ ID NO: 1505662 - RNA, 19 nt, Homo sapiens
gcaaagggcuugugucuuc

SEQ ID NO: 1505663 - RNA, 19 nt, Homo sapiens
gaaauugcuuccacuuauu

SEQ ID NO: 1505664 - RNA, 19 nt, Homo sapiens
gcaauacgaucucuaagug

SEQ ID NO: 1505665 - RNA, 19 nt, Homo sapiens
cagcagcccuugccagaua

SEQ ID NO: 1505666 - RNA, 19 nt, Homo sapiens
gaagaggacuccaucuaag

SEQ ID NO: 1505667 - RNA, 19 nt, Homo sapiens
ugaaauugcuuccacuuau

SEQ ID NO: 1505668 - RNA, 19 nt, Homo sapiens
uaaguggugccaugaauua

SEQ ID NO: 1505669 - RNA, 19 nt, Homo sapiens
gcaggacccucgcaacuuc

SEQ ID NO: 1505670 - RNA, 19 nt, Homo sapiens
acaauugucugugagguua

SEQ ID NO: 1505671 - RNA, 19 nt, Homo sapiens
ucuguacacugugaaauua

SEQ ID NO: 1505672 - RNA, 19 nt, Homo sapiens
caacacugcauguggauaa

SEQ ID NO: 1505673 - RNA, 19 nt, Homo sapiens
ucacccggcucuucacuuu

SEQ ID NO: 1505674 - RNA, 19 nt, Homo sapiens
cuaaagaucacucccaauu

SEQ ID NO: 1505675 - RNA, 19 nt, Homo sapiens
cuacgugaguuucuaaaga

SEQ ID NO: 1505676 - RNA, 19 nt, Homo sapiens
gggcaaagccugcucuuca

SEQ ID NO: 1505677 - RNA, 19 nt, Homo sapiens
ugaagaggacuccaucuaa

SEQ ID NO: 1505678 - RNA, 19 nt, Homo sapiens
guagguuguuguuuaaaga

SEQ ID NO: 1505679 - RNA, 19 nt, Homo sapiens
gucuguagguuguuguuua

SEQ ID NO: 1505680 - RNA, 19 nt, Homo sapiens
uaaagaucacucccaauuu

SEQ ID NO: 1505681 - RNA, 19 nt, Homo sapiens
ggccaucgcugcagaagca

SEQ ID NO: 1505682 - RNA, 19 nt, Homo sapiens
aaagaucacucccaauuuu

SEQ ID NO: 1505683 - RNA, 19 nt, Homo sapiens
gcuaugacauuggacuuga

SEQ ID NO: 1505684 - RNA, 19 nt, Homo sapiens
gaauuuagcaauacgaucu

SEQ ID NO: 1505685 - RNA, 19 nt, Homo sapiens
gaauuaaagaugccacuuc

SEQ ID NO: 1505686 - RNA, 19 nt, Homo sapiens
ccacggccaugcucaacuu

SEQ ID NO: 1505687 - RNA, 19 nt, Homo sapiens
ggccucaucuguacacugu

SEQ ID NO: 1505688 - RNA, 19 nt, Homo sapiens
caucuaagcugagaagcau

SEQ ID NO: 1505689 - RNA, 19 nt, Homo sapiens
gguuaaugaugguuucaga

SEQ ID NO: 1505690 - RNA, 19 nt, Homo sapiens
ggacgaggccuacaguucu

SEQ ID NO: 1505691 - RNA, 19 nt, Homo sapiens
guucaucgcuacgugaguu

SEQ ID NO: 1505692 - RNA, 19 nt, Homo sapiens
ucuguagguuguuguuuaa

SEQ ID NO: 1505693 - RNA, 19 nt, Homo sapiens
ccucaucuguacacuguga

SEQ ID NO: 1505694 - RNA, 19 nt, Homo sapiens
cuaacgcgcucugcaauuc

SEQ ID NO: 1505695 - RNA, 19 nt, Homo sapiens
cagggacucugcccauguu

SEQ ID NO: 1505696 - RNA, 19 nt, Homo sapiens
aaugacagccguaacacua

SEQ ID NO: 1505697 - RNA, 19 nt, Homo sapiens
ggcaaagccugcucuucau

SEQ ID NO: 1505698 - RNA, 19 nt, Homo sapiens
gagcccaccaguucuacua

SEQ ID NO: 1505699 - RNA, 19 nt, Homo sapiens
cuacaguucugccaugucu

SEQ ID NO: 1505700 - RNA, 19 nt, Homo sapiens
uagcucuuaucacagauuu

SEQ ID NO: 1505701 - RNA, 19 nt, Homo sapiens
ugacaaaggaagagaaucu

SEQ ID NO: 1505702 - RNA, 19 nt, Homo sapiens
gugccugccugacaaagga

SEQ ID NO: 1505703 - RNA, 19 nt, Homo sapiens
cauccucgguugccaagau

SEQ ID NO: 1505704 - RNA, 19 nt, Homo sapiens
uuugaacaauugucuguga

SEQ ID NO: 1505705 - RNA, 19 nt, Homo sapiens
uacgugaguuucuaaagau

SEQ ID NO: 1505706 - RNA, 19 nt, Homo sapiens
ccucugcucugucauggau

SEQ ID NO: 1505707 - RNA, 19 nt, Homo sapiens
gggcaaagggcuugugucu

SEQ ID NO: 1505708 - RNA, 19 nt, Homo sapiens
ucuaaguggugccaugaau

SEQ ID NO: 1505709 - RNA, 19 nt, Homo sapiens
gcaaagccuauaccacauc

SEQ ID NO: 1505710 - RNA, 19 nt, Homo sapiens
cugaaauugcuuccacuua

SEQ ID NO: 1505711 - RNA, 19 nt, Homo sapiens
gggacgaggccuacaguuc

SEQ ID NO: 1505712 - RNA, 19 nt, Homo sapiens
agaaacgucccaccuccua

SEQ ID NO: 1505713 - RNA, 19 nt, Homo sapiens
gcauuugccugugcuucug

SEQ ID NO: 1505714 - RNA, 19 nt, Homo sapiens
caaagggcuugugucuuca

SEQ ID NO: 1505715 - RNA, 19 nt, Homo sapiens
guggugccaugaauuaaag

SEQ ID NO: 1505716 - RNA, 19 nt, Homo sapiens
gcaaagccugcucuucauc

SEQ ID NO: 1505717 - RNA, 19 nt, Homo sapiens
uuucagugcuucucagcuu

SEQ ID NO: 1505718 - RNA, 19 nt, Homo sapiens
gacgaggccuacaguucug

SEQ ID NO: 1505719 - RNA, 19 nt, Homo sapiens
gaugggagcaagaggagau

SEQ ID NO: 1505720 - RNA, 19 nt, Homo sapiens
gcccaccgauggcucaagu

SEQ ID NO: 1505721 - RNA, 19 nt, Homo sapiens
cuccgaauguguaucuuug

SEQ ID NO: 1505722 - RNA, 19 nt, Homo sapiens
caaggugggcaucgucuuc

SEQ ID NO: 1505723 - RNA, 19 nt, Homo sapiens
gaaggcugagcgcguguga

SEQ ID NO: 1505724 - RNA, 19 nt, Homo sapiens
ugccaugucuguagguugu

SEQ ID NO: 1505725 - RNA, 19 nt, Homo sapiens
gacauuggacuugacauca

SEQ ID NO: 1505726 - RNA, 19 nt, Homo sapiens
ugagguuaaugaugguuuc

SEQ ID NO: 1505727 - RNA, 19 nt, Homo sapiens
ucccagggccucaucugua

SEQ ID NO: 1505728 - RNA, 19 nt, Homo sapiens
cuaaguggugccaugaauu

SEQ ID NO: 1505729 - RNA, 19 nt, Homo sapiens
gcuccugggaaggguauua

SEQ ID NO: 1505730 - RNA, 19 nt, Homo sapiens
gcucuggacacccauucaa

SEQ ID NO: 1505731 - RNA, 19 nt, Homo sapiens
ccacuuauuacccauccuu

SEQ ID NO: 1505732 - RNA, 19 nt, Homo sapiens
gcccagccuccuugccaua

SEQ ID NO: 1505733 - RNA, 19 nt, Homo sapiens
caggcuacauggcgacauc

SEQ ID NO: 1505734 - RNA, 19 nt, Homo sapiens
acacuaacgcgcucugcaa

SEQ ID NO: 1505735 - RNA, 19 nt, Homo sapiens
gcauguggaguacgagcuu

SEQ ID NO: 1505736 - RNA, 19 nt, Homo sapiens
guauuaccaccacuucuca

SEQ ID NO: 1505737 - RNA, 19 nt, Homo sapiens
gggccagcaugcaaaauga

SEQ ID NO: 1505738 - RNA, 19 nt, Homo sapiens
uguagguuguuguuuaaag

SEQ ID NO: 1505739 - RNA, 19 nt, Homo sapiens
guacgagcuuuucaagaug

SEQ ID NO: 1505740 - RNA, 19 nt, Homo sapiens
gcugaaauugcuuccacuu

SEQ ID NO: 1505741 - RNA, 19 nt, Homo sapiens
cagccuccuugccauaauc

SEQ ID NO: 1505742 - RNA, 19 nt, Homo sapiens
ugacagccguaacacuaac

SEQ ID NO: 1505743 - RNA, 19 nt, Homo sapiens
cucuagcucuuaucacaga

SEQ ID NO: 1505744 - RNA, 19 nt, Homo sapiens
ugacauuggacuugacauc

SEQ ID NO: 1505745 - RNA, 19 nt, Homo sapiens
gccugugccugccugacaa

SEQ ID NO: 1505746 - RNA, 19 nt, Homo sapiens
ccaugucuguagguuguug

SEQ ID NO: 1505747 - RNA, 19 nt, Homo sapiens
cauguggaguacgagcuuu

SEQ ID NO: 1505748 - RNA, 19 nt, Homo sapiens
cccagggccucaucuguac

SEQ ID NO: 1505749 - RNA, 19 nt, Homo sapiens
gcauuuccagccuucugaa

SEQ ID NO: 1505750 - RNA, 19 nt, Homo sapiens
cacugcauguggauaaauc

SEQ ID NO: 1505751 - RNA, 19 nt, Homo sapiens
gagcuuaaccccugcaaag

SEQ ID NO: 1505752 - RNA, 19 nt, Homo sapiens
gcaaagagaacuguccuaa

SEQ ID NO: 1505753 - RNA, 19 nt, Homo sapiens
gggaaagacuggaguaucu

SEQ ID NO: 1505754 - RNA, 19 nt, Homo sapiens
ccagaaaccugauggucaa

SEQ ID NO: 1505755 - RNA, 19 nt, Homo sapiens
gauaacgcgucucaucgaa

SEQ ID NO: 1505756 - RNA, 19 nt, Homo sapiens
aaagagaacuguccuaagc

SEQ ID NO: 1505757 - RNA, 19 nt, Homo sapiens
cacagcaacuccagcguuu

SEQ ID NO: 1505758 - RNA, 19 nt, Homo sapiens
gcuccuaggguuucuaauu

SEQ ID NO: 1505759 - RNA, 19 nt, Homo sapiens
gaaaccugauggucaaugc

SEQ ID NO: 1505760 - RNA, 19 nt, Homo sapiens
gggcgagauuccagucuug

SEQ ID NO: 1505761 - RNA, 19 nt, Homo sapiens
ucagagaccugccgaagcu

SEQ ID NO: 1505762 - RNA, 19 nt, Homo sapiens
aaacaaaacugagaacuuc

SEQ ID NO: 1505763 - RNA, 19 nt, Homo sapiens
gaaagacuggaguaucuca

SEQ ID NO: 1505764 - RNA, 19 nt, Homo sapiens
ccucacggaugcaaagaga

SEQ ID NO: 1505765 - RNA, 19 nt, Homo sapiens
uuccagaacugcaacuuga

SEQ ID NO: 1505766 - RNA, 19 nt, Homo sapiens
uagcugaguugcuguccaa

SEQ ID NO: 1505767 - RNA, 19 nt, Homo sapiens
gcaguugugacuugucuug

SEQ ID NO: 1505768 - RNA, 19 nt, Homo sapiens
uaacgcgucucaucgaacu

SEQ ID NO: 1505769 - RNA, 19 nt, Homo sapiens
ggaagacacagacggucaa

SEQ ID NO: 1505770 - RNA, 19 nt, Homo sapiens
ggauaacgcgucucaucga

SEQ ID NO: 1505771 - RNA, 19 nt, Homo sapiens
cagagaagccacacuccaa

SEQ ID NO: 1505772 - RNA, 19 nt, Homo sapiens
aaucaguggucccuagaau

SEQ ID NO: 1505773 - RNA, 19 nt, Homo sapiens
ggcguucgcuggagaggau

SEQ ID NO: 1505774 - RNA, 19 nt, Homo sapiens
cuccuaggguuucuaauuc

SEQ ID NO: 1505775 - RNA, 19 nt, Homo sapiens
gaagacacagacggucaaa

SEQ ID NO: 1505776 - RNA, 19 nt, Homo sapiens
cugaguugcuguccaaauc

SEQ ID NO: 1505777 - RNA, 19 nt, Homo sapiens
ggaguucauagcugaguug

SEQ ID NO: 1505778 - RNA, 19 nt, Homo sapiens
gcagggcagcagacacuau

SEQ ID NO: 1505779 - RNA, 19 nt, Homo sapiens
caaagagaacuguccuaag

SEQ ID NO: 1505780 - RNA, 19 nt, Homo sapiens
gaagcucacaucccucuac

SEQ ID NO: 1505781 - RNA, 19 nt, Homo sapiens
caaaucaguggucccuaga

SEQ ID NO: 1505782 - RNA, 19 nt, Homo sapiens
gugauuaccaucccugcaa

SEQ ID NO: 1505783 - RNA, 19 nt, Homo sapiens
ggaacuugccacacugagu

SEQ ID NO: 1505784 - RNA, 19 nt, Homo sapiens
acauggaacuugccacacu

SEQ ID NO: 1505785 - RNA, 19 nt, Homo sapiens
ucaguggucccuagaaucu

SEQ ID NO: 1505786 - RNA, 19 nt, Homo sapiens
agagaagccacacuccaaa

SEQ ID NO: 1505787 - RNA, 19 nt, Homo sapiens
gccuugagcacacauggaa

SEQ ID NO: 1505788 - RNA, 19 nt, Homo sapiens
cacuugcaguugugacuug

SEQ ID NO: 1505789 - RNA, 19 nt, Homo sapiens
ggggacauuuucaagauga

SEQ ID NO: 1505790 - RNA, 19 nt, Homo sapiens
acacccaccuugcuucaac

SEQ ID NO: 1505791 - RNA, 19 nt, Homo sapiens
cagaggugcauccagagaa

SEQ ID NO: 1505792 - RNA, 19 nt, Homo sapiens
cagcggcacguuccuugaa

SEQ ID NO: 1505793 - RNA, 19 nt, Homo sapiens
aggagaaggucccgcucuu

SEQ ID NO: 1505794 - RNA, 19 nt, Homo sapiens
ggcuccagaccgucaguua

SEQ ID NO: 1505795 - RNA, 19 nt, Homo sapiens
ccucccuuccuucuacuua

SEQ ID NO: 1505796 - RNA, 19 nt, Homo sapiens
cugcugcccucccuuccuu

SEQ ID NO: 1505797 - RNA, 19 nt, Homo sapiens
gaagccagaaugccuugag

SEQ ID NO: 1505798 - RNA, 19 nt, Homo sapiens
agaggugcauccagagaag

SEQ ID NO: 1505799 - RNA, 19 nt, Homo sapiens
ucaguuagcccagcuucug

SEQ ID NO: 1505800 - RNA, 19 nt, Homo sapiens
cuucucagccucccuguca

SEQ ID NO: 1505801 - RNA, 19 nt, Homo sapiens
ccucccagguccuaucgau

SEQ ID NO: 1505802 - RNA, 19 nt, Homo sapiens
ccagacgccaugcggcaaa

SEQ ID NO: 1505803 - RNA, 19 nt, Homo sapiens
gggcagcagacacuaugug

SEQ ID NO: 1505804 - RNA, 19 nt, Homo sapiens
ccaaggacauggacaauga

SEQ ID NO: 1505805 - RNA, 19 nt, Homo sapiens
gagaucaagucauuacuga

SEQ ID NO: 1505806 - RNA, 19 nt, Homo sapiens
ccaagaugcuucagagaaa

SEQ ID NO: 1505807 - RNA, 19 nt, Homo sapiens
auaaggagaucaagucauu

SEQ ID NO: 1505808 - RNA, 19 nt, Homo sapiens
ggagcugccugcugcguaa

SEQ ID NO: 1505809 - RNA, 19 nt, Homo sapiens
caagggagccagugaaaga

SEQ ID NO: 1505810 - RNA, 19 nt, Homo sapiens
gcagcagguucacgaagaa

SEQ ID NO: 1505811 - RNA, 19 nt, Homo sapiens
gcaagcgagaguucaauaa

SEQ ID NO: 1505812 - RNA, 19 nt, Homo sapiens
aagccgagauugaagauga

SEQ ID NO: 1505813 - RNA, 19 nt, Homo sapiens
gggugcagcugcccaagaa

SEQ ID NO: 1505814 - RNA, 19 nt, Homo sapiens
gauugaagaugaagaugag

SEQ ID NO: 1505815 - RNA, 19 nt, Homo sapiens
cggguuaccuggccgauga

SEQ ID NO: 1505816 - RNA, 19 nt, Homo sapiens
agaaauaaagccuguguug

SEQ ID NO: 1505817 - RNA, 19 nt, Homo sapiens
gaggagcucugcugagacu

SEQ ID NO: 1505818 - RNA, 19 nt, Homo sapiens
ggccaacgccgaaacaaga

SEQ ID NO: 1505819 - RNA, 19 nt, Homo sapiens
ggaaugcgcagcugaagag

SEQ ID NO: 1505820 - RNA, 19 nt, Homo sapiens
aggaugaguucaaggauga

SEQ ID NO: 1505821 - RNA, 19 nt, Homo sapiens
gacaaugagggccgugaua

SEQ ID NO: 1505822 - RNA, 19 nt, Homo sapiens
gggaaaggccucagucagu

SEQ ID NO: 1505823 - RNA, 19 nt, Homo sapiens
cgaccugccuggcuacugu

SEQ ID NO: 1505824 - RNA, 19 nt, Homo sapiens
gugauaaagccgagauuga

SEQ ID NO: 1505825 - RNA, 19 nt, Homo sapiens
ggagccagugaaagaaaua

SEQ ID NO: 1505826 - RNA, 19 nt, Homo sapiens
ugauaaagccgagauugaa

SEQ ID NO: 1505827 - RNA, 19 nt, Homo sapiens
caaugagggccgugauaaa

SEQ ID NO: 1505828 - RNA, 19 nt, Homo sapiens
cagcuaaacccaccaaugg

SEQ ID NO: 1505829 - RNA, 19 nt, Homo sapiens
gagaacaggagccaaucuu

SEQ ID NO: 1505830 - RNA, 19 nt, Homo sapiens
gccaccagauucaaacuca

SEQ ID NO: 1505831 - RNA, 19 nt, Homo sapiens
ggagaucaagucauuacug

SEQ ID NO: 1505832 - RNA, 19 nt, Homo sapiens
gggagccagugaaagaaau

SEQ ID NO: 1505833 - RNA, 19 nt, Homo sapiens
ggaccuuucccugggcuua

SEQ ID NO: 1505834 - RNA, 19 nt, Homo sapiens
gcagguucacgaagaagaa

SEQ ID NO: 1505835 - RNA, 19 nt, Homo sapiens
ucaauaaggagaucaaguc

SEQ ID NO: 1505836 - RNA, 19 nt, Homo sapiens
ucgauucccugcucuguca

SEQ ID NO: 1505837 - RNA, 19 nt, Homo sapiens
gcuuggagcccaccucaga

SEQ ID NO: 1505838 - RNA, 19 nt, Homo sapiens
ccagugaaagaaauagaaa

SEQ ID NO: 1505839 - RNA, 19 nt, Homo sapiens
acgaggagcucugcugaga

SEQ ID NO: 1505840 - RNA, 19 nt, Homo sapiens
gauaaagccgagauugaag

SEQ ID NO: 1505841 - RNA, 19 nt, Homo sapiens
acaaugagggccgugauaa

SEQ ID NO: 1505842 - RNA, 19 nt, Homo sapiens
uggcgugccugaagcauca

SEQ ID NO: 1505843 - RNA, 19 nt, Homo sapiens
ccucuucccugcccugcaa

SEQ ID NO: 1505844 - RNA, 19 nt, Homo sapiens
ggagcaaggcgguguuucu

SEQ ID NO: 1505845 - RNA, 19 nt, Homo sapiens
gcaaguacgaguucgaaaa

SEQ ID NO: 1505846 - RNA, 19 nt, Homo sapiens
aaauaaagccuguguugcu

SEQ ID NO: 1505847 - RNA, 19 nt, Homo sapiens
ugucagaguugcugcacau

SEQ ID NO: 1505848 - RNA, 19 nt, Homo sapiens
augcgcagcugaagagaga

SEQ ID NO: 1505849 - RNA, 19 nt, Homo sapiens
gaaaaggaccucaguaagc

SEQ ID NO: 1505850 - RNA, 19 nt, Homo sapiens
augaggagcucgccgacuu

SEQ ID NO: 1505851 - RNA, 19 nt, Homo sapiens
caauaaggagaucaaguca

SEQ ID NO: 1505852 - RNA, 19 nt, Homo sapiens
gcaugucucacuucuccaa

SEQ ID NO: 1505853 - RNA, 19 nt, Homo sapiens
uaaggagaucaagucauua

SEQ ID NO: 1505854 - RNA, 19 nt, Homo sapiens
caagcgagaguucaauaag

SEQ ID NO: 1505855 - RNA, 19 nt, Homo sapiens
aagaugaagaugaggauga

SEQ ID NO: 1505856 - RNA, 19 nt, Homo sapiens
ucuccaaccgccuuuauga

SEQ ID NO: 1505857 - RNA, 19 nt, Homo sapiens
agcgagaguucaauaagga

SEQ ID NO: 1505858 - RNA, 19 nt, Homo sapiens
uggagacagugguggagaa

SEQ ID NO: 1505859 - RNA, 19 nt, Homo sapiens
gccagugaaagaaauagaa

SEQ ID NO: 1505860 - RNA, 19 nt, Homo sapiens
gagcaaggcgguguuucug

SEQ ID NO: 1505861 - RNA, 19 nt, Homo sapiens
cccaagaugcuucagagaa

SEQ ID NO: 1505862 - RNA, 19 nt, Homo sapiens
cgagauugaagaugaagau

SEQ ID NO: 1505863 - RNA, 19 nt, Homo sapiens
agaagccgcugcccuccau

SEQ ID NO: 1505864 - RNA, 19 nt, Homo sapiens
ccaccagauucaaacucaa

SEQ ID NO: 1505865 - RNA, 19 nt, Homo sapiens
ggaagggaaaggccucagu

SEQ ID NO: 1505866 - RNA, 19 nt, Homo sapiens
ggacaaugagggccgugau

SEQ ID NO: 1505867 - RNA, 19 nt, Homo sapiens
ccagcuaaacccaccaaug

SEQ ID NO: 1505868 - RNA, 19 nt, Homo sapiens
aagcgagaguucaauaagg

SEQ ID NO: 1505869 - RNA, 19 nt, Homo sapiens
gaaccucaagcggcugcua

SEQ ID NO: 1505870 - RNA, 19 nt, Homo sapiens
cgaaguccagcaugucuca

SEQ ID NO: 1505871 - RNA, 19 nt, Homo sapiens
cgcaagcgagaguucaaua

SEQ ID NO: 1505872 - RNA, 19 nt, Homo sapiens
ggagaacaggagccaaucu

SEQ ID NO: 1505873 - RNA, 19 nt, Homo sapiens
ccagcuccauguccaacug

SEQ ID NO: 1505874 - RNA, 19 nt, Homo sapiens
aggaugaggacaaggauga

SEQ ID NO: 1505875 - RNA, 19 nt, Homo sapiens
agauugaagaugaagauga

SEQ ID NO: 1505876 - RNA, 19 nt, Homo sapiens
ggaaccagccacccacacu

SEQ ID NO: 1505877 - RNA, 19 nt, Homo sapiens
caagaugcuucagagaaaa

SEQ ID NO: 1505878 - RNA, 19 nt, Homo sapiens
aagaugaggaugaguucaa

SEQ ID NO: 1505879 - RNA, 19 nt, Homo sapiens
gaagaugaggaugaguuca

SEQ ID NO: 1505880 - RNA, 19 nt, Homo sapiens
aaaaggaccucaguaagca

SEQ ID NO: 1505881 - RNA, 19 nt, Homo sapiens
gaggccagccacuccaugu

SEQ ID NO: 1505882 - RNA, 19 nt, Homo sapiens
ugaagaugaggaugaguuc

SEQ ID NO: 1505883 - RNA, 19 nt, Homo sapiens
agcagcagguucacgaaga

SEQ ID NO: 1505884 - RNA, 19 nt, Homo sapiens
ucagcccuuuggccacuuu

SEQ ID NO: 1505885 - RNA, 19 nt, Homo sapiens
uaaagccgagauugaagau

SEQ ID NO: 1505886 - RNA, 19 nt, Homo sapiens
gccgcucccucuacaccaa

SEQ ID NO: 1505887 - RNA, 19 nt, Homo sapiens
gaccuuucccugggcuuaa

SEQ ID NO: 1505888 - RNA, 19 nt, Homo sapiens
gcagcagcagguucacgaa

SEQ ID NO: 1505889 - RNA, 19 nt, Homo sapiens
ggagucaccacaggcugaa

SEQ ID NO: 1505890 - RNA, 19 nt, Homo sapiens
cagaguugcugcacaucac

SEQ ID NO: 1505891 - RNA, 19 nt, Homo sapiens
gcacuucccuccucuguga

SEQ ID NO: 1505892 - RNA, 19 nt, Homo sapiens
agacauagcugcauugaau

SEQ ID NO: 1505893 - RNA, 19 nt, Homo sapiens
gaaaguggaugugcaguug

SEQ ID NO: 1505894 - RNA, 19 nt, Homo sapiens
ggccugcacugcuggauua

SEQ ID NO: 1505895 - RNA, 19 nt, Homo sapiens
gcaggaggauggagaagug

SEQ ID NO: 1505896 - RNA, 19 nt, Homo sapiens
gcaacgcucugcagaaagu

SEQ ID NO: 1505897 - RNA, 19 nt, Homo sapiens
cagcaacgcucugcagaaa

SEQ ID NO: 1505898 - RNA, 19 nt, Homo sapiens
cagcugcccuuuggaauaa

SEQ ID NO: 1505899 - RNA, 19 nt, Homo sapiens
ugaaagacauagcugcauu

SEQ ID NO: 1505900 - RNA, 19 nt, Homo sapiens
gcacccgccugggaacuua

SEQ ID NO: 1505901 - RNA, 19 nt, Homo sapiens
ccaaggaccucaugcucaa

SEQ ID NO: 1505902 - RNA, 19 nt, Homo sapiens
ggcaggagguggcaucuug

SEQ ID NO: 1505903 - RNA, 19 nt, Homo sapiens
ggaggcagaaguaugauuu

SEQ ID NO: 1505904 - RNA, 19 nt, Homo sapiens
gaccggagcugcgugaaga

SEQ ID NO: 1505905 - RNA, 19 nt, Homo sapiens
gcaagaaggaugccuguca

SEQ ID NO: 1505906 - RNA, 19 nt, Homo sapiens
ggacagcacaugcaucuca

SEQ ID NO: 1505907 - RNA, 19 nt, Homo sapiens
ggugcgagcugaccugaga

SEQ ID NO: 1505908 - RNA, 19 nt, Homo sapiens
gcugaccgcugggugauaa

SEQ ID NO: 1505909 - RNA, 19 nt, Homo sapiens
ggaauaaagcugccugauc

SEQ ID NO: 1505910 - RNA, 19 nt, Homo sapiens
gcaaagaggacagcacaug

SEQ ID NO: 1505911 - RNA, 19 nt, Homo sapiens
gaguuccucuguucuguga

SEQ ID NO: 1505912 - RNA, 19 nt, Homo sapiens
agaagggccugcacagcua

SEQ ID NO: 1505913 - RNA, 19 nt, Homo sapiens
gaaagacauagcugcauug

SEQ ID NO: 1505914 - RNA, 19 nt, Homo sapiens
gaugucugcuccagugaug

SEQ ID NO: 1505915 - RNA, 19 nt, Homo sapiens
ugaggaggcagaaguauga

SEQ ID NO: 1505916 - RNA, 19 nt, Homo sapiens
caacuucaccucccagauc

SEQ ID NO: 1505917 - RNA, 19 nt, Homo sapiens
gcacugaggaggcagaagu

SEQ ID NO: 1505918 - RNA, 19 nt, Homo sapiens
gggaccgacuggccaugua

SEQ ID NO: 1505919 - RNA, 19 nt, Homo sapiens
cccagaagaugcucaagga

SEQ ID NO: 1505920 - RNA, 19 nt, Homo sapiens
ugugaggacuccaagagaa

SEQ ID NO: 1505921 - RNA, 19 nt, Homo sapiens
guacaaggcggaggugaug

SEQ ID NO: 1505922 - RNA, 19 nt, Homo sapiens
ucagcugcccuuuggaaua

SEQ ID NO: 1505923 - RNA, 19 nt, Homo sapiens
gaagaggacagccaugacu

SEQ ID NO: 1505924 - RNA, 19 nt, Homo sapiens
gacauucaccuuccagugu

SEQ ID NO: 1505925 - RNA, 19 nt, Homo sapiens
gcaucucacugcccaaggu

SEQ ID NO: 1505926 - RNA, 19 nt, Homo sapiens
gaggacagcacaugcaucu

SEQ ID NO: 1505927 - RNA, 19 nt, Homo sapiens
gcucagcugcccuuuggaa

SEQ ID NO: 1505928 - RNA, 19 nt, Homo sapiens
cggcuuggcccucugguuu

SEQ ID NO: 1505929 - RNA, 19 nt, Homo sapiens
cuggagagguguccuucaa

SEQ ID NO: 1505930 - RNA, 19 nt, Homo sapiens
uaacagcugcccacugcuu

SEQ ID NO: 1505931 - RNA, 19 nt, Homo sapiens
gugaugggcagccugauug

SEQ ID NO: 1505932 - RNA, 19 nt, Homo sapiens
ucauggcggucgucuggaa

SEQ ID NO: 1505933 - RNA, 19 nt, Homo sapiens
cuacagggccgaguacgaa

SEQ ID NO: 1505934 - RNA, 19 nt, Homo sapiens
caacuccagcuccgucuau

SEQ ID NO: 1505935 - RNA, 19 nt, Homo sapiens
ggcaguggcucagcagcaa

SEQ ID NO: 1505936 - RNA, 19 nt, Homo sapiens
auuccacgcuggguuguua

SEQ ID NO: 1505937 - RNA, 19 nt, Homo sapiens
ccugggaacuuacuacaac

SEQ ID NO: 1505938 - RNA, 19 nt, Homo sapiens
gagccacauuccagugcaa

SEQ ID NO: 1505939 - RNA, 19 nt, Homo sapiens
gcuuggcccucugguuuga

SEQ ID NO: 1505940 - RNA, 19 nt, Homo sapiens
ggaccgacuggccauguau

SEQ ID NO: 1505941 - RNA, 19 nt, Homo sapiens
guuguuaccgcuacagcua

SEQ ID NO: 1505942 - RNA, 19 nt, Homo sapiens
uaacuugggaucugggaau

SEQ ID NO: 1505943 - RNA, 19 nt, Homo sapiens
gugaggacuccaagagaaa

SEQ ID NO: 1505944 - RNA, 19 nt, Homo sapiens
cggaugaggagcacuguga

SEQ ID NO: 1505945 - RNA, 19 nt, Homo sapiens
guuccucuguucugugaau

SEQ ID NO: 1505946 - RNA, 19 nt, Homo sapiens
gcagugaaaccgccaaagc

SEQ ID NO: 1505947 - RNA, 19 nt, Homo sapiens
gguauuuccuaggguacaa

SEQ ID NO: 1505948 - RNA, 19 nt, Homo sapiens
ucaccugcuucuucugguu

SEQ ID NO: 1505949 - RNA, 19 nt, Homo sapiens
gggugcuacucugguauuu

SEQ ID NO: 1505950 - RNA, 19 nt, Homo sapiens
gugguccgcuggugugcaa

SEQ ID NO: 1505951 - RNA, 19 nt, Homo sapiens
ccacugcugccuaaugcaa

SEQ ID NO: 1505952 - RNA, 19 nt, Homo sapiens
guggugaccugaggaacug

SEQ ID NO: 1505953 - RNA, 19 nt, Homo sapiens
ccacauuccagugcaaaga

SEQ ID NO: 1505954 - RNA, 19 nt, Homo sapiens
gggaucaccaucaacuuca

SEQ ID NO: 1505955 - RNA, 19 nt, Homo sapiens
ccagcuccgucuauuccuu

SEQ ID NO: 1505956 - RNA, 19 nt, Homo sapiens
gugcuacucugguauuucc

SEQ ID NO: 1505957 - RNA, 19 nt, Homo sapiens
gcacccacuugcagucacu

SEQ ID NO: 1505958 - RNA, 19 nt, Homo sapiens
cggaggugauggcgaggaa

SEQ ID NO: 1505959 - RNA, 19 nt, Homo sapiens
gacauagcugcauugaauu

SEQ ID NO: 1505960 - RNA, 19 nt, Homo sapiens
ggaagccagugugaaagac

SEQ ID NO: 1505961 - RNA, 19 nt, Homo sapiens
cgccaaagcccagaagaug

SEQ ID NO: 1505962 - RNA, 19 nt, Homo sapiens
cgccugauguuguuacucu

SEQ ID NO: 1505963 - RNA, 19 nt, Homo sapiens
caaguggugaccugaggaa

SEQ ID NO: 1505964 - RNA, 19 nt, Homo sapiens
ggcaagguguggcagaacu

SEQ ID NO: 1505965 - RNA, 19 nt, Homo sapiens
caacggcagcgacgaagag

SEQ ID NO: 1505966 - RNA, 19 nt, Homo sapiens
ccucugguuugaugccuau

SEQ ID NO: 1505967 - RNA, 19 nt, Homo sapiens
gaagccagugugaaagaca

SEQ ID NO: 1505968 - RNA, 19 nt, Homo sapiens
gaggcagaaguaugauuug

SEQ ID NO: 1505969 - RNA, 19 nt, Homo sapiens
gcccuucugccucccaauu

SEQ ID NO: 1505970 - RNA, 19 nt, Homo sapiens
cgaagagcagugccaggaa

SEQ ID NO: 1505971 - RNA, 19 nt, Homo sapiens
cagcuccgucuauuccuuu

SEQ ID NO: 1505972 - RNA, 19 nt, Homo sapiens
ggaagccccuggucuaacu

SEQ ID NO: 1505973 - RNA, 19 nt, Homo sapiens
agaaaguggaugugcaguu

SEQ ID NO: 1505974 - RNA, 19 nt, Homo sapiens
caacggccuggaugagaga

SEQ ID NO: 1505975 - RNA, 19 nt, Homo sapiens
ccacuucucccaggaucuu

SEQ ID NO: 1505976 - RNA, 19 nt, Homo sapiens
aaagacauagcugcauuga

SEQ ID NO: 1505977 - RNA, 19 nt, Homo sapiens
gcuacucugguauuuccua

SEQ ID NO: 1505978 - RNA, 19 nt, Homo sapiens
ggugcacuauggcuuguac

SEQ ID NO: 1505979 - RNA, 19 nt, Homo sapiens
uguacucaaucgccacuuc

SEQ ID NO: 1505980 - RNA, 19 nt, Homo sapiens
uggcucagcagcaagaaug

SEQ ID NO: 1505981 - RNA, 19 nt, Homo sapiens
gcaggagguggcaucuugu

SEQ ID NO: 1505982 - RNA, 19 nt, Homo sapiens
gguacaaggcggaggugau

SEQ ID NO: 1505983 - RNA, 19 nt, Homo sapiens
ucagcaacgcucugcagaa

SEQ ID NO: 1505984 - RNA, 19 nt, Homo sapiens
aagaggacagccaugacua

SEQ ID NO: 1505985 - RNA, 19 nt, Homo sapiens
gcagccugauugucucaac

SEQ ID NO: 1505986 - RNA, 19 nt, Homo sapiens
uuccaggccugugaaguga

SEQ ID NO: 1505987 - RNA, 19 nt, Homo sapiens
gaagcagaaucaacucuua

SEQ ID NO: 1505988 - RNA, 19 nt, Homo sapiens
ucaaaugucuuuaguggua

SEQ ID NO: 1505989 - RNA, 19 nt, Homo sapiens
cagaauacgugaauaacua

SEQ ID NO: 1505990 - RNA, 19 nt, Homo sapiens
gugggaagauuucauuaua

SEQ ID NO: 1505991 - RNA, 19 nt, Homo sapiens
gcaauagcauggccagaaa

SEQ ID NO: 1505992 - RNA, 19 nt, Homo sapiens
gaaaagauguucagcuuga

SEQ ID NO: 1505993 - RNA, 19 nt, Homo sapiens
gcaaagagguacccuaaaa

SEQ ID NO: 1505994 - RNA, 19 nt, Homo sapiens
gcccgaggauuuccacuua

SEQ ID NO: 1505995 - RNA, 19 nt, Homo sapiens
gaagcaagauggcggugaa

SEQ ID NO: 1505996 - RNA, 19 nt, Homo sapiens
ugacgaaccucacuguuga

SEQ ID NO: 1505997 - RNA, 19 nt, Homo sapiens
aaagauaggcaacagaaua

SEQ ID NO: 1505998 - RNA, 19 nt, Homo sapiens
cagaugccuuguucaguua

SEQ ID NO: 1505999 - RNA, 19 nt, Homo sapiens
acacuuaguuguuugagaa

SEQ ID NO: 1506000 - RNA, 19 nt, Homo sapiens
cuucucagguccauucuua

SEQ ID NO: 1506001 - RNA, 19 nt, Homo sapiens
gcggagcccucaucccuaa

SEQ ID NO: 1506002 - RNA, 19 nt, Homo sapiens
ucagaaggcucaaaugucu

SEQ ID NO: 1506003 - RNA, 19 nt, Homo sapiens
ggacgacucagguauguga

SEQ ID NO: 1506004 - RNA, 19 nt, Homo sapiens
ccacuuagaaccuuaaaug

SEQ ID NO: 1506005 - RNA, 19 nt, Homo sapiens
gaucagaaggcucaaaugu

SEQ ID NO: 1506006 - RNA, 19 nt, Homo sapiens
gaaaugcaaccugagauga

SEQ ID NO: 1506007 - RNA, 19 nt, Homo sapiens
ggugaaacuuuacuucugu

SEQ ID NO: 1506008 - RNA, 19 nt, Homo sapiens
acagaugccuuguucaguu

SEQ ID NO: 1506009 - RNA, 19 nt, Homo sapiens
cauuugaucugaugacgaa

SEQ ID NO: 1506010 - RNA, 19 nt, Homo sapiens
gauauggcacuuucacauu

SEQ ID NO: 1506011 - RNA, 19 nt, Homo sapiens
guaauuugguugacauugg

SEQ ID NO: 1506012 - RNA, 19 nt, Homo sapiens
cauuguuucucacuucaua

SEQ ID NO: 1506013 - RNA, 19 nt, Homo sapiens
ggaaaugcaaccugagaug

SEQ ID NO: 1506014 - RNA, 19 nt, Homo sapiens
gcaagauggcggugaauca

SEQ ID NO: 1506015 - RNA, 19 nt, Homo sapiens
gaccaaaaccaacaaauaa

SEQ ID NO: 1506016 - RNA, 19 nt, Homo sapiens
uuacuucugugccuagauu

SEQ ID NO: 1506017 - RNA, 19 nt, Homo sapiens
gaucccauguugucuuuua

SEQ ID NO: 1506018 - RNA, 19 nt, Homo sapiens
ccacaccauuucaaccaaa

SEQ ID NO: 1506019 - RNA, 19 nt, Homo sapiens
uguaaugucuccuucacuu

SEQ ID NO: 1506020 - RNA, 19 nt, Homo sapiens
ucuaagauguaaaccuuga

SEQ ID NO: 1506021 - RNA, 19 nt, Homo sapiens
gcugcaaacuucauuaagg

SEQ ID NO: 1506022 - RNA, 19 nt, Homo sapiens
gguaguuguuccacccuuu

SEQ ID NO: 1506023 - RNA, 19 nt, Homo sapiens
gaggacgacucagguaugu

SEQ ID NO: 1506024 - RNA, 19 nt, Homo sapiens
cuucuaagauguaaaccuu

SEQ ID NO: 1506025 - RNA, 19 nt, Homo sapiens
gagccucaccugugcgaua

SEQ ID NO: 1506026 - RNA, 19 nt, Homo sapiens
gugaucccauguugucuuu

SEQ ID NO: 1506027 - RNA, 19 nt, Homo sapiens
guagaaagacaggaacauu

SEQ ID NO: 1506028 - RNA, 19 nt, Homo sapiens
uaauaggccauaaauguga

SEQ ID NO: 1506029 - RNA, 19 nt, Homo sapiens
cgagaaaacuugcaugugu

SEQ ID NO: 1506030 - RNA, 19 nt, Homo sapiens
auauggcacuuucacauuu

SEQ ID NO: 1506031 - RNA, 19 nt, Homo sapiens
gaaaacguuugaaaagaug

SEQ ID NO: 1506032 - RNA, 19 nt, Homo sapiens
gggaaggacaagcuacuuu

SEQ ID NO: 1506033 - RNA, 19 nt, Homo sapiens
ucagcucuaugggaauuua

SEQ ID NO: 1506034 - RNA, 19 nt, Homo sapiens
guucagcucuaugggaauu

SEQ ID NO: 1506035 - RNA, 19 nt, Homo sapiens
uaagacuuguugauaagga

SEQ ID NO: 1506036 - RNA, 19 nt, Homo sapiens
uaaaggaagaauaccauug

SEQ ID NO: 1506037 - RNA, 19 nt, Homo sapiens
gaagcggucuccgaaugug

SEQ ID NO: 1506038 - RNA, 19 nt, Homo sapiens
ccgaauaaccaaggcaaua

SEQ ID NO: 1506039 - RNA, 19 nt, Homo sapiens
aagcaaagagguacccuaa

SEQ ID NO: 1506040 - RNA, 19 nt, Homo sapiens
gaaggacaagcuacuuuua

SEQ ID NO: 1506041 - RNA, 19 nt, Homo sapiens
uagaaagacaggaacauug

SEQ ID NO: 1506042 - RNA, 19 nt, Homo sapiens
gcagaaucaacucuuaaau

SEQ ID NO: 1506043 - RNA, 19 nt, Homo sapiens
ccauugaauuugcccaguu

SEQ ID NO: 1506044 - RNA, 19 nt, Homo sapiens
aaagaugcaugugggaaga

SEQ ID NO: 1506045 - RNA, 19 nt, Homo sapiens
aaaacuaugucuagaggua

SEQ ID NO: 1506046 - RNA, 19 nt, Homo sapiens
guucaguuauugucuaugg

SEQ ID NO: 1506047 - RNA, 19 nt, Homo sapiens
ucaggcagcuccauauggu

SEQ ID NO: 1506048 - RNA, 19 nt, Homo sapiens
ggccauaaaugugauagag

SEQ ID NO: 1506049 - RNA, 19 nt, Homo sapiens
cgacucagguaugugauca

SEQ ID NO: 1506050 - RNA, 19 nt, Homo sapiens
ggaggacgacucagguaug

SEQ ID NO: 1506051 - RNA, 19 nt, Homo sapiens
aaaggaagaauaccauugu

SEQ ID NO: 1506052 - RNA, 19 nt, Homo sapiens
ggauaaggaggacgacuca

SEQ ID NO: 1506053 - RNA, 19 nt, Homo sapiens
ccgaggauuuccacuuaga

SEQ ID NO: 1506054 - RNA, 19 nt, Homo sapiens
cauugaauuugcccaguug

SEQ ID NO: 1506055 - RNA, 19 nt, Homo sapiens
gcauaugauuccacaccau

SEQ ID NO: 1506056 - RNA, 19 nt, Homo sapiens
ucuaagacuuguugauaag

SEQ ID NO: 1506057 - RNA, 19 nt, Homo sapiens
ccaguaauuugguugacau

SEQ ID NO: 1506058 - RNA, 19 nt, Homo sapiens
gagcccaacccguaggaaa

SEQ ID NO: 1506059 - RNA, 19 nt, Homo sapiens
ccucaucccuaacggugaa

SEQ ID NO: 1506060 - RNA, 19 nt, Homo sapiens
cuuagaaccuuaaaugacu

SEQ ID NO: 1506061 - RNA, 19 nt, Homo sapiens
ggaggugccauugaauuug

SEQ ID NO: 1506062 - RNA, 19 nt, Homo sapiens
ugacuaguguuagggaaau

SEQ ID NO: 1506063 - RNA, 19 nt, Homo sapiens
ggcaauagcauggccagaa

SEQ ID NO: 1506064 - RNA, 19 nt, Homo sapiens
gaugccauuugaucugaug

SEQ ID NO: 1506065 - RNA, 19 nt, Homo sapiens
ggaaauaaaaggaguuugu

SEQ ID NO: 1506066 - RNA, 19 nt, Homo sapiens
agaaagacaggaacauugu

SEQ ID NO: 1506067 - RNA, 19 nt, Homo sapiens
cagaaaacguuugaaaaga

SEQ ID NO: 1506068 - RNA, 19 nt, Homo sapiens
gauaggcaacagaauagga

SEQ ID NO: 1506069 - RNA, 19 nt, Homo sapiens
ugaagacucaccaagcaaa

SEQ ID NO: 1506070 - RNA, 19 nt, Homo sapiens
gaggugccauugaauuugc

SEQ ID NO: 1506071 - RNA, 19 nt, Homo sapiens
caaguuguagggagcauau

SEQ ID NO: 1506072 - RNA, 19 nt, Homo sapiens
agaaggcucaaaugucuuu

SEQ ID NO: 1506073 - RNA, 19 nt, Homo sapiens
ugacagaaauaugaauugc

SEQ ID NO: 1506074 - RNA, 19 nt, Homo sapiens
agucagaauacgugaauaa

SEQ ID NO: 1506075 - RNA, 19 nt, Homo sapiens
ggaaggugaaacuuuacuu

SEQ ID NO: 1506076 - RNA, 19 nt, Homo sapiens
uguaaaccuugaagacuca

SEQ ID NO: 1506077 - RNA, 19 nt, Homo sapiens
cauaugauuccacaccauu

SEQ ID NO: 1506078 - RNA, 19 nt, Homo sapiens
uugaagcggucuccgaaug

SEQ ID NO: 1506079 - RNA, 19 nt, Homo sapiens
gaaauaugaauugccgaau

SEQ ID NO: 1506080 - RNA, 19 nt, Homo sapiens
gauaauugcauaugauucc

SEQ ID NO: 1506081 - RNA, 19 nt, Homo sapiens
caaaucaauucuccccaaa

SEQ ID NO: 1506082 - RNA, 19 nt, Homo sapiens
cauuuauuaugcuccguuu

SEQ ID NO: 1506083 - RNA, 19 nt, Homo sapiens
gaugccuuguucaguuauu

SEQ ID NO: 1506084 - RNA, 19 nt, Homo sapiens
uggaggugccauugaauuu

SEQ ID NO: 1506085 - RNA, 19 nt, Homo sapiens
ggaaggacaagcuacuuuu

SEQ ID NO: 1506086 - RNA, 19 nt, Homo sapiens
uuaauaggccauaaaugug

SEQ ID NO: 1506087 - RNA, 19 nt, Homo sapiens
gcacagcacucgacuauga

SEQ ID NO: 1506088 - RNA, 19 nt, Homo sapiens
gaaaugauauucaggagaa

SEQ ID NO: 1506089 - RNA, 19 nt, Homo sapiens
gaaauuugcugaagaacuu

SEQ ID NO: 1506090 - RNA, 19 nt, Homo sapiens
gaaaaugccuugaguaaaa

SEQ ID NO: 1506091 - RNA, 19 nt, Homo sapiens
ggaaacagaagaagaguua

SEQ ID NO: 1506092 - RNA, 19 nt, Homo sapiens
ggacuccugucuaauguua

SEQ ID NO: 1506093 - RNA, 19 nt, Homo sapiens
uaaaguugguucaucguua

SEQ ID NO: 1506094 - RNA, 19 nt, Homo sapiens
gagauugggugaagacauu

SEQ ID NO: 1506095 - RNA, 19 nt, Homo sapiens
gcaggugacucuccuuuga

SEQ ID NO: 1506096 - RNA, 19 nt, Homo sapiens
gagcaugcauuucucugua

SEQ ID NO: 1506097 - RNA, 19 nt, Homo sapiens
cuaaaggaauucaggauaa

SEQ ID NO: 1506098 - RNA, 19 nt, Homo sapiens
caaauuugcuucccagaga

SEQ ID NO: 1506099 - RNA, 19 nt, Homo sapiens
caaguaaaguuaucaguag

SEQ ID NO: 1506100 - RNA, 19 nt, Homo sapiens
gcauuucucuguauuaauc

SEQ ID NO: 1506101 - RNA, 19 nt, Homo sapiens
uuaaaggagugguaacuaa

SEQ ID NO: 1506102 - RNA, 19 nt, Homo sapiens
auacagagauugaaaggaa

SEQ ID NO: 1506103 - RNA, 19 nt, Homo sapiens
gaagaaacaggaaacagaa

SEQ ID NO: 1506104 - RNA, 19 nt, Homo sapiens
gaugaaagcaagcauugua

SEQ ID NO: 1506105 - RNA, 19 nt, Homo sapiens
ggagaaguguguaaagcuu

SEQ ID NO: 1506106 - RNA, 19 nt, Homo sapiens
ugaagaaucuggaauggau

SEQ ID NO: 1506107 - RNA, 19 nt, Homo sapiens
cuacaauucuaccaaguaa

SEQ ID NO: 1506108 - RNA, 19 nt, Homo sapiens
uaaccgaaguucuuaagga

SEQ ID NO: 1506109 - RNA, 19 nt, Homo sapiens
caacagaaauuugcugaag

SEQ ID NO: 1506110 - RNA, 19 nt, Homo sapiens
ggaguuuacuuccacauca

SEQ ID NO: 1506111 - RNA, 19 nt, Homo sapiens
ugaauugccuagaugauga

SEQ ID NO: 1506112 - RNA, 19 nt, Homo sapiens
guaucaggcuguuccagua

SEQ ID NO: 1506113 - RNA, 19 nt, Homo sapiens
gaaagcaagcauuguagaa

SEQ ID NO: 1506114 - RNA, 19 nt, Homo sapiens
guuaguaccucgaaaauaa

SEQ ID NO: 1506115 - RNA, 19 nt, Homo sapiens
gagcacagcacucgacuau

SEQ ID NO: 1506116 - RNA, 19 nt, Homo sapiens
gaaauacaaaggacaacaa

SEQ ID NO: 1506117 - RNA, 19 nt, Homo sapiens
cuaagaauauccaguaaag

SEQ ID NO: 1506118 - RNA, 19 nt, Homo sapiens
ccaguaauauuaagucauc

SEQ ID NO: 1506119 - RNA, 19 nt, Homo sapiens
gaauaaagaaaccaagaga

SEQ ID NO: 1506120 - RNA, 19 nt, Homo sapiens
acagaaauuugcugaagaa

SEQ ID NO: 1506121 - RNA, 19 nt, Homo sapiens
ccaaguaaaguuaucagua

SEQ ID NO: 1506122 - RNA, 19 nt, Homo sapiens
aaaguugguucaucguuaa

SEQ ID NO: 1506123 - RNA, 19 nt, Homo sapiens
caucuaagaauauccagua

SEQ ID NO: 1506124 - RNA, 19 nt, Homo sapiens
agauagacauucaggcuaa

SEQ ID NO: 1506125 - RNA, 19 nt, Homo sapiens
augaugaacuggauucuuu

SEQ ID NO: 1506126 - RNA, 19 nt, Homo sapiens
uuaaagguguugaagaaga

SEQ ID NO: 1506127 - RNA, 19 nt, Homo sapiens
caucagaucagucagauau

SEQ ID NO: 1506128 - RNA, 19 nt, Homo sapiens
gagauaaaguugguucauc

SEQ ID NO: 1506129 - RNA, 19 nt, Homo sapiens
ucaguagcaucauuuauca

SEQ ID NO: 1506130 - RNA, 19 nt, Homo sapiens
ucugaugcuucaagaaaua

SEQ ID NO: 1506131 - RNA, 19 nt, Homo sapiens
cuaaauccuugcagccuuu

SEQ ID NO: 1506132 - RNA, 19 nt, Homo sapiens
guucaagcacguuuagaua

SEQ ID NO: 1506133 - RNA, 19 nt, Homo sapiens
guacgaguuuaugacaaua

SEQ ID NO: 1506134 - RNA, 19 nt, Homo sapiens
caagcacguuuagauaauu

SEQ ID NO: 1506135 - RNA, 19 nt, Homo sapiens
ucaagcacguuuagauaau

SEQ ID NO: 1506136 - RNA, 19 nt, Homo sapiens
ucagaucagucagauauau

SEQ ID NO: 1506137 - RNA, 19 nt, Homo sapiens
gaaacaggaaacagaagaa

SEQ ID NO: 1506138 - RNA, 19 nt, Homo sapiens
gcacguaaaugugaauugc

SEQ ID NO: 1506139 - RNA, 19 nt, Homo sapiens
gcauuugauucucuuuguu

SEQ ID NO: 1506140 - RNA, 19 nt, Homo sapiens
caaagugaaacaugaagaa

SEQ ID NO: 1506141 - RNA, 19 nt, Homo sapiens
cagaggaaguacgaguuua

SEQ ID NO: 1506142 - RNA, 19 nt, Homo sapiens
cagaagaagaguuaauuga

SEQ ID NO: 1506143 - RNA, 19 nt, Homo sapiens
guauauguggugcuuauuu

SEQ ID NO: 1506144 - RNA, 19 nt, Homo sapiens
agacagcugcuuucuuuaa

SEQ ID NO: 1506145 - RNA, 19 nt, Homo sapiens
gaaguacgaguuuaugaca

SEQ ID NO: 1506146 - RNA, 19 nt, Homo sapiens
caacuaauacgaccucauc

SEQ ID NO: 1506147 - RNA, 19 nt, Homo sapiens
gcaugcauuucucuguauu

SEQ ID NO: 1506148 - RNA, 19 nt, Homo sapiens
uaaaggagugguaacuaaa

SEQ ID NO: 1506149 - RNA, 19 nt, Homo sapiens
ggaugccauuugugaauau

SEQ ID NO: 1506150 - RNA, 19 nt, Homo sapiens
guaaagcuuuugccucuaa

SEQ ID NO: 1506151 - RNA, 19 nt, Homo sapiens
ugaagaaacaggaaacaga

SEQ ID NO: 1506152 - RNA, 19 nt, Homo sapiens
caagaaauacaaaggacaa

SEQ ID NO: 1506153 - RNA, 19 nt, Homo sapiens
ccagagaaaugauauucag

SEQ ID NO: 1506154 - RNA, 19 nt, Homo sapiens
acaggaagauagacauuca

SEQ ID NO: 1506155 - RNA, 19 nt, Homo sapiens
aaagaaaccaagagacuga

SEQ ID NO: 1506156 - RNA, 19 nt, Homo sapiens
caggugauuuggauaucua

SEQ ID NO: 1506157 - RNA, 19 nt, Homo sapiens
ggacugaguguuguaguga

SEQ ID NO: 1506158 - RNA, 19 nt, Homo sapiens
uuuaagagcuccaauuugc

SEQ ID NO: 1506159 - RNA, 19 nt, Homo sapiens
gcacucgacuaugacauca

SEQ ID NO: 1506160 - RNA, 19 nt, Homo sapiens
aaucuggaauggaugguaa

SEQ ID NO: 1506161 - RNA, 19 nt, Homo sapiens
uuagcaaagugaaacauga

SEQ ID NO: 1506162 - RNA, 19 nt, Homo sapiens
ugaaagagaacaacugcuu

SEQ ID NO: 1506163 - RNA, 19 nt, Homo sapiens
ggauaauucuccacagcau

SEQ ID NO: 1506164 - RNA, 19 nt, Homo sapiens
gaaguucccaugcuguuca

SEQ ID NO: 1506165 - RNA, 19 nt, Homo sapiens
ucaggcuguuccaguaaua

SEQ ID NO: 1506166 - RNA, 19 nt, Homo sapiens
gcaaagugaaacaugaaga

SEQ ID NO: 1506167 - RNA, 19 nt, Homo sapiens
gaagaaaacaggaagauag

SEQ ID NO: 1506168 - RNA, 19 nt, Homo sapiens
gaaauugcagugugaaacu

SEQ ID NO: 1506169 - RNA, 19 nt, Homo sapiens
aaaguuaucaguagcauca

SEQ ID NO: 1506170 - RNA, 19 nt, Homo sapiens
uaguauauguggugcuuau

SEQ ID NO: 1506171 - RNA, 19 nt, Homo sapiens
ggacuugaagacagaagaa

SEQ ID NO: 1506172 - RNA, 19 nt, Homo sapiens
gauagacauucaggcuaaa

SEQ ID NO: 1506173 - RNA, 19 nt, Homo sapiens
acaguuaaaugaagcaagu

SEQ ID NO: 1506174 - RNA, 19 nt, Homo sapiens
gaacaccauugggcagcuu

SEQ ID NO: 1506175 - RNA, 19 nt, Homo sapiens
aagaauauccaguaaagga

SEQ ID NO: 1506176 - RNA, 19 nt, Homo sapiens
gaagacagaagaaggaaaa

SEQ ID NO: 1506177 - RNA, 19 nt, Homo sapiens
agugguaacuaaaggaauu

SEQ ID NO: 1506178 - RNA, 19 nt, Homo sapiens
cagagcagcuacaguggau

SEQ ID NO: 1506179 - RNA, 19 nt, Homo sapiens
gagaaguguguaaagcuuu

SEQ ID NO: 1506180 - RNA, 19 nt, Homo sapiens
uuaaugggcaaguuuauga

SEQ ID NO: 1506181 - RNA, 19 nt, Homo sapiens
gaaacugcagcacaacaga

SEQ ID NO: 1506182 - RNA, 19 nt, Homo sapiens
ggcauuugauucucuuugu

SEQ ID NO: 1506183 - RNA, 19 nt, Homo sapiens
gauaguuugcuccagauga

SEQ ID NO: 1506184 - RNA, 19 nt, Homo sapiens
gacagcugcuuucuuuaag

SEQ ID NO: 1506185 - RNA, 19 nt, Homo sapiens
aaaugaagcaagugaagaa

SEQ ID NO: 1506186 - RNA, 19 nt, Homo sapiens
uaaagguguugaagaagag

SEQ ID NO: 1506187 - RNA, 19 nt, Homo sapiens
ggaacaagaucuccuauuu

SEQ ID NO: 1506188 - RNA, 19 nt, Homo sapiens
gcagagcccugaagaaucu

SEQ ID NO: 1506189 - RNA, 19 nt, Homo sapiens
gaucaaagcccugcucauu

SEQ ID NO: 1506190 - RNA, 19 nt, Homo sapiens
gacaaagcauggaaugaaa

SEQ ID NO: 1506191 - RNA, 19 nt, Homo sapiens
gcacaaaccuggccuacac

SEQ ID NO: 1506192 - RNA, 19 nt, Homo sapiens
gaagauacaagaagcuuug

SEQ ID NO: 1506193 - RNA, 19 nt, Homo sapiens
gaacaagaucuccuauuuc

SEQ ID NO: 1506194 - RNA, 19 nt, Homo sapiens
cagacaagguccuagauau

SEQ ID NO: 1506195 - RNA, 19 nt, Homo sapiens
ugaaauacguggccaaggu

SEQ ID NO: 1506196 - RNA, 19 nt, Homo sapiens
ucaaagcccugcucauucu

SEQ ID NO: 1506197 - RNA, 19 nt, Homo sapiens
gggcacagccagaagcuaa

SEQ ID NO: 1506198 - RNA, 19 nt, Homo sapiens
cauuacaucuucaccauuc

SEQ ID NO: 1506199 - RNA, 19 nt, Homo sapiens
gcugagaccuucgcuguca

SEQ ID NO: 1506200 - RNA, 19 nt, Homo sapiens
gagcaugucagaaggcauu

SEQ ID NO: 1506201 - RNA, 19 nt, Homo sapiens
ggacaggaagauacaagaa

SEQ ID NO: 1506202 - RNA, 19 nt, Homo sapiens
ucuccacggucccucauua

SEQ ID NO: 1506203 - RNA, 19 nt, Homo sapiens
ggagagggcagcaaagcuu

SEQ ID NO: 1506204 - RNA, 19 nt, Homo sapiens
ccaagcaucccaaccugua

SEQ ID NO: 1506205 - RNA, 19 nt, Homo sapiens
gugcucaccuggaauguca

SEQ ID NO: 1506206 - RNA, 19 nt, Homo sapiens
gggaauuucuauugugcuu

SEQ ID NO: 1506207 - RNA, 19 nt, Homo sapiens
gugaguugcugccuucaga

SEQ ID NO: 1506208 - RNA, 19 nt, Homo sapiens
caacagaguguaaugucaa

SEQ ID NO: 1506209 - RNA, 19 nt, Homo sapiens
ucaaguggaaccuguauga

SEQ ID NO: 1506210 - RNA, 19 nt, Homo sapiens
ggaagauacaagaagcuuu

SEQ ID NO: 1506211 - RNA, 19 nt, Homo sapiens
gaacucuccaggacacuga

SEQ ID NO: 1506212 - RNA, 19 nt, Homo sapiens
agacaaagcauggaaugaa

SEQ ID NO: 1506213 - RNA, 19 nt, Homo sapiens
gcaaagcuuccuccuucaa

SEQ ID NO: 1506214 - RNA, 19 nt, Homo sapiens
gcuggucuccgucuaugua

SEQ ID NO: 1506215 - RNA, 19 nt, Homo sapiens
ggagagacaaagcauggaa

SEQ ID NO: 1506216 - RNA, 19 nt, Homo sapiens
gagaggucaucauggacuu

SEQ ID NO: 1506217 - RNA, 19 nt, Homo sapiens
cguaauggaacugaaauaa

SEQ ID NO: 1506218 - RNA, 19 nt, Homo sapiens
gccuucagcuuacccaaug

SEQ ID NO: 1506219 - RNA, 19 nt, Homo sapiens
gagccugacucuccaucug

SEQ ID NO: 1506220 - RNA, 19 nt, Homo sapiens
cuauguacaucuggacuuu

SEQ ID NO: 1506221 - RNA, 19 nt, Homo sapiens
gaggaggaguugggacaga

SEQ ID NO: 1506222 - RNA, 19 nt, Homo sapiens
gaaugaaaggauagacaga

SEQ ID NO: 1506223 - RNA, 19 nt, Homo sapiens
ccaucucccuggugaguug

SEQ ID NO: 1506224 - RNA, 19 nt, Homo sapiens
cuugggagcuuccauacug

SEQ ID NO: 1506225 - RNA, 19 nt, Homo sapiens
gggcuugggagcuuccaua

SEQ ID NO: 1506226 - RNA, 19 nt, Homo sapiens
guaauggaacugaaauaag

SEQ ID NO: 1506227 - RNA, 19 nt, Homo sapiens
acaacagaguguaauguca

SEQ ID NO: 1506228 - RNA, 19 nt, Homo sapiens
ccacguuuccugcugacua

SEQ ID NO: 1506229 - RNA, 19 nt, Homo sapiens
ccacagacaagguccuaga

SEQ ID NO: 1506230 - RNA, 19 nt, Homo sapiens
caucccaaccuguaaguga

SEQ ID NO: 1506231 - RNA, 19 nt, Homo sapiens
cagcugcucuuugucuuuc

SEQ ID NO: 1506232 - RNA, 19 nt, Homo sapiens
acagacaagguccuagaua

SEQ ID NO: 1506233 - RNA, 19 nt, Homo sapiens
ccauuacccuccuugucaa

SEQ ID NO: 1506234 - RNA, 19 nt, Homo sapiens
gagacaaagcauggaauga

SEQ ID NO: 1506235 - RNA, 19 nt, Homo sapiens
agggagaggucaucaugga

SEQ ID NO: 1506236 - RNA, 19 nt, Homo sapiens
ccagggagaggucaucaug

SEQ ID NO: 1506237 - RNA, 19 nt, Homo sapiens
gacaagguccuagauaugg

SEQ ID NO: 1506238 - RNA, 19 nt, Homo sapiens
agacaagguccuagauaug

SEQ ID NO: 1506239 - RNA, 19 nt, Homo sapiens
gcagcaaagcuuccuccuu

SEQ ID NO: 1506240 - RNA, 19 nt, Homo sapiens
gcgcuggucuccgucuaug

SEQ ID NO: 1506241 - RNA, 19 nt, Homo sapiens
cagggcgucuucauccuau

SEQ ID NO: 1506242 - RNA, 19 nt, Homo sapiens
ccgcagagcccugaagaau

SEQ ID NO: 1506243 - RNA, 19 nt, Homo sapiens
gucaggcucucagugcuuu

SEQ ID NO: 1506244 - RNA, 19 nt, Homo sapiens
gucaaagccuccacaacca

SEQ ID NO: 1506245 - RNA, 19 nt, Homo sapiens
agcauggaaugaaaggaua

SEQ ID NO: 1506246 - RNA, 19 nt, Homo sapiens
aacaagaucuccuauuucc

SEQ ID NO: 1506247 - RNA, 19 nt, Homo sapiens
gcuuugugcuggcuguuca

SEQ ID NO: 1506248 - RNA, 19 nt, Homo sapiens
cauaccagcuguccaucuc

SEQ ID NO: 1506249 - RNA, 19 nt, Homo sapiens
aaagcccugcucauucuua

SEQ ID NO: 1506250 - RNA, 19 nt, Homo sapiens
ggccugguccuugucauuu

SEQ ID NO: 1506251 - RNA, 19 nt, Homo sapiens
cuucugcccucaaacuaug

SEQ ID NO: 1506252 - RNA, 19 nt, Homo sapiens
gugaguacaugagcugcuu

SEQ ID NO: 1506253 - RNA, 19 nt, Homo sapiens
caagcaucccaaccuguaa

SEQ ID NO: 1506254 - RNA, 19 nt, Homo sapiens
cugcagagccagcuguuug

SEQ ID NO: 1506255 - RNA, 19 nt, Homo sapiens
cugaggaggugccacagau

SEQ ID NO: 1506256 - RNA, 19 nt, Homo sapiens
ucuccaacaugucccauca

SEQ ID NO: 1506257 - RNA, 19 nt, Homo sapiens
cauccaagagcaugucaga

SEQ ID NO: 1506258 - RNA, 19 nt, Homo sapiens
ccucauggacaggaagaua

SEQ ID NO: 1506259 - RNA, 19 nt, Homo sapiens
cgucuucauccuauuguuu

SEQ ID NO: 1506260 - RNA, 19 nt, Homo sapiens
cacggucccucauuacauc

SEQ ID NO: 1506261 - RNA, 19 nt, Homo sapiens
acaagguccuagauaugga

SEQ ID NO: 1506262 - RNA, 19 nt, Homo sapiens
cuccuggccuuguucacua

SEQ ID NO: 1506263 - RNA, 19 nt, Homo sapiens
cccaccagcugcucuuugu

SEQ ID NO: 1506264 - RNA, 19 nt, Homo sapiens
caaggggaauuucuauugu

SEQ ID NO: 1506265 - RNA, 19 nt, Homo sapiens
ccagggcgucuucauccua

SEQ ID NO: 1506266 - RNA, 19 nt, Homo sapiens
aguguaaugucaaccacaa

SEQ ID NO: 1506267 - RNA, 19 nt, Homo sapiens
gacaggaagauacaagaag

SEQ ID NO: 1506268 - RNA, 19 nt, Homo sapiens
gcuccuggaccaagagaau

SEQ ID NO: 1506269 - RNA, 19 nt, Homo sapiens
ccaagggccagacaaugug

SEQ ID NO: 1506270 - RNA, 19 nt, Homo sapiens
gagagacaaagcauggaau

SEQ ID NO: 1506271 - RNA, 19 nt, Homo sapiens
gggcgucuucauccuauug

SEQ ID NO: 1506272 - RNA, 19 nt, Homo sapiens
gguccguaauggaacugaa

SEQ ID NO: 1506273 - RNA, 19 nt, Homo sapiens
gaccgcagagcccugaaga

SEQ ID NO: 1506274 - RNA, 19 nt, Homo sapiens
gacaugggcacagccagaa

SEQ ID NO: 1506275 - RNA, 19 nt, Homo sapiens
ggaagggaggggcguuaua

SEQ ID NO: 1506276 - RNA, 19 nt, Homo sapiens
cacacacuguuccggaaga

SEQ ID NO: 1506277 - RNA, 19 nt, Homo sapiens
cccaagggccagacaaugu

SEQ ID NO: 1506278 - RNA, 19 nt, Homo sapiens
ggcagcuccuggaccaaga

SEQ ID NO: 1506279 - RNA, 19 nt, Homo sapiens
ucacaacagaguguaaugu

SEQ ID NO: 1506280 - RNA, 19 nt, Homo sapiens
gccucagacucacaacaga

SEQ ID NO: 1506281 - RNA, 19 nt, Homo sapiens
ccagcugcucuuugucuuu

SEQ ID NO: 1506282 - RNA, 19 nt, Homo sapiens
ccgccuuccucugucauuu

SEQ ID NO: 1506283 - RNA, 19 nt, Homo sapiens
ccacugcaggcucagauuc

SEQ ID NO: 1506284 - RNA, 19 nt, Homo sapiens
accagcaucugccuccauu

SEQ ID NO: 1506285 - RNA, 19 nt, Homo sapiens
cuauugugcuugccucucu

SEQ ID NO: 1506286 - RNA, 19 nt, Homo sapiens
ccacggucccucauuacau

SEQ ID NO: 1506287 - RNA, 19 nt, Homo sapiens
gaucaggccuccuucaaga

SEQ ID NO: 1506288 - RNA, 19 nt, Homo sapiens
gcagaugucuuggcaguga

SEQ ID NO: 1506289 - RNA, 19 nt, Homo sapiens
caagucaccuccuggguaa

SEQ ID NO: 1506290 - RNA, 19 nt, Homo sapiens
uaggagaccugcagacuug

SEQ ID NO: 1506291 - RNA, 19 nt, Homo sapiens
ggagaaagcugagcaucca

SEQ ID NO: 1506292 - RNA, 19 nt, Homo sapiens
caaaugugguggacagcuu

SEQ ID NO: 1506293 - RNA, 19 nt, Homo sapiens
caagucugcugaggagaaa

SEQ ID NO: 1506294 - RNA, 19 nt, Homo sapiens
caacaucuggagacaaaga

SEQ ID NO: 1506295 - RNA, 19 nt, Homo sapiens
gagugcaguuguuccagaa

SEQ ID NO: 1506296 - RNA, 19 nt, Homo sapiens
ccagugagcauuuauuucu

SEQ ID NO: 1506297 - RNA, 19 nt, Homo sapiens
cagugagcauuuauuucua

SEQ ID NO: 1506298 - RNA, 19 nt, Homo sapiens
ccagugaggagaacagcua

SEQ ID NO: 1506299 - RNA, 19 nt, Homo sapiens
gaugacagcaggucuaagg

SEQ ID NO: 1506300 - RNA, 19 nt, Homo sapiens
ucacaaauggcgaguguuc

SEQ ID NO: 1506301 - RNA, 19 nt, Homo sapiens
caccagugagcauuuauuu

SEQ ID NO: 1506302 - RNA, 19 nt, Homo sapiens
ucaguggccuccagagauc

SEQ ID NO: 1506303 - RNA, 19 nt, Homo sapiens
ucuaugagccuucagaauc

SEQ ID NO: 1506304 - RNA, 19 nt, Homo sapiens
gccagaagacacccagaaa

SEQ ID NO: 1506305 - RNA, 19 nt, Homo sapiens
ugucacaaauggcgagugu

SEQ ID NO: 1506306 - RNA, 19 nt, Homo sapiens
aucaacaucuggagacaaa

SEQ ID NO: 1506307 - RNA, 19 nt, Homo sapiens
ccaagucugcugaggagaa

SEQ ID NO: 1506308 - RNA, 19 nt, Homo sapiens
ccagaacacggccagaaga

SEQ ID NO: 1506309 - RNA, 19 nt, Homo sapiens
gagugaugcugaccauguc

SEQ ID NO: 1506310 - RNA, 19 nt, Homo sapiens
cgagagugaugcugaccau

SEQ ID NO: 1506311 - RNA, 19 nt, Homo sapiens
acucacagcagaugucuug

SEQ ID NO: 1506312 - RNA, 19 nt, Homo sapiens
ggacaagucagagucuagu

SEQ ID NO: 1506313 - RNA, 19 nt, Homo sapiens
gcugaagcuuuaccaucug

SEQ ID NO: 1506314 - RNA, 19 nt, Homo sapiens
gggacaggcagguucaaga

SEQ ID NO: 1506315 - RNA, 19 nt, Homo sapiens
uccacugacuggcaggaua

SEQ ID NO: 1506316 - RNA, 19 nt, Homo sapiens
ccacugacuggcaggauau

SEQ ID NO: 1506317 - RNA, 19 nt, Homo sapiens
caaagacaagagugcaguu

SEQ ID NO: 1506318 - RNA, 19 nt, Homo sapiens
gaaagcugagcauccaaag

SEQ ID NO: 1506319 - RNA, 19 nt, Homo sapiens
ggacaggcagguucaagac

SEQ ID NO: 1506320 - RNA, 19 nt, Homo sapiens
guucaagacgcaaggacaa

SEQ ID NO: 1506321 - RNA, 19 nt, Homo sapiens
ggccagaagacacccagaa

SEQ ID NO: 1506322 - RNA, 19 nt, Homo sapiens
ccagggccauaucaacauc

SEQ ID NO: 1506323 - RNA, 19 nt, Homo sapiens
aaaugugguggacagcuua

SEQ ID NO: 1506324 - RNA, 19 nt, Homo sapiens
cugaagcuuuaccaucuga

SEQ ID NO: 1506325 - RNA, 19 nt, Homo sapiens
agaaagcugagcauccaaa

SEQ ID NO: 1506326 - RNA, 19 nt, Homo sapiens
cgaguguuccugagagaga

SEQ ID NO: 1506327 - RNA, 19 nt, Homo sapiens
ggcgaguguuccugagaga

SEQ ID NO: 1506328 - RNA, 19 nt, Homo sapiens
guucaguggccuccagaga

SEQ ID NO: 1506329 - RNA, 19 nt, Homo sapiens
agagugaugcugaccaugu

SEQ ID NO: 1506330 - RNA, 19 nt, Homo sapiens
caaggucaggucccacuca

SEQ ID NO: 1506331 - RNA, 19 nt, Homo sapiens
ccugcucccuugcccauuc

SEQ ID NO: 1506332 - RNA, 19 nt, Homo sapiens
uagaucaggccuccuucaa

SEQ ID NO: 1506333 - RNA, 19 nt, Homo sapiens
gacgcaaggacaagucaga

SEQ ID NO: 1506334 - RNA, 19 nt, Homo sapiens
caagagugcaguuguucca

SEQ ID NO: 1506335 - RNA, 19 nt, Homo sapiens
ucacagcaggugccaaugg

SEQ ID NO: 1506336 - RNA, 19 nt, Homo sapiens
ugacuggcaggauauagau

SEQ ID NO: 1506337 - RNA, 19 nt, Homo sapiens
cccagcccaugcaauaaau

SEQ ID NO: 1506338 - RNA, 19 nt, Homo sapiens
ugagagagagccggaguca

SEQ ID NO: 1506339 - RNA, 19 nt, Homo sapiens
agucagagucuagugguuu

SEQ ID NO: 1506340 - RNA, 19 nt, Homo sapiens
caugagaccuggcgcuuug

SEQ ID NO: 1506341 - RNA, 19 nt, Homo sapiens
ucaccuaccucaacagugu

SEQ ID NO: 1506342 - RNA, 19 nt, Homo sapiens
ggcgaggucucucuggaaa

SEQ ID NO: 1506343 - RNA, 19 nt, Homo sapiens
caaagucaaccucuucaug

SEQ ID NO: 1506344 - RNA, 19 nt, Homo sapiens
gcgcucauccucuuugcua

SEQ ID NO: 1506345 - RNA, 19 nt, Homo sapiens
guagaagacuccagaaccu

SEQ ID NO: 1506346 - RNA, 19 nt, Homo sapiens
acuacuaccuccuccauga

SEQ ID NO: 1506347 - RNA, 19 nt, Homo sapiens
ucacagccaucgcacucaa

SEQ ID NO: 1506348 - RNA, 19 nt, Homo sapiens
gcugcugccugcaaaguca

SEQ ID NO: 1506349 - RNA, 19 nt, Homo sapiens
gugccaaucaucccacuuu

SEQ ID NO: 1506350 - RNA, 19 nt, Homo sapiens
cacuguaccugcuggaguu

SEQ ID NO: 1506351 - RNA, 19 nt, Homo sapiens
gaacaguuuggcccucuuc

SEQ ID NO: 1506352 - RNA, 19 nt, Homo sapiens
ccauggaacuucauaaccu

SEQ ID NO: 1506353 - RNA, 19 nt, Homo sapiens
uggcuuccaugguggcuuu

SEQ ID NO: 1506354 - RNA, 19 nt, Homo sapiens
gcucauccucuuugcuauu

SEQ ID NO: 1506355 - RNA, 19 nt, Homo sapiens
ggaacaguuuggcccucuu

SEQ ID NO: 1506356 - RNA, 19 nt, Homo sapiens
ggacuacuaccuccuccau

SEQ ID NO: 1506357 - RNA, 19 nt, Homo sapiens
ccaagcagcccauggaacu

SEQ ID NO: 1506358 - RNA, 19 nt, Homo sapiens
gcugcgagaaugcugauga

SEQ ID NO: 1506359 - RNA, 19 nt, Homo sapiens
gcuacagggugggcacgaa

SEQ ID NO: 1506360 - RNA, 19 nt, Homo sapiens
gaugaaaaccccaggaugu

SEQ ID NO: 1506361 - RNA, 19 nt, Homo sapiens
aaccugagcucuccaucuc

SEQ ID NO: 1506362 - RNA, 19 nt, Homo sapiens
gugcucuacugcuucucua

SEQ ID NO: 1506363 - RNA, 19 nt, Homo sapiens
cugcgagaaugcugaugaa

SEQ ID NO: 1506364 - RNA, 19 nt, Homo sapiens
guuuggcccucuucaucuu

SEQ ID NO: 1506365 - RNA, 19 nt, Homo sapiens
gggcgaggucucucuggaa

SEQ ID NO: 1506366 - RNA, 19 nt, Homo sapiens
cgagaaugcugaugaaaac

SEQ ID NO: 1506367 - RNA, 19 nt, Homo sapiens
cgacgagagcuccuaccaa

SEQ ID NO: 1506368 - RNA, 19 nt, Homo sapiens
gcaaagucaaccucuucau

SEQ ID NO: 1506369 - RNA, 19 nt, Homo sapiens
gcgagaaugcugaugaaaa

SEQ ID NO: 1506370 - RNA, 19 nt, Homo sapiens
ucugcucccucugccuuua

SEQ ID NO: 1506371 - RNA, 19 nt, Homo sapiens
ccauagggaagcugaaagu

SEQ ID NO: 1506372 - RNA, 19 nt, Homo sapiens
ggccauagggaagcugaaa

SEQ ID NO: 1506373 - RNA, 19 nt, Homo sapiens
uaggaaggcggaggccaua

SEQ ID NO: 1506374 - RNA, 19 nt, Homo sapiens
ccauggugguggccgucua

SEQ ID NO: 1506375 - RNA, 19 nt, Homo sapiens
cauccucuuugcuauugug

SEQ ID NO: 1506376 - RNA, 19 nt, Homo sapiens
ccucugccuuuaccacugu

SEQ ID NO: 1506377 - RNA, 19 nt, Homo sapiens
cuacaccaucugcuucuug

SEQ ID NO: 1506378 - RNA, 19 nt, Homo sapiens
gcacggccagcguugucuu

SEQ ID NO: 1506379 - RNA, 19 nt, Homo sapiens
cucauccucuuugcuauug

SEQ ID NO: 1506380 - RNA, 19 nt, Homo sapiens
gaaaaccccaggauguugu

SEQ ID NO: 1506381 - RNA, 19 nt, Homo sapiens
aauccuggcccuggaguuu

SEQ ID NO: 1506382 - RNA, 19 nt, Homo sapiens
ggaaagagcuggugaugaa

SEQ ID NO: 1506383 - RNA, 19 nt, Homo sapiens
ggaaugacaugaccuguga

SEQ ID NO: 1506384 - RNA, 19 nt, Homo sapiens
gguggaagcuuauauuauu

SEQ ID NO: 1506385 - RNA, 19 nt, Homo sapiens
caacauuacugggcauuua

SEQ ID NO: 1506386 - RNA, 19 nt, Homo sapiens
gaacacaaaugcuuuaaac

SEQ ID NO: 1506387 - RNA, 19 nt, Homo sapiens
gagcuuauccagacauuua

SEQ ID NO: 1506388 - RNA, 19 nt, Homo sapiens
gacagcagguccucaauaa

SEQ ID NO: 1506389 - RNA, 19 nt, Homo sapiens
caacaaucaucaccacuuu

SEQ ID NO: 1506390 - RNA, 19 nt, Homo sapiens
ccacucagaagguauauua

SEQ ID NO: 1506391 - RNA, 19 nt, Homo sapiens
guucaaugguggaagcuua

SEQ ID NO: 1506392 - RNA, 19 nt, Homo sapiens
ggucuuaaauggucauaug

SEQ ID NO: 1506393 - RNA, 19 nt, Homo sapiens
ugaagacuguguccaaauu

SEQ ID NO: 1506394 - RNA, 19 nt, Homo sapiens
gcagaacacaaaugcuuua

SEQ ID NO: 1506395 - RNA, 19 nt, Homo sapiens
acacagauguuaaggaguu

SEQ ID NO: 1506396 - RNA, 19 nt, Homo sapiens
gccaauagcaguuuaaaga

SEQ ID NO: 1506397 - RNA, 19 nt, Homo sapiens
gcagaaaugcgagagcuua

SEQ ID NO: 1506398 - RNA, 19 nt, Homo sapiens
ggucauuacuucacaggaa

SEQ ID NO: 1506399 - RNA, 19 nt, Homo sapiens
ccagacagauacucagauu

SEQ ID NO: 1506400 - RNA, 19 nt, Homo sapiens
cuuaagaggucauuuggaa

SEQ ID NO: 1506401 - RNA, 19 nt, Homo sapiens
uaaaggaugccacuacauu

SEQ ID NO: 1506402 - RNA, 19 nt, Homo sapiens
ccaaagcucuaaccaugga

SEQ ID NO: 1506403 - RNA, 19 nt, Homo sapiens
guagaaauccagauguuga

SEQ ID NO: 1506404 - RNA, 19 nt, Homo sapiens
ugacaucaguggcuucuca

SEQ ID NO: 1506405 - RNA, 19 nt, Homo sapiens
cagcagaaguggaaugaca

SEQ ID NO: 1506406 - RNA, 19 nt, Homo sapiens
aaagucagcuucuccagau

SEQ ID NO: 1506407 - RNA, 19 nt, Homo sapiens
gauguugaaugccaguuug

SEQ ID NO: 1506408 - RNA, 19 nt, Homo sapiens
gagcagagucgccugaaga

SEQ ID NO: 1506409 - RNA, 19 nt, Homo sapiens
gcugagauccaguucuuaa

SEQ ID NO: 1506410 - RNA, 19 nt, Homo sapiens
auaaagcccuguugucuuc

SEQ ID NO: 1506411 - RNA, 19 nt, Homo sapiens
ggagcaggcauuucuggua

SEQ ID NO: 1506412 - RNA, 19 nt, Homo sapiens
gagcccaucuggcaucugu

SEQ ID NO: 1506413 - RNA, 19 nt, Homo sapiens
gcaugaggcugagcaguuc

SEQ ID NO: 1506414 - RNA, 19 nt, Homo sapiens
gugcugagauccaguucuu

SEQ ID NO: 1506415 - RNA, 19 nt, Homo sapiens
cagcagguccucaauaaau

SEQ ID NO: 1506416 - RNA, 19 nt, Homo sapiens
ugguagaguucacaaguaa

SEQ ID NO: 1506417 - RNA, 19 nt, Homo sapiens
uaccuuaaaugcccagauu

SEQ ID NO: 1506418 - RNA, 19 nt, Homo sapiens
gaucaaggaagcagagaug

SEQ ID NO: 1506419 - RNA, 19 nt, Homo sapiens
ccucugagcucugcuuguu

SEQ ID NO: 1506420 - RNA, 19 nt, Homo sapiens
gagaggccaucuagauagu

SEQ ID NO: 1506421 - RNA, 19 nt, Homo sapiens
gaacgcuaaugcugagauc

SEQ ID NO: 1506422 - RNA, 19 nt, Homo sapiens
aaacaaggaaugaagaaug

SEQ ID NO: 1506423 - RNA, 19 nt, Homo sapiens
cucagaagguauauuauug

SEQ ID NO: 1506424 - RNA, 19 nt, Homo sapiens
gagagcuuauccagacauu

SEQ ID NO: 1506425 - RNA, 19 nt, Homo sapiens
gcuugcagcuucauagaca

SEQ ID NO: 1506426 - RNA, 19 nt, Homo sapiens
caaauacccaggcucaguu

SEQ ID NO: 1506427 - RNA, 19 nt, Homo sapiens
ggcagaugcuuuaacuuuc

SEQ ID NO: 1506428 - RNA, 19 nt, Homo sapiens
uaguagaaauccagauguu

SEQ ID NO: 1506429 - RNA, 19 nt, Homo sapiens
cagaagguauauuauugug

SEQ ID NO: 1506430 - RNA, 19 nt, Homo sapiens
agacagauacucagauuca

SEQ ID NO: 1506431 - RNA, 19 nt, Homo sapiens
caauagcaguuuaaagaac

SEQ ID NO: 1506432 - RNA, 19 nt, Homo sapiens
ggucuucucucuugugacu

SEQ ID NO: 1506433 - RNA, 19 nt, Homo sapiens
gagaacaccaaagcucuaa

SEQ ID NO: 1506434 - RNA, 19 nt, Homo sapiens
gugccgagauccagagguu

SEQ ID NO: 1506435 - RNA, 19 nt, Homo sapiens
gaaggccagugccgagauc

SEQ ID NO: 1506436 - RNA, 19 nt, Homo sapiens
ccaauagcaguuuaaagaa

SEQ ID NO: 1506437 - RNA, 19 nt, Homo sapiens
guuagccaauagcaguuua

SEQ ID NO: 1506438 - RNA, 19 nt, Homo sapiens
uaaaaggaguucuaaagga

SEQ ID NO: 1506439 - RNA, 19 nt, Homo sapiens
aaacaccaaugcugacauc

SEQ ID NO: 1506440 - RNA, 19 nt, Homo sapiens
gcagacagcagguccucaa

SEQ ID NO: 1506441 - RNA, 19 nt, Homo sapiens
gaaggacccaucucaaguc

SEQ ID NO: 1506442 - RNA, 19 nt, Homo sapiens
cugcaaggcuggaaguuca

SEQ ID NO: 1506443 - RNA, 19 nt, Homo sapiens
gagauccaguucuuaagag

SEQ ID NO: 1506444 - RNA, 19 nt, Homo sapiens
gcaaauacccaggcucagu

SEQ ID NO: 1506445 - RNA, 19 nt, Homo sapiens
agcagguccucaauaaaua

SEQ ID NO: 1506446 - RNA, 19 nt, Homo sapiens
gcacaagaaugggcagacu

SEQ ID NO: 1506447 - RNA, 19 nt, Homo sapiens
caacacuagugcugagauc

SEQ ID NO: 1506448 - RNA, 19 nt, Homo sapiens
aggcagaugcuuuaacuuu

SEQ ID NO: 1506449 - RNA, 19 nt, Homo sapiens
uuacugggcauuuaccuuu

SEQ ID NO: 1506450 - RNA, 19 nt, Homo sapiens
gccuucaucuaacaguaua

SEQ ID NO: 1506451 - RNA, 19 nt, Homo sapiens
gucccuggauccucaguaa

SEQ ID NO: 1506452 - RNA, 19 nt, Homo sapiens
gcugagauccagggacuaa

SEQ ID NO: 1506453 - RNA, 19 nt, Homo sapiens
agacagcagguccucaaua

SEQ ID NO: 1506454 - RNA, 19 nt, Homo sapiens
ccaaggaggagcaggcauu

SEQ ID NO: 1506455 - RNA, 19 nt, Homo sapiens
gaggccaucuagauagugu

SEQ ID NO: 1506456 - RNA, 19 nt, Homo sapiens
gggaaccaaugcugagauc

SEQ ID NO: 1506457 - RNA, 19 nt, Homo sapiens
ucuugugacucucuuugua

SEQ ID NO: 1506458 - RNA, 19 nt, Homo sapiens
cuacaaagaacccaaaguc

SEQ ID NO: 1506459 - RNA, 19 nt, Homo sapiens
gaagacuguguccaaauuc

SEQ ID NO: 1506460 - RNA, 19 nt, Homo sapiens
cugguagaguucacaagua

SEQ ID NO: 1506461 - RNA, 19 nt, Homo sapiens
gccgagauccagagguuaa

SEQ ID NO: 1506462 - RNA, 19 nt, Homo sapiens
gaaagagcuggugaugaaa

SEQ ID NO: 1506463 - RNA, 19 nt, Homo sapiens
ccaucuagauagugucaau

SEQ ID NO: 1506464 - RNA, 19 nt, Homo sapiens
gcagaugcuuuaacuuucc

SEQ ID NO: 1506465 - RNA, 19 nt, Homo sapiens
uccagaggcucaaggaaga

SEQ ID NO: 1506466 - RNA, 19 nt, Homo sapiens
guauaaagcccuguugucu

SEQ ID NO: 1506467 - RNA, 19 nt, Homo sapiens
ucacaggaacagcuacaaa

SEQ ID NO: 1506468 - RNA, 19 nt, Homo sapiens
aagagcuggugaugaaauu

SEQ ID NO: 1506469 - RNA, 19 nt, Homo sapiens
gaaccaaugcugagaucca

SEQ ID NO: 1506470 - RNA, 19 nt, Homo sapiens
aaauccagauguugaagug

SEQ ID NO: 1506471 - RNA, 19 nt, Homo sapiens
ggcaugaggcugagcaguu

SEQ ID NO: 1506472 - RNA, 19 nt, Homo sapiens
caggaacagcuacaaagaa

SEQ ID NO: 1506473 - RNA, 19 nt, Homo sapiens
agauucaggucuuaaaugg

SEQ ID NO: 1506474 - RNA, 19 nt, Homo sapiens
acacaaaugcuuuaaacuc

SEQ ID NO: 1506475 - RNA, 19 nt, Homo sapiens
gcaguuuaaagaacgcuaa

SEQ ID NO: 1506476 - RNA, 19 nt, Homo sapiens
aaugcaaacucugaaauuc

SEQ ID NO: 1506477 - RNA, 19 nt, Homo sapiens
gaaauccagauguugaagu

SEQ ID NO: 1506478 - RNA, 19 nt, Homo sapiens
gguaguagaaauccagaug

SEQ ID NO: 1506479 - RNA, 19 nt, Homo sapiens
agaaugggcagacugaaga

SEQ ID NO: 1506480 - RNA, 19 nt, Homo sapiens
guucacaaguaaaguguac

SEQ ID NO: 1506481 - RNA, 19 nt, Homo sapiens
uaagaggucauuuggaaag

SEQ ID NO: 1506482 - RNA, 19 nt, Homo sapiens
gaaauuaccuucuccuaac

SEQ ID NO: 1506483 - RNA, 19 nt, Homo sapiens
gaaccugagucccaagaaa

SEQ ID NO: 1506484 - RNA, 19 nt, Homo sapiens
ggaaauuaccuucuccuaa

SEQ ID NO: 1506485 - RNA, 19 nt, Homo sapiens
gcagagaccuucagaaagc

SEQ ID NO: 1506486 - RNA, 19 nt, Homo sapiens
ggacauggaugcccgaaag

SEQ ID NO: 1506487 - RNA, 19 nt, Homo sapiens
gaauugaacuucccuuguc

SEQ ID NO: 1506488 - RNA, 19 nt, Homo sapiens
gaauggagcuggguucauc

SEQ ID NO: 1506489 - RNA, 19 nt, Homo sapiens
caucugggcugcucgcuuu

SEQ ID NO: 1506490 - RNA, 19 nt, Homo sapiens
gaacucaugcaacgaauug

SEQ ID NO: 1506491 - RNA, 19 nt, Homo sapiens
gagcagaauuccaaguguu

SEQ ID NO: 1506492 - RNA, 19 nt, Homo sapiens
gaaagguuguggucacuca

SEQ ID NO: 1506493 - RNA, 19 nt, Homo sapiens
guaaaccacagucuacaua

SEQ ID NO: 1506494 - RNA, 19 nt, Homo sapiens
ggaccagccugcuccagaa

SEQ ID NO: 1506495 - RNA, 19 nt, Homo sapiens
agaaagcacuggugucaga

SEQ ID NO: 1506496 - RNA, 19 nt, Homo sapiens
acuagaagcuccaccauug

SEQ ID NO: 1506497 - RNA, 19 nt, Homo sapiens
ccuggaagauuuagacuau

SEQ ID NO: 1506498 - RNA, 19 nt, Homo sapiens
uuuagaagcccaaaguuua

SEQ ID NO: 1506499 - RNA, 19 nt, Homo sapiens
ggguucaucucaucacauu

SEQ ID NO: 1506500 - RNA, 19 nt, Homo sapiens
ccagguguaugaagccuuu

SEQ ID NO: 1506501 - RNA, 19 nt, Homo sapiens
ggacugacaugcuccucau

SEQ ID NO: 1506502 - RNA, 19 nt, Homo sapiens
ucaguggugugcagaguuu

SEQ ID NO: 1506503 - RNA, 19 nt, Homo sapiens
ugcaagcccuggaagauuu

SEQ ID NO: 1506504 - RNA, 19 nt, Homo sapiens
caaagcacccagacagauu

SEQ ID NO: 1506505 - RNA, 19 nt, Homo sapiens
cuaccacaauuucaccaua

SEQ ID NO: 1506506 - RNA, 19 nt, Homo sapiens
uggcccagcucuccucaua

SEQ ID NO: 1506507 - RNA, 19 nt, Homo sapiens
uggcagcccuggaugauga

SEQ ID NO: 1506508 - RNA, 19 nt, Homo sapiens
gcuccgaaguguuuacaau

SEQ ID NO: 1506509 - RNA, 19 nt, Homo sapiens
cagagagccuggugagaga

SEQ ID NO: 1506510 - RNA, 19 nt, Homo sapiens
gagcuggguucaucucauc

SEQ ID NO: 1506511 - RNA, 19 nt, Homo sapiens
cacagaugcugguggaauu

SEQ ID NO: 1506512 - RNA, 19 nt, Homo sapiens
caggagaugugcuaguguu

SEQ ID NO: 1506513 - RNA, 19 nt, Homo sapiens
aagcacuggugucagaaua

SEQ ID NO: 1506514 - RNA, 19 nt, Homo sapiens
gcaagcccuggaagauuua

SEQ ID NO: 1506515 - RNA, 19 nt, Homo sapiens
gauccgagcagaauuccaa

SEQ ID NO: 1506516 - RNA, 19 nt, Homo sapiens
cgaaguguuuacaauccua

SEQ ID NO: 1506517 - RNA, 19 nt, Homo sapiens
gcggguugcugaugagaug

SEQ ID NO: 1506518 - RNA, 19 nt, Homo sapiens
ucgcagagaccuucagaaa

SEQ ID NO: 1506519 - RNA, 19 nt, Homo sapiens
gauccugccucugccugua

SEQ ID NO: 1506520 - RNA, 19 nt, Homo sapiens
ggagguagaguccuugcuu

SEQ ID NO: 1506521 - RNA, 19 nt, Homo sapiens
uggagcaguuggagaguaa

SEQ ID NO: 1506522 - RNA, 19 nt, Homo sapiens
guaacuugccucccaguga

SEQ ID NO: 1506523 - RNA, 19 nt, Homo sapiens
gagccaccaugaccucuca

SEQ ID NO: 1506524 - RNA, 19 nt, Homo sapiens
ccagggagguagaguccuu

SEQ ID NO: 1506525 - RNA, 19 nt, Homo sapiens
ggccagaggguuccagaaa

SEQ ID NO: 1506526 - RNA, 19 nt, Homo sapiens
agacgggacuggaaauuac

SEQ ID NO: 1506527 - RNA, 19 nt, Homo sapiens
ggacuggagcuccgaagug

SEQ ID NO: 1506528 - RNA, 19 nt, Homo sapiens
gacaacugccucuccauug

SEQ ID NO: 1506529 - RNA, 19 nt, Homo sapiens
cagacgggacuggaaauua

SEQ ID NO: 1506530 - RNA, 19 nt, Homo sapiens
gugccaagcccauaaacuu

SEQ ID NO: 1506531 - RNA, 19 nt, Homo sapiens
gcacccagacagauuuaga

SEQ ID NO: 1506532 - RNA, 19 nt, Homo sapiens
aaauuucccugugcuguga

SEQ ID NO: 1506533 - RNA, 19 nt, Homo sapiens
uaccacaauuucaccauau

SEQ ID NO: 1506534 - RNA, 19 nt, Homo sapiens
gaucugggugucauacuau

SEQ ID NO: 1506535 - RNA, 19 nt, Homo sapiens
gacuggagcuccgaagugu

SEQ ID NO: 1506536 - RNA, 19 nt, Homo sapiens
agucugaacuggcugugaa

SEQ ID NO: 1506537 - RNA, 19 nt, Homo sapiens
ccagaggguuccagaaagg

SEQ ID NO: 1506538 - RNA, 19 nt, Homo sapiens
agccuucucuuauugauug

SEQ ID NO: 1506539 - RNA, 19 nt, Homo sapiens
aguuuagggucaaauguaa

SEQ ID NO: 1506540 - RNA, 19 nt, Homo sapiens
acccagcccuugaaccuaa

SEQ ID NO: 1506541 - RNA, 19 nt, Homo sapiens
gagugguugugguuacuga

SEQ ID NO: 1506542 - RNA, 19 nt, Homo sapiens
uguacucccuugugaucua

SEQ ID NO: 1506543 - RNA, 19 nt, Homo sapiens
ugaccugccugccuaugga

SEQ ID NO: 1506544 - RNA, 19 nt, Homo sapiens
gcccaggaguucagagauc

SEQ ID NO: 1506545 - RNA, 19 nt, Homo sapiens
caauuucaccauauccaaa

SEQ ID NO: 1506546 - RNA, 19 nt, Homo sapiens
ucccugguguuacuacuaa

SEQ ID NO: 1506547 - RNA, 19 nt, Homo sapiens
ccagugaggaggaaauuuc

SEQ ID NO: 1506548 - RNA, 19 nt, Homo sapiens
caaaguuuagggucaaaug

SEQ ID NO: 1506549 - RNA, 19 nt, Homo sapiens
caugggugcucuaccacaa

SEQ ID NO: 1506550 - RNA, 19 nt, Homo sapiens
gcacuggugucagaauacu

SEQ ID NO: 1506551 - RNA, 19 nt, Homo sapiens
agaucugggugucauacua

SEQ ID NO: 1506552 - RNA, 19 nt, Homo sapiens
gcccagcucuccucauacu

SEQ ID NO: 1506553 - RNA, 19 nt, Homo sapiens
ucagaaagcacugguguca

SEQ ID NO: 1506554 - RNA, 19 nt, Homo sapiens
gguguaugaagccuuuaua

SEQ ID NO: 1506555 - RNA, 19 nt, Homo sapiens
gccagaggguuccagaaag

SEQ ID NO: 1506556 - RNA, 19 nt, Homo sapiens
ccuuagccuucucuuauug

SEQ ID NO: 1506557 - RNA, 19 nt, Homo sapiens
gaaaugguagacugggaau

SEQ ID NO: 1506558 - RNA, 19 nt, Homo sapiens
guucaucucaucacauuag

SEQ ID NO: 1506559 - RNA, 19 nt, Homo sapiens
ggagcuggguucaucucau

SEQ ID NO: 1506560 - RNA, 19 nt, Homo sapiens
caacugccucuccauuguu

SEQ ID NO: 1506561 - RNA, 19 nt, Homo sapiens
uaccuucuccuaacccaua

SEQ ID NO: 1506562 - RNA, 19 nt, Homo sapiens
uauacaaaguggagcagau

SEQ ID NO: 1506563 - RNA, 19 nt, Homo sapiens
caugcgaguuugacugugu

SEQ ID NO: 1506564 - RNA, 19 nt, Homo sapiens
gaacuagaagcuccaccau

SEQ ID NO: 1506565 - RNA, 19 nt, Homo sapiens
cgagcagaauuccaagugu

SEQ ID NO: 1506566 - RNA, 19 nt, Homo sapiens
acucagcccuacccucuug

SEQ ID NO: 1506567 - RNA, 19 nt, Homo sapiens
ugccaaacccauucuugua

SEQ ID NO: 1506568 - RNA, 19 nt, Homo sapiens
gcccaaaguuuagggucaa

SEQ ID NO: 1506569 - RNA, 19 nt, Homo sapiens
guacucccuugugaucuau

SEQ ID NO: 1506570 - RNA, 19 nt, Homo sapiens
caggcuagcagaagaguau

SEQ ID NO: 1506571 - RNA, 19 nt, Homo sapiens
gcugcucgcuuuaccuucu

SEQ ID NO: 1506572 - RNA, 19 nt, Homo sapiens
agaagaguauggcccaagu

SEQ ID NO: 1506573 - RNA, 19 nt, Homo sapiens
caagguggccagagacaca

SEQ ID NO: 1506574 - RNA, 19 nt, Homo sapiens
guucucugauccaggugua

SEQ ID NO: 1506575 - RNA, 19 nt, Homo sapiens
gaugcaagcccuggaagau

SEQ ID NO: 1506576 - RNA, 19 nt, Homo sapiens
ggaagcugccugccaagca

SEQ ID NO: 1506577 - RNA, 19 nt, Homo sapiens
gacugggaauggaaagaau

SEQ ID NO: 1506578 - RNA, 19 nt, Homo sapiens
aaagcacccagacagauuu

SEQ ID NO: 1506579 - RNA, 19 nt, Homo sapiens
agacaacugccucuccauu

SEQ ID NO: 1506580 - RNA, 19 nt, Homo sapiens
acacagacgggacuggaaa

SEQ ID NO: 1506581 - RNA, 19 nt, Homo sapiens
cuagaacucaugcaacgaa

SEQ ID NO: 1506582 - RNA, 19 nt, Homo sapiens
gcaaauggauaucaagaau

SEQ ID NO: 1506583 - RNA, 19 nt, Homo sapiens
cauaaucgaugcuauugua

SEQ ID NO: 1506584 - RNA, 19 nt, Homo sapiens
ucacagagcuacaaccauu

SEQ ID NO: 1506585 - RNA, 19 nt, Homo sapiens
gaucaaugcuccaaagaau

SEQ ID NO: 1506586 - RNA, 19 nt, Homo sapiens
gaaaucaggugugucaaga

SEQ ID NO: 1506587 - RNA, 19 nt, Homo sapiens
gcugagaaauguaugguaa

SEQ ID NO: 1506588 - RNA, 19 nt, Homo sapiens
aaagggacgugcaggauua

SEQ ID NO: 1506589 - RNA, 19 nt, Homo sapiens
caagaugcaucaccuuaaa

SEQ ID NO: 1506590 - RNA, 19 nt, Homo sapiens
cagcacggcuuuaauagaa

SEQ ID NO: 1506591 - RNA, 19 nt, Homo sapiens
acagguagauguuauugua

SEQ ID NO: 1506592 - RNA, 19 nt, Homo sapiens
gaaagcacauguacguugu

SEQ ID NO: 1506593 - RNA, 19 nt, Homo sapiens
aaaccaagaugacauuguu

SEQ ID NO: 1506594 - RNA, 19 nt, Homo sapiens
aaccugagcugcuaaauau

SEQ ID NO: 1506595 - RNA, 19 nt, Homo sapiens
cacaguugcugauaacaua

SEQ ID NO: 1506596 - RNA, 19 nt, Homo sapiens
gacaagcuguggaaaguga

SEQ ID NO: 1506597 - RNA, 19 nt, Homo sapiens
agaacaacaugcaaucuuu

SEQ ID NO: 1506598 - RNA, 19 nt, Homo sapiens
gguggaagcugagaaaugu

SEQ ID NO: 1506599 - RNA, 19 nt, Homo sapiens
caacagcaaggacauuuaa

SEQ ID NO: 1506600 - RNA, 19 nt, Homo sapiens
uaagucaucuguaagaaca

SEQ ID NO: 1506601 - RNA, 19 nt, Homo sapiens
caaccugagcugcuaaaua

SEQ ID NO: 1506602 - RNA, 19 nt, Homo sapiens
gaacaggaaaugccggaaa

SEQ ID NO: 1506603 - RNA, 19 nt, Homo sapiens
ggucaccaguguucuagaa

SEQ ID NO: 1506604 - RNA, 19 nt, Homo sapiens
gaaagugaaugugcuguac

SEQ ID NO: 1506605 - RNA, 19 nt, Homo sapiens
gaacaacaugcaaucuuug

SEQ ID NO: 1506606 - RNA, 19 nt, Homo sapiens
cauguaaucuuccugaaca

SEQ ID NO: 1506607 - RNA, 19 nt, Homo sapiens
aaacuguacugcuuaagug

SEQ ID NO: 1506608 - RNA, 19 nt, Homo sapiens
ggagaaagcacauguacgu

SEQ ID NO: 1506609 - RNA, 19 nt, Homo sapiens
ccaggacaaucagaauaua

SEQ ID NO: 1506610 - RNA, 19 nt, Homo sapiens
ggaaagugaaugugcugua

SEQ ID NO: 1506611 - RNA, 19 nt, Homo sapiens
gaugaucaaugcuccaaag

SEQ ID NO: 1506612 - RNA, 19 nt, Homo sapiens
ucauaacuuucacggcuua

SEQ ID NO: 1506613 - RNA, 19 nt, Homo sapiens
aaucagcacggcuuuaaua

SEQ ID NO: 1506614 - RNA, 19 nt, Homo sapiens
uagagaagauugagaggau

SEQ ID NO: 1506615 - RNA, 19 nt, Homo sapiens
gaacagaggaaguacacau

SEQ ID NO: 1506616 - RNA, 19 nt, Homo sapiens
gggaaaagaugucaggaaa

SEQ ID NO: 1506617 - RNA, 19 nt, Homo sapiens
uauagccacugaacaggua

SEQ ID NO: 1506618 - RNA, 19 nt, Homo sapiens
uaaucaggcuuacccagaa

SEQ ID NO: 1506619 - RNA, 19 nt, Homo sapiens
gaggauacagaaugcauuu

SEQ ID NO: 1506620 - RNA, 19 nt, Homo sapiens
acacuggacugacaugaau

SEQ ID NO: 1506621 - RNA, 19 nt, Homo sapiens
ccagguggaugcuuaaagu

SEQ ID NO: 1506622 - RNA, 19 nt, Homo sapiens
cagcugaaaugacugaauc

SEQ ID NO: 1506623 - RNA, 19 nt, Homo sapiens
ggguuaaacuguacugcuu

SEQ ID NO: 1506624 - RNA, 19 nt, Homo sapiens
ggaaaacggucaccagugu

SEQ ID NO: 1506625 - RNA, 19 nt, Homo sapiens
gaaaaucggugcaauuacu

SEQ ID NO: 1506626 - RNA, 19 nt, Homo sapiens
cacagcauaugaaaugaaa

SEQ ID NO: 1506627 - RNA, 19 nt, Homo sapiens
gccaaaaugcugaaaauua

SEQ ID NO: 1506628 - RNA, 19 nt, Homo sapiens
uuacuggagucuucacaaa

SEQ ID NO: 1506629 - RNA, 19 nt, Homo sapiens
gaaaugacugaaucacaga

SEQ ID NO: 1506630 - RNA, 19 nt, Homo sapiens
aagaauaaaucccaacaag

SEQ ID NO: 1506631 - RNA, 19 nt, Homo sapiens
uggaacaaaucauaacaga

SEQ ID NO: 1506632 - RNA, 19 nt, Homo sapiens
acuaacuggucaagaauaa

SEQ ID NO: 1506633 - RNA, 19 nt, Homo sapiens
cuacaaccauucacagaca

SEQ ID NO: 1506634 - RNA, 19 nt, Homo sapiens
gaaaagaugucaggaaaac

SEQ ID NO: 1506635 - RNA, 19 nt, Homo sapiens
uacacgaucuccaaagcua

SEQ ID NO: 1506636 - RNA, 19 nt, Homo sapiens
ggacagaugcagacucagu

SEQ ID NO: 1506637 - RNA, 19 nt, Homo sapiens
caagaaugaccauaagaau

SEQ ID NO: 1506638 - RNA, 19 nt, Homo sapiens
ucaagaaugaccauaagaa

SEQ ID NO: 1506639 - RNA, 19 nt, Homo sapiens
guaucgcauuguuaucuaa

SEQ ID NO: 1506640 - RNA, 19 nt, Homo sapiens
ccauaagaauaaugagaga

SEQ ID NO: 1506641 - RNA, 19 nt, Homo sapiens
gucaagagcuauuuuagaa

SEQ ID NO: 1506642 - RNA, 19 nt, Homo sapiens
ccacugaacagguagaugu

SEQ ID NO: 1506643 - RNA, 19 nt, Homo sapiens
gguggcggguuaaacugua

SEQ ID NO: 1506644 - RNA, 19 nt, Homo sapiens
ugacauuguucuucuugga

SEQ ID NO: 1506645 - RNA, 19 nt, Homo sapiens
caaagggacgugcaggauu

SEQ ID NO: 1506646 - RNA, 19 nt, Homo sapiens
gcacggcuuuaauagaagu

SEQ ID NO: 1506647 - RNA, 19 nt, Homo sapiens
uaucaagaaugaccauaag

SEQ ID NO: 1506648 - RNA, 19 nt, Homo sapiens
aaaggcaaauggauaucaa

SEQ ID NO: 1506649 - RNA, 19 nt, Homo sapiens
ggaaguacacaucgguuuc

SEQ ID NO: 1506650 - RNA, 19 nt, Homo sapiens
ucaggugugucaagagcua

SEQ ID NO: 1506651 - RNA, 19 nt, Homo sapiens
gcacagccucacagagauu

SEQ ID NO: 1506652 - RNA, 19 nt, Homo sapiens
gacaaacaauacacgaucu

SEQ ID NO: 1506653 - RNA, 19 nt, Homo sapiens
ucaaucagcacggcuuuaa

SEQ ID NO: 1506654 - RNA, 19 nt, Homo sapiens
gaacuuucaguccacauuc

SEQ ID NO: 1506655 - RNA, 19 nt, Homo sapiens
ucaccaguguucuagaaga

SEQ ID NO: 1506656 - RNA, 19 nt, Homo sapiens
gguugcuacuggagauaua

SEQ ID NO: 1506657 - RNA, 19 nt, Homo sapiens
uagaugaauucacuaacug

SEQ ID NO: 1506658 - RNA, 19 nt, Homo sapiens
ggaaaucaggugugucaag

SEQ ID NO: 1506659 - RNA, 19 nt, Homo sapiens
gguuaaacuguacugcuua

SEQ ID NO: 1506660 - RNA, 19 nt, Homo sapiens
ggucgggacugucucuaag

SEQ ID NO: 1506661 - RNA, 19 nt, Homo sapiens
caugcaaucuuugucuuug

SEQ ID NO: 1506662 - RNA, 19 nt, Homo sapiens
guaagaacaacaugcaauc

SEQ ID NO: 1506663 - RNA, 19 nt, Homo sapiens
caauauuguuguagucagu

SEQ ID NO: 1506664 - RNA, 19 nt, Homo sapiens
gaccauaagaauaaugaga

SEQ ID NO: 1506665 - RNA, 19 nt, Homo sapiens
ugaaugugcuguacuagcu

SEQ ID NO: 1506666 - RNA, 19 nt, Homo sapiens
aagugaaugugcuguacua

SEQ ID NO: 1506667 - RNA, 19 nt, Homo sapiens
ccaaaaugcugaaaauuac

SEQ ID NO: 1506668 - RNA, 19 nt, Homo sapiens
ggacgugcaggauuaguca

SEQ ID NO: 1506669 - RNA, 19 nt, Homo sapiens
gaacacuggacugacauga

SEQ ID NO: 1506670 - RNA, 19 nt, Homo sapiens
gauaacauaaucgaugcua

SEQ ID NO: 1506671 - RNA, 19 nt, Homo sapiens
ucaacagcaaggacauuua

SEQ ID NO: 1506672 - RNA, 19 nt, Homo sapiens
ugacugaaucacagaauau

SEQ ID NO: 1506673 - RNA, 19 nt, Homo sapiens
ucacagacaccaaaucucu

SEQ ID NO: 1506674 - RNA, 19 nt, Homo sapiens
ccaagaauccucacaaucc

SEQ ID NO: 1506675 - RNA, 19 nt, Homo sapiens
uagaaguugugcugggaaa

SEQ ID NO: 1506676 - RNA, 19 nt, Homo sapiens
cagacucagugccauaugu

SEQ ID NO: 1506677 - RNA, 19 nt, Homo sapiens
gaugacauuguucuucuug

SEQ ID NO: 1506678 - RNA, 19 nt, Homo sapiens
caacaugcaaucuuugucu

SEQ ID NO: 1506679 - RNA, 19 nt, Homo sapiens
ccaaggacaccuacuccaa

SEQ ID NO: 1506680 - RNA, 19 nt, Homo sapiens
gcuagagccaggacaauca

SEQ ID NO: 1506681 - RNA, 19 nt, Homo sapiens
ccugaacacuggacugaca

SEQ ID NO: 1506682 - RNA, 19 nt, Homo sapiens
gcuuacagcuuauugauuu

SEQ ID NO: 1506683 - RNA, 19 nt, Homo sapiens
ccaguuaaaugcuuugaua

SEQ ID NO: 1506684 - RNA, 19 nt, Homo sapiens
guaaauagguuuggacaau

SEQ ID NO: 1506685 - RNA, 19 nt, Homo sapiens
uaaauaggcuggaaguaau

SEQ ID NO: 1506686 - RNA, 19 nt, Homo sapiens
auacagaguucaugaauug

SEQ ID NO: 1506687 - RNA, 19 nt, Homo sapiens
uaacagaccuaccagaauc

SEQ ID NO: 1506688 - RNA, 19 nt, Homo sapiens
ggauaucacaguacaauuu

SEQ ID NO: 1506689 - RNA, 19 nt, Homo sapiens
gagcaaggcugaagaacca

SEQ ID NO: 1506690 - RNA, 19 nt, Homo sapiens
aaccagaucugaacaugua

SEQ ID NO: 1506691 - RNA, 19 nt, Homo sapiens
gaaaccagaucugaacaug

SEQ ID NO: 1506692 - RNA, 19 nt, Homo sapiens
gaagagaaaccagaucuga

SEQ ID NO: 1506693 - RNA, 19 nt, Homo sapiens
agaauaagcuggaggcaau

SEQ ID NO: 1506694 - RNA, 19 nt, Homo sapiens
gaaguauccuauccuuguu

SEQ ID NO: 1506695 - RNA, 19 nt, Homo sapiens
gacuuuaccucacaaauca

SEQ ID NO: 1506696 - RNA, 19 nt, Homo sapiens
gagauaauacagugacuuu

SEQ ID NO: 1506697 - RNA, 19 nt, Homo sapiens
caacagcuccaguuaaaug

SEQ ID NO: 1506698 - RNA, 19 nt, Homo sapiens
gaccuggacuuucuuagga

SEQ ID NO: 1506699 - RNA, 19 nt, Homo sapiens
cauauucugucaacacaaa

SEQ ID NO: 1506700 - RNA, 19 nt, Homo sapiens
cagaacaauuuccuacaaa

SEQ ID NO: 1506701 - RNA, 19 nt, Homo sapiens
caugcuacauugugcuuua

SEQ ID NO: 1506702 - RNA, 19 nt, Homo sapiens
gaacuaacccacacaggau

SEQ ID NO: 1506703 - RNA, 19 nt, Homo sapiens
ugggagcgaucuauguuua

SEQ ID NO: 1506704 - RNA, 19 nt, Homo sapiens
gaucugaacauguauuugu

SEQ ID NO: 1506705 - RNA, 19 nt, Homo sapiens
gaaaagcacucucuucucu

SEQ ID NO: 1506706 - RNA, 19 nt, Homo sapiens
ggaaacagcaacccagaga

SEQ ID NO: 1506707 - RNA, 19 nt, Homo sapiens
ucagaacaauuuccuacaa

SEQ ID NO: 1506708 - RNA, 19 nt, Homo sapiens
ccagguagaauuugaguuu

SEQ ID NO: 1506709 - RNA, 19 nt, Homo sapiens
ggaggcaauuauuuccuuu

SEQ ID NO: 1506710 - RNA, 19 nt, Homo sapiens
ucuaugcacucuuauauuc

SEQ ID NO: 1506711 - RNA, 19 nt, Homo sapiens
caaacuuacugcagcuuga

SEQ ID NO: 1506712 - RNA, 19 nt, Homo sapiens
ggaauuagccagguagaau

SEQ ID NO: 1506713 - RNA, 19 nt, Homo sapiens
cagaguucaugaauuguuu

SEQ ID NO: 1506714 - RNA, 19 nt, Homo sapiens
caaaucauauucugucaac

SEQ ID NO: 1506715 - RNA, 19 nt, Homo sapiens
ggaagacaagcuaauaaau

SEQ ID NO: 1506716 - RNA, 19 nt, Homo sapiens
cucaacagcuccaguuaaa

SEQ ID NO: 1506717 - RNA, 19 nt, Homo sapiens
gcuaauaaauaggcuggaa

SEQ ID NO: 1506718 - RNA, 19 nt, Homo sapiens
aaagcacucucuucucuau

SEQ ID NO: 1506719 - RNA, 19 nt, Homo sapiens
gcucuacuaucaauaccaa

SEQ ID NO: 1506720 - RNA, 19 nt, Homo sapiens
gacacaaguuugcguagga

SEQ ID NO: 1506721 - RNA, 19 nt, Homo sapiens
guacuuucauucaguguag

SEQ ID NO: 1506722 - RNA, 19 nt, Homo sapiens
cauacagaguucaugaauu

SEQ ID NO: 1506723 - RNA, 19 nt, Homo sapiens
acucuuauauucugccuuu

SEQ ID NO: 1506724 - RNA, 19 nt, Homo sapiens
ccuugacacuuauucuaua

SEQ ID NO: 1506725 - RNA, 19 nt, Homo sapiens
gauaauacagugacuuuac

SEQ ID NO: 1506726 - RNA, 19 nt, Homo sapiens
gguauacacugccuauguc

SEQ ID NO: 1506727 - RNA, 19 nt, Homo sapiens
auaaauaggcuggaaguaa

SEQ ID NO: 1506728 - RNA, 19 nt, Homo sapiens
uuaaagugcucccuugaca

SEQ ID NO: 1506729 - RNA, 19 nt, Homo sapiens
auauguugcuuacagcuua

SEQ ID NO: 1506730 - RNA, 19 nt, Homo sapiens
ucagaaguauccuauccuu

SEQ ID NO: 1506731 - RNA, 19 nt, Homo sapiens
cuaccagaaucaugcuuaa

SEQ ID NO: 1506732 - RNA, 19 nt, Homo sapiens
ugaggcgugugaaggaaua

SEQ ID NO: 1506733 - RNA, 19 nt, Homo sapiens
uaacuauugugucuuccuu

SEQ ID NO: 1506734 - RNA, 19 nt, Homo sapiens
gcuuuccucccaauaaaua

SEQ ID NO: 1506735 - RNA, 19 nt, Homo sapiens
caaaugugaaugccaaaga

SEQ ID NO: 1506736 - RNA, 19 nt, Homo sapiens
ccagaaucaugcuuaaagu

SEQ ID NO: 1506737 - RNA, 19 nt, Homo sapiens
ucuccuggcucuacuauca

SEQ ID NO: 1506738 - RNA, 19 nt, Homo sapiens
gcagugcgguuggacacaa

SEQ ID NO: 1506739 - RNA, 19 nt, Homo sapiens
gccuaugucuuuauuccaa

SEQ ID NO: 1506740 - RNA, 19 nt, Homo sapiens
aaacugaugauacuggaaa

SEQ ID NO: 1506741 - RNA, 19 nt, Homo sapiens
ucgccuggcuugggaauuu

SEQ ID NO: 1506742 - RNA, 19 nt, Homo sapiens
gauaucacaguacaauuuc

SEQ ID NO: 1506743 - RNA, 19 nt, Homo sapiens
aguauccuauccuuguuua

SEQ ID NO: 1506744 - RNA, 19 nt, Homo sapiens
agaaguauccuauccuugu

SEQ ID NO: 1506745 - RNA, 19 nt, Homo sapiens
ugaaggagccaaccaugga

SEQ ID NO: 1506746 - RNA, 19 nt, Homo sapiens
gaaggagcaaggcugaaga

SEQ ID NO: 1506747 - RNA, 19 nt, Homo sapiens
cggaagacaagcuaauaaa

SEQ ID NO: 1506748 - RNA, 19 nt, Homo sapiens
gcuggucccuggagaacug

SEQ ID NO: 1506749 - RNA, 19 nt, Homo sapiens
uuauugcuauggugguaua

SEQ ID NO: 1506750 - RNA, 19 nt, Homo sapiens
uaagaguggcagcguauga

SEQ ID NO: 1506751 - RNA, 19 nt, Homo sapiens
ccucacaaaucauauucug

SEQ ID NO: 1506752 - RNA, 19 nt, Homo sapiens
uuagguaacuauugugucu

SEQ ID NO: 1506753 - RNA, 19 nt, Homo sapiens
auacacugccuaugucuuu

SEQ ID NO: 1506754 - RNA, 19 nt, Homo sapiens
aaauaggcuggaaguaaua

SEQ ID NO: 1506755 - RNA, 19 nt, Homo sapiens
uuuauaggcuacugucaga

SEQ ID NO: 1506756 - RNA, 19 nt, Homo sapiens
ccuaacagaccuaccagaa

SEQ ID NO: 1506757 - RNA, 19 nt, Homo sapiens
cagcaggcauucucuucug

SEQ ID NO: 1506758 - RNA, 19 nt, Homo sapiens
cauuauugcuaugguggua

SEQ ID NO: 1506759 - RNA, 19 nt, Homo sapiens
gagccaaccauggauuuga

SEQ ID NO: 1506760 - RNA, 19 nt, Homo sapiens
gaugauacuggaaauucuu

SEQ ID NO: 1506761 - RNA, 19 nt, Homo sapiens
uauccuuguuuacgaugua

SEQ ID NO: 1506762 - RNA, 19 nt, Homo sapiens
aauauuugcacccuuguuu

SEQ ID NO: 1506763 - RNA, 19 nt, Homo sapiens
gguguugccuugccuugca

SEQ ID NO: 1506764 - RNA, 19 nt, Homo sapiens
caccggaauuagccaggua

SEQ ID NO: 1506765 - RNA, 19 nt, Homo sapiens
ugucaacacaaaucuauga

SEQ ID NO: 1506766 - RNA, 19 nt, Homo sapiens
ggagcgaucuauguuuaac

SEQ ID NO: 1506767 - RNA, 19 nt, Homo sapiens
uagcugcugugcuguuuua

SEQ ID NO: 1506768 - RNA, 19 nt, Homo sapiens
gagccaaaacaaagauuua

SEQ ID NO: 1506769 - RNA, 19 nt, Homo sapiens
ggcuggaaguaauauucua

SEQ ID NO: 1506770 - RNA, 19 nt, Homo sapiens
ccggaagacaagcuaauaa

SEQ ID NO: 1506771 - RNA, 19 nt, Homo sapiens
ugacuuuaccucacaaauc

SEQ ID NO: 1506772 - RNA, 19 nt, Homo sapiens
cagaucugaacauguauuu

SEQ ID NO: 1506773 - RNA, 19 nt, Homo sapiens
gagcuagagagaaagaugu

SEQ ID NO: 1506774 - RNA, 19 nt, Homo sapiens
ucuucucuaugcacucuua

SEQ ID NO: 1506775 - RNA, 19 nt, Homo sapiens
uaauugauccuguucacau

SEQ ID NO: 1506776 - RNA, 19 nt, Homo sapiens
guuuaacaccaucuuacua

SEQ ID NO: 1506777 - RNA, 19 nt, Homo sapiens
cgaacgagcugcagaaaac

SEQ ID NO: 1506778 - RNA, 19 nt, Homo sapiens
cuagagagaaagauguuug

SEQ ID NO: 1506779 - RNA, 19 nt, Homo sapiens
cagcuccaguuaaaugcuu

SEQ ID NO: 1506780 - RNA, 19 nt, Homo sapiens
uaagcuggaggcaauuauu

SEQ ID NO: 1506781 - RNA, 19 nt, Homo sapiens
uuagccagguagaauuuga

SEQ ID NO: 1506782 - RNA, 19 nt, Homo sapiens
agacauagccugaugguua

SEQ ID NO: 1506783 - RNA, 19 nt, Homo sapiens
caagugaguucaugacaaa

SEQ ID NO: 1506784 - RNA, 19 nt, Homo sapiens
uaauaaaugugccaaguga

SEQ ID NO: 1506785 - RNA, 19 nt, Homo sapiens
gacauagccugaugguuaa

SEQ ID NO: 1506786 - RNA, 19 nt, Homo sapiens
acaagaacccugacaauaa

SEQ ID NO: 1506787 - RNA, 19 nt, Homo sapiens
caagaacccugacaauaag

SEQ ID NO: 1506788 - RNA, 19 nt, Homo sapiens
gacaagaacccugacaaua

SEQ ID NO: 1506789 - RNA, 19 nt, Homo sapiens
ccuaugagguucugucuga

SEQ ID NO: 1506790 - RNA, 19 nt, Homo sapiens
ucaaauggauggacagcaa

SEQ ID NO: 1506791 - RNA, 19 nt, Homo sapiens
gagaauugguacuacgaaa

SEQ ID NO: 1506792 - RNA, 19 nt, Homo sapiens
ccaccgagaugaucaaugg

SEQ ID NO: 1506793 - RNA, 19 nt, Homo sapiens
caagaaacgcucccuguau

SEQ ID NO: 1506794 - RNA, 19 nt, Homo sapiens
aagaaacgcucccuguaug

SEQ ID NO: 1506795 - RNA, 19 nt, Homo sapiens
ccaagugaguucaugacaa

SEQ ID NO: 1506796 - RNA, 19 nt, Homo sapiens
ggcaggcuuuggagaauuu

SEQ ID NO: 1506797 - RNA, 19 nt, Homo sapiens
gaugaucaauggccacaag

SEQ ID NO: 1506798 - RNA, 19 nt, Homo sapiens
ggacagcccauucaauagu

SEQ ID NO: 1506799 - RNA, 19 nt, Homo sapiens
ccaagaaacgcucccugua

SEQ ID NO: 1506800 - RNA, 19 nt, Homo sapiens
ggccauggcuaacuacuac

SEQ ID NO: 1506801 - RNA, 19 nt, Homo sapiens
ggacaucuuccgggaguuu

SEQ ID NO: 1506802 - RNA, 19 nt, Homo sapiens
gcguggagguggaggaaga

SEQ ID NO: 1506803 - RNA, 19 nt, Homo sapiens
guuaauaaaugugccaagu

SEQ ID NO: 1506804 - RNA, 19 nt, Homo sapiens
ccuggacccuuucuccuuu

SEQ ID NO: 1506805 - RNA, 19 nt, Homo sapiens
ccaagcgcaucguggagaa

SEQ ID NO: 1506806 - RNA, 19 nt, Homo sapiens
gacagcccauucaauagug

SEQ ID NO: 1506807 - RNA, 19 nt, Homo sapiens
cgacaagaacccugacaau

SEQ ID NO: 1506808 - RNA, 19 nt, Homo sapiens
ccugaugguuaauaaaugu

SEQ ID NO: 1506809 - RNA, 19 nt, Homo sapiens
ccgcagacauagccugaug

SEQ ID NO: 1506810 - RNA, 19 nt, Homo sapiens
gccacaaggucaccaccaa

SEQ ID NO: 1506811 - RNA, 19 nt, Homo sapiens
aguucaagcuggugucuga

SEQ ID NO: 1506812 - RNA, 19 nt, Homo sapiens
gccugaugguuaauaaaug

SEQ ID NO: 1506813 - RNA, 19 nt, Homo sapiens
gaagacgggcagcucaagu

SEQ ID NO: 1506814 - RNA, 19 nt, Homo sapiens
gaacuccugggcagaaucu

SEQ ID NO: 1506815 - RNA, 19 nt, Homo sapiens
gcuggugucugaggccuau

SEQ ID NO: 1506816 - RNA, 19 nt, Homo sapiens
cacguucccucuccucuca

SEQ ID NO: 1506817 - RNA, 19 nt, Homo sapiens
gagaauuuccggccuucau

SEQ ID NO: 1506818 - RNA, 19 nt, Homo sapiens
auagccugaugguuaauaa

SEQ ID NO: 1506819 - RNA, 19 nt, Homo sapiens
gacccuuucuccuuugagu

SEQ ID NO: 1506820 - RNA, 19 nt, Homo sapiens
uaaaugugccaagugaguu

SEQ ID NO: 1506821 - RNA, 19 nt, Homo sapiens
cggaggacaucaagaaagc

SEQ ID NO: 1506822 - RNA, 19 nt, Homo sapiens
agaaacgcucccuguauga

SEQ ID NO: 1506823 - RNA, 19 nt, Homo sapiens
ggugaacuccugggcagaa

SEQ ID NO: 1506824 - RNA, 19 nt, Homo sapiens
cggcaggcuuuggagaauu

SEQ ID NO: 1506825 - RNA, 19 nt, Homo sapiens
aggaggaggcggagaagaa

SEQ ID NO: 1506826 - RNA, 19 nt, Homo sapiens
gggacagcccauucaauag

SEQ ID NO: 1506827 - RNA, 19 nt, Homo sapiens
gcagacauagccugauggu

SEQ ID NO: 1506828 - RNA, 19 nt, Homo sapiens
cauagccugaugguuaaua

SEQ ID NO: 1506829 - RNA, 19 nt, Homo sapiens
ggaggaggcggagaagaag

SEQ ID NO: 1506830 - RNA, 19 nt, Homo sapiens
cuucucauccuucaacaug

SEQ ID NO: 1506831 - RNA, 19 nt, Homo sapiens
uuaauaaaugugccaagug

SEQ ID NO: 1506832 - RNA, 19 nt, Homo sapiens
gaggccuucucauccuuca

SEQ ID NO: 1506833 - RNA, 19 nt, Homo sapiens
ucauggaggccuucucauc

SEQ ID NO: 1506834 - RNA, 19 nt, Homo sapiens
auaaggaggaggcggagaa

SEQ ID NO: 1506835 - RNA, 19 nt, Homo sapiens
ggaagacgggcagcucaag

SEQ ID NO: 1506836 - RNA, 19 nt, Homo sapiens
gaaacgcucccuguaugac

SEQ ID NO: 1506837 - RNA, 19 nt, Homo sapiens
gaaauaaacugcucugaau

SEQ ID NO: 1506838 - RNA, 19 nt, Homo sapiens
gaagauaucugacucaaaa

SEQ ID NO: 1506839 - RNA, 19 nt, Homo sapiens
ggagggaucuuuguuugua

SEQ ID NO: 1506840 - RNA, 19 nt, Homo sapiens
caacacagcuauuuugaua

SEQ ID NO: 1506841 - RNA, 19 nt, Homo sapiens
gaccaucucuucauuaucu

SEQ ID NO: 1506842 - RNA, 19 nt, Homo sapiens
caguagcgcuuaccucuuu

SEQ ID NO: 1506843 - RNA, 19 nt, Homo sapiens
ggacuucugcugauacuuu

SEQ ID NO: 1506844 - RNA, 19 nt, Homo sapiens
cagcaaaccuggaagaaca

SEQ ID NO: 1506845 - RNA, 19 nt, Homo sapiens
gaacaggauugugaagaug

SEQ ID NO: 1506846 - RNA, 19 nt, Homo sapiens
gaaggcauuugaagaggaa

SEQ ID NO: 1506847 - RNA, 19 nt, Homo sapiens
gcacacagcaggcuacaug

SEQ ID NO: 1506848 - RNA, 19 nt, Homo sapiens
aaacugcucugaauugugu

SEQ ID NO: 1506849 - RNA, 19 nt, Homo sapiens
gaacuucaaagaugacuug

SEQ ID NO: 1506850 - RNA, 19 nt, Homo sapiens
caacuacaaucaacugcuu

SEQ ID NO: 1506851 - RNA, 19 nt, Homo sapiens
gaugugauccugcucauga

SEQ ID NO: 1506852 - RNA, 19 nt, Homo sapiens
ccaaggagcugggcuuuag

SEQ ID NO: 1506853 - RNA, 19 nt, Homo sapiens
ucagacgcauggccaaaua

SEQ ID NO: 1506854 - RNA, 19 nt, Homo sapiens
ugacgugggugcugacuga

SEQ ID NO: 1506855 - RNA, 19 nt, Homo sapiens
agacaacaauuacaucuuc

SEQ ID NO: 1506856 - RNA, 19 nt, Homo sapiens
gagaagauaucugacucaa

SEQ ID NO: 1506857 - RNA, 19 nt, Homo sapiens
acaauucacugcaggaaga

SEQ ID NO: 1506858 - RNA, 19 nt, Homo sapiens
gcaguugucucacuuacag

SEQ ID NO: 1506859 - RNA, 19 nt, Homo sapiens
guaaacaacgccaaagaga

SEQ ID NO: 1506860 - RNA, 19 nt, Homo sapiens
ggaccucccuuguguuugg

SEQ ID NO: 1506861 - RNA, 19 nt, Homo sapiens
guugauggcugaugugauc

SEQ ID NO: 1506862 - RNA, 19 nt, Homo sapiens
ggaaggaggagaagauauc

SEQ ID NO: 1506863 - RNA, 19 nt, Homo sapiens
caugaucucugcaagacaa

SEQ ID NO: 1506864 - RNA, 19 nt, Homo sapiens
gcaaacaaagccagacaga

SEQ ID NO: 1506865 - RNA, 19 nt, Homo sapiens
ucaaagaccugcaguugcu

SEQ ID NO: 1506866 - RNA, 19 nt, Homo sapiens
gaaacucucauucagacaa

SEQ ID NO: 1506867 - RNA, 19 nt, Homo sapiens
ugaaauaaacugcucugaa

SEQ ID NO: 1506868 - RNA, 19 nt, Homo sapiens
gaagauguccagucccaau

SEQ ID NO: 1506869 - RNA, 19 nt, Homo sapiens
ggaagaacaggauugugaa

SEQ ID NO: 1506870 - RNA, 19 nt, Homo sapiens
uuucagcacucccaacaaa

SEQ ID NO: 1506871 - RNA, 19 nt, Homo sapiens
ccaagccuauugugaacuu

SEQ ID NO: 1506872 - RNA, 19 nt, Homo sapiens
gcuccaagccuauugugaa

SEQ ID NO: 1506873 - RNA, 19 nt, Homo sapiens
acaaucaacugcuucaucu

SEQ ID NO: 1506874 - RNA, 19 nt, Homo sapiens
cuucagggcccuccucaua

SEQ ID NO: 1506875 - RNA, 19 nt, Homo sapiens
guauuccgauguuuggauu

SEQ ID NO: 1506876 - RNA, 19 nt, Homo sapiens
uuucuugccuuuacaauuc

SEQ ID NO: 1506877 - RNA, 19 nt, Homo sapiens
ucagggcccuccucauaug

SEQ ID NO: 1506878 - RNA, 19 nt, Homo sapiens
uaaacaacgccaaagagaa

SEQ ID NO: 1506879 - RNA, 19 nt, Homo sapiens
aaucaguccuuaaccauca

SEQ ID NO: 1506880 - RNA, 19 nt, Homo sapiens
aauaaacugcucugaauug

SEQ ID NO: 1506881 - RNA, 19 nt, Homo sapiens
uacaagguguuuacccaaa

SEQ ID NO: 1506882 - RNA, 19 nt, Homo sapiens
agaacaggauugugaagau

SEQ ID NO: 1506883 - RNA, 19 nt, Homo sapiens
gaaacuucaggaggucuua

SEQ ID NO: 1506884 - RNA, 19 nt, Homo sapiens
aaacaacgccaaagagaag

SEQ ID NO: 1506885 - RNA, 19 nt, Homo sapiens
uaucaaagaccugcaguug

SEQ ID NO: 1506886 - RNA, 19 nt, Homo sapiens
gaccagcacccacuucugu

SEQ ID NO: 1506887 - RNA, 19 nt, Homo sapiens
caaagccucaccugacuug

SEQ ID NO: 1506888 - RNA, 19 nt, Homo sapiens
cauuuagacucagguugua

SEQ ID NO: 1506889 - RNA, 19 nt, Homo sapiens
gcaagacaacaauuacauc

SEQ ID NO: 1506890 - RNA, 19 nt, Homo sapiens
ggagcucaauggaaacucu

SEQ ID NO: 1506891 - RNA, 19 nt, Homo sapiens
cagcugagugcaccuauga

SEQ ID NO: 1506892 - RNA, 19 nt, Homo sapiens
ucacuuacaguagcgcuua

SEQ ID NO: 1506893 - RNA, 19 nt, Homo sapiens
caacugcuucaucuucauu

SEQ ID NO: 1506894 - RNA, 19 nt, Homo sapiens
guacaacuacaaucaacug

SEQ ID NO: 1506895 - RNA, 19 nt, Homo sapiens
gugaaucaguccuuaacca

SEQ ID NO: 1506896 - RNA, 19 nt, Homo sapiens
ccucaagacagaccaggua

SEQ ID NO: 1506897 - RNA, 19 nt, Homo sapiens
aggaagaacaggauuguga

SEQ ID NO: 1506898 - RNA, 19 nt, Homo sapiens
gugccucccugucuucuca

SEQ ID NO: 1506899 - RNA, 19 nt, Homo sapiens
gcucugcacccucaucugu

SEQ ID NO: 1506900 - RNA, 19 nt, Homo sapiens
ggagaagauaucugacuca

SEQ ID NO: 1506901 - RNA, 19 nt, Homo sapiens
cuggagggaucuuuguuug

SEQ ID NO: 1506902 - RNA, 19 nt, Homo sapiens
gcaggaagaacaggauugu

SEQ ID NO: 1506903 - RNA, 19 nt, Homo sapiens
gcuguggacuucugcugau

SEQ ID NO: 1506904 - RNA, 19 nt, Homo sapiens
guaaucagggagaaacuuc

SEQ ID NO: 1506905 - RNA, 19 nt, Homo sapiens
agaaagaggagaccaaguc

SEQ ID NO: 1506906 - RNA, 19 nt, Homo sapiens
gaagaacaggauugugaag

SEQ ID NO: 1506907 - RNA, 19 nt, Homo sapiens
ugaauugugugacaguuuu

SEQ ID NO: 1506908 - RNA, 19 nt, Homo sapiens
cggguuaguucaguaauca

SEQ ID NO: 1506909 - RNA, 19 nt, Homo sapiens
gaggaaaaccaaacaauca

SEQ ID NO: 1506910 - RNA, 19 nt, Homo sapiens
aaagacguguccugcacuu

SEQ ID NO: 1506911 - RNA, 19 nt, Homo sapiens
gaacauugugaccuuacug

SEQ ID NO: 1506912 - RNA, 19 nt, Homo sapiens
caagacaacaauuacaucu

SEQ ID NO: 1506913 - RNA, 19 nt, Homo sapiens
gcucuucugacucuaguga

SEQ ID NO: 1506914 - RNA, 19 nt, Homo sapiens
gagcucuucugacucuagu

SEQ ID NO: 1506915 - RNA, 19 nt, Homo sapiens
ggucacggguuaguucagu

SEQ ID NO: 1506916 - RNA, 19 nt, Homo sapiens
gacgcauggccaaauauuu

SEQ ID NO: 1506917 - RNA, 19 nt, Homo sapiens
gacaguggcacaucagaca

SEQ ID NO: 1506918 - RNA, 19 nt, Homo sapiens
gccagaagccauggacuga

SEQ ID NO: 1506919 - RNA, 19 nt, Homo sapiens
ggucugcuccugcuguaug

SEQ ID NO: 1506920 - RNA, 19 nt, Homo sapiens
ggacaagagagugauuauc

SEQ ID NO: 1506921 - RNA, 19 nt, Homo sapiens
guggggagcucaauggaaa

SEQ ID NO: 1506922 - RNA, 19 nt, Homo sapiens
ucugaacauugugaccuua

SEQ ID NO: 1506923 - RNA, 19 nt, Homo sapiens
gaaacccacgcugguguga

SEQ ID NO: 1506924 - RNA, 19 nt, Homo sapiens
acaaguaaacaacgccaaa

SEQ ID NO: 1506925 - RNA, 19 nt, Homo sapiens
gcaggaacaaguaaacaac

SEQ ID NO: 1506926 - RNA, 19 nt, Homo sapiens
uugaaagccugcaggaaca

SEQ ID NO: 1506927 - RNA, 19 nt, Homo sapiens
ucaccugacuugccugaac

SEQ ID NO: 1506928 - RNA, 19 nt, Homo sapiens
gcuggcgacucuacaaggu

SEQ ID NO: 1506929 - RNA, 19 nt, Homo sapiens
gcuuaccucuuugggauuc

SEQ ID NO: 1506930 - RNA, 19 nt, Homo sapiens
ucacggguuaguucaguaa

SEQ ID NO: 1506931 - RNA, 19 nt, Homo sapiens
agaggcaucuggagaacuc

SEQ ID NO: 1506932 - RNA, 19 nt, Homo sapiens
auaaacugcucugaauugu

SEQ ID NO: 1506933 - RNA, 19 nt, Homo sapiens
cuucugugcuucccgguau

SEQ ID NO: 1506934 - RNA, 19 nt, Homo sapiens
gauucucagugucaguaug

SEQ ID NO: 1506935 - RNA, 19 nt, Homo sapiens
cagauucucagugucagua

SEQ ID NO: 1506936 - RNA, 19 nt, Homo sapiens
gggcaguugucucacuuac

SEQ ID NO: 1506937 - RNA, 19 nt, Homo sapiens
gaagaaagaugccaaauuc

SEQ ID NO: 1506938 - RNA, 19 nt, Homo sapiens
ggaaguggcugaugacuau

SEQ ID NO: 1506939 - RNA, 19 nt, Homo sapiens
gaagauaugccgacacuuu

SEQ ID NO: 1506940 - RNA, 19 nt, Homo sapiens
caagaaagcuaagcauuga

SEQ ID NO: 1506941 - RNA, 19 nt, Homo sapiens
ugaaauggcucuacccaaa

SEQ ID NO: 1506942 - RNA, 19 nt, Homo sapiens
gaagagcgauggaagaaca

SEQ ID NO: 1506943 - RNA, 19 nt, Homo sapiens
ggaaagacuccguaucuaa

SEQ ID NO: 1506944 - RNA, 19 nt, Homo sapiens
gaaauucucucgucaacgu

SEQ ID NO: 1506945 - RNA, 19 nt, Homo sapiens
uaguaaagcuggaauguga

SEQ ID NO: 1506946 - RNA, 19 nt, Homo sapiens
aaacaaagccagugaagaa

SEQ ID NO: 1506947 - RNA, 19 nt, Homo sapiens
agaaggagguggauaaaga

SEQ ID NO: 1506948 - RNA, 19 nt, Homo sapiens
gaagagucgugccuacuga

SEQ ID NO: 1506949 - RNA, 19 nt, Homo sapiens
gcaagaaagcuaagcauug

SEQ ID NO: 1506950 - RNA, 19 nt, Homo sapiens
gugaagcucuuuccuauca

SEQ ID NO: 1506951 - RNA, 19 nt, Homo sapiens
caacacaggugagacagaa

SEQ ID NO: 1506952 - RNA, 19 nt, Homo sapiens
gcaagacacagaaauagaa

SEQ ID NO: 1506953 - RNA, 19 nt, Homo sapiens
gugcaggugucguuguuua

SEQ ID NO: 1506954 - RNA, 19 nt, Homo sapiens
aagaaacacuggagauauu

SEQ ID NO: 1506955 - RNA, 19 nt, Homo sapiens
caaagaaacacuggagaua

SEQ ID NO: 1506956 - RNA, 19 nt, Homo sapiens
gaagcucuuuccuaucaaa

SEQ ID NO: 1506957 - RNA, 19 nt, Homo sapiens
ugagagacauaaacaagaa

SEQ ID NO: 1506958 - RNA, 19 nt, Homo sapiens
gcauaauacugaaacacaa

SEQ ID NO: 1506959 - RNA, 19 nt, Homo sapiens
gaacuggcaagaaagcuaa

SEQ ID NO: 1506960 - RNA, 19 nt, Homo sapiens
gaacugagaagagaauaug

SEQ ID NO: 1506961 - RNA, 19 nt, Homo sapiens
cagaggaaguggcugauga

SEQ ID NO: 1506962 - RNA, 19 nt, Homo sapiens
gcagucaguuaauagaaga

SEQ ID NO: 1506963 - RNA, 19 nt, Homo sapiens
gaggaagaaucccaaagau

SEQ ID NO: 1506964 - RNA, 19 nt, Homo sapiens
gaacaggacagguuauugg

SEQ ID NO: 1506965 - RNA, 19 nt, Homo sapiens
gacacuuucuccacagaua

SEQ ID NO: 1506966 - RNA, 19 nt, Homo sapiens
cuggagauauucagaagua

SEQ ID NO: 1506967 - RNA, 19 nt, Homo sapiens
agagaucacuguaagguau

SEQ ID NO: 1506968 - RNA, 19 nt, Homo sapiens
gacauugacaguagugaua

SEQ ID NO: 1506969 - RNA, 19 nt, Homo sapiens
gaaagacuccguaucuaag

SEQ ID NO: 1506970 - RNA, 19 nt, Homo sapiens
gauggaagaacaacugaaa

SEQ ID NO: 1506971 - RNA, 19 nt, Homo sapiens
gaacuguggacgauaauuc

SEQ ID NO: 1506972 - RNA, 19 nt, Homo sapiens
uaccauacccgaagaaauu

SEQ ID NO: 1506973 - RNA, 19 nt, Homo sapiens
ggagguggauaaagagcaa

SEQ ID NO: 1506974 - RNA, 19 nt, Homo sapiens
gagaagagaauaugaagag

SEQ ID NO: 1506975 - RNA, 19 nt, Homo sapiens
guggaacuguggacgauaa

SEQ ID NO: 1506976 - RNA, 19 nt, Homo sapiens
ggacagguuauuggcauua

SEQ ID NO: 1506977 - RNA, 19 nt, Homo sapiens
cuaaggacauugacaguag

SEQ ID NO: 1506978 - RNA, 19 nt, Homo sapiens
gaaagaugccaaauucuac

SEQ ID NO: 1506979 - RNA, 19 nt, Homo sapiens
gagcaucuacuguuugaga

SEQ ID NO: 1506980 - RNA, 19 nt, Homo sapiens
caaagccagugaagaauac

SEQ ID NO: 1506981 - RNA, 19 nt, Homo sapiens
aagagaauaugaagaggaa

SEQ ID NO: 1506982 - RNA, 19 nt, Homo sapiens
ucaagaggaaacagaaaua

SEQ ID NO: 1506983 - RNA, 19 nt, Homo sapiens
agucaaggauccaugcuuu

SEQ ID NO: 1506984 - RNA, 19 nt, Homo sapiens
gggaaagaguuaugugucu

SEQ ID NO: 1506985 - RNA, 19 nt, Homo sapiens
caacagggcaagacacaga

SEQ ID NO: 1506986 - RNA, 19 nt, Homo sapiens
ugacaguagugauaggaaa

SEQ ID NO: 1506987 - RNA, 19 nt, Homo sapiens
caagaggaaacagaaauaa

SEQ ID NO: 1506988 - RNA, 19 nt, Homo sapiens
guaaggagauuuccaaaag

SEQ ID NO: 1506989 - RNA, 19 nt, Homo sapiens
ggagauauucagaaguauu

SEQ ID NO: 1506990 - RNA, 19 nt, Homo sapiens
caaaguaaggccugguaaa

SEQ ID NO: 1506991 - RNA, 19 nt, Homo sapiens
ucagagaugcacaaaguaa

SEQ ID NO: 1506992 - RNA, 19 nt, Homo sapiens
gaagcagucaguuaauaga

SEQ ID NO: 1506993 - RNA, 19 nt, Homo sapiens
agaguuaugugucuuaagu

SEQ ID NO: 1506994 - RNA, 19 nt, Homo sapiens
aagaauacauacagagguu

SEQ ID NO: 1506995 - RNA, 19 nt, Homo sapiens
uuucagagaugcacaaagu

SEQ ID NO: 1506996 - RNA, 19 nt, Homo sapiens
ggaaacaacacaggugaga

SEQ ID NO: 1506997 - RNA, 19 nt, Homo sapiens
gaacaaacaaagaaacacu

SEQ ID NO: 1506998 - RNA, 19 nt, Homo sapiens
agaaagcuaagcauugaua

SEQ ID NO: 1506999 - RNA, 19 nt, Homo sapiens
acagauaucccuuggaguu

SEQ ID NO: 1507000 - RNA, 19 nt, Homo sapiens
gggagugcuuugugaucua

SEQ ID NO: 1507001 - RNA, 19 nt, Homo sapiens
agaagaacaggacagguua

SEQ ID NO: 1507002 - RNA, 19 nt, Homo sapiens
gcaaucaugggaaagaguu

SEQ ID NO: 1507003 - RNA, 19 nt, Homo sapiens
ggaacuggcaagaaagcua

SEQ ID NO: 1507004 - RNA, 19 nt, Homo sapiens
acaaagccagugaagaaua

SEQ ID NO: 1507005 - RNA, 19 nt, Homo sapiens
agaagaaagaugccaaauu

SEQ ID NO: 1507006 - RNA, 19 nt, Homo sapiens
uugaagcagucaguuaaua

SEQ ID NO: 1507007 - RNA, 19 nt, Homo sapiens
cagacaaagugcuaaaugg

SEQ ID NO: 1507008 - RNA, 19 nt, Homo sapiens
gcagauucuucaauagagu

SEQ ID NO: 1507009 - RNA, 19 nt, Homo sapiens
uacaagaagucaggaaaga

SEQ ID NO: 1507010 - RNA, 19 nt, Homo sapiens
acaccgaaaucucaguuug

SEQ ID NO: 1507011 - RNA, 19 nt, Homo sapiens
gagaauaugaagaggaaau

SEQ ID NO: 1507012 - RNA, 19 nt, Homo sapiens
cggcuuuacuaacauauug

SEQ ID NO: 1507013 - RNA, 19 nt, Homo sapiens
cuuuaaagaugcaguugaa

SEQ ID NO: 1507014 - RNA, 19 nt, Homo sapiens
gaucaagaggaaacagaaa

SEQ ID NO: 1507015 - RNA, 19 nt, Homo sapiens
augaggaacuggcaagaaa

SEQ ID NO: 1507016 - RNA, 19 nt, Homo sapiens
ugacacagacaaauggaaa

SEQ ID NO: 1507017 - RNA, 19 nt, Homo sapiens
gcgaagagcgauggaagaa

SEQ ID NO: 1507018 - RNA, 19 nt, Homo sapiens
uagagcgucuggccaagaa

SEQ ID NO: 1507019 - RNA, 19 nt, Homo sapiens
aaauggcucuacccaaaga

SEQ ID NO: 1507020 - RNA, 19 nt, Homo sapiens
ccaaagaugggaacuucaa

SEQ ID NO: 1507021 - RNA, 19 nt, Homo sapiens
gcuaagcauugauauuaac

SEQ ID NO: 1507022 - RNA, 19 nt, Homo sapiens
caguucgucugcucaguaa

SEQ ID NO: 1507023 - RNA, 19 nt, Homo sapiens
guuauuggcauuacaacuu

SEQ ID NO: 1507024 - RNA, 19 nt, Homo sapiens
uggagcaucuacuguuuga

SEQ ID NO: 1507025 - RNA, 19 nt, Homo sapiens
gagaacaaggugcagauuc

SEQ ID NO: 1507026 - RNA, 19 nt, Homo sapiens
gaaagcuaagcauugauau

SEQ ID NO: 1507027 - RNA, 19 nt, Homo sapiens
gcuggaaugugaagcucuu

SEQ ID NO: 1507028 - RNA, 19 nt, Homo sapiens
gaagaacaggacagguuau

SEQ ID NO: 1507029 - RNA, 19 nt, Homo sapiens
gaaggaaacgucaaaacaa

SEQ ID NO: 1507030 - RNA, 19 nt, Homo sapiens
gaacaaggugcagauucuu

SEQ ID NO: 1507031 - RNA, 19 nt, Homo sapiens
uagaagauaugccgacacu

SEQ ID NO: 1507032 - RNA, 19 nt, Homo sapiens
gaaauggcucuacccaaag

SEQ ID NO: 1507033 - RNA, 19 nt, Homo sapiens
caggaaagacuccguaucu

SEQ ID NO: 1507034 - RNA, 19 nt, Homo sapiens
aaagaaacacuggagauau

SEQ ID NO: 1507035 - RNA, 19 nt, Homo sapiens
cccagggagugcaagcuua

SEQ ID NO: 1507036 - RNA, 19 nt, Homo sapiens
cagccuagcauuucacaga

SEQ ID NO: 1507037 - RNA, 19 nt, Homo sapiens
gcaaugcggucacagguuu

SEQ ID NO: 1507038 - RNA, 19 nt, Homo sapiens
gcaagugccuuuccgacaa

SEQ ID NO: 1507039 - RNA, 19 nt, Homo sapiens
aagauggacuuccugcuuu

SEQ ID NO: 1507040 - RNA, 19 nt, Homo sapiens
gaagcucuaugaccuggau

SEQ ID NO: 1507041 - RNA, 19 nt, Homo sapiens
caagauggacuuccugcuu

SEQ ID NO: 1507042 - RNA, 19 nt, Homo sapiens
ggucaugguuuugaaauaa

SEQ ID NO: 1507043 - RNA, 19 nt, Homo sapiens
cauggugcaucagaacaua

SEQ ID NO: 1507044 - RNA, 19 nt, Homo sapiens
cuacuuggccuuccuguuc

SEQ ID NO: 1507045 - RNA, 19 nt, Homo sapiens
gugaggagcccuucaacga

SEQ ID NO: 1507046 - RNA, 19 nt, Homo sapiens
caagugccuuuccgacaag

SEQ ID NO: 1507047 - RNA, 19 nt, Homo sapiens
gcgcauggccugcucuacu

SEQ ID NO: 1507048 - RNA, 19 nt, Homo sapiens
caggcuccaugccaacaga

SEQ ID NO: 1507049 - RNA, 19 nt, Homo sapiens
cgcauggccugcucuacug

SEQ ID NO: 1507050 - RNA, 19 nt, Homo sapiens
cgacgucgugggcaaguuc

SEQ ID NO: 1507051 - RNA, 19 nt, Homo sapiens
gaagauaucucugagcaua

SEQ ID NO: 1507052 - RNA, 19 nt, Homo sapiens
ucacaggucuuaaauguaa

SEQ ID NO: 1507053 - RNA, 19 nt, Homo sapiens
gaaaugagcaacuuacuga

SEQ ID NO: 1507054 - RNA, 19 nt, Homo sapiens
gcucagcucuuaacagaaa

SEQ ID NO: 1507055 - RNA, 19 nt, Homo sapiens
uaaaggaguucuucucuau

SEQ ID NO: 1507056 - RNA, 19 nt, Homo sapiens
cgacacccaucaauuauuu

SEQ ID NO: 1507057 - RNA, 19 nt, Homo sapiens
gaagagagacugcuaaagu

SEQ ID NO: 1507058 - RNA, 19 nt, Homo sapiens
gaagcaaaguuacgucaga

SEQ ID NO: 1507059 - RNA, 19 nt, Homo sapiens
caagaaguacuccuuauaa

SEQ ID NO: 1507060 - RNA, 19 nt, Homo sapiens
gacaaccaauucaaaguaa

SEQ ID NO: 1507061 - RNA, 19 nt, Homo sapiens
gcaaagugcaauacugaua

SEQ ID NO: 1507062 - RNA, 19 nt, Homo sapiens
ggaguuauccuuacagcua

SEQ ID NO: 1507063 - RNA, 19 nt, Homo sapiens
ggaaauuuguggugugguu

SEQ ID NO: 1507064 - RNA, 19 nt, Homo sapiens
cuacgacacccaucaauua

SEQ ID NO: 1507065 - RNA, 19 nt, Homo sapiens
ggagauggcaguggacuua

SEQ ID NO: 1507066 - RNA, 19 nt, Homo sapiens
gaaguuggagccuauguuu

SEQ ID NO: 1507067 - RNA, 19 nt, Homo sapiens
cuagaggaguguuacuuua

SEQ ID NO: 1507068 - RNA, 19 nt, Homo sapiens
gcaguggacuuaugcuaga

SEQ ID NO: 1507069 - RNA, 19 nt, Homo sapiens
gggccugaauuaaugaaua

SEQ ID NO: 1507070 - RNA, 19 nt, Homo sapiens
gaauguagccgaucguguu

SEQ ID NO: 1507071 - RNA, 19 nt, Homo sapiens
caauugaugucccaaaugu

SEQ ID NO: 1507072 - RNA, 19 nt, Homo sapiens
gcaagacaaccaauucaaa

SEQ ID NO: 1507073 - RNA, 19 nt, Homo sapiens
gaaggaaaugagcaacuua

SEQ ID NO: 1507074 - RNA, 19 nt, Homo sapiens
gcucaggaccggcuagaua

SEQ ID NO: 1507075 - RNA, 19 nt, Homo sapiens
ggccugaauuaaugaauaa

SEQ ID NO: 1507076 - RNA, 19 nt, Homo sapiens
ggaaauagcaauugauguc

SEQ ID NO: 1507077 - RNA, 19 nt, Homo sapiens
caacaacaagagucaauuu

SEQ ID NO: 1507078 - RNA, 19 nt, Homo sapiens
gagcaaagugcaauacuga

SEQ ID NO: 1507079 - RNA, 19 nt, Homo sapiens
ggaagucacaggucuuaaa

SEQ ID NO: 1507080 - RNA, 19 nt, Homo sapiens
gaagaagaacugacugguu

SEQ ID NO: 1507081 - RNA, 19 nt, Homo sapiens
gcuacuaaccguccagaua

SEQ ID NO: 1507082 - RNA, 19 nt, Homo sapiens
gcaguggcgccuuccauua

SEQ ID NO: 1507083 - RNA, 19 nt, Homo sapiens
caaauagugcucauggaua

SEQ ID NO: 1507084 - RNA, 19 nt, Homo sapiens
gaagaagagagacugcuaa

SEQ ID NO: 1507085 - RNA, 19 nt, Homo sapiens
gcauaaguuucaaucaguu

SEQ ID NO: 1507086 - RNA, 19 nt, Homo sapiens
gagcauaaguuucaaucag

SEQ ID NO: 1507087 - RNA, 19 nt, Homo sapiens
gaagggaaauauuuaagcu

SEQ ID NO: 1507088 - RNA, 19 nt, Homo sapiens
gaaaguaucaaacugaagu

SEQ ID NO: 1507089 - RNA, 19 nt, Homo sapiens
ccaggcaacuuucuguauu

SEQ ID NO: 1507090 - RNA, 19 nt, Homo sapiens
gaagauuacucugaaggau

SEQ ID NO: 1507091 - RNA, 19 nt, Homo sapiens
ccgaagaccugggcgauuu

SEQ ID NO: 1507092 - RNA, 19 nt, Homo sapiens
cguacaagcugcaaguauu

SEQ ID NO: 1507093 - RNA, 19 nt, Homo sapiens
caacaagaagggaaauauu

SEQ ID NO: 1507094 - RNA, 19 nt, Homo sapiens
gcuaaaggaugugaccauu

SEQ ID NO: 1507095 - RNA, 19 nt, Homo sapiens
ccagggcuguugcuaauga

SEQ ID NO: 1507096 - RNA, 19 nt, Homo sapiens
gugaccaacuuauuagaaa

SEQ ID NO: 1507097 - RNA, 19 nt, Homo sapiens
uaaaggaugugaccauuuu

SEQ ID NO: 1507098 - RNA, 19 nt, Homo sapiens
ggcaaugaaugauaucaga

SEQ ID NO: 1507099 - RNA, 19 nt, Homo sapiens
agauuacucugaaggauuu

SEQ ID NO: 1507100 - RNA, 19 nt, Homo sapiens
auaaagagauugagauugg

SEQ ID NO: 1507101 - RNA, 19 nt, Homo sapiens
gacggugaccaacuuauua

SEQ ID NO: 1507102 - RNA, 19 nt, Homo sapiens
gaugcggccuggaagaauu

SEQ ID NO: 1507103 - RNA, 19 nt, Homo sapiens
gcaaaguuacgucagauau

SEQ ID NO: 1507104 - RNA, 19 nt, Homo sapiens
gaaagagcaguuagagaga

SEQ ID NO: 1507105 - RNA, 19 nt, Homo sapiens
cuaaaggaguucuucucua

SEQ ID NO: 1507106 - RNA, 19 nt, Homo sapiens
uaggaggacuggaaaguau

SEQ ID NO: 1507107 - RNA, 19 nt, Homo sapiens
uggcauugguucagaagua

SEQ ID NO: 1507108 - RNA, 19 nt, Homo sapiens
gagccuauguuucuguaau

SEQ ID NO: 1507109 - RNA, 19 nt, Homo sapiens
ggagcaaagugcaauacug

SEQ ID NO: 1507110 - RNA, 19 nt, Homo sapiens
aagagagacugcuaaaguu

SEQ ID NO: 1507111 - RNA, 19 nt, Homo sapiens
ucaagaaguacuccuuaua

SEQ ID NO: 1507112 - RNA, 19 nt, Homo sapiens
gaguuauccuuacagcuaa

SEQ ID NO: 1507113 - RNA, 19 nt, Homo sapiens
gcaacuuucuguauuguac

SEQ ID NO: 1507114 - RNA, 19 nt, Homo sapiens
cgaccaguguugcuuacua

SEQ ID NO: 1507115 - RNA, 19 nt, Homo sapiens
guaaguacagugaagauau

SEQ ID NO: 1507116 - RNA, 19 nt, Homo sapiens
gcaaauagugcucauggau

SEQ ID NO: 1507117 - RNA, 19 nt, Homo sapiens
gcgauuugauaaagagauu

SEQ ID NO: 1507118 - RNA, 19 nt, Homo sapiens
ugagugaaauggcacagaa

SEQ ID NO: 1507119 - RNA, 19 nt, Homo sapiens
caguguugcuuacuaguuu

SEQ ID NO: 1507120 - RNA, 19 nt, Homo sapiens
ugagggaaauagcaauuga

SEQ ID NO: 1507121 - RNA, 19 nt, Homo sapiens
uugaaagucuuguguaaug

SEQ ID NO: 1507122 - RNA, 19 nt, Homo sapiens
aguuguggcuucacucuua

SEQ ID NO: 1507123 - RNA, 19 nt, Homo sapiens
gaggaagucacaggucuua

SEQ ID NO: 1507124 - RNA, 19 nt, Homo sapiens
gcaacaagaagggaaauau

SEQ ID NO: 1507125 - RNA, 19 nt, Homo sapiens
aaucaucuaugugccuuua

SEQ ID NO: 1507126 - RNA, 19 nt, Homo sapiens
agaaguaagugaaggacaa

SEQ ID NO: 1507127 - RNA, 19 nt, Homo sapiens
gcaacuuacugaagaagag

SEQ ID NO: 1507128 - RNA, 19 nt, Homo sapiens
gcagauggcaugauauugg

SEQ ID NO: 1507129 - RNA, 19 nt, Homo sapiens
acuaugaagucugcaaaua

SEQ ID NO: 1507130 - RNA, 19 nt, Homo sapiens
agaaauggaugggauugaa

SEQ ID NO: 1507131 - RNA, 19 nt, Homo sapiens
uggcucagcucuuaacaga

SEQ ID NO: 1507132 - RNA, 19 nt, Homo sapiens
ggacugaauuuucuagcua

SEQ ID NO: 1507133 - RNA, 19 nt, Homo sapiens
gaaagucuuguguaaugaa

SEQ ID NO: 1507134 - RNA, 19 nt, Homo sapiens
uaaugaaguuggagccuau

SEQ ID NO: 1507135 - RNA, 19 nt, Homo sapiens
gcugaaagcaauuagagaa

SEQ ID NO: 1507136 - RNA, 19 nt, Homo sapiens
guagccagcugaaagcaau

SEQ ID NO: 1507137 - RNA, 19 nt, Homo sapiens
gaagucacaggucuuaaau

SEQ ID NO: 1507138 - RNA, 19 nt, Homo sapiens
gcuacaggcugaggaaaug

SEQ ID NO: 1507139 - RNA, 19 nt, Homo sapiens
gggcuuugguucuuacaga

SEQ ID NO: 1507140 - RNA, 19 nt, Homo sapiens
caaauucuauggugagacu

SEQ ID NO: 1507141 - RNA, 19 nt, Homo sapiens
agucacaggucuuaaaugu

SEQ ID NO: 1507142 - RNA, 19 nt, Homo sapiens
caucaagaaguacuccuua

SEQ ID NO: 1507143 - RNA, 19 nt, Homo sapiens
ugacacugaugcccaaaga

SEQ ID NO: 1507144 - RNA, 19 nt, Homo sapiens
uaaguacagugaagauauc

SEQ ID NO: 1507145 - RNA, 19 nt, Homo sapiens
gaaguauguucaguagaau

SEQ ID NO: 1507146 - RNA, 19 nt, Homo sapiens
ggauugaacagcuaaagga

SEQ ID NO: 1507147 - RNA, 19 nt, Homo sapiens
caaaguuacgucagauauu

SEQ ID NO: 1507148 - RNA, 19 nt, Homo sapiens
guaauuaaugguccugaaa

SEQ ID NO: 1507149 - RNA, 19 nt, Homo sapiens
ugacaugauaggaggauua

SEQ ID NO: 1507150 - RNA, 19 nt, Homo sapiens
aaauaaagccagugauguu

SEQ ID NO: 1507151 - RNA, 19 nt, Homo sapiens
gaagauagcuuaguguaaa

SEQ ID NO: 1507152 - RNA, 19 nt, Homo sapiens
gcacauacauucaacauca

SEQ ID NO: 1507153 - RNA, 19 nt, Homo sapiens
ugucuuagcugucuucaua

SEQ ID NO: 1507154 - RNA, 19 nt, Homo sapiens
gaagauagguucuggacau

SEQ ID NO: 1507155 - RNA, 19 nt, Homo sapiens
caacagaaucgcaaucuua

SEQ ID NO: 1507156 - RNA, 19 nt, Homo sapiens
caaauaaacuggagcagau

SEQ ID NO: 1507157 - RNA, 19 nt, Homo sapiens
gcaguaggcuugagucaug

SEQ ID NO: 1507158 - RNA, 19 nt, Homo sapiens
caucuuacaucuugaauga

SEQ ID NO: 1507159 - RNA, 19 nt, Homo sapiens
gcaaauggauggcagagau

SEQ ID NO: 1507160 - RNA, 19 nt, Homo sapiens
aagccaaccugcaguauua

SEQ ID NO: 1507161 - RNA, 19 nt, Homo sapiens
gaccaacugugcuuaaauu

SEQ ID NO: 1507162 - RNA, 19 nt, Homo sapiens
cagaaucgcaaucuuauua

SEQ ID NO: 1507163 - RNA, 19 nt, Homo sapiens
gaaaauaguugaugucugu

SEQ ID NO: 1507164 - RNA, 19 nt, Homo sapiens
gacagacagugaaauaauu

SEQ ID NO: 1507165 - RNA, 19 nt, Homo sapiens
ggaauuaacgggcuuucua

SEQ ID NO: 1507166 - RNA, 19 nt, Homo sapiens
guaaugauuugguagaguu

SEQ ID NO: 1507167 - RNA, 19 nt, Homo sapiens
ggacacacacagauaaauu

SEQ ID NO: 1507168 - RNA, 19 nt, Homo sapiens
cuucaucucuggcaauaua

SEQ ID NO: 1507169 - RNA, 19 nt, Homo sapiens
gaagacagcucagaagaac

SEQ ID NO: 1507170 - RNA, 19 nt, Homo sapiens
caaguuagccuguuacugu

SEQ ID NO: 1507171 - RNA, 19 nt, Homo sapiens
ggacaugugccuaucguuu

SEQ ID NO: 1507172 - RNA, 19 nt, Homo sapiens
ggucucauauagcaauuaa

SEQ ID NO: 1507173 - RNA, 19 nt, Homo sapiens
gauagucucuuccaacagu

SEQ ID NO: 1507174 - RNA, 19 nt, Homo sapiens
caaaguccuugcauucuug

SEQ ID NO: 1507175 - RNA, 19 nt, Homo sapiens
gaacacaaagggcccauga

SEQ ID NO: 1507176 - RNA, 19 nt, Homo sapiens
guacagguggccuacauua

SEQ ID NO: 1507177 - RNA, 19 nt, Homo sapiens
gaaucagccugugcgaaua

SEQ ID NO: 1507178 - RNA, 19 nt, Homo sapiens
gagcagauuccgagaguuu

SEQ ID NO: 1507179 - RNA, 19 nt, Homo sapiens
gcagugugaugcaggcuuu

SEQ ID NO: 1507180 - RNA, 19 nt, Homo sapiens
gaagaacugugggcaaauc

SEQ ID NO: 1507181 - RNA, 19 nt, Homo sapiens
caguacagcugcaauauca

SEQ ID NO: 1507182 - RNA, 19 nt, Homo sapiens
acagauaaauucacaggaa

SEQ ID NO: 1507183 - RNA, 19 nt, Homo sapiens
gugccuaucguuuguauua

SEQ ID NO: 1507184 - RNA, 19 nt, Homo sapiens
caaaccagauggauuucaa

SEQ ID NO: 1507185 - RNA, 19 nt, Homo sapiens
cagaagaacugugggcaaa

SEQ ID NO: 1507186 - RNA, 19 nt, Homo sapiens
guuguaagcuuggguuauu

SEQ ID NO: 1507187 - RNA, 19 nt, Homo sapiens
ucaaggaauugcagaauca

SEQ ID NO: 1507188 - RNA, 19 nt, Homo sapiens
gcaugaaguuaguagaaga

SEQ ID NO: 1507189 - RNA, 19 nt, Homo sapiens
ggagaucacagcagcauga

SEQ ID NO: 1507190 - RNA, 19 nt, Homo sapiens
cacaguggguuauguugua

SEQ ID NO: 1507191 - RNA, 19 nt, Homo sapiens
ucagacagacagugaaaua

SEQ ID NO: 1507192 - RNA, 19 nt, Homo sapiens
ggacauggacacacacaga

SEQ ID NO: 1507193 - RNA, 19 nt, Homo sapiens
caacaaggcaacuguacaa

SEQ ID NO: 1507194 - RNA, 19 nt, Homo sapiens
uuacacaagugaaugaaga

SEQ ID NO: 1507195 - RNA, 19 nt, Homo sapiens
guaaucggcucagugaaug

SEQ ID NO: 1507196 - RNA, 19 nt, Homo sapiens
uaagacaccugggucagaa

SEQ ID NO: 1507197 - RNA, 19 nt, Homo sapiens
gagaguuuaugacguuguu

SEQ ID NO: 1507198 - RNA, 19 nt, Homo sapiens
uccgaacgcuuaauugaaa

SEQ ID NO: 1507199 - RNA, 19 nt, Homo sapiens
ucagaaugcuugugugcaa

SEQ ID NO: 1507200 - RNA, 19 nt, Homo sapiens
cagauguaaugauuuggua

SEQ ID NO: 1507201 - RNA, 19 nt, Homo sapiens
ucacaaaacuuacagaugu

SEQ ID NO: 1507202 - RNA, 19 nt, Homo sapiens
gaauuaacgggcuuucuau

SEQ ID NO: 1507203 - RNA, 19 nt, Homo sapiens
gaagccagcacauacauuc

SEQ ID NO: 1507204 - RNA, 19 nt, Homo sapiens
gauagguucuggacaugug

SEQ ID NO: 1507205 - RNA, 19 nt, Homo sapiens
gcacagaugcaaaucaaag

SEQ ID NO: 1507206 - RNA, 19 nt, Homo sapiens
aagcaaaccagauggauuu

SEQ ID NO: 1507207 - RNA, 19 nt, Homo sapiens
gaagccaaccugcaguauu

SEQ ID NO: 1507208 - RNA, 19 nt, Homo sapiens
acaaagggcccaugaugaa

SEQ ID NO: 1507209 - RNA, 19 nt, Homo sapiens
gccaauuacucaucagaau

SEQ ID NO: 1507210 - RNA, 19 nt, Homo sapiens
ggugaaccuuguccuggua

SEQ ID NO: 1507211 - RNA, 19 nt, Homo sapiens
caggauauaucacuguugu

SEQ ID NO: 1507212 - RNA, 19 nt, Homo sapiens
ggacauggacuagguaaag

SEQ ID NO: 1507213 - RNA, 19 nt, Homo sapiens
gcacacaguggguuauguu

SEQ ID NO: 1507214 - RNA, 19 nt, Homo sapiens
acacacagauaaauucaca

SEQ ID NO: 1507215 - RNA, 19 nt, Homo sapiens
gcgccgagcauuggauuua

SEQ ID NO: 1507216 - RNA, 19 nt, Homo sapiens
caggguggcugcauaauac

SEQ ID NO: 1507217 - RNA, 19 nt, Homo sapiens
ccagauggauuucaagaac

SEQ ID NO: 1507218 - RNA, 19 nt, Homo sapiens
gaaguuaguagaagaagca

SEQ ID NO: 1507219 - RNA, 19 nt, Homo sapiens
gaucacagcagcaugaagu

SEQ ID NO: 1507220 - RNA, 19 nt, Homo sapiens
guuaguagaagaagcagua

SEQ ID NO: 1507221 - RNA, 19 nt, Homo sapiens
uuacggccgugcucacuaa

SEQ ID NO: 1507222 - RNA, 19 nt, Homo sapiens
cuaauaauccugugaucaa

SEQ ID NO: 1507223 - RNA, 19 nt, Homo sapiens
ggauuucaagaacauguua

SEQ ID NO: 1507224 - RNA, 19 nt, Homo sapiens
agacacagcagcaggauga

SEQ ID NO: 1507225 - RNA, 19 nt, Homo sapiens
cauaguggauagucucuuc

SEQ ID NO: 1507226 - RNA, 19 nt, Homo sapiens
acaaaguccuugcauucuu

SEQ ID NO: 1507227 - RNA, 19 nt, Homo sapiens
gacauggacuagguaaaga

SEQ ID NO: 1507228 - RNA, 19 nt, Homo sapiens
caaauggauggcagagaua

SEQ ID NO: 1507229 - RNA, 19 nt, Homo sapiens
uuaaauuccuggcaaaugg

SEQ ID NO: 1507230 - RNA, 19 nt, Homo sapiens
guagauaggaacaacagaa

SEQ ID NO: 1507231 - RNA, 19 nt, Homo sapiens
ugaaacuucuucuuguguu

SEQ ID NO: 1507232 - RNA, 19 nt, Homo sapiens
gaaauaauuacuggacaug

SEQ ID NO: 1507233 - RNA, 19 nt, Homo sapiens
gaagcagcccuuuggaugu

SEQ ID NO: 1507234 - RNA, 19 nt, Homo sapiens
gguaaucggcucagugaau

SEQ ID NO: 1507235 - RNA, 19 nt, Homo sapiens
caccugggauuuaauaagu

SEQ ID NO: 1507236 - RNA, 19 nt, Homo sapiens
agcauuggauuuaguauug

SEQ ID NO: 1507237 - RNA, 19 nt, Homo sapiens
gagcauuggauuuaguauu

SEQ ID NO: 1507238 - RNA, 19 nt, Homo sapiens
ccuuucaacucuccuauau

SEQ ID NO: 1507239 - RNA, 19 nt, Homo sapiens
gcagagauaccuuucaacu

SEQ ID NO: 1507240 - RNA, 19 nt, Homo sapiens
cagaaggaauuaauuuggu

SEQ ID NO: 1507241 - RNA, 19 nt, Homo sapiens
aaauguguccgaacgcuua

SEQ ID NO: 1507242 - RNA, 19 nt, Homo sapiens
agacaaaguccuugcauuc

SEQ ID NO: 1507243 - RNA, 19 nt, Homo sapiens
caacugugcuuaaauuccu

SEQ ID NO: 1507244 - RNA, 19 nt, Homo sapiens
ccucuuggcuggcuucauc

SEQ ID NO: 1507245 - RNA, 19 nt, Homo sapiens
gaacaacagaaucgcaauc

SEQ ID NO: 1507246 - RNA, 19 nt, Homo sapiens
gccagaauguagugaagga

SEQ ID NO: 1507247 - RNA, 19 nt, Homo sapiens
gccaagucauggugccuaa

SEQ ID NO: 1507248 - RNA, 19 nt, Homo sapiens
uggcagagauaccuuucaa

SEQ ID NO: 1507249 - RNA, 19 nt, Homo sapiens
uguuacagcuacucacaaa

SEQ ID NO: 1507250 - RNA, 19 nt, Homo sapiens
uggacuagguaaagacaaa

SEQ ID NO: 1507251 - RNA, 19 nt, Homo sapiens
gaacaagucuuaacagaua

SEQ ID NO: 1507252 - RNA, 19 nt, Homo sapiens
gaaaggaguuugcccuaaa

SEQ ID NO: 1507253 - RNA, 19 nt, Homo sapiens
gaacacggcucuagauaag

SEQ ID NO: 1507254 - RNA, 19 nt, Homo sapiens
ggaaggugcucccuggaua

SEQ ID NO: 1507255 - RNA, 19 nt, Homo sapiens
gaaaggaacaccugauuga

SEQ ID NO: 1507256 - RNA, 19 nt, Homo sapiens
gaaagcagguuacuugucu

SEQ ID NO: 1507257 - RNA, 19 nt, Homo sapiens
uaaagucgauuacaccaaa

SEQ ID NO: 1507258 - RNA, 19 nt, Homo sapiens
uaagaggacuggcuuucua

SEQ ID NO: 1507259 - RNA, 19 nt, Homo sapiens
ggaaaggaguuugcccuaa

SEQ ID NO: 1507260 - RNA, 19 nt, Homo sapiens
ccucagaguuuccuucuuu

SEQ ID NO: 1507261 - RNA, 19 nt, Homo sapiens
gagcuugaccguugcauaa

SEQ ID NO: 1507262 - RNA, 19 nt, Homo sapiens
ggagaucucuuugaugcaa

SEQ ID NO: 1507263 - RNA, 19 nt, Homo sapiens
gaguuugcccuaaagauua

SEQ ID NO: 1507264 - RNA, 19 nt, Homo sapiens
cauaauccguguauuuguu

SEQ ID NO: 1507265 - RNA, 19 nt, Homo sapiens
ggaaaugcccgugaacuug

SEQ ID NO: 1507266 - RNA, 19 nt, Homo sapiens
ggaguuugcccuaaagauu

SEQ ID NO: 1507267 - RNA, 19 nt, Homo sapiens
gugcggauccuucugaaua

SEQ ID NO: 1507268 - RNA, 19 nt, Homo sapiens
aagcugaggugacagguaa

SEQ ID NO: 1507269 - RNA, 19 nt, Homo sapiens
gcagugccaugguguacaa

SEQ ID NO: 1507270 - RNA, 19 nt, Homo sapiens
gggagagccugaagcagaa

SEQ ID NO: 1507271 - RNA, 19 nt, Homo sapiens
caaauguuguggaaaggaa

SEQ ID NO: 1507272 - RNA, 19 nt, Homo sapiens
aggagaaugugcaacuuua

SEQ ID NO: 1507273 - RNA, 19 nt, Homo sapiens
ggaauuaaucagucaaaug

SEQ ID NO: 1507274 - RNA, 19 nt, Homo sapiens
agaacaaucuccaggaaga

SEQ ID NO: 1507275 - RNA, 19 nt, Homo sapiens
uaaguauucuggauccaaa

SEQ ID NO: 1507276 - RNA, 19 nt, Homo sapiens
gauauacucugugaaccuu

SEQ ID NO: 1507277 - RNA, 19 nt, Homo sapiens
ggaaaggaacaccugauug

SEQ ID NO: 1507278 - RNA, 19 nt, Homo sapiens
gagcccaucucuccaguuc

SEQ ID NO: 1507279 - RNA, 19 nt, Homo sapiens
ggacucugccaaggaauua

SEQ ID NO: 1507280 - RNA, 19 nt, Homo sapiens
ggucaaagguggagaucuc

SEQ ID NO: 1507281 - RNA, 19 nt, Homo sapiens
gaggacuggcuuucuaaua

SEQ ID NO: 1507282 - RNA, 19 nt, Homo sapiens
gcaacuuuauuccagcauu

SEQ ID NO: 1507283 - RNA, 19 nt, Homo sapiens
ccucagcuguuaaguauuc

SEQ ID NO: 1507284 - RNA, 19 nt, Homo sapiens
aauccaaacuggucuguga

SEQ ID NO: 1507285 - RNA, 19 nt, Homo sapiens
gagaaugugcaacuuuauu

SEQ ID NO: 1507286 - RNA, 19 nt, Homo sapiens
gucaaaugcuucagguaaa

SEQ ID NO: 1507287 - RNA, 19 nt, Homo sapiens
gcacagagacaucaaacca

SEQ ID NO: 1507288 - RNA, 19 nt, Homo sapiens
gaaacaucccaauaucauu

SEQ ID NO: 1507289 - RNA, 19 nt, Homo sapiens
gaggugacagguaaacuaa

SEQ ID NO: 1507290 - RNA, 19 nt, Homo sapiens
gaauuaaucagucaaaugc

SEQ ID NO: 1507291 - RNA, 19 nt, Homo sapiens
gaaccaagucuuugaaacu

SEQ ID NO: 1507292 - RNA, 19 nt, Homo sapiens
uggcagaucuucuuccaau

SEQ ID NO: 1507293 - RNA, 19 nt, Homo sapiens
guccugaagucaucuuauu

SEQ ID NO: 1507294 - RNA, 19 nt, Homo sapiens
cagagacaaugcucaguau

SEQ ID NO: 1507295 - RNA, 19 nt, Homo sapiens
guaucgagcuggagcacuu

SEQ ID NO: 1507296 - RNA, 19 nt, Homo sapiens
ccaaggaauuaaucaguca

SEQ ID NO: 1507297 - RNA, 19 nt, Homo sapiens
gauccucagcuguuaagua

SEQ ID NO: 1507298 - RNA, 19 nt, Homo sapiens
guaaagauuucaucaaacc

SEQ ID NO: 1507299 - RNA, 19 nt, Homo sapiens
gagacaaugcucaguauuc

SEQ ID NO: 1507300 - RNA, 19 nt, Homo sapiens
uacgaaagacuuagaauug

SEQ ID NO: 1507301 - RNA, 19 nt, Homo sapiens
uagaaacacuuuggaaaca

SEQ ID NO: 1507302 - RNA, 19 nt, Homo sapiens
gagugaaacaucccaauau

SEQ ID NO: 1507303 - RNA, 19 nt, Homo sapiens
gauuauagacaaagccaaa

SEQ ID NO: 1507304 - RNA, 19 nt, Homo sapiens
cagaucuucuuccaaugua

SEQ ID NO: 1507305 - RNA, 19 nt, Homo sapiens
gcaaaucaccagcuucagu

SEQ ID NO: 1507306 - RNA, 19 nt, Homo sapiens
caaaucaccagcuucaguu

SEQ ID NO: 1507307 - RNA, 19 nt, Homo sapiens
caccgaagccauuaaacua

SEQ ID NO: 1507308 - RNA, 19 nt, Homo sapiens
agacaaugcucaguauuca

SEQ ID NO: 1507309 - RNA, 19 nt, Homo sapiens
ccagagacaaugcucagua

SEQ ID NO: 1507310 - RNA, 19 nt, Homo sapiens
caacuuuauuccagcauuc

SEQ ID NO: 1507311 - RNA, 19 nt, Homo sapiens
cgagugaaacaucccaaua

SEQ ID NO: 1507312 - RNA, 19 nt, Homo sapiens
gcagaucuucuuccaaugu

SEQ ID NO: 1507313 - RNA, 19 nt, Homo sapiens
ccagaaaucauugcugaaa

SEQ ID NO: 1507314 - RNA, 19 nt, Homo sapiens
ccaaguacacugagagaga

SEQ ID NO: 1507315 - RNA, 19 nt, Homo sapiens
gauugagaaugaaguguca

SEQ ID NO: 1507316 - RNA, 19 nt, Homo sapiens
aggaacaccugauugagaa

SEQ ID NO: 1507317 - RNA, 19 nt, Homo sapiens
ggaaaggucauuggugaug

SEQ ID NO: 1507318 - RNA, 19 nt, Homo sapiens
ccaggaaguuucagaggau

SEQ ID NO: 1507319 - RNA, 19 nt, Homo sapiens
ucgaugcgcuccucauaga

SEQ ID NO: 1507320 - RNA, 19 nt, Homo sapiens
gauaucaccgaagccauua

SEQ ID NO: 1507321 - RNA, 19 nt, Homo sapiens
gaaacacuuuggaaacacu

SEQ ID NO: 1507322 - RNA, 19 nt, Homo sapiens
gccugaagguggacauuug

SEQ ID NO: 1507323 - RNA, 19 nt, Homo sapiens
ggaaccaagucuuugaaac

SEQ ID NO: 1507324 - RNA, 19 nt, Homo sapiens
ggaaguuucagaggauuaa

SEQ ID NO: 1507325 - RNA, 19 nt, Homo sapiens
guuaggaaaugcccgugaa

SEQ ID NO: 1507326 - RNA, 19 nt, Homo sapiens
cgaaagacuuagaauugca

SEQ ID NO: 1507327 - RNA, 19 nt, Homo sapiens
ugaacacggcucuagauaa

SEQ ID NO: 1507328 - RNA, 19 nt, Homo sapiens
gauggaaccaagucuuuga

SEQ ID NO: 1507329 - RNA, 19 nt, Homo sapiens
caaguacacugagagagau

SEQ ID NO: 1507330 - RNA, 19 nt, Homo sapiens
agaauugcauuuguccuuu

SEQ ID NO: 1507331 - RNA, 19 nt, Homo sapiens
acacggcucuagauaagga

SEQ ID NO: 1507332 - RNA, 19 nt, Homo sapiens
ucaaaugcuucagguaaau

SEQ ID NO: 1507333 - RNA, 19 nt, Homo sapiens
gcucauggcagaucuucuu

SEQ ID NO: 1507334 - RNA, 19 nt, Homo sapiens
gcugcugccuccucuguga

SEQ ID NO: 1507335 - RNA, 19 nt, Homo sapiens
ccaaugcccucagguaucu

SEQ ID NO: 1507336 - RNA, 19 nt, Homo sapiens
gagaaugaagugucaauac

SEQ ID NO: 1507337 - RNA, 19 nt, Homo sapiens
aaacuggucugugaacauc

SEQ ID NO: 1507338 - RNA, 19 nt, Homo sapiens
gaaggugcucccuggauau

SEQ ID NO: 1507339 - RNA, 19 nt, Homo sapiens
gaaugaagugucaauacug

SEQ ID NO: 1507340 - RNA, 19 nt, Homo sapiens
ccgaagccauuaaacuaga

SEQ ID NO: 1507341 - RNA, 19 nt, Homo sapiens
ggaaacacuuuggaugaac

SEQ ID NO: 1507342 - RNA, 19 nt, Homo sapiens
uggaaacacuuuggaugaa

SEQ ID NO: 1507343 - RNA, 19 nt, Homo sapiens
uuauguggcuccagaaauc

SEQ ID NO: 1507344 - RNA, 19 nt, Homo sapiens
agaaugaagugucaauacu

SEQ ID NO: 1507345 - RNA, 19 nt, Homo sapiens
gaucuucuuccaauguaaa

SEQ ID NO: 1507346 - RNA, 19 nt, Homo sapiens
uuaaagauuucugcucaug

SEQ ID NO: 1507347 - RNA, 19 nt, Homo sapiens
aggacuggcuuucuaauag

SEQ ID NO: 1507348 - RNA, 19 nt, Homo sapiens
gcccucagcucggagaaga

SEQ ID NO: 1507349 - RNA, 19 nt, Homo sapiens
ggugacagguaaacuaaaa

SEQ ID NO: 1507350 - RNA, 19 nt, Homo sapiens
ccaacuuucuacuccuaaa

SEQ ID NO: 1507351 - RNA, 19 nt, Homo sapiens
gaaagagaaugccaugugu

SEQ ID NO: 1507352 - RNA, 19 nt, Homo sapiens
gcaagucugugcagucaaa

SEQ ID NO: 1507353 - RNA, 19 nt, Homo sapiens
gauacaagaugaagagaug

SEQ ID NO: 1507354 - RNA, 19 nt, Homo sapiens
gaaagaggcagaaagagaa

SEQ ID NO: 1507355 - RNA, 19 nt, Homo sapiens
ggaucuagaugauaccuuu

SEQ ID NO: 1507356 - RNA, 19 nt, Homo sapiens
ggaaggaucuagaugauac

SEQ ID NO: 1507357 - RNA, 19 nt, Homo sapiens
ggucuauucucuauacuuu

SEQ ID NO: 1507358 - RNA, 19 nt, Homo sapiens
guagguaacuuagccagua

SEQ ID NO: 1507359 - RNA, 19 nt, Homo sapiens
gcuaaacaacuccagauua

SEQ ID NO: 1507360 - RNA, 19 nt, Homo sapiens
gaaacaaaccuaaauggau

SEQ ID NO: 1507361 - RNA, 19 nt, Homo sapiens
gcaauugggcgauacauga

SEQ ID NO: 1507362 - RNA, 19 nt, Homo sapiens
ugacugaaauugcuaaaca

SEQ ID NO: 1507363 - RNA, 19 nt, Homo sapiens
gcacuacauuugcccuauu

SEQ ID NO: 1507364 - RNA, 19 nt, Homo sapiens
gcagucaaaccuggaauua

SEQ ID NO: 1507365 - RNA, 19 nt, Homo sapiens
gagaaugccaugugugaaa

SEQ ID NO: 1507366 - RNA, 19 nt, Homo sapiens
gccaguaaauuuaaucuca

SEQ ID NO: 1507367 - RNA, 19 nt, Homo sapiens
ggaaacaaaccuaaaugga

SEQ ID NO: 1507368 - RNA, 19 nt, Homo sapiens
gaaaagcugugcgauauga

SEQ ID NO: 1507369 - RNA, 19 nt, Homo sapiens
ucucauuucuggacucuuu

SEQ ID NO: 1507370 - RNA, 19 nt, Homo sapiens
gaaagauaaggaacuggua

SEQ ID NO: 1507371 - RNA, 19 nt, Homo sapiens
ggugguauucucuacauua

SEQ ID NO: 1507372 - RNA, 19 nt, Homo sapiens
auaaggaacugguaaaugg

SEQ ID NO: 1507373 - RNA, 19 nt, Homo sapiens
uaucaagccauuucaagua

SEQ ID NO: 1507374 - RNA, 19 nt, Homo sapiens
cagaagccguuuggccuua

SEQ ID NO: 1507375 - RNA, 19 nt, Homo sapiens
uaacgauuguuucacagaa

SEQ ID NO: 1507376 - RNA, 19 nt, Homo sapiens
gaugaagagaugaacauuu

SEQ ID NO: 1507377 - RNA, 19 nt, Homo sapiens
cuugagcccuugaggaaua

SEQ ID NO: 1507378 - RNA, 19 nt, Homo sapiens
gaauauaagagggaagaaa

SEQ ID NO: 1507379 - RNA, 19 nt, Homo sapiens
cacuacauuugcccuauua

SEQ ID NO: 1507380 - RNA, 19 nt, Homo sapiens
caugaagagugguuauguu

SEQ ID NO: 1507381 - RNA, 19 nt, Homo sapiens
caacacagcacauccucaa

SEQ ID NO: 1507382 - RNA, 19 nt, Homo sapiens
aaaaugcccugaacucuuu

SEQ ID NO: 1507383 - RNA, 19 nt, Homo sapiens
gggcaagucugugcaguca

SEQ ID NO: 1507384 - RNA, 19 nt, Homo sapiens
aaaugggucuguuucaguu

SEQ ID NO: 1507385 - RNA, 19 nt, Homo sapiens
aaaccuaaauggauauugg

SEQ ID NO: 1507386 - RNA, 19 nt, Homo sapiens
gauucuagaucucaacaca

SEQ ID NO: 1507387 - RNA, 19 nt, Homo sapiens
aaauaugguuucagucuuc

SEQ ID NO: 1507388 - RNA, 19 nt, Homo sapiens
ugaaauugcuaaacaacuc

SEQ ID NO: 1507389 - RNA, 19 nt, Homo sapiens
caggugcuuugauuucuaa

SEQ ID NO: 1507390 - RNA, 19 nt, Homo sapiens
cauaaugccacuuucauau

SEQ ID NO: 1507391 - RNA, 19 nt, Homo sapiens
gaagugggaaacaaaccua

SEQ ID NO: 1507392 - RNA, 19 nt, Homo sapiens
gauaaggaacugguaaaug

SEQ ID NO: 1507393 - RNA, 19 nt, Homo sapiens
gcacauccucaacuucuug

SEQ ID NO: 1507394 - RNA, 19 nt, Homo sapiens
cuagagaucuuauguacac

SEQ ID NO: 1507395 - RNA, 19 nt, Homo sapiens
aaacaacuccagauuagga

SEQ ID NO: 1507396 - RNA, 19 nt, Homo sapiens
gagucuagcugucccaucu

SEQ ID NO: 1507397 - RNA, 19 nt, Homo sapiens
gaagccguuuggccuuauu

SEQ ID NO: 1507398 - RNA, 19 nt, Homo sapiens
ugacacaagcuaagaguau

SEQ ID NO: 1507399 - RNA, 19 nt, Homo sapiens
uuucuggacucuuuaaguu

SEQ ID NO: 1507400 - RNA, 19 nt, Homo sapiens
gauauugggugugugucaa

SEQ ID NO: 1507401 - RNA, 19 nt, Homo sapiens
gcagauacaagaugaagag

SEQ ID NO: 1507402 - RNA, 19 nt, Homo sapiens
guagaacuuucagauuaug

SEQ ID NO: 1507403 - RNA, 19 nt, Homo sapiens
cauuugcccuauuaagaaa

SEQ ID NO: 1507404 - RNA, 19 nt, Homo sapiens
agaaagaggcagaaagaga

SEQ ID NO: 1507405 - RNA, 19 nt, Homo sapiens
agagaaagaggcagaaaga

SEQ ID NO: 1507406 - RNA, 19 nt, Homo sapiens
gugcuuugauuucuaagau

SEQ ID NO: 1507407 - RNA, 19 nt, Homo sapiens
gugguauucucuacauuau

SEQ ID NO: 1507408 - RNA, 19 nt, Homo sapiens
ucauaaugccacuuucaua

SEQ ID NO: 1507409 - RNA, 19 nt, Homo sapiens
ccacaaguaucaaaaccua

SEQ ID NO: 1507410 - RNA, 19 nt, Homo sapiens
gaaugaacaagagaugauu

SEQ ID NO: 1507411 - RNA, 19 nt, Homo sapiens
ugggugaucuuuccuuuua

SEQ ID NO: 1507412 - RNA, 19 nt, Homo sapiens
guaaaacccaguaaaauug

SEQ ID NO: 1507413 - RNA, 19 nt, Homo sapiens
gacacaagcuaagaguaug

SEQ ID NO: 1507414 - RNA, 19 nt, Homo sapiens
gaauuacugacacaagcua

SEQ ID NO: 1507415 - RNA, 19 nt, Homo sapiens
uuaggcagauacaagauga

SEQ ID NO: 1507416 - RNA, 19 nt, Homo sapiens
cuaaacaccagaagcacua

SEQ ID NO: 1507417 - RNA, 19 nt, Homo sapiens
gacugaaauugcuaaacaa

SEQ ID NO: 1507418 - RNA, 19 nt, Homo sapiens
uagguaacuuagccaguaa

SEQ ID NO: 1507419 - RNA, 19 nt, Homo sapiens
guaaaugggucuguuucag

SEQ ID NO: 1507420 - RNA, 19 nt, Homo sapiens
uagaaaagcugugcgauau

SEQ ID NO: 1507421 - RNA, 19 nt, Homo sapiens
cuaagaguaugcaccacaa

SEQ ID NO: 1507422 - RNA, 19 nt, Homo sapiens
gaggaauaauauagaacga

SEQ ID NO: 1507423 - RNA, 19 nt, Homo sapiens
cugacccucuucuguguua

SEQ ID NO: 1507424 - RNA, 19 nt, Homo sapiens
aaagcucgauggaguuugu

SEQ ID NO: 1507425 - RNA, 19 nt, Homo sapiens
ucaggugcuuugauuucua

SEQ ID NO: 1507426 - RNA, 19 nt, Homo sapiens
aaagauaaggaacugguaa

SEQ ID NO: 1507427 - RNA, 19 nt, Homo sapiens
caccagaagcacuacauuu

SEQ ID NO: 1507428 - RNA, 19 nt, Homo sapiens
ccacuaaacaccagaagca

SEQ ID NO: 1507429 - RNA, 19 nt, Homo sapiens
cguuuggccuuauuucuau

SEQ ID NO: 1507430 - RNA, 19 nt, Homo sapiens
ugucugcccugcuguccua

SEQ ID NO: 1507431 - RNA, 19 nt, Homo sapiens
gcugugcgauaugaaagaa

SEQ ID NO: 1507432 - RNA, 19 nt, Homo sapiens
acagaauuaucaagccauu

SEQ ID NO: 1507433 - RNA, 19 nt, Homo sapiens
agucaaaccuggaauuacu

SEQ ID NO: 1507434 - RNA, 19 nt, Homo sapiens
agaaagcugccucuuauca

SEQ ID NO: 1507435 - RNA, 19 nt, Homo sapiens
ggugaucuuuccuuuuaua

SEQ ID NO: 1507436 - RNA, 19 nt, Homo sapiens
ccaaggagauuuuaugucu

SEQ ID NO: 1507437 - RNA, 19 nt, Homo sapiens
caagccauuucaaguagau

SEQ ID NO: 1507438 - RNA, 19 nt, Homo sapiens
gaugauucuuaggcagaua

SEQ ID NO: 1507439 - RNA, 19 nt, Homo sapiens
aaagcugccucuuaucaca

SEQ ID NO: 1507440 - RNA, 19 nt, Homo sapiens
cuuaaaaucugcucaguau

SEQ ID NO: 1507441 - RNA, 19 nt, Homo sapiens
cuucuugucucugaggaua

SEQ ID NO: 1507442 - RNA, 19 nt, Homo sapiens
gaguaugcaccacaaguau

SEQ ID NO: 1507443 - RNA, 19 nt, Homo sapiens
ccaucugucuggaguacuu

SEQ ID NO: 1507444 - RNA, 19 nt, Homo sapiens
agaaagagaaugccaugug

SEQ ID NO: 1507445 - RNA, 19 nt, Homo sapiens
cagauuaggaggagcaaga

SEQ ID NO: 1507446 - RNA, 19 nt, Homo sapiens
caucaguucugggcggauu

SEQ ID NO: 1507447 - RNA, 19 nt, Homo sapiens
ugacagcccuggugaaccu

SEQ ID NO: 1507448 - RNA, 19 nt, Homo sapiens
ucaauugucaggugcuuug

SEQ ID NO: 1507449 - RNA, 19 nt, Homo sapiens
ugaauugggugaucuuucc

SEQ ID NO: 1507450 - RNA, 19 nt, Homo sapiens
guaguaaaacccaguaaaa

SEQ ID NO: 1507451 - RNA, 19 nt, Homo sapiens
gcagaagaaugggauauuu

SEQ ID NO: 1507452 - RNA, 19 nt, Homo sapiens
ugaaagugcuuaugcuuaa

SEQ ID NO: 1507453 - RNA, 19 nt, Homo sapiens
gauauuguauucccaagaa

SEQ ID NO: 1507454 - RNA, 19 nt, Homo sapiens
gaacucaacugaaaucacu

SEQ ID NO: 1507455 - RNA, 19 nt, Homo sapiens
ggagauaucacacaaauuc

SEQ ID NO: 1507456 - RNA, 19 nt, Homo sapiens
gaaagacugcuacuaaaga

SEQ ID NO: 1507457 - RNA, 19 nt, Homo sapiens
uuacggaacucaacugaaa

SEQ ID NO: 1507458 - RNA, 19 nt, Homo sapiens
ggagugaggcccacaguaa

SEQ ID NO: 1507459 - RNA, 19 nt, Homo sapiens
uauggaaccuugcauuauu

SEQ ID NO: 1507460 - RNA, 19 nt, Homo sapiens
agaaguggcugauccuaaa

SEQ ID NO: 1507461 - RNA, 19 nt, Homo sapiens
gguuggcuaucuuuacuua

SEQ ID NO: 1507462 - RNA, 19 nt, Homo sapiens
ggaaggaaggauacacaua

SEQ ID NO: 1507463 - RNA, 19 nt, Homo sapiens
ucaaggcuaugacaauaaa

SEQ ID NO: 1507464 - RNA, 19 nt, Homo sapiens
ugaagaugaugaggauuua

SEQ ID NO: 1507465 - RNA, 19 nt, Homo sapiens
gcauuuacuuuggugauuu

SEQ ID NO: 1507466 - RNA, 19 nt, Homo sapiens
gauaacaacuccuaaucgu

SEQ ID NO: 1507467 - RNA, 19 nt, Homo sapiens
gagguuggucuucuuguua

SEQ ID NO: 1507468 - RNA, 19 nt, Homo sapiens
uaaacuucguccagauaua

SEQ ID NO: 1507469 - RNA, 19 nt, Homo sapiens
uaaggcagaugaugaagau

SEQ ID NO: 1507470 - RNA, 19 nt, Homo sapiens
gacaauuaaugcagaaugu

SEQ ID NO: 1507471 - RNA, 19 nt, Homo sapiens
ggaaugaagccaccaguca

SEQ ID NO: 1507472 - RNA, 19 nt, Homo sapiens
gaacgccaguugcauuuac

SEQ ID NO: 1507473 - RNA, 19 nt, Homo sapiens
ucacuacaguucugacuau

SEQ ID NO: 1507474 - RNA, 19 nt, Homo sapiens
ugacaguuguucuuucuug

SEQ ID NO: 1507475 - RNA, 19 nt, Homo sapiens
ugaaggagauaucacacaa

SEQ ID NO: 1507476 - RNA, 19 nt, Homo sapiens
gccaggaagucuuuaccua

SEQ ID NO: 1507477 - RNA, 19 nt, Homo sapiens
gaugcucacuggauaacaa

SEQ ID NO: 1507478 - RNA, 19 nt, Homo sapiens
gaauauggaaccuugcauu

SEQ ID NO: 1507479 - RNA, 19 nt, Homo sapiens
ccuaaauacuggagauuau

SEQ ID NO: 1507480 - RNA, 19 nt, Homo sapiens
gaaggaaggauacacauac

SEQ ID NO: 1507481 - RNA, 19 nt, Homo sapiens
gauccacucugauuccaau

SEQ ID NO: 1507482 - RNA, 19 nt, Homo sapiens
cgauggaucucuuuguuuc

SEQ ID NO: 1507483 - RNA, 19 nt, Homo sapiens
agaaugggauauuucacua

SEQ ID NO: 1507484 - RNA, 19 nt, Homo sapiens
acaguaauaugguuggaaa

SEQ ID NO: 1507485 - RNA, 19 nt, Homo sapiens
cuucaaggcuaugacaaua

SEQ ID NO: 1507486 - RNA, 19 nt, Homo sapiens
aaggaaagacugcuacuaa

SEQ ID NO: 1507487 - RNA, 19 nt, Homo sapiens
ugacaacccugaguacaau

SEQ ID NO: 1507488 - RNA, 19 nt, Homo sapiens
aaacagcauuggaccaguu

SEQ ID NO: 1507489 - RNA, 19 nt, Homo sapiens
gggaaacuguguugauaag

SEQ ID NO: 1507490 - RNA, 19 nt, Homo sapiens
ggaaagacugcuacuaaag

SEQ ID NO: 1507491 - RNA, 19 nt, Homo sapiens
ccaguugauccaauuaaua

SEQ ID NO: 1507492 - RNA, 19 nt, Homo sapiens
gaacaaaaccugggucuug

SEQ ID NO: 1507493 - RNA, 19 nt, Homo sapiens
gagauuauaucaguuugca

SEQ ID NO: 1507494 - RNA, 19 nt, Homo sapiens
caauaaacuucguccagau

SEQ ID NO: 1507495 - RNA, 19 nt, Homo sapiens
aggaaagacugcuacuaaa

SEQ ID NO: 1507496 - RNA, 19 nt, Homo sapiens
ccaggaagucuuuaccuaa

SEQ ID NO: 1507497 - RNA, 19 nt, Homo sapiens
gugcuuaugcuuaacagua

SEQ ID NO: 1507498 - RNA, 19 nt, Homo sapiens
gauuauggguaucaguguu

SEQ ID NO: 1507499 - RNA, 19 nt, Homo sapiens
gauaucacacaaauucuga

SEQ ID NO: 1507500 - RNA, 19 nt, Homo sapiens
gauggacgaguucuguaua

SEQ ID NO: 1507501 - RNA, 19 nt, Homo sapiens
ggaccaguugauccaauua

SEQ ID NO: 1507502 - RNA, 19 nt, Homo sapiens
aaggagauaucacacaaau

SEQ ID NO: 1507503 - RNA, 19 nt, Homo sapiens
aauauggaaccuugcauua

SEQ ID NO: 1507504 - RNA, 19 nt, Homo sapiens
gaccugagcagaagaaugg

SEQ ID NO: 1507505 - RNA, 19 nt, Homo sapiens
gauccuaaauacuggagau

SEQ ID NO: 1507506 - RNA, 19 nt, Homo sapiens
aauguuaucuucagcuuca

SEQ ID NO: 1507507 - RNA, 19 nt, Homo sapiens
gaaggagauaucacacaaa

SEQ ID NO: 1507508 - RNA, 19 nt, Homo sapiens
gcagcuuucaggcuaauuu

SEQ ID NO: 1507509 - RNA, 19 nt, Homo sapiens
gcaaagauugugccagcuu

SEQ ID NO: 1507510 - RNA, 19 nt, Homo sapiens
agaagaugauuauggguau

SEQ ID NO: 1507511 - RNA, 19 nt, Homo sapiens
ccacucugauuccaaugaa

SEQ ID NO: 1507512 - RNA, 19 nt, Homo sapiens
ggauuuaacggugaacaaa

SEQ ID NO: 1507513 - RNA, 19 nt, Homo sapiens
ugaugaagaugaugaggau

SEQ ID NO: 1507514 - RNA, 19 nt, Homo sapiens
ugaguacaauugccaggaa

SEQ ID NO: 1507515 - RNA, 19 nt, Homo sapiens
gaccuacauuccaugcauu

SEQ ID NO: 1507516 - RNA, 19 nt, Homo sapiens
gggauuauguuaucaugac

SEQ ID NO: 1507517 - RNA, 19 nt, Homo sapiens
ugauuacccugcuugaaau

SEQ ID NO: 1507518 - RNA, 19 nt, Homo sapiens
ugacugcgauggaucucuu

SEQ ID NO: 1507519 - RNA, 19 nt, Homo sapiens
caggaagucuuuaccuaag

SEQ ID NO: 1507520 - RNA, 19 nt, Homo sapiens
uacauuccaugcauucuga

SEQ ID NO: 1507521 - RNA, 19 nt, Homo sapiens
caggcuaauuuacgugaaa

SEQ ID NO: 1507522 - RNA, 19 nt, Homo sapiens
uugggaaacuguguugaua

SEQ ID NO: 1507523 - RNA, 19 nt, Homo sapiens
gaacaucguuggguaucac

SEQ ID NO: 1507524 - RNA, 19 nt, Homo sapiens
ggauauuucacuauucaga

SEQ ID NO: 1507525 - RNA, 19 nt, Homo sapiens
gcuuaacaguaauaugguu

SEQ ID NO: 1507526 - RNA, 19 nt, Homo sapiens
ccaguugcauuuacuuugg

SEQ ID NO: 1507527 - RNA, 19 nt, Homo sapiens
cuuccaagauauuguauuc

SEQ ID NO: 1507528 - RNA, 19 nt, Homo sapiens
gcgauggaucucuuuguuu

SEQ ID NO: 1507529 - RNA, 19 nt, Homo sapiens
gaagaugaugaggauuuaa

SEQ ID NO: 1507530 - RNA, 19 nt, Homo sapiens
cagaacgccaguugcauuu

SEQ ID NO: 1507531 - RNA, 19 nt, Homo sapiens
ugagguuggucuucuuguu

SEQ ID NO: 1507532 - RNA, 19 nt, Homo sapiens
guaaauaaaguagcagcuu

SEQ ID NO: 1507533 - RNA, 19 nt, Homo sapiens
gaagacugcagaacaggau

SEQ ID NO: 1507534 - RNA, 19 nt, Homo sapiens
uugcagccuugauggaaua

SEQ ID NO: 1507535 - RNA, 19 nt, Homo sapiens
ugggauauuucacuauuca

SEQ ID NO: 1507536 - RNA, 19 nt, Homo sapiens
guuugcauuuguaggguua

SEQ ID NO: 1507537 - RNA, 19 nt, Homo sapiens
aaucgucugcuucgaauuu

SEQ ID NO: 1507538 - RNA, 19 nt, Homo sapiens
cuaaucgucugcuucgaau

SEQ ID NO: 1507539 - RNA, 19 nt, Homo sapiens
aauaaacuucguccagaua

SEQ ID NO: 1507540 - RNA, 19 nt, Homo sapiens
uuacuuuggugauuugcaa

SEQ ID NO: 1507541 - RNA, 19 nt, Homo sapiens
aaacagaacgccaguugca

SEQ ID NO: 1507542 - RNA, 19 nt, Homo sapiens
gaagaugauuauggguauc

SEQ ID NO: 1507543 - RNA, 19 nt, Homo sapiens
ucuguauacucuaagauug

SEQ ID NO: 1507544 - RNA, 19 nt, Homo sapiens
gaccaguugauccaauuaa

SEQ ID NO: 1507545 - RNA, 19 nt, Homo sapiens
uuuauucucugcuucauag

SEQ ID NO: 1507546 - RNA, 19 nt, Homo sapiens
uccgauggguccuuugaaa

SEQ ID NO: 1507547 - RNA, 19 nt, Homo sapiens
uuaaacagaacgccaguug

SEQ ID NO: 1507548 - RNA, 19 nt, Homo sapiens
ugauaaggcagaugaugaa

SEQ ID NO: 1507549 - RNA, 19 nt, Homo sapiens
cagcuuucaggcuaauuua

SEQ ID NO: 1507550 - RNA, 19 nt, Homo sapiens
acacauacgcauugccaaa

SEQ ID NO: 1507551 - RNA, 19 nt, Homo sapiens
gagaugagcugcaggguau

SEQ ID NO: 1507552 - RNA, 19 nt, Homo sapiens
gcucuugucuucuuuguuu

SEQ ID NO: 1507553 - RNA, 19 nt, Homo sapiens
ggccauaacucuuguagaa

SEQ ID NO: 1507554 - RNA, 19 nt, Homo sapiens
ucagauggcuuaaagagaa

SEQ ID NO: 1507555 - RNA, 19 nt, Homo sapiens
gcagcagacuucuuguuaa

SEQ ID NO: 1507556 - RNA, 19 nt, Homo sapiens
ugagagagggcacaaauua

SEQ ID NO: 1507557 - RNA, 19 nt, Homo sapiens
gaaaguguguuagagcauu

SEQ ID NO: 1507558 - RNA, 19 nt, Homo sapiens
aaaugaagcuauucuguug

SEQ ID NO: 1507559 - RNA, 19 nt, Homo sapiens
gcaaagggccuguuuagca

SEQ ID NO: 1507560 - RNA, 19 nt, Homo sapiens
cagcagacuucuuguuaaa

SEQ ID NO: 1507561 - RNA, 19 nt, Homo sapiens
ucacaagucuggaaaccaa

SEQ ID NO: 1507562 - RNA, 19 nt, Homo sapiens
ccaaagguaauucguauuu

SEQ ID NO: 1507563 - RNA, 19 nt, Homo sapiens
gaccacaaaugaagcuauu

SEQ ID NO: 1507564 - RNA, 19 nt, Homo sapiens
ugacaaggaccacaaauga

SEQ ID NO: 1507565 - RNA, 19 nt, Homo sapiens
gagcaccuuuccgauguua

SEQ ID NO: 1507566 - RNA, 19 nt, Homo sapiens
ucugguagcuguaacuaaa

SEQ ID NO: 1507567 - RNA, 19 nt, Homo sapiens
caaauuaucugugcuagcu

SEQ ID NO: 1507568 - RNA, 19 nt, Homo sapiens
ccacagagaacaagaacaa

SEQ ID NO: 1507569 - RNA, 19 nt, Homo sapiens
uaaaucugauggagacuug

SEQ ID NO: 1507570 - RNA, 19 nt, Homo sapiens
caaaugaagcuauucuguu

SEQ ID NO: 1507571 - RNA, 19 nt, Homo sapiens
ugacugaguuaucaagaga

SEQ ID NO: 1507572 - RNA, 19 nt, Homo sapiens
ccauaacucuuguagaauc

SEQ ID NO: 1507573 - RNA, 19 nt, Homo sapiens
ccacuagcauuucgaguag

SEQ ID NO: 1507574 - RNA, 19 nt, Homo sapiens
ggagcugacugccaaacga

SEQ ID NO: 1507575 - RNA, 19 nt, Homo sapiens
gaaggauacaagcggaaua

SEQ ID NO: 1507576 - RNA, 19 nt, Homo sapiens
ccgaaugacugaguuauca

SEQ ID NO: 1507577 - RNA, 19 nt, Homo sapiens
ggacuccauuguacaaagu

SEQ ID NO: 1507578 - RNA, 19 nt, Homo sapiens
guauggugcucuugucuuc

SEQ ID NO: 1507579 - RNA, 19 nt, Homo sapiens
gauacaagcggaauaugug

SEQ ID NO: 1507580 - RNA, 19 nt, Homo sapiens
gcugucagauggcuuaaag

SEQ ID NO: 1507581 - RNA, 19 nt, Homo sapiens
gugcucagccguuuaauuc

SEQ ID NO: 1507582 - RNA, 19 nt, Homo sapiens
ggauacaagcggaauaugu

SEQ ID NO: 1507583 - RNA, 19 nt, Homo sapiens
ucucugaaaugugggauaa

SEQ ID NO: 1507584 - RNA, 19 nt, Homo sapiens
gaaauuacuccgcaaacgu

SEQ ID NO: 1507585 - RNA, 19 nt, Homo sapiens
gagaacaagaacaaucaaa

SEQ ID NO: 1507586 - RNA, 19 nt, Homo sapiens
ggaguuagcccaggugcuu

SEQ ID NO: 1507587 - RNA, 19 nt, Homo sapiens
caaagguaauucguauuuc

SEQ ID NO: 1507588 - RNA, 19 nt, Homo sapiens
aaccaaagguaauucguau

SEQ ID NO: 1507589 - RNA, 19 nt, Homo sapiens
ccgcaaacguucacaaguc

SEQ ID NO: 1507590 - RNA, 19 nt, Homo sapiens
gcuauucuguugugugaag

SEQ ID NO: 1507591 - RNA, 19 nt, Homo sapiens
aagcuauucuguuguguga

SEQ ID NO: 1507592 - RNA, 19 nt, Homo sapiens
gagagagggcacaaauuau

SEQ ID NO: 1507593 - RNA, 19 nt, Homo sapiens
aaaccaaagguaauucgua

SEQ ID NO: 1507594 - RNA, 19 nt, Homo sapiens
gcagaucugguagcuguaa

SEQ ID NO: 1507595 - RNA, 19 nt, Homo sapiens
gacaaggaccacaaaugaa

SEQ ID NO: 1507596 - RNA, 19 nt, Homo sapiens
aaaguguguuagagcauuu

SEQ ID NO: 1507597 - RNA, 19 nt, Homo sapiens
gggcaaagggccuguuuag

SEQ ID NO: 1507598 - RNA, 19 nt, Homo sapiens
ugugccagcucgaaggaua

SEQ ID NO: 1507599 - RNA, 19 nt, Homo sapiens
gaauaugcccaugcugcua

SEQ ID NO: 1507600 - RNA, 19 nt, Homo sapiens
aagagcaccuuuccgaugu

SEQ ID NO: 1507601 - RNA, 19 nt, Homo sapiens
cagauggcuuaaagagaaa

SEQ ID NO: 1507602 - RNA, 19 nt, Homo sapiens
gcucagccguuuaauucuc

SEQ ID NO: 1507603 - RNA, 19 nt, Homo sapiens
cagagaacaagaacaauca

SEQ ID NO: 1507604 - RNA, 19 nt, Homo sapiens
ugagugcacugaaauuacu

SEQ ID NO: 1507605 - RNA, 19 nt, Homo sapiens
gaauaugugagugcacuga

SEQ ID NO: 1507606 - RNA, 19 nt, Homo sapiens
aaacgaauaugcccaugcu

SEQ ID NO: 1507607 - RNA, 19 nt, Homo sapiens
cauaacucuuguagaauca

SEQ ID NO: 1507608 - RNA, 19 nt, Homo sapiens
guuuggauguggaaucuca

SEQ ID NO: 1507609 - RNA, 19 nt, Homo sapiens
aaacccgaaugacugaguu

SEQ ID NO: 1507610 - RNA, 19 nt, Homo sapiens
ggaccacacagaaggacuu

SEQ ID NO: 1507611 - RNA, 19 nt, Homo sapiens
caugugcucagccguuuaa

SEQ ID NO: 1507612 - RNA, 19 nt, Homo sapiens
gaggggaucucugaaaugu

SEQ ID NO: 1507613 - RNA, 19 nt, Homo sapiens
ugugagugcacugaaauua

SEQ ID NO: 1507614 - RNA, 19 nt, Homo sapiens
gaucugguagcuguaacua

SEQ ID NO: 1507615 - RNA, 19 nt, Homo sapiens
gaaggagcgggauaugaca

SEQ ID NO: 1507616 - RNA, 19 nt, Homo sapiens
ggaccacaaaugaagcuau

SEQ ID NO: 1507617 - RNA, 19 nt, Homo sapiens
gacccuucuucuuguacua

SEQ ID NO: 1507618 - RNA, 19 nt, Homo sapiens
guggacccuucuucuugua

SEQ ID NO: 1507619 - RNA, 19 nt, Homo sapiens
gcugcugucagauggcuua

SEQ ID NO: 1507620 - RNA, 19 nt, Homo sapiens
gcagacuucuuguuaaaag

SEQ ID NO: 1507621 - RNA, 19 nt, Homo sapiens
agcagcagacuucuuguua

SEQ ID NO: 1507622 - RNA, 19 nt, Homo sapiens
gaaaugugggauaaaauga

SEQ ID NO: 1507623 - RNA, 19 nt, Homo sapiens
aaauuacuccgcaaacguu

SEQ ID NO: 1507624 - RNA, 19 nt, Homo sapiens
ucaggaaaguguguuagag

SEQ ID NO: 1507625 - RNA, 19 nt, Homo sapiens
ccacuucaucuuucacuca

SEQ ID NO: 1507626 - RNA, 19 nt, Homo sapiens
acaaaugaagcuauucugu

SEQ ID NO: 1507627 - RNA, 19 nt, Homo sapiens
caggccaucuccuacuaga

SEQ ID NO: 1507628 - RNA, 19 nt, Homo sapiens
agagagggcacaaauuauc

SEQ ID NO: 1507629 - RNA, 19 nt, Homo sapiens
ccacaaaugaagcuauucu

SEQ ID NO: 1507630 - RNA, 19 nt, Homo sapiens
acaaggaccacaaaugaag

SEQ ID NO: 1507631 - RNA, 19 nt, Homo sapiens
gugacaaggaccacaaaug

SEQ ID NO: 1507632 - RNA, 19 nt, Homo sapiens
gaaugacugaguuaucaag

SEQ ID NO: 1507633 - RNA, 19 nt, Homo sapiens
gagagggcacaaauuaucu

SEQ ID NO: 1507634 - RNA, 19 nt, Homo sapiens
cuuaaaggaccacacagaa

SEQ ID NO: 1507635 - RNA, 19 nt, Homo sapiens
ucaccagcauuuccuaaaa

SEQ ID NO: 1507636 - RNA, 19 nt, Homo sapiens
gugaaggagcgggauauga

SEQ ID NO: 1507637 - RNA, 19 nt, Homo sapiens
ccaaacgacggaagcaaca

SEQ ID NO: 1507638 - RNA, 19 nt, Homo sapiens
auaugugagugcacugaaa

SEQ ID NO: 1507639 - RNA, 19 nt, Homo sapiens
guuaccacuucaucuuuca

SEQ ID NO: 1507640 - RNA, 19 nt, Homo sapiens
gcccaggugcuucuucaga

SEQ ID NO: 1507641 - RNA, 19 nt, Homo sapiens
uagcccaggugcuucuuca

SEQ ID NO: 1507642 - RNA, 19 nt, Homo sapiens
ggaaaguguguuagagcau

SEQ ID NO: 1507643 - RNA, 19 nt, Homo sapiens
ugaaauuacuccgcaaacg

SEQ ID NO: 1507644 - RNA, 19 nt, Homo sapiens
gauggcagaucugguagcu

SEQ ID NO: 1507645 - RNA, 19 nt, Homo sapiens
gcuguggacccuucuucuu

SEQ ID NO: 1507646 - RNA, 19 nt, Homo sapiens
ggaaaccaaagguaauucg

SEQ ID NO: 1507647 - RNA, 19 nt, Homo sapiens
uagcuguaacuaaaucuga

SEQ ID NO: 1507648 - RNA, 19 nt, Homo sapiens
ugaaggagcgggauaugac

SEQ ID NO: 1507649 - RNA, 19 nt, Homo sapiens
acagagaacaagaacaauc

SEQ ID NO: 1507650 - RNA, 19 nt, Homo sapiens
acuagcagcagacuucuug

SEQ ID NO: 1507651 - RNA, 19 nt, Homo sapiens
gcacagaacugccuuucaa

SEQ ID NO: 1507652 - RNA, 19 nt, Homo sapiens
gcacuuaccuuccaacuuc

SEQ ID NO: 1507653 - RNA, 19 nt, Homo sapiens
ugaagacgcugcagaauga

SEQ ID NO: 1507654 - RNA, 19 nt, Homo sapiens
gaaauacgcagagcaagua

SEQ ID NO: 1507655 - RNA, 19 nt, Homo sapiens
acaauacgcgugugaauua

SEQ ID NO: 1507656 - RNA, 19 nt, Homo sapiens
caagucagaugaugguuug

SEQ ID NO: 1507657 - RNA, 19 nt, Homo sapiens
gugaagaagucgucaguug

SEQ ID NO: 1507658 - RNA, 19 nt, Homo sapiens
ucaaacagccaaauuacua

SEQ ID NO: 1507659 - RNA, 19 nt, Homo sapiens
gcacaguguuugcaaguuc

SEQ ID NO: 1507660 - RNA, 19 nt, Homo sapiens
gagcaucuuccaccacuua

SEQ ID NO: 1507661 - RNA, 19 nt, Homo sapiens
gcaggaauguucagcagau

SEQ ID NO: 1507662 - RNA, 19 nt, Homo sapiens
ccagaugccacuuguguua

SEQ ID NO: 1507663 - RNA, 19 nt, Homo sapiens
gaucuuaaccaggacaaua

SEQ ID NO: 1507664 - RNA, 19 nt, Homo sapiens
guuggaaucugcuaguaaa

SEQ ID NO: 1507665 - RNA, 19 nt, Homo sapiens
ccaggacaauauacaagua

SEQ ID NO: 1507666 - RNA, 19 nt, Homo sapiens
gacagugccuucuaacuag

SEQ ID NO: 1507667 - RNA, 19 nt, Homo sapiens
ugacagugccuucuaacua

SEQ ID NO: 1507668 - RNA, 19 nt, Homo sapiens
guacacuucucaucuagau

SEQ ID NO: 1507669 - RNA, 19 nt, Homo sapiens
gggagaagccguacacaug

SEQ ID NO: 1507670 - RNA, 19 nt, Homo sapiens
cauguacacuucucaucua

SEQ ID NO: 1507671 - RNA, 19 nt, Homo sapiens
acaguaagcaguaccauaa

SEQ ID NO: 1507672 - RNA, 19 nt, Homo sapiens
caacuuggagcuucacaaa

SEQ ID NO: 1507673 - RNA, 19 nt, Homo sapiens
gaagaagucgucaguugug

SEQ ID NO: 1507674 - RNA, 19 nt, Homo sapiens
gaguuuggauccugguaaa

SEQ ID NO: 1507675 - RNA, 19 nt, Homo sapiens
cggcuccuauuguaaguua

SEQ ID NO: 1507676 - RNA, 19 nt, Homo sapiens
gaacccaagucagaugaug

SEQ ID NO: 1507677 - RNA, 19 nt, Homo sapiens
guacacaugugagaucugu

SEQ ID NO: 1507678 - RNA, 19 nt, Homo sapiens
gcaaaggaaguuaguaaag

SEQ ID NO: 1507679 - RNA, 19 nt, Homo sapiens
acacacggcugauaaaguc

SEQ ID NO: 1507680 - RNA, 19 nt, Homo sapiens
gaagcucaauuuccugaag

SEQ ID NO: 1507681 - RNA, 19 nt, Homo sapiens
ggcaugccuuguaauagua

SEQ ID NO: 1507682 - RNA, 19 nt, Homo sapiens
ccaugacagugccuucuaa

SEQ ID NO: 1507683 - RNA, 19 nt, Homo sapiens
ugagaaaccuuuugaaugu

SEQ ID NO: 1507684 - RNA, 19 nt, Homo sapiens
ugaagaagcucaauuuccu

SEQ ID NO: 1507685 - RNA, 19 nt, Homo sapiens
uaacuugcagacucacuua

SEQ ID NO: 1507686 - RNA, 19 nt, Homo sapiens
gauggcagcugcacagaac

SEQ ID NO: 1507687 - RNA, 19 nt, Homo sapiens
caugugagaucuguaacaa

SEQ ID NO: 1507688 - RNA, 19 nt, Homo sapiens
gagaagccguacacaugug

SEQ ID NO: 1507689 - RNA, 19 nt, Homo sapiens
ggagaagccguacacaugu

SEQ ID NO: 1507690 - RNA, 19 nt, Homo sapiens
caaaggaaguuaguaaagc

SEQ ID NO: 1507691 - RNA, 19 nt, Homo sapiens
ggucgaggguuuaguaacu

SEQ ID NO: 1507692 - RNA, 19 nt, Homo sapiens
gaggcguguucucaguuua

SEQ ID NO: 1507693 - RNA, 19 nt, Homo sapiens
ugugagaucuguaacaagu

SEQ ID NO: 1507694 - RNA, 19 nt, Homo sapiens
guagagagccagccuugug

SEQ ID NO: 1507695 - RNA, 19 nt, Homo sapiens
guagaggcguguucucagu

SEQ ID NO: 1507696 - RNA, 19 nt, Homo sapiens
guuccucucuggcugcuuu

SEQ ID NO: 1507697 - RNA, 19 nt, Homo sapiens
caucuguggucgaggguuu

SEQ ID NO: 1507698 - RNA, 19 nt, Homo sapiens
caccuggcaugccuuguaa

SEQ ID NO: 1507699 - RNA, 19 nt, Homo sapiens
agacacacacggcugauaa

SEQ ID NO: 1507700 - RNA, 19 nt, Homo sapiens
ucaauuuccugaagucaca

SEQ ID NO: 1507701 - RNA, 19 nt, Homo sapiens
ggucaugugaaaggaauua

SEQ ID NO: 1507702 - RNA, 19 nt, Homo sapiens
gacaauacgcgugugaauu

SEQ ID NO: 1507703 - RNA, 19 nt, Homo sapiens
gaagucgucaguugugaga

SEQ ID NO: 1507704 - RNA, 19 nt, Homo sapiens
acaaagagguuggaaucug

SEQ ID NO: 1507705 - RNA, 19 nt, Homo sapiens
ugacaaagagguuggaauc

SEQ ID NO: 1507706 - RNA, 19 nt, Homo sapiens
ggacaauauacaaguaaug

SEQ ID NO: 1507707 - RNA, 19 nt, Homo sapiens
cuucucaucuagaucuuaa

SEQ ID NO: 1507708 - RNA, 19 nt, Homo sapiens
aaaggaaguuaguaaagca

SEQ ID NO: 1507709 - RNA, 19 nt, Homo sapiens
guccagcgucacauuauua

SEQ ID NO: 1507710 - RNA, 19 nt, Homo sapiens
ccacuuauaggaacucaga

SEQ ID NO: 1507711 - RNA, 19 nt, Homo sapiens
acacaugugagaucuguaa

SEQ ID NO: 1507712 - RNA, 19 nt, Homo sapiens
gaacaaaacguuggaugaa

SEQ ID NO: 1507713 - RNA, 19 nt, Homo sapiens
cuaacuagccagagaauag

SEQ ID NO: 1507714 - RNA, 19 nt, Homo sapiens
ccuccgaccucgagaaauc

SEQ ID NO: 1507715 - RNA, 19 nt, Homo sapiens
aauaguacauugucucuac

SEQ ID NO: 1507716 - RNA, 19 nt, Homo sapiens
uggcaugccuuguaauagu

SEQ ID NO: 1507717 - RNA, 19 nt, Homo sapiens
ccaccuggcaugccuugua

SEQ ID NO: 1507718 - RNA, 19 nt, Homo sapiens
cagcgucacauuauuauuc

SEQ ID NO: 1507719 - RNA, 19 nt, Homo sapiens
ucuggcggcuccuauugua

SEQ ID NO: 1507720 - RNA, 19 nt, Homo sapiens
guuaguaaagcacagaauu

SEQ ID NO: 1507721 - RNA, 19 nt, Homo sapiens
ggugaaaucucaaaacaag

SEQ ID NO: 1507722 - RNA, 19 nt, Homo sapiens
uagcuucccuccugaugau

SEQ ID NO: 1507723 - RNA, 19 nt, Homo sapiens
gcaggcauguccgcacuca

SEQ ID NO: 1507724 - RNA, 19 nt, Homo sapiens
caaacagccaaauuacuau

SEQ ID NO: 1507725 - RNA, 19 nt, Homo sapiens
agaggcguguucucaguuu

SEQ ID NO: 1507726 - RNA, 19 nt, Homo sapiens
gaguuagaccagugaugua

SEQ ID NO: 1507727 - RNA, 19 nt, Homo sapiens
cagguaacuugcagacuca

SEQ ID NO: 1507728 - RNA, 19 nt, Homo sapiens
gaauuaugcgggaaaccuu

SEQ ID NO: 1507729 - RNA, 19 nt, Homo sapiens
caauacgcgugugaauuau

SEQ ID NO: 1507730 - RNA, 19 nt, Homo sapiens
ccaagucagaugaugguuu

SEQ ID NO: 1507731 - RNA, 19 nt, Homo sapiens
cgacggcauucuggugaaa

SEQ ID NO: 1507732 - RNA, 19 nt, Homo sapiens
uaacauuugugggaaacau

SEQ ID NO: 1507733 - RNA, 19 nt, Homo sapiens
cgaugaagacgcugcagaa

SEQ ID NO: 1507734 - RNA, 19 nt, Homo sapiens
gaaguuaguaaagcacaga

SEQ ID NO: 1507735 - RNA, 19 nt, Homo sapiens
cacaaacggucucauacag

SEQ ID NO: 1507736 - RNA, 19 nt, Homo sapiens
cuucacaaacggucucaua

SEQ ID NO: 1507737 - RNA, 19 nt, Homo sapiens
uaaccaggacaauauacaa

SEQ ID NO: 1507738 - RNA, 19 nt, Homo sapiens
guaagcaguaccauaaaca

SEQ ID NO: 1507739 - RNA, 19 nt, Homo sapiens
aggagaagcugaguuugga

SEQ ID NO: 1507740 - RNA, 19 nt, Homo sapiens
gggcagauccuggacuuca

SEQ ID NO: 1507741 - RNA, 19 nt, Homo sapiens
ugcgagaucuguggaaaga

SEQ ID NO: 1507742 - RNA, 19 nt, Homo sapiens
aaaaucagccacuguagua

SEQ ID NO: 1507743 - RNA, 19 nt, Homo sapiens
gagaaaccuuuugaaugua

SEQ ID NO: 1507744 - RNA, 19 nt, Homo sapiens
caaccugucaagcagauga

SEQ ID NO: 1507745 - RNA, 19 nt, Homo sapiens
cagcaccucuacagaccuu

SEQ ID NO: 1507746 - RNA, 19 nt, Homo sapiens
gucaacuacuguacauguu

SEQ ID NO: 1507747 - RNA, 19 nt, Homo sapiens
ucacaaacggucucauaca

SEQ ID NO: 1507748 - RNA, 19 nt, Homo sapiens
ccuggcaugccuuguaaua

SEQ ID NO: 1507749 - RNA, 19 nt, Homo sapiens
gguuggaaucugcuaguaa

SEQ ID NO: 1507750 - RNA, 19 nt, Homo sapiens
cagaacugccuuucaaaca

SEQ ID NO: 1507751 - RNA, 19 nt, Homo sapiens
ggaauuagaugucaguuug

SEQ ID NO: 1507752 - RNA, 19 nt, Homo sapiens
gaagagaauucagguauga

SEQ ID NO: 1507753 - RNA, 19 nt, Homo sapiens
gcagaauaauugugaagua

SEQ ID NO: 1507754 - RNA, 19 nt, Homo sapiens
gaauuuggcgugucuaaua

SEQ ID NO: 1507755 - RNA, 19 nt, Homo sapiens
gcacuugaauggacugaaa

SEQ ID NO: 1507756 - RNA, 19 nt, Homo sapiens
ggacaagcuugacauuauu

SEQ ID NO: 1507757 - RNA, 19 nt, Homo sapiens
uaacuugucuuucuacugu

SEQ ID NO: 1507758 - RNA, 19 nt, Homo sapiens
ggaaaugucuaccaucaag

SEQ ID NO: 1507759 - RNA, 19 nt, Homo sapiens
gaugauggcagaauaauug

SEQ ID NO: 1507760 - RNA, 19 nt, Homo sapiens
gagagagaaucaucauuau

SEQ ID NO: 1507761 - RNA, 19 nt, Homo sapiens
gcaaacaguucagauccua

SEQ ID NO: 1507762 - RNA, 19 nt, Homo sapiens
gaagaaauguugaguucag

SEQ ID NO: 1507763 - RNA, 19 nt, Homo sapiens
ggaggaaucuuacgaacuc

SEQ ID NO: 1507764 - RNA, 19 nt, Homo sapiens
ggaagaacuugacaguguu

SEQ ID NO: 1507765 - RNA, 19 nt, Homo sapiens
gacauuaacucuugaaacu

SEQ ID NO: 1507766 - RNA, 19 nt, Homo sapiens
agagagagaaucaucauua

SEQ ID NO: 1507767 - RNA, 19 nt, Homo sapiens
gcacugaccuuucaaaccu

SEQ ID NO: 1507768 - RNA, 19 nt, Homo sapiens
gagagaaucaucauuaugu

SEQ ID NO: 1507769 - RNA, 19 nt, Homo sapiens
gaaggcaucucuuucaaaa

SEQ ID NO: 1507770 - RNA, 19 nt, Homo sapiens
cauuaacucuugaaacuga

SEQ ID NO: 1507771 - RNA, 19 nt, Homo sapiens
ccagggaucuugugucugu

SEQ ID NO: 1507772 - RNA, 19 nt, Homo sapiens
gugacuaucugcagugaaa

SEQ ID NO: 1507773 - RNA, 19 nt, Homo sapiens
cgugugguguugacaauua

SEQ ID NO: 1507774 - RNA, 19 nt, Homo sapiens
uggaagaacuugacagugu

SEQ ID NO: 1507775 - RNA, 19 nt, Homo sapiens
ccaaaugucacaagucuga

SEQ ID NO: 1507776 - RNA, 19 nt, Homo sapiens
caaaguacuucugggugua

SEQ ID NO: 1507777 - RNA, 19 nt, Homo sapiens
ggaaauuggucacuaucca

SEQ ID NO: 1507778 - RNA, 19 nt, Homo sapiens
gcauugacguguaacuugu

SEQ ID NO: 1507779 - RNA, 19 nt, Homo sapiens
gcgcaaaugccacagguuu

SEQ ID NO: 1507780 - RNA, 19 nt, Homo sapiens
gaaacugaccaaaguacuu

SEQ ID NO: 1507781 - RNA, 19 nt, Homo sapiens
gcaaauuuauggugcugau

SEQ ID NO: 1507782 - RNA, 19 nt, Homo sapiens
ugaaacugcugccagagaa

SEQ ID NO: 1507783 - RNA, 19 nt, Homo sapiens
gcuucugucugauaaauug

SEQ ID NO: 1507784 - RNA, 19 nt, Homo sapiens
gaaucaucauuauguguug

SEQ ID NO: 1507785 - RNA, 19 nt, Homo sapiens
caacauacgaggagcuuga

SEQ ID NO: 1507786 - RNA, 19 nt, Homo sapiens
ccacaguucgugauauuaa

SEQ ID NO: 1507787 - RNA, 19 nt, Homo sapiens
auacauggaugaaggaaau

SEQ ID NO: 1507788 - RNA, 19 nt, Homo sapiens
uggauuaucuugaacaaca

SEQ ID NO: 1507789 - RNA, 19 nt, Homo sapiens
ggaaggcaucucuuucaaa

SEQ ID NO: 1507790 - RNA, 19 nt, Homo sapiens
aggacaagcuugacauuau

SEQ ID NO: 1507791 - RNA, 19 nt, Homo sapiens
caguguaucugcaucuuug

SEQ ID NO: 1507792 - RNA, 19 nt, Homo sapiens
agaagcauauuagccauaa

SEQ ID NO: 1507793 - RNA, 19 nt, Homo sapiens
gacaagcuugacauuauua

SEQ ID NO: 1507794 - RNA, 19 nt, Homo sapiens
acaacaagaugacaugcuu

SEQ ID NO: 1507795 - RNA, 19 nt, Homo sapiens
ucaggaaauuggucacuau

SEQ ID NO: 1507796 - RNA, 19 nt, Homo sapiens
gaggaaggcaucucuuuca

SEQ ID NO: 1507797 - RNA, 19 nt, Homo sapiens
ggaugcaauuuaugaagug

SEQ ID NO: 1507798 - RNA, 19 nt, Homo sapiens
gaaauacauggaugaagga

SEQ ID NO: 1507799 - RNA, 19 nt, Homo sapiens
ggaguucuagccacuguaa

SEQ ID NO: 1507800 - RNA, 19 nt, Homo sapiens
ccauaaagcggcacuugaa

SEQ ID NO: 1507801 - RNA, 19 nt, Homo sapiens
gagaagcauauuagccaua

SEQ ID NO: 1507802 - RNA, 19 nt, Homo sapiens
uccaaaggcugcugguaaa

SEQ ID NO: 1507803 - RNA, 19 nt, Homo sapiens
gauggcagaauaauuguga

SEQ ID NO: 1507804 - RNA, 19 nt, Homo sapiens
ugccacagguuuacacaaa

SEQ ID NO: 1507805 - RNA, 19 nt, Homo sapiens
gcagugaaacuuugcuugu

SEQ ID NO: 1507806 - RNA, 19 nt, Homo sapiens
caagaugacaugcuucugu

SEQ ID NO: 1507807 - RNA, 19 nt, Homo sapiens
ugugguagcuuucaggaau

SEQ ID NO: 1507808 - RNA, 19 nt, Homo sapiens
uaucugcagugaaacuuug

SEQ ID NO: 1507809 - RNA, 19 nt, Homo sapiens
gaagcauauuagccauaaa

SEQ ID NO: 1507810 - RNA, 19 nt, Homo sapiens
gagcuuggaacaugguaaa

SEQ ID NO: 1507811 - RNA, 19 nt, Homo sapiens
caccaaaugucacaagucu

SEQ ID NO: 1507812 - RNA, 19 nt, Homo sapiens
gaaauguugaguucagaug

SEQ ID NO: 1507813 - RNA, 19 nt, Homo sapiens
acgaggagcuugauagagu

SEQ ID NO: 1507814 - RNA, 19 nt, Homo sapiens
uaaaggcccaugcacacua

SEQ ID NO: 1507815 - RNA, 19 nt, Homo sapiens
aauuuggcgugucuaauaa

SEQ ID NO: 1507816 - RNA, 19 nt, Homo sapiens
gacagugguuugaaaagua

SEQ ID NO: 1507817 - RNA, 19 nt, Homo sapiens
caaaccuuccugugacaua

SEQ ID NO: 1507818 - RNA, 19 nt, Homo sapiens
gaauccacaguucgugaua

SEQ ID NO: 1507819 - RNA, 19 nt, Homo sapiens
caauuaaggacaagcuuga

SEQ ID NO: 1507820 - RNA, 19 nt, Homo sapiens
gaagugagaggaggaaucu

SEQ ID NO: 1507821 - RNA, 19 nt, Homo sapiens
caaaagccuuccaguaaga

SEQ ID NO: 1507822 - RNA, 19 nt, Homo sapiens
gcaaaagccuuccaguaag

SEQ ID NO: 1507823 - RNA, 19 nt, Homo sapiens
gaagaacuugacaguguug

SEQ ID NO: 1507824 - RNA, 19 nt, Homo sapiens
agugagaggaggaaucuua

SEQ ID NO: 1507825 - RNA, 19 nt, Homo sapiens
cacuauaggcacucaauaa

SEQ ID NO: 1507826 - RNA, 19 nt, Homo sapiens
ggccagggaucuugugucu

SEQ ID NO: 1507827 - RNA, 19 nt, Homo sapiens
ugaaggaaaugacccaaaa

SEQ ID NO: 1507828 - RNA, 19 nt, Homo sapiens
ggaaucuuacgaacucauu

SEQ ID NO: 1507829 - RNA, 19 nt, Homo sapiens
aaaggcugcugguaaagga

SEQ ID NO: 1507830 - RNA, 19 nt, Homo sapiens
ggagcuugauagaguuaug

SEQ ID NO: 1507831 - RNA, 19 nt, Homo sapiens
gaggagcuugauagaguua

SEQ ID NO: 1507832 - RNA, 19 nt, Homo sapiens
guacggaauuggugaaucc

SEQ ID NO: 1507833 - RNA, 19 nt, Homo sapiens
ggauuaucuugaacaacaa

SEQ ID NO: 1507834 - RNA, 19 nt, Homo sapiens
gagcaaaagccuuccagua

SEQ ID NO: 1507835 - RNA, 19 nt, Homo sapiens
gaacuugacaguguuggau

SEQ ID NO: 1507836 - RNA, 19 nt, Homo sapiens
augaagaaauguugaguuc

SEQ ID NO: 1507837 - RNA, 19 nt, Homo sapiens
gaaauccaagggacuuuua

SEQ ID NO: 1507838 - RNA, 19 nt, Homo sapiens
cuacaaccagagcaaauuu

SEQ ID NO: 1507839 - RNA, 19 nt, Homo sapiens
guuaugauagagugguuua

SEQ ID NO: 1507840 - RNA, 19 nt, Homo sapiens
cguguaacuugucuuucua

SEQ ID NO: 1507841 - RNA, 19 nt, Homo sapiens
ugacguguaacuugucuuu

SEQ ID NO: 1507842 - RNA, 19 nt, Homo sapiens
cagugaaacuuugcuuguu

SEQ ID NO: 1507843 - RNA, 19 nt, Homo sapiens
uaugaacauugaugaagga

SEQ ID NO: 1507844 - RNA, 19 nt, Homo sapiens
gaaauuggucacuauccau

SEQ ID NO: 1507845 - RNA, 19 nt, Homo sapiens
caagucugauucaaccaau

SEQ ID NO: 1507846 - RNA, 19 nt, Homo sapiens
ucagaugauggcagaauaa

SEQ ID NO: 1507847 - RNA, 19 nt, Homo sapiens
cgaggagcuugauagaguu

SEQ ID NO: 1507848 - RNA, 19 nt, Homo sapiens
cacaguucgugauauuaaa

SEQ ID NO: 1507849 - RNA, 19 nt, Homo sapiens
ucaaguaccauaaccaaag

SEQ ID NO: 1507850 - RNA, 19 nt, Homo sapiens
uaugaagugucaagagcuu

SEQ ID NO: 1507851 - RNA, 19 nt, Homo sapiens
gaacaaagcuuacuccaau

SEQ ID NO: 1507852 - RNA, 19 nt, Homo sapiens
caucgcagcucaauaaaua

SEQ ID NO: 1507853 - RNA, 19 nt, Homo sapiens
ugaaagagcugggaagaua

SEQ ID NO: 1507854 - RNA, 19 nt, Homo sapiens
gcaaauggaucccagaguu

SEQ ID NO: 1507855 - RNA, 19 nt, Homo sapiens
gaagaaaguuacagaagga

SEQ ID NO: 1507856 - RNA, 19 nt, Homo sapiens
ggaaaguacucuuggugua

SEQ ID NO: 1507857 - RNA, 19 nt, Homo sapiens
ugaguuaguuccuguauuu

SEQ ID NO: 1507858 - RNA, 19 nt, Homo sapiens
ucacagagcugcugcuaug

SEQ ID NO: 1507859 - RNA, 19 nt, Homo sapiens
gaacugcaaccaugaauga

SEQ ID NO: 1507860 - RNA, 19 nt, Homo sapiens
gaaucggguuugcauauuu

SEQ ID NO: 1507861 - RNA, 19 nt, Homo sapiens
agaauaacauggaguugua

SEQ ID NO: 1507862 - RNA, 19 nt, Homo sapiens
guacuaaacaucagcuaua

SEQ ID NO: 1507863 - RNA, 19 nt, Homo sapiens
gaacggguaaagaaacuua

SEQ ID NO: 1507864 - RNA, 19 nt, Homo sapiens
ggaaacaauuaaagcagaa

SEQ ID NO: 1507865 - RNA, 19 nt, Homo sapiens
gaagacaaugguuauagua

SEQ ID NO: 1507866 - RNA, 19 nt, Homo sapiens
gcagagaguuaaaguucuu

SEQ ID NO: 1507867 - RNA, 19 nt, Homo sapiens
caauaucacuugcuaaugg

SEQ ID NO: 1507868 - RNA, 19 nt, Homo sapiens
guuagaagaugcaaaggaa

SEQ ID NO: 1507869 - RNA, 19 nt, Homo sapiens
caaacucuguacuacguua

SEQ ID NO: 1507870 - RNA, 19 nt, Homo sapiens
gaaaccaugcagagaguua

SEQ ID NO: 1507871 - RNA, 19 nt, Homo sapiens
ccaacaauaucacuugcua

SEQ ID NO: 1507872 - RNA, 19 nt, Homo sapiens
cuucaaggccuuauucuua

SEQ ID NO: 1507873 - RNA, 19 nt, Homo sapiens
gaucucaacuacagaggaa

SEQ ID NO: 1507874 - RNA, 19 nt, Homo sapiens
gaacaaauggaugcaguaa

SEQ ID NO: 1507875 - RNA, 19 nt, Homo sapiens
caauagaaccuagucauuu

SEQ ID NO: 1507876 - RNA, 19 nt, Homo sapiens
gcaauagaaccuagucauu

SEQ ID NO: 1507877 - RNA, 19 nt, Homo sapiens
acauggaguuguagaauuu

SEQ ID NO: 1507878 - RNA, 19 nt, Homo sapiens
caaauggaucccagaguua

SEQ ID NO: 1507879 - RNA, 19 nt, Homo sapiens
ggauuuaggaccaacauuu

SEQ ID NO: 1507880 - RNA, 19 nt, Homo sapiens
gggcaccaccagaauauua

SEQ ID NO: 1507881 - RNA, 19 nt, Homo sapiens
guaugaagaugaguuaguu

SEQ ID NO: 1507882 - RNA, 19 nt, Homo sapiens
acaaauggaugcaguaaag

SEQ ID NO: 1507883 - RNA, 19 nt, Homo sapiens
gcaaggaggaaacuaauuc

SEQ ID NO: 1507884 - RNA, 19 nt, Homo sapiens
uuaaagcacuugaagacaa

SEQ ID NO: 1507885 - RNA, 19 nt, Homo sapiens
ggacagcggcuauguaucu

SEQ ID NO: 1507886 - RNA, 19 nt, Homo sapiens
ggagacagcaucuuaaugg

SEQ ID NO: 1507887 - RNA, 19 nt, Homo sapiens
ccagaagcaucuaaccauu

SEQ ID NO: 1507888 - RNA, 19 nt, Homo sapiens
aaaguacucuugguguaua

SEQ ID NO: 1507889 - RNA, 19 nt, Homo sapiens
guguaagccuggauaauug

SEQ ID NO: 1507890 - RNA, 19 nt, Homo sapiens
gagcugggaagauauauga

SEQ ID NO: 1507891 - RNA, 19 nt, Homo sapiens
gcaucuaaccauuauguaa

SEQ ID NO: 1507892 - RNA, 19 nt, Homo sapiens
gaaccuagucauuuauguu

SEQ ID NO: 1507893 - RNA, 19 nt, Homo sapiens
ccuagaggcugugaaguuu

SEQ ID NO: 1507894 - RNA, 19 nt, Homo sapiens
cagaagcaucuaaccauua

SEQ ID NO: 1507895 - RNA, 19 nt, Homo sapiens
ccaaggaucacuaucugua

SEQ ID NO: 1507896 - RNA, 19 nt, Homo sapiens
gacaaacucuguacuacgu

SEQ ID NO: 1507897 - RNA, 19 nt, Homo sapiens
gaaaguacucuugguguau

SEQ ID NO: 1507898 - RNA, 19 nt, Homo sapiens
cuacagaggaaacaauuaa

SEQ ID NO: 1507899 - RNA, 19 nt, Homo sapiens
gaaaguuacagaaggaguu

SEQ ID NO: 1507900 - RNA, 19 nt, Homo sapiens
gccaucagaauucuuaaua

SEQ ID NO: 1507901 - RNA, 19 nt, Homo sapiens
cgacuuaugauggaauuua

SEQ ID NO: 1507902 - RNA, 19 nt, Homo sapiens
agaagcaucuaaccauuau

SEQ ID NO: 1507903 - RNA, 19 nt, Homo sapiens
ucagugguuucucuugaua

SEQ ID NO: 1507904 - RNA, 19 nt, Homo sapiens
gggaagauauaugaauuuc

SEQ ID NO: 1507905 - RNA, 19 nt, Homo sapiens
gacaaugguuauaguagau

SEQ ID NO: 1507906 - RNA, 19 nt, Homo sapiens
caucagcuauaauucagaa

SEQ ID NO: 1507907 - RNA, 19 nt, Homo sapiens
cagaaggaguuguagaugu

SEQ ID NO: 1507908 - RNA, 19 nt, Homo sapiens
uaaagcacuugaagacaau

SEQ ID NO: 1507909 - RNA, 19 nt, Homo sapiens
acaaagcuuacuccaauua

SEQ ID NO: 1507910 - RNA, 19 nt, Homo sapiens
gaaagagguggaugaggaa

SEQ ID NO: 1507911 - RNA, 19 nt, Homo sapiens
gaaguuuauuggugugugu

SEQ ID NO: 1507912 - RNA, 19 nt, Homo sapiens
acaauuauaugaccagaag

SEQ ID NO: 1507913 - RNA, 19 nt, Homo sapiens
guacagcaaacuacuauuc

SEQ ID NO: 1507914 - RNA, 19 nt, Homo sapiens
ggucagauuaguccaaauu

SEQ ID NO: 1507915 - RNA, 19 nt, Homo sapiens
agacaaugguuauaguaga

SEQ ID NO: 1507916 - RNA, 19 nt, Homo sapiens
uuaaugaucucaacuacag

SEQ ID NO: 1507917 - RNA, 19 nt, Homo sapiens
aaaagaagaagcccaauua

SEQ ID NO: 1507918 - RNA, 19 nt, Homo sapiens
gcaguaaugcauuuggauu

SEQ ID NO: 1507919 - RNA, 19 nt, Homo sapiens
aacacuagcuaaaccagua

SEQ ID NO: 1507920 - RNA, 19 nt, Homo sapiens
guuaguuccuguauuugaa

SEQ ID NO: 1507921 - RNA, 19 nt, Homo sapiens
cagcaaacuacuauucuuu

SEQ ID NO: 1507922 - RNA, 19 nt, Homo sapiens
ggaacaaagcuuacuccaa

SEQ ID NO: 1507923 - RNA, 19 nt, Homo sapiens
ggaacaaauggaugcagua

SEQ ID NO: 1507924 - RNA, 19 nt, Homo sapiens
gaaagagcugggaagauau

SEQ ID NO: 1507925 - RNA, 19 nt, Homo sapiens
gagcaaguauugagguaac

SEQ ID NO: 1507926 - RNA, 19 nt, Homo sapiens
ugaagacaaugguuauagu

SEQ ID NO: 1507927 - RNA, 19 nt, Homo sapiens
ggaauaugaaucucacaga

SEQ ID NO: 1507928 - RNA, 19 nt, Homo sapiens
uagauuugauuaccaagga

SEQ ID NO: 1507929 - RNA, 19 nt, Homo sapiens
ggaaaagacugguuacaac

SEQ ID NO: 1507930 - RNA, 19 nt, Homo sapiens
gggcugacccagagaaaga

SEQ ID NO: 1507931 - RNA, 19 nt, Homo sapiens
aaagagcugggaagauaua

SEQ ID NO: 1507932 - RNA, 19 nt, Homo sapiens
caaguccgccugaaguuga

SEQ ID NO: 1507933 - RNA, 19 nt, Homo sapiens
gaaauucgaccagggaagu

SEQ ID NO: 1507934 - RNA, 19 nt, Homo sapiens
gauuuaggaccaacauuug

SEQ ID NO: 1507935 - RNA, 19 nt, Homo sapiens
aaagacugguuacaacaug

SEQ ID NO: 1507936 - RNA, 19 nt, Homo sapiens
gauggaauuuaguggugaa

SEQ ID NO: 1507937 - RNA, 19 nt, Homo sapiens
cugggaagauauaugaauu

SEQ ID NO: 1507938 - RNA, 19 nt, Homo sapiens
gaaaauggacaaaggaaau

SEQ ID NO: 1507939 - RNA, 19 nt, Homo sapiens
ugccaugucuguuaugaau

SEQ ID NO: 1507940 - RNA, 19 nt, Homo sapiens
agaaggaguuguagauguc

SEQ ID NO: 1507941 - RNA, 19 nt, Homo sapiens
ggcuauguaucuccaauca

SEQ ID NO: 1507942 - RNA, 19 nt, Homo sapiens
ugagguaacacuagcuaaa

SEQ ID NO: 1507943 - RNA, 19 nt, Homo sapiens
cuggagauuagaacaauua

SEQ ID NO: 1507944 - RNA, 19 nt, Homo sapiens
cugcaaccaugaaugaaga

SEQ ID NO: 1507945 - RNA, 19 nt, Homo sapiens
agaaucggguuugcauauu

SEQ ID NO: 1507946 - RNA, 19 nt, Homo sapiens
caacaauaucacuugcuaa

SEQ ID NO: 1507947 - RNA, 19 nt, Homo sapiens
ccagcgugcuuccuuauac

SEQ ID NO: 1507948 - RNA, 19 nt, Homo sapiens
uuacuugcuuugauggaaa

SEQ ID NO: 1507949 - RNA, 19 nt, Homo sapiens
gcuaaaccaguaaauaaag

SEQ ID NO: 1507950 - RNA, 19 nt, Homo sapiens
uugcauuuguggaauauga

SEQ ID NO: 1507951 - RNA, 19 nt, Homo sapiens
cuaaugagcuuguuaaaga

SEQ ID NO: 1507952 - RNA, 19 nt, Homo sapiens
ggaaauagaaggauugaaa

SEQ ID NO: 1507953 - RNA, 19 nt, Homo sapiens
ggaaauggcuguguuagug

SEQ ID NO: 1507954 - RNA, 19 nt, Homo sapiens
gaauuuggaugaugauuug

SEQ ID NO: 1507955 - RNA, 19 nt, Homo sapiens
gaacaaauuuccacuagag

SEQ ID NO: 1507956 - RNA, 19 nt, Homo sapiens
gagcacauauggaagagua

SEQ ID NO: 1507957 - RNA, 19 nt, Homo sapiens
uuaaagaggugccaaagaa

SEQ ID NO: 1507958 - RNA, 19 nt, Homo sapiens
uaggagaacugacugguaa

SEQ ID NO: 1507959 - RNA, 19 nt, Homo sapiens
gggaucaucugcauucuug

SEQ ID NO: 1507960 - RNA, 19 nt, Homo sapiens
gaacuugaccaucuccuuu

SEQ ID NO: 1507961 - RNA, 19 nt, Homo sapiens
caucagcucuuacaccaaa

SEQ ID NO: 1507962 - RNA, 19 nt, Homo sapiens
agaacugacugguaaauga

SEQ ID NO: 1507963 - RNA, 19 nt, Homo sapiens
acaaaggcaucagcucuua

SEQ ID NO: 1507964 - RNA, 19 nt, Homo sapiens
gaacauauuccuccuuucu

SEQ ID NO: 1507965 - RNA, 19 nt, Homo sapiens
gaauuggcuuccuuucuug

SEQ ID NO: 1507966 - RNA, 19 nt, Homo sapiens
ggaauuuggaugaugauuu

SEQ ID NO: 1507967 - RNA, 19 nt, Homo sapiens
gaagggaauuuggaugaug

SEQ ID NO: 1507968 - RNA, 19 nt, Homo sapiens
cggaauaaauggaguuuca

SEQ ID NO: 1507969 - RNA, 19 nt, Homo sapiens
ccacaaagaacaagaacuu

SEQ ID NO: 1507970 - RNA, 19 nt, Homo sapiens
caaaguccauuguaagagu

SEQ ID NO: 1507971 - RNA, 19 nt, Homo sapiens
ggacuuuacuaaugagcuu

SEQ ID NO: 1507972 - RNA, 19 nt, Homo sapiens
gaacugacugguaaaugaa

SEQ ID NO: 1507973 - RNA, 19 nt, Homo sapiens
gacacugacuuauuuguuc

SEQ ID NO: 1507974 - RNA, 19 nt, Homo sapiens
aagaacauauuccuccuuu

SEQ ID NO: 1507975 - RNA, 19 nt, Homo sapiens
gaguaaaguugaagggaau

SEQ ID NO: 1507976 - RNA, 19 nt, Homo sapiens
gaucaucugcauucuugua

SEQ ID NO: 1507977 - RNA, 19 nt, Homo sapiens
caacggauucuacgauuga

SEQ ID NO: 1507978 - RNA, 19 nt, Homo sapiens
uaucuuauguggagacuuc

SEQ ID NO: 1507979 - RNA, 19 nt, Homo sapiens
gaucacaguuguacaugag

SEQ ID NO: 1507980 - RNA, 19 nt, Homo sapiens
acauauuccuccuuucuuu

SEQ ID NO: 1507981 - RNA, 19 nt, Homo sapiens
gacaauggauaucauagag

SEQ ID NO: 1507982 - RNA, 19 nt, Homo sapiens
ggacaauggauaucauaga

SEQ ID NO: 1507983 - RNA, 19 nt, Homo sapiens
caauguauguuacuacucu

SEQ ID NO: 1507984 - RNA, 19 nt, Homo sapiens
caaaagaguuaacgcugua

SEQ ID NO: 1507985 - RNA, 19 nt, Homo sapiens
ucgaugugaucauugcuua

SEQ ID NO: 1507986 - RNA, 19 nt, Homo sapiens
guaaucggauggcuaccuu

SEQ ID NO: 1507987 - RNA, 19 nt, Homo sapiens
uugcagcucuucauucauu

SEQ ID NO: 1507988 - RNA, 19 nt, Homo sapiens
ccuccuuucuuuauucuuu

SEQ ID NO: 1507989 - RNA, 19 nt, Homo sapiens
guugaagguuuguuguuga

SEQ ID NO: 1507990 - RNA, 19 nt, Homo sapiens
guaaacgauuagaaagaug

SEQ ID NO: 1507991 - RNA, 19 nt, Homo sapiens
gggauuauauuaguuggau

SEQ ID NO: 1507992 - RNA, 19 nt, Homo sapiens
gggaaaggugggauaguaa

SEQ ID NO: 1507993 - RNA, 19 nt, Homo sapiens
uuaguuggauuauggauca

SEQ ID NO: 1507994 - RNA, 19 nt, Homo sapiens
uacgaacacuuaugcaaga

SEQ ID NO: 1507995 - RNA, 19 nt, Homo sapiens
agggaaaggugggauagua

SEQ ID NO: 1507996 - RNA, 19 nt, Homo sapiens
gaugugaucauugcuuauu

SEQ ID NO: 1507997 - RNA, 19 nt, Homo sapiens
gacuauauccaaauugcua

SEQ ID NO: 1507998 - RNA, 19 nt, Homo sapiens
guaaccaaagguauaguuu

SEQ ID NO: 1507999 - RNA, 19 nt, Homo sapiens
ccacaugaacauaagacua

SEQ ID NO: 1508000 - RNA, 19 nt, Homo sapiens
gaagguuuguuguugaaaa

SEQ ID NO: 1508001 - RNA, 19 nt, Homo sapiens
caaggcugcuaaagagaga

SEQ ID NO: 1508002 - RNA, 19 nt, Homo sapiens
cauauuccuccuuucuuua

SEQ ID NO: 1508003 - RNA, 19 nt, Homo sapiens
ugaagaaauggaccaaauu

SEQ ID NO: 1508004 - RNA, 19 nt, Homo sapiens
gcacacgaacacuacacua

SEQ ID NO: 1508005 - RNA, 19 nt, Homo sapiens
aaauugcuaugcccacuga

SEQ ID NO: 1508006 - RNA, 19 nt, Homo sapiens
gcacauauggaagaguaaa

SEQ ID NO: 1508007 - RNA, 19 nt, Homo sapiens
cgcugacacugacuuauuu

SEQ ID NO: 1508008 - RNA, 19 nt, Homo sapiens
cagcaaaacuugaagaaca

SEQ ID NO: 1508009 - RNA, 19 nt, Homo sapiens
acugguaaaugaagaaaug

SEQ ID NO: 1508010 - RNA, 19 nt, Homo sapiens
ucucuucacagacuaauuu

SEQ ID NO: 1508011 - RNA, 19 nt, Homo sapiens
ugaaaguggugaagguaca

SEQ ID NO: 1508012 - RNA, 19 nt, Homo sapiens
ccuccuggcugcuucaaau

SEQ ID NO: 1508013 - RNA, 19 nt, Homo sapiens
cugcuguaauguauugaua

SEQ ID NO: 1508014 - RNA, 19 nt, Homo sapiens
ggaccuccguuagaaguag

SEQ ID NO: 1508015 - RNA, 19 nt, Homo sapiens
aagggaauuuggaugauga

SEQ ID NO: 1508016 - RNA, 19 nt, Homo sapiens
acacuacacuaucgaugug

SEQ ID NO: 1508017 - RNA, 19 nt, Homo sapiens
ggaugaugauuuggcaaga

SEQ ID NO: 1508018 - RNA, 19 nt, Homo sapiens
gaugaugauuuggcaagau

SEQ ID NO: 1508019 - RNA, 19 nt, Homo sapiens
ucaacggauucuacgauug

SEQ ID NO: 1508020 - RNA, 19 nt, Homo sapiens
gagauacaagucaauagug

SEQ ID NO: 1508021 - RNA, 19 nt, Homo sapiens
gaaucaaggaacaaauuuc

SEQ ID NO: 1508022 - RNA, 19 nt, Homo sapiens
gugauccuacgaacacuua

SEQ ID NO: 1508023 - RNA, 19 nt, Homo sapiens
gaaaggugggauaguaaca

SEQ ID NO: 1508024 - RNA, 19 nt, Homo sapiens
aggcaaggcugcuaaagag

SEQ ID NO: 1508025 - RNA, 19 nt, Homo sapiens
gaucuuggaaauagaagga

SEQ ID NO: 1508026 - RNA, 19 nt, Homo sapiens
cuucaaaucaucaugcaaa

SEQ ID NO: 1508027 - RNA, 19 nt, Homo sapiens
cggauucuacgauugauuu

SEQ ID NO: 1508028 - RNA, 19 nt, Homo sapiens
aaaaguacccggacuauau

SEQ ID NO: 1508029 - RNA, 19 nt, Homo sapiens
cgcugaaccuguugaagaa

SEQ ID NO: 1508030 - RNA, 19 nt, Homo sapiens
ccgcugaaccuguugaaga

SEQ ID NO: 1508031 - RNA, 19 nt, Homo sapiens
gaagguacagcauauagcu

SEQ ID NO: 1508032 - RNA, 19 nt, Homo sapiens
augaagaaauggaccaaau

SEQ ID NO: 1508033 - RNA, 19 nt, Homo sapiens
caaaaucacaagcuucuuu

SEQ ID NO: 1508034 - RNA, 19 nt, Homo sapiens
gugaagacaaugagaaauc

SEQ ID NO: 1508035 - RNA, 19 nt, Homo sapiens
gauuucuggugguggauug

SEQ ID NO: 1508036 - RNA, 19 nt, Homo sapiens
gcuaaauuuccacaaagaa

SEQ ID NO: 1508037 - RNA, 19 nt, Homo sapiens
ccauguugaucuuggaaau

SEQ ID NO: 1508038 - RNA, 19 nt, Homo sapiens
gcuaaagagagacaggaaa

SEQ ID NO: 1508039 - RNA, 19 nt, Homo sapiens
cuaaagagagacaggaaau

SEQ ID NO: 1508040 - RNA, 19 nt, Homo sapiens
auggcuaccuucuacauuu

SEQ ID NO: 1508041 - RNA, 19 nt, Homo sapiens
cccgggacuuuacuaauga

SEQ ID NO: 1508042 - RNA, 19 nt, Homo sapiens
acacugacuuauuuguuca

SEQ ID NO: 1508043 - RNA, 19 nt, Homo sapiens
uuacauugauagggugaaa

SEQ ID NO: 1508044 - RNA, 19 nt, Homo sapiens
ugaucacaguuguacauga

SEQ ID NO: 1508045 - RNA, 19 nt, Homo sapiens
aagcuucuuucccacauga

SEQ ID NO: 1508046 - RNA, 19 nt, Homo sapiens
ucuugcagcucuucauuca

SEQ ID NO: 1508047 - RNA, 19 nt, Homo sapiens
ggagaacugacugguaaau

SEQ ID NO: 1508048 - RNA, 19 nt, Homo sapiens
auaacuggaucacauaucu

SEQ ID NO: 1508049 - RNA, 19 nt, Homo sapiens
ggcaaaaguucaacggauu

SEQ ID NO: 1508050 - RNA, 19 nt, Homo sapiens
caaagccugggaugucaaa

SEQ ID NO: 1508051 - RNA, 19 nt, Homo sapiens
gaagaaaucugaacguuau

SEQ ID NO: 1508052 - RNA, 19 nt, Homo sapiens
gguaaaugcuucagccuua

SEQ ID NO: 1508053 - RNA, 19 nt, Homo sapiens
gagcagggauucuucagua

SEQ ID NO: 1508054 - RNA, 19 nt, Homo sapiens
gaggagagcuaucagguuu

SEQ ID NO: 1508055 - RNA, 19 nt, Homo sapiens
caagugaacuggcagauga

SEQ ID NO: 1508056 - RNA, 19 nt, Homo sapiens
gaaagauacugcugcaaug

SEQ ID NO: 1508057 - RNA, 19 nt, Homo sapiens
ggaagaaaucugaacguua

SEQ ID NO: 1508058 - RNA, 19 nt, Homo sapiens
ggaaaggccucucaagaag

SEQ ID NO: 1508059 - RNA, 19 nt, Homo sapiens
gaacaggcauuauaugaac

SEQ ID NO: 1508060 - RNA, 19 nt, Homo sapiens
gaucaaauacugcauguga

SEQ ID NO: 1508061 - RNA, 19 nt, Homo sapiens
cuauauggaucguuuagua

SEQ ID NO: 1508062 - RNA, 19 nt, Homo sapiens
gaagaaugccgaagcuuug

SEQ ID NO: 1508063 - RNA, 19 nt, Homo sapiens
ggaaggaaauaaugauugg

SEQ ID NO: 1508064 - RNA, 19 nt, Homo sapiens
ccauaaauguggaaaugaa

SEQ ID NO: 1508065 - RNA, 19 nt, Homo sapiens
gcaaauuccagugcaaaua

SEQ ID NO: 1508066 - RNA, 19 nt, Homo sapiens
aaucagagguugaagaugu

SEQ ID NO: 1508067 - RNA, 19 nt, Homo sapiens
agagcaaaguuaaggaaua

SEQ ID NO: 1508068 - RNA, 19 nt, Homo sapiens
gaagaagaaugccgaagcu

SEQ ID NO: 1508069 - RNA, 19 nt, Homo sapiens
guacgaugguaaugagaaa

SEQ ID NO: 1508070 - RNA, 19 nt, Homo sapiens
gcaaauaguuccccaagug

SEQ ID NO: 1508071 - RNA, 19 nt, Homo sapiens
gaaccaugccucuagaaga

SEQ ID NO: 1508072 - RNA, 19 nt, Homo sapiens
guaaaugcuucagccuuaa

SEQ ID NO: 1508073 - RNA, 19 nt, Homo sapiens
gaaggaaccaugccucuag

SEQ ID NO: 1508074 - RNA, 19 nt, Homo sapiens
gagcaaaguuaaggaauac

SEQ ID NO: 1508075 - RNA, 19 nt, Homo sapiens
gaucugacgccaucuguga

SEQ ID NO: 1508076 - RNA, 19 nt, Homo sapiens
cguaauggaugcaguggaa

SEQ ID NO: 1508077 - RNA, 19 nt, Homo sapiens
ccagugacuugacagcuuu

SEQ ID NO: 1508078 - RNA, 19 nt, Homo sapiens
gaucaacagcuaaacauuc

SEQ ID NO: 1508079 - RNA, 19 nt, Homo sapiens
aggaagcaaucgaaagaua

SEQ ID NO: 1508080 - RNA, 19 nt, Homo sapiens
gaaacagacagugguaauu

SEQ ID NO: 1508081 - RNA, 19 nt, Homo sapiens
gccaagcacuuagaacuga

SEQ ID NO: 1508082 - RNA, 19 nt, Homo sapiens
gaacuaugaucagcagagu

SEQ ID NO: 1508083 - RNA, 19 nt, Homo sapiens
guuugaaccuuucucacua

SEQ ID NO: 1508084 - RNA, 19 nt, Homo sapiens
uaaccuggguguggacuuu

SEQ ID NO: 1508085 - RNA, 19 nt, Homo sapiens
gagcuaacccuaugaacau

SEQ ID NO: 1508086 - RNA, 19 nt, Homo sapiens
gcacuuagaacugaguaaa

SEQ ID NO: 1508087 - RNA, 19 nt, Homo sapiens
ucagugaugucaguaugua

SEQ ID NO: 1508088 - RNA, 19 nt, Homo sapiens
gauaggauuucugcaggaa

SEQ ID NO: 1508089 - RNA, 19 nt, Homo sapiens
ggaaucagagguugaagau

SEQ ID NO: 1508090 - RNA, 19 nt, Homo sapiens
gucaguauguauagaacua

SEQ ID NO: 1508091 - RNA, 19 nt, Homo sapiens
agaauaaggugagaacuag

SEQ ID NO: 1508092 - RNA, 19 nt, Homo sapiens
gugaauuguuuggaugaua

SEQ ID NO: 1508093 - RNA, 19 nt, Homo sapiens
caaguguaaccacaauaua

SEQ ID NO: 1508094 - RNA, 19 nt, Homo sapiens
guugagacuucauuaagga

SEQ ID NO: 1508095 - RNA, 19 nt, Homo sapiens
cugaauccuuuaugaauga

SEQ ID NO: 1508096 - RNA, 19 nt, Homo sapiens
gacaguugcugagugugua

SEQ ID NO: 1508097 - RNA, 19 nt, Homo sapiens
gaacaugugcagugaagag

SEQ ID NO: 1508098 - RNA, 19 nt, Homo sapiens
uaaacauucucaacuccuu

SEQ ID NO: 1508099 - RNA, 19 nt, Homo sapiens
gcagggauucuucaguaaa

SEQ ID NO: 1508100 - RNA, 19 nt, Homo sapiens
cggacuauauggaucguuu

SEQ ID NO: 1508101 - RNA, 19 nt, Homo sapiens
cgaaagauacugcugcaau

SEQ ID NO: 1508102 - RNA, 19 nt, Homo sapiens
aaaggaagcaaucgaaaga

SEQ ID NO: 1508103 - RNA, 19 nt, Homo sapiens
gaaccuuucucacuaugac

SEQ ID NO: 1508104 - RNA, 19 nt, Homo sapiens
ggagcuaacccuaugaaca

SEQ ID NO: 1508105 - RNA, 19 nt, Homo sapiens
uggaaaggccucucaagaa

SEQ ID NO: 1508106 - RNA, 19 nt, Homo sapiens
ggagagcaaaguuaaggaa

SEQ ID NO: 1508107 - RNA, 19 nt, Homo sapiens
gaggaaggaaauaaugauu

SEQ ID NO: 1508108 - RNA, 19 nt, Homo sapiens
agacaugacacuagacaaa

SEQ ID NO: 1508109 - RNA, 19 nt, Homo sapiens
uagaagauuuacuggcauu

SEQ ID NO: 1508110 - RNA, 19 nt, Homo sapiens
ugaauuguuuggaugauag

SEQ ID NO: 1508111 - RNA, 19 nt, Homo sapiens
ggacuauauggaucguuua

SEQ ID NO: 1508112 - RNA, 19 nt, Homo sapiens
ggaauaccuuguugagacu

SEQ ID NO: 1508113 - RNA, 19 nt, Homo sapiens
gagaguacgaugguaauga

SEQ ID NO: 1508114 - RNA, 19 nt, Homo sapiens
gaagauuugaggaaggaaa

SEQ ID NO: 1508115 - RNA, 19 nt, Homo sapiens
caaauuccagugcaaauag

SEQ ID NO: 1508116 - RNA, 19 nt, Homo sapiens
ggcauucuauggcuaugaa

SEQ ID NO: 1508117 - RNA, 19 nt, Homo sapiens
gaaguuugaaccuuucuca

SEQ ID NO: 1508118 - RNA, 19 nt, Homo sapiens
guggacaaguuaaucaugu

SEQ ID NO: 1508119 - RNA, 19 nt, Homo sapiens
cagggauucuucaguaaau

SEQ ID NO: 1508120 - RNA, 19 nt, Homo sapiens
aaaggccucucaagaagga

SEQ ID NO: 1508121 - RNA, 19 nt, Homo sapiens
ccaugccucuagaagauuu

SEQ ID NO: 1508122 - RNA, 19 nt, Homo sapiens
gcauagucuuucacuggaa

SEQ ID NO: 1508123 - RNA, 19 nt, Homo sapiens
gccagugacuugacagcuu

SEQ ID NO: 1508124 - RNA, 19 nt, Homo sapiens
uuacuuugcucaacagaca

SEQ ID NO: 1508125 - RNA, 19 nt, Homo sapiens
agaagaaugccgaagcuuu

SEQ ID NO: 1508126 - RNA, 19 nt, Homo sapiens
aagauuuacuggcauucua

SEQ ID NO: 1508127 - RNA, 19 nt, Homo sapiens
uaccagacaugacacuaga

SEQ ID NO: 1508128 - RNA, 19 nt, Homo sapiens
gcagaugaacuaccagaca

SEQ ID NO: 1508129 - RNA, 19 nt, Homo sapiens
ugaacuggcagaugaacua

SEQ ID NO: 1508130 - RNA, 19 nt, Homo sapiens
uaauggaugcaguggaaua

SEQ ID NO: 1508131 - RNA, 19 nt, Homo sapiens
gggauucuucaguaaauuu

SEQ ID NO: 1508132 - RNA, 19 nt, Homo sapiens
ccugaauccuuuaugaaug

SEQ ID NO: 1508133 - RNA, 19 nt, Homo sapiens
aagaauaaggugagaacua

SEQ ID NO: 1508134 - RNA, 19 nt, Homo sapiens
ggaaggaaccaugccucua

SEQ ID NO: 1508135 - RNA, 19 nt, Homo sapiens
cagaugaacuaccagacau

SEQ ID NO: 1508136 - RNA, 19 nt, Homo sapiens
ggaaaugaacuaugaucag

SEQ ID NO: 1508137 - RNA, 19 nt, Homo sapiens
gcuucagccuuaacuucua

SEQ ID NO: 1508138 - RNA, 19 nt, Homo sapiens
gcucaacagacaagauuug

SEQ ID NO: 1508139 - RNA, 19 nt, Homo sapiens
ggacaguugcugagugugu

SEQ ID NO: 1508140 - RNA, 19 nt, Homo sapiens
aaacgaagaccaguuacuu

SEQ ID NO: 1508141 - RNA, 19 nt, Homo sapiens
acaaagaggaaauagcaaa

SEQ ID NO: 1508142 - RNA, 19 nt, Homo sapiens
gaugucaguauguauagaa

SEQ ID NO: 1508143 - RNA, 19 nt, Homo sapiens
aaccaugccucuagaagau

SEQ ID NO: 1508144 - RNA, 19 nt, Homo sapiens
uggaagaaaucugaacguu

SEQ ID NO: 1508145 - RNA, 19 nt, Homo sapiens
agacaaagaggaaauagca

SEQ ID NO: 1508146 - RNA, 19 nt, Homo sapiens
acuggaaguuugaaccuuu

SEQ ID NO: 1508147 - RNA, 19 nt, Homo sapiens
ucacaucaccagugccaaa

SEQ ID NO: 1508148 - RNA, 19 nt, Homo sapiens
gcauugccgucccugaauc

SEQ ID NO: 1508149 - RNA, 19 nt, Homo sapiens
uaaccggccugagccuauu

SEQ ID NO: 1508150 - RNA, 19 nt, Homo sapiens
ugaacaggcauuauaugaa

SEQ ID NO: 1508151 - RNA, 19 nt, Homo sapiens
ggagggagguggugaaaua

SEQ ID NO: 1508152 - RNA, 19 nt, Homo sapiens
gaaauacucuucuugaugu

SEQ ID NO: 1508153 - RNA, 19 nt, Homo sapiens
ggaauuugaucacugcuaa

SEQ ID NO: 1508154 - RNA, 19 nt, Homo sapiens
cgaaaugacuacuaucuga

SEQ ID NO: 1508155 - RNA, 19 nt, Homo sapiens
gcauauugcucucucuaaa

SEQ ID NO: 1508156 - RNA, 19 nt, Homo sapiens
uagcaaagauuucuacuuc

SEQ ID NO: 1508157 - RNA, 19 nt, Homo sapiens
guaauugucuuagaacuga

SEQ ID NO: 1508158 - RNA, 19 nt, Homo sapiens
ucacagauuuguuccuuaa

SEQ ID NO: 1508159 - RNA, 19 nt, Homo sapiens
aaacacaacucauucacuu

SEQ ID NO: 1508160 - RNA, 19 nt, Homo sapiens
gacagagacuggaaagaaa

SEQ ID NO: 1508161 - RNA, 19 nt, Homo sapiens
ggacagagacuggaaagaa

SEQ ID NO: 1508162 - RNA, 19 nt, Homo sapiens
gagauacuuuccugucuuu

SEQ ID NO: 1508163 - RNA, 19 nt, Homo sapiens
ccaaagacuugaagcagaa

SEQ ID NO: 1508164 - RNA, 19 nt, Homo sapiens
gcaauuaugggauguggua

SEQ ID NO: 1508165 - RNA, 19 nt, Homo sapiens
gagugaagaugaugauguu

SEQ ID NO: 1508166 - RNA, 19 nt, Homo sapiens
gaagacaccgccugagaaa

SEQ ID NO: 1508167 - RNA, 19 nt, Homo sapiens
guaacuauaucucuucugu

SEQ ID NO: 1508168 - RNA, 19 nt, Homo sapiens
gaagagaagucaagauucc

SEQ ID NO: 1508169 - RNA, 19 nt, Homo sapiens
cuucuaaucugaauucuug

SEQ ID NO: 1508170 - RNA, 19 nt, Homo sapiens
caaggcaccucaugcaaug

SEQ ID NO: 1508171 - RNA, 19 nt, Homo sapiens
gagaugcugugggaaagua

SEQ ID NO: 1508172 - RNA, 19 nt, Homo sapiens
ucacauucaucuccuauau

SEQ ID NO: 1508173 - RNA, 19 nt, Homo sapiens
gguuucaguuuccuuauuu

SEQ ID NO: 1508174 - RNA, 19 nt, Homo sapiens
aaugaaggauggacgcuua

SEQ ID NO: 1508175 - RNA, 19 nt, Homo sapiens
caucaacucucaaggacaa

SEQ ID NO: 1508176 - RNA, 19 nt, Homo sapiens
uaugggaugugguaacuaa

SEQ ID NO: 1508177 - RNA, 19 nt, Homo sapiens
gaagucagccggagaugga

SEQ ID NO: 1508178 - RNA, 19 nt, Homo sapiens
caaacaaguugaaauacuc

SEQ ID NO: 1508179 - RNA, 19 nt, Homo sapiens
uggaaaggcugcaaagaug

SEQ ID NO: 1508180 - RNA, 19 nt, Homo sapiens
gcucugugcuuccucaguu

SEQ ID NO: 1508181 - RNA, 19 nt, Homo sapiens
uagccuguaucaucuauuu

SEQ ID NO: 1508182 - RNA, 19 nt, Homo sapiens
gggagguggugaaauagaa

SEQ ID NO: 1508183 - RNA, 19 nt, Homo sapiens
cagaagagaagucaagauu

SEQ ID NO: 1508184 - RNA, 19 nt, Homo sapiens
gcagauugcuuuacuugcu

SEQ ID NO: 1508185 - RNA, 19 nt, Homo sapiens
gagcuggaaucacuuuauc

SEQ ID NO: 1508186 - RNA, 19 nt, Homo sapiens
gcauuagccuguaucaucu

SEQ ID NO: 1508187 - RNA, 19 nt, Homo sapiens
ucucaaggacaaccuauua

SEQ ID NO: 1508188 - RNA, 19 nt, Homo sapiens
cgagggagaagugcaauua

SEQ ID NO: 1508189 - RNA, 19 nt, Homo sapiens
gaaaugacuacuaucugaa

SEQ ID NO: 1508190 - RNA, 19 nt, Homo sapiens
uuacuggucuucgaaauga

SEQ ID NO: 1508191 - RNA, 19 nt, Homo sapiens
cugcaaagauggagucaga

SEQ ID NO: 1508192 - RNA, 19 nt, Homo sapiens
aagaaaguguugccucaaa

SEQ ID NO: 1508193 - RNA, 19 nt, Homo sapiens
gacaaccuauuaccaaaca

SEQ ID NO: 1508194 - RNA, 19 nt, Homo sapiens
cuacuucuuucccguauga

SEQ ID NO: 1508195 - RNA, 19 nt, Homo sapiens
gcaaagauggagucagaga

SEQ ID NO: 1508196 - RNA, 19 nt, Homo sapiens
gcuuacacaucuuggauau

SEQ ID NO: 1508197 - RNA, 19 nt, Homo sapiens
ccaaaccucauauuucuga

SEQ ID NO: 1508198 - RNA, 19 nt, Homo sapiens
uauaaacgauuccauacuc

SEQ ID NO: 1508199 - RNA, 19 nt, Homo sapiens
cccagaagcuuccggauca

SEQ ID NO: 1508200 - RNA, 19 nt, Homo sapiens
gaggagaugcugugggaaa

SEQ ID NO: 1508201 - RNA, 19 nt, Homo sapiens
gcaaggcaccucaugcaau

SEQ ID NO: 1508202 - RNA, 19 nt, Homo sapiens
cuagggcucuguccucuga

SEQ ID NO: 1508203 - RNA, 19 nt, Homo sapiens
ucaguucgcuguucugucu

SEQ ID NO: 1508204 - RNA, 19 nt, Homo sapiens
gcaaggauaggaauuugau

SEQ ID NO: 1508205 - RNA, 19 nt, Homo sapiens
gggaaccuccugauuauuc

SEQ ID NO: 1508206 - RNA, 19 nt, Homo sapiens
gugauggacugcugacaau

SEQ ID NO: 1508207 - RNA, 19 nt, Homo sapiens
cuacguauucugacuuuaa

SEQ ID NO: 1508208 - RNA, 19 nt, Homo sapiens
caacguacucgauucaguu

SEQ ID NO: 1508209 - RNA, 19 nt, Homo sapiens
gguuugaguucuuggcauu

SEQ ID NO: 1508210 - RNA, 19 nt, Homo sapiens
cagaauaacaucuauagca

SEQ ID NO: 1508211 - RNA, 19 nt, Homo sapiens
ugaaauacucuucuugaug

SEQ ID NO: 1508212 - RNA, 19 nt, Homo sapiens
gcaaagaacaacugaagac

SEQ ID NO: 1508213 - RNA, 19 nt, Homo sapiens
ggcauuagccuguaucauc

SEQ ID NO: 1508214 - RNA, 19 nt, Homo sapiens
gcuccaaaccucauauuuc

SEQ ID NO: 1508215 - RNA, 19 nt, Homo sapiens
ucaagguacucccaagaau

SEQ ID NO: 1508216 - RNA, 19 nt, Homo sapiens
gagcaauccgaauguguuu

SEQ ID NO: 1508217 - RNA, 19 nt, Homo sapiens
guaacucugcucuccauuu

SEQ ID NO: 1508218 - RNA, 19 nt, Homo sapiens
ggcuaagucuugugauuuc

SEQ ID NO: 1508219 - RNA, 19 nt, Homo sapiens
gauggacugcugacaauau

SEQ ID NO: 1508220 - RNA, 19 nt, Homo sapiens
agacaccgccugagaaaga

SEQ ID NO: 1508221 - RNA, 19 nt, Homo sapiens
agcacaaacucacagauuu

SEQ ID NO: 1508222 - RNA, 19 nt, Homo sapiens
ggucauuugucaguaguug

SEQ ID NO: 1508223 - RNA, 19 nt, Homo sapiens
ucagaaucuuguugccaua

SEQ ID NO: 1508224 - RNA, 19 nt, Homo sapiens
ugugauuucuugccuuauu

SEQ ID NO: 1508225 - RNA, 19 nt, Homo sapiens
cuugugauuucuugccuua

SEQ ID NO: 1508226 - RNA, 19 nt, Homo sapiens
cuucucugcuuucuucuuu

SEQ ID NO: 1508227 - RNA, 19 nt, Homo sapiens
gaaugccuguucuccuguu

SEQ ID NO: 1508228 - RNA, 19 nt, Homo sapiens
gauugcaacuggucaaggu

SEQ ID NO: 1508229 - RNA, 19 nt, Homo sapiens
gauauaaacgauuccauac

SEQ ID NO: 1508230 - RNA, 19 nt, Homo sapiens
gaaaggcugcaaagaugga

SEQ ID NO: 1508231 - RNA, 19 nt, Homo sapiens
caagguggcagcaaaguca

SEQ ID NO: 1508232 - RNA, 19 nt, Homo sapiens
gauguuaccuggguuugag

SEQ ID NO: 1508233 - RNA, 19 nt, Homo sapiens
uaagucuugugauuucuug

SEQ ID NO: 1508234 - RNA, 19 nt, Homo sapiens
gcucaucaacucucaagga

SEQ ID NO: 1508235 - RNA, 19 nt, Homo sapiens
guugaaauacucuucuuga

SEQ ID NO: 1508236 - RNA, 19 nt, Homo sapiens
agaaauaugcuuggucauu

SEQ ID NO: 1508237 - RNA, 19 nt, Homo sapiens
uaacucugcucuccauuuu

SEQ ID NO: 1508238 - RNA, 19 nt, Homo sapiens
ucuaggauccugcaaagaa

SEQ ID NO: 1508239 - RNA, 19 nt, Homo sapiens
ugagauacuuuccugucuu

SEQ ID NO: 1508240 - RNA, 19 nt, Homo sapiens
ggagaaccacaaugggauu

SEQ ID NO: 1508241 - RNA, 19 nt, Homo sapiens
uaugcuaggcaguauguua

SEQ ID NO: 1508242 - RNA, 19 nt, Homo sapiens
acacaacucauucacuuga

SEQ ID NO: 1508243 - RNA, 19 nt, Homo sapiens
gggcucugcuguauacauc

SEQ ID NO: 1508244 - RNA, 19 nt, Homo sapiens
gugauuucuugccuuauug

SEQ ID NO: 1508245 - RNA, 19 nt, Homo sapiens
ggaaccuccugauuauucu

SEQ ID NO: 1508246 - RNA, 19 nt, Homo sapiens
ucaagauuccgccaacgua

SEQ ID NO: 1508247 - RNA, 19 nt, Homo sapiens
aacuauaucucuucugugu

SEQ ID NO: 1508248 - RNA, 19 nt, Homo sapiens
aaucaguucuguaggaauc

SEQ ID NO: 1508249 - RNA, 19 nt, Homo sapiens
aaccucauauuucugauug

SEQ ID NO: 1508250 - RNA, 19 nt, Homo sapiens
guacucgauucaguuaaug

SEQ ID NO: 1508251 - RNA, 19 nt, Homo sapiens
gaaaggauaucauggauuc

SEQ ID NO: 1508252 - RNA, 19 nt, Homo sapiens
gcagaguugugguucauua

SEQ ID NO: 1508253 - RNA, 19 nt, Homo sapiens
ggaauaacauccaagaaag

SEQ ID NO: 1508254 - RNA, 19 nt, Homo sapiens
aaagacaccuugcauauuc

SEQ ID NO: 1508255 - RNA, 19 nt, Homo sapiens
gacauuggcucuuaagaug

SEQ ID NO: 1508256 - RNA, 19 nt, Homo sapiens
gcucacaggucuccacauu

SEQ ID NO: 1508257 - RNA, 19 nt, Homo sapiens
caaggaacauuucacagaa

SEQ ID NO: 1508258 - RNA, 19 nt, Homo sapiens
gaaagacaccuugcauauu

SEQ ID NO: 1508259 - RNA, 19 nt, Homo sapiens
gaaaggugaaggagacaua

SEQ ID NO: 1508260 - RNA, 19 nt, Homo sapiens
gcacaugcagucuacauuu

SEQ ID NO: 1508261 - RNA, 19 nt, Homo sapiens
ugaaacaaaucauggaaga

SEQ ID NO: 1508262 - RNA, 19 nt, Homo sapiens
ccucagauuuccagccuua

SEQ ID NO: 1508263 - RNA, 19 nt, Homo sapiens
gaacuucgacauggugaua

SEQ ID NO: 1508264 - RNA, 19 nt, Homo sapiens
ggaccggguuucucagauu

SEQ ID NO: 1508265 - RNA, 19 nt, Homo sapiens
caagggcuaugcugugauu

SEQ ID NO: 1508266 - RNA, 19 nt, Homo sapiens
cauaucaaguuaucaguug

SEQ ID NO: 1508267 - RNA, 19 nt, Homo sapiens
gacuguagguuuccagauu

SEQ ID NO: 1508268 - RNA, 19 nt, Homo sapiens
ucaaggagaugaacaaugc

SEQ ID NO: 1508269 - RNA, 19 nt, Homo sapiens
uaucauggauuccuuaaag

SEQ ID NO: 1508270 - RNA, 19 nt, Homo sapiens
cauaaugucaccaugcuua

SEQ ID NO: 1508271 - RNA, 19 nt, Homo sapiens
gcauggagacuguagguuu

SEQ ID NO: 1508272 - RNA, 19 nt, Homo sapiens
gagcaggcauggagacugu

SEQ ID NO: 1508273 - RNA, 19 nt, Homo sapiens
gaauaacauccaagaaaga

SEQ ID NO: 1508274 - RNA, 19 nt, Homo sapiens
caagaucacggucauaaug

SEQ ID NO: 1508275 - RNA, 19 nt, Homo sapiens
ucacaggucuccacauugg

SEQ ID NO: 1508276 - RNA, 19 nt, Homo sapiens
guuggaggcuugauggaaa

SEQ ID NO: 1508277 - RNA, 19 nt, Homo sapiens
gugaacaccugucagaauc

SEQ ID NO: 1508278 - RNA, 19 nt, Homo sapiens
ccaccuggcugcaaaugug

SEQ ID NO: 1508279 - RNA, 19 nt, Homo sapiens
cuacuguccuuuccugauu

SEQ ID NO: 1508280 - RNA, 19 nt, Homo sapiens
ggaagccauuaucuacuga

SEQ ID NO: 1508281 - RNA, 19 nt, Homo sapiens
ccacauauucucuucaaug

SEQ ID NO: 1508282 - RNA, 19 nt, Homo sapiens
ggagaugaacaaugccuuu

SEQ ID NO: 1508283 - RNA, 19 nt, Homo sapiens
caacagcacaugcagucua

SEQ ID NO: 1508284 - RNA, 19 nt, Homo sapiens
agaaagacaccuugcauau

SEQ ID NO: 1508285 - RNA, 19 nt, Homo sapiens
ccucaagcccuaugucuuu

SEQ ID NO: 1508286 - RNA, 19 nt, Homo sapiens
gcucuuaagaugaaacaaa

SEQ ID NO: 1508287 - RNA, 19 nt, Homo sapiens
aaacaugguccgaguagaa

SEQ ID NO: 1508288 - RNA, 19 nt, Homo sapiens
ucaaggaacauuucacaga

SEQ ID NO: 1508289 - RNA, 19 nt, Homo sapiens
ugucuuauguuccaguauu

SEQ ID NO: 1508290 - RNA, 19 nt, Homo sapiens
ggauaucauggauuccuua

SEQ ID NO: 1508291 - RNA, 19 nt, Homo sapiens
gaagacaagagauacaagu

SEQ ID NO: 1508292 - RNA, 19 nt, Homo sapiens
ugaagaucaucaaagagaa

SEQ ID NO: 1508293 - RNA, 19 nt, Homo sapiens
ccuacuaucuaucauggaa

SEQ ID NO: 1508294 - RNA, 19 nt, Homo sapiens
ccuuuccacuugcuaauuu

SEQ ID NO: 1508295 - RNA, 19 nt, Homo sapiens
ggacuggcuuccucagagu

SEQ ID NO: 1508296 - RNA, 19 nt, Homo sapiens
ccacuucauucggcucuuu

SEQ ID NO: 1508297 - RNA, 19 nt, Homo sapiens
gaagaucaucaaagagaau

SEQ ID NO: 1508298 - RNA, 19 nt, Homo sapiens
gcccugugcuugagaguuc

SEQ ID NO: 1508299 - RNA, 19 nt, Homo sapiens
acaaauucauccuuacuag

SEQ ID NO: 1508300 - RNA, 19 nt, Homo sapiens
cauuggcucuuaagaugaa

SEQ ID NO: 1508301 - RNA, 19 nt, Homo sapiens
ccaagcauccgucuguuug

SEQ ID NO: 1508302 - RNA, 19 nt, Homo sapiens
cacaugcagucuacauuug

SEQ ID NO: 1508303 - RNA, 19 nt, Homo sapiens
gaaugagaacuucgacaug

SEQ ID NO: 1508304 - RNA, 19 nt, Homo sapiens
uagaaaggauaucauggau

SEQ ID NO: 1508305 - RNA, 19 nt, Homo sapiens
ucaccaugcuuaaccacaa

SEQ ID NO: 1508306 - RNA, 19 nt, Homo sapiens
gcucaaggcagagacauug

SEQ ID NO: 1508307 - RNA, 19 nt, Homo sapiens
ugacaacaccaucaaggaa

SEQ ID NO: 1508308 - RNA, 19 nt, Homo sapiens
cauggagacuguagguuuc

SEQ ID NO: 1508309 - RNA, 19 nt, Homo sapiens
ugucucaucuucuacugaa

SEQ ID NO: 1508310 - RNA, 19 nt, Homo sapiens
gcgagugcuucuucuagug

SEQ ID NO: 1508311 - RNA, 19 nt, Homo sapiens
aagaaagacaccuugcaua

SEQ ID NO: 1508312 - RNA, 19 nt, Homo sapiens
guucauuaacucugacuuu

SEQ ID NO: 1508313 - RNA, 19 nt, Homo sapiens
gauaucauggauuccuuaa

SEQ ID NO: 1508314 - RNA, 19 nt, Homo sapiens
aaacaaaucauggaagaca

SEQ ID NO: 1508315 - RNA, 19 nt, Homo sapiens
gaccggguuucucagauuc

SEQ ID NO: 1508316 - RNA, 19 nt, Homo sapiens
ggaagugucaguguucuca

SEQ ID NO: 1508317 - RNA, 19 nt, Homo sapiens
guuccuugcugacugauca

SEQ ID NO: 1508318 - RNA, 19 nt, Homo sapiens
gccaaaauccugacaauau

SEQ ID NO: 1508319 - RNA, 19 nt, Homo sapiens
ugcuacaaauucauccuua

SEQ ID NO: 1508320 - RNA, 19 nt, Homo sapiens
gaugaacaaugccuuugcu

SEQ ID NO: 1508321 - RNA, 19 nt, Homo sapiens
uaacucugacuuugccuuu

SEQ ID NO: 1508322 - RNA, 19 nt, Homo sapiens
ugacugaucacauggacuu

SEQ ID NO: 1508323 - RNA, 19 nt, Homo sapiens
acuguagguuuccagauuu

SEQ ID NO: 1508324 - RNA, 19 nt, Homo sapiens
gcauauucuuucaguuucu

SEQ ID NO: 1508325 - RNA, 19 nt, Homo sapiens
aaauccaccuuccuucuca

SEQ ID NO: 1508326 - RNA, 19 nt, Homo sapiens
ucauggaagacaagagaua

SEQ ID NO: 1508327 - RNA, 19 nt, Homo sapiens
gguggaagccauuaucuac

SEQ ID NO: 1508328 - RNA, 19 nt, Homo sapiens
gcagcgagugcuucuucua

SEQ ID NO: 1508329 - RNA, 19 nt, Homo sapiens
acucugacuuugccuuuga

SEQ ID NO: 1508330 - RNA, 19 nt, Homo sapiens
uagaauacuuggcguugca

SEQ ID NO: 1508331 - RNA, 19 nt, Homo sapiens
caccaugcuuaaccacaaa

SEQ ID NO: 1508332 - RNA, 19 nt, Homo sapiens
ucucuucaaugcucaggaa

SEQ ID NO: 1508333 - RNA, 19 nt, Homo sapiens
gcugugauucugucucuga

SEQ ID NO: 1508334 - RNA, 19 nt, Homo sapiens
aaaucauccuuuccacuug

SEQ ID NO: 1508335 - RNA, 19 nt, Homo sapiens
ugguguuucuauucaguua

SEQ ID NO: 1508336 - RNA, 19 nt, Homo sapiens
uggaagccauuaucuacug

SEQ ID NO: 1508337 - RNA, 19 nt, Homo sapiens
uaaagaaugagaacuucga

SEQ ID NO: 1508338 - RNA, 19 nt, Homo sapiens
cugaagaucaucaaagaga

SEQ ID NO: 1508339 - RNA, 19 nt, Homo sapiens
gggcagcgagugcuucuuc

SEQ ID NO: 1508340 - RNA, 19 nt, Homo sapiens
gauauggaagugucagugu

SEQ ID NO: 1508341 - RNA, 19 nt, Homo sapiens
gcaccugaagaucaucaaa

SEQ ID NO: 1508342 - RNA, 19 nt, Homo sapiens
aaucacacccugacucuuc

SEQ ID NO: 1508343 - RNA, 19 nt, Homo sapiens
gcuacaaauucauccuuac

SEQ ID NO: 1508344 - RNA, 19 nt, Homo sapiens
cuaguuaucuccuguuuuc

SEQ ID NO: 1508345 - RNA, 19 nt, Homo sapiens
gggacucuauggcuuugug

SEQ ID NO: 1508346 - RNA, 19 nt, Homo sapiens
gagaugaacaaugccuuug

SEQ ID NO: 1508347 - RNA, 19 nt, Homo sapiens
uuaaaccaguaccacaaga

SEQ ID NO: 1508348 - RNA, 19 nt, Homo sapiens
caucaaggaacauuucaca

SEQ ID NO: 1508349 - RNA, 19 nt, Homo sapiens
ugaaagcagaguugugguu

SEQ ID NO: 1508350 - RNA, 19 nt, Homo sapiens
gaucacggucauaauguca

SEQ ID NO: 1508351 - RNA, 19 nt, Homo sapiens
gaagagauguguagaauuu

SEQ ID NO: 1508352 - RNA, 19 nt, Homo sapiens
gaacuaagguagaagaaua

SEQ ID NO: 1508353 - RNA, 19 nt, Homo sapiens
gaacacagcugcagagaga

SEQ ID NO: 1508354 - RNA, 19 nt, Homo sapiens
gagcagugauggugauuua

SEQ ID NO: 1508355 - RNA, 19 nt, Homo sapiens
caagucaguuguucauuua

SEQ ID NO: 1508356 - RNA, 19 nt, Homo sapiens
cauaaacacuucuguacua

SEQ ID NO: 1508357 - RNA, 19 nt, Homo sapiens
ggaaagggucuaauucaua

SEQ ID NO: 1508358 - RNA, 19 nt, Homo sapiens
aaagauaacuggccucuau

SEQ ID NO: 1508359 - RNA, 19 nt, Homo sapiens
gaacgaagauacucaaugc

SEQ ID NO: 1508360 - RNA, 19 nt, Homo sapiens
ucacugcagucaugaaaua

SEQ ID NO: 1508361 - RNA, 19 nt, Homo sapiens
gagagaaauucagcuguua

SEQ ID NO: 1508362 - RNA, 19 nt, Homo sapiens
gaguuugacuugaauguaa

SEQ ID NO: 1508363 - RNA, 19 nt, Homo sapiens
acaauugccuuaagucuuu

SEQ ID NO: 1508364 - RNA, 19 nt, Homo sapiens
gaaagggucuaauucauac

SEQ ID NO: 1508365 - RNA, 19 nt, Homo sapiens
gucaaagucuguucuagua

SEQ ID NO: 1508366 - RNA, 19 nt, Homo sapiens
gcagaaauuugauaugauc

SEQ ID NO: 1508367 - RNA, 19 nt, Homo sapiens
gcuuauagaugcacaauuc

SEQ ID NO: 1508368 - RNA, 19 nt, Homo sapiens
caaagucuguucuaguaaa

SEQ ID NO: 1508369 - RNA, 19 nt, Homo sapiens
cauguaauguuccuccuua

SEQ ID NO: 1508370 - RNA, 19 nt, Homo sapiens
ucaaaucacugcagucaug

SEQ ID NO: 1508371 - RNA, 19 nt, Homo sapiens
ucaagucaguuguucauuu

SEQ ID NO: 1508372 - RNA, 19 nt, Homo sapiens
gcaagucaccaucagauaa

SEQ ID NO: 1508373 - RNA, 19 nt, Homo sapiens
ggaguuauuugaaacaugu

SEQ ID NO: 1508374 - RNA, 19 nt, Homo sapiens
uuacugggcuuucuuaaau

SEQ ID NO: 1508375 - RNA, 19 nt, Homo sapiens
gcaaugugcacuucuguuu

SEQ ID NO: 1508376 - RNA, 19 nt, Homo sapiens
gaacuuaugcauaccuuga

SEQ ID NO: 1508377 - RNA, 19 nt, Homo sapiens
uaacuggccucuauuucuu

SEQ ID NO: 1508378 - RNA, 19 nt, Homo sapiens
caagagagauuugaacagu

SEQ ID NO: 1508379 - RNA, 19 nt, Homo sapiens
gucuagagcugugucauua

SEQ ID NO: 1508380 - RNA, 19 nt, Homo sapiens
caacagaaacugagaucaa

SEQ ID NO: 1508381 - RNA, 19 nt, Homo sapiens
gcuauagucuuguauugau

SEQ ID NO: 1508382 - RNA, 19 nt, Homo sapiens
gaccucagcuuccccauua

SEQ ID NO: 1508383 - RNA, 19 nt, Homo sapiens
cuacagaauuugacuggaa

SEQ ID NO: 1508384 - RNA, 19 nt, Homo sapiens
uuaagcagcuauagucuug

SEQ ID NO: 1508385 - RNA, 19 nt, Homo sapiens
ggaaaugucaguccaauac

SEQ ID NO: 1508386 - RNA, 19 nt, Homo sapiens
ggcaguaagucaccacaaa

SEQ ID NO: 1508387 - RNA, 19 nt, Homo sapiens
aagaauacauguucacuuc

SEQ ID NO: 1508388 - RNA, 19 nt, Homo sapiens
gugaagaacuaagguagaa

SEQ ID NO: 1508389 - RNA, 19 nt, Homo sapiens
gauuauauccuguuuguag

SEQ ID NO: 1508390 - RNA, 19 nt, Homo sapiens
ucagauguguuccaccuuu

SEQ ID NO: 1508391 - RNA, 19 nt, Homo sapiens
uaaguugagucagcagaua

SEQ ID NO: 1508392 - RNA, 19 nt, Homo sapiens
gaagaacuaagguagaaga

SEQ ID NO: 1508393 - RNA, 19 nt, Homo sapiens
ugaguaauauugcaugugu

SEQ ID NO: 1508394 - RNA, 19 nt, Homo sapiens
uaaagaaucaguucagugu

SEQ ID NO: 1508395 - RNA, 19 nt, Homo sapiens
agagagauuugaacaguau

SEQ ID NO: 1508396 - RNA, 19 nt, Homo sapiens
ucucagaacuuaugcauac

SEQ ID NO: 1508397 - RNA, 19 nt, Homo sapiens
gaaagaacucugucgaaca

SEQ ID NO: 1508398 - RNA, 19 nt, Homo sapiens
gcagauacuggaguuauuu

SEQ ID NO: 1508399 - RNA, 19 nt, Homo sapiens
aaaucgaguucguccguua

SEQ ID NO: 1508400 - RNA, 19 nt, Homo sapiens
gagaaauucagcuguuauu

SEQ ID NO: 1508401 - RNA, 19 nt, Homo sapiens
ucaguucaguguagacauu

SEQ ID NO: 1508402 - RNA, 19 nt, Homo sapiens
cagcuauagucuuguauug

SEQ ID NO: 1508403 - RNA, 19 nt, Homo sapiens
aaaggguggugaagaacua

SEQ ID NO: 1508404 - RNA, 19 nt, Homo sapiens
gaauacauguucacuucca

SEQ ID NO: 1508405 - RNA, 19 nt, Homo sapiens
cguuagugcuggugauuaa

SEQ ID NO: 1508406 - RNA, 19 nt, Homo sapiens
agaaagcuacgaccaagua

SEQ ID NO: 1508407 - RNA, 19 nt, Homo sapiens
agagagaaauucagcuguu

SEQ ID NO: 1508408 - RNA, 19 nt, Homo sapiens
ccaaaucaucaacaacaua

SEQ ID NO: 1508409 - RNA, 19 nt, Homo sapiens
gaagaauacauguucacuu

SEQ ID NO: 1508410 - RNA, 19 nt, Homo sapiens
caagucaccaucagauaaa

SEQ ID NO: 1508411 - RNA, 19 nt, Homo sapiens
ucaguuguguggaguuuga

SEQ ID NO: 1508412 - RNA, 19 nt, Homo sapiens
gauuuaugccuaguuguua

SEQ ID NO: 1508413 - RNA, 19 nt, Homo sapiens
ggugauuuaugccuaguug

SEQ ID NO: 1508414 - RNA, 19 nt, Homo sapiens
ccaaagauaaguugaguca

SEQ ID NO: 1508415 - RNA, 19 nt, Homo sapiens
guagaagaauacauguuca

SEQ ID NO: 1508416 - RNA, 19 nt, Homo sapiens
gauguacucuugagauugc

SEQ ID NO: 1508417 - RNA, 19 nt, Homo sapiens
gguagaagaauacauguuc

SEQ ID NO: 1508418 - RNA, 19 nt, Homo sapiens
gaacaauugccuuaagucu

SEQ ID NO: 1508419 - RNA, 19 nt, Homo sapiens
gauauagucagauguguuc

SEQ ID NO: 1508420 - RNA, 19 nt, Homo sapiens
caagcuccauguaauguuc

SEQ ID NO: 1508421 - RNA, 19 nt, Homo sapiens
gggauaaagucaguugugu

SEQ ID NO: 1508422 - RNA, 19 nt, Homo sapiens
uaagguagaagaauacaug

SEQ ID NO: 1508423 - RNA, 19 nt, Homo sapiens
ggaagagauuaagcgauga

SEQ ID NO: 1508424 - RNA, 19 nt, Homo sapiens
cuccuuaccucucaaagaa

SEQ ID NO: 1508425 - RNA, 19 nt, Homo sapiens
gagcaaaagugccaauugu

SEQ ID NO: 1508426 - RNA, 19 nt, Homo sapiens
gcagugauggugauuuaug

SEQ ID NO: 1508427 - RNA, 19 nt, Homo sapiens
gaagagauuaagcgaugaa

SEQ ID NO: 1508428 - RNA, 19 nt, Homo sapiens
gggauagacugaggcuuug

SEQ ID NO: 1508429 - RNA, 19 nt, Homo sapiens
acaagagcauguucccaaa

SEQ ID NO: 1508430 - RNA, 19 nt, Homo sapiens
aaauuuacccagagucuuu

SEQ ID NO: 1508431 - RNA, 19 nt, Homo sapiens
aagcagcuauagucuugua

SEQ ID NO: 1508432 - RNA, 19 nt, Homo sapiens
cagcuguuauuuccacaaa

SEQ ID NO: 1508433 - RNA, 19 nt, Homo sapiens
gcacaauucaacuuucaga

SEQ ID NO: 1508434 - RNA, 19 nt, Homo sapiens
aacagaaacugagaucaaa

SEQ ID NO: 1508435 - RNA, 19 nt, Homo sapiens
gauuguuuccugugcuuua

SEQ ID NO: 1508436 - RNA, 19 nt, Homo sapiens
uacguuagauaguuuguug

SEQ ID NO: 1508437 - RNA, 19 nt, Homo sapiens
auacucaccuuaguccaua

SEQ ID NO: 1508438 - RNA, 19 nt, Homo sapiens
gaugaguaauauugcaugu

SEQ ID NO: 1508439 - RNA, 19 nt, Homo sapiens
gaugaugaguaauauugca

SEQ ID NO: 1508440 - RNA, 19 nt, Homo sapiens
cuauacagcugcaccuugu

SEQ ID NO: 1508441 - RNA, 19 nt, Homo sapiens
cgaggaaggaagagauuaa

SEQ ID NO: 1508442 - RNA, 19 nt, Homo sapiens
aagaaucaguucaguguag

SEQ ID NO: 1508443 - RNA, 19 nt, Homo sapiens
gaagcaaaacgaaaucuuu

SEQ ID NO: 1508444 - RNA, 19 nt, Homo sapiens
aagagagauuugaacagua

SEQ ID NO: 1508445 - RNA, 19 nt, Homo sapiens
aaacaugucagcagcaaau

SEQ ID NO: 1508446 - RNA, 19 nt, Homo sapiens
gcucgggccuuagaacuuc

SEQ ID NO: 1508447 - RNA, 19 nt, Homo sapiens
ugacaugaagcaacagaaa

SEQ ID NO: 1508448 - RNA, 19 nt, Homo sapiens
ggaguuugacuugaaugua

SEQ ID NO: 1508449 - RNA, 19 nt, Homo sapiens
uaccagauauagucagaug

SEQ ID NO: 1508450 - RNA, 19 nt, Homo sapiens
ggccaccacuaccuccuuu

SEQ ID NO: 1508451 - RNA, 19 nt, Homo sapiens
gaaauugccuugucauaga

SEQ ID NO: 1508452 - RNA, 19 nt, Homo sapiens
ucagagaccuguugaauuu

SEQ ID NO: 1508453 - RNA, 19 nt, Homo sapiens
ggaaauuucuucuguauuc

SEQ ID NO: 1508454 - RNA, 19 nt, Homo sapiens
gauaagagacuuugcuaaa

SEQ ID NO: 1508455 - RNA, 19 nt, Homo sapiens
gcagaacacaccaggauua

SEQ ID NO: 1508456 - RNA, 19 nt, Homo sapiens
ggaaagaaucaaaguauga

SEQ ID NO: 1508457 - RNA, 19 nt, Homo sapiens
cauuacaggugaucuauuu

SEQ ID NO: 1508458 - RNA, 19 nt, Homo sapiens
ugaaaugucugaccuuuua

SEQ ID NO: 1508459 - RNA, 19 nt, Homo sapiens
gaagagaaauucggaacau

SEQ ID NO: 1508460 - RNA, 19 nt, Homo sapiens
gauagcagcacauguauug

SEQ ID NO: 1508461 - RNA, 19 nt, Homo sapiens
cagcagaauucuuugauga

SEQ ID NO: 1508462 - RNA, 19 nt, Homo sapiens
ggaaacuucaggauaauuu

SEQ ID NO: 1508463 - RNA, 19 nt, Homo sapiens
cacggaaacuucaggauaa

SEQ ID NO: 1508464 - RNA, 19 nt, Homo sapiens
caacauauggugcaauuau

SEQ ID NO: 1508465 - RNA, 19 nt, Homo sapiens
agaagaagcuccucaugau

SEQ ID NO: 1508466 - RNA, 19 nt, Homo sapiens
ggaaagagacaaugcaauc

SEQ ID NO: 1508467 - RNA, 19 nt, Homo sapiens
guacuucucucugcuucua

SEQ ID NO: 1508468 - RNA, 19 nt, Homo sapiens
cagcaaagcagcagaauuc

SEQ ID NO: 1508469 - RNA, 19 nt, Homo sapiens
gaaacuucauccacggaaa

SEQ ID NO: 1508470 - RNA, 19 nt, Homo sapiens
gagaaauugccuugucaua

SEQ ID NO: 1508471 - RNA, 19 nt, Homo sapiens
uugagcagcuucuggaaua

SEQ ID NO: 1508472 - RNA, 19 nt, Homo sapiens
gggcauuuauucuguguga

SEQ ID NO: 1508473 - RNA, 19 nt, Homo sapiens
ggacuggcuuucucgaaga

SEQ ID NO: 1508474 - RNA, 19 nt, Homo sapiens
gaagaagcuccucaugauu

SEQ ID NO: 1508475 - RNA, 19 nt, Homo sapiens
cacaagagcugagauguca

SEQ ID NO: 1508476 - RNA, 19 nt, Homo sapiens
gaacacaagagcugagaug

SEQ ID NO: 1508477 - RNA, 19 nt, Homo sapiens
ccacggaaacuucaggaua

SEQ ID NO: 1508478 - RNA, 19 nt, Homo sapiens
uaaagcauuucacuagguu

SEQ ID NO: 1508479 - RNA, 19 nt, Homo sapiens
ccaguuguguaaauaugua

SEQ ID NO: 1508480 - RNA, 19 nt, Homo sapiens
gaggcaauguuucugaaga

SEQ ID NO: 1508481 - RNA, 19 nt, Homo sapiens
gaccauaaugcuauaauga

SEQ ID NO: 1508482 - RNA, 19 nt, Homo sapiens
gcagcagaauucuuugaug

SEQ ID NO: 1508483 - RNA, 19 nt, Homo sapiens
aaagcugucuucagucauu

SEQ ID NO: 1508484 - RNA, 19 nt, Homo sapiens
uuacuuggauuucuacaug

SEQ ID NO: 1508485 - RNA, 19 nt, Homo sapiens
agauugaacuugcccauug

SEQ ID NO: 1508486 - RNA, 19 nt, Homo sapiens
guggaaauuucuucuguau

SEQ ID NO: 1508487 - RNA, 19 nt, Homo sapiens
cagcacauguauuguaaau

SEQ ID NO: 1508488 - RNA, 19 nt, Homo sapiens
gugcaauuauucuugauga

SEQ ID NO: 1508489 - RNA, 19 nt, Homo sapiens
cuaaagcugucuucaguca

SEQ ID NO: 1508490 - RNA, 19 nt, Homo sapiens
gaucucugcagccgauuua

SEQ ID NO: 1508491 - RNA, 19 nt, Homo sapiens
gaucagagaccuguugaau

SEQ ID NO: 1508492 - RNA, 19 nt, Homo sapiens
gagaaauucggaacauuga

SEQ ID NO: 1508493 - RNA, 19 nt, Homo sapiens
ccacugaggcucucuaauc

SEQ ID NO: 1508494 - RNA, 19 nt, Homo sapiens
gaagaccaguugcuagaac

SEQ ID NO: 1508495 - RNA, 19 nt, Homo sapiens
gcagaauucuuugaugaag

SEQ ID NO: 1508496 - RNA, 19 nt, Homo sapiens
acacgaguuugcacuguaa

SEQ ID NO: 1508497 - RNA, 19 nt, Homo sapiens
gagccgggaugcacuguuc

SEQ ID NO: 1508498 - RNA, 19 nt, Homo sapiens
ggacagcccguggcaugua

SEQ ID NO: 1508499 - RNA, 19 nt, Homo sapiens
ggugucuccucaagccuua

SEQ ID NO: 1508500 - RNA, 19 nt, Homo sapiens
gacagcccguggcauguaa

SEQ ID NO: 1508501 - RNA, 19 nt, Homo sapiens
guaucaagauucaccuaau

SEQ ID NO: 1508502 - RNA, 19 nt, Homo sapiens
gcaauuauucuugaugaga

SEQ ID NO: 1508503 - RNA, 19 nt, Homo sapiens
ucaaguagccaaguuaaug

SEQ ID NO: 1508504 - RNA, 19 nt, Homo sapiens
ggacccagcagcuacuuug

SEQ ID NO: 1508505 - RNA, 19 nt, Homo sapiens
guagaaagaaacacgaguu

SEQ ID NO: 1508506 - RNA, 19 nt, Homo sapiens
gggaggcaauguuucugaa

SEQ ID NO: 1508507 - RNA, 19 nt, Homo sapiens
gaugaagugugaaaagaaa

SEQ ID NO: 1508508 - RNA, 19 nt, Homo sapiens
cagcaaaagccauauaaua

SEQ ID NO: 1508509 - RNA, 19 nt, Homo sapiens
ggauaagagacuuugcuaa

SEQ ID NO: 1508510 - RNA, 19 nt, Homo sapiens
gagcagcuucuggaauaua

SEQ ID NO: 1508511 - RNA, 19 nt, Homo sapiens
agagaccuguugaauuuga

SEQ ID NO: 1508512 - RNA, 19 nt, Homo sapiens
uagcagcacauguauugua

SEQ ID NO: 1508513 - RNA, 19 nt, Homo sapiens
gaaauucggaacauugagu

SEQ ID NO: 1508514 - RNA, 19 nt, Homo sapiens
aaaugggaguaccaacaua

SEQ ID NO: 1508515 - RNA, 19 nt, Homo sapiens
guauugaucuuuggaaacu

SEQ ID NO: 1508516 - RNA, 19 nt, Homo sapiens
guauaugacuugccuagcu

SEQ ID NO: 1508517 - RNA, 19 nt, Homo sapiens
gcaaagcagcagaauucuu

SEQ ID NO: 1508518 - RNA, 19 nt, Homo sapiens
cguugcaucuccaguauug

SEQ ID NO: 1508519 - RNA, 19 nt, Homo sapiens
ccucaagccuuaccuuucu

SEQ ID NO: 1508520 - RNA, 19 nt, Homo sapiens
gaacacaccaggauuaccu

SEQ ID NO: 1508521 - RNA, 19 nt, Homo sapiens
uucacuagguuacacguua

SEQ ID NO: 1508522 - RNA, 19 nt, Homo sapiens
uuacccaaguccaaauaaa

SEQ ID NO: 1508523 - RNA, 19 nt, Homo sapiens
caguauugaucuuuggaaa

SEQ ID NO: 1508524 - RNA, 19 nt, Homo sapiens
guauuccaguuguguaaau

SEQ ID NO: 1508525 - RNA, 19 nt, Homo sapiens
ugagacugcuggaggaaau

SEQ ID NO: 1508526 - RNA, 19 nt, Homo sapiens
gggagcugaugcugugauu

SEQ ID NO: 1508527 - RNA, 19 nt, Homo sapiens
agaauucuuugaugaagug

SEQ ID NO: 1508528 - RNA, 19 nt, Homo sapiens
aagaagcuccucaugauug

SEQ ID NO: 1508529 - RNA, 19 nt, Homo sapiens
aagaagaagcuccucauga

SEQ ID NO: 1508530 - RNA, 19 nt, Homo sapiens
gcagagacugacaugcuuu

SEQ ID NO: 1508531 - RNA, 19 nt, Homo sapiens
ugaccauaaugcuauaaug

SEQ ID NO: 1508532 - RNA, 19 nt, Homo sapiens
gggauaagagacuuugcua

SEQ ID NO: 1508533 - RNA, 19 nt, Homo sapiens
ucacuagguuacacguuau

SEQ ID NO: 1508534 - RNA, 19 nt, Homo sapiens
gcagaaaacaguaucaaga

SEQ ID NO: 1508535 - RNA, 19 nt, Homo sapiens
gaacuugcccauugguuuu

SEQ ID NO: 1508536 - RNA, 19 nt, Homo sapiens
gaggggaaauggcagaaaa

SEQ ID NO: 1508537 - RNA, 19 nt, Homo sapiens
gaaagaaucaaaguaugag

SEQ ID NO: 1508538 - RNA, 19 nt, Homo sapiens
ucugaaaugucugaccuuu

SEQ ID NO: 1508539 - RNA, 19 nt, Homo sapiens
aaauugccuugucauagaa

SEQ ID NO: 1508540 - RNA, 19 nt, Homo sapiens
gaggaaagagacaaugcaa

SEQ ID NO: 1508541 - RNA, 19 nt, Homo sapiens
uacuuugggucaugucuuu

SEQ ID NO: 1508542 - RNA, 19 nt, Homo sapiens
ucucgaagauuuggcgauu

SEQ ID NO: 1508543 - RNA, 19 nt, Homo sapiens
gaacucagcgcuucaaaag

SEQ ID NO: 1508544 - RNA, 19 nt, Homo sapiens
cugaggcucucuaaucuuc

SEQ ID NO: 1508545 - RNA, 19 nt, Homo sapiens
uuaaguugcuuucuuugag

SEQ ID NO: 1508546 - RNA, 19 nt, Homo sapiens
ugaacuugcccauugguuu

SEQ ID NO: 1508547 - RNA, 19 nt, Homo sapiens
uuugauagcagcacaugua

SEQ ID NO: 1508548 - RNA, 19 nt, Homo sapiens
gaaaacaguaucaagauuc

SEQ ID NO: 1508549 - RNA, 19 nt, Homo sapiens
agacagugacaauggauuu

SEQ ID NO: 1508550 - RNA, 19 nt, Homo sapiens
agagaaauucggaacauug

SEQ ID NO: 1508551 - RNA, 19 nt, Homo sapiens
cgagacagcucacggcuua

SEQ ID NO: 1508552 - RNA, 19 nt, Homo sapiens
ggaaucgacugcaucauga

SEQ ID NO: 1508553 - RNA, 19 nt, Homo sapiens
gugaaaugcugaacacuuu

SEQ ID NO: 1508554 - RNA, 19 nt, Homo sapiens
caacuugaguggagacauu

SEQ ID NO: 1508555 - RNA, 19 nt, Homo sapiens
ccagaaggcuuauuugcaa

SEQ ID NO: 1508556 - RNA, 19 nt, Homo sapiens
ggaagguucaucuaaauaa

SEQ ID NO: 1508557 - RNA, 19 nt, Homo sapiens
gaggaagguucaucuaaau

SEQ ID NO: 1508558 - RNA, 19 nt, Homo sapiens
gaaagugucccagucauga

SEQ ID NO: 1508559 - RNA, 19 nt, Homo sapiens
gacgaugacugcaguguau

SEQ ID NO: 1508560 - RNA, 19 nt, Homo sapiens
uaacaugugccuaauugua

SEQ ID NO: 1508561 - RNA, 19 nt, Homo sapiens
gaaaugaaggucagagaug

SEQ ID NO: 1508562 - RNA, 19 nt, Homo sapiens
gaaagagaagcaugaaaug

SEQ ID NO: 1508563 - RNA, 19 nt, Homo sapiens
cuagacugcuuguaacuaa

SEQ ID NO: 1508564 - RNA, 19 nt, Homo sapiens
cagaagagcauauucgaaa

SEQ ID NO: 1508565 - RNA, 19 nt, Homo sapiens
agaggaagguucaucuaaa

SEQ ID NO: 1508566 - RNA, 19 nt, Homo sapiens
gcacuagacugcuuguaac

SEQ ID NO: 1508567 - RNA, 19 nt, Homo sapiens
gagggaaggugggaaaugu

SEQ ID NO: 1508568 - RNA, 19 nt, Homo sapiens
uguaacaugugccuaauug

SEQ ID NO: 1508569 - RNA, 19 nt, Homo sapiens
gauuguugcugcuucuaaa

SEQ ID NO: 1508570 - RNA, 19 nt, Homo sapiens
gauaagacacacauccaaa

SEQ ID NO: 1508571 - RNA, 19 nt, Homo sapiens
ggaaacggauaggcuucua

SEQ ID NO: 1508572 - RNA, 19 nt, Homo sapiens
uaacuaaccaagaugauug

SEQ ID NO: 1508573 - RNA, 19 nt, Homo sapiens
uaaagaaagagaccucaaa

SEQ ID NO: 1508574 - RNA, 19 nt, Homo sapiens
ugacugcaguguauaugaa

SEQ ID NO: 1508575 - RNA, 19 nt, Homo sapiens
ccauuaagauccuggacaa

SEQ ID NO: 1508576 - RNA, 19 nt, Homo sapiens
gcuagagccugcaaguuca

SEQ ID NO: 1508577 - RNA, 19 nt, Homo sapiens
gaaauaaccaagggagaga

SEQ ID NO: 1508578 - RNA, 19 nt, Homo sapiens
gcauuuacguggauaucug

SEQ ID NO: 1508579 - RNA, 19 nt, Homo sapiens
ugggaaaugucuugaguga

SEQ ID NO: 1508580 - RNA, 19 nt, Homo sapiens
aaaugaaggucagagauga

SEQ ID NO: 1508581 - RNA, 19 nt, Homo sapiens
ggacgaugacugcagugua

SEQ ID NO: 1508582 - RNA, 19 nt, Homo sapiens
uaagacacacauccaaauu

SEQ ID NO: 1508583 - RNA, 19 nt, Homo sapiens
aagaaaagguggccauuaa

SEQ ID NO: 1508584 - RNA, 19 nt, Homo sapiens
gaaggugggaaaugucuug

SEQ ID NO: 1508585 - RNA, 19 nt, Homo sapiens
uuagaacauuugggcauua

SEQ ID NO: 1508586 - RNA, 19 nt, Homo sapiens
gcacagccaccuaccacaa

SEQ ID NO: 1508587 - RNA, 19 nt, Homo sapiens
ccagcacucucaaggaaga

SEQ ID NO: 1508588 - RNA, 19 nt, Homo sapiens
agaaagagaagcaugaaau

SEQ ID NO: 1508589 - RNA, 19 nt, Homo sapiens
gaaggcuuauuugcaaguu

SEQ ID NO: 1508590 - RNA, 19 nt, Homo sapiens
gaaaccguggccaaacuaa

SEQ ID NO: 1508591 - RNA, 19 nt, Homo sapiens
gcacaugcaugaaaaccaa

SEQ ID NO: 1508592 - RNA, 19 nt, Homo sapiens
gcgcgacaguguagaaagu

SEQ ID NO: 1508593 - RNA, 19 nt, Homo sapiens
ggaaagugucccagucaug

SEQ ID NO: 1508594 - RNA, 19 nt, Homo sapiens
uuacauagaguccaaagga

SEQ ID NO: 1508595 - RNA, 19 nt, Homo sapiens
caacuggaucccaaacauu

SEQ ID NO: 1508596 - RNA, 19 nt, Homo sapiens
aaagcaagcucaucuucuc

SEQ ID NO: 1508597 - RNA, 19 nt, Homo sapiens
cugcucagcucucaggaaa

SEQ ID NO: 1508598 - RNA, 19 nt, Homo sapiens
ggugggaaaugucuugagu

SEQ ID NO: 1508599 - RNA, 19 nt, Homo sapiens
ccaacuggaucccaaacau

SEQ ID NO: 1508600 - RNA, 19 nt, Homo sapiens
cuacaccuuuggaaccuuu

SEQ ID NO: 1508601 - RNA, 19 nt, Homo sapiens
gaaagcaagcucaucuucu

SEQ ID NO: 1508602 - RNA, 19 nt, Homo sapiens
gcuacuaucccgagaaauc

SEQ ID NO: 1508603 - RNA, 19 nt, Homo sapiens
guagaaaguggcugucaga

SEQ ID NO: 1508604 - RNA, 19 nt, Homo sapiens
aagagaagcaugaaaugaa

SEQ ID NO: 1508605 - RNA, 19 nt, Homo sapiens
gacagaaagagaagcauga

SEQ ID NO: 1508606 - RNA, 19 nt, Homo sapiens
guaacuaaccaagaugauu

SEQ ID NO: 1508607 - RNA, 19 nt, Homo sapiens
aaccagcacucucaaggaa

SEQ ID NO: 1508608 - RNA, 19 nt, Homo sapiens
gugaagcacaugcaugaaa

SEQ ID NO: 1508609 - RNA, 19 nt, Homo sapiens
agacacacauccaaauuuu

SEQ ID NO: 1508610 - RNA, 19 nt, Homo sapiens
acaggggucuauagaauua

SEQ ID NO: 1508611 - RNA, 19 nt, Homo sapiens
ucauagagaucugaaagca

SEQ ID NO: 1508612 - RNA, 19 nt, Homo sapiens
gauaggcuucuaccgaauu

SEQ ID NO: 1508613 - RNA, 19 nt, Homo sapiens
ggauaggcuucuaccgaau

SEQ ID NO: 1508614 - RNA, 19 nt, Homo sapiens
caagggaaauagcaaacag

SEQ ID NO: 1508615 - RNA, 19 nt, Homo sapiens
gccauacccuacaccuuug

SEQ ID NO: 1508616 - RNA, 19 nt, Homo sapiens
gauugugucugccgugaag

SEQ ID NO: 1508617 - RNA, 19 nt, Homo sapiens
aaagagaagcaugaaauga

SEQ ID NO: 1508618 - RNA, 19 nt, Homo sapiens
gcuaccagacccuaaagaa

SEQ ID NO: 1508619 - RNA, 19 nt, Homo sapiens
ggugaaaugcugaacacuu

SEQ ID NO: 1508620 - RNA, 19 nt, Homo sapiens
gaaaagguggccauuaaga

SEQ ID NO: 1508621 - RNA, 19 nt, Homo sapiens
gugccuaauuguacagcua

SEQ ID NO: 1508622 - RNA, 19 nt, Homo sapiens
aagauucucuggccaucaa

SEQ ID NO: 1508623 - RNA, 19 nt, Homo sapiens
uguugcugcuucuaaauuu

SEQ ID NO: 1508624 - RNA, 19 nt, Homo sapiens
gugugaaggugggcgauuu

SEQ ID NO: 1508625 - RNA, 19 nt, Homo sapiens
agagaagcaugaaaugaag

SEQ ID NO: 1508626 - RNA, 19 nt, Homo sapiens
agaagagcauauucgaaau

SEQ ID NO: 1508627 - RNA, 19 nt, Homo sapiens
ugccauacccuacaccuuu

SEQ ID NO: 1508628 - RNA, 19 nt, Homo sapiens
cagaaaccguggccaaacu

SEQ ID NO: 1508629 - RNA, 19 nt, Homo sapiens
gaaacugacacaggacaug

SEQ ID NO: 1508630 - RNA, 19 nt, Homo sapiens
cuaccagacccuaaagaaa

SEQ ID NO: 1508631 - RNA, 19 nt, Homo sapiens
gaugcucgcagcucaauca

SEQ ID NO: 1508632 - RNA, 19 nt, Homo sapiens
ccaacaucauccgccuuua

SEQ ID NO: 1508633 - RNA, 19 nt, Homo sapiens
agaccaaguuagaccagaa

SEQ ID NO: 1508634 - RNA, 19 nt, Homo sapiens
caccugcuguccucaguug

SEQ ID NO: 1508635 - RNA, 19 nt, Homo sapiens
gaugcuaccagacccuaaa

SEQ ID NO: 1508636 - RNA, 19 nt, Homo sapiens
uacauagaguccaaaggaa

SEQ ID NO: 1508637 - RNA, 19 nt, Homo sapiens
ccagaaagcaagcucaucu

SEQ ID NO: 1508638 - RNA, 19 nt, Homo sapiens
caucauccgccuuuacgaa

SEQ ID NO: 1508639 - RNA, 19 nt, Homo sapiens
gcugacgcccuucgagaaa

SEQ ID NO: 1508640 - RNA, 19 nt, Homo sapiens
gaaggucagagaugagauc

SEQ ID NO: 1508641 - RNA, 19 nt, Homo sapiens
ucacaggggucuauagaau

SEQ ID NO: 1508642 - RNA, 19 nt, Homo sapiens
gaaagcagaaaauguauuc

SEQ ID NO: 1508643 - RNA, 19 nt, Homo sapiens
ugacauugcagggauuaaa

SEQ ID NO: 1508644 - RNA, 19 nt, Homo sapiens
gugaccagaaggcuuauuu

SEQ ID NO: 1508645 - RNA, 19 nt, Homo sapiens
aagacacacauccaaauuu

SEQ ID NO: 1508646 - RNA, 19 nt, Homo sapiens
ugugugaccagaaggcuua

SEQ ID NO: 1508647 - RNA, 19 nt, Homo sapiens
cccugcagcuugacagaaa

SEQ ID NO: 1508648 - RNA, 19 nt, Homo sapiens
gaacauuugggcauuacag

SEQ ID NO: 1508649 - RNA, 19 nt, Homo sapiens
gaugauuguugcugcuucu

SEQ ID NO: 1508650 - RNA, 19 nt, Homo sapiens
aaauugcacuagacugcuu

SEQ ID NO: 1508651 - RNA, 19 nt, Homo sapiens
ucaaugagcugcagaaauu

SEQ ID NO: 1508652 - RNA, 19 nt, Homo sapiens
gcucauaggucuuuccaua

SEQ ID NO: 1508653 - RNA, 19 nt, Homo sapiens
gaagucaucuccuacuauu

SEQ ID NO: 1508654 - RNA, 19 nt, Homo sapiens
uaacacaacugucauaauc

SEQ ID NO: 1508655 - RNA, 19 nt, Homo sapiens
caacauaacucagacauag

SEQ ID NO: 1508656 - RNA, 19 nt, Homo sapiens
caucagggauccaacauaa

SEQ ID NO: 1508657 - RNA, 19 nt, Homo sapiens
gcaaacauauaucuacaga

SEQ ID NO: 1508658 - RNA, 19 nt, Homo sapiens
gcacaccuuuacugcauua

SEQ ID NO: 1508659 - RNA, 19 nt, Homo sapiens
ucgauaaccugaacuaauu

SEQ ID NO: 1508660 - RNA, 19 nt, Homo sapiens
gaaagcaggacaagaacua

SEQ ID NO: 1508661 - RNA, 19 nt, Homo sapiens
ggacuagaguggaagauuc

SEQ ID NO: 1508662 - RNA, 19 nt, Homo sapiens
cauaagggcugucagucua

SEQ ID NO: 1508663 - RNA, 19 nt, Homo sapiens
ucacuggaaucuucuuuaa

SEQ ID NO: 1508664 - RNA, 19 nt, Homo sapiens
ggaagacuaugcuggaguu

SEQ ID NO: 1508665 - RNA, 19 nt, Homo sapiens
ggaaucuucuuuaaaggaa

SEQ ID NO: 1508666 - RNA, 19 nt, Homo sapiens
gaacguugugucaauguua

SEQ ID NO: 1508667 - RNA, 19 nt, Homo sapiens
gaacauaagcaaccaguag

SEQ ID NO: 1508668 - RNA, 19 nt, Homo sapiens
ucaacucccucuucaauga

SEQ ID NO: 1508669 - RNA, 19 nt, Homo sapiens
ucacgugccuugcuugauu

SEQ ID NO: 1508670 - RNA, 19 nt, Homo sapiens
gacaugagauaguuuaagu

SEQ ID NO: 1508671 - RNA, 19 nt, Homo sapiens
gggaucagaugggacaaua

SEQ ID NO: 1508672 - RNA, 19 nt, Homo sapiens
gggaacaauuagcuacaua

SEQ ID NO: 1508673 - RNA, 19 nt, Homo sapiens
gcccaggacugcaagaauu

SEQ ID NO: 1508674 - RNA, 19 nt, Homo sapiens
gucagaaaguacagauuua

SEQ ID NO: 1508675 - RNA, 19 nt, Homo sapiens
gcaaaucgauaaccugaac

SEQ ID NO: 1508676 - RNA, 19 nt, Homo sapiens
caagaauaguccaauauag

SEQ ID NO: 1508677 - RNA, 19 nt, Homo sapiens
gagcgggacucaccaggaa

SEQ ID NO: 1508678 - RNA, 19 nt, Homo sapiens
ggacauaaccuuggaaucu

SEQ ID NO: 1508679 - RNA, 19 nt, Homo sapiens
ggucagaaaguacagauuu

SEQ ID NO: 1508680 - RNA, 19 nt, Homo sapiens
gcuaagcaauaguuuaugu

SEQ ID NO: 1508681 - RNA, 19 nt, Homo sapiens
cauacacugucaaacuuua

SEQ ID NO: 1508682 - RNA, 19 nt, Homo sapiens
aaaaguagccucacucuua

SEQ ID NO: 1508683 - RNA, 19 nt, Homo sapiens
auaaaugggucagaaagua

SEQ ID NO: 1508684 - RNA, 19 nt, Homo sapiens
gauaagacauugccaucuc

SEQ ID NO: 1508685 - RNA, 19 nt, Homo sapiens
guuauaagcccuuugagaa

SEQ ID NO: 1508686 - RNA, 19 nt, Homo sapiens
ccuggucacucaaauuuaa

SEQ ID NO: 1508687 - RNA, 19 nt, Homo sapiens
gagacgggauuucaucaug

SEQ ID NO: 1508688 - RNA, 19 nt, Homo sapiens
agaauuaggugaaguagca

SEQ ID NO: 1508689 - RNA, 19 nt, Homo sapiens
gaugaucagcugagccuua

SEQ ID NO: 1508690 - RNA, 19 nt, Homo sapiens
gaucaacucccucuucaau

SEQ ID NO: 1508691 - RNA, 19 nt, Homo sapiens
gauaguuccuggucacuca

SEQ ID NO: 1508692 - RNA, 19 nt, Homo sapiens
gacauugccaucucuauuu

SEQ ID NO: 1508693 - RNA, 19 nt, Homo sapiens
uuucagugcugcuuaagua

SEQ ID NO: 1508694 - RNA, 19 nt, Homo sapiens
gaagauucccuauuuaaac

SEQ ID NO: 1508695 - RNA, 19 nt, Homo sapiens
ggaacaauuagcuacauaa

SEQ ID NO: 1508696 - RNA, 19 nt, Homo sapiens
acauugccaucucuauuua

SEQ ID NO: 1508697 - RNA, 19 nt, Homo sapiens
ccaaggaauucauuaugga

SEQ ID NO: 1508698 - RNA, 19 nt, Homo sapiens
caacauacacugucaaacu

SEQ ID NO: 1508699 - RNA, 19 nt, Homo sapiens
gaugggacaauaucaaauu

SEQ ID NO: 1508700 - RNA, 19 nt, Homo sapiens
gacaaugacuuccucaaac

SEQ ID NO: 1508701 - RNA, 19 nt, Homo sapiens
uuccauaucuguaacauga

SEQ ID NO: 1508702 - RNA, 19 nt, Homo sapiens
aaaguagccucacucuuau

SEQ ID NO: 1508703 - RNA, 19 nt, Homo sapiens
gcccuggacuggaucauga

SEQ ID NO: 1508704 - RNA, 19 nt, Homo sapiens
uuacacaguuccagaguau

SEQ ID NO: 1508705 - RNA, 19 nt, Homo sapiens
uagcagccuuugacaauga

SEQ ID NO: 1508706 - RNA, 19 nt, Homo sapiens
uuaagucacuggaaucuuc

SEQ ID NO: 1508707 - RNA, 19 nt, Homo sapiens
gacaagaacuacgguuuua

SEQ ID NO: 1508708 - RNA, 19 nt, Homo sapiens
caggaaagcaggacaagaa

SEQ ID NO: 1508709 - RNA, 19 nt, Homo sapiens
ccauuacucuuuacauugu

SEQ ID NO: 1508710 - RNA, 19 nt, Homo sapiens
acauauaucuacagagaga

SEQ ID NO: 1508711 - RNA, 19 nt, Homo sapiens
uaggugaaguagcaugaua

SEQ ID NO: 1508712 - RNA, 19 nt, Homo sapiens
gaacuacgguuuuacaaag

SEQ ID NO: 1508713 - RNA, 19 nt, Homo sapiens
uagcucaaauguaguauca

SEQ ID NO: 1508714 - RNA, 19 nt, Homo sapiens
guaauccagugcaucaaug

SEQ ID NO: 1508715 - RNA, 19 nt, Homo sapiens
agagcaaacugucacuaaa

SEQ ID NO: 1508716 - RNA, 19 nt, Homo sapiens
ccauaucuguaacaugaaa

SEQ ID NO: 1508717 - RNA, 19 nt, Homo sapiens
cuagauacacugcaaacua

SEQ ID NO: 1508718 - RNA, 19 nt, Homo sapiens
ugacucagaucugcaguga

SEQ ID NO: 1508719 - RNA, 19 nt, Homo sapiens
gaauggcccugaggcaguu

SEQ ID NO: 1508720 - RNA, 19 nt, Homo sapiens
agacuaugcuggaguuuca

SEQ ID NO: 1508721 - RNA, 19 nt, Homo sapiens
aaucuuugcuggucccuuu

SEQ ID NO: 1508722 - RNA, 19 nt, Homo sapiens
gggacaauaucaaauuuac

SEQ ID NO: 1508723 - RNA, 19 nt, Homo sapiens
uacuguaacugaucaugua

SEQ ID NO: 1508724 - RNA, 19 nt, Homo sapiens
gaggccagauuaacauuag

SEQ ID NO: 1508725 - RNA, 19 nt, Homo sapiens
caaacugucacuaaacuug

SEQ ID NO: 1508726 - RNA, 19 nt, Homo sapiens
caauuucagcugagacaua

SEQ ID NO: 1508727 - RNA, 19 nt, Homo sapiens
aaacugcacccauucugua

SEQ ID NO: 1508728 - RNA, 19 nt, Homo sapiens
caaacugacaccaucuuaa

SEQ ID NO: 1508729 - RNA, 19 nt, Homo sapiens
guuuauguccuacuagaua

SEQ ID NO: 1508730 - RNA, 19 nt, Homo sapiens
gaacagcagccagaauuag

SEQ ID NO: 1508731 - RNA, 19 nt, Homo sapiens
agucguaccucuaauguuc

SEQ ID NO: 1508732 - RNA, 19 nt, Homo sapiens
gcacccauucuguaaauug

SEQ ID NO: 1508733 - RNA, 19 nt, Homo sapiens
aaacuacuguaacugauca

SEQ ID NO: 1508734 - RNA, 19 nt, Homo sapiens
guacaaagguaaccaucac

SEQ ID NO: 1508735 - RNA, 19 nt, Homo sapiens
aaaggaaggauaagacauu

SEQ ID NO: 1508736 - RNA, 19 nt, Homo sapiens
ggacaucccaccaucaaag

SEQ ID NO: 1508737 - RNA, 19 nt, Homo sapiens
caugauagcaguguuuaaa

SEQ ID NO: 1508738 - RNA, 19 nt, Homo sapiens
ucaguauucucuagaugaa

SEQ ID NO: 1508739 - RNA, 19 nt, Homo sapiens
ggaagucaucuccuacuau

SEQ ID NO: 1508740 - RNA, 19 nt, Homo sapiens
aauaaagucguaccucuaa

SEQ ID NO: 1508741 - RNA, 19 nt, Homo sapiens
aaagaggguugaagagcaa

SEQ ID NO: 1508742 - RNA, 19 nt, Homo sapiens
gcugucagucuaucauaua

SEQ ID NO: 1508743 - RNA, 19 nt, Homo sapiens
ugacaaugacuuccucaaa

SEQ ID NO: 1508744 - RNA, 19 nt, Homo sapiens
acaaugaggcuaaauguca

SEQ ID NO: 1508745 - RNA, 19 nt, Homo sapiens
ucauaggucuuuccauauc

SEQ ID NO: 1508746 - RNA, 19 nt, Homo sapiens
uaaaugcucauaggucuuu

SEQ ID NO: 1508747 - RNA, 19 nt, Homo sapiens
gcuugcauuugauuaguuu

SEQ ID NO: 1508748 - RNA, 19 nt, Homo sapiens
gagagucguaggacccuua

SEQ ID NO: 1508749 - RNA, 19 nt, Homo sapiens
caccuuagaugaugcagau

SEQ ID NO: 1508750 - RNA, 19 nt, Homo sapiens
uauggaaaguguucaggaa

SEQ ID NO: 1508751 - RNA, 19 nt, Homo sapiens
ccacaaagaugcccuauaa

SEQ ID NO: 1508752 - RNA, 19 nt, Homo sapiens
gcacagagaugagaguuug

SEQ ID NO: 1508753 - RNA, 19 nt, Homo sapiens
guaccaaucucuacaaaug

SEQ ID NO: 1508754 - RNA, 19 nt, Homo sapiens
gagcauaagugugggauuu

SEQ ID NO: 1508755 - RNA, 19 nt, Homo sapiens
gaugagaguuugaaagaau

SEQ ID NO: 1508756 - RNA, 19 nt, Homo sapiens
ggaagagcaugcccacaaa

SEQ ID NO: 1508757 - RNA, 19 nt, Homo sapiens
gagcagggauguagguaau

SEQ ID NO: 1508758 - RNA, 19 nt, Homo sapiens
gagaugagaguuugaaaga

SEQ ID NO: 1508759 - RNA, 19 nt, Homo sapiens
uaaccacccugcagaagaa

SEQ ID NO: 1508760 - RNA, 19 nt, Homo sapiens
guaucuaaguggacaguuu

SEQ ID NO: 1508761 - RNA, 19 nt, Homo sapiens
ggaugugcauuucgacuug

SEQ ID NO: 1508762 - RNA, 19 nt, Homo sapiens
gaaaugaagaugaucaaag

SEQ ID NO: 1508763 - RNA, 19 nt, Homo sapiens
uaaguucccugcaaucugu

SEQ ID NO: 1508764 - RNA, 19 nt, Homo sapiens
ccagauaucuaauuguaag

SEQ ID NO: 1508765 - RNA, 19 nt, Homo sapiens
caacgugggcuuccaauuc

SEQ ID NO: 1508766 - RNA, 19 nt, Homo sapiens
gagcagggaucagguaaag

SEQ ID NO: 1508767 - RNA, 19 nt, Homo sapiens
ggauguagguaauggaaag

SEQ ID NO: 1508768 - RNA, 19 nt, Homo sapiens
cgaggcaguucaaauauag

SEQ ID NO: 1508769 - RNA, 19 nt, Homo sapiens
gcagggaucagguaaagga

SEQ ID NO: 1508770 - RNA, 19 nt, Homo sapiens
cauaugcaauacaugguaa

SEQ ID NO: 1508771 - RNA, 19 nt, Homo sapiens
ugaguauucuuccagauau

SEQ ID NO: 1508772 - RNA, 19 nt, Homo sapiens
gcaguucaaauauagcuuu

SEQ ID NO: 1508773 - RNA, 19 nt, Homo sapiens
gcgacaagaccuuccagua

SEQ ID NO: 1508774 - RNA, 19 nt, Homo sapiens
agaaggaaaugaagaugau

SEQ ID NO: 1508775 - RNA, 19 nt, Homo sapiens
cgacuuggcugugaagaag

SEQ ID NO: 1508776 - RNA, 19 nt, Homo sapiens
gaggaucuguccaccaagu

SEQ ID NO: 1508777 - RNA, 19 nt, Homo sapiens
gcgaggagaccaagcagaa

SEQ ID NO: 1508778 - RNA, 19 nt, Homo sapiens
aaguaugacucucagauga

SEQ ID NO: 1508779 - RNA, 19 nt, Homo sapiens
caaccucccuuugcuguuc

SEQ ID NO: 1508780 - RNA, 19 nt, Homo sapiens
gagcaugcccacaaagaug

SEQ ID NO: 1508781 - RNA, 19 nt, Homo sapiens
gaucaaagacgaggaugug

SEQ ID NO: 1508782 - RNA, 19 nt, Homo sapiens
gugaguauucuuccagaua

SEQ ID NO: 1508783 - RNA, 19 nt, Homo sapiens
acgaggcaguucaaauaua

SEQ ID NO: 1508784 - RNA, 19 nt, Homo sapiens
aagaauuacuggagaggaa

SEQ ID NO: 1508785 - RNA, 19 nt, Homo sapiens
ccgaggaucuguccaccaa

SEQ ID NO: 1508786 - RNA, 19 nt, Homo sapiens
cuacaaauggcuuagacua

SEQ ID NO: 1508787 - RNA, 19 nt, Homo sapiens
gaaccugacacgccacaug

SEQ ID NO: 1508788 - RNA, 19 nt, Homo sapiens
gcauaagugugggauuugu

SEQ ID NO: 1508789 - RNA, 19 nt, Homo sapiens
uaaaugagcagggauguag

SEQ ID NO: 1508790 - RNA, 19 nt, Homo sapiens
guucaaauauagcuuucug

SEQ ID NO: 1508791 - RNA, 19 nt, Homo sapiens
ggaaaugaagaugaucaaa

SEQ ID NO: 1508792 - RNA, 19 nt, Homo sapiens
gcaauacaugguaaauuuc

SEQ ID NO: 1508793 - RNA, 19 nt, Homo sapiens
gcagggauguagguaaugg

SEQ ID NO: 1508794 - RNA, 19 nt, Homo sapiens
ccuguucucuuucuuaagu

SEQ ID NO: 1508795 - RNA, 19 nt, Homo sapiens
cgacaagaccuuccaguac

SEQ ID NO: 1508796 - RNA, 19 nt, Homo sapiens
ccuuugaccucucucagaa

SEQ ID NO: 1508797 - RNA, 19 nt, Homo sapiens
acucugacgugaagccuuu

SEQ ID NO: 1508798 - RNA, 19 nt, Homo sapiens
cagcucagccaccugcaua

SEQ ID NO: 1508799 - RNA, 19 nt, Homo sapiens
gcauugccaguauaauaaa

SEQ ID NO: 1508800 - RNA, 19 nt, Homo sapiens
ugucaccucugcuacaaga

SEQ ID NO: 1508801 - RNA, 19 nt, Homo sapiens
caaagaugcccuauaacca

SEQ ID NO: 1508802 - RNA, 19 nt, Homo sapiens
cgaauaguaccaaucucua

SEQ ID NO: 1508803 - RNA, 19 nt, Homo sapiens
cagaaggaaaugaagauga

SEQ ID NO: 1508804 - RNA, 19 nt, Homo sapiens
ccugcgaguucuuuaaguu

SEQ ID NO: 1508805 - RNA, 19 nt, Homo sapiens
ggagcagggucuaggaaac

SEQ ID NO: 1508806 - RNA, 19 nt, Homo sapiens
gaaggagcagggucuagga

SEQ ID NO: 1508807 - RNA, 19 nt, Homo sapiens
ccaaggaugcagaaggaaa

SEQ ID NO: 1508808 - RNA, 19 nt, Homo sapiens
gagagcagggaucagguaa

SEQ ID NO: 1508809 - RNA, 19 nt, Homo sapiens
caaguaugacucucagaug

SEQ ID NO: 1508810 - RNA, 19 nt, Homo sapiens
agacgaggaugugcauuuc

SEQ ID NO: 1508811 - RNA, 19 nt, Homo sapiens
ggaugcagaaggaaaugaa

SEQ ID NO: 1508812 - RNA, 19 nt, Homo sapiens
ucaagcaggaacccauuaa

SEQ ID NO: 1508813 - RNA, 19 nt, Homo sapiens
agagaaagagggagagaga

SEQ ID NO: 1508814 - RNA, 19 nt, Homo sapiens
cggaagagcaugcccacaa

SEQ ID NO: 1508815 - RNA, 19 nt, Homo sapiens
ugccaaggaugcagaagga

SEQ ID NO: 1508816 - RNA, 19 nt, Homo sapiens
uaguaccaaucucuacaaa

SEQ ID NO: 1508817 - RNA, 19 nt, Homo sapiens
gaauaguaccaaucucuac

SEQ ID NO: 1508818 - RNA, 19 nt, Homo sapiens
acaagagcuucgugcagaa

SEQ ID NO: 1508819 - RNA, 19 nt, Homo sapiens
guaugacucucagaugauc

SEQ ID NO: 1508820 - RNA, 19 nt, Homo sapiens
caaggaugcagaaggaaau

SEQ ID NO: 1508821 - RNA, 19 nt, Homo sapiens
uugauacccuucacacaug

SEQ ID NO: 1508822 - RNA, 19 nt, Homo sapiens
guaauggaaagccuucuca

SEQ ID NO: 1508823 - RNA, 19 nt, Homo sapiens
agaaagagggagagagaga

SEQ ID NO: 1508824 - RNA, 19 nt, Homo sapiens
gcgaauaguaccaaucucu

SEQ ID NO: 1508825 - RNA, 19 nt, Homo sapiens
ucuggagacuggcgaauag

SEQ ID NO: 1508826 - RNA, 19 nt, Homo sapiens
guuccuguucucuuucuua

SEQ ID NO: 1508827 - RNA, 19 nt, Homo sapiens
gcaacgugggcuuccaauu

SEQ ID NO: 1508828 - RNA, 19 nt, Homo sapiens
ggagagagagagggagaga

SEQ ID NO: 1508829 - RNA, 19 nt, Homo sapiens
ugcauugccaguauaauaa

SEQ ID NO: 1508830 - RNA, 19 nt, Homo sapiens
augcauugccaguauaaua

SEQ ID NO: 1508831 - RNA, 19 nt, Homo sapiens
ccuuucaaaugcaagcuuu

SEQ ID NO: 1508832 - RNA, 19 nt, Homo sapiens
agagagagagggagagaga

SEQ ID NO: 1508833 - RNA, 19 nt, Homo sapiens
ucauaugcaauacauggua

SEQ ID NO: 1508834 - RNA, 19 nt, Homo sapiens
cuucaucaguggcguuuua

SEQ ID NO: 1508835 - RNA, 19 nt, Homo sapiens
aagaggaggauaacugcua

SEQ ID NO: 1508836 - RNA, 19 nt, Homo sapiens
uugcagaaccacaugauga

SEQ ID NO: 1508837 - RNA, 19 nt, Homo sapiens
ccaaguaugacucucagau

SEQ ID NO: 1508838 - RNA, 19 nt, Homo sapiens
ccacucagaggagaacaaa

SEQ ID NO: 1508839 - RNA, 19 nt, Homo sapiens
ccugcaaucuguacacaag

SEQ ID NO: 1508840 - RNA, 19 nt, Homo sapiens
gcagaaggaaaugaagaug

SEQ ID NO: 1508841 - RNA, 19 nt, Homo sapiens
uuuaugcauugccaguaua

SEQ ID NO: 1508842 - RNA, 19 nt, Homo sapiens
cucaggagcuggaaaauug

SEQ ID NO: 1508843 - RNA, 19 nt, Homo sapiens
ccaccugcauacccacaug

SEQ ID NO: 1508844 - RNA, 19 nt, Homo sapiens
gaagagcaugcccacaaag

SEQ ID NO: 1508845 - RNA, 19 nt, Homo sapiens
gaaaggcuccccaaagaca

SEQ ID NO: 1508846 - RNA, 19 nt, Homo sapiens
aagacgaggaugugcauuu

SEQ ID NO: 1508847 - RNA, 19 nt, Homo sapiens
caccugaagcgccacauga

SEQ ID NO: 1508848 - RNA, 19 nt, Homo sapiens
caaagacgaggaugugcau

SEQ ID NO: 1508849 - RNA, 19 nt, Homo sapiens
gaguauucuuccagauauc

SEQ ID NO: 1508850 - RNA, 19 nt, Homo sapiens
uaaacugugaguauucuuc

SEQ ID NO: 1508851 - RNA, 19 nt, Homo sapiens
gaauagagacagaaaguua

SEQ ID NO: 1508852 - RNA, 19 nt, Homo sapiens
gagaucacuucauagguua

SEQ ID NO: 1508853 - RNA, 19 nt, Homo sapiens
ggaugcugguuguguauua

SEQ ID NO: 1508854 - RNA, 19 nt, Homo sapiens
guugaaagccacauuauuu

SEQ ID NO: 1508855 - RNA, 19 nt, Homo sapiens
gaaacuaggugggcacuuc

SEQ ID NO: 1508856 - RNA, 19 nt, Homo sapiens
cgauagggcugaucaguug

SEQ ID NO: 1508857 - RNA, 19 nt, Homo sapiens
ggacaaagaauucuguaau

SEQ ID NO: 1508858 - RNA, 19 nt, Homo sapiens
gaaauugcauagauaaagg

SEQ ID NO: 1508859 - RNA, 19 nt, Homo sapiens
aauaacaugugacuccuua

SEQ ID NO: 1508860 - RNA, 19 nt, Homo sapiens
gaaaaugccugguggaaug

SEQ ID NO: 1508861 - RNA, 19 nt, Homo sapiens
ggaaucagcccaacgauca

SEQ ID NO: 1508862 - RNA, 19 nt, Homo sapiens
gaauggcacccgaaccuua

SEQ ID NO: 1508863 - RNA, 19 nt, Homo sapiens
gacaaagaauucuguaauc

SEQ ID NO: 1508864 - RNA, 19 nt, Homo sapiens
gcucaugcccucaauguuu

SEQ ID NO: 1508865 - RNA, 19 nt, Homo sapiens
ugagaucacuucauagguu

SEQ ID NO: 1508866 - RNA, 19 nt, Homo sapiens
gcaauuaguaucagaauag

SEQ ID NO: 1508867 - RNA, 19 nt, Homo sapiens
caauugugcuuacggcuaa

SEQ ID NO: 1508868 - RNA, 19 nt, Homo sapiens
ccaaugaucuccuuuacca

SEQ ID NO: 1508869 - RNA, 19 nt, Homo sapiens
uagggaagcugagacauuu

SEQ ID NO: 1508870 - RNA, 19 nt, Homo sapiens
gugcagauauugaaacuag

SEQ ID NO: 1508871 - RNA, 19 nt, Homo sapiens
acaaagggaguaucuguua

SEQ ID NO: 1508872 - RNA, 19 nt, Homo sapiens
gaaaguuacaacacaguuu

SEQ ID NO: 1508873 - RNA, 19 nt, Homo sapiens
gaugguaaagcaauuagua

SEQ ID NO: 1508874 - RNA, 19 nt, Homo sapiens
uuagauauguccuuuccua

SEQ ID NO: 1508875 - RNA, 19 nt, Homo sapiens
gaaacagggcgguguauca

SEQ ID NO: 1508876 - RNA, 19 nt, Homo sapiens
gcuaagaugaugguaaaua

SEQ ID NO: 1508877 - RNA, 19 nt, Homo sapiens
aaagguagaugguaaagca

SEQ ID NO: 1508878 - RNA, 19 nt, Homo sapiens
ggucaagaauacccacauu

SEQ ID NO: 1508879 - RNA, 19 nt, Homo sapiens
gacagaaaguuacaacaca

SEQ ID NO: 1508880 - RNA, 19 nt, Homo sapiens
agauaaagguagaugguaa

SEQ ID NO: 1508881 - RNA, 19 nt, Homo sapiens
ggaaaggacuaugucaaag

SEQ ID NO: 1508882 - RNA, 19 nt, Homo sapiens
gaaagagacagguguaugg

SEQ ID NO: 1508883 - RNA, 19 nt, Homo sapiens
ugauggaucugaaauggaa

SEQ ID NO: 1508884 - RNA, 19 nt, Homo sapiens
gcugaagcgugcucacaaa

SEQ ID NO: 1508885 - RNA, 19 nt, Homo sapiens
ggagaaagagacaggugua

SEQ ID NO: 1508886 - RNA, 19 nt, Homo sapiens
gaugguaaauacagugugu

SEQ ID NO: 1508887 - RNA, 19 nt, Homo sapiens
gguuaugccuggacuugaa

SEQ ID NO: 1508888 - RNA, 19 nt, Homo sapiens
guaguggcauucucauuuc

SEQ ID NO: 1508889 - RNA, 19 nt, Homo sapiens
uuucugaauuggaggauua

SEQ ID NO: 1508890 - RNA, 19 nt, Homo sapiens
gauauguccuuuccuaaaa

SEQ ID NO: 1508891 - RNA, 19 nt, Homo sapiens
caacacaguuuguacuacu

SEQ ID NO: 1508892 - RNA, 19 nt, Homo sapiens
gguagaugguaaagcaauu

SEQ ID NO: 1508893 - RNA, 19 nt, Homo sapiens
gguuguguauuaaauguga

SEQ ID NO: 1508894 - RNA, 19 nt, Homo sapiens
gauuaucuuuccuaugaga

SEQ ID NO: 1508895 - RNA, 19 nt, Homo sapiens
gaaugaucauguguugaaa

SEQ ID NO: 1508896 - RNA, 19 nt, Homo sapiens
ugaaugaucauguguugaa

SEQ ID NO: 1508897 - RNA, 19 nt, Homo sapiens
guaggguuguugaagauga

SEQ ID NO: 1508898 - RNA, 19 nt, Homo sapiens
guacuacucugagauggau

SEQ ID NO: 1508899 - RNA, 19 nt, Homo sapiens
gauaaagguagaugguaaa

SEQ ID NO: 1508900 - RNA, 19 nt, Homo sapiens
gaguaucuguuaggagaaa

SEQ ID NO: 1508901 - RNA, 19 nt, Homo sapiens
ugaggcagaugcuaagaug

SEQ ID NO: 1508902 - RNA, 19 nt, Homo sapiens
ggucugggacauuuaguuu

SEQ ID NO: 1508903 - RNA, 19 nt, Homo sapiens
agggugaauucucugauua

SEQ ID NO: 1508904 - RNA, 19 nt, Homo sapiens
cucaugcccucaauguuua

SEQ ID NO: 1508905 - RNA, 19 nt, Homo sapiens
ggacaaaauuagaagauca

SEQ ID NO: 1508906 - RNA, 19 nt, Homo sapiens
gaugcugguuguguauuaa

SEQ ID NO: 1508907 - RNA, 19 nt, Homo sapiens
gaaaguucaagauuugguu

SEQ ID NO: 1508908 - RNA, 19 nt, Homo sapiens
gguaaagcaauuaguauca

SEQ ID NO: 1508909 - RNA, 19 nt, Homo sapiens
guagaugguaaagcaauua

SEQ ID NO: 1508910 - RNA, 19 nt, Homo sapiens
cuaauaggaugcugguugu

SEQ ID NO: 1508911 - RNA, 19 nt, Homo sapiens
uguugaagaugaggaauaa

SEQ ID NO: 1508912 - RNA, 19 nt, Homo sapiens
caaagggaguaucuguuag

SEQ ID NO: 1508913 - RNA, 19 nt, Homo sapiens
cuaagaugaugguaaauac

SEQ ID NO: 1508914 - RNA, 19 nt, Homo sapiens
gaauuggaggauuaucuuu

SEQ ID NO: 1508915 - RNA, 19 nt, Homo sapiens
ggacuacaacguugcuguu

SEQ ID NO: 1508916 - RNA, 19 nt, Homo sapiens
gaaaggacuaugucaaagg

SEQ ID NO: 1508917 - RNA, 19 nt, Homo sapiens
gacagcagguucagcaucu

SEQ ID NO: 1508918 - RNA, 19 nt, Homo sapiens
aaagagaggguaccagaga

SEQ ID NO: 1508919 - RNA, 19 nt, Homo sapiens
uagggugaauucucugauu

SEQ ID NO: 1508920 - RNA, 19 nt, Homo sapiens
gaaauacauggaacuugga

SEQ ID NO: 1508921 - RNA, 19 nt, Homo sapiens
aaacgucgagguucuaaga

SEQ ID NO: 1508922 - RNA, 19 nt, Homo sapiens
ccacaaagggaguaucugu

SEQ ID NO: 1508923 - RNA, 19 nt, Homo sapiens
uagacacacuuuaaaccuu

SEQ ID NO: 1508924 - RNA, 19 nt, Homo sapiens
ucagaaggacuacaacguu

SEQ ID NO: 1508925 - RNA, 19 nt, Homo sapiens
cgaauccaaugaucuccuu

SEQ ID NO: 1508926 - RNA, 19 nt, Homo sapiens
uggaaaggacuaugucaaa

SEQ ID NO: 1508927 - RNA, 19 nt, Homo sapiens
uguaguggcauucucauuu

SEQ ID NO: 1508928 - RNA, 19 nt, Homo sapiens
augcuaagaugaugguaaa

SEQ ID NO: 1508929 - RNA, 19 nt, Homo sapiens
uaacaugugacuccuuaau

SEQ ID NO: 1508930 - RNA, 19 nt, Homo sapiens
ucaucuaaaucacagagaa

SEQ ID NO: 1508931 - RNA, 19 nt, Homo sapiens
uugcauagauaaagguaga

SEQ ID NO: 1508932 - RNA, 19 nt, Homo sapiens
gucaauagcauuucaacau

SEQ ID NO: 1508933 - RNA, 19 nt, Homo sapiens
ggcgguguaucaucuaaau

SEQ ID NO: 1508934 - RNA, 19 nt, Homo sapiens
cgggaacgaugccaauugu

SEQ ID NO: 1508935 - RNA, 19 nt, Homo sapiens
gggcugaucaguuggucua

SEQ ID NO: 1508936 - RNA, 19 nt, Homo sapiens
ccucauugauggaucugaa

SEQ ID NO: 1508937 - RNA, 19 nt, Homo sapiens
guaaagcaauuaguaucag

SEQ ID NO: 1508938 - RNA, 19 nt, Homo sapiens
auaggaugcugguugugua

SEQ ID NO: 1508939 - RNA, 19 nt, Homo sapiens
gaugcuaagaugaugguaa

SEQ ID NO: 1508940 - RNA, 19 nt, Homo sapiens
ggcaagaaacgucgagguu

SEQ ID NO: 1508941 - RNA, 19 nt, Homo sapiens
ggguaggguuguugaagau

SEQ ID NO: 1508942 - RNA, 19 nt, Homo sapiens
cagaauagagacagaaagu

SEQ ID NO: 1508943 - RNA, 19 nt, Homo sapiens
aaaauaugcugcuuugguu

SEQ ID NO: 1508944 - RNA, 19 nt, Homo sapiens
ggacuaugacuaugcucuu

SEQ ID NO: 1508945 - RNA, 19 nt, Homo sapiens
ccacuguguucaugaugga

SEQ ID NO: 1508946 - RNA, 19 nt, Homo sapiens
gaaaauaugcugcuuuggu

SEQ ID NO: 1508947 - RNA, 19 nt, Homo sapiens
ugggagaaauaguuuguuc

SEQ ID NO: 1508948 - RNA, 19 nt, Homo sapiens
ucaggguccuacucuaaga

SEQ ID NO: 1508949 - RNA, 19 nt, Homo sapiens
auguauaggugcagauauu

SEQ ID NO: 1508950 - RNA, 19 nt, Homo sapiens
uaacagagaccugaaacag

SEQ ID NO: 1508951 - RNA, 19 nt, Homo sapiens
gacgauaccugucuuuauu

SEQ ID NO: 1508952 - RNA, 19 nt, Homo sapiens
ccaacuagcuguccaggaa

SEQ ID NO: 1508953 - RNA, 19 nt, Homo sapiens
cuaaaugaaucuugucuga

SEQ ID NO: 1508954 - RNA, 19 nt, Homo sapiens
caugcacgcuucuaaauga

SEQ ID NO: 1508955 - RNA, 19 nt, Homo sapiens
gccauaugcucuugucaaa

SEQ ID NO: 1508956 - RNA, 19 nt, Homo sapiens
gaagcagccuaaccagaga

SEQ ID NO: 1508957 - RNA, 19 nt, Homo sapiens
gaugggaucgguguaguua

SEQ ID NO: 1508958 - RNA, 19 nt, Homo sapiens
aaccagaugucguguguuu

SEQ ID NO: 1508959 - RNA, 19 nt, Homo sapiens
gaaacuacauccucaugcu

SEQ ID NO: 1508960 - RNA, 19 nt, Homo sapiens
ggagagagcagcaaguaca

SEQ ID NO: 1508961 - RNA, 19 nt, Homo sapiens
ggagagagaaagagagaga

SEQ ID NO: 1508962 - RNA, 19 nt, Homo sapiens
gaucucagacuccacuuga

SEQ ID NO: 1508963 - RNA, 19 nt, Homo sapiens
gguuggcucucucuauuau

SEQ ID NO: 1508964 - RNA, 19 nt, Homo sapiens
gugguuguaugaaaugaaa

SEQ ID NO: 1508965 - RNA, 19 nt, Homo sapiens
gagaucaagacccaaguuu

SEQ ID NO: 1508966 - RNA, 19 nt, Homo sapiens
ugggaucgguguaguuaaa

SEQ ID NO: 1508967 - RNA, 19 nt, Homo sapiens
cgaaccagaugucgugugu

SEQ ID NO: 1508968 - RNA, 19 nt, Homo sapiens
gcgauaugaugcagaagau

SEQ ID NO: 1508969 - RNA, 19 nt, Homo sapiens
aaucaaaccgcaauuucua

SEQ ID NO: 1508970 - RNA, 19 nt, Homo sapiens
gugcaaagacccacacuca

SEQ ID NO: 1508971 - RNA, 19 nt, Homo sapiens
gcacgcuucuaaaugaauc

SEQ ID NO: 1508972 - RNA, 19 nt, Homo sapiens
ugagauggaugcgauuaug

SEQ ID NO: 1508973 - RNA, 19 nt, Homo sapiens
cgaagggacuuuugaguug

SEQ ID NO: 1508974 - RNA, 19 nt, Homo sapiens
ggaaaggaccaaaaucaaa

SEQ ID NO: 1508975 - RNA, 19 nt, Homo sapiens
ugaauuaucccaaguacuc

SEQ ID NO: 1508976 - RNA, 19 nt, Homo sapiens
uagagacaauggagagaga

SEQ ID NO: 1508977 - RNA, 19 nt, Homo sapiens
ccugaacauuugcuugaaa

SEQ ID NO: 1508978 - RNA, 19 nt, Homo sapiens
uggaugcgauuaugauugu

SEQ ID NO: 1508979 - RNA, 19 nt, Homo sapiens
gagauggaugcgauuauga

SEQ ID NO: 1508980 - RNA, 19 nt, Homo sapiens
ugucugugguuguaugaaa

SEQ ID NO: 1508981 - RNA, 19 nt, Homo sapiens
agagagagcgcgagagaga

SEQ ID NO: 1508982 - RNA, 19 nt, Homo sapiens
gacaauggagagagaaaga

SEQ ID NO: 1508983 - RNA, 19 nt, Homo sapiens
gcaugcacgcuucuaaaug

SEQ ID NO: 1508984 - RNA, 19 nt, Homo sapiens
gaucaagacccaaguuuug

SEQ ID NO: 1508985 - RNA, 19 nt, Homo sapiens
aaucuugucugaauauguc

SEQ ID NO: 1508986 - RNA, 19 nt, Homo sapiens
ccaaguacuccauauaucu

SEQ ID NO: 1508987 - RNA, 19 nt, Homo sapiens
cgauuaugauugucucugu

SEQ ID NO: 1508988 - RNA, 19 nt, Homo sapiens
ggguuggcucucucuauua

SEQ ID NO: 1508989 - RNA, 19 nt, Homo sapiens
gauggaugcgauuaugauu

SEQ ID NO: 1508990 - RNA, 19 nt, Homo sapiens
gcaugacaccuccuaugug

SEQ ID NO: 1508991 - RNA, 19 nt, Homo sapiens
gcuucuaaaugaaucuugu

SEQ ID NO: 1508992 - RNA, 19 nt, Homo sapiens
ggcaugacaccuccuaugu

SEQ ID NO: 1508993 - RNA, 19 nt, Homo sapiens
gagacaauggagagagaaa

SEQ ID NO: 1508994 - RNA, 19 nt, Homo sapiens
gagagagcagcaaguacaa

SEQ ID NO: 1508995 - RNA, 19 nt, Homo sapiens
gaaucuugucugaauaugu

SEQ ID NO: 1508996 - RNA, 19 nt, Homo sapiens
caauggagagagaaagaga

SEQ ID NO: 1508997 - RNA, 19 nt, Homo sapiens
ucacugccauaugcucuug

SEQ ID NO: 1508998 - RNA, 19 nt, Homo sapiens
gggguuggcucucucuauu

SEQ ID NO: 1508999 - RNA, 19 nt, Homo sapiens
gggcaugacaccuccuaug

SEQ ID NO: 1509000 - RNA, 19 nt, Homo sapiens
caaguacuccauauaucug

SEQ ID NO: 1509001 - RNA, 19 nt, Homo sapiens
cccaaguacuccauauauc

SEQ ID NO: 1509002 - RNA, 19 nt, Homo sapiens
agagagagagcgcgagaga

SEQ ID NO: 1509003 - RNA, 19 nt, Homo sapiens
gacucuguguucucgcuuu

SEQ ID NO: 1509004 - RNA, 19 nt, Homo sapiens
ccaggaagcagccuaacca

SEQ ID NO: 1509005 - RNA, 19 nt, Homo sapiens
gcaaguacaaaaucaagaa

SEQ ID NO: 1509006 - RNA, 19 nt, Homo sapiens
uaucccaaguacuccauau

SEQ ID NO: 1509007 - RNA, 19 nt, Homo sapiens
ucuuuaauuucccgccuaa

SEQ ID NO: 1509008 - RNA, 19 nt, Homo sapiens
cugcauuuguuguauaaag

SEQ ID NO: 1509009 - RNA, 19 nt, Homo sapiens
cagaaacuacauccucaug

SEQ ID NO: 1509010 - RNA, 19 nt, Homo sapiens
cgauaccugucuuuauuuu

SEQ ID NO: 1509011 - RNA, 19 nt, Homo sapiens
cgggagagagcagcaagua

SEQ ID NO: 1509012 - RNA, 19 nt, Homo sapiens
gaggcugguuggcgagauc

SEQ ID NO: 1509013 - RNA, 19 nt, Homo sapiens
caguugaggcugaagauca

SEQ ID NO: 1509014 - RNA, 19 nt, Homo sapiens
ggcgauaugaugcagaaga

SEQ ID NO: 1509015 - RNA, 19 nt, Homo sapiens
ugcgcaagcucuccaagau

SEQ ID NO: 1509016 - RNA, 19 nt, Homo sapiens
ucccaaguacuccauauau

SEQ ID NO: 1509017 - RNA, 19 nt, Homo sapiens
uuggcucucucuauuauca

SEQ ID NO: 1509018 - RNA, 19 nt, Homo sapiens
uaaagaugggaucggugua

SEQ ID NO: 1509019 - RNA, 19 nt, Homo sapiens
ggccaucccuuuugugcaa

SEQ ID NO: 1509020 - RNA, 19 nt, Homo sapiens
gagagcagcaaguacaaaa

SEQ ID NO: 1509021 - RNA, 19 nt, Homo sapiens
agcaggaccuacagcaguu

SEQ ID NO: 1509022 - RNA, 19 nt, Homo sapiens
cauaugcucuugucaaaac

SEQ ID NO: 1509023 - RNA, 19 nt, Homo sapiens
ggccgcauccccuguaaua

SEQ ID NO: 1509024 - RNA, 19 nt, Homo sapiens
ucucuauuaucagcuuuga

SEQ ID NO: 1509025 - RNA, 19 nt, Homo sapiens
ccacgcagggcgauaugau

SEQ ID NO: 1509026 - RNA, 19 nt, Homo sapiens
ugaaucuugucugaauaug

SEQ ID NO: 1509027 - RNA, 19 nt, Homo sapiens
gaaugcaugcacgcuucua

SEQ ID NO: 1509028 - RNA, 19 nt, Homo sapiens
gcgaagggacuuuugaguu

SEQ ID NO: 1509029 - RNA, 19 nt, Homo sapiens
gaaaggaccaaaaucaaac

SEQ ID NO: 1509030 - RNA, 19 nt, Homo sapiens
caguguuucuggaugagau

SEQ ID NO: 1509031 - RNA, 19 nt, Homo sapiens
uagugaauuaucccaagua

SEQ ID NO: 1509032 - RNA, 19 nt, Homo sapiens
uuagugaauuaucccaagu

SEQ ID NO: 1509033 - RNA, 19 nt, Homo sapiens
agagagaaagagagagaga

SEQ ID NO: 1509034 - RNA, 19 nt, Homo sapiens
gcgcaagcucuccaagauc

SEQ ID NO: 1509035 - RNA, 19 nt, Homo sapiens
gaugcacgaccugaaccua

SEQ ID NO: 1509036 - RNA, 19 nt, Homo sapiens
gaagagaguucggacuaua

SEQ ID NO: 1509037 - RNA, 19 nt, Homo sapiens
gaaggaaugucuguucuuu

SEQ ID NO: 1509038 - RNA, 19 nt, Homo sapiens
ggacagaguuucagaugga

SEQ ID NO: 1509039 - RNA, 19 nt, Homo sapiens
uaacauugcuugaugagaa

SEQ ID NO: 1509040 - RNA, 19 nt, Homo sapiens
gaauaugagugcuuuguga

SEQ ID NO: 1509041 - RNA, 19 nt, Homo sapiens
ggacaugauugaagagaaa

SEQ ID NO: 1509042 - RNA, 19 nt, Homo sapiens
caagaaguaugcugaauug

SEQ ID NO: 1509043 - RNA, 19 nt, Homo sapiens
gaaggaagauggccaggau

SEQ ID NO: 1509044 - RNA, 19 nt, Homo sapiens
gaaugucuguucuuuauca

SEQ ID NO: 1509045 - RNA, 19 nt, Homo sapiens
ccaguaagauuugauguuu

SEQ ID NO: 1509046 - RNA, 19 nt, Homo sapiens
ggaaugacuugucugaaau

SEQ ID NO: 1509047 - RNA, 19 nt, Homo sapiens
caacaagacucugaaggaa

SEQ ID NO: 1509048 - RNA, 19 nt, Homo sapiens
ggaguaagauuagucauag

SEQ ID NO: 1509049 - RNA, 19 nt, Homo sapiens
caacguggcugacaccaau

SEQ ID NO: 1509050 - RNA, 19 nt, Homo sapiens
ccaugaggauuucucuuua

SEQ ID NO: 1509051 - RNA, 19 nt, Homo sapiens
aaucagagacgcagaaaua

SEQ ID NO: 1509052 - RNA, 19 nt, Homo sapiens
gaacacagagcuugcagaa

SEQ ID NO: 1509053 - RNA, 19 nt, Homo sapiens
ugaagaggcuggaagagaa

SEQ ID NO: 1509054 - RNA, 19 nt, Homo sapiens
caaagaagccaaccugcua

SEQ ID NO: 1509055 - RNA, 19 nt, Homo sapiens
ggcaguaaaucaaauauuc

SEQ ID NO: 1509056 - RNA, 19 nt, Homo sapiens
ccagccaaauucaacauua

SEQ ID NO: 1509057 - RNA, 19 nt, Homo sapiens
ggacacagccacauggaaa

SEQ ID NO: 1509058 - RNA, 19 nt, Homo sapiens
caagaauggaguaagauua

SEQ ID NO: 1509059 - RNA, 19 nt, Homo sapiens
aaggauagcugcaacaaug

SEQ ID NO: 1509060 - RNA, 19 nt, Homo sapiens
ggccacagccuucaugaua

SEQ ID NO: 1509061 - RNA, 19 nt, Homo sapiens
ugacuugucugaaauuugu

SEQ ID NO: 1509062 - RNA, 19 nt, Homo sapiens
gcaaccauaugcuacaaga

SEQ ID NO: 1509063 - RNA, 19 nt, Homo sapiens
cagaggagguuaauagugu

SEQ ID NO: 1509064 - RNA, 19 nt, Homo sapiens
ggaagagacuuaggaucaa

SEQ ID NO: 1509065 - RNA, 19 nt, Homo sapiens
gaaccucugccgugcuuua

SEQ ID NO: 1509066 - RNA, 19 nt, Homo sapiens
gaagacaucauuaacacuu

SEQ ID NO: 1509067 - RNA, 19 nt, Homo sapiens
uggaaugacuugucugaaa

SEQ ID NO: 1509068 - RNA, 19 nt, Homo sapiens
caacauuacugcaagucuu

SEQ ID NO: 1509069 - RNA, 19 nt, Homo sapiens
gcccucaucucaauuaaug

SEQ ID NO: 1509070 - RNA, 19 nt, Homo sapiens
acacaaagaugaccacaag

SEQ ID NO: 1509071 - RNA, 19 nt, Homo sapiens
acugagagcuaaagaauau

SEQ ID NO: 1509072 - RNA, 19 nt, Homo sapiens
cuagagaugucaaauggaa

SEQ ID NO: 1509073 - RNA, 19 nt, Homo sapiens
gcacugagagcuaaagaau

SEQ ID NO: 1509074 - RNA, 19 nt, Homo sapiens
augagaaccucuaaugaua

SEQ ID NO: 1509075 - RNA, 19 nt, Homo sapiens
gcuccuuccuucccaauuu

SEQ ID NO: 1509076 - RNA, 19 nt, Homo sapiens
acacauucauucagacuuu

SEQ ID NO: 1509077 - RNA, 19 nt, Homo sapiens
cagaacacauucauucaga

SEQ ID NO: 1509078 - RNA, 19 nt, Homo sapiens
acacagagcuugcagaaaa

SEQ ID NO: 1509079 - RNA, 19 nt, Homo sapiens
guaacccaaugguagauaa

SEQ ID NO: 1509080 - RNA, 19 nt, Homo sapiens
gagaaacgaacuccacaaa

SEQ ID NO: 1509081 - RNA, 19 nt, Homo sapiens
caaaggcaguaaaucaaau

SEQ ID NO: 1509082 - RNA, 19 nt, Homo sapiens
gaaacaggcagcagaggaa

SEQ ID NO: 1509083 - RNA, 19 nt, Homo sapiens
agaaagcacugagagcuaa

SEQ ID NO: 1509084 - RNA, 19 nt, Homo sapiens
ucaaagagcccgucagcaa

SEQ ID NO: 1509085 - RNA, 19 nt, Homo sapiens
gaugagaaccucuaaugau

SEQ ID NO: 1509086 - RNA, 19 nt, Homo sapiens
gccacagccuucaugauaa

SEQ ID NO: 1509087 - RNA, 19 nt, Homo sapiens
gcacaacuccgaugaagag

SEQ ID NO: 1509088 - RNA, 19 nt, Homo sapiens
caggaagguuugaagaauu

SEQ ID NO: 1509089 - RNA, 19 nt, Homo sapiens
acaagacucugaaggaaga

SEQ ID NO: 1509090 - RNA, 19 nt, Homo sapiens
gcauacaguuuguuugaag

SEQ ID NO: 1509091 - RNA, 19 nt, Homo sapiens
gaagaaagaaacaaugucu

SEQ ID NO: 1509092 - RNA, 19 nt, Homo sapiens
gacuaaugcucuauaaauc

SEQ ID NO: 1509093 - RNA, 19 nt, Homo sapiens
gagaaccucugccgugcuu

SEQ ID NO: 1509094 - RNA, 19 nt, Homo sapiens
agaaacagguacaaauuca

SEQ ID NO: 1509095 - RNA, 19 nt, Homo sapiens
aggaaugucuguucuuuau

SEQ ID NO: 1509096 - RNA, 19 nt, Homo sapiens
ucacagccauguauaucuu

SEQ ID NO: 1509097 - RNA, 19 nt, Homo sapiens
gaaccucuaaugauacuga

SEQ ID NO: 1509098 - RNA, 19 nt, Homo sapiens
gagcuaaauauucaccaua

SEQ ID NO: 1509099 - RNA, 19 nt, Homo sapiens
gaaguagacagugaggaua

SEQ ID NO: 1509100 - RNA, 19 nt, Homo sapiens
gacuuaggaucaagacauu

SEQ ID NO: 1509101 - RNA, 19 nt, Homo sapiens
gagaaagcacugagagcua

SEQ ID NO: 1509102 - RNA, 19 nt, Homo sapiens
ggaaagcccgauuugagaa

SEQ ID NO: 1509103 - RNA, 19 nt, Homo sapiens
gagaggagcaucuggacaa

SEQ ID NO: 1509104 - RNA, 19 nt, Homo sapiens
aaauauaggugaggauuca

SEQ ID NO: 1509105 - RNA, 19 nt, Homo sapiens
gacccauucuauauucuaa

SEQ ID NO: 1509106 - RNA, 19 nt, Homo sapiens
uaagggaccucacacuaag

SEQ ID NO: 1509107 - RNA, 19 nt, Homo sapiens
gugauguucugcuuauuug

SEQ ID NO: 1509108 - RNA, 19 nt, Homo sapiens
ccacagccuucaugauaau

SEQ ID NO: 1509109 - RNA, 19 nt, Homo sapiens
ugaagaagcuggaaaagga

SEQ ID NO: 1509110 - RNA, 19 nt, Homo sapiens
gaaauaugaagcucuguca

SEQ ID NO: 1509111 - RNA, 19 nt, Homo sapiens
gaagcaaauuggagagucu

SEQ ID NO: 1509112 - RNA, 19 nt, Homo sapiens
ggagaagggaagaaagaaa

SEQ ID NO: 1509113 - RNA, 19 nt, Homo sapiens
gcaguuagacuacaaucug

SEQ ID NO: 1509114 - RNA, 19 nt, Homo sapiens
agacuaugguugacuaaug

SEQ ID NO: 1509115 - RNA, 19 nt, Homo sapiens
aaagagcccgucagcaaua

SEQ ID NO: 1509116 - RNA, 19 nt, Homo sapiens
acaauggccuggagaagga

SEQ ID NO: 1509117 - RNA, 19 nt, Homo sapiens
cugcaagucuuagagauuu

SEQ ID NO: 1509118 - RNA, 19 nt, Homo sapiens
ucagacccauucuauauuc

SEQ ID NO: 1509119 - RNA, 19 nt, Homo sapiens
gaagauggaggcagaugug

SEQ ID NO: 1509120 - RNA, 19 nt, Homo sapiens
gauggaggcuaaucacucu

SEQ ID NO: 1509121 - RNA, 19 nt, Homo sapiens
gaaguuaaagcuccuccaa

SEQ ID NO: 1509122 - RNA, 19 nt, Homo sapiens
ccaaaggcaguaaaucaaa

SEQ ID NO: 1509123 - RNA, 19 nt, Homo sapiens
ggcagaacguccaagaaug

SEQ ID NO: 1509124 - RNA, 19 nt, Homo sapiens
ggaaagggaaggaagaaag

SEQ ID NO: 1509125 - RNA, 19 nt, Homo sapiens
gccaugaggauuucucuuu

SEQ ID NO: 1509126 - RNA, 19 nt, Homo sapiens
gcagcagaguggaaacuuc

SEQ ID NO: 1509127 - RNA, 19 nt, Homo sapiens
cccaagaaaugaugaagga

SEQ ID NO: 1509128 - RNA, 19 nt, Homo sapiens
cagcagagugagcgaaaua

SEQ ID NO: 1509129 - RNA, 19 nt, Homo sapiens
uauccucgcucgaagcaaa

SEQ ID NO: 1509130 - RNA, 19 nt, Homo sapiens
gcuugucgcuauuugagaa

SEQ ID NO: 1509131 - RNA, 19 nt, Homo sapiens
caaaguugcuaggcaggaa

SEQ ID NO: 1509132 - RNA, 19 nt, Homo sapiens
guugacuaaugcucuauaa

SEQ ID NO: 1509133 - RNA, 19 nt, Homo sapiens
gcagaauauuuagaugcua

SEQ ID NO: 1509134 - RNA, 19 nt, Homo sapiens
gacuuccacugcaauauau

SEQ ID NO: 1509135 - RNA, 19 nt, Homo sapiens
gaagagacuuaggaucaag

SEQ ID NO: 1509136 - RNA, 19 nt, Homo sapiens
gaauacagcucaaauuugu

SEQ ID NO: 1509137 - RNA, 19 nt, Homo sapiens
gcaugaagcuauacaauug

SEQ ID NO: 1509138 - RNA, 19 nt, Homo sapiens
gaagugaacuggagaugga

SEQ ID NO: 1509139 - RNA, 19 nt, Homo sapiens
ucaaguggcugaacaaaug

SEQ ID NO: 1509140 - RNA, 19 nt, Homo sapiens
gaacaaauggccaguggaa

SEQ ID NO: 1509141 - RNA, 19 nt, Homo sapiens
gauauuuggugaucucuug

SEQ ID NO: 1509142 - RNA, 19 nt, Homo sapiens
gaagaggugugaaauacuc

SEQ ID NO: 1509143 - RNA, 19 nt, Homo sapiens
gcagaugcauauacauuca

SEQ ID NO: 1509144 - RNA, 19 nt, Homo sapiens
gcagacagguacaggaugu

SEQ ID NO: 1509145 - RNA, 19 nt, Homo sapiens
gcguacacaugauuaguuu

SEQ ID NO: 1509146 - RNA, 19 nt, Homo sapiens
gcagaaugauagacucaga

SEQ ID NO: 1509147 - RNA, 19 nt, Homo sapiens
gaaaaccaacuuacucuua

SEQ ID NO: 1509148 - RNA, 19 nt, Homo sapiens
gcaaaggaacgaucagaau

SEQ ID NO: 1509149 - RNA, 19 nt, Homo sapiens
ggaugaauaugaacucuac

SEQ ID NO: 1509150 - RNA, 19 nt, Homo sapiens
caagaucuccugaagaaug

SEQ ID NO: 1509151 - RNA, 19 nt, Homo sapiens
guauguagcauggauauuu

SEQ ID NO: 1509152 - RNA, 19 nt, Homo sapiens
cagcuuuaaucucuaguaa

SEQ ID NO: 1509153 - RNA, 19 nt, Homo sapiens
gagugaagacccuguguaa

SEQ ID NO: 1509154 - RNA, 19 nt, Homo sapiens
aaagaagaggugugaaaua

SEQ ID NO: 1509155 - RNA, 19 nt, Homo sapiens
caagcaagaucuccugaag

SEQ ID NO: 1509156 - RNA, 19 nt, Homo sapiens
agcaagaucuccugaagaa

SEQ ID NO: 1509157 - RNA, 19 nt, Homo sapiens
uuacagcacuggcccaaug

SEQ ID NO: 1509158 - RNA, 19 nt, Homo sapiens
caacuuacucuuacugaga

SEQ ID NO: 1509159 - RNA, 19 nt, Homo sapiens
gcauggauauuugcagaug

SEQ ID NO: 1509160 - RNA, 19 nt, Homo sapiens
gaagcuauacaauuggaaa

SEQ ID NO: 1509161 - RNA, 19 nt, Homo sapiens
gaaaagaagaggugugaaa

SEQ ID NO: 1509162 - RNA, 19 nt, Homo sapiens
gugaagacccuguguaauc

SEQ ID NO: 1509163 - RNA, 19 nt, Homo sapiens
gugaagacccuguguaauc

SEQ ID NO: 1509164 - RNA, 19 nt, Homo sapiens
ggaauucagcgcugcuuga

SEQ ID NO: 1509165 - RNA, 19 nt, Homo sapiens
uaagugggaugagauacaa

SEQ ID NO: 1509166 - RNA, 19 nt, Homo sapiens
aaacaacuuugguucauac

SEQ ID NO: 1509167 - RNA, 19 nt, Homo sapiens
caaauggccaguggaaauu

SEQ ID NO: 1509168 - RNA, 19 nt, Homo sapiens
ucacugagaauaggauuaa

SEQ ID NO: 1509169 - RNA, 19 nt, Homo sapiens
aagaagaggugugaaauac

SEQ ID NO: 1509170 - RNA, 19 nt, Homo sapiens
cagaggaaacagaagauaa

SEQ ID NO: 1509171 - RNA, 19 nt, Homo sapiens
aagcagcccuggagcagaa

SEQ ID NO: 1509172 - RNA, 19 nt, Homo sapiens
gccaacacaaguuuacaua

SEQ ID NO: 1509173 - RNA, 19 nt, Homo sapiens
uauguagcauggauauuug

SEQ ID NO: 1509174 - RNA, 19 nt, Homo sapiens
gcgugaagacccuguguaa

SEQ ID NO: 1509175 - RNA, 19 nt, Homo sapiens
caguggaaauucuuaacuu

SEQ ID NO: 1509176 - RNA, 19 nt, Homo sapiens
ggagugaagacccugugua

SEQ ID NO: 1509177 - RNA, 19 nt, Homo sapiens
gaagacggcggacauggau

SEQ ID NO: 1509178 - RNA, 19 nt, Homo sapiens
ugaauacagcucaaauuug

SEQ ID NO: 1509179 - RNA, 19 nt, Homo sapiens
ggaacgaucagaaucaucu

SEQ ID NO: 1509180 - RNA, 19 nt, Homo sapiens
gggaagagcugaggaugcu

SEQ ID NO: 1509181 - RNA, 19 nt, Homo sapiens
gagcaugaagcuauacaau

SEQ ID NO: 1509182 - RNA, 19 nt, Homo sapiens
caaaggaacgaucagaauc

SEQ ID NO: 1509183 - RNA, 19 nt, Homo sapiens
ugaagacccuguguaaucu

SEQ ID NO: 1509184 - RNA, 19 nt, Homo sapiens
cauacuggaauuucagaua

SEQ ID NO: 1509185 - RNA, 19 nt, Homo sapiens
ugaagacccuguguaaucu

SEQ ID NO: 1509186 - RNA, 19 nt, Homo sapiens
aauuguaccugaaguggaa

SEQ ID NO: 1509187 - RNA, 19 nt, Homo sapiens
ggacgucuaccucuacauc

SEQ ID NO: 1509188 - RNA, 19 nt, Homo sapiens
aagaucuccugaagaauga

SEQ ID NO: 1509189 - RNA, 19 nt, Homo sapiens
auacugaaauacacacaug

SEQ ID NO: 1509190 - RNA, 19 nt, Homo sapiens
acaaauggccaguggaaau

SEQ ID NO: 1509191 - RNA, 19 nt, Homo sapiens
uguguaaucugaagaaacu

SEQ ID NO: 1509192 - RNA, 19 nt, Homo sapiens
ggagauggagcuggcauug

SEQ ID NO: 1509193 - RNA, 19 nt, Homo sapiens
gcgggagccugaauuguac

SEQ ID NO: 1509194 - RNA, 19 nt, Homo sapiens
ggagcgggagccugaauug

SEQ ID NO: 1509195 - RNA, 19 nt, Homo sapiens
aaugauagacucagaagug

SEQ ID NO: 1509196 - RNA, 19 nt, Homo sapiens
acacaugauuaguuucugu

SEQ ID NO: 1509197 - RNA, 19 nt, Homo sapiens
caucagcuuuaaucucuag

SEQ ID NO: 1509198 - RNA, 19 nt, Homo sapiens
gagauacaagcucuggaaa

SEQ ID NO: 1509199 - RNA, 19 nt, Homo sapiens
agaaucaucugagaaacau

SEQ ID NO: 1509200 - RNA, 19 nt, Homo sapiens
cagggaagguggcgaggau

SEQ ID NO: 1509201 - RNA, 19 nt, Homo sapiens
guacacaugauuaguuucu

SEQ ID NO: 1509202 - RNA, 19 nt, Homo sapiens
cuauacaauuggaaacaga

SEQ ID NO: 1509203 - RNA, 19 nt, Homo sapiens
aaaggaacgaucagaauca

SEQ ID NO: 1509204 - RNA, 19 nt, Homo sapiens
gcagcaggagcuccagaaa

SEQ ID NO: 1509205 - RNA, 19 nt, Homo sapiens
ugagauacaagcucuggaa

SEQ ID NO: 1509206 - RNA, 19 nt, Homo sapiens
guaagugggaugagauaca

SEQ ID NO: 1509207 - RNA, 19 nt, Homo sapiens
gagcagaaugauagacuca

SEQ ID NO: 1509208 - RNA, 19 nt, Homo sapiens
gggaagguggcgaggauga

SEQ ID NO: 1509209 - RNA, 19 nt, Homo sapiens
ccaacacaaguuuacauau

SEQ ID NO: 1509210 - RNA, 19 nt, Homo sapiens
gauuaguuucuguugcaua

SEQ ID NO: 1509211 - RNA, 19 nt, Homo sapiens
gagaauaggauuaaaagca

SEQ ID NO: 1509212 - RNA, 19 nt, Homo sapiens
acacuucagaggaggauuu

SEQ ID NO: 1509213 - RNA, 19 nt, Homo sapiens
ucagaggaaacagaagaua

SEQ ID NO: 1509214 - RNA, 19 nt, Homo sapiens
gauagacucagaagugaac

SEQ ID NO: 1509215 - RNA, 19 nt, Homo sapiens
acuugaaggugcugugcua

SEQ ID NO: 1509216 - RNA, 19 nt, Homo sapiens
ggaagguggcgaggaugaa

SEQ ID NO: 1509217 - RNA, 19 nt, Homo sapiens
cagaagauaacgcucaagu

SEQ ID NO: 1509218 - RNA, 19 nt, Homo sapiens
aaucagaggaaacagaaga

SEQ ID NO: 1509219 - RNA, 19 nt, Homo sapiens
caguaagugggaugagaua

SEQ ID NO: 1509220 - RNA, 19 nt, Homo sapiens
cugagaagguugaaaagaa

SEQ ID NO: 1509221 - RNA, 19 nt, Homo sapiens
gcuauacaauuggaaacag

SEQ ID NO: 1509222 - RNA, 19 nt, Homo sapiens
gguucauacuggaauuuca

SEQ ID NO: 1509223 - RNA, 19 nt, Homo sapiens
gcccuggagcagaaugaua

SEQ ID NO: 1509224 - RNA, 19 nt, Homo sapiens
gcgcagacagguacaggau

SEQ ID NO: 1509225 - RNA, 19 nt, Homo sapiens
uucaucagcuuuaaucucu

SEQ ID NO: 1509226 - RNA, 19 nt, Homo sapiens
aguggaaauucuuaacuuc

SEQ ID NO: 1509227 - RNA, 19 nt, Homo sapiens
gcucaaguggcugaacaaa

SEQ ID NO: 1509228 - RNA, 19 nt, Homo sapiens
ugaagacggcggacaugga

SEQ ID NO: 1509229 - RNA, 19 nt, Homo sapiens
ugaauaugaacucuacaug

SEQ ID NO: 1509230 - RNA, 19 nt, Homo sapiens
gaaccggcuucagaaagac

SEQ ID NO: 1509231 - RNA, 19 nt, Homo sapiens
aacuuacucuuacugagaa

SEQ ID NO: 1509232 - RNA, 19 nt, Homo sapiens
agauggagcuggcauugcu

SEQ ID NO: 1509233 - RNA, 19 nt, Homo sapiens
gaccggcaccacuauguca

SEQ ID NO: 1509234 - RNA, 19 nt, Homo sapiens
agcgggagccugaauugua

SEQ ID NO: 1509235 - RNA, 19 nt, Homo sapiens
aacagaagauaacgcucaa

SEQ ID NO: 1509236 - RNA, 19 nt, Homo sapiens
gagagaaacccuacaaaua

SEQ ID NO: 1509237 - RNA, 19 nt, Homo sapiens
gaaagcaagugaucuguug

SEQ ID NO: 1509238 - RNA, 19 nt, Homo sapiens
gaagagacaugagauggua

SEQ ID NO: 1509239 - RNA, 19 nt, Homo sapiens
gagaugcucuuugugauua

SEQ ID NO: 1509240 - RNA, 19 nt, Homo sapiens
gaagggaaauccuacaaau

SEQ ID NO: 1509241 - RNA, 19 nt, Homo sapiens
caaaggagguuauaaugga

SEQ ID NO: 1509242 - RNA, 19 nt, Homo sapiens
ggaaaacccuaaagcauua

SEQ ID NO: 1509243 - RNA, 19 nt, Homo sapiens
ggaaagcauuuauacuuga

SEQ ID NO: 1509244 - RNA, 19 nt, Homo sapiens
gagaaacccugcaaacaug

SEQ ID NO: 1509245 - RNA, 19 nt, Homo sapiens
aaacaguccucaacccuua

SEQ ID NO: 1509246 - RNA, 19 nt, Homo sapiens
cuacaaaccugaaagaugu

SEQ ID NO: 1509247 - RNA, 19 nt, Homo sapiens
gagaaacccuacaaauaug

SEQ ID NO: 1509248 - RNA, 19 nt, Homo sapiens
cuacaaaugugaagaaugu

SEQ ID NO: 1509249 - RNA, 19 nt, Homo sapiens
cuacaaaugugaagaaugu

SEQ ID NO: 1509250 - RNA, 19 nt, Homo sapiens
gaagauaaacccuacaaau

SEQ ID NO: 1509251 - RNA, 19 nt, Homo sapiens
cuacaaaugugaagaaugu

SEQ ID NO: 1509252 - RNA, 19 nt, Homo sapiens
cuacaaaugugaugaaugu

SEQ ID NO: 1509253 - RNA, 19 nt, Homo sapiens
cuacaaaugugaagaaugu

SEQ ID NO: 1509254 - RNA, 19 nt, Homo sapiens
gaagauaaacccuacaaau

SEQ ID NO: 1509255 - RNA, 19 nt, Homo sapiens
cuacaaaugugaagaaugu

SEQ ID NO: 1509256 - RNA, 19 nt, Homo sapiens
cuacaaaugugaagaaugu

SEQ ID NO: 1509257 - RNA, 19 nt, Homo sapiens
cuacaaaugugaagaaugu

SEQ ID NO: 1509258 - RNA, 19 nt, Homo sapiens
ccucaaaucuuacuaaaca

SEQ ID NO: 1509259 - RNA, 19 nt, Homo sapiens
guagaaaucauaaggcaua

SEQ ID NO: 1509260 - RNA, 19 nt, Homo sapiens
gcacaggaaagcauuuaua

SEQ ID NO: 1509261 - RNA, 19 nt, Homo sapiens
ggacuuaaccaguguuuga

SEQ ID NO: 1509262 - RNA, 19 nt, Homo sapiens
gagagaaacccuacaaaug

SEQ ID NO: 1509263 - RNA, 19 nt, Homo sapiens
gagagaaacccuacaaaug

SEQ ID NO: 1509264 - RNA, 19 nt, Homo sapiens
gaagagaaacccuacaaau

SEQ ID NO: 1509265 - RNA, 19 nt, Homo sapiens
gagagaaacccuacaaaug

SEQ ID NO: 1509266 - RNA, 19 nt, Homo sapiens
ccaguuauguguucucauu

SEQ ID NO: 1509267 - RNA, 19 nt, Homo sapiens
aaagagcccuggaaucuga

SEQ ID NO: 1509268 - RNA, 19 nt, Homo sapiens
gauaaacccuacaaaugug

SEQ ID NO: 1509269 - RNA, 19 nt, Homo sapiens
gauaaacccuacaaaugug

SEQ ID NO: 1509270 - RNA, 19 nt, Homo sapiens
ucagagaguucauacuaaa

SEQ ID NO: 1509271 - RNA, 19 nt, Homo sapiens
caauuaccgucaaaucuuu

SEQ ID NO: 1509272 - RNA, 19 nt, Homo sapiens
ucacaacaccucaaacuuu

SEQ ID NO: 1509273 - RNA, 19 nt, Homo sapiens
ucucaaaccuuacuaaaca

SEQ ID NO: 1509274 - RNA, 19 nt, Homo sapiens
gacaugagaugguagacaa

SEQ ID NO: 1509275 - RNA, 19 nt, Homo sapiens
gagaaacccuacaaaugug

SEQ ID NO: 1509276 - RNA, 19 nt, Homo sapiens
gagaaacccuacaaaugug

SEQ ID NO: 1509277 - RNA, 19 nt, Homo sapiens
gagaaacccuacaaaugug

SEQ ID NO: 1509278 - RNA, 19 nt, Homo sapiens
gagaaacccuacaaaugug

SEQ ID NO: 1509279 - RNA, 19 nt, Homo sapiens
ugaaagaugugacaaugau

SEQ ID NO: 1509280 - RNA, 19 nt, Homo sapiens
gauaagacauacuggaaag

SEQ ID NO: 1509281 - RNA, 19 nt, Homo sapiens
gagaugugauguuagagaa

SEQ ID NO: 1509282 - RNA, 19 nt, Homo sapiens
gcagaugcaguaaauauga

SEQ ID NO: 1509283 - RNA, 19 nt, Homo sapiens
ugaagaauguggcaaacuu

SEQ ID NO: 1509284 - RNA, 19 nt, Homo sapiens
gcagagccuuuaacaaauc

SEQ ID NO: 1509285 - RNA, 19 nt, Homo sapiens
gcaagauauuucaguguga

SEQ ID NO: 1509286 - RNA, 19 nt, Homo sapiens
caugagaauuuacagcuaa

SEQ ID NO: 1509287 - RNA, 19 nt, Homo sapiens
gcaauuaccgucaaaucuu

SEQ ID NO: 1509288 - RNA, 19 nt, Homo sapiens
agagaaacccuacaaauau

SEQ ID NO: 1509289 - RNA, 19 nt, Homo sapiens
guacaaaggagguuauaau

SEQ ID NO: 1509290 - RNA, 19 nt, Homo sapiens
caucagagaguucauacua

SEQ ID NO: 1509291 - RNA, 19 nt, Homo sapiens
gcaaggccuuuaaccaguu

SEQ ID NO: 1509292 - RNA, 19 nt, Homo sapiens
ggagagaaacccuacaaau

SEQ ID NO: 1509293 - RNA, 19 nt, Homo sapiens
ggagagaaacccuacaaau

SEQ ID NO: 1509294 - RNA, 19 nt, Homo sapiens
ggagagaaacccuacaaau

SEQ ID NO: 1509295 - RNA, 19 nt, Homo sapiens
ggagagaaacccuacaaau

SEQ ID NO: 1509296 - RNA, 19 nt, Homo sapiens
uauaucugcucacauguaa

SEQ ID NO: 1509297 - RNA, 19 nt, Homo sapiens
uggcagagccuuuaacaaa

SEQ ID NO: 1509298 - RNA, 19 nt, Homo sapiens
aaccaguucucgauucuua

SEQ ID NO: 1509299 - RNA, 19 nt, Homo sapiens
gaagaauguggcaaacuuu

SEQ ID NO: 1509300 - RNA, 19 nt, Homo sapiens
gauuguagguaagguaauu

SEQ ID NO: 1509301 - RNA, 19 nt, Homo sapiens
gacaaggacuuuaaauggu

SEQ ID NO: 1509302 - RNA, 19 nt, Homo sapiens
cuagaaaugugaggaauau

SEQ ID NO: 1509303 - RNA, 19 nt, Homo sapiens
gcagcggaauuuauauaga

SEQ ID NO: 1509304 - RNA, 19 nt, Homo sapiens
ccucaacccuuacuaaaca

SEQ ID NO: 1509305 - RNA, 19 nt, Homo sapiens
ccucaacccuuacuaaaca

SEQ ID NO: 1509306 - RNA, 19 nt, Homo sapiens
ccucaacccuuacuaaaca

SEQ ID NO: 1509307 - RNA, 19 nt, Homo sapiens
gagaguauucuuacaaaug

SEQ ID NO: 1509308 - RNA, 19 nt, Homo sapiens
uugcaugcuuucacaauua

SEQ ID NO: 1509309 - RNA, 19 nt, Homo sapiens
gauaauucauacuggagaa

SEQ ID NO: 1509310 - RNA, 19 nt, Homo sapiens
caggaaagcauuuauacuu

SEQ ID NO: 1509311 - RNA, 19 nt, Homo sapiens
gaauguggcagagccuuua

SEQ ID NO: 1509312 - RNA, 19 nt, Homo sapiens
ggaaauccuacaaauguga

SEQ ID NO: 1509313 - RNA, 19 nt, Homo sapiens
gaaaagaccauaaaagugu

SEQ ID NO: 1509314 - RNA, 19 nt, Homo sapiens
caagugaucuguuguugcu

SEQ ID NO: 1509315 - RNA, 19 nt, Homo sapiens
cuucagacauuacacuaaa

SEQ ID NO: 1509316 - RNA, 19 nt, Homo sapiens
caucagggaauuuguauug

SEQ ID NO: 1509317 - RNA, 19 nt, Homo sapiens
gaauaugacaaggacuuua

SEQ ID NO: 1509318 - RNA, 19 nt, Homo sapiens
aacaaguucucaacccuua

SEQ ID NO: 1509319 - RNA, 19 nt, Homo sapiens
ucucaacccuuacuaaaca

SEQ ID NO: 1509320 - RNA, 19 nt, Homo sapiens
agagaaacccuacaaaugu

SEQ ID NO: 1509321 - RNA, 19 nt, Homo sapiens
agagaaacccuacaaaugu

SEQ ID NO: 1509322 - RNA, 19 nt, Homo sapiens
aaccaguucucaaaccuua

SEQ ID NO: 1509323 - RNA, 19 nt, Homo sapiens
agagaaacccuacaaaugu

SEQ ID NO: 1509324 - RNA, 19 nt, Homo sapiens
agagaaacccuacaaaugu

SEQ ID NO: 1509325 - RNA, 19 nt, Homo sapiens
acaaggacuuuaaaugguu

SEQ ID NO: 1509326 - RNA, 19 nt, Homo sapiens
ggcagagccuuuaacaaau

SEQ ID NO: 1509327 - RNA, 19 nt, Homo sapiens
gaaaagccauuuauaucug

SEQ ID NO: 1509328 - RNA, 19 nt, Homo sapiens
gaaagcauuuauacuugag

SEQ ID NO: 1509329 - RNA, 19 nt, Homo sapiens
gaaaugggaccacugacau

SEQ ID NO: 1509330 - RNA, 19 nt, Homo sapiens
ucagagauaugagagauuc

SEQ ID NO: 1509331 - RNA, 19 nt, Homo sapiens
uaucagaauucacaguaga

SEQ ID NO: 1509332 - RNA, 19 nt, Homo sapiens
aaccaauccucacaccuua

SEQ ID NO: 1509333 - RNA, 19 nt, Homo sapiens
gcgcagcggaauuuauaua

SEQ ID NO: 1509334 - RNA, 19 nt, Homo sapiens
auagagaugugauguuaga

SEQ ID NO: 1509335 - RNA, 19 nt, Homo sapiens
aaccaguccucaaaccuua

SEQ ID NO: 1509336 - RNA, 19 nt, Homo sapiens
gcaauuaucucaagggaaa

SEQ ID NO: 1509337 - RNA, 19 nt, Homo sapiens
ggaauuacgugaaaugcaa

SEQ ID NO: 1509338 - RNA, 19 nt, Homo sapiens
gcaagucauuucaguggua

SEQ ID NO: 1509339 - RNA, 19 nt, Homo sapiens
cauaaagccugcuagcuaa

SEQ ID NO: 1509340 - RNA, 19 nt, Homo sapiens
gauaaugucuucccagagu

SEQ ID NO: 1509341 - RNA, 19 nt, Homo sapiens
gaaagagaagugccagaua

SEQ ID NO: 1509342 - RNA, 19 nt, Homo sapiens
gaaagccuggucugaaaua

SEQ ID NO: 1509343 - RNA, 19 nt, Homo sapiens
gaagauaaagcaaagucua

SEQ ID NO: 1509344 - RNA, 19 nt, Homo sapiens
gggauaauguuuucucuua

SEQ ID NO: 1509345 - RNA, 19 nt, Homo sapiens
uauaagcccucuccucuug

SEQ ID NO: 1509346 - RNA, 19 nt, Homo sapiens
caaagcagccaaugcaauu

SEQ ID NO: 1509347 - RNA, 19 nt, Homo sapiens
ucacaagaguguaaguuug

SEQ ID NO: 1509348 - RNA, 19 nt, Homo sapiens
ugagcaaaguugaugauuu

SEQ ID NO: 1509349 - RNA, 19 nt, Homo sapiens
ggacauaucaguaagaaac

SEQ ID NO: 1509350 - RNA, 19 nt, Homo sapiens
ccauaaagccugcuagcua

SEQ ID NO: 1509351 - RNA, 19 nt, Homo sapiens
ugagauggauggaccagaa

SEQ ID NO: 1509352 - RNA, 19 nt, Homo sapiens
uuacaucucucaguucauu

SEQ ID NO: 1509353 - RNA, 19 nt, Homo sapiens
ggaaacgacuggguugcaa

SEQ ID NO: 1509354 - RNA, 19 nt, Homo sapiens
ucgaaagccuggucugaaa

SEQ ID NO: 1509355 - RNA, 19 nt, Homo sapiens
ggaggccaacucuuuauaa

SEQ ID NO: 1509356 - RNA, 19 nt, Homo sapiens
gaaauuggacaguaugaca

SEQ ID NO: 1509357 - RNA, 19 nt, Homo sapiens
ccagaaggaucuacuaaac

SEQ ID NO: 1509358 - RNA, 19 nt, Homo sapiens
gaaccuacaauuuaaaugg

SEQ ID NO: 1509359 - RNA, 19 nt, Homo sapiens
uguaaugccuuguuucaga

SEQ ID NO: 1509360 - RNA, 19 nt, Homo sapiens
acccagaacuucauaaaga

SEQ ID NO: 1509361 - RNA, 19 nt, Homo sapiens
gugagcagcuggcagaaga

SEQ ID NO: 1509362 - RNA, 19 nt, Homo sapiens
ugccauaauucaagguuua

SEQ ID NO: 1509363 - RNA, 19 nt, Homo sapiens
gaggccaacucuuuauaau

SEQ ID NO: 1509364 - RNA, 19 nt, Homo sapiens
acuaucaccuggaaacuuu

SEQ ID NO: 1509365 - RNA, 19 nt, Homo sapiens
caaaaggacugaugaagau

SEQ ID NO: 1509366 - RNA, 19 nt, Homo sapiens
gaguaggacauaucaguaa

SEQ ID NO: 1509367 - RNA, 19 nt, Homo sapiens
aaagagaagugccagauac

SEQ ID NO: 1509368 - RNA, 19 nt, Homo sapiens
guaagaaacaaacuggaaa

SEQ ID NO: 1509369 - RNA, 19 nt, Homo sapiens
gaacccagccaccauaaag

SEQ ID NO: 1509370 - RNA, 19 nt, Homo sapiens
gaaccucacgccacacuau

SEQ ID NO: 1509371 - RNA, 19 nt, Homo sapiens
agaauguaaugccuuguuu

SEQ ID NO: 1509372 - RNA, 19 nt, Homo sapiens
ucgcgagcguguugaguua

SEQ ID NO: 1509373 - RNA, 19 nt, Homo sapiens
ccugauagaugucauugau

SEQ ID NO: 1509374 - RNA, 19 nt, Homo sapiens
ccaaugcaauuaucucaag

SEQ ID NO: 1509375 - RNA, 19 nt, Homo sapiens
acacauaacuaccuaagac

SEQ ID NO: 1509376 - RNA, 19 nt, Homo sapiens
ggaaaaccuucuacaauca

SEQ ID NO: 1509377 - RNA, 19 nt, Homo sapiens
guauuuggauaaugucuuc

SEQ ID NO: 1509378 - RNA, 19 nt, Homo sapiens
uaagcccucuccucuugua

SEQ ID NO: 1509379 - RNA, 19 nt, Homo sapiens
gagaaaugccauaauucaa

SEQ ID NO: 1509380 - RNA, 19 nt, Homo sapiens
ugcaaugucuggaggaauu

SEQ ID NO: 1509381 - RNA, 19 nt, Homo sapiens
gaccagaaggaucuacuaa

SEQ ID NO: 1509382 - RNA, 19 nt, Homo sapiens
caacauagugucacaagag

SEQ ID NO: 1509383 - RNA, 19 nt, Homo sapiens
uaugucaccuacggaaaua

SEQ ID NO: 1509384 - RNA, 19 nt, Homo sapiens
acguuuggcuggaugaaua

SEQ ID NO: 1509385 - RNA, 19 nt, Homo sapiens
gauuggagcuucucaugcu

SEQ ID NO: 1509386 - RNA, 19 nt, Homo sapiens
gcaaagucuauguuaggua

SEQ ID NO: 1509387 - RNA, 19 nt, Homo sapiens
ugagaaaugccauaauuca

SEQ ID NO: 1509388 - RNA, 19 nt, Homo sapiens
gaacaucguggaauuacgu

SEQ ID NO: 1509389 - RNA, 19 nt, Homo sapiens
ggccaacucuuuauaaucc

SEQ ID NO: 1509390 - RNA, 19 nt, Homo sapiens
ggggaaagguuaaaauaau

SEQ ID NO: 1509391 - RNA, 19 nt, Homo sapiens
accaaaaccucauguaaua

SEQ ID NO: 1509392 - RNA, 19 nt, Homo sapiens
agaaggaucuacuaaacca

SEQ ID NO: 1509393 - RNA, 19 nt, Homo sapiens
uaagacuggugcacguuug

SEQ ID NO: 1509394 - RNA, 19 nt, Homo sapiens
ggaccagaaggaucuacua

SEQ ID NO: 1509395 - RNA, 19 nt, Homo sapiens
aaagugcaucagcaaauua

SEQ ID NO: 1509396 - RNA, 19 nt, Homo sapiens
ccaauccggucaccugcaa

SEQ ID NO: 1509397 - RNA, 19 nt, Homo sapiens
gaugacaugagcaaaguug

SEQ ID NO: 1509398 - RNA, 19 nt, Homo sapiens
gauaaagcaaagucuaugu

SEQ ID NO: 1509399 - RNA, 19 nt, Homo sapiens
cgaguaggacauaucagua

SEQ ID NO: 1509400 - RNA, 19 nt, Homo sapiens
gaacuuucacuaaggaucu

SEQ ID NO: 1509401 - RNA, 19 nt, Homo sapiens
gacaguaugacaaggauau

SEQ ID NO: 1509402 - RNA, 19 nt, Homo sapiens
gcuauacgucggcauuauu

SEQ ID NO: 1509403 - RNA, 19 nt, Homo sapiens
cccagaacuucauaaagaa

SEQ ID NO: 1509404 - RNA, 19 nt, Homo sapiens
aaagcaaagucuauguuag

SEQ ID NO: 1509405 - RNA, 19 nt, Homo sapiens
uaggacauaucaguaagaa

SEQ ID NO: 1509406 - RNA, 19 nt, Homo sapiens
gaaacaaacuggaaaaccu

SEQ ID NO: 1509407 - RNA, 19 nt, Homo sapiens
ucacuaaggaucuggaugu

SEQ ID NO: 1509408 - RNA, 19 nt, Homo sapiens
ugaugaagauaaagcaaag

SEQ ID NO: 1509409 - RNA, 19 nt, Homo sapiens
cagcucuguuauucauaua

SEQ ID NO: 1509410 - RNA, 19 nt, Homo sapiens
uauggguccuugacauuug

SEQ ID NO: 1509411 - RNA, 19 nt, Homo sapiens
guacagauuuuaaccauac

SEQ ID NO: 1509412 - RNA, 19 nt, Homo sapiens
aaaggacugaugaagauaa

SEQ ID NO: 1509413 - RNA, 19 nt, Homo sapiens
uagaugacaugagcaaagu

SEQ ID NO: 1509414 - RNA, 19 nt, Homo sapiens
aaacccagaacuucauaaa

SEQ ID NO: 1509415 - RNA, 19 nt, Homo sapiens
caagucauuucagugguau

SEQ ID NO: 1509416 - RNA, 19 nt, Homo sapiens
uuacaaagcagccaaugca

SEQ ID NO: 1509417 - RNA, 19 nt, Homo sapiens
guagaugacaugagcaaag

SEQ ID NO: 1509418 - RNA, 19 nt, Homo sapiens
gcauugucauuugcuucua

SEQ ID NO: 1509419 - RNA, 19 nt, Homo sapiens
uuucagugguauuuggaua

SEQ ID NO: 1509420 - RNA, 19 nt, Homo sapiens
ggacaguaugacaaggaua

SEQ ID NO: 1509421 - RNA, 19 nt, Homo sapiens
ggaacccagccaccauaaa

SEQ ID NO: 1509422 - RNA, 19 nt, Homo sapiens
guaaaaugcgucuucaaaa

SEQ ID NO: 1509423 - RNA, 19 nt, Homo sapiens
ccagauaccaggaguaaaa

SEQ ID NO: 1509424 - RNA, 19 nt, Homo sapiens
aaggacugaugaagauaaa

SEQ ID NO: 1509425 - RNA, 19 nt, Homo sapiens
uuuggaacaucguggaauu

SEQ ID NO: 1509426 - RNA, 19 nt, Homo sapiens
gaguguaaguuuggaacau

SEQ ID NO: 1509427 - RNA, 19 nt, Homo sapiens
ucaacauagugucacaaga

SEQ ID NO: 1509428 - RNA, 19 nt, Homo sapiens
guguggaggccaacucuuu

SEQ ID NO: 1509429 - RNA, 19 nt, Homo sapiens
cuauacgucggcauuauuu

SEQ ID NO: 1509430 - RNA, 19 nt, Homo sapiens
gaauguaaugccuuguuuc

SEQ ID NO: 1509431 - RNA, 19 nt, Homo sapiens
agaaaugccauaauucaag

SEQ ID NO: 1509432 - RNA, 19 nt, Homo sapiens
gucacaagaguguaaguuu

SEQ ID NO: 1509433 - RNA, 19 nt, Homo sapiens
ugacaaggauauggauuuu

SEQ ID NO: 1509434 - RNA, 19 nt, Homo sapiens
acaaugagaaaugccauaa

SEQ ID NO: 1509435 - RNA, 19 nt, Homo sapiens
gcuugggcaucgaaagaga

SEQ ID NO: 1509436 - RNA, 19 nt, Homo sapiens
uaaauuaggugcuguguga

SEQ ID NO: 1509437 - RNA, 19 nt, Homo sapiens
gcagguauccgcagauuua

SEQ ID NO: 1509438 - RNA, 19 nt, Homo sapiens
guaaugaaguuaaccaaug

SEQ ID NO: 1509439 - RNA, 19 nt, Homo sapiens
uaaagagccuuggaauaua

SEQ ID NO: 1509440 - RNA, 19 nt, Homo sapiens
cuacaaaugugaagaaugu

SEQ ID NO: 1509441 - RNA, 19 nt, Homo sapiens
gagagaaacccuacaaaug

SEQ ID NO: 1509442 - RNA, 19 nt, Homo sapiens
gagagaaacccuacaaaug

SEQ ID NO: 1509443 - RNA, 19 nt, Homo sapiens
aaagagccuuggaauauaa

SEQ ID NO: 1509444 - RNA, 19 nt, Homo sapiens
ccaguuauguguucucauu

SEQ ID NO: 1509445 - RNA, 19 nt, Homo sapiens
gagaggaacccuacaaaug

SEQ ID NO: 1509446 - RNA, 19 nt, Homo sapiens
ggaaggaccaggaauaaau

SEQ ID NO: 1509447 - RNA, 19 nt, Homo sapiens
gaaguuaaccaauguuugu

SEQ ID NO: 1509448 - RNA, 19 nt, Homo sapiens
aaagagaaaugagauggua

SEQ ID NO: 1509449 - RNA, 19 nt, Homo sapiens
auucagagauguagucaua

SEQ ID NO: 1509450 - RNA, 19 nt, Homo sapiens
gagaaacccuacaaaugug

SEQ ID NO: 1509451 - RNA, 19 nt, Homo sapiens
gaaaguauacgccacaauc

SEQ ID NO: 1509452 - RNA, 19 nt, Homo sapiens
gagaugugauguuagagaa

SEQ ID NO: 1509453 - RNA, 19 nt, Homo sapiens
gagauguagucauagaauu

SEQ ID NO: 1509454 - RNA, 19 nt, Homo sapiens
gagaaacccuacacaugug

SEQ ID NO: 1509455 - RNA, 19 nt, Homo sapiens
gagagaaacccuacacaug

SEQ ID NO: 1509456 - RNA, 19 nt, Homo sapiens
gagaaacccuacagaugug

SEQ ID NO: 1509457 - RNA, 19 nt, Homo sapiens
gagagaaacccuacagaug

SEQ ID NO: 1509458 - RNA, 19 nt, Homo sapiens
ccucaacucuuaauacuca

SEQ ID NO: 1509459 - RNA, 19 nt, Homo sapiens
gaaggaccaggaauaaauu

SEQ ID NO: 1509460 - RNA, 19 nt, Homo sapiens
ggagagaaacccuacaaau

SEQ ID NO: 1509461 - RNA, 19 nt, Homo sapiens
ggagagaaacccuacaaau

SEQ ID NO: 1509462 - RNA, 19 nt, Homo sapiens
caaagucuucggcaaauuu

SEQ ID NO: 1509463 - RNA, 19 nt, Homo sapiens
agacauaagacaagacaua

SEQ ID NO: 1509464 - RNA, 19 nt, Homo sapiens
ccucaacccuuaagaaaca

SEQ ID NO: 1509465 - RNA, 19 nt, Homo sapiens
ccucaacccuuacuaaaca

SEQ ID NO: 1509466 - RNA, 19 nt, Homo sapiens
aaguggacaugacaauuua

SEQ ID NO: 1509467 - RNA, 19 nt, Homo sapiens
cuucagaccuuauaauaca

SEQ ID NO: 1509468 - RNA, 19 nt, Homo sapiens
gagagaaaccauacacaug

SEQ ID NO: 1509469 - RNA, 19 nt, Homo sapiens
cuacguauuucccagcuuu

SEQ ID NO: 1509470 - RNA, 19 nt, Homo sapiens
gaggaacccuacaaaugug

SEQ ID NO: 1509471 - RNA, 19 nt, Homo sapiens
gagaaaccauacacaugug

SEQ ID NO: 1509472 - RNA, 19 nt, Homo sapiens
gaauguggccaagccuuua

SEQ ID NO: 1509473 - RNA, 19 nt, Homo sapiens
cuacagaugugaggaaugu

SEQ ID NO: 1509474 - RNA, 19 nt, Homo sapiens
auaaagagccuuggaauau

SEQ ID NO: 1509475 - RNA, 19 nt, Homo sapiens
ucagagauguagucauaga

SEQ ID NO: 1509476 - RNA, 19 nt, Homo sapiens
gaaaugggacuguugacau

SEQ ID NO: 1509477 - RNA, 19 nt, Homo sapiens
agagaaacccuacaaaugu

SEQ ID NO: 1509478 - RNA, 19 nt, Homo sapiens
agagaaacccuacaaaugu

SEQ ID NO: 1509479 - RNA, 19 nt, Homo sapiens
gagaauucauacuggagaa

SEQ ID NO: 1509480 - RNA, 19 nt, Homo sapiens
aaaguggacaugacaauuu

SEQ ID NO: 1509481 - RNA, 19 nt, Homo sapiens
cagcagaauuuauauagag

SEQ ID NO: 1509482 - RNA, 19 nt, Homo sapiens
ggagagaaacccuacagau

SEQ ID NO: 1509483 - RNA, 19 nt, Homo sapiens
gacaagacauacuggaaag

SEQ ID NO: 1509484 - RNA, 19 nt, Homo sapiens
gcucuucaacccuuucuaa

SEQ ID NO: 1509485 - RNA, 19 nt, Homo sapiens
ucauaaaugugucaaaguc

SEQ ID NO: 1509486 - RNA, 19 nt, Homo sapiens
auagagaugugauguuaga

SEQ ID NO: 1509487 - RNA, 19 nt, Homo sapiens
cuucaacccuuucuaaaca

SEQ ID NO: 1509488 - RNA, 19 nt, Homo sapiens
caauagacauaagacaaga

SEQ ID NO: 1509489 - RNA, 19 nt, Homo sapiens
aaaaggagguuguaaugaa

SEQ ID NO: 1509490 - RNA, 19 nt, Homo sapiens
cuucugagcuccaguucuu

SEQ ID NO: 1509491 - RNA, 19 nt, Homo sapiens
ggugcugugugaaaguaua

SEQ ID NO: 1509492 - RNA, 19 nt, Homo sapiens
ggagaggaacccuacaaau

SEQ ID NO: 1509493 - RNA, 19 nt, Homo sapiens
ggagagaaaccauacacau

SEQ ID NO: 1509494 - RNA, 19 nt, Homo sapiens
ggacaugacaauuuacaag

SEQ ID NO: 1509495 - RNA, 19 nt, Homo sapiens
aauaaagagccuuggaaua

SEQ ID NO: 1509496 - RNA, 19 nt, Homo sapiens
gcucagcagaauuuauaua

SEQ ID NO: 1509497 - RNA, 19 nt, Homo sapiens
gcgggaaggaccaggaaua

SEQ ID NO: 1509498 - RNA, 19 nt, Homo sapiens
cuacaucaacaucagauaa

SEQ ID NO: 1509499 - RNA, 19 nt, Homo sapiens
ugaagaaugugacaaagcu

SEQ ID NO: 1509500 - RNA, 19 nt, Homo sapiens
ggaccaggaauaaauuuca

SEQ ID NO: 1509501 - RNA, 19 nt, Homo sapiens
ucaacccuuucuaaacaua

SEQ ID NO: 1509502 - RNA, 19 nt, Homo sapiens
cauaaaagauucacuccaa

SEQ ID NO: 1509503 - RNA, 19 nt, Homo sapiens
gcugggcccaagcaaauua

SEQ ID NO: 1509504 - RNA, 19 nt, Homo sapiens
agagaaacccuacacaugu

SEQ ID NO: 1509505 - RNA, 19 nt, Homo sapiens
ggagagaaacccuacacau

SEQ ID NO: 1509506 - RNA, 19 nt, Homo sapiens
agagaaacccuacagaugu

SEQ ID NO: 1509507 - RNA, 19 nt, Homo sapiens
cgccagagcuaggcauaaa

SEQ ID NO: 1509508 - RNA, 19 nt, Homo sapiens
gccuucagaccuuauaaua

SEQ ID NO: 1509509 - RNA, 19 nt, Homo sapiens
cauaagaggauucauacug

SEQ ID NO: 1509510 - RNA, 19 nt, Homo sapiens
ucacuuaccacaagagaau

SEQ ID NO: 1509511 - RNA, 19 nt, Homo sapiens
uugcaugguuucacaacua

SEQ ID NO: 1509512 - RNA, 19 nt, Homo sapiens
caagacauacuggaaagaa

SEQ ID NO: 1509513 - RNA, 19 nt, Homo sapiens
agaggaacccuacaaaugu

SEQ ID NO: 1509514 - RNA, 19 nt, Homo sapiens
ccucaacacuugcuaacca

SEQ ID NO: 1509515 - RNA, 19 nt, Homo sapiens
gauguuagagaacuacaga

SEQ ID NO: 1509516 - RNA, 19 nt, Homo sapiens
ggaucacgcucagcagaau

SEQ ID NO: 1509517 - RNA, 19 nt, Homo sapiens
ggcccaagcaaauuaguaa

SEQ ID NO: 1509518 - RNA, 19 nt, Homo sapiens
acucauaagaggauucaua

SEQ ID NO: 1509519 - RNA, 19 nt, Homo sapiens
agacaagacauacuggaaa

SEQ ID NO: 1509520 - RNA, 19 nt, Homo sapiens
gagguuguaaugaaguuaa

SEQ ID NO: 1509521 - RNA, 19 nt, Homo sapiens
gaaaccauacacaugugaa

SEQ ID NO: 1509522 - RNA, 19 nt, Homo sapiens
ucacaauucuacguauuuc

SEQ ID NO: 1509523 - RNA, 19 nt, Homo sapiens
ucaaagucuucggcaaauu

SEQ ID NO: 1509524 - RNA, 19 nt, Homo sapiens
guaauaccaagaagauaug

SEQ ID NO: 1509525 - RNA, 19 nt, Homo sapiens
cgagaaaugggacuguuga

SEQ ID NO: 1509526 - RNA, 19 nt, Homo sapiens
ccucaucccucacuuacca

SEQ ID NO: 1509527 - RNA, 19 nt, Homo sapiens
agagaaaccauacacaugu

SEQ ID NO: 1509528 - RNA, 19 nt, Homo sapiens
aaaggagguuguaaugaag

SEQ ID NO: 1509529 - RNA, 19 nt, Homo sapiens
ccaaacacccaguuaugug

SEQ ID NO: 1509530 - RNA, 19 nt, Homo sapiens
acgcucagcagaauuuaua

SEQ ID NO: 1509531 - RNA, 19 nt, Homo sapiens
gccuucuccucaacucuua

SEQ ID NO: 1509532 - RNA, 19 nt, Homo sapiens
ggucugagagucuacacuu

SEQ ID NO: 1509533 - RNA, 19 nt, Homo sapiens
gguccucaacccuuacuaa

SEQ ID NO: 1509534 - RNA, 19 nt, Homo sapiens
aagacauacuggaaagaaa

SEQ ID NO: 1509535 - RNA, 19 nt, Homo sapiens
aaccaauguuugucaacua

SEQ ID NO: 1509536 - RNA, 19 nt, Homo sapiens
ggaagaagcuccacuuuga

SEQ ID NO: 1509537 - RNA, 19 nt, Homo sapiens
gaacagaaccuuugcaagu

SEQ ID NO: 1509538 - RNA, 19 nt, Homo sapiens
ggagacaaauaaugaaguu

SEQ ID NO: 1509539 - RNA, 19 nt, Homo sapiens
gaagggaguucucauuaca

SEQ ID NO: 1509540 - RNA, 19 nt, Homo sapiens
ggaaucauguguugucaga

SEQ ID NO: 1509541 - RNA, 19 nt, Homo sapiens
gaaaucagguccuaauacu

SEQ ID NO: 1509542 - RNA, 19 nt, Homo sapiens
caacagaucuucagaacac

SEQ ID NO: 1509543 - RNA, 19 nt, Homo sapiens
gaaagcacaucaucuggau

SEQ ID NO: 1509544 - RNA, 19 nt, Homo sapiens
ugaacugccugaaaccuua

SEQ ID NO: 1509545 - RNA, 19 nt, Homo sapiens
caaaugaacugccugaaac

SEQ ID NO: 1509546 - RNA, 19 nt, Homo sapiens
ugucacaacugcuaccuua

SEQ ID NO: 1509547 - RNA, 19 nt, Homo sapiens
gaagaugucguugugguua

SEQ ID NO: 1509548 - RNA, 19 nt, Homo sapiens
gagaguggcaggaguuaua

SEQ ID NO: 1509549 - RNA, 19 nt, Homo sapiens
gugaagaggagacaaauaa

SEQ ID NO: 1509550 - RNA, 19 nt, Homo sapiens
gaacacauuuggacaacuc

SEQ ID NO: 1509551 - RNA, 19 nt, Homo sapiens
gcaggaaccucagauaaag

SEQ ID NO: 1509552 - RNA, 19 nt, Homo sapiens
ccugaaaccuuaucaccua

SEQ ID NO: 1509553 - RNA, 19 nt, Homo sapiens
guggagugaucaucuauaa

SEQ ID NO: 1509554 - RNA, 19 nt, Homo sapiens
gaaguucaguguucuuugg

SEQ ID NO: 1509555 - RNA, 19 nt, Homo sapiens
gaagaggagacaaauaaug

SEQ ID NO: 1509556 - RNA, 19 nt, Homo sapiens
cuauaagccuaaugacaua

SEQ ID NO: 1509557 - RNA, 19 nt, Homo sapiens
gagcaaguguuguuuggau

SEQ ID NO: 1509558 - RNA, 19 nt, Homo sapiens
guauuaaaccuguauguga

SEQ ID NO: 1509559 - RNA, 19 nt, Homo sapiens
ucaccucucucuaguaaga

SEQ ID NO: 1509560 - RNA, 19 nt, Homo sapiens
aaauuaaaguggcaacuga

SEQ ID NO: 1509561 - RNA, 19 nt, Homo sapiens
gaaacaacacugccucuuc

SEQ ID NO: 1509562 - RNA, 19 nt, Homo sapiens
ugacauaguucguauucug

SEQ ID NO: 1509563 - RNA, 19 nt, Homo sapiens
ggagaaagcacaucaucug

SEQ ID NO: 1509564 - RNA, 19 nt, Homo sapiens
gaagagaguggcaggaguu

SEQ ID NO: 1509565 - RNA, 19 nt, Homo sapiens
gacaguggaucuuguuugu

SEQ ID NO: 1509566 - RNA, 19 nt, Homo sapiens
cauccagccucauucagua

SEQ ID NO: 1509567 - RNA, 19 nt, Homo sapiens
ggggauagcugcguaauuu

SEQ ID NO: 1509568 - RNA, 19 nt, Homo sapiens
caguggaucuuguuuguau

SEQ ID NO: 1509569 - RNA, 19 nt, Homo sapiens
gguuguaccuucacacaga

SEQ ID NO: 1509570 - RNA, 19 nt, Homo sapiens
gaagaagcuccacuuugaa

SEQ ID NO: 1509571 - RNA, 19 nt, Homo sapiens
gaaguguauuaaaccugua

SEQ ID NO: 1509572 - RNA, 19 nt, Homo sapiens
gcuauaagccuaaugacau

SEQ ID NO: 1509573 - RNA, 19 nt, Homo sapiens
uaagacaucugaaacucau

SEQ ID NO: 1509574 - RNA, 19 nt, Homo sapiens
cagauaaaguaauccaugu

SEQ ID NO: 1509575 - RNA, 19 nt, Homo sapiens
acuguuagguugguucuua

SEQ ID NO: 1509576 - RNA, 19 nt, Homo sapiens
ucaaaugaacugccugaaa

SEQ ID NO: 1509577 - RNA, 19 nt, Homo sapiens
cuaaugacauaguucguau

SEQ ID NO: 1509578 - RNA, 19 nt, Homo sapiens
ccaguggagugaucaucua

SEQ ID NO: 1509579 - RNA, 19 nt, Homo sapiens
caagcaguuugucuguuaa

SEQ ID NO: 1509580 - RNA, 19 nt, Homo sapiens
gaaaccuuaucaccuagug

SEQ ID NO: 1509581 - RNA, 19 nt, Homo sapiens
uuucaccucucucuaguaa

SEQ ID NO: 1509582 - RNA, 19 nt, Homo sapiens
agaccuggcuugcacuuau

SEQ ID NO: 1509583 - RNA, 19 nt, Homo sapiens
guuuguauccugaagauuu

SEQ ID NO: 1509584 - RNA, 19 nt, Homo sapiens
uaacaacagaucuucagaa

SEQ ID NO: 1509585 - RNA, 19 nt, Homo sapiens
gaccuggcuugcacuuauu

SEQ ID NO: 1509586 - RNA, 19 nt, Homo sapiens
aagaggagacaaauaauga

SEQ ID NO: 1509587 - RNA, 19 nt, Homo sapiens
acucauaagccaucuuuaa

SEQ ID NO: 1509588 - RNA, 19 nt, Homo sapiens
uaucuagaguuaacaguag

SEQ ID NO: 1509589 - RNA, 19 nt, Homo sapiens
aaacucauaagccaucuuu

SEQ ID NO: 1509590 - RNA, 19 nt, Homo sapiens
guaucuagaguuaacagua

SEQ ID NO: 1509591 - RNA, 19 nt, Homo sapiens
gcagagcaaguguuguuug

SEQ ID NO: 1509592 - RNA, 19 nt, Homo sapiens
caaguucuaaugucaaaug

SEQ ID NO: 1509593 - RNA, 19 nt, Homo sapiens
ccacaagaauugcauugac

SEQ ID NO: 1509594 - RNA, 19 nt, Homo sapiens
gaucaucuauaacguucca

SEQ ID NO: 1509595 - RNA, 19 nt, Homo sapiens
aacagaaccuuugcaaguu

SEQ ID NO: 1509596 - RNA, 19 nt, Homo sapiens
aaaccuguaugugaaauca

SEQ ID NO: 1509597 - RNA, 19 nt, Homo sapiens
ucauagacuuuguuuagca

SEQ ID NO: 1509598 - RNA, 19 nt, Homo sapiens
gugaaaucagguccuaaua

SEQ ID NO: 1509599 - RNA, 19 nt, Homo sapiens
guucguauucugacuugua

SEQ ID NO: 1509600 - RNA, 19 nt, Homo sapiens
cauagacuuuguuuagcaa

SEQ ID NO: 1509601 - RNA, 19 nt, Homo sapiens
ucacauucauagacuuugu

SEQ ID NO: 1509602 - RNA, 19 nt, Homo sapiens
ggagugaucaucuauaacg

SEQ ID NO: 1509603 - RNA, 19 nt, Homo sapiens
gaaccucagauaaaguaau

SEQ ID NO: 1509604 - RNA, 19 nt, Homo sapiens
cuggaugaaucacuauuug

SEQ ID NO: 1509605 - RNA, 19 nt, Homo sapiens
uuaagucacucggagaaga

SEQ ID NO: 1509606 - RNA, 19 nt, Homo sapiens
aguguucuuuggcuuguua

SEQ ID NO: 1509607 - RNA, 19 nt, Homo sapiens
uaugugaaaucagguccua

SEQ ID NO: 1509608 - RNA, 19 nt, Homo sapiens
gacauaguucguauucuga

SEQ ID NO: 1509609 - RNA, 19 nt, Homo sapiens
guaagacaucugaaacuca

SEQ ID NO: 1509610 - RNA, 19 nt, Homo sapiens
gaugugcaacuguuagguu

SEQ ID NO: 1509611 - RNA, 19 nt, Homo sapiens
aaucauguguugucagagu

SEQ ID NO: 1509612 - RNA, 19 nt, Homo sapiens
uagguugguucuuaaguca

SEQ ID NO: 1509613 - RNA, 19 nt, Homo sapiens
agacaucugaaacucauaa

SEQ ID NO: 1509614 - RNA, 19 nt, Homo sapiens
cagagcaaguguuguuugg

SEQ ID NO: 1509615 - RNA, 19 nt, Homo sapiens
gaucuucagaacacauuug

SEQ ID NO: 1509616 - RNA, 19 nt, Homo sapiens
ggaugaaucacuauuuggu

SEQ ID NO: 1509617 - RNA, 19 nt, Homo sapiens
ugcaaguucuaaugucaaa

SEQ ID NO: 1509618 - RNA, 19 nt, Homo sapiens
cugcguaauuugcuuugaa

SEQ ID NO: 1509619 - RNA, 19 nt, Homo sapiens
gcgauuaacaacagaucuu

SEQ ID NO: 1509620 - RNA, 19 nt, Homo sapiens
uguaaucccaauaccauuu

SEQ ID NO: 1509621 - RNA, 19 nt, Homo sapiens
guucauccuucaccuugau

SEQ ID NO: 1509622 - RNA, 19 nt, Homo sapiens
uaccuuagcauauuucauc

SEQ ID NO: 1509623 - RNA, 19 nt, Homo sapiens
ugaaaucagguccuaauac

SEQ ID NO: 1509624 - RNA, 19 nt, Homo sapiens
ugcaggaaccucagauaaa

SEQ ID NO: 1509625 - RNA, 19 nt, Homo sapiens
gaacugccugaaaccuuau

SEQ ID NO: 1509626 - RNA, 19 nt, Homo sapiens
aaauggaacagaaccuuug

SEQ ID NO: 1509627 - RNA, 19 nt, Homo sapiens
ggacaugccccauuugcaa

SEQ ID NO: 1509628 - RNA, 19 nt, Homo sapiens
ccuaaugacauaguucgua

SEQ ID NO: 1509629 - RNA, 19 nt, Homo sapiens
uaagccuaaugacauaguu

SEQ ID NO: 1509630 - RNA, 19 nt, Homo sapiens
ucagaacacauuuggacaa

SEQ ID NO: 1509631 - RNA, 19 nt, Homo sapiens
gagauggcagcgauuaaca

SEQ ID NO: 1509632 - RNA, 19 nt, Homo sapiens
uaaaguggcaacugagaag

SEQ ID NO: 1509633 - RNA, 19 nt, Homo sapiens
cgaucaaaguacucagaga

SEQ ID NO: 1509634 - RNA, 19 nt, Homo sapiens
gaagcuccacuuugaagag

SEQ ID NO: 1509635 - RNA, 19 nt, Homo sapiens
gaggaaguguauuaaaccu

SEQ ID NO: 1509636 - RNA, 19 nt, Homo sapiens
gaagggaugggccuaauua

SEQ ID NO: 1509637 - RNA, 19 nt, Homo sapiens
gaccagaacugaaggaaga

SEQ ID NO: 1509638 - RNA, 19 nt, Homo sapiens
gauaauaccagaccgauuu

SEQ ID NO: 1509639 - RNA, 19 nt, Homo sapiens
gaugcuacaugguuauaua

SEQ ID NO: 1509640 - RNA, 19 nt, Homo sapiens
caucuucacuugacuguuu

SEQ ID NO: 1509641 - RNA, 19 nt, Homo sapiens
gcaagcaaauguaccaaga

SEQ ID NO: 1509642 - RNA, 19 nt, Homo sapiens
gcuguugcauguuguaaua

SEQ ID NO: 1509643 - RNA, 19 nt, Homo sapiens
caguauggcuuccuuaauu

SEQ ID NO: 1509644 - RNA, 19 nt, Homo sapiens
caacagaaauuagcacaau

SEQ ID NO: 1509645 - RNA, 19 nt, Homo sapiens
ggagauacacccuauauuc

SEQ ID NO: 1509646 - RNA, 19 nt, Homo sapiens
aaacggagauuuaaauugg

SEQ ID NO: 1509647 - RNA, 19 nt, Homo sapiens
gcaaacaagucauuagcau

SEQ ID NO: 1509648 - RNA, 19 nt, Homo sapiens
cuaagaagcuaaucaaugg

SEQ ID NO: 1509649 - RNA, 19 nt, Homo sapiens
ggaagacucuaggaacuga

SEQ ID NO: 1509650 - RNA, 19 nt, Homo sapiens
gcaaugguuuacagauauu

SEQ ID NO: 1509651 - RNA, 19 nt, Homo sapiens
acagauggcucaugcuauu

SEQ ID NO: 1509652 - RNA, 19 nt, Homo sapiens
uaaagaaggcaaugcagua

SEQ ID NO: 1509653 - RNA, 19 nt, Homo sapiens
uuacagugcugcagagauu

SEQ ID NO: 1509654 - RNA, 19 nt, Homo sapiens
gcacagauggcucaugcua

SEQ ID NO: 1509655 - RNA, 19 nt, Homo sapiens
gcuacaucaugaagcauua

SEQ ID NO: 1509656 - RNA, 19 nt, Homo sapiens
agaagcagcauauagaaua

SEQ ID NO: 1509657 - RNA, 19 nt, Homo sapiens
gaccaaagagugcaucaaa

SEQ ID NO: 1509658 - RNA, 19 nt, Homo sapiens
gagauuuacccacauauug

SEQ ID NO: 1509659 - RNA, 19 nt, Homo sapiens
gugcugaccuuuacacugu

SEQ ID NO: 1509660 - RNA, 19 nt, Homo sapiens
cagauauuguugcaagaua

SEQ ID NO: 1509661 - RNA, 19 nt, Homo sapiens
ggcaaugguuuacagauau

SEQ ID NO: 1509662 - RNA, 19 nt, Homo sapiens
cgaaaucaauggagugaca

SEQ ID NO: 1509663 - RNA, 19 nt, Homo sapiens
cuacaugguuauauacuug

SEQ ID NO: 1509664 - RNA, 19 nt, Homo sapiens
uggcaaugguuuacagaua

SEQ ID NO: 1509665 - RNA, 19 nt, Homo sapiens
ucacuugacuguuuguaau

SEQ ID NO: 1509666 - RNA, 19 nt, Homo sapiens
gguacuuucuguaauuuga

SEQ ID NO: 1509667 - RNA, 19 nt, Homo sapiens
aaacaagucauuagcauug

SEQ ID NO: 1509668 - RNA, 19 nt, Homo sapiens
aaacuucucucugguguug

SEQ ID NO: 1509669 - RNA, 19 nt, Homo sapiens
uaaacgcuguugcauguug

SEQ ID NO: 1509670 - RNA, 19 nt, Homo sapiens
acagagauuuacccacaua

SEQ ID NO: 1509671 - RNA, 19 nt, Homo sapiens
uuacacuucuugacuguuu

SEQ ID NO: 1509672 - RNA, 19 nt, Homo sapiens
ccaaagagugcaucaaaug

SEQ ID NO: 1509673 - RNA, 19 nt, Homo sapiens
gaagauguugcaagucauu

SEQ ID NO: 1509674 - RNA, 19 nt, Homo sapiens
cagcauagauaaugaacuc

SEQ ID NO: 1509675 - RNA, 19 nt, Homo sapiens
gcuggaagauguugcaagu

SEQ ID NO: 1509676 - RNA, 19 nt, Homo sapiens
uauggaagcugcaauuucu

SEQ ID NO: 1509677 - RNA, 19 nt, Homo sapiens
gacacaaggugauagaagu

SEQ ID NO: 1509678 - RNA, 19 nt, Homo sapiens
guuggaugcuacaugguua

SEQ ID NO: 1509679 - RNA, 19 nt, Homo sapiens
guacauuauuucagcauag

SEQ ID NO: 1509680 - RNA, 19 nt, Homo sapiens
uaacagcaaacaagucauu

SEQ ID NO: 1509681 - RNA, 19 nt, Homo sapiens
guugucaucugguggauug

SEQ ID NO: 1509682 - RNA, 19 nt, Homo sapiens
uggaagauguugcaaguca

SEQ ID NO: 1509683 - RNA, 19 nt, Homo sapiens
uuuaaacgcuguugcaugu

SEQ ID NO: 1509684 - RNA, 19 nt, Homo sapiens
aagaaugacucaaagaaag

SEQ ID NO: 1509685 - RNA, 19 nt, Homo sapiens
agacacacacacagaaaua

SEQ ID NO: 1509686 - RNA, 19 nt, Homo sapiens
gauacacccuauauuccuu

SEQ ID NO: 1509687 - RNA, 19 nt, Homo sapiens
aaagagugcaucaaaugua

SEQ ID NO: 1509688 - RNA, 19 nt, Homo sapiens
gggaugggccuaauuaaag

SEQ ID NO: 1509689 - RNA, 19 nt, Homo sapiens
ggagguugcccauuguuug

SEQ ID NO: 1509690 - RNA, 19 nt, Homo sapiens
gaauugaggaucugaugga

SEQ ID NO: 1509691 - RNA, 19 nt, Homo sapiens
ggcauuagggccauuauga

SEQ ID NO: 1509692 - RNA, 19 nt, Homo sapiens
gcauagguugggcuaguua

SEQ ID NO: 1509693 - RNA, 19 nt, Homo sapiens
gguguaaagugggaaauca

SEQ ID NO: 1509694 - RNA, 19 nt, Homo sapiens
gucaaaagauuucuggaua

SEQ ID NO: 1509695 - RNA, 19 nt, Homo sapiens
guugaugacauuuccauaa

SEQ ID NO: 1509696 - RNA, 19 nt, Homo sapiens
aagcugcaauuucuacauu

SEQ ID NO: 1509697 - RNA, 19 nt, Homo sapiens
gcuacaugguuauauacuu

SEQ ID NO: 1509698 - RNA, 19 nt, Homo sapiens
caaaaggcauuacugaaau

SEQ ID NO: 1509699 - RNA, 19 nt, Homo sapiens
uaaagacacacacacagaa

SEQ ID NO: 1509700 - RNA, 19 nt, Homo sapiens
ggagugacacaaggugaua

SEQ ID NO: 1509701 - RNA, 19 nt, Homo sapiens
gaaucaagaccagcaagaa

SEQ ID NO: 1509702 - RNA, 19 nt, Homo sapiens
uuucagagaugcugccuau

SEQ ID NO: 1509703 - RNA, 19 nt, Homo sapiens
gaaaggcccagcucucaag

SEQ ID NO: 1509704 - RNA, 19 nt, Homo sapiens
gcauuagggccauuaugaa

SEQ ID NO: 1509705 - RNA, 19 nt, Homo sapiens
gauuguuugugacuacauu

SEQ ID NO: 1509706 - RNA, 19 nt, Homo sapiens
gcaagaacccaaaccuuac

SEQ ID NO: 1509707 - RNA, 19 nt, Homo sapiens
agcaagaacccaaaccuua

SEQ ID NO: 1509708 - RNA, 19 nt, Homo sapiens
cauauuuccuuccaugcaa

SEQ ID NO: 1509709 - RNA, 19 nt, Homo sapiens
gcuuuaccaucuucacuug

SEQ ID NO: 1509710 - RNA, 19 nt, Homo sapiens
cagagcagccuucuccaaa

SEQ ID NO: 1509711 - RNA, 19 nt, Homo sapiens
cagagaugcugccuaugga

SEQ ID NO: 1509712 - RNA, 19 nt, Homo sapiens
gauaaugaacucgaauaug

SEQ ID NO: 1509713 - RNA, 19 nt, Homo sapiens
ggaugggccuaauuaaagg

SEQ ID NO: 1509714 - RNA, 19 nt, Homo sapiens
caaacaagucauuagcauu

SEQ ID NO: 1509715 - RNA, 19 nt, Homo sapiens
uaaauggggucgagaauca

SEQ ID NO: 1509716 - RNA, 19 nt, Homo sapiens
gagcagccuucuccaaacu

SEQ ID NO: 1509717 - RNA, 19 nt, Homo sapiens
aguauggcuuccuuaauuu

SEQ ID NO: 1509718 - RNA, 19 nt, Homo sapiens
cauagauaaugaacucgaa

SEQ ID NO: 1509719 - RNA, 19 nt, Homo sapiens
caaagagugcaucaaaugu

SEQ ID NO: 1509720 - RNA, 19 nt, Homo sapiens
ucagaagaauugaggaucu

SEQ ID NO: 1509721 - RNA, 19 nt, Homo sapiens
uggcaagcauuguaguuga

SEQ ID NO: 1509722 - RNA, 19 nt, Homo sapiens
gcuauuguuuguggcuuaa

SEQ ID NO: 1509723 - RNA, 19 nt, Homo sapiens
ccuaagaagcuaaucaaug

SEQ ID NO: 1509724 - RNA, 19 nt, Homo sapiens
ucugguggauuguuuguga

SEQ ID NO: 1509725 - RNA, 19 nt, Homo sapiens
caacucauuuaaccuugau

SEQ ID NO: 1509726 - RNA, 19 nt, Homo sapiens
cugcuugucuucuaccaaa

SEQ ID NO: 1509727 - RNA, 19 nt, Homo sapiens
ggaauuaaagacacacaca

SEQ ID NO: 1509728 - RNA, 19 nt, Homo sapiens
cuuaguugcuuuccaccua

SEQ ID NO: 1509729 - RNA, 19 nt, Homo sapiens
gauagcugcuucucuccau

SEQ ID NO: 1509730 - RNA, 19 nt, Homo sapiens
cuauuuggcuuuaccaucu

SEQ ID NO: 1509731 - RNA, 19 nt, Homo sapiens
caagucauuagcauuguuu

SEQ ID NO: 1509732 - RNA, 19 nt, Homo sapiens
ggagaauggacaacacaga

SEQ ID NO: 1509733 - RNA, 19 nt, Homo sapiens
gugcauguguguccuugug

SEQ ID NO: 1509734 - RNA, 19 nt, Homo sapiens
agaaugccuuuaagcaguu

SEQ ID NO: 1509735 - RNA, 19 nt, Homo sapiens
gcagaaaacggagauuuaa

SEQ ID NO: 1509736 - RNA, 19 nt, Homo sapiens
ggacagaaguucgaacaug

SEQ ID NO: 1509737 - RNA, 19 nt, Homo sapiens
gcucagugauuacaaacaa

SEQ ID NO: 1509738 - RNA, 19 nt, Homo sapiens
uguaugggcucagugauua

SEQ ID NO: 1509739 - RNA, 19 nt, Homo sapiens
ggaauuugguuucgugcuu

SEQ ID NO: 1509740 - RNA, 19 nt, Homo sapiens
gaagcccacucguuuccua

SEQ ID NO: 1509741 - RNA, 19 nt, Homo sapiens
gacagaaguucgaacaugu

SEQ ID NO: 1509742 - RNA, 19 nt, Homo sapiens
gaaguccuccgaagacauu

SEQ ID NO: 1509743 - RNA, 19 nt, Homo sapiens
gguucaagcuugugacugu

SEQ ID NO: 1509744 - RNA, 19 nt, Homo sapiens
guuucgugcuuguguaaua

SEQ ID NO: 1509745 - RNA, 19 nt, Homo sapiens
gcacuuuacgcgcgaagaa

SEQ ID NO: 1509746 - RNA, 19 nt, Homo sapiens
ggaaugaacaagugucagu

SEQ ID NO: 1509747 - RNA, 19 nt, Homo sapiens
guuaguagugcaaggauuu

SEQ ID NO: 1509748 - RNA, 19 nt, Homo sapiens
cuaccucacuggucuggaa

SEQ ID NO: 1509749 - RNA, 19 nt, Homo sapiens
gggaggagaagguggugua

SEQ ID NO: 1509750 - RNA, 19 nt, Homo sapiens
gaaguugccggaugguugu

SEQ ID NO: 1509751 - RNA, 19 nt, Homo sapiens
gcccacucguuuccuaauu

SEQ ID NO: 1509752 - RNA, 19 nt, Homo sapiens
cccacucguuuccuaauuu

SEQ ID NO: 1509753 - RNA, 19 nt, Homo sapiens
aagcuuugaucgaggauau

SEQ ID NO: 1509754 - RNA, 19 nt, Homo sapiens
uauauuuacugagcuccua

SEQ ID NO: 1509755 - RNA, 19 nt, Homo sapiens
acaaagacaugcaaaauac

SEQ ID NO: 1509756 - RNA, 19 nt, Homo sapiens
ucagucgaguguuuacaga

SEQ ID NO: 1509757 - RNA, 19 nt, Homo sapiens
ccggaggaaugaacaagug

SEQ ID NO: 1509758 - RNA, 19 nt, Homo sapiens
guagugcaaggauuuguau

SEQ ID NO: 1509759 - RNA, 19 nt, Homo sapiens
uuaagagguucaagcuugu

SEQ ID NO: 1509760 - RNA, 19 nt, Homo sapiens
aaugguagaauacacauga

SEQ ID NO: 1509761 - RNA, 19 nt, Homo sapiens
gcuugugacuguuaguagu

SEQ ID NO: 1509762 - RNA, 19 nt, Homo sapiens
gaggaaugaacaaguguca

SEQ ID NO: 1509763 - RNA, 19 nt, Homo sapiens
gauuacaaacaaagacaug

SEQ ID NO: 1509764 - RNA, 19 nt, Homo sapiens
aagccagaauuuacuuguu

SEQ ID NO: 1509765 - RNA, 19 nt, Homo sapiens
aagugucagucgaguguuu

SEQ ID NO: 1509766 - RNA, 19 nt, Homo sapiens
gcuuugaucgaggauauuu

SEQ ID NO: 1509767 - RNA, 19 nt, Homo sapiens
agccagaauuuacuuguuc

SEQ ID NO: 1509768 - RNA, 19 nt, Homo sapiens
ggauuuguaugggcucagu

SEQ ID NO: 1509769 - RNA, 19 nt, Homo sapiens
gggcagauccguuuucuca

SEQ ID NO: 1509770 - RNA, 19 nt, Homo sapiens
aggagaaggugguguacuc

SEQ ID NO: 1509771 - RNA, 19 nt, Homo sapiens
uuucgugcuuguguaauaa

SEQ ID NO: 1509772 - RNA, 19 nt, Homo sapiens
agacgucuccaggaccuua

SEQ ID NO: 1509773 - RNA, 19 nt, Homo sapiens
ccacucguuuccuaauuuu

SEQ ID NO: 1509774 - RNA, 19 nt, Homo sapiens
acaaacaaagacaugcaaa

SEQ ID NO: 1509775 - RNA, 19 nt, Homo sapiens
ugggcucagugauuacaaa

SEQ ID NO: 1509776 - RNA, 19 nt, Homo sapiens
guucaagcuugugacuguu

SEQ ID NO: 1509777 - RNA, 19 nt, Homo sapiens
ggaaguccuccgaagacau

SEQ ID NO: 1509778 - RNA, 19 nt, Homo sapiens
acaagugucagucgagugu

SEQ ID NO: 1509779 - RNA, 19 nt, Homo sapiens
caaacaaagacaugcaaaa

SEQ ID NO: 1509780 - RNA, 19 nt, Homo sapiens
gcagauccguuuucucacu

SEQ ID NO: 1509781 - RNA, 19 nt, Homo sapiens
caugugguguugcacuagu

SEQ ID NO: 1509782 - RNA, 19 nt, Homo sapiens
agucgaguguuuacagauc

SEQ ID NO: 1509783 - RNA, 19 nt, Homo sapiens
gguagaauacacaugaaaa

SEQ ID NO: 1509784 - RNA, 19 nt, Homo sapiens
ucaagcuugugacuguuag

SEQ ID NO: 1509785 - RNA, 19 nt, Homo sapiens
ccacaaaccuuucauuaua

SEQ ID NO: 1509786 - RNA, 19 nt, Homo sapiens
ggacuuccauuaugaauuu

SEQ ID NO: 1509787 - RNA, 19 nt, Homo sapiens
ggagagacacccaguauua

SEQ ID NO: 1509788 - RNA, 19 nt, Homo sapiens
gcucaaggcuguuauuuau

SEQ ID NO: 1509789 - RNA, 19 nt, Homo sapiens
uaacagugcugauagaauu

SEQ ID NO: 1509790 - RNA, 19 nt, Homo sapiens
ggccauggcuuguuacuuu

SEQ ID NO: 1509791 - RNA, 19 nt, Homo sapiens
uuaaagaugucacugcuua

SEQ ID NO: 1509792 - RNA, 19 nt, Homo sapiens
ggaaacaccuccaaacaca

SEQ ID NO: 1509793 - RNA, 19 nt, Homo sapiens
cagaguaccuggaggauuu

SEQ ID NO: 1509794 - RNA, 19 nt, Homo sapiens
aaagaaagcugguuacauc

SEQ ID NO: 1509795 - RNA, 19 nt, Homo sapiens
gcgaggaccuguauaauuc

SEQ ID NO: 1509796 - RNA, 19 nt, Homo sapiens
gaacagacagugacaauca

SEQ ID NO: 1509797 - RNA, 19 nt, Homo sapiens
ccaaacagauauuuagcua

SEQ ID NO: 1509798 - RNA, 19 nt, Homo sapiens
gaaaagcacugugguuaua

SEQ ID NO: 1509799 - RNA, 19 nt, Homo sapiens
gaaaggaauuccagacaca

SEQ ID NO: 1509800 - RNA, 19 nt, Homo sapiens
ucagaaagaugccagugua

SEQ ID NO: 1509801 - RNA, 19 nt, Homo sapiens
ggaagucucugagcaagaa

SEQ ID NO: 1509802 - RNA, 19 nt, Homo sapiens
ggaagaggcugagaugguu

SEQ ID NO: 1509803 - RNA, 19 nt, Homo sapiens
ggaagucuaucgacaugaa

SEQ ID NO: 1509804 - RNA, 19 nt, Homo sapiens
gaaaugaggcuacacaaca

SEQ ID NO: 1509805 - RNA, 19 nt, Homo sapiens
ccaguaaccuuggauauga

SEQ ID NO: 1509806 - RNA, 19 nt, Homo sapiens
gaggauggccuggauaaua

SEQ ID NO: 1509807 - RNA, 19 nt, Homo sapiens
gcacugugguuauacauca

SEQ ID NO: 1509808 - RNA, 19 nt, Homo sapiens
ggacuuugccgagcauuua

SEQ ID NO: 1509809 - RNA, 19 nt, Homo sapiens
ucaaagguguacauuguuu

SEQ ID NO: 1509810 - RNA, 19 nt, Homo sapiens
caacaugucugaggcaaug

SEQ ID NO: 1509811 - RNA, 19 nt, Homo sapiens
ggacauuucuaguuaccaa

SEQ ID NO: 1509812 - RNA, 19 nt, Homo sapiens
guucaacucuaccguauga

SEQ ID NO: 1509813 - RNA, 19 nt, Homo sapiens
gaauuacagucaucucaga

SEQ ID NO: 1509814 - RNA, 19 nt, Homo sapiens
gaagacagccagcuaagga

SEQ ID NO: 1509815 - RNA, 19 nt, Homo sapiens
gaagcagcguuaaguguug

SEQ ID NO: 1509816 - RNA, 19 nt, Homo sapiens
gaaucacaauuacuacuug

SEQ ID NO: 1509817 - RNA, 19 nt, Homo sapiens
gcacuucacucucuauaac

SEQ ID NO: 1509818 - RNA, 19 nt, Homo sapiens
gcagugaacuauacaguac

SEQ ID NO: 1509819 - RNA, 19 nt, Homo sapiens
gcauuuaccuggugaccuu

SEQ ID NO: 1509820 - RNA, 19 nt, Homo sapiens
gaauuuaguuaccagauag

SEQ ID NO: 1509821 - RNA, 19 nt, Homo sapiens
gugagcacuuggacaauua

SEQ ID NO: 1509822 - RNA, 19 nt, Homo sapiens
ggaacuugauggacucuga

SEQ ID NO: 1509823 - RNA, 19 nt, Homo sapiens
gaagaaggaauuacaguca

SEQ ID NO: 1509824 - RNA, 19 nt, Homo sapiens
cucgugagcuucucuaaua

SEQ ID NO: 1509825 - RNA, 19 nt, Homo sapiens
uaguggacauuucuaguua

SEQ ID NO: 1509826 - RNA, 19 nt, Homo sapiens
ccucaaagguguacauugu

SEQ ID NO: 1509827 - RNA, 19 nt, Homo sapiens
gcacuuggacaauuacaaa

SEQ ID NO: 1509828 - RNA, 19 nt, Homo sapiens
acacagaaaucaggaacua

SEQ ID NO: 1509829 - RNA, 19 nt, Homo sapiens
gcagucuucugugauauuu

SEQ ID NO: 1509830 - RNA, 19 nt, Homo sapiens
gcugcagucuucugugaua

SEQ ID NO: 1509831 - RNA, 19 nt, Homo sapiens
auacaucacuuuccaucua

SEQ ID NO: 1509832 - RNA, 19 nt, Homo sapiens
cggaaagaauuuacaagaa

SEQ ID NO: 1509833 - RNA, 19 nt, Homo sapiens
cagcaggacuucucugaug

SEQ ID NO: 1509834 - RNA, 19 nt, Homo sapiens
gaggaagucuaucgacaug

SEQ ID NO: 1509835 - RNA, 19 nt, Homo sapiens
gcaugacugucugguauaa

SEQ ID NO: 1509836 - RNA, 19 nt, Homo sapiens
cagcaugacugucugguau

SEQ ID NO: 1509837 - RNA, 19 nt, Homo sapiens
gaacguuucucuccacaac

SEQ ID NO: 1509838 - RNA, 19 nt, Homo sapiens
caaucaagcuauccggaaa

SEQ ID NO: 1509839 - RNA, 19 nt, Homo sapiens
cagagcccaugcuacauua

SEQ ID NO: 1509840 - RNA, 19 nt, Homo sapiens
gcagugaaauaccgaaucu

SEQ ID NO: 1509841 - RNA, 19 nt, Homo sapiens
ugacagcuaugaucaguuc

SEQ ID NO: 1509842 - RNA, 19 nt, Homo sapiens
gcacagauguugccuaccu

SEQ ID NO: 1509843 - RNA, 19 nt, Homo sapiens
gaaaugauugguucuguuc

SEQ ID NO: 1509844 - RNA, 19 nt, Homo sapiens
gcacugugguggugacugu

SEQ ID NO: 1509845 - RNA, 19 nt, Homo sapiens
gagacacccaguauuauuu

SEQ ID NO: 1509846 - RNA, 19 nt, Homo sapiens
ggccggaacucuucugaga

SEQ ID NO: 1509847 - RNA, 19 nt, Homo sapiens
gcacacaccuauucuucuc

SEQ ID NO: 1509848 - RNA, 19 nt, Homo sapiens
acacagacauuacauuuac

SEQ ID NO: 1509849 - RNA, 19 nt, Homo sapiens
ucauauaacguguccuuua

SEQ ID NO: 1509850 - RNA, 19 nt, Homo sapiens
gaggcucucugucugauga

SEQ ID NO: 1509851 - RNA, 19 nt, Homo sapiens
uauaugcggucgucauuga

SEQ ID NO: 1509852 - RNA, 19 nt, Homo sapiens
cuacagagccacccagaaa

SEQ ID NO: 1509853 - RNA, 19 nt, Homo sapiens
gaacuauacaguacauuuc

SEQ ID NO: 1509854 - RNA, 19 nt, Homo sapiens
uguaggcuauuuauccuua

SEQ ID NO: 1509855 - RNA, 19 nt, Homo sapiens
gcagauugguggaguugug

SEQ ID NO: 1509856 - RNA, 19 nt, Homo sapiens
cagcagacaucaaggacuu

SEQ ID NO: 1509857 - RNA, 19 nt, Homo sapiens
gcacugggcagauggaguu

SEQ ID NO: 1509858 - RNA, 19 nt, Homo sapiens
ggugugcucugaauggaaa

SEQ ID NO: 1509859 - RNA, 19 nt, Homo sapiens
uagacgaacuucugaugaa

SEQ ID NO: 1509860 - RNA, 19 nt, Homo sapiens
ggaaaaugcuaccuaauag

SEQ ID NO: 1509861 - RNA, 19 nt, Homo sapiens
gaugaauacucccucaauc

SEQ ID NO: 1509862 - RNA, 19 nt, Homo sapiens
ugagagacauuuccaugga

SEQ ID NO: 1509863 - RNA, 19 nt, Homo sapiens
ggugagcacuuggacaauu

SEQ ID NO: 1509864 - RNA, 19 nt, Homo sapiens
ccaaugguaucgugugaug

SEQ ID NO: 1509865 - RNA, 19 nt, Homo sapiens
gacacagacauuacauuua

SEQ ID NO: 1509866 - RNA, 19 nt, Homo sapiens
cauccuagcucgaaauucu

SEQ ID NO: 1509867 - RNA, 19 nt, Homo sapiens
gaaaacaacuagugaagca

SEQ ID NO: 1509868 - RNA, 19 nt, Homo sapiens
guagacaaguagaucauca

SEQ ID NO: 1509869 - RNA, 19 nt, Homo sapiens
gaaaucaggaacuacauca

SEQ ID NO: 1509870 - RNA, 19 nt, Homo sapiens
gaaaaccggacuuccauua

SEQ ID NO: 1509871 - RNA, 19 nt, Homo sapiens
gcaauaccaucgggaggaa

SEQ ID NO: 1509872 - RNA, 19 nt, Homo sapiens
gcuaaucaugugcuucuua

SEQ ID NO: 1509873 - RNA, 19 nt, Homo sapiens
ggaggaaaaugcuaccuaa

SEQ ID NO: 1509874 - RNA, 19 nt, Homo sapiens
gaauacaggaugcauuaau

SEQ ID NO: 1509875 - RNA, 19 nt, Homo sapiens
aaaccggacuuccauuaug

SEQ ID NO: 1509876 - RNA, 19 nt, Homo sapiens
uauuauggguucugugauu

SEQ ID NO: 1509877 - RNA, 19 nt, Homo sapiens
agucaauugugcagauuua

SEQ ID NO: 1509878 - RNA, 19 nt, Homo sapiens
ggaggaggauggccuggau

SEQ ID NO: 1509879 - RNA, 19 nt, Homo sapiens
ggacccuucuucauuacaa

SEQ ID NO: 1509880 - RNA, 19 nt, Homo sapiens
uaugaucaguuccuuguga

SEQ ID NO: 1509881 - RNA, 19 nt, Homo sapiens
gguaucgugugaugguuaa

SEQ ID NO: 1509882 - RNA, 19 nt, Homo sapiens
agacacagacauuacauuu

SEQ ID NO: 1509883 - RNA, 19 nt, Homo sapiens
ccaugaagaugaagugcuu

SEQ ID NO: 1509884 - RNA, 19 nt, Homo sapiens
ggauauguccaccuacaaa

SEQ ID NO: 1509885 - RNA, 19 nt, Homo sapiens
ggaagaagcugagagaaau

SEQ ID NO: 1509886 - RNA, 19 nt, Homo sapiens
aaucuacacugaccaauua

SEQ ID NO: 1509887 - RNA, 19 nt, Homo sapiens
ggagagaccuucuuguugu

SEQ ID NO: 1509888 - RNA, 19 nt, Homo sapiens
gcaaagauaguuagagaaa

SEQ ID NO: 1509889 - RNA, 19 nt, Homo sapiens
gagagaccuucuuguugua

SEQ ID NO: 1509890 - RNA, 19 nt, Homo sapiens
gaagaagcugagagaaaua

SEQ ID NO: 1509891 - RNA, 19 nt, Homo sapiens
uagaagaggauaagcauaa

SEQ ID NO: 1509892 - RNA, 19 nt, Homo sapiens
gggaagaagcugagagaaa

SEQ ID NO: 1509893 - RNA, 19 nt, Homo sapiens
ggccagagcuuccaugacu

SEQ ID NO: 1509894 - RNA, 19 nt, Homo sapiens
ggacaccaccugcaaggaa

SEQ ID NO: 1509895 - RNA, 19 nt, Homo sapiens
ggagaaaaccugaaaauuc

SEQ ID NO: 1509896 - RNA, 19 nt, Homo sapiens
gcauaaaucagaggaagaa

SEQ ID NO: 1509897 - RNA, 19 nt, Homo sapiens
gaaacaacgggaagagguu

SEQ ID NO: 1509898 - RNA, 19 nt, Homo sapiens
gaagcugagagaaauauau

SEQ ID NO: 1509899 - RNA, 19 nt, Homo sapiens
gggaagagguuuugaggaa

SEQ ID NO: 1509900 - RNA, 19 nt, Homo sapiens
gaaccgcugcugugccuuu

SEQ ID NO: 1509901 - RNA, 19 nt, Homo sapiens
gcacauggucaucuuguuc

SEQ ID NO: 1509902 - RNA, 19 nt, Homo sapiens
gcagaaaaccguugcauug

SEQ ID NO: 1509903 - RNA, 19 nt, Homo sapiens
gacaccaccugcaaggaaa

SEQ ID NO: 1509904 - RNA, 19 nt, Homo sapiens
acacugaccaauuaaauga

SEQ ID NO: 1509905 - RNA, 19 nt, Homo sapiens
gggagagaccuucuuguug

SEQ ID NO: 1509906 - RNA, 19 nt, Homo sapiens
uugcaaagauaguuagaga

SEQ ID NO: 1509907 - RNA, 19 nt, Homo sapiens
aaagucaagugcaggaguu

SEQ ID NO: 1509908 - RNA, 19 nt, Homo sapiens
gaggaaaggcugaaacaac

SEQ ID NO: 1509909 - RNA, 19 nt, Homo sapiens
ugguggagcugauagagaa

SEQ ID NO: 1509910 - RNA, 19 nt, Homo sapiens
ugaagcacauggucaucuu

SEQ ID NO: 1509911 - RNA, 19 nt, Homo sapiens
guacgugccuaaguucuag

SEQ ID NO: 1509912 - RNA, 19 nt, Homo sapiens
gaagaggauaagcauaaau

SEQ ID NO: 1509913 - RNA, 19 nt, Homo sapiens
agaagaggauaagcauaaa

SEQ ID NO: 1509914 - RNA, 19 nt, Homo sapiens
gaaaaccguugcauugauc

SEQ ID NO: 1509915 - RNA, 19 nt, Homo sapiens
cccaagcuguuaccaagaa

SEQ ID NO: 1509916 - RNA, 19 nt, Homo sapiens
ggaagucagccaugaagca

SEQ ID NO: 1509917 - RNA, 19 nt, Homo sapiens
guagaagaggauaagcaua

SEQ ID NO: 1509918 - RNA, 19 nt, Homo sapiens
cuuguucacucgcaaagaa

SEQ ID NO: 1509919 - RNA, 19 nt, Homo sapiens
acacagaggaggagcagaa

SEQ ID NO: 1509920 - RNA, 19 nt, Homo sapiens
caacgaaggggcuuacuuu

SEQ ID NO: 1509921 - RNA, 19 nt, Homo sapiens
uuuggaagaugcuuucaga

SEQ ID NO: 1509922 - RNA, 19 nt, Homo sapiens
gaagaaaaggagaaagaaa

SEQ ID NO: 1509923 - RNA, 19 nt, Homo sapiens
gugauuuguuaauggauga

SEQ ID NO: 1509924 - RNA, 19 nt, Homo sapiens
aggauaagcauaaaucaga

SEQ ID NO: 1509925 - RNA, 19 nt, Homo sapiens
gagaccuucuuguuguaga

SEQ ID NO: 1509926 - RNA, 19 nt, Homo sapiens
ggaguugguggagcugaua

SEQ ID NO: 1509927 - RNA, 19 nt, Homo sapiens
ccaguaaggcagagaagga

SEQ ID NO: 1509928 - RNA, 19 nt, Homo sapiens
uagaauugcugcccaagcu

SEQ ID NO: 1509929 - RNA, 19 nt, Homo sapiens
ugaggaaaaucuacacuga

SEQ ID NO: 1509930 - RNA, 19 nt, Homo sapiens
gggcuuacuuuucugauga

SEQ ID NO: 1509931 - RNA, 19 nt, Homo sapiens
cugaugacauauacaagga

SEQ ID NO: 1509932 - RNA, 19 nt, Homo sapiens
gcagagaaggaaagucaag

SEQ ID NO: 1509933 - RNA, 19 nt, Homo sapiens
uaauaggauuuggaagaug

SEQ ID NO: 1509934 - RNA, 19 nt, Homo sapiens
cgaaggggcuuacuuuucu

SEQ ID NO: 1509935 - RNA, 19 nt, Homo sapiens
ucuuguacgugccuaaguu

SEQ ID NO: 1509936 - RNA, 19 nt, Homo sapiens
cuacacugaccaauuaaau

SEQ ID NO: 1509937 - RNA, 19 nt, Homo sapiens
gaagcacauggucaucuug

SEQ ID NO: 1509938 - RNA, 19 nt, Homo sapiens
ggaagagguuuugaggaaa

SEQ ID NO: 1509939 - RNA, 19 nt, Homo sapiens
cauagcagaugcggaugug

SEQ ID NO: 1509940 - RNA, 19 nt, Homo sapiens
ccuaauuuacugugauuug

SEQ ID NO: 1509941 - RNA, 19 nt, Homo sapiens
ggauuuggaagaugcuuuc

SEQ ID NO: 1509942 - RNA, 19 nt, Homo sapiens
aaaucuacacugaccaauu

SEQ ID NO: 1509943 - RNA, 19 nt, Homo sapiens
uaaacuaguagaagaggau

SEQ ID NO: 1509944 - RNA, 19 nt, Homo sapiens
gaaaaucuacacugaccaa

SEQ ID NO: 1509945 - RNA, 19 nt, Homo sapiens
ccuuggagaggaaaucuuu

SEQ ID NO: 1509946 - RNA, 19 nt, Homo sapiens
cagaggaaaggcugaaaca

SEQ ID NO: 1509947 - RNA, 19 nt, Homo sapiens
gacgugagcauggcugaga

SEQ ID NO: 1509948 - RNA, 19 nt, Homo sapiens
ccagagcuuccaugacuuc

SEQ ID NO: 1509949 - RNA, 19 nt, Homo sapiens
gaggauaagcauaaaucag

SEQ ID NO: 1509950 - RNA, 19 nt, Homo sapiens
auacaaggacacagaggaa

SEQ ID NO: 1509951 - RNA, 19 nt, Homo sapiens
gccagagcuuccaugacuu

SEQ ID NO: 1509952 - RNA, 19 nt, Homo sapiens
ggaagaaaaggagaaagaa

SEQ ID NO: 1509953 - RNA, 19 nt, Homo sapiens
aagaggauaagcauaaauc

SEQ ID NO: 1509954 - RNA, 19 nt, Homo sapiens
aggcagagaaggaaaguca

SEQ ID NO: 1509955 - RNA, 19 nt, Homo sapiens
acauauacaaggacacaga

SEQ ID NO: 1509956 - RNA, 19 nt, Homo sapiens
ugacauauacaaggacaca

SEQ ID NO: 1509957 - RNA, 19 nt, Homo sapiens
guaaggcagagaaggaaag

SEQ ID NO: 1509958 - RNA, 19 nt, Homo sapiens
acugugauuuguuaaugga

SEQ ID NO: 1509959 - RNA, 19 nt, Homo sapiens
aaccgcugcugugccuuua

SEQ ID NO: 1509960 - RNA, 19 nt, Homo sapiens
aaacuaguagaagaggaua

SEQ ID NO: 1509961 - RNA, 19 nt, Homo sapiens
aagagaggcugacuuaaua

SEQ ID NO: 1509962 - RNA, 19 nt, Homo sapiens
caauuuaacugcaugcaaa

SEQ ID NO: 1509963 - RNA, 19 nt, Homo sapiens
ggacaaacgagaauauauu

SEQ ID NO: 1509964 - RNA, 19 nt, Homo sapiens
ggauucauauuucuccuaa

SEQ ID NO: 1509965 - RNA, 19 nt, Homo sapiens
gaaagaauccaaaccaauc

SEQ ID NO: 1509966 - RNA, 19 nt, Homo sapiens
cauaaaugaucuccuagaa

SEQ ID NO: 1509967 - RNA, 19 nt, Homo sapiens
gggaacaaaucauucaaau

SEQ ID NO: 1509968 - RNA, 19 nt, Homo sapiens
ggacugauaauccuauuga

SEQ ID NO: 1509969 - RNA, 19 nt, Homo sapiens
aaacaaagccaagccauaa

SEQ ID NO: 1509970 - RNA, 19 nt, Homo sapiens
gaggaaauauaguucacaa

SEQ ID NO: 1509971 - RNA, 19 nt, Homo sapiens
gccaacaguucagaaauaa

SEQ ID NO: 1509972 - RNA, 19 nt, Homo sapiens
cuaaggagggauucaauua

SEQ ID NO: 1509973 - RNA, 19 nt, Homo sapiens
gaacuaaacaacuuaagca

SEQ ID NO: 1509974 - RNA, 19 nt, Homo sapiens
ggaaacuucugacaauucu

SEQ ID NO: 1509975 - RNA, 19 nt, Homo sapiens
caaccuuccugauguaaau

SEQ ID NO: 1509976 - RNA, 19 nt, Homo sapiens
ugacaaccuuccugaugua

SEQ ID NO: 1509977 - RNA, 19 nt, Homo sapiens
caguugauauguugucuuu

SEQ ID NO: 1509978 - RNA, 19 nt, Homo sapiens
ugccaacaguucagaaaua

SEQ ID NO: 1509979 - RNA, 19 nt, Homo sapiens
ccagauggaugacaaccuu

SEQ ID NO: 1509980 - RNA, 19 nt, Homo sapiens
ucagaggauuaccaaauuu

SEQ ID NO: 1509981 - RNA, 19 nt, Homo sapiens
guugauauguugucuuugu

SEQ ID NO: 1509982 - RNA, 19 nt, Homo sapiens
uaaaagauguggacacuau

SEQ ID NO: 1509983 - RNA, 19 nt, Homo sapiens
uaaacaaagccaagccaua

SEQ ID NO: 1509984 - RNA, 19 nt, Homo sapiens
caaaggcugaauacaauuu

SEQ ID NO: 1509985 - RNA, 19 nt, Homo sapiens
gaagccauauauccaagug

SEQ ID NO: 1509986 - RNA, 19 nt, Homo sapiens
ccaaaccaauccucuaaag

SEQ ID NO: 1509987 - RNA, 19 nt, Homo sapiens
ggucaccaguugauauguu

SEQ ID NO: 1509988 - RNA, 19 nt, Homo sapiens
gaugacaaccuuccugaug

SEQ ID NO: 1509989 - RNA, 19 nt, Homo sapiens
gaauuaaagggaacaaauc

SEQ ID NO: 1509990 - RNA, 19 nt, Homo sapiens
aaagagaggcugacuuaau

SEQ ID NO: 1509991 - RNA, 19 nt, Homo sapiens
ggaguuguccaguauguug

SEQ ID NO: 1509992 - RNA, 19 nt, Homo sapiens
gauauguugucuuuguaga

SEQ ID NO: 1509993 - RNA, 19 nt, Homo sapiens
gcugugaaccaguuuauau

SEQ ID NO: 1509994 - RNA, 19 nt, Homo sapiens
cagaggauuaccaaauuua

SEQ ID NO: 1509995 - RNA, 19 nt, Homo sapiens
gaaguucagauacaggaaa

SEQ ID NO: 1509996 - RNA, 19 nt, Homo sapiens
uagaacccauagaaacuaa

SEQ ID NO: 1509997 - RNA, 19 nt, Homo sapiens
caaaucugguauucaacaa

SEQ ID NO: 1509998 - RNA, 19 nt, Homo sapiens
gcaagaggaaauauaguuc

SEQ ID NO: 1509999 - RNA, 19 nt, Homo sapiens
aaaccgaaguucagauaca

SEQ ID NO: 1510000 - RNA, 19 nt, Homo sapiens
guuccuggauucauauuuc

SEQ ID NO: 1510001 - RNA, 19 nt, Homo sapiens
guucauagaggacuaagga

SEQ ID NO: 1510002 - RNA, 19 nt, Homo sapiens
ugaaagcccuaaaucaacu

SEQ ID NO: 1510003 - RNA, 19 nt, Homo sapiens
caaccuuuguuccuggauu

SEQ ID NO: 1510004 - RNA, 19 nt, Homo sapiens
uccaguauguuguaaauca

SEQ ID NO: 1510005 - RNA, 19 nt, Homo sapiens
gagaggcugacuuaauaaa

SEQ ID NO: 1510006 - RNA, 19 nt, Homo sapiens
acaaaccgaaguucagaua

SEQ ID NO: 1510007 - RNA, 19 nt, Homo sapiens
cuaguuccauuaaguagga

SEQ ID NO: 1510008 - RNA, 19 nt, Homo sapiens
aaacaguaccgguuacaga

SEQ ID NO: 1510009 - RNA, 19 nt, Homo sapiens
acaggaaacuagcacugaa

SEQ ID NO: 1510010 - RNA, 19 nt, Homo sapiens
aagcaguacuccugaacaa

SEQ ID NO: 1510011 - RNA, 19 nt, Homo sapiens
uaagcuagaacccauagaa

SEQ ID NO: 1510012 - RNA, 19 nt, Homo sapiens
agccauaaaugaucuccua

SEQ ID NO: 1510013 - RNA, 19 nt, Homo sapiens
cgaaagaauccaaaccaau

SEQ ID NO: 1510014 - RNA, 19 nt, Homo sapiens
cuuggaaacuucugacaau

SEQ ID NO: 1510015 - RNA, 19 nt, Homo sapiens
aaagauguggacacuauuu

SEQ ID NO: 1510016 - RNA, 19 nt, Homo sapiens
ucugaaagcccuaaaucaa

SEQ ID NO: 1510017 - RNA, 19 nt, Homo sapiens
ggacuaaggagggauucaa

SEQ ID NO: 1510018 - RNA, 19 nt, Homo sapiens
aguaggaguuguccaguau

SEQ ID NO: 1510019 - RNA, 19 nt, Homo sapiens
gaaguucauagaggacuaa

SEQ ID NO: 1510020 - RNA, 19 nt, Homo sapiens
guucuaguuccauuaagua

SEQ ID NO: 1510021 - RNA, 19 nt, Homo sapiens
uaaaggacgcaguaagaau

SEQ ID NO: 1510022 - RNA, 19 nt, Homo sapiens
gaaacacgaaagaauccaa

SEQ ID NO: 1510023 - RNA, 19 nt, Homo sapiens
gguguucgccgucacauuc

SEQ ID NO: 1510024 - RNA, 19 nt, Homo sapiens
aaacuucugacaauucuga

SEQ ID NO: 1510025 - RNA, 19 nt, Homo sapiens
uucagaggauuaccaaauu

SEQ ID NO: 1510026 - RNA, 19 nt, Homo sapiens
ucuaaaggacgcaguaaga

SEQ ID NO: 1510027 - RNA, 19 nt, Homo sapiens
gaaagcccuaaaucaacua

SEQ ID NO: 1510028 - RNA, 19 nt, Homo sapiens
gaaaacaaaagucuucuuc

SEQ ID NO: 1510029 - RNA, 19 nt, Homo sapiens
aaaggacgcaguaagaaug

SEQ ID NO: 1510030 - RNA, 19 nt, Homo sapiens
gaaguugcaccuacaucug

SEQ ID NO: 1510031 - RNA, 19 nt, Homo sapiens
gcaguacuccugaacaaac

SEQ ID NO: 1510032 - RNA, 19 nt, Homo sapiens
uaaagggaacaaaucauuc

SEQ ID NO: 1510033 - RNA, 19 nt, Homo sapiens
caagaggaaauauaguuca

SEQ ID NO: 1510034 - RNA, 19 nt, Homo sapiens
aaguaggaguuguccagua

SEQ ID NO: 1510035 - RNA, 19 nt, Homo sapiens
gagauccuccuuuguuaca

SEQ ID NO: 1510036 - RNA, 19 nt, Homo sapiens
gaacccauagaaacuaauc

SEQ ID NO: 1510037 - RNA, 19 nt, Homo sapiens
ucaggaacuaaacaacuua

SEQ ID NO: 1510038 - RNA, 19 nt, Homo sapiens
gaucaggaacuaaacaacu

SEQ ID NO: 1510039 - RNA, 19 nt, Homo sapiens
uaaacaagacucugaaagc

SEQ ID NO: 1510040 - RNA, 19 nt, Homo sapiens
gauaacucuuucuggaaca

SEQ ID NO: 1510041 - RNA, 19 nt, Homo sapiens
ugagauuguuacagaugaa

SEQ ID NO: 1510042 - RNA, 19 nt, Homo sapiens
caaagccaagccauaaaug

SEQ ID NO: 1510043 - RNA, 19 nt, Homo sapiens
cggaugcugugaaccaguu

SEQ ID NO: 1510044 - RNA, 19 nt, Homo sapiens
gcuagaacccauagaaacu

SEQ ID NO: 1510045 - RNA, 19 nt, Homo sapiens
agacugaccaccaucauca

SEQ ID NO: 1510046 - RNA, 19 nt, Homo sapiens
ccaaaucugguauucaaca

SEQ ID NO: 1510047 - RNA, 19 nt, Homo sapiens
auccaaaucugguauucaa

SEQ ID NO: 1510048 - RNA, 19 nt, Homo sapiens
aaagccaagccauaaauga

SEQ ID NO: 1510049 - RNA, 19 nt, Homo sapiens
aaagggaacaaaucauuca

SEQ ID NO: 1510050 - RNA, 19 nt, Homo sapiens
caacaacuaccaccgaaaa

SEQ ID NO: 1510051 - RNA, 19 nt, Homo sapiens
uaggaguuguccaguaugu

SEQ ID NO: 1510052 - RNA, 19 nt, Homo sapiens
ggacgcaguaagaauguuc

SEQ ID NO: 1510053 - RNA, 19 nt, Homo sapiens
cuaaaggacgcaguaagaa

SEQ ID NO: 1510054 - RNA, 19 nt, Homo sapiens
acgaaagaauccaaaccaa

SEQ ID NO: 1510055 - RNA, 19 nt, Homo sapiens
guucagauacaggaaacua

SEQ ID NO: 1510056 - RNA, 19 nt, Homo sapiens
gucacagagucaagcagua

SEQ ID NO: 1510057 - RNA, 19 nt, Homo sapiens
gauucaauuacuccugaua

SEQ ID NO: 1510058 - RNA, 19 nt, Homo sapiens
uguccaguauguuguaaau

SEQ ID NO: 1510059 - RNA, 19 nt, Homo sapiens
gucaccaguugauauguug

SEQ ID NO: 1510060 - RNA, 19 nt, Homo sapiens
gccaagccauaaaugaucu

SEQ ID NO: 1510061 - RNA, 19 nt, Homo sapiens
gaagcaauauccuaaagua

SEQ ID NO: 1510062 - RNA, 19 nt, Homo sapiens
gcacagugguugcaaauga

SEQ ID NO: 1510063 - RNA, 19 nt, Homo sapiens
caauauagcuguccauguu

SEQ ID NO: 1510064 - RNA, 19 nt, Homo sapiens
caacacagccggaguauga

SEQ ID NO: 1510065 - RNA, 19 nt, Homo sapiens
gauuuaaccuuucagcuaa

SEQ ID NO: 1510066 - RNA, 19 nt, Homo sapiens
aaagggauaugcaaagaua

SEQ ID NO: 1510067 - RNA, 19 nt, Homo sapiens
ucauaugacucaaugcuua

SEQ ID NO: 1510068 - RNA, 19 nt, Homo sapiens
gcaaagggauaugcaaaga

SEQ ID NO: 1510069 - RNA, 19 nt, Homo sapiens
caaccucagugaacauuaa

SEQ ID NO: 1510070 - RNA, 19 nt, Homo sapiens
agaagacgauugugaaauu

SEQ ID NO: 1510071 - RNA, 19 nt, Homo sapiens
gaacaaagggaacucaaug

SEQ ID NO: 1510072 - RNA, 19 nt, Homo sapiens
gaaacaaccucagugaaca

SEQ ID NO: 1510073 - RNA, 19 nt, Homo sapiens
ugacagcuauuaacaaugu

SEQ ID NO: 1510074 - RNA, 19 nt, Homo sapiens
gaaauuaauccguaugugu

SEQ ID NO: 1510075 - RNA, 19 nt, Homo sapiens
ggacaacacagccggagua

SEQ ID NO: 1510076 - RNA, 19 nt, Homo sapiens
gcaaugaauuuggucuauu

SEQ ID NO: 1510077 - RNA, 19 nt, Homo sapiens
uaauugcacuccuuaaaug

SEQ ID NO: 1510078 - RNA, 19 nt, Homo sapiens
gaaguuaugccucagaaug

SEQ ID NO: 1510079 - RNA, 19 nt, Homo sapiens
uaaagaaauugcccauuca

SEQ ID NO: 1510080 - RNA, 19 nt, Homo sapiens
uuaaagaaauugcccauuc

SEQ ID NO: 1510081 - RNA, 19 nt, Homo sapiens
ggaacucaaugaaggcaaa

SEQ ID NO: 1510082 - RNA, 19 nt, Homo sapiens
ggucuauugugacuacaua

SEQ ID NO: 1510083 - RNA, 19 nt, Homo sapiens
gaagauaaggaccuauuug

SEQ ID NO: 1510084 - RNA, 19 nt, Homo sapiens
gagauuagcguccuucuuc

SEQ ID NO: 1510085 - RNA, 19 nt, Homo sapiens
ugaauuuggucuauuguga

SEQ ID NO: 1510086 - RNA, 19 nt, Homo sapiens
gugaaacuacgaucaaaua

SEQ ID NO: 1510087 - RNA, 19 nt, Homo sapiens
caugacagcuauuaacaau

SEQ ID NO: 1510088 - RNA, 19 nt, Homo sapiens
agauguaccuaccuucaua

SEQ ID NO: 1510089 - RNA, 19 nt, Homo sapiens
gaagacgauugugaaauuc

SEQ ID NO: 1510090 - RNA, 19 nt, Homo sapiens
guauguguccuuauuauga

SEQ ID NO: 1510091 - RNA, 19 nt, Homo sapiens
gagcuaauugcacuccuua

SEQ ID NO: 1510092 - RNA, 19 nt, Homo sapiens
guucauaucucagaguuuc

SEQ ID NO: 1510093 - RNA, 19 nt, Homo sapiens
ucaccagacucguucauau

SEQ ID NO: 1510094 - RNA, 19 nt, Homo sapiens
ccugaugauucuaacaaua

SEQ ID NO: 1510095 - RNA, 19 nt, Homo sapiens
gaguaugagcaauaucuua

SEQ ID NO: 1510096 - RNA, 19 nt, Homo sapiens
ccucagugaacauuaauua

SEQ ID NO: 1510097 - RNA, 19 nt, Homo sapiens
gcuguaacauuuauagaag

SEQ ID NO: 1510098 - RNA, 19 nt, Homo sapiens
guggaaaguggaaauauaa

SEQ ID NO: 1510099 - RNA, 19 nt, Homo sapiens
gcuaauugcacuccuuaaa

SEQ ID NO: 1510100 - RNA, 19 nt, Homo sapiens
ggaauggccuacuuuaucc

SEQ ID NO: 1510101 - RNA, 19 nt, Homo sapiens
ccuuucagcuaaaugauaa

SEQ ID NO: 1510102 - RNA, 19 nt, Homo sapiens
ucaacaaccugaugauucu

SEQ ID NO: 1510103 - RNA, 19 nt, Homo sapiens
aguggaaaguggaaauaua

SEQ ID NO: 1510104 - RNA, 19 nt, Homo sapiens
ccacagagaaauuugaaga

SEQ ID NO: 1510105 - RNA, 19 nt, Homo sapiens
gcagcacagugguugcaaa

SEQ ID NO: 1510106 - RNA, 19 nt, Homo sapiens
cuaagcacauuaauuaugg

SEQ ID NO: 1510107 - RNA, 19 nt, Homo sapiens
gaauugccuuucaaacaca

SEQ ID NO: 1510108 - RNA, 19 nt, Homo sapiens
ggaguccuuuggugagauu

SEQ ID NO: 1510109 - RNA, 19 nt, Homo sapiens
ucuggaugcuguaacauuu

SEQ ID NO: 1510110 - RNA, 19 nt, Homo sapiens
ugacagaagacgauuguga

SEQ ID NO: 1510111 - RNA, 19 nt, Homo sapiens
guaccuaccuucauaugac

SEQ ID NO: 1510112 - RNA, 19 nt, Homo sapiens
caaacuaccagcaaugaau

SEQ ID NO: 1510113 - RNA, 19 nt, Homo sapiens
gacagaagacgauugugaa

SEQ ID NO: 1510114 - RNA, 19 nt, Homo sapiens
ggucaucuaucugccuuug

SEQ ID NO: 1510115 - RNA, 19 nt, Homo sapiens
gaaaggcagcacagugguu

SEQ ID NO: 1510116 - RNA, 19 nt, Homo sapiens
cgaauugccuuucaaacac

SEQ ID NO: 1510117 - RNA, 19 nt, Homo sapiens
ggccuacuuuauccauaua

SEQ ID NO: 1510118 - RNA, 19 nt, Homo sapiens
gcugagauguaccuaccuu

SEQ ID NO: 1510119 - RNA, 19 nt, Homo sapiens
gaagaauuccuagcuaucu

SEQ ID NO: 1510120 - RNA, 19 nt, Homo sapiens
ggaaagucaacaucaacaa

SEQ ID NO: 1510121 - RNA, 19 nt, Homo sapiens
gaggaauggccuacuuuau

SEQ ID NO: 1510122 - RNA, 19 nt, Homo sapiens
ugaggaauggccuacuuua

SEQ ID NO: 1510123 - RNA, 19 nt, Homo sapiens
gcaaagauaaaggaggaaa

SEQ ID NO: 1510124 - RNA, 19 nt, Homo sapiens
agaggaaagucaacaucaa

SEQ ID NO: 1510125 - RNA, 19 nt, Homo sapiens
gauaugcaaagauaaagga

SEQ ID NO: 1510126 - RNA, 19 nt, Homo sapiens
gacgccauaugaacacaaa

SEQ ID NO: 1510127 - RNA, 19 nt, Homo sapiens
ggaacaaagggaacucaau

SEQ ID NO: 1510128 - RNA, 19 nt, Homo sapiens
uaugaggaauggccuacuu

SEQ ID NO: 1510129 - RNA, 19 nt, Homo sapiens
uaaccuuucagcuaaauga

SEQ ID NO: 1510130 - RNA, 19 nt, Homo sapiens
ucacaggacgccauaugaa

SEQ ID NO: 1510131 - RNA, 19 nt, Homo sapiens
gcaaagaggaaagucaaca

SEQ ID NO: 1510132 - RNA, 19 nt, Homo sapiens
cagcaaagggauaugcaaa

SEQ ID NO: 1510133 - RNA, 19 nt, Homo sapiens
cauuuggagugaagaauuc

SEQ ID NO: 1510134 - RNA, 19 nt, Homo sapiens
agauuuaaccuuucagcua

SEQ ID NO: 1510135 - RNA, 19 nt, Homo sapiens
gaauuccuagcuaucuuaa

SEQ ID NO: 1510136 - RNA, 19 nt, Homo sapiens
aaagagccacagagaaauu

SEQ ID NO: 1510137 - RNA, 19 nt, Homo sapiens
caaugaaggcaaagaggaa

SEQ ID NO: 1510138 - RNA, 19 nt, Homo sapiens
uagcagucuuucuugguuu

SEQ ID NO: 1510139 - RNA, 19 nt, Homo sapiens
aaacuaccagcaaugaauu

SEQ ID NO: 1510140 - RNA, 19 nt, Homo sapiens
uagcguccuucuucaaguu

SEQ ID NO: 1510141 - RNA, 19 nt, Homo sapiens
agaauuccuagcuaucuua

SEQ ID NO: 1510142 - RNA, 19 nt, Homo sapiens
gaaagucaacaucaacaac

SEQ ID NO: 1510143 - RNA, 19 nt, Homo sapiens
cuagaaacaaccucaguga

SEQ ID NO: 1510144 - RNA, 19 nt, Homo sapiens
ugaagauaaggaccuauuu

SEQ ID NO: 1510145 - RNA, 19 nt, Homo sapiens
cagacucguucauaucuca

SEQ ID NO: 1510146 - RNA, 19 nt, Homo sapiens
caaagggaacucaaugaag

SEQ ID NO: 1510147 - RNA, 19 nt, Homo sapiens
acaaagggaacucaaugaa

SEQ ID NO: 1510148 - RNA, 19 nt, Homo sapiens
uuagcagucuuucuugguu

SEQ ID NO: 1510149 - RNA, 19 nt, Homo sapiens
gaaguugagauggcaauca

SEQ ID NO: 1510150 - RNA, 19 nt, Homo sapiens
cuaauugcacuccuuaaau

SEQ ID NO: 1510151 - RNA, 19 nt, Homo sapiens
cauuaauuauggccaguug

SEQ ID NO: 1510152 - RNA, 19 nt, Homo sapiens
ccguauguguccuuauuau

SEQ ID NO: 1510153 - RNA, 19 nt, Homo sapiens
ccacuucacaguauaccaa

SEQ ID NO: 1510154 - RNA, 19 nt, Homo sapiens
cuggaauacuaucaaacua

SEQ ID NO: 1510155 - RNA, 19 nt, Homo sapiens
caguauaccaaacuugaaa

SEQ ID NO: 1510156 - RNA, 19 nt, Homo sapiens
gacgauugugaaauucuua

SEQ ID NO: 1510157 - RNA, 19 nt, Homo sapiens
uugaagaauuccuagcuau

SEQ ID NO: 1510158 - RNA, 19 nt, Homo sapiens
gauaguggaaaguggaaau

SEQ ID NO: 1510159 - RNA, 19 nt, Homo sapiens
cacaguauaccaaacuuga

SEQ ID NO: 1510160 - RNA, 19 nt, Homo sapiens
gcucacgauacauuuauga

SEQ ID NO: 1510161 - RNA, 19 nt, Homo sapiens
gaacguaucuugugaauga

SEQ ID NO: 1510162 - RNA, 19 nt, Homo sapiens
ggagaucuauuucagagua

SEQ ID NO: 1510163 - RNA, 19 nt, Homo sapiens
uaauugaccugaccaguuu

SEQ ID NO: 1510164 - RNA, 19 nt, Homo sapiens
gaauuacaguggugugaaa

SEQ ID NO: 1510165 - RNA, 19 nt, Homo sapiens
ugauaaagcugccaagaug

SEQ ID NO: 1510166 - RNA, 19 nt, Homo sapiens
ccaaagagccugaauuaca

SEQ ID NO: 1510167 - RNA, 19 nt, Homo sapiens
caacagaaaccggugaaua

SEQ ID NO: 1510168 - RNA, 19 nt, Homo sapiens
caucgaagccucccucuaa

SEQ ID NO: 1510169 - RNA, 19 nt, Homo sapiens
ggagagaaauugcuaaagc

SEQ ID NO: 1510170 - RNA, 19 nt, Homo sapiens
gaaacucuguucugcuuca

SEQ ID NO: 1510171 - RNA, 19 nt, Homo sapiens
gcuaauuagugcacuuauu

SEQ ID NO: 1510172 - RNA, 19 nt, Homo sapiens
agaaaccggugaauaaaga

SEQ ID NO: 1510173 - RNA, 19 nt, Homo sapiens
caaagagccugaauuacag

SEQ ID NO: 1510174 - RNA, 19 nt, Homo sapiens
guaauucucucagcucaug

SEQ ID NO: 1510175 - RNA, 19 nt, Homo sapiens
caucuggucucuaacaaug

SEQ ID NO: 1510176 - RNA, 19 nt, Homo sapiens
cugcacaucuggucucuaa

SEQ ID NO: 1510177 - RNA, 19 nt, Homo sapiens
gacccaaucugcacauuca

SEQ ID NO: 1510178 - RNA, 19 nt, Homo sapiens
caagaugcaugcuuucaca

SEQ ID NO: 1510179 - RNA, 19 nt, Homo sapiens
gaugcaugcuuucacacua

SEQ ID NO: 1510180 - RNA, 19 nt, Homo sapiens
uaaaggacuucuccaucuu

SEQ ID NO: 1510181 - RNA, 19 nt, Homo sapiens
gcacauugcugggagucuu

SEQ ID NO: 1510182 - RNA, 19 nt, Homo sapiens
gcaauaugcuucauuuuca

SEQ ID NO: 1510183 - RNA, 19 nt, Homo sapiens
gaguaucagugugcuaauu

SEQ ID NO: 1510184 - RNA, 19 nt, Homo sapiens
ugccaaagagccugaauua

SEQ ID NO: 1510185 - RNA, 19 nt, Homo sapiens
uuaaaggacuucuccaucu

SEQ ID NO: 1510186 - RNA, 19 nt, Homo sapiens
gguggugacuggcgugcua

SEQ ID NO: 1510187 - RNA, 19 nt, Homo sapiens
aacagaaaccggugaauaa

SEQ ID NO: 1510188 - RNA, 19 nt, Homo sapiens
gcacaucuggucucuaaca

SEQ ID NO: 1510189 - RNA, 19 nt, Homo sapiens
uaguguaccuggcauguga

SEQ ID NO: 1510190 - RNA, 19 nt, Homo sapiens
ugacuggcgugcuagugua

SEQ ID NO: 1510191 - RNA, 19 nt, Homo sapiens
caccaucacuaucuuaaag

SEQ ID NO: 1510192 - RNA, 19 nt, Homo sapiens
uggaaacucuguucugcuu

SEQ ID NO: 1510193 - RNA, 19 nt, Homo sapiens
aaaggacuucuccaucuua

SEQ ID NO: 1510194 - RNA, 19 nt, Homo sapiens
gagaugccuuggccacaau

SEQ ID NO: 1510195 - RNA, 19 nt, Homo sapiens
ggucgugggugggcacauu

SEQ ID NO: 1510196 - RNA, 19 nt, Homo sapiens
ccucuaagcggcugacauu

SEQ ID NO: 1510197 - RNA, 19 nt, Homo sapiens
ggugugaaagagcuuauuu

SEQ ID NO: 1510198 - RNA, 19 nt, Homo sapiens
cugccaagaugcaugcuuu

SEQ ID NO: 1510199 - RNA, 19 nt, Homo sapiens
gaaauugcuaaagcccuua

SEQ ID NO: 1510200 - RNA, 19 nt, Homo sapiens
ugaaagagcuuauuuuagc

SEQ ID NO: 1510201 - RNA, 19 nt, Homo sapiens
gcaccaucacuaucuuaaa

SEQ ID NO: 1510202 - RNA, 19 nt, Homo sapiens
uaaaauagccgacccaauc

SEQ ID NO: 1510203 - RNA, 19 nt, Homo sapiens
gagaucuauuucagaguau

SEQ ID NO: 1510204 - RNA, 19 nt, Homo sapiens
cuaagcggcugacauuugg

SEQ ID NO: 1510205 - RNA, 19 nt, Homo sapiens
ccaagugguucggagagaa

SEQ ID NO: 1510206 - RNA, 19 nt, Homo sapiens
ggacuucuccaucuuacuc

SEQ ID NO: 1510207 - RNA, 19 nt, Homo sapiens
caugugagcgccugcugua

SEQ ID NO: 1510208 - RNA, 19 nt, Homo sapiens
aaucugcacauucaucuuu

SEQ ID NO: 1510209 - RNA, 19 nt, Homo sapiens
acuuuaagccagaguauaa

SEQ ID NO: 1510210 - RNA, 19 nt, Homo sapiens
aguaucagugugcuaauua

SEQ ID NO: 1510211 - RNA, 19 nt, Homo sapiens
gaucagugucccagagaga

SEQ ID NO: 1510212 - RNA, 19 nt, Homo sapiens
gugcacuuauuaucuacuu

SEQ ID NO: 1510213 - RNA, 19 nt, Homo sapiens
cagaguaucagugugcuaa

SEQ ID NO: 1510214 - RNA, 19 nt, Homo sapiens
cgucagagcugcuuuugug

SEQ ID NO: 1510215 - RNA, 19 nt, Homo sapiens
gcaccgagcagagauccuu

SEQ ID NO: 1510216 - RNA, 19 nt, Homo sapiens
uuaauugaccugaccaguu

SEQ ID NO: 1510217 - RNA, 19 nt, Homo sapiens
caagugguucggagagaaa

SEQ ID NO: 1510218 - RNA, 19 nt, Homo sapiens
acagaaaccggugaauaaa

SEQ ID NO: 1510219 - RNA, 19 nt, Homo sapiens
ccaucacuaucuuaaagga

SEQ ID NO: 1510220 - RNA, 19 nt, Homo sapiens
ucuaagcggcugacauuug

SEQ ID NO: 1510221 - RNA, 19 nt, Homo sapiens
cugcccaccucuuaauuga

SEQ ID NO: 1510222 - RNA, 19 nt, Homo sapiens
guaucagugugcuaauuag

SEQ ID NO: 1510223 - RNA, 19 nt, Homo sapiens
gcaugcccuuggagaucua

SEQ ID NO: 1510224 - RNA, 19 nt, Homo sapiens
cagcaccaucacuaucuua

SEQ ID NO: 1510225 - RNA, 19 nt, Homo sapiens
gagucuugcuguugucaca

SEQ ID NO: 1510226 - RNA, 19 nt, Homo sapiens
ggccaacauuguacuaacu

SEQ ID NO: 1510227 - RNA, 19 nt, Homo sapiens
ccaguuuccugcucagucu

SEQ ID NO: 1510228 - RNA, 19 nt, Homo sapiens
guucggagagaaauugcua

SEQ ID NO: 1510229 - RNA, 19 nt, Homo sapiens
gaaagagcuuauuuuagca

SEQ ID NO: 1510230 - RNA, 19 nt, Homo sapiens
caaggaaguacaagccaau

SEQ ID NO: 1510231 - RNA, 19 nt, Homo sapiens
agagaugccuuggccacaa

SEQ ID NO: 1510232 - RNA, 19 nt, Homo sapiens
ucuggucucuaacaaugaa

SEQ ID NO: 1510233 - RNA, 19 nt, Homo sapiens
cauggaaggugugccaaag

SEQ ID NO: 1510234 - RNA, 19 nt, Homo sapiens
ccagcaccaucacuaucuu

SEQ ID NO: 1510235 - RNA, 19 nt, Homo sapiens
gccaagugguucggagaga

SEQ ID NO: 1510236 - RNA, 19 nt, Homo sapiens
ccacaaucacaaggaagua

SEQ ID NO: 1510237 - RNA, 19 nt, Homo sapiens
gaugcugcccaccucuuaa

SEQ ID NO: 1510238 - RNA, 19 nt, Homo sapiens
gcaaaagcuuuacgaugca

SEQ ID NO: 1510239 - RNA, 19 nt, Homo sapiens
ggagucaggaggcauguac

SEQ ID NO: 1510240 - RNA, 19 nt, Homo sapiens
gauccaggcgacugugaug

SEQ ID NO: 1510241 - RNA, 19 nt, Homo sapiens
gcuccaagcccacagaaaa

SEQ ID NO: 1510242 - RNA, 19 nt, Homo sapiens
ccaaguggaaacucuguuc

SEQ ID NO: 1510243 - RNA, 19 nt, Homo sapiens
ccaacauuguacuaacugu

SEQ ID NO: 1510244 - RNA, 19 nt, Homo sapiens
gcgaaugaguacgccuaug

SEQ ID NO: 1510245 - RNA, 19 nt, Homo sapiens
gcugcccaccucuuaauug

SEQ ID NO: 1510246 - RNA, 19 nt, Homo sapiens
gaugcacucacucaccauu

SEQ ID NO: 1510247 - RNA, 19 nt, Homo sapiens
cacaucuggucucuaacaa

SEQ ID NO: 1510248 - RNA, 19 nt, Homo sapiens
uggaaggugugccaaagag

SEQ ID NO: 1510249 - RNA, 19 nt, Homo sapiens
gcacauucaucuuuuccau

SEQ ID NO: 1510250 - RNA, 19 nt, Homo sapiens
cagaaaccggugaauaaag

SEQ ID NO: 1510251 - RNA, 19 nt, Homo sapiens
gcuuuacgaugcacucacu

SEQ ID NO: 1510252 - RNA, 19 nt, Homo sapiens
gcccuuagcaaaagcuuua

SEQ ID NO: 1510253 - RNA, 19 nt, Homo sapiens
ucucucagcucauguugcu

SEQ ID NO: 1510254 - RNA, 19 nt, Homo sapiens
agaugcugcccaccucuua

SEQ ID NO: 1510255 - RNA, 19 nt, Homo sapiens
cgaaugaguacgccuaugc

SEQ ID NO: 1510256 - RNA, 19 nt, Homo sapiens
gaucuauuucagaguauca

SEQ ID NO: 1510257 - RNA, 19 nt, Homo sapiens
cccuguggcugucaucgaa

SEQ ID NO: 1510258 - RNA, 19 nt, Homo sapiens
gaaaccggugaauaaagau

SEQ ID NO: 1510259 - RNA, 19 nt, Homo sapiens
gcugggagucuugcuguug

SEQ ID NO: 1510260 - RNA, 19 nt, Homo sapiens
ggauggcaccgagcagaga

SEQ ID NO: 1510261 - RNA, 19 nt, Homo sapiens
gaagaaagcucucauauuu

SEQ ID NO: 1510262 - RNA, 19 nt, Homo sapiens
gcaaggaggugaugaaaua

SEQ ID NO: 1510263 - RNA, 19 nt, Homo sapiens
gaaccaaguuauagaguua

SEQ ID NO: 1510264 - RNA, 19 nt, Homo sapiens
ggaagaagaucucugaaga

SEQ ID NO: 1510265 - RNA, 19 nt, Homo sapiens
gaacuuagagcucagauuu

SEQ ID NO: 1510266 - RNA, 19 nt, Homo sapiens
gaaggcaguucaauaauca

SEQ ID NO: 1510267 - RNA, 19 nt, Homo sapiens
caauauggauguacucaaa

SEQ ID NO: 1510268 - RNA, 19 nt, Homo sapiens
ccacagcacucuauggaaa

SEQ ID NO: 1510269 - RNA, 19 nt, Homo sapiens
gaagaucucugaagaaagc

SEQ ID NO: 1510270 - RNA, 19 nt, Homo sapiens
gaacauaaaggaagaagau

SEQ ID NO: 1510271 - RNA, 19 nt, Homo sapiens
gaauagggcucugagaaau

SEQ ID NO: 1510272 - RNA, 19 nt, Homo sapiens
gaaagaagacagucaaaca

SEQ ID NO: 1510273 - RNA, 19 nt, Homo sapiens
gcauuaacauggacuguau

SEQ ID NO: 1510274 - RNA, 19 nt, Homo sapiens
ggcagugguuuguuauuua

SEQ ID NO: 1510275 - RNA, 19 nt, Homo sapiens
gggaccaacuggaacaaua

SEQ ID NO: 1510276 - RNA, 19 nt, Homo sapiens
gaagaugcauuucuguauc

SEQ ID NO: 1510277 - RNA, 19 nt, Homo sapiens
ccacagcuauggcucauga

SEQ ID NO: 1510278 - RNA, 19 nt, Homo sapiens
aagcuuaucuggacauauu

SEQ ID NO: 1510279 - RNA, 19 nt, Homo sapiens
uaacuggguuguauaccua

SEQ ID NO: 1510280 - RNA, 19 nt, Homo sapiens
gagcucagauuucaauaca

SEQ ID NO: 1510281 - RNA, 19 nt, Homo sapiens
auacagaaaugcagauuga

SEQ ID NO: 1510282 - RNA, 19 nt, Homo sapiens
gaaagcuuaucuggacaua

SEQ ID NO: 1510283 - RNA, 19 nt, Homo sapiens
gaaauggaaucacugaaaa

SEQ ID NO: 1510284 - RNA, 19 nt, Homo sapiens
gcaggucacuuuccuugga

SEQ ID NO: 1510285 - RNA, 19 nt, Homo sapiens
gcacagaggcagaaauuag

SEQ ID NO: 1510286 - RNA, 19 nt, Homo sapiens
gugaaacgcugcccuguuc

SEQ ID NO: 1510287 - RNA, 19 nt, Homo sapiens
aagaagaucucugaagaaa

SEQ ID NO: 1510288 - RNA, 19 nt, Homo sapiens
gaagaagaucucugaagaa

SEQ ID NO: 1510289 - RNA, 19 nt, Homo sapiens
caagcucccuguugugaaa

SEQ ID NO: 1510290 - RNA, 19 nt, Homo sapiens
caacaaagccagcagaaag

SEQ ID NO: 1510291 - RNA, 19 nt, Homo sapiens
gaacagaguauuagaaucg

SEQ ID NO: 1510292 - RNA, 19 nt, Homo sapiens
gagaauagggcucugagaa

SEQ ID NO: 1510293 - RNA, 19 nt, Homo sapiens
uaagauagcuaaagaugac

SEQ ID NO: 1510294 - RNA, 19 nt, Homo sapiens
aaagcuagcugcugagaau

SEQ ID NO: 1510295 - RNA, 19 nt, Homo sapiens
agaggaaucuguauagugu

SEQ ID NO: 1510296 - RNA, 19 nt, Homo sapiens
gaauuaagaccacaauaag

SEQ ID NO: 1510297 - RNA, 19 nt, Homo sapiens
ggacauauuucugcccaau

SEQ ID NO: 1510298 - RNA, 19 nt, Homo sapiens
gcucagauuucaauacagu

SEQ ID NO: 1510299 - RNA, 19 nt, Homo sapiens
uggcgcagcugaauacauu

SEQ ID NO: 1510300 - RNA, 19 nt, Homo sapiens
ugacaucgccaccaagaaa

SEQ ID NO: 1510301 - RNA, 19 nt, Homo sapiens
gaggcuaucucaagacagu

SEQ ID NO: 1510302 - RNA, 19 nt, Homo sapiens
ugaagaaagcucucauauu

SEQ ID NO: 1510303 - RNA, 19 nt, Homo sapiens
ccaaacguguugagaagug

SEQ ID NO: 1510304 - RNA, 19 nt, Homo sapiens
uggguuguauaccuaauua

SEQ ID NO: 1510305 - RNA, 19 nt, Homo sapiens
gaagacagucaaacaaagu

SEQ ID NO: 1510306 - RNA, 19 nt, Homo sapiens
acauauuucugcccaauga

SEQ ID NO: 1510307 - RNA, 19 nt, Homo sapiens
cuucauuucucucauggua

SEQ ID NO: 1510308 - RNA, 19 nt, Homo sapiens
caugcuauuuggaauguuu

SEQ ID NO: 1510309 - RNA, 19 nt, Homo sapiens
gcaguucaauaaucaacau

SEQ ID NO: 1510310 - RNA, 19 nt, Homo sapiens
ggaucgauuucuaaagaug

SEQ ID NO: 1510311 - RNA, 19 nt, Homo sapiens
aaaauuggcugacuuugaa

SEQ ID NO: 1510312 - RNA, 19 nt, Homo sapiens
agacaccgcucagccauga

SEQ ID NO: 1510313 - RNA, 19 nt, Homo sapiens
uaaggcgggucuuuggaaa

SEQ ID NO: 1510314 - RNA, 19 nt, Homo sapiens
gcagugguuuguuauuuac

SEQ ID NO: 1510315 - RNA, 19 nt, Homo sapiens
agucugagccuaccaauau

SEQ ID NO: 1510316 - RNA, 19 nt, Homo sapiens
agaaauggaaucacugaaa

SEQ ID NO: 1510317 - RNA, 19 nt, Homo sapiens
aaaggaagaagaucucuga

SEQ ID NO: 1510318 - RNA, 19 nt, Homo sapiens
gcaagauuaagauagcuaa

SEQ ID NO: 1510319 - RNA, 19 nt, Homo sapiens
gcaggguggcgguagauuu

SEQ ID NO: 1510320 - RNA, 19 nt, Homo sapiens
guucucugcuugaccauug

SEQ ID NO: 1510321 - RNA, 19 nt, Homo sapiens
gaugaaauacugaucucuu

SEQ ID NO: 1510322 - RNA, 19 nt, Homo sapiens
uggcagugguuuguuauuu

SEQ ID NO: 1510323 - RNA, 19 nt, Homo sapiens
ggcagaaauuagaagcuuu

SEQ ID NO: 1510324 - RNA, 19 nt, Homo sapiens
ggaccaacuggaacaauau

SEQ ID NO: 1510325 - RNA, 19 nt, Homo sapiens
ccaugaagaugcauuucug

SEQ ID NO: 1510326 - RNA, 19 nt, Homo sapiens
aggaaucuguauaguguaa

SEQ ID NO: 1510327 - RNA, 19 nt, Homo sapiens
gacaguauagaguuuguuu

SEQ ID NO: 1510328 - RNA, 19 nt, Homo sapiens
uaacauggacuguauucau

SEQ ID NO: 1510329 - RNA, 19 nt, Homo sapiens
gaggagggaccaacuggaa

SEQ ID NO: 1510330 - RNA, 19 nt, Homo sapiens
uuggaucgauuucuaaaga

SEQ ID NO: 1510331 - RNA, 19 nt, Homo sapiens
aaugacaaguggcaaauuc

SEQ ID NO: 1510332 - RNA, 19 nt, Homo sapiens
ugaacucccuuauguuagu

SEQ ID NO: 1510333 - RNA, 19 nt, Homo sapiens
uuugaacucccuuauguua

SEQ ID NO: 1510334 - RNA, 19 nt, Homo sapiens
gagcaaggaggugaugaaa

SEQ ID NO: 1510335 - RNA, 19 nt, Homo sapiens
gcaaugaccacagcuaugg

SEQ ID NO: 1510336 - RNA, 19 nt, Homo sapiens
agaauagggcucugagaaa

SEQ ID NO: 1510337 - RNA, 19 nt, Homo sapiens
ucaugacaguauagaguuu

SEQ ID NO: 1510338 - RNA, 19 nt, Homo sapiens
ggacuguauucaucaaggu

SEQ ID NO: 1510339 - RNA, 19 nt, Homo sapiens
gcucagccaugaagaugca

SEQ ID NO: 1510340 - RNA, 19 nt, Homo sapiens
gaaaugcagauugaaguuc

SEQ ID NO: 1510341 - RNA, 19 nt, Homo sapiens
aaagaagacagucaaacaa

SEQ ID NO: 1510342 - RNA, 19 nt, Homo sapiens
cccaaugaacagaguauua

SEQ ID NO: 1510343 - RNA, 19 nt, Homo sapiens
agaaccaaguuauagaguu

SEQ ID NO: 1510344 - RNA, 19 nt, Homo sapiens
aauuugaccucuucccauu

SEQ ID NO: 1510345 - RNA, 19 nt, Homo sapiens
ggacuccgaaagugguaua

SEQ ID NO: 1510346 - RNA, 19 nt, Homo sapiens
caacaugcuauuuggaaug

SEQ ID NO: 1510347 - RNA, 19 nt, Homo sapiens
gaauacagaaaugcagauu

SEQ ID NO: 1510348 - RNA, 19 nt, Homo sapiens
ugaagaugcauuucuguau

SEQ ID NO: 1510349 - RNA, 19 nt, Homo sapiens
ucauuucucucaugguaau

SEQ ID NO: 1510350 - RNA, 19 nt, Homo sapiens
gacaaguggcaaauucaaa

SEQ ID NO: 1510351 - RNA, 19 nt, Homo sapiens
aagaagacagucaaacaaa

SEQ ID NO: 1510352 - RNA, 19 nt, Homo sapiens
gcuugaccauuguuauaau

SEQ ID NO: 1510353 - RNA, 19 nt, Homo sapiens
ccacacagaacuagagcaa

SEQ ID NO: 1510354 - RNA, 19 nt, Homo sapiens
gcacuucgucaugacagua

SEQ ID NO: 1510355 - RNA, 19 nt, Homo sapiens
agaagacagucaaacaaag

SEQ ID NO: 1510356 - RNA, 19 nt, Homo sapiens
ccaacuggaacaauauuug

SEQ ID NO: 1510357 - RNA, 19 nt, Homo sapiens
aaacuggcgcagcugaaua

SEQ ID NO: 1510358 - RNA, 19 nt, Homo sapiens
caaacguguugagaaguga

SEQ ID NO: 1510359 - RNA, 19 nt, Homo sapiens
uaaucaacaugcuauuugg

SEQ ID NO: 1510360 - RNA, 19 nt, Homo sapiens
ggauguacucaaagugaaa

SEQ ID NO: 1510361 - RNA, 19 nt, Homo sapiens
gguaaagccuucaauagaa

SEQ ID NO: 1510362 - RNA, 19 nt, Homo sapiens
gcaaacagcucugcaaauc

SEQ ID NO: 1510363 - RNA, 19 nt, Homo sapiens
gaaauucacaccaaaugua

SEQ ID NO: 1510364 - RNA, 19 nt, Homo sapiens
gcucggauuugucuucuua

SEQ ID NO: 1510365 - RNA, 19 nt, Homo sapiens
ugaaagaacucacaaugga

SEQ ID NO: 1510366 - RNA, 19 nt, Homo sapiens
gggaaagccuucacucauu

SEQ ID NO: 1510367 - RNA, 19 nt, Homo sapiens
ggaaagccuucacucauug

SEQ ID NO: 1510368 - RNA, 19 nt, Homo sapiens
gaagauuucacucaacaua

SEQ ID NO: 1510369 - RNA, 19 nt, Homo sapiens
guagagaaguuggcauuaa

SEQ ID NO: 1510370 - RNA, 19 nt, Homo sapiens
gcaaaucaguugugcuuuc

SEQ ID NO: 1510371 - RNA, 19 nt, Homo sapiens
gaauucacaugguguagaa

SEQ ID NO: 1510372 - RNA, 19 nt, Homo sapiens
gaugaggccucuugaacaa

SEQ ID NO: 1510373 - RNA, 19 nt, Homo sapiens
gauuaugccuuuauccaaa

SEQ ID NO: 1510374 - RNA, 19 nt, Homo sapiens
caaacauacuacaggaaua

SEQ ID NO: 1510375 - RNA, 19 nt, Homo sapiens
ggaaaagccuucucucauu

SEQ ID NO: 1510376 - RNA, 19 nt, Homo sapiens
ggagaaaucacaucacgaa

SEQ ID NO: 1510377 - RNA, 19 nt, Homo sapiens
gaaaccauaugaaugcaau

SEQ ID NO: 1510378 - RNA, 19 nt, Homo sapiens
gagaagauuucacucaaca

SEQ ID NO: 1510379 - RNA, 19 nt, Homo sapiens
ccacuuugcucaaccuaaa

SEQ ID NO: 1510380 - RNA, 19 nt, Homo sapiens
gcacaaacuucagacucua

SEQ ID NO: 1510381 - RNA, 19 nt, Homo sapiens
gaacucacuuaggagauaa

SEQ ID NO: 1510382 - RNA, 19 nt, Homo sapiens
gggaaaaccuuuagcaaaa

SEQ ID NO: 1510383 - RNA, 19 nt, Homo sapiens
acucuaggcugaccauaua

SEQ ID NO: 1510384 - RNA, 19 nt, Homo sapiens
ggagagaaaccauaugaau

SEQ ID NO: 1510385 - RNA, 19 nt, Homo sapiens
ggagagaaaccauaugaau

SEQ ID NO: 1510386 - RNA, 19 nt, Homo sapiens
caaggaaauucacaccaaa

SEQ ID NO: 1510387 - RNA, 19 nt, Homo sapiens
uagagaaguuggcauuaaa

SEQ ID NO: 1510388 - RNA, 19 nt, Homo sapiens
ugaaauaaccugggaauau

SEQ ID NO: 1510389 - RNA, 19 nt, Homo sapiens
caaccuaaaugaauucaag

SEQ ID NO: 1510390 - RNA, 19 nt, Homo sapiens
guaagaaucaucagcugua

SEQ ID NO: 1510391 - RNA, 19 nt, Homo sapiens
gcuguagcguuaacacuaa

SEQ ID NO: 1510392 - RNA, 19 nt, Homo sapiens
gaaguuggcauuaaacauc

SEQ ID NO: 1510393 - RNA, 19 nt, Homo sapiens
gugagagaaugaaacuaua

SEQ ID NO: 1510394 - RNA, 19 nt, Homo sapiens
caagagauaccauucauuc

SEQ ID NO: 1510395 - RNA, 19 nt, Homo sapiens
guagaacucucaaugacau

SEQ ID NO: 1510396 - RNA, 19 nt, Homo sapiens
gaaaucacaucacgaaaau

SEQ ID NO: 1510397 - RNA, 19 nt, Homo sapiens
gugauuaccuacaugagaa

SEQ ID NO: 1510398 - RNA, 19 nt, Homo sapiens
gagauaccauucauucauc

SEQ ID NO: 1510399 - RNA, 19 nt, Homo sapiens
gagagaaaccauaugaaug

SEQ ID NO: 1510400 - RNA, 19 nt, Homo sapiens
gagagaaaccauaugaaug

SEQ ID NO: 1510401 - RNA, 19 nt, Homo sapiens
gcagaauuauguaagaagu

SEQ ID NO: 1510402 - RNA, 19 nt, Homo sapiens
guggagaaguuauucaaug

SEQ ID NO: 1510403 - RNA, 19 nt, Homo sapiens
gagagaauccagauguauu

SEQ ID NO: 1510404 - RNA, 19 nt, Homo sapiens
uaaacgacaugagagaauu

SEQ ID NO: 1510405 - RNA, 19 nt, Homo sapiens
gaaaagccuucucucauug

SEQ ID NO: 1510406 - RNA, 19 nt, Homo sapiens
ggagauaaaccauauggau

SEQ ID NO: 1510407 - RNA, 19 nt, Homo sapiens
gggaaagccuucaguaaaa

SEQ ID NO: 1510408 - RNA, 19 nt, Homo sapiens
ggaagucaucuauuugauu

SEQ ID NO: 1510409 - RNA, 19 nt, Homo sapiens
ucagucaucuggucucuau

SEQ ID NO: 1510410 - RNA, 19 nt, Homo sapiens
ggauaucauuguagacuuc

SEQ ID NO: 1510411 - RNA, 19 nt, Homo sapiens
ggguugaaauguacaauuc

SEQ ID NO: 1510412 - RNA, 19 nt, Homo sapiens
ggaaggcuuucaguaaaug

SEQ ID NO: 1510413 - RNA, 19 nt, Homo sapiens
gggaaggcuuucaguaaau

SEQ ID NO: 1510414 - RNA, 19 nt, Homo sapiens
gcaaccauaugucuguaau

SEQ ID NO: 1510415 - RNA, 19 nt, Homo sapiens
gaaaaugcccuugcugaua

SEQ ID NO: 1510416 - RNA, 19 nt, Homo sapiens
uagagagaauccagaugua

SEQ ID NO: 1510417 - RNA, 19 nt, Homo sapiens
ccauaugaaugccaucuau

SEQ ID NO: 1510418 - RNA, 19 nt, Homo sapiens
ggagagaaaccauaugagu

SEQ ID NO: 1510419 - RNA, 19 nt, Homo sapiens
ccauauggaugucuccuau

SEQ ID NO: 1510420 - RNA, 19 nt, Homo sapiens
uggagaaguuauucaauga

SEQ ID NO: 1510421 - RNA, 19 nt, Homo sapiens
ugggaaggcuuucaguaaa

SEQ ID NO: 1510422 - RNA, 19 nt, Homo sapiens
gauucacacuggagagaaa

SEQ ID NO: 1510423 - RNA, 19 nt, Homo sapiens
cuagagagauaacauugga

SEQ ID NO: 1510424 - RNA, 19 nt, Homo sapiens
agaacucacuuaggagaua

SEQ ID NO: 1510425 - RNA, 19 nt, Homo sapiens
acaaggaaauucacaccaa

SEQ ID NO: 1510426 - RNA, 19 nt, Homo sapiens
aaaaugcccuugcugauaa

SEQ ID NO: 1510427 - RNA, 19 nt, Homo sapiens
gaaacuauagaucaaagga

SEQ ID NO: 1510428 - RNA, 19 nt, Homo sapiens
ccauaugagugccauguau

SEQ ID NO: 1510429 - RNA, 19 nt, Homo sapiens
ggagagaaaccacauggau

SEQ ID NO: 1510430 - RNA, 19 nt, Homo sapiens
ggagagaagccauauggau

SEQ ID NO: 1510431 - RNA, 19 nt, Homo sapiens
gcaaugacuuaggagaaga

SEQ ID NO: 1510432 - RNA, 19 nt, Homo sapiens
gguaguccucaguaaauua

SEQ ID NO: 1510433 - RNA, 19 nt, Homo sapiens
ugaggccucuugaacaauu

SEQ ID NO: 1510434 - RNA, 19 nt, Homo sapiens
guagagagaauccagaugu

SEQ ID NO: 1510435 - RNA, 19 nt, Homo sapiens
ucucauuguucucaccuua

SEQ ID NO: 1510436 - RNA, 19 nt, Homo sapiens
uggcugagcuaguacaaug

SEQ ID NO: 1510437 - RNA, 19 nt, Homo sapiens
guacaauucugaaauaacc

SEQ ID NO: 1510438 - RNA, 19 nt, Homo sapiens
gagaauccagauguauuua

SEQ ID NO: 1510439 - RNA, 19 nt, Homo sapiens
aaccauaugucuguaauug

SEQ ID NO: 1510440 - RNA, 19 nt, Homo sapiens
aaacagcucugcaaaucag

SEQ ID NO: 1510441 - RNA, 19 nt, Homo sapiens
ugcccuugcugauaauuua

SEQ ID NO: 1510442 - RNA, 19 nt, Homo sapiens
agagaaaccauaugaaugu

SEQ ID NO: 1510443 - RNA, 19 nt, Homo sapiens
gugggaaggcuuucaguaa

SEQ ID NO: 1510444 - RNA, 19 nt, Homo sapiens
cuuaggagauaaaccauau

SEQ ID NO: 1510445 - RNA, 19 nt, Homo sapiens
acucauugcucugaccuua

SEQ ID NO: 1510446 - RNA, 19 nt, Homo sapiens
ggagaagauuucacucaac

SEQ ID NO: 1510447 - RNA, 19 nt, Homo sapiens
gaacucacacuggagagaa

SEQ ID NO: 1510448 - RNA, 19 nt, Homo sapiens
guucuuaccuuagacaaca

SEQ ID NO: 1510449 - RNA, 19 nt, Homo sapiens
gaacucacacuggagagaa

SEQ ID NO: 1510450 - RNA, 19 nt, Homo sapiens
ggaaauucacaccaaaugu

SEQ ID NO: 1510451 - RNA, 19 nt, Homo sapiens
aucaucagcuguagcguua

SEQ ID NO: 1510452 - RNA, 19 nt, Homo sapiens
caacaugagcgaagucaca

SEQ ID NO: 1510453 - RNA, 19 nt, Homo sapiens
ucauugcucugaccuuaga

SEQ ID NO: 1510454 - RNA, 19 nt, Homo sapiens
ugggaaagccuucaguaaa

SEQ ID NO: 1510455 - RNA, 19 nt, Homo sapiens
ccaaaacucugcccuuaga

SEQ ID NO: 1510456 - RNA, 19 nt, Homo sapiens
ugacuuaggagaagauuuc

SEQ ID NO: 1510457 - RNA, 19 nt, Homo sapiens
gcauuaaacaucaagagau

SEQ ID NO: 1510458 - RNA, 19 nt, Homo sapiens
caguugugcuuucccaauu

SEQ ID NO: 1510459 - RNA, 19 nt, Homo sapiens
acucauuccuuagucaaua

SEQ ID NO: 1510460 - RNA, 19 nt, Homo sapiens
ccacaggcaagcaaccaua

SEQ ID NO: 1510461 - RNA, 19 nt, Homo sapiens
gaagauagcugaguguuug

SEQ ID NO: 1510462 - RNA, 19 nt, Homo sapiens
ggacagagggcaacuauaa

SEQ ID NO: 1510463 - RNA, 19 nt, Homo sapiens
gcugaaggcuuaugaguau

SEQ ID NO: 1510464 - RNA, 19 nt, Homo sapiens
caacaccgcaggagcauuu

SEQ ID NO: 1510465 - RNA, 19 nt, Homo sapiens
caagacaagagaauuagua

SEQ ID NO: 1510466 - RNA, 19 nt, Homo sapiens
ggaacacgacggagaauga

SEQ ID NO: 1510467 - RNA, 19 nt, Homo sapiens
gcagacagacgaauacuuc

SEQ ID NO: 1510468 - RNA, 19 nt, Homo sapiens
gcagagagccagaaagaag

SEQ ID NO: 1510469 - RNA, 19 nt, Homo sapiens
ggagacauguacccagaga

SEQ ID NO: 1510470 - RNA, 19 nt, Homo sapiens
ccaugggcaucuucacuuu

SEQ ID NO: 1510471 - RNA, 19 nt, Homo sapiens
gcuaccagcuggacuacug

SEQ ID NO: 1510472 - RNA, 19 nt, Homo sapiens
uaaggugggucagguguug

SEQ ID NO: 1510473 - RNA, 19 nt, Homo sapiens
acauguggcugguagauuc

SEQ ID NO: 1510474 - RNA, 19 nt, Homo sapiens
gcaccaacuucacuaccau

SEQ ID NO: 1510475 - RNA, 19 nt, Homo sapiens
ucuggaaccucauggagaa

SEQ ID NO: 1510476 - RNA, 19 nt, Homo sapiens
ucaacgggaugcccauuuc

SEQ ID NO: 1510477 - RNA, 19 nt, Homo sapiens
gggcaacuauaacuacuac

SEQ ID NO: 1510478 - RNA, 19 nt, Homo sapiens
gcgaacggcucaagaucca

SEQ ID NO: 1510479 - RNA, 19 nt, Homo sapiens
gcugaguguuugcuuggaa

SEQ ID NO: 1510480 - RNA, 19 nt, Homo sapiens
gaaggacgaccuggcagaa

SEQ ID NO: 1510481 - RNA, 19 nt, Homo sapiens
ccauuuccauccucuacaa

SEQ ID NO: 1510482 - RNA, 19 nt, Homo sapiens
gcaacuauaacuacuacau

SEQ ID NO: 1510483 - RNA, 19 nt, Homo sapiens
gggcuggccucucuaagac

SEQ ID NO: 1510484 - RNA, 19 nt, Homo sapiens
ccgcagccaugcucaaaca

SEQ ID NO: 1510485 - RNA, 19 nt, Homo sapiens
cagcuggucuacaauuucu

SEQ ID NO: 1510486 - RNA, 19 nt, Homo sapiens
cuacaucgaggaagacgaa

SEQ ID NO: 1510487 - RNA, 19 nt, Homo sapiens
gacagacgaauacuucuuc

SEQ ID NO: 1510488 - RNA, 19 nt, Homo sapiens
uguccacgcugaaugugaa

SEQ ID NO: 1510489 - RNA, 19 nt, Homo sapiens
uaacuacuacaucgaggaa

SEQ ID NO: 1510490 - RNA, 19 nt, Homo sapiens
caacuauaacuacuacauc

SEQ ID NO: 1510491 - RNA, 19 nt, Homo sapiens
gcagccaugcucaaacaga

SEQ ID NO: 1510492 - RNA, 19 nt, Homo sapiens
ggacauguggcugguagau

SEQ ID NO: 1510493 - RNA, 19 nt, Homo sapiens
agaagauagcugaguguuu

SEQ ID NO: 1510494 - RNA, 19 nt, Homo sapiens
caacaaguuuucugauuac

SEQ ID NO: 1510495 - RNA, 19 nt, Homo sapiens
uggaggagcugggcuacug

SEQ ID NO: 1510496 - RNA, 19 nt, Homo sapiens
aggacgaccuggcagaaga

SEQ ID NO: 1510497 - RNA, 19 nt, Homo sapiens
gagggcaacuauaacuacu

SEQ ID NO: 1510498 - RNA, 19 nt, Homo sapiens
cagagggcaacuauaacua

SEQ ID NO: 1510499 - RNA, 19 nt, Homo sapiens
cagagagccagaaagaaga

SEQ ID NO: 1510500 - RNA, 19 nt, Homo sapiens
uccagcuggucuacaauuu

SEQ ID NO: 1510501 - RNA, 19 nt, Homo sapiens
ggagcagacagacgaauac

SEQ ID NO: 1510502 - RNA, 19 nt, Homo sapiens
acuacuacaucgaggaaga

SEQ ID NO: 1510503 - RNA, 19 nt, Homo sapiens
cgugauccauccuccuaga

SEQ ID NO: 1510504 - RNA, 19 nt, Homo sapiens
gaacacgacggagaaugag

SEQ ID NO: 1510505 - RNA, 19 nt, Homo sapiens
cauccucuacaacaaguuu

SEQ ID NO: 1510506 - RNA, 19 nt, Homo sapiens
ucaacaccguggaggagau

SEQ ID NO: 1510507 - RNA, 19 nt, Homo sapiens
ggaggcggaggaacucuuc

SEQ ID NO: 1510508 - RNA, 19 nt, Homo sapiens
gccaugggcaucuucacuu

SEQ ID NO: 1510509 - RNA, 19 nt, Homo sapiens
caaguuuucugauuacuac

SEQ ID NO: 1510510 - RNA, 19 nt, Homo sapiens
ggagacgguccuggagcua

SEQ ID NO: 1510511 - RNA, 19 nt, Homo sapiens
ucuuccagcuggucuacaa

SEQ ID NO: 1510512 - RNA, 19 nt, Homo sapiens
aggagcagacagacgaaua

SEQ ID NO: 1510513 - RNA, 19 nt, Homo sapiens
cagcuccgguggcaauguc

SEQ ID NO: 1510514 - RNA, 19 nt, Homo sapiens
gacauguggcugguagauu

SEQ ID NO: 1510515 - RNA, 19 nt, Homo sapiens
augcagagagccagaaaga

SEQ ID NO: 1510516 - RNA, 19 nt, Homo sapiens
cacgugauccauccuccua

SEQ ID NO: 1510517 - RNA, 19 nt, Homo sapiens
agacgguccuggagcuaca

SEQ ID NO: 1510518 - RNA, 19 nt, Homo sapiens
agacagacgaauacuucuu

SEQ ID NO: 1510519 - RNA, 19 nt, Homo sapiens
guaaggugggucagguguu

SEQ ID NO: 1510520 - RNA, 19 nt, Homo sapiens
gaacagaacuggccucauu

SEQ ID NO: 1510521 - RNA, 19 nt, Homo sapiens
gagcagcuacugauaauaa

SEQ ID NO: 1510522 - RNA, 19 nt, Homo sapiens
gcgaagguuuguuguuuaa

SEQ ID NO: 1510523 - RNA, 19 nt, Homo sapiens
caagaugguucaaacacaa

SEQ ID NO: 1510524 - RNA, 19 nt, Homo sapiens
gcccugaauuccagacaua

SEQ ID NO: 1510525 - RNA, 19 nt, Homo sapiens
ccaggugacugaaagcaaa

SEQ ID NO: 1510526 - RNA, 19 nt, Homo sapiens
gggagcagcuacugauaau

SEQ ID NO: 1510527 - RNA, 19 nt, Homo sapiens
aagcgaagguuuguuguuu

SEQ ID NO: 1510528 - RNA, 19 nt, Homo sapiens
uuuguuagcuuguuuccua

SEQ ID NO: 1510529 - RNA, 19 nt, Homo sapiens
gagcuguccugcagagaga

SEQ ID NO: 1510530 - RNA, 19 nt, Homo sapiens
gcaaggaugcagaacagaa

SEQ ID NO: 1510531 - RNA, 19 nt, Homo sapiens
ccacaugccuuccuguucu

SEQ ID NO: 1510532 - RNA, 19 nt, Homo sapiens
gaauagaugcugguuguca

SEQ ID NO: 1510533 - RNA, 19 nt, Homo sapiens
gaacccaugaauguuauuu

SEQ ID NO: 1510534 - RNA, 19 nt, Homo sapiens
aggaauagaugcugguugu

SEQ ID NO: 1510535 - RNA, 19 nt, Homo sapiens
ucaagaugguucaaacaca

SEQ ID NO: 1510536 - RNA, 19 nt, Homo sapiens
ccugauggguuuccugaug

SEQ ID NO: 1510537 - RNA, 19 nt, Homo sapiens
gaaagcaaaggaguguuga

SEQ ID NO: 1510538 - RNA, 19 nt, Homo sapiens
ucggaacccaugaauguua

SEQ ID NO: 1510539 - RNA, 19 nt, Homo sapiens
uuagcuuguuuccuaguua

SEQ ID NO: 1510540 - RNA, 19 nt, Homo sapiens
ccucggaacccaugaaugu

SEQ ID NO: 1510541 - RNA, 19 nt, Homo sapiens
gaccauacuaccagaguga

SEQ ID NO: 1510542 - RNA, 19 nt, Homo sapiens
gagauucuuucugcuguca

SEQ ID NO: 1510543 - RNA, 19 nt, Homo sapiens
uguaauauuugccuucaag

SEQ ID NO: 1510544 - RNA, 19 nt, Homo sapiens
uguucuauaucaccuagua

SEQ ID NO: 1510545 - RNA, 19 nt, Homo sapiens
gggaugacagcccugaauu

SEQ ID NO: 1510546 - RNA, 19 nt, Homo sapiens
cgacaacaccuugcucaug

SEQ ID NO: 1510547 - RNA, 19 nt, Homo sapiens
ugaaagcaaaggaguguug

SEQ ID NO: 1510548 - RNA, 19 nt, Homo sapiens
agcgaagguuuguuguuua

SEQ ID NO: 1510549 - RNA, 19 nt, Homo sapiens
ucugagagcucugcuuaca

SEQ ID NO: 1510550 - RNA, 19 nt, Homo sapiens
caacaccaagcagacauuu

SEQ ID NO: 1510551 - RNA, 19 nt, Homo sapiens
ggaugacagcccugaauuc

SEQ ID NO: 1510552 - RNA, 19 nt, Homo sapiens
acaccaagcagacauuuca

SEQ ID NO: 1510553 - RNA, 19 nt, Homo sapiens
cggaacccaugaauguuau

SEQ ID NO: 1510554 - RNA, 19 nt, Homo sapiens
gcauuccuccaccucuaua

SEQ ID NO: 1510555 - RNA, 19 nt, Homo sapiens
gagggacugugggaggaaa

SEQ ID NO: 1510556 - RNA, 19 nt, Homo sapiens
ucagggugcuggguuccua

SEQ ID NO: 1510557 - RNA, 19 nt, Homo sapiens
guuagcuuguuuccuaguu

SEQ ID NO: 1510558 - RNA, 19 nt, Homo sapiens
uuucugcugucacucaauu

SEQ ID NO: 1510559 - RNA, 19 nt, Homo sapiens
uggcauuccuccaccucua

SEQ ID NO: 1510560 - RNA, 19 nt, Homo sapiens
aauauuugccuucaagaug

SEQ ID NO: 1510561 - RNA, 19 nt, Homo sapiens
cuucacauccugggagaua

SEQ ID NO: 1510562 - RNA, 19 nt, Homo sapiens
cacaugccuuccuguucua

SEQ ID NO: 1510563 - RNA, 19 nt, Homo sapiens
cuaccagagugaggcagua

SEQ ID NO: 1510564 - RNA, 19 nt, Homo sapiens
uauaucaccuaguaaucuc

SEQ ID NO: 1510565 - RNA, 19 nt, Homo sapiens
ggagcagcuacugauaaua

SEQ ID NO: 1510566 - RNA, 19 nt, Homo sapiens
cagagacgggccuggaauu

SEQ ID NO: 1510567 - RNA, 19 nt, Homo sapiens
ggugcuggguuccuaaggu

SEQ ID NO: 1510568 - RNA, 19 nt, Homo sapiens
gauugcggccuauuugcuu

SEQ ID NO: 1510569 - RNA, 19 nt, Homo sapiens
uauugauuguucagccuuu

SEQ ID NO: 1510570 - RNA, 19 nt, Homo sapiens
caaaggugucacucugaga

SEQ ID NO: 1510571 - RNA, 19 nt, Homo sapiens
ccaacaccaagcagacauu

SEQ ID NO: 1510572 - RNA, 19 nt, Homo sapiens
gguggugacagcaaucuca

SEQ ID NO: 1510573 - RNA, 19 nt, Homo sapiens
ggaauuuucuggagcaacu

SEQ ID NO: 1510574 - RNA, 19 nt, Homo sapiens
gccuuccuguucuauauca

SEQ ID NO: 1510575 - RNA, 19 nt, Homo sapiens
guaauauuugccuucaaga

SEQ ID NO: 1510576 - RNA, 19 nt, Homo sapiens
ccagagugaggcaguacuu

SEQ ID NO: 1510577 - RNA, 19 nt, Homo sapiens
ggaggaauagaugcugguu

SEQ ID NO: 1510578 - RNA, 19 nt, Homo sapiens
ccugauugcggccuauuug

SEQ ID NO: 1510579 - RNA, 19 nt, Homo sapiens
aaagcgaagguuuguuguu

SEQ ID NO: 1510580 - RNA, 19 nt, Homo sapiens
cucauucucugugcucuug

SEQ ID NO: 1510581 - RNA, 19 nt, Homo sapiens
gcuccauauucgacuguca

SEQ ID NO: 1510582 - RNA, 19 nt, Homo sapiens
gcacaugcuccgacaacac

SEQ ID NO: 1510583 - RNA, 19 nt, Homo sapiens
ucacauccugggagauaug

SEQ ID NO: 1510584 - RNA, 19 nt, Homo sapiens
cuccaccucuauauacaga

SEQ ID NO: 1510585 - RNA, 19 nt, Homo sapiens
gaaaugaugugcauaugaa

SEQ ID NO: 1510586 - RNA, 19 nt, Homo sapiens
gaauauaccuccuucagau

SEQ ID NO: 1510587 - RNA, 19 nt, Homo sapiens
gauaccaggucccuuauuu

SEQ ID NO: 1510588 - RNA, 19 nt, Homo sapiens
gaacacagccucccuauac

SEQ ID NO: 1510589 - RNA, 19 nt, Homo sapiens
ccagaucaguccuagcuua

SEQ ID NO: 1510590 - RNA, 19 nt, Homo sapiens
gaaaguagccacucuccuu

SEQ ID NO: 1510591 - RNA, 19 nt, Homo sapiens
ggacgcaucuggacaccaa

SEQ ID NO: 1510592 - RNA, 19 nt, Homo sapiens
gcaggaaucauuacaguug

SEQ ID NO: 1510593 - RNA, 19 nt, Homo sapiens
ggaaauccauguccaaagc

SEQ ID NO: 1510594 - RNA, 19 nt, Homo sapiens
gcaauagugucucuaacuc

SEQ ID NO: 1510595 - RNA, 19 nt, Homo sapiens
ucagauaccaggucccuua

SEQ ID NO: 1510596 - RNA, 19 nt, Homo sapiens
ccaguuaccuccacucaca

SEQ ID NO: 1510597 - RNA, 19 nt, Homo sapiens
gacccaaguucccuaagaa

SEQ ID NO: 1510598 - RNA, 19 nt, Homo sapiens
caccaaaccuuaugcuugu

SEQ ID NO: 1510599 - RNA, 19 nt, Homo sapiens
gggagaagcccaacaagug

SEQ ID NO: 1510600 - RNA, 19 nt, Homo sapiens
aaaggcagcugcaacaauc

SEQ ID NO: 1510601 - RNA, 19 nt, Homo sapiens
aguguggucucaacucuua

SEQ ID NO: 1510602 - RNA, 19 nt, Homo sapiens
gcuauaaacugcugaucca

SEQ ID NO: 1510603 - RNA, 19 nt, Homo sapiens
uagugucucuaacucauua

SEQ ID NO: 1510604 - RNA, 19 nt, Homo sapiens
ggaaggaugucagcccaau

SEQ ID NO: 1510605 - RNA, 19 nt, Homo sapiens
gcaguguggugccuucguu

SEQ ID NO: 1510606 - RNA, 19 nt, Homo sapiens
gcgagaagccguauuugug

SEQ ID NO: 1510607 - RNA, 19 nt, Homo sapiens
caacaaguguacguuugaa

SEQ ID NO: 1510608 - RNA, 19 nt, Homo sapiens
ggauagauuucaauaccau

SEQ ID NO: 1510609 - RNA, 19 nt, Homo sapiens
gcugaaguggcaacuaaua

SEQ ID NO: 1510610 - RNA, 19 nt, Homo sapiens
cugcugaaguggcaacuaa

SEQ ID NO: 1510611 - RNA, 19 nt, Homo sapiens
gauguugcuugccaccuuu

SEQ ID NO: 1510612 - RNA, 19 nt, Homo sapiens
gcuaaccaguugcuucuca

SEQ ID NO: 1510613 - RNA, 19 nt, Homo sapiens
ggucucaacucuuagaaac

SEQ ID NO: 1510614 - RNA, 19 nt, Homo sapiens
gaaagucagucggccucaa

SEQ ID NO: 1510615 - RNA, 19 nt, Homo sapiens
gaaguccuaucagccagaa

SEQ ID NO: 1510616 - RNA, 19 nt, Homo sapiens
gggcagcaccguagaccua

SEQ ID NO: 1510617 - RNA, 19 nt, Homo sapiens
gaaugcagccaaccugaau

SEQ ID NO: 1510618 - RNA, 19 nt, Homo sapiens
ggagaagcccaacaagugu

SEQ ID NO: 1510619 - RNA, 19 nt, Homo sapiens
aaaguagccacucuccuua

SEQ ID NO: 1510620 - RNA, 19 nt, Homo sapiens
ugaccugccucaccuaauc

SEQ ID NO: 1510621 - RNA, 19 nt, Homo sapiens
gagccucacucuccuggau

SEQ ID NO: 1510622 - RNA, 19 nt, Homo sapiens
ggacugaauggcagagcua

SEQ ID NO: 1510623 - RNA, 19 nt, Homo sapiens
gagaagcccaacaagugua

SEQ ID NO: 1510624 - RNA, 19 nt, Homo sapiens
cgcaggagcugagagguuu

SEQ ID NO: 1510625 - RNA, 19 nt, Homo sapiens
guaccaaacgcuacacaga

SEQ ID NO: 1510626 - RNA, 19 nt, Homo sapiens
ugaaaugaugugcauauga

SEQ ID NO: 1510627 - RNA, 19 nt, Homo sapiens
ccagugaaaugaugugcau

SEQ ID NO: 1510628 - RNA, 19 nt, Homo sapiens
ucauuacaguugcuccuuu

SEQ ID NO: 1510629 - RNA, 19 nt, Homo sapiens
gggaggacuucacuugcuu

SEQ ID NO: 1510630 - RNA, 19 nt, Homo sapiens
ucauuaccauccuaccuuu

SEQ ID NO: 1510631 - RNA, 19 nt, Homo sapiens
ggguuucccuuuucucuua

SEQ ID NO: 1510632 - RNA, 19 nt, Homo sapiens
caacaagggaaauccaugu

SEQ ID NO: 1510633 - RNA, 19 nt, Homo sapiens
ggaggacugucuuuucaaa

SEQ ID NO: 1510634 - RNA, 19 nt, Homo sapiens
cagaguuacugauguucuu

SEQ ID NO: 1510635 - RNA, 19 nt, Homo sapiens
agagagcgcuguccuuguc

SEQ ID NO: 1510636 - RNA, 19 nt, Homo sapiens
gggaugacucuaccugaaa

SEQ ID NO: 1510637 - RNA, 19 nt, Homo sapiens
gagcuagcuuugcaggaau

SEQ ID NO: 1510638 - RNA, 19 nt, Homo sapiens
agagcuagcuuugcaggaa

SEQ ID NO: 1510639 - RNA, 19 nt, Homo sapiens
uggcagagcuagcuuugca

SEQ ID NO: 1510640 - RNA, 19 nt, Homo sapiens
uagagaugcugcugcugaa

SEQ ID NO: 1510641 - RNA, 19 nt, Homo sapiens
gcagccaaccugaauauac

SEQ ID NO: 1510642 - RNA, 19 nt, Homo sapiens
uuacagagggcaaugaaug

SEQ ID NO: 1510643 - RNA, 19 nt, Homo sapiens
gaucaguccuagcuuacag

SEQ ID NO: 1510644 - RNA, 19 nt, Homo sapiens
gaauggcagagcuagcuuu

SEQ ID NO: 1510645 - RNA, 19 nt, Homo sapiens
agacccaaguucccuaaga

SEQ ID NO: 1510646 - RNA, 19 nt, Homo sapiens
ucgacucacucgggcauua

SEQ ID NO: 1510647 - RNA, 19 nt, Homo sapiens
ccuaucagccagaaacaaa

SEQ ID NO: 1510648 - RNA, 19 nt, Homo sapiens
ccaacaaguguacguuuga

SEQ ID NO: 1510649 - RNA, 19 nt, Homo sapiens
gugaaaugaugugcauaug

SEQ ID NO: 1510650 - RNA, 19 nt, Homo sapiens
cuagccagcucuccucugu

SEQ ID NO: 1510651 - RNA, 19 nt, Homo sapiens
cagaccugcucacagauug

SEQ ID NO: 1510652 - RNA, 19 nt, Homo sapiens
caaguucccuaagaaagca

SEQ ID NO: 1510653 - RNA, 19 nt, Homo sapiens
caccagcagucccaugaug

SEQ ID NO: 1510654 - RNA, 19 nt, Homo sapiens
ccgaacgccuggaggaguu

SEQ ID NO: 1510655 - RNA, 19 nt, Homo sapiens
gcaucgggauagauuucaa

SEQ ID NO: 1510656 - RNA, 19 nt, Homo sapiens
ccagcaauagugucucuaa

SEQ ID NO: 1510657 - RNA, 19 nt, Homo sapiens
cagaauggccuugaucuag

SEQ ID NO: 1510658 - RNA, 19 nt, Homo sapiens
aaccacggcucucagaaug

SEQ ID NO: 1510659 - RNA, 19 nt, Homo sapiens
cugcagaguuacugauguu

SEQ ID NO: 1510660 - RNA, 19 nt, Homo sapiens
ugaaguggcaacuaauaga

SEQ ID NO: 1510661 - RNA, 19 nt, Homo sapiens
caaccacggcucucagaau

SEQ ID NO: 1510662 - RNA, 19 nt, Homo sapiens
uccacgaccuugagucuga

SEQ ID NO: 1510663 - RNA, 19 nt, Homo sapiens
caguguuucucuucaauag

SEQ ID NO: 1510664 - RNA, 19 nt, Homo sapiens
gaaguggcaacuaauagag

SEQ ID NO: 1510665 - RNA, 19 nt, Homo sapiens
cccaacaaguguacguuug

SEQ ID NO: 1510666 - RNA, 19 nt, Homo sapiens
gccacaugcuaaccaguug

SEQ ID NO: 1510667 - RNA, 19 nt, Homo sapiens
uuacuuguuuguugucuag

SEQ ID NO: 1510668 - RNA, 19 nt, Homo sapiens
caggcgagaagccguauuu

SEQ ID NO: 1510669 - RNA, 19 nt, Homo sapiens
ccacaucgaccagcgcaaa

SEQ ID NO: 1510670 - RNA, 19 nt, Homo sapiens
gggauagauuucaauacca

SEQ ID NO: 1510671 - RNA, 19 nt, Homo sapiens
ggaugacucuaccugaaaa

SEQ ID NO: 1510672 - RNA, 19 nt, Homo sapiens
acuaauagagguuugaaug

SEQ ID NO: 1510673 - RNA, 19 nt, Homo sapiens
aaacugcugauccacauga

SEQ ID NO: 1510674 - RNA, 19 nt, Homo sapiens
gcaacuaauagagguuuga

SEQ ID NO: 1510675 - RNA, 19 nt, Homo sapiens
guuugaagguugcgagaag

SEQ ID NO: 1510676 - RNA, 19 nt, Homo sapiens
ucagaauggccuugaucua

SEQ ID NO: 1510677 - RNA, 19 nt, Homo sapiens
ccaguugcuucucaguguu

SEQ ID NO: 1510678 - RNA, 19 nt, Homo sapiens
gaccaggaggacugucuuu

SEQ ID NO: 1510679 - RNA, 19 nt, Homo sapiens
ucacagacugcuugaggaa

SEQ ID NO: 1510680 - RNA, 19 nt, Homo sapiens
ugauguugcuugccaccuu

SEQ ID NO: 1510681 - RNA, 19 nt, Homo sapiens
caacuaauagagguuugaa

SEQ ID NO: 1510682 - RNA, 19 nt, Homo sapiens
uuauuucgcgugagucuuu

SEQ ID NO: 1510683 - RNA, 19 nt, Homo sapiens
uagcuuugcaggaaucauu

SEQ ID NO: 1510684 - RNA, 19 nt, Homo sapiens
ugucuacaccgaaggcuaa

SEQ ID NO: 1510685 - RNA, 19 nt, Homo sapiens
gaggagcugucuuaaauua

SEQ ID NO: 1510686 - RNA, 19 nt, Homo sapiens
gaaaguacuuggagaacua

SEQ ID NO: 1510687 - RNA, 19 nt, Homo sapiens
ugaaggaucuacugaauaa

SEQ ID NO: 1510688 - RNA, 19 nt, Homo sapiens
caacaacuguauaccuuua

SEQ ID NO: 1510689 - RNA, 19 nt, Homo sapiens
gaucaaaugguaugaguua

SEQ ID NO: 1510690 - RNA, 19 nt, Homo sapiens
gaaaagcucuccccagaua

SEQ ID NO: 1510691 - RNA, 19 nt, Homo sapiens
ggaaagcccuggacauuag

SEQ ID NO: 1510692 - RNA, 19 nt, Homo sapiens
gaaagacgcuuacguacag

SEQ ID NO: 1510693 - RNA, 19 nt, Homo sapiens
guagauuccuuucaaauug

SEQ ID NO: 1510694 - RNA, 19 nt, Homo sapiens
ggacagaaguacaccaaau

SEQ ID NO: 1510695 - RNA, 19 nt, Homo sapiens
gaguaagacuguuaaauuc

SEQ ID NO: 1510696 - RNA, 19 nt, Homo sapiens
ugugaaagaucaacucaua

SEQ ID NO: 1510697 - RNA, 19 nt, Homo sapiens
caauuaagccaucauagua

SEQ ID NO: 1510698 - RNA, 19 nt, Homo sapiens
gugcuuaucuucacuguau

SEQ ID NO: 1510699 - RNA, 19 nt, Homo sapiens
gggcaaggaauuauuguua

SEQ ID NO: 1510700 - RNA, 19 nt, Homo sapiens
ucagucaguuccuuuguua

SEQ ID NO: 1510701 - RNA, 19 nt, Homo sapiens
gaggcaagguacccuauuu

SEQ ID NO: 1510702 - RNA, 19 nt, Homo sapiens
gagaucagauacaggguuu

SEQ ID NO: 1510703 - RNA, 19 nt, Homo sapiens
gugaaggaaugaccaagua

SEQ ID NO: 1510704 - RNA, 19 nt, Homo sapiens
caacacaagcucauaugua

SEQ ID NO: 1510705 - RNA, 19 nt, Homo sapiens
ggacuuaccacuuucuuga

SEQ ID NO: 1510706 - RNA, 19 nt, Homo sapiens
caagguacccuauuuaugu

SEQ ID NO: 1510707 - RNA, 19 nt, Homo sapiens
ggcaaggaauuauuguuaa

SEQ ID NO: 1510708 - RNA, 19 nt, Homo sapiens
gcagagguuuauagccaua

SEQ ID NO: 1510709 - RNA, 19 nt, Homo sapiens
guucaguacuuaacagaaa

SEQ ID NO: 1510710 - RNA, 19 nt, Homo sapiens
gcucauauguaccaggaaa

SEQ ID NO: 1510711 - RNA, 19 nt, Homo sapiens
caaagaauccuauccuguu

SEQ ID NO: 1510712 - RNA, 19 nt, Homo sapiens
gaccagcucugaaugugaa

SEQ ID NO: 1510713 - RNA, 19 nt, Homo sapiens
gauguacagugaaguauca

SEQ ID NO: 1510714 - RNA, 19 nt, Homo sapiens
guacuuggagaacuaaaua

SEQ ID NO: 1510715 - RNA, 19 nt, Homo sapiens
caugauuguuggagucuua

SEQ ID NO: 1510716 - RNA, 19 nt, Homo sapiens
caauugaucuacugacuuc

SEQ ID NO: 1510717 - RNA, 19 nt, Homo sapiens
gacagaaguacaccaaaua

SEQ ID NO: 1510718 - RNA, 19 nt, Homo sapiens
aauauuaccugaaguguca

SEQ ID NO: 1510719 - RNA, 19 nt, Homo sapiens
gccauagcauuuaccauuu

SEQ ID NO: 1510720 - RNA, 19 nt, Homo sapiens
gguaaaggauguuagucuu

SEQ ID NO: 1510721 - RNA, 19 nt, Homo sapiens
ccauacagcugugcaacua

SEQ ID NO: 1510722 - RNA, 19 nt, Homo sapiens
guguugagcuuccagguaa

SEQ ID NO: 1510723 - RNA, 19 nt, Homo sapiens
uaaauuggguuggauacaa

SEQ ID NO: 1510724 - RNA, 19 nt, Homo sapiens
aaauacacaugcaaccaua

SEQ ID NO: 1510725 - RNA, 19 nt, Homo sapiens
gauguuagucuucagagua

SEQ ID NO: 1510726 - RNA, 19 nt, Homo sapiens
gcacaaguggccaucagua

SEQ ID NO: 1510727 - RNA, 19 nt, Homo sapiens
gcucuagauucuuuauuga

SEQ ID NO: 1510728 - RNA, 19 nt, Homo sapiens
caugaaagacgcuuacgua

SEQ ID NO: 1510729 - RNA, 19 nt, Homo sapiens
ccaaccacuuuaaauguuu

SEQ ID NO: 1510730 - RNA, 19 nt, Homo sapiens
caacuauauugcauucuug

SEQ ID NO: 1510731 - RNA, 19 nt, Homo sapiens
gcacuuucguggaucaaau

SEQ ID NO: 1510732 - RNA, 19 nt, Homo sapiens
agacggcaguuugaauuua

SEQ ID NO: 1510733 - RNA, 19 nt, Homo sapiens
acaauggaaucagcuauaa

SEQ ID NO: 1510734 - RNA, 19 nt, Homo sapiens
acagaacccugaggcuuua

SEQ ID NO: 1510735 - RNA, 19 nt, Homo sapiens
ccacaaccauuucauaggu

SEQ ID NO: 1510736 - RNA, 19 nt, Homo sapiens
uaacgaagaauuucagguu

SEQ ID NO: 1510737 - RNA, 19 nt, Homo sapiens
cccgauaauuugccaguua

SEQ ID NO: 1510738 - RNA, 19 nt, Homo sapiens
gaacucugguaaaggaugu

SEQ ID NO: 1510739 - RNA, 19 nt, Homo sapiens
acuauggacuuaccacuuu

SEQ ID NO: 1510740 - RNA, 19 nt, Homo sapiens
guuuauagccauagcauuu

SEQ ID NO: 1510741 - RNA, 19 nt, Homo sapiens
gaucaauuaagccaucaua

SEQ ID NO: 1510742 - RNA, 19 nt, Homo sapiens
aaagcaaguuuccaaaugu

SEQ ID NO: 1510743 - RNA, 19 nt, Homo sapiens
gaccaaguaugacuaccuu

SEQ ID NO: 1510744 - RNA, 19 nt, Homo sapiens
gaugccagauugaaugguu

SEQ ID NO: 1510745 - RNA, 19 nt, Homo sapiens
uaagauguacagugaagua

SEQ ID NO: 1510746 - RNA, 19 nt, Homo sapiens
uaaaggauguuagucuuca

SEQ ID NO: 1510747 - RNA, 19 nt, Homo sapiens
uaugugcucuagauucuuu

SEQ ID NO: 1510748 - RNA, 19 nt, Homo sapiens
caaauaacacugggaagaa

SEQ ID NO: 1510749 - RNA, 19 nt, Homo sapiens
agaaauuggucaagguuug

SEQ ID NO: 1510750 - RNA, 19 nt, Homo sapiens
gcaagguacccuauuuaug

SEQ ID NO: 1510751 - RNA, 19 nt, Homo sapiens
aaagaauccuauccuguug

SEQ ID NO: 1510752 - RNA, 19 nt, Homo sapiens
uguuaaagaugccagauug

SEQ ID NO: 1510753 - RNA, 19 nt, Homo sapiens
ucagcaaagucuacuauca

SEQ ID NO: 1510754 - RNA, 19 nt, Homo sapiens
uacaguugauggaauagua

SEQ ID NO: 1510755 - RNA, 19 nt, Homo sapiens
gcauggaguugugaaugaa

SEQ ID NO: 1510756 - RNA, 19 nt, Homo sapiens
caaaagauguaaagaagga

SEQ ID NO: 1510757 - RNA, 19 nt, Homo sapiens
uguuaaagaugcaguucua

SEQ ID NO: 1510758 - RNA, 19 nt, Homo sapiens
caaguggccaucaguauau

SEQ ID NO: 1510759 - RNA, 19 nt, Homo sapiens
gaauaacaauaccauacag

SEQ ID NO: 1510760 - RNA, 19 nt, Homo sapiens
aagcaaguuuccaaaugua

SEQ ID NO: 1510761 - RNA, 19 nt, Homo sapiens
gaucaaguguuagaugaag

SEQ ID NO: 1510762 - RNA, 19 nt, Homo sapiens
gcaaguuuccaaauguaaa

SEQ ID NO: 1510763 - RNA, 19 nt, Homo sapiens
aaucauaccuccacaacca

SEQ ID NO: 1510764 - RNA, 19 nt, Homo sapiens
ugggaagaauuuagaacua

SEQ ID NO: 1510765 - RNA, 19 nt, Homo sapiens
aaauuggguuggauacaaa

SEQ ID NO: 1510766 - RNA, 19 nt, Homo sapiens
aaaccaaccacuuuaaaug

SEQ ID NO: 1510767 - RNA, 19 nt, Homo sapiens
gaaggaaugaccaaguaug

SEQ ID NO: 1510768 - RNA, 19 nt, Homo sapiens
ugacacauuugcaacacaa

SEQ ID NO: 1510769 - RNA, 19 nt, Homo sapiens
gaagaauuucagguuguua

SEQ ID NO: 1510770 - RNA, 19 nt, Homo sapiens
cgaagaauuucagguuguu

SEQ ID NO: 1510771 - RNA, 19 nt, Homo sapiens
acaaguggccaucaguaua

SEQ ID NO: 1510772 - RNA, 19 nt, Homo sapiens
ucaguuccuuuguuacauu

SEQ ID NO: 1510773 - RNA, 19 nt, Homo sapiens
cuguuugccucaugaguua

SEQ ID NO: 1510774 - RNA, 19 nt, Homo sapiens
aaguaugacuaccuuauga

SEQ ID NO: 1510775 - RNA, 19 nt, Homo sapiens
uuucguggaucaaauggua

SEQ ID NO: 1510776 - RNA, 19 nt, Homo sapiens
ugaccaauauuaccugaag

SEQ ID NO: 1510777 - RNA, 19 nt, Homo sapiens
guugagaaacauuccauuu

SEQ ID NO: 1510778 - RNA, 19 nt, Homo sapiens
guaagacuguuaaauucag

SEQ ID NO: 1510779 - RNA, 19 nt, Homo sapiens
ucuauaaaccaaccacuuu

SEQ ID NO: 1510780 - RNA, 19 nt, Homo sapiens
caauuacaguugauggaau

SEQ ID NO: 1510781 - RNA, 19 nt, Homo sapiens
aagguacccuauuuaugua

SEQ ID NO: 1510782 - RNA, 19 nt, Homo sapiens
gcaguuugaauuuagugua

SEQ ID NO: 1510783 - RNA, 19 nt, Homo sapiens
agucuuaucucccuuucaa

SEQ ID NO: 1510784 - RNA, 19 nt, Homo sapiens
uggaucaaguguuagauga

SEQ ID NO: 1510785 - RNA, 19 nt, Homo sapiens
caagugggcuggagaccua

SEQ ID NO: 1510786 - RNA, 19 nt, Homo sapiens
gaagauacaccaagcacaa

SEQ ID NO: 1510787 - RNA, 19 nt, Homo sapiens
ggcaacaucuguaaauuca

SEQ ID NO: 1510788 - RNA, 19 nt, Homo sapiens
ucaauuuacugcuuacuug

SEQ ID NO: 1510789 - RNA, 19 nt, Homo sapiens
ggacuuacgacucuguuaa

SEQ ID NO: 1510790 - RNA, 19 nt, Homo sapiens
ggaugaggucgaauucuua

SEQ ID NO: 1510791 - RNA, 19 nt, Homo sapiens
gcacagcgugggaggauaa

SEQ ID NO: 1510792 - RNA, 19 nt, Homo sapiens
caccgagucugguaaauau

SEQ ID NO: 1510793 - RNA, 19 nt, Homo sapiens
acaaaccgccuuccaagua

SEQ ID NO: 1510794 - RNA, 19 nt, Homo sapiens
caaagaagacgucacagau

SEQ ID NO: 1510795 - RNA, 19 nt, Homo sapiens
gugaugaaccuuugauuga

SEQ ID NO: 1510796 - RNA, 19 nt, Homo sapiens
guacaacuuuggcaacauc

SEQ ID NO: 1510797 - RNA, 19 nt, Homo sapiens
guacaaagaagacgucaca

SEQ ID NO: 1510798 - RNA, 19 nt, Homo sapiens
gaucaagaccaaaagauua

SEQ ID NO: 1510799 - RNA, 19 nt, Homo sapiens
gcauggagcuagacgacau

SEQ ID NO: 1510800 - RNA, 19 nt, Homo sapiens
gcagaacaaccgaucaaga

SEQ ID NO: 1510801 - RNA, 19 nt, Homo sapiens
gcaccgcauucuuauagug

SEQ ID NO: 1510802 - RNA, 19 nt, Homo sapiens
ggagaagacaaccgaggua

SEQ ID NO: 1510803 - RNA, 19 nt, Homo sapiens
cagugcaaguuuacaagua

SEQ ID NO: 1510804 - RNA, 19 nt, Homo sapiens
gucgaauucuuacggauaa

SEQ ID NO: 1510805 - RNA, 19 nt, Homo sapiens
ccuaggaguuaaugaagaa

SEQ ID NO: 1510806 - RNA, 19 nt, Homo sapiens
ucccauaacucgucgaaug

SEQ ID NO: 1510807 - RNA, 19 nt, Homo sapiens
gggauggacuuacgacucu

SEQ ID NO: 1510808 - RNA, 19 nt, Homo sapiens
ggucgaauucuuacggaua

SEQ ID NO: 1510809 - RNA, 19 nt, Homo sapiens
ccaagaagggauggacuua

SEQ ID NO: 1510810 - RNA, 19 nt, Homo sapiens
gcuaagaagugaugaaccu

SEQ ID NO: 1510811 - RNA, 19 nt, Homo sapiens
gcaaacgagugugcuucaa

SEQ ID NO: 1510812 - RNA, 19 nt, Homo sapiens
gaccggagcgucccaucua

SEQ ID NO: 1510813 - RNA, 19 nt, Homo sapiens
gaaaagcuguuugccaaga

SEQ ID NO: 1510814 - RNA, 19 nt, Homo sapiens
caugguacuucgagccuaa

SEQ ID NO: 1510815 - RNA, 19 nt, Homo sapiens
uaaauucaauacccaaugc

SEQ ID NO: 1510816 - RNA, 19 nt, Homo sapiens
ccaccgagucugguaaaua

SEQ ID NO: 1510817 - RNA, 19 nt, Homo sapiens
caauacccaaugcuuauaa

SEQ ID NO: 1510818 - RNA, 19 nt, Homo sapiens
uaagaagugaugaaccuuu

SEQ ID NO: 1510819 - RNA, 19 nt, Homo sapiens
uggaugaggucgaauucuu

SEQ ID NO: 1510820 - RNA, 19 nt, Homo sapiens
gaagauacgcuuguuuguc

SEQ ID NO: 1510821 - RNA, 19 nt, Homo sapiens
gguguccaguuuccuacua

SEQ ID NO: 1510822 - RNA, 19 nt, Homo sapiens
gguauuucuugcucucauu

SEQ ID NO: 1510823 - RNA, 19 nt, Homo sapiens
aagaagugaugaaccuuug

SEQ ID NO: 1510824 - RNA, 19 nt, Homo sapiens
gcuggagaccuaggaguua

SEQ ID NO: 1510825 - RNA, 19 nt, Homo sapiens
gaugaacccgacauucuug

SEQ ID NO: 1510826 - RNA, 19 nt, Homo sapiens
caaaccgccuuccaaguac

SEQ ID NO: 1510827 - RNA, 19 nt, Homo sapiens
ggagaugacaaccgaggaa

SEQ ID NO: 1510828 - RNA, 19 nt, Homo sapiens
guagacacacaucgagaaa

SEQ ID NO: 1510829 - RNA, 19 nt, Homo sapiens
caacguagacacacaucga

SEQ ID NO: 1510830 - RNA, 19 nt, Homo sapiens
ggagcuagacgacauggau

SEQ ID NO: 1510831 - RNA, 19 nt, Homo sapiens
caauggaguguguuucuga

SEQ ID NO: 1510832 - RNA, 19 nt, Homo sapiens
uaagaaggcaaacgagugu

SEQ ID NO: 1510833 - RNA, 19 nt, Homo sapiens
aaagaagacgucacagaug

SEQ ID NO: 1510834 - RNA, 19 nt, Homo sapiens
gaagugaugaaccuuugau

SEQ ID NO: 1510835 - RNA, 19 nt, Homo sapiens
gaacuguuucaggaagaua

SEQ ID NO: 1510836 - RNA, 19 nt, Homo sapiens
aaagauaugccuccagauc

SEQ ID NO: 1510837 - RNA, 19 nt, Homo sapiens
guaaauucaauacccaaug

SEQ ID NO: 1510838 - RNA, 19 nt, Homo sapiens
acaaagaagacgucacaga

SEQ ID NO: 1510839 - RNA, 19 nt, Homo sapiens
uuacgacucuguuaagacu

SEQ ID NO: 1510840 - RNA, 19 nt, Homo sapiens
gcccagagccuuccaagac

SEQ ID NO: 1510841 - RNA, 19 nt, Homo sapiens
guucguagaggaaguggaa

SEQ ID NO: 1510842 - RNA, 19 nt, Homo sapiens
cgucacagaugcaucaaaa

SEQ ID NO: 1510843 - RNA, 19 nt, Homo sapiens
ugcugaaacuggauucuga

SEQ ID NO: 1510844 - RNA, 19 nt, Homo sapiens
aagcccagcugaugaccaa

SEQ ID NO: 1510845 - RNA, 19 nt, Homo sapiens
uguuaagacuccuauucaa

SEQ ID NO: 1510846 - RNA, 19 nt, Homo sapiens
ucaauacccaaugcuuaua

SEQ ID NO: 1510847 - RNA, 19 nt, Homo sapiens
caacuuuggcaacaucugu

SEQ ID NO: 1510848 - RNA, 19 nt, Homo sapiens
gcaaguuuacaaguacaaa

SEQ ID NO: 1510849 - RNA, 19 nt, Homo sapiens
aagcaucccuuggccaugu

SEQ ID NO: 1510850 - RNA, 19 nt, Homo sapiens
gaaccucccaacacucauc

SEQ ID NO: 1510851 - RNA, 19 nt, Homo sapiens
aagcaagggcuacagaaug

SEQ ID NO: 1510852 - RNA, 19 nt, Homo sapiens
gaaggcguucguagaggaa

SEQ ID NO: 1510853 - RNA, 19 nt, Homo sapiens
gaauccaucagcagucugu

SEQ ID NO: 1510854 - RNA, 19 nt, Homo sapiens
cuggagaccuaggaguuaa

SEQ ID NO: 1510855 - RNA, 19 nt, Homo sapiens
gccuccagaucuccuacua

SEQ ID NO: 1510856 - RNA, 19 nt, Homo sapiens
cuccagaucuccuacuaca

SEQ ID NO: 1510857 - RNA, 19 nt, Homo sapiens
gcucucauucuaaacauca

SEQ ID NO: 1510858 - RNA, 19 nt, Homo sapiens
uaagcaagggcuacagaau

SEQ ID NO: 1510859 - RNA, 19 nt, Homo sapiens
agaccuaggaguuaaugaa

SEQ ID NO: 1510860 - RNA, 19 nt, Homo sapiens
cugaagauacgcuuguuug

SEQ ID NO: 1510861 - RNA, 19 nt, Homo sapiens
auucaauacccaaugcuua

SEQ ID NO: 1510862 - RNA, 19 nt, Homo sapiens
uacuacaggugcugaaaca

SEQ ID NO: 1510863 - RNA, 19 nt, Homo sapiens
gcagugcaaguuuacaagu

SEQ ID NO: 1510864 - RNA, 19 nt, Homo sapiens
cgacauucuugacggucuu

SEQ ID NO: 1510865 - RNA, 19 nt, Homo sapiens
cagaacaaccgaucaagac

SEQ ID NO: 1510866 - RNA, 19 nt, Homo sapiens
guccucagcuucccaagac

SEQ ID NO: 1510867 - RNA, 19 nt, Homo sapiens
ugaugaacccgacauucuu

SEQ ID NO: 1510868 - RNA, 19 nt, Homo sapiens
cggcaccgcauucuuauag

SEQ ID NO: 1510869 - RNA, 19 nt, Homo sapiens
agacuggagugucccaucu

SEQ ID NO: 1510870 - RNA, 19 nt, Homo sapiens
agacuggagugucccaucu

SEQ ID NO: 1510871 - RNA, 19 nt, Homo sapiens
gcccugguacugugacaaa

SEQ ID NO: 1510872 - RNA, 19 nt, Homo sapiens
gacaaaccgccuuccaagu

SEQ ID NO: 1510873 - RNA, 19 nt, Homo sapiens
caaacgagugugcuucaag

SEQ ID NO: 1510874 - RNA, 19 nt, Homo sapiens
aacaaccgaucaagaccaa

SEQ ID NO: 1510875 - RNA, 19 nt, Homo sapiens
gaagacgcacgggcucguu

SEQ ID NO: 1510876 - RNA, 19 nt, Homo sapiens
gcuggagugucccaucucu

SEQ ID NO: 1510877 - RNA, 19 nt, Homo sapiens
gugcagaacaaccgaucaa

SEQ ID NO: 1510878 - RNA, 19 nt, Homo sapiens
gaccuaggaguuaaugaag

SEQ ID NO: 1510879 - RNA, 19 nt, Homo sapiens
ggagaccuaggaguuaaug

SEQ ID NO: 1510880 - RNA, 19 nt, Homo sapiens
cgagaaaacuccgugacuu

SEQ ID NO: 1510881 - RNA, 19 nt, Homo sapiens
aagaacuguuucaggaaga

SEQ ID NO: 1510882 - RNA, 19 nt, Homo sapiens
caaccgaggaacucaccaa

SEQ ID NO: 1510883 - RNA, 19 nt, Homo sapiens
cucaucggguguccaguuu

SEQ ID NO: 1510884 - RNA, 19 nt, Homo sapiens
ccuggaaccucccaacacu

SEQ ID NO: 1510885 - RNA, 19 nt, Homo sapiens
gaaauucagugcaucauaa

SEQ ID NO: 1510886 - RNA, 19 nt, Homo sapiens
gaaauuugauccugguaua

SEQ ID NO: 1510887 - RNA, 19 nt, Homo sapiens
ggagaaacaugaagugauu

SEQ ID NO: 1510888 - RNA, 19 nt, Homo sapiens
gcacguguauacaauaaua

SEQ ID NO: 1510889 - RNA, 19 nt, Homo sapiens
gcuaauggcuguugguaaa

SEQ ID NO: 1510890 - RNA, 19 nt, Homo sapiens
uaucaaagcucaugugguu

SEQ ID NO: 1510891 - RNA, 19 nt, Homo sapiens
ccacgaggcuucuucauga

SEQ ID NO: 1510892 - RNA, 19 nt, Homo sapiens
gagaugcucuugaguauca

SEQ ID NO: 1510893 - RNA, 19 nt, Homo sapiens
caacagaaauuccucuaau

SEQ ID NO: 1510894 - RNA, 19 nt, Homo sapiens
ucaaaggacuuaaaucaga

SEQ ID NO: 1510895 - RNA, 19 nt, Homo sapiens
ggaaacgcguugaagcuaa

SEQ ID NO: 1510896 - RNA, 19 nt, Homo sapiens
guacagauauucaacaaag

SEQ ID NO: 1510897 - RNA, 19 nt, Homo sapiens
uggcaaagcuccaggcaua

SEQ ID NO: 1510898 - RNA, 19 nt, Homo sapiens
ugacagcuaugguggaaua

SEQ ID NO: 1510899 - RNA, 19 nt, Homo sapiens
caagaaaguugugaugaaa

SEQ ID NO: 1510900 - RNA, 19 nt, Homo sapiens
gaugugauguguucauuug

SEQ ID NO: 1510901 - RNA, 19 nt, Homo sapiens
gagagaugaugacuauaaa

SEQ ID NO: 1510902 - RNA, 19 nt, Homo sapiens
gcuaagucaucaaugguua

SEQ ID NO: 1510903 - RNA, 19 nt, Homo sapiens
gaaacgcguugaagcuaaa

SEQ ID NO: 1510904 - RNA, 19 nt, Homo sapiens
ccaagaaaguugugaugaa

SEQ ID NO: 1510905 - RNA, 19 nt, Homo sapiens
gcccagagcccauaaauug

SEQ ID NO: 1510906 - RNA, 19 nt, Homo sapiens
caacaaagaacagauauug

SEQ ID NO: 1510907 - RNA, 19 nt, Homo sapiens
gauugcagcuuaauguuga

SEQ ID NO: 1510908 - RNA, 19 nt, Homo sapiens
ggaaagcuguaauaugcaa

SEQ ID NO: 1510909 - RNA, 19 nt, Homo sapiens
ggaagagucugugagaaga

SEQ ID NO: 1510910 - RNA, 19 nt, Homo sapiens
gaauuguugugcucaguuu

SEQ ID NO: 1510911 - RNA, 19 nt, Homo sapiens
aaacaugauugcagcuuaa

SEQ ID NO: 1510912 - RNA, 19 nt, Homo sapiens
gcacacugguugccaauag

SEQ ID NO: 1510913 - RNA, 19 nt, Homo sapiens
caaaggacuuaaaucagaa

SEQ ID NO: 1510914 - RNA, 19 nt, Homo sapiens
ggacaugaugauacucuua

SEQ ID NO: 1510915 - RNA, 19 nt, Homo sapiens
uaaaggcacuguugaagca

SEQ ID NO: 1510916 - RNA, 19 nt, Homo sapiens
caaagcaaauucaucaagu

SEQ ID NO: 1510917 - RNA, 19 nt, Homo sapiens
gaagagccagugaaggaua

SEQ ID NO: 1510918 - RNA, 19 nt, Homo sapiens
gaagaauuggguacagaua

SEQ ID NO: 1510919 - RNA, 19 nt, Homo sapiens
ggaaauugaaucaguaguu

SEQ ID NO: 1510920 - RNA, 19 nt, Homo sapiens
caagaauuaugcaccugua

SEQ ID NO: 1510921 - RNA, 19 nt, Homo sapiens
ucacguauauuuagcuuuc

SEQ ID NO: 1510922 - RNA, 19 nt, Homo sapiens
caggaccaguucuuaauuu

SEQ ID NO: 1510923 - RNA, 19 nt, Homo sapiens
gaagccaaaugcucuuuua

SEQ ID NO: 1510924 - RNA, 19 nt, Homo sapiens
gagccucuauaaauaugua

SEQ ID NO: 1510925 - RNA, 19 nt, Homo sapiens
gggagcgcauguauucaua

SEQ ID NO: 1510926 - RNA, 19 nt, Homo sapiens
ugagagaugaugacuauaa

SEQ ID NO: 1510927 - RNA, 19 nt, Homo sapiens
gagaagaauuggguacaga

SEQ ID NO: 1510928 - RNA, 19 nt, Homo sapiens
ggacaguuagauuguauaa

SEQ ID NO: 1510929 - RNA, 19 nt, Homo sapiens
uagagcgaaucgauuguua

SEQ ID NO: 1510930 - RNA, 19 nt, Homo sapiens
cacuugagcuaucuucuaa

SEQ ID NO: 1510931 - RNA, 19 nt, Homo sapiens
gcgaaucgauuguuaacca

SEQ ID NO: 1510932 - RNA, 19 nt, Homo sapiens
aaacauuucaggccaauuu

SEQ ID NO: 1510933 - RNA, 19 nt, Homo sapiens
gccaagaauuguagaugaa

SEQ ID NO: 1510934 - RNA, 19 nt, Homo sapiens
gaugacagcuaugguggaa

SEQ ID NO: 1510935 - RNA, 19 nt, Homo sapiens
gagccaggaucaggucuaa

SEQ ID NO: 1510936 - RNA, 19 nt, Homo sapiens
ccaauuacccauccucauu

SEQ ID NO: 1510937 - RNA, 19 nt, Homo sapiens
agaauaccacggccaauua

SEQ ID NO: 1510938 - RNA, 19 nt, Homo sapiens
gcaguuguccagccaguaa

SEQ ID NO: 1510939 - RNA, 19 nt, Homo sapiens
ucagaagaccaaccaauuu

SEQ ID NO: 1510940 - RNA, 19 nt, Homo sapiens
ggacuuaaaucagaaccau

SEQ ID NO: 1510941 - RNA, 19 nt, Homo sapiens
gcgcauguauucauaugau

SEQ ID NO: 1510942 - RNA, 19 nt, Homo sapiens
caucaaaagugaacgauuu

SEQ ID NO: 1510943 - RNA, 19 nt, Homo sapiens
agaauuggguacagauauu

SEQ ID NO: 1510944 - RNA, 19 nt, Homo sapiens
gaagaggcaauagugauuu

SEQ ID NO: 1510945 - RNA, 19 nt, Homo sapiens
ccagagggccuuaaauuca

SEQ ID NO: 1510946 - RNA, 19 nt, Homo sapiens
cuaaugagcuaguauugag

SEQ ID NO: 1510947 - RNA, 19 nt, Homo sapiens
ggaagucuuucaccuuuac

SEQ ID NO: 1510948 - RNA, 19 nt, Homo sapiens
aaucaucgcucaugugaag

SEQ ID NO: 1510949 - RNA, 19 nt, Homo sapiens
ugaagcagaugauagagau

SEQ ID NO: 1510950 - RNA, 19 nt, Homo sapiens
guaccaaauuucccacuca

SEQ ID NO: 1510951 - RNA, 19 nt, Homo sapiens
cuucaugucuuucaaggaa

SEQ ID NO: 1510952 - RNA, 19 nt, Homo sapiens
ggaggaagagucugugaga

SEQ ID NO: 1510953 - RNA, 19 nt, Homo sapiens
gagcgcauguauucauaug

SEQ ID NO: 1510954 - RNA, 19 nt, Homo sapiens
guuccaagauuuaacuaug

SEQ ID NO: 1510955 - RNA, 19 nt, Homo sapiens
cuaaagaccaucauaaaca

SEQ ID NO: 1510956 - RNA, 19 nt, Homo sapiens
gcaacuaucaggucuaaag

SEQ ID NO: 1510957 - RNA, 19 nt, Homo sapiens
ucacaaaaguuccaagauu

SEQ ID NO: 1510958 - RNA, 19 nt, Homo sapiens
ugaccgagcugcaacuauc

SEQ ID NO: 1510959 - RNA, 19 nt, Homo sapiens
caagaauuguagaugaaga

SEQ ID NO: 1510960 - RNA, 19 nt, Homo sapiens
gcagaccagccaagaauug

SEQ ID NO: 1510961 - RNA, 19 nt, Homo sapiens
gcaaagcuccaggcauauu

SEQ ID NO: 1510962 - RNA, 19 nt, Homo sapiens
cagcuaugguggaauauca

SEQ ID NO: 1510963 - RNA, 19 nt, Homo sapiens
gauccaggaccaguucuua

SEQ ID NO: 1510964 - RNA, 19 nt, Homo sapiens
uuugagagaugaugacuau

SEQ ID NO: 1510965 - RNA, 19 nt, Homo sapiens
acaggacuaugcucucuuu

SEQ ID NO: 1510966 - RNA, 19 nt, Homo sapiens
uaaauuggguggccaucau

SEQ ID NO: 1510967 - RNA, 19 nt, Homo sapiens
ugacagaacucaguauggu

SEQ ID NO: 1510968 - RNA, 19 nt, Homo sapiens
gaagagggauagcauuuuc

SEQ ID NO: 1510969 - RNA, 19 nt, Homo sapiens
gaagugugcgcuugcagaa

SEQ ID NO: 1510970 - RNA, 19 nt, Homo sapiens
guaaagcuuccaccaagaa

SEQ ID NO: 1510971 - RNA, 19 nt, Homo sapiens
aaucucaccuacauaagaa

SEQ ID NO: 1510972 - RNA, 19 nt, Homo sapiens
uaucguggaugcuaaguca

SEQ ID NO: 1510973 - RNA, 19 nt, Homo sapiens
cuaaagagauuacuaucac

SEQ ID NO: 1510974 - RNA, 19 nt, Homo sapiens
agugaaggauaugcuauua

SEQ ID NO: 1510975 - RNA, 19 nt, Homo sapiens
gugaagagccagugaagga

SEQ ID NO: 1510976 - RNA, 19 nt, Homo sapiens
guucagaaauucagugcau

SEQ ID NO: 1510977 - RNA, 19 nt, Homo sapiens
uauuggaccuucauacaga

SEQ ID NO: 1510978 - RNA, 19 nt, Homo sapiens
ucuccugucuuccuaauga

SEQ ID NO: 1510979 - RNA, 19 nt, Homo sapiens
agggaaagcuguaauaugc

SEQ ID NO: 1510980 - RNA, 19 nt, Homo sapiens
agacuuucaugcaacagua

SEQ ID NO: 1510981 - RNA, 19 nt, Homo sapiens
gaggaagagucugugagaa

SEQ ID NO: 1510982 - RNA, 19 nt, Homo sapiens
gauauuggaccuucauaca

SEQ ID NO: 1510983 - RNA, 19 nt, Homo sapiens
ggguacagauauucaacaa

SEQ ID NO: 1510984 - RNA, 19 nt, Homo sapiens
caauuacccauccucauuu

SEQ ID NO: 1510985 - RNA, 19 nt, Homo sapiens
gaaaggcucuuguguuaua

SEQ ID NO: 1510986 - RNA, 19 nt, Homo sapiens
gaaagaguguguacagaua

SEQ ID NO: 1510987 - RNA, 19 nt, Homo sapiens
gaagaugacuuauuugaag

SEQ ID NO: 1510988 - RNA, 19 nt, Homo sapiens
gcacagaaacugaguaauu

SEQ ID NO: 1510989 - RNA, 19 nt, Homo sapiens
gaugauagcuugguuguug

SEQ ID NO: 1510990 - RNA, 19 nt, Homo sapiens
gaaaagaacuucagagaga

SEQ ID NO: 1510991 - RNA, 19 nt, Homo sapiens
aaacuuagcuuaguacuga

SEQ ID NO: 1510992 - RNA, 19 nt, Homo sapiens
gcacaaagacuugauauug

SEQ ID NO: 1510993 - RNA, 19 nt, Homo sapiens
gaaaugcguuugaguuuua

SEQ ID NO: 1510994 - RNA, 19 nt, Homo sapiens
gaauuaaccucccuuacau

SEQ ID NO: 1510995 - RNA, 19 nt, Homo sapiens
gcaacugugugucagauuu

SEQ ID NO: 1510996 - RNA, 19 nt, Homo sapiens
gaaauaggauuggaagcaa

SEQ ID NO: 1510997 - RNA, 19 nt, Homo sapiens
gaggaaagcuuuguuugug

SEQ ID NO: 1510998 - RNA, 19 nt, Homo sapiens
gagaaggaaugucuuguuc

SEQ ID NO: 1510999 - RNA, 19 nt, Homo sapiens
caauaaugcuugugcugua

SEQ ID NO: 1511000 - RNA, 19 nt, Homo sapiens
cacagaaacugaguaauuu

SEQ ID NO: 1511001 - RNA, 19 nt, Homo sapiens
caucagaauucucccuaua

SEQ ID NO: 1511002 - RNA, 19 nt, Homo sapiens
caaagaauuuccagaagug

SEQ ID NO: 1511003 - RNA, 19 nt, Homo sapiens
gagagaaagugguaacugu

SEQ ID NO: 1511004 - RNA, 19 nt, Homo sapiens
gaacacccaucuaagaaag

SEQ ID NO: 1511005 - RNA, 19 nt, Homo sapiens
ggaaagcuuuguuugugaa

SEQ ID NO: 1511006 - RNA, 19 nt, Homo sapiens
cuacugacauuuccaaaga

SEQ ID NO: 1511007 - RNA, 19 nt, Homo sapiens
cagaacagcuaguagagaa

SEQ ID NO: 1511008 - RNA, 19 nt, Homo sapiens
gcaaugaagaugacuuauu

SEQ ID NO: 1511009 - RNA, 19 nt, Homo sapiens
ggaauuaaccucccuuaca

SEQ ID NO: 1511010 - RNA, 19 nt, Homo sapiens
cuauaugccuccuuuguaa

SEQ ID NO: 1511011 - RNA, 19 nt, Homo sapiens
cauauuacaugucagaaga

SEQ ID NO: 1511012 - RNA, 19 nt, Homo sapiens
ucagaagaaugguauuuga

SEQ ID NO: 1511013 - RNA, 19 nt, Homo sapiens
ggaagaauguacucaagag

SEQ ID NO: 1511014 - RNA, 19 nt, Homo sapiens
ggaagaaaacucucauuua

SEQ ID NO: 1511015 - RNA, 19 nt, Homo sapiens
ucagaauucucccuauaaa

SEQ ID NO: 1511016 - RNA, 19 nt, Homo sapiens
gcuaugcccugaauucaau

SEQ ID NO: 1511017 - RNA, 19 nt, Homo sapiens
gcaguguggugacuuaugu

SEQ ID NO: 1511018 - RNA, 19 nt, Homo sapiens
ggaggcaugucaaagcauu

SEQ ID NO: 1511019 - RNA, 19 nt, Homo sapiens
agacuuugcugcacagaaa

SEQ ID NO: 1511020 - RNA, 19 nt, Homo sapiens
gugauuaaguugaguacaa

SEQ ID NO: 1511021 - RNA, 19 nt, Homo sapiens
aaacuaggcuaugagauga

SEQ ID NO: 1511022 - RNA, 19 nt, Homo sapiens
gaagugagaauuuccuaau

SEQ ID NO: 1511023 - RNA, 19 nt, Homo sapiens
gcucuuagaacauaugaaa

SEQ ID NO: 1511024 - RNA, 19 nt, Homo sapiens
ugaaugaugugacuuuauc

SEQ ID NO: 1511025 - RNA, 19 nt, Homo sapiens
gaagugagcaaaggaaaga

SEQ ID NO: 1511026 - RNA, 19 nt, Homo sapiens
gaugugacuuuaucauugu

SEQ ID NO: 1511027 - RNA, 19 nt, Homo sapiens
aaguggaacugaacaagua

SEQ ID NO: 1511028 - RNA, 19 nt, Homo sapiens
uuagaaacaucaacuggaa

SEQ ID NO: 1511029 - RNA, 19 nt, Homo sapiens
gcccaugacuccagauuuc

SEQ ID NO: 1511030 - RNA, 19 nt, Homo sapiens
ucaaagaauuuccagaagu

SEQ ID NO: 1511031 - RNA, 19 nt, Homo sapiens
gucaagaaguauuaaguga

SEQ ID NO: 1511032 - RNA, 19 nt, Homo sapiens
gaugaaggauggccuaagg

SEQ ID NO: 1511033 - RNA, 19 nt, Homo sapiens
aaauaaacaccgaggcuua

SEQ ID NO: 1511034 - RNA, 19 nt, Homo sapiens
gauuucggcuucuaaagug

SEQ ID NO: 1511035 - RNA, 19 nt, Homo sapiens
gcuuaguacugauagauga

SEQ ID NO: 1511036 - RNA, 19 nt, Homo sapiens
gcuauaugccuccuuugua

SEQ ID NO: 1511037 - RNA, 19 nt, Homo sapiens
ugccauagcuaaacaugaa

SEQ ID NO: 1511038 - RNA, 19 nt, Homo sapiens
caacuggaaucaauuugca

SEQ ID NO: 1511039 - RNA, 19 nt, Homo sapiens
ggaaacagagaacaccauu

SEQ ID NO: 1511040 - RNA, 19 nt, Homo sapiens
caaagaagaaaccuauaga

SEQ ID NO: 1511041 - RNA, 19 nt, Homo sapiens
ggagaaggaaugucuuguu

SEQ ID NO: 1511042 - RNA, 19 nt, Homo sapiens
guacauauuugugcaacug

SEQ ID NO: 1511043 - RNA, 19 nt, Homo sapiens
gaggaagaauguacucaag

SEQ ID NO: 1511044 - RNA, 19 nt, Homo sapiens
uaaccucccuuacauugug

SEQ ID NO: 1511045 - RNA, 19 nt, Homo sapiens
aacaagcaaugucaucuaa

SEQ ID NO: 1511046 - RNA, 19 nt, Homo sapiens
caaauuauggagagagaaa

SEQ ID NO: 1511047 - RNA, 19 nt, Homo sapiens
gaguguguacagauaauua

SEQ ID NO: 1511048 - RNA, 19 nt, Homo sapiens
cagacugccugacuucauu

SEQ ID NO: 1511049 - RNA, 19 nt, Homo sapiens
uaaacuaggcuaugagaug

SEQ ID NO: 1511050 - RNA, 19 nt, Homo sapiens
cauaaucucaucagaauuc

SEQ ID NO: 1511051 - RNA, 19 nt, Homo sapiens
gcuuucagguugcugcuaa

SEQ ID NO: 1511052 - RNA, 19 nt, Homo sapiens
caggggagauugaaaauuu

SEQ ID NO: 1511053 - RNA, 19 nt, Homo sapiens
ucaccaccauauaagauuu

SEQ ID NO: 1511054 - RNA, 19 nt, Homo sapiens
gaagguguggcucuuagaa

SEQ ID NO: 1511055 - RNA, 19 nt, Homo sapiens
ccaguugucuaaaggaaau

SEQ ID NO: 1511056 - RNA, 19 nt, Homo sapiens
gaacagcuaguagagaaga

SEQ ID NO: 1511057 - RNA, 19 nt, Homo sapiens
acaaacaagagaaucguua

SEQ ID NO: 1511058 - RNA, 19 nt, Homo sapiens
ggacacucuucacuuggaa

SEQ ID NO: 1511059 - RNA, 19 nt, Homo sapiens
gcaagaaagaggaaagcuu

SEQ ID NO: 1511060 - RNA, 19 nt, Homo sapiens
acagcaguguggugacuua

SEQ ID NO: 1511061 - RNA, 19 nt, Homo sapiens
ggacuaaaggaauguuguu

SEQ ID NO: 1511062 - RNA, 19 nt, Homo sapiens
gacuugauauuguggaaug

SEQ ID NO: 1511063 - RNA, 19 nt, Homo sapiens
gauuucagaacuggaauua

SEQ ID NO: 1511064 - RNA, 19 nt, Homo sapiens
aaauauccaucccuacaga

SEQ ID NO: 1511065 - RNA, 19 nt, Homo sapiens
gaaagugguaacuguccua

SEQ ID NO: 1511066 - RNA, 19 nt, Homo sapiens
gguccuuaauggcccuuua

SEQ ID NO: 1511067 - RNA, 19 nt, Homo sapiens
cgucgcggcugcuuuauca

SEQ ID NO: 1511068 - RNA, 19 nt, Homo sapiens
uaaagaucguuauguugug

SEQ ID NO: 1511069 - RNA, 19 nt, Homo sapiens
gaugccaugugaaauagga

SEQ ID NO: 1511070 - RNA, 19 nt, Homo sapiens
gguaucguguaauagauga

SEQ ID NO: 1511071 - RNA, 19 nt, Homo sapiens
cgagugaaccaucagauug

SEQ ID NO: 1511072 - RNA, 19 nt, Homo sapiens
caaaguuguuaguguguca

SEQ ID NO: 1511073 - RNA, 19 nt, Homo sapiens
gcagauaaagagccuacaa

SEQ ID NO: 1511074 - RNA, 19 nt, Homo sapiens
gcaaacaagcaaugucauc

SEQ ID NO: 1511075 - RNA, 19 nt, Homo sapiens
cuaaagaucguuauguugu

SEQ ID NO: 1511076 - RNA, 19 nt, Homo sapiens
ucagguugcugcuaaaugg

SEQ ID NO: 1511077 - RNA, 19 nt, Homo sapiens
ucauugcccuuacucgaaa

SEQ ID NO: 1511078 - RNA, 19 nt, Homo sapiens
uggaaugacuagcaaacaa

SEQ ID NO: 1511079 - RNA, 19 nt, Homo sapiens
caucaacuggaaucaauuu

SEQ ID NO: 1511080 - RNA, 19 nt, Homo sapiens
gggacacucuucacuugga

SEQ ID NO: 1511081 - RNA, 19 nt, Homo sapiens
ccaaagaagaaaccuauag

SEQ ID NO: 1511082 - RNA, 19 nt, Homo sapiens
gaaguggaacugaacaagu

SEQ ID NO: 1511083 - RNA, 19 nt, Homo sapiens
guacugauagaugacuuua

SEQ ID NO: 1511084 - RNA, 19 nt, Homo sapiens
ggagauccuugugcaguuc

SEQ ID NO: 1511085 - RNA, 19 nt, Homo sapiens
guaaaucaguguucucuua

SEQ ID NO: 1511086 - RNA, 19 nt, Homo sapiens
gggaguggaugacuauuua

SEQ ID NO: 1511087 - RNA, 19 nt, Homo sapiens
gacuagaucuucauucuuu

SEQ ID NO: 1511088 - RNA, 19 nt, Homo sapiens
gaucuuggcucacugcaaa

SEQ ID NO: 1511089 - RNA, 19 nt, Homo sapiens
caacacgccuucuauguga

SEQ ID NO: 1511090 - RNA, 19 nt, Homo sapiens
gaaauacaauugcaaaguc

SEQ ID NO: 1511091 - RNA, 19 nt, Homo sapiens
caugagaacuaaaugcaua

SEQ ID NO: 1511092 - RNA, 19 nt, Homo sapiens
ggaaagcuguuuauaagca

SEQ ID NO: 1511093 - RNA, 19 nt, Homo sapiens
ucauggagauggcaaauaa

SEQ ID NO: 1511094 - RNA, 19 nt, Homo sapiens
gaggaacagcccuaaauua

SEQ ID NO: 1511095 - RNA, 19 nt, Homo sapiens
cagguaaucuuccaggaua

SEQ ID NO: 1511096 - RNA, 19 nt, Homo sapiens
cgaaagagcacagcacaua

SEQ ID NO: 1511097 - RNA, 19 nt, Homo sapiens
caacauguuuaguccuuaa

SEQ ID NO: 1511098 - RNA, 19 nt, Homo sapiens
ucaaugccaucaaguguaa

SEQ ID NO: 1511099 - RNA, 19 nt, Homo sapiens
gcccaucacuuuagccuuu

SEQ ID NO: 1511100 - RNA, 19 nt, Homo sapiens
cuacaaaccuaccauuuca

SEQ ID NO: 1511101 - RNA, 19 nt, Homo sapiens
gaaagagcacagcacauaa

SEQ ID NO: 1511102 - RNA, 19 nt, Homo sapiens
guggaaagcuguuuauaag

SEQ ID NO: 1511103 - RNA, 19 nt, Homo sapiens
gaaaugauugugccugaaa

SEQ ID NO: 1511104 - RNA, 19 nt, Homo sapiens
caauuuaugugacuaagga

SEQ ID NO: 1511105 - RNA, 19 nt, Homo sapiens
acagauaaccggagugaua

SEQ ID NO: 1511106 - RNA, 19 nt, Homo sapiens
caacacccaugagaacuaa

SEQ ID NO: 1511107 - RNA, 19 nt, Homo sapiens
gaaauugaagagcauguuu

SEQ ID NO: 1511108 - RNA, 19 nt, Homo sapiens
aaauagagccauucaauug

SEQ ID NO: 1511109 - RNA, 19 nt, Homo sapiens
ggaacagcccuaaauuauu

SEQ ID NO: 1511110 - RNA, 19 nt, Homo sapiens
ggagacagauguggucaga

SEQ ID NO: 1511111 - RNA, 19 nt, Homo sapiens
ucaagucgguguuuauguu

SEQ ID NO: 1511112 - RNA, 19 nt, Homo sapiens
aaagugugguuucauauga

SEQ ID NO: 1511113 - RNA, 19 nt, Homo sapiens
caaaugaugacuuacguaa

SEQ ID NO: 1511114 - RNA, 19 nt, Homo sapiens
uuacugagcuagaaacaau

SEQ ID NO: 1511115 - RNA, 19 nt, Homo sapiens
gagaacagcccagcauaaa

SEQ ID NO: 1511116 - RNA, 19 nt, Homo sapiens
gagagggaguggaugacua

SEQ ID NO: 1511117 - RNA, 19 nt, Homo sapiens
aaacccagaugaacaaaug

SEQ ID NO: 1511118 - RNA, 19 nt, Homo sapiens
gcaaagucacuguaauuga

SEQ ID NO: 1511119 - RNA, 19 nt, Homo sapiens
gaucuuggcaaccaccuua

SEQ ID NO: 1511120 - RNA, 19 nt, Homo sapiens
gaggaagcccaucacuuua

SEQ ID NO: 1511121 - RNA, 19 nt, Homo sapiens
gacacaaccauaaauagua

SEQ ID NO: 1511122 - RNA, 19 nt, Homo sapiens
gcaacauguuuaguccuua

SEQ ID NO: 1511123 - RNA, 19 nt, Homo sapiens
agaggaagcccaucacuuu

SEQ ID NO: 1511124 - RNA, 19 nt, Homo sapiens
cauggaauguucaccguuu

SEQ ID NO: 1511125 - RNA, 19 nt, Homo sapiens
gagacuggcucaauaucga

SEQ ID NO: 1511126 - RNA, 19 nt, Homo sapiens
caaaguggaaagcuguuua

SEQ ID NO: 1511127 - RNA, 19 nt, Homo sapiens
guaacagacguuuaucuaa

SEQ ID NO: 1511128 - RNA, 19 nt, Homo sapiens
ggagcccucuugcuuaguu

SEQ ID NO: 1511129 - RNA, 19 nt, Homo sapiens
guugagaacuacucggaaa

SEQ ID NO: 1511130 - RNA, 19 nt, Homo sapiens
gaacagcccagcauaaacu

SEQ ID NO: 1511131 - RNA, 19 nt, Homo sapiens
uaaccggagugauaccuuu

SEQ ID NO: 1511132 - RNA, 19 nt, Homo sapiens
ggagauggcaaauaaggaa

SEQ ID NO: 1511133 - RNA, 19 nt, Homo sapiens
aaaccuaccauuucacuuu

SEQ ID NO: 1511134 - RNA, 19 nt, Homo sapiens
ccaagugacacaaccauaa

SEQ ID NO: 1511135 - RNA, 19 nt, Homo sapiens
cauaugacuuggaauaauc

SEQ ID NO: 1511136 - RNA, 19 nt, Homo sapiens
gaaggaguuucguaguugu

SEQ ID NO: 1511137 - RNA, 19 nt, Homo sapiens
ugaaggaguuucguaguug

SEQ ID NO: 1511138 - RNA, 19 nt, Homo sapiens
uaggauaguuugagaagug

SEQ ID NO: 1511139 - RNA, 19 nt, Homo sapiens
ggaauucaaacccagauga

SEQ ID NO: 1511140 - RNA, 19 nt, Homo sapiens
gaaaauagagccauucaau

SEQ ID NO: 1511141 - RNA, 19 nt, Homo sapiens
uaagcagacucacuccaaa

SEQ ID NO: 1511142 - RNA, 19 nt, Homo sapiens
uauacacacuacucucuaa

SEQ ID NO: 1511143 - RNA, 19 nt, Homo sapiens
caccacacccggcuaauuu

SEQ ID NO: 1511144 - RNA, 19 nt, Homo sapiens
ggagugauaccuuuuauuu

SEQ ID NO: 1511145 - RNA, 19 nt, Homo sapiens
ccacgagaauuugcugaaa

SEQ ID NO: 1511146 - RNA, 19 nt, Homo sapiens
cuaacucucuuccuuuguu

SEQ ID NO: 1511147 - RNA, 19 nt, Homo sapiens
ugaauccacuggcaagaga

SEQ ID NO: 1511148 - RNA, 19 nt, Homo sapiens
ccaggcacuucacgaauga

SEQ ID NO: 1511149 - RNA, 19 nt, Homo sapiens
gagaacuacucggaaauag

SEQ ID NO: 1511150 - RNA, 19 nt, Homo sapiens
gaguggaugacuauuuaua

SEQ ID NO: 1511151 - RNA, 19 nt, Homo sapiens
gauggcacacagacaaaua

SEQ ID NO: 1511152 - RNA, 19 nt, Homo sapiens
caagugacacaaccauaaa

SEQ ID NO: 1511153 - RNA, 19 nt, Homo sapiens
ccaaagugcugggauuaca

SEQ ID NO: 1511154 - RNA, 19 nt, Homo sapiens
caauucaguuggaaccuau

SEQ ID NO: 1511155 - RNA, 19 nt, Homo sapiens
gaacaaaugaugacuuacg

SEQ ID NO: 1511156 - RNA, 19 nt, Homo sapiens
gaaagccaaguguuugcua

SEQ ID NO: 1511157 - RNA, 19 nt, Homo sapiens
uuaccugccugacagaauu

SEQ ID NO: 1511158 - RNA, 19 nt, Homo sapiens
gcagacgcugugagaaaua

SEQ ID NO: 1511159 - RNA, 19 nt, Homo sapiens
caacugauguccaaaagga

SEQ ID NO: 1511160 - RNA, 19 nt, Homo sapiens
uuacgcagcuuuaacuagu

SEQ ID NO: 1511161 - RNA, 19 nt, Homo sapiens
aaagagcacagcacauaaa

SEQ ID NO: 1511162 - RNA, 19 nt, Homo sapiens
gcacuucacgaaugaggaa

SEQ ID NO: 1511163 - RNA, 19 nt, Homo sapiens
gacccaggcaucaacauuu

SEQ ID NO: 1511164 - RNA, 19 nt, Homo sapiens
gaauguguuuaaacuccaa

SEQ ID NO: 1511165 - RNA, 19 nt, Homo sapiens
ugagaacuacucggaaaua

SEQ ID NO: 1511166 - RNA, 19 nt, Homo sapiens
cuagaacaauucaguugga

SEQ ID NO: 1511167 - RNA, 19 nt, Homo sapiens
gagcagugguaccauagca

SEQ ID NO: 1511168 - RNA, 19 nt, Homo sapiens
gcugugagaaauacaauug

SEQ ID NO: 1511169 - RNA, 19 nt, Homo sapiens
gcgaggaacagcccuaaau

SEQ ID NO: 1511170 - RNA, 19 nt, Homo sapiens
gugacuagaucuucauucu

SEQ ID NO: 1511171 - RNA, 19 nt, Homo sapiens
ccauaaauaguaccaauuc

SEQ ID NO: 1511172 - RNA, 19 nt, Homo sapiens
ggacccaggcaucaacauu

SEQ ID NO: 1511173 - RNA, 19 nt, Homo sapiens
ugagaacagcccagcauaa

SEQ ID NO: 1511174 - RNA, 19 nt, Homo sapiens
uaacagauaaccggaguga

SEQ ID NO: 1511175 - RNA, 19 nt, Homo sapiens
aaagaaagccaaguguuug

SEQ ID NO: 1511176 - RNA, 19 nt, Homo sapiens
aauaggcucucauuugauc

SEQ ID NO: 1511177 - RNA, 19 nt, Homo sapiens
ggaaucuuguauccaggaa

SEQ ID NO: 1511178 - RNA, 19 nt, Homo sapiens
caaauaaggaacugaagca

SEQ ID NO: 1511179 - RNA, 19 nt, Homo sapiens
cgaggaacagcccuaaauu

SEQ ID NO: 1511180 - RNA, 19 nt, Homo sapiens
gguuucauaugacuuggaa

SEQ ID NO: 1511181 - RNA, 19 nt, Homo sapiens
caaagugugguuucauaug

SEQ ID NO: 1511182 - RNA, 19 nt, Homo sapiens
gaggaaacagguccacaga

SEQ ID NO: 1511183 - RNA, 19 nt, Homo sapiens
ggaggaaagaaagucguua

SEQ ID NO: 1511184 - RNA, 19 nt, Homo sapiens
aggaacagcccuaaauuau

SEQ ID NO: 1511185 - RNA, 19 nt, Homo sapiens
ccaaaucucuccacccuua

SEQ ID NO: 1511186 - RNA, 19 nt, Homo sapiens
ccagauagauauaugcaua

SEQ ID NO: 1511187 - RNA, 19 nt, Homo sapiens
gagcuucuaugucaauaaa

SEQ ID NO: 1511188 - RNA, 19 nt, Homo sapiens
ugagugauauuucccuaua

SEQ ID NO: 1511189 - RNA, 19 nt, Homo sapiens
gaauaugucugaggaggaa

SEQ ID NO: 1511190 - RNA, 19 nt, Homo sapiens
cuugacagcuuuauucuuu

SEQ ID NO: 1511191 - RNA, 19 nt, Homo sapiens
caaggaggcuucaguucuu

SEQ ID NO: 1511192 - RNA, 19 nt, Homo sapiens
guugugagcuucuauguca

SEQ ID NO: 1511193 - RNA, 19 nt, Homo sapiens
caauauauguugugagcuu

SEQ ID NO: 1511194 - RNA, 19 nt, Homo sapiens
gagauagccugaccucugu

SEQ ID NO: 1511195 - RNA, 19 nt, Homo sapiens
guagaaagggucuuggaua

SEQ ID NO: 1511196 - RNA, 19 nt, Homo sapiens
gcaaugugauagagauaga

SEQ ID NO: 1511197 - RNA, 19 nt, Homo sapiens
cuaggcaucuucuuauauu

SEQ ID NO: 1511198 - RNA, 19 nt, Homo sapiens
gaaagggucuuggauacca

SEQ ID NO: 1511199 - RNA, 19 nt, Homo sapiens
caucugaacuugaauucug

SEQ ID NO: 1511200 - RNA, 19 nt, Homo sapiens
caucaaagccgcaucugaa

SEQ ID NO: 1511201 - RNA, 19 nt, Homo sapiens
uauaagugcuguucuaucu

SEQ ID NO: 1511202 - RNA, 19 nt, Homo sapiens
cauuauagcugagaaagau

SEQ ID NO: 1511203 - RNA, 19 nt, Homo sapiens
gaagaggauugggaugaug

SEQ ID NO: 1511204 - RNA, 19 nt, Homo sapiens
gaccaacccuaaccuaagu

SEQ ID NO: 1511205 - RNA, 19 nt, Homo sapiens
acaauccgcuguucguauu

SEQ ID NO: 1511206 - RNA, 19 nt, Homo sapiens
ggaagaggauugggaugau

SEQ ID NO: 1511207 - RNA, 19 nt, Homo sapiens
guacccagauagauauaug

SEQ ID NO: 1511208 - RNA, 19 nt, Homo sapiens
gaaguacaaauuacccaaa

SEQ ID NO: 1511209 - RNA, 19 nt, Homo sapiens
gaagugcuggucauugauu

SEQ ID NO: 1511210 - RNA, 19 nt, Homo sapiens
gaguuaaucagaaugguaa

SEQ ID NO: 1511211 - RNA, 19 nt, Homo sapiens
gacucagacuuaaggauuu

SEQ ID NO: 1511212 - RNA, 19 nt, Homo sapiens
uaagugcuguucuaucugu

SEQ ID NO: 1511213 - RNA, 19 nt, Homo sapiens
gaaggccacucaaaagaaa

SEQ ID NO: 1511214 - RNA, 19 nt, Homo sapiens
ggccagaccucaggaugaa

SEQ ID NO: 1511215 - RNA, 19 nt, Homo sapiens
ggaguuaaucagaauggua

SEQ ID NO: 1511216 - RNA, 19 nt, Homo sapiens
gaccuccgacucagacuua

SEQ ID NO: 1511217 - RNA, 19 nt, Homo sapiens
gaagaaaccuuugaaaacu

SEQ ID NO: 1511218 - RNA, 19 nt, Homo sapiens
agucauggcuagcaucauu

SEQ ID NO: 1511219 - RNA, 19 nt, Homo sapiens
gccuaggcaucuucuuaua

SEQ ID NO: 1511220 - RNA, 19 nt, Homo sapiens
agugaacccuuaccuauau

SEQ ID NO: 1511221 - RNA, 19 nt, Homo sapiens
gagcugacccauacugaga

SEQ ID NO: 1511222 - RNA, 19 nt, Homo sapiens
ggagcggcuucccaacuuu

SEQ ID NO: 1511223 - RNA, 19 nt, Homo sapiens
cgaauacaaugacuucucu

SEQ ID NO: 1511224 - RNA, 19 nt, Homo sapiens
agaagucucgguccuauaa

SEQ ID NO: 1511225 - RNA, 19 nt, Homo sapiens
uagaaagggucuuggauac

SEQ ID NO: 1511226 - RNA, 19 nt, Homo sapiens
cgacucagacuuaaggauu

SEQ ID NO: 1511227 - RNA, 19 nt, Homo sapiens
gauauuucccuauaccuau

SEQ ID NO: 1511228 - RNA, 19 nt, Homo sapiens
ugauagagauagaugauac

SEQ ID NO: 1511229 - RNA, 19 nt, Homo sapiens
auaccuauguacccagaua

SEQ ID NO: 1511230 - RNA, 19 nt, Homo sapiens
caaagccgcaucugaacuu

SEQ ID NO: 1511231 - RNA, 19 nt, Homo sapiens
gacugcccaugguaaauuu

SEQ ID NO: 1511232 - RNA, 19 nt, Homo sapiens
ucucccaccugcagauuaa

SEQ ID NO: 1511233 - RNA, 19 nt, Homo sapiens
guacaaauuacccaaaucu

SEQ ID NO: 1511234 - RNA, 19 nt, Homo sapiens
ugacagcuuuauucuuugu

SEQ ID NO: 1511235 - RNA, 19 nt, Homo sapiens
cuaacugcaugaauuaauc

SEQ ID NO: 1511236 - RNA, 19 nt, Homo sapiens
cagugaacccuuaccuaua

SEQ ID NO: 1511237 - RNA, 19 nt, Homo sapiens
ucagugaacccuuaccuau

SEQ ID NO: 1511238 - RNA, 19 nt, Homo sapiens
gccaugaaauugguguuug

SEQ ID NO: 1511239 - RNA, 19 nt, Homo sapiens
gacgcgcucuuguuucaga

SEQ ID NO: 1511240 - RNA, 19 nt, Homo sapiens
ggauugggaugaugcuuuu

SEQ ID NO: 1511241 - RNA, 19 nt, Homo sapiens
cuucuaacugcaugaauua

SEQ ID NO: 1511242 - RNA, 19 nt, Homo sapiens
agucagcccuguggcauuu

SEQ ID NO: 1511243 - RNA, 19 nt, Homo sapiens
gcgaccaacccuaaccuaa

SEQ ID NO: 1511244 - RNA, 19 nt, Homo sapiens
gacagaaacaugaaguugu

SEQ ID NO: 1511245 - RNA, 19 nt, Homo sapiens
aagccuaggcaucuucuua

SEQ ID NO: 1511246 - RNA, 19 nt, Homo sapiens
ucucuccacccuuauauaa

SEQ ID NO: 1511247 - RNA, 19 nt, Homo sapiens
ccauuuccuugacagcuuu

SEQ ID NO: 1511248 - RNA, 19 nt, Homo sapiens
gcagaggcuggaagugaaa

SEQ ID NO: 1511249 - RNA, 19 nt, Homo sapiens
ggaagaaaccuuugaaaac

SEQ ID NO: 1511250 - RNA, 19 nt, Homo sapiens
ucuccacccuuauauaauc

SEQ ID NO: 1511251 - RNA, 19 nt, Homo sapiens
uaagggaggaagaggauug

SEQ ID NO: 1511252 - RNA, 19 nt, Homo sapiens
gugcuguucuaucuguauu

SEQ ID NO: 1511253 - RNA, 19 nt, Homo sapiens
gggaugaugcuuuuauuaa

SEQ ID NO: 1511254 - RNA, 19 nt, Homo sapiens
gagcacaggccaucaaagc

SEQ ID NO: 1511255 - RNA, 19 nt, Homo sapiens
gcuauucaggcaggcauua

SEQ ID NO: 1511256 - RNA, 19 nt, Homo sapiens
uaaccuaaguguggcagau

SEQ ID NO: 1511257 - RNA, 19 nt, Homo sapiens
ugaauucugugcagcugau

SEQ ID NO: 1511258 - RNA, 19 nt, Homo sapiens
uccaggagcugacccauac

SEQ ID NO: 1511259 - RNA, 19 nt, Homo sapiens
gcauuauagcugagaaaga

SEQ ID NO: 1511260 - RNA, 19 nt, Homo sapiens
gggaagaaaccuuugaaaa

SEQ ID NO: 1511261 - RNA, 19 nt, Homo sapiens
gcagacagaaacaugaagu

SEQ ID NO: 1511262 - RNA, 19 nt, Homo sapiens
ccaaggaggcuucaguucu

SEQ ID NO: 1511263 - RNA, 19 nt, Homo sapiens
ugaaauauaagugcuguuc

SEQ ID NO: 1511264 - RNA, 19 nt, Homo sapiens
gggccagaccucaggauga

SEQ ID NO: 1511265 - RNA, 19 nt, Homo sapiens
ggcuggaagugaaauaaag

SEQ ID NO: 1511266 - RNA, 19 nt, Homo sapiens
uaaucauugucaacccuuu

SEQ ID NO: 1511267 - RNA, 19 nt, Homo sapiens
acuucuaacugcaugaauu

SEQ ID NO: 1511268 - RNA, 19 nt, Homo sapiens
ugacugcccaugguaaauu

SEQ ID NO: 1511269 - RNA, 19 nt, Homo sapiens
gaggcuggaagugaaauaa

SEQ ID NO: 1511270 - RNA, 19 nt, Homo sapiens
gcaaggcggagaccagaag

SEQ ID NO: 1511271 - RNA, 19 nt, Homo sapiens
ugauauuucccuauaccua

SEQ ID NO: 1511272 - RNA, 19 nt, Homo sapiens
gcaugaauuaauccacaaa

SEQ ID NO: 1511273 - RNA, 19 nt, Homo sapiens
ggacuucuaacugcaugaa

SEQ ID NO: 1511274 - RNA, 19 nt, Homo sapiens
gaacccuuaccuauauuca

SEQ ID NO: 1511275 - RNA, 19 nt, Homo sapiens
gugaacccuuaccuauauu

SEQ ID NO: 1511276 - RNA, 19 nt, Homo sapiens
cgacgacuccgaugaggau

SEQ ID NO: 1511277 - RNA, 19 nt, Homo sapiens
caggauguaugcaaaugag

SEQ ID NO: 1511278 - RNA, 19 nt, Homo sapiens
ccaugaaauugguguuugg

SEQ ID NO: 1511279 - RNA, 19 nt, Homo sapiens
ugcagaggcuggaagugaa

SEQ ID NO: 1511280 - RNA, 19 nt, Homo sapiens
gcuggaagugaaauaaaga

SEQ ID NO: 1511281 - RNA, 19 nt, Homo sapiens
guagagccaggaagcgaaa

SEQ ID NO: 1511282 - RNA, 19 nt, Homo sapiens
agacagaaacaugaaguug

SEQ ID NO: 1511283 - RNA, 19 nt, Homo sapiens
gugagcuucuaugucaaua

SEQ ID NO: 1511284 - RNA, 19 nt, Homo sapiens
gaaauauaagugcuguucu

SEQ ID NO: 1511285 - RNA, 19 nt, Homo sapiens
caacuuugcucuccuccua

SEQ ID NO: 1511286 - RNA, 19 nt, Homo sapiens
gcaaggaggugugcuaaag

SEQ ID NO: 1511287 - RNA, 19 nt, Homo sapiens
caacauccacucucucuug

SEQ ID NO: 1511288 - RNA, 19 nt, Homo sapiens
gcaccacguucaccagcua

SEQ ID NO: 1511289 - RNA, 19 nt, Homo sapiens
ccagacgccugauauugaa

SEQ ID NO: 1511290 - RNA, 19 nt, Homo sapiens
gggaggaacuggccaugag

SEQ ID NO: 1511291 - RNA, 19 nt, Homo sapiens
gaaaauaucggggagguuu

SEQ ID NO: 1511292 - RNA, 19 nt, Homo sapiens
cauccacucucucuuguuc

SEQ ID NO: 1511293 - RNA, 19 nt, Homo sapiens
cagcaccacucaagaccaa

SEQ ID NO: 1511294 - RNA, 19 nt, Homo sapiens
gcacuacccggacgucuuc

SEQ ID NO: 1511295 - RNA, 19 nt, Homo sapiens
cgccugauauugaaguaaa

SEQ ID NO: 1511296 - RNA, 19 nt, Homo sapiens
cagacgcgccucuagcaua

SEQ ID NO: 1511297 - RNA, 19 nt, Homo sapiens
gugcaaggcuccccuaaga

SEQ ID NO: 1511298 - RNA, 19 nt, Homo sapiens
ccacuuagccuuucuuuuc

SEQ ID NO: 1511299 - RNA, 19 nt, Homo sapiens
gcuaccagcuggaggaacu

SEQ ID NO: 1511300 - RNA, 19 nt, Homo sapiens
agacgcgccucuagcauag

SEQ ID NO: 1511301 - RNA, 19 nt, Homo sapiens
gcagacagacgcgccucua

SEQ ID NO: 1511302 - RNA, 19 nt, Homo sapiens
cccagacgccugauauuga

SEQ ID NO: 1511303 - RNA, 19 nt, Homo sapiens
ucacgcagcucaacauccu

SEQ ID NO: 1511304 - RNA, 19 nt, Homo sapiens
gggacacgcucaagaucag

SEQ ID NO: 1511305 - RNA, 19 nt, Homo sapiens
ucucucuuguucuuacuuu

SEQ ID NO: 1511306 - RNA, 19 nt, Homo sapiens
gggcaaggaggugugcuaa

SEQ ID NO: 1511307 - RNA, 19 nt, Homo sapiens
ggacagcgugugccucucu

SEQ ID NO: 1511308 - RNA, 19 nt, Homo sapiens
gacgccugauauugaagua

SEQ ID NO: 1511309 - RNA, 19 nt, Homo sapiens
aagaccaaauggaaacaga

SEQ ID NO: 1511310 - RNA, 19 nt, Homo sapiens
gcaccacucaagaccaaau

SEQ ID NO: 1511311 - RNA, 19 nt, Homo sapiens
guaaaucuccaacuuugcu

SEQ ID NO: 1511312 - RNA, 19 nt, Homo sapiens
ucacucagcaccacucaag

SEQ ID NO: 1511313 - RNA, 19 nt, Homo sapiens
ccaugaggcuggacuugac

SEQ ID NO: 1511314 - RNA, 19 nt, Homo sapiens
gcuggaggacgaagaagau

SEQ ID NO: 1511315 - RNA, 19 nt, Homo sapiens
gacagacgcgccucuagca

SEQ ID NO: 1511316 - RNA, 19 nt, Homo sapiens
cgagaggcccgagugcaaa

SEQ ID NO: 1511317 - RNA, 19 nt, Homo sapiens
ggacgaggaagaggaacug

SEQ ID NO: 1511318 - RNA, 19 nt, Homo sapiens
aagaugaggacgaggaaga

SEQ ID NO: 1511319 - RNA, 19 nt, Homo sapiens
gccaugaggcuggacuuga

SEQ ID NO: 1511320 - RNA, 19 nt, Homo sapiens
ggaggacgaagaagaugag

SEQ ID NO: 1511321 - RNA, 19 nt, Homo sapiens
gcaagucguaccgcgagaa

SEQ ID NO: 1511322 - RNA, 19 nt, Homo sapiens
cgacacccagcuuucauca

SEQ ID NO: 1511323 - RNA, 19 nt, Homo sapiens
aagcaaaugcgagccugua

SEQ ID NO: 1511324 - RNA, 19 nt, Homo sapiens
acucaagaccaaauggaaa

SEQ ID NO: 1511325 - RNA, 19 nt, Homo sapiens
ccacucaagaccaaaugga

SEQ ID NO: 1511326 - RNA, 19 nt, Homo sapiens
ggcaaggaggugugcuaaa

SEQ ID NO: 1511327 - RNA, 19 nt, Homo sapiens
ugaggacgaggaagaggaa

SEQ ID NO: 1511328 - RNA, 19 nt, Homo sapiens
ugaaauaccuggcauacaa

SEQ ID NO: 1511329 - RNA, 19 nt, Homo sapiens
aaacagagcagacgaaauu

SEQ ID NO: 1511330 - RNA, 19 nt, Homo sapiens
ucucaucucuugcuuuaua

SEQ ID NO: 1511331 - RNA, 19 nt, Homo sapiens
ggaaaugccugcagaaucg

SEQ ID NO: 1511332 - RNA, 19 nt, Homo sapiens
agauguggcugcaagauua

SEQ ID NO: 1511333 - RNA, 19 nt, Homo sapiens
gcacaaacccuuaaugaac

SEQ ID NO: 1511334 - RNA, 19 nt, Homo sapiens
gggauuaccuacaugaaau

SEQ ID NO: 1511335 - RNA, 19 nt, Homo sapiens
gguuacgacuuacaacuuu

SEQ ID NO: 1511336 - RNA, 19 nt, Homo sapiens
aaggagagauggagggaua

SEQ ID NO: 1511337 - RNA, 19 nt, Homo sapiens
gggcaucaccaaccaauuu

SEQ ID NO: 1511338 - RNA, 19 nt, Homo sapiens
ucaguacauuucccaauaa

SEQ ID NO: 1511339 - RNA, 19 nt, Homo sapiens
uuucucaucucuugcuuua

SEQ ID NO: 1511340 - RNA, 19 nt, Homo sapiens
ugggucagguuacgacuua

SEQ ID NO: 1511341 - RNA, 19 nt, Homo sapiens
gaugaggaguauaugaaau

SEQ ID NO: 1511342 - RNA, 19 nt, Homo sapiens
caagaaugaugaggaguau

SEQ ID NO: 1511343 - RNA, 19 nt, Homo sapiens
cacaaacccuuaaugaaca

SEQ ID NO: 1511344 - RNA, 19 nt, Homo sapiens
gaggcaacaucucuaagug

SEQ ID NO: 1511345 - RNA, 19 nt, Homo sapiens
gggagugaaugauccuuug

SEQ ID NO: 1511346 - RNA, 19 nt, Homo sapiens
ucaaggaauuccaguuuua

SEQ ID NO: 1511347 - RNA, 19 nt, Homo sapiens
guacauuucccaauaaucu

SEQ ID NO: 1511348 - RNA, 19 nt, Homo sapiens
caaccaauuucuucuggau

SEQ ID NO: 1511349 - RNA, 19 nt, Homo sapiens
ggauacaauucuugguuca

SEQ ID NO: 1511350 - RNA, 19 nt, Homo sapiens
gaacaaucacuccgucauc

SEQ ID NO: 1511351 - RNA, 19 nt, Homo sapiens
auccagagcucuuggcuuu

SEQ ID NO: 1511352 - RNA, 19 nt, Homo sapiens
aaucuuaccuccaccuuca

SEQ ID NO: 1511353 - RNA, 19 nt, Homo sapiens
uagccaaggucuaacauag

SEQ ID NO: 1511354 - RNA, 19 nt, Homo sapiens
uggcagaguuuauugacuu

SEQ ID NO: 1511355 - RNA, 19 nt, Homo sapiens
uuaccuacaugaaaucuuc

SEQ ID NO: 1511356 - RNA, 19 nt, Homo sapiens
gaagcuggcagaguuuauu

SEQ ID NO: 1511357 - RNA, 19 nt, Homo sapiens
uucaguacauuucccaaua

SEQ ID NO: 1511358 - RNA, 19 nt, Homo sapiens
ccagacuccucauuauuca

SEQ ID NO: 1511359 - RNA, 19 nt, Homo sapiens
ucaaggugcugguccaaca

SEQ ID NO: 1511360 - RNA, 19 nt, Homo sapiens
gggacuggaugccgaacaa

SEQ ID NO: 1511361 - RNA, 19 nt, Homo sapiens
gagauguggcugcaagauu

SEQ ID NO: 1511362 - RNA, 19 nt, Homo sapiens
gagaaugacaguuggaaag

SEQ ID NO: 1511363 - RNA, 19 nt, Homo sapiens
cuacucacuucuuuauuuc

SEQ ID NO: 1511364 - RNA, 19 nt, Homo sapiens
cucagaagcuggcagaguu

SEQ ID NO: 1511365 - RNA, 19 nt, Homo sapiens
cgacuguacuugauuacca

SEQ ID NO: 1511366 - RNA, 19 nt, Homo sapiens
uuucgacuguacuugauua

SEQ ID NO: 1511367 - RNA, 19 nt, Homo sapiens
gagauggagggauacaauu

SEQ ID NO: 1511368 - RNA, 19 nt, Homo sapiens
ucacugccaugauccacaa

SEQ ID NO: 1511369 - RNA, 19 nt, Homo sapiens
ucaacggcuucgaguguuu

SEQ ID NO: 1511370 - RNA, 19 nt, Homo sapiens
agaaugaugaggaguauau

SEQ ID NO: 1511371 - RNA, 19 nt, Homo sapiens
ggcagaguuuauugacuuu

SEQ ID NO: 1511372 - RNA, 19 nt, Homo sapiens
acaagaaugaugaggagua

SEQ ID NO: 1511373 - RNA, 19 nt, Homo sapiens
guacuugauuaccagugaa

SEQ ID NO: 1511374 - RNA, 19 nt, Homo sapiens
cauagggccucuccucaag

SEQ ID NO: 1511375 - RNA, 19 nt, Homo sapiens
aaugacaguuggaaagaga

SEQ ID NO: 1511376 - RNA, 19 nt, Homo sapiens
gaaugacaguuggaaagag

SEQ ID NO: 1511377 - RNA, 19 nt, Homo sapiens
gggaaaugccugcagaauc

SEQ ID NO: 1511378 - RNA, 19 nt, Homo sapiens
aaacauuuggugaguugua

SEQ ID NO: 1511379 - RNA, 19 nt, Homo sapiens
gaaacagagcagacgaaau

SEQ ID NO: 1511380 - RNA, 19 nt, Homo sapiens
gcaagauuauuggcaaggu

SEQ ID NO: 1511381 - RNA, 19 nt, Homo sapiens
aguaagaugggucagguua

SEQ ID NO: 1511382 - RNA, 19 nt, Homo sapiens
ccagagcucuuggcuuucu

SEQ ID NO: 1511383 - RNA, 19 nt, Homo sapiens
ccacugcacaaacccuuaa

SEQ ID NO: 1511384 - RNA, 19 nt, Homo sapiens
acaccuggcuuuggcaaug

SEQ ID NO: 1511385 - RNA, 19 nt, Homo sapiens
gaaauaccuggcauacaag

SEQ ID NO: 1511386 - RNA, 19 nt, Homo sapiens
gugggaaacagaacccuaa

SEQ ID NO: 1511387 - RNA, 19 nt, Homo sapiens
ucagucgccacucggauua

SEQ ID NO: 1511388 - RNA, 19 nt, Homo sapiens
guagccaaggucuaacaua

SEQ ID NO: 1511389 - RNA, 19 nt, Homo sapiens
gccaugauccacaacaaug

SEQ ID NO: 1511390 - RNA, 19 nt, Homo sapiens
gaagcucucacugccauga

SEQ ID NO: 1511391 - RNA, 19 nt, Homo sapiens
gcauccgccucuucaaucu

SEQ ID NO: 1511392 - RNA, 19 nt, Homo sapiens
ggugaguuguauucugguu

SEQ ID NO: 1511393 - RNA, 19 nt, Homo sapiens
cugcacaaacccuuaauga

SEQ ID NO: 1511394 - RNA, 19 nt, Homo sapiens
agacgaaauuuugggauua

SEQ ID NO: 1511395 - RNA, 19 nt, Homo sapiens
cgaacuggcucggcuggau

SEQ ID NO: 1511396 - RNA, 19 nt, Homo sapiens
auccgccucuucaaucuua

SEQ ID NO: 1511397 - RNA, 19 nt, Homo sapiens
uguacuugauuaccaguga

SEQ ID NO: 1511398 - RNA, 19 nt, Homo sapiens
gggcauccgccucuucaau

SEQ ID NO: 1511399 - RNA, 19 nt, Homo sapiens
caguacauuucccaauaau

SEQ ID NO: 1511400 - RNA, 19 nt, Homo sapiens
gagcauccacugcacaaac

SEQ ID NO: 1511401 - RNA, 19 nt, Homo sapiens
ucgaguguuucgucuguga

SEQ ID NO: 1511402 - RNA, 19 nt, Homo sapiens
cagaguuuauugacuuucu

SEQ ID NO: 1511403 - RNA, 19 nt, Homo sapiens
cagaagcuggcagaguuua

SEQ ID NO: 1511404 - RNA, 19 nt, Homo sapiens
aaacagaacccuaaaacau

SEQ ID NO: 1511405 - RNA, 19 nt, Homo sapiens
ucuaagugcccuugcaaga

SEQ ID NO: 1511406 - RNA, 19 nt, Homo sapiens
ugaaacagagcagacgaaa

SEQ ID NO: 1511407 - RNA, 19 nt, Homo sapiens
ugaugaggaguauaugaaa

SEQ ID NO: 1511408 - RNA, 19 nt, Homo sapiens
cuuaaugaacacugucuuu

SEQ ID NO: 1511409 - RNA, 19 nt, Homo sapiens
uuacguugguggagaagca

SEQ ID NO: 1511410 - RNA, 19 nt, Homo sapiens
ccauuagggugguguuggu

SEQ ID NO: 1511411 - RNA, 19 nt, Homo sapiens
gaugaguagccaaggucua

SEQ ID NO: 1511412 - RNA, 19 nt, Homo sapiens
ccucaacggcuucgagugu

SEQ ID NO: 1511413 - RNA, 19 nt, Homo sapiens
guaacgacuacaugacaga

SEQ ID NO: 1511414 - RNA, 19 nt, Homo sapiens
ugaguuguauucugguuuu

SEQ ID NO: 1511415 - RNA, 19 nt, Homo sapiens
ccucauuauucaguacauu

SEQ ID NO: 1511416 - RNA, 19 nt, Homo sapiens
cccagacuccucauuauuc

SEQ ID NO: 1511417 - RNA, 19 nt, Homo sapiens
uaagaugggucagguuacg

SEQ ID NO: 1511418 - RNA, 19 nt, Homo sapiens
ggaauuccaguuuuaucua

SEQ ID NO: 1511419 - RNA, 19 nt, Homo sapiens
gauccacaacaaugaaaca

SEQ ID NO: 1511420 - RNA, 19 nt, Homo sapiens
ccaugauccacaacaauga

SEQ ID NO: 1511421 - RNA, 19 nt, Homo sapiens
ucagaagcuggcagaguuu

SEQ ID NO: 1511422 - RNA, 19 nt, Homo sapiens
agaaugacaguuggaaaga

SEQ ID NO: 1511423 - RNA, 19 nt, Homo sapiens
auccuuugcugccuaacua

SEQ ID NO: 1511424 - RNA, 19 nt, Homo sapiens
accaauuucuucuggauag

SEQ ID NO: 1511425 - RNA, 19 nt, Homo sapiens
ccuaaaacauccauuugau

SEQ ID NO: 1511426 - RNA, 19 nt, Homo sapiens
gaaacagaacccuaaaaca

SEQ ID NO: 1511427 - RNA, 19 nt, Homo sapiens
auacaauucuugguucagu

SEQ ID NO: 1511428 - RNA, 19 nt, Homo sapiens
caaaggaacaccaguauua

SEQ ID NO: 1511429 - RNA, 19 nt, Homo sapiens
gaagcuggguauaauauuu

SEQ ID NO: 1511430 - RNA, 19 nt, Homo sapiens
cccaaugacuccuuaaaua

SEQ ID NO: 1511431 - RNA, 19 nt, Homo sapiens
ugacuuaaauacccaauga

SEQ ID NO: 1511432 - RNA, 19 nt, Homo sapiens
cauggcagcugcucagaua

SEQ ID NO: 1511433 - RNA, 19 nt, Homo sapiens
guugaaggaugccacaaua

SEQ ID NO: 1511434 - RNA, 19 nt, Homo sapiens
ggacaaaggaacaccagua

SEQ ID NO: 1511435 - RNA, 19 nt, Homo sapiens
caauucaaaugcagacuaa

SEQ ID NO: 1511436 - RNA, 19 nt, Homo sapiens
ccauuucccucauuucuuu

SEQ ID NO: 1511437 - RNA, 19 nt, Homo sapiens
gcaccugucuggcucaaug

SEQ ID NO: 1511438 - RNA, 19 nt, Homo sapiens
ggacggcucugcucuuugg

SEQ ID NO: 1511439 - RNA, 19 nt, Homo sapiens
ucgacgagguccugaaaua

SEQ ID NO: 1511440 - RNA, 19 nt, Homo sapiens
gcaaagaccacaaggaagu

SEQ ID NO: 1511441 - RNA, 19 nt, Homo sapiens
gcagugagaucugugugaa

SEQ ID NO: 1511442 - RNA, 19 nt, Homo sapiens
ccagaaggaugccuccauu

SEQ ID NO: 1511443 - RNA, 19 nt, Homo sapiens
gaaagacacucaccccauu

SEQ ID NO: 1511444 - RNA, 19 nt, Homo sapiens
gggcaaagaccacaaggaa

SEQ ID NO: 1511445 - RNA, 19 nt, Homo sapiens
ccaaugacuccuuaaauau

SEQ ID NO: 1511446 - RNA, 19 nt, Homo sapiens
gcagacaugcuuugaugaa

SEQ ID NO: 1511447 - RNA, 19 nt, Homo sapiens
ggacuaguucguagccaua

SEQ ID NO: 1511448 - RNA, 19 nt, Homo sapiens
gaaaucaugagccgaaauc

SEQ ID NO: 1511449 - RNA, 19 nt, Homo sapiens
guacaccauuucugaagga

SEQ ID NO: 1511450 - RNA, 19 nt, Homo sapiens
gaaaaugaaugugagcaaa

SEQ ID NO: 1511451 - RNA, 19 nt, Homo sapiens
gccaacagcuggguucaga

SEQ ID NO: 1511452 - RNA, 19 nt, Homo sapiens
gaaggaugccacaauaaca

SEQ ID NO: 1511453 - RNA, 19 nt, Homo sapiens
gagaugccaugccuaccuu

SEQ ID NO: 1511454 - RNA, 19 nt, Homo sapiens
ucaagguccuccucuaugu

SEQ ID NO: 1511455 - RNA, 19 nt, Homo sapiens
caaggacaaugaguuugaa

SEQ ID NO: 1511456 - RNA, 19 nt, Homo sapiens
gaucgacgagguccugaaa

SEQ ID NO: 1511457 - RNA, 19 nt, Homo sapiens
ugacaggucuacccaagca

SEQ ID NO: 1511458 - RNA, 19 nt, Homo sapiens
caaugacuccuuaaauaug

SEQ ID NO: 1511459 - RNA, 19 nt, Homo sapiens
cuacagggccagacgcuaa

SEQ ID NO: 1511460 - RNA, 19 nt, Homo sapiens
ggacucagccggucuacag

SEQ ID NO: 1511461 - RNA, 19 nt, Homo sapiens
ccacgccuguacaccauuu

SEQ ID NO: 1511462 - RNA, 19 nt, Homo sapiens
ugagaaaggcuaccagugu

SEQ ID NO: 1511463 - RNA, 19 nt, Homo sapiens
gacaaaggaacaccaguau

SEQ ID NO: 1511464 - RNA, 19 nt, Homo sapiens
aaucagaagcuggguauaa

SEQ ID NO: 1511465 - RNA, 19 nt, Homo sapiens
gcacgugagcggcuuggaa

SEQ ID NO: 1511466 - RNA, 19 nt, Homo sapiens
ugaaugagcccuggaggaa

SEQ ID NO: 1511467 - RNA, 19 nt, Homo sapiens
ccaccgcccucuaagaaca

SEQ ID NO: 1511468 - RNA, 19 nt, Homo sapiens
gggaucaccuagcaaagca

SEQ ID NO: 1511469 - RNA, 19 nt, Homo sapiens
ggauggcuguguuucagau

SEQ ID NO: 1511470 - RNA, 19 nt, Homo sapiens
cagacaugcuuugaugaaa

SEQ ID NO: 1511471 - RNA, 19 nt, Homo sapiens
aggcagacaugcuuugaug

SEQ ID NO: 1511472 - RNA, 19 nt, Homo sapiens
ccagagcuguggacaccuu

SEQ ID NO: 1511473 - RNA, 19 nt, Homo sapiens
uagggaauuuggaagugua

SEQ ID NO: 1511474 - RNA, 19 nt, Homo sapiens
cagaagcuggguauaauau

SEQ ID NO: 1511475 - RNA, 19 nt, Homo sapiens
aaaggaacaccaguauuaa

SEQ ID NO: 1511476 - RNA, 19 nt, Homo sapiens
ucagaagcuggguauaaua

SEQ ID NO: 1511477 - RNA, 19 nt, Homo sapiens
ggacaaugaguuugaagag

SEQ ID NO: 1511478 - RNA, 19 nt, Homo sapiens
ggaauuuggaaguguauca

SEQ ID NO: 1511479 - RNA, 19 nt, Homo sapiens
caaguuacaaacccuagaa

SEQ ID NO: 1511480 - RNA, 19 nt, Homo sapiens
uaccagugcugauaaaguc

SEQ ID NO: 1511481 - RNA, 19 nt, Homo sapiens
gaaaggcuaccagugugaa

SEQ ID NO: 1511482 - RNA, 19 nt, Homo sapiens
ggaaguguaucaauaaaac

SEQ ID NO: 1511483 - RNA, 19 nt, Homo sapiens
uaaacuguccacccagaaa

SEQ ID NO: 1511484 - RNA, 19 nt, Homo sapiens
aauacccaaugacuccuua

SEQ ID NO: 1511485 - RNA, 19 nt, Homo sapiens
acgagguccugaaauacua

SEQ ID NO: 1511486 - RNA, 19 nt, Homo sapiens
cuaagaacaucugccaaca

SEQ ID NO: 1511487 - RNA, 19 nt, Homo sapiens
guucuugucuguggagugu

SEQ ID NO: 1511488 - RNA, 19 nt, Homo sapiens
caccauuucugaaggauac

SEQ ID NO: 1511489 - RNA, 19 nt, Homo sapiens
ggugcaaucagaccacaaa

SEQ ID NO: 1511490 - RNA, 19 nt, Homo sapiens
uguggugaaugacaagauu

SEQ ID NO: 1511491 - RNA, 19 nt, Homo sapiens
cagccacucuugccuugga

SEQ ID NO: 1511492 - RNA, 19 nt, Homo sapiens
ggcaguugguccagaagga

SEQ ID NO: 1511493 - RNA, 19 nt, Homo sapiens
ucaauucaaaugcagacua

SEQ ID NO: 1511494 - RNA, 19 nt, Homo sapiens
cuucaaggacaaugaguuu

SEQ ID NO: 1511495 - RNA, 19 nt, Homo sapiens
ccuggaggcuacuaugugu

SEQ ID NO: 1511496 - RNA, 19 nt, Homo sapiens
aaugggaacugcugucucu

SEQ ID NO: 1511497 - RNA, 19 nt, Homo sapiens
gcaaucagaccacaaaauc

SEQ ID NO: 1511498 - RNA, 19 nt, Homo sapiens
gguucagacuucacacugu

SEQ ID NO: 1511499 - RNA, 19 nt, Homo sapiens
gucccugucuucaaguuug

SEQ ID NO: 1511500 - RNA, 19 nt, Homo sapiens
caacggcacccaugucaac

SEQ ID NO: 1511501 - RNA, 19 nt, Homo sapiens
aaugagcccuggaggaaca

SEQ ID NO: 1511502 - RNA, 19 nt, Homo sapiens
cgacugggaggacuaguuc

SEQ ID NO: 1511503 - RNA, 19 nt, Homo sapiens
ggaaaucaugagccgaaau

SEQ ID NO: 1511504 - RNA, 19 nt, Homo sapiens
ccuagaaggcgacggcauu

SEQ ID NO: 1511505 - RNA, 19 nt, Homo sapiens
cuagauccuuguucugcuu

SEQ ID NO: 1511506 - RNA, 19 nt, Homo sapiens
uauagggaauuuggaagug

SEQ ID NO: 1511507 - RNA, 19 nt, Homo sapiens
acagcuggguucagacuuc

SEQ ID NO: 1511508 - RNA, 19 nt, Homo sapiens
cacaugcgcuccaggaacu

SEQ ID NO: 1511509 - RNA, 19 nt, Homo sapiens
gaauuuggaaguguaucaa

SEQ ID NO: 1511510 - RNA, 19 nt, Homo sapiens
cagcaccaacucacucuga

SEQ ID NO: 1511511 - RNA, 19 nt, Homo sapiens
gugacucccucuacuuugg

SEQ ID NO: 1511512 - RNA, 19 nt, Homo sapiens
acucuugccuuggaucuga

SEQ ID NO: 1511513 - RNA, 19 nt, Homo sapiens
aacgguggcugcagugaga

SEQ ID NO: 1511514 - RNA, 19 nt, Homo sapiens
ggcccuagauccuuguucu

SEQ ID NO: 1511515 - RNA, 19 nt, Homo sapiens
acaccaguauuaagaggau

SEQ ID NO: 1511516 - RNA, 19 nt, Homo sapiens
aggaacaccaguauuaaga

SEQ ID NO: 1511517 - RNA, 19 nt, Homo sapiens
ucagaugacucgguaaagc

SEQ ID NO: 1511518 - RNA, 19 nt, Homo sapiens
ucaacauccucuucucucu

SEQ ID NO: 1511519 - RNA, 19 nt, Homo sapiens
cguguauggugcaaucaga

SEQ ID NO: 1511520 - RNA, 19 nt, Homo sapiens
ccucguguauggugcaauc

SEQ ID NO: 1511521 - RNA, 19 nt, Homo sapiens
gugguacaguggucgaugu

SEQ ID NO: 1511522 - RNA, 19 nt, Homo sapiens
ggacaccuuaucccacuca

SEQ ID NO: 1511523 - RNA, 19 nt, Homo sapiens
agacaugcuuugaugaaaa

SEQ ID NO: 1511524 - RNA, 19 nt, Homo sapiens
acaaaggaacaccaguauu

SEQ ID NO: 1511525 - RNA, 19 nt, Homo sapiens
ggaacaccaguauuaagag

SEQ ID NO: 1511526 - RNA, 19 nt, Homo sapiens
uggucgauguggugaauga

SEQ ID NO: 1511527 - RNA, 19 nt, Homo sapiens
ugacaggcagacaugcuuu

SEQ ID NO: 1511528 - RNA, 19 nt, Homo sapiens
aaacaaaucuccugucaaa

SEQ ID NO: 1511529 - RNA, 19 nt, Homo sapiens
ggaaacaaaucuccuguca

SEQ ID NO: 1511530 - RNA, 19 nt, Homo sapiens
gagaagaacguuaacagua

SEQ ID NO: 1511531 - RNA, 19 nt, Homo sapiens
gaagaacguuaacaguauu

SEQ ID NO: 1511532 - RNA, 19 nt, Homo sapiens
agaagaacguuaacaguau

SEQ ID NO: 1511533 - RNA, 19 nt, Homo sapiens
gcacgucgcccauuucuca

SEQ ID NO: 1511534 - RNA, 19 nt, Homo sapiens
guauaaagcagcugaaaug

SEQ ID NO: 1511535 - RNA, 19 nt, Homo sapiens
ugaggcagcucccguggua

SEQ ID NO: 1511536 - RNA, 19 nt, Homo sapiens
cagcugaaauguggaguuu

SEQ ID NO: 1511537 - RNA, 19 nt, Homo sapiens
agagaaaccucagacaaga

SEQ ID NO: 1511538 - RNA, 19 nt, Homo sapiens
guucucagcuuccuguuca

SEQ ID NO: 1511539 - RNA, 19 nt, Homo sapiens
agaagcacgucgcccauuu

SEQ ID NO: 1511540 - RNA, 19 nt, Homo sapiens
acacauggguucucagcuu

SEQ ID NO: 1511541 - RNA, 19 nt, Homo sapiens
ccacaggcacccaggauaa

SEQ ID NO: 1511542 - RNA, 19 nt, Homo sapiens
caggauaacucaguacaca

SEQ ID NO: 1511543 - RNA, 19 nt, Homo sapiens
ggauaacucaguacacaug

SEQ ID NO: 1511544 - RNA, 19 nt, Homo sapiens
ggaggcuucucuggguaua

SEQ ID NO: 1511545 - RNA, 19 nt, Homo sapiens
caaaucuccugucaaaauu

SEQ ID NO: 1511546 - RNA, 19 nt, Homo sapiens
gaaacaaaucuccugucaa

SEQ ID NO: 1511547 - RNA, 19 nt, Homo sapiens
cuaugggacucacgccuuu

SEQ ID NO: 1511548 - RNA, 19 nt, Homo sapiens
ccagaggcacaaucccuua

SEQ ID NO: 1511549 - RNA, 19 nt, Homo sapiens
acaagacgguuaauuacag

SEQ ID NO: 1511550 - RNA, 19 nt, Homo sapiens
gagaaaccucagacaagaa

SEQ ID NO: 1511551 - RNA, 19 nt, Homo sapiens
gcagaggcaggaaacaaau

SEQ ID NO: 1511552 - RNA, 19 nt, Homo sapiens
ggcagaggcaggaaacaaa

SEQ ID NO: 1511553 - RNA, 19 nt, Homo sapiens
cagagaaaccucagacaag

SEQ ID NO: 1511554 - RNA, 19 nt, Homo sapiens
gaggcacaaucccuuaucu

SEQ ID NO: 1511555 - RNA, 19 nt, Homo sapiens
ggacgcaugaccaggauuc

SEQ ID NO: 1511556 - RNA, 19 nt, Homo sapiens
gguauaaagcagcugaaau

SEQ ID NO: 1511557 - RNA, 19 nt, Homo sapiens
cacccaggauaacucagua

SEQ ID NO: 1511558 - RNA, 19 nt, Homo sapiens
gaagcacgucgcccauuuc

SEQ ID NO: 1511559 - RNA, 19 nt, Homo sapiens
aauuacagcccgagaagaa

SEQ ID NO: 1511560 - RNA, 19 nt, Homo sapiens
agucaggguuucaggaaug

SEQ ID NO: 1511561 - RNA, 19 nt, Homo sapiens
gggcagaggcaggaaacaa

SEQ ID NO: 1511562 - RNA, 19 nt, Homo sapiens
aggcuucucuggguauaaa

SEQ ID NO: 1511563 - RNA, 19 nt, Homo sapiens
acagagaaaccucagacaa

SEQ ID NO: 1511564 - RNA, 19 nt, Homo sapiens
gagcugagagcguguccau

SEQ ID NO: 1511565 - RNA, 19 nt, Homo sapiens
cgagaagaacguuaacagu

SEQ ID NO: 1511566 - RNA, 19 nt, Homo sapiens
gcacccaggauaacucagu

SEQ ID NO: 1511567 - RNA, 19 nt, Homo sapiens
cagcucccgugguagauca

SEQ ID NO: 1511568 - RNA, 19 nt, Homo sapiens
gagcuugcuggacgcauga

SEQ ID NO: 1511569 - RNA, 19 nt, Homo sapiens
gcagcugaaauguggaguu

SEQ ID NO: 1511570 - RNA, 19 nt, Homo sapiens
guuaauuacagcccgagaa

SEQ ID NO: 1511571 - RNA, 19 nt, Homo sapiens
acaaaucuccugucaaaau

SEQ ID NO: 1511572 - RNA, 19 nt, Homo sapiens
cgucgcccauuucucauca

SEQ ID NO: 1511573 - RNA, 19 nt, Homo sapiens
acugagagaauaagggaaa

SEQ ID NO: 1511574 - RNA, 19 nt, Homo sapiens
ggaggcaggaggcuucucu

SEQ ID NO: 1511575 - RNA, 19 nt, Homo sapiens
caggaaugcggccuucgaa

SEQ ID NO: 1511576 - RNA, 19 nt, Homo sapiens
ggguauaaagcagcugaaa

SEQ ID NO: 1511577 - RNA, 19 nt, Homo sapiens
caguacacauggguucuca

SEQ ID NO: 1511578 - RNA, 19 nt, Homo sapiens
accggacacugagagaaua

SEQ ID NO: 1511579 - RNA, 19 nt, Homo sapiens
cugagacaccggacacuga

SEQ ID NO: 1511580 - RNA, 19 nt, Homo sapiens
caccggacacugagagaau

SEQ ID NO: 1511581 - RNA, 19 nt, Homo sapiens
gaccacaggcacccaggau

SEQ ID NO: 1511582 - RNA, 19 nt, Homo sapiens
auaaagcagcugaaaugug

SEQ ID NO: 1511583 - RNA, 19 nt, Homo sapiens
gaacaugggcccaggaguu

SEQ ID NO: 1511584 - RNA, 19 nt, Homo sapiens
gaaaacauguacacuauca

SEQ ID NO: 1511585 - RNA, 19 nt, Homo sapiens
gcgagaaguuggcgcugua

SEQ ID NO: 1511586 - RNA, 19 nt, Homo sapiens
gcgaaaacauguacacuau

SEQ ID NO: 1511587 - RNA, 19 nt, Homo sapiens
gaaguuggcgcuguacguu

SEQ ID NO: 1511588 - RNA, 19 nt, Homo sapiens
ccaaggccuuccaggacua

SEQ ID NO: 1511589 - RNA, 19 nt, Homo sapiens
gagauccgaugggagaaga

SEQ ID NO: 1511590 - RNA, 19 nt, Homo sapiens
aguuggcgcuguacguuua

SEQ ID NO: 1511591 - RNA, 19 nt, Homo sapiens
cauggcggcuggcuucuuc

SEQ ID NO: 1511592 - RNA, 19 nt, Homo sapiens
ggaagcugguuuugguuuu

SEQ ID NO: 1511593 - RNA, 19 nt, Homo sapiens
cgcuguacguuuaugagua

SEQ ID NO: 1511594 - RNA, 19 nt, Homo sapiens
gacccuuccugccauuugu

SEQ ID NO: 1511595 - RNA, 19 nt, Homo sapiens
ggacccuuccugccauuug

SEQ ID NO: 1511596 - RNA, 19 nt, Homo sapiens
gaaacucgauccccuacuc

SEQ ID NO: 1511597 - RNA, 19 nt, Homo sapiens
gagacguucuuuucuguau

SEQ ID NO: 1511598 - RNA, 19 nt, Homo sapiens
cuuccugccauuuguauuu

SEQ ID NO: 1511599 - RNA, 19 nt, Homo sapiens
gaccucagagacguucuuu

SEQ ID NO: 1511600 - RNA, 19 nt, Homo sapiens
ggaccucagagacguucuu

SEQ ID NO: 1511601 - RNA, 19 nt, Homo sapiens
uccaccaacuccagcgaaa

SEQ ID NO: 1511602 - RNA, 19 nt, Homo sapiens
gaaaggacauagaagauug

SEQ ID NO: 1511603 - RNA, 19 nt, Homo sapiens
gaaauauucucccuggaaa

SEQ ID NO: 1511604 - RNA, 19 nt, Homo sapiens
gaacaggauuucaucauuc

SEQ ID NO: 1511605 - RNA, 19 nt, Homo sapiens
gggcuuggcuuguuugaaa

SEQ ID NO: 1511606 - RNA, 19 nt, Homo sapiens
ccaaagugcugagauuaua

SEQ ID NO: 1511607 - RNA, 19 nt, Homo sapiens
ucaagaggcuguccaaguu

SEQ ID NO: 1511608 - RNA, 19 nt, Homo sapiens
gaagucaauuugcaagaug

SEQ ID NO: 1511609 - RNA, 19 nt, Homo sapiens
gcacucaggugaacccaau

SEQ ID NO: 1511610 - RNA, 19 nt, Homo sapiens
ggaaggaaaggacauagaa

SEQ ID NO: 1511611 - RNA, 19 nt, Homo sapiens
gaugagcguugugcgauaa

SEQ ID NO: 1511612 - RNA, 19 nt, Homo sapiens
cuacugggaugcaaucuug

SEQ ID NO: 1511613 - RNA, 19 nt, Homo sapiens
gcaauggguugaccagaca

SEQ ID NO: 1511614 - RNA, 19 nt, Homo sapiens
ggaaaggacauagaagauu

SEQ ID NO: 1511615 - RNA, 19 nt, Homo sapiens
ccaccucacccucuuguua

SEQ ID NO: 1511616 - RNA, 19 nt, Homo sapiens
agaacaggauuucaucauu

SEQ ID NO: 1511617 - RNA, 19 nt, Homo sapiens
gggaugcaaucuuggacua

SEQ ID NO: 1511618 - RNA, 19 nt, Homo sapiens
caccaugcuuggcuaauuu

SEQ ID NO: 1511619 - RNA, 19 nt, Homo sapiens
gagaguaucaacaguauca

SEQ ID NO: 1511620 - RNA, 19 nt, Homo sapiens
ccaccaugcuuggcuaauu

SEQ ID NO: 1511621 - RNA, 19 nt, Homo sapiens
caagaggcuguccaaguua

SEQ ID NO: 1511622 - RNA, 19 nt, Homo sapiens
gggcugaucugguggugau

SEQ ID NO: 1511623 - RNA, 19 nt, Homo sapiens
cagucuaguugcuacuuua

SEQ ID NO: 1511624 - RNA, 19 nt, Homo sapiens
gaugaagaagaucuacaua

SEQ ID NO: 1511625 - RNA, 19 nt, Homo sapiens
gaccagacaccauacaaug

SEQ ID NO: 1511626 - RNA, 19 nt, Homo sapiens
ggaagaacaggauuucauc

SEQ ID NO: 1511627 - RNA, 19 nt, Homo sapiens
acacaauggugccugaaga

SEQ ID NO: 1511628 - RNA, 19 nt, Homo sapiens
cuaagggcuuggcuuguuu

SEQ ID NO: 1511629 - RNA, 19 nt, Homo sapiens
agaaaggacucuggugguu

SEQ ID NO: 1511630 - RNA, 19 nt, Homo sapiens
uggagaaagugauacaaga

SEQ ID NO: 1511631 - RNA, 19 nt, Homo sapiens
gaagaacaggauuucauca

SEQ ID NO: 1511632 - RNA, 19 nt, Homo sapiens
ugaaauauucucccuggaa

SEQ ID NO: 1511633 - RNA, 19 nt, Homo sapiens
aguaacaucuuuggagaaa

SEQ ID NO: 1511634 - RNA, 19 nt, Homo sapiens
agcaggcugucaccuauua

SEQ ID NO: 1511635 - RNA, 19 nt, Homo sapiens
gagcguugugcgauaauaa

SEQ ID NO: 1511636 - RNA, 19 nt, Homo sapiens
ccucagaagucaauuugca

SEQ ID NO: 1511637 - RNA, 19 nt, Homo sapiens
gaucaacaccagggaagaa

SEQ ID NO: 1511638 - RNA, 19 nt, Homo sapiens
ucuaagggcuuggcuuguu

SEQ ID NO: 1511639 - RNA, 19 nt, Homo sapiens
gcugucaccuauuacacuu

SEQ ID NO: 1511640 - RNA, 19 nt, Homo sapiens
ugaugagcguugugcgaua

SEQ ID NO: 1511641 - RNA, 19 nt, Homo sapiens
ccagacaccauacaaugaa

SEQ ID NO: 1511642 - RNA, 19 nt, Homo sapiens
gaaugccccuaaaauguuu

SEQ ID NO: 1511643 - RNA, 19 nt, Homo sapiens
gaaagugauacaagagcuu

SEQ ID NO: 1511644 - RNA, 19 nt, Homo sapiens
cacuacaccuggccacaaa

SEQ ID NO: 1511645 - RNA, 19 nt, Homo sapiens
ucauguaccucagaaguca

SEQ ID NO: 1511646 - RNA, 19 nt, Homo sapiens
gaauggggcuggaaugaca

SEQ ID NO: 1511647 - RNA, 19 nt, Homo sapiens
uaucaacaguaucauccaa

SEQ ID NO: 1511648 - RNA, 19 nt, Homo sapiens
uaaauuuccguucuucaga

SEQ ID NO: 1511649 - RNA, 19 nt, Homo sapiens
cagacaccauacaaugaaa

SEQ ID NO: 1511650 - RNA, 19 nt, Homo sapiens
gggaagaacaggauuucau

SEQ ID NO: 1511651 - RNA, 19 nt, Homo sapiens
ucagucuaguugcuacuuu

SEQ ID NO: 1511652 - RNA, 19 nt, Homo sapiens
guaccucagaagucaauuu

SEQ ID NO: 1511653 - RNA, 19 nt, Homo sapiens
gaaggaaaggacauagaag

SEQ ID NO: 1511654 - RNA, 19 nt, Homo sapiens
ggagaaagugauacaagag

SEQ ID NO: 1511655 - RNA, 19 nt, Homo sapiens
ggguugaccagacaccaua

SEQ ID NO: 1511656 - RNA, 19 nt, Homo sapiens
gaugcaaucuuggacuaag

SEQ ID NO: 1511657 - RNA, 19 nt, Homo sapiens
caauggugccugaagaaga

SEQ ID NO: 1511658 - RNA, 19 nt, Homo sapiens
ucaccuauuacacuuauga

SEQ ID NO: 1511659 - RNA, 19 nt, Homo sapiens
ggaaugccccuaaaauguu

SEQ ID NO: 1511660 - RNA, 19 nt, Homo sapiens
ugucaccuauuacacuuau

SEQ ID NO: 1511661 - RNA, 19 nt, Homo sapiens
caauuugcaagaugaagaa

SEQ ID NO: 1511662 - RNA, 19 nt, Homo sapiens
agaagucaauuugcaagau

SEQ ID NO: 1511663 - RNA, 19 nt, Homo sapiens
acgagaguaucaacaguau

SEQ ID NO: 1511664 - RNA, 19 nt, Homo sapiens
ccagggaagaacaggauuu

SEQ ID NO: 1511665 - RNA, 19 nt, Homo sapiens
gagaugggguuucacuaug

SEQ ID NO: 1511666 - RNA, 19 nt, Homo sapiens
gcuccucagugucuguuuc

SEQ ID NO: 1511667 - RNA, 19 nt, Homo sapiens
cuucugcacccaccugaua

SEQ ID NO: 1511668 - RNA, 19 nt, Homo sapiens
cugaguagccgaaauuaca

SEQ ID NO: 1511669 - RNA, 19 nt, Homo sapiens
gauagaggaaguccaaagg

SEQ ID NO: 1511670 - RNA, 19 nt, Homo sapiens
ugagcguugugcgauaaua

SEQ ID NO: 1511671 - RNA, 19 nt, Homo sapiens
aacaggauuucaucauuca

SEQ ID NO: 1511672 - RNA, 19 nt, Homo sapiens
aaggaaaggacauagaaga

SEQ ID NO: 1511673 - RNA, 19 nt, Homo sapiens
gaaccacaccccgaaagua

SEQ ID NO: 1511674 - RNA, 19 nt, Homo sapiens
ccaucuugcuccucagugu

SEQ ID NO: 1511675 - RNA, 19 nt, Homo sapiens
ggcauccaccguuguagaa

SEQ ID NO: 1511676 - RNA, 19 nt, Homo sapiens
ucaauuugcaagaugaaga

SEQ ID NO: 1511677 - RNA, 19 nt, Homo sapiens
gaacuccuggccugaagca

SEQ ID NO: 1511678 - RNA, 19 nt, Homo sapiens
guuguagaaagcuaaauug

SEQ ID NO: 1511679 - RNA, 19 nt, Homo sapiens
ccaccguuguagaaagcua

SEQ ID NO: 1511680 - RNA, 19 nt, Homo sapiens
ggaugcaaucuuggacuaa

SEQ ID NO: 1511681 - RNA, 19 nt, Homo sapiens
uacgagaguaucaacagua

SEQ ID NO: 1511682 - RNA, 19 nt, Homo sapiens
uggccaggcuagucuugaa

SEQ ID NO: 1511683 - RNA, 19 nt, Homo sapiens
guacaaggaaugccccuaa

SEQ ID NO: 1511684 - RNA, 19 nt, Homo sapiens
caccucagccucccaaagu

SEQ ID NO: 1511685 - RNA, 19 nt, Homo sapiens
gucaagaggcuguccaagu

SEQ ID NO: 1511686 - RNA, 19 nt, Homo sapiens
caaagugcugagauuauag

SEQ ID NO: 1511687 - RNA, 19 nt, Homo sapiens
cauccaccguuguagaaag

SEQ ID NO: 1511688 - RNA, 19 nt, Homo sapiens
uuugcaagaugaagaagau

SEQ ID NO: 1511689 - RNA, 19 nt, Homo sapiens
ccaaguuacgagaguauca

SEQ ID NO: 1511690 - RNA, 19 nt, Homo sapiens
aauggugccugaagaagag

SEQ ID NO: 1511691 - RNA, 19 nt, Homo sapiens
gaacccaauaaccuugaug

SEQ ID NO: 1511692 - RNA, 19 nt, Homo sapiens
ucccaaagugcugagauua

SEQ ID NO: 1511693 - RNA, 19 nt, Homo sapiens
cauggaaggaaaggacaua

SEQ ID NO: 1511694 - RNA, 19 nt, Homo sapiens
caggauuucaucauucaga

SEQ ID NO: 1511695 - RNA, 19 nt, Homo sapiens
guugcuacuuuauuucuac

SEQ ID NO: 1511696 - RNA, 19 nt, Homo sapiens
uuacgagaguaucaacagu

SEQ ID NO: 1511697 - RNA, 19 nt, Homo sapiens
ugaagaagagccucaagac

SEQ ID NO: 1511698 - RNA, 19 nt, Homo sapiens
cacaauggugccugaagaa

SEQ ID NO: 1511699 - RNA, 19 nt, Homo sapiens
ccugauagaggaaguccaa

SEQ ID NO: 1511700 - RNA, 19 nt, Homo sapiens
guuggcauccaccguugua

SEQ ID NO: 1511701 - RNA, 19 nt, Homo sapiens
aauauucucccuggaaaug

SEQ ID NO: 1511702 - RNA, 19 nt, Homo sapiens
gaacacagaugccaguuua

SEQ ID NO: 1511703 - RNA, 19 nt, Homo sapiens
gaaacaggguucuaucuua

SEQ ID NO: 1511704 - RNA, 19 nt, Homo sapiens
guacugaaguuucuacuaa

SEQ ID NO: 1511705 - RNA, 19 nt, Homo sapiens
gagcaagucuucuagauga

SEQ ID NO: 1511706 - RNA, 19 nt, Homo sapiens
gcacagauauccugguuug

SEQ ID NO: 1511707 - RNA, 19 nt, Homo sapiens
gaaaggaacuagauauucu

SEQ ID NO: 1511708 - RNA, 19 nt, Homo sapiens
gaaaggaauuggcaaagga

SEQ ID NO: 1511709 - RNA, 19 nt, Homo sapiens
gcaguacugucagcuauua

SEQ ID NO: 1511710 - RNA, 19 nt, Homo sapiens
gagaaaagcugccuucgua

SEQ ID NO: 1511711 - RNA, 19 nt, Homo sapiens
gaucugaauuugauuguug

SEQ ID NO: 1511712 - RNA, 19 nt, Homo sapiens
gcacagagguuuccccaua

SEQ ID NO: 1511713 - RNA, 19 nt, Homo sapiens
gauggaggaugauaaaguu

SEQ ID NO: 1511714 - RNA, 19 nt, Homo sapiens
gcaagggcauguaaauaga

SEQ ID NO: 1511715 - RNA, 19 nt, Homo sapiens
gaagaaugauaaagaguca

SEQ ID NO: 1511716 - RNA, 19 nt, Homo sapiens
gaaauuccuuuguucuguu

SEQ ID NO: 1511717 - RNA, 19 nt, Homo sapiens
ugaaccagauggaacuuua

SEQ ID NO: 1511718 - RNA, 19 nt, Homo sapiens
guagaugaguggauuguau

SEQ ID NO: 1511719 - RNA, 19 nt, Homo sapiens
aaacagacuuucacuacaa

SEQ ID NO: 1511720 - RNA, 19 nt, Homo sapiens
caucugugcugguuuauau

SEQ ID NO: 1511721 - RNA, 19 nt, Homo sapiens
gcauguaaauagacaagaa

SEQ ID NO: 1511722 - RNA, 19 nt, Homo sapiens
gcugaacgcuuuggauaaa

SEQ ID NO: 1511723 - RNA, 19 nt, Homo sapiens
ugauggagcugaacgcuuu

SEQ ID NO: 1511724 - RNA, 19 nt, Homo sapiens
gaagaaaggaauuggcaaa

SEQ ID NO: 1511725 - RNA, 19 nt, Homo sapiens
gcuaucaucuguauaaugg

SEQ ID NO: 1511726 - RNA, 19 nt, Homo sapiens
gagcugaacgcuuuggaua

SEQ ID NO: 1511727 - RNA, 19 nt, Homo sapiens
ggauaaacaagaagaauug

SEQ ID NO: 1511728 - RNA, 19 nt, Homo sapiens
gaacagaucauauauugac

SEQ ID NO: 1511729 - RNA, 19 nt, Homo sapiens
gcaauauguucucugauca

SEQ ID NO: 1511730 - RNA, 19 nt, Homo sapiens
acaacuggcuuaucuauca

SEQ ID NO: 1511731 - RNA, 19 nt, Homo sapiens
aaacaggguucuaucuuau

SEQ ID NO: 1511732 - RNA, 19 nt, Homo sapiens
ugaccgagauucugaguau

SEQ ID NO: 1511733 - RNA, 19 nt, Homo sapiens
aggaacagaucauauauug

SEQ ID NO: 1511734 - RNA, 19 nt, Homo sapiens
gugcaugacuugauguuau

SEQ ID NO: 1511735 - RNA, 19 nt, Homo sapiens
ugaaaguccucauccugua

SEQ ID NO: 1511736 - RNA, 19 nt, Homo sapiens
agaagaggauggugcgaua

SEQ ID NO: 1511737 - RNA, 19 nt, Homo sapiens
gaccuucgguauauugaaa

SEQ ID NO: 1511738 - RNA, 19 nt, Homo sapiens
ccugggacaugaacaauuu

SEQ ID NO: 1511739 - RNA, 19 nt, Homo sapiens
ggaacuagauauucuucug

SEQ ID NO: 1511740 - RNA, 19 nt, Homo sapiens
ucaggaaacuauugcugua

SEQ ID NO: 1511741 - RNA, 19 nt, Homo sapiens
gcaaacagacuuucacuac

SEQ ID NO: 1511742 - RNA, 19 nt, Homo sapiens
uaccauagaugaugucguu

SEQ ID NO: 1511743 - RNA, 19 nt, Homo sapiens
gaacugcgaagaagguauu

SEQ ID NO: 1511744 - RNA, 19 nt, Homo sapiens
ggaaagaguagcugcagaa

SEQ ID NO: 1511745 - RNA, 19 nt, Homo sapiens
uagaugaugucguuuaugu

SEQ ID NO: 1511746 - RNA, 19 nt, Homo sapiens
gaaaugauggaggaugaua

SEQ ID NO: 1511747 - RNA, 19 nt, Homo sapiens
gcaaguacuguagauguua

SEQ ID NO: 1511748 - RNA, 19 nt, Homo sapiens
aaagcaauauguucucuga

SEQ ID NO: 1511749 - RNA, 19 nt, Homo sapiens
gcaagagagagcuguagua

SEQ ID NO: 1511750 - RNA, 19 nt, Homo sapiens
gaugagaacaagcaguaua

SEQ ID NO: 1511751 - RNA, 19 nt, Homo sapiens
aaagaacguuggccagauu

SEQ ID NO: 1511752 - RNA, 19 nt, Homo sapiens
ugacagccauucuucauca

SEQ ID NO: 1511753 - RNA, 19 nt, Homo sapiens
ugucaucugugcugguuua

SEQ ID NO: 1511754 - RNA, 19 nt, Homo sapiens
aauuaaagcugucaucugu

SEQ ID NO: 1511755 - RNA, 19 nt, Homo sapiens
uaacaugaaaggacaguuu

SEQ ID NO: 1511756 - RNA, 19 nt, Homo sapiens
uagguggaauugcuuauuu

SEQ ID NO: 1511757 - RNA, 19 nt, Homo sapiens
ggucauugcuaucaucugu

SEQ ID NO: 1511758 - RNA, 19 nt, Homo sapiens
uaguaaagcuaaugccaaa

SEQ ID NO: 1511759 - RNA, 19 nt, Homo sapiens
gaugaugucguuuauguga

SEQ ID NO: 1511760 - RNA, 19 nt, Homo sapiens
ggacaaugaguuaugacua

SEQ ID NO: 1511761 - RNA, 19 nt, Homo sapiens
gguucuaucuuauacugua

SEQ ID NO: 1511762 - RNA, 19 nt, Homo sapiens
ccacucaaguuacucaguu

SEQ ID NO: 1511763 - RNA, 19 nt, Homo sapiens
uagaaaugauggaggauga

SEQ ID NO: 1511764 - RNA, 19 nt, Homo sapiens
ugaaagaaaucugcaguca

SEQ ID NO: 1511765 - RNA, 19 nt, Homo sapiens
gaauugcccaucuuguuaa

SEQ ID NO: 1511766 - RNA, 19 nt, Homo sapiens
gcacuguucugcugcuuag

SEQ ID NO: 1511767 - RNA, 19 nt, Homo sapiens
ugaugucguuuaugugaua

SEQ ID NO: 1511768 - RNA, 19 nt, Homo sapiens
uggcuuaucuaucaccuaa

SEQ ID NO: 1511769 - RNA, 19 nt, Homo sapiens
caaacagacuuucacuaca

SEQ ID NO: 1511770 - RNA, 19 nt, Homo sapiens
ucuuggagcuggauuugua

SEQ ID NO: 1511771 - RNA, 19 nt, Homo sapiens
ggaaacaggguucuaucuu

SEQ ID NO: 1511772 - RNA, 19 nt, Homo sapiens
gcucagagaacaaacuuga

SEQ ID NO: 1511773 - RNA, 19 nt, Homo sapiens
agaauugcccaucuuguua

SEQ ID NO: 1511774 - RNA, 19 nt, Homo sapiens
caaaggauacuagaaguga

SEQ ID NO: 1511775 - RNA, 19 nt, Homo sapiens
gacaaugaguuaugacuac

SEQ ID NO: 1511776 - RNA, 19 nt, Homo sapiens
gggacaauaucagcacuuu

SEQ ID NO: 1511777 - RNA, 19 nt, Homo sapiens
gaugaaauccaugaaagaa

SEQ ID NO: 1511778 - RNA, 19 nt, Homo sapiens
gagaacuccuuuggaagaa

SEQ ID NO: 1511779 - RNA, 19 nt, Homo sapiens
cauagaugaugucguuuau

SEQ ID NO: 1511780 - RNA, 19 nt, Homo sapiens
gcagucagauguuuuaaug

SEQ ID NO: 1511781 - RNA, 19 nt, Homo sapiens
gagacuagcauuaccauag

SEQ ID NO: 1511782 - RNA, 19 nt, Homo sapiens
aagaguagcugcagaaagg

SEQ ID NO: 1511783 - RNA, 19 nt, Homo sapiens
ggacaauaucagcacuuua

SEQ ID NO: 1511784 - RNA, 19 nt, Homo sapiens
guaaagacuuaaugugcau

SEQ ID NO: 1511785 - RNA, 19 nt, Homo sapiens
ccaggacaaugaguuauga

SEQ ID NO: 1511786 - RNA, 19 nt, Homo sapiens
caguagaaauccuaaagau

SEQ ID NO: 1511787 - RNA, 19 nt, Homo sapiens
ccauagaugaugucguuua

SEQ ID NO: 1511788 - RNA, 19 nt, Homo sapiens
caaguacuguagauguuau

SEQ ID NO: 1511789 - RNA, 19 nt, Homo sapiens
aauaagguauguuccagaa

SEQ ID NO: 1511790 - RNA, 19 nt, Homo sapiens
gccaaacccugggacauga

SEQ ID NO: 1511791 - RNA, 19 nt, Homo sapiens
ggaaacuauugcuguagau

SEQ ID NO: 1511792 - RNA, 19 nt, Homo sapiens
cagagucgguugccaagga

SEQ ID NO: 1511793 - RNA, 19 nt, Homo sapiens
gcagaauaguuuguacuca

SEQ ID NO: 1511794 - RNA, 19 nt, Homo sapiens
caaguuacucaguucauuu

SEQ ID NO: 1511795 - RNA, 19 nt, Homo sapiens
gacuugauguuauauguag

SEQ ID NO: 1511796 - RNA, 19 nt, Homo sapiens
agacuggaaugacacuaaa

SEQ ID NO: 1511797 - RNA, 19 nt, Homo sapiens
gcaguguuacucuccauaa

SEQ ID NO: 1511798 - RNA, 19 nt, Homo sapiens
agacuagcauuaccauaga

SEQ ID NO: 1511799 - RNA, 19 nt, Homo sapiens
ucaaguuacucaguucauu

SEQ ID NO: 1511800 - RNA, 19 nt, Homo sapiens
gaacuuuccgccacgauuc

SEQ ID NO: 1511801 - RNA, 19 nt, Homo sapiens
ggaauuaagaaaggaacua

SEQ ID NO: 1511802 - RNA, 19 nt, Homo sapiens
ggaaauggcucaugccuuu

SEQ ID NO: 1511803 - RNA, 19 nt, Homo sapiens
gaagaggaauuugccguuu

SEQ ID NO: 1511804 - RNA, 19 nt, Homo sapiens
gaauuugccguuuguuaua

SEQ ID NO: 1511805 - RNA, 19 nt, Homo sapiens
ggaauuugccguuuguuau

SEQ ID NO: 1511806 - RNA, 19 nt, Homo sapiens
caagaaacauaagcucaga

SEQ ID NO: 1511807 - RNA, 19 nt, Homo sapiens
ccgcugagcuugcagaauc

SEQ ID NO: 1511808 - RNA, 19 nt, Homo sapiens
gcagaaucaagaaacauaa

SEQ ID NO: 1511809 - RNA, 19 nt, Homo sapiens
gagcagaugaucaggaaau

SEQ ID NO: 1511810 - RNA, 19 nt, Homo sapiens
gaaauggcucaugccuuua

SEQ ID NO: 1511811 - RNA, 19 nt, Homo sapiens
gcaugaaagugccgcucuu

SEQ ID NO: 1511812 - RNA, 19 nt, Homo sapiens
gaaacauaagcucagaauu

SEQ ID NO: 1511813 - RNA, 19 nt, Homo sapiens
ggagcagccuggagcagau

SEQ ID NO: 1511814 - RNA, 19 nt, Homo sapiens
gaggugcauuugcggaaga

SEQ ID NO: 1511815 - RNA, 19 nt, Homo sapiens
uggagcagaugaucaggaa

SEQ ID NO: 1511816 - RNA, 19 nt, Homo sapiens
aagaggaauuugccguuug

SEQ ID NO: 1511817 - RNA, 19 nt, Homo sapiens
agaggaauuugccguuugu

SEQ ID NO: 1511818 - RNA, 19 nt, Homo sapiens
aggaauuugccguuuguua

SEQ ID NO: 1511819 - RNA, 19 nt, Homo sapiens
ugcagaaucaagaaacaua

SEQ ID NO: 1511820 - RNA, 19 nt, Homo sapiens
agaaacauaagcucagaau

SEQ ID NO: 1511821 - RNA, 19 nt, Homo sapiens
ugucugcccucccucuuca

SEQ ID NO: 1511822 - RNA, 19 nt, Homo sapiens
gugccgcucuuccgcuuuc

SEQ ID NO: 1511823 - RNA, 19 nt, Homo sapiens
gaucaggaaauggcucaug

SEQ ID NO: 1511824 - RNA, 19 nt, Homo sapiens
cauaagcucagaauuuacu

SEQ ID NO: 1511825 - RNA, 19 nt, Homo sapiens
ccuccucacugccaugcuu

SEQ ID NO: 1511826 - RNA, 19 nt, Homo sapiens
ggagccacuucaggcaaga

SEQ ID NO: 1511827 - RNA, 19 nt, Homo sapiens
gaccuucgcccuccucacu

SEQ ID NO: 1511828 - RNA, 19 nt, Homo sapiens
aagcucagaauuuacuuug

SEQ ID NO: 1511829 - RNA, 19 nt, Homo sapiens
cugccuaccuugaggaucu

SEQ ID NO: 1511830 - RNA, 19 nt, Homo sapiens
cagaauuuacuuugagagu

SEQ ID NO: 1511831 - RNA, 19 nt, Homo sapiens
gaaucaagaaacauaagcu

SEQ ID NO: 1511832 - RNA, 19 nt, Homo sapiens
gaacagagguuucucaaau

SEQ ID NO: 1511833 - RNA, 19 nt, Homo sapiens
ggacacggauuuauauaua

SEQ ID NO: 1511834 - RNA, 19 nt, Homo sapiens
gcacuagacugcuguuauu

SEQ ID NO: 1511835 - RNA, 19 nt, Homo sapiens
gaaaggagaaggaauaaga

SEQ ID NO: 1511836 - RNA, 19 nt, Homo sapiens
ggugauagaauucgucuua

SEQ ID NO: 1511837 - RNA, 19 nt, Homo sapiens
ucacuuugcuuccuauuga

SEQ ID NO: 1511838 - RNA, 19 nt, Homo sapiens
caaccagccucuuguucua

SEQ ID NO: 1511839 - RNA, 19 nt, Homo sapiens
gcacauccguauacacuca

SEQ ID NO: 1511840 - RNA, 19 nt, Homo sapiens
cuagacugcuguuauuaua

SEQ ID NO: 1511841 - RNA, 19 nt, Homo sapiens
ggaauuggauuuauuucuc

SEQ ID NO: 1511842 - RNA, 19 nt, Homo sapiens
caaagacccuauacucuca

SEQ ID NO: 1511843 - RNA, 19 nt, Homo sapiens
ggccagaaauucccaaguu

SEQ ID NO: 1511844 - RNA, 19 nt, Homo sapiens
gaucagcuguugccagaga

SEQ ID NO: 1511845 - RNA, 19 nt, Homo sapiens
ccuguaaccuagacaauuu

SEQ ID NO: 1511846 - RNA, 19 nt, Homo sapiens
ucacacaacucuccaaucu

SEQ ID NO: 1511847 - RNA, 19 nt, Homo sapiens
gagaaagccuucacacaac

SEQ ID NO: 1511848 - RNA, 19 nt, Homo sapiens
gaugaaggaucagcuguug

SEQ ID NO: 1511849 - RNA, 19 nt, Homo sapiens
ucaacaagaugaaggauca

SEQ ID NO: 1511850 - RNA, 19 nt, Homo sapiens
ggaaguggcugggccugaa

SEQ ID NO: 1511851 - RNA, 19 nt, Homo sapiens
gcucagaccuuccccauuu

SEQ ID NO: 1511852 - RNA, 19 nt, Homo sapiens
gagagaggguagaauggaa

SEQ ID NO: 1511853 - RNA, 19 nt, Homo sapiens
acaaauaauuccugagguu

SEQ ID NO: 1511854 - RNA, 19 nt, Homo sapiens
gauagaauucgucuuaguu

SEQ ID NO: 1511855 - RNA, 19 nt, Homo sapiens
ugagaaagccuucacacaa

SEQ ID NO: 1511856 - RNA, 19 nt, Homo sapiens
ggugauagaccauacaaau

SEQ ID NO: 1511857 - RNA, 19 nt, Homo sapiens
cgagaugaaugacccuuau

SEQ ID NO: 1511858 - RNA, 19 nt, Homo sapiens
cagacugacugcugacaaa

SEQ ID NO: 1511859 - RNA, 19 nt, Homo sapiens
guaaccauuucuguguuua

SEQ ID NO: 1511860 - RNA, 19 nt, Homo sapiens
cccaaacgcuggugauaga

SEQ ID NO: 1511861 - RNA, 19 nt, Homo sapiens
gccagaaauucccaaguug

SEQ ID NO: 1511862 - RNA, 19 nt, Homo sapiens
gauagaccauacaaaugug

SEQ ID NO: 1511863 - RNA, 19 nt, Homo sapiens
aaacgcuggugauagaauu

SEQ ID NO: 1511864 - RNA, 19 nt, Homo sapiens
agaaguguguguuaugguu

SEQ ID NO: 1511865 - RNA, 19 nt, Homo sapiens
acugacugcugacaaauaa

SEQ ID NO: 1511866 - RNA, 19 nt, Homo sapiens
aaacauaugcgcaaacaca

SEQ ID NO: 1511867 - RNA, 19 nt, Homo sapiens
gcagauccacuccaaguca

SEQ ID NO: 1511868 - RNA, 19 nt, Homo sapiens
ugugggaggcuuuguguua

SEQ ID NO: 1511869 - RNA, 19 nt, Homo sapiens
ugaaacauaugcgcaaaca

SEQ ID NO: 1511870 - RNA, 19 nt, Homo sapiens
gcaacacaacaaagauaaa

SEQ ID NO: 1511871 - RNA, 19 nt, Homo sapiens
ucccugaccucuccaagaa

SEQ ID NO: 1511872 - RNA, 19 nt, Homo sapiens
gaaguguguguuaugguuu

SEQ ID NO: 1511873 - RNA, 19 nt, Homo sapiens
gaacucuucuucaaaagga

SEQ ID NO: 1511874 - RNA, 19 nt, Homo sapiens
ggaagaggaagaaguaguc

SEQ ID NO: 1511875 - RNA, 19 nt, Homo sapiens
ugauagaccauacaaaugu

SEQ ID NO: 1511876 - RNA, 19 nt, Homo sapiens
cauuucggcucccaugauu

SEQ ID NO: 1511877 - RNA, 19 nt, Homo sapiens
gcaucaguauggacacaga

SEQ ID NO: 1511878 - RNA, 19 nt, Homo sapiens
agacugcuguuauuauauc

SEQ ID NO: 1511879 - RNA, 19 nt, Homo sapiens
caucuuuguuguaaccauu

SEQ ID NO: 1511880 - RNA, 19 nt, Homo sapiens
ccuauugacugcugguaga

SEQ ID NO: 1511881 - RNA, 19 nt, Homo sapiens
ggcaacacaacaaagauaa

SEQ ID NO: 1511882 - RNA, 19 nt, Homo sapiens
acacagaguccaagucaga

SEQ ID NO: 1511883 - RNA, 19 nt, Homo sapiens
uguaaccauuucuguguuu

SEQ ID NO: 1511884 - RNA, 19 nt, Homo sapiens
cuacaaagacccuauacuc

SEQ ID NO: 1511885 - RNA, 19 nt, Homo sapiens
gcugguagaaggagauuug

SEQ ID NO: 1511886 - RNA, 19 nt, Homo sapiens
gaaaagggagccccaaaug

SEQ ID NO: 1511887 - RNA, 19 nt, Homo sapiens
gcauacacaucagaaacau

SEQ ID NO: 1511888 - RNA, 19 nt, Homo sapiens
gccaagcccuacaacuguu

SEQ ID NO: 1511889 - RNA, 19 nt, Homo sapiens
ugacugcugacaaauaauu

SEQ ID NO: 1511890 - RNA, 19 nt, Homo sapiens
gcuuagaaguguguguuau

SEQ ID NO: 1511891 - RNA, 19 nt, Homo sapiens
ccacuuacccuauccuuac

SEQ ID NO: 1511892 - RNA, 19 nt, Homo sapiens
gggccucugucacggcuuu

SEQ ID NO: 1511893 - RNA, 19 nt, Homo sapiens
aaacacaacccgccugauc

SEQ ID NO: 1511894 - RNA, 19 nt, Homo sapiens
aagauaaacccuucaagug

SEQ ID NO: 1511895 - RNA, 19 nt, Homo sapiens
aaagauaaacccuucaagu

SEQ ID NO: 1511896 - RNA, 19 nt, Homo sapiens
gagaagggagucaaucaag

SEQ ID NO: 1511897 - RNA, 19 nt, Homo sapiens
cgucuuaguuucugggaau

SEQ ID NO: 1511898 - RNA, 19 nt, Homo sapiens
gaagagaagggagucaauc

SEQ ID NO: 1511899 - RNA, 19 nt, Homo sapiens
gcaaccagccucuuguucu

SEQ ID NO: 1511900 - RNA, 19 nt, Homo sapiens
caucagaaacauaccuuau

SEQ ID NO: 1511901 - RNA, 19 nt, Homo sapiens
gaauucgucuuaguuucug

SEQ ID NO: 1511902 - RNA, 19 nt, Homo sapiens
gacugacugcugacaaaua

SEQ ID NO: 1511903 - RNA, 19 nt, Homo sapiens
ucacggccaucuuuguugu

SEQ ID NO: 1511904 - RNA, 19 nt, Homo sapiens
cggcaacacaacaaagaua

SEQ ID NO: 1511905 - RNA, 19 nt, Homo sapiens
ggucagaucgagaacacaa

SEQ ID NO: 1511906 - RNA, 19 nt, Homo sapiens
acagguggcuuagaagugu

SEQ ID NO: 1511907 - RNA, 19 nt, Homo sapiens
ucugggaauuggauuuauu

SEQ ID NO: 1511908 - RNA, 19 nt, Homo sapiens
cuccuuauccucaaaguuu

SEQ ID NO: 1511909 - RNA, 19 nt, Homo sapiens
ugauagaauucgucuuagu

SEQ ID NO: 1511910 - RNA, 19 nt, Homo sapiens
ggaugcagccucacuagag

SEQ ID NO: 1511911 - RNA, 19 nt, Homo sapiens
caucucuaauguucucuga

SEQ ID NO: 1511912 - RNA, 19 nt, Homo sapiens
agaaagacggcaagaccua

SEQ ID NO: 1511913 - RNA, 19 nt, Homo sapiens
cuggaaaggagaaggaaua

SEQ ID NO: 1511914 - RNA, 19 nt, Homo sapiens
aguuugggcugauguaaga

SEQ ID NO: 1511915 - RNA, 19 nt, Homo sapiens
agggaaggauuugcuauga

SEQ ID NO: 1511916 - RNA, 19 nt, Homo sapiens
guguacaccugcacuaucu

SEQ ID NO: 1511917 - RNA, 19 nt, Homo sapiens
uagaauucgucuuaguuuc

SEQ ID NO: 1511918 - RNA, 19 nt, Homo sapiens
aauccacacuggugauaga

SEQ ID NO: 1511919 - RNA, 19 nt, Homo sapiens
uaagacggcaggaggaaga

SEQ ID NO: 1511920 - RNA, 19 nt, Homo sapiens
ggcuuuguguuaucuguga

SEQ ID NO: 1511921 - RNA, 19 nt, Homo sapiens
gugggaggcuuuguguuau

SEQ ID NO: 1511922 - RNA, 19 nt, Homo sapiens
gugauagaccauacaaaug

SEQ ID NO: 1511923 - RNA, 19 nt, Homo sapiens
cuccuucucugccuacaaa

SEQ ID NO: 1511924 - RNA, 19 nt, Homo sapiens
gggcaagggcugagaugug

SEQ ID NO: 1511925 - RNA, 19 nt, Homo sapiens
aacagagguuucucaaaug

SEQ ID NO: 1511926 - RNA, 19 nt, Homo sapiens
gaaguaguccuggugucuu

SEQ ID NO: 1511927 - RNA, 19 nt, Homo sapiens
cggcggagcaucauaagga

SEQ ID NO: 1511928 - RNA, 19 nt, Homo sapiens
agacggcggagcaucauaa

SEQ ID NO: 1511929 - RNA, 19 nt, Homo sapiens
agagagagaggguagaaug

SEQ ID NO: 1511930 - RNA, 19 nt, Homo sapiens
caucacggccaucuuuguu

SEQ ID NO: 1511931 - RNA, 19 nt, Homo sapiens
ugaagcaugccaaggugua

SEQ ID NO: 1511932 - RNA, 19 nt, Homo sapiens
gaaugcugcuucuaaauua

SEQ ID NO: 1511933 - RNA, 19 nt, Homo sapiens
ccacugaacuggcuacuuu

SEQ ID NO: 1511934 - RNA, 19 nt, Homo sapiens
gugaagagguccagaauga

SEQ ID NO: 1511935 - RNA, 19 nt, Homo sapiens
caccagaccuacuaucuua

SEQ ID NO: 1511936 - RNA, 19 nt, Homo sapiens
guacaggaaugaacuuauu

SEQ ID NO: 1511937 - RNA, 19 nt, Homo sapiens
gaagagguccagaaugaua

SEQ ID NO: 1511938 - RNA, 19 nt, Homo sapiens
ucacuggacugguuugaua

SEQ ID NO: 1511939 - RNA, 19 nt, Homo sapiens
gaacaagcaaggagucaua

SEQ ID NO: 1511940 - RNA, 19 nt, Homo sapiens
gacaugaacucucuuaaca

SEQ ID NO: 1511941 - RNA, 19 nt, Homo sapiens
gaggaaugcugcuucuaaa

SEQ ID NO: 1511942 - RNA, 19 nt, Homo sapiens
gaaauugcacuuaaccaaa

SEQ ID NO: 1511943 - RNA, 19 nt, Homo sapiens
ccaaguacauccuuaaaca

SEQ ID NO: 1511944 - RNA, 19 nt, Homo sapiens
ggaaugcugcuucuaaauu

SEQ ID NO: 1511945 - RNA, 19 nt, Homo sapiens
ugaacucucuuaacaugua

SEQ ID NO: 1511946 - RNA, 19 nt, Homo sapiens
ggaggaaugcugcuucuaa

SEQ ID NO: 1511947 - RNA, 19 nt, Homo sapiens
guuauaaggugguacauuc

SEQ ID NO: 1511948 - RNA, 19 nt, Homo sapiens
gagcagcauugccaagaaa

SEQ ID NO: 1511949 - RNA, 19 nt, Homo sapiens
gcacaaauuuuaacuguug

SEQ ID NO: 1511950 - RNA, 19 nt, Homo sapiens
ggauacagaugugugguuu

SEQ ID NO: 1511951 - RNA, 19 nt, Homo sapiens
gcagauggaggacagauuu

SEQ ID NO: 1511952 - RNA, 19 nt, Homo sapiens
gaucgugucuucaagcaau

SEQ ID NO: 1511953 - RNA, 19 nt, Homo sapiens
gcgauucacuucagucaug

SEQ ID NO: 1511954 - RNA, 19 nt, Homo sapiens
caaaguaguauguacauga

SEQ ID NO: 1511955 - RNA, 19 nt, Homo sapiens
uaaauucuguggaugaugu

SEQ ID NO: 1511956 - RNA, 19 nt, Homo sapiens
caaccugccuucagucuuc

SEQ ID NO: 1511957 - RNA, 19 nt, Homo sapiens
cuaaggguauuuauaguug

SEQ ID NO: 1511958 - RNA, 19 nt, Homo sapiens
gcaccgacauauguuugua

SEQ ID NO: 1511959 - RNA, 19 nt, Homo sapiens
caacaaaguuagacugacu

SEQ ID NO: 1511960 - RNA, 19 nt, Homo sapiens
gacaagugcaacaaaguua

SEQ ID NO: 1511961 - RNA, 19 nt, Homo sapiens
guacaugaaauugcacuua

SEQ ID NO: 1511962 - RNA, 19 nt, Homo sapiens
gaauuaggauacagaugug

SEQ ID NO: 1511963 - RNA, 19 nt, Homo sapiens
gaccuacuaucuuauuguu

SEQ ID NO: 1511964 - RNA, 19 nt, Homo sapiens
uuacauggaucgugucuuc

SEQ ID NO: 1511965 - RNA, 19 nt, Homo sapiens
ggacagacccugcuuagac

SEQ ID NO: 1511966 - RNA, 19 nt, Homo sapiens
ccaguauugugucuaaauu

SEQ ID NO: 1511967 - RNA, 19 nt, Homo sapiens
gauaagcgauucacuucag

SEQ ID NO: 1511968 - RNA, 19 nt, Homo sapiens
ggacugguuugauaaugau

SEQ ID NO: 1511969 - RNA, 19 nt, Homo sapiens
gcaaauaagccagcagaug

SEQ ID NO: 1511970 - RNA, 19 nt, Homo sapiens
ggccaagacaguccacuua

SEQ ID NO: 1511971 - RNA, 19 nt, Homo sapiens
gccaaggacuuauuguugu

SEQ ID NO: 1511972 - RNA, 19 nt, Homo sapiens
guacauccuuaaacaaagu

SEQ ID NO: 1511973 - RNA, 19 nt, Homo sapiens
cagcuuagugcacaaauuu

SEQ ID NO: 1511974 - RNA, 19 nt, Homo sapiens
guuaauaagcaccgacaua

SEQ ID NO: 1511975 - RNA, 19 nt, Homo sapiens
caagcaaggagucauauau

SEQ ID NO: 1511976 - RNA, 19 nt, Homo sapiens
gagggaaucuggccaagac

SEQ ID NO: 1511977 - RNA, 19 nt, Homo sapiens
cuucauaugauccaucuua

SEQ ID NO: 1511978 - RNA, 19 nt, Homo sapiens
gauggcagcugcaacuuuu

SEQ ID NO: 1511979 - RNA, 19 nt, Homo sapiens
guacauuccuaaggguauu

SEQ ID NO: 1511980 - RNA, 19 nt, Homo sapiens
ugccuucagucuucaguua

SEQ ID NO: 1511981 - RNA, 19 nt, Homo sapiens
gcuuagaccuuucaucacu

SEQ ID NO: 1511982 - RNA, 19 nt, Homo sapiens
aaagacaagugcaacaaag

SEQ ID NO: 1511983 - RNA, 19 nt, Homo sapiens
gauuguuacuuacguagau

SEQ ID NO: 1511984 - RNA, 19 nt, Homo sapiens
ccaagacaguccacuuaca

SEQ ID NO: 1511985 - RNA, 19 nt, Homo sapiens
ggggugggcuuaucccuua

SEQ ID NO: 1511986 - RNA, 19 nt, Homo sapiens
ggagacaguuauucaccau

SEQ ID NO: 1511987 - RNA, 19 nt, Homo sapiens
gaagacuuggagacaguua

SEQ ID NO: 1511988 - RNA, 19 nt, Homo sapiens
guauguacaugaaauugca

SEQ ID NO: 1511989 - RNA, 19 nt, Homo sapiens
gacaguuauucaccaugua

SEQ ID NO: 1511990 - RNA, 19 nt, Homo sapiens
ggacaugaacucucuuaac

SEQ ID NO: 1511991 - RNA, 19 nt, Homo sapiens
aguaggaauuccaguauug

SEQ ID NO: 1511992 - RNA, 19 nt, Homo sapiens
cuaaauccaucagagaguu

SEQ ID NO: 1511993 - RNA, 19 nt, Homo sapiens
ggacuuauuguugugcuaa

SEQ ID NO: 1511994 - RNA, 19 nt, Homo sapiens
gcaccagaccuacuaucuu

SEQ ID NO: 1511995 - RNA, 19 nt, Homo sapiens
cauaugauccaucuuagug

SEQ ID NO: 1511996 - RNA, 19 nt, Homo sapiens
agacugacuucuauaugug

SEQ ID NO: 1511997 - RNA, 19 nt, Homo sapiens
ccaaggacuuauuguugug

SEQ ID NO: 1511998 - RNA, 19 nt, Homo sapiens
gaccuuucaucacuucgaa

SEQ ID NO: 1511999 - RNA, 19 nt, Homo sapiens
ucacuucagucauguuugg

SEQ ID NO: 1512000 - RNA, 19 nt, Homo sapiens
aauaagcaccgacauaugu

SEQ ID NO: 1512001 - RNA, 19 nt, Homo sapiens
agacaguuauucaccaugu

SEQ ID NO: 1512002 - RNA, 19 nt, Homo sapiens
uaugauccaucuuagugaa

SEQ ID NO: 1512003 - RNA, 19 nt, Homo sapiens
gcacuuaaccaaaacuauu

SEQ ID NO: 1512004 - RNA, 19 nt, Homo sapiens
gaacucucuuaacauguag

SEQ ID NO: 1512005 - RNA, 19 nt, Homo sapiens
caguaggaauuccaguauu

SEQ ID NO: 1512006 - RNA, 19 nt, Homo sapiens
ggagucauauauccuucau

SEQ ID NO: 1512007 - RNA, 19 nt, Homo sapiens
uggacugguuugauaauga

SEQ ID NO: 1512008 - RNA, 19 nt, Homo sapiens
ugaaauugcacuuaaccaa

SEQ ID NO: 1512009 - RNA, 19 nt, Homo sapiens
gguccagaaugauaugcaa

SEQ ID NO: 1512010 - RNA, 19 nt, Homo sapiens
cuucagucauguuuggaua

SEQ ID NO: 1512011 - RNA, 19 nt, Homo sapiens
agaauuaggauacagaugu

SEQ ID NO: 1512012 - RNA, 19 nt, Homo sapiens
gguccuuacuucuuaugga

SEQ ID NO: 1512013 - RNA, 19 nt, Homo sapiens
gauaccaaacaauugauga

SEQ ID NO: 1512014 - RNA, 19 nt, Homo sapiens
gaagaauuaggauacagau

SEQ ID NO: 1512015 - RNA, 19 nt, Homo sapiens
agauuucacuggacugguu

SEQ ID NO: 1512016 - RNA, 19 nt, Homo sapiens
ggguauuuauaguugauga

SEQ ID NO: 1512017 - RNA, 19 nt, Homo sapiens
ugagcagcauugccaagaa

SEQ ID NO: 1512018 - RNA, 19 nt, Homo sapiens
cuuugguccuuacuucuua

SEQ ID NO: 1512019 - RNA, 19 nt, Homo sapiens
uuaauaagcaccgacauau

SEQ ID NO: 1512020 - RNA, 19 nt, Homo sapiens
ccauggaccugcggauguu

SEQ ID NO: 1512021 - RNA, 19 nt, Homo sapiens
ccagaccuacuaucuuauu

SEQ ID NO: 1512022 - RNA, 19 nt, Homo sapiens
caaguacauccuuaaacaa

SEQ ID NO: 1512023 - RNA, 19 nt, Homo sapiens
ucagcuuagugcacaaauu

SEQ ID NO: 1512024 - RNA, 19 nt, Homo sapiens
caagacaguccacuuacau

SEQ ID NO: 1512025 - RNA, 19 nt, Homo sapiens
aauacaacgugcuaaaucu

SEQ ID NO: 1512026 - RNA, 19 nt, Homo sapiens
uaaggugguacauuccuaa

SEQ ID NO: 1512027 - RNA, 19 nt, Homo sapiens
gaauuccaguauugugucu

SEQ ID NO: 1512028 - RNA, 19 nt, Homo sapiens
ucgcuuaugccuucuacua

SEQ ID NO: 1512029 - RNA, 19 nt, Homo sapiens
gaggacagacccugcuuag

SEQ ID NO: 1512030 - RNA, 19 nt, Homo sapiens
agacaagugcaacaaaguu

SEQ ID NO: 1512031 - RNA, 19 nt, Homo sapiens
cuuaacauguaguucuuug

SEQ ID NO: 1512032 - RNA, 19 nt, Homo sapiens
gcaaucagccacuucuuua

SEQ ID NO: 1512033 - RNA, 19 nt, Homo sapiens
ggccaaaucucacuaaaug

SEQ ID NO: 1512034 - RNA, 19 nt, Homo sapiens
cggaagcugugcaguauua

SEQ ID NO: 1512035 - RNA, 19 nt, Homo sapiens
gaaccacugucucugauca

SEQ ID NO: 1512036 - RNA, 19 nt, Homo sapiens
gagaaggaccgcacucuga

SEQ ID NO: 1512037 - RNA, 19 nt, Homo sapiens
ggaggacaguuacgaaauc

SEQ ID NO: 1512038 - RNA, 19 nt, Homo sapiens
aagaagagcuggcguccaa

SEQ ID NO: 1512039 - RNA, 19 nt, Homo sapiens
cggcacaucuuccucauca

SEQ ID NO: 1512040 - RNA, 19 nt, Homo sapiens
ggcaggaggaggacaguua

SEQ ID NO: 1512041 - RNA, 19 nt, Homo sapiens
ggacaguuacgaaaucuuc

SEQ ID NO: 1512042 - RNA, 19 nt, Homo sapiens
cagaaggguuggccaaauc

SEQ ID NO: 1512043 - RNA, 19 nt, Homo sapiens
ccauagagaccaccgauau

SEQ ID NO: 1512044 - RNA, 19 nt, Homo sapiens
gccggaagcugugcaguau

SEQ ID NO: 1512045 - RNA, 19 nt, Homo sapiens
ggagcaggcugaacucacu

SEQ ID NO: 1512046 - RNA, 19 nt, Homo sapiens
guccugaccucuuucacuu

SEQ ID NO: 1512047 - RNA, 19 nt, Homo sapiens
gaggaggacaguuacgaaa

SEQ ID NO: 1512048 - RNA, 19 nt, Homo sapiens
caagcuggaccacuacaaa

SEQ ID NO: 1512049 - RNA, 19 nt, Homo sapiens
ggaagaggaacguggaauc

SEQ ID NO: 1512050 - RNA, 19 nt, Homo sapiens
ccaggcgucugcaaaguca

SEQ ID NO: 1512051 - RNA, 19 nt, Homo sapiens
ggaggaggacaguuacgaa

SEQ ID NO: 1512052 - RNA, 19 nt, Homo sapiens
caucaggcauucccaguac

SEQ ID NO: 1512053 - RNA, 19 nt, Homo sapiens
ucagaaggguuggccaaau

SEQ ID NO: 1512054 - RNA, 19 nt, Homo sapiens
gaagaggaacguggaaucu

SEQ ID NO: 1512055 - RNA, 19 nt, Homo sapiens
agggccagcucuacgguua

SEQ ID NO: 1512056 - RNA, 19 nt, Homo sapiens
ccaaaucucacuaaaugca

SEQ ID NO: 1512057 - RNA, 19 nt, Homo sapiens
caaucagccacuucuuuaa

SEQ ID NO: 1512058 - RNA, 19 nt, Homo sapiens
ucucagcaccacagaauga

SEQ ID NO: 1512059 - RNA, 19 nt, Homo sapiens
guuacgaaaucuucaucug

SEQ ID NO: 1512060 - RNA, 19 nt, Homo sapiens
gaggacaguuacgaaaucu

SEQ ID NO: 1512061 - RNA, 19 nt, Homo sapiens
gcaaagucagcacagaucu

SEQ ID NO: 1512062 - RNA, 19 nt, Homo sapiens
caaaucucacuaaaugcaa

SEQ ID NO: 1512063 - RNA, 19 nt, Homo sapiens
ucagccacuucuuuaagga

SEQ ID NO: 1512064 - RNA, 19 nt, Homo sapiens
ugcaaucagccacuucuuu

SEQ ID NO: 1512065 - RNA, 19 nt, Homo sapiens
caacgucauccgcuacauc

SEQ ID NO: 1512066 - RNA, 19 nt, Homo sapiens
uuacgaaaucuucaucugu

SEQ ID NO: 1512067 - RNA, 19 nt, Homo sapiens
caacugggacaggcgagaa

SEQ ID NO: 1512068 - RNA, 19 nt, Homo sapiens
gagaccaccgauaucauca

SEQ ID NO: 1512069 - RNA, 19 nt, Homo sapiens
ucaucaggcauucccagua

SEQ ID NO: 1512070 - RNA, 19 nt, Homo sapiens
ggccagcucuacgguuaca

SEQ ID NO: 1512071 - RNA, 19 nt, Homo sapiens
gccauagagaccaccgaua

SEQ ID NO: 1512072 - RNA, 19 nt, Homo sapiens
gcaggaggaggacaguuac

SEQ ID NO: 1512073 - RNA, 19 nt, Homo sapiens
caaagucagcacagaucug

SEQ ID NO: 1512074 - RNA, 19 nt, Homo sapiens
gcuugggguugaaguuuaa

SEQ ID NO: 1512075 - RNA, 19 nt, Homo sapiens
cauagagaccaccgauauc

SEQ ID NO: 1512076 - RNA, 19 nt, Homo sapiens
gcacaccgccaacguaguc

SEQ ID NO: 1512077 - RNA, 19 nt, Homo sapiens
gggcgugaguuucuuagca

SEQ ID NO: 1512078 - RNA, 19 nt, Homo sapiens
gcgcacagcaguccuccuu

SEQ ID NO: 1512079 - RNA, 19 nt, Homo sapiens
caucgacgacgccuacaug

SEQ ID NO: 1512080 - RNA, 19 nt, Homo sapiens
cgcgacagcuggagcaagu

SEQ ID NO: 1512081 - RNA, 19 nt, Homo sapiens
ggugggcgugaguuucuua

SEQ ID NO: 1512082 - RNA, 19 nt, Homo sapiens
agaugcugcucauguggaa

SEQ ID NO: 1512083 - RNA, 19 nt, Homo sapiens
ccgcuuacccgguguacug

SEQ ID NO: 1512084 - RNA, 19 nt, Homo sapiens
acgagaugcugcucaugug

SEQ ID NO: 1512085 - RNA, 19 nt, Homo sapiens
ccuacgagaugcugcucau

SEQ ID NO: 1512086 - RNA, 19 nt, Homo sapiens
guagacagccauuaaauua

SEQ ID NO: 1512087 - RNA, 19 nt, Homo sapiens
gaauauuacugcuuuguga

SEQ ID NO: 1512088 - RNA, 19 nt, Homo sapiens
gcuaagcaguuauuucuuu

SEQ ID NO: 1512089 - RNA, 19 nt, Homo sapiens
gaaaucugcugcuagaaau

SEQ ID NO: 1512090 - RNA, 19 nt, Homo sapiens
cauaaccucuguacauaaa

SEQ ID NO: 1512091 - RNA, 19 nt, Homo sapiens
ggaaaucugcugcuagaaa

SEQ ID NO: 1512092 - RNA, 19 nt, Homo sapiens
ugauagugcuuuagaauga

SEQ ID NO: 1512093 - RNA, 19 nt, Homo sapiens
uaugcucccuggaauauua

SEQ ID NO: 1512094 - RNA, 19 nt, Homo sapiens
agaaaugucugaacuaagu

SEQ ID NO: 1512095 - RNA, 19 nt, Homo sapiens
ucagugacauuucauaguu

SEQ ID NO: 1512096 - RNA, 19 nt, Homo sapiens
cuagaaaugucugaacuaa

SEQ ID NO: 1512097 - RNA, 19 nt, Homo sapiens
gcaguuauuucuuucaagu

SEQ ID NO: 1512098 - RNA, 19 nt, Homo sapiens
gaagagccaguaaccagua

SEQ ID NO: 1512099 - RNA, 19 nt, Homo sapiens
ggucagcuguguaugauca

SEQ ID NO: 1512100 - RNA, 19 nt, Homo sapiens
aaagguaacuucaccaaag

SEQ ID NO: 1512101 - RNA, 19 nt, Homo sapiens
aaacauaaccucuguacau

SEQ ID NO: 1512102 - RNA, 19 nt, Homo sapiens
gauaacgaauagaagcaaa

SEQ ID NO: 1512103 - RNA, 19 nt, Homo sapiens
gaaggaagauuuggaucca

SEQ ID NO: 1512104 - RNA, 19 nt, Homo sapiens
gcaaaacgauuggcuacua

SEQ ID NO: 1512105 - RNA, 19 nt, Homo sapiens
aacauaaccucuguacaua

SEQ ID NO: 1512106 - RNA, 19 nt, Homo sapiens
cauaguagacagccauuaa

SEQ ID NO: 1512107 - RNA, 19 nt, Homo sapiens
ucaaacauaagcugagaua

SEQ ID NO: 1512108 - RNA, 19 nt, Homo sapiens
aaaccugggucucucacua

SEQ ID NO: 1512109 - RNA, 19 nt, Homo sapiens
caucuucugugcucuuuau

SEQ ID NO: 1512110 - RNA, 19 nt, Homo sapiens
ccuggaauauuacugcuuu

SEQ ID NO: 1512111 - RNA, 19 nt, Homo sapiens
ccuaggacuuguuguuaaa

SEQ ID NO: 1512112 - RNA, 19 nt, Homo sapiens
aagcugagauaacgaauag

SEQ ID NO: 1512113 - RNA, 19 nt, Homo sapiens
uuaaggcaauugcauaugu

SEQ ID NO: 1512114 - RNA, 19 nt, Homo sapiens
gcaaugguaaauuaaguug

SEQ ID NO: 1512115 - RNA, 19 nt, Homo sapiens
gagcuagggcuaagcaguu

SEQ ID NO: 1512116 - RNA, 19 nt, Homo sapiens
uaaggcaauugcauauguu

SEQ ID NO: 1512117 - RNA, 19 nt, Homo sapiens
gcugagauaacgaauagaa

SEQ ID NO: 1512118 - RNA, 19 nt, Homo sapiens
gcuuguauuugaugauaga

SEQ ID NO: 1512119 - RNA, 19 nt, Homo sapiens
gggcuaagcaguuauuucu

SEQ ID NO: 1512120 - RNA, 19 nt, Homo sapiens
gguucaagauaacucugua

SEQ ID NO: 1512121 - RNA, 19 nt, Homo sapiens
ggaaacauaaccucuguac

SEQ ID NO: 1512122 - RNA, 19 nt, Homo sapiens
acuaugaaauuccugauuc

SEQ ID NO: 1512123 - RNA, 19 nt, Homo sapiens
gguaagauuugggaaacau

SEQ ID NO: 1512124 - RNA, 19 nt, Homo sapiens
gcuagaaaugucugaacua

SEQ ID NO: 1512125 - RNA, 19 nt, Homo sapiens
guuaggagaaugugccuuu

SEQ ID NO: 1512126 - RNA, 19 nt, Homo sapiens
uguccuuccuuuauacuaa

SEQ ID NO: 1512127 - RNA, 19 nt, Homo sapiens
gaauuaugccugaaaucug

SEQ ID NO: 1512128 - RNA, 19 nt, Homo sapiens
ugagaauuaugccugaaau

SEQ ID NO: 1512129 - RNA, 19 nt, Homo sapiens
gaaaucuggcaaaccgaaa

SEQ ID NO: 1512130 - RNA, 19 nt, Homo sapiens
ugccagugguaacuuauuu

SEQ ID NO: 1512131 - RNA, 19 nt, Homo sapiens
cagugacauuucauaguuu

SEQ ID NO: 1512132 - RNA, 19 nt, Homo sapiens
aaacauaagcugagauaac

SEQ ID NO: 1512133 - RNA, 19 nt, Homo sapiens
guucuaugcucccuggaau

SEQ ID NO: 1512134 - RNA, 19 nt, Homo sapiens
guguucaaguguaaagaaa

SEQ ID NO: 1512135 - RNA, 19 nt, Homo sapiens
ggaauauuacugcuuugug

SEQ ID NO: 1512136 - RNA, 19 nt, Homo sapiens
gcucugagaaguguagauu

SEQ ID NO: 1512137 - RNA, 19 nt, Homo sapiens
aagguaacuucaccaaaga

SEQ ID NO: 1512138 - RNA, 19 nt, Homo sapiens
cgacggccauuaccaaucg

SEQ ID NO: 1512139 - RNA, 19 nt, Homo sapiens
guaagauuugggaaacaua

SEQ ID NO: 1512140 - RNA, 19 nt, Homo sapiens
ugaacuaagugccauacuc

SEQ ID NO: 1512141 - RNA, 19 nt, Homo sapiens
agacagaaauuugauagcu

SEQ ID NO: 1512142 - RNA, 19 nt, Homo sapiens
cuaagcaguuauuucuuuc

SEQ ID NO: 1512143 - RNA, 19 nt, Homo sapiens
uaagcugagauaacgaaua

SEQ ID NO: 1512144 - RNA, 19 nt, Homo sapiens
uaaagguaacuucaccaaa

SEQ ID NO: 1512145 - RNA, 19 nt, Homo sapiens
uccuaggacuuguuguuaa

SEQ ID NO: 1512146 - RNA, 19 nt, Homo sapiens
ggggaaaucugcugcuaga

SEQ ID NO: 1512147 - RNA, 19 nt, Homo sapiens
accaguagcuccaacuugu

SEQ ID NO: 1512148 - RNA, 19 nt, Homo sapiens
cugggucucucacuacuug

SEQ ID NO: 1512149 - RNA, 19 nt, Homo sapiens
guacauuugaucagauugu

SEQ ID NO: 1512150 - RNA, 19 nt, Homo sapiens
cauaagcugagauaacgaa

SEQ ID NO: 1512151 - RNA, 19 nt, Homo sapiens
ggcaauugcauauguuuua

SEQ ID NO: 1512152 - RNA, 19 nt, Homo sapiens
gaacuguacauuugaucag

SEQ ID NO: 1512153 - RNA, 19 nt, Homo sapiens
gccauacucgucuggguaa

SEQ ID NO: 1512154 - RNA, 19 nt, Homo sapiens
ggucucucacuacuugaua

SEQ ID NO: 1512155 - RNA, 19 nt, Homo sapiens
uugaucagauuguuagcuu

SEQ ID NO: 1512156 - RNA, 19 nt, Homo sapiens
gagauaacgaauagaagca

SEQ ID NO: 1512157 - RNA, 19 nt, Homo sapiens
uuuguccgguucaagauaa

SEQ ID NO: 1512158 - RNA, 19 nt, Homo sapiens
ugggaaacauaaccucugu

SEQ ID NO: 1512159 - RNA, 19 nt, Homo sapiens
cagagucuauuuucuuuug

SEQ ID NO: 1512160 - RNA, 19 nt, Homo sapiens
gcaugaaggaagauuugga

SEQ ID NO: 1512161 - RNA, 19 nt, Homo sapiens
ggcaaaagcuaaaaguaag

SEQ ID NO: 1512162 - RNA, 19 nt, Homo sapiens
gguaaauuaaguugucuuc

SEQ ID NO: 1512163 - RNA, 19 nt, Homo sapiens
caacuugucucagcaucac

SEQ ID NO: 1512164 - RNA, 19 nt, Homo sapiens
gaauagaagcaaaacgauu

SEQ ID NO: 1512165 - RNA, 19 nt, Homo sapiens
aaacaucacauaguagaca

SEQ ID NO: 1512166 - RNA, 19 nt, Homo sapiens
gaaacauaaccucuguaca

SEQ ID NO: 1512167 - RNA, 19 nt, Homo sapiens
uuugauagcucgguuagag

SEQ ID NO: 1512168 - RNA, 19 nt, Homo sapiens
gaucagauuguuagcuuuu

SEQ ID NO: 1512169 - RNA, 19 nt, Homo sapiens
ugaucagauuguuagcuuu

SEQ ID NO: 1512170 - RNA, 19 nt, Homo sapiens
guaguuuucuuuccuagga

SEQ ID NO: 1512171 - RNA, 19 nt, Homo sapiens
ucaguuaaacaucacauag

SEQ ID NO: 1512172 - RNA, 19 nt, Homo sapiens
acauaaccucuguacauaa

SEQ ID NO: 1512173 - RNA, 19 nt, Homo sapiens
cuucaaacauaagcugaga

SEQ ID NO: 1512174 - RNA, 19 nt, Homo sapiens
gugccacacuuuacaucau

SEQ ID NO: 1512175 - RNA, 19 nt, Homo sapiens
ucuauaugaucaagagagu

SEQ ID NO: 1512176 - RNA, 19 nt, Homo sapiens
aguagacagccauuaaauu

SEQ ID NO: 1512177 - RNA, 19 nt, Homo sapiens
gaaaugucugaacuaagug

SEQ ID NO: 1512178 - RNA, 19 nt, Homo sapiens
gccauuaccaaucgcgaaa

SEQ ID NO: 1512179 - RNA, 19 nt, Homo sapiens
gauagugcuuuagaaugag

SEQ ID NO: 1512180 - RNA, 19 nt, Homo sapiens
agcuguguaugaucaguua

SEQ ID NO: 1512181 - RNA, 19 nt, Homo sapiens
acacuuuacaucaucacua

SEQ ID NO: 1512182 - RNA, 19 nt, Homo sapiens
aacauaagcugagauaacg

SEQ ID NO: 1512183 - RNA, 19 nt, Homo sapiens
uugcauuaguuaagacaga

SEQ ID NO: 1512184 - RNA, 19 nt, Homo sapiens
gagaauuaugccugaaauc

SEQ ID NO: 1512185 - RNA, 19 nt, Homo sapiens
aagcaugaaggaagauuug

SEQ ID NO: 1512186 - RNA, 19 nt, Homo sapiens
gaagugacccuuuguguaa

SEQ ID NO: 1512187 - RNA, 19 nt, Homo sapiens
ggaagugacccuuugugua

SEQ ID NO: 1512188 - RNA, 19 nt, Homo sapiens
uaugaagucucgacccuaa

SEQ ID NO: 1512189 - RNA, 19 nt, Homo sapiens
ccgcagaaaugauuccaaa

SEQ ID NO: 1512190 - RNA, 19 nt, Homo sapiens
gggaggaagugacccuuug

SEQ ID NO: 1512191 - RNA, 19 nt, Homo sapiens
ccuagaugcuguuguuuga

SEQ ID NO: 1512192 - RNA, 19 nt, Homo sapiens
ugaaagcuccgcagaaaug

SEQ ID NO: 1512193 - RNA, 19 nt, Homo sapiens
cuugaaagcuccgcagaaa

SEQ ID NO: 1512194 - RNA, 19 nt, Homo sapiens
ccacuccccugcuuaauaa

SEQ ID NO: 1512195 - RNA, 19 nt, Homo sapiens
aauccuagaugcuguuguu

SEQ ID NO: 1512196 - RNA, 19 nt, Homo sapiens
uagaugcuguuguuugaau

SEQ ID NO: 1512197 - RNA, 19 nt, Homo sapiens
acaggaauccagagaguuu

SEQ ID NO: 1512198 - RNA, 19 nt, Homo sapiens
gaaagcuccgcagaaauga

SEQ ID NO: 1512199 - RNA, 19 nt, Homo sapiens
uuacaggaauccagagagu

SEQ ID NO: 1512200 - RNA, 19 nt, Homo sapiens
gaacccggugguacccaua

SEQ ID NO: 1512201 - RNA, 19 nt, Homo sapiens
gacccuuuguguaacugua

SEQ ID NO: 1512202 - RNA, 19 nt, Homo sapiens
gaaaaguucguucgcaaga

SEQ ID NO: 1512203 - RNA, 19 nt, Homo sapiens
cgaagccuccagucauuga

SEQ ID NO: 1512204 - RNA, 19 nt, Homo sapiens
caucgaagccuccagucau

SEQ ID NO: 1512205 - RNA, 19 nt, Homo sapiens
ggaggaagugacccuuugu

SEQ ID NO: 1512206 - RNA, 19 nt, Homo sapiens
ggcccuaccgugggacuua

SEQ ID NO: 1512207 - RNA, 19 nt, Homo sapiens
ccagcgcucucagcucaug

SEQ ID NO: 1512208 - RNA, 19 nt, Homo sapiens
ccuacggccucuacuccuu

SEQ ID NO: 1512209 - RNA, 19 nt, Homo sapiens
gcuguuguuugaauguuac

SEQ ID NO: 1512210 - RNA, 19 nt, Homo sapiens
uccagagaguuucaaggaa

SEQ ID NO: 1512211 - RNA, 19 nt, Homo sapiens
ugcuguuguuugaauguua

SEQ ID NO: 1512212 - RNA, 19 nt, Homo sapiens
aagcuccgcagaaaugauu

SEQ ID NO: 1512213 - RNA, 19 nt, Homo sapiens
gaggaagugacccuuugug

SEQ ID NO: 1512214 - RNA, 19 nt, Homo sapiens
ggcugucacugcuaugaag

SEQ ID NO: 1512215 - RNA, 19 nt, Homo sapiens
ccugcuuaauaaacucuaa

SEQ ID NO: 1512216 - RNA, 19 nt, Homo sapiens
aucgaagccuccagucauu

SEQ ID NO: 1512217 - RNA, 19 nt, Homo sapiens
gcaacagccagcgcucuca

SEQ ID NO: 1512218 - RNA, 19 nt, Homo sapiens
guacaaaggaccagaguua

SEQ ID NO: 1512219 - RNA, 19 nt, Homo sapiens
cagcaugguucauaaauuu

SEQ ID NO: 1512220 - RNA, 19 nt, Homo sapiens
ggaccagaguuauauauau

SEQ ID NO: 1512221 - RNA, 19 nt, Homo sapiens
gcagagggcaugucaguaa

SEQ ID NO: 1512222 - RNA, 19 nt, Homo sapiens
guaacugagugaaccauaa

SEQ ID NO: 1512223 - RNA, 19 nt, Homo sapiens
guuaugagcuggaacuguu

SEQ ID NO: 1512224 - RNA, 19 nt, Homo sapiens
gauguuaccuccaaucagu

SEQ ID NO: 1512225 - RNA, 19 nt, Homo sapiens
gaacaacuucccaccauug

SEQ ID NO: 1512226 - RNA, 19 nt, Homo sapiens
ggagagaaccaguaugaga

SEQ ID NO: 1512227 - RNA, 19 nt, Homo sapiens
gggcacacauucaucuuug

SEQ ID NO: 1512228 - RNA, 19 nt, Homo sapiens
gggaggcucucuggcuuua

SEQ ID NO: 1512229 - RNA, 19 nt, Homo sapiens
agcaguagcuguucuguuu

SEQ ID NO: 1512230 - RNA, 19 nt, Homo sapiens
ggugcuagauguguguuua

SEQ ID NO: 1512231 - RNA, 19 nt, Homo sapiens
gagagaaccaguaugagaa

SEQ ID NO: 1512232 - RNA, 19 nt, Homo sapiens
caaaggaccagaguuauau

SEQ ID NO: 1512233 - RNA, 19 nt, Homo sapiens
gaagccauguuucuaccaa

SEQ ID NO: 1512234 - RNA, 19 nt, Homo sapiens
gcacacauucaucuuugua

SEQ ID NO: 1512235 - RNA, 19 nt, Homo sapiens
ggaacuguuucuacuuuca

SEQ ID NO: 1512236 - RNA, 19 nt, Homo sapiens
acaaaggaccagaguuaua

SEQ ID NO: 1512237 - RNA, 19 nt, Homo sapiens
uagcauccaugaccuguug

SEQ ID NO: 1512238 - RNA, 19 nt, Homo sapiens
gauauucccuugcucuuuu

SEQ ID NO: 1512239 - RNA, 19 nt, Homo sapiens
gggcaugucaguaaugauu

SEQ ID NO: 1512240 - RNA, 19 nt, Homo sapiens
gagggcaugucaguaauga

SEQ ID NO: 1512241 - RNA, 19 nt, Homo sapiens
ggaacucccuaccacuuuc

SEQ ID NO: 1512242 - RNA, 19 nt, Homo sapiens
caagccacaucgucauuug

SEQ ID NO: 1512243 - RNA, 19 nt, Homo sapiens
caaagagcaucugcccauu

SEQ ID NO: 1512244 - RNA, 19 nt, Homo sapiens
caugaccuguuggauguua

SEQ ID NO: 1512245 - RNA, 19 nt, Homo sapiens
gggcaguugucagauguaa

SEQ ID NO: 1512246 - RNA, 19 nt, Homo sapiens
ugaaucagccucagacuca

SEQ ID NO: 1512247 - RNA, 19 nt, Homo sapiens
ucagcaugguucauaaauu

SEQ ID NO: 1512248 - RNA, 19 nt, Homo sapiens
ugaccaagcgccucuacua

SEQ ID NO: 1512249 - RNA, 19 nt, Homo sapiens
ccaggcaacuaugcacuuu

SEQ ID NO: 1512250 - RNA, 19 nt, Homo sapiens
gagccaaugugucugucuu

SEQ ID NO: 1512251 - RNA, 19 nt, Homo sapiens
guacuccaaugagauguga

SEQ ID NO: 1512252 - RNA, 19 nt, Homo sapiens
cuggaacuguuucuacuuu

SEQ ID NO: 1512253 - RNA, 19 nt, Homo sapiens
caacuuuggccucgccuuu

SEQ ID NO: 1512254 - RNA, 19 nt, Homo sapiens
gaaugggauuucagguuag

SEQ ID NO: 1512255 - RNA, 19 nt, Homo sapiens
gagcagagggcaugucagu

SEQ ID NO: 1512256 - RNA, 19 nt, Homo sapiens
gcaguugucagauguaaag

SEQ ID NO: 1512257 - RNA, 19 nt, Homo sapiens
uaacaguacuuagcacucu

SEQ ID NO: 1512258 - RNA, 19 nt, Homo sapiens
gugaacaacuucccaccau

SEQ ID NO: 1512259 - RNA, 19 nt, Homo sapiens
ccaauuacacguacuccaa

SEQ ID NO: 1512260 - RNA, 19 nt, Homo sapiens
caaugugucugucuuuggu

SEQ ID NO: 1512261 - RNA, 19 nt, Homo sapiens
aagagcaucugcccauuuc

SEQ ID NO: 1512262 - RNA, 19 nt, Homo sapiens
ggauauucccuugcucuuu

SEQ ID NO: 1512263 - RNA, 19 nt, Homo sapiens
ugaacaacuucccaccauu

SEQ ID NO: 1512264 - RNA, 19 nt, Homo sapiens
gaacauuuggcccugugaa

SEQ ID NO: 1512265 - RNA, 19 nt, Homo sapiens
ggaccuauauggccaugcu

SEQ ID NO: 1512266 - RNA, 19 nt, Homo sapiens
uaacaucauggcagagaaa

SEQ ID NO: 1512267 - RNA, 19 nt, Homo sapiens
gucuaucucuuuccuaugu

SEQ ID NO: 1512268 - RNA, 19 nt, Homo sapiens
guaacaucauggcagagaa

SEQ ID NO: 1512269 - RNA, 19 nt, Homo sapiens
uuucauggcauucuucuuu

SEQ ID NO: 1512270 - RNA, 19 nt, Homo sapiens
ugacagcuccuucaguuuc

SEQ ID NO: 1512271 - RNA, 19 nt, Homo sapiens
acaaggccuucaagacuga

SEQ ID NO: 1512272 - RNA, 19 nt, Homo sapiens
gaggcucucuggcuuuagu

SEQ ID NO: 1512273 - RNA, 19 nt, Homo sapiens
guacaggccagggauauuc

SEQ ID NO: 1512274 - RNA, 19 nt, Homo sapiens
gcauucuucuuuaccuuca

SEQ ID NO: 1512275 - RNA, 19 nt, Homo sapiens
uguccuaccugccucuuug

SEQ ID NO: 1512276 - RNA, 19 nt, Homo sapiens
aaagagcaucugcccauuu

SEQ ID NO: 1512277 - RNA, 19 nt, Homo sapiens
acagugaggcauuuaggua

SEQ ID NO: 1512278 - RNA, 19 nt, Homo sapiens
gcugggcaguugucagaug

SEQ ID NO: 1512279 - RNA, 19 nt, Homo sapiens
uaucugcuccugagacuga

SEQ ID NO: 1512280 - RNA, 19 nt, Homo sapiens
ugagugaaccauaauaaag

SEQ ID NO: 1512281 - RNA, 19 nt, Homo sapiens
gcagagaaagugaacaacu

SEQ ID NO: 1512282 - RNA, 19 nt, Homo sapiens
gaaaagguaccuaggucua

SEQ ID NO: 1512283 - RNA, 19 nt, Homo sapiens
gacagcuccuucaguuuca

SEQ ID NO: 1512284 - RNA, 19 nt, Homo sapiens
gccaaugugucugucuuug

SEQ ID NO: 1512285 - RNA, 19 nt, Homo sapiens
gcugguuucggcccauuua

SEQ ID NO: 1512286 - RNA, 19 nt, Homo sapiens
gcaugucaguaaugauugg

SEQ ID NO: 1512287 - RNA, 19 nt, Homo sapiens
uucauggcauucuucuuua

SEQ ID NO: 1512288 - RNA, 19 nt, Homo sapiens
gguaacugagugaaccaua

SEQ ID NO: 1512289 - RNA, 19 nt, Homo sapiens
caagcacaauagccugaau

SEQ ID NO: 1512290 - RNA, 19 nt, Homo sapiens
cagagggcaugucaguaau

SEQ ID NO: 1512291 - RNA, 19 nt, Homo sapiens
gggacaugcugggcaguug

SEQ ID NO: 1512292 - RNA, 19 nt, Homo sapiens
gcccucagcaugguucaua

SEQ ID NO: 1512293 - RNA, 19 nt, Homo sapiens
uaacugagugaaccauaau

SEQ ID NO: 1512294 - RNA, 19 nt, Homo sapiens
caaucaguuuccuguccua

SEQ ID NO: 1512295 - RNA, 19 nt, Homo sapiens
ccagcacagugaggcauuu

SEQ ID NO: 1512296 - RNA, 19 nt, Homo sapiens
caguugcuguggcuugauu

SEQ ID NO: 1512297 - RNA, 19 nt, Homo sapiens
agacuucgaggcagauauu

SEQ ID NO: 1512298 - RNA, 19 nt, Homo sapiens
ugaugguccuuuagguuug

SEQ ID NO: 1512299 - RNA, 19 nt, Homo sapiens
ccuccucccucaucuguuc

SEQ ID NO: 1512300 - RNA, 19 nt, Homo sapiens
gcuccuacgucugcugguu

SEQ ID NO: 1512301 - RNA, 19 nt, Homo sapiens
gagugaaccauaauaaagg

SEQ ID NO: 1512302 - RNA, 19 nt, Homo sapiens
caucauggcagagaaagug

SEQ ID NO: 1512303 - RNA, 19 nt, Homo sapiens
caagcagugugagaacaug

SEQ ID NO: 1512304 - RNA, 19 nt, Homo sapiens
gagcuggaacuguuucuac

SEQ ID NO: 1512305 - RNA, 19 nt, Homo sapiens
gguaacaucauggcagaga

SEQ ID NO: 1512306 - RNA, 19 nt, Homo sapiens
gcagggcacacauucaucu

SEQ ID NO: 1512307 - RNA, 19 nt, Homo sapiens
gcacggagggaaggucaga

SEQ ID NO: 1512308 - RNA, 19 nt, Homo sapiens
aaaggaccagaguuauaua

SEQ ID NO: 1512309 - RNA, 19 nt, Homo sapiens
gcuaauucccacugucaug

SEQ ID NO: 1512310 - RNA, 19 nt, Homo sapiens
uuacaaggccuucaagacu

SEQ ID NO: 1512311 - RNA, 19 nt, Homo sapiens
ucuacuaccucuggauguu

SEQ ID NO: 1512312 - RNA, 19 nt, Homo sapiens
gaacucccuaccacuuuca

SEQ ID NO: 1512313 - RNA, 19 nt, Homo sapiens
gggcagggcacacauucau

SEQ ID NO: 1512314 - RNA, 19 nt, Homo sapiens
cugaugguccuuuagguuu

SEQ ID NO: 1512315 - RNA, 19 nt, Homo sapiens
acucagggcccaagcagaa

SEQ ID NO: 1512316 - RNA, 19 nt, Homo sapiens
gcacagugaggcauuuagg

SEQ ID NO: 1512317 - RNA, 19 nt, Homo sapiens
gcugucccgugcgguagua

SEQ ID NO: 1512318 - RNA, 19 nt, Homo sapiens
gaaauggcaugaaauauga

SEQ ID NO: 1512319 - RNA, 19 nt, Homo sapiens
gaaaggaacauguuugaau

SEQ ID NO: 1512320 - RNA, 19 nt, Homo sapiens
gaaacuugccuuagucuuu

SEQ ID NO: 1512321 - RNA, 19 nt, Homo sapiens
gcuaugaaauggcaugaaa

SEQ ID NO: 1512322 - RNA, 19 nt, Homo sapiens
uaaguaaucucaccagguu

SEQ ID NO: 1512323 - RNA, 19 nt, Homo sapiens
ugaacuuucuuuccuguuu

SEQ ID NO: 1512324 - RNA, 19 nt, Homo sapiens
caucuuugauugacugauu

SEQ ID NO: 1512325 - RNA, 19 nt, Homo sapiens
ugaaauggcaugaaauaug

SEQ ID NO: 1512326 - RNA, 19 nt, Homo sapiens
gcaaggaaaggaacauguu

SEQ ID NO: 1512327 - RNA, 19 nt, Homo sapiens
aauaugaucuucagggaau

SEQ ID NO: 1512328 - RNA, 19 nt, Homo sapiens
ucagauguguuccucaaug

SEQ ID NO: 1512329 - RNA, 19 nt, Homo sapiens
ggacaacuggcuaugaaau

SEQ ID NO: 1512330 - RNA, 19 nt, Homo sapiens
cagauguguuccucaauga

SEQ ID NO: 1512331 - RNA, 19 nt, Homo sapiens
augaaucacuugaagauga

SEQ ID NO: 1512332 - RNA, 19 nt, Homo sapiens
gcagacgccuguggauuca

SEQ ID NO: 1512333 - RNA, 19 nt, Homo sapiens
ugaaucacuugaagaugaa

SEQ ID NO: 1512334 - RNA, 19 nt, Homo sapiens
ccacaaguacauuggagua

SEQ ID NO: 1512335 - RNA, 19 nt, Homo sapiens
caaggaaaggaacauguuu

SEQ ID NO: 1512336 - RNA, 19 nt, Homo sapiens
gagaaaacuugcaaggaaa

SEQ ID NO: 1512337 - RNA, 19 nt, Homo sapiens
gcugaaacuugccuuaguc

SEQ ID NO: 1512338 - RNA, 19 nt, Homo sapiens
gucgaauucuuucaucuga

SEQ ID NO: 1512339 - RNA, 19 nt, Homo sapiens
caaugaaucacuugaagau

SEQ ID NO: 1512340 - RNA, 19 nt, Homo sapiens
gaacuuucuuuccuguuuu

SEQ ID NO: 1512341 - RNA, 19 nt, Homo sapiens
ggaaggggcucuuggucaa

SEQ ID NO: 1512342 - RNA, 19 nt, Homo sapiens
ggaaaggaacauguuugaa

SEQ ID NO: 1512343 - RNA, 19 nt, Homo sapiens
agagaaaacuugcaaggaa

SEQ ID NO: 1512344 - RNA, 19 nt, Homo sapiens
caggaaggaugcaauucug

SEQ ID NO: 1512345 - RNA, 19 nt, Homo sapiens
ccugguguaucaacugaaa

SEQ ID NO: 1512346 - RNA, 19 nt, Homo sapiens
uugauugacugauucuuug

SEQ ID NO: 1512347 - RNA, 19 nt, Homo sapiens
gacaacuggcuaugaaaug

SEQ ID NO: 1512348 - RNA, 19 nt, Homo sapiens
ugacugauucuuugacaau

SEQ ID NO: 1512349 - RNA, 19 nt, Homo sapiens
cuuagaagcuuugcagaag

SEQ ID NO: 1512350 - RNA, 19 nt, Homo sapiens
ggcaugaaauaugaucuuc

SEQ ID NO: 1512351 - RNA, 19 nt, Homo sapiens
gauguguuccucaaugaau

SEQ ID NO: 1512352 - RNA, 19 nt, Homo sapiens
uuggacaacuggcuaugaa

SEQ ID NO: 1512353 - RNA, 19 nt, Homo sapiens
ccacugggaacaacagguu

SEQ ID NO: 1512354 - RNA, 19 nt, Homo sapiens
ggaggcaagaauugaaguu

SEQ ID NO: 1512355 - RNA, 19 nt, Homo sapiens
acacaggaaggaugcaauu

SEQ ID NO: 1512356 - RNA, 19 nt, Homo sapiens
aaacuugccuuagucuuuu

SEQ ID NO: 1512357 - RNA, 19 nt, Homo sapiens
caucugaggaggcaagaau

SEQ ID NO: 1512358 - RNA, 19 nt, Homo sapiens
guuccucaaugaaucacuu

SEQ ID NO: 1512359 - RNA, 19 nt, Homo sapiens
uuucagauguguuccucaa

SEQ ID NO: 1512360 - RNA, 19 nt, Homo sapiens
ugacaaugacuaucuggau

SEQ ID NO: 1512361 - RNA, 19 nt, Homo sapiens
ggaguaaccacugggaaca

SEQ ID NO: 1512362 - RNA, 19 nt, Homo sapiens
gaucuucagggaauguuuc

SEQ ID NO: 1512363 - RNA, 19 nt, Homo sapiens
ucagucgaauucuuucauc

SEQ ID NO: 1512364 - RNA, 19 nt, Homo sapiens
ccacuccugugcugaaacu

SEQ ID NO: 1512365 - RNA, 19 nt, Homo sapiens
gaggcaagaauugaaguug

SEQ ID NO: 1512366 - RNA, 19 nt, Homo sapiens
aaacuugcaaggaaaggaa

SEQ ID NO: 1512367 - RNA, 19 nt, Homo sapiens
acaaugacuaucuggauga

SEQ ID NO: 1512368 - RNA, 19 nt, Homo sapiens
guguaucaacugaaacaaa

SEQ ID NO: 1512369 - RNA, 19 nt, Homo sapiens
acaacuggcuaugaaaugg

SEQ ID NO: 1512370 - RNA, 19 nt, Homo sapiens
cagguugccuuagaagcuu

SEQ ID NO: 1512371 - RNA, 19 nt, Homo sapiens
ggauucaccacaaguacau

SEQ ID NO: 1512372 - RNA, 19 nt, Homo sapiens
ccugaaaacucaacuucuu

SEQ ID NO: 1512373 - RNA, 19 nt, Homo sapiens
aggaacauguuugaauuuc

SEQ ID NO: 1512374 - RNA, 19 nt, Homo sapiens
aggaaaggaacauguuuga

SEQ ID NO: 1512375 - RNA, 19 nt, Homo sapiens
acugauucuuugacaauga

SEQ ID NO: 1512376 - RNA, 19 nt, Homo sapiens
ugagauauuccugguguau

SEQ ID NO: 1512377 - RNA, 19 nt, Homo sapiens
ugaggaggcaagaauugaa

SEQ ID NO: 1512378 - RNA, 19 nt, Homo sapiens
caacuucuucauuugagau

SEQ ID NO: 1512379 - RNA, 19 nt, Homo sapiens
gacugauucuuugacaaug

SEQ ID NO: 1512380 - RNA, 19 nt, Homo sapiens
caaguacauuggaguaacc

SEQ ID NO: 1512381 - RNA, 19 nt, Homo sapiens
ccuuagaagcuuugcagaa

SEQ ID NO: 1512382 - RNA, 19 nt, Homo sapiens
gaggaggcaagaauugaag

SEQ ID NO: 1512383 - RNA, 19 nt, Homo sapiens
acaaguacauuggaguaac

SEQ ID NO: 1512384 - RNA, 19 nt, Homo sapiens
cacaaguacauuggaguaa

SEQ ID NO: 1512385 - RNA, 19 nt, Homo sapiens
aaggaaaggaacauguuug

SEQ ID NO: 1512386 - RNA, 19 nt, Homo sapiens
gaacguugcuggugaaaua

SEQ ID NO: 1512387 - RNA, 19 nt, Homo sapiens
uaaaugggcuggcagauua

SEQ ID NO: 1512388 - RNA, 19 nt, Homo sapiens
gcacauuuauggacuuaua

SEQ ID NO: 1512389 - RNA, 19 nt, Homo sapiens
gaagaacguugcuggugaa

SEQ ID NO: 1512390 - RNA, 19 nt, Homo sapiens
caacaaugccggaaucgua

SEQ ID NO: 1512391 - RNA, 19 nt, Homo sapiens
ggaaugaggaaacauguaa

SEQ ID NO: 1512392 - RNA, 19 nt, Homo sapiens
uggcuaaggucaucugaua

SEQ ID NO: 1512393 - RNA, 19 nt, Homo sapiens
acacagcucuggauuucua

SEQ ID NO: 1512394 - RNA, 19 nt, Homo sapiens
gaagaggacauguggauau

SEQ ID NO: 1512395 - RNA, 19 nt, Homo sapiens
ggaaggaguguauagagua

SEQ ID NO: 1512396 - RNA, 19 nt, Homo sapiens
agaccaaacucuuaaauag

SEQ ID NO: 1512397 - RNA, 19 nt, Homo sapiens
gcugggaucuguucuuguu

SEQ ID NO: 1512398 - RNA, 19 nt, Homo sapiens
gaaaaucacuguuuagucu

SEQ ID NO: 1512399 - RNA, 19 nt, Homo sapiens
caaaacagcuacacaaaug

SEQ ID NO: 1512400 - RNA, 19 nt, Homo sapiens
gcucuuagccuugcaguuu

SEQ ID NO: 1512401 - RNA, 19 nt, Homo sapiens
ggauucagguugaggcauu

SEQ ID NO: 1512402 - RNA, 19 nt, Homo sapiens
gaaauuauaccaaguuagg

SEQ ID NO: 1512403 - RNA, 19 nt, Homo sapiens
gaaggaguguauagaguag

SEQ ID NO: 1512404 - RNA, 19 nt, Homo sapiens
gaacaugacagcccugauc

SEQ ID NO: 1512405 - RNA, 19 nt, Homo sapiens
ggacauuugguuugcauuu

SEQ ID NO: 1512406 - RNA, 19 nt, Homo sapiens
cagaugagcuuauggaaaa

SEQ ID NO: 1512407 - RNA, 19 nt, Homo sapiens
ccacuaugguuuaccuuga

SEQ ID NO: 1512408 - RNA, 19 nt, Homo sapiens
ucuguuaucuggacuagaa

SEQ ID NO: 1512409 - RNA, 19 nt, Homo sapiens
gaaccuguaccaccuaaug

SEQ ID NO: 1512410 - RNA, 19 nt, Homo sapiens
acacacagcucuggauuuc

SEQ ID NO: 1512411 - RNA, 19 nt, Homo sapiens
uuaaucaacuggcaaagug

SEQ ID NO: 1512412 - RNA, 19 nt, Homo sapiens
ggacuagaauuuucaauca

SEQ ID NO: 1512413 - RNA, 19 nt, Homo sapiens
cuacacaaaugcuucugaa

SEQ ID NO: 1512414 - RNA, 19 nt, Homo sapiens
gcccugagcuuuggucguu

SEQ ID NO: 1512415 - RNA, 19 nt, Homo sapiens
ccacagauguaagaaagug

SEQ ID NO: 1512416 - RNA, 19 nt, Homo sapiens
gcagugauccuagaccaaa

SEQ ID NO: 1512417 - RNA, 19 nt, Homo sapiens
uggauuaaguggaguaaau

SEQ ID NO: 1512418 - RNA, 19 nt, Homo sapiens
gaccaaacucuuaaauaga

SEQ ID NO: 1512419 - RNA, 19 nt, Homo sapiens
ccagugcccuucuuuccaa

SEQ ID NO: 1512420 - RNA, 19 nt, Homo sapiens
cauaaugcguacuucaaug

SEQ ID NO: 1512421 - RNA, 19 nt, Homo sapiens
caagacaggacugcuuaua

SEQ ID NO: 1512422 - RNA, 19 nt, Homo sapiens
guaaaugggcuggcagauu

SEQ ID NO: 1512423 - RNA, 19 nt, Homo sapiens
caucacaggugcuggaagu

SEQ ID NO: 1512424 - RNA, 19 nt, Homo sapiens
gccagaacaugucuuucaa

SEQ ID NO: 1512425 - RNA, 19 nt, Homo sapiens
ggacacacagcucuggauu

SEQ ID NO: 1512426 - RNA, 19 nt, Homo sapiens
acacaaaugcuucugaaug

SEQ ID NO: 1512427 - RNA, 19 nt, Homo sapiens
gaaaagucauuugauguga

SEQ ID NO: 1512428 - RNA, 19 nt, Homo sapiens
gggcagccuugcaagagaa

SEQ ID NO: 1512429 - RNA, 19 nt, Homo sapiens
uagaguagccgaccagguu

SEQ ID NO: 1512430 - RNA, 19 nt, Homo sapiens
ucaccuauuugguugaguu

SEQ ID NO: 1512431 - RNA, 19 nt, Homo sapiens
uaccacuccuauucuguua

SEQ ID NO: 1512432 - RNA, 19 nt, Homo sapiens
ugaaauaguccucaucaca

SEQ ID NO: 1512433 - RNA, 19 nt, Homo sapiens
gggguaaaaugcugucaua

SEQ ID NO: 1512434 - RNA, 19 nt, Homo sapiens
cacaaaugcuucugaaugc

SEQ ID NO: 1512435 - RNA, 19 nt, Homo sapiens
acaaguaccacuccuauuc

SEQ ID NO: 1512436 - RNA, 19 nt, Homo sapiens
agugguugcuucuuacuuu

SEQ ID NO: 1512437 - RNA, 19 nt, Homo sapiens
cugcuaugauugcuaauga

SEQ ID NO: 1512438 - RNA, 19 nt, Homo sapiens
gaucaaagagugguugcuu

SEQ ID NO: 1512439 - RNA, 19 nt, Homo sapiens
uaauguugcuaucaccuau

SEQ ID NO: 1512440 - RNA, 19 nt, Homo sapiens
ugcugaaucuguauuugua

SEQ ID NO: 1512441 - RNA, 19 nt, Homo sapiens
uaccugcuaugauugcuaa

SEQ ID NO: 1512442 - RNA, 19 nt, Homo sapiens
ggacagcuagggagagugu

SEQ ID NO: 1512443 - RNA, 19 nt, Homo sapiens
cagcagccuuugucucuuc

SEQ ID NO: 1512444 - RNA, 19 nt, Homo sapiens
uaccacagauguaagaaag

SEQ ID NO: 1512445 - RNA, 19 nt, Homo sapiens
ccacaaguaccacuccuau

SEQ ID NO: 1512446 - RNA, 19 nt, Homo sapiens
aagaagcucuaaagaccaa

SEQ ID NO: 1512447 - RNA, 19 nt, Homo sapiens
gcaauggauggcuuuguug

SEQ ID NO: 1512448 - RNA, 19 nt, Homo sapiens
guauaugccaaaguuguua

SEQ ID NO: 1512449 - RNA, 19 nt, Homo sapiens
ccugaucuguauuuccuuu

SEQ ID NO: 1512450 - RNA, 19 nt, Homo sapiens
gugcugcccucacuuugga

SEQ ID NO: 1512451 - RNA, 19 nt, Homo sapiens
ccacuccuauucuguuauc

SEQ ID NO: 1512452 - RNA, 19 nt, Homo sapiens
aagcacauuuauggacuua

SEQ ID NO: 1512453 - RNA, 19 nt, Homo sapiens
ccagaugagcuuauggaaa

SEQ ID NO: 1512454 - RNA, 19 nt, Homo sapiens
uaagauggcucgggaagcu

SEQ ID NO: 1512455 - RNA, 19 nt, Homo sapiens
ggaauccacuaugguuuac

SEQ ID NO: 1512456 - RNA, 19 nt, Homo sapiens
gauccuagaccaaacucuu

SEQ ID NO: 1512457 - RNA, 19 nt, Homo sapiens
aaagaagaagcucuaaaga

SEQ ID NO: 1512458 - RNA, 19 nt, Homo sapiens
ugcaauggauggcuuuguu

SEQ ID NO: 1512459 - RNA, 19 nt, Homo sapiens
aaguaaauuugcagccuuu

SEQ ID NO: 1512460 - RNA, 19 nt, Homo sapiens
ugaggaaacauguaagaug

SEQ ID NO: 1512461 - RNA, 19 nt, Homo sapiens
ucugggauaucaauaagga

SEQ ID NO: 1512462 - RNA, 19 nt, Homo sapiens
cacuuuggaucuauuguau

SEQ ID NO: 1512463 - RNA, 19 nt, Homo sapiens
gcgaagaggacauguggau

SEQ ID NO: 1512464 - RNA, 19 nt, Homo sapiens
gacauuugguuugcauuuc

SEQ ID NO: 1512465 - RNA, 19 nt, Homo sapiens
ugaguggccugcacgaaca

SEQ ID NO: 1512466 - RNA, 19 nt, Homo sapiens
uuucaugcuuuggagauua

SEQ ID NO: 1512467 - RNA, 19 nt, Homo sapiens
ucauuuccauuaccacaga

SEQ ID NO: 1512468 - RNA, 19 nt, Homo sapiens
guaccacuccuauucuguu

SEQ ID NO: 1512469 - RNA, 19 nt, Homo sapiens
gcuaaggucaucugauaca

SEQ ID NO: 1512470 - RNA, 19 nt, Homo sapiens
ggugaaauaguccucauca

SEQ ID NO: 1512471 - RNA, 19 nt, Homo sapiens
ggauggcuuuguugaccaa

SEQ ID NO: 1512472 - RNA, 19 nt, Homo sapiens
agacaggacugcuuauagc

SEQ ID NO: 1512473 - RNA, 19 nt, Homo sapiens
gaaccaaaauaugcaguug

SEQ ID NO: 1512474 - RNA, 19 nt, Homo sapiens
uggguuugcugaaucugua

SEQ ID NO: 1512475 - RNA, 19 nt, Homo sapiens
uguauuuccuuuccauuca

SEQ ID NO: 1512476 - RNA, 19 nt, Homo sapiens
ucacuuuggaucuauugua

SEQ ID NO: 1512477 - RNA, 19 nt, Homo sapiens
gcuauccucucuggccauu

SEQ ID NO: 1512478 - RNA, 19 nt, Homo sapiens
aaguucagcuggauuaagu

SEQ ID NO: 1512479 - RNA, 19 nt, Homo sapiens
aaucaacaaugccggaauc

SEQ ID NO: 1512480 - RNA, 19 nt, Homo sapiens
aaagaagucggcgauguuu

SEQ ID NO: 1512481 - RNA, 19 nt, Homo sapiens
caagagugcacgccuauac

SEQ ID NO: 1512482 - RNA, 19 nt, Homo sapiens
gggaaugaggaaacaugua

SEQ ID NO: 1512483 - RNA, 19 nt, Homo sapiens
gagaaacagcagccuuugu

SEQ ID NO: 1512484 - RNA, 19 nt, Homo sapiens
aagagaaacagcagccuuu

SEQ ID NO: 1512485 - RNA, 19 nt, Homo sapiens
aaccugcaaucaucaaaga

SEQ ID NO: 1512486 - RNA, 19 nt, Homo sapiens
gauggaauccgacguggua

SEQ ID NO: 1512487 - RNA, 19 nt, Homo sapiens
gagcauucauccagcagaa

SEQ ID NO: 1512488 - RNA, 19 nt, Homo sapiens
gcaggacccucuggaauac

SEQ ID NO: 1512489 - RNA, 19 nt, Homo sapiens
cagaauccguuguaacauc

SEQ ID NO: 1512490 - RNA, 19 nt, Homo sapiens
aaggcaagcugguucagaa

SEQ ID NO: 1512491 - RNA, 19 nt, Homo sapiens
gaagcgagcagcccagaca

SEQ ID NO: 1512492 - RNA, 19 nt, Homo sapiens
cguuguaacaucuguaaua

SEQ ID NO: 1512493 - RNA, 19 nt, Homo sapiens
gauacuguccgcgauuuaa

SEQ ID NO: 1512494 - RNA, 19 nt, Homo sapiens
cagauacuguccgcgauuu

SEQ ID NO: 1512495 - RNA, 19 nt, Homo sapiens
ggugagaggcccuaucugu

SEQ ID NO: 1512496 - RNA, 19 nt, Homo sapiens
ucauagagcuugccaaccu

SEQ ID NO: 1512497 - RNA, 19 nt, Homo sapiens
guuguaacaucuguaauag

SEQ ID NO: 1512498 - RNA, 19 nt, Homo sapiens
gcagauacuguccgcgauu

SEQ ID NO: 1512499 - RNA, 19 nt, Homo sapiens
gcagauucacccaugcaaa

SEQ ID NO: 1512500 - RNA, 19 nt, Homo sapiens
ggcccuaucugugugacua

SEQ ID NO: 1512501 - RNA, 19 nt, Homo sapiens
ccagcagaauccguuguaa

SEQ ID NO: 1512502 - RNA, 19 nt, Homo sapiens
gaagaggacgacgagaaga

SEQ ID NO: 1512503 - RNA, 19 nt, Homo sapiens
ucagcgacuucauggugua

SEQ ID NO: 1512504 - RNA, 19 nt, Homo sapiens
gcagcaggacccucuggaa

SEQ ID NO: 1512505 - RNA, 19 nt, Homo sapiens
ugagaggcccuaucugugu

SEQ ID NO: 1512506 - RNA, 19 nt, Homo sapiens
gguaggcccagagcagaua

SEQ ID NO: 1512507 - RNA, 19 nt, Homo sapiens
gcgagguauugggaaauga

SEQ ID NO: 1512508 - RNA, 19 nt, Homo sapiens
ggcgagguauugggaaaug

SEQ ID NO: 1512509 - RNA, 19 nt, Homo sapiens
agcaggacccucuggaaua

SEQ ID NO: 1512510 - RNA, 19 nt, Homo sapiens
cagcaggacccucuggaau

SEQ ID NO: 1512511 - RNA, 19 nt, Homo sapiens
ggacacacucagcaaacau

SEQ ID NO: 1512512 - RNA, 19 nt, Homo sapiens
acgccaggcugaagagaga

SEQ ID NO: 1512513 - RNA, 19 nt, Homo sapiens
caucuguaauaggguguuu

SEQ ID NO: 1512514 - RNA, 19 nt, Homo sapiens
gguauugggaaaugagaga

SEQ ID NO: 1512515 - RNA, 19 nt, Homo sapiens
agaauccguuguaacaucu

SEQ ID NO: 1512516 - RNA, 19 nt, Homo sapiens
ugaagaggacgacgagaag

SEQ ID NO: 1512517 - RNA, 19 nt, Homo sapiens
ccacggacacacucagcaa

SEQ ID NO: 1512518 - RNA, 19 nt, Homo sapiens
acacaucagcgucuucaca

SEQ ID NO: 1512519 - RNA, 19 nt, Homo sapiens
guggacagcucaaaacaca

SEQ ID NO: 1512520 - RNA, 19 nt, Homo sapiens
caaaguggacagcucaaaa

SEQ ID NO: 1512521 - RNA, 19 nt, Homo sapiens
gagcagauucacccaugca

SEQ ID NO: 1512522 - RNA, 19 nt, Homo sapiens
aaacacaucagcgucuuca

SEQ ID NO: 1512523 - RNA, 19 nt, Homo sapiens
gcucacaaaaggacucaua

SEQ ID NO: 1512524 - RNA, 19 nt, Homo sapiens
agacagcggccaccucaag

SEQ ID NO: 1512525 - RNA, 19 nt, Homo sapiens
ucaaaguggacagcucaaa

SEQ ID NO: 1512526 - RNA, 19 nt, Homo sapiens
gugcuggugucggucauca

SEQ ID NO: 1512527 - RNA, 19 nt, Homo sapiens
uacuguccgcgauuuaaua

SEQ ID NO: 1512528 - RNA, 19 nt, Homo sapiens
cagauucacccaugcaaac

SEQ ID NO: 1512529 - RNA, 19 nt, Homo sapiens
gugugacuauccagacugu

SEQ ID NO: 1512530 - RNA, 19 nt, Homo sapiens
gcagaauccguuguaacau

SEQ ID NO: 1512531 - RNA, 19 nt, Homo sapiens
cggacacacucagcaaaca

SEQ ID NO: 1512532 - RNA, 19 nt, Homo sapiens
gaaggagagcauucaucca

SEQ ID NO: 1512533 - RNA, 19 nt, Homo sapiens
gagaagagcuccuuuaaug

SEQ ID NO: 1512534 - RNA, 19 nt, Homo sapiens
gcagaagccuuauuaauga

SEQ ID NO: 1512535 - RNA, 19 nt, Homo sapiens
gaagacagcucagaaguuu

SEQ ID NO: 1512536 - RNA, 19 nt, Homo sapiens
ggaaauacaugacagagaa

SEQ ID NO: 1512537 - RNA, 19 nt, Homo sapiens
gagcagcuaucaaauuaua

SEQ ID NO: 1512538 - RNA, 19 nt, Homo sapiens
gaaaaucgcuucagcaauu

SEQ ID NO: 1512539 - RNA, 19 nt, Homo sapiens
uagagcagcuaucaaauua

SEQ ID NO: 1512540 - RNA, 19 nt, Homo sapiens
ggaauaagcaugacagaaa

SEQ ID NO: 1512541 - RNA, 19 nt, Homo sapiens
ggagauugauucauaauuc

SEQ ID NO: 1512542 - RNA, 19 nt, Homo sapiens
cccaacagcuuaugcauua

SEQ ID NO: 1512543 - RNA, 19 nt, Homo sapiens
gcacuugcaucuauccuaa

SEQ ID NO: 1512544 - RNA, 19 nt, Homo sapiens
gcaaacagaucaaacucaa

SEQ ID NO: 1512545 - RNA, 19 nt, Homo sapiens
gaacaauccuacagggaaa

SEQ ID NO: 1512546 - RNA, 19 nt, Homo sapiens
ggagaagcaugccaagaaa

SEQ ID NO: 1512547 - RNA, 19 nt, Homo sapiens
ugacugguguuccuuauaa

SEQ ID NO: 1512548 - RNA, 19 nt, Homo sapiens
guucaucuaucgcaaagua

SEQ ID NO: 1512549 - RNA, 19 nt, Homo sapiens
cuacagcgaucuacccaua

SEQ ID NO: 1512550 - RNA, 19 nt, Homo sapiens
guuguaggaugcauaauaa

SEQ ID NO: 1512551 - RNA, 19 nt, Homo sapiens
ccaagugaaugaaauauca

SEQ ID NO: 1512552 - RNA, 19 nt, Homo sapiens
agagaaagauguuguaauc

SEQ ID NO: 1512553 - RNA, 19 nt, Homo sapiens
gaaaacccaucucuacuaa

SEQ ID NO: 1512554 - RNA, 19 nt, Homo sapiens
acaaagauaugguaacugu

SEQ ID NO: 1512555 - RNA, 19 nt, Homo sapiens
gaagagcuccuuuaaugug

SEQ ID NO: 1512556 - RNA, 19 nt, Homo sapiens
ucaacaaucuuucaccuau

SEQ ID NO: 1512557 - RNA, 19 nt, Homo sapiens
gaaugcaccuagguuaauu

SEQ ID NO: 1512558 - RNA, 19 nt, Homo sapiens
uugaggagauugauucaua

SEQ ID NO: 1512559 - RNA, 19 nt, Homo sapiens
gaauaagcaugacagaaag

SEQ ID NO: 1512560 - RNA, 19 nt, Homo sapiens
aagaaugccuuucauguug

SEQ ID NO: 1512561 - RNA, 19 nt, Homo sapiens
gaacaaugagcucaaugaa

SEQ ID NO: 1512562 - RNA, 19 nt, Homo sapiens
ggcagaagccuuauuaaug

SEQ ID NO: 1512563 - RNA, 19 nt, Homo sapiens
ccucagaguuccaguaguu

SEQ ID NO: 1512564 - RNA, 19 nt, Homo sapiens
uaugugaccuuauuuggaa

SEQ ID NO: 1512565 - RNA, 19 nt, Homo sapiens
guucacuacuucugcuuua

SEQ ID NO: 1512566 - RNA, 19 nt, Homo sapiens
uaaaaucaaugcucccuua

SEQ ID NO: 1512567 - RNA, 19 nt, Homo sapiens
aaucaaugcucccuuaaug

SEQ ID NO: 1512568 - RNA, 19 nt, Homo sapiens
ucucuaaucuuuacucaug

SEQ ID NO: 1512569 - RNA, 19 nt, Homo sapiens
gggaauugauacacaagaa

SEQ ID NO: 1512570 - RNA, 19 nt, Homo sapiens
gcagaaggagucagauauu

SEQ ID NO: 1512571 - RNA, 19 nt, Homo sapiens
gaaucuggcauaccuaauu

SEQ ID NO: 1512572 - RNA, 19 nt, Homo sapiens
gagaaugcaccuagguuaa

SEQ ID NO: 1512573 - RNA, 19 nt, Homo sapiens
ucaaagggcacauggagua

SEQ ID NO: 1512574 - RNA, 19 nt, Homo sapiens
aaagaugaguuggagauaa

SEQ ID NO: 1512575 - RNA, 19 nt, Homo sapiens
acaaugagcucaaugaacu

SEQ ID NO: 1512576 - RNA, 19 nt, Homo sapiens
gaacaucuuucagaguugu

SEQ ID NO: 1512577 - RNA, 19 nt, Homo sapiens
ggaagaaagagaagauaga

SEQ ID NO: 1512578 - RNA, 19 nt, Homo sapiens
caacaaucuuucaccuauu

SEQ ID NO: 1512579 - RNA, 19 nt, Homo sapiens
gaagguacuuaguccacaa

SEQ ID NO: 1512580 - RNA, 19 nt, Homo sapiens
gaaggagucagauauuguu

SEQ ID NO: 1512581 - RNA, 19 nt, Homo sapiens
ggagauaauuagucaaagg

SEQ ID NO: 1512582 - RNA, 19 nt, Homo sapiens
gaaagaugaguuggagaua

SEQ ID NO: 1512583 - RNA, 19 nt, Homo sapiens
uaugguaacuguaauaugg

SEQ ID NO: 1512584 - RNA, 19 nt, Homo sapiens
cacaaugccuuuaguaagu

SEQ ID NO: 1512585 - RNA, 19 nt, Homo sapiens
gaauccaagugaaugaaau

SEQ ID NO: 1512586 - RNA, 19 nt, Homo sapiens
gaucaggauguacaagaua

SEQ ID NO: 1512587 - RNA, 19 nt, Homo sapiens
gcucuucgcauauuuguga

SEQ ID NO: 1512588 - RNA, 19 nt, Homo sapiens
cagaaggagucagauauug

SEQ ID NO: 1512589 - RNA, 19 nt, Homo sapiens
gagauuggagugauacauu

SEQ ID NO: 1512590 - RNA, 19 nt, Homo sapiens
ugaggagauugauucauaa

SEQ ID NO: 1512591 - RNA, 19 nt, Homo sapiens
ccaauuugcaucagucuuu

SEQ ID NO: 1512592 - RNA, 19 nt, Homo sapiens
caaagagaaagauguugua

SEQ ID NO: 1512593 - RNA, 19 nt, Homo sapiens
gcuuagagcagcuaucaaa

SEQ ID NO: 1512594 - RNA, 19 nt, Homo sapiens
uuucagaguuguauccuaa

SEQ ID NO: 1512595 - RNA, 19 nt, Homo sapiens
cccaaacucuuuauuagga

SEQ ID NO: 1512596 - RNA, 19 nt, Homo sapiens
gcacaucuagcauccagaa

SEQ ID NO: 1512597 - RNA, 19 nt, Homo sapiens
gaauccuacuugaacauug

SEQ ID NO: 1512598 - RNA, 19 nt, Homo sapiens
ggagaacaauaugguugaa

SEQ ID NO: 1512599 - RNA, 19 nt, Homo sapiens
ggcccaaacucuuuauuag

SEQ ID NO: 1512600 - RNA, 19 nt, Homo sapiens
acagagacccaacagcuua

SEQ ID NO: 1512601 - RNA, 19 nt, Homo sapiens
cuaaauacguaaacucaag

SEQ ID NO: 1512602 - RNA, 19 nt, Homo sapiens
gaaaauggacgaauugaau

SEQ ID NO: 1512603 - RNA, 19 nt, Homo sapiens
uggauaauaugcaugagaa

SEQ ID NO: 1512604 - RNA, 19 nt, Homo sapiens
ggcagagauuggagugaua

SEQ ID NO: 1512605 - RNA, 19 nt, Homo sapiens
gcaggcccuuaauccaaua

SEQ ID NO: 1512606 - RNA, 19 nt, Homo sapiens
ggaaaucagaauuaggaaa

SEQ ID NO: 1512607 - RNA, 19 nt, Homo sapiens
gaugaguuggagauaauua

SEQ ID NO: 1512608 - RNA, 19 nt, Homo sapiens
aaucuggcauaccuaauuu

SEQ ID NO: 1512609 - RNA, 19 nt, Homo sapiens
cauguuaugucccugaaug

SEQ ID NO: 1512610 - RNA, 19 nt, Homo sapiens
cagcaucguugcagaauac

SEQ ID NO: 1512611 - RNA, 19 nt, Homo sapiens
gaaacuauggcuaaauuac

SEQ ID NO: 1512612 - RNA, 19 nt, Homo sapiens
gaaauacaugacagagaaa

SEQ ID NO: 1512613 - RNA, 19 nt, Homo sapiens
cuucagauuuguuuaccua

SEQ ID NO: 1512614 - RNA, 19 nt, Homo sapiens
cgaauugaauagcaaaugg

SEQ ID NO: 1512615 - RNA, 19 nt, Homo sapiens
ugcauuagcugaacaucuu

SEQ ID NO: 1512616 - RNA, 19 nt, Homo sapiens
agucagauauuguucucua

SEQ ID NO: 1512617 - RNA, 19 nt, Homo sapiens
ucaccuauuucauaaguca

SEQ ID NO: 1512618 - RNA, 19 nt, Homo sapiens
aagaugaguuggagauaau

SEQ ID NO: 1512619 - RNA, 19 nt, Homo sapiens
guacuuaguccacaagauc

SEQ ID NO: 1512620 - RNA, 19 nt, Homo sapiens
caucuauccuaagaacaua

SEQ ID NO: 1512621 - RNA, 19 nt, Homo sapiens
gaagcuggaggcagagauu

SEQ ID NO: 1512622 - RNA, 19 nt, Homo sapiens
gcauguugauuaaccauac

SEQ ID NO: 1512623 - RNA, 19 nt, Homo sapiens
ucaaugcucccuuaauguu

SEQ ID NO: 1512624 - RNA, 19 nt, Homo sapiens
acaaugccuuuaguaagua

SEQ ID NO: 1512625 - RNA, 19 nt, Homo sapiens
gacagaaagauuuaaccua

SEQ ID NO: 1512626 - RNA, 19 nt, Homo sapiens
aagcaugacagaaagauuu

SEQ ID NO: 1512627 - RNA, 19 nt, Homo sapiens
ugggaacccucagaagaua

SEQ ID NO: 1512628 - RNA, 19 nt, Homo sapiens
uaaauugugaccugaaaga

SEQ ID NO: 1512629 - RNA, 19 nt, Homo sapiens
gcucacaaugccuuuagua

SEQ ID NO: 1512630 - RNA, 19 nt, Homo sapiens
aaacucaagcuaccaaaga

SEQ ID NO: 1512631 - RNA, 19 nt, Homo sapiens
gcaacuugauacuccugaa

SEQ ID NO: 1512632 - RNA, 19 nt, Homo sapiens
aaacccaucucuacuaaaa

SEQ ID NO: 1512633 - RNA, 19 nt, Homo sapiens
ccaaagaggugacauugug

SEQ ID NO: 1512634 - RNA, 19 nt, Homo sapiens
gauauugucuuugcagaaa

SEQ ID NO: 1512635 - RNA, 19 nt, Homo sapiens
gaggacgaaucuucuuuaa

SEQ ID NO: 1512636 - RNA, 19 nt, Homo sapiens
cuacagaauucuacagauu

SEQ ID NO: 1512637 - RNA, 19 nt, Homo sapiens
gagaaaggcccaccugugu

SEQ ID NO: 1512638 - RNA, 19 nt, Homo sapiens
caauggagccuacaauuca

SEQ ID NO: 1512639 - RNA, 19 nt, Homo sapiens
gugacaaucuacagaauuc

SEQ ID NO: 1512640 - RNA, 19 nt, Homo sapiens
ccacuaguccaucagauuu

SEQ ID NO: 1512641 - RNA, 19 nt, Homo sapiens
acaaucagguggacaacuu

SEQ ID NO: 1512642 - RNA, 19 nt, Homo sapiens
gaaggugacaaucuacaga

SEQ ID NO: 1512643 - RNA, 19 nt, Homo sapiens
gaaaccguguacuuaccaa

SEQ ID NO: 1512644 - RNA, 19 nt, Homo sapiens
gaggugacauugugauugc

SEQ ID NO: 1512645 - RNA, 19 nt, Homo sapiens
ggucauguuugguuagaag

SEQ ID NO: 1512646 - RNA, 19 nt, Homo sapiens
ugaauacguuggugguguu

SEQ ID NO: 1512647 - RNA, 19 nt, Homo sapiens
ugaaauuacugccaauggu

SEQ ID NO: 1512648 - RNA, 19 nt, Homo sapiens
gacuuuggguauucugaaa

SEQ ID NO: 1512649 - RNA, 19 nt, Homo sapiens
aagaguaauugguuuggaa

SEQ ID NO: 1512650 - RNA, 19 nt, Homo sapiens
uuuaagauuuggccucuga

SEQ ID NO: 1512651 - RNA, 19 nt, Homo sapiens
ggacuaauaagaggacgaa

SEQ ID NO: 1512652 - RNA, 19 nt, Homo sapiens
gacaaucuacagaauucua

SEQ ID NO: 1512653 - RNA, 19 nt, Homo sapiens
cgaaaggacggucgacuuc

SEQ ID NO: 1512654 - RNA, 19 nt, Homo sapiens
cuuguuggcuauacuauuc

SEQ ID NO: 1512655 - RNA, 19 nt, Homo sapiens
agaggacgaaucuucuuua

SEQ ID NO: 1512656 - RNA, 19 nt, Homo sapiens
ucaauggagccuacaauuc

SEQ ID NO: 1512657 - RNA, 19 nt, Homo sapiens
gacaaaauccucaccacua

SEQ ID NO: 1512658 - RNA, 19 nt, Homo sapiens
caaagaggugacauuguga

SEQ ID NO: 1512659 - RNA, 19 nt, Homo sapiens
cuaauaagaggacgaaucu

SEQ ID NO: 1512660 - RNA, 19 nt, Homo sapiens
ggugacaaucuacagaauu

SEQ ID NO: 1512661 - RNA, 19 nt, Homo sapiens
aaugggucauguuugguua

SEQ ID NO: 1512662 - RNA, 19 nt, Homo sapiens
cauguguucuggaccauca

SEQ ID NO: 1512663 - RNA, 19 nt, Homo sapiens
cguugaaaccguguacuua

SEQ ID NO: 1512664 - RNA, 19 nt, Homo sapiens
gaaaaucuuagucgacauu

SEQ ID NO: 1512665 - RNA, 19 nt, Homo sapiens
agauuuggccucugaguga

SEQ ID NO: 1512666 - RNA, 19 nt, Homo sapiens
guccaucagauuucuuuaa

SEQ ID NO: 1512667 - RNA, 19 nt, Homo sapiens
ccucaccacuaguccauca

SEQ ID NO: 1512668 - RNA, 19 nt, Homo sapiens
cgacuuguuggcuauacua

SEQ ID NO: 1512669 - RNA, 19 nt, Homo sapiens
accguguacuuaccaauaa

SEQ ID NO: 1512670 - RNA, 19 nt, Homo sapiens
ccauauggacuaauaagag

SEQ ID NO: 1512671 - RNA, 19 nt, Homo sapiens
caaugggucauguuugguu

SEQ ID NO: 1512672 - RNA, 19 nt, Homo sapiens
guauagcucauugugcuuu

SEQ ID NO: 1512673 - RNA, 19 nt, Homo sapiens
aaagugcgcccuacgaaag

SEQ ID NO: 1512674 - RNA, 19 nt, Homo sapiens
cuuuggguauucugaaauu

SEQ ID NO: 1512675 - RNA, 19 nt, Homo sapiens
gcccuaauggccacagauu

SEQ ID NO: 1512676 - RNA, 19 nt, Homo sapiens
ugaacaaucagguggacaa

SEQ ID NO: 1512677 - RNA, 19 nt, Homo sapiens
ucagguggacaacuucuug

SEQ ID NO: 1512678 - RNA, 19 nt, Homo sapiens
gugccaaugggucauguuu

SEQ ID NO: 1512679 - RNA, 19 nt, Homo sapiens
aaagaguaauugguuugga

SEQ ID NO: 1512680 - RNA, 19 nt, Homo sapiens
aaccguguacuuaccaaua

SEQ ID NO: 1512681 - RNA, 19 nt, Homo sapiens
gugacauugugauugcaaa

SEQ ID NO: 1512682 - RNA, 19 nt, Homo sapiens
cuacagauuccaggugcua

SEQ ID NO: 1512683 - RNA, 19 nt, Homo sapiens
aauggagccuacaauucaa

SEQ ID NO: 1512684 - RNA, 19 nt, Homo sapiens
uuacgugccagcccuaaug

SEQ ID NO: 1512685 - RNA, 19 nt, Homo sapiens
auucagauauugucuuugc

SEQ ID NO: 1512686 - RNA, 19 nt, Homo sapiens
ccguguacuuaccaauaaa

SEQ ID NO: 1512687 - RNA, 19 nt, Homo sapiens
gauuuggccucugagugau

SEQ ID NO: 1512688 - RNA, 19 nt, Homo sapiens
gguuagaaggugacaaucu

SEQ ID NO: 1512689 - RNA, 19 nt, Homo sapiens
aguaauugguuuggaagga

SEQ ID NO: 1512690 - RNA, 19 nt, Homo sapiens
uauccaaagaggugacauu

SEQ ID NO: 1512691 - RNA, 19 nt, Homo sapiens
guugaaaccguguacuuac

SEQ ID NO: 1512692 - RNA, 19 nt, Homo sapiens
cuugauuauugucuccuuu

SEQ ID NO: 1512693 - RNA, 19 nt, Homo sapiens
ccuaauggccacagauuuu

SEQ ID NO: 1512694 - RNA, 19 nt, Homo sapiens
caucaauggagccuacaau

SEQ ID NO: 1512695 - RNA, 19 nt, Homo sapiens
gugguguugucauguguuc

SEQ ID NO: 1512696 - RNA, 19 nt, Homo sapiens
gguggcagagucuacauag

SEQ ID NO: 1512697 - RNA, 19 nt, Homo sapiens
caacuucuugugacuuugg

SEQ ID NO: 1512698 - RNA, 19 nt, Homo sapiens
ucugagugauuuuggauuu

SEQ ID NO: 1512699 - RNA, 19 nt, Homo sapiens
ucuacagaauucuacagau

SEQ ID NO: 1512700 - RNA, 19 nt, Homo sapiens
acaaaauccucaccacuag

SEQ ID NO: 1512701 - RNA, 19 nt, Homo sapiens
ggaaggcaauuguggcaua

SEQ ID NO: 1512702 - RNA, 19 nt, Homo sapiens
caaggaaacuaaauucauc

SEQ ID NO: 1512703 - RNA, 19 nt, Homo sapiens
ugaagcaucugaaugaaga

SEQ ID NO: 1512704 - RNA, 19 nt, Homo sapiens
ccaguuugcuuccuucauu

SEQ ID NO: 1512705 - RNA, 19 nt, Homo sapiens
ucacacaccuugacaaucu

SEQ ID NO: 1512706 - RNA, 19 nt, Homo sapiens
guccagacguguucuauug

SEQ ID NO: 1512707 - RNA, 19 nt, Homo sapiens
gaguauaaguccaaguaug

SEQ ID NO: 1512708 - RNA, 19 nt, Homo sapiens
ccaagguaguucaauuaaa

SEQ ID NO: 1512709 - RNA, 19 nt, Homo sapiens
cauccaagguaguucaauu

SEQ ID NO: 1512710 - RNA, 19 nt, Homo sapiens
gaaggcaauuguggcauau

SEQ ID NO: 1512711 - RNA, 19 nt, Homo sapiens
gaucagaacccucaacaac

SEQ ID NO: 1512712 - RNA, 19 nt, Homo sapiens
ugucaugucuggaggaguu

SEQ ID NO: 1512713 - RNA, 19 nt, Homo sapiens
ccacaggcgugccacacuu

SEQ ID NO: 1512714 - RNA, 19 nt, Homo sapiens
gcacaccucacccagcaaa

SEQ ID NO: 1512715 - RNA, 19 nt, Homo sapiens
ucagaacccucaacaacca

SEQ ID NO: 1512716 - RNA, 19 nt, Homo sapiens
gcaauuguggcauaucugu

SEQ ID NO: 1512717 - RNA, 19 nt, Homo sapiens
agacauccaucaccuacug

SEQ ID NO: 1512718 - RNA, 19 nt, Homo sapiens
ugagcaagauggaguugga

SEQ ID NO: 1512719 - RNA, 19 nt, Homo sapiens
acaguugagucgagucuga

SEQ ID NO: 1512720 - RNA, 19 nt, Homo sapiens
aaacgaaaguccagaucuc

SEQ ID NO: 1512721 - RNA, 19 nt, Homo sapiens
gaaacgaaaguccagaucu

SEQ ID NO: 1512722 - RNA, 19 nt, Homo sapiens
gaaggacccuguuuuggau

SEQ ID NO: 1512723 - RNA, 19 nt, Homo sapiens
ucucucagcuacaccaaga

SEQ ID NO: 1512724 - RNA, 19 nt, Homo sapiens
gcaccagccaggucacuau

SEQ ID NO: 1512725 - RNA, 19 nt, Homo sapiens
acaagguccuggagacgaa

SEQ ID NO: 1512726 - RNA, 19 nt, Homo sapiens
ucaggugucugcccagcuu

SEQ ID NO: 1512727 - RNA, 19 nt, Homo sapiens
aguauaaguccaaguauga

SEQ ID NO: 1512728 - RNA, 19 nt, Homo sapiens
cagccacucuaucaaggaa

SEQ ID NO: 1512729 - RNA, 19 nt, Homo sapiens
ccacaucccagccacucua

SEQ ID NO: 1512730 - RNA, 19 nt, Homo sapiens
cagacguguucuauuggua

SEQ ID NO: 1512731 - RNA, 19 nt, Homo sapiens
gcagcaggagccuuaauuc

SEQ ID NO: 1512732 - RNA, 19 nt, Homo sapiens
gccacaccauccugaagaa

SEQ ID NO: 1512733 - RNA, 19 nt, Homo sapiens
gccuggagccugucuuuga

SEQ ID NO: 1512734 - RNA, 19 nt, Homo sapiens
gcaucugaaugaagaagag

SEQ ID NO: 1512735 - RNA, 19 nt, Homo sapiens
aggcagcgcugucaugucu

SEQ ID NO: 1512736 - RNA, 19 nt, Homo sapiens
uccaagaagugaccaucaa

SEQ ID NO: 1512737 - RNA, 19 nt, Homo sapiens
ucuugaagcaucugaauga

SEQ ID NO: 1512738 - RNA, 19 nt, Homo sapiens
ggaaggacccuguuuugga

SEQ ID NO: 1512739 - RNA, 19 nt, Homo sapiens
cgaaaguccagaucucuca

SEQ ID NO: 1512740 - RNA, 19 nt, Homo sapiens
ggaaacgaaaguccagauc

SEQ ID NO: 1512741 - RNA, 19 nt, Homo sapiens
gugccacacuugagaacga

SEQ ID NO: 1512742 - RNA, 19 nt, Homo sapiens
gagaucagaacccucaaca

SEQ ID NO: 1512743 - RNA, 19 nt, Homo sapiens
ccuccuuccugaacacauu

SEQ ID NO: 1512744 - RNA, 19 nt, Homo sapiens
ggaguauaaguccaaguau

SEQ ID NO: 1512745 - RNA, 19 nt, Homo sapiens
ggaaacuaaauucauccaa

SEQ ID NO: 1512746 - RNA, 19 nt, Homo sapiens
ggacuucagcagcaucauc

SEQ ID NO: 1512747 - RNA, 19 nt, Homo sapiens
ggcgaggagugcaggaugu

SEQ ID NO: 1512748 - RNA, 19 nt, Homo sapiens
ucagcuacaccaagagauu

SEQ ID NO: 1512749 - RNA, 19 nt, Homo sapiens
ggaggcagcgcugucaugu

SEQ ID NO: 1512750 - RNA, 19 nt, Homo sapiens
aggaguauaaguccaagua

SEQ ID NO: 1512751 - RNA, 19 nt, Homo sapiens
caucccagccacucuauca

SEQ ID NO: 1512752 - RNA, 19 nt, Homo sapiens
ccagacguguucuauuggu

SEQ ID NO: 1512753 - RNA, 19 nt, Homo sapiens
gggacaggaugcaggaaac

SEQ ID NO: 1512754 - RNA, 19 nt, Homo sapiens
gggccuggagccugucuuu

SEQ ID NO: 1512755 - RNA, 19 nt, Homo sapiens
caguuugcuuccuucauug

SEQ ID NO: 1512756 - RNA, 19 nt, Homo sapiens
acaaccaguuugcuuccuu

SEQ ID NO: 1512757 - RNA, 19 nt, Homo sapiens
ugaagacauccaucaccua

SEQ ID NO: 1512758 - RNA, 19 nt, Homo sapiens
cacugaagauugagaucga

SEQ ID NO: 1512759 - RNA, 19 nt, Homo sapiens
uucagaggcugcagaguca

SEQ ID NO: 1512760 - RNA, 19 nt, Homo sapiens
ccagaucucucagcuacac

SEQ ID NO: 1512761 - RNA, 19 nt, Homo sapiens
accaggaggaggaguauaa

SEQ ID NO: 1512762 - RNA, 19 nt, Homo sapiens
ggaccaggaggaggaguau

SEQ ID NO: 1512763 - RNA, 19 nt, Homo sapiens
gggaccaggaggaggagua

SEQ ID NO: 1512764 - RNA, 19 nt, Homo sapiens
uggaucagcucaggaagca

SEQ ID NO: 1512765 - RNA, 19 nt, Homo sapiens
ugagaucgauccccaguuc

SEQ ID NO: 1512766 - RNA, 19 nt, Homo sapiens
gcaggagacccaggagauc

SEQ ID NO: 1512767 - RNA, 19 nt, Homo sapiens
ggcucuggaugcugaguug

SEQ ID NO: 1512768 - RNA, 19 nt, Homo sapiens
uccaagguaguucaauuaa

SEQ ID NO: 1512769 - RNA, 19 nt, Homo sapiens
acuaaauucauccaaggua

SEQ ID NO: 1512770 - RNA, 19 nt, Homo sapiens
gacuucagcagcaucauca

SEQ ID NO: 1512771 - RNA, 19 nt, Homo sapiens
auccaagguaguucaauua

SEQ ID NO: 1512772 - RNA, 19 nt, Homo sapiens
cugacgagcacgaagcuuu

SEQ ID NO: 1512773 - RNA, 19 nt, Homo sapiens
caagcuggaggcucugaga

SEQ ID NO: 1512774 - RNA, 19 nt, Homo sapiens
uaaauucauccaagguagu

SEQ ID NO: 1512775 - RNA, 19 nt, Homo sapiens
gacguguucuauugguauc

SEQ ID NO: 1512776 - RNA, 19 nt, Homo sapiens
ccagccaggucacuaucuc

SEQ ID NO: 1512777 - RNA, 19 nt, Homo sapiens
ugacgagcacgaagcuuuc

SEQ ID NO: 1512778 - RNA, 19 nt, Homo sapiens
ggaugcaggaaacgaaagu

SEQ ID NO: 1512779 - RNA, 19 nt, Homo sapiens
caggaugcaggaaacgaaa

SEQ ID NO: 1512780 - RNA, 19 nt, Homo sapiens
ccaggaacuucaggugucu

SEQ ID NO: 1512781 - RNA, 19 nt, Homo sapiens
caacaugccuuucuuuaug

SEQ ID NO: 1512782 - RNA, 19 nt, Homo sapiens
gggaggaagucuaaccuuu

SEQ ID NO: 1512783 - RNA, 19 nt, Homo sapiens
ugacuucacugauauuuag

SEQ ID NO: 1512784 - RNA, 19 nt, Homo sapiens
gauccaaggccacaaguaa

SEQ ID NO: 1512785 - RNA, 19 nt, Homo sapiens
aggaagagcugcagugcua

SEQ ID NO: 1512786 - RNA, 19 nt, Homo sapiens
gaggagaagacaaucauaa

SEQ ID NO: 1512787 - RNA, 19 nt, Homo sapiens
gaaccugggcccaaacaaa

SEQ ID NO: 1512788 - RNA, 19 nt, Homo sapiens
uagacacccuugaagauuu

SEQ ID NO: 1512789 - RNA, 19 nt, Homo sapiens
cuacaagaguggccugauu

SEQ ID NO: 1512790 - RNA, 19 nt, Homo sapiens
gagcugcagugcuacaaga

SEQ ID NO: 1512791 - RNA, 19 nt, Homo sapiens
uggaggcgcuggugaauga

SEQ ID NO: 1512792 - RNA, 19 nt, Homo sapiens
ugacgcagcugcaguucaa

SEQ ID NO: 1512793 - RNA, 19 nt, Homo sapiens
ugacaucuccuaccuguug

SEQ ID NO: 1512794 - RNA, 19 nt, Homo sapiens
ggaggaagucuaaccuuug

SEQ ID NO: 1512795 - RNA, 19 nt, Homo sapiens
gccaacaugccuuucuuua

SEQ ID NO: 1512796 - RNA, 19 nt, Homo sapiens
gaacuagacacccuugaag

SEQ ID NO: 1512797 - RNA, 19 nt, Homo sapiens
uggaggagcugaagaugga

SEQ ID NO: 1512798 - RNA, 19 nt, Homo sapiens
gaggaagucuaaccuuugg

SEQ ID NO: 1512799 - RNA, 19 nt, Homo sapiens
cacuaggccuguguauuua

SEQ ID NO: 1512800 - RNA, 19 nt, Homo sapiens
aagacaaccuuccaagaug

SEQ ID NO: 1512801 - RNA, 19 nt, Homo sapiens
ggaaacagaccuagaucca

SEQ ID NO: 1512802 - RNA, 19 nt, Homo sapiens
gaacaaggaggagaagaca

SEQ ID NO: 1512803 - RNA, 19 nt, Homo sapiens
ggaggagaagacaaucaua

SEQ ID NO: 1512804 - RNA, 19 nt, Homo sapiens
gcaggaaaaugugcuauug

SEQ ID NO: 1512805 - RNA, 19 nt, Homo sapiens
ggagggaggagacgagguu

SEQ ID NO: 1512806 - RNA, 19 nt, Homo sapiens
gaacgcaacaaacucaagu

SEQ ID NO: 1512807 - RNA, 19 nt, Homo sapiens
gaaacagaccuagauccaa

SEQ ID NO: 1512808 - RNA, 19 nt, Homo sapiens
ccaacaugccuuucuuuau

SEQ ID NO: 1512809 - RNA, 19 nt, Homo sapiens
guaaggcuauggcucugau

SEQ ID NO: 1512810 - RNA, 19 nt, Homo sapiens
gcaggaacaaggaggagaa

SEQ ID NO: 1512811 - RNA, 19 nt, Homo sapiens
ggcuauggcucugauucua

SEQ ID NO: 1512812 - RNA, 19 nt, Homo sapiens
agacacccuugaagauuug

SEQ ID NO: 1512813 - RNA, 19 nt, Homo sapiens
caaacaaaauggugguuga

SEQ ID NO: 1512814 - RNA, 19 nt, Homo sapiens
gcagacgcguguccuacuc

SEQ ID NO: 1512815 - RNA, 19 nt, Homo sapiens
cuaggccuguguauuuauu

SEQ ID NO: 1512816 - RNA, 19 nt, Homo sapiens
cuucucggcugccuccuuu

SEQ ID NO: 1512817 - RNA, 19 nt, Homo sapiens
gaaaaugugcuauugagau

SEQ ID NO: 1512818 - RNA, 19 nt, Homo sapiens
gaaaagaaagcaggaaaau

SEQ ID NO: 1512819 - RNA, 19 nt, Homo sapiens
ggagaagacaaucauaaaa

SEQ ID NO: 1512820 - RNA, 19 nt, Homo sapiens
ccaggaggaagaagagaaa

SEQ ID NO: 1512821 - RNA, 19 nt, Homo sapiens
aaagaaagcaggaaaaugu

SEQ ID NO: 1512822 - RNA, 19 nt, Homo sapiens
cuauggcucugauucuaga

SEQ ID NO: 1512823 - RNA, 19 nt, Homo sapiens
uagccaacaugccuuucuu

SEQ ID NO: 1512824 - RNA, 19 nt, Homo sapiens
acaaggaggagaagacaau

SEQ ID NO: 1512825 - RNA, 19 nt, Homo sapiens
aagaugcugugguuacuag

SEQ ID NO: 1512826 - RNA, 19 nt, Homo sapiens
gcagaagggagaaaagaaa

SEQ ID NO: 1512827 - RNA, 19 nt, Homo sapiens
cuagacacccuugaagauu

SEQ ID NO: 1512828 - RNA, 19 nt, Homo sapiens
ggaacaaggaggagaagac

SEQ ID NO: 1512829 - RNA, 19 nt, Homo sapiens
gaagagcugcagugcuaca

SEQ ID NO: 1512830 - RNA, 19 nt, Homo sapiens
gggaccaccucaggaagga

SEQ ID NO: 1512831 - RNA, 19 nt, Homo sapiens
cucccuggcugcagaacua

SEQ ID NO: 1512832 - RNA, 19 nt, Homo sapiens
aggagaagacaaucauaaa

SEQ ID NO: 1512833 - RNA, 19 nt, Homo sapiens
ccgaggacguguaugacau

SEQ ID NO: 1512834 - RNA, 19 nt, Homo sapiens
ggacucugcccagcggaaa

SEQ ID NO: 1512835 - RNA, 19 nt, Homo sapiens
gagaaaagaaagcaggaaa

SEQ ID NO: 1512836 - RNA, 19 nt, Homo sapiens
caggaacgcaacaaacuca

SEQ ID NO: 1512837 - RNA, 19 nt, Homo sapiens
gcaggaacgcaacaaacuc

SEQ ID NO: 1512838 - RNA, 19 nt, Homo sapiens
acccuggucuucaaugguu

SEQ ID NO: 1512839 - RNA, 19 nt, Homo sapiens
agaacuagacacccuugaa

SEQ ID NO: 1512840 - RNA, 19 nt, Homo sapiens
agagaaggcccaggaggaa

SEQ ID NO: 1512841 - RNA, 19 nt, Homo sapiens
ccgccgaggacguguauga

SEQ ID NO: 1512842 - RNA, 19 nt, Homo sapiens
gauucuagaagacaaccuu

SEQ ID NO: 1512843 - RNA, 19 nt, Homo sapiens
gugccgggaggaagucuaa

SEQ ID NO: 1512844 - RNA, 19 nt, Homo sapiens
uggcucugauucuagaaga

SEQ ID NO: 1512845 - RNA, 19 nt, Homo sapiens
gcuauggcucugauucuag

SEQ ID NO: 1512846 - RNA, 19 nt, Homo sapiens
ggaacgcaacaaacucaag

SEQ ID NO: 1512847 - RNA, 19 nt, Homo sapiens
gaaggcccaggaggaagaa

SEQ ID NO: 1512848 - RNA, 19 nt, Homo sapiens
agaaggcccaggaggaaga

SEQ ID NO: 1512849 - RNA, 19 nt, Homo sapiens
ugcaggagcuaagggaugu

SEQ ID NO: 1512850 - RNA, 19 nt, Homo sapiens
uacaagaguggccugauuc

SEQ ID NO: 1512851 - RNA, 19 nt, Homo sapiens
gcugcaggaacgcaacaaa

SEQ ID NO: 1512852 - RNA, 19 nt, Homo sapiens
gggaaaggcugucaaauaa

SEQ ID NO: 1512853 - RNA, 19 nt, Homo sapiens
gaaaggcugucaaauaauc

SEQ ID NO: 1512854 - RNA, 19 nt, Homo sapiens
ggacuagucucccaacguu

SEQ ID NO: 1512855 - RNA, 19 nt, Homo sapiens
gaacaggcaccuccaauau

SEQ ID NO: 1512856 - RNA, 19 nt, Homo sapiens
caaagagcauggcugagaa

SEQ ID NO: 1512857 - RNA, 19 nt, Homo sapiens
gcaaguuucuggacuaguc

SEQ ID NO: 1512858 - RNA, 19 nt, Homo sapiens
ucuaggaacuggucacaaa

SEQ ID NO: 1512859 - RNA, 19 nt, Homo sapiens
acaggcaccuccaauauga

SEQ ID NO: 1512860 - RNA, 19 nt, Homo sapiens
gagaaguuccugacaaaga

SEQ ID NO: 1512861 - RNA, 19 nt, Homo sapiens
ugggaaaggcugucaaaua

SEQ ID NO: 1512862 - RNA, 19 nt, Homo sapiens
ggagcaaaguccuaucaca

SEQ ID NO: 1512863 - RNA, 19 nt, Homo sapiens
ggcaaucucuaacuucaau

SEQ ID NO: 1512864 - RNA, 19 nt, Homo sapiens
gagcccaccuggaaacaca

SEQ ID NO: 1512865 - RNA, 19 nt, Homo sapiens
gcauguggcagaaccauau

SEQ ID NO: 1512866 - RNA, 19 nt, Homo sapiens
ccagggcaaucucuaacuu

SEQ ID NO: 1512867 - RNA, 19 nt, Homo sapiens
caagauggagagcaagaaa

SEQ ID NO: 1512868 - RNA, 19 nt, Homo sapiens
gaaccggagccaacuuuca

SEQ ID NO: 1512869 - RNA, 19 nt, Homo sapiens
ggaaaggcugucaaauaau

SEQ ID NO: 1512870 - RNA, 19 nt, Homo sapiens
acacuaggacccuguugua

SEQ ID NO: 1512871 - RNA, 19 nt, Homo sapiens
agagggaccuagcagaaug

SEQ ID NO: 1512872 - RNA, 19 nt, Homo sapiens
uugagaaguuccugacaaa

SEQ ID NO: 1512873 - RNA, 19 nt, Homo sapiens
agaacaggcaccuccaaua

SEQ ID NO: 1512874 - RNA, 19 nt, Homo sapiens
caagagcaaccgcaagaug

SEQ ID NO: 1512875 - RNA, 19 nt, Homo sapiens
acaaagagcauggcugaga

SEQ ID NO: 1512876 - RNA, 19 nt, Homo sapiens
ccaccagccuaucuaucuu

SEQ ID NO: 1512877 - RNA, 19 nt, Homo sapiens
gcugcugccucaccagaga

SEQ ID NO: 1512878 - RNA, 19 nt, Homo sapiens
ucaccugccuagacccaaa

SEQ ID NO: 1512879 - RNA, 19 nt, Homo sapiens
ugagagggaccuagcagaa

SEQ ID NO: 1512880 - RNA, 19 nt, Homo sapiens
ccagggagaaucagagaug

SEQ ID NO: 1512881 - RNA, 19 nt, Homo sapiens
gcuccaaggcacucauuug

SEQ ID NO: 1512882 - RNA, 19 nt, Homo sapiens
gagaacaggcaccuccaau

SEQ ID NO: 1512883 - RNA, 19 nt, Homo sapiens
gagcucuucagccagauaa

SEQ ID NO: 1512884 - RNA, 19 nt, Homo sapiens
agaaguuccugacaaagag

SEQ ID NO: 1512885 - RNA, 19 nt, Homo sapiens
gaacuggucacaaaaguca

SEQ ID NO: 1512886 - RNA, 19 nt, Homo sapiens
ccaguucuccgaaauccaa

SEQ ID NO: 1512887 - RNA, 19 nt, Homo sapiens
gcaagauggagagcaagaa

SEQ ID NO: 1512888 - RNA, 19 nt, Homo sapiens
gagagggaccuagcagaau

SEQ ID NO: 1512889 - RNA, 19 nt, Homo sapiens
gcaggagguccggagagua

SEQ ID NO: 1512890 - RNA, 19 nt, Homo sapiens
ccuccaauaugagcgguuu

SEQ ID NO: 1512891 - RNA, 19 nt, Homo sapiens
caacguuugccucccaaug

SEQ ID NO: 1512892 - RNA, 19 nt, Homo sapiens
uuugagaaguuccugacaa

SEQ ID NO: 1512893 - RNA, 19 nt, Homo sapiens
cugcuggugcugcuucuua

SEQ ID NO: 1512894 - RNA, 19 nt, Homo sapiens
ggagcucuucagccagaua

SEQ ID NO: 1512895 - RNA, 19 nt, Homo sapiens
ugccagagcaagacucaaa

SEQ ID NO: 1512896 - RNA, 19 nt, Homo sapiens
caugggaaaggcugucaaa

SEQ ID NO: 1512897 - RNA, 19 nt, Homo sapiens
gcagaaccauauggaagcu

SEQ ID NO: 1512898 - RNA, 19 nt, Homo sapiens
gagggaccuagcagaauga

SEQ ID NO: 1512899 - RNA, 19 nt, Homo sapiens
ucaaagaggcagagguuuu

SEQ ID NO: 1512900 - RNA, 19 nt, Homo sapiens
ccagagcaagacucaaaga

SEQ ID NO: 1512901 - RNA, 19 nt, Homo sapiens
cuaggacccuguuguaucc

SEQ ID NO: 1512902 - RNA, 19 nt, Homo sapiens
ccacccaccagccuaucua

SEQ ID NO: 1512903 - RNA, 19 nt, Homo sapiens
acucaaagaggcagagguu

SEQ ID NO: 1512904 - RNA, 19 nt, Homo sapiens
uaucuaucuuccacugaga

SEQ ID NO: 1512905 - RNA, 19 nt, Homo sapiens
cucccaauguugucccuuu

SEQ ID NO: 1512906 - RNA, 19 nt, Homo sapiens
acugcaaguuucuggacua

SEQ ID NO: 1512907 - RNA, 19 nt, Homo sapiens
ggagacaaggagcaaaguc

SEQ ID NO: 1512908 - RNA, 19 nt, Homo sapiens
cggaaccggagccaacuuu

SEQ ID NO: 1512909 - RNA, 19 nt, Homo sapiens
cccaagagcaaccgcaaga

SEQ ID NO: 1512910 - RNA, 19 nt, Homo sapiens
agggcaaucucuaacuuca

SEQ ID NO: 1512911 - RNA, 19 nt, Homo sapiens
gcagagguuuuguucucaa

SEQ ID NO: 1512912 - RNA, 19 nt, Homo sapiens
ccuggaaggaucuugagaa

SEQ ID NO: 1512913 - RNA, 19 nt, Homo sapiens
gaugccagagcaagacuca

SEQ ID NO: 1512914 - RNA, 19 nt, Homo sapiens
acccaugcgucucuaggaa

SEQ ID NO: 1512915 - RNA, 19 nt, Homo sapiens
uuccuucguucccauggua

SEQ ID NO: 1512916 - RNA, 19 nt, Homo sapiens
aaauagacgaaaccacgaa

SEQ ID NO: 1512917 - RNA, 19 nt, Homo sapiens
ggaaccggagccaacuuuc

SEQ ID NO: 1512918 - RNA, 19 nt, Homo sapiens
gaacuagaaugcaucaaua

SEQ ID NO: 1512919 - RNA, 19 nt, Homo sapiens
gaauggauguugaaguuua

SEQ ID NO: 1512920 - RNA, 19 nt, Homo sapiens
gugaauggauguugaaguu

SEQ ID NO: 1512921 - RNA, 19 nt, Homo sapiens
gggcuaagguuguguggaa

SEQ ID NO: 1512922 - RNA, 19 nt, Homo sapiens
ggauucaaguaaagaagua

SEQ ID NO: 1512923 - RNA, 19 nt, Homo sapiens
ggaaaucagugacgacgau

SEQ ID NO: 1512924 - RNA, 19 nt, Homo sapiens
ggaagaaacuuuugaagau

SEQ ID NO: 1512925 - RNA, 19 nt, Homo sapiens
gaaggucuccaucaagaaa

SEQ ID NO: 1512926 - RNA, 19 nt, Homo sapiens
gcaccgacccaguccguua

SEQ ID NO: 1512927 - RNA, 19 nt, Homo sapiens
gauaauaacagccagauac

SEQ ID NO: 1512928 - RNA, 19 nt, Homo sapiens
gauaagaaccguuugaaaa

SEQ ID NO: 1512929 - RNA, 19 nt, Homo sapiens
uagaaugcaucaauaagga

SEQ ID NO: 1512930 - RNA, 19 nt, Homo sapiens
ggaccaaacuagcacugau

SEQ ID NO: 1512931 - RNA, 19 nt, Homo sapiens
caaacuagcacugauaaug

SEQ ID NO: 1512932 - RNA, 19 nt, Homo sapiens
ggaacuagaaugcaucaau

SEQ ID NO: 1512933 - RNA, 19 nt, Homo sapiens
gaagggaaacgaggcaauu

SEQ ID NO: 1512934 - RNA, 19 nt, Homo sapiens
ggagauaagaaccguuuga

SEQ ID NO: 1512935 - RNA, 19 nt, Homo sapiens
gaccaaacuagcacugaua

SEQ ID NO: 1512936 - RNA, 19 nt, Homo sapiens
cggaagagcuccaaaaguu

SEQ ID NO: 1512937 - RNA, 19 nt, Homo sapiens
guauuaaaccacccuugua

SEQ ID NO: 1512938 - RNA, 19 nt, Homo sapiens
aaacuagcauugaguagca

SEQ ID NO: 1512939 - RNA, 19 nt, Homo sapiens
ucagugacgacgauaauaa

SEQ ID NO: 1512940 - RNA, 19 nt, Homo sapiens
aaaccacccuuguaugcuu

SEQ ID NO: 1512941 - RNA, 19 nt, Homo sapiens
gaacuucgaggaccaaacu

SEQ ID NO: 1512942 - RNA, 19 nt, Homo sapiens
cagcgugaauggauguuga

SEQ ID NO: 1512943 - RNA, 19 nt, Homo sapiens
ggagaaaacacaagucaaa

SEQ ID NO: 1512944 - RNA, 19 nt, Homo sapiens
acaaaggauucaaguaaag

SEQ ID NO: 1512945 - RNA, 19 nt, Homo sapiens
aagagaaugugcaggaaga

SEQ ID NO: 1512946 - RNA, 19 nt, Homo sapiens
cuuguaugcuugcguuuaa

SEQ ID NO: 1512947 - RNA, 19 nt, Homo sapiens
gagauaagaaccguuugaa

SEQ ID NO: 1512948 - RNA, 19 nt, Homo sapiens
aaacuagcacugauaaugu

SEQ ID NO: 1512949 - RNA, 19 nt, Homo sapiens
ggaagauccuaaaacauug

SEQ ID NO: 1512950 - RNA, 19 nt, Homo sapiens
gaaaucagugacgacgaua

SEQ ID NO: 1512951 - RNA, 19 nt, Homo sapiens
uuacuccuauuccugguuu

SEQ ID NO: 1512952 - RNA, 19 nt, Homo sapiens
ugaaauccgacacuacuga

SEQ ID NO: 1512953 - RNA, 19 nt, Homo sapiens
caaaaccacuuucccugaa

SEQ ID NO: 1512954 - RNA, 19 nt, Homo sapiens
ggauguugaaguuuacaaa

SEQ ID NO: 1512955 - RNA, 19 nt, Homo sapiens
caggagauaagaaccguuu

SEQ ID NO: 1512956 - RNA, 19 nt, Homo sapiens
caaaggauucaaguaaaga

SEQ ID NO: 1512957 - RNA, 19 nt, Homo sapiens
ggaaggucuccaucaagaa

SEQ ID NO: 1512958 - RNA, 19 nt, Homo sapiens
gcagcuaccgacccaaaga

SEQ ID NO: 1512959 - RNA, 19 nt, Homo sapiens
ggucucauccgccuucugu

SEQ ID NO: 1512960 - RNA, 19 nt, Homo sapiens
gaaauccgacacuacugau

SEQ ID NO: 1512961 - RNA, 19 nt, Homo sapiens
uaaaaccacucaggcaaaa

SEQ ID NO: 1512962 - RNA, 19 nt, Homo sapiens
uauuaaaccacccuuguau

SEQ ID NO: 1512963 - RNA, 19 nt, Homo sapiens
agaagagaaugugcaggaa

SEQ ID NO: 1512964 - RNA, 19 nt, Homo sapiens
cgagcucacuguccgaaag

SEQ ID NO: 1512965 - RNA, 19 nt, Homo sapiens
gguaucccuuaucggguaa

SEQ ID NO: 1512966 - RNA, 19 nt, Homo sapiens
gacccaguccguuaggaaa

SEQ ID NO: 1512967 - RNA, 19 nt, Homo sapiens
ggagcaggauccggguuca

SEQ ID NO: 1512968 - RNA, 19 nt, Homo sapiens
agauaagaaccguuugaaa

SEQ ID NO: 1512969 - RNA, 19 nt, Homo sapiens
cagcagcuaccgacccaaa

SEQ ID NO: 1512970 - RNA, 19 nt, Homo sapiens
ggaagagcuccaaaaguuu

SEQ ID NO: 1512971 - RNA, 19 nt, Homo sapiens
gcauugaguagcaaagaag

SEQ ID NO: 1512972 - RNA, 19 nt, Homo sapiens
cgauaauaacagccagaua

SEQ ID NO: 1512973 - RNA, 19 nt, Homo sapiens
uguaugcuugcguuuaaua

SEQ ID NO: 1512974 - RNA, 19 nt, Homo sapiens
gggaaacgaggcaauuguc

SEQ ID NO: 1512975 - RNA, 19 nt, Homo sapiens
ugaaaacuguguggaagaa

SEQ ID NO: 1512976 - RNA, 19 nt, Homo sapiens
ugacuuuaccaggagauaa

SEQ ID NO: 1512977 - RNA, 19 nt, Homo sapiens
gaaaacacaagucaaaacu

SEQ ID NO: 1512978 - RNA, 19 nt, Homo sapiens
gaguagcaaagaagagaau

SEQ ID NO: 1512979 - RNA, 19 nt, Homo sapiens
ggauggcgaccgcagauac

SEQ ID NO: 1512980 - RNA, 19 nt, Homo sapiens
gccgcuugguguccgagua

SEQ ID NO: 1512981 - RNA, 19 nt, Homo sapiens
uccuauuccugguuugaaa

SEQ ID NO: 1512982 - RNA, 19 nt, Homo sapiens
uagcaaagaagagaaugug

SEQ ID NO: 1512983 - RNA, 19 nt, Homo sapiens
guagcaaagaagagaaugu

SEQ ID NO: 1512984 - RNA, 19 nt, Homo sapiens
cuuggaccguuuccgcuuu

SEQ ID NO: 1512985 - RNA, 19 nt, Homo sapiens
cgucaucguccucuucuca

SEQ ID NO: 1512986 - RNA, 19 nt, Homo sapiens
gagaaaacacaagucaaaa

SEQ ID NO: 1512987 - RNA, 19 nt, Homo sapiens
cgacccaguccguuaggaa

SEQ ID NO: 1512988 - RNA, 19 nt, Homo sapiens
ggguucagcagcagucaga

SEQ ID NO: 1512989 - RNA, 19 nt, Homo sapiens
cagcuaccgacccaaagaa

SEQ ID NO: 1512990 - RNA, 19 nt, Homo sapiens
uuaaaccacccuuguaugc

SEQ ID NO: 1512991 - RNA, 19 nt, Homo sapiens
ugaauggauguugaaguuu

SEQ ID NO: 1512992 - RNA, 19 nt, Homo sapiens
ucccugaaauccgacacua

SEQ ID NO: 1512993 - RNA, 19 nt, Homo sapiens
ccaguccguuaggaaagaa

SEQ ID NO: 1512994 - RNA, 19 nt, Homo sapiens
cuagaaugcaucaauaagg

SEQ ID NO: 1512995 - RNA, 19 nt, Homo sapiens
aguuaaagauggagcaaaa

SEQ ID NO: 1512996 - RNA, 19 nt, Homo sapiens
aaucagugacgacgauaau

SEQ ID NO: 1512997 - RNA, 19 nt, Homo sapiens
ugaacacgguggugaauua

SEQ ID NO: 1512998 - RNA, 19 nt, Homo sapiens
gaacaagaccaagaucaaa

SEQ ID NO: 1512999 - RNA, 19 nt, Homo sapiens
gcaacaagcuggucuucuc

SEQ ID NO: 1513000 - RNA, 19 nt, Homo sapiens
ccucggagcucuaccagaa

SEQ ID NO: 1513001 - RNA, 19 nt, Homo sapiens
aggaagagauggagucaaa

SEQ ID NO: 1513002 - RNA, 19 nt, Homo sapiens
gcgagaggcugaagagcuu

SEQ ID NO: 1513003 - RNA, 19 nt, Homo sapiens
acaaugacuuccuccauga

SEQ ID NO: 1513004 - RNA, 19 nt, Homo sapiens
gcuggaggguucugaaugu

SEQ ID NO: 1513005 - RNA, 19 nt, Homo sapiens
gaacaacuaccagcacaug

SEQ ID NO: 1513006 - RNA, 19 nt, Homo sapiens
cggaggagcucaucuacau

SEQ ID NO: 1513007 - RNA, 19 nt, Homo sapiens
gcacaaguggccaauacaa

SEQ ID NO: 1513008 - RNA, 19 nt, Homo sapiens
gacagaaacuugaaaacaa

SEQ ID NO: 1513009 - RNA, 19 nt, Homo sapiens
gcugggaaguucaccauca

SEQ ID NO: 1513010 - RNA, 19 nt, Homo sapiens
gggcacaaguggccaauac

SEQ ID NO: 1513011 - RNA, 19 nt, Homo sapiens
caaaguuucuggccaucug

SEQ ID NO: 1513012 - RNA, 19 nt, Homo sapiens
uagaguggaugcaggaaga

SEQ ID NO: 1513013 - RNA, 19 nt, Homo sapiens
gaaguucgcgccugucaag

SEQ ID NO: 1513014 - RNA, 19 nt, Homo sapiens
gcaugucacuggccaggau

SEQ ID NO: 1513015 - RNA, 19 nt, Homo sapiens
gagcuggcccugaacaaga

SEQ ID NO: 1513016 - RNA, 19 nt, Homo sapiens
ugagucaucuccuccuaga

SEQ ID NO: 1513017 - RNA, 19 nt, Homo sapiens
caaguggccaauacaauga

SEQ ID NO: 1513018 - RNA, 19 nt, Homo sapiens
uauaacaaccaguggauga

SEQ ID NO: 1513019 - RNA, 19 nt, Homo sapiens
aacaagagcggcugugaaa

SEQ ID NO: 1513020 - RNA, 19 nt, Homo sapiens
ggaugaucguggacuacaa

SEQ ID NO: 1513021 - RNA, 19 nt, Homo sapiens
aaacaaacacaaaccaaag

SEQ ID NO: 1513022 - RNA, 19 nt, Homo sapiens
gggcuucguucucugaucu

SEQ ID NO: 1513023 - RNA, 19 nt, Homo sapiens
ugaacaagaccaagaucaa

SEQ ID NO: 1513024 - RNA, 19 nt, Homo sapiens
acaaguggccaauacaaug

SEQ ID NO: 1513025 - RNA, 19 nt, Homo sapiens
cuucugcccugcccuaaau

SEQ ID NO: 1513026 - RNA, 19 nt, Homo sapiens
guucgcgccugucaagguu

SEQ ID NO: 1513027 - RNA, 19 nt, Homo sapiens
gugccaccauuaaacaaga

SEQ ID NO: 1513028 - RNA, 19 nt, Homo sapiens
gcuacaacauaccguccuu

SEQ ID NO: 1513029 - RNA, 19 nt, Homo sapiens
cacaacaccuggaacaacu

SEQ ID NO: 1513030 - RNA, 19 nt, Homo sapiens
caaggccaccggacuucua

SEQ ID NO: 1513031 - RNA, 19 nt, Homo sapiens
gaugagguacaaugacuuc

SEQ ID NO: 1513032 - RNA, 19 nt, Homo sapiens
ggaugaacacgguggugaa

SEQ ID NO: 1513033 - RNA, 19 nt, Homo sapiens
uacaugcacuggaugaaca

SEQ ID NO: 1513034 - RNA, 19 nt, Homo sapiens
aaacaagagcggcugugaa

SEQ ID NO: 1513035 - RNA, 19 nt, Homo sapiens
caaacccagacucaccuua

SEQ ID NO: 1513036 - RNA, 19 nt, Homo sapiens
uaaacaagagcggcuguga

SEQ ID NO: 1513037 - RNA, 19 nt, Homo sapiens
acacgguggugaauuacug

SEQ ID NO: 1513038 - RNA, 19 nt, Homo sapiens
gcaggcugugccaccauua

SEQ ID NO: 1513039 - RNA, 19 nt, Homo sapiens
guacaaugacuuccuccau

SEQ ID NO: 1513040 - RNA, 19 nt, Homo sapiens
ucaacagcggcacguauaa

SEQ ID NO: 1513041 - RNA, 19 nt, Homo sapiens
gaaaacaaacacaaaccaa

SEQ ID NO: 1513042 - RNA, 19 nt, Homo sapiens
acccagcccuguggaagua

SEQ ID NO: 1513043 - RNA, 19 nt, Homo sapiens
guucugcccucaucaagcu

SEQ ID NO: 1513044 - RNA, 19 nt, Homo sapiens
gaauguccucucuccaugu

SEQ ID NO: 1513045 - RNA, 19 nt, Homo sapiens
ggacagaaacuugaaaaca

SEQ ID NO: 1513046 - RNA, 19 nt, Homo sapiens
gggacugguuuucuuauga

SEQ ID NO: 1513047 - RNA, 19 nt, Homo sapiens
ucggagcucuaccagaaga

SEQ ID NO: 1513048 - RNA, 19 nt, Homo sapiens
gcacaugcugcgugucauc

SEQ ID NO: 1513049 - RNA, 19 nt, Homo sapiens
gccaauacaaugacagcuu

SEQ ID NO: 1513050 - RNA, 19 nt, Homo sapiens
acaaacacaaaccaaaguu

SEQ ID NO: 1513051 - RNA, 19 nt, Homo sapiens
ucaugggacugaaguucug

SEQ ID NO: 1513052 - RNA, 19 nt, Homo sapiens
gaugaacacgguggugaau

SEQ ID NO: 1513053 - RNA, 19 nt, Homo sapiens
gaccaccauuggcaacaag

SEQ ID NO: 1513054 - RNA, 19 nt, Homo sapiens
gcaggaagagauggaguca

SEQ ID NO: 1513055 - RNA, 19 nt, Homo sapiens
ggagccgggugcuuaccau

SEQ ID NO: 1513056 - RNA, 19 nt, Homo sapiens
gaagagauggagucaaacc

SEQ ID NO: 1513057 - RNA, 19 nt, Homo sapiens
gaacacgguggugaauuac

SEQ ID NO: 1513058 - RNA, 19 nt, Homo sapiens
uggagcaccucgcccuuca

SEQ ID NO: 1513059 - RNA, 19 nt, Homo sapiens
ggucauggugggccagaug

SEQ ID NO: 1513060 - RNA, 19 nt, Homo sapiens
guucaacagcggcacguau

SEQ ID NO: 1513061 - RNA, 19 nt, Homo sapiens
gcugugccaccauuaaaca

SEQ ID NO: 1513062 - RNA, 19 nt, Homo sapiens
gaugaucguggacuacaag

SEQ ID NO: 1513063 - RNA, 19 nt, Homo sapiens
ucaucuacaugcacuggau

SEQ ID NO: 1513064 - RNA, 19 nt, Homo sapiens
gcccugaacaagaccaaga

SEQ ID NO: 1513065 - RNA, 19 nt, Homo sapiens
ucugagucaucuccuccua

SEQ ID NO: 1513066 - RNA, 19 nt, Homo sapiens
cuucgagacuguguucaau

SEQ ID NO: 1513067 - RNA, 19 nt, Homo sapiens
ugggccagauguacugcua

SEQ ID NO: 1513068 - RNA, 19 nt, Homo sapiens
ugucggaggagcucaucua

SEQ ID NO: 1513069 - RNA, 19 nt, Homo sapiens
ggaggagcucaucuacaug

SEQ ID NO: 1513070 - RNA, 19 nt, Homo sapiens
caccugggcagacaucuuc

SEQ ID NO: 1513071 - RNA, 19 nt, Homo sapiens
ggaguggguacgcaacauc

SEQ ID NO: 1513072 - RNA, 19 nt, Homo sapiens
ccacaacaccuggaacaac

SEQ ID NO: 1513073 - RNA, 19 nt, Homo sapiens
cugggaaguucaccaucaa

SEQ ID NO: 1513074 - RNA, 19 nt, Homo sapiens
gcagcauugugcggucaug

SEQ ID NO: 1513075 - RNA, 19 nt, Homo sapiens
caagguuucaugggacuga

SEQ ID NO: 1513076 - RNA, 19 nt, Homo sapiens
ggaaguucgcgccugucaa

SEQ ID NO: 1513077 - RNA, 19 nt, Homo sapiens
ucgagacuguguucaaugc

SEQ ID NO: 1513078 - RNA, 19 nt, Homo sapiens
cacaaguggccaauacaau

SEQ ID NO: 1513079 - RNA, 19 nt, Homo sapiens
uucaacagcggcacguaua

SEQ ID NO: 1513080 - RNA, 19 nt, Homo sapiens
ugcgugucaucaagaagua

SEQ ID NO: 1513081 - RNA, 19 nt, Homo sapiens
ggagcuggcccugaacaag

SEQ ID NO: 1513082 - RNA, 19 nt, Homo sapiens
aaucucccacucucuguuu

SEQ ID NO: 1513083 - RNA, 19 nt, Homo sapiens
cugaugagguacaaugacu

SEQ ID NO: 1513084 - RNA, 19 nt, Homo sapiens
ggacuacaaggcguucauc

SEQ ID NO: 1513085 - RNA, 19 nt, Homo sapiens
uaacaaccaguggaugauc

SEQ ID NO: 1513086 - RNA, 19 nt, Homo sapiens
gcccacaacaccuggaaca

SEQ ID NO: 1513087 - RNA, 19 nt, Homo sapiens
caacauaccucccacauau

SEQ ID NO: 1513088 - RNA, 19 nt, Homo sapiens
gcagugggauugccaguua

SEQ ID NO: 1513089 - RNA, 19 nt, Homo sapiens
ggaacugucuugauuuaaa

SEQ ID NO: 1513090 - RNA, 19 nt, Homo sapiens
gauugacucugcaguaaua

SEQ ID NO: 1513091 - RNA, 19 nt, Homo sapiens
gaaacaggaugcccgcuaa

SEQ ID NO: 1513092 - RNA, 19 nt, Homo sapiens
ugagaaggcuguugcauug

SEQ ID NO: 1513093 - RNA, 19 nt, Homo sapiens
caugaaugcugaaauguuu

SEQ ID NO: 1513094 - RNA, 19 nt, Homo sapiens
gcuguaugcuaccguauua

SEQ ID NO: 1513095 - RNA, 19 nt, Homo sapiens
gcugggaacugucuugauu

SEQ ID NO: 1513096 - RNA, 19 nt, Homo sapiens
gcagagagauacugagaag

SEQ ID NO: 1513097 - RNA, 19 nt, Homo sapiens
ucacaugaaugcugaaaug

SEQ ID NO: 1513098 - RNA, 19 nt, Homo sapiens
gcuaaagcauguuaaggaa

SEQ ID NO: 1513099 - RNA, 19 nt, Homo sapiens
caaaggcuguugugaagug

SEQ ID NO: 1513100 - RNA, 19 nt, Homo sapiens
gaacugucuugauuuaaag

SEQ ID NO: 1513101 - RNA, 19 nt, Homo sapiens
gagcaaaggcuguugugaa

SEQ ID NO: 1513102 - RNA, 19 nt, Homo sapiens
guggacaucucaccuaaga

SEQ ID NO: 1513103 - RNA, 19 nt, Homo sapiens
ugggaacugucuugauuua

SEQ ID NO: 1513104 - RNA, 19 nt, Homo sapiens
aaaggguacuucaagcaua

SEQ ID NO: 1513105 - RNA, 19 nt, Homo sapiens
aaagaaagccugcagaaca

SEQ ID NO: 1513106 - RNA, 19 nt, Homo sapiens
ucucagcucugcaggauga

SEQ ID NO: 1513107 - RNA, 19 nt, Homo sapiens
guugugaaguggaauauca

SEQ ID NO: 1513108 - RNA, 19 nt, Homo sapiens
ccacauauacuacguucaa

SEQ ID NO: 1513109 - RNA, 19 nt, Homo sapiens
gaagagaaggagcaauuca

SEQ ID NO: 1513110 - RNA, 19 nt, Homo sapiens
gagcagagagauacugaga

SEQ ID NO: 1513111 - RNA, 19 nt, Homo sapiens
gcaguagugaugacaguaa

SEQ ID NO: 1513112 - RNA, 19 nt, Homo sapiens
gguaugcacccauguuuga

SEQ ID NO: 1513113 - RNA, 19 nt, Homo sapiens
guaagcaccaccacaggua

SEQ ID NO: 1513114 - RNA, 19 nt, Homo sapiens
gaagaagagcagugggauu

SEQ ID NO: 1513115 - RNA, 19 nt, Homo sapiens
gugaagagaaggagcaauu

SEQ ID NO: 1513116 - RNA, 19 nt, Homo sapiens
uauacuacguucaagaguu

SEQ ID NO: 1513117 - RNA, 19 nt, Homo sapiens
caaccgugcccgaauggua

SEQ ID NO: 1513118 - RNA, 19 nt, Homo sapiens
gcacauucuuguccuaaaa

SEQ ID NO: 1513119 - RNA, 19 nt, Homo sapiens
cacacuaccugaugucaug

SEQ ID NO: 1513120 - RNA, 19 nt, Homo sapiens
cuaccuagcuggauugacu

SEQ ID NO: 1513121 - RNA, 19 nt, Homo sapiens
ggaugcaagugaagaccuu

SEQ ID NO: 1513122 - RNA, 19 nt, Homo sapiens
uggauugacucugcaguaa

SEQ ID NO: 1513123 - RNA, 19 nt, Homo sapiens
ggaacacauuggacucauc

SEQ ID NO: 1513124 - RNA, 19 nt, Homo sapiens
caaaagaggagaagugauu

SEQ ID NO: 1513125 - RNA, 19 nt, Homo sapiens
ggaggacugcuguaugcua

SEQ ID NO: 1513126 - RNA, 19 nt, Homo sapiens
cuacuggccucucccuaga

SEQ ID NO: 1513127 - RNA, 19 nt, Homo sapiens
gugcuuccaugucuuaauc

SEQ ID NO: 1513128 - RNA, 19 nt, Homo sapiens
gagaaggagcaauucagaa

SEQ ID NO: 1513129 - RNA, 19 nt, Homo sapiens
ggacaucucaccuaagacu

SEQ ID NO: 1513130 - RNA, 19 nt, Homo sapiens
caguuaagguuguggaauc

SEQ ID NO: 1513131 - RNA, 19 nt, Homo sapiens
ccaacauaccucccacaua

SEQ ID NO: 1513132 - RNA, 19 nt, Homo sapiens
gauaugccaugaaguuuug

SEQ ID NO: 1513133 - RNA, 19 nt, Homo sapiens
gcacuaagcagggcacagu

SEQ ID NO: 1513134 - RNA, 19 nt, Homo sapiens
uuaagguuguggaaucaaa

SEQ ID NO: 1513135 - RNA, 19 nt, Homo sapiens
gaacacauuggacucaucu

SEQ ID NO: 1513136 - RNA, 19 nt, Homo sapiens
caccaucccuguucucagu

SEQ ID NO: 1513137 - RNA, 19 nt, Homo sapiens
gaaggcuguugcauugaca

SEQ ID NO: 1513138 - RNA, 19 nt, Homo sapiens
cuacaggagcagagagaua

SEQ ID NO: 1513139 - RNA, 19 nt, Homo sapiens
ucaagcauaucaguaagug

SEQ ID NO: 1513140 - RNA, 19 nt, Homo sapiens
gaaacacagcacuggcaaa

SEQ ID NO: 1513141 - RNA, 19 nt, Homo sapiens
gaaaguccgccugcagaga

SEQ ID NO: 1513142 - RNA, 19 nt, Homo sapiens
guggaggcuuacagugaua

SEQ ID NO: 1513143 - RNA, 19 nt, Homo sapiens
ccacagguaccauggaugu

SEQ ID NO: 1513144 - RNA, 19 nt, Homo sapiens
ugacagcuccaugcacuaa

SEQ ID NO: 1513145 - RNA, 19 nt, Homo sapiens
cagcauugggagucaguua

SEQ ID NO: 1513146 - RNA, 19 nt, Homo sapiens
caacagcaguagugaugac

SEQ ID NO: 1513147 - RNA, 19 nt, Homo sapiens
caggguagcaacagcagua

SEQ ID NO: 1513148 - RNA, 19 nt, Homo sapiens
auacuacguucaagaguuc

SEQ ID NO: 1513149 - RNA, 19 nt, Homo sapiens
guccaccuauugugauuau

SEQ ID NO: 1513150 - RNA, 19 nt, Homo sapiens
ccagugggauaugccauga

SEQ ID NO: 1513151 - RNA, 19 nt, Homo sapiens
gaaaauaaccauccacaac

SEQ ID NO: 1513152 - RNA, 19 nt, Homo sapiens
cugcuucccuugauguuug

SEQ ID NO: 1513153 - RNA, 19 nt, Homo sapiens
cugcagagaucuuagaacu

SEQ ID NO: 1513154 - RNA, 19 nt, Homo sapiens
cuagagggcaguaugaaug

SEQ ID NO: 1513155 - RNA, 19 nt, Homo sapiens
uauccuagcugggaacaca

SEQ ID NO: 1513156 - RNA, 19 nt, Homo sapiens
guacaaaggcgaguauacu

SEQ ID NO: 1513157 - RNA, 19 nt, Homo sapiens
gggauugccaguuaagguu

SEQ ID NO: 1513158 - RNA, 19 nt, Homo sapiens
acacaccccugcagucaua

SEQ ID NO: 1513159 - RNA, 19 nt, Homo sapiens
caauagagauaugaaucca

SEQ ID NO: 1513160 - RNA, 19 nt, Homo sapiens
aagaagagcagugggauug

SEQ ID NO: 1513161 - RNA, 19 nt, Homo sapiens
acauuggacucaucugugu

SEQ ID NO: 1513162 - RNA, 19 nt, Homo sapiens
uacaaaggcgaguauacua

SEQ ID NO: 1513163 - RNA, 19 nt, Homo sapiens
uaucucagcucugcaggau

SEQ ID NO: 1513164 - RNA, 19 nt, Homo sapiens
aaggguacuucaagcauau

SEQ ID NO: 1513165 - RNA, 19 nt, Homo sapiens
gagcgacuuuauccagauc

SEQ ID NO: 1513166 - RNA, 19 nt, Homo sapiens
gaggaaguauagccagcau

SEQ ID NO: 1513167 - RNA, 19 nt, Homo sapiens
gggauaugccaugaaguuu

SEQ ID NO: 1513168 - RNA, 19 nt, Homo sapiens
guaucucucugcuacucaa

SEQ ID NO: 1513169 - RNA, 19 nt, Homo sapiens
gguagcaacagcaguagug

SEQ ID NO: 1513170 - RNA, 19 nt, Homo sapiens
agcaaaggcuguugugaag

SEQ ID NO: 1513171 - RNA, 19 nt, Homo sapiens
caguggaggcuuacaguga

SEQ ID NO: 1513172 - RNA, 19 nt, Homo sapiens
cagcaguagugaugacagu

SEQ ID NO: 1513173 - RNA, 19 nt, Homo sapiens
ggguccaccuauugugauu

SEQ ID NO: 1513174 - RNA, 19 nt, Homo sapiens
acaaaggcgaguauacuau

SEQ ID NO: 1513175 - RNA, 19 nt, Homo sapiens
gcaguaauaaccucaaagc

SEQ ID NO: 1513176 - RNA, 19 nt, Homo sapiens
ugggauaugccaugaaguu

SEQ ID NO: 1513177 - RNA, 19 nt, Homo sapiens
ucaaagagcaaaggcuguu

SEQ ID NO: 1513178 - RNA, 19 nt, Homo sapiens
cagguaugcacccauguuu

SEQ ID NO: 1513179 - RNA, 19 nt, Homo sapiens
cagaguagccaaggaaaca

SEQ ID NO: 1513180 - RNA, 19 nt, Homo sapiens
ccucaaagcccaguacuac

SEQ ID NO: 1513181 - RNA, 19 nt, Homo sapiens
caccacagguaccauggau

SEQ ID NO: 1513182 - RNA, 19 nt, Homo sapiens
aaauaaccauccacaacag

SEQ ID NO: 1513183 - RNA, 19 nt, Homo sapiens
guacuucaagcauaucagu

SEQ ID NO: 1513184 - RNA, 19 nt, Homo sapiens
agagaaggagcaauucaga

SEQ ID NO: 1513185 - RNA, 19 nt, Homo sapiens
ccaggcugcuucccuugau

SEQ ID NO: 1513186 - RNA, 19 nt, Homo sapiens
ccgcaaugggcauguuuaa

SEQ ID NO: 1513187 - RNA, 19 nt, Homo sapiens
uaacauaacugaagccauu

SEQ ID NO: 1513188 - RNA, 19 nt, Homo sapiens
ggaaaugccuuuaucaauc

SEQ ID NO: 1513189 - RNA, 19 nt, Homo sapiens
gaauaucccuagaugauga

SEQ ID NO: 1513190 - RNA, 19 nt, Homo sapiens
gggaagcuuucaaauauaa

SEQ ID NO: 1513191 - RNA, 19 nt, Homo sapiens
gauuaaaggccaaguauuu

SEQ ID NO: 1513192 - RNA, 19 nt, Homo sapiens
gcagauaauucccaaagug

SEQ ID NO: 1513193 - RNA, 19 nt, Homo sapiens
aaacaaagauguguaagug

SEQ ID NO: 1513194 - RNA, 19 nt, Homo sapiens
gaaaugccuuuaucaaucu

SEQ ID NO: 1513195 - RNA, 19 nt, Homo sapiens
gaauguugguuguuacuga

SEQ ID NO: 1513196 - RNA, 19 nt, Homo sapiens
gcuaguuucugaugucuaa

SEQ ID NO: 1513197 - RNA, 19 nt, Homo sapiens
gaacauggcuuagguuuug

SEQ ID NO: 1513198 - RNA, 19 nt, Homo sapiens
caccagugcucuuaacaua

SEQ ID NO: 1513199 - RNA, 19 nt, Homo sapiens
caacuuggccacuuaauga

SEQ ID NO: 1513200 - RNA, 19 nt, Homo sapiens
gaacugauuugaggcuaaa

SEQ ID NO: 1513201 - RNA, 19 nt, Homo sapiens
ugucaucgcuuauugauau

SEQ ID NO: 1513202 - RNA, 19 nt, Homo sapiens
gcucuugugucaucgcuua

SEQ ID NO: 1513203 - RNA, 19 nt, Homo sapiens
aagaagaggucgaagauga

SEQ ID NO: 1513204 - RNA, 19 nt, Homo sapiens
gcaauuaccuauggagaau

SEQ ID NO: 1513205 - RNA, 19 nt, Homo sapiens
gauaaaaguuccauccaua

SEQ ID NO: 1513206 - RNA, 19 nt, Homo sapiens
ggaaucaagagauaguuua

SEQ ID NO: 1513207 - RNA, 19 nt, Homo sapiens
cgaagaggcugaauaugug

SEQ ID NO: 1513208 - RNA, 19 nt, Homo sapiens
gaaaagggauugagaaaag

SEQ ID NO: 1513209 - RNA, 19 nt, Homo sapiens
ggagcucccugaaccauga

SEQ ID NO: 1513210 - RNA, 19 nt, Homo sapiens
ggugaugucuuaccugaau

SEQ ID NO: 1513211 - RNA, 19 nt, Homo sapiens
ggaacugauuugaggcuaa

SEQ ID NO: 1513212 - RNA, 19 nt, Homo sapiens
aaacagcaauuaccuaugg

SEQ ID NO: 1513213 - RNA, 19 nt, Homo sapiens
gaaccacaaguuagcauuu

SEQ ID NO: 1513214 - RNA, 19 nt, Homo sapiens
uauacaacuuggccacuua

SEQ ID NO: 1513215 - RNA, 19 nt, Homo sapiens
aggaagaggucgaagauga

SEQ ID NO: 1513216 - RNA, 19 nt, Homo sapiens
ggaagaagaggucgaagau

SEQ ID NO: 1513217 - RNA, 19 nt, Homo sapiens
ggaagcagccgaagcaaca

SEQ ID NO: 1513218 - RNA, 19 nt, Homo sapiens
gaaggacaagcgauuacua

SEQ ID NO: 1513219 - RNA, 19 nt, Homo sapiens
uuaaugagcuuggaaucaa

SEQ ID NO: 1513220 - RNA, 19 nt, Homo sapiens
ggucgaagaugaggaggaa

SEQ ID NO: 1513221 - RNA, 19 nt, Homo sapiens
ggucgaagaugaggaggaa

SEQ ID NO: 1513222 - RNA, 19 nt, Homo sapiens
ugugugagcuaguuucuga

SEQ ID NO: 1513223 - RNA, 19 nt, Homo sapiens
agagagaacuuuauaagcu

SEQ ID NO: 1513224 - RNA, 19 nt, Homo sapiens
ggucgaagaggcugaauau

SEQ ID NO: 1513225 - RNA, 19 nt, Homo sapiens
gcauuuauuuguugaagag

SEQ ID NO: 1513226 - RNA, 19 nt, Homo sapiens
gaagccucguuauuggaua

SEQ ID NO: 1513227 - RNA, 19 nt, Homo sapiens
aauguguggugaugucuua

SEQ ID NO: 1513228 - RNA, 19 nt, Homo sapiens
cuauggaucuuccucagaa

SEQ ID NO: 1513229 - RNA, 19 nt, Homo sapiens
gaaaagggauggaacugau

SEQ ID NO: 1513230 - RNA, 19 nt, Homo sapiens
ucacuugccucuggaaaug

SEQ ID NO: 1513231 - RNA, 19 nt, Homo sapiens
gcagagaggggaagaauuu

SEQ ID NO: 1513232 - RNA, 19 nt, Homo sapiens
cagaauaucccuagaugau

SEQ ID NO: 1513233 - RNA, 19 nt, Homo sapiens
cauagcauauuuccagaau

SEQ ID NO: 1513234 - RNA, 19 nt, Homo sapiens
gcaaguguuucggguguau

SEQ ID NO: 1513235 - RNA, 19 nt, Homo sapiens
caauagaccgcaccgauau

SEQ ID NO: 1513236 - RNA, 19 nt, Homo sapiens
ggaagaagaggucgaagag

SEQ ID NO: 1513237 - RNA, 19 nt, Homo sapiens
ggaggugugugaugcaaag

SEQ ID NO: 1513238 - RNA, 19 nt, Homo sapiens
aaccacaaguuagcauuua

SEQ ID NO: 1513239 - RNA, 19 nt, Homo sapiens
uaguuaaaguccaagguaa

SEQ ID NO: 1513240 - RNA, 19 nt, Homo sapiens
ggaggaagaggucgaagau

SEQ ID NO: 1513241 - RNA, 19 nt, Homo sapiens
cagaaucccucucuagcau

SEQ ID NO: 1513242 - RNA, 19 nt, Homo sapiens
gaaacucuguauggcuuug

SEQ ID NO: 1513243 - RNA, 19 nt, Homo sapiens
gagaggaggagcuggaaga

SEQ ID NO: 1513244 - RNA, 19 nt, Homo sapiens
caacaccacccaauucauc

SEQ ID NO: 1513245 - RNA, 19 nt, Homo sapiens
acaauagaccgcaccgaua

SEQ ID NO: 1513246 - RNA, 19 nt, Homo sapiens
ucgaagaggcugaauaugu

SEQ ID NO: 1513247 - RNA, 19 nt, Homo sapiens
ccagugcucuuaacauaac

SEQ ID NO: 1513248 - RNA, 19 nt, Homo sapiens
ugaagcaccuggguugaga

SEQ ID NO: 1513249 - RNA, 19 nt, Homo sapiens
gagcagauaauucccaaag

SEQ ID NO: 1513250 - RNA, 19 nt, Homo sapiens
caaggaagcagccgaagca

SEQ ID NO: 1513251 - RNA, 19 nt, Homo sapiens
agaagaauguguggugaug

SEQ ID NO: 1513252 - RNA, 19 nt, Homo sapiens
gcucuuaacauaacugaag

SEQ ID NO: 1513253 - RNA, 19 nt, Homo sapiens
aagaagaggaggagaagaa

SEQ ID NO: 1513254 - RNA, 19 nt, Homo sapiens
ccacaaguuagcauuuauu

SEQ ID NO: 1513255 - RNA, 19 nt, Homo sapiens
aucccuagaugaugaauuu

SEQ ID NO: 1513256 - RNA, 19 nt, Homo sapiens
cuaaacagcaauuaccuau

SEQ ID NO: 1513257 - RNA, 19 nt, Homo sapiens
guucauggcacaggacuuu

SEQ ID NO: 1513258 - RNA, 19 nt, Homo sapiens
ccacagugcuauggaucuu

SEQ ID NO: 1513259 - RNA, 19 nt, Homo sapiens
gcagaaucccucucuagca

SEQ ID NO: 1513260 - RNA, 19 nt, Homo sapiens
caaagauguguaaguguga

SEQ ID NO: 1513261 - RNA, 19 nt, Homo sapiens
uggggaagcuuucaaauau

SEQ ID NO: 1513262 - RNA, 19 nt, Homo sapiens
ggaggaagaagaggucgaa

SEQ ID NO: 1513263 - RNA, 19 nt, Homo sapiens
gaagaagaggucgaagaug

SEQ ID NO: 1513264 - RNA, 19 nt, Homo sapiens
ggaggaagaagaggucgaa

SEQ ID NO: 1513265 - RNA, 19 nt, Homo sapiens
guugguuguuacugauaua

SEQ ID NO: 1513266 - RNA, 19 nt, Homo sapiens
cuaguuaaaguccaaggua

SEQ ID NO: 1513267 - RNA, 19 nt, Homo sapiens
uaacgcuacuaaauguuca

SEQ ID NO: 1513268 - RNA, 19 nt, Homo sapiens
uuccauccauagcauauuu

SEQ ID NO: 1513269 - RNA, 19 nt, Homo sapiens
ggggaagcuuucaaauaua

SEQ ID NO: 1513270 - RNA, 19 nt, Homo sapiens
ggaagaagaggaggagaag

SEQ ID NO: 1513271 - RNA, 19 nt, Homo sapiens
uaaguucugaggagccaua

SEQ ID NO: 1513272 - RNA, 19 nt, Homo sapiens
aaagggauggaacugauuu

SEQ ID NO: 1513273 - RNA, 19 nt, Homo sapiens
uuaaacaugccuucucaga

SEQ ID NO: 1513274 - RNA, 19 nt, Homo sapiens
ggacggcgacagugaagca

SEQ ID NO: 1513275 - RNA, 19 nt, Homo sapiens
uccagaauaucccuagaug

SEQ ID NO: 1513276 - RNA, 19 nt, Homo sapiens
uugcacaucuaguuaaagu

SEQ ID NO: 1513277 - RNA, 19 nt, Homo sapiens
augcguauguguaugacua

SEQ ID NO: 1513278 - RNA, 19 nt, Homo sapiens
gagagggagcagcagguaa

SEQ ID NO: 1513279 - RNA, 19 nt, Homo sapiens
ggaagaggaggagcuggaa

SEQ ID NO: 1513280 - RNA, 19 nt, Homo sapiens
cuauggagaauacaucauu

SEQ ID NO: 1513281 - RNA, 19 nt, Homo sapiens
agaagaacaugaaguugcu

SEQ ID NO: 1513282 - RNA, 19 nt, Homo sapiens
uauguaaacaccuucuuug

SEQ ID NO: 1513283 - RNA, 19 nt, Homo sapiens
ccaaagugccacaggaauc

SEQ ID NO: 1513284 - RNA, 19 nt, Homo sapiens
uggaaaugccuuuaucaau

SEQ ID NO: 1513285 - RNA, 19 nt, Homo sapiens
gcccaacaccacccaauuc

SEQ ID NO: 1513286 - RNA, 19 nt, Homo sapiens
aaaguuccauccauagcau

SEQ ID NO: 1513287 - RNA, 19 nt, Homo sapiens
gcuccuaggcugugauaua

SEQ ID NO: 1513288 - RNA, 19 nt, Homo sapiens
ggagucgccugcugcacua

SEQ ID NO: 1513289 - RNA, 19 nt, Homo sapiens
ccuaggcugugauauauau

SEQ ID NO: 1513290 - RNA, 19 nt, Homo sapiens
gcuccagccuuccaguuga

SEQ ID NO: 1513291 - RNA, 19 nt, Homo sapiens
ccacuggcaucaucuucaa

SEQ ID NO: 1513292 - RNA, 19 nt, Homo sapiens
ugaaagccuugcacacuca

SEQ ID NO: 1513293 - RNA, 19 nt, Homo sapiens
ccagcucuaugucacaauu

SEQ ID NO: 1513294 - RNA, 19 nt, Homo sapiens
ggucacagcugaggaagac

SEQ ID NO: 1513295 - RNA, 19 nt, Homo sapiens
acacucaccuccaccuuca

SEQ ID NO: 1513296 - RNA, 19 nt, Homo sapiens
gugaucaucuugaauuacu

SEQ ID NO: 1513297 - RNA, 19 nt, Homo sapiens
gcgccaagcaugcaguaaa

SEQ ID NO: 1513298 - RNA, 19 nt, Homo sapiens
ucagcugacucucauguuc

SEQ ID NO: 1513299 - RNA, 19 nt, Homo sapiens
gcucagggcucuucauccu

SEQ ID NO: 1513300 - RNA, 19 nt, Homo sapiens
cauguucucucgucucaca

SEQ ID NO: 1513301 - RNA, 19 nt, Homo sapiens
acaauuaccaucuccauca

SEQ ID NO: 1513302 - RNA, 19 nt, Homo sapiens
uggugaucaucuugaauua

SEQ ID NO: 1513303 - RNA, 19 nt, Homo sapiens
guggugaucaucuugaauu

SEQ ID NO: 1513304 - RNA, 19 nt, Homo sapiens
ggaccggagucagcugguu

SEQ ID NO: 1513305 - RNA, 19 nt, Homo sapiens
ggcaucaucuucaaguucu

SEQ ID NO: 1513306 - RNA, 19 nt, Homo sapiens
ccacaccauuuguuucucu

SEQ ID NO: 1513307 - RNA, 19 nt, Homo sapiens
guucucucgucucacauuu

SEQ ID NO: 1513308 - RNA, 19 nt, Homo sapiens
cuccuaggcugugauauau

SEQ ID NO: 1513309 - RNA, 19 nt, Homo sapiens
cuuccacucuccuuccuuu

SEQ ID NO: 1513310 - RNA, 19 nt, Homo sapiens
caauuaccaucuccaucau

SEQ ID NO: 1513311 - RNA, 19 nt, Homo sapiens
caugcgaggugauggagau

SEQ ID NO: 1513312 - RNA, 19 nt, Homo sapiens
uaccaucuccaucaucauu

SEQ ID NO: 1513313 - RNA, 19 nt, Homo sapiens
ccggauuucuggacuaugg

SEQ ID NO: 1513314 - RNA, 19 nt, Homo sapiens
caccgugucucgagaggau

SEQ ID NO: 1513315 - RNA, 19 nt, Homo sapiens
gaucaucuugaauuacugu

SEQ ID NO: 1513316 - RNA, 19 nt, Homo sapiens
cgccaagcaugcaguaaag

SEQ ID NO: 1513317 - RNA, 19 nt, Homo sapiens
cugcugcacuacaugagaa

SEQ ID NO: 1513318 - RNA, 19 nt, Homo sapiens
ccgcucagcugacucucau

SEQ ID NO: 1513319 - RNA, 19 nt, Homo sapiens
ugauggagaugggcuuauc

SEQ ID NO: 1513320 - RNA, 19 nt, Homo sapiens
gccauucucuggacuucag

SEQ ID NO: 1513321 - RNA, 19 nt, Homo sapiens
gcucagcugacucucaugu

SEQ ID NO: 1513322 - RNA, 19 nt, Homo sapiens
ccaucuccaucaucauugu

SEQ ID NO: 1513323 - RNA, 19 nt, Homo sapiens
gagcgagcaccuccaccaa

SEQ ID NO: 1513324 - RNA, 19 nt, Homo sapiens
cauuugcccuucccuuucu

SEQ ID NO: 1513325 - RNA, 19 nt, Homo sapiens
gccagcagccacugacaga

SEQ ID NO: 1513326 - RNA, 19 nt, Homo sapiens
ggugauggagaugggcuua

SEQ ID NO: 1513327 - RNA, 19 nt, Homo sapiens
ugaauuacugugggaugua

SEQ ID NO: 1513328 - RNA, 19 nt, Homo sapiens
cugcacacuuuaccucuca

SEQ ID NO: 1513329 - RNA, 19 nt, Homo sapiens
gcacacucaccuccaccuu

SEQ ID NO: 1513330 - RNA, 19 nt, Homo sapiens
ggaagaccucagacaugga

SEQ ID NO: 1513331 - RNA, 19 nt, Homo sapiens
caugaaagccuugcacacu

SEQ ID NO: 1513332 - RNA, 19 nt, Homo sapiens
cagcucuaugucacaauua

SEQ ID NO: 1513333 - RNA, 19 nt, Homo sapiens
cucacucucucccucauga

SEQ ID NO: 1513334 - RNA, 19 nt, Homo sapiens
acugugggauguaaguuuc

SEQ ID NO: 1513335 - RNA, 19 nt, Homo sapiens
gagcucugccuccaagucu

SEQ ID NO: 1513336 - RNA, 19 nt, Homo sapiens
caccuucacaggccauuug

SEQ ID NO: 1513337 - RNA, 19 nt, Homo sapiens
cccauuugcccuucccuuu

SEQ ID NO: 1513338 - RNA, 19 nt, Homo sapiens
uuaccucucaugugcguuu

SEQ ID NO: 1513339 - RNA, 19 nt, Homo sapiens
ucucacauuugcacucucu

SEQ ID NO: 1513340 - RNA, 19 nt, Homo sapiens
caagaucacgucggcaagu

SEQ ID NO: 1513341 - RNA, 19 nt, Homo sapiens
gagagccagcagccacuga

SEQ ID NO: 1513342 - RNA, 19 nt, Homo sapiens
uacagucccuuuugucuug

SEQ ID NO: 1513343 - RNA, 19 nt, Homo sapiens
ccauuugcccuucccuuuc

SEQ ID NO: 1513344 - RNA, 19 nt, Homo sapiens
gcacacuuuaccucucaug

SEQ ID NO: 1513345 - RNA, 19 nt, Homo sapiens
acucucuccuucccacauu

SEQ ID NO: 1513346 - RNA, 19 nt, Homo sapiens
auuaccaucuccaucauca

SEQ ID NO: 1513347 - RNA, 19 nt, Homo sapiens
gaaggaaguuuggguagua

SEQ ID NO: 1513348 - RNA, 19 nt, Homo sapiens
gaaguucgagugaagauua

SEQ ID NO: 1513349 - RNA, 19 nt, Homo sapiens
ggaaggagguggguguuaa

SEQ ID NO: 1513350 - RNA, 19 nt, Homo sapiens
gaaagugucugggauguuc

SEQ ID NO: 1513351 - RNA, 19 nt, Homo sapiens
gagugaagauuaaacugua

SEQ ID NO: 1513352 - RNA, 19 nt, Homo sapiens
ugacaauggugaugcauaa

SEQ ID NO: 1513353 - RNA, 19 nt, Homo sapiens
ggugaucacugaaaucuug

SEQ ID NO: 1513354 - RNA, 19 nt, Homo sapiens
ggagauacuugugaauauu

SEQ ID NO: 1513355 - RNA, 19 nt, Homo sapiens
ggaagaagauaugaaagug

SEQ ID NO: 1513356 - RNA, 19 nt, Homo sapiens
gagaaaauguggcucuuua

SEQ ID NO: 1513357 - RNA, 19 nt, Homo sapiens
ggagaggaguuauaauauc

SEQ ID NO: 1513358 - RNA, 19 nt, Homo sapiens
gggagauacuugugaauau

SEQ ID NO: 1513359 - RNA, 19 nt, Homo sapiens
gaacaucccaucaaaccaa

SEQ ID NO: 1513360 - RNA, 19 nt, Homo sapiens
cagaugccaugccuguuua

SEQ ID NO: 1513361 - RNA, 19 nt, Homo sapiens
ggagguccaugaacuagga

SEQ ID NO: 1513362 - RNA, 19 nt, Homo sapiens
gaaagaggcaugugaagag

SEQ ID NO: 1513363 - RNA, 19 nt, Homo sapiens
gaaaggcuguggccauguc

SEQ ID NO: 1513364 - RNA, 19 nt, Homo sapiens
gcuaggaguggcucauuua

SEQ ID NO: 1513365 - RNA, 19 nt, Homo sapiens
agacaaagacauagccaua

SEQ ID NO: 1513366 - RNA, 19 nt, Homo sapiens
ucuaagaggugaaggucua

SEQ ID NO: 1513367 - RNA, 19 nt, Homo sapiens
ucacagagcacguugauca

SEQ ID NO: 1513368 - RNA, 19 nt, Homo sapiens
ggcaagugauggagaacua

SEQ ID NO: 1513369 - RNA, 19 nt, Homo sapiens
cgauaucccugcuugagaa

SEQ ID NO: 1513370 - RNA, 19 nt, Homo sapiens
caagaagaguugaggaaag

SEQ ID NO: 1513371 - RNA, 19 nt, Homo sapiens
gaacugacagcauuuaaac

SEQ ID NO: 1513372 - RNA, 19 nt, Homo sapiens
ggagugauguggccugaag

SEQ ID NO: 1513373 - RNA, 19 nt, Homo sapiens
gagaggagaugggcacugu

SEQ ID NO: 1513374 - RNA, 19 nt, Homo sapiens
ggaaagaggcaugugaaga

SEQ ID NO: 1513375 - RNA, 19 nt, Homo sapiens
ggaacugacagcauuuaaa

SEQ ID NO: 1513376 - RNA, 19 nt, Homo sapiens
guuauaauauccucaccuu

SEQ ID NO: 1513377 - RNA, 19 nt, Homo sapiens
gauguucucuccucuguac

SEQ ID NO: 1513378 - RNA, 19 nt, Homo sapiens
caacuccacuuucuuugca

SEQ ID NO: 1513379 - RNA, 19 nt, Homo sapiens
ggacacccuuccucugaau

SEQ ID NO: 1513380 - RNA, 19 nt, Homo sapiens
guauuugcauggagacuga

SEQ ID NO: 1513381 - RNA, 19 nt, Homo sapiens
ggaguaaccagaccauuag

SEQ ID NO: 1513382 - RNA, 19 nt, Homo sapiens
uauaauauccucaccuuuc

SEQ ID NO: 1513383 - RNA, 19 nt, Homo sapiens
gaagaguugaggaaagauu

SEQ ID NO: 1513384 - RNA, 19 nt, Homo sapiens
acagcuaccuggucauuau

SEQ ID NO: 1513385 - RNA, 19 nt, Homo sapiens
caccugaccuugacaaugg

SEQ ID NO: 1513386 - RNA, 19 nt, Homo sapiens
ucucuucucugaccugauu

SEQ ID NO: 1513387 - RNA, 19 nt, Homo sapiens
aagaagaguugaggaaaga

SEQ ID NO: 1513388 - RNA, 19 nt, Homo sapiens
gcauuaagucugggagaua

SEQ ID NO: 1513389 - RNA, 19 nt, Homo sapiens
gaacuucaagcucuuucuu

SEQ ID NO: 1513390 - RNA, 19 nt, Homo sapiens
gaaagggagcaaugacaug

SEQ ID NO: 1513391 - RNA, 19 nt, Homo sapiens
ggaaggaaguuuggguagu

SEQ ID NO: 1513392 - RNA, 19 nt, Homo sapiens
aaagagaaccauugaagga

SEQ ID NO: 1513393 - RNA, 19 nt, Homo sapiens
guaaaugagggaacgauau

SEQ ID NO: 1513394 - RNA, 19 nt, Homo sapiens
gaaguagagcugagaaucu

SEQ ID NO: 1513395 - RNA, 19 nt, Homo sapiens
ggaggcagaggaagagaaa

SEQ ID NO: 1513396 - RNA, 19 nt, Homo sapiens
gagaggaguuauaauaucc

SEQ ID NO: 1513397 - RNA, 19 nt, Homo sapiens
gaagaagauaugaaagugu

SEQ ID NO: 1513398 - RNA, 19 nt, Homo sapiens
cuggagaggaguuauaaua

SEQ ID NO: 1513399 - RNA, 19 nt, Homo sapiens
gugaaggucuaacaugauc

SEQ ID NO: 1513400 - RNA, 19 nt, Homo sapiens
gaacuaaacaaagaacagu

SEQ ID NO: 1513401 - RNA, 19 nt, Homo sapiens
gggauguucucuccucugu

SEQ ID NO: 1513402 - RNA, 19 nt, Homo sapiens
gcugaaggcuuggaaagag

SEQ ID NO: 1513403 - RNA, 19 nt, Homo sapiens
gagaaccauugaaggaauc

SEQ ID NO: 1513404 - RNA, 19 nt, Homo sapiens
gggaagaagauaugaaagu

SEQ ID NO: 1513405 - RNA, 19 nt, Homo sapiens
ucagaugccaugccuguuu

SEQ ID NO: 1513406 - RNA, 19 nt, Homo sapiens
gcagauggaguugguauuc

SEQ ID NO: 1513407 - RNA, 19 nt, Homo sapiens
gaggagaugggcacuguug

SEQ ID NO: 1513408 - RNA, 19 nt, Homo sapiens
gguaaaugagggaacgaua

SEQ ID NO: 1513409 - RNA, 19 nt, Homo sapiens
guuaaccucucaguuccua

SEQ ID NO: 1513410 - RNA, 19 nt, Homo sapiens
gaaaagagaaccauugaag

SEQ ID NO: 1513411 - RNA, 19 nt, Homo sapiens
aggaguaaccagaccauua

SEQ ID NO: 1513412 - RNA, 19 nt, Homo sapiens
cauggagacugagauguga

SEQ ID NO: 1513413 - RNA, 19 nt, Homo sapiens
gcauggagacugagaugug

SEQ ID NO: 1513414 - RNA, 19 nt, Homo sapiens
cuaaaggaccggagugaug

SEQ ID NO: 1513415 - RNA, 19 nt, Homo sapiens
ggaaguagagcugagaauc

SEQ ID NO: 1513416 - RNA, 19 nt, Homo sapiens
gguccugagagaaauguua

SEQ ID NO: 1513417 - RNA, 19 nt, Homo sapiens
ugccaugccuguuuaaauc

SEQ ID NO: 1513418 - RNA, 19 nt, Homo sapiens
auggagaacuaaacaaaga

SEQ ID NO: 1513419 - RNA, 19 nt, Homo sapiens
ggagugaugugggaaacca

SEQ ID NO: 1513420 - RNA, 19 nt, Homo sapiens
ccaagaagauacaguuuuc

SEQ ID NO: 1513421 - RNA, 19 nt, Homo sapiens
ggaauaugggaagaagaua

SEQ ID NO: 1513422 - RNA, 19 nt, Homo sapiens
guuaucuggugaucacuga

SEQ ID NO: 1513423 - RNA, 19 nt, Homo sapiens
gaacgauaucccugcuuga

SEQ ID NO: 1513424 - RNA, 19 nt, Homo sapiens
guaaccagaccauuaguag

SEQ ID NO: 1513425 - RNA, 19 nt, Homo sapiens
caagcucuuucuucacuca

SEQ ID NO: 1513426 - RNA, 19 nt, Homo sapiens
agagaaccauugaaggaau

SEQ ID NO: 1513427 - RNA, 19 nt, Homo sapiens
caaacccuuucacucaguu

SEQ ID NO: 1513428 - RNA, 19 nt, Homo sapiens
ccaagaagaguugaggaaa

SEQ ID NO: 1513429 - RNA, 19 nt, Homo sapiens
ggagaugggcacuguugug

SEQ ID NO: 1513430 - RNA, 19 nt, Homo sapiens
ugauggagaacuaaacaaa

SEQ ID NO: 1513431 - RNA, 19 nt, Homo sapiens
gcaagugauggagaacuaa

SEQ ID NO: 1513432 - RNA, 19 nt, Homo sapiens
ggccaugucugcuucuuuu

SEQ ID NO: 1513433 - RNA, 19 nt, Homo sapiens
ucagucugguuacagcuuu

SEQ ID NO: 1513434 - RNA, 19 nt, Homo sapiens
acugggaacugacagcauu

SEQ ID NO: 1513435 - RNA, 19 nt, Homo sapiens
guuaagcgauuggugauac

SEQ ID NO: 1513436 - RNA, 19 nt, Homo sapiens
uaaaugagggaacgauauc

SEQ ID NO: 1513437 - RNA, 19 nt, Homo sapiens
aggugaaggucuaacauga

SEQ ID NO: 1513438 - RNA, 19 nt, Homo sapiens
uggagagccugcuggagaa

SEQ ID NO: 1513439 - RNA, 19 nt, Homo sapiens
aagaguugaggaaagauua

SEQ ID NO: 1513440 - RNA, 19 nt, Homo sapiens
gauacuaaguggucuuuuc

SEQ ID NO: 1513441 - RNA, 19 nt, Homo sapiens
gaggugaaggucuaacaug

SEQ ID NO: 1513442 - RNA, 19 nt, Homo sapiens
caucugugguagaguuaga

SEQ ID NO: 1513443 - RNA, 19 nt, Homo sapiens
gcaccugaccuugacaaug

SEQ ID NO: 1513444 - RNA, 19 nt, Homo sapiens
gaagugugcaaaggagauu

SEQ ID NO: 1513445 - RNA, 19 nt, Homo sapiens
ccaaacccuuucacucagu

SEQ ID NO: 1513446 - RNA, 19 nt, Homo sapiens
caagugauggagaacuaaa

SEQ ID NO: 1513447 - RNA, 19 nt, Homo sapiens
ggacagaaccuauuacuaa

SEQ ID NO: 1513448 - RNA, 19 nt, Homo sapiens
caagagaagcuuccaauua

SEQ ID NO: 1513449 - RNA, 19 nt, Homo sapiens
gcacaagguucuuucaugu

SEQ ID NO: 1513450 - RNA, 19 nt, Homo sapiens
gaagaaugccaaagaauug

SEQ ID NO: 1513451 - RNA, 19 nt, Homo sapiens
ggaagaaugccaaagaauu

SEQ ID NO: 1513452 - RNA, 19 nt, Homo sapiens
gcgcagaccuccacccauu

SEQ ID NO: 1513453 - RNA, 19 nt, Homo sapiens
cuacagaaaugccagauug

SEQ ID NO: 1513454 - RNA, 19 nt, Homo sapiens
gaacagcagacuccucuuu

SEQ ID NO: 1513455 - RNA, 19 nt, Homo sapiens
gacagaaccuauuacuaaa

SEQ ID NO: 1513456 - RNA, 19 nt, Homo sapiens
gcaaagaaguagacauuuu

SEQ ID NO: 1513457 - RNA, 19 nt, Homo sapiens
ggagaaaacugauguggaa

SEQ ID NO: 1513458 - RNA, 19 nt, Homo sapiens
ccacaggccuauuucaaug

SEQ ID NO: 1513459 - RNA, 19 nt, Homo sapiens
aagagaagcuuccaauuag

SEQ ID NO: 1513460 - RNA, 19 nt, Homo sapiens
gaaugaugacaacuucuua

SEQ ID NO: 1513461 - RNA, 19 nt, Homo sapiens
gggcaaagaaguagacauu

SEQ ID NO: 1513462 - RNA, 19 nt, Homo sapiens
ccaaagaauugcagagcuu

SEQ ID NO: 1513463 - RNA, 19 nt, Homo sapiens
cagaaccuauuacuaaaga

SEQ ID NO: 1513464 - RNA, 19 nt, Homo sapiens
cagcagagcucccacuucu

SEQ ID NO: 1513465 - RNA, 19 nt, Homo sapiens
gcacugcuguaccucauuc

SEQ ID NO: 1513466 - RNA, 19 nt, Homo sapiens
caaaccaauuccagugaaa

SEQ ID NO: 1513467 - RNA, 19 nt, Homo sapiens
aaaccuaacucaguaugaa

SEQ ID NO: 1513468 - RNA, 19 nt, Homo sapiens
gaucuccccucaagaguua

SEQ ID NO: 1513469 - RNA, 19 nt, Homo sapiens
guuguuuccuucaauguuu

SEQ ID NO: 1513470 - RNA, 19 nt, Homo sapiens
acaagguucuuucauguug

SEQ ID NO: 1513471 - RNA, 19 nt, Homo sapiens
guucugcgaucuauugaga

SEQ ID NO: 1513472 - RNA, 19 nt, Homo sapiens
gaagagaacaguccacacu

SEQ ID NO: 1513473 - RNA, 19 nt, Homo sapiens
gcaagagaagcuuccaauu

SEQ ID NO: 1513474 - RNA, 19 nt, Homo sapiens
uaaggaagaaugccaaaga

SEQ ID NO: 1513475 - RNA, 19 nt, Homo sapiens
ggcacaagguucuuucaug

SEQ ID NO: 1513476 - RNA, 19 nt, Homo sapiens
gccuaucucuucagcauga

SEQ ID NO: 1513477 - RNA, 19 nt, Homo sapiens
ucagaaugaugacaacuuc

SEQ ID NO: 1513478 - RNA, 19 nt, Homo sapiens
caauccaaaucucaucaaa

SEQ ID NO: 1513479 - RNA, 19 nt, Homo sapiens
ccucaagaguuacugaaga

SEQ ID NO: 1513480 - RNA, 19 nt, Homo sapiens
ggacaucaggcucauggaa

SEQ ID NO: 1513481 - RNA, 19 nt, Homo sapiens
aaagcuacaugucaggaaa

SEQ ID NO: 1513482 - RNA, 19 nt, Homo sapiens
ccaaagacgaauacacaaa

SEQ ID NO: 1513483 - RNA, 19 nt, Homo sapiens
ugaauaggcugagcaugga

SEQ ID NO: 1513484 - RNA, 19 nt, Homo sapiens
ggaacuggagcaggaauuu

SEQ ID NO: 1513485 - RNA, 19 nt, Homo sapiens
caaagaauugcagagcuua

SEQ ID NO: 1513486 - RNA, 19 nt, Homo sapiens
caagacacccaacacagaa

SEQ ID NO: 1513487 - RNA, 19 nt, Homo sapiens
caacaagacacccaacaca

SEQ ID NO: 1513488 - RNA, 19 nt, Homo sapiens
gcagcucuguccagccauu

SEQ ID NO: 1513489 - RNA, 19 nt, Homo sapiens
ucaaaccaauuccagugaa

SEQ ID NO: 1513490 - RNA, 19 nt, Homo sapiens
ccaaaucucaucaaaccaa

SEQ ID NO: 1513491 - RNA, 19 nt, Homo sapiens
ccagugaaacccagugaaa

SEQ ID NO: 1513492 - RNA, 19 nt, Homo sapiens
caucaaggccaaagacgaa

SEQ ID NO: 1513493 - RNA, 19 nt, Homo sapiens
aaggaagaaugccaaagaa

SEQ ID NO: 1513494 - RNA, 19 nt, Homo sapiens
aaacaagugugacccuagu

SEQ ID NO: 1513495 - RNA, 19 nt, Homo sapiens
ucgagaaacuucagaguac

SEQ ID NO: 1513496 - RNA, 19 nt, Homo sapiens
gaaaaccggccuugugaaa

SEQ ID NO: 1513497 - RNA, 19 nt, Homo sapiens
ggccaaagacgaauacaca

SEQ ID NO: 1513498 - RNA, 19 nt, Homo sapiens
caagguucuuucauguuga

SEQ ID NO: 1513499 - RNA, 19 nt, Homo sapiens
caaaucucaucaaaccaau

SEQ ID NO: 1513500 - RNA, 19 nt, Homo sapiens
caaagacgaauacacaaag

SEQ ID NO: 1513501 - RNA, 19 nt, Homo sapiens
gaauugcagagcuuaugaa

SEQ ID NO: 1513502 - RNA, 19 nt, Homo sapiens
gauaaggaagaaugccaaa

SEQ ID NO: 1513503 - RNA, 19 nt, Homo sapiens
cucaagaguuacugaagaa

SEQ ID NO: 1513504 - RNA, 19 nt, Homo sapiens
caaggucugcuucuccaaa

SEQ ID NO: 1513505 - RNA, 19 nt, Homo sapiens
gggcagcaaacaaguguga

SEQ ID NO: 1513506 - RNA, 19 nt, Homo sapiens
uggcagcucuggagugauc

SEQ ID NO: 1513507 - RNA, 19 nt, Homo sapiens
cuucaauguuucugccuuu

SEQ ID NO: 1513508 - RNA, 19 nt, Homo sapiens
acaagacacccaacacaga

SEQ ID NO: 1513509 - RNA, 19 nt, Homo sapiens
acaucaggcucauggaaga

SEQ ID NO: 1513510 - RNA, 19 nt, Homo sapiens
cuacaugucaggaaacugu

SEQ ID NO: 1513511 - RNA, 19 nt, Homo sapiens
aaagacgaauacacaaagu

SEQ ID NO: 1513512 - RNA, 19 nt, Homo sapiens
ucacaacauuggaacuucu

SEQ ID NO: 1513513 - RNA, 19 nt, Homo sapiens
gaacuggagcaggaauuuc

SEQ ID NO: 1513514 - RNA, 19 nt, Homo sapiens
gaaaacugauguggaagga

SEQ ID NO: 1513515 - RNA, 19 nt, Homo sapiens
gaacuucucgugguguaca

SEQ ID NO: 1513516 - RNA, 19 nt, Homo sapiens
gaaguagacauuuuacgaa

SEQ ID NO: 1513517 - RNA, 19 nt, Homo sapiens
gaguguuguuuccuucaau

SEQ ID NO: 1513518 - RNA, 19 nt, Homo sapiens
guucuuucauguugagugu

SEQ ID NO: 1513519 - RNA, 19 nt, Homo sapiens
ccucagcgcaucccugcua

SEQ ID NO: 1513520 - RNA, 19 nt, Homo sapiens
gcagaccuccacccauugu

SEQ ID NO: 1513521 - RNA, 19 nt, Homo sapiens
uacgcucccuguccuauga

SEQ ID NO: 1513522 - RNA, 19 nt, Homo sapiens
ggagagggcaaagaaguag

SEQ ID NO: 1513523 - RNA, 19 nt, Homo sapiens
gaaagcccaucagggaacu

SEQ ID NO: 1513524 - RNA, 19 nt, Homo sapiens
gacucaagcagccaugaaa

SEQ ID NO: 1513525 - RNA, 19 nt, Homo sapiens
ccagaacucagaaccuguu

SEQ ID NO: 1513526 - RNA, 19 nt, Homo sapiens
uggaacuucucguggugua

SEQ ID NO: 1513527 - RNA, 19 nt, Homo sapiens
gcaggacaaagcuacaugu

SEQ ID NO: 1513528 - RNA, 19 nt, Homo sapiens
ccucugccaucuaugacaa

SEQ ID NO: 1513529 - RNA, 19 nt, Homo sapiens
caguuccucugccaucuau

SEQ ID NO: 1513530 - RNA, 19 nt, Homo sapiens
gaaccuauuacuaaagacu

SEQ ID NO: 1513531 - RNA, 19 nt, Homo sapiens
ucaaggccaaagacgaaua

SEQ ID NO: 1513532 - RNA, 19 nt, Homo sapiens
aagccuaucucuucagcau

SEQ ID NO: 1513533 - RNA, 19 nt, Homo sapiens
caaagcuacaugucaggaa

SEQ ID NO: 1513534 - RNA, 19 nt, Homo sapiens
ggcaaagaaguagacauuu

SEQ ID NO: 1513535 - RNA, 19 nt, Homo sapiens
ugaguguuguuuccuucaa

SEQ ID NO: 1513536 - RNA, 19 nt, Homo sapiens
gcaaggccuuuuaaaacug

SEQ ID NO: 1513537 - RNA, 19 nt, Homo sapiens
ugcuguaccucauucagaa

SEQ ID NO: 1513538 - RNA, 19 nt, Homo sapiens
gccagggucuccucacaac

SEQ ID NO: 1513539 - RNA, 19 nt, Homo sapiens
cagccagggucuccucaca

SEQ ID NO: 1513540 - RNA, 19 nt, Homo sapiens
gaaaugccagauuguccau

SEQ ID NO: 1513541 - RNA, 19 nt, Homo sapiens
caccacaggccuauuucaa

SEQ ID NO: 1513542 - RNA, 19 nt, Homo sapiens
aaaccggccuugugaaaau

SEQ ID NO: 1513543 - RNA, 19 nt, Homo sapiens
guccagccauucagaaacu

SEQ ID NO: 1513544 - RNA, 19 nt, Homo sapiens
guuccucugccaucuauga

SEQ ID NO: 1513545 - RNA, 19 nt, Homo sapiens
ucuuucauguugaguguug

SEQ ID NO: 1513546 - RNA, 19 nt, Homo sapiens
gcagcccacucaccaagcu

SEQ ID NO: 1513547 - RNA, 19 nt, Homo sapiens
gaacagccauucugauuaa

SEQ ID NO: 1513548 - RNA, 19 nt, Homo sapiens
gcaaacaaguucacaauug

SEQ ID NO: 1513549 - RNA, 19 nt, Homo sapiens
caaacaaguucacaauuga

SEQ ID NO: 1513550 - RNA, 19 nt, Homo sapiens
gcacugaccuagcagaaga

SEQ ID NO: 1513551 - RNA, 19 nt, Homo sapiens
gaucagggcuggcaguaga

SEQ ID NO: 1513552 - RNA, 19 nt, Homo sapiens
gaacugcucugccaaaauu

SEQ ID NO: 1513553 - RNA, 19 nt, Homo sapiens
ggaauuggcugggagagaa

SEQ ID NO: 1513554 - RNA, 19 nt, Homo sapiens
gcacuugucuuuuccauaa

SEQ ID NO: 1513555 - RNA, 19 nt, Homo sapiens
gaagacagcccaaagagau

SEQ ID NO: 1513556 - RNA, 19 nt, Homo sapiens
uauaauggcuccaguuugu

SEQ ID NO: 1513557 - RNA, 19 nt, Homo sapiens
gaagacagcuuauuuugug

SEQ ID NO: 1513558 - RNA, 19 nt, Homo sapiens
cagaagagaucagcgcuaa

SEQ ID NO: 1513559 - RNA, 19 nt, Homo sapiens
ucaaacuguuccugcauua

SEQ ID NO: 1513560 - RNA, 19 nt, Homo sapiens
cagccauucugauuaauaa

SEQ ID NO: 1513561 - RNA, 19 nt, Homo sapiens
cauuauaucuacccaaguu

SEQ ID NO: 1513562 - RNA, 19 nt, Homo sapiens
gcaccaguauugcaucaga

SEQ ID NO: 1513563 - RNA, 19 nt, Homo sapiens
gaucagcgcuaacuuugag

SEQ ID NO: 1513564 - RNA, 19 nt, Homo sapiens
cacaccaccucuaccauua

SEQ ID NO: 1513565 - RNA, 19 nt, Homo sapiens
cgucuuagauguugauuca

SEQ ID NO: 1513566 - RNA, 19 nt, Homo sapiens
gaaauaaggacaagagcau

SEQ ID NO: 1513567 - RNA, 19 nt, Homo sapiens
gguaggcucuccagucuca

SEQ ID NO: 1513568 - RNA, 19 nt, Homo sapiens
ggagucgucuuagauguug

SEQ ID NO: 1513569 - RNA, 19 nt, Homo sapiens
gccgagccgugcacuauaa

SEQ ID NO: 1513570 - RNA, 19 nt, Homo sapiens
aaacuguuccugcauuaua

SEQ ID NO: 1513571 - RNA, 19 nt, Homo sapiens
ggacgaagacacaaagcaa

SEQ ID NO: 1513572 - RNA, 19 nt, Homo sapiens
cagaugaguuucucuucaa

SEQ ID NO: 1513573 - RNA, 19 nt, Homo sapiens
gcucagcaacaauaugaua

SEQ ID NO: 1513574 - RNA, 19 nt, Homo sapiens
gaaaaggucucacaguagu

SEQ ID NO: 1513575 - RNA, 19 nt, Homo sapiens
gagaucagcgcuaacuuug

SEQ ID NO: 1513576 - RNA, 19 nt, Homo sapiens
ugaacagccauucugauua

SEQ ID NO: 1513577 - RNA, 19 nt, Homo sapiens
gugagucccugucuccaaa

SEQ ID NO: 1513578 - RNA, 19 nt, Homo sapiens
uaauggcuccaguuuguua

SEQ ID NO: 1513579 - RNA, 19 nt, Homo sapiens
gugaacagccauucugauu

SEQ ID NO: 1513580 - RNA, 19 nt, Homo sapiens
gacagacgguugaauuucu

SEQ ID NO: 1513581 - RNA, 19 nt, Homo sapiens
gagagcgacuugcaguugu

SEQ ID NO: 1513582 - RNA, 19 nt, Homo sapiens
ggagagcgacuugcaguug

SEQ ID NO: 1513583 - RNA, 19 nt, Homo sapiens
caucucaccuuaccucagu

SEQ ID NO: 1513584 - RNA, 19 nt, Homo sapiens
guaacccgcucuccagaca

SEQ ID NO: 1513585 - RNA, 19 nt, Homo sapiens
caucugacagugacaauga

SEQ ID NO: 1513586 - RNA, 19 nt, Homo sapiens
ggcagcgccucucaccaua

SEQ ID NO: 1513587 - RNA, 19 nt, Homo sapiens
ugaaagcgaugaugaugac

SEQ ID NO: 1513588 - RNA, 19 nt, Homo sapiens
gaagagaucagcgcuaacu

SEQ ID NO: 1513589 - RNA, 19 nt, Homo sapiens
gaagcaaacaaguucacaa

SEQ ID NO: 1513590 - RNA, 19 nt, Homo sapiens
ugaaguucuuaaccuagua

SEQ ID NO: 1513591 - RNA, 19 nt, Homo sapiens
caccaccucuaccauuauu

SEQ ID NO: 1513592 - RNA, 19 nt, Homo sapiens
ccacaccaccucuaccauu

SEQ ID NO: 1513593 - RNA, 19 nt, Homo sapiens
gguugaauuucucuacgaa

SEQ ID NO: 1513594 - RNA, 19 nt, Homo sapiens
gcgaugaugaugacgauga

SEQ ID NO: 1513595 - RNA, 19 nt, Homo sapiens
gaugaaagcgaugaugaug

SEQ ID NO: 1513596 - RNA, 19 nt, Homo sapiens
ccaccgcucagcaacaaua

SEQ ID NO: 1513597 - RNA, 19 nt, Homo sapiens
ggccagugguucacauuca

SEQ ID NO: 1513598 - RNA, 19 nt, Homo sapiens
gagcugugauggcgucagu

SEQ ID NO: 1513599 - RNA, 19 nt, Homo sapiens
ggccgaggaaggaggauua

SEQ ID NO: 1513600 - RNA, 19 nt, Homo sapiens
ucgaaaaggucucacagua

SEQ ID NO: 1513601 - RNA, 19 nt, Homo sapiens
acagaugaguuucucuuca

SEQ ID NO: 1513602 - RNA, 19 nt, Homo sapiens
gagccugcauguucucauc

SEQ ID NO: 1513603 - RNA, 19 nt, Homo sapiens
ugaagacauuaaagacgaa

SEQ ID NO: 1513604 - RNA, 19 nt, Homo sapiens
agagaucagcgcuaacuuu

SEQ ID NO: 1513605 - RNA, 19 nt, Homo sapiens
gacgaagacacaaagcaaa

SEQ ID NO: 1513606 - RNA, 19 nt, Homo sapiens
ggucauggcccagcuuuua

SEQ ID NO: 1513607 - RNA, 19 nt, Homo sapiens
ccagacagcaauaauguag

SEQ ID NO: 1513608 - RNA, 19 nt, Homo sapiens
agacgaagcaaacaaguuc

SEQ ID NO: 1513609 - RNA, 19 nt, Homo sapiens
caccuccugucauuauaaa

SEQ ID NO: 1513610 - RNA, 19 nt, Homo sapiens
ggccaccgcucagcaacaa

SEQ ID NO: 1513611 - RNA, 19 nt, Homo sapiens
uaaggugggaggaucguuu

SEQ ID NO: 1513612 - RNA, 19 nt, Homo sapiens
uugaauuucucuacgaaga

SEQ ID NO: 1513613 - RNA, 19 nt, Homo sapiens
ugggucagcuccugugaug

SEQ ID NO: 1513614 - RNA, 19 nt, Homo sapiens
agacagcccaaagagauua

SEQ ID NO: 1513615 - RNA, 19 nt, Homo sapiens
ggucauacagacacaaauc

SEQ ID NO: 1513616 - RNA, 19 nt, Homo sapiens
augaauggaugaucuguca

SEQ ID NO: 1513617 - RNA, 19 nt, Homo sapiens
gaguuucucuucaaaucag

SEQ ID NO: 1513618 - RNA, 19 nt, Homo sapiens
ccauugaagacauuaaaga

SEQ ID NO: 1513619 - RNA, 19 nt, Homo sapiens
caacuagguaugguggaua

SEQ ID NO: 1513620 - RNA, 19 nt, Homo sapiens
cagcaacaauaugauagug

SEQ ID NO: 1513621 - RNA, 19 nt, Homo sapiens
uguugaaguucuuaaccua

SEQ ID NO: 1513622 - RNA, 19 nt, Homo sapiens
cugcugaccugugcacuga

SEQ ID NO: 1513623 - RNA, 19 nt, Homo sapiens
gaugacaccggacccauag

SEQ ID NO: 1513624 - RNA, 19 nt, Homo sapiens
cauacagacacaaaucaaa

SEQ ID NO: 1513625 - RNA, 19 nt, Homo sapiens
ccuaguagcccaggaaugu

SEQ ID NO: 1513626 - RNA, 19 nt, Homo sapiens
caaugaagcagagcggaaa

SEQ ID NO: 1513627 - RNA, 19 nt, Homo sapiens
cgaagacagcccaaagaga

SEQ ID NO: 1513628 - RNA, 19 nt, Homo sapiens
gagugaacagccauucuga

SEQ ID NO: 1513629 - RNA, 19 nt, Homo sapiens
uaaagacgaagcaaacaag

SEQ ID NO: 1513630 - RNA, 19 nt, Homo sapiens
ccgcucagcaacaauauga

SEQ ID NO: 1513631 - RNA, 19 nt, Homo sapiens
ugaccuagcagaagagauc

SEQ ID NO: 1513632 - RNA, 19 nt, Homo sapiens
ggacccauaguuuccuuug

SEQ ID NO: 1513633 - RNA, 19 nt, Homo sapiens
aaaauuagcuagucauggu

SEQ ID NO: 1513634 - RNA, 19 nt, Homo sapiens
cagcuuauuuugugaagaa

SEQ ID NO: 1513635 - RNA, 19 nt, Homo sapiens
cagcgccucucaccauauc

SEQ ID NO: 1513636 - RNA, 19 nt, Homo sapiens
agaugaguuucucuucaaa

SEQ ID NO: 1513637 - RNA, 19 nt, Homo sapiens
gugauuauacagaugaguu

SEQ ID NO: 1513638 - RNA, 19 nt, Homo sapiens
aaaggucucacaguaguaa

SEQ ID NO: 1513639 - RNA, 19 nt, Homo sapiens
cgacagacgguugaauuuc

SEQ ID NO: 1513640 - RNA, 19 nt, Homo sapiens
ccuguaaucccagcacuuu

SEQ ID NO: 1513641 - RNA, 19 nt, Homo sapiens
ccgacagacgguugaauuu

SEQ ID NO: 1513642 - RNA, 19 nt, Homo sapiens
gacaccggacccauaguuu

SEQ ID NO: 1513643 - RNA, 19 nt, Homo sapiens
ugacaccggacccauaguu

SEQ ID NO: 1513644 - RNA, 19 nt, Homo sapiens
ugaugacaccggacccaua

SEQ ID NO: 1513645 - RNA, 19 nt, Homo sapiens
guucgagccugcauguucu

SEQ ID NO: 1513646 - RNA, 19 nt, Homo sapiens
ucuuagauguugauucagu

SEQ ID NO: 1513647 - RNA, 19 nt, Homo sapiens
ggagagcacuuuauuacuu

SEQ ID NO: 1513648 - RNA, 19 nt, Homo sapiens
gcaagaaccuggucuaucu

SEQ ID NO: 1513649 - RNA, 19 nt, Homo sapiens
gaaauuaggccacaagcua

SEQ ID NO: 1513650 - RNA, 19 nt, Homo sapiens
gaagacacaugcacauaug

SEQ ID NO: 1513651 - RNA, 19 nt, Homo sapiens
caaaguauguauugucuug

SEQ ID NO: 1513652 - RNA, 19 nt, Homo sapiens
gaaccuacuucucaaucua

SEQ ID NO: 1513653 - RNA, 19 nt, Homo sapiens
gcacauauguauacacaca

SEQ ID NO: 1513654 - RNA, 19 nt, Homo sapiens
gaacuuguauuccaguauc

SEQ ID NO: 1513655 - RNA, 19 nt, Homo sapiens
caaaugaaccuacuucuca

SEQ ID NO: 1513656 - RNA, 19 nt, Homo sapiens
gaucuuaauucucacuuug

SEQ ID NO: 1513657 - RNA, 19 nt, Homo sapiens
ggacuagacugcucaggau

SEQ ID NO: 1513658 - RNA, 19 nt, Homo sapiens
acagagagaucauuuguca

SEQ ID NO: 1513659 - RNA, 19 nt, Homo sapiens
gaaauugacaugccaggaa

SEQ ID NO: 1513660 - RNA, 19 nt, Homo sapiens
gagagcacuuuauuacuug

SEQ ID NO: 1513661 - RNA, 19 nt, Homo sapiens
gagcaguguuagagaaauu

SEQ ID NO: 1513662 - RNA, 19 nt, Homo sapiens
gcucauaggaagaauagua

SEQ ID NO: 1513663 - RNA, 19 nt, Homo sapiens
ggaucaaggugagcucaua

SEQ ID NO: 1513664 - RNA, 19 nt, Homo sapiens
ucagugagcuuucaacuac

SEQ ID NO: 1513665 - RNA, 19 nt, Homo sapiens
ucucuuagcucaauucugu

SEQ ID NO: 1513666 - RNA, 19 nt, Homo sapiens
cacaaacucuuuaacauca

SEQ ID NO: 1513667 - RNA, 19 nt, Homo sapiens
gcaauuaggccuugacaca

SEQ ID NO: 1513668 - RNA, 19 nt, Homo sapiens
ggaauuaccaucuuuaaac

SEQ ID NO: 1513669 - RNA, 19 nt, Homo sapiens
cagaggcuguguagaauga

SEQ ID NO: 1513670 - RNA, 19 nt, Homo sapiens
cuguuuagcucaacuguaa

SEQ ID NO: 1513671 - RNA, 19 nt, Homo sapiens
gcauguauaccugcauuua

SEQ ID NO: 1513672 - RNA, 19 nt, Homo sapiens
caaaggcuguagugagcua

SEQ ID NO: 1513673 - RNA, 19 nt, Homo sapiens
ugucuaaugucaagggaua

SEQ ID NO: 1513674 - RNA, 19 nt, Homo sapiens
gguuauccuuugugguuua

SEQ ID NO: 1513675 - RNA, 19 nt, Homo sapiens
gaacucucaucaucucuag

SEQ ID NO: 1513676 - RNA, 19 nt, Homo sapiens
ugccaaugcuuaugaauga

SEQ ID NO: 1513677 - RNA, 19 nt, Homo sapiens
cuaauguccuuaaguguug

SEQ ID NO: 1513678 - RNA, 19 nt, Homo sapiens
ucaggacgcguaaguauaa

SEQ ID NO: 1513679 - RNA, 19 nt, Homo sapiens
uguugagucuuccuaaaua

SEQ ID NO: 1513680 - RNA, 19 nt, Homo sapiens
gaaaugcguuuaggucucu

SEQ ID NO: 1513681 - RNA, 19 nt, Homo sapiens
gagaagacacaugcacaua

SEQ ID NO: 1513682 - RNA, 19 nt, Homo sapiens
gaaacuuacucugaauauc

SEQ ID NO: 1513683 - RNA, 19 nt, Homo sapiens
cuaccuugguuuauacuaa

SEQ ID NO: 1513684 - RNA, 19 nt, Homo sapiens
guagugagcuaugaaugug

SEQ ID NO: 1513685 - RNA, 19 nt, Homo sapiens
acauaaaggagcaguguua

SEQ ID NO: 1513686 - RNA, 19 nt, Homo sapiens
cagaaagagaugcuaauuu

SEQ ID NO: 1513687 - RNA, 19 nt, Homo sapiens
aaacagccgauuuauauug

SEQ ID NO: 1513688 - RNA, 19 nt, Homo sapiens
ucacauccauucaucagau

SEQ ID NO: 1513689 - RNA, 19 nt, Homo sapiens
gaaccaacaccacagaauc

SEQ ID NO: 1513690 - RNA, 19 nt, Homo sapiens
gaaagaaaugaaacuguuc

SEQ ID NO: 1513691 - RNA, 19 nt, Homo sapiens
gaugagaggcauggaaauu

SEQ ID NO: 1513692 - RNA, 19 nt, Homo sapiens
gugauuugaugaagacuau

SEQ ID NO: 1513693 - RNA, 19 nt, Homo sapiens
gggaaucuuuggucagaau

SEQ ID NO: 1513694 - RNA, 19 nt, Homo sapiens
gcacuguggcuuacaccua

SEQ ID NO: 1513695 - RNA, 19 nt, Homo sapiens
uaacagaaggcacaaaaua

SEQ ID NO: 1513696 - RNA, 19 nt, Homo sapiens
ggauauguacucuaauuuc

SEQ ID NO: 1513697 - RNA, 19 nt, Homo sapiens
gcuggagagcacuuuauua

SEQ ID NO: 1513698 - RNA, 19 nt, Homo sapiens
gcucaacuguaauuauagu

SEQ ID NO: 1513699 - RNA, 19 nt, Homo sapiens
gucaucaaauguuaucuga

SEQ ID NO: 1513700 - RNA, 19 nt, Homo sapiens
ggauccaccuuaggcagua

SEQ ID NO: 1513701 - RNA, 19 nt, Homo sapiens
gagcauagacauguuagug

SEQ ID NO: 1513702 - RNA, 19 nt, Homo sapiens
gaaaagagcauagacaugu

SEQ ID NO: 1513703 - RNA, 19 nt, Homo sapiens
gagaaagaaaugaaacugu

SEQ ID NO: 1513704 - RNA, 19 nt, Homo sapiens
ucccauaucuuaaaucucu

SEQ ID NO: 1513705 - RNA, 19 nt, Homo sapiens
gaugcuaauuucuucugaa

SEQ ID NO: 1513706 - RNA, 19 nt, Homo sapiens
ggagugcuuucucuaccuu

SEQ ID NO: 1513707 - RNA, 19 nt, Homo sapiens
gccacaagcuauagagcaa

SEQ ID NO: 1513708 - RNA, 19 nt, Homo sapiens
aaagagcauagacauguua

SEQ ID NO: 1513709 - RNA, 19 nt, Homo sapiens
ucacucaacuaacuuggau

SEQ ID NO: 1513710 - RNA, 19 nt, Homo sapiens
cuaaauaccuggccuuuuc

SEQ ID NO: 1513711 - RNA, 19 nt, Homo sapiens
ggaagaauaguauaauagg

SEQ ID NO: 1513712 - RNA, 19 nt, Homo sapiens
aauuaggccuugacacauu

SEQ ID NO: 1513713 - RNA, 19 nt, Homo sapiens
caaacucuuuaacaucaga

SEQ ID NO: 1513714 - RNA, 19 nt, Homo sapiens
cuugacacauuaggaaaua

SEQ ID NO: 1513715 - RNA, 19 nt, Homo sapiens
ggacauaaaggagcagugu

SEQ ID NO: 1513716 - RNA, 19 nt, Homo sapiens
uaacuuggauccaccuaac

SEQ ID NO: 1513717 - RNA, 19 nt, Homo sapiens
guucucacguucauucaug

SEQ ID NO: 1513718 - RNA, 19 nt, Homo sapiens
agauugaacucucaucauc

SEQ ID NO: 1513719 - RNA, 19 nt, Homo sapiens
ucaauucuguuuagcucaa

SEQ ID NO: 1513720 - RNA, 19 nt, Homo sapiens
cuauggauauucagauguu

SEQ ID NO: 1513721 - RNA, 19 nt, Homo sapiens
cuacagguaauagauguua

SEQ ID NO: 1513722 - RNA, 19 nt, Homo sapiens
caucaucucuagcuaucug

SEQ ID NO: 1513723 - RNA, 19 nt, Homo sapiens
gaucauuugucaucucacu

SEQ ID NO: 1513724 - RNA, 19 nt, Homo sapiens
ggaggaugcucguguucuc

SEQ ID NO: 1513725 - RNA, 19 nt, Homo sapiens
ggucagaauauuaaugguu

SEQ ID NO: 1513726 - RNA, 19 nt, Homo sapiens
caacuacagguaauagaug

SEQ ID NO: 1513727 - RNA, 19 nt, Homo sapiens
cuucuaauguccuuaagug

SEQ ID NO: 1513728 - RNA, 19 nt, Homo sapiens
ggcaggauuuagaguaaug

SEQ ID NO: 1513729 - RNA, 19 nt, Homo sapiens
gaauuuggauauguacucu

SEQ ID NO: 1513730 - RNA, 19 nt, Homo sapiens
ccuauaaucccagcacuuu

SEQ ID NO: 1513731 - RNA, 19 nt, Homo sapiens
auugagaauuuguggcuua

SEQ ID NO: 1513732 - RNA, 19 nt, Homo sapiens
gcaaaugaaccuacuucuc

SEQ ID NO: 1513733 - RNA, 19 nt, Homo sapiens
cauuugucaucucacuuua

SEQ ID NO: 1513734 - RNA, 19 nt, Homo sapiens
caaaaugucuaaugucaag

SEQ ID NO: 1513735 - RNA, 19 nt, Homo sapiens
gauuuagaguaaugugaug

SEQ ID NO: 1513736 - RNA, 19 nt, Homo sapiens
ucacggaaaugggagaugu

SEQ ID NO: 1513737 - RNA, 19 nt, Homo sapiens
gcaaagcagaagauaaugg

SEQ ID NO: 1513738 - RNA, 19 nt, Homo sapiens
cacaagaguuuuauccuaa

SEQ ID NO: 1513739 - RNA, 19 nt, Homo sapiens
uguaugcaguggaaucuug

SEQ ID NO: 1513740 - RNA, 19 nt, Homo sapiens
ucauagagaugggacuaga

SEQ ID NO: 1513741 - RNA, 19 nt, Homo sapiens
ccuuugaccuucacaguuc

SEQ ID NO: 1513742 - RNA, 19 nt, Homo sapiens
aaaugucagugaauacuca

SEQ ID NO: 1513743 - RNA, 19 nt, Homo sapiens
ugaaguguauagauuugug

SEQ ID NO: 1513744 - RNA, 19 nt, Homo sapiens
caucaggacgcguaaguau

SEQ ID NO: 1513745 - RNA, 19 nt, Homo sapiens
uagugugucugguuucuau

SEQ ID NO: 1513746 - RNA, 19 nt, Homo sapiens
ucacaagaguuuuauccua

SEQ ID NO: 1513747 - RNA, 19 nt, Homo sapiens
caacacagcugcggcauua

SEQ ID NO: 1513748 - RNA, 19 nt, Homo sapiens
gaagagaccauccauauuu

SEQ ID NO: 1513749 - RNA, 19 nt, Homo sapiens
gaauagagaucuugaacau

SEQ ID NO: 1513750 - RNA, 19 nt, Homo sapiens
gaacgaagaacaaacuaaa

SEQ ID NO: 1513751 - RNA, 19 nt, Homo sapiens
gagagaacaucccgaaauc

SEQ ID NO: 1513752 - RNA, 19 nt, Homo sapiens
gaagaagagaccauccaua

SEQ ID NO: 1513753 - RNA, 19 nt, Homo sapiens
gaacuacucauaggaaaug

SEQ ID NO: 1513754 - RNA, 19 nt, Homo sapiens
auagagaucuugaacauag

SEQ ID NO: 1513755 - RNA, 19 nt, Homo sapiens
gaacuuggaucccauucac

SEQ ID NO: 1513756 - RNA, 19 nt, Homo sapiens
caucgcagcuuucaacaag

SEQ ID NO: 1513757 - RNA, 19 nt, Homo sapiens
ggacggaaacacacccuuu

SEQ ID NO: 1513758 - RNA, 19 nt, Homo sapiens
gaggagaucaccaaguuug

SEQ ID NO: 1513759 - RNA, 19 nt, Homo sapiens
uaacagaacgaagaacaaa

SEQ ID NO: 1513760 - RNA, 19 nt, Homo sapiens
acacauaacagaacgaaga

SEQ ID NO: 1513761 - RNA, 19 nt, Homo sapiens
aggaggagaucaccaaguu

SEQ ID NO: 1513762 - RNA, 19 nt, Homo sapiens
aagaagagaccauccauau

SEQ ID NO: 1513763 - RNA, 19 nt, Homo sapiens
ggaaguggacaaccagaga

SEQ ID NO: 1513764 - RNA, 19 nt, Homo sapiens
guucaaauauggcgaugca

SEQ ID NO: 1513765 - RNA, 19 nt, Homo sapiens
caaauauggcgaugcagaa

SEQ ID NO: 1513766 - RNA, 19 nt, Homo sapiens
gcauggugccagacacaua

SEQ ID NO: 1513767 - RNA, 19 nt, Homo sapiens
caaacuuaaugaagcugaa

SEQ ID NO: 1513768 - RNA, 19 nt, Homo sapiens
cgaugacauugaccuguuu

SEQ ID NO: 1513769 - RNA, 19 nt, Homo sapiens
ugacgaggacgaugacauu

SEQ ID NO: 1513770 - RNA, 19 nt, Homo sapiens
gagauucuacgaacagaug

SEQ ID NO: 1513771 - RNA, 19 nt, Homo sapiens
guccuuggcuggcgucaga

SEQ ID NO: 1513772 - RNA, 19 nt, Homo sapiens
aaacacacccuuuccuuag

SEQ ID NO: 1513773 - RNA, 19 nt, Homo sapiens
cgaagaacaaacuaaauuc

SEQ ID NO: 1513774 - RNA, 19 nt, Homo sapiens
aacaagaucuggccugagu

SEQ ID NO: 1513775 - RNA, 19 nt, Homo sapiens
ggagaucaccaaguuugaa

SEQ ID NO: 1513776 - RNA, 19 nt, Homo sapiens
gaagaucugguuccacaag

SEQ ID NO: 1513777 - RNA, 19 nt, Homo sapiens
ggaggagaucaccaaguuu

SEQ ID NO: 1513778 - RNA, 19 nt, Homo sapiens
aagagaccauccauauuuc

SEQ ID NO: 1513779 - RNA, 19 nt, Homo sapiens
ggcuacaaacuuucuagua

SEQ ID NO: 1513780 - RNA, 19 nt, Homo sapiens
cgacaucgcagcuuucaac

SEQ ID NO: 1513781 - RNA, 19 nt, Homo sapiens
gcaacacagcugcggcauu

SEQ ID NO: 1513782 - RNA, 19 nt, Homo sapiens
agaagagaccauccauauu

SEQ ID NO: 1513783 - RNA, 19 nt, Homo sapiens
cauggugccagacacauaa

SEQ ID NO: 1513784 - RNA, 19 nt, Homo sapiens
caccaaguuugaagagugu

SEQ ID NO: 1513785 - RNA, 19 nt, Homo sapiens
agagagaacaucccgaaau

SEQ ID NO: 1513786 - RNA, 19 nt, Homo sapiens
ugaacgugcuggagaagag

SEQ ID NO: 1513787 - RNA, 19 nt, Homo sapiens
aagaguguaugcagagugu

SEQ ID NO: 1513788 - RNA, 19 nt, Homo sapiens
cggagaagaaggccaagaa

SEQ ID NO: 1513789 - RNA, 19 nt, Homo sapiens
cauaacagaacgaagaaca

SEQ ID NO: 1513790 - RNA, 19 nt, Homo sapiens
gaucugguuccacaaguuc

SEQ ID NO: 1513791 - RNA, 19 nt, Homo sapiens
aaaggagauucuacgaaca

SEQ ID NO: 1513792 - RNA, 19 nt, Homo sapiens
ucuaguaggugagaagauc

SEQ ID NO: 1513793 - RNA, 19 nt, Homo sapiens
gaaacauuaagaacuugga

SEQ ID NO: 1513794 - RNA, 19 nt, Homo sapiens
caagaucuggccugagugu

SEQ ID NO: 1513795 - RNA, 19 nt, Homo sapiens
ggagaagaaggccaagaag

SEQ ID NO: 1513796 - RNA, 19 nt, Homo sapiens
acgaugacauugaccuguu

SEQ ID NO: 1513797 - RNA, 19 nt, Homo sapiens
cugaacuacucauaggaaa

SEQ ID NO: 1513798 - RNA, 19 nt, Homo sapiens
cgaggacgaugacauugac

SEQ ID NO: 1513799 - RNA, 19 nt, Homo sapiens
ggcugaacgugcuggagaa

SEQ ID NO: 1513800 - RNA, 19 nt, Homo sapiens
caccugaacuacucauagg

SEQ ID NO: 1513801 - RNA, 19 nt, Homo sapiens
ucgcagcuuucaacaagau

SEQ ID NO: 1513802 - RNA, 19 nt, Homo sapiens
augaggcccugccacaauu

SEQ ID NO: 1513803 - RNA, 19 nt, Homo sapiens
caugaggcccugccacaau

SEQ ID NO: 1513804 - RNA, 19 nt, Homo sapiens
gugucgacaucgcagcuuu

SEQ ID NO: 1513805 - RNA, 19 nt, Homo sapiens
agaacgaagaacaaacuaa

SEQ ID NO: 1513806 - RNA, 19 nt, Homo sapiens
gagaucaccaaguuugaag

SEQ ID NO: 1513807 - RNA, 19 nt, Homo sapiens
ccacaccagcagaggauga

SEQ ID NO: 1513808 - RNA, 19 nt, Homo sapiens
uacaaacuuucuaguaggu

SEQ ID NO: 1513809 - RNA, 19 nt, Homo sapiens
uaagaacuuggaucccauu

SEQ ID NO: 1513810 - RNA, 19 nt, Homo sapiens
ggacgaaaacaaacuuaau

SEQ ID NO: 1513811 - RNA, 19 nt, Homo sapiens
gcaguacgcggagaagaag

SEQ ID NO: 1513812 - RNA, 19 nt, Homo sapiens
ccgcagacccagcacaugu

SEQ ID NO: 1513813 - RNA, 19 nt, Homo sapiens
uuccacaaguucaaauaug

SEQ ID NO: 1513814 - RNA, 19 nt, Homo sapiens
gguuccacaaguucaaaua

SEQ ID NO: 1513815 - RNA, 19 nt, Homo sapiens
gcaugaggcccugccacaa

SEQ ID NO: 1513816 - RNA, 19 nt, Homo sapiens
gaucaccaaguuugaagag

SEQ ID NO: 1513817 - RNA, 19 nt, Homo sapiens
gugagaagaucugguucca

SEQ ID NO: 1513818 - RNA, 19 nt, Homo sapiens
uaggugagaagaucugguu

SEQ ID NO: 1513819 - RNA, 19 nt, Homo sapiens
gaggcccugccacaauuaa

SEQ ID NO: 1513820 - RNA, 19 nt, Homo sapiens
ccaccugaacuacucauag

SEQ ID NO: 1513821 - RNA, 19 nt, Homo sapiens
uccacaaguucaaauaugg

SEQ ID NO: 1513822 - RNA, 19 nt, Homo sapiens
agaucugguuccacaaguu

SEQ ID NO: 1513823 - RNA, 19 nt, Homo sapiens
ccugaacuacucauaggaa

SEQ ID NO: 1513824 - RNA, 19 nt, Homo sapiens
ccaggaggccagcaugauc

SEQ ID NO: 1513825 - RNA, 19 nt, Homo sapiens
cagaacgaagaacaaacua

SEQ ID NO: 1513826 - RNA, 19 nt, Homo sapiens
aaauauggcgaugcagaaa

SEQ ID NO: 1513827 - RNA, 19 nt, Homo sapiens
guuccacaaguucaaauau

SEQ ID NO: 1513828 - RNA, 19 nt, Homo sapiens
gaugaaaagauucugaaga

SEQ ID NO: 1513829 - RNA, 19 nt, Homo sapiens
ugaggcccugccacaauua

SEQ ID NO: 1513830 - RNA, 19 nt, Homo sapiens
cacauaacagaacgaagaa

SEQ ID NO: 1513831 - RNA, 19 nt, Homo sapiens
cgaagaagagaccauccau

SEQ ID NO: 1513832 - RNA, 19 nt, Homo sapiens
cagcgacaaugaggcaaca

SEQ ID NO: 1513833 - RNA, 19 nt, Homo sapiens
gaggaggagaucaccaagu

SEQ ID NO: 1513834 - RNA, 19 nt, Homo sapiens
caacagggcucucuaaauu

SEQ ID NO: 1513835 - RNA, 19 nt, Homo sapiens
ggacuaugauuuacaucua

SEQ ID NO: 1513836 - RNA, 19 nt, Homo sapiens
caggugagcuggauucaaa

SEQ ID NO: 1513837 - RNA, 19 nt, Homo sapiens
ccauagugcugcauuauau

SEQ ID NO: 1513838 - RNA, 19 nt, Homo sapiens
gcucagacauuccgaguca

SEQ ID NO: 1513839 - RNA, 19 nt, Homo sapiens
uaaccauagugcugcauua

SEQ ID NO: 1513840 - RNA, 19 nt, Homo sapiens
gaaaguuggagaaauagaa

SEQ ID NO: 1513841 - RNA, 19 nt, Homo sapiens
ccucagcucugcaugcuuu

SEQ ID NO: 1513842 - RNA, 19 nt, Homo sapiens
caaaggcaccaaacguaua

SEQ ID NO: 1513843 - RNA, 19 nt, Homo sapiens
ggcagcagcuuaugaaagu

SEQ ID NO: 1513844 - RNA, 19 nt, Homo sapiens
gaaacaagggaaauaaaca

SEQ ID NO: 1513845 - RNA, 19 nt, Homo sapiens
guauacaccugagcuagaa

SEQ ID NO: 1513846 - RNA, 19 nt, Homo sapiens
gagugggucucagaguuua

SEQ ID NO: 1513847 - RNA, 19 nt, Homo sapiens
gcaggaggcugagcacugu

SEQ ID NO: 1513848 - RNA, 19 nt, Homo sapiens
gaaguucagcuguuguuga

SEQ ID NO: 1513849 - RNA, 19 nt, Homo sapiens
caccugagcuagaaagugu

SEQ ID NO: 1513850 - RNA, 19 nt, Homo sapiens
gcaacagggcucucuaaau

SEQ ID NO: 1513851 - RNA, 19 nt, Homo sapiens
aaauauagacugaggauca

SEQ ID NO: 1513852 - RNA, 19 nt, Homo sapiens
caaaggcagcagcuuauga

SEQ ID NO: 1513853 - RNA, 19 nt, Homo sapiens
cuacaaaccugcuccuacu

SEQ ID NO: 1513854 - RNA, 19 nt, Homo sapiens
ggaaacaagggaaauaaac

SEQ ID NO: 1513855 - RNA, 19 nt, Homo sapiens
gggaaacaagggaaauaaa

SEQ ID NO: 1513856 - RNA, 19 nt, Homo sapiens
guucagcuguuguugacuu

SEQ ID NO: 1513857 - RNA, 19 nt, Homo sapiens
ccucguggcuuugggcuuu

SEQ ID NO: 1513858 - RNA, 19 nt, Homo sapiens
uguaagggcuggguacgaa

SEQ ID NO: 1513859 - RNA, 19 nt, Homo sapiens
cuucaaaggcagcagcuua

SEQ ID NO: 1513860 - RNA, 19 nt, Homo sapiens
caaggacagugugggaaga

SEQ ID NO: 1513861 - RNA, 19 nt, Homo sapiens
caggauguguguaaacuac

SEQ ID NO: 1513862 - RNA, 19 nt, Homo sapiens
ucaaaggcaccaaacguau

SEQ ID NO: 1513863 - RNA, 19 nt, Homo sapiens
ccagaaagagagcagaaug

SEQ ID NO: 1513864 - RNA, 19 nt, Homo sapiens
aaaggcagcagcuuaugaa

SEQ ID NO: 1513865 - RNA, 19 nt, Homo sapiens
ggugaugacugggauuucu

SEQ ID NO: 1513866 - RNA, 19 nt, Homo sapiens
gucuacauuucaaggguua

SEQ ID NO: 1513867 - RNA, 19 nt, Homo sapiens
gcucagauccccagaaaga

SEQ ID NO: 1513868 - RNA, 19 nt, Homo sapiens
ggucucagaguuuacaaau

SEQ ID NO: 1513869 - RNA, 19 nt, Homo sapiens
gucucagaguuuacaaaua

SEQ ID NO: 1513870 - RNA, 19 nt, Homo sapiens
cauagugcugcauuauaua

SEQ ID NO: 1513871 - RNA, 19 nt, Homo sapiens
cagaauggcagcucagaca

SEQ ID NO: 1513872 - RNA, 19 nt, Homo sapiens
cacaucagccaccuaggua

SEQ ID NO: 1513873 - RNA, 19 nt, Homo sapiens
gggaaauaaacauggcuuu

SEQ ID NO: 1513874 - RNA, 19 nt, Homo sapiens
ugauuuacaucuaccaaac

SEQ ID NO: 1513875 - RNA, 19 nt, Homo sapiens
ccuggguucuuccuuguug

SEQ ID NO: 1513876 - RNA, 19 nt, Homo sapiens
ggaaauaaacauggcuuuu

SEQ ID NO: 1513877 - RNA, 19 nt, Homo sapiens
ucagccaccuagguaguuu

SEQ ID NO: 1513878 - RNA, 19 nt, Homo sapiens
gacuaugauuuacaucuac

SEQ ID NO: 1513879 - RNA, 19 nt, Homo sapiens
uugcugaccuuggacugua

SEQ ID NO: 1513880 - RNA, 19 nt, Homo sapiens
gcuggugucuggucucacu

SEQ ID NO: 1513881 - RNA, 19 nt, Homo sapiens
ucacaucagaagcacauug

SEQ ID NO: 1513882 - RNA, 19 nt, Homo sapiens
uagccugucuacauuucaa

SEQ ID NO: 1513883 - RNA, 19 nt, Homo sapiens
cagcucagauccccagaaa

SEQ ID NO: 1513884 - RNA, 19 nt, Homo sapiens
acagggcucucuaaauugc

SEQ ID NO: 1513885 - RNA, 19 nt, Homo sapiens
gcagcagcuuaugaaaguu

SEQ ID NO: 1513886 - RNA, 19 nt, Homo sapiens
cucaaaggcaccaaacgua

SEQ ID NO: 1513887 - RNA, 19 nt, Homo sapiens
guacaccacaggcccuuuc

SEQ ID NO: 1513888 - RNA, 19 nt, Homo sapiens
cagcagcuuaugaaaguug

SEQ ID NO: 1513889 - RNA, 19 nt, Homo sapiens
caaacucugccaccgacaa

SEQ ID NO: 1513890 - RNA, 19 nt, Homo sapiens
gcuugcaccuggguucuuc

SEQ ID NO: 1513891 - RNA, 19 nt, Homo sapiens
cagggaaggccagugguuu

SEQ ID NO: 1513892 - RNA, 19 nt, Homo sapiens
uagaagcgggcaagucuca

SEQ ID NO: 1513893 - RNA, 19 nt, Homo sapiens
cguauacaccugagcuaga

SEQ ID NO: 1513894 - RNA, 19 nt, Homo sapiens
ucugcugacugcccuauag

SEQ ID NO: 1513895 - RNA, 19 nt, Homo sapiens
cagaaagagagcagaaugg

SEQ ID NO: 1513896 - RNA, 19 nt, Homo sapiens
acaaauauagacugaggau

SEQ ID NO: 1513897 - RNA, 19 nt, Homo sapiens
aagggacuaugauuuacau

SEQ ID NO: 1513898 - RNA, 19 nt, Homo sapiens
caccuggguucuuccuugu

SEQ ID NO: 1513899 - RNA, 19 nt, Homo sapiens
gugaugacugggauuucua

SEQ ID NO: 1513900 - RNA, 19 nt, Homo sapiens
uaagggacuaugauuuaca

SEQ ID NO: 1513901 - RNA, 19 nt, Homo sapiens
cccugagccuugugacuug

SEQ ID NO: 1513902 - RNA, 19 nt, Homo sapiens
guccuggucagaucuagaa

SEQ ID NO: 1513903 - RNA, 19 nt, Homo sapiens
gcuuaugaaaguuggagaa

SEQ ID NO: 1513904 - RNA, 19 nt, Homo sapiens
ccaggauguguguaaacua

SEQ ID NO: 1513905 - RNA, 19 nt, Homo sapiens
ccaguauccucuacaaacc

SEQ ID NO: 1513906 - RNA, 19 nt, Homo sapiens
uugaguugcuuugaaguuc

SEQ ID NO: 1513907 - RNA, 19 nt, Homo sapiens
caauuuagcuuccugcuua

SEQ ID NO: 1513908 - RNA, 19 nt, Homo sapiens
ccaaagaucuacccaaauu

SEQ ID NO: 1513909 - RNA, 19 nt, Homo sapiens
gaagugaauugaccucuaa

SEQ ID NO: 1513910 - RNA, 19 nt, Homo sapiens
gcuaaacgaugcccagaua

SEQ ID NO: 1513911 - RNA, 19 nt, Homo sapiens
gcacagugaugaugucaaa

SEQ ID NO: 1513912 - RNA, 19 nt, Homo sapiens
gcaaauccuuccugucauu

SEQ ID NO: 1513913 - RNA, 19 nt, Homo sapiens
gaaaggguuuaaagaagaa

SEQ ID NO: 1513914 - RNA, 19 nt, Homo sapiens
gacuugcgaugauauauuu

SEQ ID NO: 1513915 - RNA, 19 nt, Homo sapiens
ugaaaggguuuaaagaaga

SEQ ID NO: 1513916 - RNA, 19 nt, Homo sapiens
ggacacaauuucaagaagu

SEQ ID NO: 1513917 - RNA, 19 nt, Homo sapiens
gaauugaccucuaaaauag

SEQ ID NO: 1513918 - RNA, 19 nt, Homo sapiens
cuacucaacuuaacauuuc

SEQ ID NO: 1513919 - RNA, 19 nt, Homo sapiens
gauagcagguaaaacauua

SEQ ID NO: 1513920 - RNA, 19 nt, Homo sapiens
guccaaagaucuacccaaa

SEQ ID NO: 1513921 - RNA, 19 nt, Homo sapiens
cuuauuaucuguccugauu

SEQ ID NO: 1513922 - RNA, 19 nt, Homo sapiens
gcacauggagggugacuug

SEQ ID NO: 1513923 - RNA, 19 nt, Homo sapiens
aggcugagaugaagaauug

SEQ ID NO: 1513924 - RNA, 19 nt, Homo sapiens
gaugaagaauugcuuaaac

SEQ ID NO: 1513925 - RNA, 19 nt, Homo sapiens
gucaauaaaucuccaugaa

SEQ ID NO: 1513926 - RNA, 19 nt, Homo sapiens
ggaguguuggcucuuauua

SEQ ID NO: 1513927 - RNA, 19 nt, Homo sapiens
gaauaucccugaccuuagc

SEQ ID NO: 1513928 - RNA, 19 nt, Homo sapiens
ggaugaugaugauaacaau

SEQ ID NO: 1513929 - RNA, 19 nt, Homo sapiens
gauccucaauagauacuug

SEQ ID NO: 1513930 - RNA, 19 nt, Homo sapiens
caaagaucuacccaaauua

SEQ ID NO: 1513931 - RNA, 19 nt, Homo sapiens
uguaaagaguguucuguga

SEQ ID NO: 1513932 - RNA, 19 nt, Homo sapiens
gcccuucaccgcagacuua

SEQ ID NO: 1513933 - RNA, 19 nt, Homo sapiens
ccauaucucuacucaacuu

SEQ ID NO: 1513934 - RNA, 19 nt, Homo sapiens
gugcaaauccuuccuguca

SEQ ID NO: 1513935 - RNA, 19 nt, Homo sapiens
gcaguacuaugggaauuuc

SEQ ID NO: 1513936 - RNA, 19 nt, Homo sapiens
gagggugacuugcgaugau

SEQ ID NO: 1513937 - RNA, 19 nt, Homo sapiens
aauacuaccucacucuuug

SEQ ID NO: 1513938 - RNA, 19 nt, Homo sapiens
ggauuucccuuguaauacu

SEQ ID NO: 1513939 - RNA, 19 nt, Homo sapiens
gagaugaagaauugcuuaa

SEQ ID NO: 1513940 - RNA, 19 nt, Homo sapiens
acauaagaguguugguuaa

SEQ ID NO: 1513941 - RNA, 19 nt, Homo sapiens
ggaaacucccagaaagaaa

SEQ ID NO: 1513942 - RNA, 19 nt, Homo sapiens
gcuuucaucuuccaucaau

SEQ ID NO: 1513943 - RNA, 19 nt, Homo sapiens
uacauaagaguguugguua

SEQ ID NO: 1513944 - RNA, 19 nt, Homo sapiens
gacacaauuucaagaagug

SEQ ID NO: 1513945 - RNA, 19 nt, Homo sapiens
gaagagccauaggaguguu

SEQ ID NO: 1513946 - RNA, 19 nt, Homo sapiens
ggauuggucuacauaagag

SEQ ID NO: 1513947 - RNA, 19 nt, Homo sapiens
ccacggauuggucuacaua

SEQ ID NO: 1513948 - RNA, 19 nt, Homo sapiens
uaccauaucucuacucaac

SEQ ID NO: 1513949 - RNA, 19 nt, Homo sapiens
agaagugaauugaccucua

SEQ ID NO: 1513950 - RNA, 19 nt, Homo sapiens
gccgugcgcugguucuuug

SEQ ID NO: 1513951 - RNA, 19 nt, Homo sapiens
uauauuaccaccagcauug

SEQ ID NO: 1513952 - RNA, 19 nt, Homo sapiens
ugaagcugcuguaaaucuu

SEQ ID NO: 1513953 - RNA, 19 nt, Homo sapiens
gaaacucccagaaagaaag

SEQ ID NO: 1513954 - RNA, 19 nt, Homo sapiens
gaagcugcuguaaaucuuu

SEQ ID NO: 1513955 - RNA, 19 nt, Homo sapiens
uaaagaguguucugugacu

SEQ ID NO: 1513956 - RNA, 19 nt, Homo sapiens
uuaccucucuuucccuuga

SEQ ID NO: 1513957 - RNA, 19 nt, Homo sapiens
gauuucccuuguaauacua

SEQ ID NO: 1513958 - RNA, 19 nt, Homo sapiens
gugacucgcuuuucugaua

SEQ ID NO: 1513959 - RNA, 19 nt, Homo sapiens
cagacuaacacaaucauau

SEQ ID NO: 1513960 - RNA, 19 nt, Homo sapiens
gcacuguagacacaacauu

SEQ ID NO: 1513961 - RNA, 19 nt, Homo sapiens
gaucccagacuaacacaau

SEQ ID NO: 1513962 - RNA, 19 nt, Homo sapiens
cugaaaggguuuaaagaag

SEQ ID NO: 1513963 - RNA, 19 nt, Homo sapiens
ugagaugaagaauugcuua

SEQ ID NO: 1513964 - RNA, 19 nt, Homo sapiens
gaaaccccaucucuacaaa

SEQ ID NO: 1513965 - RNA, 19 nt, Homo sapiens
ugaccuauuucaaucauac

SEQ ID NO: 1513966 - RNA, 19 nt, Homo sapiens
ugucaagugucauuagcaa

SEQ ID NO: 1513967 - RNA, 19 nt, Homo sapiens
uaauacuaccucacucuuu

SEQ ID NO: 1513968 - RNA, 19 nt, Homo sapiens
cacuguagacacaacauua

SEQ ID NO: 1513969 - RNA, 19 nt, Homo sapiens
caucuuguagcuucuguuu

SEQ ID NO: 1513970 - RNA, 19 nt, Homo sapiens
ccacuggcaacaucuugua

SEQ ID NO: 1513971 - RNA, 19 nt, Homo sapiens
acauccagcuuucaucuuc

SEQ ID NO: 1513972 - RNA, 19 nt, Homo sapiens
ugacuuaccauaucucuac

SEQ ID NO: 1513973 - RNA, 19 nt, Homo sapiens
guccugauuuccauauguu

SEQ ID NO: 1513974 - RNA, 19 nt, Homo sapiens
gagauaaaauugcuugucu

SEQ ID NO: 1513975 - RNA, 19 nt, Homo sapiens
cugcagaguucuugaugug

SEQ ID NO: 1513976 - RNA, 19 nt, Homo sapiens
uuccaucaaugccuucuuu

SEQ ID NO: 1513977 - RNA, 19 nt, Homo sapiens
ucccugaccuuagcauaaa

SEQ ID NO: 1513978 - RNA, 19 nt, Homo sapiens
uauuaucuguccugauuuc

SEQ ID NO: 1513979 - RNA, 19 nt, Homo sapiens
auaggaguguuggcucuua

SEQ ID NO: 1513980 - RNA, 19 nt, Homo sapiens
ccuggucucuccucauuuc

SEQ ID NO: 1513981 - RNA, 19 nt, Homo sapiens
cagcuuucaucuuccauca

SEQ ID NO: 1513982 - RNA, 19 nt, Homo sapiens
caacagugccugguacaca

SEQ ID NO: 1513983 - RNA, 19 nt, Homo sapiens
uuccauauguugguuguuu

SEQ ID NO: 1513984 - RNA, 19 nt, Homo sapiens
gaucacgaagucaagaguu

SEQ ID NO: 1513985 - RNA, 19 nt, Homo sapiens
uauuguuacuggacauuug

SEQ ID NO: 1513986 - RNA, 19 nt, Homo sapiens
aguguuggcucuuauuauc

SEQ ID NO: 1513987 - RNA, 19 nt, Homo sapiens
ugacuugcgaugauauauu

SEQ ID NO: 1513988 - RNA, 19 nt, Homo sapiens
ugccuggucucuccucauu

SEQ ID NO: 1513989 - RNA, 19 nt, Homo sapiens
gcaccuguaaucccagcua

SEQ ID NO: 1513990 - RNA, 19 nt, Homo sapiens
uaacaaugaaugccugcaa

SEQ ID NO: 1513991 - RNA, 19 nt, Homo sapiens
augaauaucccugaccuua

SEQ ID NO: 1513992 - RNA, 19 nt, Homo sapiens
gugcaguacuaugggaauu

SEQ ID NO: 1513993 - RNA, 19 nt, Homo sapiens
uaagauugccggguccaaa

SEQ ID NO: 1513994 - RNA, 19 nt, Homo sapiens
acugaaaggguuuaaagaa

SEQ ID NO: 1513995 - RNA, 19 nt, Homo sapiens
guaauacuaccucacucuu

SEQ ID NO: 1513996 - RNA, 19 nt, Homo sapiens
gcuguaaaucuuugucaau

SEQ ID NO: 1513997 - RNA, 19 nt, Homo sapiens
ccuguaaucccagcacuuu

SEQ ID NO: 1513998 - RNA, 19 nt, Homo sapiens
gcauaaaauccuggaaaua

SEQ ID NO: 1513999 - RNA, 19 nt, Homo sapiens
ggugacuugcgaugauaua

SEQ ID NO: 1514000 - RNA, 19 nt, Homo sapiens
guggguggaucacgaaguc

SEQ ID NO: 1514001 - RNA, 19 nt, Homo sapiens
gcaggcacaggaacaagug

SEQ ID NO: 1514002 - RNA, 19 nt, Homo sapiens
gggaggcugagaugaagaa

SEQ ID NO: 1514003 - RNA, 19 nt, Homo sapiens
gaagucaagaguucaagac

SEQ ID NO: 1514004 - RNA, 19 nt, Homo sapiens
ccagauagcagguaaaaca

SEQ ID NO: 1514005 - RNA, 19 nt, Homo sapiens
cggauuggucuacauaaga

SEQ ID NO: 1514006 - RNA, 19 nt, Homo sapiens
aagcugcuguaaaucuuug

SEQ ID NO: 1514007 - RNA, 19 nt, Homo sapiens
gggaguaccucaagaagga

SEQ ID NO: 1514008 - RNA, 19 nt, Homo sapiens
ggacacauaaagcaaguua

SEQ ID NO: 1514009 - RNA, 19 nt, Homo sapiens
cggagaugcuggacacaua

SEQ ID NO: 1514010 - RNA, 19 nt, Homo sapiens
gaagcaaucaggaagauag

SEQ ID NO: 1514011 - RNA, 19 nt, Homo sapiens
caagugcuccggagaguga

SEQ ID NO: 1514012 - RNA, 19 nt, Homo sapiens
ggagaugcuggacacauaa

SEQ ID NO: 1514013 - RNA, 19 nt, Homo sapiens
ggagauggcgacucuguuc

SEQ ID NO: 1514014 - RNA, 19 nt, Homo sapiens
guucuugugucuguuauug

SEQ ID NO: 1514015 - RNA, 19 nt, Homo sapiens
cagucuggcuugaaauuug

SEQ ID NO: 1514016 - RNA, 19 nt, Homo sapiens
uggagacucugucggauga

SEQ ID NO: 1514017 - RNA, 19 nt, Homo sapiens
gggaacauuuggacaccuu

SEQ ID NO: 1514018 - RNA, 19 nt, Homo sapiens
gcagaagcaaucaggaaga

SEQ ID NO: 1514019 - RNA, 19 nt, Homo sapiens
ucugucggaugaagaagua

SEQ ID NO: 1514020 - RNA, 19 nt, Homo sapiens
ccacacaucgcacguuuua

SEQ ID NO: 1514021 - RNA, 19 nt, Homo sapiens
ggacucacaaacugcauga

SEQ ID NO: 1514022 - RNA, 19 nt, Homo sapiens
cagaagcaaucaggaagau

SEQ ID NO: 1514023 - RNA, 19 nt, Homo sapiens
ucucaguucuugugucugu

SEQ ID NO: 1514024 - RNA, 19 nt, Homo sapiens
caucgucaccgugcccuua

SEQ ID NO: 1514025 - RNA, 19 nt, Homo sapiens
gaagcuggccguccugaac

SEQ ID NO: 1514026 - RNA, 19 nt, Homo sapiens
ucaguucuugugucuguua

SEQ ID NO: 1514027 - RNA, 19 nt, Homo sapiens
aaaucuuccuggaguuuga

SEQ ID NO: 1514028 - RNA, 19 nt, Homo sapiens
ggggagaccuuuccagugu

SEQ ID NO: 1514029 - RNA, 19 nt, Homo sapiens
acacauaaagcaaguuaca

SEQ ID NO: 1514030 - RNA, 19 nt, Homo sapiens
ugagaaggcagaagcaauc

SEQ ID NO: 1514031 - RNA, 19 nt, Homo sapiens
gggcuggacugcaccuuuu

SEQ ID NO: 1514032 - RNA, 19 nt, Homo sapiens
gagaugcuggacacauaaa

SEQ ID NO: 1514033 - RNA, 19 nt, Homo sapiens
ucaccgugcccuuagguuu

SEQ ID NO: 1514034 - RNA, 19 nt, Homo sapiens
cagugucgguagaguguga

SEQ ID NO: 1514035 - RNA, 19 nt, Homo sapiens
aaccuggaaugcuguguga

SEQ ID NO: 1514036 - RNA, 19 nt, Homo sapiens
gguagagugugaggaugga

SEQ ID NO: 1514037 - RNA, 19 nt, Homo sapiens
uaucaaggacucacaaacu

SEQ ID NO: 1514038 - RNA, 19 nt, Homo sapiens
uggcggagauggcgacucu

SEQ ID NO: 1514039 - RNA, 19 nt, Homo sapiens
gggcccagccuacucuguu

SEQ ID NO: 1514040 - RNA, 19 nt, Homo sapiens
agccacacaucgcacguuu

SEQ ID NO: 1514041 - RNA, 19 nt, Homo sapiens
gauggcgacucuguucuac

SEQ ID NO: 1514042 - RNA, 19 nt, Homo sapiens
ucaggaagauaggcuuugg

SEQ ID NO: 1514043 - RNA, 19 nt, Homo sapiens
gcuaucaaggacucacaaa

SEQ ID NO: 1514044 - RNA, 19 nt, Homo sapiens
ggcccagccuacucuguuc

SEQ ID NO: 1514045 - RNA, 19 nt, Homo sapiens
ucuugugucuguuauugga

SEQ ID NO: 1514046 - RNA, 19 nt, Homo sapiens
gcucugcugucgggaugga

SEQ ID NO: 1514047 - RNA, 19 nt, Homo sapiens
gagacucugucggaugaag

SEQ ID NO: 1514048 - RNA, 19 nt, Homo sapiens
acauuuggacaccuucuuu

SEQ ID NO: 1514049 - RNA, 19 nt, Homo sapiens
gcggagauggcgacucugu

SEQ ID NO: 1514050 - RNA, 19 nt, Homo sapiens
gaaauuuggggauguuaau

SEQ ID NO: 1514051 - RNA, 19 nt, Homo sapiens
gagaaggcagaagcaauca

SEQ ID NO: 1514052 - RNA, 19 nt, Homo sapiens
gcaaguuacagccacaaaa

SEQ ID NO: 1514053 - RNA, 19 nt, Homo sapiens
gaacauuuggacaccuucu

SEQ ID NO: 1514054 - RNA, 19 nt, Homo sapiens
gaccgccuccucagucugu

SEQ ID NO: 1514055 - RNA, 19 nt, Homo sapiens
ucuguucuacggccugaua

SEQ ID NO: 1514056 - RNA, 19 nt, Homo sapiens
ggguugacuugagcugaga

SEQ ID NO: 1514057 - RNA, 19 nt, Homo sapiens
ucagucuggcuugaaauuu

SEQ ID NO: 1514058 - RNA, 19 nt, Homo sapiens
ggccaaagcugaccucuga

SEQ ID NO: 1514059 - RNA, 19 nt, Homo sapiens
gagaagcacucacggaaga

SEQ ID NO: 1514060 - RNA, 19 nt, Homo sapiens
ggagaauucugccugcaaa

SEQ ID NO: 1514061 - RNA, 19 nt, Homo sapiens
gcagucagcuccacauugg

SEQ ID NO: 1514062 - RNA, 19 nt, Homo sapiens
gcaccaauuucugaauaaa

SEQ ID NO: 1514063 - RNA, 19 nt, Homo sapiens
ucaacaaacuucagaguag

SEQ ID NO: 1514064 - RNA, 19 nt, Homo sapiens
gcacugggcucaggcuuca

SEQ ID NO: 1514065 - RNA, 19 nt, Homo sapiens
ggaaaacugugaccuguga

SEQ ID NO: 1514066 - RNA, 19 nt, Homo sapiens
uggcaccaauuucugaaua

SEQ ID NO: 1514067 - RNA, 19 nt, Homo sapiens
ggcaccaauuucugaauaa

SEQ ID NO: 1514068 - RNA, 19 nt, Homo sapiens
gaagauucaggacaagcua

SEQ ID NO: 1514069 - RNA, 19 nt, Homo sapiens
acaggcggcuucaccauga

SEQ ID NO: 1514070 - RNA, 19 nt, Homo sapiens
agacagugcucagugcaaa

SEQ ID NO: 1514071 - RNA, 19 nt, Homo sapiens
uaaauucaccggagacauc

SEQ ID NO: 1514072 - RNA, 19 nt, Homo sapiens
gacaagcuacggaggauga

SEQ ID NO: 1514073 - RNA, 19 nt, Homo sapiens
caacucaacaaacuucaga

SEQ ID NO: 1514074 - RNA, 19 nt, Homo sapiens
cuucagcggugccgacauu

SEQ ID NO: 1514075 - RNA, 19 nt, Homo sapiens
gcuaugagcagagaaacuu

SEQ ID NO: 1514076 - RNA, 19 nt, Homo sapiens
ccacaacccagacccagaa

SEQ ID NO: 1514077 - RNA, 19 nt, Homo sapiens
aaagauagcagaggucaug

SEQ ID NO: 1514078 - RNA, 19 nt, Homo sapiens
cacggaagauucaggacaa

SEQ ID NO: 1514079 - RNA, 19 nt, Homo sapiens
ucaggaacaucgcaaaggu

SEQ ID NO: 1514080 - RNA, 19 nt, Homo sapiens
ugaaagccguggaggucuu

SEQ ID NO: 1514081 - RNA, 19 nt, Homo sapiens
aauucugccugcaaagaua

SEQ ID NO: 1514082 - RNA, 19 nt, Homo sapiens
gaauucugccugcaaagau

SEQ ID NO: 1514083 - RNA, 19 nt, Homo sapiens
ggaggaugaaggcuacauu

SEQ ID NO: 1514084 - RNA, 19 nt, Homo sapiens
gaagcacucacggaagauu

SEQ ID NO: 1514085 - RNA, 19 nt, Homo sapiens
ugugacaaaucgcugcauu

SEQ ID NO: 1514086 - RNA, 19 nt, Homo sapiens
ugaaggcuacauuccagua

SEQ ID NO: 1514087 - RNA, 19 nt, Homo sapiens
gaggaugaaggcuacauuc

SEQ ID NO: 1514088 - RNA, 19 nt, Homo sapiens
gcagauagcagggccaacu

SEQ ID NO: 1514089 - RNA, 19 nt, Homo sapiens
ggucauggaggagcugaaa

SEQ ID NO: 1514090 - RNA, 19 nt, Homo sapiens
acgaaaugcaguucacuuu

SEQ ID NO: 1514091 - RNA, 19 nt, Homo sapiens
cuuggagguuugcguguuu

SEQ ID NO: 1514092 - RNA, 19 nt, Homo sapiens
gagaacccuuacaccuuca

SEQ ID NO: 1514093 - RNA, 19 nt, Homo sapiens
ggaugaaggcuacauucca

SEQ ID NO: 1514094 - RNA, 19 nt, Homo sapiens
ggguugugcuuuugaguuu

SEQ ID NO: 1514095 - RNA, 19 nt, Homo sapiens
cuccacagcucgccacaca

SEQ ID NO: 1514096 - RNA, 19 nt, Homo sapiens
ccguggaggucuuccugaa

SEQ ID NO: 1514097 - RNA, 19 nt, Homo sapiens
guugugcuuuugaguuuua

SEQ ID NO: 1514098 - RNA, 19 nt, Homo sapiens
cgacagccaugcagauccu

SEQ ID NO: 1514099 - RNA, 19 nt, Homo sapiens
gcucucacggugccaauca

SEQ ID NO: 1514100 - RNA, 19 nt, Homo sapiens
ccagcuaguggcauuucua

SEQ ID NO: 1514101 - RNA, 19 nt, Homo sapiens
gcucagugcaaaucaacau

SEQ ID NO: 1514102 - RNA, 19 nt, Homo sapiens
acugugaccugugacaaau

SEQ ID NO: 1514103 - RNA, 19 nt, Homo sapiens
ccaaagcugaccucugagu

SEQ ID NO: 1514104 - RNA, 19 nt, Homo sapiens
cucaacaaacuucagagua

SEQ ID NO: 1514105 - RNA, 19 nt, Homo sapiens
ggaagauucaggacaagcu

SEQ ID NO: 1514106 - RNA, 19 nt, Homo sapiens
gcgcagucagcuccacauu

SEQ ID NO: 1514107 - RNA, 19 nt, Homo sapiens
ccaccgccaacucaacaaa

SEQ ID NO: 1514108 - RNA, 19 nt, Homo sapiens
gaaagccguggaggucuuc

SEQ ID NO: 1514109 - RNA, 19 nt, Homo sapiens
ccacagcucgccacacacu

SEQ ID NO: 1514110 - RNA, 19 nt, Homo sapiens
gagcaacgaagggccaaag

SEQ ID NO: 1514111 - RNA, 19 nt, Homo sapiens
agacagcuucccaggaguu

SEQ ID NO: 1514112 - RNA, 19 nt, Homo sapiens
cagccugugucugauggaa

SEQ ID NO: 1514113 - RNA, 19 nt, Homo sapiens
aggagaacccuuacaccuu

SEQ ID NO: 1514114 - RNA, 19 nt, Homo sapiens
gugccgacauuuccacacu

SEQ ID NO: 1514115 - RNA, 19 nt, Homo sapiens
agaauucugccugcaaaga

SEQ ID NO: 1514116 - RNA, 19 nt, Homo sapiens
gcagaggagccauuauuua

SEQ ID NO: 1514117 - RNA, 19 nt, Homo sapiens
caaaucaaguucuaguguu

SEQ ID NO: 1514118 - RNA, 19 nt, Homo sapiens
gcagugcugugaaggauau

SEQ ID NO: 1514119 - RNA, 19 nt, Homo sapiens
gcuaaaagcugcaaaggaa

SEQ ID NO: 1514120 - RNA, 19 nt, Homo sapiens
gagcagaggagccauuauu

SEQ ID NO: 1514121 - RNA, 19 nt, Homo sapiens
gagcgucuauggucaguug

SEQ ID NO: 1514122 - RNA, 19 nt, Homo sapiens
gcagguacaucgaagucuu

SEQ ID NO: 1514123 - RNA, 19 nt, Homo sapiens
ugaaggauauagaaugugu

SEQ ID NO: 1514124 - RNA, 19 nt, Homo sapiens
cagaggagccauuauuuau

SEQ ID NO: 1514125 - RNA, 19 nt, Homo sapiens
gaggagccauuauuuaugc

SEQ ID NO: 1514126 - RNA, 19 nt, Homo sapiens
ggggauaucugacacauga

SEQ ID NO: 1514127 - RNA, 19 nt, Homo sapiens
uaggaaaggugggcacaaa

SEQ ID NO: 1514128 - RNA, 19 nt, Homo sapiens
gcucugucuuuacuucaaa

SEQ ID NO: 1514129 - RNA, 19 nt, Homo sapiens
ggauaucugacacaugauu

SEQ ID NO: 1514130 - RNA, 19 nt, Homo sapiens
ugugaaggauauagaaugu

SEQ ID NO: 1514131 - RNA, 19 nt, Homo sapiens
ugucaucgcuggugguauc

SEQ ID NO: 1514132 - RNA, 19 nt, Homo sapiens
uauagaaugugugccaguu

SEQ ID NO: 1514133 - RNA, 19 nt, Homo sapiens
ggaagcugcaguuggaaga

SEQ ID NO: 1514134 - RNA, 19 nt, Homo sapiens
gagaugggaagcugcaguu

SEQ ID NO: 1514135 - RNA, 19 nt, Homo sapiens
ugaccuccauacagugauu

SEQ ID NO: 1514136 - RNA, 19 nt, Homo sapiens
ccuuagaaguggugagaug

SEQ ID NO: 1514137 - RNA, 19 nt, Homo sapiens
gccauuauuuaugcaggua

SEQ ID NO: 1514138 - RNA, 19 nt, Homo sapiens
ucaaaucaaguucuagugu

SEQ ID NO: 1514139 - RNA, 19 nt, Homo sapiens
ucaugagcaauacuucuua

SEQ ID NO: 1514140 - RNA, 19 nt, Homo sapiens
auacagugauuaugcuugu

SEQ ID NO: 1514141 - RNA, 19 nt, Homo sapiens
cugaagcuguggcuguaaa

SEQ ID NO: 1514142 - RNA, 19 nt, Homo sapiens
ucuauggucaguugccuua

SEQ ID NO: 1514143 - RNA, 19 nt, Homo sapiens
gcuguugcgacauaaauga

SEQ ID NO: 1514144 - RNA, 19 nt, Homo sapiens
uauggucaguugccuuaga

SEQ ID NO: 1514145 - RNA, 19 nt, Homo sapiens
caugagcaauacuucuuag

SEQ ID NO: 1514146 - RNA, 19 nt, Homo sapiens
guacaucgaagucuuuuga

SEQ ID NO: 1514147 - RNA, 19 nt, Homo sapiens
gauaucugacacaugauug

SEQ ID NO: 1514148 - RNA, 19 nt, Homo sapiens
acacaugauuggagcucuu

SEQ ID NO: 1514149 - RNA, 19 nt, Homo sapiens
uagaaugugugccaguuuu

SEQ ID NO: 1514150 - RNA, 19 nt, Homo sapiens
caagaacagccaggccaaa

SEQ ID NO: 1514151 - RNA, 19 nt, Homo sapiens
ccuggaggaugccugacaa

SEQ ID NO: 1514152 - RNA, 19 nt, Homo sapiens
augggaagcugcaguugga

SEQ ID NO: 1514153 - RNA, 19 nt, Homo sapiens
cagguacaucgaagucuuu

SEQ ID NO: 1514154 - RNA, 19 nt, Homo sapiens
gcccugcagugcugugaag

SEQ ID NO: 1514155 - RNA, 19 nt, Homo sapiens
agaggagccauuauuuaug

SEQ ID NO: 1514156 - RNA, 19 nt, Homo sapiens
gucaguugccuuagaagug

SEQ ID NO: 1514157 - RNA, 19 nt, Homo sapiens
gcugugaaggauauagaau

SEQ ID NO: 1514158 - RNA, 19 nt, Homo sapiens
ggucaguugccuuagaagu

SEQ ID NO: 1514159 - RNA, 19 nt, Homo sapiens
ccauugccacggagucuug

SEQ ID NO: 1514160 - RNA, 19 nt, Homo sapiens
cgugcucugucuuuacuuc

SEQ ID NO: 1514161 - RNA, 19 nt, Homo sapiens
uggagcagaggagccauua

SEQ ID NO: 1514162 - RNA, 19 nt, Homo sapiens
gaaagcagcugacuuauug

SEQ ID NO: 1514163 - RNA, 19 nt, Homo sapiens
gaauuaagcucuagagaaa

SEQ ID NO: 1514164 - RNA, 19 nt, Homo sapiens
gaacauaauugaagacuug

SEQ ID NO: 1514165 - RNA, 19 nt, Homo sapiens
gcagaaagcagcugacuua

SEQ ID NO: 1514166 - RNA, 19 nt, Homo sapiens
cagcagaaguuaacaaaua

SEQ ID NO: 1514167 - RNA, 19 nt, Homo sapiens
ggaguuaaaugaagaaaga

SEQ ID NO: 1514168 - RNA, 19 nt, Homo sapiens
gaacagauuucaauacuac

SEQ ID NO: 1514169 - RNA, 19 nt, Homo sapiens
ggucuaaacugacuuguga

SEQ ID NO: 1514170 - RNA, 19 nt, Homo sapiens
gaaaguugcuagcaugaug

SEQ ID NO: 1514171 - RNA, 19 nt, Homo sapiens
ggagcacuaugacaacuua

SEQ ID NO: 1514172 - RNA, 19 nt, Homo sapiens
gaaguagcauguccucuga

SEQ ID NO: 1514173 - RNA, 19 nt, Homo sapiens
gggaagaucuaaaucagaa

SEQ ID NO: 1514174 - RNA, 19 nt, Homo sapiens
gacugaaguugaaagauua

SEQ ID NO: 1514175 - RNA, 19 nt, Homo sapiens
gaagagaguugaggaggaa

SEQ ID NO: 1514176 - RNA, 19 nt, Homo sapiens
acaacaagcugaacagauu

SEQ ID NO: 1514177 - RNA, 19 nt, Homo sapiens
ggaguauucugaugcaauu

SEQ ID NO: 1514178 - RNA, 19 nt, Homo sapiens
gcacacaggccuuugauga

SEQ ID NO: 1514179 - RNA, 19 nt, Homo sapiens
gauggaaaguaaagaugua

SEQ ID NO: 1514180 - RNA, 19 nt, Homo sapiens
aaagugagauuccaguuga

SEQ ID NO: 1514181 - RNA, 19 nt, Homo sapiens
gagcaaaaguggaaaauga

SEQ ID NO: 1514182 - RNA, 19 nt, Homo sapiens
gaccaaggauuuccaaaca

SEQ ID NO: 1514183 - RNA, 19 nt, Homo sapiens
agacugaaguugaaagauu

SEQ ID NO: 1514184 - RNA, 19 nt, Homo sapiens
ggaaagggaagaucuaaau

SEQ ID NO: 1514185 - RNA, 19 nt, Homo sapiens
gcagcugacuuauuggaaa

SEQ ID NO: 1514186 - RNA, 19 nt, Homo sapiens
guaaaggaguuaaaugaag

SEQ ID NO: 1514187 - RNA, 19 nt, Homo sapiens
gcaaggagcacuaugacaa

SEQ ID NO: 1514188 - RNA, 19 nt, Homo sapiens
gaugaagaauuaagcucua

SEQ ID NO: 1514189 - RNA, 19 nt, Homo sapiens
aaagacaucuguaaugcaa

SEQ ID NO: 1514190 - RNA, 19 nt, Homo sapiens
ggaaaguucagcaaucaaa

SEQ ID NO: 1514191 - RNA, 19 nt, Homo sapiens
ucagaaggcuugggauauu

SEQ ID NO: 1514192 - RNA, 19 nt, Homo sapiens
ugaaagcuauggaugaguu

SEQ ID NO: 1514193 - RNA, 19 nt, Homo sapiens
gcaauucucaucaacaaga

SEQ ID NO: 1514194 - RNA, 19 nt, Homo sapiens
gaaagugagauuccaguug

SEQ ID NO: 1514195 - RNA, 19 nt, Homo sapiens
ccaaggauuuccaaacaga

SEQ ID NO: 1514196 - RNA, 19 nt, Homo sapiens
gcccuaagcugcaaucuac

SEQ ID NO: 1514197 - RNA, 19 nt, Homo sapiens
gaucuggcaaguugaauaa

SEQ ID NO: 1514198 - RNA, 19 nt, Homo sapiens
gcaauggggucuaaacuga

SEQ ID NO: 1514199 - RNA, 19 nt, Homo sapiens
agacuugaauucugugauu

SEQ ID NO: 1514200 - RNA, 19 nt, Homo sapiens
ggacaauauuaguaacaug

SEQ ID NO: 1514201 - RNA, 19 nt, Homo sapiens
uggaugaguuggacaauau

SEQ ID NO: 1514202 - RNA, 19 nt, Homo sapiens
ggacugaagaagaaagaaa

SEQ ID NO: 1514203 - RNA, 19 nt, Homo sapiens
gugaaaagauugucaaaga

SEQ ID NO: 1514204 - RNA, 19 nt, Homo sapiens
aagcagaacugaagaaacu

SEQ ID NO: 1514205 - RNA, 19 nt, Homo sapiens
ggaugccuuugcccaguua

SEQ ID NO: 1514206 - RNA, 19 nt, Homo sapiens
ugaaauuccuggucaucaa

SEQ ID NO: 1514207 - RNA, 19 nt, Homo sapiens
uaaacaaggacaaguagaa

SEQ ID NO: 1514208 - RNA, 19 nt, Homo sapiens
caacuuuccuccagaagag

SEQ ID NO: 1514209 - RNA, 19 nt, Homo sapiens
uauuggaaauggcaacuuu

SEQ ID NO: 1514210 - RNA, 19 nt, Homo sapiens
cagauugagugggaacaua

SEQ ID NO: 1514211 - RNA, 19 nt, Homo sapiens
ggaaauugaaguagcaugu

SEQ ID NO: 1514212 - RNA, 19 nt, Homo sapiens
caagagaucgucaaaagua

SEQ ID NO: 1514213 - RNA, 19 nt, Homo sapiens
gaugaguuggacaauauua

SEQ ID NO: 1514214 - RNA, 19 nt, Homo sapiens
ggauauacucuacaaacuu

SEQ ID NO: 1514215 - RNA, 19 nt, Homo sapiens
gaaaauaaguaaccuugca

SEQ ID NO: 1514216 - RNA, 19 nt, Homo sapiens
caaggaaacagcacgagaa

SEQ ID NO: 1514217 - RNA, 19 nt, Homo sapiens
gaaaagacaucuguaaugc

SEQ ID NO: 1514218 - RNA, 19 nt, Homo sapiens
guaccuaaaugaaccaaac

SEQ ID NO: 1514219 - RNA, 19 nt, Homo sapiens
ggccuuugaugaacauuug

SEQ ID NO: 1514220 - RNA, 19 nt, Homo sapiens
uaaguaaccuugcauuuuc

SEQ ID NO: 1514221 - RNA, 19 nt, Homo sapiens
agacaucuguaaugcaaug

SEQ ID NO: 1514222 - RNA, 19 nt, Homo sapiens
gaaagggaagaucuaaauc

SEQ ID NO: 1514223 - RNA, 19 nt, Homo sapiens
uaaugaaagcuauggauga

SEQ ID NO: 1514224 - RNA, 19 nt, Homo sapiens
uagcauguccucugaguug

SEQ ID NO: 1514225 - RNA, 19 nt, Homo sapiens
ggacaaguagaacuggaaa

SEQ ID NO: 1514226 - RNA, 19 nt, Homo sapiens
gaaaguaaagcagaaagca

SEQ ID NO: 1514227 - RNA, 19 nt, Homo sapiens
caacaagcugaacagauuu

SEQ ID NO: 1514228 - RNA, 19 nt, Homo sapiens
ggaucuggcaaguugaaua

SEQ ID NO: 1514229 - RNA, 19 nt, Homo sapiens
guucggaaaucuagagaag

SEQ ID NO: 1514230 - RNA, 19 nt, Homo sapiens
cuagcaugauggaaaguaa

SEQ ID NO: 1514231 - RNA, 19 nt, Homo sapiens
aaacgccgaccaaggauuu

SEQ ID NO: 1514232 - RNA, 19 nt, Homo sapiens
ucaaguggauauacucuac

SEQ ID NO: 1514233 - RNA, 19 nt, Homo sapiens
uucagaagcuguucggaaa

SEQ ID NO: 1514234 - RNA, 19 nt, Homo sapiens
agaauuaagcucuagagaa

SEQ ID NO: 1514235 - RNA, 19 nt, Homo sapiens
guaaagauguacacaaaag

SEQ ID NO: 1514236 - RNA, 19 nt, Homo sapiens
agaaagcagcugacuuauu

SEQ ID NO: 1514237 - RNA, 19 nt, Homo sapiens
caaccaggaggaacugaaa

SEQ ID NO: 1514238 - RNA, 19 nt, Homo sapiens
gauggaaagggaagaucua

SEQ ID NO: 1514239 - RNA, 19 nt, Homo sapiens
gcaacuuuccuccagaaga

SEQ ID NO: 1514240 - RNA, 19 nt, Homo sapiens
gaguuggacaauauuagua

SEQ ID NO: 1514241 - RNA, 19 nt, Homo sapiens
cugaacaacuaccuuacaa

SEQ ID NO: 1514242 - RNA, 19 nt, Homo sapiens
caacagcagaaguuaacaa

SEQ ID NO: 1514243 - RNA, 19 nt, Homo sapiens
ccuuuggucuggaaucauu

SEQ ID NO: 1514244 - RNA, 19 nt, Homo sapiens
gaugcaacagcagaaguua

SEQ ID NO: 1514245 - RNA, 19 nt, Homo sapiens
aaagggaagaucuaaauca

SEQ ID NO: 1514246 - RNA, 19 nt, Homo sapiens
gaaaguaaagauguacaca

SEQ ID NO: 1514247 - RNA, 19 nt, Homo sapiens
gaagagaaagugagauucc

SEQ ID NO: 1514248 - RNA, 19 nt, Homo sapiens
cagcugacuuauuggaaau

SEQ ID NO: 1514249 - RNA, 19 nt, Homo sapiens
gaagcuguucggaaaucua

SEQ ID NO: 1514250 - RNA, 19 nt, Homo sapiens
cagaagcuguucggaaauc

SEQ ID NO: 1514251 - RNA, 19 nt, Homo sapiens
cugcaugaauaaaugugua

SEQ ID NO: 1514252 - RNA, 19 nt, Homo sapiens
acacaaggccaaaucaauc

SEQ ID NO: 1514253 - RNA, 19 nt, Homo sapiens
aaucagaaggcuugggaua

SEQ ID NO: 1514254 - RNA, 19 nt, Homo sapiens
gauucggacucaaggacaa

SEQ ID NO: 1514255 - RNA, 19 nt, Homo sapiens
ucaaagaacgguaugaaaa

SEQ ID NO: 1514256 - RNA, 19 nt, Homo sapiens
ggaaacagcacgagaaaag

SEQ ID NO: 1514257 - RNA, 19 nt, Homo sapiens
aagcugcaaucuacgagaa

SEQ ID NO: 1514258 - RNA, 19 nt, Homo sapiens
cagaaggcuugggauauuc

SEQ ID NO: 1514259 - RNA, 19 nt, Homo sapiens
cuaaaugaaccaaacuaug

SEQ ID NO: 1514260 - RNA, 19 nt, Homo sapiens
gaaauuccuggucaucaag

SEQ ID NO: 1514261 - RNA, 19 nt, Homo sapiens
acaacuuacuggcagaaga

SEQ ID NO: 1514262 - RNA, 19 nt, Homo sapiens
gaaacaaggcccuggauua

SEQ ID NO: 1514263 - RNA, 19 nt, Homo sapiens
gcagggaucucuccgaaga

SEQ ID NO: 1514264 - RNA, 19 nt, Homo sapiens
caaacaaggucacauucug

SEQ ID NO: 1514265 - RNA, 19 nt, Homo sapiens
gguuaggccuucaacauau

SEQ ID NO: 1514266 - RNA, 19 nt, Homo sapiens
cuaggucggucccagguua

SEQ ID NO: 1514267 - RNA, 19 nt, Homo sapiens
caucucugcuccuguguuu

SEQ ID NO: 1514268 - RNA, 19 nt, Homo sapiens
ccgaaggccucccugguuu

SEQ ID NO: 1514269 - RNA, 19 nt, Homo sapiens
acaaggcccuggauuacaa

SEQ ID NO: 1514270 - RNA, 19 nt, Homo sapiens
ggguuaggccuucaacaua

SEQ ID NO: 1514271 - RNA, 19 nt, Homo sapiens
ugugggagcugcccuaguu

SEQ ID NO: 1514272 - RNA, 19 nt, Homo sapiens
ugaagggcguggagugaga

SEQ ID NO: 1514273 - RNA, 19 nt, Homo sapiens
aaacaaggucacauucuga

SEQ ID NO: 1514274 - RNA, 19 nt, Homo sapiens
cauccucgcuguuggaaag

SEQ ID NO: 1514275 - RNA, 19 nt, Homo sapiens
ccacagaagcccucucaca

SEQ ID NO: 1514276 - RNA, 19 nt, Homo sapiens
ucacggccacucuguguaa

SEQ ID NO: 1514277 - RNA, 19 nt, Homo sapiens
aggacuggcucucgacaaa

SEQ ID NO: 1514278 - RNA, 19 nt, Homo sapiens
ggauuacaagugucauuug

SEQ ID NO: 1514279 - RNA, 19 nt, Homo sapiens
ggcccuggauuacaagugu

SEQ ID NO: 1514280 - RNA, 19 nt, Homo sapiens
ggccugcaucucaguguua

SEQ ID NO: 1514281 - RNA, 19 nt, Homo sapiens
cuaaucaacguaaaucugu

SEQ ID NO: 1514282 - RNA, 19 nt, Homo sapiens
guuaggccuucaacauaug

SEQ ID NO: 1514283 - RNA, 19 nt, Homo sapiens
aaacaaggcccuggauuac

SEQ ID NO: 1514284 - RNA, 19 nt, Homo sapiens
ccauuccaccagucuguua

SEQ ID NO: 1514285 - RNA, 19 nt, Homo sapiens
gaacugauggacacaagcu

SEQ ID NO: 1514286 - RNA, 19 nt, Homo sapiens
gggaaacggccuccuaggu

SEQ ID NO: 1514287 - RNA, 19 nt, Homo sapiens
gcuuaucgccacacugguu

SEQ ID NO: 1514288 - RNA, 19 nt, Homo sapiens
gacacaauucgacccguaa

SEQ ID NO: 1514289 - RNA, 19 nt, Homo sapiens
cagaugaggugcgcaacca

SEQ ID NO: 1514290 - RNA, 19 nt, Homo sapiens
ugaaacaaggcccuggauu

SEQ ID NO: 1514291 - RNA, 19 nt, Homo sapiens
cauagccgauuagcuguca

SEQ ID NO: 1514292 - RNA, 19 nt, Homo sapiens
uaccagagugggaaagaaa

SEQ ID NO: 1514293 - RNA, 19 nt, Homo sapiens
cagcgaaggaggccaagga

SEQ ID NO: 1514294 - RNA, 19 nt, Homo sapiens
gccugcaucucaguguuaa

SEQ ID NO: 1514295 - RNA, 19 nt, Homo sapiens
ggugaagggcguggaguga

SEQ ID NO: 1514296 - RNA, 19 nt, Homo sapiens
cagaaucccuggguuuuga

SEQ ID NO: 1514297 - RNA, 19 nt, Homo sapiens
ccaaacaaggucacauucu

SEQ ID NO: 1514298 - RNA, 19 nt, Homo sapiens
uuuccacggaccuuuauua

SEQ ID NO: 1514299 - RNA, 19 nt, Homo sapiens
caagugucauuuguggaau

SEQ ID NO: 1514300 - RNA, 19 nt, Homo sapiens
acugauggacacaagcuua

SEQ ID NO: 1514301 - RNA, 19 nt, Homo sapiens
gagccuguguggccaccau

SEQ ID NO: 1514302 - RNA, 19 nt, Homo sapiens
gcauggccaccuccaguuc

SEQ ID NO: 1514303 - RNA, 19 nt, Homo sapiens
uuaccagagugggaaagaa

SEQ ID NO: 1514304 - RNA, 19 nt, Homo sapiens
ccacaucagggcucagaca

SEQ ID NO: 1514305 - RNA, 19 nt, Homo sapiens
uaggugacaugggaauauc

SEQ ID NO: 1514306 - RNA, 19 nt, Homo sapiens
uggauuacaagugucauuu

SEQ ID NO: 1514307 - RNA, 19 nt, Homo sapiens
gcauuuucauggauuacaa

SEQ ID NO: 1514308 - RNA, 19 nt, Homo sapiens
gacaccauccucgcuguug

SEQ ID NO: 1514309 - RNA, 19 nt, Homo sapiens
cggccacucuguguaagga

SEQ ID NO: 1514310 - RNA, 19 nt, Homo sapiens
cuaagaaccucaauaaaga

SEQ ID NO: 1514311 - RNA, 19 nt, Homo sapiens
cguaguagcuggaguuauu

SEQ ID NO: 1514312 - RNA, 19 nt, Homo sapiens
agaaggagauggagaaaga

SEQ ID NO: 1514313 - RNA, 19 nt, Homo sapiens
gaugagguguguccugaaa

SEQ ID NO: 1514314 - RNA, 19 nt, Homo sapiens
ccagagagcacuaacaauu

SEQ ID NO: 1514315 - RNA, 19 nt, Homo sapiens
caacaagcauucauucaac

SEQ ID NO: 1514316 - RNA, 19 nt, Homo sapiens
ggucuaagcuggacgucau

SEQ ID NO: 1514317 - RNA, 19 nt, Homo sapiens
gggacuagaugaugaacug

SEQ ID NO: 1514318 - RNA, 19 nt, Homo sapiens
gaacguggcaggaguguac

SEQ ID NO: 1514319 - RNA, 19 nt, Homo sapiens
gagagaaggagauggagaa

SEQ ID NO: 1514320 - RNA, 19 nt, Homo sapiens
gaaccauggacccguagua

SEQ ID NO: 1514321 - RNA, 19 nt, Homo sapiens
agacagagacgauggagaa

SEQ ID NO: 1514322 - RNA, 19 nt, Homo sapiens
cagagagcacuaacaauuu

SEQ ID NO: 1514323 - RNA, 19 nt, Homo sapiens
gcacuaugguggaauuugc

SEQ ID NO: 1514324 - RNA, 19 nt, Homo sapiens
gggcagaggaggaggauga

SEQ ID NO: 1514325 - RNA, 19 nt, Homo sapiens
cccagaagccgcaauauga

SEQ ID NO: 1514326 - RNA, 19 nt, Homo sapiens
aauccaacaucaaucauga

SEQ ID NO: 1514327 - RNA, 19 nt, Homo sapiens
gaaggagcccaaacugaug

SEQ ID NO: 1514328 - RNA, 19 nt, Homo sapiens
agagagcacuaacaauuuc

SEQ ID NO: 1514329 - RNA, 19 nt, Homo sapiens
ggugcuaucuccuucuuca

SEQ ID NO: 1514330 - RNA, 19 nt, Homo sapiens
ugacucggcugcucuugga

SEQ ID NO: 1514331 - RNA, 19 nt, Homo sapiens
caauguguccuccaugauu

SEQ ID NO: 1514332 - RNA, 19 nt, Homo sapiens
gaaccucaauaaagagacu

SEQ ID NO: 1514333 - RNA, 19 nt, Homo sapiens
ucuaagaaccucaauaaag

SEQ ID NO: 1514334 - RNA, 19 nt, Homo sapiens
acacuguacuucagagaga

SEQ ID NO: 1514335 - RNA, 19 nt, Homo sapiens
ucaacccacugacacugua

SEQ ID NO: 1514336 - RNA, 19 nt, Homo sapiens
ucaacaagcauucauucaa

SEQ ID NO: 1514337 - RNA, 19 nt, Homo sapiens
ugaaggagcccaaacugau

SEQ ID NO: 1514338 - RNA, 19 nt, Homo sapiens
aauguguccuccaugauuu

SEQ ID NO: 1514339 - RNA, 19 nt, Homo sapiens
gcucuggccaucacguaua

SEQ ID NO: 1514340 - RNA, 19 nt, Homo sapiens
cuaccuaucuggucaucga

SEQ ID NO: 1514341 - RNA, 19 nt, Homo sapiens
gaaugcaugcggaucaaga

SEQ ID NO: 1514342 - RNA, 19 nt, Homo sapiens
ccaggaacaccuucucuug

SEQ ID NO: 1514343 - RNA, 19 nt, Homo sapiens
ccaagugacugaggagaca

SEQ ID NO: 1514344 - RNA, 19 nt, Homo sapiens
cccaauguguccuccauga

SEQ ID NO: 1514345 - RNA, 19 nt, Homo sapiens
ggacuucaacccacugaca

SEQ ID NO: 1514346 - RNA, 19 nt, Homo sapiens
gaaguggcaguacgacguu

SEQ ID NO: 1514347 - RNA, 19 nt, Homo sapiens
gaauccaacaucaaucaug

SEQ ID NO: 1514348 - RNA, 19 nt, Homo sapiens
gacguuuggucacaugaug

SEQ ID NO: 1514349 - RNA, 19 nt, Homo sapiens
ggccagagagcacuaacaa

SEQ ID NO: 1514350 - RNA, 19 nt, Homo sapiens
agauugcacucgccuucua

SEQ ID NO: 1514351 - RNA, 19 nt, Homo sapiens
ccacugacacuguacuuca

SEQ ID NO: 1514352 - RNA, 19 nt, Homo sapiens
gccugcaccuuccugguuu

SEQ ID NO: 1514353 - RNA, 19 nt, Homo sapiens
cagcucaacucgcagaaac

SEQ ID NO: 1514354 - RNA, 19 nt, Homo sapiens
agaagaagcaccaggaaca

SEQ ID NO: 1514355 - RNA, 19 nt, Homo sapiens
uggagaagaucaagaccau

SEQ ID NO: 1514356 - RNA, 19 nt, Homo sapiens
cgaccaggacugagaauag

SEQ ID NO: 1514357 - RNA, 19 nt, Homo sapiens
gcaccuacuuccugaacac

SEQ ID NO: 1514358 - RNA, 19 nt, Homo sapiens
gcccagaagccgcaauaug

SEQ ID NO: 1514359 - RNA, 19 nt, Homo sapiens
cagaggaggaggaugagaa

SEQ ID NO: 1514360 - RNA, 19 nt, Homo sapiens
ucaucgggcugcagaagug

SEQ ID NO: 1514361 - RNA, 19 nt, Homo sapiens
gcacucaggcagcguacug

SEQ ID NO: 1514362 - RNA, 19 nt, Homo sapiens
ggccacgccuuccuguuca

SEQ ID NO: 1514363 - RNA, 19 nt, Homo sapiens
gcaacgaggaucucuacca

SEQ ID NO: 1514364 - RNA, 19 nt, Homo sapiens
ccaaacugaugggugcuau

SEQ ID NO: 1514365 - RNA, 19 nt, Homo sapiens
uuaccagccuguucuucuu

SEQ ID NO: 1514366 - RNA, 19 nt, Homo sapiens
ucagagagaaggagaugga

SEQ ID NO: 1514367 - RNA, 19 nt, Homo sapiens
caucaacaagcauucauuc

SEQ ID NO: 1514368 - RNA, 19 nt, Homo sapiens
gcuaucuccuucuucaucu

SEQ ID NO: 1514369 - RNA, 19 nt, Homo sapiens
uuuccaagcucccaaugug

SEQ ID NO: 1514370 - RNA, 19 nt, Homo sapiens
ggagauggagaaagaguac

SEQ ID NO: 1514371 - RNA, 19 nt, Homo sapiens
cacacuggcuaaccacaug

SEQ ID NO: 1514372 - RNA, 19 nt, Homo sapiens
gaagccgcaauaugacauu

SEQ ID NO: 1514373 - RNA, 19 nt, Homo sapiens
gggcccagaagccgcaaua

SEQ ID NO: 1514374 - RNA, 19 nt, Homo sapiens
agacugcccuuuccaagcu

SEQ ID NO: 1514375 - RNA, 19 nt, Homo sapiens
gccaucacguauagcauca

SEQ ID NO: 1514376 - RNA, 19 nt, Homo sapiens
ucccagacuucaaggaguu

SEQ ID NO: 1514377 - RNA, 19 nt, Homo sapiens
uggcaggaguguaccacaa

SEQ ID NO: 1514378 - RNA, 19 nt, Homo sapiens
aggaacaccuucucuuguc

SEQ ID NO: 1514379 - RNA, 19 nt, Homo sapiens
gauugcacucgccuucuaa

SEQ ID NO: 1514380 - RNA, 19 nt, Homo sapiens
ucucaucagugucccauac

SEQ ID NO: 1514381 - RNA, 19 nt, Homo sapiens
caccauccuccuugucuuu

SEQ ID NO: 1514382 - RNA, 19 nt, Homo sapiens
gaccaggacugagaauagc

SEQ ID NO: 1514383 - RNA, 19 nt, Homo sapiens
uccagaugcuagugacaaa

SEQ ID NO: 1514384 - RNA, 19 nt, Homo sapiens
guacgacguuuggucacau

SEQ ID NO: 1514385 - RNA, 19 nt, Homo sapiens
gagaugaaggcagagauca

SEQ ID NO: 1514386 - RNA, 19 nt, Homo sapiens
aacacagacuugacacgaa

SEQ ID NO: 1514387 - RNA, 19 nt, Homo sapiens
ccuacuuccugaacacaga

SEQ ID NO: 1514388 - RNA, 19 nt, Homo sapiens
gaccagguguccuauuuuc

SEQ ID NO: 1514389 - RNA, 19 nt, Homo sapiens
ccaccauccuccuugucuu

SEQ ID NO: 1514390 - RNA, 19 nt, Homo sapiens
ugagguguguccugaaagg

SEQ ID NO: 1514391 - RNA, 19 nt, Homo sapiens
ucacguauagcaucaccuu

SEQ ID NO: 1514392 - RNA, 19 nt, Homo sapiens
caggaacaccuucucuugu

SEQ ID NO: 1514393 - RNA, 19 nt, Homo sapiens
ucgaccagauugccaagga

SEQ ID NO: 1514394 - RNA, 19 nt, Homo sapiens
cgagcuuccugaccacugu

SEQ ID NO: 1514395 - RNA, 19 nt, Homo sapiens
gcgcaacgaggaucucuac

SEQ ID NO: 1514396 - RNA, 19 nt, Homo sapiens
gggaggagacagagacgau

SEQ ID NO: 1514397 - RNA, 19 nt, Homo sapiens
cgagaagaagcaccaggaa

SEQ ID NO: 1514398 - RNA, 19 nt, Homo sapiens
cuaccuggcccgagagaug

SEQ ID NO: 1514399 - RNA, 19 nt, Homo sapiens
ccaacuucaucauccagau

SEQ ID NO: 1514400 - RNA, 19 nt, Homo sapiens
uaccaccaguccuaugaau

SEQ ID NO: 1514401 - RNA, 19 nt, Homo sapiens
cagagacgauggagaaccu

SEQ ID NO: 1514402 - RNA, 19 nt, Homo sapiens
gccgcaauaugacauuugg

SEQ ID NO: 1514403 - RNA, 19 nt, Homo sapiens
ccaccaguccuaugaaugc

SEQ ID NO: 1514404 - RNA, 19 nt, Homo sapiens
cauggaggcaggcggugua

SEQ ID NO: 1514405 - RNA, 19 nt, Homo sapiens
gaagcaccaggaacaccuu

SEQ ID NO: 1514406 - RNA, 19 nt, Homo sapiens
ccucaucguccgccucuau

SEQ ID NO: 1514407 - RNA, 19 nt, Homo sapiens
gcagcucaacucgcagaaa

SEQ ID NO: 1514408 - RNA, 19 nt, Homo sapiens
aacaagcauucauucaaca

SEQ ID NO: 1514409 - RNA, 19 nt, Homo sapiens
caaguucuuccaggucauu

SEQ ID NO: 1514410 - RNA, 19 nt, Homo sapiens
gggaaaguauguagauaua

SEQ ID NO: 1514411 - RNA, 19 nt, Homo sapiens
gaaauaaacuagaccuuac

SEQ ID NO: 1514412 - RNA, 19 nt, Homo sapiens
aaacugcccuuguauaugu

SEQ ID NO: 1514413 - RNA, 19 nt, Homo sapiens
caacgacaauccacccauu

SEQ ID NO: 1514414 - RNA, 19 nt, Homo sapiens
caucagaguucaucaucaa

SEQ ID NO: 1514415 - RNA, 19 nt, Homo sapiens
gaggaaggcaccauccaua

SEQ ID NO: 1514416 - RNA, 19 nt, Homo sapiens
gagacgggcuccucacugu

SEQ ID NO: 1514417 - RNA, 19 nt, Homo sapiens
gugaaggccuauaugaaug

SEQ ID NO: 1514418 - RNA, 19 nt, Homo sapiens
uaaacuagaccuuacauag

SEQ ID NO: 1514419 - RNA, 19 nt, Homo sapiens
ucaaggauguggccucugu

SEQ ID NO: 1514420 - RNA, 19 nt, Homo sapiens
acaacgcccugauggcaua

SEQ ID NO: 1514421 - RNA, 19 nt, Homo sapiens
gcaggcaccguauuuguga

SEQ ID NO: 1514422 - RNA, 19 nt, Homo sapiens
gaaaacugcccuuguauau

SEQ ID NO: 1514423 - RNA, 19 nt, Homo sapiens
gcaccguauuugugauuga

SEQ ID NO: 1514424 - RNA, 19 nt, Homo sapiens
gagcguugcuucucuaucc

SEQ ID NO: 1514425 - RNA, 19 nt, Homo sapiens
uaugaaaacugcccuugua

SEQ ID NO: 1514426 - RNA, 19 nt, Homo sapiens
ugacagugccugagaacaa

SEQ ID NO: 1514427 - RNA, 19 nt, Homo sapiens
gguguacacuguucuggau

SEQ ID NO: 1514428 - RNA, 19 nt, Homo sapiens
gcaauauucauguuaccaa

SEQ ID NO: 1514429 - RNA, 19 nt, Homo sapiens
ggaguggacaccauaagga

SEQ ID NO: 1514430 - RNA, 19 nt, Homo sapiens
gaugaggccacaggcaaua

SEQ ID NO: 1514431 - RNA, 19 nt, Homo sapiens
ucagccauguguauaauuc

SEQ ID NO: 1514432 - RNA, 19 nt, Homo sapiens
uguugaguguacagaauua

SEQ ID NO: 1514433 - RNA, 19 nt, Homo sapiens
ggguauauaucuguaaugg

SEQ ID NO: 1514434 - RNA, 19 nt, Homo sapiens
ucagugaaggccuauauga

SEQ ID NO: 1514435 - RNA, 19 nt, Homo sapiens
cagagaagcccuguuggaa

SEQ ID NO: 1514436 - RNA, 19 nt, Homo sapiens
ggaaggcaccauccauaca

SEQ ID NO: 1514437 - RNA, 19 nt, Homo sapiens
ccaccaacacgcucauuga

SEQ ID NO: 1514438 - RNA, 19 nt, Homo sapiens
ccauguguauaauuccaaa

SEQ ID NO: 1514439 - RNA, 19 nt, Homo sapiens
uccagagccuguucucauu

SEQ ID NO: 1514440 - RNA, 19 nt, Homo sapiens
cuggguaccucuucugguu

SEQ ID NO: 1514441 - RNA, 19 nt, Homo sapiens
cacagagccuauaccaguu

SEQ ID NO: 1514442 - RNA, 19 nt, Homo sapiens
ccaagcugguguacacugu

SEQ ID NO: 1514443 - RNA, 19 nt, Homo sapiens
gcaagccccuagacuuuga

SEQ ID NO: 1514444 - RNA, 19 nt, Homo sapiens
ugcaagacaucaacgacaa

SEQ ID NO: 1514445 - RNA, 19 nt, Homo sapiens
cagaguucaucaucaaagu

SEQ ID NO: 1514446 - RNA, 19 nt, Homo sapiens
ccacaggcaauauucaugu

SEQ ID NO: 1514447 - RNA, 19 nt, Homo sapiens
guguauaauuccaaaugug

SEQ ID NO: 1514448 - RNA, 19 nt, Homo sapiens
gguauguucucagccaugu

SEQ ID NO: 1514449 - RNA, 19 nt, Homo sapiens
gaguggacaccauaaggaa

SEQ ID NO: 1514450 - RNA, 19 nt, Homo sapiens
ccagagaagcccuguugga

SEQ ID NO: 1514451 - RNA, 19 nt, Homo sapiens
gacagugccugagaacaag

SEQ ID NO: 1514452 - RNA, 19 nt, Homo sapiens
ggaaaaggcgcaauaugug

SEQ ID NO: 1514453 - RNA, 19 nt, Homo sapiens
gaaggcaccauccauacag

SEQ ID NO: 1514454 - RNA, 19 nt, Homo sapiens
caacauggaccgggagaca

SEQ ID NO: 1514455 - RNA, 19 nt, Homo sapiens
uggauggacugccuuucuu

SEQ ID NO: 1514456 - RNA, 19 nt, Homo sapiens
aagcugcacucggauguug

SEQ ID NO: 1514457 - RNA, 19 nt, Homo sapiens
gaaggccuauaugaaugug

SEQ ID NO: 1514458 - RNA, 19 nt, Homo sapiens
gcccuuguauauguggaua

SEQ ID NO: 1514459 - RNA, 19 nt, Homo sapiens
gcucauugacccagccuau

SEQ ID NO: 1514460 - RNA, 19 nt, Homo sapiens
caucaaagugcaagacauc

SEQ ID NO: 1514461 - RNA, 19 nt, Homo sapiens
guggguauauaucuguaau

SEQ ID NO: 1514462 - RNA, 19 nt, Homo sapiens
guucucagccauguguaua

SEQ ID NO: 1514463 - RNA, 19 nt, Homo sapiens
uggaagcgcugugggaauc

SEQ ID NO: 1514464 - RNA, 19 nt, Homo sapiens
gcaagcugcacucggaugu

SEQ ID NO: 1514465 - RNA, 19 nt, Homo sapiens
gugccaagcugguguacac

SEQ ID NO: 1514466 - RNA, 19 nt, Homo sapiens
gcaagacaucaacgacaau

SEQ ID NO: 1514467 - RNA, 19 nt, Homo sapiens
gggcaggcaccguauuugu

SEQ ID NO: 1514468 - RNA, 19 nt, Homo sapiens
cagugaaggccuauaugaa

SEQ ID NO: 1514469 - RNA, 19 nt, Homo sapiens
acaggcaauauucauguua

SEQ ID NO: 1514470 - RNA, 19 nt, Homo sapiens
cacaggcaauauucauguu

SEQ ID NO: 1514471 - RNA, 19 nt, Homo sapiens
ccguauuugugauugauga

SEQ ID NO: 1514472 - RNA, 19 nt, Homo sapiens
gaaggagcugggucuggaa

SEQ ID NO: 1514473 - RNA, 19 nt, Homo sapiens
agaccucccucccgaucuu

SEQ ID NO: 1514474 - RNA, 19 nt, Homo sapiens
gggagacacaggaggaguu

SEQ ID NO: 1514475 - RNA, 19 nt, Homo sapiens
ugcccgagauguccaaugu

SEQ ID NO: 1514476 - RNA, 19 nt, Homo sapiens
ccaucagaguucaucauca

SEQ ID NO: 1514477 - RNA, 19 nt, Homo sapiens
aaccaguucuuugucauug

SEQ ID NO: 1514478 - RNA, 19 nt, Homo sapiens
ccggagcguugcuucucua

SEQ ID NO: 1514479 - RNA, 19 nt, Homo sapiens
cagcaucagcacagacuug

SEQ ID NO: 1514480 - RNA, 19 nt, Homo sapiens
agugaaggccuauaugaau

SEQ ID NO: 1514481 - RNA, 19 nt, Homo sapiens
caacccagaaauaaacuag

SEQ ID NO: 1514482 - RNA, 19 nt, Homo sapiens
caggcaauauucauguuac

SEQ ID NO: 1514483 - RNA, 19 nt, Homo sapiens
ucuuugucauugaggaaua

SEQ ID NO: 1514484 - RNA, 19 nt, Homo sapiens
ucucagccauguguauaau

SEQ ID NO: 1514485 - RNA, 19 nt, Homo sapiens
gcauucuccugacccucaa

SEQ ID NO: 1514486 - RNA, 19 nt, Homo sapiens
gcucugcugcggacucgaa

SEQ ID NO: 1514487 - RNA, 19 nt, Homo sapiens
guacacuguucuggaugga

SEQ ID NO: 1514488 - RNA, 19 nt, Homo sapiens
ucaaagugcaagacaucaa

SEQ ID NO: 1514489 - RNA, 19 nt, Homo sapiens
uguguuuacuguugagugu

SEQ ID NO: 1514490 - RNA, 19 nt, Homo sapiens
aaacuagaccuuacauagc

SEQ ID NO: 1514491 - RNA, 19 nt, Homo sapiens
gcagcacuacggugacugu

SEQ ID NO: 1514492 - RNA, 19 nt, Homo sapiens
ccaguucuuugucauugag

SEQ ID NO: 1514493 - RNA, 19 nt, Homo sapiens
ccagagccuguucucauug

SEQ ID NO: 1514494 - RNA, 19 nt, Homo sapiens
ugaaaacugcccuuguaua

SEQ ID NO: 1514495 - RNA, 19 nt, Homo sapiens
cucccgaucuucugugaau

SEQ ID NO: 1514496 - RNA, 19 nt, Homo sapiens
ggagcugggucuggaacca

SEQ ID NO: 1514497 - RNA, 19 nt, Homo sapiens
guccagagccuguucucau

SEQ ID NO: 1514498 - RNA, 19 nt, Homo sapiens
agacacaggaggaguucuu

SEQ ID NO: 1514499 - RNA, 19 nt, Homo sapiens
ggagacacaggaggaguuc

SEQ ID NO: 1514500 - RNA, 19 nt, Homo sapiens
guacagccauccccaacau

SEQ ID NO: 1514501 - RNA, 19 nt, Homo sapiens
ggauggacugccuuucuuc

SEQ ID NO: 1514502 - RNA, 19 nt, Homo sapiens
cagagccuguucucauugg

SEQ ID NO: 1514503 - RNA, 19 nt, Homo sapiens
aagcugguguacacuguuc

SEQ ID NO: 1514504 - RNA, 19 nt, Homo sapiens
uuaugcauaugugugauug

SEQ ID NO: 1514505 - RNA, 19 nt, Homo sapiens
ggcaggcaccguauuugug

SEQ ID NO: 1514506 - RNA, 19 nt, Homo sapiens
gauccaggccaaggacaug

SEQ ID NO: 1514507 - RNA, 19 nt, Homo sapiens
caaagugcaagacaucaac

SEQ ID NO: 1514508 - RNA, 19 nt, Homo sapiens
ugaaggccuauaugaaugu

SEQ ID NO: 1514509 - RNA, 19 nt, Homo sapiens
ugugaauagucccuuauac

SEQ ID NO: 1514510 - RNA, 19 nt, Homo sapiens
caagauugcuuauucgaua

SEQ ID NO: 1514511 - RNA, 19 nt, Homo sapiens
ccacaccucugaaauauuu

SEQ ID NO: 1514512 - RNA, 19 nt, Homo sapiens
cgaguuaccucuuuaauga

SEQ ID NO: 1514513 - RNA, 19 nt, Homo sapiens
caagaaaccucaugaagug

SEQ ID NO: 1514514 - RNA, 19 nt, Homo sapiens
gcaacaaagucgcacuaua

SEQ ID NO: 1514515 - RNA, 19 nt, Homo sapiens
gaagaagaauacuaagaga

SEQ ID NO: 1514516 - RNA, 19 nt, Homo sapiens
caaagagcauugaagaauu

SEQ ID NO: 1514517 - RNA, 19 nt, Homo sapiens
caacgaacaugucaaagga

SEQ ID NO: 1514518 - RNA, 19 nt, Homo sapiens
uaaagaagaucuagggaau

SEQ ID NO: 1514519 - RNA, 19 nt, Homo sapiens
aaaccaagauugcuuauuc

SEQ ID NO: 1514520 - RNA, 19 nt, Homo sapiens
gaaucgaguuaccucuuua

SEQ ID NO: 1514521 - RNA, 19 nt, Homo sapiens
ggaaagaauugcagacagu

SEQ ID NO: 1514522 - RNA, 19 nt, Homo sapiens
caacaaagucgcacuauag

SEQ ID NO: 1514523 - RNA, 19 nt, Homo sapiens
gauauauccugauuguuug

SEQ ID NO: 1514524 - RNA, 19 nt, Homo sapiens
cuaaagaaguaccauaaga

SEQ ID NO: 1514525 - RNA, 19 nt, Homo sapiens
ggucagaguccauugauuu

SEQ ID NO: 1514526 - RNA, 19 nt, Homo sapiens
aagaagaucuagggaauaa

SEQ ID NO: 1514527 - RNA, 19 nt, Homo sapiens
cuucauuucugcaaaguua

SEQ ID NO: 1514528 - RNA, 19 nt, Homo sapiens
gaacaacccaagagcauau

SEQ ID NO: 1514529 - RNA, 19 nt, Homo sapiens
uaucaagacuagcaacaaa

SEQ ID NO: 1514530 - RNA, 19 nt, Homo sapiens
ugaaagaacucuccacaac

SEQ ID NO: 1514531 - RNA, 19 nt, Homo sapiens
caacuaguaucgacuucaa

SEQ ID NO: 1514532 - RNA, 19 nt, Homo sapiens
ggugguuucuccauaaauu

SEQ ID NO: 1514533 - RNA, 19 nt, Homo sapiens
aaaccacaccucugaaaua

SEQ ID NO: 1514534 - RNA, 19 nt, Homo sapiens
gaaaccucaugaagugaaa

SEQ ID NO: 1514535 - RNA, 19 nt, Homo sapiens
cagaugaaauggagacaga

SEQ ID NO: 1514536 - RNA, 19 nt, Homo sapiens
caacagacaacuacaacuu

SEQ ID NO: 1514537 - RNA, 19 nt, Homo sapiens
gcacaagccauauaugcaa

SEQ ID NO: 1514538 - RNA, 19 nt, Homo sapiens
gguggugguuucuccauaa

SEQ ID NO: 1514539 - RNA, 19 nt, Homo sapiens
cagcugauuucucuucauu

SEQ ID NO: 1514540 - RNA, 19 nt, Homo sapiens
ggaagaagaauacuaagag

SEQ ID NO: 1514541 - RNA, 19 nt, Homo sapiens
agauaaugcuuucagauga

SEQ ID NO: 1514542 - RNA, 19 nt, Homo sapiens
ugagacaaguucuuauaga

SEQ ID NO: 1514543 - RNA, 19 nt, Homo sapiens
uaagagaaaccagaaauga

SEQ ID NO: 1514544 - RNA, 19 nt, Homo sapiens
aaagagcauugaagaauuc

SEQ ID NO: 1514545 - RNA, 19 nt, Homo sapiens
gcugauuucucuucauuuc

SEQ ID NO: 1514546 - RNA, 19 nt, Homo sapiens
gagagaauguguggcauca

SEQ ID NO: 1514547 - RNA, 19 nt, Homo sapiens
uuugagaaguuccuacaua

SEQ ID NO: 1514548 - RNA, 19 nt, Homo sapiens
ggaagcgguucucgaaaca

SEQ ID NO: 1514549 - RNA, 19 nt, Homo sapiens
caaagucgcacuauaguag

SEQ ID NO: 1514550 - RNA, 19 nt, Homo sapiens
gaagaucuagggaauaaca

SEQ ID NO: 1514551 - RNA, 19 nt, Homo sapiens
ugaggaagaagaauacuaa

SEQ ID NO: 1514552 - RNA, 19 nt, Homo sapiens
ucacaggauucaaagcaaa

SEQ ID NO: 1514553 - RNA, 19 nt, Homo sapiens
gaucuagggaauaacauuu

SEQ ID NO: 1514554 - RNA, 19 nt, Homo sapiens
ccaaagagcauugaagaau

SEQ ID NO: 1514555 - RNA, 19 nt, Homo sapiens
aaccagaaaugaacucuau

SEQ ID NO: 1514556 - RNA, 19 nt, Homo sapiens
uugagaaguuccuacauaa

SEQ ID NO: 1514557 - RNA, 19 nt, Homo sapiens
caaagcaaaugaacuuacu

SEQ ID NO: 1514558 - RNA, 19 nt, Homo sapiens
caacuacaacuuugaggaa

SEQ ID NO: 1514559 - RNA, 19 nt, Homo sapiens
gaaacaggacuuugagaag

SEQ ID NO: 1514560 - RNA, 19 nt, Homo sapiens
aaagacaauuugcaaggaa

SEQ ID NO: 1514561 - RNA, 19 nt, Homo sapiens
aagcgguucucgaaacaua

SEQ ID NO: 1514562 - RNA, 19 nt, Homo sapiens
agaaucgaguuaccucuuu

SEQ ID NO: 1514563 - RNA, 19 nt, Homo sapiens
ccaagaaaccucaugaagu

SEQ ID NO: 1514564 - RNA, 19 nt, Homo sapiens
aagcaaaggcuaccaagaa

SEQ ID NO: 1514565 - RNA, 19 nt, Homo sapiens
agacagagaagaauauaga

SEQ ID NO: 1514566 - RNA, 19 nt, Homo sapiens
ggagacagagaagaauaua

SEQ ID NO: 1514567 - RNA, 19 nt, Homo sapiens
ccuaagacccagcugauuu

SEQ ID NO: 1514568 - RNA, 19 nt, Homo sapiens
acagacaacuacaacuuug

SEQ ID NO: 1514569 - RNA, 19 nt, Homo sapiens
gagaauguguggcaucacu

SEQ ID NO: 1514570 - RNA, 19 nt, Homo sapiens
aagcugaaauugagagaga

SEQ ID NO: 1514571 - RNA, 19 nt, Homo sapiens
aaagaacucuccacaacca

SEQ ID NO: 1514572 - RNA, 19 nt, Homo sapiens
ggaacgauauggggaauuu

SEQ ID NO: 1514573 - RNA, 19 nt, Homo sapiens
gcagacagucaagaacaua

SEQ ID NO: 1514574 - RNA, 19 nt, Homo sapiens
caugaagcauuuccagaau

SEQ ID NO: 1514575 - RNA, 19 nt, Homo sapiens
caacuuugaggaagaagaa

SEQ ID NO: 1514576 - RNA, 19 nt, Homo sapiens
gggaagcgguucucgaaac

SEQ ID NO: 1514577 - RNA, 19 nt, Homo sapiens
ccucugaaauauuuaagug

SEQ ID NO: 1514578 - RNA, 19 nt, Homo sapiens
gaaaauguuccucgaauau

SEQ ID NO: 1514579 - RNA, 19 nt, Homo sapiens
gaagaauacuaagagaaac

SEQ ID NO: 1514580 - RNA, 19 nt, Homo sapiens
ugaaacaggacuuugagaa

SEQ ID NO: 1514581 - RNA, 19 nt, Homo sapiens
ugcaugagcuggcugguau

SEQ ID NO: 1514582 - RNA, 19 nt, Homo sapiens
gagaaguuccuacauaaac

SEQ ID NO: 1514583 - RNA, 19 nt, Homo sapiens
ccaugaagcauuuccagaa

SEQ ID NO: 1514584 - RNA, 19 nt, Homo sapiens
cuacaacuuugaggaagaa

SEQ ID NO: 1514585 - RNA, 19 nt, Homo sapiens
agcaaaggcuaccaagaaa

SEQ ID NO: 1514586 - RNA, 19 nt, Homo sapiens
ucaagauuaucaagacuag

SEQ ID NO: 1514587 - RNA, 19 nt, Homo sapiens
aaaagcaccugcaaaauca

SEQ ID NO: 1514588 - RNA, 19 nt, Homo sapiens
aaccacaccucugaaauau

SEQ ID NO: 1514589 - RNA, 19 nt, Homo sapiens
gcauaccucuaagucgaaa

SEQ ID NO: 1514590 - RNA, 19 nt, Homo sapiens
gguugcagcuucacaggau

SEQ ID NO: 1514591 - RNA, 19 nt, Homo sapiens
ucgaauauuugaagcacuu

SEQ ID NO: 1514592 - RNA, 19 nt, Homo sapiens
uagagaugaugauaaaugg

SEQ ID NO: 1514593 - RNA, 19 nt, Homo sapiens
caaguccaauccauguaau

SEQ ID NO: 1514594 - RNA, 19 nt, Homo sapiens
ucaaguccaauccauguaa

SEQ ID NO: 1514595 - RNA, 19 nt, Homo sapiens
caucaucaacagacaacua

SEQ ID NO: 1514596 - RNA, 19 nt, Homo sapiens
agacccagcugauuucucu

SEQ ID NO: 1514597 - RNA, 19 nt, Homo sapiens
gaaauggagacagagaaga

SEQ ID NO: 1514598 - RNA, 19 nt, Homo sapiens
ccagaaaugaacucuauuc

SEQ ID NO: 1514599 - RNA, 19 nt, Homo sapiens
gaauguguggcaucacuau

SEQ ID NO: 1514600 - RNA, 19 nt, Homo sapiens
gcuccaacauaccgugaug

SEQ ID NO: 1514601 - RNA, 19 nt, Homo sapiens
acauuuggaugcugaacaa

SEQ ID NO: 1514602 - RNA, 19 nt, Homo sapiens
uuacucagcuacccagaca

SEQ ID NO: 1514603 - RNA, 19 nt, Homo sapiens
acaauucagugguaucagu

SEQ ID NO: 1514604 - RNA, 19 nt, Homo sapiens
ggaggucagaguccauuga

SEQ ID NO: 1514605 - RNA, 19 nt, Homo sapiens
cagcuucacaggauucaaa

SEQ ID NO: 1514606 - RNA, 19 nt, Homo sapiens
ggccaacgaacaugucaaa

SEQ ID NO: 1514607 - RNA, 19 nt, Homo sapiens
caauccauguaaucaguau

SEQ ID NO: 1514608 - RNA, 19 nt, Homo sapiens
ugcauacaauucaguggua

SEQ ID NO: 1514609 - RNA, 19 nt, Homo sapiens
caacguuccaugaagcauu

SEQ ID NO: 1514610 - RNA, 19 nt, Homo sapiens
gaaagaagauuccauuaug

SEQ ID NO: 1514611 - RNA, 19 nt, Homo sapiens
aaacaaagaugaagcauug

SEQ ID NO: 1514612 - RNA, 19 nt, Homo sapiens
caacaacacugcauuauag

SEQ ID NO: 1514613 - RNA, 19 nt, Homo sapiens
gaaauggacugucucuuau

SEQ ID NO: 1514614 - RNA, 19 nt, Homo sapiens
ggaaaugguuauucucuuu

SEQ ID NO: 1514615 - RNA, 19 nt, Homo sapiens
ccagaaaucuacugccuua

SEQ ID NO: 1514616 - RNA, 19 nt, Homo sapiens
gaauugaucuucagcaguu

SEQ ID NO: 1514617 - RNA, 19 nt, Homo sapiens
gaaucaagcuucucauuuc

SEQ ID NO: 1514618 - RNA, 19 nt, Homo sapiens
gauuauggcucaucagaaa

SEQ ID NO: 1514619 - RNA, 19 nt, Homo sapiens
ggaggaaaguguacaaaug

SEQ ID NO: 1514620 - RNA, 19 nt, Homo sapiens
ugauagagcuuccugauga

SEQ ID NO: 1514621 - RNA, 19 nt, Homo sapiens
gaauaucuuugcccucuuu

SEQ ID NO: 1514622 - RNA, 19 nt, Homo sapiens
gaaacuggcuuagagaaug

SEQ ID NO: 1514623 - RNA, 19 nt, Homo sapiens
ugacagaaguaucucuaua

SEQ ID NO: 1514624 - RNA, 19 nt, Homo sapiens
gcaaaucucugugcaauac

SEQ ID NO: 1514625 - RNA, 19 nt, Homo sapiens
gcaacaacacugcauuaua

SEQ ID NO: 1514626 - RNA, 19 nt, Homo sapiens
guaagauccuucaugaauu

SEQ ID NO: 1514627 - RNA, 19 nt, Homo sapiens
gaagcacaguggagcauuu

SEQ ID NO: 1514628 - RNA, 19 nt, Homo sapiens
agacacagauucuaacuug

SEQ ID NO: 1514629 - RNA, 19 nt, Homo sapiens
gcaguaauaugugaccuaa

SEQ ID NO: 1514630 - RNA, 19 nt, Homo sapiens
gagaagauccagauauuug

SEQ ID NO: 1514631 - RNA, 19 nt, Homo sapiens
gugaagcgauuaagagaaa

SEQ ID NO: 1514632 - RNA, 19 nt, Homo sapiens
ucauaaggcuucaagauug

SEQ ID NO: 1514633 - RNA, 19 nt, Homo sapiens
cagaugcaauugaagaaua

SEQ ID NO: 1514634 - RNA, 19 nt, Homo sapiens
guauuacacucagagauua

SEQ ID NO: 1514635 - RNA, 19 nt, Homo sapiens
agaaauggacugucucuua

SEQ ID NO: 1514636 - RNA, 19 nt, Homo sapiens
caacauguguacucuguau

SEQ ID NO: 1514637 - RNA, 19 nt, Homo sapiens
ucaguuaguucuuccuaua

SEQ ID NO: 1514638 - RNA, 19 nt, Homo sapiens
uaagauccuucaugaauug

SEQ ID NO: 1514639 - RNA, 19 nt, Homo sapiens
caaauagcaucaaggaaau

SEQ ID NO: 1514640 - RNA, 19 nt, Homo sapiens
ucaaauagcaucaaggaaa

SEQ ID NO: 1514641 - RNA, 19 nt, Homo sapiens
cggaaucuauuaagaauga

SEQ ID NO: 1514642 - RNA, 19 nt, Homo sapiens
uagcaaggcugaacauaug

SEQ ID NO: 1514643 - RNA, 19 nt, Homo sapiens
uaaacaaaguggccacauu

SEQ ID NO: 1514644 - RNA, 19 nt, Homo sapiens
ccaaauggcuuuucauauu

SEQ ID NO: 1514645 - RNA, 19 nt, Homo sapiens
ggaugaauauggagaaaca

SEQ ID NO: 1514646 - RNA, 19 nt, Homo sapiens
uauaagacaugcuaaagga

SEQ ID NO: 1514647 - RNA, 19 nt, Homo sapiens
gaagaagaaguaacauuug

SEQ ID NO: 1514648 - RNA, 19 nt, Homo sapiens
gcugagauguggcgaagaa

SEQ ID NO: 1514649 - RNA, 19 nt, Homo sapiens
ggaagaguauaugcaguaa

SEQ ID NO: 1514650 - RNA, 19 nt, Homo sapiens
ggacaaauugggaagagua

SEQ ID NO: 1514651 - RNA, 19 nt, Homo sapiens
ggaaaucagcgcggaguua

SEQ ID NO: 1514652 - RNA, 19 nt, Homo sapiens
auaaacaacugcagaaaga

SEQ ID NO: 1514653 - RNA, 19 nt, Homo sapiens
ggaagagcagguacuauaa

SEQ ID NO: 1514654 - RNA, 19 nt, Homo sapiens
ggaauauccuuuacguugu

SEQ ID NO: 1514655 - RNA, 19 nt, Homo sapiens
guucagauguuuacuguuc

SEQ ID NO: 1514656 - RNA, 19 nt, Homo sapiens
agaaguaucucuauaacug

SEQ ID NO: 1514657 - RNA, 19 nt, Homo sapiens
ggaagcaaaggaagauaua

SEQ ID NO: 1514658 - RNA, 19 nt, Homo sapiens
guacuuauuuggagaagau

SEQ ID NO: 1514659 - RNA, 19 nt, Homo sapiens
gaaauuugcuuugcgucuu

SEQ ID NO: 1514660 - RNA, 19 nt, Homo sapiens
gaaaugugaccaaagaaga

SEQ ID NO: 1514661 - RNA, 19 nt, Homo sapiens
aauggacugucucuuauua

SEQ ID NO: 1514662 - RNA, 19 nt, Homo sapiens
gaagagcagguacuauaaa

SEQ ID NO: 1514663 - RNA, 19 nt, Homo sapiens
ccagauauuugcuuagaga

SEQ ID NO: 1514664 - RNA, 19 nt, Homo sapiens
gaucauggcucagaugucu

SEQ ID NO: 1514665 - RNA, 19 nt, Homo sapiens
gcaaagugauuaaccuucu

SEQ ID NO: 1514666 - RNA, 19 nt, Homo sapiens
gcagagaagaaauguauga

SEQ ID NO: 1514667 - RNA, 19 nt, Homo sapiens
ccacugccauugacaaaga

SEQ ID NO: 1514668 - RNA, 19 nt, Homo sapiens
cuauagaucuguuucaugu

SEQ ID NO: 1514669 - RNA, 19 nt, Homo sapiens
gaaagugccaccugaugaa

SEQ ID NO: 1514670 - RNA, 19 nt, Homo sapiens
caaaggaauuccccaguua

SEQ ID NO: 1514671 - RNA, 19 nt, Homo sapiens
ggcauuggguuuacuagaa

SEQ ID NO: 1514672 - RNA, 19 nt, Homo sapiens
guacaaucguguggacaua

SEQ ID NO: 1514673 - RNA, 19 nt, Homo sapiens
ggacaggaacaauaaauuc

SEQ ID NO: 1514674 - RNA, 19 nt, Homo sapiens
gacagaaguaucucuauaa

SEQ ID NO: 1514675 - RNA, 19 nt, Homo sapiens
gccagaauaucagguuaua

SEQ ID NO: 1514676 - RNA, 19 nt, Homo sapiens
uaagaaaccagguguauca

SEQ ID NO: 1514677 - RNA, 19 nt, Homo sapiens
aaacaaaguggccacauuu

SEQ ID NO: 1514678 - RNA, 19 nt, Homo sapiens
ugagagaaaucauucacuu

SEQ ID NO: 1514679 - RNA, 19 nt, Homo sapiens
acagaaagauuaagaaugc

SEQ ID NO: 1514680 - RNA, 19 nt, Homo sapiens
gaucagcaaacccacaaua

SEQ ID NO: 1514681 - RNA, 19 nt, Homo sapiens
gcagaaagaauauaucagu

SEQ ID NO: 1514682 - RNA, 19 nt, Homo sapiens
ccaagagacuaaucagaug

SEQ ID NO: 1514683 - RNA, 19 nt, Homo sapiens
gcuauacuauguucucaga

SEQ ID NO: 1514684 - RNA, 19 nt, Homo sapiens
ggcguugagucuucgauua

SEQ ID NO: 1514685 - RNA, 19 nt, Homo sapiens
gaucggaaucuauuaagaa

SEQ ID NO: 1514686 - RNA, 19 nt, Homo sapiens
caaagaagaggucacaaug

SEQ ID NO: 1514687 - RNA, 19 nt, Homo sapiens
gcgaagaaauggacugucu

SEQ ID NO: 1514688 - RNA, 19 nt, Homo sapiens
caccaugccuucugucuau

SEQ ID NO: 1514689 - RNA, 19 nt, Homo sapiens
gcaguugcacagaggauua

SEQ ID NO: 1514690 - RNA, 19 nt, Homo sapiens
agaaaugccugggaaagaa

SEQ ID NO: 1514691 - RNA, 19 nt, Homo sapiens
gcaaaggaagauauaaaga

SEQ ID NO: 1514692 - RNA, 19 nt, Homo sapiens
gcagaggcccaguugcaua

SEQ ID NO: 1514693 - RNA, 19 nt, Homo sapiens
gaacauuugcugccaggaa

SEQ ID NO: 1514694 - RNA, 19 nt, Homo sapiens
caacugugauaucaugaug

SEQ ID NO: 1514695 - RNA, 19 nt, Homo sapiens
gaaaucauucacuugcuuu

SEQ ID NO: 1514696 - RNA, 19 nt, Homo sapiens
gcaagacaguaguacaauc

SEQ ID NO: 1514697 - RNA, 19 nt, Homo sapiens
uaaagaaugucacaaagcu

SEQ ID NO: 1514698 - RNA, 19 nt, Homo sapiens
ggacagaaagauuaagaau

SEQ ID NO: 1514699 - RNA, 19 nt, Homo sapiens
gggaagaguauaugcagua

SEQ ID NO: 1514700 - RNA, 19 nt, Homo sapiens
guuacaagaugcauacuuc

SEQ ID NO: 1514701 - RNA, 19 nt, Homo sapiens
ccaggacaguguucauaaa

SEQ ID NO: 1514702 - RNA, 19 nt, Homo sapiens
gugcugacgugcauccuuu

SEQ ID NO: 1514703 - RNA, 19 nt, Homo sapiens
ggaucggaaucuauuaaga

SEQ ID NO: 1514704 - RNA, 19 nt, Homo sapiens
gaagggaugcuccaaaugg

SEQ ID NO: 1514705 - RNA, 19 nt, Homo sapiens
uaaugaaacuggcuuagag

SEQ ID NO: 1514706 - RNA, 19 nt, Homo sapiens
uaauggaucccaauaaguu

SEQ ID NO: 1514707 - RNA, 19 nt, Homo sapiens
gauguuaagugcagagaag

SEQ ID NO: 1514708 - RNA, 19 nt, Homo sapiens
ggaaacaaaguccuacaga

SEQ ID NO: 1514709 - RNA, 19 nt, Homo sapiens
gaaccugacucggagaauc

SEQ ID NO: 1514710 - RNA, 19 nt, Homo sapiens
gaugaaaccuuaucucuac

SEQ ID NO: 1514711 - RNA, 19 nt, Homo sapiens
cgauguagcugauucugua

SEQ ID NO: 1514712 - RNA, 19 nt, Homo sapiens
ggaccugcauguuaacaaa

SEQ ID NO: 1514713 - RNA, 19 nt, Homo sapiens
caaaguaucucuccaugag

SEQ ID NO: 1514714 - RNA, 19 nt, Homo sapiens
gaaaccuuaucucuacuaa

SEQ ID NO: 1514715 - RNA, 19 nt, Homo sapiens
ccaacaugaugaaaccuua

SEQ ID NO: 1514716 - RNA, 19 nt, Homo sapiens
ugagaaugcuuaauccaaa

SEQ ID NO: 1514717 - RNA, 19 nt, Homo sapiens
ucccagagcuuguggcuuu

SEQ ID NO: 1514718 - RNA, 19 nt, Homo sapiens
ggaaguauuuguggaagga

SEQ ID NO: 1514719 - RNA, 19 nt, Homo sapiens
gcucauguuuguaauccua

SEQ ID NO: 1514720 - RNA, 19 nt, Homo sapiens
gcaaaagugugaugaagaa

SEQ ID NO: 1514721 - RNA, 19 nt, Homo sapiens
cagcaggguuaccuccuua

SEQ ID NO: 1514722 - RNA, 19 nt, Homo sapiens
gaagaaauggagaucauca

SEQ ID NO: 1514723 - RNA, 19 nt, Homo sapiens
gagcgaaacucugucucaa

SEQ ID NO: 1514724 - RNA, 19 nt, Homo sapiens
ggugaagccuggcagaugu

SEQ ID NO: 1514725 - RNA, 19 nt, Homo sapiens
uaaaggcugagaaugcuua

SEQ ID NO: 1514726 - RNA, 19 nt, Homo sapiens
uccaugagauacuuacuaa

SEQ ID NO: 1514727 - RNA, 19 nt, Homo sapiens
gcgaaacucugucucaaaa

SEQ ID NO: 1514728 - RNA, 19 nt, Homo sapiens
gaagaacggcgauuugcau

SEQ ID NO: 1514729 - RNA, 19 nt, Homo sapiens
gaccagcccuucacuacuc

SEQ ID NO: 1514730 - RNA, 19 nt, Homo sapiens
gcagcaggguuaccuccuu

SEQ ID NO: 1514731 - RNA, 19 nt, Homo sapiens
ggugaugggugccuguaau

SEQ ID NO: 1514732 - RNA, 19 nt, Homo sapiens
gaugaagaacggcgauuug

SEQ ID NO: 1514733 - RNA, 19 nt, Homo sapiens
caaggaaccacgugggaaa

SEQ ID NO: 1514734 - RNA, 19 nt, Homo sapiens
gcaggagaaucacuugaac

SEQ ID NO: 1514735 - RNA, 19 nt, Homo sapiens
aaacaguccauuugguuaa

SEQ ID NO: 1514736 - RNA, 19 nt, Homo sapiens
gcccuucacuacucaaagu

SEQ ID NO: 1514737 - RNA, 19 nt, Homo sapiens
uugcaucguuucaaaguau

SEQ ID NO: 1514738 - RNA, 19 nt, Homo sapiens
ugaugaaaccuuaucucua

SEQ ID NO: 1514739 - RNA, 19 nt, Homo sapiens
ugauccauguccacaguaa

SEQ ID NO: 1514740 - RNA, 19 nt, Homo sapiens
ggacuggcagagacugaaa

SEQ ID NO: 1514741 - RNA, 19 nt, Homo sapiens
uaacaaaccccacaucugu

SEQ ID NO: 1514742 - RNA, 19 nt, Homo sapiens
ggaaggaagaaauggagau

SEQ ID NO: 1514743 - RNA, 19 nt, Homo sapiens
ccuaggacccagaauaaug

SEQ ID NO: 1514744 - RNA, 19 nt, Homo sapiens
gagaaugcuuaauccaaaa

SEQ ID NO: 1514745 - RNA, 19 nt, Homo sapiens
ugagguggguggaucaucu

SEQ ID NO: 1514746 - RNA, 19 nt, Homo sapiens
aaagugggccucugcacaa

SEQ ID NO: 1514747 - RNA, 19 nt, Homo sapiens
gaaggaagaaauggagauc

SEQ ID NO: 1514748 - RNA, 19 nt, Homo sapiens
ggcaggagaaucacuugaa

SEQ ID NO: 1514749 - RNA, 19 nt, Homo sapiens
ccagagggacccaggcuau

SEQ ID NO: 1514750 - RNA, 19 nt, Homo sapiens
caacaugaugaaaccuuau

SEQ ID NO: 1514751 - RNA, 19 nt, Homo sapiens
aggaagaaauggagaucau

SEQ ID NO: 1514752 - RNA, 19 nt, Homo sapiens
aguaggcacggaaguauuu

SEQ ID NO: 1514753 - RNA, 19 nt, Homo sapiens
ucccuaggacccagaauaa

SEQ ID NO: 1514754 - RNA, 19 nt, Homo sapiens
ucaaaguaucucuccauga

SEQ ID NO: 1514755 - RNA, 19 nt, Homo sapiens
gcacacgcaccuuguucug

SEQ ID NO: 1514756 - RNA, 19 nt, Homo sapiens
cacgguaggcgcaugguuu

SEQ ID NO: 1514757 - RNA, 19 nt, Homo sapiens
ugaaaccuuaucucuacua

SEQ ID NO: 1514758 - RNA, 19 nt, Homo sapiens
uguccucgcugcguccuaa

SEQ ID NO: 1514759 - RNA, 19 nt, Homo sapiens
agaaauggagaucaucaug

SEQ ID NO: 1514760 - RNA, 19 nt, Homo sapiens
gaugccauuugucugaaca

SEQ ID NO: 1514761 - RNA, 19 nt, Homo sapiens
aauaaugccugcgcacagu

SEQ ID NO: 1514762 - RNA, 19 nt, Homo sapiens
gucugaacaucacaaggaa

SEQ ID NO: 1514763 - RNA, 19 nt, Homo sapiens
ugucugaacaucacaagga

SEQ ID NO: 1514764 - RNA, 19 nt, Homo sapiens
gagcaaaagugugaugaag

SEQ ID NO: 1514765 - RNA, 19 nt, Homo sapiens
ggaagaaauggagaucauc

SEQ ID NO: 1514766 - RNA, 19 nt, Homo sapiens
gcugcguccuaaccaaaug

SEQ ID NO: 1514767 - RNA, 19 nt, Homo sapiens
gcuugucgauguagcugau

SEQ ID NO: 1514768 - RNA, 19 nt, Homo sapiens
gaugucacuuacacugagu

SEQ ID NO: 1514769 - RNA, 19 nt, Homo sapiens
ggacaauggccaggugaag

SEQ ID NO: 1514770 - RNA, 19 nt, Homo sapiens
cacaguaggcacggaagua

SEQ ID NO: 1514771 - RNA, 19 nt, Homo sapiens
caguaaaggcugagaaugc

SEQ ID NO: 1514772 - RNA, 19 nt, Homo sapiens
uacaccagcagcaggguua

SEQ ID NO: 1514773 - RNA, 19 nt, Homo sapiens
cagaugucacuuacacuga

SEQ ID NO: 1514774 - RNA, 19 nt, Homo sapiens
ccacaguaaaggcugagaa

SEQ ID NO: 1514775 - RNA, 19 nt, Homo sapiens
gugugugcuugucgaugua

SEQ ID NO: 1514776 - RNA, 19 nt, Homo sapiens
uggcagaugucacuuacac

SEQ ID NO: 1514777 - RNA, 19 nt, Homo sapiens
gcacaguaggcacggaagu

SEQ ID NO: 1514778 - RNA, 19 nt, Homo sapiens
aacaguccauuugguuaaa

SEQ ID NO: 1514779 - RNA, 19 nt, Homo sapiens
ugaugaagaacggcgauuu

SEQ ID NO: 1514780 - RNA, 19 nt, Homo sapiens
gauccauguccacaguaaa

SEQ ID NO: 1514781 - RNA, 19 nt, Homo sapiens
uuuguaauccuagcacuuu

SEQ ID NO: 1514782 - RNA, 19 nt, Homo sapiens
agugugugcuugucgaugu

SEQ ID NO: 1514783 - RNA, 19 nt, Homo sapiens
cagccuggccaacaugaug

SEQ ID NO: 1514784 - RNA, 19 nt, Homo sapiens
gguuuccugucuccaaagu

SEQ ID NO: 1514785 - RNA, 19 nt, Homo sapiens
ccauuugucugaacaucac

SEQ ID NO: 1514786 - RNA, 19 nt, Homo sapiens
cagccuggccaacaugaug

SEQ ID NO: 1514787 - RNA, 19 nt, Homo sapiens
cuucuccgcugcccuugug

SEQ ID NO: 1514788 - RNA, 19 nt, Homo sapiens
ggaccagcccuucacuacu

SEQ ID NO: 1514789 - RNA, 19 nt, Homo sapiens
agccaugccucugccauug

SEQ ID NO: 1514790 - RNA, 19 nt, Homo sapiens
ucacuugaacccagaaggu

SEQ ID NO: 1514791 - RNA, 19 nt, Homo sapiens
gaacacuccuuuccuggua

SEQ ID NO: 1514792 - RNA, 19 nt, Homo sapiens
gaacggagccucugacuuc

SEQ ID NO: 1514793 - RNA, 19 nt, Homo sapiens
gcauugaguuccuggauga

SEQ ID NO: 1514794 - RNA, 19 nt, Homo sapiens
ggacagcggccucugguuu

SEQ ID NO: 1514795 - RNA, 19 nt, Homo sapiens
gagcucccgugacaugaua

SEQ ID NO: 1514796 - RNA, 19 nt, Homo sapiens
caugauaggucuucuccuu

SEQ ID NO: 1514797 - RNA, 19 nt, Homo sapiens
ggucaaggcuuuugcagaa

SEQ ID NO: 1514798 - RNA, 19 nt, Homo sapiens
gagcauggcaucggaaaug

SEQ ID NO: 1514799 - RNA, 19 nt, Homo sapiens
ggacucacaggaagcauug

SEQ ID NO: 1514800 - RNA, 19 nt, Homo sapiens
ccucaugaauccaggcaaa

SEQ ID NO: 1514801 - RNA, 19 nt, Homo sapiens
ggacagcacggcacaaugc

SEQ ID NO: 1514802 - RNA, 19 nt, Homo sapiens
gagagcgucuggguccauu

SEQ ID NO: 1514803 - RNA, 19 nt, Homo sapiens
ugacgcauauggaccgaau

SEQ ID NO: 1514804 - RNA, 19 nt, Homo sapiens
gaccaaggaggaucugaau

SEQ ID NO: 1514805 - RNA, 19 nt, Homo sapiens
gaaccaggaggacuucucu

SEQ ID NO: 1514806 - RNA, 19 nt, Homo sapiens
ccagagggcccagagagaa

SEQ ID NO: 1514807 - RNA, 19 nt, Homo sapiens
cgucaaaggccgugcuaga

SEQ ID NO: 1514808 - RNA, 19 nt, Homo sapiens
ccaaggaggaucugaaugc

SEQ ID NO: 1514809 - RNA, 19 nt, Homo sapiens
cagggugguucccagcaaa

SEQ ID NO: 1514810 - RNA, 19 nt, Homo sapiens
gaccaugcggcacgucaaa

SEQ ID NO: 1514811 - RNA, 19 nt, Homo sapiens
gcagcgcacagaggagaua

SEQ ID NO: 1514812 - RNA, 19 nt, Homo sapiens
gcuugaggguggcgucugu

SEQ ID NO: 1514813 - RNA, 19 nt, Homo sapiens
aacgugagcucccgugaca

SEQ ID NO: 1514814 - RNA, 19 nt, Homo sapiens
gugcgaaccuccugaugcu

SEQ ID NO: 1514815 - RNA, 19 nt, Homo sapiens
gcucugcagggacuucgua

SEQ ID NO: 1514816 - RNA, 19 nt, Homo sapiens
ccagggugguucccagcaa

SEQ ID NO: 1514817 - RNA, 19 nt, Homo sapiens
cccacaaguucccugacua

SEQ ID NO: 1514818 - RNA, 19 nt, Homo sapiens
gaagcauugucgggcaugu

SEQ ID NO: 1514819 - RNA, 19 nt, Homo sapiens
ggagauaguccagcagaac

SEQ ID NO: 1514820 - RNA, 19 nt, Homo sapiens
gccaaggugugcccaucau

SEQ ID NO: 1514821 - RNA, 19 nt, Homo sapiens
cgacugcucaggucugcaa

SEQ ID NO: 1514822 - RNA, 19 nt, Homo sapiens
gagcgucuggguccauuca

SEQ ID NO: 1514823 - RNA, 19 nt, Homo sapiens
ccagcgagcccacuguauc

SEQ ID NO: 1514824 - RNA, 19 nt, Homo sapiens
gcccacaaguucccugacu

SEQ ID NO: 1514825 - RNA, 19 nt, Homo sapiens
gacagcggccucugguuuc

SEQ ID NO: 1514826 - RNA, 19 nt, Homo sapiens
cccaggagccuuugguuca

SEQ ID NO: 1514827 - RNA, 19 nt, Homo sapiens
caggcaaagugcugugaag

SEQ ID NO: 1514828 - RNA, 19 nt, Homo sapiens
ccacaaguucccugacuac

SEQ ID NO: 1514829 - RNA, 19 nt, Homo sapiens
ugggcagggucaaggcuuu

SEQ ID NO: 1514830 - RNA, 19 nt, Homo sapiens
gaaugccucaggacucaca

SEQ ID NO: 1514831 - RNA, 19 nt, Homo sapiens
cccaaggccucaugaaucc

SEQ ID NO: 1514832 - RNA, 19 nt, Homo sapiens
cgugagcucccgugacaug

SEQ ID NO: 1514833 - RNA, 19 nt, Homo sapiens
ccauucaagacucugauga

SEQ ID NO: 1514834 - RNA, 19 nt, Homo sapiens
gggagcauggcaucggaaa

SEQ ID NO: 1514835 - RNA, 19 nt, Homo sapiens
gggacaacgugcucaaccu

SEQ ID NO: 1514836 - RNA, 19 nt, Homo sapiens
gcaaggcgaugcagaugua

SEQ ID NO: 1514837 - RNA, 19 nt, Homo sapiens
gcuuagaguuguagacuua

SEQ ID NO: 1514838 - RNA, 19 nt, Homo sapiens
gcacaugggucgagacuuc

SEQ ID NO: 1514839 - RNA, 19 nt, Homo sapiens
ugagaugacugugaagaua

SEQ ID NO: 1514840 - RNA, 19 nt, Homo sapiens
ggagggagcuucgcgauca

SEQ ID NO: 1514841 - RNA, 19 nt, Homo sapiens
gaaggucccaagcuuagua

SEQ ID NO: 1514842 - RNA, 19 nt, Homo sapiens
ccgagggccuugggaauua

SEQ ID NO: 1514843 - RNA, 19 nt, Homo sapiens
gccagugccugaccucgua

SEQ ID NO: 1514844 - RNA, 19 nt, Homo sapiens
gcacugaggcagagauuca

SEQ ID NO: 1514845 - RNA, 19 nt, Homo sapiens
ccacguggccuuuacaaau

SEQ ID NO: 1514846 - RNA, 19 nt, Homo sapiens
ggaguugauuggacaguca

SEQ ID NO: 1514847 - RNA, 19 nt, Homo sapiens
cgaaucugcucccaaagga

SEQ ID NO: 1514848 - RNA, 19 nt, Homo sapiens
gcagugacccagugauuca

SEQ ID NO: 1514849 - RNA, 19 nt, Homo sapiens
gaugucagcccagcacuuu

SEQ ID NO: 1514850 - RNA, 19 nt, Homo sapiens
gguggaggcuuucucuauc

SEQ ID NO: 1514851 - RNA, 19 nt, Homo sapiens
gagcugguaugcccgacuu

SEQ ID NO: 1514852 - RNA, 19 nt, Homo sapiens
cugcgaaucugcucccaaa

SEQ ID NO: 1514853 - RNA, 19 nt, Homo sapiens
gagaaaaccuggagcuaca

SEQ ID NO: 1514854 - RNA, 19 nt, Homo sapiens
aaucauggcgucuaccuaa

SEQ ID NO: 1514855 - RNA, 19 nt, Homo sapiens
acacucaacccucauguga

SEQ ID NO: 1514856 - RNA, 19 nt, Homo sapiens
ggacaggggccuagaugua

SEQ ID NO: 1514857 - RNA, 19 nt, Homo sapiens
ucucaggacuggcauucuu

SEQ ID NO: 1514858 - RNA, 19 nt, Homo sapiens
gaagcugaccagagcaaga

SEQ ID NO: 1514859 - RNA, 19 nt, Homo sapiens
gcauccaccugguugaagu

SEQ ID NO: 1514860 - RNA, 19 nt, Homo sapiens
aggaugagaugacugugaa

SEQ ID NO: 1514861 - RNA, 19 nt, Homo sapiens
gaagguggagguagaagag

SEQ ID NO: 1514862 - RNA, 19 nt, Homo sapiens
gcccuggagugaauucuuc

SEQ ID NO: 1514863 - RNA, 19 nt, Homo sapiens
augcagauguagcggguua

SEQ ID NO: 1514864 - RNA, 19 nt, Homo sapiens
cuacggagcgugccaagug

SEQ ID NO: 1514865 - RNA, 19 nt, Homo sapiens
gagagggacaaguggcuaa

SEQ ID NO: 1514866 - RNA, 19 nt, Homo sapiens
gcaaggccaacccugaaga

SEQ ID NO: 1514867 - RNA, 19 nt, Homo sapiens
cacguggccuuuacaaauc

SEQ ID NO: 1514868 - RNA, 19 nt, Homo sapiens
uaggaaggucccaagcuua

SEQ ID NO: 1514869 - RNA, 19 nt, Homo sapiens
gaggcuuucucuaucuguu

SEQ ID NO: 1514870 - RNA, 19 nt, Homo sapiens
gagauucagcgguguguca

SEQ ID NO: 1514871 - RNA, 19 nt, Homo sapiens
auaggaaggucccaagcuu

SEQ ID NO: 1514872 - RNA, 19 nt, Homo sapiens
ccacaagggcccuggaaag

SEQ ID NO: 1514873 - RNA, 19 nt, Homo sapiens
gagaugacugugaagauag

SEQ ID NO: 1514874 - RNA, 19 nt, Homo sapiens
uggcugaccugcgggacua

SEQ ID NO: 1514875 - RNA, 19 nt, Homo sapiens
gaugagaugacugugaaga

SEQ ID NO: 1514876 - RNA, 19 nt, Homo sapiens
gaaucauggcgucuaccua

SEQ ID NO: 1514877 - RNA, 19 nt, Homo sapiens
ccuauggcuuagaguugua

SEQ ID NO: 1514878 - RNA, 19 nt, Homo sapiens
gcugguggcugcugaacac

SEQ ID NO: 1514879 - RNA, 19 nt, Homo sapiens
uagcagugacccagugauu

SEQ ID NO: 1514880 - RNA, 19 nt, Homo sapiens
aggcauucccuauggcuua

SEQ ID NO: 1514881 - RNA, 19 nt, Homo sapiens
ccaaggagccacagcaaaa

SEQ ID NO: 1514882 - RNA, 19 nt, Homo sapiens
gcacggaagcccugaucca

SEQ ID NO: 1514883 - RNA, 19 nt, Homo sapiens
caagaggacagguguucga

SEQ ID NO: 1514884 - RNA, 19 nt, Homo sapiens
gaaccuccaccuccuacuc

SEQ ID NO: 1514885 - RNA, 19 nt, Homo sapiens
ggcuuucucuaucuguuga

SEQ ID NO: 1514886 - RNA, 19 nt, Homo sapiens
caacgugcccuggagugaa

SEQ ID NO: 1514887 - RNA, 19 nt, Homo sapiens
ggagcugcgugaccuuguc

SEQ ID NO: 1514888 - RNA, 19 nt, Homo sapiens
ucccaggccuuaacuagca

SEQ ID NO: 1514889 - RNA, 19 nt, Homo sapiens
caugugagcgugggaguga

SEQ ID NO: 1514890 - RNA, 19 nt, Homo sapiens
uagcaaggccaacccugaa

SEQ ID NO: 1514891 - RNA, 19 nt, Homo sapiens
gaccaaggagccacagcaa

SEQ ID NO: 1514892 - RNA, 19 nt, Homo sapiens
ucaaugaccaccugcucuu

SEQ ID NO: 1514893 - RNA, 19 nt, Homo sapiens
cacugaagguggagguaga

SEQ ID NO: 1514894 - RNA, 19 nt, Homo sapiens
ggccuacgcucagaaucau

SEQ ID NO: 1514895 - RNA, 19 nt, Homo sapiens
ggucgagacuuccccuuug

SEQ ID NO: 1514896 - RNA, 19 nt, Homo sapiens
gauccucauucugcacaug

SEQ ID NO: 1514897 - RNA, 19 nt, Homo sapiens
ggcagaagcgggagcagau

SEQ ID NO: 1514898 - RNA, 19 nt, Homo sapiens
gccuagauguagccucugu

SEQ ID NO: 1514899 - RNA, 19 nt, Homo sapiens
ccacccaccucugcgaauc

SEQ ID NO: 1514900 - RNA, 19 nt, Homo sapiens
guggaggcuuucucuaucu

SEQ ID NO: 1514901 - RNA, 19 nt, Homo sapiens
gaaugcccacagccuggua

SEQ ID NO: 1514902 - RNA, 19 nt, Homo sapiens
ucagaaucauggcgucuac

SEQ ID NO: 1514903 - RNA, 19 nt, Homo sapiens
ccaggucuuucagagagaa

SEQ ID NO: 1514904 - RNA, 19 nt, Homo sapiens
gcgaaucugcucccaaagg

SEQ ID NO: 1514905 - RNA, 19 nt, Homo sapiens
ucagagagaacuggaagug

SEQ ID NO: 1514906 - RNA, 19 nt, Homo sapiens
caggaugagaugacuguga

SEQ ID NO: 1514907 - RNA, 19 nt, Homo sapiens
cuguugcccuuucccauga

SEQ ID NO: 1514908 - RNA, 19 nt, Homo sapiens
gaaucugcucccaaaggaa

SEQ ID NO: 1514909 - RNA, 19 nt, Homo sapiens
ccgccaggcugugauguca

SEQ ID NO: 1514910 - RNA, 19 nt, Homo sapiens
uacggagcgugccaaguga

SEQ ID NO: 1514911 - RNA, 19 nt, Homo sapiens
cacggugccugagggcuuu

SEQ ID NO: 1514912 - RNA, 19 nt, Homo sapiens
gaccgagggccuugggaau

SEQ ID NO: 1514913 - RNA, 19 nt, Homo sapiens
ggcuuagaguuguagacuu

SEQ ID NO: 1514914 - RNA, 19 nt, Homo sapiens
gggcaaggcgaugcagaug

SEQ ID NO: 1514915 - RNA, 19 nt, Homo sapiens
gggcacugaggcagagauu

SEQ ID NO: 1514916 - RNA, 19 nt, Homo sapiens
uggaagccuuggucugcaa

SEQ ID NO: 1514917 - RNA, 19 nt, Homo sapiens
caucccaggccuuaacuag

SEQ ID NO: 1514918 - RNA, 19 nt, Homo sapiens
aaaccuggagcuacagugu

SEQ ID NO: 1514919 - RNA, 19 nt, Homo sapiens
cgguggaggcuuucucuau

SEQ ID NO: 1514920 - RNA, 19 nt, Homo sapiens
gugcugaggagcugguaug

SEQ ID NO: 1514921 - RNA, 19 nt, Homo sapiens
agaugacugugaagauagu

SEQ ID NO: 1514922 - RNA, 19 nt, Homo sapiens
ggaaggagcucucgcuguu

SEQ ID NO: 1514923 - RNA, 19 nt, Homo sapiens
caagaggccuuauaaaugu

SEQ ID NO: 1514924 - RNA, 19 nt, Homo sapiens
aaacauaccucugacagua

SEQ ID NO: 1514925 - RNA, 19 nt, Homo sapiens
uaaagaaacucuccaccuu

SEQ ID NO: 1514926 - RNA, 19 nt, Homo sapiens
ggagggcacuggacagaaa

SEQ ID NO: 1514927 - RNA, 19 nt, Homo sapiens
caaccaacauggcagcuaa

SEQ ID NO: 1514928 - RNA, 19 nt, Homo sapiens
ucaaggagaucaagaagga

SEQ ID NO: 1514929 - RNA, 19 nt, Homo sapiens
gagcaacgcaugccuguuu

SEQ ID NO: 1514930 - RNA, 19 nt, Homo sapiens
aauagaagcuucacugaga

SEQ ID NO: 1514931 - RNA, 19 nt, Homo sapiens
ggacacaucccacuccaaa

SEQ ID NO: 1514932 - RNA, 19 nt, Homo sapiens
gaugaaauacugcaagaaa

SEQ ID NO: 1514933 - RNA, 19 nt, Homo sapiens
gagaugaaauacugcaaga

SEQ ID NO: 1514934 - RNA, 19 nt, Homo sapiens
gugaagagaugaaauacug

SEQ ID NO: 1514935 - RNA, 19 nt, Homo sapiens
ggaacuggaagauguauuu

SEQ ID NO: 1514936 - RNA, 19 nt, Homo sapiens
ggacaucucucucucucau

SEQ ID NO: 1514937 - RNA, 19 nt, Homo sapiens
guggcacgcuucucuguua

SEQ ID NO: 1514938 - RNA, 19 nt, Homo sapiens
ugagggagcuguuggauag

SEQ ID NO: 1514939 - RNA, 19 nt, Homo sapiens
gcagaucccagcccaaauu

SEQ ID NO: 1514940 - RNA, 19 nt, Homo sapiens
gcagcuaacacaugaauga

SEQ ID NO: 1514941 - RNA, 19 nt, Homo sapiens
uuuccuagcugaagucaua

SEQ ID NO: 1514942 - RNA, 19 nt, Homo sapiens
gacaguaacuuugauagau

SEQ ID NO: 1514943 - RNA, 19 nt, Homo sapiens
ggagauaucccguuucaag

SEQ ID NO: 1514944 - RNA, 19 nt, Homo sapiens
gaucaagccucuggagaug

SEQ ID NO: 1514945 - RNA, 19 nt, Homo sapiens
ucaagaggccuuauaaaug

SEQ ID NO: 1514946 - RNA, 19 nt, Homo sapiens
ccacaccucuuggcaauga

SEQ ID NO: 1514947 - RNA, 19 nt, Homo sapiens
ucacugagacgauuagaaa

SEQ ID NO: 1514948 - RNA, 19 nt, Homo sapiens
gaaaacgauuccagucaua

SEQ ID NO: 1514949 - RNA, 19 nt, Homo sapiens
caacauccugcguauauuu

SEQ ID NO: 1514950 - RNA, 19 nt, Homo sapiens
gaaauauacagcuuuggaa

SEQ ID NO: 1514951 - RNA, 19 nt, Homo sapiens
ucaaggacgugaacaggaa

SEQ ID NO: 1514952 - RNA, 19 nt, Homo sapiens
ugaaagaaaucaaggaaac

SEQ ID NO: 1514953 - RNA, 19 nt, Homo sapiens
ggaaaucgccacuggagau

SEQ ID NO: 1514954 - RNA, 19 nt, Homo sapiens
ugaggcagacuuucaauaa

SEQ ID NO: 1514955 - RNA, 19 nt, Homo sapiens
caacauggcagcuaacaca

SEQ ID NO: 1514956 - RNA, 19 nt, Homo sapiens
gcuccucccuuccauaaau

SEQ ID NO: 1514957 - RNA, 19 nt, Homo sapiens
agucaaaucuacagcauau

SEQ ID NO: 1514958 - RNA, 19 nt, Homo sapiens
ggugugaagagaugaaaua

SEQ ID NO: 1514959 - RNA, 19 nt, Homo sapiens
ggagcuaaauaaauuacug

SEQ ID NO: 1514960 - RNA, 19 nt, Homo sapiens
gaaaucgccacuggagaua

SEQ ID NO: 1514961 - RNA, 19 nt, Homo sapiens
acacagacuuccaugaguu

SEQ ID NO: 1514962 - RNA, 19 nt, Homo sapiens
caaacuuccugguaacuca

SEQ ID NO: 1514963 - RNA, 19 nt, Homo sapiens
caccugaacuccacggaaa

SEQ ID NO: 1514964 - RNA, 19 nt, Homo sapiens
uaaaggagaauaccacaga

SEQ ID NO: 1514965 - RNA, 19 nt, Homo sapiens
gagcuccaguggccauaaa

SEQ ID NO: 1514966 - RNA, 19 nt, Homo sapiens
caaacggugugaagagaug

SEQ ID NO: 1514967 - RNA, 19 nt, Homo sapiens
acaaucaggagcuaaauaa

SEQ ID NO: 1514968 - RNA, 19 nt, Homo sapiens
ugaaugaggccaaucaaga

SEQ ID NO: 1514969 - RNA, 19 nt, Homo sapiens
ugagcaugcuggagaauga

SEQ ID NO: 1514970 - RNA, 19 nt, Homo sapiens
gcgaaggcauggaaaauuu

SEQ ID NO: 1514971 - RNA, 19 nt, Homo sapiens
gagaccacaugaagcagaa

SEQ ID NO: 1514972 - RNA, 19 nt, Homo sapiens
gcuaagaagagauaaugaa

SEQ ID NO: 1514973 - RNA, 19 nt, Homo sapiens
caggcgagcuuuccagaug

SEQ ID NO: 1514974 - RNA, 19 nt, Homo sapiens
ucaauagaauguggaagaa

SEQ ID NO: 1514975 - RNA, 19 nt, Homo sapiens
aaggaucccuggacaagaa

SEQ ID NO: 1514976 - RNA, 19 nt, Homo sapiens
ggaaucguccucugggaaa

SEQ ID NO: 1514977 - RNA, 19 nt, Homo sapiens
acucaaggcuaccaaguga

SEQ ID NO: 1514978 - RNA, 19 nt, Homo sapiens
gaaggagcucucgcuguua

SEQ ID NO: 1514979 - RNA, 19 nt, Homo sapiens
gauccaauaucugcagguu

SEQ ID NO: 1514980 - RNA, 19 nt, Homo sapiens
ggcauuggguuaucuaugg

SEQ ID NO: 1514981 - RNA, 19 nt, Homo sapiens
aaacuuugaggcaguauuu

SEQ ID NO: 1514982 - RNA, 19 nt, Homo sapiens
aagugaagcuugcaggauu

SEQ ID NO: 1514983 - RNA, 19 nt, Homo sapiens
acaggaagcugagugaugu

SEQ ID NO: 1514984 - RNA, 19 nt, Homo sapiens
uuugauagaugguuuguca

SEQ ID NO: 1514985 - RNA, 19 nt, Homo sapiens
gcacgcuucucuguuacaa

SEQ ID NO: 1514986 - RNA, 19 nt, Homo sapiens
gcaagcugguggcugugaa

SEQ ID NO: 1514987 - RNA, 19 nt, Homo sapiens
gaggcagacuuucaauaag

SEQ ID NO: 1514988 - RNA, 19 nt, Homo sapiens
uccaauaucugcagguuuc

SEQ ID NO: 1514989 - RNA, 19 nt, Homo sapiens
uggaagaagugacuguaug

SEQ ID NO: 1514990 - RNA, 19 nt, Homo sapiens
gcacugugacuugauuuga

SEQ ID NO: 1514991 - RNA, 19 nt, Homo sapiens
acaguaacuuugauagaug

SEQ ID NO: 1514992 - RNA, 19 nt, Homo sapiens
ucucauauccuucggcauu

SEQ ID NO: 1514993 - RNA, 19 nt, Homo sapiens
aaagacagacagagucaaa

SEQ ID NO: 1514994 - RNA, 19 nt, Homo sapiens
ggagaucccgcaagagcaa

SEQ ID NO: 1514995 - RNA, 19 nt, Homo sapiens
caacaugaaagaaaucaag

SEQ ID NO: 1514996 - RNA, 19 nt, Homo sapiens
aauagaauguggaagaagu

SEQ ID NO: 1514997 - RNA, 19 nt, Homo sapiens
agaaacagccauccaagug

SEQ ID NO: 1514998 - RNA, 19 nt, Homo sapiens
ggauuugcauugaugaaac

SEQ ID NO: 1514999 - RNA, 19 nt, Homo sapiens
cugcguauauuugggauuu

SEQ ID NO: 1515000 - RNA, 19 nt, Homo sapiens
caaauugcccauucacaca

SEQ ID NO: 1515001 - RNA, 19 nt, Homo sapiens
gagaaugagagaccacaug

SEQ ID NO: 1515002 - RNA, 19 nt, Homo sapiens
gagugagcaugcuggagaa

SEQ ID NO: 1515003 - RNA, 19 nt, Homo sapiens
gcacaaacuggacaucucu

SEQ ID NO: 1515004 - RNA, 19 nt, Homo sapiens
ugaaauauacagcuuugga

SEQ ID NO: 1515005 - RNA, 19 nt, Homo sapiens
gauuugcauugaugaaaca

SEQ ID NO: 1515006 - RNA, 19 nt, Homo sapiens
cagaugcuaagaagagaua

SEQ ID NO: 1515007 - RNA, 19 nt, Homo sapiens
gaaccuuacccagccauga

SEQ ID NO: 1515008 - RNA, 19 nt, Homo sapiens
ccauaaaugaagucucuuu

SEQ ID NO: 1515009 - RNA, 19 nt, Homo sapiens
acacaucccacuccaaaug

SEQ ID NO: 1515010 - RNA, 19 nt, Homo sapiens
uuucaaggcuguaauucug

SEQ ID NO: 1515011 - RNA, 19 nt, Homo sapiens
ucugaaauauacagcuuug

SEQ ID NO: 1515012 - RNA, 19 nt, Homo sapiens
caauagugaggcagacuuu

SEQ ID NO: 1515013 - RNA, 19 nt, Homo sapiens
gagcaaaucaaggagauca

SEQ ID NO: 1515014 - RNA, 19 nt, Homo sapiens
cauacuagcccaaccaaca

SEQ ID NO: 1515015 - RNA, 19 nt, Homo sapiens
cagcuccucccuuccauaa

SEQ ID NO: 1515016 - RNA, 19 nt, Homo sapiens
ccaacauccugcguauauu

SEQ ID NO: 1515017 - RNA, 19 nt, Homo sapiens
cagaagaaccacucaagca

SEQ ID NO: 1515018 - RNA, 19 nt, Homo sapiens
ccaaucaagaccagaagaa

SEQ ID NO: 1515019 - RNA, 19 nt, Homo sapiens
acgcuucucuguuacaaau

SEQ ID NO: 1515020 - RNA, 19 nt, Homo sapiens
ugaaauacugcaagaaaca

SEQ ID NO: 1515021 - RNA, 19 nt, Homo sapiens
gacagaaacagccauccaa

SEQ ID NO: 1515022 - RNA, 19 nt, Homo sapiens
caaaucaacuuacugcaua

SEQ ID NO: 1515023 - RNA, 19 nt, Homo sapiens
caacucaacucacacugua

SEQ ID NO: 1515024 - RNA, 19 nt, Homo sapiens
caacgcaacucaacucaug

SEQ ID NO: 1515025 - RNA, 19 nt, Homo sapiens
gcaaaucaacuuacugcau

SEQ ID NO: 1515026 - RNA, 19 nt, Homo sapiens
gcacugcguaugcaaauca

SEQ ID NO: 1515027 - RNA, 19 nt, Homo sapiens
guaugcaacucaacucaca

SEQ ID NO: 1515028 - RNA, 19 nt, Homo sapiens
ccacaccaagccaguauuu

SEQ ID NO: 1515029 - RNA, 19 nt, Homo sapiens
caacucacacuguaugcaa

SEQ ID NO: 1515030 - RNA, 19 nt, Homo sapiens
gcacugcguaugcaacuca

SEQ ID NO: 1515031 - RNA, 19 nt, Homo sapiens
gcacugcguaugcaacuca

SEQ ID NO: 1515032 - RNA, 19 nt, Homo sapiens
gcacugcguaugcaacuca

SEQ ID NO: 1515033 - RNA, 19 nt, Homo sapiens
gcacugcguaugcaacuca

SEQ ID NO: 1515034 - RNA, 19 nt, Homo sapiens
gcaacucaacucacacugu

SEQ ID NO: 1515035 - RNA, 19 nt, Homo sapiens
uguccugccuuuccuguga

SEQ ID NO: 1515036 - RNA, 19 nt, Homo sapiens
gaagucagcccaggaugag

SEQ ID NO: 1515037 - RNA, 19 nt, Homo sapiens
ugaagucagcccaggauga

SEQ ID NO: 1515038 - RNA, 19 nt, Homo sapiens
gcauaugcaacucaacuca

SEQ ID NO: 1515039 - RNA, 19 nt, Homo sapiens
gcguaugcaaaucaacuua

SEQ ID NO: 1515040 - RNA, 19 nt, Homo sapiens
gcacuagacagcaggacau

SEQ ID NO: 1515041 - RNA, 19 nt, Homo sapiens
ucagcucgcucugcauaug

SEQ ID NO: 1515042 - RNA, 19 nt, Homo sapiens
caacucaugcugcguaugc

SEQ ID NO: 1515043 - RNA, 19 nt, Homo sapiens
gcuggaaguaugcagacua

SEQ ID NO: 1515044 - RNA, 19 nt, Homo sapiens
guaugcaaaucaacuuacu

SEQ ID NO: 1515045 - RNA, 19 nt, Homo sapiens
acucagcucgcucugcaua

SEQ ID NO: 1515046 - RNA, 19 nt, Homo sapiens
cuggaaguaugcagacuag

SEQ ID NO: 1515047 - RNA, 19 nt, Homo sapiens
guauuucuccucccugaag

SEQ ID NO: 1515048 - RNA, 19 nt, Homo sapiens
acaccaagccaguauuucu

SEQ ID NO: 1515049 - RNA, 19 nt, Homo sapiens
caacucacugcguaugcaa

SEQ ID NO: 1515050 - RNA, 19 nt, Homo sapiens
ucaacucacugcguaugca

SEQ ID NO: 1515051 - RNA, 19 nt, Homo sapiens
ucacugcguaugcaacuca

SEQ ID NO: 1515052 - RNA, 19 nt, Homo sapiens
caaaucaggucacguagaa

SEQ ID NO: 1515053 - RNA, 19 nt, Homo sapiens
gaagguguguugugaaugu

SEQ ID NO: 1515054 - RNA, 19 nt, Homo sapiens
gaacuuacccagaacauuc

SEQ ID NO: 1515055 - RNA, 19 nt, Homo sapiens
acaccaagcugauggagua

SEQ ID NO: 1515056 - RNA, 19 nt, Homo sapiens
gggaaaaggucaaauuuaa

SEQ ID NO: 1515057 - RNA, 19 nt, Homo sapiens
gagcagggauggaggaaca

SEQ ID NO: 1515058 - RNA, 19 nt, Homo sapiens
ggaaugcacgucugaaaga

SEQ ID NO: 1515059 - RNA, 19 nt, Homo sapiens
ggccugaacuuacccagaa

SEQ ID NO: 1515060 - RNA, 19 nt, Homo sapiens
caagaacuguuugggauga

SEQ ID NO: 1515061 - RNA, 19 nt, Homo sapiens
gaauaaaccagaagaaacu

SEQ ID NO: 1515062 - RNA, 19 nt, Homo sapiens
gcugguagcuaaggaaaug

SEQ ID NO: 1515063 - RNA, 19 nt, Homo sapiens
gggaugaaaucaccaugug

SEQ ID NO: 1515064 - RNA, 19 nt, Homo sapiens
gcggaucaaugucuuuaug

SEQ ID NO: 1515065 - RNA, 19 nt, Homo sapiens
ggacagaaucgcccugguu

SEQ ID NO: 1515066 - RNA, 19 nt, Homo sapiens
ucaggaagguguguuguga

SEQ ID NO: 1515067 - RNA, 19 nt, Homo sapiens
cuggauggcugguuuaaga

SEQ ID NO: 1515068 - RNA, 19 nt, Homo sapiens
ggucaaauuuaacauagca

SEQ ID NO: 1515069 - RNA, 19 nt, Homo sapiens
ccaagcugauggaguacua

SEQ ID NO: 1515070 - RNA, 19 nt, Homo sapiens
gggaggagcugaggguuca

SEQ ID NO: 1515071 - RNA, 19 nt, Homo sapiens
ggaauaaaccagaagaaac

SEQ ID NO: 1515072 - RNA, 19 nt, Homo sapiens
ggagccaccugugugauga

SEQ ID NO: 1515073 - RNA, 19 nt, Homo sapiens
cgagaauacuggaauaaac

SEQ ID NO: 1515074 - RNA, 19 nt, Homo sapiens
ggaaccagaugggcaagau

SEQ ID NO: 1515075 - RNA, 19 nt, Homo sapiens
gaccaaagacgacgugauc

SEQ ID NO: 1515076 - RNA, 19 nt, Homo sapiens
gcacccacguugcauuuac

SEQ ID NO: 1515077 - RNA, 19 nt, Homo sapiens
ucaaagagugggccagaaa

SEQ ID NO: 1515078 - RNA, 19 nt, Homo sapiens
ggaggacgaggaagaguug

SEQ ID NO: 1515079 - RNA, 19 nt, Homo sapiens
ccaggaggaugagcauuug

SEQ ID NO: 1515080 - RNA, 19 nt, Homo sapiens
caagggaacggcagucaga

SEQ ID NO: 1515081 - RNA, 19 nt, Homo sapiens
gaccuggccucccuuaaac

SEQ ID NO: 1515082 - RNA, 19 nt, Homo sapiens
gcgcugcucuguccucucu

SEQ ID NO: 1515083 - RNA, 19 nt, Homo sapiens
acacguacagggagcuuua

SEQ ID NO: 1515084 - RNA, 19 nt, Homo sapiens
cugaaagaguggccagaaa

SEQ ID NO: 1515085 - RNA, 19 nt, Homo sapiens
guagaaucaagaacuguuu

SEQ ID NO: 1515086 - RNA, 19 nt, Homo sapiens
gggcaagauugacaagaag

SEQ ID NO: 1515087 - RNA, 19 nt, Homo sapiens
ugggcaagauugacaagaa

SEQ ID NO: 1515088 - RNA, 19 nt, Homo sapiens
gcgugcaguuugugaagaa

SEQ ID NO: 1515089 - RNA, 19 nt, Homo sapiens
cggcccagcuggaguaugu

SEQ ID NO: 1515090 - RNA, 19 nt, Homo sapiens
gaaacuaagagugcauuca

SEQ ID NO: 1515091 - RNA, 19 nt, Homo sapiens
guucagcccucagcagguu

SEQ ID NO: 1515092 - RNA, 19 nt, Homo sapiens
ggaccucaguggacaucau

SEQ ID NO: 1515093 - RNA, 19 nt, Homo sapiens
gguauggcaugaccgagau

SEQ ID NO: 1515094 - RNA, 19 nt, Homo sapiens
ucccagagguuucccacaa

SEQ ID NO: 1515095 - RNA, 19 nt, Homo sapiens
caagaccuggccucccuua

SEQ ID NO: 1515096 - RNA, 19 nt, Homo sapiens
gaaccagaugggcaagauu

SEQ ID NO: 1515097 - RNA, 19 nt, Homo sapiens
gaguacaggugcgcauugu

SEQ ID NO: 1515098 - RNA, 19 nt, Homo sapiens
guucuuaaguucugaaacg

SEQ ID NO: 1515099 - RNA, 19 nt, Homo sapiens
gacaagaaggcgcucauca

SEQ ID NO: 1515100 - RNA, 19 nt, Homo sapiens
gauuggaguuccggauaug

SEQ ID NO: 1515101 - RNA, 19 nt, Homo sapiens
aggaugagcauuugcauug

SEQ ID NO: 1515102 - RNA, 19 nt, Homo sapiens
gaaugcacgucugaaagag

SEQ ID NO: 1515103 - RNA, 19 nt, Homo sapiens
caugcagaauccagaaguu

SEQ ID NO: 1515104 - RNA, 19 nt, Homo sapiens
gggcaggucccagagguuu

SEQ ID NO: 1515105 - RNA, 19 nt, Homo sapiens
ccacagugcccugcaguug

SEQ ID NO: 1515106 - RNA, 19 nt, Homo sapiens
agaccuggccucccuuaaa

SEQ ID NO: 1515107 - RNA, 19 nt, Homo sapiens
ugauuggaguuccggauau

SEQ ID NO: 1515108 - RNA, 19 nt, Homo sapiens
ggaguacaggugcgcauug

SEQ ID NO: 1515109 - RNA, 19 nt, Homo sapiens
ugaacccucucucccauca

SEQ ID NO: 1515110 - RNA, 19 nt, Homo sapiens
cacccuggauggcugguuu

SEQ ID NO: 1515111 - RNA, 19 nt, Homo sapiens
uuucgagaauacuggaaua

SEQ ID NO: 1515112 - RNA, 19 nt, Homo sapiens
gugauuggaguuccggaua

SEQ ID NO: 1515113 - RNA, 19 nt, Homo sapiens
gaggaugagcauuugcauu

SEQ ID NO: 1515114 - RNA, 19 nt, Homo sapiens
gcacgcccaggauuucuug

SEQ ID NO: 1515115 - RNA, 19 nt, Homo sapiens
guacaggugcgcauugucu

SEQ ID NO: 1515116 - RNA, 19 nt, Homo sapiens
caauauacaccaagcugau

SEQ ID NO: 1515117 - RNA, 19 nt, Homo sapiens
cagcgucccagcccuguuu

SEQ ID NO: 1515118 - RNA, 19 nt, Homo sapiens
gaacuguuugggaugaaau

SEQ ID NO: 1515119 - RNA, 19 nt, Homo sapiens
caaagagugggccagaaau

SEQ ID NO: 1515120 - RNA, 19 nt, Homo sapiens
gcgcuaacgaugccuccua

SEQ ID NO: 1515121 - RNA, 19 nt, Homo sapiens
aggaagguguguugugaau

SEQ ID NO: 1515122 - RNA, 19 nt, Homo sapiens
cccagagguuucccacaaa

SEQ ID NO: 1515123 - RNA, 19 nt, Homo sapiens
uggaauaaaccagaagaaa

SEQ ID NO: 1515124 - RNA, 19 nt, Homo sapiens
caagugggcauggaccaaa

SEQ ID NO: 1515125 - RNA, 19 nt, Homo sapiens
ccaaaucaggucacguaga

SEQ ID NO: 1515126 - RNA, 19 nt, Homo sapiens
guuuaaggauggccaguac

SEQ ID NO: 1515127 - RNA, 19 nt, Homo sapiens
gaagaaacuaagagugcau

SEQ ID NO: 1515128 - RNA, 19 nt, Homo sapiens
gaaagaguggccagaaacg

SEQ ID NO: 1515129 - RNA, 19 nt, Homo sapiens
ccacagggagcucaaagag

SEQ ID NO: 1515130 - RNA, 19 nt, Homo sapiens
cgagaaggacacucacugu

SEQ ID NO: 1515131 - RNA, 19 nt, Homo sapiens
gagaaguggaagaacauca

SEQ ID NO: 1515132 - RNA, 19 nt, Homo sapiens
cccaggaggaugagcauuu

SEQ ID NO: 1515133 - RNA, 19 nt, Homo sapiens
ccacguugcauuuacuuag

SEQ ID NO: 1515134 - RNA, 19 nt, Homo sapiens
guucacaagccucccagaa

SEQ ID NO: 1515135 - RNA, 19 nt, Homo sapiens
gagggucuccuuccuaugc

SEQ ID NO: 1515136 - RNA, 19 nt, Homo sapiens
cuggagaaguggaagaaca

SEQ ID NO: 1515137 - RNA, 19 nt, Homo sapiens
aggccuugcugguagcuaa

SEQ ID NO: 1515138 - RNA, 19 nt, Homo sapiens
ccacaugcagaauccagaa

SEQ ID NO: 1515139 - RNA, 19 nt, Homo sapiens
gcucacaccagccaucuac

SEQ ID NO: 1515140 - RNA, 19 nt, Homo sapiens
ucaguggacaucaucaaga

SEQ ID NO: 1515141 - RNA, 19 nt, Homo sapiens
ggucaacgcgcugcucugu

SEQ ID NO: 1515142 - RNA, 19 nt, Homo sapiens
ucacguagaaucaagaacu

SEQ ID NO: 1515143 - RNA, 19 nt, Homo sapiens
aaagagugggccagaaaug

SEQ ID NO: 1515144 - RNA, 19 nt, Homo sapiens
ugucuaggccuugcuggua

SEQ ID NO: 1515145 - RNA, 19 nt, Homo sapiens
gcaugucgcccaccaagcu

SEQ ID NO: 1515146 - RNA, 19 nt, Homo sapiens
cuugugaacugcgaacuuc

SEQ ID NO: 1515147 - RNA, 19 nt, Homo sapiens
gggagccaccugugugaug

SEQ ID NO: 1515148 - RNA, 19 nt, Homo sapiens
agauguggcugugauugga

SEQ ID NO: 1515149 - RNA, 19 nt, Homo sapiens
ccagagguuucccacaaaa

SEQ ID NO: 1515150 - RNA, 19 nt, Homo sapiens
cacguagaaucaagaacug

SEQ ID NO: 1515151 - RNA, 19 nt, Homo sapiens
ggucacguagaaucaagaa

SEQ ID NO: 1515152 - RNA, 19 nt, Homo sapiens
caacaugccuggcuaauuu

SEQ ID NO: 1515153 - RNA, 19 nt, Homo sapiens
ggacguggguaguguguga

SEQ ID NO: 1515154 - RNA, 19 nt, Homo sapiens
agagagaucugguggguuu

SEQ ID NO: 1515155 - RNA, 19 nt, Homo sapiens
ucccaaagcuucaggauga

SEQ ID NO: 1515156 - RNA, 19 nt, Homo sapiens
gauaggguuucauuacauu

SEQ ID NO: 1515157 - RNA, 19 nt, Homo sapiens
gagauaggguuucauuaca

SEQ ID NO: 1515158 - RNA, 19 nt, Homo sapiens
ugaaggcugucgucgguua

SEQ ID NO: 1515159 - RNA, 19 nt, Homo sapiens
gugaugcgguuguaagauu

SEQ ID NO: 1515160 - RNA, 19 nt, Homo sapiens
ccagugaccugugcuuuga

SEQ ID NO: 1515161 - RNA, 19 nt, Homo sapiens
guagagauaggguuucauu

SEQ ID NO: 1515162 - RNA, 19 nt, Homo sapiens
ugccucagcuucccagaua

SEQ ID NO: 1515163 - RNA, 19 nt, Homo sapiens
ucaaggaguuuaagucuac

SEQ ID NO: 1515164 - RNA, 19 nt, Homo sapiens
gauaggcuuucaccuuguu

SEQ ID NO: 1515165 - RNA, 19 nt, Homo sapiens
uuacacaccucgccucguu

SEQ ID NO: 1515166 - RNA, 19 nt, Homo sapiens
gcacccacguguugacuca

SEQ ID NO: 1515167 - RNA, 19 nt, Homo sapiens
caccacaccuggcuaacuu

SEQ ID NO: 1515168 - RNA, 19 nt, Homo sapiens
ccaggauggucucacguuu

SEQ ID NO: 1515169 - RNA, 19 nt, Homo sapiens
ucaccgaccuggccuucaa

SEQ ID NO: 1515170 - RNA, 19 nt, Homo sapiens
ccaaagugcugggaucaca

SEQ ID NO: 1515171 - RNA, 19 nt, Homo sapiens
ggcagcagcucacuauugg

SEQ ID NO: 1515172 - RNA, 19 nt, Homo sapiens
caaaggcgcacacugacuu

SEQ ID NO: 1515173 - RNA, 19 nt, Homo sapiens
cgaagcacccggcaucuug

SEQ ID NO: 1515174 - RNA, 19 nt, Homo sapiens
gcuauacgacuucacauca

SEQ ID NO: 1515175 - RNA, 19 nt, Homo sapiens
gauggcagcagcucacuau

SEQ ID NO: 1515176 - RNA, 19 nt, Homo sapiens
gaugagcugcugcgaguug

SEQ ID NO: 1515177 - RNA, 19 nt, Homo sapiens
gcgggucucuguagaaguc

SEQ ID NO: 1515178 - RNA, 19 nt, Homo sapiens
ggccaucggagucgguuua

SEQ ID NO: 1515179 - RNA, 19 nt, Homo sapiens
ucuccaaccucuucaagga

SEQ ID NO: 1515180 - RNA, 19 nt, Homo sapiens
ccaagccgauugagaagag

SEQ ID NO: 1515181 - RNA, 19 nt, Homo sapiens
uggcaaaggcgcacacuga

SEQ ID NO: 1515182 - RNA, 19 nt, Homo sapiens
gcuggaagggucuugguuu

SEQ ID NO: 1515183 - RNA, 19 nt, Homo sapiens
ccacguggcuccaguuucc

SEQ ID NO: 1515184 - RNA, 19 nt, Homo sapiens
ugaugcgguuguaagauuu

SEQ ID NO: 1515185 - RNA, 19 nt, Homo sapiens
agagauaggcuuucaccuu

SEQ ID NO: 1515186 - RNA, 19 nt, Homo sapiens
gcuugaaagugccuuccaa

SEQ ID NO: 1515187 - RNA, 19 nt, Homo sapiens
cuacauccacguccgguuu

SEQ ID NO: 1515188 - RNA, 19 nt, Homo sapiens
agagagagccuuguucugu

SEQ ID NO: 1515189 - RNA, 19 nt, Homo sapiens
gcaagcacuucgucaucca

SEQ ID NO: 1515190 - RNA, 19 nt, Homo sapiens
gcagcuauacgacuucaca

SEQ ID NO: 1515191 - RNA, 19 nt, Homo sapiens
cauuucacgucucggcuuu

SEQ ID NO: 1515192 - RNA, 19 nt, Homo sapiens
gaaacuccagcuucaugug

SEQ ID NO: 1515193 - RNA, 19 nt, Homo sapiens
cacguugucugcucucuca

SEQ ID NO: 1515194 - RNA, 19 nt, Homo sapiens
ccaggacaccucagagaga

SEQ ID NO: 1515195 - RNA, 19 nt, Homo sapiens
ccaucaaggugugggacua

SEQ ID NO: 1515196 - RNA, 19 nt, Homo sapiens
gcaguggccacaucuugga

SEQ ID NO: 1515197 - RNA, 19 nt, Homo sapiens
uagagauaggguuucauua

SEQ ID NO: 1515198 - RNA, 19 nt, Homo sapiens
ccaacaugccuggcuaauu

SEQ ID NO: 1515199 - RNA, 19 nt, Homo sapiens
agagagccuuguucuguca

SEQ ID NO: 1515200 - RNA, 19 nt, Homo sapiens
accagcagcucacauuuca

SEQ ID NO: 1515201 - RNA, 19 nt, Homo sapiens
aaacuccagcuucauguga

SEQ ID NO: 1515202 - RNA, 19 nt, Homo sapiens
ggucccgccuagccuaaga

SEQ ID NO: 1515203 - RNA, 19 nt, Homo sapiens
gugcaguggcgcgaucuua

SEQ ID NO: 1515204 - RNA, 19 nt, Homo sapiens
agauaggguuucauuacau

SEQ ID NO: 1515205 - RNA, 19 nt, Homo sapiens
agagauaggguuucauuac

SEQ ID NO: 1515206 - RNA, 19 nt, Homo sapiens
caaggacaaccaagucauc

SEQ ID NO: 1515207 - RNA, 19 nt, Homo sapiens
uggcagcagcucacuauug

SEQ ID NO: 1515208 - RNA, 19 nt, Homo sapiens
gcuggaggccucugacauc

SEQ ID NO: 1515209 - RNA, 19 nt, Homo sapiens
ccugugcgguucagugugu

SEQ ID NO: 1515210 - RNA, 19 nt, Homo sapiens
caggacaccucagagagau

SEQ ID NO: 1515211 - RNA, 19 nt, Homo sapiens
uauacgacuucacaucauc

SEQ ID NO: 1515212 - RNA, 19 nt, Homo sapiens
ggugggacguggguagugu

SEQ ID NO: 1515213 - RNA, 19 nt, Homo sapiens
caaagcuucaggaugagaa

SEQ ID NO: 1515214 - RNA, 19 nt, Homo sapiens
ccaccagcagcucacauuu

SEQ ID NO: 1515215 - RNA, 19 nt, Homo sapiens
cuuccaagccgauugagaa

SEQ ID NO: 1515216 - RNA, 19 nt, Homo sapiens
guguggagccugggacuuu

SEQ ID NO: 1515217 - RNA, 19 nt, Homo sapiens
uaguagagauaggcuuuca

SEQ ID NO: 1515218 - RNA, 19 nt, Homo sapiens
caagggcgucaucggcuuu

SEQ ID NO: 1515219 - RNA, 19 nt, Homo sapiens
caccucagccucccaaagu

SEQ ID NO: 1515220 - RNA, 19 nt, Homo sapiens
ggagcccaaugcacguugu

SEQ ID NO: 1515221 - RNA, 19 nt, Homo sapiens
gccagggacaccaggaauu

SEQ ID NO: 1515222 - RNA, 19 nt, Homo sapiens
gcauugcgggucucuguag

SEQ ID NO: 1515223 - RNA, 19 nt, Homo sapiens
cagcauugcgggucucugu

SEQ ID NO: 1515224 - RNA, 19 nt, Homo sapiens
gcugggaucacaggcauga

SEQ ID NO: 1515225 - RNA, 19 nt, Homo sapiens
ggccaggacaccucagaga

SEQ ID NO: 1515226 - RNA, 19 nt, Homo sapiens
gccggacacaggcuucuuu

SEQ ID NO: 1515227 - RNA, 19 nt, Homo sapiens
guggguggcugcgucugaa

SEQ ID NO: 1515228 - RNA, 19 nt, Homo sapiens
ccagggacaccaggaauuc

SEQ ID NO: 1515229 - RNA, 19 nt, Homo sapiens
gcaaaggcgcacacugacu

SEQ ID NO: 1515230 - RNA, 19 nt, Homo sapiens
cagcaagcacuucgucauc

SEQ ID NO: 1515231 - RNA, 19 nt, Homo sapiens
gagagagagccuuguucug

SEQ ID NO: 1515232 - RNA, 19 nt, Homo sapiens
gguuuaagccagcguuuac

SEQ ID NO: 1515233 - RNA, 19 nt, Homo sapiens
ggaagggucuugguuuucu

SEQ ID NO: 1515234 - RNA, 19 nt, Homo sapiens
cuacugagagcgaccaaag

SEQ ID NO: 1515235 - RNA, 19 nt, Homo sapiens
ugacgggacgauaccugua

SEQ ID NO: 1515236 - RNA, 19 nt, Homo sapiens
gcucggccucccuugauga

SEQ ID NO: 1515237 - RNA, 19 nt, Homo sapiens
cuauacgacuucacaucau

SEQ ID NO: 1515238 - RNA, 19 nt, Homo sapiens
ugcagcagcuauacgacuu

SEQ ID NO: 1515239 - RNA, 19 nt, Homo sapiens
gaccguaccguccgcaucu

SEQ ID NO: 1515240 - RNA, 19 nt, Homo sapiens
uucaaggaguuuaagucua

SEQ ID NO: 1515241 - RNA, 19 nt, Homo sapiens
gaggcuggucuccgcauga

SEQ ID NO: 1515242 - RNA, 19 nt, Homo sapiens
ggacaccucagagagaucu

SEQ ID NO: 1515243 - RNA, 19 nt, Homo sapiens
cagcagcuauacgacuuca

SEQ ID NO: 1515244 - RNA, 19 nt, Homo sapiens
gagcagcagggagugcauu

SEQ ID NO: 1515245 - RNA, 19 nt, Homo sapiens
ccgcaguggccacaucuug

SEQ ID NO: 1515246 - RNA, 19 nt, Homo sapiens
acauccagcucccuaagag

SEQ ID NO: 1515247 - RNA, 19 nt, Homo sapiens
ucacggacaagacccugaa

SEQ ID NO: 1515248 - RNA, 19 nt, Homo sapiens
ugagagagagccuuguucu

SEQ ID NO: 1515249 - RNA, 19 nt, Homo sapiens
ggauggcagcagcucacua

SEQ ID NO: 1515250 - RNA, 19 nt, Homo sapiens
caccagcagcucacauuuc

SEQ ID NO: 1515251 - RNA, 19 nt, Homo sapiens
ggagcagcgcuucuuccuu

SEQ ID NO: 1515252 - RNA, 19 nt, Homo sapiens
caaagagugugaagacuua

SEQ ID NO: 1515253 - RNA, 19 nt, Homo sapiens
ggagcaagcuguuguaaau

SEQ ID NO: 1515254 - RNA, 19 nt, Homo sapiens
acaaggaggugaucaucua

SEQ ID NO: 1515255 - RNA, 19 nt, Homo sapiens
gaagauaccacugcccuuu

SEQ ID NO: 1515256 - RNA, 19 nt, Homo sapiens
guaauaaacaugggcauuu

SEQ ID NO: 1515257 - RNA, 19 nt, Homo sapiens
gcaagcuguuguaaauuug

SEQ ID NO: 1515258 - RNA, 19 nt, Homo sapiens
cgugaagcguuccauauuu

SEQ ID NO: 1515259 - RNA, 19 nt, Homo sapiens
gcaaagagugugaagacuu

SEQ ID NO: 1515260 - RNA, 19 nt, Homo sapiens
agcaagcuguuguaaauuu

SEQ ID NO: 1515261 - RNA, 19 nt, Homo sapiens
agaagcaggugguggagaa

SEQ ID NO: 1515262 - RNA, 19 nt, Homo sapiens
ccauggagcucaagaugca

SEQ ID NO: 1515263 - RNA, 19 nt, Homo sapiens
ccuccuggcuguuggcuuu

SEQ ID NO: 1515264 - RNA, 19 nt, Homo sapiens
gcacggccauggagcucaa

SEQ ID NO: 1515265 - RNA, 19 nt, Homo sapiens
gcaaggaugacacgcaaau

SEQ ID NO: 1515266 - RNA, 19 nt, Homo sapiens
gaacgauacagagaagauu

SEQ ID NO: 1515267 - RNA, 19 nt, Homo sapiens
aaacaugggcauuuauuuc

SEQ ID NO: 1515268 - RNA, 19 nt, Homo sapiens
gaaaugccugcgucccuuu

SEQ ID NO: 1515269 - RNA, 19 nt, Homo sapiens
caugggcauuuauuucaaa

SEQ ID NO: 1515270 - RNA, 19 nt, Homo sapiens
gaaccacugugagcuugug

SEQ ID NO: 1515271 - RNA, 19 nt, Homo sapiens
ggccaggauucacguaaau

SEQ ID NO: 1515272 - RNA, 19 nt, Homo sapiens
ggaacgauacagagaagau

SEQ ID NO: 1515273 - RNA, 19 nt, Homo sapiens
gcacauauacuaaaauugg

SEQ ID NO: 1515274 - RNA, 19 nt, Homo sapiens
gcuguuggcuuugcugagu

SEQ ID NO: 1515275 - RNA, 19 nt, Homo sapiens
gugaagcguuccauauuuu

SEQ ID NO: 1515276 - RNA, 19 nt, Homo sapiens
gagcaagcuguuguaaauu

SEQ ID NO: 1515277 - RNA, 19 nt, Homo sapiens
gcaggugguggagaagaua

SEQ ID NO: 1515278 - RNA, 19 nt, Homo sapiens
ggagggcacagaccuaugg

SEQ ID NO: 1515279 - RNA, 19 nt, Homo sapiens
cccaaucucuaccaucugu

SEQ ID NO: 1515280 - RNA, 19 nt, Homo sapiens
ggacucacccagaucuagu

SEQ ID NO: 1515281 - RNA, 19 nt, Homo sapiens
gguugucaauggccucaug

SEQ ID NO: 1515282 - RNA, 19 nt, Homo sapiens
gcagugaggaugggagugu

SEQ ID NO: 1515283 - RNA, 19 nt, Homo sapiens
cuuguggacugguugaguu

SEQ ID NO: 1515284 - RNA, 19 nt, Homo sapiens
aacgauacagagaagauua

SEQ ID NO: 1515285 - RNA, 19 nt, Homo sapiens
gcacaugcucugguuugga

SEQ ID NO: 1515286 - RNA, 19 nt, Homo sapiens
acaugggcauuuauuucaa

SEQ ID NO: 1515287 - RNA, 19 nt, Homo sapiens
cgaggcacauauacuaaaa

SEQ ID NO: 1515288 - RNA, 19 nt, Homo sapiens
ggccauggagcucaagaug

SEQ ID NO: 1515289 - RNA, 19 nt, Homo sapiens
cagcauggagcuugugauc

SEQ ID NO: 1515290 - RNA, 19 nt, Homo sapiens
caaggaugacacgcaaauu

SEQ ID NO: 1515291 - RNA, 19 nt, Homo sapiens
aggaggugaucaucuacaa

SEQ ID NO: 1515292 - RNA, 19 nt, Homo sapiens
aaggaugacacgcaaauuc

SEQ ID NO: 1515293 - RNA, 19 nt, Homo sapiens
gugcaaagagugugaagac

SEQ ID NO: 1515294 - RNA, 19 nt, Homo sapiens
aggccaggauucacguaaa

SEQ ID NO: 1515295 - RNA, 19 nt, Homo sapiens
cacgaggcacauauacuaa

SEQ ID NO: 1515296 - RNA, 19 nt, Homo sapiens
ucgugaagcguuccauauu

SEQ ID NO: 1515297 - RNA, 19 nt, Homo sapiens
auacagagaagauuagcau

SEQ ID NO: 1515298 - RNA, 19 nt, Homo sapiens
aacaugggcauuuauuuca

SEQ ID NO: 1515299 - RNA, 19 nt, Homo sapiens
ggcgccagguugucaaugg

SEQ ID NO: 1515300 - RNA, 19 nt, Homo sapiens
gagcuuguggacugguuga

SEQ ID NO: 1515301 - RNA, 19 nt, Homo sapiens
gaugggcucguggcuguga

SEQ ID NO: 1515302 - RNA, 19 nt, Homo sapiens
ggacugcccaagacuuugc

SEQ ID NO: 1515303 - RNA, 19 nt, Homo sapiens
gcggaaccacugugagcuu

SEQ ID NO: 1515304 - RNA, 19 nt, Homo sapiens
aaaugccugcgucccuuua

SEQ ID NO: 1515305 - RNA, 19 nt, Homo sapiens
gguggagggcacagaccua

SEQ ID NO: 1515306 - RNA, 19 nt, Homo sapiens
ccaccgauggucagacugu

SEQ ID NO: 1515307 - RNA, 19 nt, Homo sapiens
gcaagaagaugaggaagaa

SEQ ID NO: 1515308 - RNA, 19 nt, Homo sapiens
gaacuggauuuguuuagaa

SEQ ID NO: 1515309 - RNA, 19 nt, Homo sapiens
ccacagcccuucuuggaaa

SEQ ID NO: 1515310 - RNA, 19 nt, Homo sapiens
gaaaggcucuggaacugau

SEQ ID NO: 1515311 - RNA, 19 nt, Homo sapiens
agaaugaacuggauuuguu

SEQ ID NO: 1515312 - RNA, 19 nt, Homo sapiens
acaaguggcugauugagaa

SEQ ID NO: 1515313 - RNA, 19 nt, Homo sapiens
gaaugggcgucaugacuga

SEQ ID NO: 1515314 - RNA, 19 nt, Homo sapiens
gagggagucuggugucuug

SEQ ID NO: 1515315 - RNA, 19 nt, Homo sapiens
ccaaguacuuccagucgaa

SEQ ID NO: 1515316 - RNA, 19 nt, Homo sapiens
ggagucuggugucuugaaa

SEQ ID NO: 1515317 - RNA, 19 nt, Homo sapiens
gaaugaacuggauuuguuu

SEQ ID NO: 1515318 - RNA, 19 nt, Homo sapiens
ucaacaacauuaacagugu

SEQ ID NO: 1515319 - RNA, 19 nt, Homo sapiens
gcagugccaccguagauaa

SEQ ID NO: 1515320 - RNA, 19 nt, Homo sapiens
caacuuaaaggcaagaaga

SEQ ID NO: 1515321 - RNA, 19 nt, Homo sapiens
caaaacaaguggcugauug

SEQ ID NO: 1515322 - RNA, 19 nt, Homo sapiens
gcucuggaacugauuauug

SEQ ID NO: 1515323 - RNA, 19 nt, Homo sapiens
gaugacccauggcgugcua

SEQ ID NO: 1515324 - RNA, 19 nt, Homo sapiens
aauaaaccauccugggaaa

SEQ ID NO: 1515325 - RNA, 19 nt, Homo sapiens
ggucaaagcugcgaaaccu

SEQ ID NO: 1515326 - RNA, 19 nt, Homo sapiens
gaaaccggcuuugcgucuu

SEQ ID NO: 1515327 - RNA, 19 nt, Homo sapiens
guccuuguauauugagaua

SEQ ID NO: 1515328 - RNA, 19 nt, Homo sapiens
ccacagcuuuggaauaaac

SEQ ID NO: 1515329 - RNA, 19 nt, Homo sapiens
ggaacugauuauugacuca

SEQ ID NO: 1515330 - RNA, 19 nt, Homo sapiens
gaaucuugcuacaacuuca

SEQ ID NO: 1515331 - RNA, 19 nt, Homo sapiens
uagaaaggcucuggaacug

SEQ ID NO: 1515332 - RNA, 19 nt, Homo sapiens
ggacuucaucaacaacauu

SEQ ID NO: 1515333 - RNA, 19 nt, Homo sapiens
gcggugaagaucugcaaua

SEQ ID NO: 1515334 - RNA, 19 nt, Homo sapiens
ccacaaacauauugaaccu

SEQ ID NO: 1515335 - RNA, 19 nt, Homo sapiens
caacauuaacagugucuug

SEQ ID NO: 1515336 - RNA, 19 nt, Homo sapiens
ugaacuggauuuguuuaga

SEQ ID NO: 1515337 - RNA, 19 nt, Homo sapiens
agagaggagucacggaaga

SEQ ID NO: 1515338 - RNA, 19 nt, Homo sapiens
gacuucaucaacaacauua

SEQ ID NO: 1515339 - RNA, 19 nt, Homo sapiens
gagaaugaacuggauuugu

SEQ ID NO: 1515340 - RNA, 19 nt, Homo sapiens
gcagagaaugaacuggauu

SEQ ID NO: 1515341 - RNA, 19 nt, Homo sapiens
uuggaguccuuguauauug

SEQ ID NO: 1515342 - RNA, 19 nt, Homo sapiens
cggugaagaucugcaauau

SEQ ID NO: 1515343 - RNA, 19 nt, Homo sapiens
gagaaugggcgucaugacu

SEQ ID NO: 1515344 - RNA, 19 nt, Homo sapiens
cagagaaugaacuggauuu

SEQ ID NO: 1515345 - RNA, 19 nt, Homo sapiens
gaggagucacggaagauga

SEQ ID NO: 1515346 - RNA, 19 nt, Homo sapiens
uggaguccuuguauauuga

SEQ ID NO: 1515347 - RNA, 19 nt, Homo sapiens
uggaggacuucaucaacaa

SEQ ID NO: 1515348 - RNA, 19 nt, Homo sapiens
ggcaagaagaugaggaaga

SEQ ID NO: 1515349 - RNA, 19 nt, Homo sapiens
cucuggaacugauuauuga

SEQ ID NO: 1515350 - RNA, 19 nt, Homo sapiens
gaagaugaggaagaaggaa

SEQ ID NO: 1515351 - RNA, 19 nt, Homo sapiens
ccucuuucgucuuaauguu

SEQ ID NO: 1515352 - RNA, 19 nt, Homo sapiens
cuuaaaggcaagaagauga

SEQ ID NO: 1515353 - RNA, 19 nt, Homo sapiens
gagauaaagagaggaguca

SEQ ID NO: 1515354 - RNA, 19 nt, Homo sapiens
uacccugcguggccaagua

SEQ ID NO: 1515355 - RNA, 19 nt, Homo sapiens
gagagggagucuggugucu

SEQ ID NO: 1515356 - RNA, 19 nt, Homo sapiens
aaaccggcuuugcgucuuc

SEQ ID NO: 1515357 - RNA, 19 nt, Homo sapiens
gugccaccguagauaaguu

SEQ ID NO: 1515358 - RNA, 19 nt, Homo sapiens
gcuacaacuucaauuucca

SEQ ID NO: 1515359 - RNA, 19 nt, Homo sapiens
agucuggugucuugaaauc

SEQ ID NO: 1515360 - RNA, 19 nt, Homo sapiens
ugacucagaaaccggcuuu

SEQ ID NO: 1515361 - RNA, 19 nt, Homo sapiens
gucuuggaguccuuguaua

SEQ ID NO: 1515362 - RNA, 19 nt, Homo sapiens
ccauuuaugcguuggugaa

SEQ ID NO: 1515363 - RNA, 19 nt, Homo sapiens
uuggaggacuucaucaaca

SEQ ID NO: 1515364 - RNA, 19 nt, Homo sapiens
guucaccguccacagcuuu

SEQ ID NO: 1515365 - RNA, 19 nt, Homo sapiens
gggagaaugggcgucauga

SEQ ID NO: 1515366 - RNA, 19 nt, Homo sapiens
ucuggugucuugaaaucga

SEQ ID NO: 1515367 - RNA, 19 nt, Homo sapiens
caucaacaacauuaacagu

SEQ ID NO: 1515368 - RNA, 19 nt, Homo sapiens
ugcgaaaccugugggauca

SEQ ID NO: 1515369 - RNA, 19 nt, Homo sapiens
gggagucuggugucuugaa

SEQ ID NO: 1515370 - RNA, 19 nt, Homo sapiens
cgccacagcccuucuugga

SEQ ID NO: 1515371 - RNA, 19 nt, Homo sapiens
uuagaaaggcucuggaacu

SEQ ID NO: 1515372 - RNA, 19 nt, Homo sapiens
guuggugaaucuugcuaca

SEQ ID NO: 1515373 - RNA, 19 nt, Homo sapiens
gagaggagucacggaagau

SEQ ID NO: 1515374 - RNA, 19 nt, Homo sapiens
ccacgcgaguccccucuuu

SEQ ID NO: 1515375 - RNA, 19 nt, Homo sapiens
gccacagcccuucuuggaa

SEQ ID NO: 1515376 - RNA, 19 nt, Homo sapiens
gaucgccacagcccuucuu

SEQ ID NO: 1515377 - RNA, 19 nt, Homo sapiens
ggugaagaucugcaauauc

SEQ ID NO: 1515378 - RNA, 19 nt, Homo sapiens
cgucuuccacaaacauauu

SEQ ID NO: 1515379 - RNA, 19 nt, Homo sapiens
cuacggauuuugcagagaa

SEQ ID NO: 1515380 - RNA, 19 nt, Homo sapiens
uggugaaucuugcuacaac

SEQ ID NO: 1515381 - RNA, 19 nt, Homo sapiens
uuuaugcguuggugaaucu

SEQ ID NO: 1515382 - RNA, 19 nt, Homo sapiens
gaacugggaugacuuaugg

SEQ ID NO: 1515383 - RNA, 19 nt, Homo sapiens
gcucagaucuggucaaaca

SEQ ID NO: 1515384 - RNA, 19 nt, Homo sapiens
ccauauaucugcacugauu

SEQ ID NO: 1515385 - RNA, 19 nt, Homo sapiens
ggaaaugucucucucaaac

SEQ ID NO: 1515386 - RNA, 19 nt, Homo sapiens
ggagaaacccuacaagugu

SEQ ID NO: 1515387 - RNA, 19 nt, Homo sapiens
gcucugaccuggugaaaca

SEQ ID NO: 1515388 - RNA, 19 nt, Homo sapiens
gcacaggucuagggaguga

SEQ ID NO: 1515389 - RNA, 19 nt, Homo sapiens
gaggaagaauagauagaaa

SEQ ID NO: 1515390 - RNA, 19 nt, Homo sapiens
ggagaaacccuaccucugu

SEQ ID NO: 1515391 - RNA, 19 nt, Homo sapiens
gagcucagaucuggucaaa

SEQ ID NO: 1515392 - RNA, 19 nt, Homo sapiens
cgaaugaguuugaacauac

SEQ ID NO: 1515393 - RNA, 19 nt, Homo sapiens
guucugaccuggugaaaca

SEQ ID NO: 1515394 - RNA, 19 nt, Homo sapiens
ugucagaucuggugaaaca

SEQ ID NO: 1515395 - RNA, 19 nt, Homo sapiens
cuacaaguguggcauaugu

SEQ ID NO: 1515396 - RNA, 19 nt, Homo sapiens
gauccgaccuggugaagca

SEQ ID NO: 1515397 - RNA, 19 nt, Homo sapiens
gaugucagaucuggugaaa

SEQ ID NO: 1515398 - RNA, 19 nt, Homo sapiens
gagagagggucuaggaaag

SEQ ID NO: 1515399 - RNA, 19 nt, Homo sapiens
uaaauaaacuggcuuucac

SEQ ID NO: 1515400 - RNA, 19 nt, Homo sapiens
ccgaaugaguuugaacaua

SEQ ID NO: 1515401 - RNA, 19 nt, Homo sapiens
ggaggaagaauagauagaa

SEQ ID NO: 1515402 - RNA, 19 nt, Homo sapiens
ggagugagaacgugauuuc

SEQ ID NO: 1515403 - RNA, 19 nt, Homo sapiens
gggagaaacccuacaagug

SEQ ID NO: 1515404 - RNA, 19 nt, Homo sapiens
ggagaagccauacaagugu

SEQ ID NO: 1515405 - RNA, 19 nt, Homo sapiens
gggagaagccauacaagug

SEQ ID NO: 1515406 - RNA, 19 nt, Homo sapiens
gugagaagcccuacaagug

SEQ ID NO: 1515407 - RNA, 19 nt, Homo sapiens
aaacaccagcggacucaua

SEQ ID NO: 1515408 - RNA, 19 nt, Homo sapiens
ggagaaggaagggaagaaa

SEQ ID NO: 1515409 - RNA, 19 nt, Homo sapiens
ggagagggagccacagaga

SEQ ID NO: 1515410 - RNA, 19 nt, Homo sapiens
gcacacaguaggcauucaa

SEQ ID NO: 1515411 - RNA, 19 nt, Homo sapiens
ggacacacacuggugagaa

SEQ ID NO: 1515412 - RNA, 19 nt, Homo sapiens
ccagagagagggucuagga

SEQ ID NO: 1515413 - RNA, 19 nt, Homo sapiens
guucaaggaagaagauuug

SEQ ID NO: 1515414 - RNA, 19 nt, Homo sapiens
gcugugauguguguggaaa

SEQ ID NO: 1515415 - RNA, 19 nt, Homo sapiens
uaggaaaugucucucucaa

SEQ ID NO: 1515416 - RNA, 19 nt, Homo sapiens
gaaauagggauuggagaca

SEQ ID NO: 1515417 - RNA, 19 nt, Homo sapiens
aaacacaggcguacacaca

SEQ ID NO: 1515418 - RNA, 19 nt, Homo sapiens
ggcuccagaucaugaagua

SEQ ID NO: 1515419 - RNA, 19 nt, Homo sapiens
auacaagugugcagagugu

SEQ ID NO: 1515420 - RNA, 19 nt, Homo sapiens
gaucaugaaguaggaaaug

SEQ ID NO: 1515421 - RNA, 19 nt, Homo sapiens
gacacacacuggugagaag

SEQ ID NO: 1515422 - RNA, 19 nt, Homo sapiens
ugagaagcccuacaagugu

SEQ ID NO: 1515423 - RNA, 19 nt, Homo sapiens
gaagaugacuugggguuca

SEQ ID NO: 1515424 - RNA, 19 nt, Homo sapiens
gcccaggacaagccauaua

SEQ ID NO: 1515425 - RNA, 19 nt, Homo sapiens
ccacaagugcccugagugu

SEQ ID NO: 1515426 - RNA, 19 nt, Homo sapiens
gcugcagccuccugaguca

SEQ ID NO: 1515427 - RNA, 19 nt, Homo sapiens
gaccgaaggcccaggacaa

SEQ ID NO: 1515428 - RNA, 19 nt, Homo sapiens
agagagagggucuaggaaa

SEQ ID NO: 1515429 - RNA, 19 nt, Homo sapiens
acacaguaggcauucaaua

SEQ ID NO: 1515430 - RNA, 19 nt, Homo sapiens
gaggagagggagccacaga

SEQ ID NO: 1515431 - RNA, 19 nt, Homo sapiens
cagaucuggugaaacauca

SEQ ID NO: 1515432 - RNA, 19 nt, Homo sapiens
gaaaggggaggaagaauag

SEQ ID NO: 1515433 - RNA, 19 nt, Homo sapiens
gaagaaaggggaggaagaa

SEQ ID NO: 1515434 - RNA, 19 nt, Homo sapiens
gaagacugccuagcacaca

SEQ ID NO: 1515435 - RNA, 19 nt, Homo sapiens
ccgcuuagcagagaagaaa

SEQ ID NO: 1515436 - RNA, 19 nt, Homo sapiens
ucaccagcguagucacuug

SEQ ID NO: 1515437 - RNA, 19 nt, Homo sapiens
ugacuuauggguccagaga

SEQ ID NO: 1515438 - RNA, 19 nt, Homo sapiens
gaagauuuggcuccagauc

SEQ ID NO: 1515439 - RNA, 19 nt, Homo sapiens
gagaaggaagggaagaaag

SEQ ID NO: 1515440 - RNA, 19 nt, Homo sapiens
gaaugcgaccguaccuuca

SEQ ID NO: 1515441 - RNA, 19 nt, Homo sapiens
cacuaucuguggugaaugu

SEQ ID NO: 1515442 - RNA, 19 nt, Homo sapiens
ggcaagggcuuuggggaua

SEQ ID NO: 1515443 - RNA, 19 nt, Homo sapiens
ccagagugcggcaaagguu

SEQ ID NO: 1515444 - RNA, 19 nt, Homo sapiens
ugauuucucagccgaauga

SEQ ID NO: 1515445 - RNA, 19 nt, Homo sapiens
caagggcuuuggcgacagu

SEQ ID NO: 1515446 - RNA, 19 nt, Homo sapiens
ggugagaagcccuacaagu

SEQ ID NO: 1515447 - RNA, 19 nt, Homo sapiens
agauuuggcuccagaucau

SEQ ID NO: 1515448 - RNA, 19 nt, Homo sapiens
agccauauaucugcacuga

SEQ ID NO: 1515449 - RNA, 19 nt, Homo sapiens
gggccaggcuaguagugau

SEQ ID NO: 1515450 - RNA, 19 nt, Homo sapiens
gauuggagacaguaaccuu

SEQ ID NO: 1515451 - RNA, 19 nt, Homo sapiens
gcucugcccggaucaaaca

SEQ ID NO: 1515452 - RNA, 19 nt, Homo sapiens
gggaggaagaauagauaga

SEQ ID NO: 1515453 - RNA, 19 nt, Homo sapiens
cagcucagcccgagucaag

SEQ ID NO: 1515454 - RNA, 19 nt, Homo sapiens
guaggaaaugucucucuca

SEQ ID NO: 1515455 - RNA, 19 nt, Homo sapiens
cacaguaggcauucaauac

SEQ ID NO: 1515456 - RNA, 19 nt, Homo sapiens
cugaaggcauccagaacug

SEQ ID NO: 1515457 - RNA, 19 nt, Homo sapiens
ccugacgcccuuugggaua

SEQ ID NO: 1515458 - RNA, 19 nt, Homo sapiens
gguucaaggaagaagauuu

SEQ ID NO: 1515459 - RNA, 19 nt, Homo sapiens
gaaugaguuugaacauacc

SEQ ID NO: 1515460 - RNA, 19 nt, Homo sapiens
acuuauggguccagagaga

SEQ ID NO: 1515461 - RNA, 19 nt, Homo sapiens
uggagacaguaaccuugaa

SEQ ID NO: 1515462 - RNA, 19 nt, Homo sapiens
gggagaaggaagggaagaa

SEQ ID NO: 1515463 - RNA, 19 nt, Homo sapiens
gaagcucugaccuggugaa

SEQ ID NO: 1515464 - RNA, 19 nt, Homo sapiens
aaaugucucucucaaaccu

SEQ ID NO: 1515465 - RNA, 19 nt, Homo sapiens
caggacaagccauauaucu

SEQ ID NO: 1515466 - RNA, 19 nt, Homo sapiens
gcccuacaaguguggcaua

SEQ ID NO: 1515467 - RNA, 19 nt, Homo sapiens
ugaaguaggaaaugucucu

SEQ ID NO: 1515468 - RNA, 19 nt, Homo sapiens
ccuugaagcucaggaaacu

SEQ ID NO: 1515469 - RNA, 19 nt, Homo sapiens
ggagacaguaaccuugaag

SEQ ID NO: 1515470 - RNA, 19 nt, Homo sapiens
gcagcaacaggacuggaau

SEQ ID NO: 1515471 - RNA, 19 nt, Homo sapiens
cagaguguggcaaggguuu

SEQ ID NO: 1515472 - RNA, 19 nt, Homo sapiens
cagagugcggcaaagguuu

SEQ ID NO: 1515473 - RNA, 19 nt, Homo sapiens
gcuuccggcugaguucuga

SEQ ID NO: 1515474 - RNA, 19 nt, Homo sapiens
agaaaggggaggaagaaua

SEQ ID NO: 1515475 - RNA, 19 nt, Homo sapiens
ggaagaaaggggaggaaga

SEQ ID NO: 1515476 - RNA, 19 nt, Homo sapiens
ccauacaagugugcagagu

SEQ ID NO: 1515477 - RNA, 19 nt, Homo sapiens
cuaccucuguccugaaugc

SEQ ID NO: 1515478 - RNA, 19 nt, Homo sapiens
ucaaacaccagcggacuca

SEQ ID NO: 1515479 - RNA, 19 nt, Homo sapiens
ggcagcaacaggacuggaa

SEQ ID NO: 1515480 - RNA, 19 nt, Homo sapiens
uaaccuugaagcucaggaa

SEQ ID NO: 1515481 - RNA, 19 nt, Homo sapiens
gauagaaauagggauugga

SEQ ID NO: 1515482 - RNA, 19 nt, Homo sapiens
gcacauggcugagaagaaa

SEQ ID NO: 1515483 - RNA, 19 nt, Homo sapiens
gcucaaagcucccagagaa

SEQ ID NO: 1515484 - RNA, 19 nt, Homo sapiens
ggaaauagaagcuaagaaa

SEQ ID NO: 1515485 - RNA, 19 nt, Homo sapiens
ggaacaagcuaggaucauu

SEQ ID NO: 1515486 - RNA, 19 nt, Homo sapiens
ugaaggaacugcaugaaga

SEQ ID NO: 1515487 - RNA, 19 nt, Homo sapiens
aagcagagcucauucauca

SEQ ID NO: 1515488 - RNA, 19 nt, Homo sapiens
caaaggaccacacguguaa

SEQ ID NO: 1515489 - RNA, 19 nt, Homo sapiens
guaguaaucuagugacaga

SEQ ID NO: 1515490 - RNA, 19 nt, Homo sapiens
gcuagaagcuccagcaaag

SEQ ID NO: 1515491 - RNA, 19 nt, Homo sapiens
gaagacagaaauucagaaa

SEQ ID NO: 1515492 - RNA, 19 nt, Homo sapiens
aagcagaacucuacacuag

SEQ ID NO: 1515493 - RNA, 19 nt, Homo sapiens
uggaagagguguuagaaga

SEQ ID NO: 1515494 - RNA, 19 nt, Homo sapiens
ccacuuggcuggaccuugu

SEQ ID NO: 1515495 - RNA, 19 nt, Homo sapiens
gaacaagcuaggaucauug

SEQ ID NO: 1515496 - RNA, 19 nt, Homo sapiens
gagaaaggguuaaaauaga

SEQ ID NO: 1515497 - RNA, 19 nt, Homo sapiens
gagaagcagugcagggaau

SEQ ID NO: 1515498 - RNA, 19 nt, Homo sapiens
gagagaagacagaaauuca

SEQ ID NO: 1515499 - RNA, 19 nt, Homo sapiens
gcagagcucauucaucaga

SEQ ID NO: 1515500 - RNA, 19 nt, Homo sapiens
uggcgcagcucaucauuga

SEQ ID NO: 1515501 - RNA, 19 nt, Homo sapiens
gcacaagguaguaaucuag

SEQ ID NO: 1515502 - RNA, 19 nt, Homo sapiens
gaaauagaagcuaagaaag

SEQ ID NO: 1515503 - RNA, 19 nt, Homo sapiens
aagagaagcucgaaagcau

SEQ ID NO: 1515504 - RNA, 19 nt, Homo sapiens
gagaagacagaaauucaga

SEQ ID NO: 1515505 - RNA, 19 nt, Homo sapiens
caagaguggaccaaacuuu

SEQ ID NO: 1515506 - RNA, 19 nt, Homo sapiens
gagcaagaguggaccaaac

SEQ ID NO: 1515507 - RNA, 19 nt, Homo sapiens
agagggaaauagaagcuaa

SEQ ID NO: 1515508 - RNA, 19 nt, Homo sapiens
gggaauggauaugaucuca

SEQ ID NO: 1515509 - RNA, 19 nt, Homo sapiens
ccagagaggcccagccaaa

SEQ ID NO: 1515510 - RNA, 19 nt, Homo sapiens
gaagagaagcucgaaagca

SEQ ID NO: 1515511 - RNA, 19 nt, Homo sapiens
ccaaaggaccacacgugua

SEQ ID NO: 1515512 - RNA, 19 nt, Homo sapiens
gagagugacuuggagaucu

SEQ ID NO: 1515513 - RNA, 19 nt, Homo sapiens
ggauaaggaaggaugcaaa

SEQ ID NO: 1515514 - RNA, 19 nt, Homo sapiens
gaagagcacauggcugaga

SEQ ID NO: 1515515 - RNA, 19 nt, Homo sapiens
aagaguggaccaaacuuua

SEQ ID NO: 1515516 - RNA, 19 nt, Homo sapiens
guaaucuagugacagagaa

SEQ ID NO: 1515517 - RNA, 19 nt, Homo sapiens
cagcucagguccacuucaa

SEQ ID NO: 1515518 - RNA, 19 nt, Homo sapiens
gggugauccuggagaguuu

SEQ ID NO: 1515519 - RNA, 19 nt, Homo sapiens
cauaugagaggccaucuau

SEQ ID NO: 1515520 - RNA, 19 nt, Homo sapiens
gcagugcagggaauggaua

SEQ ID NO: 1515521 - RNA, 19 nt, Homo sapiens
gagaugauccaguccuugu

SEQ ID NO: 1515522 - RNA, 19 nt, Homo sapiens
caagguaguaaucuaguga

SEQ ID NO: 1515523 - RNA, 19 nt, Homo sapiens
ggaaggaugcaaagggaau

SEQ ID NO: 1515524 - RNA, 19 nt, Homo sapiens
gagagagaagacagaaauu

SEQ ID NO: 1515525 - RNA, 19 nt, Homo sapiens
ugagagagaagacagaaau

SEQ ID NO: 1515526 - RNA, 19 nt, Homo sapiens
ggaacacuguggagauggu

SEQ ID NO: 1515527 - RNA, 19 nt, Homo sapiens
gcaggaacacuguggagau

SEQ ID NO: 1515528 - RNA, 19 nt, Homo sapiens
ucuagccucucacuacuga

SEQ ID NO: 1515529 - RNA, 19 nt, Homo sapiens
caggaacacuguggagaug

SEQ ID NO: 1515530 - RNA, 19 nt, Homo sapiens
cagguccacuucaacagaa

SEQ ID NO: 1515531 - RNA, 19 nt, Homo sapiens
gcaccgaggagcucucugu

SEQ ID NO: 1515532 - RNA, 19 nt, Homo sapiens
uagaagcuccagcaaagaa

SEQ ID NO: 1515533 - RNA, 19 nt, Homo sapiens
ccaggaagcagagcucauu

SEQ ID NO: 1515534 - RNA, 19 nt, Homo sapiens
gcccuugucucgcucaaag

SEQ ID NO: 1515535 - RNA, 19 nt, Homo sapiens
gcagagcgaaggagagaca

SEQ ID NO: 1515536 - RNA, 19 nt, Homo sapiens
uggcagcucugaggcguaa

SEQ ID NO: 1515537 - RNA, 19 nt, Homo sapiens
uggaaucccugcugagagu

SEQ ID NO: 1515538 - RNA, 19 nt, Homo sapiens
gcauaugagaggccaucua

SEQ ID NO: 1515539 - RNA, 19 nt, Homo sapiens
cgaaggagagacaggagaa

SEQ ID NO: 1515540 - RNA, 19 nt, Homo sapiens
aagggaggauggccacuug

SEQ ID NO: 1515541 - RNA, 19 nt, Homo sapiens
gaagggaggauggccacuu

SEQ ID NO: 1515542 - RNA, 19 nt, Homo sapiens
ccacucugcaggagaauau

SEQ ID NO: 1515543 - RNA, 19 nt, Homo sapiens
ucacaaacaaccaagagau

SEQ ID NO: 1515544 - RNA, 19 nt, Homo sapiens
gaaguuuucugaauuucug

SEQ ID NO: 1515545 - RNA, 19 nt, Homo sapiens
gauaaggaaggaugcaaag

SEQ ID NO: 1515546 - RNA, 19 nt, Homo sapiens
gugcccagcugcaggaaca

SEQ ID NO: 1515547 - RNA, 19 nt, Homo sapiens
gaaggaacugcaugaagag

SEQ ID NO: 1515548 - RNA, 19 nt, Homo sapiens
gaaaagaaaagugaaggaa

SEQ ID NO: 1515549 - RNA, 19 nt, Homo sapiens
gaagcagagcucauucauc

SEQ ID NO: 1515550 - RNA, 19 nt, Homo sapiens
ggaagcagagcucauucau

SEQ ID NO: 1515551 - RNA, 19 nt, Homo sapiens
ccaccugugugacaagaca

SEQ ID NO: 1515552 - RNA, 19 nt, Homo sapiens
gaggacacccuggaagaga

SEQ ID NO: 1515553 - RNA, 19 nt, Homo sapiens
aagagcacauggcugagaa

SEQ ID NO: 1515554 - RNA, 19 nt, Homo sapiens
caagcagaacucuacacua

SEQ ID NO: 1515555 - RNA, 19 nt, Homo sapiens
gaagcuaagaaagaauuug

SEQ ID NO: 1515556 - RNA, 19 nt, Homo sapiens
ggaagagguguuagaagag

SEQ ID NO: 1515557 - RNA, 19 nt, Homo sapiens
agucagucauucagugauu

SEQ ID NO: 1515558 - RNA, 19 nt, Homo sapiens
ugggaucacugcgagauga

SEQ ID NO: 1515559 - RNA, 19 nt, Homo sapiens
gcaagaguggaccaaacuu

SEQ ID NO: 1515560 - RNA, 19 nt, Homo sapiens
ggcaucaccuucugcaacu

SEQ ID NO: 1515561 - RNA, 19 nt, Homo sapiens
gcucagguccacuucaaca

SEQ ID NO: 1515562 - RNA, 19 nt, Homo sapiens
cgggcagccuucagucaaa

SEQ ID NO: 1515563 - RNA, 19 nt, Homo sapiens
cugcugcacugccaggauu

SEQ ID NO: 1515564 - RNA, 19 nt, Homo sapiens
gugcagggaauggauauga

SEQ ID NO: 1515565 - RNA, 19 nt, Homo sapiens
gagaauauugcuggcauca

SEQ ID NO: 1515566 - RNA, 19 nt, Homo sapiens
gccaguggaagagguguua

SEQ ID NO: 1515567 - RNA, 19 nt, Homo sapiens
ggaccacacguguaauuuu

SEQ ID NO: 1515568 - RNA, 19 nt, Homo sapiens
gacauaugccucagucagu

SEQ ID NO: 1515569 - RNA, 19 nt, Homo sapiens
gcagggaauggauaugauc

SEQ ID NO: 1515570 - RNA, 19 nt, Homo sapiens
agacaggcacccacagcua

SEQ ID NO: 1515571 - RNA, 19 nt, Homo sapiens
caaagcucccagagaaguu

SEQ ID NO: 1515572 - RNA, 19 nt, Homo sapiens
gacugggacuggucugaca

SEQ ID NO: 1515573 - RNA, 19 nt, Homo sapiens
caaacuuuauggggaaaua

SEQ ID NO: 1515574 - RNA, 19 nt, Homo sapiens
auucagugauugauccaaa

SEQ ID NO: 1515575 - RNA, 19 nt, Homo sapiens
agacagaaauucagaaaac

SEQ ID NO: 1515576 - RNA, 19 nt, Homo sapiens
caucagagggaaauagaag

SEQ ID NO: 1515577 - RNA, 19 nt, Homo sapiens
gcauuagcacccuggaugu

SEQ ID NO: 1515578 - RNA, 19 nt, Homo sapiens
cagcagagcgaaggagaga

SEQ ID NO: 1515579 - RNA, 19 nt, Homo sapiens
gaguggaccaaacuuuaug

SEQ ID NO: 1515580 - RNA, 19 nt, Homo sapiens
gugacaagacauucaugaa

SEQ ID NO: 1515581 - RNA, 19 nt, Homo sapiens
ggccuucucucagcuccuu

SEQ ID NO: 1515582 - RNA, 19 nt, Homo sapiens
caacaaggcuggagacuau

SEQ ID NO: 1515583 - RNA, 19 nt, Homo sapiens
gggaucaucuugugucaua

SEQ ID NO: 1515584 - RNA, 19 nt, Homo sapiens
gaacugggcuaucucuuca

SEQ ID NO: 1515585 - RNA, 19 nt, Homo sapiens
caucuugugucauaucuua

SEQ ID NO: 1515586 - RNA, 19 nt, Homo sapiens
caacgaagccuuaaaguuc

SEQ ID NO: 1515587 - RNA, 19 nt, Homo sapiens
gauguuaagugccugcuuu

SEQ ID NO: 1515588 - RNA, 19 nt, Homo sapiens
gaagaaagccauugaguac

SEQ ID NO: 1515589 - RNA, 19 nt, Homo sapiens
gcaaugacccuguguugaa

SEQ ID NO: 1515590 - RNA, 19 nt, Homo sapiens
ggacacagaauccuagaaa

SEQ ID NO: 1515591 - RNA, 19 nt, Homo sapiens
gagagaagauggccaacau

SEQ ID NO: 1515592 - RNA, 19 nt, Homo sapiens
ggacugcacuguacuaugc

SEQ ID NO: 1515593 - RNA, 19 nt, Homo sapiens
gaaggucaauaaagcagaa

SEQ ID NO: 1515594 - RNA, 19 nt, Homo sapiens
uaaagaaggucaauaaagc

SEQ ID NO: 1515595 - RNA, 19 nt, Homo sapiens
ggaaacaugaccacaguaa

SEQ ID NO: 1515596 - RNA, 19 nt, Homo sapiens
ggagaaagcgccagacaau

SEQ ID NO: 1515597 - RNA, 19 nt, Homo sapiens
gauagaaacuuugaacaag

SEQ ID NO: 1515598 - RNA, 19 nt, Homo sapiens
gaaaggcaauguacuucau

SEQ ID NO: 1515599 - RNA, 19 nt, Homo sapiens
agacauuccugccuucuuu

SEQ ID NO: 1515600 - RNA, 19 nt, Homo sapiens
acaaggcgguacagucuua

SEQ ID NO: 1515601 - RNA, 19 nt, Homo sapiens
agaaagcgccagacaauuu

SEQ ID NO: 1515602 - RNA, 19 nt, Homo sapiens
caagacaucccauccauga

SEQ ID NO: 1515603 - RNA, 19 nt, Homo sapiens
gaucgugucuccacuucuu

SEQ ID NO: 1515604 - RNA, 19 nt, Homo sapiens
gagagcaacuacacagaga

SEQ ID NO: 1515605 - RNA, 19 nt, Homo sapiens
ugagaccgcuucuguguug

SEQ ID NO: 1515606 - RNA, 19 nt, Homo sapiens
cugaggcaauugaguauua

SEQ ID NO: 1515607 - RNA, 19 nt, Homo sapiens
gaugaggccuauagacaga

SEQ ID NO: 1515608 - RNA, 19 nt, Homo sapiens
gaaauacgcaagacaguca

SEQ ID NO: 1515609 - RNA, 19 nt, Homo sapiens
ccacagaacugggcuaucu

SEQ ID NO: 1515610 - RNA, 19 nt, Homo sapiens
caaguucgaccucgccuua

SEQ ID NO: 1515611 - RNA, 19 nt, Homo sapiens
ggaagaaggcagaaaguuc

SEQ ID NO: 1515612 - RNA, 19 nt, Homo sapiens
aauccaagccuccaucuua

SEQ ID NO: 1515613 - RNA, 19 nt, Homo sapiens
cgaagaaagccauugagua

SEQ ID NO: 1515614 - RNA, 19 nt, Homo sapiens
ccaugaaacuggacaagga

SEQ ID NO: 1515615 - RNA, 19 nt, Homo sapiens
guugauggcugaccugaug

SEQ ID NO: 1515616 - RNA, 19 nt, Homo sapiens
ugacagggaucaucuugug

SEQ ID NO: 1515617 - RNA, 19 nt, Homo sapiens
gaugagagcaauauugaug

SEQ ID NO: 1515618 - RNA, 19 nt, Homo sapiens
caaacuugcuuucaacuac

SEQ ID NO: 1515619 - RNA, 19 nt, Homo sapiens
ugaaggaggugcagaaguc

SEQ ID NO: 1515620 - RNA, 19 nt, Homo sapiens
gaaguucuuuaaagccuau

SEQ ID NO: 1515621 - RNA, 19 nt, Homo sapiens
ucaacuaccugaaggacaa

SEQ ID NO: 1515622 - RNA, 19 nt, Homo sapiens
gaagcggccaucaaucuuu

SEQ ID NO: 1515623 - RNA, 19 nt, Homo sapiens
gaucuugaauccuguaguc

SEQ ID NO: 1515624 - RNA, 19 nt, Homo sapiens
gagaagggauucagaaaau

SEQ ID NO: 1515625 - RNA, 19 nt, Homo sapiens
gaauugggcacgcuuaugu

SEQ ID NO: 1515626 - RNA, 19 nt, Homo sapiens
uggcucaggucagguauua

SEQ ID NO: 1515627 - RNA, 19 nt, Homo sapiens
ggagcaaccagaaaugauu

SEQ ID NO: 1515628 - RNA, 19 nt, Homo sapiens
gagaaccgcaucaccauug

SEQ ID NO: 1515629 - RNA, 19 nt, Homo sapiens
gcaagagaaggaaacauga

SEQ ID NO: 1515630 - RNA, 19 nt, Homo sapiens
ugaaaucauugaccgagaa

SEQ ID NO: 1515631 - RNA, 19 nt, Homo sapiens
gcuacaaggccuaugagua

SEQ ID NO: 1515632 - RNA, 19 nt, Homo sapiens
caacaaguccugcuacaag

SEQ ID NO: 1515633 - RNA, 19 nt, Homo sapiens
gcugggaucauuuacuaua

SEQ ID NO: 1515634 - RNA, 19 nt, Homo sapiens
aagcggccaucaaucuuua

SEQ ID NO: 1515635 - RNA, 19 nt, Homo sapiens
agacugagcagaaccauga

SEQ ID NO: 1515636 - RNA, 19 nt, Homo sapiens
aaaagaagcugugauagaa

SEQ ID NO: 1515637 - RNA, 19 nt, Homo sapiens
uggcugggaucauuuacua

SEQ ID NO: 1515638 - RNA, 19 nt, Homo sapiens
gaguacagccugaaggaaa

SEQ ID NO: 1515639 - RNA, 19 nt, Homo sapiens
gcaacuacacagagaagaa

SEQ ID NO: 1515640 - RNA, 19 nt, Homo sapiens
agcaaugacuccucccuua

SEQ ID NO: 1515641 - RNA, 19 nt, Homo sapiens
gaaggaagaaggcagaaag

SEQ ID NO: 1515642 - RNA, 19 nt, Homo sapiens
gaauucaggacaccaaaga

SEQ ID NO: 1515643 - RNA, 19 nt, Homo sapiens
uggcaaagguuuacaagag

SEQ ID NO: 1515644 - RNA, 19 nt, Homo sapiens
gggcuaguguguaguuuca

SEQ ID NO: 1515645 - RNA, 19 nt, Homo sapiens
gguacagucuuauaaggau

SEQ ID NO: 1515646 - RNA, 19 nt, Homo sapiens
cagcgucgguuuccaagga

SEQ ID NO: 1515647 - RNA, 19 nt, Homo sapiens
gaaaauggucaucaaauug

SEQ ID NO: 1515648 - RNA, 19 nt, Homo sapiens
gcaaugacuccucccuuau

SEQ ID NO: 1515649 - RNA, 19 nt, Homo sapiens
ccaucaaccuacugaaguu

SEQ ID NO: 1515650 - RNA, 19 nt, Homo sapiens
uggcugaccugauguuuag

SEQ ID NO: 1515651 - RNA, 19 nt, Homo sapiens
ccagcgggcauccaucuua

SEQ ID NO: 1515652 - RNA, 19 nt, Homo sapiens
uggcauggcugguuugaca

SEQ ID NO: 1515653 - RNA, 19 nt, Homo sapiens
aaacuggccuggaaguaca

SEQ ID NO: 1515654 - RNA, 19 nt, Homo sapiens
gcagaauugggcacgcuua

SEQ ID NO: 1515655 - RNA, 19 nt, Homo sapiens
guagaaaugggacacagaa

SEQ ID NO: 1515656 - RNA, 19 nt, Homo sapiens
ccucauuuaugcucacaaa

SEQ ID NO: 1515657 - RNA, 19 nt, Homo sapiens
caccauggcccucauuuau

SEQ ID NO: 1515658 - RNA, 19 nt, Homo sapiens
ccaacgaagccuuaaaguu

SEQ ID NO: 1515659 - RNA, 19 nt, Homo sapiens
uaaucgaucugcuaagaag

SEQ ID NO: 1515660 - RNA, 19 nt, Homo sapiens
gaggcugcccagaagauua

SEQ ID NO: 1515661 - RNA, 19 nt, Homo sapiens
ggaaaggcaauguacuuca

SEQ ID NO: 1515662 - RNA, 19 nt, Homo sapiens
acacagagaagaaggaguu

SEQ ID NO: 1515663 - RNA, 19 nt, Homo sapiens
agaaggcccuggaggucua

SEQ ID NO: 1515664 - RNA, 19 nt, Homo sapiens
gcuacugggcgaugccuua

SEQ ID NO: 1515665 - RNA, 19 nt, Homo sapiens
gacaggcgccucuacauca

SEQ ID NO: 1515666 - RNA, 19 nt, Homo sapiens
ugaagaaccaagugaaaga

SEQ ID NO: 1515667 - RNA, 19 nt, Homo sapiens
gcaugagcuugcaagagaa

SEQ ID NO: 1515668 - RNA, 19 nt, Homo sapiens
aaagaugagagcaauauug

SEQ ID NO: 1515669 - RNA, 19 nt, Homo sapiens
ucagugaccuggaaagcau

SEQ ID NO: 1515670 - RNA, 19 nt, Homo sapiens
ccuauggaguccucaaaga

SEQ ID NO: 1515671 - RNA, 19 nt, Homo sapiens
gaccgcaugcugaagauuu

SEQ ID NO: 1515672 - RNA, 19 nt, Homo sapiens
cuacaaggccuaugaguac

SEQ ID NO: 1515673 - RNA, 19 nt, Homo sapiens
gggagaaggcuaacaugga

SEQ ID NO: 1515674 - RNA, 19 nt, Homo sapiens
gagaugagcagcaaugacu

SEQ ID NO: 1515675 - RNA, 19 nt, Homo sapiens
caugaugaaugauguuaag

SEQ ID NO: 1515676 - RNA, 19 nt, Homo sapiens
gcgcugaacaugcuaagga

SEQ ID NO: 1515677 - RNA, 19 nt, Homo sapiens
ccaccauggcccucauuua

SEQ ID NO: 1515678 - RNA, 19 nt, Homo sapiens
ccaaggcgcguaugcaguu

SEQ ID NO: 1515679 - RNA, 19 nt, Homo sapiens
acucagagcuagagaaugc

SEQ ID NO: 1515680 - RNA, 19 nt, Homo sapiens
aaacaugaccacaguaagu

SEQ ID NO: 1515681 - RNA, 19 nt, Homo sapiens
gaagccaucaaccuacuga

SEQ ID NO: 1515682 - RNA, 19 nt, Homo sapiens
gaauggaggucaacuauau

SEQ ID NO: 1515683 - RNA, 19 nt, Homo sapiens
gcagaagacuguuggauug

SEQ ID NO: 1515684 - RNA, 19 nt, Homo sapiens
gaaggaacuugcagaaauc

SEQ ID NO: 1515685 - RNA, 19 nt, Homo sapiens
caaaaccgcugcuaaauug

SEQ ID NO: 1515686 - RNA, 19 nt, Homo sapiens
gcaagaaccagaaagagaa

SEQ ID NO: 1515687 - RNA, 19 nt, Homo sapiens
acaagaaucuaucacugua

SEQ ID NO: 1515688 - RNA, 19 nt, Homo sapiens
guacugaagucuuuauugg

SEQ ID NO: 1515689 - RNA, 19 nt, Homo sapiens
uguuggagcuguaauagua

SEQ ID NO: 1515690 - RNA, 19 nt, Homo sapiens
agaaggaacuugcagaaau

SEQ ID NO: 1515691 - RNA, 19 nt, Homo sapiens
caaaggagacaacauuuau

SEQ ID NO: 1515692 - RNA, 19 nt, Homo sapiens
ccaaaggagacaacauuua

SEQ ID NO: 1515693 - RNA, 19 nt, Homo sapiens
caacuggaguccggcuuua

SEQ ID NO: 1515694 - RNA, 19 nt, Homo sapiens
gagacucuguuuaucacua

SEQ ID NO: 1515695 - RNA, 19 nt, Homo sapiens
gcaagcacauucaccaagu

SEQ ID NO: 1515696 - RNA, 19 nt, Homo sapiens
gcugcuaaauugucaacua

SEQ ID NO: 1515697 - RNA, 19 nt, Homo sapiens
gcucacuucuuacagauug

SEQ ID NO: 1515698 - RNA, 19 nt, Homo sapiens
ucaccagacuauccguuua

SEQ ID NO: 1515699 - RNA, 19 nt, Homo sapiens
ggagacaacauuuaugaau

SEQ ID NO: 1515700 - RNA, 19 nt, Homo sapiens
guugauuucuguuaacuug

SEQ ID NO: 1515701 - RNA, 19 nt, Homo sapiens
acaaagaguugaugacagu

SEQ ID NO: 1515702 - RNA, 19 nt, Homo sapiens
gaucuaaaauguccacuga

SEQ ID NO: 1515703 - RNA, 19 nt, Homo sapiens
gcuaaauugucaacuagug

SEQ ID NO: 1515704 - RNA, 19 nt, Homo sapiens
cuugaaagauuugggauuu

SEQ ID NO: 1515705 - RNA, 19 nt, Homo sapiens
cuccagaccucgguucuua

SEQ ID NO: 1515706 - RNA, 19 nt, Homo sapiens
gcacaaagaguugaugaca

SEQ ID NO: 1515707 - RNA, 19 nt, Homo sapiens
cgauggagaucaacgugaa

SEQ ID NO: 1515708 - RNA, 19 nt, Homo sapiens
uuacugagacucuguuuau

SEQ ID NO: 1515709 - RNA, 19 nt, Homo sapiens
gaugggaacuuuuguuuuc

SEQ ID NO: 1515710 - RNA, 19 nt, Homo sapiens
cccaggaucugucuaugaa

SEQ ID NO: 1515711 - RNA, 19 nt, Homo sapiens
ucagaaucacugugcauua

SEQ ID NO: 1515712 - RNA, 19 nt, Homo sapiens
gguguucuuucuugacauu

SEQ ID NO: 1515713 - RNA, 19 nt, Homo sapiens
gaaucacugugcauuacug

SEQ ID NO: 1515714 - RNA, 19 nt, Homo sapiens
uacaaaagcuucaaucaga

SEQ ID NO: 1515715 - RNA, 19 nt, Homo sapiens
gaugacaguccaagcacua

SEQ ID NO: 1515716 - RNA, 19 nt, Homo sapiens
uccaucugcucacuucuua

SEQ ID NO: 1515717 - RNA, 19 nt, Homo sapiens
ggaguccggcuuuaacuau

SEQ ID NO: 1515718 - RNA, 19 nt, Homo sapiens
gaguccggcuuuaacuauu

SEQ ID NO: 1515719 - RNA, 19 nt, Homo sapiens
gcaaaaccgcugcuaaauu

SEQ ID NO: 1515720 - RNA, 19 nt, Homo sapiens
gagaucaacgugaaagugu

SEQ ID NO: 1515721 - RNA, 19 nt, Homo sapiens
caauguuggagcuguaaua

SEQ ID NO: 1515722 - RNA, 19 nt, Homo sapiens
gaagacuguuggauugaac

SEQ ID NO: 1515723 - RNA, 19 nt, Homo sapiens
cagaaucacugugcauuac

SEQ ID NO: 1515724 - RNA, 19 nt, Homo sapiens
cuaaaguucuccucuccau

SEQ ID NO: 1515725 - RNA, 19 nt, Homo sapiens
ggagaucaacgugaaagug

SEQ ID NO: 1515726 - RNA, 19 nt, Homo sapiens
caagaaucuaucacuguaa

SEQ ID NO: 1515727 - RNA, 19 nt, Homo sapiens
ugaauggaggucaacuaua

SEQ ID NO: 1515728 - RNA, 19 nt, Homo sapiens
aaggagacaacauuuauga

SEQ ID NO: 1515729 - RNA, 19 nt, Homo sapiens
ggacccuccucccaacugu

SEQ ID NO: 1515730 - RNA, 19 nt, Homo sapiens
uugcagaaaucacauugga

SEQ ID NO: 1515731 - RNA, 19 nt, Homo sapiens
caagcacauucaccaagug

SEQ ID NO: 1515732 - RNA, 19 nt, Homo sapiens
ggagggguguucuuucuug

SEQ ID NO: 1515733 - RNA, 19 nt, Homo sapiens
gccaaggugugaucugucu

SEQ ID NO: 1515734 - RNA, 19 nt, Homo sapiens
ggaacuugcagaaaucaca

SEQ ID NO: 1515735 - RNA, 19 nt, Homo sapiens
agaagacuguuggauugaa

SEQ ID NO: 1515736 - RNA, 19 nt, Homo sapiens
ucucguuucuacuuaaaug

SEQ ID NO: 1515737 - RNA, 19 nt, Homo sapiens
ccagaccucgguucuuauu

SEQ ID NO: 1515738 - RNA, 19 nt, Homo sapiens
cagccaaggugugaucugu

SEQ ID NO: 1515739 - RNA, 19 nt, Homo sapiens
gaucaacgugaaaguguuc

SEQ ID NO: 1515740 - RNA, 19 nt, Homo sapiens
ucagaaggaacuugcagaa

SEQ ID NO: 1515741 - RNA, 19 nt, Homo sapiens
ucacugugcauuacugaga

SEQ ID NO: 1515742 - RNA, 19 nt, Homo sapiens
ccuuguugauuucuguuaa

SEQ ID NO: 1515743 - RNA, 19 nt, Homo sapiens
caacagagcagagcaugac

SEQ ID NO: 1515744 - RNA, 19 nt, Homo sapiens
caccagacuauccguuuaa

SEQ ID NO: 1515745 - RNA, 19 nt, Homo sapiens
cuaaaagaauucagaagga

SEQ ID NO: 1515746 - RNA, 19 nt, Homo sapiens
ccacugaggcacaaagagu

SEQ ID NO: 1515747 - RNA, 19 nt, Homo sapiens
ucagcaagaaccagaaaga

SEQ ID NO: 1515748 - RNA, 19 nt, Homo sapiens
aguccggcuuuaacuauuu

SEQ ID NO: 1515749 - RNA, 19 nt, Homo sapiens
gaacuugcagaaaucacau

SEQ ID NO: 1515750 - RNA, 19 nt, Homo sapiens
cagaaggaacuugcagaaa

SEQ ID NO: 1515751 - RNA, 19 nt, Homo sapiens
cugcuaaauugucaacuag

SEQ ID NO: 1515752 - RNA, 19 nt, Homo sapiens
aauguagugcuuaggguua

SEQ ID NO: 1515753 - RNA, 19 nt, Homo sapiens
agaccucgguucuuauuuu

SEQ ID NO: 1515754 - RNA, 19 nt, Homo sapiens
ccacacaguacaugaccaa

SEQ ID NO: 1515755 - RNA, 19 nt, Homo sapiens
cggcuuuaacuauuucuaa

SEQ ID NO: 1515756 - RNA, 19 nt, Homo sapiens
uaacagccaaggugugauc

SEQ ID NO: 1515757 - RNA, 19 nt, Homo sapiens
cuuagggaccugccacuuu

SEQ ID NO: 1515758 - RNA, 19 nt, Homo sapiens
ccaagcgguacgccacaua

SEQ ID NO: 1515759 - RNA, 19 nt, Homo sapiens
cacaguacaugaccaacag

SEQ ID NO: 1515760 - RNA, 19 nt, Homo sapiens
cagcaucgccacacaguac

SEQ ID NO: 1515761 - RNA, 19 nt, Homo sapiens
cgcagaagacuguuggauu

SEQ ID NO: 1515762 - RNA, 19 nt, Homo sapiens
gaaguuccgauggagauca

SEQ ID NO: 1515763 - RNA, 19 nt, Homo sapiens
gucuggacaucuuaaagga

SEQ ID NO: 1515764 - RNA, 19 nt, Homo sapiens
gcacucaauaaaucacugu

SEQ ID NO: 1515765 - RNA, 19 nt, Homo sapiens
uuagggaccugccacuuuu

SEQ ID NO: 1515766 - RNA, 19 nt, Homo sapiens
gcuguaauaguaagagcuu

SEQ ID NO: 1515767 - RNA, 19 nt, Homo sapiens
gcagcaucgccacacagua

SEQ ID NO: 1515768 - RNA, 19 nt, Homo sapiens
caucuucccaucccaguuc

SEQ ID NO: 1515769 - RNA, 19 nt, Homo sapiens
aaaguucuccucuccaucu

SEQ ID NO: 1515770 - RNA, 19 nt, Homo sapiens
gauggagaucaacgugaaa

SEQ ID NO: 1515771 - RNA, 19 nt, Homo sapiens
cagaagacuguuggauuga

SEQ ID NO: 1515772 - RNA, 19 nt, Homo sapiens
agacucuguuuaucacuag

SEQ ID NO: 1515773 - RNA, 19 nt, Homo sapiens
uaugugaucuuugggaaaa

SEQ ID NO: 1515774 - RNA, 19 nt, Homo sapiens
uuucccaccucaucauaga

SEQ ID NO: 1515775 - RNA, 19 nt, Homo sapiens
agaucaacgugaaaguguu

SEQ ID NO: 1515776 - RNA, 19 nt, Homo sapiens
cgaacaagaaucuaucacu

SEQ ID NO: 1515777 - RNA, 19 nt, Homo sapiens
uaugaauggaggucaacua

SEQ ID NO: 1515778 - RNA, 19 nt, Homo sapiens
aaaggagacaacauuuaug

SEQ ID NO: 1515779 - RNA, 19 nt, Homo sapiens
cccaaaggagacaacauuu

SEQ ID NO: 1515780 - RNA, 19 nt, Homo sapiens
caucugcucacuucuuaca

SEQ ID NO: 1515781 - RNA, 19 nt, Homo sapiens
acccaaaggagacaacauu

SEQ ID NO: 1515782 - RNA, 19 nt, Homo sapiens
gaaaggugaugaaugaaua

SEQ ID NO: 1515783 - RNA, 19 nt, Homo sapiens
gagcaagauugauagauua

SEQ ID NO: 1515784 - RNA, 19 nt, Homo sapiens
ccagaaaggugaugaauga

SEQ ID NO: 1515785 - RNA, 19 nt, Homo sapiens
ggacguguauggacaaauu

SEQ ID NO: 1515786 - RNA, 19 nt, Homo sapiens
ggagcaagauugauagauu

SEQ ID NO: 1515787 - RNA, 19 nt, Homo sapiens
gaacggcugugucauuaug

SEQ ID NO: 1515788 - RNA, 19 nt, Homo sapiens
gugaacggcugugucauua

SEQ ID NO: 1515789 - RNA, 19 nt, Homo sapiens
caacgaagacgggaaauga

SEQ ID NO: 1515790 - RNA, 19 nt, Homo sapiens
gaaugagugucucggaguu

SEQ ID NO: 1515791 - RNA, 19 nt, Homo sapiens
gcacaugcacacagacauu

SEQ ID NO: 1515792 - RNA, 19 nt, Homo sapiens
ccacaguccucaccucaau

SEQ ID NO: 1515793 - RNA, 19 nt, Homo sapiens
guacaagcaugcgaagaga

SEQ ID NO: 1515794 - RNA, 19 nt, Homo sapiens
ggugaagaaugcugagaug

SEQ ID NO: 1515795 - RNA, 19 nt, Homo sapiens
guccucaccucaauaaaug

SEQ ID NO: 1515796 - RNA, 19 nt, Homo sapiens
gcaaaggguggacauuuca

SEQ ID NO: 1515797 - RNA, 19 nt, Homo sapiens
caagauugauagauuagag

SEQ ID NO: 1515798 - RNA, 19 nt, Homo sapiens
ggguggacauuucagugua

SEQ ID NO: 1515799 - RNA, 19 nt, Homo sapiens
gacccagacuaugagaaua

SEQ ID NO: 1515800 - RNA, 19 nt, Homo sapiens
uuaugagugugccgaguua

SEQ ID NO: 1515801 - RNA, 19 nt, Homo sapiens
ggugaacggcugugucauu

SEQ ID NO: 1515802 - RNA, 19 nt, Homo sapiens
gggccugucucccuguuug

SEQ ID NO: 1515803 - RNA, 19 nt, Homo sapiens
gucaggagcaagauugaua

SEQ ID NO: 1515804 - RNA, 19 nt, Homo sapiens
ccauggaaguggaggaaau

SEQ ID NO: 1515805 - RNA, 19 nt, Homo sapiens
ugacacaaagguacagaaa

SEQ ID NO: 1515806 - RNA, 19 nt, Homo sapiens
cagaagagaggcugggauu

SEQ ID NO: 1515807 - RNA, 19 nt, Homo sapiens
gaaucaaggugcccaugac

SEQ ID NO: 1515808 - RNA, 19 nt, Homo sapiens
ggaaguggaggaaaucuac

SEQ ID NO: 1515809 - RNA, 19 nt, Homo sapiens
gguggacauuucaguguau

SEQ ID NO: 1515810 - RNA, 19 nt, Homo sapiens
gacauuagcaggcauaaaa

SEQ ID NO: 1515811 - RNA, 19 nt, Homo sapiens
gcacacagacauuuaucuc

SEQ ID NO: 1515812 - RNA, 19 nt, Homo sapiens
acacaaagguacagaaaau

SEQ ID NO: 1515813 - RNA, 19 nt, Homo sapiens
uagauuagagacgacauua

SEQ ID NO: 1515814 - RNA, 19 nt, Homo sapiens
ggugagguccauccaggua

SEQ ID NO: 1515815 - RNA, 19 nt, Homo sapiens
caguguaucucccagaaag

SEQ ID NO: 1515816 - RNA, 19 nt, Homo sapiens
cagcuucucuuuugaaaug

SEQ ID NO: 1515817 - RNA, 19 nt, Homo sapiens
gcaccaggaagucaagaug

SEQ ID NO: 1515818 - RNA, 19 nt, Homo sapiens
ugucacagcuucucuuuug

SEQ ID NO: 1515819 - RNA, 19 nt, Homo sapiens
acauuuaucucugcacuca

SEQ ID NO: 1515820 - RNA, 19 nt, Homo sapiens
ugcaaaggguggacauuuc

SEQ ID NO: 1515821 - RNA, 19 nt, Homo sapiens
cggaguugcucgugugugu

SEQ ID NO: 1515822 - RNA, 19 nt, Homo sapiens
aaacguugacacaaaggua

SEQ ID NO: 1515823 - RNA, 19 nt, Homo sapiens
ugcaaaggguggucauuca

SEQ ID NO: 1515824 - RNA, 19 nt, Homo sapiens
uggaggaaaucuacaagca

SEQ ID NO: 1515825 - RNA, 19 nt, Homo sapiens
augcugagauguccaagga

SEQ ID NO: 1515826 - RNA, 19 nt, Homo sapiens
gagccauccugagccugua

SEQ ID NO: 1515827 - RNA, 19 nt, Homo sapiens
cagggcacaugcacacaga

SEQ ID NO: 1515828 - RNA, 19 nt, Homo sapiens
gaagagaggcugggauucc

SEQ ID NO: 1515829 - RNA, 19 nt, Homo sapiens
acacagacacacacagaga

SEQ ID NO: 1515830 - RNA, 19 nt, Homo sapiens
agacacagacacacacaga

SEQ ID NO: 1515831 - RNA, 19 nt, Homo sapiens
gagcaccuccagcagaugu

SEQ ID NO: 1515832 - RNA, 19 nt, Homo sapiens
ugagguccauccagguaga

SEQ ID NO: 1515833 - RNA, 19 nt, Homo sapiens
cagccaaagccacaacuug

SEQ ID NO: 1515834 - RNA, 19 nt, Homo sapiens
acaguccucaccucaauaa

SEQ ID NO: 1515835 - RNA, 19 nt, Homo sapiens
ggugucacagcuucucuuu

SEQ ID NO: 1515836 - RNA, 19 nt, Homo sapiens
cccaugacccagacuauga

SEQ ID NO: 1515837 - RNA, 19 nt, Homo sapiens
gaugaaugaauaggacuga

SEQ ID NO: 1515838 - RNA, 19 nt, Homo sapiens
ucuuggaggugcugcagaa

SEQ ID NO: 1515839 - RNA, 19 nt, Homo sapiens
gauuagagacgacauuagc

SEQ ID NO: 1515840 - RNA, 19 nt, Homo sapiens
gcgaagagagacagaagag

SEQ ID NO: 1515841 - RNA, 19 nt, Homo sapiens
ugaaugaauaggacugaga

SEQ ID NO: 1515842 - RNA, 19 nt, Homo sapiens
ugaagaaugcugagauguc

SEQ ID NO: 1515843 - RNA, 19 nt, Homo sapiens
uaucucugcacucacauuu

SEQ ID NO: 1515844 - RNA, 19 nt, Homo sapiens
agaaaggugaugaaugaau

SEQ ID NO: 1515845 - RNA, 19 nt, Homo sapiens
ggcugcaccugccaacgaa

SEQ ID NO: 1515846 - RNA, 19 nt, Homo sapiens
ccugucagccuucaucaug

SEQ ID NO: 1515847 - RNA, 19 nt, Homo sapiens
ugacccagacuaugagaau

SEQ ID NO: 1515848 - RNA, 19 nt, Homo sapiens
ccagguagacacagacaca

SEQ ID NO: 1515849 - RNA, 19 nt, Homo sapiens
ccaagccugguugcucuua

SEQ ID NO: 1515850 - RNA, 19 nt, Homo sapiens
cgccaugugugcccuguca

SEQ ID NO: 1515851 - RNA, 19 nt, Homo sapiens
gcaagauugauagauuaga

SEQ ID NO: 1515852 - RNA, 19 nt, Homo sapiens
acaugcacacagacauuua

SEQ ID NO: 1515853 - RNA, 19 nt, Homo sapiens
ugguugcucuuacgcgaaa

SEQ ID NO: 1515854 - RNA, 19 nt, Homo sapiens
ccucgucccacguauagaa

SEQ ID NO: 1515855 - RNA, 19 nt, Homo sapiens
ccauccagguagacacaga

SEQ ID NO: 1515856 - RNA, 19 nt, Homo sapiens
gacgacauuagcaggcaua

SEQ ID NO: 1515857 - RNA, 19 nt, Homo sapiens
acaagcaugcgaagagaga

SEQ ID NO: 1515858 - RNA, 19 nt, Homo sapiens
aauaucaccuuggccuuca

SEQ ID NO: 1515859 - RNA, 19 nt, Homo sapiens
guaggagggugagguccau

SEQ ID NO: 1515860 - RNA, 19 nt, Homo sapiens
agaaucaaggugcccauga

SEQ ID NO: 1515861 - RNA, 19 nt, Homo sapiens
gaccauggaaguggaggaa

SEQ ID NO: 1515862 - RNA, 19 nt, Homo sapiens
ggucucagccaagaaucaa

SEQ ID NO: 1515863 - RNA, 19 nt, Homo sapiens
cugagcaccuccagcagau

SEQ ID NO: 1515864 - RNA, 19 nt, Homo sapiens
gguggguggcugugucuga

SEQ ID NO: 1515865 - RNA, 19 nt, Homo sapiens
uugcaaaggguggacauuu

SEQ ID NO: 1515866 - RNA, 19 nt, Homo sapiens
gcagccaaagccacaacuu

SEQ ID NO: 1515867 - RNA, 19 nt, Homo sapiens
gaaguggaggaaaucuaca

SEQ ID NO: 1515868 - RNA, 19 nt, Homo sapiens
ucucugcacucacauuuug

SEQ ID NO: 1515869 - RNA, 19 nt, Homo sapiens
cacaugcacacagacauuu

SEQ ID NO: 1515870 - RNA, 19 nt, Homo sapiens
cagugaauguggcaugcau

SEQ ID NO: 1515871 - RNA, 19 nt, Homo sapiens
gaguugcucgugugugugu

SEQ ID NO: 1515872 - RNA, 19 nt, Homo sapiens
gcucuuacgcgaaaaguug

SEQ ID NO: 1515873 - RNA, 19 nt, Homo sapiens
agccacaacuuggaagaug

SEQ ID NO: 1515874 - RNA, 19 nt, Homo sapiens
ggagcugcugggcuuuaaa

SEQ ID NO: 1515875 - RNA, 19 nt, Homo sapiens
gacguguauggacaaauuu

SEQ ID NO: 1515876 - RNA, 19 nt, Homo sapiens
gaaagacccuguaagauaa

SEQ ID NO: 1515877 - RNA, 19 nt, Homo sapiens
ggagacagcugugugaaua

SEQ ID NO: 1515878 - RNA, 19 nt, Homo sapiens
gaccauaccuguugucaaa

SEQ ID NO: 1515879 - RNA, 19 nt, Homo sapiens
gagaaacccuauaaaugua

SEQ ID NO: 1515880 - RNA, 19 nt, Homo sapiens
gaauauccauccacacuuu

SEQ ID NO: 1515881 - RNA, 19 nt, Homo sapiens
gcauacaacuuaaggaauu

SEQ ID NO: 1515882 - RNA, 19 nt, Homo sapiens
gaaccuggcuucuguagga

SEQ ID NO: 1515883 - RNA, 19 nt, Homo sapiens
guaagcaccuuuguucaua

SEQ ID NO: 1515884 - RNA, 19 nt, Homo sapiens
caauggaccuuauaaaugu

SEQ ID NO: 1515885 - RNA, 19 nt, Homo sapiens
ggaaagcccuaugauugua

SEQ ID NO: 1515886 - RNA, 19 nt, Homo sapiens
gaggaaagcccuaugauug

SEQ ID NO: 1515887 - RNA, 19 nt, Homo sapiens
uaaccuaucuuacaugaga

SEQ ID NO: 1515888 - RNA, 19 nt, Homo sapiens
ggagaaagacccuguaaga

SEQ ID NO: 1515889 - RNA, 19 nt, Homo sapiens
gaagacacaugauaaagca

SEQ ID NO: 1515890 - RNA, 19 nt, Homo sapiens
agaaagacccuguaagaua

SEQ ID NO: 1515891 - RNA, 19 nt, Homo sapiens
gagagaaacccuauaaaug

SEQ ID NO: 1515892 - RNA, 19 nt, Homo sapiens
gcaauggaccuuauaaaug

SEQ ID NO: 1515893 - RNA, 19 nt, Homo sapiens
gagagaaacccuaugauug

SEQ ID NO: 1515894 - RNA, 19 nt, Homo sapiens
gaacuagauuucccagaau

SEQ ID NO: 1515895 - RNA, 19 nt, Homo sapiens
ggaguuggaucucuggauu

SEQ ID NO: 1515896 - RNA, 19 nt, Homo sapiens
gagaaacccuaugaaugua

SEQ ID NO: 1515897 - RNA, 19 nt, Homo sapiens
gagaaacccuaugauugua

SEQ ID NO: 1515898 - RNA, 19 nt, Homo sapiens
gggaaagccuucaguuguu

SEQ ID NO: 1515899 - RNA, 19 nt, Homo sapiens
ggagagaaacccuaugauu

SEQ ID NO: 1515900 - RNA, 19 nt, Homo sapiens
gggaaagccuucaguuguu

SEQ ID NO: 1515901 - RNA, 19 nt, Homo sapiens
ggacgagccuugaguuauc

SEQ ID NO: 1515902 - RNA, 19 nt, Homo sapiens
ggaaagaagucauauacac

SEQ ID NO: 1515903 - RNA, 19 nt, Homo sapiens
ggagagaaacccuauaaau

SEQ ID NO: 1515904 - RNA, 19 nt, Homo sapiens
caggaaauuucaaguguuu

SEQ ID NO: 1515905 - RNA, 19 nt, Homo sapiens
gggaaagccuucagucguu

SEQ ID NO: 1515906 - RNA, 19 nt, Homo sapiens
gagaaacccuacgaaugua

SEQ ID NO: 1515907 - RNA, 19 nt, Homo sapiens
gagauaaacccuaugaaug

SEQ ID NO: 1515908 - RNA, 19 nt, Homo sapiens
gagagaaaccuuaugaaug

SEQ ID NO: 1515909 - RNA, 19 nt, Homo sapiens
uaaagaagguggucaaggu

SEQ ID NO: 1515910 - RNA, 19 nt, Homo sapiens
caaagaggguguaauaaac

SEQ ID NO: 1515911 - RNA, 19 nt, Homo sapiens
gcagagaccauaccuguug

SEQ ID NO: 1515912 - RNA, 19 nt, Homo sapiens
aaacaagacuucuguacau

SEQ ID NO: 1515913 - RNA, 19 nt, Homo sapiens
agacacauguuaacgcaua

SEQ ID NO: 1515914 - RNA, 19 nt, Homo sapiens
gagagaaacccuaugagaa

SEQ ID NO: 1515915 - RNA, 19 nt, Homo sapiens
gagagaaacccuaugaaug

SEQ ID NO: 1515916 - RNA, 19 nt, Homo sapiens
caaaacgacuugacuuuaa

SEQ ID NO: 1515917 - RNA, 19 nt, Homo sapiens
ucaaagaggguguaauaaa

SEQ ID NO: 1515918 - RNA, 19 nt, Homo sapiens
ggagauaaacccuaugaau

SEQ ID NO: 1515919 - RNA, 19 nt, Homo sapiens
ggagagaaaccuuaugaau

SEQ ID NO: 1515920 - RNA, 19 nt, Homo sapiens
ggucuaauuuguguaguaa

SEQ ID NO: 1515921 - RNA, 19 nt, Homo sapiens
ggagagaaacccuaugaga

SEQ ID NO: 1515922 - RNA, 19 nt, Homo sapiens
gagagaaacccuacgaaug

SEQ ID NO: 1515923 - RNA, 19 nt, Homo sapiens
gagauucggaaguaaguua

SEQ ID NO: 1515924 - RNA, 19 nt, Homo sapiens
gggaaagccuucaguccuu

SEQ ID NO: 1515925 - RNA, 19 nt, Homo sapiens
ugucuucagucuuggauua

SEQ ID NO: 1515926 - RNA, 19 nt, Homo sapiens
uuucaaguguuuccuguua

SEQ ID NO: 1515927 - RNA, 19 nt, Homo sapiens
ggagagaaacccuaugaau

SEQ ID NO: 1515928 - RNA, 19 nt, Homo sapiens
gggaagaccagaacauuga

SEQ ID NO: 1515929 - RNA, 19 nt, Homo sapiens
ugucaaagaggguguaaua

SEQ ID NO: 1515930 - RNA, 19 nt, Homo sapiens
ggaauuggcauacggucua

SEQ ID NO: 1515931 - RNA, 19 nt, Homo sapiens
agagaaaccuuaugaaugc

SEQ ID NO: 1515932 - RNA, 19 nt, Homo sapiens
ggaggaaagcccuaugauu

SEQ ID NO: 1515933 - RNA, 19 nt, Homo sapiens
gguccuucaucacuuaaua

SEQ ID NO: 1515934 - RNA, 19 nt, Homo sapiens
gggaaagccuucagucgau

SEQ ID NO: 1515935 - RNA, 19 nt, Homo sapiens
gaacauugaagacccauuc

SEQ ID NO: 1515936 - RNA, 19 nt, Homo sapiens
caagacuucuguacauguu

SEQ ID NO: 1515937 - RNA, 19 nt, Homo sapiens
gacgugaaccaaaugaaua

SEQ ID NO: 1515938 - RNA, 19 nt, Homo sapiens
ggacuuugaugugagaaug

SEQ ID NO: 1515939 - RNA, 19 nt, Homo sapiens
guaguaagcaccuuuguuc

SEQ ID NO: 1515940 - RNA, 19 nt, Homo sapiens
ccacacaggucuccagaag

SEQ ID NO: 1515941 - RNA, 19 nt, Homo sapiens
uacaugagauucggaagua

SEQ ID NO: 1515942 - RNA, 19 nt, Homo sapiens
gugauuccaugauacaauu

SEQ ID NO: 1515943 - RNA, 19 nt, Homo sapiens
agagaaacccuauaaaugu

SEQ ID NO: 1515944 - RNA, 19 nt, Homo sapiens
gagacucugugaaaguaaa

SEQ ID NO: 1515945 - RNA, 19 nt, Homo sapiens
ggauguggcugugaacuuc

SEQ ID NO: 1515946 - RNA, 19 nt, Homo sapiens
ggaaagccuucaguuguuc

SEQ ID NO: 1515947 - RNA, 19 nt, Homo sapiens
gacccacacuggagagaaa

SEQ ID NO: 1515948 - RNA, 19 nt, Homo sapiens
ggaaagccuucaguuguuc

SEQ ID NO: 1515949 - RNA, 19 nt, Homo sapiens
gaauguggagaaaccuuua

SEQ ID NO: 1515950 - RNA, 19 nt, Homo sapiens
aaaguuaagucaugcuguu

SEQ ID NO: 1515951 - RNA, 19 nt, Homo sapiens
uaagaaggcauuagucaug

SEQ ID NO: 1515952 - RNA, 19 nt, Homo sapiens
ucaacuacgugaaaggauu

SEQ ID NO: 1515953 - RNA, 19 nt, Homo sapiens
guuagaagacacaugauaa

SEQ ID NO: 1515954 - RNA, 19 nt, Homo sapiens
ucaaguguuuccuguuauu

SEQ ID NO: 1515955 - RNA, 19 nt, Homo sapiens
gaauuggcauacggucuaa

SEQ ID NO: 1515956 - RNA, 19 nt, Homo sapiens
agagaaacccuaugaaugu

SEQ ID NO: 1515957 - RNA, 19 nt, Homo sapiens
aaugagcacuuuccucuau

SEQ ID NO: 1515958 - RNA, 19 nt, Homo sapiens
ugauacaauucaccaguaa

SEQ ID NO: 1515959 - RNA, 19 nt, Homo sapiens
ccaaaugaauaucaggaau

SEQ ID NO: 1515960 - RNA, 19 nt, Homo sapiens
ggagugggcuuugcuggau

SEQ ID NO: 1515961 - RNA, 19 nt, Homo sapiens
guugguagguuaggaacua

SEQ ID NO: 1515962 - RNA, 19 nt, Homo sapiens
ggagagaaacccuacgaau

SEQ ID NO: 1515963 - RNA, 19 nt, Homo sapiens
ggacucacacuggagauaa

SEQ ID NO: 1515964 - RNA, 19 nt, Homo sapiens
gaaagcccuaugauuguaa

SEQ ID NO: 1515965 - RNA, 19 nt, Homo sapiens
ggcauacggucuaauuugu

SEQ ID NO: 1515966 - RNA, 19 nt, Homo sapiens
gaagacccauucaaaauuc

SEQ ID NO: 1515967 - RNA, 19 nt, Homo sapiens
cauuugugauuccaugaua

SEQ ID NO: 1515968 - RNA, 19 nt, Homo sapiens
agagaaacccuacgaaugu

SEQ ID NO: 1515969 - RNA, 19 nt, Homo sapiens
ggacgugaaccaaaugaau

SEQ ID NO: 1515970 - RNA, 19 nt, Homo sapiens
cuaccaugcugcugucaaa

SEQ ID NO: 1515971 - RNA, 19 nt, Homo sapiens
ggaaggcuuugacuugucu

SEQ ID NO: 1515972 - RNA, 19 nt, Homo sapiens
ggaauguggagaaaccuuu

SEQ ID NO: 1515973 - RNA, 19 nt, Homo sapiens
aguagugacuguauucuug

SEQ ID NO: 1515974 - RNA, 19 nt, Homo sapiens
gcaccuuuguucauacuag

SEQ ID NO: 1515975 - RNA, 19 nt, Homo sapiens
ggcaauggaccuuauaaau

SEQ ID NO: 1515976 - RNA, 19 nt, Homo sapiens
gaccagggaugcaggguua

SEQ ID NO: 1515977 - RNA, 19 nt, Homo sapiens
agacagaguuucaccauau

SEQ ID NO: 1515978 - RNA, 19 nt, Homo sapiens
gaaaucaucugugcuuugg

SEQ ID NO: 1515979 - RNA, 19 nt, Homo sapiens
ggagauggaccaagaaaga

SEQ ID NO: 1515980 - RNA, 19 nt, Homo sapiens
ugaacugucucuuauagaa

SEQ ID NO: 1515981 - RNA, 19 nt, Homo sapiens
gaucaaauccacuguuaau

SEQ ID NO: 1515982 - RNA, 19 nt, Homo sapiens
ccaaagugcugggaucaaa

SEQ ID NO: 1515983 - RNA, 19 nt, Homo sapiens
gagacagaguuucaccaua

SEQ ID NO: 1515984 - RNA, 19 nt, Homo sapiens
gcugaacugucucuuauag

SEQ ID NO: 1515985 - RNA, 19 nt, Homo sapiens
gaucuuggcucacuguaac

SEQ ID NO: 1515986 - RNA, 19 nt, Homo sapiens
caaauccacuguuaaucau

SEQ ID NO: 1515987 - RNA, 19 nt, Homo sapiens
ucaaagacacucccaguug

SEQ ID NO: 1515988 - RNA, 19 nt, Homo sapiens
ggucauugcuccucucucu

SEQ ID NO: 1515989 - RNA, 19 nt, Homo sapiens
gacagaguuucaccauauu

SEQ ID NO: 1515990 - RNA, 19 nt, Homo sapiens
ggaccuggaugauguacuc

SEQ ID NO: 1515991 - RNA, 19 nt, Homo sapiens
ucaaauccacuguuaauca

SEQ ID NO: 1515992 - RNA, 19 nt, Homo sapiens
gcauggcauuccacagaaa

SEQ ID NO: 1515993 - RNA, 19 nt, Homo sapiens
gauguacucugggucaaga

SEQ ID NO: 1515994 - RNA, 19 nt, Homo sapiens
caucugugcuuuggucauu

SEQ ID NO: 1515995 - RNA, 19 nt, Homo sapiens
ccacagaaaccauaaaggu

SEQ ID NO: 1515996 - RNA, 19 nt, Homo sapiens
ugccuuggccuuauuauuu

SEQ ID NO: 1515997 - RNA, 19 nt, Homo sapiens
ggagugcaguggcgcaauc

SEQ ID NO: 1515998 - RNA, 19 nt, Homo sapiens
aggcugaacugucucuuau

SEQ ID NO: 1515999 - RNA, 19 nt, Homo sapiens
caccaugcccagcuaauuu

SEQ ID NO: 1516000 - RNA, 19 nt, Homo sapiens
ggccagcuauccacucuuc

SEQ ID NO: 1516001 - RNA, 19 nt, Homo sapiens
gaacugucucuuauagaau

SEQ ID NO: 1516002 - RNA, 19 nt, Homo sapiens
acucuucugugccugcuua

SEQ ID NO: 1516003 - RNA, 19 nt, Homo sapiens
gauagucacagcacacaau

SEQ ID NO: 1516004 - RNA, 19 nt, Homo sapiens
ucauuaggcugaacugucu

SEQ ID NO: 1516005 - RNA, 19 nt, Homo sapiens
ccauaaagguuggcugagu

SEQ ID NO: 1516006 - RNA, 19 nt, Homo sapiens
ggcauggcauuccacagaa

SEQ ID NO: 1516007 - RNA, 19 nt, Homo sapiens
ccaccugagucuccacaga

SEQ ID NO: 1516008 - RNA, 19 nt, Homo sapiens
uagccaggauggucucuau

SEQ ID NO: 1516009 - RNA, 19 nt, Homo sapiens
gcauuccacagaaaccaua

SEQ ID NO: 1516010 - RNA, 19 nt, Homo sapiens
cgagguggcugcugugacu

SEQ ID NO: 1516011 - RNA, 19 nt, Homo sapiens
gaaagacguggaccuggau

SEQ ID NO: 1516012 - RNA, 19 nt, Homo sapiens
cgaaaucaucugugcuuug

SEQ ID NO: 1516013 - RNA, 19 nt, Homo sapiens
ggaguugcaccacugauag

SEQ ID NO: 1516014 - RNA, 19 nt, Homo sapiens
uauagaaugaggucaaaga

SEQ ID NO: 1516015 - RNA, 19 nt, Homo sapiens
ugucucagccucccgagua

SEQ ID NO: 1516016 - RNA, 19 nt, Homo sapiens
gaggggagauggaccaaga

SEQ ID NO: 1516017 - RNA, 19 nt, Homo sapiens
ccacuaguccugugcaaca

SEQ ID NO: 1516018 - RNA, 19 nt, Homo sapiens
gccauacgccuccgaaauc

SEQ ID NO: 1516019 - RNA, 19 nt, Homo sapiens
acacgcaccuuggagaaau

SEQ ID NO: 1516020 - RNA, 19 nt, Homo sapiens
ccauacgccuccgaaauca

SEQ ID NO: 1516021 - RNA, 19 nt, Homo sapiens
acagaguuucaccauauua

SEQ ID NO: 1516022 - RNA, 19 nt, Homo sapiens
agacagacaggcagacaga

SEQ ID NO: 1516023 - RNA, 19 nt, Homo sapiens
gaugcuccuuggccagcua

SEQ ID NO: 1516024 - RNA, 19 nt, Homo sapiens
gacaggguuucaccguguu

SEQ ID NO: 1516025 - RNA, 19 nt, Homo sapiens
gcagacagguccccagagu

SEQ ID NO: 1516026 - RNA, 19 nt, Homo sapiens
gcacggagacacgcaccuu

SEQ ID NO: 1516027 - RNA, 19 nt, Homo sapiens
ccaccaugcccagcuaauu

SEQ ID NO: 1516028 - RNA, 19 nt, Homo sapiens
ccgaaaucaucugugcuuu

SEQ ID NO: 1516029 - RNA, 19 nt, Homo sapiens
uggcauggcauuccacaga

SEQ ID NO: 1516030 - RNA, 19 nt, Homo sapiens
cuuauagaaugaggucaaa

SEQ ID NO: 1516031 - RNA, 19 nt, Homo sapiens
uaggcugaacugucucuua

SEQ ID NO: 1516032 - RNA, 19 nt, Homo sapiens
ucacuguaacuuccacuug

SEQ ID NO: 1516033 - RNA, 19 nt, Homo sapiens
uggaguugcaccacugaua

SEQ ID NO: 1516034 - RNA, 19 nt, Homo sapiens
caaagugcugggaucaaau

SEQ ID NO: 1516035 - RNA, 19 nt, Homo sapiens
uugccaggcucaagcaguu

SEQ ID NO: 1516036 - RNA, 19 nt, Homo sapiens
aacugucucuuauagaaug

SEQ ID NO: 1516037 - RNA, 19 nt, Homo sapiens
uuuaguagagacagaguuu

SEQ ID NO: 1516038 - RNA, 19 nt, Homo sapiens
gccuuggccuuauuauuuu

SEQ ID NO: 1516039 - RNA, 19 nt, Homo sapiens
gucaaagacacucccaguu

SEQ ID NO: 1516040 - RNA, 19 nt, Homo sapiens
uaguagagacagaguuuca

SEQ ID NO: 1516041 - RNA, 19 nt, Homo sapiens
gcccuucguucagguguuc

SEQ ID NO: 1516042 - RNA, 19 nt, Homo sapiens
gacacgcaccuuggagaaa

SEQ ID NO: 1516043 - RNA, 19 nt, Homo sapiens
acguggaccuggaugaugu

SEQ ID NO: 1516044 - RNA, 19 nt, Homo sapiens
ccaggauggucucuaucuc

SEQ ID NO: 1516045 - RNA, 19 nt, Homo sapiens
gugcaguggcgcaaucuca

SEQ ID NO: 1516046 - RNA, 19 nt, Homo sapiens
agaccgagagacacaguga

SEQ ID NO: 1516047 - RNA, 19 nt, Homo sapiens
cgaucuuggcucacuguaa

SEQ ID NO: 1516048 - RNA, 19 nt, Homo sapiens
cgucgacgggugaagauau

SEQ ID NO: 1516049 - RNA, 19 nt, Homo sapiens
gucgacgggugaagauauc

SEQ ID NO: 1516050 - RNA, 19 nt, Homo sapiens
agacacgcaccuuggagaa

SEQ ID NO: 1516051 - RNA, 19 nt, Homo sapiens
caagaaagcuuccgaggua

SEQ ID NO: 1516052 - RNA, 19 nt, Homo sapiens
gggaaaggcuucucuuaua

SEQ ID NO: 1516053 - RNA, 19 nt, Homo sapiens
gaacaauuaucucccguua

SEQ ID NO: 1516054 - RNA, 19 nt, Homo sapiens
ggauguaacuuucauguaa

SEQ ID NO: 1516055 - RNA, 19 nt, Homo sapiens
ggaaaggcuucucuuauaa

SEQ ID NO: 1516056 - RNA, 19 nt, Homo sapiens
ggagaaagcuuaugaaugc

SEQ ID NO: 1516057 - RNA, 19 nt, Homo sapiens
ucacgaugaugaacaauua

SEQ ID NO: 1516058 - RNA, 19 nt, Homo sapiens
uaacucagaucucaguaua

SEQ ID NO: 1516059 - RNA, 19 nt, Homo sapiens
gcaauacaaugguuucuau

SEQ ID NO: 1516060 - RNA, 19 nt, Homo sapiens
gggaagaccuuucgacaga

SEQ ID NO: 1516061 - RNA, 19 nt, Homo sapiens
ggucaaaucucauuacaca

SEQ ID NO: 1516062 - RNA, 19 nt, Homo sapiens
ggacuggccuucauucaga

SEQ ID NO: 1516063 - RNA, 19 nt, Homo sapiens
gccaacaaauugaaugaua

SEQ ID NO: 1516064 - RNA, 19 nt, Homo sapiens
agagaaaccucauaaaugu

SEQ ID NO: 1516065 - RNA, 19 nt, Homo sapiens
agagaaaucuuccauaugu

SEQ ID NO: 1516066 - RNA, 19 nt, Homo sapiens
gagagaagccuuaugaaug

SEQ ID NO: 1516067 - RNA, 19 nt, Homo sapiens
gagagaaaccucauaaaug

SEQ ID NO: 1516068 - RNA, 19 nt, Homo sapiens
ggucagaguugauuauuca

SEQ ID NO: 1516069 - RNA, 19 nt, Homo sapiens
gagagaaacccuuuaaaug

SEQ ID NO: 1516070 - RNA, 19 nt, Homo sapiens
gaagucacaccucaauaua

SEQ ID NO: 1516071 - RNA, 19 nt, Homo sapiens
guacagaagccagaauuua

SEQ ID NO: 1516072 - RNA, 19 nt, Homo sapiens
gcaacuccauguucauaaa

SEQ ID NO: 1516073 - RNA, 19 nt, Homo sapiens
ggagaagccuuaugaaugc

SEQ ID NO: 1516074 - RNA, 19 nt, Homo sapiens
ggaaaggcuucguucagaa

SEQ ID NO: 1516075 - RNA, 19 nt, Homo sapiens
ggaaagccuucaaccagaa

SEQ ID NO: 1516076 - RNA, 19 nt, Homo sapiens
ggaaagccuucacucagaa

SEQ ID NO: 1516077 - RNA, 19 nt, Homo sapiens
gagaaacccuuuaaaugca

SEQ ID NO: 1516078 - RNA, 19 nt, Homo sapiens
ggagagaaaccucauaaau

SEQ ID NO: 1516079 - RNA, 19 nt, Homo sapiens
gggaaagccuucacucaga

SEQ ID NO: 1516080 - RNA, 19 nt, Homo sapiens
gcacaccgaagaauucaua

SEQ ID NO: 1516081 - RNA, 19 nt, Homo sapiens
gguggaugcuguuaacuuu

SEQ ID NO: 1516082 - RNA, 19 nt, Homo sapiens
gagagaaaccuuaugaaug

SEQ ID NO: 1516083 - RNA, 19 nt, Homo sapiens
ggagagaaacccuauguau

SEQ ID NO: 1516084 - RNA, 19 nt, Homo sapiens
gagaaaagcucuauguaug

SEQ ID NO: 1516085 - RNA, 19 nt, Homo sapiens
ggaaauuguuuaccuccaa

SEQ ID NO: 1516086 - RNA, 19 nt, Homo sapiens
gagaaaucuuccauaugua

SEQ ID NO: 1516087 - RNA, 19 nt, Homo sapiens
gugaagcccuauauaugua

SEQ ID NO: 1516088 - RNA, 19 nt, Homo sapiens
gaauaaacaucagacaaca

SEQ ID NO: 1516089 - RNA, 19 nt, Homo sapiens
gauuacacaucacagaauu

SEQ ID NO: 1516090 - RNA, 19 nt, Homo sapiens
gcuguuaacuuucuuccuu

SEQ ID NO: 1516091 - RNA, 19 nt, Homo sapiens
gggaaaggcuucguucaga

SEQ ID NO: 1516092 - RNA, 19 nt, Homo sapiens
agagagaaaucuuccauau

SEQ ID NO: 1516093 - RNA, 19 nt, Homo sapiens
gggagaagccuuaugaaug

SEQ ID NO: 1516094 - RNA, 19 nt, Homo sapiens
ggagagaaaccuuaugaau

SEQ ID NO: 1516095 - RNA, 19 nt, Homo sapiens
gaagucacagcucaaagua

SEQ ID NO: 1516096 - RNA, 19 nt, Homo sapiens
ggaaaagccuucucaugaa

SEQ ID NO: 1516097 - RNA, 19 nt, Homo sapiens
gaaaagcccuacauuuguu

SEQ ID NO: 1516098 - RNA, 19 nt, Homo sapiens
ggucaaaucucaguaagca

SEQ ID NO: 1516099 - RNA, 19 nt, Homo sapiens
gaacucccaucaccuucaa

SEQ ID NO: 1516100 - RNA, 19 nt, Homo sapiens
caaggaaccgagucaauuu

SEQ ID NO: 1516101 - RNA, 19 nt, Homo sapiens
caacuuaaaucucccuucu

SEQ ID NO: 1516102 - RNA, 19 nt, Homo sapiens
gaaaagccuucucaugaaa

SEQ ID NO: 1516103 - RNA, 19 nt, Homo sapiens
gaaaggcuucguucagaaa

SEQ ID NO: 1516104 - RNA, 19 nt, Homo sapiens
gggaaggccuuuacugaca

SEQ ID NO: 1516105 - RNA, 19 nt, Homo sapiens
cgacagaagucagaguuga

SEQ ID NO: 1516106 - RNA, 19 nt, Homo sapiens
ggagagaagccuuaugaau

SEQ ID NO: 1516107 - RNA, 19 nt, Homo sapiens
ggaaaagccuucacucaga

SEQ ID NO: 1516108 - RNA, 19 nt, Homo sapiens
ggcaaagcauucacacaaa

SEQ ID NO: 1516109 - RNA, 19 nt, Homo sapiens
cagccacgcuugagagaaa

SEQ ID NO: 1516110 - RNA, 19 nt, Homo sapiens
acacaucacagaauucaua

SEQ ID NO: 1516111 - RNA, 19 nt, Homo sapiens
ggagagagacaguaugaau

SEQ ID NO: 1516112 - RNA, 19 nt, Homo sapiens
agagaaaccuuaugaaugc

SEQ ID NO: 1516113 - RNA, 19 nt, Homo sapiens
gagaaaagcccuacauuug

SEQ ID NO: 1516114 - RNA, 19 nt, Homo sapiens
ggagagaaacccuaugugu

SEQ ID NO: 1516115 - RNA, 19 nt, Homo sapiens
gagagaaacccuauguaug

SEQ ID NO: 1516116 - RNA, 19 nt, Homo sapiens
aagcagagguggucauguu

SEQ ID NO: 1516117 - RNA, 19 nt, Homo sapiens
ggucaucugggacaacuua

SEQ ID NO: 1516118 - RNA, 19 nt, Homo sapiens
agugaugaauccuaaguua

SEQ ID NO: 1516119 - RNA, 19 nt, Homo sapiens
caacccucauucaguauuu

SEQ ID NO: 1516120 - RNA, 19 nt, Homo sapiens
gaaaugaccacagcagaau

SEQ ID NO: 1516121 - RNA, 19 nt, Homo sapiens
ggucagacuugauuacaca

SEQ ID NO: 1516122 - RNA, 19 nt, Homo sapiens
ccagaagacccauuugauu

SEQ ID NO: 1516123 - RNA, 19 nt, Homo sapiens
ggagagagacaccaugaau

SEQ ID NO: 1516124 - RNA, 19 nt, Homo sapiens
gacuuacaaugaaccauaa

SEQ ID NO: 1516125 - RNA, 19 nt, Homo sapiens
agaaagagaugcuacaaaa

SEQ ID NO: 1516126 - RNA, 19 nt, Homo sapiens
ucaauuuggugaauaggaa

SEQ ID NO: 1516127 - RNA, 19 nt, Homo sapiens
ggaaguccuuuaccuccaa

SEQ ID NO: 1516128 - RNA, 19 nt, Homo sapiens
gagugaagcccuauauaug

SEQ ID NO: 1516129 - RNA, 19 nt, Homo sapiens
cagaagacccauuugauug

SEQ ID NO: 1516130 - RNA, 19 nt, Homo sapiens
cagaagccagaauuuauua

SEQ ID NO: 1516131 - RNA, 19 nt, Homo sapiens
caauggcggugacuuacaa

SEQ ID NO: 1516132 - RNA, 19 nt, Homo sapiens
ggagagaaaccuuaugagu

SEQ ID NO: 1516133 - RNA, 19 nt, Homo sapiens
uaaguuaugugaguuguuc

SEQ ID NO: 1516134 - RNA, 19 nt, Homo sapiens
ccagaaaucaauacucauu

SEQ ID NO: 1516135 - RNA, 19 nt, Homo sapiens
gagaauucauacaggagaa

SEQ ID NO: 1516136 - RNA, 19 nt, Homo sapiens
gggaaggccuuuaccuaca

SEQ ID NO: 1516137 - RNA, 19 nt, Homo sapiens
ugauagugaugaauccuaa

SEQ ID NO: 1516138 - RNA, 19 nt, Homo sapiens
agacaaacccuacaagugu

SEQ ID NO: 1516139 - RNA, 19 nt, Homo sapiens
gagacaaacccuacaagug

SEQ ID NO: 1516140 - RNA, 19 nt, Homo sapiens
gcaaagcauucacacaaaa

SEQ ID NO: 1516141 - RNA, 19 nt, Homo sapiens
caaaguacaccugaaaguu

SEQ ID NO: 1516142 - RNA, 19 nt, Homo sapiens
gcucaaaguacaccugaaa

SEQ ID NO: 1516143 - RNA, 19 nt, Homo sapiens
gguauagugccaacaaauu

SEQ ID NO: 1516144 - RNA, 19 nt, Homo sapiens
caguaaaccuugggucauu

SEQ ID NO: 1516145 - RNA, 19 nt, Homo sapiens
gcaggucaaaucucaguaa

SEQ ID NO: 1516146 - RNA, 19 nt, Homo sapiens
gaaaagccuucacucagaa

SEQ ID NO: 1516147 - RNA, 19 nt, Homo sapiens
ucauaaauguggucacugu

SEQ ID NO: 1516148 - RNA, 19 nt, Homo sapiens
ugacuuacaaugaaccaua

SEQ ID NO: 1516149 - RNA, 19 nt, Homo sapiens
gaugaccacuuauuacaac

SEQ ID NO: 1516150 - RNA, 19 nt, Homo sapiens
gacguaaaccucagaaugu

SEQ ID NO: 1516151 - RNA, 19 nt, Homo sapiens
gcaagaaacuggcagaaau

SEQ ID NO: 1516152 - RNA, 19 nt, Homo sapiens
ccagauagcucguggauug

SEQ ID NO: 1516153 - RNA, 19 nt, Homo sapiens
gaacgaggaugaauuaaag

SEQ ID NO: 1516154 - RNA, 19 nt, Homo sapiens
ccaggaagcuaacaccuua

SEQ ID NO: 1516155 - RNA, 19 nt, Homo sapiens
gaaauucaauggagaaaca

SEQ ID NO: 1516156 - RNA, 19 nt, Homo sapiens
gcagugggcugaauucuuc

SEQ ID NO: 1516157 - RNA, 19 nt, Homo sapiens
ggaguuugcugaagaggaa

SEQ ID NO: 1516158 - RNA, 19 nt, Homo sapiens
ucacagggauaauaaaguu

SEQ ID NO: 1516159 - RNA, 19 nt, Homo sapiens
ggaccuugcugcugucuug

SEQ ID NO: 1516160 - RNA, 19 nt, Homo sapiens
gaagagagccaaggaguug

SEQ ID NO: 1516161 - RNA, 19 nt, Homo sapiens
gaggaugaauuaaagaguu

SEQ ID NO: 1516162 - RNA, 19 nt, Homo sapiens
ccaaugugcuccuggauga

SEQ ID NO: 1516163 - RNA, 19 nt, Homo sapiens
gcugggagaugcagaagaa

SEQ ID NO: 1516164 - RNA, 19 nt, Homo sapiens
gcugaacgaggaugaauua

SEQ ID NO: 1516165 - RNA, 19 nt, Homo sapiens
gaagaccuaugaaacuaau

SEQ ID NO: 1516166 - RNA, 19 nt, Homo sapiens
gcucagaaaucauaaaugc

SEQ ID NO: 1516167 - RNA, 19 nt, Homo sapiens
gaacugggcucggcaggau

SEQ ID NO: 1516168 - RNA, 19 nt, Homo sapiens
gucagagggucacauguua

SEQ ID NO: 1516169 - RNA, 19 nt, Homo sapiens
ggacuucugucuugcuuuc

SEQ ID NO: 1516170 - RNA, 19 nt, Homo sapiens
ggguguuccuggagaauua

SEQ ID NO: 1516171 - RNA, 19 nt, Homo sapiens
ggaugagggugccauguug

SEQ ID NO: 1516172 - RNA, 19 nt, Homo sapiens
gagcugaucuccaaagacu

SEQ ID NO: 1516173 - RNA, 19 nt, Homo sapiens
ggucacauguuaacacuag

SEQ ID NO: 1516174 - RNA, 19 nt, Homo sapiens
aauccaaacuguaaccuaa

SEQ ID NO: 1516175 - RNA, 19 nt, Homo sapiens
ucacaaaccuggacuugag

SEQ ID NO: 1516176 - RNA, 19 nt, Homo sapiens
gggcugaauucuucuaugu

SEQ ID NO: 1516177 - RNA, 19 nt, Homo sapiens
gaacuggacauugaauuug

SEQ ID NO: 1516178 - RNA, 19 nt, Homo sapiens
aaggaaggauggagaaauu

SEQ ID NO: 1516179 - RNA, 19 nt, Homo sapiens
gcucguggauuguggauuc

SEQ ID NO: 1516180 - RNA, 19 nt, Homo sapiens
aagcacaucuucaugcaaa

SEQ ID NO: 1516181 - RNA, 19 nt, Homo sapiens
gucaacaccuccucagaaa

SEQ ID NO: 1516182 - RNA, 19 nt, Homo sapiens
ugggaucgcucuacgaauu

SEQ ID NO: 1516183 - RNA, 19 nt, Homo sapiens
gcacuuaccuaaccauucc

SEQ ID NO: 1516184 - RNA, 19 nt, Homo sapiens
gcacaucuucaugcaaaua

SEQ ID NO: 1516185 - RNA, 19 nt, Homo sapiens
caagaaacuggcagaaauu

SEQ ID NO: 1516186 - RNA, 19 nt, Homo sapiens
gagaagaaagacucaagaa

SEQ ID NO: 1516187 - RNA, 19 nt, Homo sapiens
uagagaauccaaacuguaa

SEQ ID NO: 1516188 - RNA, 19 nt, Homo sapiens
gauuguggauucucuguca

SEQ ID NO: 1516189 - RNA, 19 nt, Homo sapiens
gaccugcucagaaaucaua

SEQ ID NO: 1516190 - RNA, 19 nt, Homo sapiens
ggcaaaggcugagaugaug

SEQ ID NO: 1516191 - RNA, 19 nt, Homo sapiens
gggugaaguuucuguguga

SEQ ID NO: 1516192 - RNA, 19 nt, Homo sapiens
gaaacaaagcuuccugagu

SEQ ID NO: 1516193 - RNA, 19 nt, Homo sapiens
ggacaucaaacaggaauug

SEQ ID NO: 1516194 - RNA, 19 nt, Homo sapiens
gcagaaaguggagauuaaa

SEQ ID NO: 1516195 - RNA, 19 nt, Homo sapiens
caaagcacaucuucaugca

SEQ ID NO: 1516196 - RNA, 19 nt, Homo sapiens
uugcagagcugaucuccaa

SEQ ID NO: 1516197 - RNA, 19 nt, Homo sapiens
ugugugaccugcucagaaa

SEQ ID NO: 1516198 - RNA, 19 nt, Homo sapiens
ggucaacaccuccucagaa

SEQ ID NO: 1516199 - RNA, 19 nt, Homo sapiens
gaagacgugcuacagaaga

SEQ ID NO: 1516200 - RNA, 19 nt, Homo sapiens
uagagucugucgagaggua

SEQ ID NO: 1516201 - RNA, 19 nt, Homo sapiens
ugcagaaaguggagauuaa

SEQ ID NO: 1516202 - RNA, 19 nt, Homo sapiens
ucgaagacgugcuacagaa

SEQ ID NO: 1516203 - RNA, 19 nt, Homo sapiens
caaagacuggccugaauug

SEQ ID NO: 1516204 - RNA, 19 nt, Homo sapiens
ggagaaauucaauggagaa

SEQ ID NO: 1516205 - RNA, 19 nt, Homo sapiens
ggaaugcgacugugaacau

SEQ ID NO: 1516206 - RNA, 19 nt, Homo sapiens
ggucagagggucacauguu

SEQ ID NO: 1516207 - RNA, 19 nt, Homo sapiens
gaaacucucacugcaggua

SEQ ID NO: 1516208 - RNA, 19 nt, Homo sapiens
ggauucgggucucuaagau

SEQ ID NO: 1516209 - RNA, 19 nt, Homo sapiens
aagcuuggcuguagauauc

SEQ ID NO: 1516210 - RNA, 19 nt, Homo sapiens
ucaaguuucuggaagugaa

SEQ ID NO: 1516211 - RNA, 19 nt, Homo sapiens
ugaacuggacauugaauuu

SEQ ID NO: 1516212 - RNA, 19 nt, Homo sapiens
guaggacacuucuuauucg

SEQ ID NO: 1516213 - RNA, 19 nt, Homo sapiens
ggagaagaaagacucaaga

SEQ ID NO: 1516214 - RNA, 19 nt, Homo sapiens
gauucucugucaggcauua

SEQ ID NO: 1516215 - RNA, 19 nt, Homo sapiens
gggcgcagauguccguguu

SEQ ID NO: 1516216 - RNA, 19 nt, Homo sapiens
caauggagaaacagucuuu

SEQ ID NO: 1516217 - RNA, 19 nt, Homo sapiens
gggaucgcucuacgaauua

SEQ ID NO: 1516218 - RNA, 19 nt, Homo sapiens
ugaacgaggaugaauuaaa

SEQ ID NO: 1516219 - RNA, 19 nt, Homo sapiens
ggacaggagggccuauuuc

SEQ ID NO: 1516220 - RNA, 19 nt, Homo sapiens
ggaaggauggagaaauuca

SEQ ID NO: 1516221 - RNA, 19 nt, Homo sapiens
uugaagaccuaugaaacua

SEQ ID NO: 1516222 - RNA, 19 nt, Homo sapiens
uaccgggacuucugucuug

SEQ ID NO: 1516223 - RNA, 19 nt, Homo sapiens
ggacauugaauuugaaagg

SEQ ID NO: 1516224 - RNA, 19 nt, Homo sapiens
gcggugugcuggauugugu

SEQ ID NO: 1516225 - RNA, 19 nt, Homo sapiens
ccaaagacuggccugaauu

SEQ ID NO: 1516226 - RNA, 19 nt, Homo sapiens
ggaaaacugucgucuuaca

SEQ ID NO: 1516227 - RNA, 19 nt, Homo sapiens
gaauccaaacuguaaccua

SEQ ID NO: 1516228 - RNA, 19 nt, Homo sapiens
aaccuggacuugaguauca

SEQ ID NO: 1516229 - RNA, 19 nt, Homo sapiens
gcaccugucaucugcagaa

SEQ ID NO: 1516230 - RNA, 19 nt, Homo sapiens
uuggaaaacugucgucuua

SEQ ID NO: 1516231 - RNA, 19 nt, Homo sapiens
gagggccuauuuccugaga

SEQ ID NO: 1516232 - RNA, 19 nt, Homo sapiens
ggacggacaggugcaagaa

SEQ ID NO: 1516233 - RNA, 19 nt, Homo sapiens
gaaugcgacugugaacauc

SEQ ID NO: 1516234 - RNA, 19 nt, Homo sapiens
ggucuugggcugccuguau

SEQ ID NO: 1516235 - RNA, 19 nt, Homo sapiens
cagagcugaucuccaaaga

SEQ ID NO: 1516236 - RNA, 19 nt, Homo sapiens
gggauucgggucucuaaga

SEQ ID NO: 1516237 - RNA, 19 nt, Homo sapiens
ugugugagggcuugaguua

SEQ ID NO: 1516238 - RNA, 19 nt, Homo sapiens
gcacgaugaugcugaugcu

SEQ ID NO: 1516239 - RNA, 19 nt, Homo sapiens
ggauaaggaaugcgacugu

SEQ ID NO: 1516240 - RNA, 19 nt, Homo sapiens
gaaggauggagaaauucaa

SEQ ID NO: 1516241 - RNA, 19 nt, Homo sapiens
ggacaggugcaagaaauag

SEQ ID NO: 1516242 - RNA, 19 nt, Homo sapiens
ggaaaucaagaagcuguug

SEQ ID NO: 1516243 - RNA, 19 nt, Homo sapiens
cagauguugucguuggaaa

SEQ ID NO: 1516244 - RNA, 19 nt, Homo sapiens
gcaaugcaaagcacaucuu

SEQ ID NO: 1516245 - RNA, 19 nt, Homo sapiens
cgaccugauucaaguagga

SEQ ID NO: 1516246 - RNA, 19 nt, Homo sapiens
ucacggaauuguguaagau

SEQ ID NO: 1516247 - RNA, 19 nt, Homo sapiens
ccugucaucugcagaaagu

SEQ ID NO: 1516248 - RNA, 19 nt, Homo sapiens
uaaggaaugcgacugugaa

SEQ ID NO: 1516249 - RNA, 19 nt, Homo sapiens
acagcaaccucaaguuucu

SEQ ID NO: 1516250 - RNA, 19 nt, Homo sapiens
gauuucugcucucucuuca

SEQ ID NO: 1516251 - RNA, 19 nt, Homo sapiens
gagcgcaacuuuccgcaua

SEQ ID NO: 1516252 - RNA, 19 nt, Homo sapiens
gguguugccugacaucuug

SEQ ID NO: 1516253 - RNA, 19 nt, Homo sapiens
gcccaguguucgugaauca

SEQ ID NO: 1516254 - RNA, 19 nt, Homo sapiens
cgaagugggucccuguucu

SEQ ID NO: 1516255 - RNA, 19 nt, Homo sapiens
guucgagaguaacuuuguu

SEQ ID NO: 1516256 - RNA, 19 nt, Homo sapiens
accaugaucuggcuucgaa

SEQ ID NO: 1516257 - RNA, 19 nt, Homo sapiens
gcaucuccacgcucuguaa

SEQ ID NO: 1516258 - RNA, 19 nt, Homo sapiens
gaaacaggaggugccuuga

SEQ ID NO: 1516259 - RNA, 19 nt, Homo sapiens
caagcgcaguuucaagucu

SEQ ID NO: 1516260 - RNA, 19 nt, Homo sapiens
gaagugggucccuguucug

SEQ ID NO: 1516261 - RNA, 19 nt, Homo sapiens
cgaggugggcuuccuguuc

SEQ ID NO: 1516262 - RNA, 19 nt, Homo sapiens
cauguucgagaguaacuuu

SEQ ID NO: 1516263 - RNA, 19 nt, Homo sapiens
gcaaaagacccuccagaag

SEQ ID NO: 1516264 - RNA, 19 nt, Homo sapiens
ggauaugccgcuggccaaa

SEQ ID NO: 1516265 - RNA, 19 nt, Homo sapiens
ggccugguguugccugaca

SEQ ID NO: 1516266 - RNA, 19 nt, Homo sapiens
ccacagccaccaugaucug

SEQ ID NO: 1516267 - RNA, 19 nt, Homo sapiens
gcaacuuuccgcauaagac

SEQ ID NO: 1516268 - RNA, 19 nt, Homo sapiens
gcgcaacuuuccgcauaag

SEQ ID NO: 1516269 - RNA, 19 nt, Homo sapiens
caccacagccaccaugauc

SEQ ID NO: 1516270 - RNA, 19 nt, Homo sapiens
ggaaggccaaggcgcucaa

SEQ ID NO: 1516271 - RNA, 19 nt, Homo sapiens
gaacgggccucuccaguga

SEQ ID NO: 1516272 - RNA, 19 nt, Homo sapiens
ggaacaagaccucggagua

SEQ ID NO: 1516273 - RNA, 19 nt, Homo sapiens
gaacaagaccucggaguau

SEQ ID NO: 1516274 - RNA, 19 nt, Homo sapiens
gaacgccacuuccgcuuca

SEQ ID NO: 1516275 - RNA, 19 nt, Homo sapiens
ggucugagccugcugugua

SEQ ID NO: 1516276 - RNA, 19 nt, Homo sapiens
gaagccgucacgaccauua

SEQ ID NO: 1516277 - RNA, 19 nt, Homo sapiens
uggccaagcuggagcacua

SEQ ID NO: 1516278 - RNA, 19 nt, Homo sapiens
ccucaggugccaucucuua

SEQ ID NO: 1516279 - RNA, 19 nt, Homo sapiens
uaaagcacaucuuggaaac

SEQ ID NO: 1516280 - RNA, 19 nt, Homo sapiens
aagcacaucuuggaaacaa

SEQ ID NO: 1516281 - RNA, 19 nt, Homo sapiens
gccagcagccugucaauca

SEQ ID NO: 1516282 - RNA, 19 nt, Homo sapiens
ggccacccauuccaacuga

SEQ ID NO: 1516283 - RNA, 19 nt, Homo sapiens
gcucaacacccuccaccuu

SEQ ID NO: 1516284 - RNA, 19 nt, Homo sapiens
aacaagaccucggaguauu

SEQ ID NO: 1516285 - RNA, 19 nt, Homo sapiens
gcacaucuuggaaacaauc

SEQ ID NO: 1516286 - RNA, 19 nt, Homo sapiens
uuaaagcacaucuuggaaa

SEQ ID NO: 1516287 - RNA, 19 nt, Homo sapiens
cauuaaagcacaucuugga

SEQ ID NO: 1516288 - RNA, 19 nt, Homo sapiens
acaagaccucggaguauuu

SEQ ID NO: 1516289 - RNA, 19 nt, Homo sapiens
gccauuaaagcacaucuug

SEQ ID NO: 1516290 - RNA, 19 nt, Homo sapiens
gggcaggaucgccauuaaa

SEQ ID NO: 1516291 - RNA, 19 nt, Homo sapiens
gucugagccugcuguguaa

SEQ ID NO: 1516292 - RNA, 19 nt, Homo sapiens
ucacgaccauuaccuucug

SEQ ID NO: 1516293 - RNA, 19 nt, Homo sapiens
ucuccgagcuccgucagaa

SEQ ID NO: 1516294 - RNA, 19 nt, Homo sapiens
ggcaggaucgccauuaaag

SEQ ID NO: 1516295 - RNA, 19 nt, Homo sapiens
caggaucgccauuaaagca

SEQ ID NO: 1516296 - RNA, 19 nt, Homo sapiens
gcuggagcacuacgacuug

SEQ ID NO: 1516297 - RNA, 19 nt, Homo sapiens
agggcaggaucgccauuaa

SEQ ID NO: 1516298 - RNA, 19 nt, Homo sapiens
cagggcaggaucgccauua

SEQ ID NO: 1516299 - RNA, 19 nt, Homo sapiens
gaguguagucggcucaaca

SEQ ID NO: 1516300 - RNA, 19 nt, Homo sapiens
caagaccucggaguauuuc

SEQ ID NO: 1516301 - RNA, 19 nt, Homo sapiens
gaucauaugugugcuagug

SEQ ID NO: 1516302 - RNA, 19 nt, Homo sapiens
ggacgacggugguaucauc

SEQ ID NO: 1516303 - RNA, 19 nt, Homo sapiens
ggaaauagggauucugugu

SEQ ID NO: 1516304 - RNA, 19 nt, Homo sapiens
gaaccagcaaagacauuua

SEQ ID NO: 1516305 - RNA, 19 nt, Homo sapiens
gacaggaaguacagacaga

SEQ ID NO: 1516306 - RNA, 19 nt, Homo sapiens
caaagacauuuaccagagu

SEQ ID NO: 1516307 - RNA, 19 nt, Homo sapiens
ccauuaaacugaggagaga

SEQ ID NO: 1516308 - RNA, 19 nt, Homo sapiens
gagcguggcaagcacagua

SEQ ID NO: 1516309 - RNA, 19 nt, Homo sapiens
gggauucugugucuuugug

SEQ ID NO: 1516310 - RNA, 19 nt, Homo sapiens
ggaaccagcaaagacauuu

SEQ ID NO: 1516311 - RNA, 19 nt, Homo sapiens
caacgucugucccauccau

SEQ ID NO: 1516312 - RNA, 19 nt, Homo sapiens
aaauagggauucugugucu

SEQ ID NO: 1516313 - RNA, 19 nt, Homo sapiens
gauaacggcaccuacacuu

SEQ ID NO: 1516314 - RNA, 19 nt, Homo sapiens
ggcagacccucuucuucaa

SEQ ID NO: 1516315 - RNA, 19 nt, Homo sapiens
gcaaggaaccagcaaagac

SEQ ID NO: 1516316 - RNA, 19 nt, Homo sapiens
ggaugagcguuuccagcuu

SEQ ID NO: 1516317 - RNA, 19 nt, Homo sapiens
gcugguguuucugaucaua

SEQ ID NO: 1516318 - RNA, 19 nt, Homo sapiens
caaggaaccagcaaagaca

SEQ ID NO: 1516319 - RNA, 19 nt, Homo sapiens
gcaagcagacgcaguacgu

SEQ ID NO: 1516320 - RNA, 19 nt, Homo sapiens
ggcaagcacaguacgguuu

SEQ ID NO: 1516321 - RNA, 19 nt, Homo sapiens
ccauaguugucauccagaa

SEQ ID NO: 1516322 - RNA, 19 nt, Homo sapiens
ucacuaaccaccauuaaac

SEQ ID NO: 1516323 - RNA, 19 nt, Homo sapiens
cagacccucuucuucaaug

SEQ ID NO: 1516324 - RNA, 19 nt, Homo sapiens
gucuuugugucauaacuuu

SEQ ID NO: 1516325 - RNA, 19 nt, Homo sapiens
agacgucgguucccuaugc

SEQ ID NO: 1516326 - RNA, 19 nt, Homo sapiens
ggaaggggaacacagauuu

SEQ ID NO: 1516327 - RNA, 19 nt, Homo sapiens
acagcaagcagacgcagua

SEQ ID NO: 1516328 - RNA, 19 nt, Homo sapiens
gcaagcacaguacgguuuc

SEQ ID NO: 1516329 - RNA, 19 nt, Homo sapiens
guuuccagcuugaggaguu

SEQ ID NO: 1516330 - RNA, 19 nt, Homo sapiens
cggcagacccucuucuuca

SEQ ID NO: 1516331 - RNA, 19 nt, Homo sapiens
cgagggcgcucuacguacu

SEQ ID NO: 1516332 - RNA, 19 nt, Homo sapiens
gugguaucaucaucuguga

SEQ ID NO: 1516333 - RNA, 19 nt, Homo sapiens
cgacggugguaucaucauc

SEQ ID NO: 1516334 - RNA, 19 nt, Homo sapiens
cuaaccaccauuaaacuga

SEQ ID NO: 1516335 - RNA, 19 nt, Homo sapiens
gaacagggagaagcaagag

SEQ ID NO: 1516336 - RNA, 19 nt, Homo sapiens
agacagagaacgugacagu

SEQ ID NO: 1516337 - RNA, 19 nt, Homo sapiens
gaggauucguggucuucau

SEQ ID NO: 1516338 - RNA, 19 nt, Homo sapiens
gagcucugggcacuucuuu

SEQ ID NO: 1516339 - RNA, 19 nt, Homo sapiens
agaggaauucuucaucuga

SEQ ID NO: 1516340 - RNA, 19 nt, Homo sapiens
caagaggaaagaggaauuc

SEQ ID NO: 1516341 - RNA, 19 nt, Homo sapiens
gguuucguguggaccguaa

SEQ ID NO: 1516342 - RNA, 19 nt, Homo sapiens
cgcaguacgugcuggaugu

SEQ ID NO: 1516343 - RNA, 19 nt, Homo sapiens
gcagacccucuucuucaau

SEQ ID NO: 1516344 - RNA, 19 nt, Homo sapiens
gugagcagcagccaggaaa

SEQ ID NO: 1516345 - RNA, 19 nt, Homo sapiens
ucugggcacuucuuugcaa

SEQ ID NO: 1516346 - RNA, 19 nt, Homo sapiens
ccaguggcuuggaugaaca

SEQ ID NO: 1516347 - RNA, 19 nt, Homo sapiens
gcgcugcugguguuucuga

SEQ ID NO: 1516348 - RNA, 19 nt, Homo sapiens
ggaaguacagacagagaac

SEQ ID NO: 1516349 - RNA, 19 nt, Homo sapiens
gggagggcguggaaauagg

SEQ ID NO: 1516350 - RNA, 19 nt, Homo sapiens
gggaacacagauuucuuug

SEQ ID NO: 1516351 - RNA, 19 nt, Homo sapiens
acagggagaagcaagagaa

SEQ ID NO: 1516352 - RNA, 19 nt, Homo sapiens
caugccagccauuguaaga

SEQ ID NO: 1516353 - RNA, 19 nt, Homo sapiens
ggaacacagauuucuuugg

SEQ ID NO: 1516354 - RNA, 19 nt, Homo sapiens
acaagaggaaagaggaauu

SEQ ID NO: 1516355 - RNA, 19 nt, Homo sapiens
ggcagaaggguuccuaucu

SEQ ID NO: 1516356 - RNA, 19 nt, Homo sapiens
cugcugguguuucugauca

SEQ ID NO: 1516357 - RNA, 19 nt, Homo sapiens
cuugcgaggcguccaauaa

SEQ ID NO: 1516358 - RNA, 19 nt, Homo sapiens
gcggauaacggcaccuaca

SEQ ID NO: 1516359 - RNA, 19 nt, Homo sapiens
ucugugucuuugugucaua

SEQ ID NO: 1516360 - RNA, 19 nt, Homo sapiens
agacacccaccaccagauu

SEQ ID NO: 1516361 - RNA, 19 nt, Homo sapiens
auagggauucugugucuuu

SEQ ID NO: 1516362 - RNA, 19 nt, Homo sapiens
guggaaauagggauucugu

SEQ ID NO: 1516363 - RNA, 19 nt, Homo sapiens
ggaugaacagggagaagca

SEQ ID NO: 1516364 - RNA, 19 nt, Homo sapiens
gguuuggcaaucucacuaa

SEQ ID NO: 1516365 - RNA, 19 nt, Homo sapiens
gccagccauuguaagaguu

SEQ ID NO: 1516366 - RNA, 19 nt, Homo sapiens
caaucucacuaaccaccau

SEQ ID NO: 1516367 - RNA, 19 nt, Homo sapiens
uucguggucuucaugguuu

SEQ ID NO: 1516368 - RNA, 19 nt, Homo sapiens
gggcaggacaggaaguaca

SEQ ID NO: 1516369 - RNA, 19 nt, Homo sapiens
ccugccgucugcaccagua

SEQ ID NO: 1516370 - RNA, 19 nt, Homo sapiens
ucugucccauccauauuug

SEQ ID NO: 1516371 - RNA, 19 nt, Homo sapiens
gcucugggcacuucuuugc

SEQ ID NO: 1516372 - RNA, 19 nt, Homo sapiens
ggggaacacagauuucuuu

SEQ ID NO: 1516373 - RNA, 19 nt, Homo sapiens
cuacguacuuguggucuac

SEQ ID NO: 1516374 - RNA, 19 nt, Homo sapiens
uaaggacgacggugguauc

SEQ ID NO: 1516375 - RNA, 19 nt, Homo sapiens
guaaggacgacggugguau

SEQ ID NO: 1516376 - RNA, 19 nt, Homo sapiens
ggguuuggcaaucucacua

SEQ ID NO: 1516377 - RNA, 19 nt, Homo sapiens
gggcguggaaauagggauu

SEQ ID NO: 1516378 - RNA, 19 nt, Homo sapiens
cgacggacacaagaggaaa

SEQ ID NO: 1516379 - RNA, 19 nt, Homo sapiens
gcgacggacacaagaggaa

SEQ ID NO: 1516380 - RNA, 19 nt, Homo sapiens
ugaacagggagaagcaaga

SEQ ID NO: 1516381 - RNA, 19 nt, Homo sapiens
ggaccgcaaggagcugaaa

SEQ ID NO: 1516382 - RNA, 19 nt, Homo sapiens
ucuacguacuuguggucua

SEQ ID NO: 1516383 - RNA, 19 nt, Homo sapiens
gcgaggcguccaauaagca

SEQ ID NO: 1516384 - RNA, 19 nt, Homo sapiens
caagaacacugcagacaug

SEQ ID NO: 1516385 - RNA, 19 nt, Homo sapiens
ggauagccaugcccaagua

SEQ ID NO: 1516386 - RNA, 19 nt, Homo sapiens
gcauaaggaucaagacaga

SEQ ID NO: 1516387 - RNA, 19 nt, Homo sapiens
gcucagaucuuugcaaauc

SEQ ID NO: 1516388 - RNA, 19 nt, Homo sapiens
gagauugacuagccaguug

SEQ ID NO: 1516389 - RNA, 19 nt, Homo sapiens
gaaaaucccugcccucaug

SEQ ID NO: 1516390 - RNA, 19 nt, Homo sapiens
gcagacaaccgcccuguga

SEQ ID NO: 1516391 - RNA, 19 nt, Homo sapiens
aguagacgaugaacuagua

SEQ ID NO: 1516392 - RNA, 19 nt, Homo sapiens
agggaucucuugaaccuua

SEQ ID NO: 1516393 - RNA, 19 nt, Homo sapiens
uguacuggaugccugauua

SEQ ID NO: 1516394 - RNA, 19 nt, Homo sapiens
gaggaggaaagacauuaua

SEQ ID NO: 1516395 - RNA, 19 nt, Homo sapiens
ggacacagcugagaaaauc

SEQ ID NO: 1516396 - RNA, 19 nt, Homo sapiens
gaagauggaggaggaaaga

SEQ ID NO: 1516397 - RNA, 19 nt, Homo sapiens
aaucauaccugguucuaag

SEQ ID NO: 1516398 - RNA, 19 nt, Homo sapiens
ccugugagcuucuacaagu

SEQ ID NO: 1516399 - RNA, 19 nt, Homo sapiens
ucccaaaccuucaccauca

SEQ ID NO: 1516400 - RNA, 19 nt, Homo sapiens
gcagugcccuccaucuucu

SEQ ID NO: 1516401 - RNA, 19 nt, Homo sapiens
cggcucagaucuuugcaaa

SEQ ID NO: 1516402 - RNA, 19 nt, Homo sapiens
gcgccgaacugcuccaaca

SEQ ID NO: 1516403 - RNA, 19 nt, Homo sapiens
gggagaaucauaccugguu

SEQ ID NO: 1516404 - RNA, 19 nt, Homo sapiens
acgaugaacuaguaaacaa

SEQ ID NO: 1516405 - RNA, 19 nt, Homo sapiens
gagcagagcaaggguuguu

SEQ ID NO: 1516406 - RNA, 19 nt, Homo sapiens
gcagagcaaggguuguuug

SEQ ID NO: 1516407 - RNA, 19 nt, Homo sapiens
ugacuagccaguugauuug

SEQ ID NO: 1516408 - RNA, 19 nt, Homo sapiens
ccaccuagaggaacuaugu

SEQ ID NO: 1516409 - RNA, 19 nt, Homo sapiens
guacugaguucaugauacc

SEQ ID NO: 1516410 - RNA, 19 nt, Homo sapiens
cuaaggagucccacgcuuu

SEQ ID NO: 1516411 - RNA, 19 nt, Homo sapiens
guacuggaugccugauuaa

SEQ ID NO: 1516412 - RNA, 19 nt, Homo sapiens
gaggaaagacauuauacgu

SEQ ID NO: 1516413 - RNA, 19 nt, Homo sapiens
ggaggaggaaagacauuau

SEQ ID NO: 1516414 - RNA, 19 nt, Homo sapiens
ggaucaagacagacaaugu

SEQ ID NO: 1516415 - RNA, 19 nt, Homo sapiens
gaaucauaccugguucuaa

SEQ ID NO: 1516416 - RNA, 19 nt, Homo sapiens
ugacauagccaugguccuu

SEQ ID NO: 1516417 - RNA, 19 nt, Homo sapiens
ugaagucccugcccaacag

SEQ ID NO: 1516418 - RNA, 19 nt, Homo sapiens
uugaguagacgaugaacua

SEQ ID NO: 1516419 - RNA, 19 nt, Homo sapiens
gguacugaguucaugauac

SEQ ID NO: 1516420 - RNA, 19 nt, Homo sapiens
gggcccaagucucucauca

SEQ ID NO: 1516421 - RNA, 19 nt, Homo sapiens
gggaccaccugccaagagu

SEQ ID NO: 1516422 - RNA, 19 nt, Homo sapiens
auuauucgcugaaacauac

SEQ ID NO: 1516423 - RNA, 19 nt, Homo sapiens
ccaagacuguggccaccau

SEQ ID NO: 1516424 - RNA, 19 nt, Homo sapiens
gguggacacagcugagaaa

SEQ ID NO: 1516425 - RNA, 19 nt, Homo sapiens
cuagggaucucuugaaccu

SEQ ID NO: 1516426 - RNA, 19 nt, Homo sapiens
cccaacacgugaugaaagu

SEQ ID NO: 1516427 - RNA, 19 nt, Homo sapiens
gguggagccguaagagauu

SEQ ID NO: 1516428 - RNA, 19 nt, Homo sapiens
caaggguuguuugggagaa

SEQ ID NO: 1516429 - RNA, 19 nt, Homo sapiens
cauuauucgcugaaacaua

SEQ ID NO: 1516430 - RNA, 19 nt, Homo sapiens
gaccugggcccaagucucu

SEQ ID NO: 1516431 - RNA, 19 nt, Homo sapiens
ggguggagccguaagagau

SEQ ID NO: 1516432 - RNA, 19 nt, Homo sapiens
ucaagggccuggguucuac

SEQ ID NO: 1516433 - RNA, 19 nt, Homo sapiens
cuagccaguugauuugguu

SEQ ID NO: 1516434 - RNA, 19 nt, Homo sapiens
uugacuagccaguugauuu

SEQ ID NO: 1516435 - RNA, 19 nt, Homo sapiens
ucuacaaguucccacugaa

SEQ ID NO: 1516436 - RNA, 19 nt, Homo sapiens
cgaugaacuaguaaacaaa

SEQ ID NO: 1516437 - RNA, 19 nt, Homo sapiens
gaucuuugcaaaucaguac

SEQ ID NO: 1516438 - RNA, 19 nt, Homo sapiens
agacugcguuuucauuauu

SEQ ID NO: 1516439 - RNA, 19 nt, Homo sapiens
uggaggaggaaagacauua

SEQ ID NO: 1516440 - RNA, 19 nt, Homo sapiens
guagacgaugaacuaguaa

SEQ ID NO: 1516441 - RNA, 19 nt, Homo sapiens
ccagacugcguuuucauua

SEQ ID NO: 1516442 - RNA, 19 nt, Homo sapiens
ggacaaaagauagaagaug

SEQ ID NO: 1516443 - RNA, 19 nt, Homo sapiens
gaggaaucccaaaccuuca

SEQ ID NO: 1516444 - RNA, 19 nt, Homo sapiens
gaccaccugccaagaguca

SEQ ID NO: 1516445 - RNA, 19 nt, Homo sapiens
gacgaugaacuaguaaaca

SEQ ID NO: 1516446 - RNA, 19 nt, Homo sapiens
ccucauggugcucauucua

SEQ ID NO: 1516447 - RNA, 19 nt, Homo sapiens
ucagaucuuugcaaaucag

SEQ ID NO: 1516448 - RNA, 19 nt, Homo sapiens
guaggguggagccguaaga

SEQ ID NO: 1516449 - RNA, 19 nt, Homo sapiens
guggagccguaagagauug

SEQ ID NO: 1516450 - RNA, 19 nt, Homo sapiens
ggaggaaagacauuauacg

SEQ ID NO: 1516451 - RNA, 19 nt, Homo sapiens
ggaccugaggaaucccaaa

SEQ ID NO: 1516452 - RNA, 19 nt, Homo sapiens
acaagaacacugcagacau

SEQ ID NO: 1516453 - RNA, 19 nt, Homo sapiens
caagccugguacugaguuc

SEQ ID NO: 1516454 - RNA, 19 nt, Homo sapiens
uagcagugccucccucaag

SEQ ID NO: 1516455 - RNA, 19 nt, Homo sapiens
ggccugacauagccauggu

SEQ ID NO: 1516456 - RNA, 19 nt, Homo sapiens
ucacagaacugcaggagaa

SEQ ID NO: 1516457 - RNA, 19 nt, Homo sapiens
caacgucuaugucaaguuc

SEQ ID NO: 1516458 - RNA, 19 nt, Homo sapiens
uaauaaagcugcguguuuc

SEQ ID NO: 1516459 - RNA, 19 nt, Homo sapiens
gccaggagguguucacaga

SEQ ID NO: 1516460 - RNA, 19 nt, Homo sapiens
gcauggagaccuucuucua

SEQ ID NO: 1516461 - RNA, 19 nt, Homo sapiens
uuaauaaagcugcguguuu

SEQ ID NO: 1516462 - RNA, 19 nt, Homo sapiens
ggacugagaaggacaaggu

SEQ ID NO: 1516463 - RNA, 19 nt, Homo sapiens
gcucccggcuucacaacaa

SEQ ID NO: 1516464 - RNA, 19 nt, Homo sapiens
gagaggaaccaucgguguu

SEQ ID NO: 1516465 - RNA, 19 nt, Homo sapiens
cgagguggcuucugcaacu

SEQ ID NO: 1516466 - RNA, 19 nt, Homo sapiens
cagaacugcaggagaagua

SEQ ID NO: 1516467 - RNA, 19 nt, Homo sapiens
aauguaaucuguucagcau

SEQ ID NO: 1516468 - RNA, 19 nt, Homo sapiens
gaaugugugcgacaaccuu

SEQ ID NO: 1516469 - RNA, 19 nt, Homo sapiens
gaacugcaggagaaguaug

SEQ ID NO: 1516470 - RNA, 19 nt, Homo sapiens
gcuccauaauguaaucugu

SEQ ID NO: 1516471 - RNA, 19 nt, Homo sapiens
ggagaaguauggggagauu

SEQ ID NO: 1516472 - RNA, 19 nt, Homo sapiens
uccauaauguaaucuguuc

SEQ ID NO: 1516473 - RNA, 19 nt, Homo sapiens
gagauugaagagaugaaug

SEQ ID NO: 1516474 - RNA, 19 nt, Homo sapiens
aaagcugcguguuucacuu

SEQ ID NO: 1516475 - RNA, 19 nt, Homo sapiens
gggcaacgucuaugucaag

SEQ ID NO: 1516476 - RNA, 19 nt, Homo sapiens
ggagauugaagagaugaau

SEQ ID NO: 1516477 - RNA, 19 nt, Homo sapiens
cugagaaggacaagguuaa

SEQ ID NO: 1516478 - RNA, 19 nt, Homo sapiens
guuccauacuggccacaau

SEQ ID NO: 1516479 - RNA, 19 nt, Homo sapiens
gagguggcuucugcaacuu

SEQ ID NO: 1516480 - RNA, 19 nt, Homo sapiens
cugaauauuuagcuucgau

SEQ ID NO: 1516481 - RNA, 19 nt, Homo sapiens
cagcauggagaccuucuuc

SEQ ID NO: 1516482 - RNA, 19 nt, Homo sapiens
gauauucgggacugagaag

SEQ ID NO: 1516483 - RNA, 19 nt, Homo sapiens
gguggcuucugcaacuuca

SEQ ID NO: 1516484 - RNA, 19 nt, Homo sapiens
cacaacaagccgacauuca

SEQ ID NO: 1516485 - RNA, 19 nt, Homo sapiens
agaaggacaagguuaacug

SEQ ID NO: 1516486 - RNA, 19 nt, Homo sapiens
guaaucuguucagcaugga

SEQ ID NO: 1516487 - RNA, 19 nt, Homo sapiens
gcaacgucuaugucaaguu

SEQ ID NO: 1516488 - RNA, 19 nt, Homo sapiens
cauggagaccuucuucuac

SEQ ID NO: 1516489 - RNA, 19 nt, Homo sapiens
acaacaagccgacauucag

SEQ ID NO: 1516490 - RNA, 19 nt, Homo sapiens
gaaacuagcccuacaaaua

SEQ ID NO: 1516491 - RNA, 19 nt, Homo sapiens
ggaauaacaucucuaguaa

SEQ ID NO: 1516492 - RNA, 19 nt, Homo sapiens
cgacaaaugugaagaaugu

SEQ ID NO: 1516493 - RNA, 19 nt, Homo sapiens
ggaaagcauuuauacuuga

SEQ ID NO: 1516494 - RNA, 19 nt, Homo sapiens
gagaagcucuacaaaccua

SEQ ID NO: 1516495 - RNA, 19 nt, Homo sapiens
gaaagcaugcgaucaauug

SEQ ID NO: 1516496 - RNA, 19 nt, Homo sapiens
cuacaaaugugaagaaugu

SEQ ID NO: 1516497 - RNA, 19 nt, Homo sapiens
cuacaaacgugaagaaugu

SEQ ID NO: 1516498 - RNA, 19 nt, Homo sapiens
ugaagaauguggcaaaguu

SEQ ID NO: 1516499 - RNA, 19 nt, Homo sapiens
gguaagagauggcaacagu

SEQ ID NO: 1516500 - RNA, 19 nt, Homo sapiens
ggucgaauguggcaaaguu

SEQ ID NO: 1516501 - RNA, 19 nt, Homo sapiens
ucagagauaugaaagauuc

SEQ ID NO: 1516502 - RNA, 19 nt, Homo sapiens
gaaaucauagugucaagaa

SEQ ID NO: 1516503 - RNA, 19 nt, Homo sapiens
uggcaacaguuuacuauuu

SEQ ID NO: 1516504 - RNA, 19 nt, Homo sapiens
gcucuucauuccuacuuua

SEQ ID NO: 1516505 - RNA, 19 nt, Homo sapiens
guacaccuaugaagaaugu

SEQ ID NO: 1516506 - RNA, 19 nt, Homo sapiens
ccaaagugcugggauuaaa

SEQ ID NO: 1516507 - RNA, 19 nt, Homo sapiens
gaagaauguugcaaagcuu

SEQ ID NO: 1516508 - RNA, 19 nt, Homo sapiens
gagaacaccuuaaacuuuu

SEQ ID NO: 1516509 - RNA, 19 nt, Homo sapiens
ggcaaacacuguaaccauu

SEQ ID NO: 1516510 - RNA, 19 nt, Homo sapiens
aauaucugcucacaucuua

SEQ ID NO: 1516511 - RNA, 19 nt, Homo sapiens
ggcaacaguuuacuauuug

SEQ ID NO: 1516512 - RNA, 19 nt, Homo sapiens
gcaauuacugugagaauau

SEQ ID NO: 1516513 - RNA, 19 nt, Homo sapiens
ugagaacaccuuaaacuuu

SEQ ID NO: 1516514 - RNA, 19 nt, Homo sapiens
aaccauuucucacaucuua

SEQ ID NO: 1516515 - RNA, 19 nt, Homo sapiens
gcaaacacuguaaccauuu

SEQ ID NO: 1516516 - RNA, 19 nt, Homo sapiens
ccucaaaccuuacugaaca

SEQ ID NO: 1516517 - RNA, 19 nt, Homo sapiens
gggaauguauaauagagaa

SEQ ID NO: 1516518 - RNA, 19 nt, Homo sapiens
ugaagaauguggcaaaaua

SEQ ID NO: 1516519 - RNA, 19 nt, Homo sapiens
aaacuagcccuacaaauau

SEQ ID NO: 1516520 - RNA, 19 nt, Homo sapiens
gcacuucagacuacacuaa

SEQ ID NO: 1516521 - RNA, 19 nt, Homo sapiens
uaagagauggcaacaguuu

SEQ ID NO: 1516522 - RNA, 19 nt, Homo sapiens
ggauguaauucaacucuca

SEQ ID NO: 1516523 - RNA, 19 nt, Homo sapiens
uaaaucagaguguugagua

SEQ ID NO: 1516524 - RNA, 19 nt, Homo sapiens
gcuaauuuauccuagagaa

SEQ ID NO: 1516525 - RNA, 19 nt, Homo sapiens
gaagaauguggcaaaguuu

SEQ ID NO: 1516526 - RNA, 19 nt, Homo sapiens
caauccaaaucuacacuuu

SEQ ID NO: 1516527 - RNA, 19 nt, Homo sapiens
uggaauaacaucucuagua

SEQ ID NO: 1516528 - RNA, 19 nt, Homo sapiens
gcauaggaaagcauuuaua

SEQ ID NO: 1516529 - RNA, 19 nt, Homo sapiens
acucacaccuuaucgcaua

SEQ ID NO: 1516530 - RNA, 19 nt, Homo sapiens
aaagacgguuguaguacua

SEQ ID NO: 1516531 - RNA, 19 nt, Homo sapiens
uauaaagacgguuguagua

SEQ ID NO: 1516532 - RNA, 19 nt, Homo sapiens
guagaugcaguaaauauga

SEQ ID NO: 1516533 - RNA, 19 nt, Homo sapiens
gaagagaaacccuacaaac

SEQ ID NO: 1516534 - RNA, 19 nt, Homo sapiens
gaagagaaacccgacaaau

SEQ ID NO: 1516535 - RNA, 19 nt, Homo sapiens
uaacaucucuaguaaucuc

SEQ ID NO: 1516536 - RNA, 19 nt, Homo sapiens
caucagagauaugaaagau

SEQ ID NO: 1516537 - RNA, 19 nt, Homo sapiens
aaccaauacucacaccuua

SEQ ID NO: 1516538 - RNA, 19 nt, Homo sapiens
ggucuucaacucauacuaa

SEQ ID NO: 1516539 - RNA, 19 nt, Homo sapiens
gaauauuguucucguaggu

SEQ ID NO: 1516540 - RNA, 19 nt, Homo sapiens
ggcuuuaaccugcaaauaa

SEQ ID NO: 1516541 - RNA, 19 nt, Homo sapiens
gcaaauaaggauguaauuc

SEQ ID NO: 1516542 - RNA, 19 nt, Homo sapiens
gcacuggcacuucagacua

SEQ ID NO: 1516543 - RNA, 19 nt, Homo sapiens
ucaagaagcccuagaugug

SEQ ID NO: 1516544 - RNA, 19 nt, Homo sapiens
gaaaagccauuaauaucug

SEQ ID NO: 1516545 - RNA, 19 nt, Homo sapiens
gagaauucauacagaagau

SEQ ID NO: 1516546 - RNA, 19 nt, Homo sapiens
uuaacguccucaaaccuua

SEQ ID NO: 1516547 - RNA, 19 nt, Homo sapiens
ggugcaaucucaguucauu

SEQ ID NO: 1516548 - RNA, 19 nt, Homo sapiens
ugaagaauguaacaaaguc

SEQ ID NO: 1516549 - RNA, 19 nt, Homo sapiens
agagaaacccgacaaaugu

SEQ ID NO: 1516550 - RNA, 19 nt, Homo sapiens
gccacucgcuuuaaccuau

SEQ ID NO: 1516551 - RNA, 19 nt, Homo sapiens
ucagagaauucacaguaga

SEQ ID NO: 1516552 - RNA, 19 nt, Homo sapiens
acacuugaguauaagcuaa

SEQ ID NO: 1516553 - RNA, 19 nt, Homo sapiens
caagaagcccuagauguga

SEQ ID NO: 1516554 - RNA, 19 nt, Homo sapiens
uaacuggucuucaacucau

SEQ ID NO: 1516555 - RNA, 19 nt, Homo sapiens
gaauguggcaaacacugua

SEQ ID NO: 1516556 - RNA, 19 nt, Homo sapiens
uacaagcaauccaaaucua

SEQ ID NO: 1516557 - RNA, 19 nt, Homo sapiens
aggaaagcauuuauacuug

SEQ ID NO: 1516558 - RNA, 19 nt, Homo sapiens
ccaaagugcugggauuaca

SEQ ID NO: 1516559 - RNA, 19 nt, Homo sapiens
caaacacuguaaccauuuc

SEQ ID NO: 1516560 - RNA, 19 nt, Homo sapiens
agaugggcauuauuuauga

SEQ ID NO: 1516561 - RNA, 19 nt, Homo sapiens
uuaaaugguugucacacuu

SEQ ID NO: 1516562 - RNA, 19 nt, Homo sapiens
ugacagugcucuugagaac

SEQ ID NO: 1516563 - RNA, 19 nt, Homo sapiens
uuaagucuguuguacauuc

SEQ ID NO: 1516564 - RNA, 19 nt, Homo sapiens
ugucagagaauucacagua

SEQ ID NO: 1516565 - RNA, 19 nt, Homo sapiens
uuagaauggugaagaguau

SEQ ID NO: 1516566 - RNA, 19 nt, Homo sapiens
ugaagaauguugcaaagcu

SEQ ID NO: 1516567 - RNA, 19 nt, Homo sapiens
aaaucagaguguugaguaa

SEQ ID NO: 1516568 - RNA, 19 nt, Homo sapiens
caauaucagggaauguaua

SEQ ID NO: 1516569 - RNA, 19 nt, Homo sapiens
uaaagacgguuguaguacu

SEQ ID NO: 1516570 - RNA, 19 nt, Homo sapiens
gauggcaacaguuuacuau

SEQ ID NO: 1516571 - RNA, 19 nt, Homo sapiens
auuaauaucugcucacauc

SEQ ID NO: 1516572 - RNA, 19 nt, Homo sapiens
ucucacaucuuaccacaca

SEQ ID NO: 1516573 - RNA, 19 nt, Homo sapiens
gaauuacaagcaauccaaa

SEQ ID NO: 1516574 - RNA, 19 nt, Homo sapiens
gagggauucuucaccuuca

SEQ ID NO: 1516575 - RNA, 19 nt, Homo sapiens
guagguguucugaggaaua

SEQ ID NO: 1516576 - RNA, 19 nt, Homo sapiens
guaaaugucagagaauuca

SEQ ID NO: 1516577 - RNA, 19 nt, Homo sapiens
caucacagaguuuauacuu

SEQ ID NO: 1516578 - RNA, 19 nt, Homo sapiens
gcucacaucuuaacaucac

SEQ ID NO: 1516579 - RNA, 19 nt, Homo sapiens
aagagaaacccgacaaaug

SEQ ID NO: 1516580 - RNA, 19 nt, Homo sapiens
gaauucacaguagaaauga

SEQ ID NO: 1516581 - RNA, 19 nt, Homo sapiens
uuuaaccuaucccaccuua

SEQ ID NO: 1516582 - RNA, 19 nt, Homo sapiens
uuacaagcaugagccauug

SEQ ID NO: 1516583 - RNA, 19 nt, Homo sapiens
agaauucacaguagaaaug

SEQ ID NO: 1516584 - RNA, 19 nt, Homo sapiens
ccaagcagcugggauugca

SEQ ID NO: 1516585 - RNA, 19 nt, Homo sapiens
gcgauucucuggccucaac

SEQ ID NO: 1516586 - RNA, 19 nt, Homo sapiens
auauuguucucguagguua

SEQ ID NO: 1516587 - RNA, 19 nt, Homo sapiens
ugcaauuacugugagaaua

SEQ ID NO: 1516588 - RNA, 19 nt, Homo sapiens
uuucaacccuuauuacaca

SEQ ID NO: 1516589 - RNA, 19 nt, Homo sapiens
guaaaugagggauucuuca

SEQ ID NO: 1516590 - RNA, 19 nt, Homo sapiens
gcacagcggaauuuauaua

SEQ ID NO: 1516591 - RNA, 19 nt, Homo sapiens
gcacaaaugucugcaugau

SEQ ID NO: 1516592 - RNA, 19 nt, Homo sapiens
ucagugagcuuccuucaag

SEQ ID NO: 1516593 - RNA, 19 nt, Homo sapiens
gaaaugucugagaguaaua

SEQ ID NO: 1516594 - RNA, 19 nt, Homo sapiens
ugaaaugucugagaguaau

SEQ ID NO: 1516595 - RNA, 19 nt, Homo sapiens
gccaaaguccucuucauga

SEQ ID NO: 1516596 - RNA, 19 nt, Homo sapiens
uuagagauguggccauaga

SEQ ID NO: 1516597 - RNA, 19 nt, Homo sapiens
gaguaauaguuucuguuga

SEQ ID NO: 1516598 - RNA, 19 nt, Homo sapiens
gagauguggccauagaauu

SEQ ID NO: 1516599 - RNA, 19 nt, Homo sapiens
cugcacagcggaauuuaua

SEQ ID NO: 1516600 - RNA, 19 nt, Homo sapiens
ugucugagaguaauaguuu

SEQ ID NO: 1516601 - RNA, 19 nt, Homo sapiens
aaccuggucuuccuuggua

SEQ ID NO: 1516602 - RNA, 19 nt, Homo sapiens
guucuuacuucuccuaaag

SEQ ID NO: 1516603 - RNA, 19 nt, Homo sapiens
ucugaaaugucugagagua

SEQ ID NO: 1516604 - RNA, 19 nt, Homo sapiens
ccauugcaauuuagagaug

SEQ ID NO: 1516605 - RNA, 19 nt, Homo sapiens
gagccaaaguccucuucau

SEQ ID NO: 1516606 - RNA, 19 nt, Homo sapiens
ccaaaguccucuucaugac

SEQ ID NO: 1516607 - RNA, 19 nt, Homo sapiens
gagaguaauaguuucuguu

SEQ ID NO: 1516608 - RNA, 19 nt, Homo sapiens
gaucaccugucuggagcaa

SEQ ID NO: 1516609 - RNA, 19 nt, Homo sapiens
gaccauugcaauuuagaga

SEQ ID NO: 1516610 - RNA, 19 nt, Homo sapiens
ggcuugaaauauauaguuc

SEQ ID NO: 1516611 - RNA, 19 nt, Homo sapiens
agaguaauaguuucuguug

SEQ ID NO: 1516612 - RNA, 19 nt, Homo sapiens
ugagaguaauaguuucugu

SEQ ID NO: 1516613 - RNA, 19 nt, Homo sapiens
aaaguccucuucaugacau

SEQ ID NO: 1516614 - RNA, 19 nt, Homo sapiens
caaaguccucuucaugaca

SEQ ID NO: 1516615 - RNA, 19 nt, Homo sapiens
acacugcacagcggaauuu

SEQ ID NO: 1516616 - RNA, 19 nt, Homo sapiens
gguucuuacuucuccuaaa

SEQ ID NO: 1516617 - RNA, 19 nt, Homo sapiens
auugggagauccacagcua

SEQ ID NO: 1516618 - RNA, 19 nt, Homo sapiens
cuucaugacauauaagaga

SEQ ID NO: 1516619 - RNA, 19 nt, Homo sapiens
gagauccacagcuaagaca

SEQ ID NO: 1516620 - RNA, 19 nt, Homo sapiens
auuuagagauguggccaua

SEQ ID NO: 1516621 - RNA, 19 nt, Homo sapiens
cacaaaugucugcaugauu

SEQ ID NO: 1516622 - RNA, 19 nt, Homo sapiens
ugagcuuccuucaaguuca

SEQ ID NO: 1516623 - RNA, 19 nt, Homo sapiens
caggucugguucuuacuuc

SEQ ID NO: 1516624 - RNA, 19 nt, Homo sapiens
agauguggccauagaauuc

SEQ ID NO: 1516625 - RNA, 19 nt, Homo sapiens
cugaaaugucugagaguaa

SEQ ID NO: 1516626 - RNA, 19 nt, Homo sapiens
ggagauccacagcuaagac

SEQ ID NO: 1516627 - RNA, 19 nt, Homo sapiens
cuaucuaggcuugaaauau

SEQ ID NO: 1516628 - RNA, 19 nt, Homo sapiens
gagcuuccuucaaguucac

SEQ ID NO: 1516629 - RNA, 19 nt, Homo sapiens
ggaccuccuggaagccaaa

SEQ ID NO: 1516630 - RNA, 19 nt, Homo sapiens
gcagggagguuuacucauu

SEQ ID NO: 1516631 - RNA, 19 nt, Homo sapiens
gcagaggauugaccaagaa

SEQ ID NO: 1516632 - RNA, 19 nt, Homo sapiens
gauacacgcuccugacuuc

SEQ ID NO: 1516633 - RNA, 19 nt, Homo sapiens
cgacggcccucaacuguga

SEQ ID NO: 1516634 - RNA, 19 nt, Homo sapiens
ccacugagggcaucuauga

SEQ ID NO: 1516635 - RNA, 19 nt, Homo sapiens
gaggauugaccaagaauug

SEQ ID NO: 1516636 - RNA, 19 nt, Homo sapiens
ccaagacaaugagauauuc

SEQ ID NO: 1516637 - RNA, 19 nt, Homo sapiens
cagggagguuuacucauuu

SEQ ID NO: 1516638 - RNA, 19 nt, Homo sapiens
cagccgaucuucuguguuc

SEQ ID NO: 1516639 - RNA, 19 nt, Homo sapiens
gccaggcucugaccacuga

SEQ ID NO: 1516640 - RNA, 19 nt, Homo sapiens
gcaggccacucagauguga

SEQ ID NO: 1516641 - RNA, 19 nt, Homo sapiens
aaaaggagcugccugaguu

SEQ ID NO: 1516642 - RNA, 19 nt, Homo sapiens
ccacagaaagugaaguuug

SEQ ID NO: 1516643 - RNA, 19 nt, Homo sapiens
ccacaaggaggaauaugaa

SEQ ID NO: 1516644 - RNA, 19 nt, Homo sapiens
gaugcucucugcccugaau

SEQ ID NO: 1516645 - RNA, 19 nt, Homo sapiens
gcaaagucaucugcuaacu

SEQ ID NO: 1516646 - RNA, 19 nt, Homo sapiens
ggauugaccaagaauugaa

SEQ ID NO: 1516647 - RNA, 19 nt, Homo sapiens
ggcgcgugcugaagaaauu

SEQ ID NO: 1516648 - RNA, 19 nt, Homo sapiens
gggagaccauacucaggaa

SEQ ID NO: 1516649 - RNA, 19 nt, Homo sapiens
gcagagggacuuucacacu

SEQ ID NO: 1516650 - RNA, 19 nt, Homo sapiens
caggagaugggaauugaaa

SEQ ID NO: 1516651 - RNA, 19 nt, Homo sapiens
ggagaugccgugggacuug

SEQ ID NO: 1516652 - RNA, 19 nt, Homo sapiens
gcucaaucauuugcacuuc

SEQ ID NO: 1516653 - RNA, 19 nt, Homo sapiens
gccacaaggaggaauauga

SEQ ID NO: 1516654 - RNA, 19 nt, Homo sapiens
gagcaggagaugggaauug

SEQ ID NO: 1516655 - RNA, 19 nt, Homo sapiens
aaucuuaacuuggugucaa

SEQ ID NO: 1516656 - RNA, 19 nt, Homo sapiens
gcgcagggagguuuacuca

SEQ ID NO: 1516657 - RNA, 19 nt, Homo sapiens
ugacuucccagcgagaaua

SEQ ID NO: 1516658 - RNA, 19 nt, Homo sapiens
gaugugagagugaggaagu

SEQ ID NO: 1516659 - RNA, 19 nt, Homo sapiens
gagauauuccugcccuuuc

SEQ ID NO: 1516660 - RNA, 19 nt, Homo sapiens
cgaaaccacagaaagugaa

SEQ ID NO: 1516661 - RNA, 19 nt, Homo sapiens
gucaucugcuaacuggaua

SEQ ID NO: 1516662 - RNA, 19 nt, Homo sapiens
gaugcagagccucguguuu

SEQ ID NO: 1516663 - RNA, 19 nt, Homo sapiens
ggauucccguguguucuug

SEQ ID NO: 1516664 - RNA, 19 nt, Homo sapiens
gagaccauacucaggaaga

SEQ ID NO: 1516665 - RNA, 19 nt, Homo sapiens
ccacugccuuggcucaaca

SEQ ID NO: 1516666 - RNA, 19 nt, Homo sapiens
ggcagccgaucuucugugu

SEQ ID NO: 1516667 - RNA, 19 nt, Homo sapiens
cagcagcggcagcaccuaa

SEQ ID NO: 1516668 - RNA, 19 nt, Homo sapiens
caaagucaucugcuaacug

SEQ ID NO: 1516669 - RNA, 19 nt, Homo sapiens
cacagaaagugaaguuugc

SEQ ID NO: 1516670 - RNA, 19 nt, Homo sapiens
gcagcaccaaggccacuuu

SEQ ID NO: 1516671 - RNA, 19 nt, Homo sapiens
ggauacacgcuccugacuu

SEQ ID NO: 1516672 - RNA, 19 nt, Homo sapiens
ucaaucauuugcacuucau

SEQ ID NO: 1516673 - RNA, 19 nt, Homo sapiens
gauugaccaagaauugaaa

SEQ ID NO: 1516674 - RNA, 19 nt, Homo sapiens
ugcagaggauugaccaaga

SEQ ID NO: 1516675 - RNA, 19 nt, Homo sapiens
gacgacggcccucaacugu

SEQ ID NO: 1516676 - RNA, 19 nt, Homo sapiens
cccaagacaaugagauauu

SEQ ID NO: 1516677 - RNA, 19 nt, Homo sapiens
gagaccguuuccucccauu

SEQ ID NO: 1516678 - RNA, 19 nt, Homo sapiens
gagccgaaaccacagaaag

SEQ ID NO: 1516679 - RNA, 19 nt, Homo sapiens
ggcagcaccguuuggcuuu

SEQ ID NO: 1516680 - RNA, 19 nt, Homo sapiens
ugagauauuccugcccuuu

SEQ ID NO: 1516681 - RNA, 19 nt, Homo sapiens
uggacacccugcugaggaa

SEQ ID NO: 1516682 - RNA, 19 nt, Homo sapiens
cccauucugucuggaguuu

SEQ ID NO: 1516683 - RNA, 19 nt, Homo sapiens
ucugcuaacuggauauugg

SEQ ID NO: 1516684 - RNA, 19 nt, Homo sapiens
ggugcuugcugcagaggau

SEQ ID NO: 1516685 - RNA, 19 nt, Homo sapiens
gcaggagaugggaauugaa

SEQ ID NO: 1516686 - RNA, 19 nt, Homo sapiens
agcaggagaugggaauuga

SEQ ID NO: 1516687 - RNA, 19 nt, Homo sapiens
gaccggaagccaguugcua

SEQ ID NO: 1516688 - RNA, 19 nt, Homo sapiens
gcagcaccguuuggcuuuc

SEQ ID NO: 1516689 - RNA, 19 nt, Homo sapiens
gaaaccacagaaagugaag

SEQ ID NO: 1516690 - RNA, 19 nt, Homo sapiens
ccgaaaccacagaaaguga

SEQ ID NO: 1516691 - RNA, 19 nt, Homo sapiens
gguggcagccgaucuucug

SEQ ID NO: 1516692 - RNA, 19 nt, Homo sapiens
ugacgacggcccucaacug

SEQ ID NO: 1516693 - RNA, 19 nt, Homo sapiens
uuccugcccuuuccuccua

SEQ ID NO: 1516694 - RNA, 19 nt, Homo sapiens
uuaccgacuuccucugcuu

SEQ ID NO: 1516695 - RNA, 19 nt, Homo sapiens
cgagcccucuggacaagca

SEQ ID NO: 1516696 - RNA, 19 nt, Homo sapiens
ggaugcagagccucguguu

SEQ ID NO: 1516697 - RNA, 19 nt, Homo sapiens
gaauaucuccgccuuuugg

SEQ ID NO: 1516698 - RNA, 19 nt, Homo sapiens
ucagccacaaggaggaaua

SEQ ID NO: 1516699 - RNA, 19 nt, Homo sapiens
cacaaggaggaauaugaaa

SEQ ID NO: 1516700 - RNA, 19 nt, Homo sapiens
gaaagcaucugccguguag

SEQ ID NO: 1516701 - RNA, 19 nt, Homo sapiens
guagaaacguuauccaugu

SEQ ID NO: 1516702 - RNA, 19 nt, Homo sapiens
ugaaaugagugccaauaaa

SEQ ID NO: 1516703 - RNA, 19 nt, Homo sapiens
gaaacugaggcuucucuua

SEQ ID NO: 1516704 - RNA, 19 nt, Homo sapiens
gcaguuaacaguaguaugu

SEQ ID NO: 1516705 - RNA, 19 nt, Homo sapiens
cagauuugguguuguguaa

SEQ ID NO: 1516706 - RNA, 19 nt, Homo sapiens
gaagccagauuugguguug

SEQ ID NO: 1516707 - RNA, 19 nt, Homo sapiens
ucagauuacuucauuguuc

SEQ ID NO: 1516708 - RNA, 19 nt, Homo sapiens
gaacuagaucgagcugaua

SEQ ID NO: 1516709 - RNA, 19 nt, Homo sapiens
aauggcaacugacuucuuu

SEQ ID NO: 1516710 - RNA, 19 nt, Homo sapiens
ucucucagauuacuucauu

SEQ ID NO: 1516711 - RNA, 19 nt, Homo sapiens
agaaagugaucauugucua

SEQ ID NO: 1516712 - RNA, 19 nt, Homo sapiens
gauagagacccuaguaaca

SEQ ID NO: 1516713 - RNA, 19 nt, Homo sapiens
gaaaugagugccaauaaaa

SEQ ID NO: 1516714 - RNA, 19 nt, Homo sapiens
cuacucaccuagacauuau

SEQ ID NO: 1516715 - RNA, 19 nt, Homo sapiens
aaacugaggcuucucuuau

SEQ ID NO: 1516716 - RNA, 19 nt, Homo sapiens
gcugauagagacccuagua

SEQ ID NO: 1516717 - RNA, 19 nt, Homo sapiens
gaugaaaugagugccaaua

SEQ ID NO: 1516718 - RNA, 19 nt, Homo sapiens
ugacaguccugagaauuau

SEQ ID NO: 1516719 - RNA, 19 nt, Homo sapiens
cuaguaacauguauaccaa

SEQ ID NO: 1516720 - RNA, 19 nt, Homo sapiens
cagauuacuucauuguuca

SEQ ID NO: 1516721 - RNA, 19 nt, Homo sapiens
guacagaugacucagugaa

SEQ ID NO: 1516722 - RNA, 19 nt, Homo sapiens
uaacggaccaggaacaugu

SEQ ID NO: 1516723 - RNA, 19 nt, Homo sapiens
ggugugcguucucguucua

SEQ ID NO: 1516724 - RNA, 19 nt, Homo sapiens
acagaugacucagugaaga

SEQ ID NO: 1516725 - RNA, 19 nt, Homo sapiens
gaucauugucuacguugaa

SEQ ID NO: 1516726 - RNA, 19 nt, Homo sapiens
ugaacuagaucgagcugau

SEQ ID NO: 1516727 - RNA, 19 nt, Homo sapiens
ugaggcuucucuuaugaaa

SEQ ID NO: 1516728 - RNA, 19 nt, Homo sapiens
uagagacccuaguaacaug

SEQ ID NO: 1516729 - RNA, 19 nt, Homo sapiens
cugacaguccugagaauua

SEQ ID NO: 1516730 - RNA, 19 nt, Homo sapiens
gggagucucucaguaucuu

SEQ ID NO: 1516731 - RNA, 19 nt, Homo sapiens
aggcuucucuuaugaaaca

SEQ ID NO: 1516732 - RNA, 19 nt, Homo sapiens
gagaauuauugaugguaag

SEQ ID NO: 1516733 - RNA, 19 nt, Homo sapiens
ugacacugaugaaaugagu

SEQ ID NO: 1516734 - RNA, 19 nt, Homo sapiens
gggauacuaggaauaaaga

SEQ ID NO: 1516735 - RNA, 19 nt, Homo sapiens
gcgaauauggguagugcuu

SEQ ID NO: 1516736 - RNA, 19 nt, Homo sapiens
gaaagugaucauugucuac

SEQ ID NO: 1516737 - RNA, 19 nt, Homo sapiens
ggaauaaagaaagugauca

SEQ ID NO: 1516738 - RNA, 19 nt, Homo sapiens
acaaauggcaacugacuuc

SEQ ID NO: 1516739 - RNA, 19 nt, Homo sapiens
uaccuugggcgaauuguuu

SEQ ID NO: 1516740 - RNA, 19 nt, Homo sapiens
aaauguuuaugccucugua

SEQ ID NO: 1516741 - RNA, 19 nt, Homo sapiens
caagaagccgggagguuca

SEQ ID NO: 1516742 - RNA, 19 nt, Homo sapiens
uccaaugccuacucaccua

SEQ ID NO: 1516743 - RNA, 19 nt, Homo sapiens
acugaggcuucucuuauga

SEQ ID NO: 1516744 - RNA, 19 nt, Homo sapiens
ugaaagcaucugccgugua

SEQ ID NO: 1516745 - RNA, 19 nt, Homo sapiens
ccuacucaccuagacauua

SEQ ID NO: 1516746 - RNA, 19 nt, Homo sapiens
guauuacuaccugcaaauu

SEQ ID NO: 1516747 - RNA, 19 nt, Homo sapiens
ggacgcaugcgccguuucu

SEQ ID NO: 1516748 - RNA, 19 nt, Homo sapiens
guccugagaauuauugaug

SEQ ID NO: 1516749 - RNA, 19 nt, Homo sapiens
gauucuguuucaucucuca

SEQ ID NO: 1516750 - RNA, 19 nt, Homo sapiens
cguuauccauguccggaaa

SEQ ID NO: 1516751 - RNA, 19 nt, Homo sapiens
uagaaacguuauccauguc

SEQ ID NO: 1516752 - RNA, 19 nt, Homo sapiens
aagcaucugccguguagaa

SEQ ID NO: 1516753 - RNA, 19 nt, Homo sapiens
gacccuaguaacauguaua

SEQ ID NO: 1516754 - RNA, 19 nt, Homo sapiens
cagaugacucagugaagaa

SEQ ID NO: 1516755 - RNA, 19 nt, Homo sapiens
guuccuaucuguguaucug

SEQ ID NO: 1516756 - RNA, 19 nt, Homo sapiens
aacugaggcuucucuuaug

SEQ ID NO: 1516757 - RNA, 19 nt, Homo sapiens
gauuugguguuguguaacg

SEQ ID NO: 1516758 - RNA, 19 nt, Homo sapiens
gagacccuaguaacaugua

SEQ ID NO: 1516759 - RNA, 19 nt, Homo sapiens
uuccuaauccugcgaauau

SEQ ID NO: 1516760 - RNA, 19 nt, Homo sapiens
cuaggaauaaagaaaguga

SEQ ID NO: 1516761 - RNA, 19 nt, Homo sapiens
ccauguggcucuccuuucc

SEQ ID NO: 1516762 - RNA, 19 nt, Homo sapiens
gguguaccuugggcgaauu

SEQ ID NO: 1516763 - RNA, 19 nt, Homo sapiens
ugacaaauggcaacugacu

SEQ ID NO: 1516764 - RNA, 19 nt, Homo sapiens
caucugccguguagaaacg

SEQ ID NO: 1516765 - RNA, 19 nt, Homo sapiens
ccagauuugguguugugua

SEQ ID NO: 1516766 - RNA, 19 nt, Homo sapiens
gacaaauggcaacugacuu

SEQ ID NO: 1516767 - RNA, 19 nt, Homo sapiens
ugcugacacugaugaaaug

SEQ ID NO: 1516768 - RNA, 19 nt, Homo sapiens
uguaaaggcgucugacagu

SEQ ID NO: 1516769 - RNA, 19 nt, Homo sapiens
ggcaacugacuucuuuaga

SEQ ID NO: 1516770 - RNA, 19 nt, Homo sapiens
agugaucauugucuacguu

SEQ ID NO: 1516771 - RNA, 19 nt, Homo sapiens
cuugggauacuaggaauaa

SEQ ID NO: 1516772 - RNA, 19 nt, Homo sapiens
ccuaguaacauguauacca

SEQ ID NO: 1516773 - RNA, 19 nt, Homo sapiens
uuaugccucuguaaaccaa

SEQ ID NO: 1516774 - RNA, 19 nt, Homo sapiens
guccggaaagauucuguuu

SEQ ID NO: 1516775 - RNA, 19 nt, Homo sapiens
ccgggagucucucaguauc

SEQ ID NO: 1516776 - RNA, 19 nt, Homo sapiens
augaaaugagugccaauaa

SEQ ID NO: 1516777 - RNA, 19 nt, Homo sapiens
caacauaauugcagcauuu

SEQ ID NO: 1516778 - RNA, 19 nt, Homo sapiens
gaagguagaugggaaauug

SEQ ID NO: 1516779 - RNA, 19 nt, Homo sapiens
gcagugggcugaauggaaa

SEQ ID NO: 1516780 - RNA, 19 nt, Homo sapiens
ccagauguauuauguauga

SEQ ID NO: 1516781 - RNA, 19 nt, Homo sapiens
gcccaaaccuugucaguau

SEQ ID NO: 1516782 - RNA, 19 nt, Homo sapiens
ggaauugcaagcuuucuua

SEQ ID NO: 1516783 - RNA, 19 nt, Homo sapiens
gaagaagauuacagaguug

SEQ ID NO: 1516784 - RNA, 19 nt, Homo sapiens
agaagaagauuacagaguu

SEQ ID NO: 1516785 - RNA, 19 nt, Homo sapiens
gaagagcauuuauggagau

SEQ ID NO: 1516786 - RNA, 19 nt, Homo sapiens
gaaagaugauagaaagaag

SEQ ID NO: 1516787 - RNA, 19 nt, Homo sapiens
gagaaagagaagaagauua

SEQ ID NO: 1516788 - RNA, 19 nt, Homo sapiens
ggaaagaugauagaaagaa

SEQ ID NO: 1516789 - RNA, 19 nt, Homo sapiens
guaaugugcagaaugauuu

SEQ ID NO: 1516790 - RNA, 19 nt, Homo sapiens
caggaaagaugauagaaag

SEQ ID NO: 1516791 - RNA, 19 nt, Homo sapiens
caagaaaugugcucagaac

SEQ ID NO: 1516792 - RNA, 19 nt, Homo sapiens
gcauuuauggagauacuua

SEQ ID NO: 1516793 - RNA, 19 nt, Homo sapiens
ggcuuucucucuccaauaa

SEQ ID NO: 1516794 - RNA, 19 nt, Homo sapiens
acaaagaagucacagaaca

SEQ ID NO: 1516795 - RNA, 19 nt, Homo sapiens
ccacaaagaagucacagaa

SEQ ID NO: 1516796 - RNA, 19 nt, Homo sapiens
ugccagcgcugcacaaauu

SEQ ID NO: 1516797 - RNA, 19 nt, Homo sapiens
uaagggagguagcaaagau

SEQ ID NO: 1516798 - RNA, 19 nt, Homo sapiens
uugcuaaggugaaacaauu

SEQ ID NO: 1516799 - RNA, 19 nt, Homo sapiens
gugcacacuuucauacaaa

SEQ ID NO: 1516800 - RNA, 19 nt, Homo sapiens
ggagaaaacccacaaagaa

SEQ ID NO: 1516801 - RNA, 19 nt, Homo sapiens
ggaccacccuauucuugug

SEQ ID NO: 1516802 - RNA, 19 nt, Homo sapiens
aaacaguccuauucacuag

SEQ ID NO: 1516803 - RNA, 19 nt, Homo sapiens
caaagaagucacagaacaa

SEQ ID NO: 1516804 - RNA, 19 nt, Homo sapiens
acaaacggguccuucagaa

SEQ ID NO: 1516805 - RNA, 19 nt, Homo sapiens
gaauaaugguggucuagcu

SEQ ID NO: 1516806 - RNA, 19 nt, Homo sapiens
gaauugcaagcuuucuuaa

SEQ ID NO: 1516807 - RNA, 19 nt, Homo sapiens
gcuauaaccucuccaugac

SEQ ID NO: 1516808 - RNA, 19 nt, Homo sapiens
ccaaagagcagaggaaaca

SEQ ID NO: 1516809 - RNA, 19 nt, Homo sapiens
ucagagaagucaggagcua

SEQ ID NO: 1516810 - RNA, 19 nt, Homo sapiens
gcaagaaaugugcucagaa

SEQ ID NO: 1516811 - RNA, 19 nt, Homo sapiens
cuucagacuugguauaaug

SEQ ID NO: 1516812 - RNA, 19 nt, Homo sapiens
ccaauacaauaugcaagaa

SEQ ID NO: 1516813 - RNA, 19 nt, Homo sapiens
aaagugaugccucuugaaa

SEQ ID NO: 1516814 - RNA, 19 nt, Homo sapiens
aguguaaugugcagaauga

SEQ ID NO: 1516815 - RNA, 19 nt, Homo sapiens
gagaagaagauuacagagu

SEQ ID NO: 1516816 - RNA, 19 nt, Homo sapiens
ucacacugccacuucuuua

SEQ ID NO: 1516817 - RNA, 19 nt, Homo sapiens
gcaagguuguccagguugu

SEQ ID NO: 1516818 - RNA, 19 nt, Homo sapiens
caauaaaccuuuugcuuca

SEQ ID NO: 1516819 - RNA, 19 nt, Homo sapiens
gcaagcagcagugugcauu

SEQ ID NO: 1516820 - RNA, 19 nt, Homo sapiens
guaugaacuuuguacuaug

SEQ ID NO: 1516821 - RNA, 19 nt, Homo sapiens
gcaagaagucagagaaguc

SEQ ID NO: 1516822 - RNA, 19 nt, Homo sapiens
uaccaggaaucgcagauga

SEQ ID NO: 1516823 - RNA, 19 nt, Homo sapiens
gagcauuuauggagauacu

SEQ ID NO: 1516824 - RNA, 19 nt, Homo sapiens
uuacaguuauccuucuuug

SEQ ID NO: 1516825 - RNA, 19 nt, Homo sapiens
caagcucgcucucuuucuc

SEQ ID NO: 1516826 - RNA, 19 nt, Homo sapiens
ccugguuugugcuguguua

SEQ ID NO: 1516827 - RNA, 19 nt, Homo sapiens
auugcaagcuuucuuaaga

SEQ ID NO: 1516828 - RNA, 19 nt, Homo sapiens
gcagcugcuuuguccaaga

SEQ ID NO: 1516829 - RNA, 19 nt, Homo sapiens
gcucagaacgugcaguugu

SEQ ID NO: 1516830 - RNA, 19 nt, Homo sapiens
aagcaagguuguccagguu

SEQ ID NO: 1516831 - RNA, 19 nt, Homo sapiens
ugucaguauugcaacauaa

SEQ ID NO: 1516832 - RNA, 19 nt, Homo sapiens
gccucagacugucagauaa

SEQ ID NO: 1516833 - RNA, 19 nt, Homo sapiens
agaaagagaagaagauuac

SEQ ID NO: 1516834 - RNA, 19 nt, Homo sapiens
agaaguggcuacccugaag

SEQ ID NO: 1516835 - RNA, 19 nt, Homo sapiens
uaaaagugaugccucuuga

SEQ ID NO: 1516836 - RNA, 19 nt, Homo sapiens
gagaagucaggagcuauaa

SEQ ID NO: 1516837 - RNA, 19 nt, Homo sapiens
agagaagucaggagcuaua

SEQ ID NO: 1516838 - RNA, 19 nt, Homo sapiens
gaguggugguggccauuau

SEQ ID NO: 1516839 - RNA, 19 nt, Homo sapiens
gcauuugacaggaaagaug

SEQ ID NO: 1516840 - RNA, 19 nt, Homo sapiens
gccacccucugaacuuuga

SEQ ID NO: 1516841 - RNA, 19 nt, Homo sapiens
uggcuacccugaagaagau

SEQ ID NO: 1516842 - RNA, 19 nt, Homo sapiens
gagucaaucacaacuaaug

SEQ ID NO: 1516843 - RNA, 19 nt, Homo sapiens
gcaguauagucgccugagu

SEQ ID NO: 1516844 - RNA, 19 nt, Homo sapiens
cagaggaaacaccugagua

SEQ ID NO: 1516845 - RNA, 19 nt, Homo sapiens
gaccaaagagcagaggaaa

SEQ ID NO: 1516846 - RNA, 19 nt, Homo sapiens
caaggaaugucggauugca

SEQ ID NO: 1516847 - RNA, 19 nt, Homo sapiens
gcuugaguguuugggauuu

SEQ ID NO: 1516848 - RNA, 19 nt, Homo sapiens
cucagaacgugcaguugua

SEQ ID NO: 1516849 - RNA, 19 nt, Homo sapiens
gaaguauggaccacccuau

SEQ ID NO: 1516850 - RNA, 19 nt, Homo sapiens
gcacaaauucagaaaagaa

SEQ ID NO: 1516851 - RNA, 19 nt, Homo sapiens
acacugccacuucuuuaaa

SEQ ID NO: 1516852 - RNA, 19 nt, Homo sapiens
ugcaaggaaugucggauug

SEQ ID NO: 1516853 - RNA, 19 nt, Homo sapiens
acaguuauccuucuuugug

SEQ ID NO: 1516854 - RNA, 19 nt, Homo sapiens
accaggcacugaccacuuu

SEQ ID NO: 1516855 - RNA, 19 nt, Homo sapiens
aaacugccaucuucagacu

SEQ ID NO: 1516856 - RNA, 19 nt, Homo sapiens
ugugcagaaugauuuguuu

SEQ ID NO: 1516857 - RNA, 19 nt, Homo sapiens
caagaagucagagaaguca

SEQ ID NO: 1516858 - RNA, 19 nt, Homo sapiens
ugacaggaaagaugauaga

SEQ ID NO: 1516859 - RNA, 19 nt, Homo sapiens
gauuugaaccgucugucuu

SEQ ID NO: 1516860 - RNA, 19 nt, Homo sapiens
caucuucagacuugguaua

SEQ ID NO: 1516861 - RNA, 19 nt, Homo sapiens
ugugggaauugcaagcuuu

SEQ ID NO: 1516862 - RNA, 19 nt, Homo sapiens
aagagaagaagauuacaga

SEQ ID NO: 1516863 - RNA, 19 nt, Homo sapiens
ggugguggccauuauaaca

SEQ ID NO: 1516864 - RNA, 19 nt, Homo sapiens
ccaaaccuugucaguauug

SEQ ID NO: 1516865 - RNA, 19 nt, Homo sapiens
aaaugaaccagauggagaa

SEQ ID NO: 1516866 - RNA, 19 nt, Homo sapiens
caucauugcccaacugaag

SEQ ID NO: 1516867 - RNA, 19 nt, Homo sapiens
caacuaauggagacagcuu

SEQ ID NO: 1516868 - RNA, 19 nt, Homo sapiens
gagaaggagcaguauaguc

SEQ ID NO: 1516869 - RNA, 19 nt, Homo sapiens
acaggaaagaugauagaaa

SEQ ID NO: 1516870 - RNA, 19 nt, Homo sapiens
aagcagcagugugcauuug

SEQ ID NO: 1516871 - RNA, 19 nt, Homo sapiens
gaggcuuucucucuccaau

SEQ ID NO: 1516872 - RNA, 19 nt, Homo sapiens
gaacgugcaguuguaugga

SEQ ID NO: 1516873 - RNA, 19 nt, Homo sapiens
gagcaagaagucagagaag

SEQ ID NO: 1516874 - RNA, 19 nt, Homo sapiens
gaagauuacagaguugaag

SEQ ID NO: 1516875 - RNA, 19 nt, Homo sapiens
gaaguggcuacccugaaga

SEQ ID NO: 1516876 - RNA, 19 nt, Homo sapiens
agaccuggcucuggacuca

SEQ ID NO: 1516877 - RNA, 19 nt, Homo sapiens
ggacauagugguuccaaua

SEQ ID NO: 1516878 - RNA, 19 nt, Homo sapiens
cugaagagcugaaccagua

SEQ ID NO: 1516879 - RNA, 19 nt, Homo sapiens
gcaaugaccaauacacuuu

SEQ ID NO: 1516880 - RNA, 19 nt, Homo sapiens
gaagguauuuccaaucauc

SEQ ID NO: 1516881 - RNA, 19 nt, Homo sapiens
gaaaugcggugcuuuuaaa

SEQ ID NO: 1516882 - RNA, 19 nt, Homo sapiens
gaacuaauacgccaagcaa

SEQ ID NO: 1516883 - RNA, 19 nt, Homo sapiens
gaccaguucuguagaguga

SEQ ID NO: 1516884 - RNA, 19 nt, Homo sapiens
caaagagccggcaagaaua

SEQ ID NO: 1516885 - RNA, 19 nt, Homo sapiens
ucaaagagccggcaagaau

SEQ ID NO: 1516886 - RNA, 19 nt, Homo sapiens
uaucaucgcuccaacuuuc

SEQ ID NO: 1516887 - RNA, 19 nt, Homo sapiens
gcauugugcugcucacuuc

SEQ ID NO: 1516888 - RNA, 19 nt, Homo sapiens
gagggugucugcuccauca

SEQ ID NO: 1516889 - RNA, 19 nt, Homo sapiens
gagcuucgagucuauggua

SEQ ID NO: 1516890 - RNA, 19 nt, Homo sapiens
guaauaaucaccucagcuu

SEQ ID NO: 1516891 - RNA, 19 nt, Homo sapiens
gacauagugguuccaauaa

SEQ ID NO: 1516892 - RNA, 19 nt, Homo sapiens
gaagcaggacucagaggaa

SEQ ID NO: 1516893 - RNA, 19 nt, Homo sapiens
gguaugaguuaaacagaag

SEQ ID NO: 1516894 - RNA, 19 nt, Homo sapiens
ucagagggccguccuaugu

SEQ ID NO: 1516895 - RNA, 19 nt, Homo sapiens
gagucuaugguaugaguua

SEQ ID NO: 1516896 - RNA, 19 nt, Homo sapiens
ugacuucaguggaauuaca

SEQ ID NO: 1516897 - RNA, 19 nt, Homo sapiens
acauagugguuccaauaaa

SEQ ID NO: 1516898 - RNA, 19 nt, Homo sapiens
aaggguaucuccuccauca

SEQ ID NO: 1516899 - RNA, 19 nt, Homo sapiens
acagguaacucaagaacuc

SEQ ID NO: 1516900 - RNA, 19 nt, Homo sapiens
gcagggugcugggcauugu

SEQ ID NO: 1516901 - RNA, 19 nt, Homo sapiens
gagcagccaggcacaggua

SEQ ID NO: 1516902 - RNA, 19 nt, Homo sapiens
uaagccaguuuucacauua

SEQ ID NO: 1516903 - RNA, 19 nt, Homo sapiens
ggaagacccagggagauga

SEQ ID NO: 1516904 - RNA, 19 nt, Homo sapiens
cauagugguuccaauaaac

SEQ ID NO: 1516905 - RNA, 19 nt, Homo sapiens
aaacaaagccauugaaacc

SEQ ID NO: 1516906 - RNA, 19 nt, Homo sapiens
agagcacccugaccacaaa

SEQ ID NO: 1516907 - RNA, 19 nt, Homo sapiens
ggcagaagcaggacucaga

SEQ ID NO: 1516908 - RNA, 19 nt, Homo sapiens
ucacuuaaacaaagccauu

SEQ ID NO: 1516909 - RNA, 19 nt, Homo sapiens
cagcuucaccuccgccuuu

SEQ ID NO: 1516910 - RNA, 19 nt, Homo sapiens
gccguccuauguucaguaa

SEQ ID NO: 1516911 - RNA, 19 nt, Homo sapiens
gaguuaaacagaaggguau

SEQ ID NO: 1516912 - RNA, 19 nt, Homo sapiens
gcagaaaugcggugcuuuu

SEQ ID NO: 1516913 - RNA, 19 nt, Homo sapiens
ccaauaaacacgaauaagc

SEQ ID NO: 1516914 - RNA, 19 nt, Homo sapiens
auaaacagcagguaauugu

SEQ ID NO: 1516915 - RNA, 19 nt, Homo sapiens
ccaguuggguggagauguc

SEQ ID NO: 1516916 - RNA, 19 nt, Homo sapiens
ugaaagaauggaugaguca

SEQ ID NO: 1516917 - RNA, 19 nt, Homo sapiens
ggagacaggaggaacucaa

SEQ ID NO: 1516918 - RNA, 19 nt, Homo sapiens
cagcaucauguguggauuu

SEQ ID NO: 1516919 - RNA, 19 nt, Homo sapiens
gcacagguaacucaagaac

SEQ ID NO: 1516920 - RNA, 19 nt, Homo sapiens
gcuccaacuuucacuaaaa

SEQ ID NO: 1516921 - RNA, 19 nt, Homo sapiens
ucaccuccgccuuucauuu

SEQ ID NO: 1516922 - RNA, 19 nt, Homo sapiens
aggcacagguaacucaaga

SEQ ID NO: 1516923 - RNA, 19 nt, Homo sapiens
ggguaucuccuccaucaga

SEQ ID NO: 1516924 - RNA, 19 nt, Homo sapiens
cuggagcccuagaagguaa

SEQ ID NO: 1516925 - RNA, 19 nt, Homo sapiens
uggcagagcgagaguucua

SEQ ID NO: 1516926 - RNA, 19 nt, Homo sapiens
aauaaucaccucagcuuca

SEQ ID NO: 1516927 - RNA, 19 nt, Homo sapiens
aaacacgaauaagccaguu

SEQ ID NO: 1516928 - RNA, 19 nt, Homo sapiens
agucgccucucacugguaa

SEQ ID NO: 1516929 - RNA, 19 nt, Homo sapiens
ugguaugaguuaaacagaa

SEQ ID NO: 1516930 - RNA, 19 nt, Homo sapiens
cuucgagucuaugguauga

SEQ ID NO: 1516931 - RNA, 19 nt, Homo sapiens
uaaacaaagccauugaaac

SEQ ID NO: 1516932 - RNA, 19 nt, Homo sapiens
guuccaauaaacacgaaua

SEQ ID NO: 1516933 - RNA, 19 nt, Homo sapiens
gguauuuccaaucaucaaa

SEQ ID NO: 1516934 - RNA, 19 nt, Homo sapiens
gggaagacccagggagaug

SEQ ID NO: 1516935 - RNA, 19 nt, Homo sapiens
aguccaauuucccaaggua

SEQ ID NO: 1516936 - RNA, 19 nt, Homo sapiens
ggauggaagggccaaauac

SEQ ID NO: 1516937 - RNA, 19 nt, Homo sapiens
gaccacaugggacauagug

SEQ ID NO: 1516938 - RNA, 19 nt, Homo sapiens
caugacuucaguggaauua

SEQ ID NO: 1516939 - RNA, 19 nt, Homo sapiens
ggcaaugaccaauacacuu

SEQ ID NO: 1516940 - RNA, 19 nt, Homo sapiens
agagggccguccuauguuc

SEQ ID NO: 1516941 - RNA, 19 nt, Homo sapiens
cagggacugugcugagugu

SEQ ID NO: 1516942 - RNA, 19 nt, Homo sapiens
acagcugaaugacugaaga

SEQ ID NO: 1516943 - RNA, 19 nt, Homo sapiens
gcugugcuguguccucagu

SEQ ID NO: 1516944 - RNA, 19 nt, Homo sapiens
gagcuuccaaggcauuuua

SEQ ID NO: 1516945 - RNA, 19 nt, Homo sapiens
ggucacccguguccuucug

SEQ ID NO: 1516946 - RNA, 19 nt, Homo sapiens
caaagccccaggugacuua

SEQ ID NO: 1516947 - RNA, 19 nt, Homo sapiens
uguugugggugcugugauu

SEQ ID NO: 1516948 - RNA, 19 nt, Homo sapiens
ucagugaaagaauggauga

SEQ ID NO: 1516949 - RNA, 19 nt, Homo sapiens
gcuggagcccuagaaggua

SEQ ID NO: 1516950 - RNA, 19 nt, Homo sapiens
aaagagccggcaagaauag

SEQ ID NO: 1516951 - RNA, 19 nt, Homo sapiens
ucccuuccguucacucauu

SEQ ID NO: 1516952 - RNA, 19 nt, Homo sapiens
cauuagagaaauaccaguu

SEQ ID NO: 1516953 - RNA, 19 nt, Homo sapiens
agaaggguaucuccuccau

SEQ ID NO: 1516954 - RNA, 19 nt, Homo sapiens
gggcuucuacugaggugaa

SEQ ID NO: 1516955 - RNA, 19 nt, Homo sapiens
acccgaaggugauggaauc

SEQ ID NO: 1516956 - RNA, 19 nt, Homo sapiens
aaaugcaugucaguuaagu

SEQ ID NO: 1516957 - RNA, 19 nt, Homo sapiens
ggccuucccaguccuguug

SEQ ID NO: 1516958 - RNA, 19 nt, Homo sapiens
uguccucagugaaagaaug

SEQ ID NO: 1516959 - RNA, 19 nt, Homo sapiens
ucgagucuaugguaugagu

SEQ ID NO: 1516960 - RNA, 19 nt, Homo sapiens
guucacucauuccuuccuu

SEQ ID NO: 1516961 - RNA, 19 nt, Homo sapiens
gcgcuucccuuccguucac

SEQ ID NO: 1516962 - RNA, 19 nt, Homo sapiens
uugccaggguccagaaaga

SEQ ID NO: 1516963 - RNA, 19 nt, Homo sapiens
cagagggccguccuauguu

SEQ ID NO: 1516964 - RNA, 19 nt, Homo sapiens
gacgaggacacagcaguga

SEQ ID NO: 1516965 - RNA, 19 nt, Homo sapiens
gaugaguggcuugcaguuc

SEQ ID NO: 1516966 - RNA, 19 nt, Homo sapiens
ccaauuucccaagguagaa

SEQ ID NO: 1516967 - RNA, 19 nt, Homo sapiens
aggauggaagggccaaaua

SEQ ID NO: 1516968 - RNA, 19 nt, Homo sapiens
gaggauggaagggccaaau

SEQ ID NO: 1516969 - RNA, 19 nt, Homo sapiens
gggacauagugguuccaau

SEQ ID NO: 1516970 - RNA, 19 nt, Homo sapiens
cguccuauguucaguaagc

SEQ ID NO: 1516971 - RNA, 19 nt, Homo sapiens
ggcagggacugugcugagu

SEQ ID NO: 1516972 - RNA, 19 nt, Homo sapiens
ccuggagcuucgagucuau

SEQ ID NO: 1516973 - RNA, 19 nt, Homo sapiens
aauaaacagcagguaauug

SEQ ID NO: 1516974 - RNA, 19 nt, Homo sapiens
gaauaagccaguuuucaca

SEQ ID NO: 1516975 - RNA, 19 nt, Homo sapiens
ggugguggcagucgagaca

SEQ ID NO: 1516976 - RNA, 19 nt, Homo sapiens
gaaugacugaagagcugaa

SEQ ID NO: 1516977 - RNA, 19 nt, Homo sapiens
guaauucaaugcacguuua

SEQ ID NO: 1516978 - RNA, 19 nt, Homo sapiens
guacugaccuccuuuguuc

SEQ ID NO: 1516979 - RNA, 19 nt, Homo sapiens
gcagaauuguguugaugua

SEQ ID NO: 1516980 - RNA, 19 nt, Homo sapiens
cgacugagugguucaauua

SEQ ID NO: 1516981 - RNA, 19 nt, Homo sapiens
aaugauaccuguguucuuu

SEQ ID NO: 1516982 - RNA, 19 nt, Homo sapiens
acacaggccucccuaacaa

SEQ ID NO: 1516983 - RNA, 19 nt, Homo sapiens
caacagacugcaccacuuu

SEQ ID NO: 1516984 - RNA, 19 nt, Homo sapiens
caaugcacguuuacaaaug

SEQ ID NO: 1516985 - RNA, 19 nt, Homo sapiens
guuugagucuguauucuuu

SEQ ID NO: 1516986 - RNA, 19 nt, Homo sapiens
ucacauacacacaccauuu

SEQ ID NO: 1516987 - RNA, 19 nt, Homo sapiens
ccauguauguuuguacuuu

SEQ ID NO: 1516988 - RNA, 19 nt, Homo sapiens
ggacauuucuaucauucca

SEQ ID NO: 1516989 - RNA, 19 nt, Homo sapiens
ccgguaauguuaugaaaug

SEQ ID NO: 1516990 - RNA, 19 nt, Homo sapiens
gcauauuguuugagucugu

SEQ ID NO: 1516991 - RNA, 19 nt, Homo sapiens
ggagaaauuaagaugauga

SEQ ID NO: 1516992 - RNA, 19 nt, Homo sapiens
gcuaguauggagaaauuaa

SEQ ID NO: 1516993 - RNA, 19 nt, Homo sapiens
ugaaauggccucccaccuu

SEQ ID NO: 1516994 - RNA, 19 nt, Homo sapiens
gcacguuuacaaauggaua

SEQ ID NO: 1516995 - RNA, 19 nt, Homo sapiens
uaugaauacugacaccauu

SEQ ID NO: 1516996 - RNA, 19 nt, Homo sapiens
gaaaugauaccuguguucu

SEQ ID NO: 1516997 - RNA, 19 nt, Homo sapiens
uugcuaguauggagaaauu

SEQ ID NO: 1516998 - RNA, 19 nt, Homo sapiens
caacuuauugcuucuucaa

SEQ ID NO: 1516999 - RNA, 19 nt, Homo sapiens
cugagugguucaauuaaau

SEQ ID NO: 1517000 - RNA, 19 nt, Homo sapiens
ucaaugcacguuuacaaau

SEQ ID NO: 1517001 - RNA, 19 nt, Homo sapiens
acugagugguucaauuaaa

SEQ ID NO: 1517002 - RNA, 19 nt, Homo sapiens
acaaauggauacacuaacg

SEQ ID NO: 1517003 - RNA, 19 nt, Homo sapiens
acaacagacugcaccacuu

SEQ ID NO: 1517004 - RNA, 19 nt, Homo sapiens
guguugauguaauaugcua

SEQ ID NO: 1517005 - RNA, 19 nt, Homo sapiens
cauauuguuugagucugua

SEQ ID NO: 1517006 - RNA, 19 nt, Homo sapiens
agggauagauggacagaca

SEQ ID NO: 1517007 - RNA, 19 nt, Homo sapiens
caccauuacuacuguuuua

SEQ ID NO: 1517008 - RNA, 19 nt, Homo sapiens
ccgacugagugguucaauu

SEQ ID NO: 1517009 - RNA, 19 nt, Homo sapiens
gcaggccaggucucacuaa

SEQ ID NO: 1517010 - RNA, 19 nt, Homo sapiens
gggcuauuaugaagaaacu

SEQ ID NO: 1517011 - RNA, 19 nt, Homo sapiens
aagcagaauuguguugaug

SEQ ID NO: 1517012 - RNA, 19 nt, Homo sapiens
aagaaacuaucaugagcau

SEQ ID NO: 1517013 - RNA, 19 nt, Homo sapiens
guccgguaauguuaugaaa

SEQ ID NO: 1517014 - RNA, 19 nt, Homo sapiens
ggccaggucucacuaacac

SEQ ID NO: 1517015 - RNA, 19 nt, Homo sapiens
ccaaggagccacugucacu

SEQ ID NO: 1517016 - RNA, 19 nt, Homo sapiens
guauggagaaauuaagaug

SEQ ID NO: 1517017 - RNA, 19 nt, Homo sapiens
gcugcuaauugcuaguaug

SEQ ID NO: 1517018 - RNA, 19 nt, Homo sapiens
aaauccaucuguaaugucu

SEQ ID NO: 1517019 - RNA, 19 nt, Homo sapiens
ucucuaaaaucuccuacua

SEQ ID NO: 1517020 - RNA, 19 nt, Homo sapiens
acagacugcaccacuuuaa

SEQ ID NO: 1517021 - RNA, 19 nt, Homo sapiens
uugcauguauuguuaagca

SEQ ID NO: 1517022 - RNA, 19 nt, Homo sapiens
uaacacaggccucccuaac

SEQ ID NO: 1517023 - RNA, 19 nt, Homo sapiens
uuugggcuauuaugaagaa

SEQ ID NO: 1517024 - RNA, 19 nt, Homo sapiens
cauguauguuuguacuuuc

SEQ ID NO: 1517025 - RNA, 19 nt, Homo sapiens
cuucagguccguuugcauu

SEQ ID NO: 1517026 - RNA, 19 nt, Homo sapiens
ugacaccauuacuacuguu

SEQ ID NO: 1517027 - RNA, 19 nt, Homo sapiens
gugggcauauuguuugagu

SEQ ID NO: 1517028 - RNA, 19 nt, Homo sapiens
ugaaaugauaccuguguuc

SEQ ID NO: 1517029 - RNA, 19 nt, Homo sapiens
cagacugcaccacuuuaaa

SEQ ID NO: 1517030 - RNA, 19 nt, Homo sapiens
aggcauaauuucgguacaa

SEQ ID NO: 1517031 - RNA, 19 nt, Homo sapiens
gggcauauuguuugagucu

SEQ ID NO: 1517032 - RNA, 19 nt, Homo sapiens
gacugagugguucaauuaa

SEQ ID NO: 1517033 - RNA, 19 nt, Homo sapiens
gugucugccuucuuucaug

SEQ ID NO: 1517034 - RNA, 19 nt, Homo sapiens
aauacugacaccauuacua

SEQ ID NO: 1517035 - RNA, 19 nt, Homo sapiens
uuucuaucauuccacguuu

SEQ ID NO: 1517036 - RNA, 19 nt, Homo sapiens
aacccaagauagaggaaau

SEQ ID NO: 1517037 - RNA, 19 nt, Homo sapiens
cuaacaaaauugagucuuc

SEQ ID NO: 1517038 - RNA, 19 nt, Homo sapiens
cagaauuguguugauguaa

SEQ ID NO: 1517039 - RNA, 19 nt, Homo sapiens
cguuugggcuauuaugaag

SEQ ID NO: 1517040 - RNA, 19 nt, Homo sapiens
gcaguucaucagccuuuca

SEQ ID NO: 1517041 - RNA, 19 nt, Homo sapiens
guuaagcauguaaugauuc

SEQ ID NO: 1517042 - RNA, 19 nt, Homo sapiens
cuucauugcauguauuguu

SEQ ID NO: 1517043 - RNA, 19 nt, Homo sapiens
cugcuucauugcauguauu

SEQ ID NO: 1517044 - RNA, 19 nt, Homo sapiens
ccaacuuauugcuucuuca

SEQ ID NO: 1517045 - RNA, 19 nt, Homo sapiens
gacaccauuacuacuguuu

SEQ ID NO: 1517046 - RNA, 19 nt, Homo sapiens
guuuacaaauggauacacu

SEQ ID NO: 1517047 - RNA, 19 nt, Homo sapiens
uaauugcuaguauggagaa

SEQ ID NO: 1517048 - RNA, 19 nt, Homo sapiens
uuacuccacacaccuuauu

SEQ ID NO: 1517049 - RNA, 19 nt, Homo sapiens
cuucuuucaugcaucaaug

SEQ ID NO: 1517050 - RNA, 19 nt, Homo sapiens
aaugaaaugauaccugugu

SEQ ID NO: 1517051 - RNA, 19 nt, Homo sapiens
ugccacaacccaagauaga

SEQ ID NO: 1517052 - RNA, 19 nt, Homo sapiens
uuggacauuucuaucauuc

SEQ ID NO: 1517053 - RNA, 19 nt, Homo sapiens
uaccauguauguuuguacu

SEQ ID NO: 1517054 - RNA, 19 nt, Homo sapiens
ucguguggcuauaccaugu

SEQ ID NO: 1517055 - RNA, 19 nt, Homo sapiens
ggagagagcccucaaauuu

SEQ ID NO: 1517056 - RNA, 19 nt, Homo sapiens
gcacugggcuagaaacuga

SEQ ID NO: 1517057 - RNA, 19 nt, Homo sapiens
gcuagaaacugaagcuaaa

SEQ ID NO: 1517058 - RNA, 19 nt, Homo sapiens
gagauaaacuacccaccua

SEQ ID NO: 1517059 - RNA, 19 nt, Homo sapiens
gaaagcacaugccaaguca

SEQ ID NO: 1517060 - RNA, 19 nt, Homo sapiens
gaaagacgaguagguguua

SEQ ID NO: 1517061 - RNA, 19 nt, Homo sapiens
gcaccaaggccgcugaaua

SEQ ID NO: 1517062 - RNA, 19 nt, Homo sapiens
gcauugguguguucuuuaa

SEQ ID NO: 1517063 - RNA, 19 nt, Homo sapiens
gauuuggucuucucuuuga

SEQ ID NO: 1517064 - RNA, 19 nt, Homo sapiens
caccaaggccgcugaauaa

SEQ ID NO: 1517065 - RNA, 19 nt, Homo sapiens
gcaaggaaauaaggaggaa

SEQ ID NO: 1517066 - RNA, 19 nt, Homo sapiens
gagagagcccucaaauuug

SEQ ID NO: 1517067 - RNA, 19 nt, Homo sapiens
guacuaugcugggcaaaca

SEQ ID NO: 1517068 - RNA, 19 nt, Homo sapiens
gaauccagcuuccaacacu

SEQ ID NO: 1517069 - RNA, 19 nt, Homo sapiens
gagaauggacucuggaauc

SEQ ID NO: 1517070 - RNA, 19 nt, Homo sapiens
gcaaggacagguugugaug

SEQ ID NO: 1517071 - RNA, 19 nt, Homo sapiens
ccgauuuggucuucucuuu

SEQ ID NO: 1517072 - RNA, 19 nt, Homo sapiens
gguguuagcaaggaaauaa

SEQ ID NO: 1517073 - RNA, 19 nt, Homo sapiens
ccagugacgguauuucuaa

SEQ ID NO: 1517074 - RNA, 19 nt, Homo sapiens
aauggacucuggaaucuga

SEQ ID NO: 1517075 - RNA, 19 nt, Homo sapiens
gccucugucugguguguua

SEQ ID NO: 1517076 - RNA, 19 nt, Homo sapiens
cagagcugcugauaaugaa

SEQ ID NO: 1517077 - RNA, 19 nt, Homo sapiens
gcaaagaaaaguagaauuc

SEQ ID NO: 1517078 - RNA, 19 nt, Homo sapiens
gaauaagccugcccuucac

SEQ ID NO: 1517079 - RNA, 19 nt, Homo sapiens
ggagcuugcugagucuuga

SEQ ID NO: 1517080 - RNA, 19 nt, Homo sapiens
agaacugucugcacccaaa

SEQ ID NO: 1517081 - RNA, 19 nt, Homo sapiens
agagagcccucaaauuugg

SEQ ID NO: 1517082 - RNA, 19 nt, Homo sapiens
caaggccacuccugcuaug

SEQ ID NO: 1517083 - RNA, 19 nt, Homo sapiens
gcacaugccaagucagcaa

SEQ ID NO: 1517084 - RNA, 19 nt, Homo sapiens
aagcauugguguguucuuu

SEQ ID NO: 1517085 - RNA, 19 nt, Homo sapiens
gaggagucagccaggauua

SEQ ID NO: 1517086 - RNA, 19 nt, Homo sapiens
gagacaggccucuggaugu

SEQ ID NO: 1517087 - RNA, 19 nt, Homo sapiens
cuaccagauuguuguacua

SEQ ID NO: 1517088 - RNA, 19 nt, Homo sapiens
gaaucugacgucuggguuu

SEQ ID NO: 1517089 - RNA, 19 nt, Homo sapiens
ccacagacugcccauagaa

SEQ ID NO: 1517090 - RNA, 19 nt, Homo sapiens
ugaugaggguucugaagga

SEQ ID NO: 1517091 - RNA, 19 nt, Homo sapiens
ggucuucucuuugacaucu

SEQ ID NO: 1517092 - RNA, 19 nt, Homo sapiens
cuacccaccuaccagauug

SEQ ID NO: 1517093 - RNA, 19 nt, Homo sapiens
ggaggagucagccaggauu

SEQ ID NO: 1517094 - RNA, 19 nt, Homo sapiens
gaaugcagccagacucgau

SEQ ID NO: 1517095 - RNA, 19 nt, Homo sapiens
ggcaagcauugguguguuc

SEQ ID NO: 1517096 - RNA, 19 nt, Homo sapiens
gccacagacugcccauaga

SEQ ID NO: 1517097 - RNA, 19 nt, Homo sapiens
gaguagguguuagcaagga

SEQ ID NO: 1517098 - RNA, 19 nt, Homo sapiens
ccagauuguuguacuaugc

SEQ ID NO: 1517099 - RNA, 19 nt, Homo sapiens
agaauggacucuggaaucu

SEQ ID NO: 1517100 - RNA, 19 nt, Homo sapiens
ugaggguucugaaggauag

SEQ ID NO: 1517101 - RNA, 19 nt, Homo sapiens
gaugaggguucugaaggau

SEQ ID NO: 1517102 - RNA, 19 nt, Homo sapiens
agacaggaacccacaauca

SEQ ID NO: 1517103 - RNA, 19 nt, Homo sapiens
ggagucagccaggauuaga

SEQ ID NO: 1517104 - RNA, 19 nt, Homo sapiens
gaauuagcgccauguugga

SEQ ID NO: 1517105 - RNA, 19 nt, Homo sapiens
ggcuagaaacugaagcuaa

SEQ ID NO: 1517106 - RNA, 19 nt, Homo sapiens
ugaaagacgaguagguguu

SEQ ID NO: 1517107 - RNA, 19 nt, Homo sapiens
ugucugcaccugccuaauu

SEQ ID NO: 1517108 - RNA, 19 nt, Homo sapiens
agacaggccucuggaugug

SEQ ID NO: 1517109 - RNA, 19 nt, Homo sapiens
cagauggccugggugcuau

SEQ ID NO: 1517110 - RNA, 19 nt, Homo sapiens
ucagauggccugggugcua

SEQ ID NO: 1517111 - RNA, 19 nt, Homo sapiens
gacaguggcauggagcuuu

SEQ ID NO: 1517112 - RNA, 19 nt, Homo sapiens
gcucucggcaacaucgaua

SEQ ID NO: 1517113 - RNA, 19 nt, Homo sapiens
cagugacgguauuucuaaa

SEQ ID NO: 1517114 - RNA, 19 nt, Homo sapiens
caugugucauuggagauaa

SEQ ID NO: 1517115 - RNA, 19 nt, Homo sapiens
acaguggcauggagcuuug

SEQ ID NO: 1517116 - RNA, 19 nt, Homo sapiens
agucuugaaugcccuucua

SEQ ID NO: 1517117 - RNA, 19 nt, Homo sapiens
ccaccuaccagauuguugu

SEQ ID NO: 1517118 - RNA, 19 nt, Homo sapiens
aaucugacgucuggguuug

SEQ ID NO: 1517119 - RNA, 19 nt, Homo sapiens
uucuuuaacuugcuacuug

SEQ ID NO: 1517120 - RNA, 19 nt, Homo sapiens
gccaaggccacuccugcua

SEQ ID NO: 1517121 - RNA, 19 nt, Homo sapiens
ggccacagacugcccauag

SEQ ID NO: 1517122 - RNA, 19 nt, Homo sapiens
cggagagagcccucaaauu

SEQ ID NO: 1517123 - RNA, 19 nt, Homo sapiens
gucugcaccugccuaauuc

SEQ ID NO: 1517124 - RNA, 19 nt, Homo sapiens
ccaaggccacuccugcuau

SEQ ID NO: 1517125 - RNA, 19 nt, Homo sapiens
ugucauuggagauaaacua

SEQ ID NO: 1517126 - RNA, 19 nt, Homo sapiens
ccaugugucauuggagaua

SEQ ID NO: 1517127 - RNA, 19 nt, Homo sapiens
guccagccuugaagagaau

SEQ ID NO: 1517128 - RNA, 19 nt, Homo sapiens
aguccagccuugaagagaa

SEQ ID NO: 1517129 - RNA, 19 nt, Homo sapiens
ucugaaggauagagaccaa

SEQ ID NO: 1517130 - RNA, 19 nt, Homo sapiens
agaaagcacaugccaaguc

SEQ ID NO: 1517131 - RNA, 19 nt, Homo sapiens
uagaauuagcgccauguug

SEQ ID NO: 1517132 - RNA, 19 nt, Homo sapiens
uuaguuaccuagaauuagc

SEQ ID NO: 1517133 - RNA, 19 nt, Homo sapiens
gacaggaacccacaaucag

SEQ ID NO: 1517134 - RNA, 19 nt, Homo sapiens
gcuccauccuccugguugu

SEQ ID NO: 1517135 - RNA, 19 nt, Homo sapiens
aaggacagguugugaugag

SEQ ID NO: 1517136 - RNA, 19 nt, Homo sapiens
cguggucccugcugcuaug

SEQ ID NO: 1517137 - RNA, 19 nt, Homo sapiens
ugagagcuccugcgucagu

SEQ ID NO: 1517138 - RNA, 19 nt, Homo sapiens
ccagggcucucggcaacau

SEQ ID NO: 1517139 - RNA, 19 nt, Homo sapiens
gaugggaagccaggaagug

SEQ ID NO: 1517140 - RNA, 19 nt, Homo sapiens
cgguauuucuaaagccaaa

SEQ ID NO: 1517141 - RNA, 19 nt, Homo sapiens
gaaggauagagaccaagca

SEQ ID NO: 1517142 - RNA, 19 nt, Homo sapiens
caaggacagguugugauga

SEQ ID NO: 1517143 - RNA, 19 nt, Homo sapiens
uugaaugcccuucuagaug

SEQ ID NO: 1517144 - RNA, 19 nt, Homo sapiens
uggacagaaugcacagaga

SEQ ID NO: 1517145 - RNA, 19 nt, Homo sapiens
aaacugaagcuaaaacaga

SEQ ID NO: 1517146 - RNA, 19 nt, Homo sapiens
ugccaagucagcaaagaaa

SEQ ID NO: 1517147 - RNA, 19 nt, Homo sapiens
cgauuuggucuucucuuug

SEQ ID NO: 1517148 - RNA, 19 nt, Homo sapiens
caugccaagucagcaaaga

SEQ ID NO: 1517149 - RNA, 19 nt, Homo sapiens
cgaugucccucagcacaca

SEQ ID NO: 1517150 - RNA, 19 nt, Homo sapiens
uggcugccuuucaccuuga

SEQ ID NO: 1517151 - RNA, 19 nt, Homo sapiens
aaagagaggugaacuguug

SEQ ID NO: 1517152 - RNA, 19 nt, Homo sapiens
acacuaaacuucugaaaug

SEQ ID NO: 1517153 - RNA, 19 nt, Homo sapiens
caacaugaaacaccaaaua

SEQ ID NO: 1517154 - RNA, 19 nt, Homo sapiens
cuacaaacuugaugacuuu

SEQ ID NO: 1517155 - RNA, 19 nt, Homo sapiens
gaacacagcagaauuuaag

SEQ ID NO: 1517156 - RNA, 19 nt, Homo sapiens
uggaauagaucguagcuaa

SEQ ID NO: 1517157 - RNA, 19 nt, Homo sapiens
gaaaggaaauucguacaag

SEQ ID NO: 1517158 - RNA, 19 nt, Homo sapiens
gaucguagcuaauuugcau

SEQ ID NO: 1517159 - RNA, 19 nt, Homo sapiens
gaauagaucguagcuaauu

SEQ ID NO: 1517160 - RNA, 19 nt, Homo sapiens
gcaauagaaugaaugcaau

SEQ ID NO: 1517161 - RNA, 19 nt, Homo sapiens
guacaaaggcuguguguuc

SEQ ID NO: 1517162 - RNA, 19 nt, Homo sapiens
guaggaaugagaaauguua

SEQ ID NO: 1517163 - RNA, 19 nt, Homo sapiens
cgaaauggcuaucgaaguc

SEQ ID NO: 1517164 - RNA, 19 nt, Homo sapiens
gaaccgaggugaagagacu

SEQ ID NO: 1517165 - RNA, 19 nt, Homo sapiens
ggaaaccacugccuuaaaa

SEQ ID NO: 1517166 - RNA, 19 nt, Homo sapiens
gggaaugauuugagauauu

SEQ ID NO: 1517167 - RNA, 19 nt, Homo sapiens
gcacuaauuucagggaaug

SEQ ID NO: 1517168 - RNA, 19 nt, Homo sapiens
caaaggcuguguguucauu

SEQ ID NO: 1517169 - RNA, 19 nt, Homo sapiens
gaaccaugcuucuuaucuc

SEQ ID NO: 1517170 - RNA, 19 nt, Homo sapiens
ucuaaaggcuaccgaaaga

SEQ ID NO: 1517171 - RNA, 19 nt, Homo sapiens
caugugaguucuuggguuu

SEQ ID NO: 1517172 - RNA, 19 nt, Homo sapiens
ugaaugcaauguuaugguu

SEQ ID NO: 1517173 - RNA, 19 nt, Homo sapiens
ugacaagaguggcacgaaa

SEQ ID NO: 1517174 - RNA, 19 nt, Homo sapiens
gaacugaccuguggaaacc

SEQ ID NO: 1517175 - RNA, 19 nt, Homo sapiens
gaacagauuauaccauucu

SEQ ID NO: 1517176 - RNA, 19 nt, Homo sapiens
gaggugaacuguugcuucu

SEQ ID NO: 1517177 - RNA, 19 nt, Homo sapiens
cagcaagaguguaggaaug

SEQ ID NO: 1517178 - RNA, 19 nt, Homo sapiens
gaaauguaguacuguaagg

SEQ ID NO: 1517179 - RNA, 19 nt, Homo sapiens
aacaacagguuccuacaaa

SEQ ID NO: 1517180 - RNA, 19 nt, Homo sapiens
ccacauggacauaggaauu

SEQ ID NO: 1517181 - RNA, 19 nt, Homo sapiens
uccaggagcuguuacuauu

SEQ ID NO: 1517182 - RNA, 19 nt, Homo sapiens
aauaagaacguaucuguga

SEQ ID NO: 1517183 - RNA, 19 nt, Homo sapiens
ugagaaauguuagucaugu

SEQ ID NO: 1517184 - RNA, 19 nt, Homo sapiens
aaagagcgccagcuauaaa

SEQ ID NO: 1517185 - RNA, 19 nt, Homo sapiens
uaaaagagcgccagcuaua

SEQ ID NO: 1517186 - RNA, 19 nt, Homo sapiens
uaaaggcuaccgaaagaaa

SEQ ID NO: 1517187 - RNA, 19 nt, Homo sapiens
aggaacagauuauaccauu

SEQ ID NO: 1517188 - RNA, 19 nt, Homo sapiens
gaaugaaugcaauguuaug

SEQ ID NO: 1517189 - RNA, 19 nt, Homo sapiens
ccaauaagaacguaucugu

SEQ ID NO: 1517190 - RNA, 19 nt, Homo sapiens
uagcagcgaugguucugaa

SEQ ID NO: 1517191 - RNA, 19 nt, Homo sapiens
caaauagugugugugaauc

SEQ ID NO: 1517192 - RNA, 19 nt, Homo sapiens
ccaaauagugugugugaau

SEQ ID NO: 1517193 - RNA, 19 nt, Homo sapiens
agauuuggcaguacauuua

SEQ ID NO: 1517194 - RNA, 19 nt, Homo sapiens
cuaaacuucugaaauguag

SEQ ID NO: 1517195 - RNA, 19 nt, Homo sapiens
ccuacaaacuugaugacuu

SEQ ID NO: 1517196 - RNA, 19 nt, Homo sapiens
gcaauguuaugguuuaagc

SEQ ID NO: 1517197 - RNA, 19 nt, Homo sapiens
ggaacagauuauaccauuc

SEQ ID NO: 1517198 - RNA, 19 nt, Homo sapiens
gaacaaauuggaguugcaa

SEQ ID NO: 1517199 - RNA, 19 nt, Homo sapiens
guuucaagcuggcaauaga

SEQ ID NO: 1517200 - RNA, 19 nt, Homo sapiens
caggagcuguuacuauuca

SEQ ID NO: 1517201 - RNA, 19 nt, Homo sapiens
aguggaauaucaauaggua

SEQ ID NO: 1517202 - RNA, 19 nt, Homo sapiens
gcuuggaccuguuagaaag

SEQ ID NO: 1517203 - RNA, 19 nt, Homo sapiens
gagaaauguuagucaugug

SEQ ID NO: 1517204 - RNA, 19 nt, Homo sapiens
gagcaugaggaccugauaa

SEQ ID NO: 1517205 - RNA, 19 nt, Homo sapiens
uuacuaugcugccaaaucu

SEQ ID NO: 1517206 - RNA, 19 nt, Homo sapiens
gcacgaaauggcuaucgaa

SEQ ID NO: 1517207 - RNA, 19 nt, Homo sapiens
gaaaggaaaaccaacauga

SEQ ID NO: 1517208 - RNA, 19 nt, Homo sapiens
caagcuggcaauagaauga

SEQ ID NO: 1517209 - RNA, 19 nt, Homo sapiens
caaaucaacauccaauaag

SEQ ID NO: 1517210 - RNA, 19 nt, Homo sapiens
gaccaagacaucuguuaga

SEQ ID NO: 1517211 - RNA, 19 nt, Homo sapiens
gaaaggaacagauuauacc

SEQ ID NO: 1517212 - RNA, 19 nt, Homo sapiens
ucugaaauguaguacugua

SEQ ID NO: 1517213 - RNA, 19 nt, Homo sapiens
agacuuagcagggauugua

SEQ ID NO: 1517214 - RNA, 19 nt, Homo sapiens
aaugaacacagcagaauuu

SEQ ID NO: 1517215 - RNA, 19 nt, Homo sapiens
caugaaacaccaaauagug

SEQ ID NO: 1517216 - RNA, 19 nt, Homo sapiens
gauauucccagagaacaaa

SEQ ID NO: 1517217 - RNA, 19 nt, Homo sapiens
cagggaaugauuugagaua

SEQ ID NO: 1517218 - RNA, 19 nt, Homo sapiens
ggugaacuguugcuucuac

SEQ ID NO: 1517219 - RNA, 19 nt, Homo sapiens
aaaggaaauucguacaagu

SEQ ID NO: 1517220 - RNA, 19 nt, Homo sapiens
cagaagauuuggcaguaca

SEQ ID NO: 1517221 - RNA, 19 nt, Homo sapiens
ggcaauagaaugaaugcaa

SEQ ID NO: 1517222 - RNA, 19 nt, Homo sapiens
gaaugagaaauguuaguca

SEQ ID NO: 1517223 - RNA, 19 nt, Homo sapiens
caaccucacuggcuuucuc

SEQ ID NO: 1517224 - RNA, 19 nt, Homo sapiens
ggaccaagacaucuguuag

SEQ ID NO: 1517225 - RNA, 19 nt, Homo sapiens
gaaugcaauguuaugguuu

SEQ ID NO: 1517226 - RNA, 19 nt, Homo sapiens
ugaacauccugaucucuuc

SEQ ID NO: 1517227 - RNA, 19 nt, Homo sapiens
aacauacucuuguggauuc

SEQ ID NO: 1517228 - RNA, 19 nt, Homo sapiens
gugcaacguuuccaaaugc

SEQ ID NO: 1517229 - RNA, 19 nt, Homo sapiens
uaggauggauggugaugau

SEQ ID NO: 1517230 - RNA, 19 nt, Homo sapiens
guagcuaauuugcauuucu

SEQ ID NO: 1517231 - RNA, 19 nt, Homo sapiens
uacaaaggcuguguguuca

SEQ ID NO: 1517232 - RNA, 19 nt, Homo sapiens
ggaauagaucguagcuaau

SEQ ID NO: 1517233 - RNA, 19 nt, Homo sapiens
caccaaauaguguguguga

SEQ ID NO: 1517234 - RNA, 19 nt, Homo sapiens
aaacaacagguuccuacaa

SEQ ID NO: 1517235 - RNA, 19 nt, Homo sapiens
gaagauuuggcaguacauu

SEQ ID NO: 1517236 - RNA, 19 nt, Homo sapiens
gacaagaguggcacgaaau

SEQ ID NO: 1517237 - RNA, 19 nt, Homo sapiens
ggaaugagaaauguuaguc

SEQ ID NO: 1517238 - RNA, 19 nt, Homo sapiens
uuugagauauucccagaga

SEQ ID NO: 1517239 - RNA, 19 nt, Homo sapiens
ggcaguacauuuauaucca

SEQ ID NO: 1517240 - RNA, 19 nt, Homo sapiens
cuucugaaauguaguacug

SEQ ID NO: 1517241 - RNA, 19 nt, Homo sapiens
aaacauacucuuguggauu

SEQ ID NO: 1517242 - RNA, 19 nt, Homo sapiens
gugcugugcuuggaauaga

SEQ ID NO: 1517243 - RNA, 19 nt, Homo sapiens
gauaaaagagcgccagcua

SEQ ID NO: 1517244 - RNA, 19 nt, Homo sapiens
acagguuccuacaaacuug

SEQ ID NO: 1517245 - RNA, 19 nt, Homo sapiens
caacagguuccuacaaacu

SEQ ID NO: 1517246 - RNA, 19 nt, Homo sapiens
uaagugaagagaccucaug

SEQ ID NO: 1517247 - RNA, 19 nt, Homo sapiens
ugaaaggaacagauuauac

SEQ ID NO: 1517248 - RNA, 19 nt, Homo sapiens
caacauccaauaagaacgu

SEQ ID NO: 1517249 - RNA, 19 nt, Homo sapiens
acaugguuguuucuaacua

SEQ ID NO: 1517250 - RNA, 19 nt, Homo sapiens
ugaacacagcagaauuuaa

SEQ ID NO: 1517251 - RNA, 19 nt, Homo sapiens
ucaagaagcuggagaaaga

SEQ ID NO: 1517252 - RNA, 19 nt, Homo sapiens
gcaaugaccugaacaagag

SEQ ID NO: 1517253 - RNA, 19 nt, Homo sapiens
caacuguguuuguuucuaa

SEQ ID NO: 1517254 - RNA, 19 nt, Homo sapiens
gaaaauagcaacuguguuu

SEQ ID NO: 1517255 - RNA, 19 nt, Homo sapiens
cagcaucgcucaucacaau

SEQ ID NO: 1517256 - RNA, 19 nt, Homo sapiens
ggaccuauguggcaaggaa

SEQ ID NO: 1517257 - RNA, 19 nt, Homo sapiens
gacaaagucuucaaacaca

SEQ ID NO: 1517258 - RNA, 19 nt, Homo sapiens
gaaagaaaccaccauguac

SEQ ID NO: 1517259 - RNA, 19 nt, Homo sapiens
gaacggggcugccaaacaa

SEQ ID NO: 1517260 - RNA, 19 nt, Homo sapiens
ugagauggcugaggagaaa

SEQ ID NO: 1517261 - RNA, 19 nt, Homo sapiens
cauacuguguggacaauaa

SEQ ID NO: 1517262 - RNA, 19 nt, Homo sapiens
ggaaggagaucacguugcu

SEQ ID NO: 1517263 - RNA, 19 nt, Homo sapiens
caagaaguaugcugaacug

SEQ ID NO: 1517264 - RNA, 19 nt, Homo sapiens
cagagaaguuugaggaguu

SEQ ID NO: 1517265 - RNA, 19 nt, Homo sapiens
agaugaagcuccuacagaa

SEQ ID NO: 1517266 - RNA, 19 nt, Homo sapiens
agaaagaaaccaccaugua

SEQ ID NO: 1517267 - RNA, 19 nt, Homo sapiens
gucaguggcuugucuguga

SEQ ID NO: 1517268 - RNA, 19 nt, Homo sapiens
gcaacuguguuuguuucua

SEQ ID NO: 1517269 - RNA, 19 nt, Homo sapiens
ugacuaagaagaucaagaa

SEQ ID NO: 1517270 - RNA, 19 nt, Homo sapiens
cuaagaagaucaagaagcu

SEQ ID NO: 1517271 - RNA, 19 nt, Homo sapiens
ucacagaagcgccuugcua

SEQ ID NO: 1517272 - RNA, 19 nt, Homo sapiens
gaaaagaugacuaagaaga

SEQ ID NO: 1517273 - RNA, 19 nt, Homo sapiens
gcaccggaauucacagaag

SEQ ID NO: 1517274 - RNA, 19 nt, Homo sapiens
gaaggccacaggagaagaa

SEQ ID NO: 1517275 - RNA, 19 nt, Homo sapiens
gccaaacaauccaauccaa

SEQ ID NO: 1517276 - RNA, 19 nt, Homo sapiens
gcaagagacccaccugaag

SEQ ID NO: 1517277 - RNA, 19 nt, Homo sapiens
ggaauucacagaagcagau

SEQ ID NO: 1517278 - RNA, 19 nt, Homo sapiens
gcgaggagcauaucgacaa

SEQ ID NO: 1517279 - RNA, 19 nt, Homo sapiens
uagcaacuguguuuguuuc

SEQ ID NO: 1517280 - RNA, 19 nt, Homo sapiens
gaagacauacugagcacau

SEQ ID NO: 1517281 - RNA, 19 nt, Homo sapiens
ugugugagcugaugaagca

SEQ ID NO: 1517282 - RNA, 19 nt, Homo sapiens
cccaggagaugcuaaagga

SEQ ID NO: 1517283 - RNA, 19 nt, Homo sapiens
cgaggagcauaucgacaaa

SEQ ID NO: 1517284 - RNA, 19 nt, Homo sapiens
uggaaaagaugacuaagaa

SEQ ID NO: 1517285 - RNA, 19 nt, Homo sapiens
gaggaugugugagcugaug

SEQ ID NO: 1517286 - RNA, 19 nt, Homo sapiens
gcauaucgacaaagucuuc

SEQ ID NO: 1517287 - RNA, 19 nt, Homo sapiens
gagcauaucgacaaagucu

SEQ ID NO: 1517288 - RNA, 19 nt, Homo sapiens
gaagcugauugagcaguau

SEQ ID NO: 1517289 - RNA, 19 nt, Homo sapiens
agaagcugauugagcagua

SEQ ID NO: 1517290 - RNA, 19 nt, Homo sapiens
uuacguacauagggcauuu

SEQ ID NO: 1517291 - RNA, 19 nt, Homo sapiens
ccagaacacacuuuccaaa

SEQ ID NO: 1517292 - RNA, 19 nt, Homo sapiens
gaugaagcuccuacagaaa

SEQ ID NO: 1517293 - RNA, 19 nt, Homo sapiens
ugaaccaacuccaguaguc

SEQ ID NO: 1517294 - RNA, 19 nt, Homo sapiens
ccaaacaauccaauccaaa

SEQ ID NO: 1517295 - RNA, 19 nt, Homo sapiens
guacagugggcuugcauug

SEQ ID NO: 1517296 - RNA, 19 nt, Homo sapiens
gcaucuggcacuugcaauu

SEQ ID NO: 1517297 - RNA, 19 nt, Homo sapiens
aaacaguccgggauaaaga

SEQ ID NO: 1517298 - RNA, 19 nt, Homo sapiens
gagaaagaaaccaccaugu

SEQ ID NO: 1517299 - RNA, 19 nt, Homo sapiens
caaccgcucccucaaggaa

SEQ ID NO: 1517300 - RNA, 19 nt, Homo sapiens
gcacaaccgcucccucaag

SEQ ID NO: 1517301 - RNA, 19 nt, Homo sapiens
caacuccaguagucaaugg

SEQ ID NO: 1517302 - RNA, 19 nt, Homo sapiens
aaagaugacuaagaagauc

SEQ ID NO: 1517303 - RNA, 19 nt, Homo sapiens
acaaugagcgcaacuccaa

SEQ ID NO: 1517304 - RNA, 19 nt, Homo sapiens
agagccagcuggugcaaga

SEQ ID NO: 1517305 - RNA, 19 nt, Homo sapiens
acauucagcugcagaugga

SEQ ID NO: 1517306 - RNA, 19 nt, Homo sapiens
gaucaagaagcuggagaaa

SEQ ID NO: 1517307 - RNA, 19 nt, Homo sapiens
gcgagguauucaccacauu

SEQ ID NO: 1517308 - RNA, 19 nt, Homo sapiens
cagaugaagcuccuacaga

SEQ ID NO: 1517309 - RNA, 19 nt, Homo sapiens
aauagcaacuguguuuguu

SEQ ID NO: 1517310 - RNA, 19 nt, Homo sapiens
caacuggaagacauacuga

SEQ ID NO: 1517311 - RNA, 19 nt, Homo sapiens
ugaagucaguggcuugucu

SEQ ID NO: 1517312 - RNA, 19 nt, Homo sapiens
caaugaagaaccaagacaa

SEQ ID NO: 1517313 - RNA, 19 nt, Homo sapiens
gcaagaaguaugcugaacu

SEQ ID NO: 1517314 - RNA, 19 nt, Homo sapiens
gcauuuauaccuguaagug

SEQ ID NO: 1517315 - RNA, 19 nt, Homo sapiens
uggagggccugcagguaaa

SEQ ID NO: 1517316 - RNA, 19 nt, Homo sapiens
gaaccaacuccaguaguca

SEQ ID NO: 1517317 - RNA, 19 nt, Homo sapiens
caucuggcacuugcaauuu

SEQ ID NO: 1517318 - RNA, 19 nt, Homo sapiens
ucgacaaagucuucaaaca

SEQ ID NO: 1517319 - RNA, 19 nt, Homo sapiens
agauggaacagcacaauga

SEQ ID NO: 1517320 - RNA, 19 nt, Homo sapiens
guguacagaugaagucagu

SEQ ID NO: 1517321 - RNA, 19 nt, Homo sapiens
cgacaaagucuucaaacac

SEQ ID NO: 1517322 - RNA, 19 nt, Homo sapiens
gcagauggaacagcacaau

SEQ ID NO: 1517323 - RNA, 19 nt, Homo sapiens
gauccaaacacagaagaga

SEQ ID NO: 1517324 - RNA, 19 nt, Homo sapiens
gacccagcaucgcucauca

SEQ ID NO: 1517325 - RNA, 19 nt, Homo sapiens
gaaaacaguccgggauaaa

SEQ ID NO: 1517326 - RNA, 19 nt, Homo sapiens
gagaaaacaguccgggaua

SEQ ID NO: 1517327 - RNA, 19 nt, Homo sapiens
agacccaccugaagcaaca

SEQ ID NO: 1517328 - RNA, 19 nt, Homo sapiens
acaaagucuucaaacacaa

SEQ ID NO: 1517329 - RNA, 19 nt, Homo sapiens
ucacaaugaagaaccaaga

SEQ ID NO: 1517330 - RNA, 19 nt, Homo sapiens
gagagaaggaacccuccaa

SEQ ID NO: 1517331 - RNA, 19 nt, Homo sapiens
gagcugcgcgaggagcaua

SEQ ID NO: 1517332 - RNA, 19 nt, Homo sapiens
caaacaauccaauccaaaa

SEQ ID NO: 1517333 - RNA, 19 nt, Homo sapiens
uggcugcucugugcaagaa

SEQ ID NO: 1517334 - RNA, 19 nt, Homo sapiens
aagacauacugagcacaua

SEQ ID NO: 1517335 - RNA, 19 nt, Homo sapiens
aaugaagaaccaagacaaa

SEQ ID NO: 1517336 - RNA, 19 nt, Homo sapiens
gcuaaaggaggcagaagag

SEQ ID NO: 1517337 - RNA, 19 nt, Homo sapiens
caaacacaaggaccuacaa

SEQ ID NO: 1517338 - RNA, 19 nt, Homo sapiens
cgcaaugaccugaacaaga

SEQ ID NO: 1517339 - RNA, 19 nt, Homo sapiens
gguauucaccacauucaag

SEQ ID NO: 1517340 - RNA, 19 nt, Homo sapiens
gagcaccggaauucacaga

SEQ ID NO: 1517341 - RNA, 19 nt, Homo sapiens
ggagaccgagaccaucgaa

SEQ ID NO: 1517342 - RNA, 19 nt, Homo sapiens
cuggagggccugcagguaa

SEQ ID NO: 1517343 - RNA, 19 nt, Homo sapiens
caacagcuugcccuauaca

SEQ ID NO: 1517344 - RNA, 19 nt, Homo sapiens
uaucgacaaagucuucaaa

SEQ ID NO: 1517345 - RNA, 19 nt, Homo sapiens
aaauagcaacuguguuugu

SEQ ID NO: 1517346 - RNA, 19 nt, Homo sapiens
gcaccgagcacagaagcau

SEQ ID NO: 1517347 - RNA, 19 nt, Homo sapiens
ccuauacacagagaaguuu

SEQ ID NO: 1517348 - RNA, 19 nt, Homo sapiens
acuccaagcugcgccaaga

SEQ ID NO: 1517349 - RNA, 19 nt, Homo sapiens
gcugagccgccaacuggaa

SEQ ID NO: 1517350 - RNA, 19 nt, Homo sapiens
gagguauucaccacauuca

SEQ ID NO: 1517351 - RNA, 19 nt, Homo sapiens
ugacauaccugaauuguuu

SEQ ID NO: 1517352 - RNA, 19 nt, Homo sapiens
agacagagccacauuauaa

SEQ ID NO: 1517353 - RNA, 19 nt, Homo sapiens
uagaguaccuguuuacauu

SEQ ID NO: 1517354 - RNA, 19 nt, Homo sapiens
ggagauauuucuuuaccuu

SEQ ID NO: 1517355 - RNA, 19 nt, Homo sapiens
caaguggcguuucaucuaa

SEQ ID NO: 1517356 - RNA, 19 nt, Homo sapiens
ccagagccguuucuuuaaa

SEQ ID NO: 1517357 - RNA, 19 nt, Homo sapiens
gaauaguugugauguuguu

SEQ ID NO: 1517358 - RNA, 19 nt, Homo sapiens
ucauguaacugucuguauu

SEQ ID NO: 1517359 - RNA, 19 nt, Homo sapiens
ucuaagacgucaucaguug

SEQ ID NO: 1517360 - RNA, 19 nt, Homo sapiens
uuugauaacuggucuaaga

SEQ ID NO: 1517361 - RNA, 19 nt, Homo sapiens
gaucugaggcgugguguuu

SEQ ID NO: 1517362 - RNA, 19 nt, Homo sapiens
gaaaagagggagcagauuu

SEQ ID NO: 1517363 - RNA, 19 nt, Homo sapiens
gaucacauccuaaauuguc

SEQ ID NO: 1517364 - RNA, 19 nt, Homo sapiens
uaacuggucuaagaaacaa

SEQ ID NO: 1517365 - RNA, 19 nt, Homo sapiens
agagaucuguuucuuccua

SEQ ID NO: 1517366 - RNA, 19 nt, Homo sapiens
guaacugucuguauuucau

SEQ ID NO: 1517367 - RNA, 19 nt, Homo sapiens
gagacagagccacauuaua

SEQ ID NO: 1517368 - RNA, 19 nt, Homo sapiens
acccagagccguuucuuua

SEQ ID NO: 1517369 - RNA, 19 nt, Homo sapiens
gaucuucucuggucuuuug

SEQ ID NO: 1517370 - RNA, 19 nt, Homo sapiens
caaaauaaccaguuucuug

SEQ ID NO: 1517371 - RNA, 19 nt, Homo sapiens
cuagaucuucuuucaguua

SEQ ID NO: 1517372 - RNA, 19 nt, Homo sapiens
gaauuaacuugauguucca

SEQ ID NO: 1517373 - RNA, 19 nt, Homo sapiens
ggucuaagaaacaaagauu

SEQ ID NO: 1517374 - RNA, 19 nt, Homo sapiens
gaucuguuucuuccuauuu

SEQ ID NO: 1517375 - RNA, 19 nt, Homo sapiens
cagagggcccugaaacuuu

SEQ ID NO: 1517376 - RNA, 19 nt, Homo sapiens
ggagugcaguguucgaucu

SEQ ID NO: 1517377 - RNA, 19 nt, Homo sapiens
ucaaguggcguuucaucua

SEQ ID NO: 1517378 - RNA, 19 nt, Homo sapiens
gcacacacucuuccuuugu

SEQ ID NO: 1517379 - RNA, 19 nt, Homo sapiens
uaagacgucaucaguugua

SEQ ID NO: 1517380 - RNA, 19 nt, Homo sapiens
gggcacacacucuuccuuu

SEQ ID NO: 1517381 - RNA, 19 nt, Homo sapiens
guauuacccuguucaaggu

SEQ ID NO: 1517382 - RNA, 19 nt, Homo sapiens
uaaacaagccugcgucucu

SEQ ID NO: 1517383 - RNA, 19 nt, Homo sapiens
uacacuagaucuucuuuca

SEQ ID NO: 1517384 - RNA, 19 nt, Homo sapiens
gauaacuggucuaagaaac

SEQ ID NO: 1517385 - RNA, 19 nt, Homo sapiens
caugugagccggcaauuuc

SEQ ID NO: 1517386 - RNA, 19 nt, Homo sapiens
gacgucaucaguuguaauu

SEQ ID NO: 1517387 - RNA, 19 nt, Homo sapiens
gagccacauuauaaucuau

SEQ ID NO: 1517388 - RNA, 19 nt, Homo sapiens
cuuagagccuuccgugauu

SEQ ID NO: 1517389 - RNA, 19 nt, Homo sapiens
cugaauaguugugauguug

SEQ ID NO: 1517390 - RNA, 19 nt, Homo sapiens
uaaccaguuucuugucaau

SEQ ID NO: 1517391 - RNA, 19 nt, Homo sapiens
cacuagaucuucuuucagu

SEQ ID NO: 1517392 - RNA, 19 nt, Homo sapiens
acacucuuccuuugucuua

SEQ ID NO: 1517393 - RNA, 19 nt, Homo sapiens
ccacaguccugggaucuuc

SEQ ID NO: 1517394 - RNA, 19 nt, Homo sapiens
guaaagagggaggaacuug

SEQ ID NO: 1517395 - RNA, 19 nt, Homo sapiens
accaguuucuugucaauuu

SEQ ID NO: 1517396 - RNA, 19 nt, Homo sapiens
gguguguuauugauaugaa

SEQ ID NO: 1517397 - RNA, 19 nt, Homo sapiens
gagaucuguuucuuccuau

SEQ ID NO: 1517398 - RNA, 19 nt, Homo sapiens
aaacaagccugcgucucuu

SEQ ID NO: 1517399 - RNA, 19 nt, Homo sapiens
uaaagagggaggaacuuga

SEQ ID NO: 1517400 - RNA, 19 nt, Homo sapiens
cauccugguuaaauaaaug

SEQ ID NO: 1517401 - RNA, 19 nt, Homo sapiens
ggcacacacucuuccuuug

SEQ ID NO: 1517402 - RNA, 19 nt, Homo sapiens
caaccucgccuggcuaguu

SEQ ID NO: 1517403 - RNA, 19 nt, Homo sapiens
gggaucuucucuggucuuu

SEQ ID NO: 1517404 - RNA, 19 nt, Homo sapiens
ccagagcuuccaugacuuu

SEQ ID NO: 1517405 - RNA, 19 nt, Homo sapiens
gcccagacccugcuuaucu

SEQ ID NO: 1517406 - RNA, 19 nt, Homo sapiens
ucuugucaauuucugguua

SEQ ID NO: 1517407 - RNA, 19 nt, Homo sapiens
guaauucugcuuauguugu

SEQ ID NO: 1517408 - RNA, 19 nt, Homo sapiens
ucaguuguaauucugcuua

SEQ ID NO: 1517409 - RNA, 19 nt, Homo sapiens
cauguaacugucuguauuu

SEQ ID NO: 1517410 - RNA, 19 nt, Homo sapiens
acggugcgguugagaagua

SEQ ID NO: 1517411 - RNA, 19 nt, Homo sapiens
aauaaccaguuucuuguca

SEQ ID NO: 1517412 - RNA, 19 nt, Homo sapiens
cgucaucaguuguaauucu

SEQ ID NO: 1517413 - RNA, 19 nt, Homo sapiens
ggaggcugaagcaaucaua

SEQ ID NO: 1517414 - RNA, 19 nt, Homo sapiens
ugacuuccagguucucuaa

SEQ ID NO: 1517415 - RNA, 19 nt, Homo sapiens
aauccuggccugcaccuua

SEQ ID NO: 1517416 - RNA, 19 nt, Homo sapiens
ugcuggagauauuucuuua

SEQ ID NO: 1517417 - RNA, 19 nt, Homo sapiens
cuguuuacauuccucuaua

SEQ ID NO: 1517418 - RNA, 19 nt, Homo sapiens
agagccacauuauaaucua

SEQ ID NO: 1517419 - RNA, 19 nt, Homo sapiens
ccagagggcccugaaacuu

SEQ ID NO: 1517420 - RNA, 19 nt, Homo sapiens
ugagacagagccacauuau

SEQ ID NO: 1517421 - RNA, 19 nt, Homo sapiens
aaagagggaggaacuugaa

SEQ ID NO: 1517422 - RNA, 19 nt, Homo sapiens
gaaguacggcgaccaaacg

SEQ ID NO: 1517423 - RNA, 19 nt, Homo sapiens
cugcuuauguuguuugaca

SEQ ID NO: 1517424 - RNA, 19 nt, Homo sapiens
uaaguuacacuagaucuuc

SEQ ID NO: 1517425 - RNA, 19 nt, Homo sapiens
gauccgguuucaucguguu

SEQ ID NO: 1517426 - RNA, 19 nt, Homo sapiens
gacagagccacauuauaau

SEQ ID NO: 1517427 - RNA, 19 nt, Homo sapiens
cagcuuuacaguugaauau

SEQ ID NO: 1517428 - RNA, 19 nt, Homo sapiens
gcagcuuuacaguugaaua

SEQ ID NO: 1517429 - RNA, 19 nt, Homo sapiens
ggugugcucugagguguca

SEQ ID NO: 1517430 - RNA, 19 nt, Homo sapiens
gaagaugauaaacuguaug

SEQ ID NO: 1517431 - RNA, 19 nt, Homo sapiens
aaccucgccuggcuaguuu

SEQ ID NO: 1517432 - RNA, 19 nt, Homo sapiens
gacacaaaauaaccaguuu

SEQ ID NO: 1517433 - RNA, 19 nt, Homo sapiens
ucuggaggcugaagcaauc

SEQ ID NO: 1517434 - RNA, 19 nt, Homo sapiens
cuccagagcuuccaugacu

SEQ ID NO: 1517435 - RNA, 19 nt, Homo sapiens
ccaguuucuugucaauuuc

SEQ ID NO: 1517436 - RNA, 19 nt, Homo sapiens
ccacugugccuaccagcuu

SEQ ID NO: 1517437 - RNA, 19 nt, Homo sapiens
gacggauucucgcucuguu

SEQ ID NO: 1517438 - RNA, 19 nt, Homo sapiens
aaaagagggagcagauuua

SEQ ID NO: 1517439 - RNA, 19 nt, Homo sapiens
gacaaaacagcgcuuaaaa

SEQ ID NO: 1517440 - RNA, 19 nt, Homo sapiens
ccugaauaguugugauguu

SEQ ID NO: 1517441 - RNA, 19 nt, Homo sapiens
gacauuugaugcuguuuug

SEQ ID NO: 1517442 - RNA, 19 nt, Homo sapiens
acucuuccuuugucuuauu

SEQ ID NO: 1517443 - RNA, 19 nt, Homo sapiens
ccuaccagcuuuuacuuuu

SEQ ID NO: 1517444 - RNA, 19 nt, Homo sapiens
aaucuaagacgucaucagu

SEQ ID NO: 1517445 - RNA, 19 nt, Homo sapiens
guuguaauucugcuuaugu

SEQ ID NO: 1517446 - RNA, 19 nt, Homo sapiens
guguaaaacuccuagaaau

SEQ ID NO: 1517447 - RNA, 19 nt, Homo sapiens
uaaacuaaaucaggcucau

SEQ ID NO: 1517448 - RNA, 19 nt, Homo sapiens
caaaacagcgcuuaaaagg

SEQ ID NO: 1517449 - RNA, 19 nt, Homo sapiens
ugauaacuggucuaagaaa

SEQ ID NO: 1517450 - RNA, 19 nt, Homo sapiens
gacaugguuucugcacguu

SEQ ID NO: 1517451 - RNA, 19 nt, Homo sapiens
gaugauaucucucgccuua

SEQ ID NO: 1517452 - RNA, 19 nt, Homo sapiens
gaaagaaacaacacugaua

SEQ ID NO: 1517453 - RNA, 19 nt, Homo sapiens
gcaaaugucuaugcaguuu

SEQ ID NO: 1517454 - RNA, 19 nt, Homo sapiens
aaaguuggcucuucaguaa

SEQ ID NO: 1517455 - RNA, 19 nt, Homo sapiens
gcuggcaccuuaacaaaua

SEQ ID NO: 1517456 - RNA, 19 nt, Homo sapiens
ucaaacaacuggaagcuuu

SEQ ID NO: 1517457 - RNA, 19 nt, Homo sapiens
uauauacccugaccaauaa

SEQ ID NO: 1517458 - RNA, 19 nt, Homo sapiens
ccauagacauagauucuua

SEQ ID NO: 1517459 - RNA, 19 nt, Homo sapiens
gggaguauuucuucucuaa

SEQ ID NO: 1517460 - RNA, 19 nt, Homo sapiens
caucaaagauucuaugagu

SEQ ID NO: 1517461 - RNA, 19 nt, Homo sapiens
gaaaguuggcucuucagua

SEQ ID NO: 1517462 - RNA, 19 nt, Homo sapiens
ugaaguagacauugugaua

SEQ ID NO: 1517463 - RNA, 19 nt, Homo sapiens
gaacaggcagagcauaauu

SEQ ID NO: 1517464 - RNA, 19 nt, Homo sapiens
gaaaaccaguuaaugcuuu

SEQ ID NO: 1517465 - RNA, 19 nt, Homo sapiens
auauauggcuggcaccuua

SEQ ID NO: 1517466 - RNA, 19 nt, Homo sapiens
gagcagcauucauuaagug

SEQ ID NO: 1517467 - RNA, 19 nt, Homo sapiens
ccucagugcugcauauaaa

SEQ ID NO: 1517468 - RNA, 19 nt, Homo sapiens
caguuuaccuugagugauu

SEQ ID NO: 1517469 - RNA, 19 nt, Homo sapiens
cuauauacccugaccaaua

SEQ ID NO: 1517470 - RNA, 19 nt, Homo sapiens
gaaaucuagcucuuacuuu

SEQ ID NO: 1517471 - RNA, 19 nt, Homo sapiens
ugaguacugugucuuauau

SEQ ID NO: 1517472 - RNA, 19 nt, Homo sapiens
gaggguagccacagaaaga

SEQ ID NO: 1517473 - RNA, 19 nt, Homo sapiens
ggucaaagacuaauuguac

SEQ ID NO: 1517474 - RNA, 19 nt, Homo sapiens
cgccacggaucauuuauuu

SEQ ID NO: 1517475 - RNA, 19 nt, Homo sapiens
gaguauuucuucucuaagu

SEQ ID NO: 1517476 - RNA, 19 nt, Homo sapiens
gagaaagaaacaacacuga

SEQ ID NO: 1517477 - RNA, 19 nt, Homo sapiens
aggcagagcauaauuauug

SEQ ID NO: 1517478 - RNA, 19 nt, Homo sapiens
aaccagcuaucuacaagua

SEQ ID NO: 1517479 - RNA, 19 nt, Homo sapiens
gcaaugcuguagucuuaag

SEQ ID NO: 1517480 - RNA, 19 nt, Homo sapiens
uguuaaaggucaaagacua

SEQ ID NO: 1517481 - RNA, 19 nt, Homo sapiens
guaaccagcuaucuacaag

SEQ ID NO: 1517482 - RNA, 19 nt, Homo sapiens
gaaguagacauugugauau

SEQ ID NO: 1517483 - RNA, 19 nt, Homo sapiens
gccuagaggacauuuguua

SEQ ID NO: 1517484 - RNA, 19 nt, Homo sapiens
ugaaacugcugagguagaa

SEQ ID NO: 1517485 - RNA, 19 nt, Homo sapiens
ggaaaacaccuaucaguug

SEQ ID NO: 1517486 - RNA, 19 nt, Homo sapiens
gcaaauggaaaaccaguua

SEQ ID NO: 1517487 - RNA, 19 nt, Homo sapiens
uuacagggcugaaauagcu

SEQ ID NO: 1517488 - RNA, 19 nt, Homo sapiens
acauguaccugacaguuga

SEQ ID NO: 1517489 - RNA, 19 nt, Homo sapiens
aaauugagcagcauucauu

SEQ ID NO: 1517490 - RNA, 19 nt, Homo sapiens
ucucuucgcucuugcaaau

SEQ ID NO: 1517491 - RNA, 19 nt, Homo sapiens
guacacauauggagaaaau

SEQ ID NO: 1517492 - RNA, 19 nt, Homo sapiens
caacaugguauacacaaau

SEQ ID NO: 1517493 - RNA, 19 nt, Homo sapiens
gaggacauuuguuaaaggu

SEQ ID NO: 1517494 - RNA, 19 nt, Homo sapiens
ggacacugaaguagacauu

SEQ ID NO: 1517495 - RNA, 19 nt, Homo sapiens
gcaggaacuugaucuuggu

SEQ ID NO: 1517496 - RNA, 19 nt, Homo sapiens
gcauguguaguuaccauuu

SEQ ID NO: 1517497 - RNA, 19 nt, Homo sapiens
acacugaaguagacauugu

SEQ ID NO: 1517498 - RNA, 19 nt, Homo sapiens
gcagcucauucauggaaga

SEQ ID NO: 1517499 - RNA, 19 nt, Homo sapiens
acuggaagcuuuugaauuu

SEQ ID NO: 1517500 - RNA, 19 nt, Homo sapiens
gcuauuuucuggcuuuuaa

SEQ ID NO: 1517501 - RNA, 19 nt, Homo sapiens
guuaaaggucaaagacuaa

SEQ ID NO: 1517502 - RNA, 19 nt, Homo sapiens
gagggaguauuucuucucu

SEQ ID NO: 1517503 - RNA, 19 nt, Homo sapiens
ugauaucucucgccuuaca

SEQ ID NO: 1517504 - RNA, 19 nt, Homo sapiens
ccagucagcgugaugauau

SEQ ID NO: 1517505 - RNA, 19 nt, Homo sapiens
cuagaggacauuuguuaaa

SEQ ID NO: 1517506 - RNA, 19 nt, Homo sapiens
gaaauucaugggcgcauca

SEQ ID NO: 1517507 - RNA, 19 nt, Homo sapiens
cagcauucauuaagugcaa

SEQ ID NO: 1517508 - RNA, 19 nt, Homo sapiens
ucaacaugguauacacaaa

SEQ ID NO: 1517509 - RNA, 19 nt, Homo sapiens
caacacugauauuucaaac

SEQ ID NO: 1517510 - RNA, 19 nt, Homo sapiens
caaaugucuaugcaguuua

SEQ ID NO: 1517511 - RNA, 19 nt, Homo sapiens
uagaggacauuuguuaaag

SEQ ID NO: 1517512 - RNA, 19 nt, Homo sapiens
acaaauaaagcauguguag

SEQ ID NO: 1517513 - RNA, 19 nt, Homo sapiens
ggaacuugaucuugguuuu

SEQ ID NO: 1517514 - RNA, 19 nt, Homo sapiens
gcuguagucuuaaggaaaa

SEQ ID NO: 1517515 - RNA, 19 nt, Homo sapiens
uaaauauccuaggcuaaca

SEQ ID NO: 1517516 - RNA, 19 nt, Homo sapiens
ggauugcuuuccauagaca

SEQ ID NO: 1517517 - RNA, 19 nt, Homo sapiens
ucaaagauucuaugaguac

SEQ ID NO: 1517518 - RNA, 19 nt, Homo sapiens
caaguaaaaugauguugug

SEQ ID NO: 1517519 - RNA, 19 nt, Homo sapiens
uuacgccacggaucauuua

SEQ ID NO: 1517520 - RNA, 19 nt, Homo sapiens
cuaugaguacugugucuua

SEQ ID NO: 1517521 - RNA, 19 nt, Homo sapiens
ucuaugcaguuuaccuuga

SEQ ID NO: 1517522 - RNA, 19 nt, Homo sapiens
aaaggucaaagacuaauug

SEQ ID NO: 1517523 - RNA, 19 nt, Homo sapiens
guaaguggacugccuagag

SEQ ID NO: 1517524 - RNA, 19 nt, Homo sapiens
cccacgggcugcaagcuaa

SEQ ID NO: 1517525 - RNA, 19 nt, Homo sapiens
cugcugagguagaauuaau

SEQ ID NO: 1517526 - RNA, 19 nt, Homo sapiens
cuuauuauucugcugguua

SEQ ID NO: 1517527 - RNA, 19 nt, Homo sapiens
ugaauagacgggugcuaaa

SEQ ID NO: 1517528 - RNA, 19 nt, Homo sapiens
caugggcgcaucaaagauu

SEQ ID NO: 1517529 - RNA, 19 nt, Homo sapiens
gugauaccuuuucaucuua

SEQ ID NO: 1517530 - RNA, 19 nt, Homo sapiens
cgguauaaacuaauuguga

SEQ ID NO: 1517531 - RNA, 19 nt, Homo sapiens
uaaaaucccuucccuucug

SEQ ID NO: 1517532 - RNA, 19 nt, Homo sapiens
gucaaagacuaauuguaca

SEQ ID NO: 1517533 - RNA, 19 nt, Homo sapiens
aaagugacccagugagguu

SEQ ID NO: 1517534 - RNA, 19 nt, Homo sapiens
cuucaguaauggaaacuau

SEQ ID NO: 1517535 - RNA, 19 nt, Homo sapiens
gaauuaauggcuucauaac

SEQ ID NO: 1517536 - RNA, 19 nt, Homo sapiens
aaacugcugagguagaauu

SEQ ID NO: 1517537 - RNA, 19 nt, Homo sapiens
guggucaccgucaaucaua

SEQ ID NO: 1517538 - RNA, 19 nt, Homo sapiens
gaacccagucagcgugaug

SEQ ID NO: 1517539 - RNA, 19 nt, Homo sapiens
guagacagaugacuaaaac

SEQ ID NO: 1517540 - RNA, 19 nt, Homo sapiens
ugagcagcauucauuaagu

SEQ ID NO: 1517541 - RNA, 19 nt, Homo sapiens
gcucauucauggaagaaaa

SEQ ID NO: 1517542 - RNA, 19 nt, Homo sapiens
uacugugucuuauauggaa

SEQ ID NO: 1517543 - RNA, 19 nt, Homo sapiens
gugccucagugcugcauau

SEQ ID NO: 1517544 - RNA, 19 nt, Homo sapiens
agaaaucuagcucuuacuu

SEQ ID NO: 1517545 - RNA, 19 nt, Homo sapiens
ccauuucugagguuauuaa

SEQ ID NO: 1517546 - RNA, 19 nt, Homo sapiens
uguaguaaccagcuaucua

SEQ ID NO: 1517547 - RNA, 19 nt, Homo sapiens
ucccuucccuucugcuauu

SEQ ID NO: 1517548 - RNA, 19 nt, Homo sapiens
ccuagaggacauuuguuaa

SEQ ID NO: 1517549 - RNA, 19 nt, Homo sapiens
gcguuguucuuggauggua

SEQ ID NO: 1517550 - RNA, 19 nt, Homo sapiens
ugccugcacuuuacacaau

SEQ ID NO: 1517551 - RNA, 19 nt, Homo sapiens
ucugagaacuguugauuua

SEQ ID NO: 1517552 - RNA, 19 nt, Homo sapiens
gaacaacacauaauaccua

SEQ ID NO: 1517553 - RNA, 19 nt, Homo sapiens
ggaaugauuucacucagaa

SEQ ID NO: 1517554 - RNA, 19 nt, Homo sapiens
gaaaagaaauugcaacuuc

SEQ ID NO: 1517555 - RNA, 19 nt, Homo sapiens
gcacgggccuuguuaucaa

SEQ ID NO: 1517556 - RNA, 19 nt, Homo sapiens
ccauuucacuuaucacuuu

SEQ ID NO: 1517557 - RNA, 19 nt, Homo sapiens
gaacguauaacaugaugaa

SEQ ID NO: 1517558 - RNA, 19 nt, Homo sapiens
ggacugguauucaccguau

SEQ ID NO: 1517559 - RNA, 19 nt, Homo sapiens
ggccuuaacuauucagaaa

SEQ ID NO: 1517560 - RNA, 19 nt, Homo sapiens
ggacaaacagcacguguau

SEQ ID NO: 1517561 - RNA, 19 nt, Homo sapiens
cguauaacaugaugaagaa

SEQ ID NO: 1517562 - RNA, 19 nt, Homo sapiens
gcacugaaauagccaacug

SEQ ID NO: 1517563 - RNA, 19 nt, Homo sapiens
caaccacacucauccauca

SEQ ID NO: 1517564 - RNA, 19 nt, Homo sapiens
gaacaugaccgcuuacaac

SEQ ID NO: 1517565 - RNA, 19 nt, Homo sapiens
gaacaacagaagcaucauu

SEQ ID NO: 1517566 - RNA, 19 nt, Homo sapiens
gcuaauauccagcaagcua

SEQ ID NO: 1517567 - RNA, 19 nt, Homo sapiens
augaauagcuuacaucuca

SEQ ID NO: 1517568 - RNA, 19 nt, Homo sapiens
gguuaaaucgcaacaagua

SEQ ID NO: 1517569 - RNA, 19 nt, Homo sapiens
gaauggauacuaaguggaa

SEQ ID NO: 1517570 - RNA, 19 nt, Homo sapiens
gcucaagccuguucaaacu

SEQ ID NO: 1517571 - RNA, 19 nt, Homo sapiens
gaaagggacugguauucac

SEQ ID NO: 1517572 - RNA, 19 nt, Homo sapiens
ugagaacuguugauuuaga

SEQ ID NO: 1517573 - RNA, 19 nt, Homo sapiens
gaaaccaaaucucaagcau

SEQ ID NO: 1517574 - RNA, 19 nt, Homo sapiens
acaaacagcacguguauau

SEQ ID NO: 1517575 - RNA, 19 nt, Homo sapiens
gaggauggacucucagaaa

SEQ ID NO: 1517576 - RNA, 19 nt, Homo sapiens
ucagcaauauguauccuuu

SEQ ID NO: 1517577 - RNA, 19 nt, Homo sapiens
gagaggaaggugaggauuu

SEQ ID NO: 1517578 - RNA, 19 nt, Homo sapiens
acaaguacauggugacaga

SEQ ID NO: 1517579 - RNA, 19 nt, Homo sapiens
gguauuagaagccuugaaa

SEQ ID NO: 1517580 - RNA, 19 nt, Homo sapiens
aaaucaagcuagugaguga

SEQ ID NO: 1517581 - RNA, 19 nt, Homo sapiens
uguauucaccucaacauua

SEQ ID NO: 1517582 - RNA, 19 nt, Homo sapiens
gggaaugauuucacucaga

SEQ ID NO: 1517583 - RNA, 19 nt, Homo sapiens
uuaaagcgauuugcacuga

SEQ ID NO: 1517584 - RNA, 19 nt, Homo sapiens
gguccuagauuuacaaagg

SEQ ID NO: 1517585 - RNA, 19 nt, Homo sapiens
uguaacagcugauucaaag

SEQ ID NO: 1517586 - RNA, 19 nt, Homo sapiens
cugaaggccuuaacuauuc

SEQ ID NO: 1517587 - RNA, 19 nt, Homo sapiens
ggaaagagagaaugcuugu

SEQ ID NO: 1517588 - RNA, 19 nt, Homo sapiens
gaaagaacucggugucauc

SEQ ID NO: 1517589 - RNA, 19 nt, Homo sapiens
gcuagugagugauguaaca

SEQ ID NO: 1517590 - RNA, 19 nt, Homo sapiens
gagccgaggugacguacau

SEQ ID NO: 1517591 - RNA, 19 nt, Homo sapiens
caauauguauccuuucucu

SEQ ID NO: 1517592 - RNA, 19 nt, Homo sapiens
ucaguugaaugaaaccaaa

SEQ ID NO: 1517593 - RNA, 19 nt, Homo sapiens
ggccagacuuggaugcaaa

SEQ ID NO: 1517594 - RNA, 19 nt, Homo sapiens
gaaugaaaccaaaucucaa

SEQ ID NO: 1517595 - RNA, 19 nt, Homo sapiens
gcagcugccugguccuaga

SEQ ID NO: 1517596 - RNA, 19 nt, Homo sapiens
gaauugcccugguggaaaa

SEQ ID NO: 1517597 - RNA, 19 nt, Homo sapiens
guauucaccucaacauuac

SEQ ID NO: 1517598 - RNA, 19 nt, Homo sapiens
uaaaggacuugaggagaga

SEQ ID NO: 1517599 - RNA, 19 nt, Homo sapiens
caacagaagcaucauuaag

SEQ ID NO: 1517600 - RNA, 19 nt, Homo sapiens
uggagcagcuuauauugga

SEQ ID NO: 1517601 - RNA, 19 nt, Homo sapiens
ugacagauggagcagcuua

SEQ ID NO: 1517602 - RNA, 19 nt, Homo sapiens
ugaaugaaaccaaaucuca

SEQ ID NO: 1517603 - RNA, 19 nt, Homo sapiens
caacacauaauaccuaucu

SEQ ID NO: 1517604 - RNA, 19 nt, Homo sapiens
aaagcgauuugcacugaaa

SEQ ID NO: 1517605 - RNA, 19 nt, Homo sapiens
cauagugucuucccauugg

SEQ ID NO: 1517606 - RNA, 19 nt, Homo sapiens
ccagcaagcuaucaagucu

SEQ ID NO: 1517607 - RNA, 19 nt, Homo sapiens
gaggugggcucuuuaacac

SEQ ID NO: 1517608 - RNA, 19 nt, Homo sapiens
caugaccgcuuacaacaag

SEQ ID NO: 1517609 - RNA, 19 nt, Homo sapiens
aacaacagaagcaucauua

SEQ ID NO: 1517610 - RNA, 19 nt, Homo sapiens
gaagugcaucgugaucuuu

SEQ ID NO: 1517611 - RNA, 19 nt, Homo sapiens
gaggugacguacaugaaca

SEQ ID NO: 1517612 - RNA, 19 nt, Homo sapiens
guuaggaagcuuagcauga

SEQ ID NO: 1517613 - RNA, 19 nt, Homo sapiens
uuacgaagcguuagaguuc

SEQ ID NO: 1517614 - RNA, 19 nt, Homo sapiens
uagaugaugccaagcagua

SEQ ID NO: 1517615 - RNA, 19 nt, Homo sapiens
ccucaaaccugguccaaaa

SEQ ID NO: 1517616 - RNA, 19 nt, Homo sapiens
caaaauaaaugucgguaag

SEQ ID NO: 1517617 - RNA, 19 nt, Homo sapiens
gauacuaaguggaaauagc

SEQ ID NO: 1517618 - RNA, 19 nt, Homo sapiens
gagaacuguugauuuagag

SEQ ID NO: 1517619 - RNA, 19 nt, Homo sapiens
gcaacuuaaagauguguuu

SEQ ID NO: 1517620 - RNA, 19 nt, Homo sapiens
ugaaagaacucggugucau

SEQ ID NO: 1517621 - RNA, 19 nt, Homo sapiens
cagcugacuucgcaaaaua

SEQ ID NO: 1517622 - RNA, 19 nt, Homo sapiens
gaccuacacagucagcuaa

SEQ ID NO: 1517623 - RNA, 19 nt, Homo sapiens
gauggagcagcuuauauug

SEQ ID NO: 1517624 - RNA, 19 nt, Homo sapiens
agaacucggugucaucuuc

SEQ ID NO: 1517625 - RNA, 19 nt, Homo sapiens
gagaauugcccugguggaa

SEQ ID NO: 1517626 - RNA, 19 nt, Homo sapiens
ggaugaauuuacucaacau

SEQ ID NO: 1517627 - RNA, 19 nt, Homo sapiens
ucaagccuguucaaacuca

SEQ ID NO: 1517628 - RNA, 19 nt, Homo sapiens
acagaagcaucauuaagca

SEQ ID NO: 1517629 - RNA, 19 nt, Homo sapiens
ccugaaggccuuaacuauu

SEQ ID NO: 1517630 - RNA, 19 nt, Homo sapiens
gcaugaggugggcucuuua

SEQ ID NO: 1517631 - RNA, 19 nt, Homo sapiens
ggugucaucuucuacaacu

SEQ ID NO: 1517632 - RNA, 19 nt, Homo sapiens
uccaagaccuacacaguca

SEQ ID NO: 1517633 - RNA, 19 nt, Homo sapiens
gagcagcuuauauuggaaa

SEQ ID NO: 1517634 - RNA, 19 nt, Homo sapiens
agagaaugcuugugcuaca

SEQ ID NO: 1517635 - RNA, 19 nt, Homo sapiens
ucaagcauuuguaucgaau

SEQ ID NO: 1517636 - RNA, 19 nt, Homo sapiens
agaagugcaucgugaucuu

SEQ ID NO: 1517637 - RNA, 19 nt, Homo sapiens
gaauagcuuacaucucaug

SEQ ID NO: 1517638 - RNA, 19 nt, Homo sapiens
cgacacaggcggaaaggau

SEQ ID NO: 1517639 - RNA, 19 nt, Homo sapiens
gaugugaggaacaacagaa

SEQ ID NO: 1517640 - RNA, 19 nt, Homo sapiens
ggagcagcuuauauuggaa

SEQ ID NO: 1517641 - RNA, 19 nt, Homo sapiens
agauggagcagcuuauauu

SEQ ID NO: 1517642 - RNA, 19 nt, Homo sapiens
uaaagcgauuugcacugaa

SEQ ID NO: 1517643 - RNA, 19 nt, Homo sapiens
gcauuuguaucgaauucuc

SEQ ID NO: 1517644 - RNA, 19 nt, Homo sapiens
caaccaaacagccgaacug

SEQ ID NO: 1517645 - RNA, 19 nt, Homo sapiens
gguagggaaugauuucacu

SEQ ID NO: 1517646 - RNA, 19 nt, Homo sapiens
uagguuaaaucgcaacaag

SEQ ID NO: 1517647 - RNA, 19 nt, Homo sapiens
uggagucuaugacaaugaa

SEQ ID NO: 1517648 - RNA, 19 nt, Homo sapiens
aaauaaaugucgguaagag

SEQ ID NO: 1517649 - RNA, 19 nt, Homo sapiens
gaagcaucauuaagcaacu

SEQ ID NO: 1517650 - RNA, 19 nt, Homo sapiens
gggagaggaugaggaugga

SEQ ID NO: 1517651 - RNA, 19 nt, Homo sapiens
ggacaaaucugcaaacuug

SEQ ID NO: 1517652 - RNA, 19 nt, Homo sapiens
caacucauuuguucaauug

SEQ ID NO: 1517653 - RNA, 19 nt, Homo sapiens
ggaaggaccugcuauugag

SEQ ID NO: 1517654 - RNA, 19 nt, Homo sapiens
gaaagaauugugaggagua

SEQ ID NO: 1517655 - RNA, 19 nt, Homo sapiens
caacucaauuucacauuug

SEQ ID NO: 1517656 - RNA, 19 nt, Homo sapiens
gaaggaaguugggccagaa

SEQ ID NO: 1517657 - RNA, 19 nt, Homo sapiens
gguaaucacccucuuuaaa

SEQ ID NO: 1517658 - RNA, 19 nt, Homo sapiens
guaacaaucugccuugaag

SEQ ID NO: 1517659 - RNA, 19 nt, Homo sapiens
gcagaagggcaaaccauuu

SEQ ID NO: 1517660 - RNA, 19 nt, Homo sapiens
gaagagaucagugcaaaca

SEQ ID NO: 1517661 - RNA, 19 nt, Homo sapiens
gggaaggaccugcuauuga

SEQ ID NO: 1517662 - RNA, 19 nt, Homo sapiens
gaaguugggccagaaggua

SEQ ID NO: 1517663 - RNA, 19 nt, Homo sapiens
guaaucacccucuuuaaag

SEQ ID NO: 1517664 - RNA, 19 nt, Homo sapiens
guaugaaguuuauccuguu

SEQ ID NO: 1517665 - RNA, 19 nt, Homo sapiens
caagguggcugcgcucaga

SEQ ID NO: 1517666 - RNA, 19 nt, Homo sapiens
ggugggacaugggacguua

SEQ ID NO: 1517667 - RNA, 19 nt, Homo sapiens
gacaugggacguuaggaua

SEQ ID NO: 1517668 - RNA, 19 nt, Homo sapiens
gagaagacaggaagguuug

SEQ ID NO: 1517669 - RNA, 19 nt, Homo sapiens
ccaacucauuuguucaauu

SEQ ID NO: 1517670 - RNA, 19 nt, Homo sapiens
aggcugaacugcuggcuuu

SEQ ID NO: 1517671 - RNA, 19 nt, Homo sapiens
cacagaauaugcagaggaa

SEQ ID NO: 1517672 - RNA, 19 nt, Homo sapiens
acaaauagcaugagugaag

SEQ ID NO: 1517673 - RNA, 19 nt, Homo sapiens
aaagaauugugaggaguaa

SEQ ID NO: 1517674 - RNA, 19 nt, Homo sapiens
caccaaggcuaucauccaa

SEQ ID NO: 1517675 - RNA, 19 nt, Homo sapiens
agacaaauagcaugaguga

SEQ ID NO: 1517676 - RNA, 19 nt, Homo sapiens
gcucaugaaagaauuguga

SEQ ID NO: 1517677 - RNA, 19 nt, Homo sapiens
gaugguguuuaaacuguug

SEQ ID NO: 1517678 - RNA, 19 nt, Homo sapiens
ggacaugggacguuaggau

SEQ ID NO: 1517679 - RNA, 19 nt, Homo sapiens
uggcuuacauuucaacuca

SEQ ID NO: 1517680 - RNA, 19 nt, Homo sapiens
caaauagcaugagugaagu

SEQ ID NO: 1517681 - RNA, 19 nt, Homo sapiens
uguuuaaacuguugcagaa

SEQ ID NO: 1517682 - RNA, 19 nt, Homo sapiens
gcaggagaauggcuugaac

SEQ ID NO: 1517683 - RNA, 19 nt, Homo sapiens
gaaaccccgucucuacuaa

SEQ ID NO: 1517684 - RNA, 19 nt, Homo sapiens
ccacgcucaugaaagaauu

SEQ ID NO: 1517685 - RNA, 19 nt, Homo sapiens
uuaaacuguugcagaacua

SEQ ID NO: 1517686 - RNA, 19 nt, Homo sapiens
gcucaagcccgacguuugu

SEQ ID NO: 1517687 - RNA, 19 nt, Homo sapiens
gaacugcuggcuuuauugg

SEQ ID NO: 1517688 - RNA, 19 nt, Homo sapiens
gaguaacaaucugccuuga

SEQ ID NO: 1517689 - RNA, 19 nt, Homo sapiens
ugucagagcccuucaugga

SEQ ID NO: 1517690 - RNA, 19 nt, Homo sapiens
ugagugaaguggucagaag

SEQ ID NO: 1517691 - RNA, 19 nt, Homo sapiens
cugaacugcuggcuuuauu

SEQ ID NO: 1517692 - RNA, 19 nt, Homo sapiens
caaucugccuugaaguuag

SEQ ID NO: 1517693 - RNA, 19 nt, Homo sapiens
aacccacgcucaugaaaga

SEQ ID NO: 1517694 - RNA, 19 nt, Homo sapiens
aaagacaaauagcaugagu

SEQ ID NO: 1517695 - RNA, 19 nt, Homo sapiens
ggcaagggacacagaauau

SEQ ID NO: 1517696 - RNA, 19 nt, Homo sapiens
cgacguuugugugaagaaa

SEQ ID NO: 1517697 - RNA, 19 nt, Homo sapiens
gcuuacauuucaacucaau

SEQ ID NO: 1517698 - RNA, 19 nt, Homo sapiens
gcaagggacacagaauaug

SEQ ID NO: 1517699 - RNA, 19 nt, Homo sapiens
acaaucugccuugaaguua

SEQ ID NO: 1517700 - RNA, 19 nt, Homo sapiens
agagaucagugcaaacaca

SEQ ID NO: 1517701 - RNA, 19 nt, Homo sapiens
gggcuuagagggaguguca

SEQ ID NO: 1517702 - RNA, 19 nt, Homo sapiens
gagagaagacaggaagguu

SEQ ID NO: 1517703 - RNA, 19 nt, Homo sapiens
gaucgagaccauggugaaa

SEQ ID NO: 1517704 - RNA, 19 nt, Homo sapiens
uaaucacccucuuuaaagg

SEQ ID NO: 1517705 - RNA, 19 nt, Homo sapiens
agagaagacaggaagguuu

SEQ ID NO: 1517706 - RNA, 19 nt, Homo sapiens
ucagagcugugagagaaga

SEQ ID NO: 1517707 - RNA, 19 nt, Homo sapiens
cccuggagcucccacuaaa

SEQ ID NO: 1517708 - RNA, 19 nt, Homo sapiens
augaagagaucagugcaaa

SEQ ID NO: 1517709 - RNA, 19 nt, Homo sapiens
ugaaguuuauccuguuucu

SEQ ID NO: 1517710 - RNA, 19 nt, Homo sapiens
uggcccaacucauuuguuc

SEQ ID NO: 1517711 - RNA, 19 nt, Homo sapiens
gucaggagaucgagaccau

SEQ ID NO: 1517712 - RNA, 19 nt, Homo sapiens
agcagucccugacggagua

SEQ ID NO: 1517713 - RNA, 19 nt, Homo sapiens
gauaggucacuccaugaga

SEQ ID NO: 1517714 - RNA, 19 nt, Homo sapiens
caaaagacaaauagcauga

SEQ ID NO: 1517715 - RNA, 19 nt, Homo sapiens
aggcaagggacacagaaua

SEQ ID NO: 1517716 - RNA, 19 nt, Homo sapiens
gcucuguggcuuacauuuc

SEQ ID NO: 1517717 - RNA, 19 nt, Homo sapiens
ggaguuggacaggcacuug

SEQ ID NO: 1517718 - RNA, 19 nt, Homo sapiens
gcccaacucauuuguucaa

SEQ ID NO: 1517719 - RNA, 19 nt, Homo sapiens
gaaguuuauccuguuucua

SEQ ID NO: 1517720 - RNA, 19 nt, Homo sapiens
uaaaaggcucuguggcuua

SEQ ID NO: 1517721 - RNA, 19 nt, Homo sapiens
ucacgccacugcacuccau

SEQ ID NO: 1517722 - RNA, 19 nt, Homo sapiens
uagagggagugucaugucu

SEQ ID NO: 1517723 - RNA, 19 nt, Homo sapiens
caagggacacagaauaugc

SEQ ID NO: 1517724 - RNA, 19 nt, Homo sapiens
gaguaaggcagggaugaga

SEQ ID NO: 1517725 - RNA, 19 nt, Homo sapiens
guucaauugacaaacauga

SEQ ID NO: 1517726 - RNA, 19 nt, Homo sapiens
gcccgacguuugugugaag

SEQ ID NO: 1517727 - RNA, 19 nt, Homo sapiens
gggacaaaucugcaaacuu

SEQ ID NO: 1517728 - RNA, 19 nt, Homo sapiens
caguuugccucaagcucaa

SEQ ID NO: 1517729 - RNA, 19 nt, Homo sapiens
ggaagcagggacaaaucug

SEQ ID NO: 1517730 - RNA, 19 nt, Homo sapiens
gaaggaccugcuauugagu

SEQ ID NO: 1517731 - RNA, 19 nt, Homo sapiens
ggaaguugggccagaaggu

SEQ ID NO: 1517732 - RNA, 19 nt, Homo sapiens
ccugggagacccuagaaga

SEQ ID NO: 1517733 - RNA, 19 nt, Homo sapiens
gggaagcagggacaaaucu

SEQ ID NO: 1517734 - RNA, 19 nt, Homo sapiens
aacaaucugccuugaaguu

SEQ ID NO: 1517735 - RNA, 19 nt, Homo sapiens
ccaacccacgcucaugaaa

SEQ ID NO: 1517736 - RNA, 19 nt, Homo sapiens
ggauaggucacuccaugag

SEQ ID NO: 1517737 - RNA, 19 nt, Homo sapiens
cuuguaaucccagcacuuu

SEQ ID NO: 1517738 - RNA, 19 nt, Homo sapiens
cagaagcagccagcaguga

SEQ ID NO: 1517739 - RNA, 19 nt, Homo sapiens
caacccacgcucaugaaag

SEQ ID NO: 1517740 - RNA, 19 nt, Homo sapiens
gcugaacugcuggcuuuau

SEQ ID NO: 1517741 - RNA, 19 nt, Homo sapiens
gcuuagagggagugucaug

SEQ ID NO: 1517742 - RNA, 19 nt, Homo sapiens
ugaugguguuuaaacuguu

SEQ ID NO: 1517743 - RNA, 19 nt, Homo sapiens
ggugucagagcccuucaug

SEQ ID NO: 1517744 - RNA, 19 nt, Homo sapiens
gugggaaggaccugcuauu

SEQ ID NO: 1517745 - RNA, 19 nt, Homo sapiens
cucuguggcuuacauuuca

SEQ ID NO: 1517746 - RNA, 19 nt, Homo sapiens
uaaacuguugcagaacuaa

SEQ ID NO: 1517747 - RNA, 19 nt, Homo sapiens
augaugguguuuaaacugu

SEQ ID NO: 1517748 - RNA, 19 nt, Homo sapiens
gcaaagaucuucccugaga

SEQ ID NO: 1517749 - RNA, 19 nt, Homo sapiens
gcaaaggauuccaagcaaa

SEQ ID NO: 1517750 - RNA, 19 nt, Homo sapiens
ucaauaaucuggagaaucu

SEQ ID NO: 1517751 - RNA, 19 nt, Homo sapiens
aaacugacccugaauguuc

SEQ ID NO: 1517752 - RNA, 19 nt, Homo sapiens
ggcaaaggauuccaagcaa

SEQ ID NO: 1517753 - RNA, 19 nt, Homo sapiens
gcaagagcaagaagagaaa

SEQ ID NO: 1517754 - RNA, 19 nt, Homo sapiens
aagagaaacugacccugaa

SEQ ID NO: 1517755 - RNA, 19 nt, Homo sapiens
gaaacugacccugaauguu

SEQ ID NO: 1517756 - RNA, 19 nt, Homo sapiens
uggagaaucuugucuuugg

SEQ ID NO: 1517757 - RNA, 19 nt, Homo sapiens
ggcaagagcaagaagagaa

SEQ ID NO: 1517758 - RNA, 19 nt, Homo sapiens
gagcaagaagagaaacuga

SEQ ID NO: 1517759 - RNA, 19 nt, Homo sapiens
guucgggucucuucguguu

SEQ ID NO: 1517760 - RNA, 19 nt, Homo sapiens
ucuggagaaucuugucuuu

SEQ ID NO: 1517761 - RNA, 19 nt, Homo sapiens
gagaaacugacccugaaug

SEQ ID NO: 1517762 - RNA, 19 nt, Homo sapiens
ucacugccuucaauaaucu

SEQ ID NO: 1517763 - RNA, 19 nt, Homo sapiens
caaaggauuccaagcaaag

SEQ ID NO: 1517764 - RNA, 19 nt, Homo sapiens
uugcugggaugcagaugua

SEQ ID NO: 1517765 - RNA, 19 nt, Homo sapiens
gcucacugccuucaauaau

SEQ ID NO: 1517766 - RNA, 19 nt, Homo sapiens
guucagcucgccuuucuug

SEQ ID NO: 1517767 - RNA, 19 nt, Homo sapiens
ccuguuggcucucuuugca

SEQ ID NO: 1517768 - RNA, 19 nt, Homo sapiens
ugacgcaugcgcauagcua

SEQ ID NO: 1517769 - RNA, 19 nt, Homo sapiens
ccgaguggcucaccaucca

SEQ ID NO: 1517770 - RNA, 19 nt, Homo sapiens
agaaacugacccugaaugu

SEQ ID NO: 1517771 - RNA, 19 nt, Homo sapiens
ucacaggcaagagcaagaa

SEQ ID NO: 1517772 - RNA, 19 nt, Homo sapiens
uggcaaaggauuccaagca

SEQ ID NO: 1517773 - RNA, 19 nt, Homo sapiens
cgguucagcucgccuuucu

SEQ ID NO: 1517774 - RNA, 19 nt, Homo sapiens
guacuacaucaacaagauc

SEQ ID NO: 1517775 - RNA, 19 nt, Homo sapiens
aauaaucuggagaaucuug

SEQ ID NO: 1517776 - RNA, 19 nt, Homo sapiens
cucacugccuucaauaauc

SEQ ID NO: 1517777 - RNA, 19 nt, Homo sapiens
cauauucacuuccaacuuu

SEQ ID NO: 1517778 - RNA, 19 nt, Homo sapiens
gaaacccugucucuacuaa

SEQ ID NO: 1517779 - RNA, 19 nt, Homo sapiens
guaacugugucaugaauug

SEQ ID NO: 1517780 - RNA, 19 nt, Homo sapiens
gcccaagucuccaucauga

SEQ ID NO: 1517781 - RNA, 19 nt, Homo sapiens
gcaguaugcucccgaucaa

SEQ ID NO: 1517782 - RNA, 19 nt, Homo sapiens
ggaccugguuccuucuuug

SEQ ID NO: 1517783 - RNA, 19 nt, Homo sapiens
gcaccucggucaagaugga

SEQ ID NO: 1517784 - RNA, 19 nt, Homo sapiens
ggguugagcagcagaauaa

SEQ ID NO: 1517785 - RNA, 19 nt, Homo sapiens
cuugauggauccacacaua

SEQ ID NO: 1517786 - RNA, 19 nt, Homo sapiens
gaccuacgaugaauuuaag

SEQ ID NO: 1517787 - RNA, 19 nt, Homo sapiens
cuucauaucuagacuaaca

SEQ ID NO: 1517788 - RNA, 19 nt, Homo sapiens
ggagaacacacacgugaga

SEQ ID NO: 1517789 - RNA, 19 nt, Homo sapiens
gcucacagacgccagcaaa

SEQ ID NO: 1517790 - RNA, 19 nt, Homo sapiens
uccaagaaaugcaaacaga

SEQ ID NO: 1517791 - RNA, 19 nt, Homo sapiens
ggcuucauaucuagacuaa

SEQ ID NO: 1517792 - RNA, 19 nt, Homo sapiens
caaguacacaauaguaaga

SEQ ID NO: 1517793 - RNA, 19 nt, Homo sapiens
ccacacauauucacuucca

SEQ ID NO: 1517794 - RNA, 19 nt, Homo sapiens
gaagggacaagcacaugga

SEQ ID NO: 1517795 - RNA, 19 nt, Homo sapiens
ugaccuacgaugaauuuaa

SEQ ID NO: 1517796 - RNA, 19 nt, Homo sapiens
ggugaaacccugucucuac

SEQ ID NO: 1517797 - RNA, 19 nt, Homo sapiens
gcccugggauggacuagau

SEQ ID NO: 1517798 - RNA, 19 nt, Homo sapiens
caugaccuacgaugaauuu

SEQ ID NO: 1517799 - RNA, 19 nt, Homo sapiens
uugcaagaguuuccacaaa

SEQ ID NO: 1517800 - RNA, 19 nt, Homo sapiens
ggaugggccucagucucua

SEQ ID NO: 1517801 - RNA, 19 nt, Homo sapiens
ggaggacacagaccaggaa

SEQ ID NO: 1517802 - RNA, 19 nt, Homo sapiens
gucaugaauugcaagaguu

SEQ ID NO: 1517803 - RNA, 19 nt, Homo sapiens
gagccgagauugcgcuacu

SEQ ID NO: 1517804 - RNA, 19 nt, Homo sapiens
gggccucagucucuaagga

SEQ ID NO: 1517805 - RNA, 19 nt, Homo sapiens
ucucuuauguuccaaguac

SEQ ID NO: 1517806 - RNA, 19 nt, Homo sapiens
ucgagaccauccuggcuaa

SEQ ID NO: 1517807 - RNA, 19 nt, Homo sapiens
ugucaugaauugcaagagu

SEQ ID NO: 1517808 - RNA, 19 nt, Homo sapiens
gugaaacccugucucuacu

SEQ ID NO: 1517809 - RNA, 19 nt, Homo sapiens
ugauggauccacacauauu

SEQ ID NO: 1517810 - RNA, 19 nt, Homo sapiens
gauccacacauauucacuu

SEQ ID NO: 1517811 - RNA, 19 nt, Homo sapiens
gauggauccacacauauuc

SEQ ID NO: 1517812 - RNA, 19 nt, Homo sapiens
gagaagggacaagcacaug

SEQ ID NO: 1517813 - RNA, 19 nt, Homo sapiens
gcacagccaagcccugagu

SEQ ID NO: 1517814 - RNA, 19 nt, Homo sapiens
gucaggagaucgagaccau

SEQ ID NO: 1517815 - RNA, 19 nt, Homo sapiens
ccuguaaucccagcacuuu

SEQ ID NO: 1517816 - RNA, 19 nt, Homo sapiens
cugcccgcaucuaugauua

SEQ ID NO: 1517817 - RNA, 19 nt, Homo sapiens
agaccuaccugugcuacga

SEQ ID NO: 1517818 - RNA, 19 nt, Homo sapiens
ggcauuggaaggcauaaga

SEQ ID NO: 1517819 - RNA, 19 nt, Homo sapiens
gcaggagaguagcgugaac

SEQ ID NO: 1517820 - RNA, 19 nt, Homo sapiens
ucacuuccaacuuuaacaa

SEQ ID NO: 1517821 - RNA, 19 nt, Homo sapiens
ucuacagggucacuugguu

SEQ ID NO: 1517822 - RNA, 19 nt, Homo sapiens
guaugcucccgaucaagua

SEQ ID NO: 1517823 - RNA, 19 nt, Homo sapiens
cuacacaaccaggcuaaga

SEQ ID NO: 1517824 - RNA, 19 nt, Homo sapiens
ucaugaauugcaagaguuu

SEQ ID NO: 1517825 - RNA, 19 nt, Homo sapiens
ccaaguacacaauaguaag

SEQ ID NO: 1517826 - RNA, 19 nt, Homo sapiens
gaugggccucagucucuaa

SEQ ID NO: 1517827 - RNA, 19 nt, Homo sapiens
cagggucacuugguucauc

SEQ ID NO: 1517828 - RNA, 19 nt, Homo sapiens
gaaucuuccauaauugcuu

SEQ ID NO: 1517829 - RNA, 19 nt, Homo sapiens
ugaaacccugucucuacua

SEQ ID NO: 1517830 - RNA, 19 nt, Homo sapiens
gagaccauccuggcuaaca

SEQ ID NO: 1517831 - RNA, 19 nt, Homo sapiens
uccaaguacacaauaguaa

SEQ ID NO: 1517832 - RNA, 19 nt, Homo sapiens
gaaggaugggccucagucu

SEQ ID NO: 1517833 - RNA, 19 nt, Homo sapiens
ucgcugcccgcaucuauga

SEQ ID NO: 1517834 - RNA, 19 nt, Homo sapiens
acacaaccaggcuaagaau

SEQ ID NO: 1517835 - RNA, 19 nt, Homo sapiens
ggccucagucucuaaggaa

SEQ ID NO: 1517836 - RNA, 19 nt, Homo sapiens
uacacaaccaggcuaagaa

SEQ ID NO: 1517837 - RNA, 19 nt, Homo sapiens
uaugcucaauauucucaga

SEQ ID NO: 1517838 - RNA, 19 nt, Homo sapiens
cuuccaacuuuaacaaugg

SEQ ID NO: 1517839 - RNA, 19 nt, Homo sapiens
uggaccugguuccuucuuu

SEQ ID NO: 1517840 - RNA, 19 nt, Homo sapiens
gaaucuucucuguggcuuu

SEQ ID NO: 1517841 - RNA, 19 nt, Homo sapiens
uaauugcuuuugcucagua

SEQ ID NO: 1517842 - RNA, 19 nt, Homo sapiens
guggagcgccuggacaaug

SEQ ID NO: 1517843 - RNA, 19 nt, Homo sapiens
aauggcaccucggucaaga

SEQ ID NO: 1517844 - RNA, 19 nt, Homo sapiens
uggagcgccuggacaaugg

SEQ ID NO: 1517845 - RNA, 19 nt, Homo sapiens
gcugcccgcaucuaugauu

SEQ ID NO: 1517846 - RNA, 19 nt, Homo sapiens
acaaccaggcuaagaaucu

SEQ ID NO: 1517847 - RNA, 19 nt, Homo sapiens
gaaaccagcuuuauccaua

SEQ ID NO: 1517848 - RNA, 19 nt, Homo sapiens
gcaaccagcugccugcuua

SEQ ID NO: 1517849 - RNA, 19 nt, Homo sapiens
gaucuuggcucacugcaaa

SEQ ID NO: 1517850 - RNA, 19 nt, Homo sapiens
gcacaaccaaaucuuauua

SEQ ID NO: 1517851 - RNA, 19 nt, Homo sapiens
gaacugagaucacgucacu

SEQ ID NO: 1517852 - RNA, 19 nt, Homo sapiens
caaauugggucauucaugu

SEQ ID NO: 1517853 - RNA, 19 nt, Homo sapiens
gaaaugugcuuccucucuu

SEQ ID NO: 1517854 - RNA, 19 nt, Homo sapiens
gaaaggugcuuccucucuu

SEQ ID NO: 1517855 - RNA, 19 nt, Homo sapiens
uauggacgaugaagaauuu

SEQ ID NO: 1517856 - RNA, 19 nt, Homo sapiens
auccauagcuucugcaaua

SEQ ID NO: 1517857 - RNA, 19 nt, Homo sapiens
gaaauggguauguaaguug

SEQ ID NO: 1517858 - RNA, 19 nt, Homo sapiens
gaaauggguaugaaaguug

SEQ ID NO: 1517859 - RNA, 19 nt, Homo sapiens
gcaugcaccuguaguugaa

SEQ ID NO: 1517860 - RNA, 19 nt, Homo sapiens
cagaucaccugguuuguau

SEQ ID NO: 1517861 - RNA, 19 nt, Homo sapiens
uauaauagacccauccuuu

SEQ ID NO: 1517862 - RNA, 19 nt, Homo sapiens
cgaaauggguaugaaaguu

SEQ ID NO: 1517863 - RNA, 19 nt, Homo sapiens
uggcgaagcuggccgaauu

SEQ ID NO: 1517864 - RNA, 19 nt, Homo sapiens
ccgaguagcuggaauuaca

SEQ ID NO: 1517865 - RNA, 19 nt, Homo sapiens
ggaaaggacuaaaauacaa

SEQ ID NO: 1517866 - RNA, 19 nt, Homo sapiens
gaaacacaguggagcgaau

SEQ ID NO: 1517867 - RNA, 19 nt, Homo sapiens
gaucaugggcuacaaagau

SEQ ID NO: 1517868 - RNA, 19 nt, Homo sapiens
ugaaauggguauguaaguu

SEQ ID NO: 1517869 - RNA, 19 nt, Homo sapiens
auaaauggcuguaagucuu

SEQ ID NO: 1517870 - RNA, 19 nt, Homo sapiens
gaaacccgauggaggcaau

SEQ ID NO: 1517871 - RNA, 19 nt, Homo sapiens
guacaaauucgaugacaau

SEQ ID NO: 1517872 - RNA, 19 nt, Homo sapiens
gauuauggacgaugaagaa

SEQ ID NO: 1517873 - RNA, 19 nt, Homo sapiens
caaccgaaauggguaugaa

SEQ ID NO: 1517874 - RNA, 19 nt, Homo sapiens
ggagugcaauggcuugauc

SEQ ID NO: 1517875 - RNA, 19 nt, Homo sapiens
gcgaauguaucgagacaca

SEQ ID NO: 1517876 - RNA, 19 nt, Homo sapiens
gagcgaauguaucgagaca

SEQ ID NO: 1517877 - RNA, 19 nt, Homo sapiens
ugaagauuauggacgauga

SEQ ID NO: 1517878 - RNA, 19 nt, Homo sapiens
ggugagagacugaggaaga

SEQ ID NO: 1517879 - RNA, 19 nt, Homo sapiens
gagagacugaggaagauaa

SEQ ID NO: 1517880 - RNA, 19 nt, Homo sapiens
ccaaagugcugggauuaca

SEQ ID NO: 1517881 - RNA, 19 nt, Homo sapiens
cauauucuacuuccacuuu

SEQ ID NO: 1517882 - RNA, 19 nt, Homo sapiens
ucaccugucuccuggaaga

SEQ ID NO: 1517883 - RNA, 19 nt, Homo sapiens
gcaauaaauggcuguaagu

SEQ ID NO: 1517884 - RNA, 19 nt, Homo sapiens
cacauucuccuacaacuuu

SEQ ID NO: 1517885 - RNA, 19 nt, Homo sapiens
cauagcuucugcaauaaau

SEQ ID NO: 1517886 - RNA, 19 nt, Homo sapiens
ccagaaagagggugagaga

SEQ ID NO: 1517887 - RNA, 19 nt, Homo sapiens
ugacuggguuucaccaugu

SEQ ID NO: 1517888 - RNA, 19 nt, Homo sapiens
agggagggcuguccugaaa

SEQ ID NO: 1517889 - RNA, 19 nt, Homo sapiens
uuacaaguguuuccagauc

SEQ ID NO: 1517890 - RNA, 19 nt, Homo sapiens
cgaugacaauuaugcauuc

SEQ ID NO: 1517891 - RNA, 19 nt, Homo sapiens
gguacaaauucgaugacaa

SEQ ID NO: 1517892 - RNA, 19 nt, Homo sapiens
aaauggguauguaaguuga

SEQ ID NO: 1517893 - RNA, 19 nt, Homo sapiens
aaauggguaugaaaguuga

SEQ ID NO: 1517894 - RNA, 19 nt, Homo sapiens
ggacuaaaauacaacuuuc

SEQ ID NO: 1517895 - RNA, 19 nt, Homo sapiens
ccauggaaguuguaaagca

SEQ ID NO: 1517896 - RNA, 19 nt, Homo sapiens
gagaucacgucacugaacu

SEQ ID NO: 1517897 - RNA, 19 nt, Homo sapiens
ggagaucaugggcuacaaa

SEQ ID NO: 1517898 - RNA, 19 nt, Homo sapiens
cauacugucuccuaacaca

SEQ ID NO: 1517899 - RNA, 19 nt, Homo sapiens
aaaggugcuuccucucuug

SEQ ID NO: 1517900 - RNA, 19 nt, Homo sapiens
ggaugaagugggaggauug

SEQ ID NO: 1517901 - RNA, 19 nt, Homo sapiens
gcggcacaaccaaaucuua

SEQ ID NO: 1517902 - RNA, 19 nt, Homo sapiens
gguggaggcugcagugaac

SEQ ID NO: 1517903 - RNA, 19 nt, Homo sapiens
ucagggccauuccauagug

SEQ ID NO: 1517904 - RNA, 19 nt, Homo sapiens
gcaagccugacuccugaaa

SEQ ID NO: 1517905 - RNA, 19 nt, Homo sapiens
gaagauuauggacgaugaa

SEQ ID NO: 1517906 - RNA, 19 nt, Homo sapiens
gcccugggaggucacuuua

SEQ ID NO: 1517907 - RNA, 19 nt, Homo sapiens
uaucucagccucccaaagu

SEQ ID NO: 1517908 - RNA, 19 nt, Homo sapiens
gaugaagaauuugcauacu

SEQ ID NO: 1517909 - RNA, 19 nt, Homo sapiens
cagagcggccugucuuuau

SEQ ID NO: 1517910 - RNA, 19 nt, Homo sapiens
gcuacgaagugaaaacaaa

SEQ ID NO: 1517911 - RNA, 19 nt, Homo sapiens
aaaccagcuuuauccauag

SEQ ID NO: 1517912 - RNA, 19 nt, Homo sapiens
ugacaaagccccaucucua

SEQ ID NO: 1517913 - RNA, 19 nt, Homo sapiens
aagccucacuucagaaaca

SEQ ID NO: 1517914 - RNA, 19 nt, Homo sapiens
gugagagacugaggaagau

SEQ ID NO: 1517915 - RNA, 19 nt, Homo sapiens
cuaccagguucaagcgauu

SEQ ID NO: 1517916 - RNA, 19 nt, Homo sapiens
ccagcauaaccuaauauuu

SEQ ID NO: 1517917 - RNA, 19 nt, Homo sapiens
gaggcaauguauccacaca

SEQ ID NO: 1517918 - RNA, 19 nt, Homo sapiens
uaaauggcuguaagucuug

SEQ ID NO: 1517919 - RNA, 19 nt, Homo sapiens
aaaugugcuuccucucuug

SEQ ID NO: 1517920 - RNA, 19 nt, Homo sapiens
acacaccauugcucccaaa

SEQ ID NO: 1517921 - RNA, 19 nt, Homo sapiens
ggcaugcaccuguaguuga

SEQ ID NO: 1517922 - RNA, 19 nt, Homo sapiens
ccuggagccuggagcagaa

SEQ ID NO: 1517923 - RNA, 19 nt, Homo sapiens
ccagcugccugcuuacaag

SEQ ID NO: 1517924 - RNA, 19 nt, Homo sapiens
gcugugcuacgaagugaaa

SEQ ID NO: 1517925 - RNA, 19 nt, Homo sapiens
aaaauggacuucucugcaa

SEQ ID NO: 1517926 - RNA, 19 nt, Homo sapiens
uaauagacccauccuuucu

SEQ ID NO: 1517927 - RNA, 19 nt, Homo sapiens
cauggucugucuccucuag

SEQ ID NO: 1517928 - RNA, 19 nt, Homo sapiens
uugguucugugacgacaua

SEQ ID NO: 1517929 - RNA, 19 nt, Homo sapiens
auucaugccuugguacaaa

SEQ ID NO: 1517930 - RNA, 19 nt, Homo sapiens
cuacaaauugggucauuca

SEQ ID NO: 1517931 - RNA, 19 nt, Homo sapiens
cauccuuuguuaacuuuca

SEQ ID NO: 1517932 - RNA, 19 nt, Homo sapiens
gacccugccugaaaauaaa

SEQ ID NO: 1517933 - RNA, 19 nt, Homo sapiens
ggugcuuccucucuugguu

SEQ ID NO: 1517934 - RNA, 19 nt, Homo sapiens
ccauagcuucugcaauaaa

SEQ ID NO: 1517935 - RNA, 19 nt, Homo sapiens
aaguugaaauggguaugua

SEQ ID NO: 1517936 - RNA, 19 nt, Homo sapiens
aaacucugccuaccagguu

SEQ ID NO: 1517937 - RNA, 19 nt, Homo sapiens
gacccauugucaugcagaa

SEQ ID NO: 1517938 - RNA, 19 nt, Homo sapiens
cagugaaggucagccauuc

SEQ ID NO: 1517939 - RNA, 19 nt, Homo sapiens
uacaaguguuuccagauca

SEQ ID NO: 1517940 - RNA, 19 nt, Homo sapiens
aauaaacucaaccgaaaug

SEQ ID NO: 1517941 - RNA, 19 nt, Homo sapiens
ggugacucaugccuauaau

SEQ ID NO: 1517942 - RNA, 19 nt, Homo sapiens
gcuccagacaaagaucuua

SEQ ID NO: 1517943 - RNA, 19 nt, Homo sapiens
gagcaccacgcagaaaugu

SEQ ID NO: 1517944 - RNA, 19 nt, Homo sapiens
ugcaauaaauggcuguaag

SEQ ID NO: 1517945 - RNA, 19 nt, Homo sapiens
cugaaacugugcauuguac

SEQ ID NO: 1517946 - RNA, 19 nt, Homo sapiens
aggcagaggugagagaauc

SEQ ID NO: 1517947 - RNA, 19 nt, Homo sapiens
cauaauagguguucaauca

SEQ ID NO: 1517948 - RNA, 19 nt, Homo sapiens
gcaccucacuuuccucauu

SEQ ID NO: 1517949 - RNA, 19 nt, Homo sapiens
gcaccucacuuuccucauu

SEQ ID NO: 1517950 - RNA, 19 nt, Homo sapiens
caauguaggcucaauaaua

SEQ ID NO: 1517951 - RNA, 19 nt, Homo sapiens
uaucagagauggacaagau

SEQ ID NO: 1517952 - RNA, 19 nt, Homo sapiens
ucacagagguguugcaaag

SEQ ID NO: 1517953 - RNA, 19 nt, Homo sapiens
caaaguuggugucacaaga

SEQ ID NO: 1517954 - RNA, 19 nt, Homo sapiens
caacgcagguccagcucua

SEQ ID NO: 1517955 - RNA, 19 nt, Homo sapiens
ucacuuuccucauugguuu

SEQ ID NO: 1517956 - RNA, 19 nt, Homo sapiens
ucacuuuccucauugguuu

SEQ ID NO: 1517957 - RNA, 19 nt, Homo sapiens
caauaauacuuccuucuca

SEQ ID NO: 1517958 - RNA, 19 nt, Homo sapiens
uuaggaaugugacggauaa

SEQ ID NO: 1517959 - RNA, 19 nt, Homo sapiens
ggaaugugacggauaagaa

SEQ ID NO: 1517960 - RNA, 19 nt, Homo sapiens
gaacuaacuaucagagaug

SEQ ID NO: 1517961 - RNA, 19 nt, Homo sapiens
gaacaaucagcccaaagaa

SEQ ID NO: 1517962 - RNA, 19 nt, Homo sapiens
gaaaccccaucucuaguua

SEQ ID NO: 1517963 - RNA, 19 nt, Homo sapiens
auagagagaucccauggaa

SEQ ID NO: 1517964 - RNA, 19 nt, Homo sapiens
gcacaccuguagucaaagu

SEQ ID NO: 1517965 - RNA, 19 nt, Homo sapiens
cagagggucuucaguguca

SEQ ID NO: 1517966 - RNA, 19 nt, Homo sapiens
cugcacaccuguagucaaa

SEQ ID NO: 1517967 - RNA, 19 nt, Homo sapiens
ugauagagcuggccuugca

SEQ ID NO: 1517968 - RNA, 19 nt, Homo sapiens
ccaccauucuaguccauuu

SEQ ID NO: 1517969 - RNA, 19 nt, Homo sapiens
ucacagaggaugaaugaau

SEQ ID NO: 1517970 - RNA, 19 nt, Homo sapiens
aauguaggcucaauaauac

SEQ ID NO: 1517971 - RNA, 19 nt, Homo sapiens
ugaacuaacuaucagagau

SEQ ID NO: 1517972 - RNA, 19 nt, Homo sapiens
cacagaggaugaaugaaug

SEQ ID NO: 1517973 - RNA, 19 nt, Homo sapiens
caggcgagcuggcacauca

SEQ ID NO: 1517974 - RNA, 19 nt, Homo sapiens
gagcuggacucugaucaca

SEQ ID NO: 1517975 - RNA, 19 nt, Homo sapiens
gaaugugacggauaagaau

SEQ ID NO: 1517976 - RNA, 19 nt, Homo sapiens
gcucuaugcccucuacuga

SEQ ID NO: 1517977 - RNA, 19 nt, Homo sapiens
gauaugugcagccggguaa

SEQ ID NO: 1517978 - RNA, 19 nt, Homo sapiens
ggacuuuguuggguaagga

SEQ ID NO: 1517979 - RNA, 19 nt, Homo sapiens
gaauuggcuucuuuucuuu

SEQ ID NO: 1517980 - RNA, 19 nt, Homo sapiens
cugcugaauuggcuucuuu

SEQ ID NO: 1517981 - RNA, 19 nt, Homo sapiens
cacaauguaggcucaauaa

SEQ ID NO: 1517982 - RNA, 19 nt, Homo sapiens
ggacugagcccuggaacag

SEQ ID NO: 1517983 - RNA, 19 nt, Homo sapiens
cguauucaguucaguggaa

SEQ ID NO: 1517984 - RNA, 19 nt, Homo sapiens
cacaguggcucacgcuugu

SEQ ID NO: 1517985 - RNA, 19 nt, Homo sapiens
ugaauuggcuucuuuucuu

SEQ ID NO: 1517986 - RNA, 19 nt, Homo sapiens
ugagaacaaucagcccaaa

SEQ ID NO: 1517987 - RNA, 19 nt, Homo sapiens
cacagagggucuucagugu

SEQ ID NO: 1517988 - RNA, 19 nt, Homo sapiens
aaguuggugucacaagaua

SEQ ID NO: 1517989 - RNA, 19 nt, Homo sapiens
agucaaaguuggugucaca

SEQ ID NO: 1517990 - RNA, 19 nt, Homo sapiens
caucaacuagcacccagua

SEQ ID NO: 1517991 - RNA, 19 nt, Homo sapiens
aaacaaacaaagccaaaca

SEQ ID NO: 1517992 - RNA, 19 nt, Homo sapiens
ugaccaggguagugauaug

SEQ ID NO: 1517993 - RNA, 19 nt, Homo sapiens
cgagcuggcacaucaacua

SEQ ID NO: 1517994 - RNA, 19 nt, Homo sapiens
ugagaaagcccaggguguu

SEQ ID NO: 1517995 - RNA, 19 nt, Homo sapiens
agaacaaucagcccaaaga

SEQ ID NO: 1517996 - RNA, 19 nt, Homo sapiens
gcccucuacugaaggcuuu

SEQ ID NO: 1517997 - RNA, 19 nt, Homo sapiens
ggccgaagcaggcagauca

SEQ ID NO: 1517998 - RNA, 19 nt, Homo sapiens
gaggaggccaccauucuag

SEQ ID NO: 1517999 - RNA, 19 nt, Homo sapiens
gcagaggaggccaccauuc

SEQ ID NO: 1518000 - RNA, 19 nt, Homo sapiens
cagugguccugucuggaua

SEQ ID NO: 1518001 - RNA, 19 nt, Homo sapiens
gaucugcacaccuguaguc

SEQ ID NO: 1518002 - RNA, 19 nt, Homo sapiens
acacaauguaggcucaaua

SEQ ID NO: 1518003 - RNA, 19 nt, Homo sapiens
gcuggcacaucaacuagca

SEQ ID NO: 1518004 - RNA, 19 nt, Homo sapiens
caccucacuuuccucauug

SEQ ID NO: 1518005 - RNA, 19 nt, Homo sapiens
caccucacuuuccucauug

SEQ ID NO: 1518006 - RNA, 19 nt, Homo sapiens
ucaguucaguggaagaaag

SEQ ID NO: 1518007 - RNA, 19 nt, Homo sapiens
gaaggaacucacagaggau

SEQ ID NO: 1518008 - RNA, 19 nt, Homo sapiens
ucuaugcccucuacugaag

SEQ ID NO: 1518009 - RNA, 19 nt, Homo sapiens
acucacagaggaugaauga

SEQ ID NO: 1518010 - RNA, 19 nt, Homo sapiens
caacuagcacccaguaggu

SEQ ID NO: 1518011 - RNA, 19 nt, Homo sapiens
gaggcggaguuugcaguga

SEQ ID NO: 1518012 - RNA, 19 nt, Homo sapiens
ccaggaaacagcauaggau

SEQ ID NO: 1518013 - RNA, 19 nt, Homo sapiens
gagaaagcccaggguguuc

SEQ ID NO: 1518014 - RNA, 19 nt, Homo sapiens
ggaaaugggccagaaaaug

SEQ ID NO: 1518015 - RNA, 19 nt, Homo sapiens
cccaguaggugcucaaugc

SEQ ID NO: 1518016 - RNA, 19 nt, Homo sapiens
gccugaugauugugagauu

SEQ ID NO: 1518017 - RNA, 19 nt, Homo sapiens
gaaaugggccagaaaaugc

SEQ ID NO: 1518018 - RNA, 19 nt, Homo sapiens
ggaacucacagaggaugaa

SEQ ID NO: 1518019 - RNA, 19 nt, Homo sapiens
agaccagccugaccaaggu

SEQ ID NO: 1518020 - RNA, 19 nt, Homo sapiens
ucaauaauacuuccuucuc

SEQ ID NO: 1518021 - RNA, 19 nt, Homo sapiens
ccagaucugcacaccugua

SEQ ID NO: 1518022 - RNA, 19 nt, Homo sapiens
aaauuagccaggcguggua

SEQ ID NO: 1518023 - RNA, 19 nt, Homo sapiens
gauagagagaucccaugga

SEQ ID NO: 1518024 - RNA, 19 nt, Homo sapiens
gucacaagauagagagauc

SEQ ID NO: 1518025 - RNA, 19 nt, Homo sapiens
cagaggaggccaccauucu

SEQ ID NO: 1518026 - RNA, 19 nt, Homo sapiens
gaacucacagaggaugaau

SEQ ID NO: 1518027 - RNA, 19 nt, Homo sapiens
acaaucagcccaaagaaaa

SEQ ID NO: 1518028 - RNA, 19 nt, Homo sapiens
agacauaauagguguucaa

SEQ ID NO: 1518029 - RNA, 19 nt, Homo sapiens
gcaccaggaaacagcauag

SEQ ID NO: 1518030 - RNA, 19 nt, Homo sapiens
agaggaggccaccauucua

SEQ ID NO: 1518031 - RNA, 19 nt, Homo sapiens
gagcuggcacaucaacuag

SEQ ID NO: 1518032 - RNA, 19 nt, Homo sapiens
gccgcugccugaugauugu

SEQ ID NO: 1518033 - RNA, 19 nt, Homo sapiens
gacauaauagguguucaau

SEQ ID NO: 1518034 - RNA, 19 nt, Homo sapiens
agagagaucccauggaaaa

SEQ ID NO: 1518035 - RNA, 19 nt, Homo sapiens
aacaaucagcccaaagaaa

SEQ ID NO: 1518036 - RNA, 19 nt, Homo sapiens
gaucacagagggucuucag

SEQ ID NO: 1518037 - RNA, 19 nt, Homo sapiens
caccauucuaguccauuua

SEQ ID NO: 1518038 - RNA, 19 nt, Homo sapiens
acagagguguugcaaagcu

SEQ ID NO: 1518039 - RNA, 19 nt, Homo sapiens
gaggaugcaccaggaaaca

SEQ ID NO: 1518040 - RNA, 19 nt, Homo sapiens
cucaaugcgugcagaagga

SEQ ID NO: 1518041 - RNA, 19 nt, Homo sapiens
guagcacacgccuguaauc

SEQ ID NO: 1518042 - RNA, 19 nt, Homo sapiens
caguggcucacgcuuguaa

SEQ ID NO: 1518043 - RNA, 19 nt, Homo sapiens
gaaagcccaggguguucug

SEQ ID NO: 1518044 - RNA, 19 nt, Homo sapiens
ccagcucuaugcccucuac

SEQ ID NO: 1518045 - RNA, 19 nt, Homo sapiens
ggaggccaccauucuaguc

SEQ ID NO: 1518046 - RNA, 19 nt, Homo sapiens
uguaaucgcagcacuuugg

SEQ ID NO: 1518047 - RNA, 19 nt, Homo sapiens
guucgacaauggcagcuuu

SEQ ID NO: 1518048 - RNA, 19 nt, Homo sapiens
gagaggaggaagaugaaga

SEQ ID NO: 1518049 - RNA, 19 nt, Homo sapiens
ggaggcggaugcaucucuu

SEQ ID NO: 1518050 - RNA, 19 nt, Homo sapiens
gccacaaccucucgcugaa

SEQ ID NO: 1518051 - RNA, 19 nt, Homo sapiens
gaacagcauccgccacaac

SEQ ID NO: 1518052 - RNA, 19 nt, Homo sapiens
caucugcgccuucauuagu

SEQ ID NO: 1518053 - RNA, 19 nt, Homo sapiens
ggcaucugcgccuucauua

SEQ ID NO: 1518054 - RNA, 19 nt, Homo sapiens
ggaagacgguaaaaucgau

SEQ ID NO: 1518055 - RNA, 19 nt, Homo sapiens
caggacauguucgacaaug

SEQ ID NO: 1518056 - RNA, 19 nt, Homo sapiens
gggagaggaggaagaugaa

SEQ ID NO: 1518057 - RNA, 19 nt, Homo sapiens
gcaucucuuucagcauuga

SEQ ID NO: 1518058 - RNA, 19 nt, Homo sapiens
gcauccuccucgcuaccua

SEQ ID NO: 1518059 - RNA, 19 nt, Homo sapiens
cccaggacauguucgacaa

SEQ ID NO: 1518060 - RNA, 19 nt, Homo sapiens
gccaugaaccugccaagag

SEQ ID NO: 1518061 - RNA, 19 nt, Homo sapiens
cggcaucugcgccuucauu

SEQ ID NO: 1518062 - RNA, 19 nt, Homo sapiens
ugggagaggaggaagauga

SEQ ID NO: 1518063 - RNA, 19 nt, Homo sapiens
gcggaugcaucucuuucag

SEQ ID NO: 1518064 - RNA, 19 nt, Homo sapiens
gcaccugcuccgccaugaa

SEQ ID NO: 1518065 - RNA, 19 nt, Homo sapiens
caccauggccauccugcaa

SEQ ID NO: 1518066 - RNA, 19 nt, Homo sapiens
ccauggccauccugcaaag

SEQ ID NO: 1518067 - RNA, 19 nt, Homo sapiens
gugcugcagcccucacuug

SEQ ID NO: 1518068 - RNA, 19 nt, Homo sapiens
caauugaccuggaauauuu

SEQ ID NO: 1518069 - RNA, 19 nt, Homo sapiens
gaacauguuucaaggauug

SEQ ID NO: 1518070 - RNA, 19 nt, Homo sapiens
caaccgagauguuccauuu

SEQ ID NO: 1518071 - RNA, 19 nt, Homo sapiens
gaugauacgucaagaaaga

SEQ ID NO: 1518072 - RNA, 19 nt, Homo sapiens
ggaaagaaauacaggaugu

SEQ ID NO: 1518073 - RNA, 19 nt, Homo sapiens
gaacgaaucauaccuacuu

SEQ ID NO: 1518074 - RNA, 19 nt, Homo sapiens
caaaauggcugguguagaa

SEQ ID NO: 1518075 - RNA, 19 nt, Homo sapiens
gguaggaugugccagagua

SEQ ID NO: 1518076 - RNA, 19 nt, Homo sapiens
gaacagagacgagguagga

SEQ ID NO: 1518077 - RNA, 19 nt, Homo sapiens
caggugaagugccuaauuu

SEQ ID NO: 1518078 - RNA, 19 nt, Homo sapiens
aggacuaucuugaugauua

SEQ ID NO: 1518079 - RNA, 19 nt, Homo sapiens
agauaaagcugaucggauu

SEQ ID NO: 1518080 - RNA, 19 nt, Homo sapiens
ggaguuaacuuggcaaugg

SEQ ID NO: 1518081 - RNA, 19 nt, Homo sapiens
gcauucauauggacuuuga

SEQ ID NO: 1518082 - RNA, 19 nt, Homo sapiens
caagucccauuaugucuuu

SEQ ID NO: 1518083 - RNA, 19 nt, Homo sapiens
caaacugcaucaagcauug

SEQ ID NO: 1518084 - RNA, 19 nt, Homo sapiens
caaauguucuacaggacua

SEQ ID NO: 1518085 - RNA, 19 nt, Homo sapiens
caucauauuuggagauuuc

SEQ ID NO: 1518086 - RNA, 19 nt, Homo sapiens
uaaauaacauccugaacuc

SEQ ID NO: 1518087 - RNA, 19 nt, Homo sapiens
uaaaugguuuccugaguga

SEQ ID NO: 1518088 - RNA, 19 nt, Homo sapiens
ggacuaucuugaugauuau

SEQ ID NO: 1518089 - RNA, 19 nt, Homo sapiens
ugacaugccugauauagag

SEQ ID NO: 1518090 - RNA, 19 nt, Homo sapiens
ccaaaugugugcaagacaa

SEQ ID NO: 1518091 - RNA, 19 nt, Homo sapiens
ggacacaagagaucauuga

SEQ ID NO: 1518092 - RNA, 19 nt, Homo sapiens
gaaagauggaguuaacuug

SEQ ID NO: 1518093 - RNA, 19 nt, Homo sapiens
guaguuauguggcuuuauc

SEQ ID NO: 1518094 - RNA, 19 nt, Homo sapiens
uauaugcgguuacaaaugu

SEQ ID NO: 1518095 - RNA, 19 nt, Homo sapiens
gcaauugaccuggaauauu

SEQ ID NO: 1518096 - RNA, 19 nt, Homo sapiens
gcucaaacuucaucugcaa

SEQ ID NO: 1518097 - RNA, 19 nt, Homo sapiens
gaagacaagaauaugguuu

SEQ ID NO: 1518098 - RNA, 19 nt, Homo sapiens
cuacaggacuaucuugaug

SEQ ID NO: 1518099 - RNA, 19 nt, Homo sapiens
gguggaaaccuaacugaaa

SEQ ID NO: 1518100 - RNA, 19 nt, Homo sapiens
ggaaagauggaguuaacuu

SEQ ID NO: 1518101 - RNA, 19 nt, Homo sapiens
caaaguuacuacacucugu

SEQ ID NO: 1518102 - RNA, 19 nt, Homo sapiens
ucacaaaucccaaagaagu

SEQ ID NO: 1518103 - RNA, 19 nt, Homo sapiens
gcucucagccuccgauuga

SEQ ID NO: 1518104 - RNA, 19 nt, Homo sapiens
gaaguaaaguugguguucu

SEQ ID NO: 1518105 - RNA, 19 nt, Homo sapiens
gugaagugccuaauuuauu

SEQ ID NO: 1518106 - RNA, 19 nt, Homo sapiens
ucucacaaaucccaaagaa

SEQ ID NO: 1518107 - RNA, 19 nt, Homo sapiens
gcaaacugcaucaagcauu

SEQ ID NO: 1518108 - RNA, 19 nt, Homo sapiens
guggacaucagcaaaguua

SEQ ID NO: 1518109 - RNA, 19 nt, Homo sapiens
gagcauucauauggacuuu

SEQ ID NO: 1518110 - RNA, 19 nt, Homo sapiens
gcucauauaugcgguuaca

SEQ ID NO: 1518111 - RNA, 19 nt, Homo sapiens
ggagauuucauuaaguuug

SEQ ID NO: 1518112 - RNA, 19 nt, Homo sapiens
gagacuugcagcucauaua

SEQ ID NO: 1518113 - RNA, 19 nt, Homo sapiens
caaauacaaccgagauguu

SEQ ID NO: 1518114 - RNA, 19 nt, Homo sapiens
gaucuguggagcauucaua

SEQ ID NO: 1518115 - RNA, 19 nt, Homo sapiens
ggugaucuguggagcauuc

SEQ ID NO: 1518116 - RNA, 19 nt, Homo sapiens
agaaucagcuggcuauguc

SEQ ID NO: 1518117 - RNA, 19 nt, Homo sapiens
gaguaguuauguggcuuua

SEQ ID NO: 1518118 - RNA, 19 nt, Homo sapiens
ggaguuccuagaagauaua

SEQ ID NO: 1518119 - RNA, 19 nt, Homo sapiens
gagauuucauuaaguuugg

SEQ ID NO: 1518120 - RNA, 19 nt, Homo sapiens
gaauaugguuuuccuuuuc

SEQ ID NO: 1518121 - RNA, 19 nt, Homo sapiens
aaggauugcucggaugaua

SEQ ID NO: 1518122 - RNA, 19 nt, Homo sapiens
aagcugaucggauuuauga

SEQ ID NO: 1518123 - RNA, 19 nt, Homo sapiens
ccaagcaauuccacaagug

SEQ ID NO: 1518124 - RNA, 19 nt, Homo sapiens
ggagugggcaagucuguga

SEQ ID NO: 1518125 - RNA, 19 nt, Homo sapiens
ggaugugccagaguaguua

SEQ ID NO: 1518126 - RNA, 19 nt, Homo sapiens
ucauauaugcgguuacaaa

SEQ ID NO: 1518127 - RNA, 19 nt, Homo sapiens
uagaacauguuucaaggau

SEQ ID NO: 1518128 - RNA, 19 nt, Homo sapiens
cccauuaugucuuuaacuu

SEQ ID NO: 1518129 - RNA, 19 nt, Homo sapiens
uaugaugacaugccugaua

SEQ ID NO: 1518130 - RNA, 19 nt, Homo sapiens
cagcucauauaugcgguua

SEQ ID NO: 1518131 - RNA, 19 nt, Homo sapiens
ggugaagugccuaauuuau

SEQ ID NO: 1518132 - RNA, 19 nt, Homo sapiens
agagaaaacugcaaauguu

SEQ ID NO: 1518133 - RNA, 19 nt, Homo sapiens
gauaaagcugaucggauuu

SEQ ID NO: 1518134 - RNA, 19 nt, Homo sapiens
ucaagaaucagcuggcuau

SEQ ID NO: 1518135 - RNA, 19 nt, Homo sapiens
gccaagcaauuccacaagu

SEQ ID NO: 1518136 - RNA, 19 nt, Homo sapiens
ugagggacuuauccaaaug

SEQ ID NO: 1518137 - RNA, 19 nt, Homo sapiens
cgaaucauaccuacuuuca

SEQ ID NO: 1518138 - RNA, 19 nt, Homo sapiens
gaguuaacuuggcaaugga

SEQ ID NO: 1518139 - RNA, 19 nt, Homo sapiens
ggaguaggaggcacaggaa

SEQ ID NO: 1518140 - RNA, 19 nt, Homo sapiens
cugaucggauuuaugauga

SEQ ID NO: 1518141 - RNA, 19 nt, Homo sapiens
agucaagcauuccguguug

SEQ ID NO: 1518142 - RNA, 19 nt, Homo sapiens
gaagugccuaauuuauuug

SEQ ID NO: 1518143 - RNA, 19 nt, Homo sapiens
cggaugauacgucaagaaa

SEQ ID NO: 1518144 - RNA, 19 nt, Homo sapiens
augaagaccugaggaaguu

SEQ ID NO: 1518145 - RNA, 19 nt, Homo sapiens
gaugcuauagaacauguuu

SEQ ID NO: 1518146 - RNA, 19 nt, Homo sapiens
ccaggaugcuauagaacau

SEQ ID NO: 1518147 - RNA, 19 nt, Homo sapiens
uaaaguugguguucuucca

SEQ ID NO: 1518148 - RNA, 19 nt, Homo sapiens
caaaugugugcaagacaaa

SEQ ID NO: 1518149 - RNA, 19 nt, Homo sapiens
uacacucuguugcuuauug

SEQ ID NO: 1518150 - RNA, 19 nt, Homo sapiens
cacaaaucccaaagaagua

SEQ ID NO: 1518151 - RNA, 19 nt, Homo sapiens
gcugaucggauuuaugaug

SEQ ID NO: 1518152 - RNA, 19 nt, Homo sapiens
agucaaaacuggagagaaa

SEQ ID NO: 1518153 - RNA, 19 nt, Homo sapiens
gcaaggacacaagagauca

SEQ ID NO: 1518154 - RNA, 19 nt, Homo sapiens
ugaacacuauacuauguca

SEQ ID NO: 1518155 - RNA, 19 nt, Homo sapiens
caaaagaaguaggaauuuc

SEQ ID NO: 1518156 - RNA, 19 nt, Homo sapiens
gcaaaagaaguaggaauuu

SEQ ID NO: 1518157 - RNA, 19 nt, Homo sapiens
ucacugacacccagauugu

SEQ ID NO: 1518158 - RNA, 19 nt, Homo sapiens
guagaagacaagaauaugg

SEQ ID NO: 1518159 - RNA, 19 nt, Homo sapiens
cuuccaggaugcuauagaa

SEQ ID NO: 1518160 - RNA, 19 nt, Homo sapiens
gaucggauuuaugaugaca

SEQ ID NO: 1518161 - RNA, 19 nt, Homo sapiens
cuggcuaugucccuguuua

SEQ ID NO: 1518162 - RNA, 19 nt, Homo sapiens
aagcauuccguguuguuua

SEQ ID NO: 1518163 - RNA, 19 nt, Homo sapiens
gaugccaggcuucccaauu

SEQ ID NO: 1518164 - RNA, 19 nt, Homo sapiens
guggaaaccuaacugaaaa

SEQ ID NO: 1518165 - RNA, 19 nt, Homo sapiens
aaacguuucuucaccuuuu

SEQ ID NO: 1518166 - RNA, 19 nt, Homo sapiens
ugggaaagauggaguuaac

SEQ ID NO: 1518167 - RNA, 19 nt, Homo sapiens
gacaucagcaaaguuacua

SEQ ID NO: 1518168 - RNA, 19 nt, Homo sapiens
gaaaagcgcuugaauaaaa

SEQ ID NO: 1518169 - RNA, 19 nt, Homo sapiens
caacagaaauugcaaggaa

SEQ ID NO: 1518170 - RNA, 19 nt, Homo sapiens
aggaacagcugaaauauaa

SEQ ID NO: 1518171 - RNA, 19 nt, Homo sapiens
gagccaaacucaauaucua

SEQ ID NO: 1518172 - RNA, 19 nt, Homo sapiens
gaacucugcuuuccucuuc

SEQ ID NO: 1518173 - RNA, 19 nt, Homo sapiens
aaggaaaucuguucuauga

SEQ ID NO: 1518174 - RNA, 19 nt, Homo sapiens
ucauagcacuucccaauaa

SEQ ID NO: 1518175 - RNA, 19 nt, Homo sapiens
gcaaggaaauccaacaaag

SEQ ID NO: 1518176 - RNA, 19 nt, Homo sapiens
gguuggagauuauguguuu

SEQ ID NO: 1518177 - RNA, 19 nt, Homo sapiens
gggaacaucaucucauuua

SEQ ID NO: 1518178 - RNA, 19 nt, Homo sapiens
gaaaguccuucacgcagaa

SEQ ID NO: 1518179 - RNA, 19 nt, Homo sapiens
gugcaaagccucaaucuga

SEQ ID NO: 1518180 - RNA, 19 nt, Homo sapiens
gagagacugucauguguau

SEQ ID NO: 1518181 - RNA, 19 nt, Homo sapiens
caagaucauucaguucaua

SEQ ID NO: 1518182 - RNA, 19 nt, Homo sapiens
gaagaauuaugcaaacaag

SEQ ID NO: 1518183 - RNA, 19 nt, Homo sapiens
caaacaaaccaauacagua

SEQ ID NO: 1518184 - RNA, 19 nt, Homo sapiens
acacaaacuucaucucuga

SEQ ID NO: 1518185 - RNA, 19 nt, Homo sapiens
ugucuaaggucuuugauga

SEQ ID NO: 1518186 - RNA, 19 nt, Homo sapiens
ugcaagaccuuuauucuga

SEQ ID NO: 1518187 - RNA, 19 nt, Homo sapiens
guagguaacucuaauugag

SEQ ID NO: 1518188 - RNA, 19 nt, Homo sapiens
gcuggaaagugaaauccua

SEQ ID NO: 1518189 - RNA, 19 nt, Homo sapiens
ucagaugugucuucagaaa

SEQ ID NO: 1518190 - RNA, 19 nt, Homo sapiens
ugaaagagcugucgaugcu

SEQ ID NO: 1518191 - RNA, 19 nt, Homo sapiens
ggagacagcaagcaucaaa

SEQ ID NO: 1518192 - RNA, 19 nt, Homo sapiens
cagaggcuguucagaauga

SEQ ID NO: 1518193 - RNA, 19 nt, Homo sapiens
ggacagaagguuauugcaa

SEQ ID NO: 1518194 - RNA, 19 nt, Homo sapiens
gagaaggaagccagguuua

SEQ ID NO: 1518195 - RNA, 19 nt, Homo sapiens
gaagaugcaagaccuuuau

SEQ ID NO: 1518196 - RNA, 19 nt, Homo sapiens
gggagagacugucaugugu

SEQ ID NO: 1518197 - RNA, 19 nt, Homo sapiens
ccaagaagaauuaugcaaa

SEQ ID NO: 1518198 - RNA, 19 nt, Homo sapiens
gcacagcuccaccuauguu

SEQ ID NO: 1518199 - RNA, 19 nt, Homo sapiens
gaaggaagccagguuuaug

SEQ ID NO: 1518200 - RNA, 19 nt, Homo sapiens
cagggaacaucaucucauu

SEQ ID NO: 1518201 - RNA, 19 nt, Homo sapiens
caagaagaauuaugcaaac

SEQ ID NO: 1518202 - RNA, 19 nt, Homo sapiens
gcaaacaaaccaauacagu

SEQ ID NO: 1518203 - RNA, 19 nt, Homo sapiens
guucagaccucagcguuga

SEQ ID NO: 1518204 - RNA, 19 nt, Homo sapiens
uauaccaucuccuucaauu

SEQ ID NO: 1518205 - RNA, 19 nt, Homo sapiens
gaugggcagugcuggauga

SEQ ID NO: 1518206 - RNA, 19 nt, Homo sapiens
gagagaagcccaggaggaa

SEQ ID NO: 1518207 - RNA, 19 nt, Homo sapiens
uaacaaccggagagaauuu

SEQ ID NO: 1518208 - RNA, 19 nt, Homo sapiens
gaagguuauugcaagaugu

SEQ ID NO: 1518209 - RNA, 19 nt, Homo sapiens
ccaaggagccaaacucaau

SEQ ID NO: 1518210 - RNA, 19 nt, Homo sapiens
ccaagaaacucacccucau

SEQ ID NO: 1518211 - RNA, 19 nt, Homo sapiens
ggacugcucuaagugacaa

SEQ ID NO: 1518212 - RNA, 19 nt, Homo sapiens
ccucggagugcacuuauua

SEQ ID NO: 1518213 - RNA, 19 nt, Homo sapiens
caaggaaauccaacaaaga

SEQ ID NO: 1518214 - RNA, 19 nt, Homo sapiens
uacaggaacagcugaaaua

SEQ ID NO: 1518215 - RNA, 19 nt, Homo sapiens
ccucauggaugccuuguca

SEQ ID NO: 1518216 - RNA, 19 nt, Homo sapiens
gaaacucacccucauggau

SEQ ID NO: 1518217 - RNA, 19 nt, Homo sapiens
ggacaugcccuaggccauu

SEQ ID NO: 1518218 - RNA, 19 nt, Homo sapiens
ccgcacagcuccaccuaug

SEQ ID NO: 1518219 - RNA, 19 nt, Homo sapiens
gacaagaucauucaguuca

SEQ ID NO: 1518220 - RNA, 19 nt, Homo sapiens
ccaggaggcugccaagaag

SEQ ID NO: 1518221 - RNA, 19 nt, Homo sapiens
caaggagccaaacucaaua

SEQ ID NO: 1518222 - RNA, 19 nt, Homo sapiens
cuucagaugugucuucaga

SEQ ID NO: 1518223 - RNA, 19 nt, Homo sapiens
ggaggacugcucuaaguga

SEQ ID NO: 1518224 - RNA, 19 nt, Homo sapiens
caggaacagcugaaauaua

SEQ ID NO: 1518225 - RNA, 19 nt, Homo sapiens
ggagagacugucaugugua

SEQ ID NO: 1518226 - RNA, 19 nt, Homo sapiens
ccacgauucuucagaugug

SEQ ID NO: 1518227 - RNA, 19 nt, Homo sapiens
ccucacagcagccguuuaa

SEQ ID NO: 1518228 - RNA, 19 nt, Homo sapiens
gaacaucaucucauuuacu

SEQ ID NO: 1518229 - RNA, 19 nt, Homo sapiens
ugucgaugcuggaaaguga

SEQ ID NO: 1518230 - RNA, 19 nt, Homo sapiens
gcucaguccuggauuagag

SEQ ID NO: 1518231 - RNA, 19 nt, Homo sapiens
caacacaaacuucaucucu

SEQ ID NO: 1518232 - RNA, 19 nt, Homo sapiens
gaugucgauucaacacaaa

SEQ ID NO: 1518233 - RNA, 19 nt, Homo sapiens
caggcaaucuaccuucuga

SEQ ID NO: 1518234 - RNA, 19 nt, Homo sapiens
cggagucuguuguagguaa

SEQ ID NO: 1518235 - RNA, 19 nt, Homo sapiens
gagaagaugcaagaccuuu

SEQ ID NO: 1518236 - RNA, 19 nt, Homo sapiens
gagcgucccugagacacuu

SEQ ID NO: 1518237 - RNA, 19 nt, Homo sapiens
ugucaugucuaaggucuuu

SEQ ID NO: 1518238 - RNA, 19 nt, Homo sapiens
ggucaaacguuuucaggaa

SEQ ID NO: 1518239 - RNA, 19 nt, Homo sapiens
gcaacgacacaaauaagau

SEQ ID NO: 1518240 - RNA, 19 nt, Homo sapiens
ggacaagaucauucaguuc

SEQ ID NO: 1518241 - RNA, 19 nt, Homo sapiens
ggagcuguuuccuucauuc

SEQ ID NO: 1518242 - RNA, 19 nt, Homo sapiens
ggaacaucaucucauuuac

SEQ ID NO: 1518243 - RNA, 19 nt, Homo sapiens
agcauuaucucaagaggaa

SEQ ID NO: 1518244 - RNA, 19 nt, Homo sapiens
caaacucaauaucuacaag

SEQ ID NO: 1518245 - RNA, 19 nt, Homo sapiens
caacgacacaaauaagaug

SEQ ID NO: 1518246 - RNA, 19 nt, Homo sapiens
ugugauacccaaaggauuu

SEQ ID NO: 1518247 - RNA, 19 nt, Homo sapiens
ucaaaggacagaagguuau

SEQ ID NO: 1518248 - RNA, 19 nt, Homo sapiens
cgggagagcaacagaaauu

SEQ ID NO: 1518249 - RNA, 19 nt, Homo sapiens
ggaaggauggccucuccaa

SEQ ID NO: 1518250 - RNA, 19 nt, Homo sapiens
gagacugucauguguauca

SEQ ID NO: 1518251 - RNA, 19 nt, Homo sapiens
aaggaaauccaacaaagaa

SEQ ID NO: 1518252 - RNA, 19 nt, Homo sapiens
aaacaaaccaauacaguac

SEQ ID NO: 1518253 - RNA, 19 nt, Homo sapiens
ugaccacgauucuucagau

SEQ ID NO: 1518254 - RNA, 19 nt, Homo sapiens
cgagaaggaagccagguuu

SEQ ID NO: 1518255 - RNA, 19 nt, Homo sapiens
gcaaagccucaaucugaug

SEQ ID NO: 1518256 - RNA, 19 nt, Homo sapiens
cccagaggcuguucagaau

SEQ ID NO: 1518257 - RNA, 19 nt, Homo sapiens
acagaagguuauugcaaga

SEQ ID NO: 1518258 - RNA, 19 nt, Homo sapiens
gaccacgauucuucagaug

SEQ ID NO: 1518259 - RNA, 19 nt, Homo sapiens
aggacaagaucauucaguu

SEQ ID NO: 1518260 - RNA, 19 nt, Homo sapiens
ugaugucgauucaacacaa

SEQ ID NO: 1518261 - RNA, 19 nt, Homo sapiens
guaacaaccggagagaauu

SEQ ID NO: 1518262 - RNA, 19 nt, Homo sapiens
acaaaccaauacaguacuu

SEQ ID NO: 1518263 - RNA, 19 nt, Homo sapiens
gcucuaagugacaaagaaa

SEQ ID NO: 1518264 - RNA, 19 nt, Homo sapiens
ccggaggacugcucuaagu

SEQ ID NO: 1518265 - RNA, 19 nt, Homo sapiens
aaaccagccugcucagaag

SEQ ID NO: 1518266 - RNA, 19 nt, Homo sapiens
gaagcggacacgcaggauu

SEQ ID NO: 1518267 - RNA, 19 nt, Homo sapiens
cgacacaaauaagaugaca

SEQ ID NO: 1518268 - RNA, 19 nt, Homo sapiens
cagcaaaucucuagaaauu

SEQ ID NO: 1518269 - RNA, 19 nt, Homo sapiens
ggagaaagcuggaagaaca

SEQ ID NO: 1518270 - RNA, 19 nt, Homo sapiens
gaaguggccucgucaauau

SEQ ID NO: 1518271 - RNA, 19 nt, Homo sapiens
gcagagaauucuuuauuug

SEQ ID NO: 1518272 - RNA, 19 nt, Homo sapiens
caaaugacaugcucaaaug

SEQ ID NO: 1518273 - RNA, 19 nt, Homo sapiens
gcucaaauguauugcauaa

SEQ ID NO: 1518274 - RNA, 19 nt, Homo sapiens
gagauuaaaugcauacaga

SEQ ID NO: 1518275 - RNA, 19 nt, Homo sapiens
uaagaccucugaucauuaa

SEQ ID NO: 1518276 - RNA, 19 nt, Homo sapiens
gauccugucuugcagauaa

SEQ ID NO: 1518277 - RNA, 19 nt, Homo sapiens
gaagaaaggaagccaguaa

SEQ ID NO: 1518278 - RNA, 19 nt, Homo sapiens
gcaaguguguuucagcaaa

SEQ ID NO: 1518279 - RNA, 19 nt, Homo sapiens
cagaagccaucucauuuaa

SEQ ID NO: 1518280 - RNA, 19 nt, Homo sapiens
ggaguagcuuugacauuaa

SEQ ID NO: 1518281 - RNA, 19 nt, Homo sapiens
gaucauuguuguuucauug

SEQ ID NO: 1518282 - RNA, 19 nt, Homo sapiens
caacagaagccaucucauu

SEQ ID NO: 1518283 - RNA, 19 nt, Homo sapiens
gaacauagggugcuuugug

SEQ ID NO: 1518284 - RNA, 19 nt, Homo sapiens
ggaaguggccucgucaaua

SEQ ID NO: 1518285 - RNA, 19 nt, Homo sapiens
gcacugggauuccuuucuu

SEQ ID NO: 1518286 - RNA, 19 nt, Homo sapiens
aggaguagcuuugacauua

SEQ ID NO: 1518287 - RNA, 19 nt, Homo sapiens
ggaggaauauuucaaagca

SEQ ID NO: 1518288 - RNA, 19 nt, Homo sapiens
gagaugauguuucuugcuu

SEQ ID NO: 1518289 - RNA, 19 nt, Homo sapiens
uauaauagcugguggucaa

SEQ ID NO: 1518290 - RNA, 19 nt, Homo sapiens
ucacguagauagucuuuau

SEQ ID NO: 1518291 - RNA, 19 nt, Homo sapiens
ggaggcgcauccaguauuu

SEQ ID NO: 1518292 - RNA, 19 nt, Homo sapiens
gagaguaucuuuguugcuu

SEQ ID NO: 1518293 - RNA, 19 nt, Homo sapiens
ucaaagcaguucccagaaa

SEQ ID NO: 1518294 - RNA, 19 nt, Homo sapiens
gaagaaaguccuugguguu

SEQ ID NO: 1518295 - RNA, 19 nt, Homo sapiens
gggugaagcugggaaagua

SEQ ID NO: 1518296 - RNA, 19 nt, Homo sapiens
guuagaggcuguucuggaa

SEQ ID NO: 1518297 - RNA, 19 nt, Homo sapiens
gaacaaaugacaugcucaa

SEQ ID NO: 1518298 - RNA, 19 nt, Homo sapiens
ggaccuauguauauauauc

SEQ ID NO: 1518299 - RNA, 19 nt, Homo sapiens
uggcugaucugaugaagaa

SEQ ID NO: 1518300 - RNA, 19 nt, Homo sapiens
ucuaagaccucugaucauu

SEQ ID NO: 1518301 - RNA, 19 nt, Homo sapiens
gaagccaucucauuuaagc

SEQ ID NO: 1518302 - RNA, 19 nt, Homo sapiens
gauagucuuuauuccauug

SEQ ID NO: 1518303 - RNA, 19 nt, Homo sapiens
agacacagguggagugguu

SEQ ID NO: 1518304 - RNA, 19 nt, Homo sapiens
ugaaaugcauggguagaaa

SEQ ID NO: 1518305 - RNA, 19 nt, Homo sapiens
guugagcugucccaaguuu

SEQ ID NO: 1518306 - RNA, 19 nt, Homo sapiens
acagaagccaucucauuua

SEQ ID NO: 1518307 - RNA, 19 nt, Homo sapiens
gguguuugcacuuaaauaa

SEQ ID NO: 1518308 - RNA, 19 nt, Homo sapiens
caaagcaguucccagaaag

SEQ ID NO: 1518309 - RNA, 19 nt, Homo sapiens
uuagggagguuguauaaca

SEQ ID NO: 1518310 - RNA, 19 nt, Homo sapiens
gaaaguccuugguguuugc

SEQ ID NO: 1518311 - RNA, 19 nt, Homo sapiens
caagaaaacuagacucaga

SEQ ID NO: 1518312 - RNA, 19 nt, Homo sapiens
gcaucacgcagucacaaua

SEQ ID NO: 1518313 - RNA, 19 nt, Homo sapiens
gagauuaaaguggucauuu

SEQ ID NO: 1518314 - RNA, 19 nt, Homo sapiens
gggagguuguauaacauaa

SEQ ID NO: 1518315 - RNA, 19 nt, Homo sapiens
agauuaaaguggucauuug

SEQ ID NO: 1518316 - RNA, 19 nt, Homo sapiens
ggguugagcugucccaagu

SEQ ID NO: 1518317 - RNA, 19 nt, Homo sapiens
uacaagacauccaguuuua

SEQ ID NO: 1518318 - RNA, 19 nt, Homo sapiens
ggcagcaucuggcagcaaa

SEQ ID NO: 1518319 - RNA, 19 nt, Homo sapiens
ccacgaagcagcugacugu

SEQ ID NO: 1518320 - RNA, 19 nt, Homo sapiens
agaugaauguuaucagcua

SEQ ID NO: 1518321 - RNA, 19 nt, Homo sapiens
caaaagaguuccuaacagu

SEQ ID NO: 1518322 - RNA, 19 nt, Homo sapiens
auaguaagaugcagagaau

SEQ ID NO: 1518323 - RNA, 19 nt, Homo sapiens
gguuagggagguuguauaa

SEQ ID NO: 1518324 - RNA, 19 nt, Homo sapiens
ccauggcagucauuaaaga

SEQ ID NO: 1518325 - RNA, 19 nt, Homo sapiens
caaaugcagucuugguucu

SEQ ID NO: 1518326 - RNA, 19 nt, Homo sapiens
aagucaaccucacaccuua

SEQ ID NO: 1518327 - RNA, 19 nt, Homo sapiens
cuaagaccucugaucauua

SEQ ID NO: 1518328 - RNA, 19 nt, Homo sapiens
ugagaucauuguuguuuca

SEQ ID NO: 1518329 - RNA, 19 nt, Homo sapiens
caaguguguuucagcaaau

SEQ ID NO: 1518330 - RNA, 19 nt, Homo sapiens
ggucacugcugcuucaaag

SEQ ID NO: 1518331 - RNA, 19 nt, Homo sapiens
aaaggucacugcugcuuca

SEQ ID NO: 1518332 - RNA, 19 nt, Homo sapiens
uaacauacaacgagagcuu

SEQ ID NO: 1518333 - RNA, 19 nt, Homo sapiens
acagauacuucacguagau

SEQ ID NO: 1518334 - RNA, 19 nt, Homo sapiens
gaugaauguuaucagcuau

SEQ ID NO: 1518335 - RNA, 19 nt, Homo sapiens
aaccacagaugaauguuau

SEQ ID NO: 1518336 - RNA, 19 nt, Homo sapiens
caaauguauugcauaaguc

SEQ ID NO: 1518337 - RNA, 19 nt, Homo sapiens
gaaaugcauggguagaaau

SEQ ID NO: 1518338 - RNA, 19 nt, Homo sapiens
ccaaauuacaggaaaugaa

SEQ ID NO: 1518339 - RNA, 19 nt, Homo sapiens
uauagucagguuccauuua

SEQ ID NO: 1518340 - RNA, 19 nt, Homo sapiens
cgugguggcugaucugaug

SEQ ID NO: 1518341 - RNA, 19 nt, Homo sapiens
uaucuaagaccucugauca

SEQ ID NO: 1518342 - RNA, 19 nt, Homo sapiens
cuucuaaggucuacaugga

SEQ ID NO: 1518343 - RNA, 19 nt, Homo sapiens
aacagaagccaucucauuu

SEQ ID NO: 1518344 - RNA, 19 nt, Homo sapiens
gcacguuacagaaggaaga

SEQ ID NO: 1518345 - RNA, 19 nt, Homo sapiens
gaugcauuauuaggucaua

SEQ ID NO: 1518346 - RNA, 19 nt, Homo sapiens
guugagaucauuguuguuu

SEQ ID NO: 1518347 - RNA, 19 nt, Homo sapiens
cagaagaaguagaauuugc

SEQ ID NO: 1518348 - RNA, 19 nt, Homo sapiens
cgcagugucuccagaagaa

SEQ ID NO: 1518349 - RNA, 19 nt, Homo sapiens
guaagaacauagggugcuu

SEQ ID NO: 1518350 - RNA, 19 nt, Homo sapiens
gaacagggaacucuaugcu

SEQ ID NO: 1518351 - RNA, 19 nt, Homo sapiens
gauccaaggacugccauuu

SEQ ID NO: 1518352 - RNA, 19 nt, Homo sapiens
ggaagaaaggaagccagua

SEQ ID NO: 1518353 - RNA, 19 nt, Homo sapiens
gcagcacguuacagaagga

SEQ ID NO: 1518354 - RNA, 19 nt, Homo sapiens
gauggccccuucaacaaua

SEQ ID NO: 1518355 - RNA, 19 nt, Homo sapiens
ugaccacugucucuuuguu

SEQ ID NO: 1518356 - RNA, 19 nt, Homo sapiens
uccagaagaaguagaauuu

SEQ ID NO: 1518357 - RNA, 19 nt, Homo sapiens
ggguaagaauaguguugaa

SEQ ID NO: 1518358 - RNA, 19 nt, Homo sapiens
guuaucagcuauuuaucca

SEQ ID NO: 1518359 - RNA, 19 nt, Homo sapiens
acaaaugacaugcucaaau

SEQ ID NO: 1518360 - RNA, 19 nt, Homo sapiens
aacgagagcuugaguuguc

SEQ ID NO: 1518361 - RNA, 19 nt, Homo sapiens
uagcuugccuggagaugau

SEQ ID NO: 1518362 - RNA, 19 nt, Homo sapiens
gaacaggggcauccaaaau

SEQ ID NO: 1518363 - RNA, 19 nt, Homo sapiens
ugauugcuuuguauuguga

SEQ ID NO: 1518364 - RNA, 19 nt, Homo sapiens
agaaaguccuugguguuug

SEQ ID NO: 1518365 - RNA, 19 nt, Homo sapiens
ggagguuguauaacauaaa

SEQ ID NO: 1518366 - RNA, 19 nt, Homo sapiens
aauaagaagcucuccauuc

SEQ ID NO: 1518367 - RNA, 19 nt, Homo sapiens
cauuaaagagaaaggagua

SEQ ID NO: 1518368 - RNA, 19 nt, Homo sapiens
gauaaagcgucugaaguua

SEQ ID NO: 1518369 - RNA, 19 nt, Homo sapiens
ggacuuaguucuccuugaa

SEQ ID NO: 1518370 - RNA, 19 nt, Homo sapiens
ccacugaacuguacacguu

SEQ ID NO: 1518371 - RNA, 19 nt, Homo sapiens
gcagguaacuuggagauug

SEQ ID NO: 1518372 - RNA, 19 nt, Homo sapiens
ggauaaagcgucugaaguu

SEQ ID NO: 1518373 - RNA, 19 nt, Homo sapiens
ucacagaccugacuucauc

SEQ ID NO: 1518374 - RNA, 19 nt, Homo sapiens
gcaggaaucgcuucaguuu

SEQ ID NO: 1518375 - RNA, 19 nt, Homo sapiens
gaagaaugcccaugaagga

SEQ ID NO: 1518376 - RNA, 19 nt, Homo sapiens
gagcaacccugcaggaauc

SEQ ID NO: 1518377 - RNA, 19 nt, Homo sapiens
caagaagaaugcccaugaa

SEQ ID NO: 1518378 - RNA, 19 nt, Homo sapiens
gaaacccacugaagcuguu

SEQ ID NO: 1518379 - RNA, 19 nt, Homo sapiens
uaaagcgucugaaguuaau

SEQ ID NO: 1518380 - RNA, 19 nt, Homo sapiens
ggaguuuccugguuuguuc

SEQ ID NO: 1518381 - RNA, 19 nt, Homo sapiens
guacgcacaucuucacaug

SEQ ID NO: 1518382 - RNA, 19 nt, Homo sapiens
gacuucaucucccacauuu

SEQ ID NO: 1518383 - RNA, 19 nt, Homo sapiens
gacaucacauccggaauaa

SEQ ID NO: 1518384 - RNA, 19 nt, Homo sapiens
cagcgaggcuaaauuggaa

SEQ ID NO: 1518385 - RNA, 19 nt, Homo sapiens
gcaagaaggaaaugauuca

SEQ ID NO: 1518386 - RNA, 19 nt, Homo sapiens
agagaaagcugcagagcau

SEQ ID NO: 1518387 - RNA, 19 nt, Homo sapiens
gaagaggacagugauguga

SEQ ID NO: 1518388 - RNA, 19 nt, Homo sapiens
gcacacauguaaaacaaaa

SEQ ID NO: 1518389 - RNA, 19 nt, Homo sapiens
ccacugaagcuguuuguga

SEQ ID NO: 1518390 - RNA, 19 nt, Homo sapiens
acagugaugugacuucuug

SEQ ID NO: 1518391 - RNA, 19 nt, Homo sapiens
gaaauagauuguggugaca

SEQ ID NO: 1518392 - RNA, 19 nt, Homo sapiens
agacaucacauccggaaua

SEQ ID NO: 1518393 - RNA, 19 nt, Homo sapiens
aggaaucgcuucaguuuca

SEQ ID NO: 1518394 - RNA, 19 nt, Homo sapiens
gccgaaggcuuguuaugug

SEQ ID NO: 1518395 - RNA, 19 nt, Homo sapiens
gaaggcaccagaugucaga

SEQ ID NO: 1518396 - RNA, 19 nt, Homo sapiens
agacacaguaggacaaaua

SEQ ID NO: 1518397 - RNA, 19 nt, Homo sapiens
gcagagaggauggcagaaa

SEQ ID NO: 1518398 - RNA, 19 nt, Homo sapiens
gaaugcccaugaaggaguu

SEQ ID NO: 1518399 - RNA, 19 nt, Homo sapiens
gcaacaagcagaauguaca

SEQ ID NO: 1518400 - RNA, 19 nt, Homo sapiens
ccuaguggguacagaguuu

SEQ ID NO: 1518401 - RNA, 19 nt, Homo sapiens
gcaaguucguagagacaga

SEQ ID NO: 1518402 - RNA, 19 nt, Homo sapiens
gaauguagaacagggcuuu

SEQ ID NO: 1518403 - RNA, 19 nt, Homo sapiens
cugcagagcauguuaaaga

SEQ ID NO: 1518404 - RNA, 19 nt, Homo sapiens
guagagacagaauguagaa

SEQ ID NO: 1518405 - RNA, 19 nt, Homo sapiens
cacaguaggacaaauauug

SEQ ID NO: 1518406 - RNA, 19 nt, Homo sapiens
cagaagaacaagccuauca

SEQ ID NO: 1518407 - RNA, 19 nt, Homo sapiens
acaagaagaaugcccauga

SEQ ID NO: 1518408 - RNA, 19 nt, Homo sapiens
cagaauaggcaaguucgua

SEQ ID NO: 1518409 - RNA, 19 nt, Homo sapiens
gaggagaagacaaggaguu

SEQ ID NO: 1518410 - RNA, 19 nt, Homo sapiens
gggaugcgcuauucgacau

SEQ ID NO: 1518411 - RNA, 19 nt, Homo sapiens
ggacagugaugugacuucu

SEQ ID NO: 1518412 - RNA, 19 nt, Homo sapiens
uagauuguggugacaguua

SEQ ID NO: 1518413 - RNA, 19 nt, Homo sapiens
gaggaacaguagcacaaag

SEQ ID NO: 1518414 - RNA, 19 nt, Homo sapiens
agaacaagccuaucagcaa

SEQ ID NO: 1518415 - RNA, 19 nt, Homo sapiens
gcagaaacccacugaagcu

SEQ ID NO: 1518416 - RNA, 19 nt, Homo sapiens
aaaaugcucuuuaccaguu

SEQ ID NO: 1518417 - RNA, 19 nt, Homo sapiens
ggaagaggacagugaugug

SEQ ID NO: 1518418 - RNA, 19 nt, Homo sapiens
gcagcacccagaccaugua

SEQ ID NO: 1518419 - RNA, 19 nt, Homo sapiens
aauguggagucuagauaaa

SEQ ID NO: 1518420 - RNA, 19 nt, Homo sapiens
ucacauccggaauaacuuu

SEQ ID NO: 1518421 - RNA, 19 nt, Homo sapiens
ggaggaacaguagcacaaa

SEQ ID NO: 1518422 - RNA, 19 nt, Homo sapiens
cagcaagaaggaaaugauu

SEQ ID NO: 1518423 - RNA, 19 nt, Homo sapiens
gaauaggcaaguucguaga

SEQ ID NO: 1518424 - RNA, 19 nt, Homo sapiens
gagcggauaaagcgucuga

SEQ ID NO: 1518425 - RNA, 19 nt, Homo sapiens
aaauguggagucuagauaa

SEQ ID NO: 1518426 - RNA, 19 nt, Homo sapiens
cagguaacuuggagauugu

SEQ ID NO: 1518427 - RNA, 19 nt, Homo sapiens
gagacagaauguagaacag

SEQ ID NO: 1518428 - RNA, 19 nt, Homo sapiens
auaaagcgucugaaguuaa

SEQ ID NO: 1518429 - RNA, 19 nt, Homo sapiens
uuccugagcucgaacucua

SEQ ID NO: 1518430 - RNA, 19 nt, Homo sapiens
gcaugaaggcaccagaugu

SEQ ID NO: 1518431 - RNA, 19 nt, Homo sapiens
gaugcgcuauucgacauug

SEQ ID NO: 1518432 - RNA, 19 nt, Homo sapiens
caucacauccggaauaacu

SEQ ID NO: 1518433 - RNA, 19 nt, Homo sapiens
cauaauuaguaccacugaa

SEQ ID NO: 1518434 - RNA, 19 nt, Homo sapiens
gcacccagaccauguaagg

SEQ ID NO: 1518435 - RNA, 19 nt, Homo sapiens
cagagaggauggcagaaac

SEQ ID NO: 1518436 - RNA, 19 nt, Homo sapiens
aaaugcucuuuaccaguua

SEQ ID NO: 1518437 - RNA, 19 nt, Homo sapiens
gcacacaagcagguaacuu

SEQ ID NO: 1518438 - RNA, 19 nt, Homo sapiens
uuucuaaucugugccuuga

SEQ ID NO: 1518439 - RNA, 19 nt, Homo sapiens
gaaagcugcagagcauguu

SEQ ID NO: 1518440 - RNA, 19 nt, Homo sapiens
gagagcaacccugcaggaa

SEQ ID NO: 1518441 - RNA, 19 nt, Homo sapiens
caaguuccagcgaggcuaa

SEQ ID NO: 1518442 - RNA, 19 nt, Homo sapiens
aaggaguucuugccuagug

SEQ ID NO: 1518443 - RNA, 19 nt, Homo sapiens
ucuaaucugugccuugagu

SEQ ID NO: 1518444 - RNA, 19 nt, Homo sapiens
acacgcaggaggaacagua

SEQ ID NO: 1518445 - RNA, 19 nt, Homo sapiens
gaacuguacacguuaaaau

SEQ ID NO: 1518446 - RNA, 19 nt, Homo sapiens
uaauaguccaggagagaaa

SEQ ID NO: 1518447 - RNA, 19 nt, Homo sapiens
guuaauaguccaggagaga

SEQ ID NO: 1518448 - RNA, 19 nt, Homo sapiens
aaacaagggcacacaagca

SEQ ID NO: 1518449 - RNA, 19 nt, Homo sapiens
cauccggaauaacuuuguu

SEQ ID NO: 1518450 - RNA, 19 nt, Homo sapiens
ccugaggacagaaaguuaa

SEQ ID NO: 1518451 - RNA, 19 nt, Homo sapiens
ugacaguuaggacuuaguu

SEQ ID NO: 1518452 - RNA, 19 nt, Homo sapiens
guucguagagacagaaugu

SEQ ID NO: 1518453 - RNA, 19 nt, Homo sapiens
ggaaggugaacuugacagu

SEQ ID NO: 1518454 - RNA, 19 nt, Homo sapiens
ugacuucaucucccacauu

SEQ ID NO: 1518455 - RNA, 19 nt, Homo sapiens
guuaggaaggugaacuuga

SEQ ID NO: 1518456 - RNA, 19 nt, Homo sapiens
gacacaguaggacaaauau

SEQ ID NO: 1518457 - RNA, 19 nt, Homo sapiens
acaagccuaucagcaagaa

SEQ ID NO: 1518458 - RNA, 19 nt, Homo sapiens
ggccgaaggcuuguuaugu

SEQ ID NO: 1518459 - RNA, 19 nt, Homo sapiens
gauggcagaaacccacuga

SEQ ID NO: 1518460 - RNA, 19 nt, Homo sapiens
ccagcgaggcuaaauugga

SEQ ID NO: 1518461 - RNA, 19 nt, Homo sapiens
acugaacuguacacguuaa

SEQ ID NO: 1518462 - RNA, 19 nt, Homo sapiens
uuaggaaggugaacuugac

SEQ ID NO: 1518463 - RNA, 19 nt, Homo sapiens
ugagcucgaacucuacuuu

SEQ ID NO: 1518464 - RNA, 19 nt, Homo sapiens
gugcacacauguaaaacaa

SEQ ID NO: 1518465 - RNA, 19 nt, Homo sapiens
ugacaguuacacaccauug

SEQ ID NO: 1518466 - RNA, 19 nt, Homo sapiens
gaaaggaaaaccagacaca

SEQ ID NO: 1518467 - RNA, 19 nt, Homo sapiens
acaccauugugaacauaau

SEQ ID NO: 1518468 - RNA, 19 nt, Homo sapiens
caacaggacucuccaugug

SEQ ID NO: 1518469 - RNA, 19 nt, Homo sapiens
gcagagaggagaacugaaa

SEQ ID NO: 1518470 - RNA, 19 nt, Homo sapiens
gaggagaacugaaaauaaa

SEQ ID NO: 1518471 - RNA, 19 nt, Homo sapiens
gagaagcugucugucguuu

SEQ ID NO: 1518472 - RNA, 19 nt, Homo sapiens
gcaccugccauuucacaua

SEQ ID NO: 1518473 - RNA, 19 nt, Homo sapiens
ggaacaauccuaugaccuu

SEQ ID NO: 1518474 - RNA, 19 nt, Homo sapiens
ccacaugacugccaaagac

SEQ ID NO: 1518475 - RNA, 19 nt, Homo sapiens
gaagcugucugucguuugc

SEQ ID NO: 1518476 - RNA, 19 nt, Homo sapiens
gggugucccugucuucauu

SEQ ID NO: 1518477 - RNA, 19 nt, Homo sapiens
ggccaaaggcuaccugcua

SEQ ID NO: 1518478 - RNA, 19 nt, Homo sapiens
ggauuuagacauauaccaa

SEQ ID NO: 1518479 - RNA, 19 nt, Homo sapiens
caccugccauuucacauau

SEQ ID NO: 1518480 - RNA, 19 nt, Homo sapiens
uggguacccugcuuucaaa

SEQ ID NO: 1518481 - RNA, 19 nt, Homo sapiens
gcucccacauggucgacua

SEQ ID NO: 1518482 - RNA, 19 nt, Homo sapiens
ccaagggcauguggaacaa

SEQ ID NO: 1518483 - RNA, 19 nt, Homo sapiens
cccuguggauuuagacaua

SEQ ID NO: 1518484 - RNA, 19 nt, Homo sapiens
cugcagagauggccaaagg

SEQ ID NO: 1518485 - RNA, 19 nt, Homo sapiens
ccuccagagugcugacuuu

SEQ ID NO: 1518486 - RNA, 19 nt, Homo sapiens
gagaggagaacugaaaaua

SEQ ID NO: 1518487 - RNA, 19 nt, Homo sapiens
ggaggacgagcgcaaguuc

SEQ ID NO: 1518488 - RNA, 19 nt, Homo sapiens
ccuacaggaagcacaaaua

SEQ ID NO: 1518489 - RNA, 19 nt, Homo sapiens
gcauguggaacaauccuau

SEQ ID NO: 1518490 - RNA, 19 nt, Homo sapiens
gacccuugaugccauuuua

SEQ ID NO: 1518491 - RNA, 19 nt, Homo sapiens
ccauggcaggugugaaaua

SEQ ID NO: 1518492 - RNA, 19 nt, Homo sapiens
gugcagagaggagaacuga

SEQ ID NO: 1518493 - RNA, 19 nt, Homo sapiens
acagauggguacccugcuu

SEQ ID NO: 1518494 - RNA, 19 nt, Homo sapiens
ugucuucauugccauauag

SEQ ID NO: 1518495 - RNA, 19 nt, Homo sapiens
acaauccuaugaccuugga

SEQ ID NO: 1518496 - RNA, 19 nt, Homo sapiens
cauggcaggugugaaauac

SEQ ID NO: 1518497 - RNA, 19 nt, Homo sapiens
caccagcaccugccauuuc

SEQ ID NO: 1518498 - RNA, 19 nt, Homo sapiens
aaagcucgaugcucaacuc

SEQ ID NO: 1518499 - RNA, 19 nt, Homo sapiens
uaggagagaagcugucugu

SEQ ID NO: 1518500 - RNA, 19 nt, Homo sapiens
acuaucagcccuacaggaa

SEQ ID NO: 1518501 - RNA, 19 nt, Homo sapiens
acaggaagcacaaauacuc

SEQ ID NO: 1518502 - RNA, 19 nt, Homo sapiens
cuguggauuuagacauaua

SEQ ID NO: 1518503 - RNA, 19 nt, Homo sapiens
caaaagaccccacaugacu

SEQ ID NO: 1518504 - RNA, 19 nt, Homo sapiens
cuacaggaagcacaaauac

SEQ ID NO: 1518505 - RNA, 19 nt, Homo sapiens
ggaugaaaauaccuuccaa

SEQ ID NO: 1518506 - RNA, 19 nt, Homo sapiens
gcucaacuccgggacaaag

SEQ ID NO: 1518507 - RNA, 19 nt, Homo sapiens
cagauggguacccugcuuu

SEQ ID NO: 1518508 - RNA, 19 nt, Homo sapiens
caaaggcuaccugcuacug

SEQ ID NO: 1518509 - RNA, 19 nt, Homo sapiens
accagcaccugccauuuca

SEQ ID NO: 1518510 - RNA, 19 nt, Homo sapiens
aagaagcgguaggcucugu

SEQ ID NO: 1518511 - RNA, 19 nt, Homo sapiens
ucccaucacaggaacauga

SEQ ID NO: 1518512 - RNA, 19 nt, Homo sapiens
gaagacaacuccucaucua

SEQ ID NO: 1518513 - RNA, 19 nt, Homo sapiens
gggagaagcugaaauugga

SEQ ID NO: 1518514 - RNA, 19 nt, Homo sapiens
uaaccuggcugacuuggaa

SEQ ID NO: 1518515 - RNA, 19 nt, Homo sapiens
agaaagaguugaagggaaa

SEQ ID NO: 1518516 - RNA, 19 nt, Homo sapiens
gaagaagaaacuugaaaga

SEQ ID NO: 1518517 - RNA, 19 nt, Homo sapiens
cuagacaacuuuggucaua

SEQ ID NO: 1518518 - RNA, 19 nt, Homo sapiens
ucaaacagcugcuuaacca

SEQ ID NO: 1518519 - RNA, 19 nt, Homo sapiens
gacaacuccucaucuagaa

SEQ ID NO: 1518520 - RNA, 19 nt, Homo sapiens
gaaauuggaagaagagaag

SEQ ID NO: 1518521 - RNA, 19 nt, Homo sapiens
ccacuagguugccucagaa

SEQ ID NO: 1518522 - RNA, 19 nt, Homo sapiens
gagaagaagaagaaacuug

SEQ ID NO: 1518523 - RNA, 19 nt, Homo sapiens
guugguaaguggagaaaga

SEQ ID NO: 1518524 - RNA, 19 nt, Homo sapiens
gaacgcacaggauaaggaa

SEQ ID NO: 1518525 - RNA, 19 nt, Homo sapiens
gcacugggccugucugaag

SEQ ID NO: 1518526 - RNA, 19 nt, Homo sapiens
gggaaaguguugggauuug

SEQ ID NO: 1518527 - RNA, 19 nt, Homo sapiens
gaagaagaagaaacuugaa

SEQ ID NO: 1518528 - RNA, 19 nt, Homo sapiens
aguauccucuguucauuaa

SEQ ID NO: 1518529 - RNA, 19 nt, Homo sapiens
aagaagagaagaagaagaa

SEQ ID NO: 1518530 - RNA, 19 nt, Homo sapiens
gaagaagagaagaagaaga

SEQ ID NO: 1518531 - RNA, 19 nt, Homo sapiens
cuacaaagccaugaagcua

SEQ ID NO: 1518532 - RNA, 19 nt, Homo sapiens
gggccaagaacgagccuua

SEQ ID NO: 1518533 - RNA, 19 nt, Homo sapiens
uggauaaccuggcugacuu

SEQ ID NO: 1518534 - RNA, 19 nt, Homo sapiens
gagaagacaacuccucauc

SEQ ID NO: 1518535 - RNA, 19 nt, Homo sapiens
agaagaagaagaaacuuga

SEQ ID NO: 1518536 - RNA, 19 nt, Homo sapiens
aaaacuggcuauccauuaa

SEQ ID NO: 1518537 - RNA, 19 nt, Homo sapiens
aggaguaccugauugacaa

SEQ ID NO: 1518538 - RNA, 19 nt, Homo sapiens
ggaaaguguugggauuugg

SEQ ID NO: 1518539 - RNA, 19 nt, Homo sapiens
ggagguggguucuggucau

SEQ ID NO: 1518540 - RNA, 19 nt, Homo sapiens
ggagagugagggccaagaa

SEQ ID NO: 1518541 - RNA, 19 nt, Homo sapiens
guaaguggagaaagaguug

SEQ ID NO: 1518542 - RNA, 19 nt, Homo sapiens
gauuuaacaguaccagauu

SEQ ID NO: 1518543 - RNA, 19 nt, Homo sapiens
agacaacuccucaucuaga

SEQ ID NO: 1518544 - RNA, 19 nt, Homo sapiens
ccacagggaagcagaggaa

SEQ ID NO: 1518545 - RNA, 19 nt, Homo sapiens
ggagcgcgcauuugagaga

SEQ ID NO: 1518546 - RNA, 19 nt, Homo sapiens
gaagagaagaagaagaaac

SEQ ID NO: 1518547 - RNA, 19 nt, Homo sapiens
gaaaguguugggauuugga

SEQ ID NO: 1518548 - RNA, 19 nt, Homo sapiens
caaucaguauccucuguuc

SEQ ID NO: 1518549 - RNA, 19 nt, Homo sapiens
caguauccucuguucauua

SEQ ID NO: 1518550 - RNA, 19 nt, Homo sapiens
ucaguauccucuguucauu

SEQ ID NO: 1518551 - RNA, 19 nt, Homo sapiens
caucagcauucagcaguug

SEQ ID NO: 1518552 - RNA, 19 nt, Homo sapiens
aagggaaaguguugggauu

SEQ ID NO: 1518553 - RNA, 19 nt, Homo sapiens
gcacccacccugcuugauc

SEQ ID NO: 1518554 - RNA, 19 nt, Homo sapiens
cagcagcccuggcagaacu

SEQ ID NO: 1518555 - RNA, 19 nt, Homo sapiens
uaaaacuggcuauccauua

SEQ ID NO: 1518556 - RNA, 19 nt, Homo sapiens
cuugagcucuugccuggaa

SEQ ID NO: 1518557 - RNA, 19 nt, Homo sapiens
gagcgcgcauuugagagaa

SEQ ID NO: 1518558 - RNA, 19 nt, Homo sapiens
ugaagcuacugcugcucua

SEQ ID NO: 1518559 - RNA, 19 nt, Homo sapiens
gccuggagauguuccugaa

SEQ ID NO: 1518560 - RNA, 19 nt, Homo sapiens
uggaagaagagaagaagaa

SEQ ID NO: 1518561 - RNA, 19 nt, Homo sapiens
gguaaguggagaaagaguu

SEQ ID NO: 1518562 - RNA, 19 nt, Homo sapiens
guccacuugucccagguua

SEQ ID NO: 1518563 - RNA, 19 nt, Homo sapiens
ccacaaggcagcagaaagc

SEQ ID NO: 1518564 - RNA, 19 nt, Homo sapiens
ucaagaccauggagaagac

SEQ ID NO: 1518565 - RNA, 19 nt, Homo sapiens
cccacuagguugccucaga

SEQ ID NO: 1518566 - RNA, 19 nt, Homo sapiens
gaagcugaaauuggaagaa

SEQ ID NO: 1518567 - RNA, 19 nt, Homo sapiens
ggaagaagagaagaagaag

SEQ ID NO: 1518568 - RNA, 19 nt, Homo sapiens
gaagcccuaagacugauga

SEQ ID NO: 1518569 - RNA, 19 nt, Homo sapiens
gguggcuacucaacagguu

SEQ ID NO: 1518570 - RNA, 19 nt, Homo sapiens
aaacuggcuauccauuaaa

SEQ ID NO: 1518571 - RNA, 19 nt, Homo sapiens
gcgaagcaggcguucaaga

SEQ ID NO: 1518572 - RNA, 19 nt, Homo sapiens
guugggauuuggacaugga

SEQ ID NO: 1518573 - RNA, 19 nt, Homo sapiens
ggagaagcugaaauuggaa

SEQ ID NO: 1518574 - RNA, 19 nt, Homo sapiens
ggaccacaaggcagcagaa

SEQ ID NO: 1518575 - RNA, 19 nt, Homo sapiens
ggauaaccuggcugacuug

SEQ ID NO: 1518576 - RNA, 19 nt, Homo sapiens
agacaacuuuggucauagg

SEQ ID NO: 1518577 - RNA, 19 nt, Homo sapiens
acaaagccaugaagcuacu

SEQ ID NO: 1518578 - RNA, 19 nt, Homo sapiens
gcauucagcaguugguaag

SEQ ID NO: 1518579 - RNA, 19 nt, Homo sapiens
ggacacugaggagcucuga

SEQ ID NO: 1518580 - RNA, 19 nt, Homo sapiens
ugaaauuggaagaagagaa

SEQ ID NO: 1518581 - RNA, 19 nt, Homo sapiens
gcaguugguaaguggagaa

SEQ ID NO: 1518582 - RNA, 19 nt, Homo sapiens
gagguggguucuggucauc

SEQ ID NO: 1518583 - RNA, 19 nt, Homo sapiens
cugcugagaaccaggagua

SEQ ID NO: 1518584 - RNA, 19 nt, Homo sapiens
ggaaaacuugguucaaaga

SEQ ID NO: 1518585 - RNA, 19 nt, Homo sapiens
gagcuggagcgcgcauuug

SEQ ID NO: 1518586 - RNA, 19 nt, Homo sapiens
aagcugaaauuggaagaag

SEQ ID NO: 1518587 - RNA, 19 nt, Homo sapiens
ccaagaacgagccuuaagg

SEQ ID NO: 1518588 - RNA, 19 nt, Homo sapiens
gcagcuacaaagccaugaa

SEQ ID NO: 1518589 - RNA, 19 nt, Homo sapiens
gacaucuggucauccucaa

SEQ ID NO: 1518590 - RNA, 19 nt, Homo sapiens
aguaccugauugacaagua

SEQ ID NO: 1518591 - RNA, 19 nt, Homo sapiens
ccaaucaguauccucuguu

SEQ ID NO: 1518592 - RNA, 19 nt, Homo sapiens
ucaucagcauucagcaguu

SEQ ID NO: 1518593 - RNA, 19 nt, Homo sapiens
cagaagcccuaagacugau

SEQ ID NO: 1518594 - RNA, 19 nt, Homo sapiens
gguggguucuggucaucug

SEQ ID NO: 1518595 - RNA, 19 nt, Homo sapiens
cgucugcaccucugugguu

SEQ ID NO: 1518596 - RNA, 19 nt, Homo sapiens
gaagcuacugcugcucuau

SEQ ID NO: 1518597 - RNA, 19 nt, Homo sapiens
cgaagcaggcguucaagac

SEQ ID NO: 1518598 - RNA, 19 nt, Homo sapiens
agaagaagaaacuugaaag

SEQ ID NO: 1518599 - RNA, 19 nt, Homo sapiens
ugaacgcacaggauaagga

SEQ ID NO: 1518600 - RNA, 19 nt, Homo sapiens
gaguugaagggaaaguguu

SEQ ID NO: 1518601 - RNA, 19 nt, Homo sapiens
gcccguaacccuaguuugc

SEQ ID NO: 1518602 - RNA, 19 nt, Homo sapiens
ccauggacuucaucagcau

SEQ ID NO: 1518603 - RNA, 19 nt, Homo sapiens
ggccaagaacgagccuuaa

SEQ ID NO: 1518604 - RNA, 19 nt, Homo sapiens
gaccacaaggcagcagaaa

SEQ ID NO: 1518605 - RNA, 19 nt, Homo sapiens
gggauuuggacauggaguu

SEQ ID NO: 1518606 - RNA, 19 nt, Homo sapiens
guagcaacccuggcagugu

SEQ ID NO: 1518607 - RNA, 19 nt, Homo sapiens
gccaagaacgagccuuaag

SEQ ID NO: 1518608 - RNA, 19 nt, Homo sapiens
gagugagggccaagaacga

SEQ ID NO: 1518609 - RNA, 19 nt, Homo sapiens
cggaggacaucuggucauc

SEQ ID NO: 1518610 - RNA, 19 nt, Homo sapiens
caacuccucaucuagaaaa

SEQ ID NO: 1518611 - RNA, 19 nt, Homo sapiens
uggcgaagcaggcguucaa

SEQ ID NO: 1518612 - RNA, 19 nt, Homo sapiens
gcacaacucuguaaauaua

SEQ ID NO: 1518613 - RNA, 19 nt, Homo sapiens
gcaaugagcuguucugaaa

SEQ ID NO: 1518614 - RNA, 19 nt, Homo sapiens
gaaacaaacuuccaauaga

SEQ ID NO: 1518615 - RNA, 19 nt, Homo sapiens
gaaaugcaauguaccuuaa

SEQ ID NO: 1518616 - RNA, 19 nt, Homo sapiens
gaugugagcuuugcaauuu

SEQ ID NO: 1518617 - RNA, 19 nt, Homo sapiens
ggaagaauccuguucauuu

SEQ ID NO: 1518618 - RNA, 19 nt, Homo sapiens
cgacauaacuuucucaaau

SEQ ID NO: 1518619 - RNA, 19 nt, Homo sapiens
ggaagaaggcaauuaauuu

SEQ ID NO: 1518620 - RNA, 19 nt, Homo sapiens
gcacgugaacuauauauuu

SEQ ID NO: 1518621 - RNA, 19 nt, Homo sapiens
gcaauuuacuguauguuug

SEQ ID NO: 1518622 - RNA, 19 nt, Homo sapiens
caaagucuaucaacuauca

SEQ ID NO: 1518623 - RNA, 19 nt, Homo sapiens
gaagagaaauguucaccau

SEQ ID NO: 1518624 - RNA, 19 nt, Homo sapiens
gcaaucacauuaaguaaca

SEQ ID NO: 1518625 - RNA, 19 nt, Homo sapiens
aaagauaaaucccagcuaa

SEQ ID NO: 1518626 - RNA, 19 nt, Homo sapiens
ggaaggaagcacagaaaua

SEQ ID NO: 1518627 - RNA, 19 nt, Homo sapiens
gaaaguagcaaguuguuug

SEQ ID NO: 1518628 - RNA, 19 nt, Homo sapiens
gcaaauccauaaagacaga

SEQ ID NO: 1518629 - RNA, 19 nt, Homo sapiens
guacuuaagugacaguuau

SEQ ID NO: 1518630 - RNA, 19 nt, Homo sapiens
ggaaaugcaauguaccuua

SEQ ID NO: 1518631 - RNA, 19 nt, Homo sapiens
caacuaggcuguagaagag

SEQ ID NO: 1518632 - RNA, 19 nt, Homo sapiens
caauguaccuuaagaaaca

SEQ ID NO: 1518633 - RNA, 19 nt, Homo sapiens
gcuaaugaguauaggauuu

SEQ ID NO: 1518634 - RNA, 19 nt, Homo sapiens
gagaaauguucaccaugua

SEQ ID NO: 1518635 - RNA, 19 nt, Homo sapiens
ggaagagucuaccauuuca

SEQ ID NO: 1518636 - RNA, 19 nt, Homo sapiens
cuaaaguccuagcugauua

SEQ ID NO: 1518637 - RNA, 19 nt, Homo sapiens
ggaauaaaguacugauaca

SEQ ID NO: 1518638 - RNA, 19 nt, Homo sapiens
ucagugugcugucuuuaua

SEQ ID NO: 1518639 - RNA, 19 nt, Homo sapiens
gcaaacugcuauaggaaga

SEQ ID NO: 1518640 - RNA, 19 nt, Homo sapiens
gaagaauccuguucauuuu

SEQ ID NO: 1518641 - RNA, 19 nt, Homo sapiens
gaagaaggcaauuaauuuc

SEQ ID NO: 1518642 - RNA, 19 nt, Homo sapiens
ccaaaucuauggugcuauu

SEQ ID NO: 1518643 - RNA, 19 nt, Homo sapiens
gaaaggaagaugaagagaa

SEQ ID NO: 1518644 - RNA, 19 nt, Homo sapiens
uaaagaagaugaggcaaug

SEQ ID NO: 1518645 - RNA, 19 nt, Homo sapiens
gacauaacuuucucaaaug

SEQ ID NO: 1518646 - RNA, 19 nt, Homo sapiens
gaaauaggaagacagagaa

SEQ ID NO: 1518647 - RNA, 19 nt, Homo sapiens
gaacaccacauaaagaaga

SEQ ID NO: 1518648 - RNA, 19 nt, Homo sapiens
gagaaacaaacuuccaaua

SEQ ID NO: 1518649 - RNA, 19 nt, Homo sapiens
gaaggaagauguggaagag

SEQ ID NO: 1518650 - RNA, 19 nt, Homo sapiens
caaggaagaaggcaauuaa

SEQ ID NO: 1518651 - RNA, 19 nt, Homo sapiens
cauauuacgugacuuugaa

SEQ ID NO: 1518652 - RNA, 19 nt, Homo sapiens
gaaaauagagacugcaaua

SEQ ID NO: 1518653 - RNA, 19 nt, Homo sapiens
gaaggaagcacagaaauag

SEQ ID NO: 1518654 - RNA, 19 nt, Homo sapiens
ggaaauaggaagacagaga

SEQ ID NO: 1518655 - RNA, 19 nt, Homo sapiens
gcacagagaaacaaacuuc

SEQ ID NO: 1518656 - RNA, 19 nt, Homo sapiens
aaagaauccuuccaacuug

SEQ ID NO: 1518657 - RNA, 19 nt, Homo sapiens
gcaauaagcagcagccaau

SEQ ID NO: 1518658 - RNA, 19 nt, Homo sapiens
ccagaugacucccacaaau

SEQ ID NO: 1518659 - RNA, 19 nt, Homo sapiens
ucugugcaauggaauauua

SEQ ID NO: 1518660 - RNA, 19 nt, Homo sapiens
ucaacugggugaauggaua

SEQ ID NO: 1518661 - RNA, 19 nt, Homo sapiens
caggaagagucuaccauuu

SEQ ID NO: 1518662 - RNA, 19 nt, Homo sapiens
gcaaggaagaaggcaauua

SEQ ID NO: 1518663 - RNA, 19 nt, Homo sapiens
gcacagaaauagccaagac

SEQ ID NO: 1518664 - RNA, 19 nt, Homo sapiens
acacagagcaggagauauu

SEQ ID NO: 1518665 - RNA, 19 nt, Homo sapiens
gcagaacauuuaagugauc

SEQ ID NO: 1518666 - RNA, 19 nt, Homo sapiens
gagcaggagauauuuauug

SEQ ID NO: 1518667 - RNA, 19 nt, Homo sapiens
gcauaaaacuuuggucuuu

SEQ ID NO: 1518668 - RNA, 19 nt, Homo sapiens
ggagacagcuuuucuuugu

SEQ ID NO: 1518669 - RNA, 19 nt, Homo sapiens
cuuaauccuugaaguguua

SEQ ID NO: 1518670 - RNA, 19 nt, Homo sapiens
gaauagagaaacgacauaa

SEQ ID NO: 1518671 - RNA, 19 nt, Homo sapiens
gaacgacagcuuucuagau

SEQ ID NO: 1518672 - RNA, 19 nt, Homo sapiens
gcgacucacuucaggauga

SEQ ID NO: 1518673 - RNA, 19 nt, Homo sapiens
aaacaaacuuccaauagag

SEQ ID NO: 1518674 - RNA, 19 nt, Homo sapiens
ccaaggaaaugccacaauc

SEQ ID NO: 1518675 - RNA, 19 nt, Homo sapiens
ucaaaccgauacacacaaa

SEQ ID NO: 1518676 - RNA, 19 nt, Homo sapiens
gaaguggaaaugcaaugua

SEQ ID NO: 1518677 - RNA, 19 nt, Homo sapiens
caucugcaauuuacuguau

SEQ ID NO: 1518678 - RNA, 19 nt, Homo sapiens
gggaauaacagacaagaga

SEQ ID NO: 1518679 - RNA, 19 nt, Homo sapiens
aaaggaagaugaagagaag

SEQ ID NO: 1518680 - RNA, 19 nt, Homo sapiens
uugcacaacucuguaaaua

SEQ ID NO: 1518681 - RNA, 19 nt, Homo sapiens
guauaucugugcaauggaa

SEQ ID NO: 1518682 - RNA, 19 nt, Homo sapiens
gcaaguauaaccaggcaaa

SEQ ID NO: 1518683 - RNA, 19 nt, Homo sapiens
uaaagcaucuggaaauagg

SEQ ID NO: 1518684 - RNA, 19 nt, Homo sapiens
cauaucugccuuacauuua

SEQ ID NO: 1518685 - RNA, 19 nt, Homo sapiens
uagcagaacauuuaaguga

SEQ ID NO: 1518686 - RNA, 19 nt, Homo sapiens
agagaaauguucaccaugu

SEQ ID NO: 1518687 - RNA, 19 nt, Homo sapiens
agacagagaagguagagua

SEQ ID NO: 1518688 - RNA, 19 nt, Homo sapiens
cauaauacgcuuccaguga

SEQ ID NO: 1518689 - RNA, 19 nt, Homo sapiens
gacaagagaguauccagaa

SEQ ID NO: 1518690 - RNA, 19 nt, Homo sapiens
aaacaugccucuuuucauu

SEQ ID NO: 1518691 - RNA, 19 nt, Homo sapiens
guauauacccagaggaauu

SEQ ID NO: 1518692 - RNA, 19 nt, Homo sapiens
ccacuaacuuaauccuuga

SEQ ID NO: 1518693 - RNA, 19 nt, Homo sapiens
agucagcucuuaccauuga

SEQ ID NO: 1518694 - RNA, 19 nt, Homo sapiens
gaaggcaauuaauuucauc

SEQ ID NO: 1518695 - RNA, 19 nt, Homo sapiens
cagaugacucccacaaaua

SEQ ID NO: 1518696 - RNA, 19 nt, Homo sapiens
guacacagagcaggagaua

SEQ ID NO: 1518697 - RNA, 19 nt, Homo sapiens
cuuaaagcaucuggaaaua

SEQ ID NO: 1518698 - RNA, 19 nt, Homo sapiens
aagaagaaaucugcaaaga

SEQ ID NO: 1518699 - RNA, 19 nt, Homo sapiens
gauacaugcuacaagauag

SEQ ID NO: 1518700 - RNA, 19 nt, Homo sapiens
cauaaucuacuccuaggua

SEQ ID NO: 1518701 - RNA, 19 nt, Homo sapiens
gauaaacauuucucuagac

SEQ ID NO: 1518702 - RNA, 19 nt, Homo sapiens
gugauuaauuuaccucaug

SEQ ID NO: 1518703 - RNA, 19 nt, Homo sapiens
caaguuguuugccaguuga

SEQ ID NO: 1518704 - RNA, 19 nt, Homo sapiens
gcacaagauagaauauaga

SEQ ID NO: 1518705 - RNA, 19 nt, Homo sapiens
guaacacagagaugaauaa

SEQ ID NO: 1518706 - RNA, 19 nt, Homo sapiens
caagaagaaaccacuuauu

SEQ ID NO: 1518707 - RNA, 19 nt, Homo sapiens
gccaacagaugaagauucu

SEQ ID NO: 1518708 - RNA, 19 nt, Homo sapiens
caagagaguauccagaaga

SEQ ID NO: 1518709 - RNA, 19 nt, Homo sapiens
uaauuuaccucaugagacu

SEQ ID NO: 1518710 - RNA, 19 nt, Homo sapiens
agucauaucugccuuacau

SEQ ID NO: 1518711 - RNA, 19 nt, Homo sapiens
aaagaacaccacauaaaga

SEQ ID NO: 1518712 - RNA, 19 nt, Homo sapiens
gcacaucagucagcaguuu

SEQ ID NO: 1518713 - RNA, 19 nt, Homo sapiens
gcaagaggaugcugggaaa

SEQ ID NO: 1518714 - RNA, 19 nt, Homo sapiens
ucaagaagcccuccaagua

SEQ ID NO: 1518715 - RNA, 19 nt, Homo sapiens
gaauggaguuucaggauca

SEQ ID NO: 1518716 - RNA, 19 nt, Homo sapiens
guucuacccuuucucauuu

SEQ ID NO: 1518717 - RNA, 19 nt, Homo sapiens
ggaaaucuccugcucgaaa

SEQ ID NO: 1518718 - RNA, 19 nt, Homo sapiens
ugaagaaggugacgauaau

SEQ ID NO: 1518719 - RNA, 19 nt, Homo sapiens
gaaaggaauuagucaacug

SEQ ID NO: 1518720 - RNA, 19 nt, Homo sapiens
ggacucugcuaaugauuug

SEQ ID NO: 1518721 - RNA, 19 nt, Homo sapiens
gaaauggccacagaugaua

SEQ ID NO: 1518722 - RNA, 19 nt, Homo sapiens
gaucaccgcuacugguuga

SEQ ID NO: 1518723 - RNA, 19 nt, Homo sapiens
gaaaucuccugcucgaaau

SEQ ID NO: 1518724 - RNA, 19 nt, Homo sapiens
gaaagccagccguaacaua

SEQ ID NO: 1518725 - RNA, 19 nt, Homo sapiens
acagauagcugaagaaggu

SEQ ID NO: 1518726 - RNA, 19 nt, Homo sapiens
ucacacacuuuaaaccuuu

SEQ ID NO: 1518727 - RNA, 19 nt, Homo sapiens
ggcacaagcuauagcaauu

SEQ ID NO: 1518728 - RNA, 19 nt, Homo sapiens
gcaguggaauggaguuuca

SEQ ID NO: 1518729 - RNA, 19 nt, Homo sapiens
gaucagccagcauuacuaa

SEQ ID NO: 1518730 - RNA, 19 nt, Homo sapiens
ugacugcucuucccauaau

SEQ ID NO: 1518731 - RNA, 19 nt, Homo sapiens
ccuccgagcuugcacauau

SEQ ID NO: 1518732 - RNA, 19 nt, Homo sapiens
gaaaaucauucacacauuc

SEQ ID NO: 1518733 - RNA, 19 nt, Homo sapiens
cagaacagauagcugaaga

SEQ ID NO: 1518734 - RNA, 19 nt, Homo sapiens
gacguuggcuggauugugu

SEQ ID NO: 1518735 - RNA, 19 nt, Homo sapiens
ucacuaaacccauuaagau

SEQ ID NO: 1518736 - RNA, 19 nt, Homo sapiens
uggcauuucuuugcauuua

SEQ ID NO: 1518737 - RNA, 19 nt, Homo sapiens
cauccagauuccucaaaua

SEQ ID NO: 1518738 - RNA, 19 nt, Homo sapiens
ccacagacaguaauucuau

SEQ ID NO: 1518739 - RNA, 19 nt, Homo sapiens
ccacguggcugaggguauu

SEQ ID NO: 1518740 - RNA, 19 nt, Homo sapiens
guguaaagcuuguagucuu

SEQ ID NO: 1518741 - RNA, 19 nt, Homo sapiens
uaacaaagagagagcagaa

SEQ ID NO: 1518742 - RNA, 19 nt, Homo sapiens
uaagaugcuugaacuagau

SEQ ID NO: 1518743 - RNA, 19 nt, Homo sapiens
ucaacuggcuaauccgaaa

SEQ ID NO: 1518744 - RNA, 19 nt, Homo sapiens
ggaaaaucauucacacauu

SEQ ID NO: 1518745 - RNA, 19 nt, Homo sapiens
ggaaaggaauuagucaacu

SEQ ID NO: 1518746 - RNA, 19 nt, Homo sapiens
gaacgcaucccaacugcau

SEQ ID NO: 1518747 - RNA, 19 nt, Homo sapiens
gauggacguuggcuggauu

SEQ ID NO: 1518748 - RNA, 19 nt, Homo sapiens
ccaacugcauuguaggaaa

SEQ ID NO: 1518749 - RNA, 19 nt, Homo sapiens
uuaagaugcuugaacuaga

SEQ ID NO: 1518750 - RNA, 19 nt, Homo sapiens
gcaccaccaugcccagugu

SEQ ID NO: 1518751 - RNA, 19 nt, Homo sapiens
gaacagauagcugaagaag

SEQ ID NO: 1518752 - RNA, 19 nt, Homo sapiens
gacauaaaguuugaugaca

SEQ ID NO: 1518753 - RNA, 19 nt, Homo sapiens
ucugagccauccugguuua

SEQ ID NO: 1518754 - RNA, 19 nt, Homo sapiens
caacugcauuguaggaaag

SEQ ID NO: 1518755 - RNA, 19 nt, Homo sapiens
aacgugaacuuccauauca

SEQ ID NO: 1518756 - RNA, 19 nt, Homo sapiens
gagaugaguaugcgcugua

SEQ ID NO: 1518757 - RNA, 19 nt, Homo sapiens
acacuggacucugcuaaug

SEQ ID NO: 1518758 - RNA, 19 nt, Homo sapiens
gaagaaggugacgauaauu

SEQ ID NO: 1518759 - RNA, 19 nt, Homo sapiens
gagccauccugguuuaaag

SEQ ID NO: 1518760 - RNA, 19 nt, Homo sapiens
cacaagggcacaagcuaua

SEQ ID NO: 1518761 - RNA, 19 nt, Homo sapiens
ggagaacagcagccuuuga

SEQ ID NO: 1518762 - RNA, 19 nt, Homo sapiens
cuauuugccuuugccguua

SEQ ID NO: 1518763 - RNA, 19 nt, Homo sapiens
gcuaaugauuugccucgau

SEQ ID NO: 1518764 - RNA, 19 nt, Homo sapiens
cagcauuacuaaccuguca

SEQ ID NO: 1518765 - RNA, 19 nt, Homo sapiens
caaauacuccucuuucaac

SEQ ID NO: 1518766 - RNA, 19 nt, Homo sapiens
ucucaucucacacacuuua

SEQ ID NO: 1518767 - RNA, 19 nt, Homo sapiens
ccauuaagaugcuugaacu

SEQ ID NO: 1518768 - RNA, 19 nt, Homo sapiens
gcucuauucuuuucucuuu

SEQ ID NO: 1518769 - RNA, 19 nt, Homo sapiens
ggacagcugggccauagga

SEQ ID NO: 1518770 - RNA, 19 nt, Homo sapiens
cauaaaguuugaugacagu

SEQ ID NO: 1518771 - RNA, 19 nt, Homo sapiens
gcacaagcuauagcaauug

SEQ ID NO: 1518772 - RNA, 19 nt, Homo sapiens
caucccaacugcauuguag

SEQ ID NO: 1518773 - RNA, 19 nt, Homo sapiens
ccagauuccucaaauacuc

SEQ ID NO: 1518774 - RNA, 19 nt, Homo sapiens
caagaagcccuccaaguac

SEQ ID NO: 1518775 - RNA, 19 nt, Homo sapiens
cagcagccuuugaguggaa

SEQ ID NO: 1518776 - RNA, 19 nt, Homo sapiens
gguaggagguagucaccau

SEQ ID NO: 1518777 - RNA, 19 nt, Homo sapiens
ggucacccacaccuuauaa

SEQ ID NO: 1518778 - RNA, 19 nt, Homo sapiens
aagaaggugacgauaauuu

SEQ ID NO: 1518779 - RNA, 19 nt, Homo sapiens
ucaaauacuccucuuucaa

SEQ ID NO: 1518780 - RNA, 19 nt, Homo sapiens
gagaacagcagccuuugag

SEQ ID NO: 1518781 - RNA, 19 nt, Homo sapiens
ucugacugcucuucccaua

SEQ ID NO: 1518782 - RNA, 19 nt, Homo sapiens
caacgugaacuuccauauc

SEQ ID NO: 1518783 - RNA, 19 nt, Homo sapiens
aaauagaucagccagcauu

SEQ ID NO: 1518784 - RNA, 19 nt, Homo sapiens
aaagccagccguaacauau

SEQ ID NO: 1518785 - RNA, 19 nt, Homo sapiens
ugaaauggccacagaugau

SEQ ID NO: 1518786 - RNA, 19 nt, Homo sapiens
uggauguucugcucuauuc

SEQ ID NO: 1518787 - RNA, 19 nt, Homo sapiens
gguggcauuucuuugcauu

SEQ ID NO: 1518788 - RNA, 19 nt, Homo sapiens
ggcgcagacucaugaaaug

SEQ ID NO: 1518789 - RNA, 19 nt, Homo sapiens
caacacuggacucugcuaa

SEQ ID NO: 1518790 - RNA, 19 nt, Homo sapiens
gaaggugacgauaauuugg

SEQ ID NO: 1518791 - RNA, 19 nt, Homo sapiens
ccacaagggcacaagcuau

SEQ ID NO: 1518792 - RNA, 19 nt, Homo sapiens
gcuugcacauauuguagaa

SEQ ID NO: 1518793 - RNA, 19 nt, Homo sapiens
ggacaagcaaugguugaug

SEQ ID NO: 1518794 - RNA, 19 nt, Homo sapiens
caaagagagagcagaagga

SEQ ID NO: 1518795 - RNA, 19 nt, Homo sapiens
acuaaccugucacuggaua

SEQ ID NO: 1518796 - RNA, 19 nt, Homo sapiens
caacuuccaagguggcauu

SEQ ID NO: 1518797 - RNA, 19 nt, Homo sapiens
cugaagaaggugacgauaa

SEQ ID NO: 1518798 - RNA, 19 nt, Homo sapiens
ugaugacagugacacagaa

SEQ ID NO: 1518799 - RNA, 19 nt, Homo sapiens
agccagccguaacauauuu

SEQ ID NO: 1518800 - RNA, 19 nt, Homo sapiens
uaaaguuugaugacaguga

SEQ ID NO: 1518801 - RNA, 19 nt, Homo sapiens
uauagaccacugcagagua

SEQ ID NO: 1518802 - RNA, 19 nt, Homo sapiens
cauuguaggaaaggaauua

SEQ ID NO: 1518803 - RNA, 19 nt, Homo sapiens
cuucucaucucacacacuu

SEQ ID NO: 1518804 - RNA, 19 nt, Homo sapiens
guaggaaagccagccguaa

SEQ ID NO: 1518805 - RNA, 19 nt, Homo sapiens
cacagacaguaauucuauu

SEQ ID NO: 1518806 - RNA, 19 nt, Homo sapiens
ggcauuucuuugcauuuau

SEQ ID NO: 1518807 - RNA, 19 nt, Homo sapiens
uaaaaggaacuacaucuga

SEQ ID NO: 1518808 - RNA, 19 nt, Homo sapiens
ugacucagccgcuucuauc

SEQ ID NO: 1518809 - RNA, 19 nt, Homo sapiens
agaaggugacgauaauuug

SEQ ID NO: 1518810 - RNA, 19 nt, Homo sapiens
ucuggacagugugcaguua

SEQ ID NO: 1518811 - RNA, 19 nt, Homo sapiens
ccucaaauacuccucuuuc

SEQ ID NO: 1518812 - RNA, 19 nt, Homo sapiens
gggaugagauaacaaauug

SEQ ID NO: 1518813 - RNA, 19 nt, Homo sapiens
gcucgaaucuccuaaaugu

SEQ ID NO: 1518814 - RNA, 19 nt, Homo sapiens
ccacaagaaucuaugauac

SEQ ID NO: 1518815 - RNA, 19 nt, Homo sapiens
ucacagagaaguuggguuu

SEQ ID NO: 1518816 - RNA, 19 nt, Homo sapiens
gagcucgaaucuccuaaau

SEQ ID NO: 1518817 - RNA, 19 nt, Homo sapiens
ucgaaucuccuaaauguaa

SEQ ID NO: 1518818 - RNA, 19 nt, Homo sapiens
guaaaaggcaggaaaauga

SEQ ID NO: 1518819 - RNA, 19 nt, Homo sapiens
gaaauccgggcaucacaga

SEQ ID NO: 1518820 - RNA, 19 nt, Homo sapiens
ggaaaugacagagcucgaa

SEQ ID NO: 1518821 - RNA, 19 nt, Homo sapiens
gaaaugacagagcucgaau

SEQ ID NO: 1518822 - RNA, 19 nt, Homo sapiens
cgaaucuccuaaauguaaa

SEQ ID NO: 1518823 - RNA, 19 nt, Homo sapiens
aggcugcucuaucugguua

SEQ ID NO: 1518824 - RNA, 19 nt, Homo sapiens
gagcagcuacuggaucaaa

SEQ ID NO: 1518825 - RNA, 19 nt, Homo sapiens
ggaguacaccguagccaau

SEQ ID NO: 1518826 - RNA, 19 nt, Homo sapiens
uagccaaugucaucucugu

SEQ ID NO: 1518827 - RNA, 19 nt, Homo sapiens
acagagaaguuggguuuag

SEQ ID NO: 1518828 - RNA, 19 nt, Homo sapiens
gcagcuagaggaaaugaca

SEQ ID NO: 1518829 - RNA, 19 nt, Homo sapiens
gggcaucacagagaaguug

SEQ ID NO: 1518830 - RNA, 19 nt, Homo sapiens
gcaggaaaaugagcagcua

SEQ ID NO: 1518831 - RNA, 19 nt, Homo sapiens
acucaguccuaaaggguuu

SEQ ID NO: 1518832 - RNA, 19 nt, Homo sapiens
acaagaaucuaugauacag

SEQ ID NO: 1518833 - RNA, 19 nt, Homo sapiens
cccacaagaaucuaugaua

SEQ ID NO: 1518834 - RNA, 19 nt, Homo sapiens
ggaucaaaaucaagaaauc

SEQ ID NO: 1518835 - RNA, 19 nt, Homo sapiens
cgggaugagauaacaaauu

SEQ ID NO: 1518836 - RNA, 19 nt, Homo sapiens
caccguagccaaugucauc

SEQ ID NO: 1518837 - RNA, 19 nt, Homo sapiens
gaucccuucuuugcucaug

SEQ ID NO: 1518838 - RNA, 19 nt, Homo sapiens
cacaagaaucuaugauaca

SEQ ID NO: 1518839 - RNA, 19 nt, Homo sapiens
ggcacuagcucuggugaac

SEQ ID NO: 1518840 - RNA, 19 nt, Homo sapiens
cagagaaguuggguuuagg

SEQ ID NO: 1518841 - RNA, 19 nt, Homo sapiens
acugcuggauccucuggua

SEQ ID NO: 1518842 - RNA, 19 nt, Homo sapiens
augagcagcuacuggauca

SEQ ID NO: 1518843 - RNA, 19 nt, Homo sapiens
gaguugggcccugcaggaa

SEQ ID NO: 1518844 - RNA, 19 nt, Homo sapiens
gcuacuggaucaaaaucaa

SEQ ID NO: 1518845 - RNA, 19 nt, Homo sapiens
acagagcucgaaucuccua

SEQ ID NO: 1518846 - RNA, 19 nt, Homo sapiens
gggcagcuagaggaaauga

SEQ ID NO: 1518847 - RNA, 19 nt, Homo sapiens
ucccugggccuccuucuug

SEQ ID NO: 1518848 - RNA, 19 nt, Homo sapiens
gcacagguauagaacauuu

SEQ ID NO: 1518849 - RNA, 19 nt, Homo sapiens
gggaagaacuggauaugug

SEQ ID NO: 1518850 - RNA, 19 nt, Homo sapiens
ugaaacaggugcucaauag

SEQ ID NO: 1518851 - RNA, 19 nt, Homo sapiens
caacaaauccaacaaagga

SEQ ID NO: 1518852 - RNA, 19 nt, Homo sapiens
ccacaaauaucccuaccaa

SEQ ID NO: 1518853 - RNA, 19 nt, Homo sapiens
ggacagcacagguauagaa

SEQ ID NO: 1518854 - RNA, 19 nt, Homo sapiens
ggacaguacugguauagag

SEQ ID NO: 1518855 - RNA, 19 nt, Homo sapiens
gaacuggaguaucugacaa

SEQ ID NO: 1518856 - RNA, 19 nt, Homo sapiens
cgacuuggauccuuuggaa

SEQ ID NO: 1518857 - RNA, 19 nt, Homo sapiens
uaaauaauccugccuguca

SEQ ID NO: 1518858 - RNA, 19 nt, Homo sapiens
acaaguagauuccgcaaau

SEQ ID NO: 1518859 - RNA, 19 nt, Homo sapiens
gcuugucguuuacauauuu

SEQ ID NO: 1518860 - RNA, 19 nt, Homo sapiens
gaaccuaccucuggcuugu

SEQ ID NO: 1518861 - RNA, 19 nt, Homo sapiens
gaaagaaguguagaugauu

SEQ ID NO: 1518862 - RNA, 19 nt, Homo sapiens
gccaauugcuccuagacua

SEQ ID NO: 1518863 - RNA, 19 nt, Homo sapiens
gcaagagggcuuuauuuca

SEQ ID NO: 1518864 - RNA, 19 nt, Homo sapiens
caacacaccuaggcuguau

SEQ ID NO: 1518865 - RNA, 19 nt, Homo sapiens
gguuagaacuggaguaucu

SEQ ID NO: 1518866 - RNA, 19 nt, Homo sapiens
gcauguugcuguacugaau

SEQ ID NO: 1518867 - RNA, 19 nt, Homo sapiens
aaagcuaugugaaccuuaa

SEQ ID NO: 1518868 - RNA, 19 nt, Homo sapiens
agaaagaaguguagaugau

SEQ ID NO: 1518869 - RNA, 19 nt, Homo sapiens
caacauaacaagacucugu

SEQ ID NO: 1518870 - RNA, 19 nt, Homo sapiens
gagcaucacuagagcaucu

SEQ ID NO: 1518871 - RNA, 19 nt, Homo sapiens
gcaagcaguuccgaaugaa

SEQ ID NO: 1518872 - RNA, 19 nt, Homo sapiens
caacaaaggaucacucaag

SEQ ID NO: 1518873 - RNA, 19 nt, Homo sapiens
caagagggcuuuauuucac

SEQ ID NO: 1518874 - RNA, 19 nt, Homo sapiens
ucuaggaccagaauaaaua

SEQ ID NO: 1518875 - RNA, 19 nt, Homo sapiens
cgaauacccaccacaagua

SEQ ID NO: 1518876 - RNA, 19 nt, Homo sapiens
cuacaaaucuauacagcau

SEQ ID NO: 1518877 - RNA, 19 nt, Homo sapiens
gagaaugaaagcuauguga

SEQ ID NO: 1518878 - RNA, 19 nt, Homo sapiens
cagauaagcuuggaugagu

SEQ ID NO: 1518879 - RNA, 19 nt, Homo sapiens
caccuaggcuguaugaugu

SEQ ID NO: 1518880 - RNA, 19 nt, Homo sapiens
guacagauuccacaacuca

SEQ ID NO: 1518881 - RNA, 19 nt, Homo sapiens
guagccagguguugcugua

SEQ ID NO: 1518882 - RNA, 19 nt, Homo sapiens
uggaguaucugacaaguag

SEQ ID NO: 1518883 - RNA, 19 nt, Homo sapiens
guauagaacauuuccauca

SEQ ID NO: 1518884 - RNA, 19 nt, Homo sapiens
gaaccugucguauauucuu

SEQ ID NO: 1518885 - RNA, 19 nt, Homo sapiens
aaaugcagauucaaacaug

SEQ ID NO: 1518886 - RNA, 19 nt, Homo sapiens
gaggaugugugauggagau

SEQ ID NO: 1518887 - RNA, 19 nt, Homo sapiens
gaaacccaaagccaaagua

SEQ ID NO: 1518888 - RNA, 19 nt, Homo sapiens
uguaugauguagccaauug

SEQ ID NO: 1518889 - RNA, 19 nt, Homo sapiens
gaggaagagucggaaauag

SEQ ID NO: 1518890 - RNA, 19 nt, Homo sapiens
aaagaaguguagaugauuc

SEQ ID NO: 1518891 - RNA, 19 nt, Homo sapiens
ggaagaauagaaagaagug

SEQ ID NO: 1518892 - RNA, 19 nt, Homo sapiens
ggagagaggaugaagaucu

SEQ ID NO: 1518893 - RNA, 19 nt, Homo sapiens
aaaguucuauuggacagua

SEQ ID NO: 1518894 - RNA, 19 nt, Homo sapiens
ucagagacauuuggagaga

SEQ ID NO: 1518895 - RNA, 19 nt, Homo sapiens
gaaucaagagaaagugaaa

SEQ ID NO: 1518896 - RNA, 19 nt, Homo sapiens
ggaagagucggaaauaguc

SEQ ID NO: 1518897 - RNA, 19 nt, Homo sapiens
agaaagaauucagaacaga

SEQ ID NO: 1518898 - RNA, 19 nt, Homo sapiens
acaaaucuauacagcaugu

SEQ ID NO: 1518899 - RNA, 19 nt, Homo sapiens
acaaugaccuagcaacagu

SEQ ID NO: 1518900 - RNA, 19 nt, Homo sapiens
gaccauccagggcaacaua

SEQ ID NO: 1518901 - RNA, 19 nt, Homo sapiens
uuuggaauaugcuggcuua

SEQ ID NO: 1518902 - RNA, 19 nt, Homo sapiens
gagaaucaagagaaaguga

SEQ ID NO: 1518903 - RNA, 19 nt, Homo sapiens
cagcacagguauagaacau

SEQ ID NO: 1518904 - RNA, 19 nt, Homo sapiens
gaaagcuaugugaaccuua

SEQ ID NO: 1518905 - RNA, 19 nt, Homo sapiens
uaacgaauacccaccacaa

SEQ ID NO: 1518906 - RNA, 19 nt, Homo sapiens
gaaugaaacaggugcucaa

SEQ ID NO: 1518907 - RNA, 19 nt, Homo sapiens
cuaaucaaauuccagaagu

SEQ ID NO: 1518908 - RNA, 19 nt, Homo sapiens
uagccucaguggagccuua

SEQ ID NO: 1518909 - RNA, 19 nt, Homo sapiens
ugcaagcaguuccgaauga

SEQ ID NO: 1518910 - RNA, 19 nt, Homo sapiens
gaugugugauggagaugug

SEQ ID NO: 1518911 - RNA, 19 nt, Homo sapiens
ugaaagcuaugugaaccuu

SEQ ID NO: 1518912 - RNA, 19 nt, Homo sapiens
cggaaccugucguauauuc

SEQ ID NO: 1518913 - RNA, 19 nt, Homo sapiens
gaagaugaugagccugauu

SEQ ID NO: 1518914 - RNA, 19 nt, Homo sapiens
cuacauaugacuucugaga

SEQ ID NO: 1518915 - RNA, 19 nt, Homo sapiens
ucucugagcagcauucuga

SEQ ID NO: 1518916 - RNA, 19 nt, Homo sapiens
gccagguguugcuguauug

SEQ ID NO: 1518917 - RNA, 19 nt, Homo sapiens
ccuagcaacaguaacauaa

SEQ ID NO: 1518918 - RNA, 19 nt, Homo sapiens
gaaugaaagcuaugugaac

SEQ ID NO: 1518919 - RNA, 19 nt, Homo sapiens
ucacuagagcaucuccuua

SEQ ID NO: 1518920 - RNA, 19 nt, Homo sapiens
caacaguaacauaagcaaa

SEQ ID NO: 1518921 - RNA, 19 nt, Homo sapiens
cauccaaucccaacaaauc

SEQ ID NO: 1518922 - RNA, 19 nt, Homo sapiens
gcuccuagacuacaaaucu

SEQ ID NO: 1518923 - RNA, 19 nt, Homo sapiens
caaauuguuggaagaauag

SEQ ID NO: 1518924 - RNA, 19 nt, Homo sapiens
uagaacauuuccaucaaca

SEQ ID NO: 1518925 - RNA, 19 nt, Homo sapiens
uauagugacccuccuguga

SEQ ID NO: 1518926 - RNA, 19 nt, Homo sapiens
agaggaagagucggaaaua

SEQ ID NO: 1518927 - RNA, 19 nt, Homo sapiens
cuucggaaccugucguaua

SEQ ID NO: 1518928 - RNA, 19 nt, Homo sapiens
uagaaagaauucagaacag

SEQ ID NO: 1518929 - RNA, 19 nt, Homo sapiens
gggaggaggaagaugauga

SEQ ID NO: 1518930 - RNA, 19 nt, Homo sapiens
gcaagaacaagaugcugau

SEQ ID NO: 1518931 - RNA, 19 nt, Homo sapiens
caacacggaaaguucuauu

SEQ ID NO: 1518932 - RNA, 19 nt, Homo sapiens
gcaauuauaacacaaugac

SEQ ID NO: 1518933 - RNA, 19 nt, Homo sapiens
ggaccagaauaaauaaucc

SEQ ID NO: 1518934 - RNA, 19 nt, Homo sapiens
gccuuauguuccagaauuu

SEQ ID NO: 1518935 - RNA, 19 nt, Homo sapiens
agucggaaauagucaaguu

SEQ ID NO: 1518936 - RNA, 19 nt, Homo sapiens
aagcuccgcucguggcauu

SEQ ID NO: 1518937 - RNA, 19 nt, Homo sapiens
uagaaagaaguguagauga

SEQ ID NO: 1518938 - RNA, 19 nt, Homo sapiens
agccuuauguuccagaauu

SEQ ID NO: 1518939 - RNA, 19 nt, Homo sapiens
ggaagaugaugagccugau

SEQ ID NO: 1518940 - RNA, 19 nt, Homo sapiens
cuucagacucuacauauga

SEQ ID NO: 1518941 - RNA, 19 nt, Homo sapiens
guauuggacagcacaggua

SEQ ID NO: 1518942 - RNA, 19 nt, Homo sapiens
gauaugacuggcaggcaaa

SEQ ID NO: 1518943 - RNA, 19 nt, Homo sapiens
gaaguguagaugauucuca

SEQ ID NO: 1518944 - RNA, 19 nt, Homo sapiens
ccucaaaggaaauuguaaa

SEQ ID NO: 1518945 - RNA, 19 nt, Homo sapiens
cacggaaaguucuauugga

SEQ ID NO: 1518946 - RNA, 19 nt, Homo sapiens
gcuaugugaaccuuaagaa

SEQ ID NO: 1518947 - RNA, 19 nt, Homo sapiens
gcuguaugauguagccaau

SEQ ID NO: 1518948 - RNA, 19 nt, Homo sapiens
gcacaucucucacuuuaaa

SEQ ID NO: 1518949 - RNA, 19 nt, Homo sapiens
gaugaggaguuguuucuua

SEQ ID NO: 1518950 - RNA, 19 nt, Homo sapiens
cuagggcccuuaagaauua

SEQ ID NO: 1518951 - RNA, 19 nt, Homo sapiens
gcaaacaguuagccaaguu

SEQ ID NO: 1518952 - RNA, 19 nt, Homo sapiens
cagcaugguuuacugaaua

SEQ ID NO: 1518953 - RNA, 19 nt, Homo sapiens
gaaacagccuucuauugga

SEQ ID NO: 1518954 - RNA, 19 nt, Homo sapiens
uaaugcagcuggugacuuu

SEQ ID NO: 1518955 - RNA, 19 nt, Homo sapiens
ggaaguaagugcagaugug

SEQ ID NO: 1518956 - RNA, 19 nt, Homo sapiens
gaacuagaauuagaaguag

SEQ ID NO: 1518957 - RNA, 19 nt, Homo sapiens
gaaaugacaacaaaggauu

SEQ ID NO: 1518958 - RNA, 19 nt, Homo sapiens
gaagguggcuacacuaaac

SEQ ID NO: 1518959 - RNA, 19 nt, Homo sapiens
ucgcacaucucucacuuua

SEQ ID NO: 1518960 - RNA, 19 nt, Homo sapiens
gcugcaaucucaugauaaa

SEQ ID NO: 1518961 - RNA, 19 nt, Homo sapiens
ggucaaauugucaacauua

SEQ ID NO: 1518962 - RNA, 19 nt, Homo sapiens
uggaaaggauucaccauuu

SEQ ID NO: 1518963 - RNA, 19 nt, Homo sapiens
gagcucugauggagauaua

SEQ ID NO: 1518964 - RNA, 19 nt, Homo sapiens
ccaaugaacacacgaauga

SEQ ID NO: 1518965 - RNA, 19 nt, Homo sapiens
gaucuuugauguugcuauu

SEQ ID NO: 1518966 - RNA, 19 nt, Homo sapiens
caagagcucugauggagau

SEQ ID NO: 1518967 - RNA, 19 nt, Homo sapiens
uaacaggaguuuggaagaa

SEQ ID NO: 1518968 - RNA, 19 nt, Homo sapiens
gaacuuucauagcuagaga

SEQ ID NO: 1518969 - RNA, 19 nt, Homo sapiens
caggcugacucucuuguua

SEQ ID NO: 1518970 - RNA, 19 nt, Homo sapiens
caaguuauccagaagcuuu

SEQ ID NO: 1518971 - RNA, 19 nt, Homo sapiens
ucagugaucuuugauguug

SEQ ID NO: 1518972 - RNA, 19 nt, Homo sapiens
ggaaauagcaaaagaacua

SEQ ID NO: 1518973 - RNA, 19 nt, Homo sapiens
uguggaagcugcagaagaa

SEQ ID NO: 1518974 - RNA, 19 nt, Homo sapiens
ucuaagugcucaagugaaa

SEQ ID NO: 1518975 - RNA, 19 nt, Homo sapiens
cuucaccgaugucuuauuu

SEQ ID NO: 1518976 - RNA, 19 nt, Homo sapiens
ggaaaggauucaccauuuu

SEQ ID NO: 1518977 - RNA, 19 nt, Homo sapiens
gaagaaaaguuugaagcua

SEQ ID NO: 1518978 - RNA, 19 nt, Homo sapiens
ggagauauacgaggagauu

SEQ ID NO: 1518979 - RNA, 19 nt, Homo sapiens
aaacagccuucuauuggaa

SEQ ID NO: 1518980 - RNA, 19 nt, Homo sapiens
aaagaagccauuuccauaa

SEQ ID NO: 1518981 - RNA, 19 nt, Homo sapiens
acacacgaaugauaagaaa

SEQ ID NO: 1518982 - RNA, 19 nt, Homo sapiens
cgaaggcucagauugauaa

SEQ ID NO: 1518983 - RNA, 19 nt, Homo sapiens
uaaagcagcagcaggguuu

SEQ ID NO: 1518984 - RNA, 19 nt, Homo sapiens
gugcagaugugguggaaau

SEQ ID NO: 1518985 - RNA, 19 nt, Homo sapiens
ugaagaugcugugaacauu

SEQ ID NO: 1518986 - RNA, 19 nt, Homo sapiens
gggaggaggucaaauuguc

SEQ ID NO: 1518987 - RNA, 19 nt, Homo sapiens
gaagaugcugugaacauug

SEQ ID NO: 1518988 - RNA, 19 nt, Homo sapiens
gaaaggauucaccauuuua

SEQ ID NO: 1518989 - RNA, 19 nt, Homo sapiens
gagguugguucaugagguu

SEQ ID NO: 1518990 - RNA, 19 nt, Homo sapiens
gccaaagccuaauccagaa

SEQ ID NO: 1518991 - RNA, 19 nt, Homo sapiens
aagcuucaccgaugucuua

SEQ ID NO: 1518992 - RNA, 19 nt, Homo sapiens
uagcagagguugguucaug

SEQ ID NO: 1518993 - RNA, 19 nt, Homo sapiens
ggaacuuaauguugugugu

SEQ ID NO: 1518994 - RNA, 19 nt, Homo sapiens
ucaccgaugucuuauuuua

SEQ ID NO: 1518995 - RNA, 19 nt, Homo sapiens
ugaaacagccuucuauugg

SEQ ID NO: 1518996 - RNA, 19 nt, Homo sapiens
uguagaagcugcagcaagu

SEQ ID NO: 1518997 - RNA, 19 nt, Homo sapiens
ggaguuguuucuuauggau

SEQ ID NO: 1518998 - RNA, 19 nt, Homo sapiens
cugaagauguaacugaauu

SEQ ID NO: 1518999 - RNA, 19 nt, Homo sapiens
gaggaguuguuucuuaugg

SEQ ID NO: 1519000 - RNA, 19 nt, Homo sapiens
aguagagccugaagaugua

SEQ ID NO: 1519001 - RNA, 19 nt, Homo sapiens
acgaggagauuaauguuau

SEQ ID NO: 1519002 - RNA, 19 nt, Homo sapiens
gaugaaacagccuucuauu

SEQ ID NO: 1519003 - RNA, 19 nt, Homo sapiens
caacagauuuucaauguag

SEQ ID NO: 1519004 - RNA, 19 nt, Homo sapiens
uuauuacgcuucgcagaua

SEQ ID NO: 1519005 - RNA, 19 nt, Homo sapiens
cuaacucucuucaacucua

SEQ ID NO: 1519006 - RNA, 19 nt, Homo sapiens
gacaacaaaggauuuagaa

SEQ ID NO: 1519007 - RNA, 19 nt, Homo sapiens
gaggucaaauugucaacau

SEQ ID NO: 1519008 - RNA, 19 nt, Homo sapiens
gaucagaccagccgcaaca

SEQ ID NO: 1519009 - RNA, 19 nt, Homo sapiens
gaacacacgaaugauaaga

SEQ ID NO: 1519010 - RNA, 19 nt, Homo sapiens
uagcugccauggauaguga

SEQ ID NO: 1519011 - RNA, 19 nt, Homo sapiens
gagaccuacugcucagaaa

SEQ ID NO: 1519012 - RNA, 19 nt, Homo sapiens
gucagugccuggcuucaaa

SEQ ID NO: 1519013 - RNA, 19 nt, Homo sapiens
gaagccauuuccauaacau

SEQ ID NO: 1519014 - RNA, 19 nt, Homo sapiens
uggacucgcugcuugguaa

SEQ ID NO: 1519015 - RNA, 19 nt, Homo sapiens
ugacgaagguggcuacacu

SEQ ID NO: 1519016 - RNA, 19 nt, Homo sapiens
gggacgcacucucugguau

SEQ ID NO: 1519017 - RNA, 19 nt, Homo sapiens
ucuagaacuuucauagcua

SEQ ID NO: 1519018 - RNA, 19 nt, Homo sapiens
uagaagcugcagcaaguua

SEQ ID NO: 1519019 - RNA, 19 nt, Homo sapiens
gcugauauggagaaaguuu

SEQ ID NO: 1519020 - RNA, 19 nt, Homo sapiens
gaucugggcaaagcaaauu

SEQ ID NO: 1519021 - RNA, 19 nt, Homo sapiens
ggauagugaugucucugau

SEQ ID NO: 1519022 - RNA, 19 nt, Homo sapiens
uaagaucauugacgaaggu

SEQ ID NO: 1519023 - RNA, 19 nt, Homo sapiens
gaaaggaagagucgcacau

SEQ ID NO: 1519024 - RNA, 19 nt, Homo sapiens
ugauguugcuauugucauu

SEQ ID NO: 1519025 - RNA, 19 nt, Homo sapiens
cgaggagauuaauguuauu

SEQ ID NO: 1519026 - RNA, 19 nt, Homo sapiens
gcagcaaguuauccagaag

SEQ ID NO: 1519027 - RNA, 19 nt, Homo sapiens
agaaagcgaaacagccuua

SEQ ID NO: 1519028 - RNA, 19 nt, Homo sapiens
ccacauacagcgucuuuua

SEQ ID NO: 1519029 - RNA, 19 nt, Homo sapiens
cgaccuucaagucuuauua

SEQ ID NO: 1519030 - RNA, 19 nt, Homo sapiens
aagcgaaacagccuuauug

SEQ ID NO: 1519031 - RNA, 19 nt, Homo sapiens
aaugaacacacgaaugaua

SEQ ID NO: 1519032 - RNA, 19 nt, Homo sapiens
acaguuagccaaguuguaa

SEQ ID NO: 1519033 - RNA, 19 nt, Homo sapiens
gaauuaaugacucugcaau

SEQ ID NO: 1519034 - RNA, 19 nt, Homo sapiens
uggcauaccucguuuuauu

SEQ ID NO: 1519035 - RNA, 19 nt, Homo sapiens
cagcaggguuugagaggau

SEQ ID NO: 1519036 - RNA, 19 nt, Homo sapiens
gccugaagauguaacugaa

SEQ ID NO: 1519037 - RNA, 19 nt, Homo sapiens
caugggaggaggucaaauu

SEQ ID NO: 1519038 - RNA, 19 nt, Homo sapiens
uuucgaccuucaagucuua

SEQ ID NO: 1519039 - RNA, 19 nt, Homo sapiens
acaaagcccuaacucucuu

SEQ ID NO: 1519040 - RNA, 19 nt, Homo sapiens
aacauucccuuaagccaaa

SEQ ID NO: 1519041 - RNA, 19 nt, Homo sapiens
caccgaaggcucagauuga

SEQ ID NO: 1519042 - RNA, 19 nt, Homo sapiens
aaagugguuucuugagaug

SEQ ID NO: 1519043 - RNA, 19 nt, Homo sapiens
uaacacaacauccauucug

SEQ ID NO: 1519044 - RNA, 19 nt, Homo sapiens
gagauauacgaggagauua

SEQ ID NO: 1519045 - RNA, 19 nt, Homo sapiens
uucaugagguuuaaggaaa

SEQ ID NO: 1519046 - RNA, 19 nt, Homo sapiens
uaaaagugcuacuccaaug

SEQ ID NO: 1519047 - RNA, 19 nt, Homo sapiens
acucugcaauggccucuaa

SEQ ID NO: 1519048 - RNA, 19 nt, Homo sapiens
gcagaggucuuuagagauu

SEQ ID NO: 1519049 - RNA, 19 nt, Homo sapiens
caaaugauguggauaaaga

SEQ ID NO: 1519050 - RNA, 19 nt, Homo sapiens
ggagacacguuuagcuuaa

SEQ ID NO: 1519051 - RNA, 19 nt, Homo sapiens
uagacgggcuuuacaguua

SEQ ID NO: 1519052 - RNA, 19 nt, Homo sapiens
cagaacaacuguauaaaca

SEQ ID NO: 1519053 - RNA, 19 nt, Homo sapiens
gaaacaguaugauaaagca

SEQ ID NO: 1519054 - RNA, 19 nt, Homo sapiens
gcagaagaacuuuaugaaa

SEQ ID NO: 1519055 - RNA, 19 nt, Homo sapiens
guuagaagagcuuacauua

SEQ ID NO: 1519056 - RNA, 19 nt, Homo sapiens
gguaauagcagcaguuaga

SEQ ID NO: 1519057 - RNA, 19 nt, Homo sapiens
uagaagagcuuacauuagg

SEQ ID NO: 1519058 - RNA, 19 nt, Homo sapiens
ggacacaccugauaaugcu

SEQ ID NO: 1519059 - RNA, 19 nt, Homo sapiens
gggaguccauggcaaauga

SEQ ID NO: 1519060 - RNA, 19 nt, Homo sapiens
cguugaagcuuugccauua

SEQ ID NO: 1519061 - RNA, 19 nt, Homo sapiens
gcagcucuaugcaaugaaa

SEQ ID NO: 1519062 - RNA, 19 nt, Homo sapiens
aacagaagcugcaugauug

SEQ ID NO: 1519063 - RNA, 19 nt, Homo sapiens
aaacagaagcugcaugauu

SEQ ID NO: 1519064 - RNA, 19 nt, Homo sapiens
gguaaggacacaccugaua

SEQ ID NO: 1519065 - RNA, 19 nt, Homo sapiens
uugcuuagcugaucuuuau

SEQ ID NO: 1519066 - RNA, 19 nt, Homo sapiens
ggaacucuauccugagaug

SEQ ID NO: 1519067 - RNA, 19 nt, Homo sapiens
auaaagagcuaaugaagca

SEQ ID NO: 1519068 - RNA, 19 nt, Homo sapiens
gaaauucgacagaaaucuu

SEQ ID NO: 1519069 - RNA, 19 nt, Homo sapiens
ugaacaagcugaacauuuu

SEQ ID NO: 1519070 - RNA, 19 nt, Homo sapiens
guaaacagaagcugcauga

SEQ ID NO: 1519071 - RNA, 19 nt, Homo sapiens
ggauguggcuugcuuaggu

SEQ ID NO: 1519072 - RNA, 19 nt, Homo sapiens
gaagagcuuacauuaggua

SEQ ID NO: 1519073 - RNA, 19 nt, Homo sapiens
gcaaauguaccuuaagaca

SEQ ID NO: 1519074 - RNA, 19 nt, Homo sapiens
aaagggcaauggaaauaaa

SEQ ID NO: 1519075 - RNA, 19 nt, Homo sapiens
gaaaugagggagcgaguuc

SEQ ID NO: 1519076 - RNA, 19 nt, Homo sapiens
guaaggacacaccugauaa

SEQ ID NO: 1519077 - RNA, 19 nt, Homo sapiens
uugaagcacuugcaacuuu

SEQ ID NO: 1519078 - RNA, 19 nt, Homo sapiens
gaagaaguuuggcaaugca

SEQ ID NO: 1519079 - RNA, 19 nt, Homo sapiens
guacggauuugcccuuuua

SEQ ID NO: 1519080 - RNA, 19 nt, Homo sapiens
ggaagaaguuuggcaaugc

SEQ ID NO: 1519081 - RNA, 19 nt, Homo sapiens
gcaacagaauacuucgauu

SEQ ID NO: 1519082 - RNA, 19 nt, Homo sapiens
uugcugaguugcugaguua

SEQ ID NO: 1519083 - RNA, 19 nt, Homo sapiens
gaugaacucccguggcuuu

SEQ ID NO: 1519084 - RNA, 19 nt, Homo sapiens
ggcaaaagcuaaucaacua

SEQ ID NO: 1519085 - RNA, 19 nt, Homo sapiens
aaacagcucauucuccuaa

SEQ ID NO: 1519086 - RNA, 19 nt, Homo sapiens
ugaagcaucuugccaucuu

SEQ ID NO: 1519087 - RNA, 19 nt, Homo sapiens
caucagaaagcuauaaaga

SEQ ID NO: 1519088 - RNA, 19 nt, Homo sapiens
cugcaugauugccuucuua

SEQ ID NO: 1519089 - RNA, 19 nt, Homo sapiens
gcagggaaguaaacagaag

SEQ ID NO: 1519090 - RNA, 19 nt, Homo sapiens
uagcugaucuuuaugaaac

SEQ ID NO: 1519091 - RNA, 19 nt, Homo sapiens
gcuuugccauuauaugaaa

SEQ ID NO: 1519092 - RNA, 19 nt, Homo sapiens
uugcagaggucuuuagaga

SEQ ID NO: 1519093 - RNA, 19 nt, Homo sapiens
ccaaagcacccuaguguag

SEQ ID NO: 1519094 - RNA, 19 nt, Homo sapiens
gaagcguuccuuagaaaug

SEQ ID NO: 1519095 - RNA, 19 nt, Homo sapiens
ugauaaagcagaagaacuu

SEQ ID NO: 1519096 - RNA, 19 nt, Homo sapiens
gugcucagucuuugaauaa

SEQ ID NO: 1519097 - RNA, 19 nt, Homo sapiens
gguguucucuacuaucuuc

SEQ ID NO: 1519098 - RNA, 19 nt, Homo sapiens
gaacuugaagcacuugcaa

SEQ ID NO: 1519099 - RNA, 19 nt, Homo sapiens
ggauaaagagcuaaugaag

SEQ ID NO: 1519100 - RNA, 19 nt, Homo sapiens
ccacuguuacuucuucaua

SEQ ID NO: 1519101 - RNA, 19 nt, Homo sapiens
caaauguaccuuaagacaa

SEQ ID NO: 1519102 - RNA, 19 nt, Homo sapiens
gaaacuugacaaagcugua

SEQ ID NO: 1519103 - RNA, 19 nt, Homo sapiens
gaagcaucuugccaucuug

SEQ ID NO: 1519104 - RNA, 19 nt, Homo sapiens
gcagaacaacuguauaaac

SEQ ID NO: 1519105 - RNA, 19 nt, Homo sapiens
aaagugcaauggcaacaga

SEQ ID NO: 1519106 - RNA, 19 nt, Homo sapiens
gcagcuaagucaggacaga

SEQ ID NO: 1519107 - RNA, 19 nt, Homo sapiens
ggcaaaugauguggauaaa

SEQ ID NO: 1519108 - RNA, 19 nt, Homo sapiens
cauauacggugaagcaucu

SEQ ID NO: 1519109 - RNA, 19 nt, Homo sapiens
uauuucaccuugcagcuaa

SEQ ID NO: 1519110 - RNA, 19 nt, Homo sapiens
gcaguuagaauucuuugca

SEQ ID NO: 1519111 - RNA, 19 nt, Homo sapiens
caucuugccaucuuguaua

SEQ ID NO: 1519112 - RNA, 19 nt, Homo sapiens
gcucagucuuugaauaauc

SEQ ID NO: 1519113 - RNA, 19 nt, Homo sapiens
cugaagcguuccuuagaaa

SEQ ID NO: 1519114 - RNA, 19 nt, Homo sapiens
uugcaaauguaccuuaaga

SEQ ID NO: 1519115 - RNA, 19 nt, Homo sapiens
uugaagcuuugccauuaua

SEQ ID NO: 1519116 - RNA, 19 nt, Homo sapiens
gcccaaagcacccuagugu

SEQ ID NO: 1519117 - RNA, 19 nt, Homo sapiens
gagauuggaguaccuggaa

SEQ ID NO: 1519118 - RNA, 19 nt, Homo sapiens
gauguggcuugcuuagguu

SEQ ID NO: 1519119 - RNA, 19 nt, Homo sapiens
gcaaugaaaagaaacagua

SEQ ID NO: 1519120 - RNA, 19 nt, Homo sapiens
gaacaagcugaacauuuua

SEQ ID NO: 1519121 - RNA, 19 nt, Homo sapiens
ugaagcacuugcaacuuug

SEQ ID NO: 1519122 - RNA, 19 nt, Homo sapiens
gaaguuuggcaaugcagaa

SEQ ID NO: 1519123 - RNA, 19 nt, Homo sapiens
guguauacgugcaguggaa

SEQ ID NO: 1519124 - RNA, 19 nt, Homo sapiens
gcugaguuauuggcaguuu

SEQ ID NO: 1519125 - RNA, 19 nt, Homo sapiens
aaacaggcguuggaaaucu

SEQ ID NO: 1519126 - RNA, 19 nt, Homo sapiens
ucaaguggagacacguuua

SEQ ID NO: 1519127 - RNA, 19 nt, Homo sapiens
ggaaauaaaagaagcagaa

SEQ ID NO: 1519128 - RNA, 19 nt, Homo sapiens
guugaagcuuugccauuau

SEQ ID NO: 1519129 - RNA, 19 nt, Homo sapiens
gaacugauggaacucuauc

SEQ ID NO: 1519130 - RNA, 19 nt, Homo sapiens
cagaacugauggaacucua

SEQ ID NO: 1519131 - RNA, 19 nt, Homo sapiens
ucugaagcguuccuuagaa

SEQ ID NO: 1519132 - RNA, 19 nt, Homo sapiens
uggcaaaugauguggauaa

SEQ ID NO: 1519133 - RNA, 19 nt, Homo sapiens
gggaaacagugagauugga

SEQ ID NO: 1519134 - RNA, 19 nt, Homo sapiens
aauagcagcaguuagaauu

SEQ ID NO: 1519135 - RNA, 19 nt, Homo sapiens
ugauguggauaaagagcua

SEQ ID NO: 1519136 - RNA, 19 nt, Homo sapiens
uggcagcucuaugcaauga

SEQ ID NO: 1519137 - RNA, 19 nt, Homo sapiens
guagacgggcuuuacaguu

SEQ ID NO: 1519138 - RNA, 19 nt, Homo sapiens
gcaaugcagaacaacugua

SEQ ID NO: 1519139 - RNA, 19 nt, Homo sapiens
caaaagggcaauggaaaua

SEQ ID NO: 1519140 - RNA, 19 nt, Homo sapiens
uguaugaauuggcuguuga

SEQ ID NO: 1519141 - RNA, 19 nt, Homo sapiens
gcuguaccuuuguaugaau

SEQ ID NO: 1519142 - RNA, 19 nt, Homo sapiens
aagcguuccuuagaaauga

SEQ ID NO: 1519143 - RNA, 19 nt, Homo sapiens
uugcuuagguuucaacauc

SEQ ID NO: 1519144 - RNA, 19 nt, Homo sapiens
uggaagaaguuuggcaaug

SEQ ID NO: 1519145 - RNA, 19 nt, Homo sapiens
gugcaauggcaacagaaua

SEQ ID NO: 1519146 - RNA, 19 nt, Homo sapiens
gggacacuuugcugaguug

SEQ ID NO: 1519147 - RNA, 19 nt, Homo sapiens
guucucuacuaucuucaaa

SEQ ID NO: 1519148 - RNA, 19 nt, Homo sapiens
gaaggcaucucaaauuauu

SEQ ID NO: 1519149 - RNA, 19 nt, Homo sapiens
ggagaugucugacuagaaa

SEQ ID NO: 1519150 - RNA, 19 nt, Homo sapiens
gaaagacucuccaggaaau

SEQ ID NO: 1519151 - RNA, 19 nt, Homo sapiens
uagaaggcaucucaaauua

SEQ ID NO: 1519152 - RNA, 19 nt, Homo sapiens
caacgucucucaccacauu

SEQ ID NO: 1519153 - RNA, 19 nt, Homo sapiens
cuuaagaacuucagaauug

SEQ ID NO: 1519154 - RNA, 19 nt, Homo sapiens
ggaauaagcacaugaugga

SEQ ID NO: 1519155 - RNA, 19 nt, Homo sapiens
ugacaacuguuucuuucua

SEQ ID NO: 1519156 - RNA, 19 nt, Homo sapiens
gagcacaacuggacuuucu

SEQ ID NO: 1519157 - RNA, 19 nt, Homo sapiens
caacuaaccaucaccacua

SEQ ID NO: 1519158 - RNA, 19 nt, Homo sapiens
ucaaugauccuaagccuuu

SEQ ID NO: 1519159 - RNA, 19 nt, Homo sapiens
ggaaagacucuccaggaaa

SEQ ID NO: 1519160 - RNA, 19 nt, Homo sapiens
cccaguggcugucaucaua

SEQ ID NO: 1519161 - RNA, 19 nt, Homo sapiens
aaauguagguggacacuug

SEQ ID NO: 1519162 - RNA, 19 nt, Homo sapiens
ccauggagaugucugacua

SEQ ID NO: 1519163 - RNA, 19 nt, Homo sapiens
cucggaagcuuucuaagua

SEQ ID NO: 1519164 - RNA, 19 nt, Homo sapiens
gauauguccucaacuucuu

SEQ ID NO: 1519165 - RNA, 19 nt, Homo sapiens
gaaagaauaagcagaguac

SEQ ID NO: 1519166 - RNA, 19 nt, Homo sapiens
gaaauggaagauacugauu

SEQ ID NO: 1519167 - RNA, 19 nt, Homo sapiens
gaagacagacgacugaucu

SEQ ID NO: 1519168 - RNA, 19 nt, Homo sapiens
cuagaaggcaucucaaauu

SEQ ID NO: 1519169 - RNA, 19 nt, Homo sapiens
gcaguauaauucccaagug

SEQ ID NO: 1519170 - RNA, 19 nt, Homo sapiens
gucccuaacucaacuagaa

SEQ ID NO: 1519171 - RNA, 19 nt, Homo sapiens
uaugacaacuguuucuuuc

SEQ ID NO: 1519172 - RNA, 19 nt, Homo sapiens
uaaggaauuugaucugcuu

SEQ ID NO: 1519173 - RNA, 19 nt, Homo sapiens
gcaugugccuguucagagu

SEQ ID NO: 1519174 - RNA, 19 nt, Homo sapiens
ccucaaggcaauuacuuua

SEQ ID NO: 1519175 - RNA, 19 nt, Homo sapiens
gaaaacuguuccaaucauu

SEQ ID NO: 1519176 - RNA, 19 nt, Homo sapiens
gaaggaaguuuugugcuuu

SEQ ID NO: 1519177 - RNA, 19 nt, Homo sapiens
gacaacuguuucuuucuau

SEQ ID NO: 1519178 - RNA, 19 nt, Homo sapiens
gcagugaggaccagaagga

SEQ ID NO: 1519179 - RNA, 19 nt, Homo sapiens
ggaaauggaagauacugau

SEQ ID NO: 1519180 - RNA, 19 nt, Homo sapiens
guacucggaagcuuucuaa

SEQ ID NO: 1519181 - RNA, 19 nt, Homo sapiens
ucaccacauugacgcguua

SEQ ID NO: 1519182 - RNA, 19 nt, Homo sapiens
ccugaaaccugggcucuug

SEQ ID NO: 1519183 - RNA, 19 nt, Homo sapiens
ggcagacuccuccauguuu

SEQ ID NO: 1519184 - RNA, 19 nt, Homo sapiens
guagguggacacuuguaua

SEQ ID NO: 1519185 - RNA, 19 nt, Homo sapiens
caccaggaaguuucucuua

SEQ ID NO: 1519186 - RNA, 19 nt, Homo sapiens
caaggaaccaaauaucugu

SEQ ID NO: 1519187 - RNA, 19 nt, Homo sapiens
guacucaugaugccuuuga

SEQ ID NO: 1519188 - RNA, 19 nt, Homo sapiens
ccaggaaguuucucuuagg

SEQ ID NO: 1519189 - RNA, 19 nt, Homo sapiens
caguauaauucccaagugu

SEQ ID NO: 1519190 - RNA, 19 nt, Homo sapiens
aaaugucccugugguagaa

SEQ ID NO: 1519191 - RNA, 19 nt, Homo sapiens
ugaaagaauaagcagagua

SEQ ID NO: 1519192 - RNA, 19 nt, Homo sapiens
gaacuucagaauugaccuu

SEQ ID NO: 1519193 - RNA, 19 nt, Homo sapiens
cuuuaugccuggugcagua

SEQ ID NO: 1519194 - RNA, 19 nt, Homo sapiens
gaguacucaugaugccuuu

SEQ ID NO: 1519195 - RNA, 19 nt, Homo sapiens
gcacaacuggacuuucugu

SEQ ID NO: 1519196 - RNA, 19 nt, Homo sapiens
caccugauggaauacauua

SEQ ID NO: 1519197 - RNA, 19 nt, Homo sapiens
gauuaucaccaggaaguuu

SEQ ID NO: 1519198 - RNA, 19 nt, Homo sapiens
caccagagacugccagguu

SEQ ID NO: 1519199 - RNA, 19 nt, Homo sapiens
gaucgagauggaccucuuu

SEQ ID NO: 1519200 - RNA, 19 nt, Homo sapiens
uggagcagauggauaaugg

SEQ ID NO: 1519201 - RNA, 19 nt, Homo sapiens
agauugagcccuugauuca

SEQ ID NO: 1519202 - RNA, 19 nt, Homo sapiens
gguagaaaacuuacucuuu

SEQ ID NO: 1519203 - RNA, 19 nt, Homo sapiens
agaauaagcagaguacuca

SEQ ID NO: 1519204 - RNA, 19 nt, Homo sapiens
gcagacuccuccauguuuu

SEQ ID NO: 1519205 - RNA, 19 nt, Homo sapiens
caaguggaauaagcacaug

SEQ ID NO: 1519206 - RNA, 19 nt, Homo sapiens
ugaccuuaccguuggauuu

SEQ ID NO: 1519207 - RNA, 19 nt, Homo sapiens
guaugcaugugccuguuca

SEQ ID NO: 1519208 - RNA, 19 nt, Homo sapiens
cacuggagcagauggauaa

SEQ ID NO: 1519209 - RNA, 19 nt, Homo sapiens
ucaaggaaccaaauaucug

SEQ ID NO: 1519210 - RNA, 19 nt, Homo sapiens
ucaugaugccuuugagaaa

SEQ ID NO: 1519211 - RNA, 19 nt, Homo sapiens
ggaagacagacgacugauc

SEQ ID NO: 1519212 - RNA, 19 nt, Homo sapiens
gguccauuccuuacuagaa

SEQ ID NO: 1519213 - RNA, 19 nt, Homo sapiens
aacuaaccaucaccacuaa

SEQ ID NO: 1519214 - RNA, 19 nt, Homo sapiens
uccgauauguccucaacuu

SEQ ID NO: 1519215 - RNA, 19 nt, Homo sapiens
guccauuccuuacuagaag

SEQ ID NO: 1519216 - RNA, 19 nt, Homo sapiens
guuguggagcugucuagua

SEQ ID NO: 1519217 - RNA, 19 nt, Homo sapiens
ccagauugagcccuugauu

SEQ ID NO: 1519218 - RNA, 19 nt, Homo sapiens
uaugccuggugcaguauaa

SEQ ID NO: 1519219 - RNA, 19 nt, Homo sapiens
aaauaucuguagccaugga

SEQ ID NO: 1519220 - RNA, 19 nt, Homo sapiens
guucagagucuccagauac

SEQ ID NO: 1519221 - RNA, 19 nt, Homo sapiens
ucacuggagcagauggaua

SEQ ID NO: 1519222 - RNA, 19 nt, Homo sapiens
acgcaucacuggagcagau

SEQ ID NO: 1519223 - RNA, 19 nt, Homo sapiens
gaaguuguggagcugucua

SEQ ID NO: 1519224 - RNA, 19 nt, Homo sapiens
gauccuaagccuuuguauc

SEQ ID NO: 1519225 - RNA, 19 nt, Homo sapiens
gaguaugcaugugccuguu

SEQ ID NO: 1519226 - RNA, 19 nt, Homo sapiens
accagagacugccagguuu

SEQ ID NO: 1519227 - RNA, 19 nt, Homo sapiens
uaacgcaacuaaccaucac

SEQ ID NO: 1519228 - RNA, 19 nt, Homo sapiens
gagacccucaaggcaauua

SEQ ID NO: 1519229 - RNA, 19 nt, Homo sapiens
agaugucugacuagaaaua

SEQ ID NO: 1519230 - RNA, 19 nt, Homo sapiens
gagcuuuucuuauuacagu

SEQ ID NO: 1519231 - RNA, 19 nt, Homo sapiens
ucgagacccucaaggcaau

SEQ ID NO: 1519232 - RNA, 19 nt, Homo sapiens
auaagcagaguacucauga

SEQ ID NO: 1519233 - RNA, 19 nt, Homo sapiens
gauucagugucucaaugau

SEQ ID NO: 1519234 - RNA, 19 nt, Homo sapiens
cagauugagcccuugauuc

SEQ ID NO: 1519235 - RNA, 19 nt, Homo sapiens
guauaauucccaaguguac

SEQ ID NO: 1519236 - RNA, 19 nt, Homo sapiens
acaacuguuucuuucuaug

SEQ ID NO: 1519237 - RNA, 19 nt, Homo sapiens
caugaugccuuugagaaaa

SEQ ID NO: 1519238 - RNA, 19 nt, Homo sapiens
aagcagaguacucaugaug

SEQ ID NO: 1519239 - RNA, 19 nt, Homo sapiens
cugauggaauacauuacaa

SEQ ID NO: 1519240 - RNA, 19 nt, Homo sapiens
agaaggcaucucaaauuau

SEQ ID NO: 1519241 - RNA, 19 nt, Homo sapiens
ugaucgagauggaccucuu

SEQ ID NO: 1519242 - RNA, 19 nt, Homo sapiens
ccaguggcugucaucauaa

SEQ ID NO: 1519243 - RNA, 19 nt, Homo sapiens
gaugucugacuagaaauau

SEQ ID NO: 1519244 - RNA, 19 nt, Homo sapiens
caucauaacgcaacuaacc

SEQ ID NO: 1519245 - RNA, 19 nt, Homo sapiens
guggagcugucuaguacuc

SEQ ID NO: 1519246 - RNA, 19 nt, Homo sapiens
uaagcagaguacucaugau

SEQ ID NO: 1519247 - RNA, 19 nt, Homo sapiens
gagacugccagguuuccuu

SEQ ID NO: 1519248 - RNA, 19 nt, Homo sapiens
gaacaagaauguaagaaga

SEQ ID NO: 1519249 - RNA, 19 nt, Homo sapiens
gaacgaaacugacgucuac

SEQ ID NO: 1519250 - RNA, 19 nt, Homo sapiens
gaaacagucuuccaaccua

SEQ ID NO: 1519251 - RNA, 19 nt, Homo sapiens
gaacguaguuguuguugau

SEQ ID NO: 1519252 - RNA, 19 nt, Homo sapiens
gauaguggaugaagaaaga

SEQ ID NO: 1519253 - RNA, 19 nt, Homo sapiens
ggacacauggccauaaaua

SEQ ID NO: 1519254 - RNA, 19 nt, Homo sapiens
ggagaaggaucacuuuaca

SEQ ID NO: 1519255 - RNA, 19 nt, Homo sapiens
ccacauaucuggguuuguu

SEQ ID NO: 1519256 - RNA, 19 nt, Homo sapiens
ucgaggagcuacaacuuua

SEQ ID NO: 1519257 - RNA, 19 nt, Homo sapiens
gggauggacugacagcuaa

SEQ ID NO: 1519258 - RNA, 19 nt, Homo sapiens
cauuugggcuuaucuaauu

SEQ ID NO: 1519259 - RNA, 19 nt, Homo sapiens
agagagagcugcaccauca

SEQ ID NO: 1519260 - RNA, 19 nt, Homo sapiens
gcccagaguugcaguugua

SEQ ID NO: 1519261 - RNA, 19 nt, Homo sapiens
ggacauuaccaucaaauug

SEQ ID NO: 1519262 - RNA, 19 nt, Homo sapiens
ucagaaauaucaccaagug

SEQ ID NO: 1519263 - RNA, 19 nt, Homo sapiens
cgaaguaaaucauucuugu

SEQ ID NO: 1519264 - RNA, 19 nt, Homo sapiens
aagcaacccuuaagaaaug

SEQ ID NO: 1519265 - RNA, 19 nt, Homo sapiens
gggcuuaucuaauuugcaa

SEQ ID NO: 1519266 - RNA, 19 nt, Homo sapiens
gaaaaugcguagauacaaa

SEQ ID NO: 1519267 - RNA, 19 nt, Homo sapiens
gguaugaucuuguccugau

SEQ ID NO: 1519268 - RNA, 19 nt, Homo sapiens
cacacgaucucuccaguuu

SEQ ID NO: 1519269 - RNA, 19 nt, Homo sapiens
guaccugucuucccugaga

SEQ ID NO: 1519270 - RNA, 19 nt, Homo sapiens
gagcuucucuugaugacau

SEQ ID NO: 1519271 - RNA, 19 nt, Homo sapiens
gaucuuguccugauggaaa

SEQ ID NO: 1519272 - RNA, 19 nt, Homo sapiens
gcaauuuccuugauguucu

SEQ ID NO: 1519273 - RNA, 19 nt, Homo sapiens
cugcauguaucauuacuuu

SEQ ID NO: 1519274 - RNA, 19 nt, Homo sapiens
ggaaagauccuccaaugac

SEQ ID NO: 1519275 - RNA, 19 nt, Homo sapiens
agaaacauguccuucauuc

SEQ ID NO: 1519276 - RNA, 19 nt, Homo sapiens
ggagaggccucagcugugu

SEQ ID NO: 1519277 - RNA, 19 nt, Homo sapiens
ggaauuuauugaccagaug

SEQ ID NO: 1519278 - RNA, 19 nt, Homo sapiens
ggacucaacucugcauucu

SEQ ID NO: 1519279 - RNA, 19 nt, Homo sapiens
gagccucucucuaucaaca

SEQ ID NO: 1519280 - RNA, 19 nt, Homo sapiens
uaaaguggcugcaauuucc

SEQ ID NO: 1519281 - RNA, 19 nt, Homo sapiens
gauaaaguggcugcaauuu

SEQ ID NO: 1519282 - RNA, 19 nt, Homo sapiens
ggauaaaguggcugcaauu

SEQ ID NO: 1519283 - RNA, 19 nt, Homo sapiens
gagucuacuugcaagauuu

SEQ ID NO: 1519284 - RNA, 19 nt, Homo sapiens
gaacccaccacauuucaga

SEQ ID NO: 1519285 - RNA, 19 nt, Homo sapiens
ggagcuacaacuuuaauau

SEQ ID NO: 1519286 - RNA, 19 nt, Homo sapiens
caggacacauggccauaaa

SEQ ID NO: 1519287 - RNA, 19 nt, Homo sapiens
uuggauggaugacuuagua

SEQ ID NO: 1519288 - RNA, 19 nt, Homo sapiens
cacauggccauaaauaaua

SEQ ID NO: 1519289 - RNA, 19 nt, Homo sapiens
gcauguaucauuacuuugu

SEQ ID NO: 1519290 - RNA, 19 nt, Homo sapiens
cauucugcauguaucauua

SEQ ID NO: 1519291 - RNA, 19 nt, Homo sapiens
cagauuagaucccagugau

SEQ ID NO: 1519292 - RNA, 19 nt, Homo sapiens
ggccauaaauaauagaaag

SEQ ID NO: 1519293 - RNA, 19 nt, Homo sapiens
ggaacgaaacugacgucua

SEQ ID NO: 1519294 - RNA, 19 nt, Homo sapiens
ugacgaaggcauucuuuga

SEQ ID NO: 1519295 - RNA, 19 nt, Homo sapiens
caccucaccuuucugcaaa

SEQ ID NO: 1519296 - RNA, 19 nt, Homo sapiens
ggaacaagaauguaagaag

SEQ ID NO: 1519297 - RNA, 19 nt, Homo sapiens
acaaggagccauuaggaaa

SEQ ID NO: 1519298 - RNA, 19 nt, Homo sapiens
uaaaggguuugcucucugu

SEQ ID NO: 1519299 - RNA, 19 nt, Homo sapiens
gggaaagauccuccaauga

SEQ ID NO: 1519300 - RNA, 19 nt, Homo sapiens
ugggaggauuucaguauuu

SEQ ID NO: 1519301 - RNA, 19 nt, Homo sapiens
ggagagauguacgauggau

SEQ ID NO: 1519302 - RNA, 19 nt, Homo sapiens
uuugggaacuugaauguga

SEQ ID NO: 1519303 - RNA, 19 nt, Homo sapiens
gcucagggaaggcaagaaa

SEQ ID NO: 1519304 - RNA, 19 nt, Homo sapiens
acacauggccauaaauaau

SEQ ID NO: 1519305 - RNA, 19 nt, Homo sapiens
gguacaagcucaggauucu

SEQ ID NO: 1519306 - RNA, 19 nt, Homo sapiens
uggaggagcuggaggagau

SEQ ID NO: 1519307 - RNA, 19 nt, Homo sapiens
gaaguaaaucauucuugug

SEQ ID NO: 1519308 - RNA, 19 nt, Homo sapiens
gacacauggccauaaauaa

SEQ ID NO: 1519309 - RNA, 19 nt, Homo sapiens
gauguucucuacaggaucu

SEQ ID NO: 1519310 - RNA, 19 nt, Homo sapiens
gagagcccauucugcaugu

SEQ ID NO: 1519311 - RNA, 19 nt, Homo sapiens
caaccuggcugccccaaaa

SEQ ID NO: 1519312 - RNA, 19 nt, Homo sapiens
gagauucuacuuauucauc

SEQ ID NO: 1519313 - RNA, 19 nt, Homo sapiens
gccauggucuugaaggaau

SEQ ID NO: 1519314 - RNA, 19 nt, Homo sapiens
ggaaggagccccuaacuag

SEQ ID NO: 1519315 - RNA, 19 nt, Homo sapiens
uuaagccucugcgaaguaa

SEQ ID NO: 1519316 - RNA, 19 nt, Homo sapiens
ugagucuacuugcaagauu

SEQ ID NO: 1519317 - RNA, 19 nt, Homo sapiens
cuacccaaauggaggauug

SEQ ID NO: 1519318 - RNA, 19 nt, Homo sapiens
gaccagauguuggcagaag

SEQ ID NO: 1519319 - RNA, 19 nt, Homo sapiens
gaaacauguccuucauuca

SEQ ID NO: 1519320 - RNA, 19 nt, Homo sapiens
cuagauaguggaugaagaa

SEQ ID NO: 1519321 - RNA, 19 nt, Homo sapiens
aaacagucuuccaaccuau

SEQ ID NO: 1519322 - RNA, 19 nt, Homo sapiens
acccaugccucuaguaaga

SEQ ID NO: 1519323 - RNA, 19 nt, Homo sapiens
gacaugaacguaguuguug

SEQ ID NO: 1519324 - RNA, 19 nt, Homo sapiens
ggauggaugacuuaguaaa

SEQ ID NO: 1519325 - RNA, 19 nt, Homo sapiens
gguacgggacuaaauguga

SEQ ID NO: 1519326 - RNA, 19 nt, Homo sapiens
aaacugacgucuaccucau

SEQ ID NO: 1519327 - RNA, 19 nt, Homo sapiens
guuccgaccugucaauucu

SEQ ID NO: 1519328 - RNA, 19 nt, Homo sapiens
cuaccaggauuauaggaau

SEQ ID NO: 1519329 - RNA, 19 nt, Homo sapiens
ucaccaggcugagcuuuca

SEQ ID NO: 1519330 - RNA, 19 nt, Homo sapiens
ggucuugaaggaauuuauu

SEQ ID NO: 1519331 - RNA, 19 nt, Homo sapiens
uagaagggaacgaaacuga

SEQ ID NO: 1519332 - RNA, 19 nt, Homo sapiens
guugagauucuacuuauuc

SEQ ID NO: 1519333 - RNA, 19 nt, Homo sapiens
ucuacaggaucucuaauag

SEQ ID NO: 1519334 - RNA, 19 nt, Homo sapiens
ucaugaacccaccacauuu

SEQ ID NO: 1519335 - RNA, 19 nt, Homo sapiens
aaacaccacagaauccaaa

SEQ ID NO: 1519336 - RNA, 19 nt, Homo sapiens
gcagaagaaacauguccuu

SEQ ID NO: 1519337 - RNA, 19 nt, Homo sapiens
ggggaaagauccuccaaug

SEQ ID NO: 1519338 - RNA, 19 nt, Homo sapiens
ucucuaaagugcuguugga

SEQ ID NO: 1519339 - RNA, 19 nt, Homo sapiens
aucaagaucuggauaaagu

SEQ ID NO: 1519340 - RNA, 19 nt, Homo sapiens
gaaggcauucuuugacaca

SEQ ID NO: 1519341 - RNA, 19 nt, Homo sapiens
caagaaaaccaccuucauu

SEQ ID NO: 1519342 - RNA, 19 nt, Homo sapiens
gaaacaccacagaauccaa

SEQ ID NO: 1519343 - RNA, 19 nt, Homo sapiens
caagaucagacgcagaaga

SEQ ID NO: 1519344 - RNA, 19 nt, Homo sapiens
agacaugaacguaguuguu

SEQ ID NO: 1519345 - RNA, 19 nt, Homo sapiens
gaagacaugaacguaguug

SEQ ID NO: 1519346 - RNA, 19 nt, Homo sapiens
cuagggcaagucagaaaua

SEQ ID NO: 1519347 - RNA, 19 nt, Homo sapiens
gaucucuccaguuuccaua

SEQ ID NO: 1519348 - RNA, 19 nt, Homo sapiens
ggaaacagcuuguguacua

SEQ ID NO: 1519349 - RNA, 19 nt, Homo sapiens
ggaccugacuugauaauua

SEQ ID NO: 1519350 - RNA, 19 nt, Homo sapiens
gcacuucucuugcacuuaa

SEQ ID NO: 1519351 - RNA, 19 nt, Homo sapiens
caacagacaugugcuagua

SEQ ID NO: 1519352 - RNA, 19 nt, Homo sapiens
ggaaucagcuaaugguaaa

SEQ ID NO: 1519353 - RNA, 19 nt, Homo sapiens
guaauagcguuguucuuua

SEQ ID NO: 1519354 - RNA, 19 nt, Homo sapiens
ggacucagcacuuucuuua

SEQ ID NO: 1519355 - RNA, 19 nt, Homo sapiens
gaugugaucucauaaacaa

SEQ ID NO: 1519356 - RNA, 19 nt, Homo sapiens
agaaggagcuuuaggagaa

SEQ ID NO: 1519357 - RNA, 19 nt, Homo sapiens
gguagaaccacuuaauaua

SEQ ID NO: 1519358 - RNA, 19 nt, Homo sapiens
uggaggaguucucuuaaua

SEQ ID NO: 1519359 - RNA, 19 nt, Homo sapiens
agaauacccugaagaugua

SEQ ID NO: 1519360 - RNA, 19 nt, Homo sapiens
gacaugaacuauacaaaca

SEQ ID NO: 1519361 - RNA, 19 nt, Homo sapiens
ggacuucuaggaauuuaua

SEQ ID NO: 1519362 - RNA, 19 nt, Homo sapiens
cuacuggcuucauuuaaua

SEQ ID NO: 1519363 - RNA, 19 nt, Homo sapiens
gaaugucuaucucuggaaa

SEQ ID NO: 1519364 - RNA, 19 nt, Homo sapiens
gaagauuaauacucaagga

SEQ ID NO: 1519365 - RNA, 19 nt, Homo sapiens
gcgggagccugucagaaua

SEQ ID NO: 1519366 - RNA, 19 nt, Homo sapiens
gaaacagcuuguguacuaa

SEQ ID NO: 1519367 - RNA, 19 nt, Homo sapiens
ccaauggacucagcacuuu

SEQ ID NO: 1519368 - RNA, 19 nt, Homo sapiens
gcacuuucuuuacuauuug

SEQ ID NO: 1519369 - RNA, 19 nt, Homo sapiens
gaacaagagaaacaagaaa

SEQ ID NO: 1519370 - RNA, 19 nt, Homo sapiens
gcuacuggcuucauuuaau

SEQ ID NO: 1519371 - RNA, 19 nt, Homo sapiens
ggaccaaauuagcaagauu

SEQ ID NO: 1519372 - RNA, 19 nt, Homo sapiens
aggagaagcugaugucauu

SEQ ID NO: 1519373 - RNA, 19 nt, Homo sapiens
agagguggcugaaauguga

SEQ ID NO: 1519374 - RNA, 19 nt, Homo sapiens
agacuaacuucuagaugua

SEQ ID NO: 1519375 - RNA, 19 nt, Homo sapiens
caaaauacauucugugaga

SEQ ID NO: 1519376 - RNA, 19 nt, Homo sapiens
ggcaagauaaccauaauaa

SEQ ID NO: 1519377 - RNA, 19 nt, Homo sapiens
ucacuucccucccggcuuu

SEQ ID NO: 1519378 - RNA, 19 nt, Homo sapiens
gaaagaaaauugacaaguc

SEQ ID NO: 1519379 - RNA, 19 nt, Homo sapiens
gaaaugcuaagacauccua

SEQ ID NO: 1519380 - RNA, 19 nt, Homo sapiens
gguaauauuuguuguggau

SEQ ID NO: 1519381 - RNA, 19 nt, Homo sapiens
gacaugugcuaguaucuga

SEQ ID NO: 1519382 - RNA, 19 nt, Homo sapiens
gaacuauacaaacaggaua

SEQ ID NO: 1519383 - RNA, 19 nt, Homo sapiens
guauggaggaguucucuua

SEQ ID NO: 1519384 - RNA, 19 nt, Homo sapiens
gcugccaccugaaacauaa

SEQ ID NO: 1519385 - RNA, 19 nt, Homo sapiens
gaagagagaauggaagaga

SEQ ID NO: 1519386 - RNA, 19 nt, Homo sapiens
agucagcacuguauauauu

SEQ ID NO: 1519387 - RNA, 19 nt, Homo sapiens
gaggaguucucuuaauauc

SEQ ID NO: 1519388 - RNA, 19 nt, Homo sapiens
gaaagccuauauugguguu

SEQ ID NO: 1519389 - RNA, 19 nt, Homo sapiens
uaacagugaugcucaugau

SEQ ID NO: 1519390 - RNA, 19 nt, Homo sapiens
acacagcaguuaaagaaug

SEQ ID NO: 1519391 - RNA, 19 nt, Homo sapiens
ggagcaggcugaacucgau

SEQ ID NO: 1519392 - RNA, 19 nt, Homo sapiens
caaggaaaguuugaaguca

SEQ ID NO: 1519393 - RNA, 19 nt, Homo sapiens
gcauuugauuucagaucua

SEQ ID NO: 1519394 - RNA, 19 nt, Homo sapiens
ggaguucucuuaauaucag

SEQ ID NO: 1519395 - RNA, 19 nt, Homo sapiens
ggaacaagagaaacaagaa

SEQ ID NO: 1519396 - RNA, 19 nt, Homo sapiens
gcagcgugcucuugaggaa

SEQ ID NO: 1519397 - RNA, 19 nt, Homo sapiens
cagaauacccugaagaugu

SEQ ID NO: 1519398 - RNA, 19 nt, Homo sapiens
uuagcaagauuuacuguug

SEQ ID NO: 1519399 - RNA, 19 nt, Homo sapiens
gccaauagcaucuguaauc

SEQ ID NO: 1519400 - RNA, 19 nt, Homo sapiens
cguaacaaccuaaauuuga

SEQ ID NO: 1519401 - RNA, 19 nt, Homo sapiens
gaacugggacauucuucuu

SEQ ID NO: 1519402 - RNA, 19 nt, Homo sapiens
caagacguauggaggaguu

SEQ ID NO: 1519403 - RNA, 19 nt, Homo sapiens
guaacaaccuaaauuugag

SEQ ID NO: 1519404 - RNA, 19 nt, Homo sapiens
guagaaccacuuaauauag

SEQ ID NO: 1519405 - RNA, 19 nt, Homo sapiens
gaauuuggacuaguagaaa

SEQ ID NO: 1519406 - RNA, 19 nt, Homo sapiens
uagcaucuguaaucauuga

SEQ ID NO: 1519407 - RNA, 19 nt, Homo sapiens
ccaauagcaucuguaauca

SEQ ID NO: 1519408 - RNA, 19 nt, Homo sapiens
gaucaaggugcucccuaua

SEQ ID NO: 1519409 - RNA, 19 nt, Homo sapiens
uuacuaugcugaauccuau

SEQ ID NO: 1519410 - RNA, 19 nt, Homo sapiens
gaagcacaaugaccaguac

SEQ ID NO: 1519411 - RNA, 19 nt, Homo sapiens
agacuuugaugccuuaaau

SEQ ID NO: 1519412 - RNA, 19 nt, Homo sapiens
gagaagcugaugucauuga

SEQ ID NO: 1519413 - RNA, 19 nt, Homo sapiens
gaagaauuacuaugcugaa

SEQ ID NO: 1519414 - RNA, 19 nt, Homo sapiens
gaaucuggaagaauuacua

SEQ ID NO: 1519415 - RNA, 19 nt, Homo sapiens
ggaaauaccuuuuguaccu

SEQ ID NO: 1519416 - RNA, 19 nt, Homo sapiens
uguaauagcguuguucuuu

SEQ ID NO: 1519417 - RNA, 19 nt, Homo sapiens
ggaggaguucucuuaauau

SEQ ID NO: 1519418 - RNA, 19 nt, Homo sapiens
ggguagaaccacuuaauau

SEQ ID NO: 1519419 - RNA, 19 nt, Homo sapiens
gaaacaagaaagagcugaa

SEQ ID NO: 1519420 - RNA, 19 nt, Homo sapiens
gaaaagcaauacgaaaaga

SEQ ID NO: 1519421 - RNA, 19 nt, Homo sapiens
gaaaugugaugaaaagcaa

SEQ ID NO: 1519422 - RNA, 19 nt, Homo sapiens
guuagacacuuucagagau

SEQ ID NO: 1519423 - RNA, 19 nt, Homo sapiens
aaugauagcacuucucuug

SEQ ID NO: 1519424 - RNA, 19 nt, Homo sapiens
uagcaagauuuacuguuga

SEQ ID NO: 1519425 - RNA, 19 nt, Homo sapiens
agacagaccggccaucauu

SEQ ID NO: 1519426 - RNA, 19 nt, Homo sapiens
aagagacuuugaugccuua

SEQ ID NO: 1519427 - RNA, 19 nt, Homo sapiens
gaauuacuaugcugaaucc

SEQ ID NO: 1519428 - RNA, 19 nt, Homo sapiens
guauuuggcauuuagacua

SEQ ID NO: 1519429 - RNA, 19 nt, Homo sapiens
gaagcugcagugacucuuu

SEQ ID NO: 1519430 - RNA, 19 nt, Homo sapiens
uuauauggcuugagguaug

SEQ ID NO: 1519431 - RNA, 19 nt, Homo sapiens
gaccugacuugauaauuac

SEQ ID NO: 1519432 - RNA, 19 nt, Homo sapiens
ugacuugggagguggaaua

SEQ ID NO: 1519433 - RNA, 19 nt, Homo sapiens
ggugaaacacaucauaaug

SEQ ID NO: 1519434 - RNA, 19 nt, Homo sapiens
cacagcaguuaaagaauga

SEQ ID NO: 1519435 - RNA, 19 nt, Homo sapiens
caaaagaggcuaugucaga

SEQ ID NO: 1519436 - RNA, 19 nt, Homo sapiens
uauaccaccuuguuaagau

SEQ ID NO: 1519437 - RNA, 19 nt, Homo sapiens
cuugggagguggaauaaga

SEQ ID NO: 1519438 - RNA, 19 nt, Homo sapiens
caucguaauuugaccuaau

SEQ ID NO: 1519439 - RNA, 19 nt, Homo sapiens
gcguuguucuuuaagugua

SEQ ID NO: 1519440 - RNA, 19 nt, Homo sapiens
gaguugauuuacuuucaga

SEQ ID NO: 1519441 - RNA, 19 nt, Homo sapiens
gggacauucuucuuucuca

SEQ ID NO: 1519442 - RNA, 19 nt, Homo sapiens
ugacugugcuccugagagu

SEQ ID NO: 1519443 - RNA, 19 nt, Homo sapiens
gagcaugagcaaauagaga

SEQ ID NO: 1519444 - RNA, 19 nt, Homo sapiens
caucuguaaucauugagaa

SEQ ID NO: 1519445 - RNA, 19 nt, Homo sapiens
aguaguagauucucagauc

SEQ ID NO: 1519446 - RNA, 19 nt, Homo sapiens
gcacaaugaccaguacaug

SEQ ID NO: 1519447 - RNA, 19 nt, Homo sapiens
gggcaagauaaccauaaua

SEQ ID NO: 1519448 - RNA, 19 nt, Homo sapiens
gaaagaagcugcuguaaug

SEQ ID NO: 1519449 - RNA, 19 nt, Homo sapiens
ggagaaagcuagaguauuu

SEQ ID NO: 1519450 - RNA, 19 nt, Homo sapiens
ggaaagaggucauauuaau

SEQ ID NO: 1519451 - RNA, 19 nt, Homo sapiens
gcaauuccauguuuaagua

SEQ ID NO: 1519452 - RNA, 19 nt, Homo sapiens
gaacauugcuagaagaguu

SEQ ID NO: 1519453 - RNA, 19 nt, Homo sapiens
ggaaacacaucaaguacaa

SEQ ID NO: 1519454 - RNA, 19 nt, Homo sapiens
gaccacaacuucuucagua

SEQ ID NO: 1519455 - RNA, 19 nt, Homo sapiens
gaaauugacuuggagaaau

SEQ ID NO: 1519456 - RNA, 19 nt, Homo sapiens
uggcagaucuucauucuuu

SEQ ID NO: 1519457 - RNA, 19 nt, Homo sapiens
gaccagaauuagcaaauaa

SEQ ID NO: 1519458 - RNA, 19 nt, Homo sapiens
ggacucagcaucuuuauau

SEQ ID NO: 1519459 - RNA, 19 nt, Homo sapiens
gaagugcauugaagauaaa

SEQ ID NO: 1519460 - RNA, 19 nt, Homo sapiens
gaugaugccuuaaaacuua

SEQ ID NO: 1519461 - RNA, 19 nt, Homo sapiens
ucacuaaucuuggcuauau

SEQ ID NO: 1519462 - RNA, 19 nt, Homo sapiens
ugagaagaaucgaccuuua

SEQ ID NO: 1519463 - RNA, 19 nt, Homo sapiens
gcaguucuguuuauaagga

SEQ ID NO: 1519464 - RNA, 19 nt, Homo sapiens
gagaagaaucgaccuuuaa

SEQ ID NO: 1519465 - RNA, 19 nt, Homo sapiens
gaaagaagugcauugaaga

SEQ ID NO: 1519466 - RNA, 19 nt, Homo sapiens
gaaaggcaauguguuauac

SEQ ID NO: 1519467 - RNA, 19 nt, Homo sapiens
gaaccaugccuucagaauu

SEQ ID NO: 1519468 - RNA, 19 nt, Homo sapiens
gaagucaucaaucgaagua

SEQ ID NO: 1519469 - RNA, 19 nt, Homo sapiens
agaagugcauugaagauaa

SEQ ID NO: 1519470 - RNA, 19 nt, Homo sapiens
gggcugagauggaggauuc

SEQ ID NO: 1519471 - RNA, 19 nt, Homo sapiens
gugagaaggaugauuaaua

SEQ ID NO: 1519472 - RNA, 19 nt, Homo sapiens
gacaugauuuggauaguug

SEQ ID NO: 1519473 - RNA, 19 nt, Homo sapiens
gcaaauaaaguagacauga

SEQ ID NO: 1519474 - RNA, 19 nt, Homo sapiens
aaaggaaccuccacaagga

SEQ ID NO: 1519475 - RNA, 19 nt, Homo sapiens
agaaguagagagagaauua

SEQ ID NO: 1519476 - RNA, 19 nt, Homo sapiens
ugaaagaaguagagagaga

SEQ ID NO: 1519477 - RNA, 19 nt, Homo sapiens
agagaaaggcaauguguua

SEQ ID NO: 1519478 - RNA, 19 nt, Homo sapiens
ggaaguagcaggauauucu

SEQ ID NO: 1519479 - RNA, 19 nt, Homo sapiens
gcuaaauccucaucuguca

SEQ ID NO: 1519480 - RNA, 19 nt, Homo sapiens
guacuccaccuacucaaua

SEQ ID NO: 1519481 - RNA, 19 nt, Homo sapiens
gaaguccagugaugggaaa

SEQ ID NO: 1519482 - RNA, 19 nt, Homo sapiens
gagaugccuuugagaaaug

SEQ ID NO: 1519483 - RNA, 19 nt, Homo sapiens
cgaccagaauuagcaaaua

SEQ ID NO: 1519484 - RNA, 19 nt, Homo sapiens
aaacaacuuugcuuacgaa

SEQ ID NO: 1519485 - RNA, 19 nt, Homo sapiens
uaacuacuuugggacaaua

SEQ ID NO: 1519486 - RNA, 19 nt, Homo sapiens
ccaaacacuuaaagcaauu

SEQ ID NO: 1519487 - RNA, 19 nt, Homo sapiens
ggacuguuaggaugcauua

SEQ ID NO: 1519488 - RNA, 19 nt, Homo sapiens
cuauggagcuagcuuuaaa

SEQ ID NO: 1519489 - RNA, 19 nt, Homo sapiens
gcaaauaguauccaacaca

SEQ ID NO: 1519490 - RNA, 19 nt, Homo sapiens
ggugaaugccaaacacuua

SEQ ID NO: 1519491 - RNA, 19 nt, Homo sapiens
gcuccauacugcugagaua

SEQ ID NO: 1519492 - RNA, 19 nt, Homo sapiens
gaaacauucuugcuauaac

SEQ ID NO: 1519493 - RNA, 19 nt, Homo sapiens
gacuucagaucuauggaua

SEQ ID NO: 1519494 - RNA, 19 nt, Homo sapiens
gaagauagugaugguguaa

SEQ ID NO: 1519495 - RNA, 19 nt, Homo sapiens
caacaaugggcaauaugua

SEQ ID NO: 1519496 - RNA, 19 nt, Homo sapiens
gccaaacacuuaaagcaau

SEQ ID NO: 1519497 - RNA, 19 nt, Homo sapiens
agaaagaagugcauugaag

SEQ ID NO: 1519498 - RNA, 19 nt, Homo sapiens
guucaaggcugcagugagu

SEQ ID NO: 1519499 - RNA, 19 nt, Homo sapiens
caauugagcccaugaguuc

SEQ ID NO: 1519500 - RNA, 19 nt, Homo sapiens
aaauggaacugagaaggua

SEQ ID NO: 1519501 - RNA, 19 nt, Homo sapiens
caaagcagauuccaagacu

SEQ ID NO: 1519502 - RNA, 19 nt, Homo sapiens
gacaaauguugcagccuuu

SEQ ID NO: 1519503 - RNA, 19 nt, Homo sapiens
guuaaccgcugcugucaug

SEQ ID NO: 1519504 - RNA, 19 nt, Homo sapiens
uaaauccucaucugucaua

SEQ ID NO: 1519505 - RNA, 19 nt, Homo sapiens
auaaugauguggugacuga

SEQ ID NO: 1519506 - RNA, 19 nt, Homo sapiens
aaucaagggugaagguaaa

SEQ ID NO: 1519507 - RNA, 19 nt, Homo sapiens
gauugcaugugguaagaaa

SEQ ID NO: 1519508 - RNA, 19 nt, Homo sapiens
gaagguguuuucugguuua

SEQ ID NO: 1519509 - RNA, 19 nt, Homo sapiens
uaugugagaaggaugauua

SEQ ID NO: 1519510 - RNA, 19 nt, Homo sapiens
auaaacuucugccugaaua

SEQ ID NO: 1519511 - RNA, 19 nt, Homo sapiens
ugacguggauccagcaaau

SEQ ID NO: 1519512 - RNA, 19 nt, Homo sapiens
gaaucaagggugaagguaa

SEQ ID NO: 1519513 - RNA, 19 nt, Homo sapiens
gaaagaaguagagagagaa

SEQ ID NO: 1519514 - RNA, 19 nt, Homo sapiens
gaaauggaacugagaaggu

SEQ ID NO: 1519515 - RNA, 19 nt, Homo sapiens
uguggugacugacugcuua

SEQ ID NO: 1519516 - RNA, 19 nt, Homo sapiens
caaaggauugcauguggua

SEQ ID NO: 1519517 - RNA, 19 nt, Homo sapiens
cagcugagcaguuucacua

SEQ ID NO: 1519518 - RNA, 19 nt, Homo sapiens
uaaacaacuuugcuuacga

SEQ ID NO: 1519519 - RNA, 19 nt, Homo sapiens
uuggaaagaggucauauua

SEQ ID NO: 1519520 - RNA, 19 nt, Homo sapiens
aaccaugccuucagaauuc

SEQ ID NO: 1519521 - RNA, 19 nt, Homo sapiens
gaaguagagagagaauuaa

SEQ ID NO: 1519522 - RNA, 19 nt, Homo sapiens
ccuaggccaucuuaaacua

SEQ ID NO: 1519523 - RNA, 19 nt, Homo sapiens
gagggaugaugguaguuug

SEQ ID NO: 1519524 - RNA, 19 nt, Homo sapiens
ccacacaugguuuauuuga

SEQ ID NO: 1519525 - RNA, 19 nt, Homo sapiens
gagaaagcuagaguauuua

SEQ ID NO: 1519526 - RNA, 19 nt, Homo sapiens
gguggcaguucuguuuaua

SEQ ID NO: 1519527 - RNA, 19 nt, Homo sapiens
gcaauguguuauacuugga

SEQ ID NO: 1519528 - RNA, 19 nt, Homo sapiens
ucauugcuccagagaauua

SEQ ID NO: 1519529 - RNA, 19 nt, Homo sapiens
cagcagagaacuaaaggaa

SEQ ID NO: 1519530 - RNA, 19 nt, Homo sapiens
agaaaggcaauguguuaua

SEQ ID NO: 1519531 - RNA, 19 nt, Homo sapiens
gauggaggauucaauugag

SEQ ID NO: 1519532 - RNA, 19 nt, Homo sapiens
gaaaugaaagaaguagaga

SEQ ID NO: 1519533 - RNA, 19 nt, Homo sapiens
ugagaugccuuugagaaau

SEQ ID NO: 1519534 - RNA, 19 nt, Homo sapiens
agccacacaugguuuauuu

SEQ ID NO: 1519535 - RNA, 19 nt, Homo sapiens
gcugaaagaagcugcugua

SEQ ID NO: 1519536 - RNA, 19 nt, Homo sapiens
ggagaaauggaacugagaa

SEQ ID NO: 1519537 - RNA, 19 nt, Homo sapiens
ucaccuaggccaucuuaaa

SEQ ID NO: 1519538 - RNA, 19 nt, Homo sapiens
aaguuuggaugaugccuua

SEQ ID NO: 1519539 - RNA, 19 nt, Homo sapiens
cuguuaggaugcauuauaa

SEQ ID NO: 1519540 - RNA, 19 nt, Homo sapiens
ugaagauagugauggugua

SEQ ID NO: 1519541 - RNA, 19 nt, Homo sapiens
gaaguauggagaaauggaa

SEQ ID NO: 1519542 - RNA, 19 nt, Homo sapiens
ggucauaccagaagucauc

SEQ ID NO: 1519543 - RNA, 19 nt, Homo sapiens
cugagcaguuucacuagua

SEQ ID NO: 1519544 - RNA, 19 nt, Homo sapiens
ggaaguaagagcaucauac

SEQ ID NO: 1519545 - RNA, 19 nt, Homo sapiens
aaaugaaggcguacacaaa

SEQ ID NO: 1519546 - RNA, 19 nt, Homo sapiens
gggugaagguaaaauaaua

SEQ ID NO: 1519547 - RNA, 19 nt, Homo sapiens
gaacggugaaugccaaaca

SEQ ID NO: 1519548 - RNA, 19 nt, Homo sapiens
gaacaugggagccaaauuu

SEQ ID NO: 1519549 - RNA, 19 nt, Homo sapiens
ggucucaagugaugaauug

SEQ ID NO: 1519550 - RNA, 19 nt, Homo sapiens
ggacccagauaaagcuuga

SEQ ID NO: 1519551 - RNA, 19 nt, Homo sapiens
gaacuugcccucacuagca

SEQ ID NO: 1519552 - RNA, 19 nt, Homo sapiens
gaauugccaccuccucaua

SEQ ID NO: 1519553 - RNA, 19 nt, Homo sapiens
gcacagcucuauggaucaa

SEQ ID NO: 1519554 - RNA, 19 nt, Homo sapiens
ccacaagguuggguaugaa

SEQ ID NO: 1519555 - RNA, 19 nt, Homo sapiens
ugacugugcugacacgaau

SEQ ID NO: 1519556 - RNA, 19 nt, Homo sapiens
cgaauguacuaccgaagga

SEQ ID NO: 1519557 - RNA, 19 nt, Homo sapiens
gaaggaaagaccacaaggu

SEQ ID NO: 1519558 - RNA, 19 nt, Homo sapiens
ggccaacggugggcagauu

SEQ ID NO: 1519559 - RNA, 19 nt, Homo sapiens
aaccaggucucaagugaug

SEQ ID NO: 1519560 - RNA, 19 nt, Homo sapiens
cuacagcccuccaucuucu

SEQ ID NO: 1519561 - RNA, 19 nt, Homo sapiens
ucacuagcauccugaccuu

SEQ ID NO: 1519562 - RNA, 19 nt, Homo sapiens
gugggcagauugcuuguuc

SEQ ID NO: 1519563 - RNA, 19 nt, Homo sapiens
ggucaugguggaaggcuuu

SEQ ID NO: 1519564 - RNA, 19 nt, Homo sapiens
ggcggacucugcucuggaa

SEQ ID NO: 1519565 - RNA, 19 nt, Homo sapiens
ccgucuaccuguacaagaa

SEQ ID NO: 1519566 - RNA, 19 nt, Homo sapiens
aaggaaagaccacaagguu

SEQ ID NO: 1519567 - RNA, 19 nt, Homo sapiens
gggcaucauuucccgucaa

SEQ ID NO: 1519568 - RNA, 19 nt, Homo sapiens
aaaugaccaucaccucguu

SEQ ID NO: 1519569 - RNA, 19 nt, Homo sapiens
cucuauggaucaacacuuu

SEQ ID NO: 1519570 - RNA, 19 nt, Homo sapiens
gcagaacaugggagccaaa

SEQ ID NO: 1519571 - RNA, 19 nt, Homo sapiens
ucuaaugacugugcugaca

SEQ ID NO: 1519572 - RNA, 19 nt, Homo sapiens
aaaaccaggucucaaguga

SEQ ID NO: 1519573 - RNA, 19 nt, Homo sapiens
uggaggugcugaagaccaa

SEQ ID NO: 1519574 - RNA, 19 nt, Homo sapiens
gggcaggacccagauaaag

SEQ ID NO: 1519575 - RNA, 19 nt, Homo sapiens
gggcuccauugccaucuuc

SEQ ID NO: 1519576 - RNA, 19 nt, Homo sapiens
agccaaauuugcucuguuc

SEQ ID NO: 1519577 - RNA, 19 nt, Homo sapiens
aggaugccgucuaccugua

SEQ ID NO: 1519578 - RNA, 19 nt, Homo sapiens
accacaagguuggguauga

SEQ ID NO: 1519579 - RNA, 19 nt, Homo sapiens
gaauguacuaccgaaggaa

SEQ ID NO: 1519580 - RNA, 19 nt, Homo sapiens
gcaggacccagauaaagcu

SEQ ID NO: 1519581 - RNA, 19 nt, Homo sapiens
cauccugacugcccuacag

SEQ ID NO: 1519582 - RNA, 19 nt, Homo sapiens
cuuguucgccucccuauuc

SEQ ID NO: 1519583 - RNA, 19 nt, Homo sapiens
uccaauacgccuucuugaa

SEQ ID NO: 1519584 - RNA, 19 nt, Homo sapiens
guuccagguucuccucauc

SEQ ID NO: 1519585 - RNA, 19 nt, Homo sapiens
guacaagaacacccuuugc

SEQ ID NO: 1519586 - RNA, 19 nt, Homo sapiens
ccaggucucaagugaugaa

SEQ ID NO: 1519587 - RNA, 19 nt, Homo sapiens
gaggugcugaagaccaauu

SEQ ID NO: 1519588 - RNA, 19 nt, Homo sapiens
ggcaucauuucccgucaag

SEQ ID NO: 1519589 - RNA, 19 nt, Homo sapiens
acagcucuauggaucaaca

SEQ ID NO: 1519590 - RNA, 19 nt, Homo sapiens
ucugugcugugcugcuuug

SEQ ID NO: 1519591 - RNA, 19 nt, Homo sapiens
ccuggaggaugccgucuac

SEQ ID NO: 1519592 - RNA, 19 nt, Homo sapiens
aagcaaagcuggccucaug

SEQ ID NO: 1519593 - RNA, 19 nt, Homo sapiens
gaguuuggauguggaagua

SEQ ID NO: 1519594 - RNA, 19 nt, Homo sapiens
ucagcauccucaucuauaa

SEQ ID NO: 1519595 - RNA, 19 nt, Homo sapiens
gaaaccagccauguccuuu

SEQ ID NO: 1519596 - RNA, 19 nt, Homo sapiens
acacauaugcuuacaccua

SEQ ID NO: 1519597 - RNA, 19 nt, Homo sapiens
gagaugguaugguguaugc

SEQ ID NO: 1519598 - RNA, 19 nt, Homo sapiens
gaggaaugcuggcuuugag

SEQ ID NO: 1519599 - RNA, 19 nt, Homo sapiens
ggacacacauaugcuuaca

SEQ ID NO: 1519600 - RNA, 19 nt, Homo sapiens
ggacauggccucgcacaca

SEQ ID NO: 1519601 - RNA, 19 nt, Homo sapiens
ucccuggacuggucauaua

SEQ ID NO: 1519602 - RNA, 19 nt, Homo sapiens
gauaagagggcagacuuug

SEQ ID NO: 1519603 - RNA, 19 nt, Homo sapiens
ggauaagagggcagacuuu

SEQ ID NO: 1519604 - RNA, 19 nt, Homo sapiens
cgucgggacugcuggcuuu

SEQ ID NO: 1519605 - RNA, 19 nt, Homo sapiens
guggaggaaugcuggcuuu

SEQ ID NO: 1519606 - RNA, 19 nt, Homo sapiens
ggugagcacuugaaacacu

SEQ ID NO: 1519607 - RNA, 19 nt, Homo sapiens
ggaggaaugcuggcuuuga

SEQ ID NO: 1519608 - RNA, 19 nt, Homo sapiens
gaguucaaguggaggaaug

SEQ ID NO: 1519609 - RNA, 19 nt, Homo sapiens
uaucaccauucguucauga

SEQ ID NO: 1519610 - RNA, 19 nt, Homo sapiens
uaagagggcagacuuugug

SEQ ID NO: 1519611 - RNA, 19 nt, Homo sapiens
gcacaguggcacaccaaga

SEQ ID NO: 1519612 - RNA, 19 nt, Homo sapiens
ggacacagagagaauagag

SEQ ID NO: 1519613 - RNA, 19 nt, Homo sapiens
agaggcagcuauuucuaug

SEQ ID NO: 1519614 - RNA, 19 nt, Homo sapiens
guuuggauguggaaguaaa

SEQ ID NO: 1519615 - RNA, 19 nt, Homo sapiens
cuauuucuauggcuccuuu

SEQ ID NO: 1519616 - RNA, 19 nt, Homo sapiens
ggaaaccagccauguccuu

SEQ ID NO: 1519617 - RNA, 19 nt, Homo sapiens
gagggcagacuuugugguu

SEQ ID NO: 1519618 - RNA, 19 nt, Homo sapiens
gagagaugguaugguguau

SEQ ID NO: 1519619 - RNA, 19 nt, Homo sapiens
gcuuacaccuaccuuuauc

SEQ ID NO: 1519620 - RNA, 19 nt, Homo sapiens
gcaggacacacauaugcuu

SEQ ID NO: 1519621 - RNA, 19 nt, Homo sapiens
gacauggccucgcacacau

SEQ ID NO: 1519622 - RNA, 19 nt, Homo sapiens
gaaguaaaagugcugcuaa

SEQ ID NO: 1519623 - RNA, 19 nt, Homo sapiens
ccaguugccauuccugaaa

SEQ ID NO: 1519624 - RNA, 19 nt, Homo sapiens
caggacacacauaugcuua

SEQ ID NO: 1519625 - RNA, 19 nt, Homo sapiens
ccucuacacugcugguugu

SEQ ID NO: 1519626 - RNA, 19 nt, Homo sapiens
gagcgcaggaguucaagug

SEQ ID NO: 1519627 - RNA, 19 nt, Homo sapiens
ugucaacacuguggagaug

SEQ ID NO: 1519628 - RNA, 19 nt, Homo sapiens
gggauaagagggcagacuu

SEQ ID NO: 1519629 - RNA, 19 nt, Homo sapiens
gagagaauagagaggaugu

SEQ ID NO: 1519630 - RNA, 19 nt, Homo sapiens
gcacugugucugcgugaug

SEQ ID NO: 1519631 - RNA, 19 nt, Homo sapiens
ggagagcuuuagccuugca

SEQ ID NO: 1519632 - RNA, 19 nt, Homo sapiens
gcauccucaucuauaaaug

SEQ ID NO: 1519633 - RNA, 19 nt, Homo sapiens
cagaggcagcuauuucuau

SEQ ID NO: 1519634 - RNA, 19 nt, Homo sapiens
agagagaugguauggugua

SEQ ID NO: 1519635 - RNA, 19 nt, Homo sapiens
ccagaggcagcuauuucua

SEQ ID NO: 1519636 - RNA, 19 nt, Homo sapiens
agugaggccuacagucuga

SEQ ID NO: 1519637 - RNA, 19 nt, Homo sapiens
gcacgggaacaagaucuau

SEQ ID NO: 1519638 - RNA, 19 nt, Homo sapiens
cccgguagcugcuguagag

SEQ ID NO: 1519639 - RNA, 19 nt, Homo sapiens
ccagugaggccuacagucu

SEQ ID NO: 1519640 - RNA, 19 nt, Homo sapiens
gguugcaacuguggagaga

SEQ ID NO: 1519641 - RNA, 19 nt, Homo sapiens
cagagagaauagagaggau

SEQ ID NO: 1519642 - RNA, 19 nt, Homo sapiens
guuccuaucuggaguugac

SEQ ID NO: 1519643 - RNA, 19 nt, Homo sapiens
uugcaacuguggagagaga

SEQ ID NO: 1519644 - RNA, 19 nt, Homo sapiens
uguagaggccuuccugaug

SEQ ID NO: 1519645 - RNA, 19 nt, Homo sapiens
cagcauccucaucuauaaa

SEQ ID NO: 1519646 - RNA, 19 nt, Homo sapiens
augcuuacaccuaccuuua

SEQ ID NO: 1519647 - RNA, 19 nt, Homo sapiens
ccacuugccgggucuaugg

SEQ ID NO: 1519648 - RNA, 19 nt, Homo sapiens
gugaggacccagggaguuu

SEQ ID NO: 1519649 - RNA, 19 nt, Homo sapiens
ccuggacacugcugagaca

SEQ ID NO: 1519650 - RNA, 19 nt, Homo sapiens
aagcuggccucaugcucuu

SEQ ID NO: 1519651 - RNA, 19 nt, Homo sapiens
uaggggagccuuugucuuu

SEQ ID NO: 1519652 - RNA, 19 nt, Homo sapiens
gcuuugagcccucuacacu

SEQ ID NO: 1519653 - RNA, 19 nt, Homo sapiens
uacuaggccuuccauccaa

SEQ ID NO: 1519654 - RNA, 19 nt, Homo sapiens
aaaccagccauguccuuug

SEQ ID NO: 1519655 - RNA, 19 nt, Homo sapiens
ccagguacguguguaugag

SEQ ID NO: 1519656 - RNA, 19 nt, Homo sapiens
uaaaagugcugcuaaaacc

SEQ ID NO: 1519657 - RNA, 19 nt, Homo sapiens
gggagccuuugucuuuagu

SEQ ID NO: 1519658 - RNA, 19 nt, Homo sapiens
ggaguuuggauguggaagu

SEQ ID NO: 1519659 - RNA, 19 nt, Homo sapiens
cucagcauccucaucuaua

SEQ ID NO: 1519660 - RNA, 19 nt, Homo sapiens
ugucaugccuccccaguga

SEQ ID NO: 1519661 - RNA, 19 nt, Homo sapiens
ggaaauggggagaagcaaa

SEQ ID NO: 1519662 - RNA, 19 nt, Homo sapiens
acacuguggagauguuuga

SEQ ID NO: 1519663 - RNA, 19 nt, Homo sapiens
uaaauggggaucucugaaa

SEQ ID NO: 1519664 - RNA, 19 nt, Homo sapiens
ccucagcauccucaucuau

SEQ ID NO: 1519665 - RNA, 19 nt, Homo sapiens
gaccaggccuaccccaguu

SEQ ID NO: 1519666 - RNA, 19 nt, Homo sapiens
cagggucaguuccuaucug

SEQ ID NO: 1519667 - RNA, 19 nt, Homo sapiens
gcaacuguggagagagaug

SEQ ID NO: 1519668 - RNA, 19 nt, Homo sapiens
cuacuaggccuuccaucca

SEQ ID NO: 1519669 - RNA, 19 nt, Homo sapiens
uagaggccuuccugaugga

SEQ ID NO: 1519670 - RNA, 19 nt, Homo sapiens
cacaguggcacaccaagau

SEQ ID NO: 1519671 - RNA, 19 nt, Homo sapiens
gcaaagcuggccucaugcu

SEQ ID NO: 1519672 - RNA, 19 nt, Homo sapiens
gaaauggggagaagcaaag

SEQ ID NO: 1519673 - RNA, 19 nt, Homo sapiens
gugcaggacacacauaugc

SEQ ID NO: 1519674 - RNA, 19 nt, Homo sapiens
ggcccuggcagaaucaaga

SEQ ID NO: 1519675 - RNA, 19 nt, Homo sapiens
caaagacacucacaaugga

SEQ ID NO: 1519676 - RNA, 19 nt, Homo sapiens
ucacaaacaucgagguuau

SEQ ID NO: 1519677 - RNA, 19 nt, Homo sapiens
gcaaagacacucacaaugg

SEQ ID NO: 1519678 - RNA, 19 nt, Homo sapiens
gugcuuccauccugcauua

SEQ ID NO: 1519679 - RNA, 19 nt, Homo sapiens
caagagagaccaggaguuu

SEQ ID NO: 1519680 - RNA, 19 nt, Homo sapiens
ggacucaccuuggcacaug

SEQ ID NO: 1519681 - RNA, 19 nt, Homo sapiens
acaucgagguuauuaauug

SEQ ID NO: 1519682 - RNA, 19 nt, Homo sapiens
gcucacaccuccacagaag

SEQ ID NO: 1519683 - RNA, 19 nt, Homo sapiens
cauguucuguguuucagua

SEQ ID NO: 1519684 - RNA, 19 nt, Homo sapiens
acacagaagugcccgcuau

SEQ ID NO: 1519685 - RNA, 19 nt, Homo sapiens
guaaagagagaccugauca

SEQ ID NO: 1519686 - RNA, 19 nt, Homo sapiens
ccucagcccucucuguuga

SEQ ID NO: 1519687 - RNA, 19 nt, Homo sapiens
gacaccaaguuacgucaaa

SEQ ID NO: 1519688 - RNA, 19 nt, Homo sapiens
guuauuaauugcagcauca

SEQ ID NO: 1519689 - RNA, 19 nt, Homo sapiens
cuaagggccuguccucaga

SEQ ID NO: 1519690 - RNA, 19 nt, Homo sapiens
ggaaugaccacaguucaga

SEQ ID NO: 1519691 - RNA, 19 nt, Homo sapiens
cagcaucacagaaauagaa

SEQ ID NO: 1519692 - RNA, 19 nt, Homo sapiens
acaaacaucgagguuauua

SEQ ID NO: 1519693 - RNA, 19 nt, Homo sapiens
ucacagaaauagaaacaac

SEQ ID NO: 1519694 - RNA, 19 nt, Homo sapiens
gagcuggaaugaccacagu

SEQ ID NO: 1519695 - RNA, 19 nt, Homo sapiens
gcugagagguacccagaag

SEQ ID NO: 1519696 - RNA, 19 nt, Homo sapiens
cccagaagguucccaugaa

SEQ ID NO: 1519697 - RNA, 19 nt, Homo sapiens
gcgcugagaccucuucuag

SEQ ID NO: 1519698 - RNA, 19 nt, Homo sapiens
ccagaagguucccaugaag

SEQ ID NO: 1519699 - RNA, 19 nt, Homo sapiens
cagcgaagaccacgaugaa

SEQ ID NO: 1519700 - RNA, 19 nt, Homo sapiens
ucacuuccaggucuccuua

SEQ ID NO: 1519701 - RNA, 19 nt, Homo sapiens
acacaucacugaggucaca

SEQ ID NO: 1519702 - RNA, 19 nt, Homo sapiens
gaagaggcaaagacacuca

SEQ ID NO: 1519703 - RNA, 19 nt, Homo sapiens
gcaagagagaccaggaguu

SEQ ID NO: 1519704 - RNA, 19 nt, Homo sapiens
ccauggacaucgcaaccaa

SEQ ID NO: 1519705 - RNA, 19 nt, Homo sapiens
cagcuccggucuccauaga

SEQ ID NO: 1519706 - RNA, 19 nt, Homo sapiens
aaacaucucccaacuucau

SEQ ID NO: 1519707 - RNA, 19 nt, Homo sapiens
gaccaggaguuucacaaaa

SEQ ID NO: 1519708 - RNA, 19 nt, Homo sapiens
gaccugaucacccaucugu

SEQ ID NO: 1519709 - RNA, 19 nt, Homo sapiens
gacaacggacgacacagaa

SEQ ID NO: 1519710 - RNA, 19 nt, Homo sapiens
cugaagcccuggugacugu

SEQ ID NO: 1519711 - RNA, 19 nt, Homo sapiens
ucccagagguguccuugga

SEQ ID NO: 1519712 - RNA, 19 nt, Homo sapiens
ccaccggaguguauguaug

SEQ ID NO: 1519713 - RNA, 19 nt, Homo sapiens
caaacaucgagguuauuaa

SEQ ID NO: 1519714 - RNA, 19 nt, Homo sapiens
ugacaacggacgacacaga

SEQ ID NO: 1519715 - RNA, 19 nt, Homo sapiens
agacgugagugcaggugaa

SEQ ID NO: 1519716 - RNA, 19 nt, Homo sapiens
gaugacaacggacgacaca

SEQ ID NO: 1519717 - RNA, 19 nt, Homo sapiens
ggcaaagacacucacaaug

SEQ ID NO: 1519718 - RNA, 19 nt, Homo sapiens
agagagaccaggaguuuca

SEQ ID NO: 1519719 - RNA, 19 nt, Homo sapiens
caacggacgacacagaagu

SEQ ID NO: 1519720 - RNA, 19 nt, Homo sapiens
gcauuaaaauucacucagu

SEQ ID NO: 1519721 - RNA, 19 nt, Homo sapiens
guucuguguuucaguaaag

SEQ ID NO: 1519722 - RNA, 19 nt, Homo sapiens
caucacagaaauagaaaca

SEQ ID NO: 1519723 - RNA, 19 nt, Homo sapiens
gcaccgaugacagcucuga

SEQ ID NO: 1519724 - RNA, 19 nt, Homo sapiens
ugacuccacugaagcaaaa

SEQ ID NO: 1519725 - RNA, 19 nt, Homo sapiens
ccacgccgcucuggaaacu

SEQ ID NO: 1519726 - RNA, 19 nt, Homo sapiens
acagacugcagcugcguua

SEQ ID NO: 1519727 - RNA, 19 nt, Homo sapiens
gggaggggcuucaccuguu

SEQ ID NO: 1519728 - RNA, 19 nt, Homo sapiens
gcuuccauccugcauuaaa

SEQ ID NO: 1519729 - RNA, 19 nt, Homo sapiens
gacugcagcugcguuacug

SEQ ID NO: 1519730 - RNA, 19 nt, Homo sapiens
cagagacaccgaccaugga

SEQ ID NO: 1519731 - RNA, 19 nt, Homo sapiens
cuguugagacaccaaguua

SEQ ID NO: 1519732 - RNA, 19 nt, Homo sapiens
caaaaccacacaucacuga

SEQ ID NO: 1519733 - RNA, 19 nt, Homo sapiens
gagaccaggaguuucacaa

SEQ ID NO: 1519734 - RNA, 19 nt, Homo sapiens
ucacauccaccggagugua

SEQ ID NO: 1519735 - RNA, 19 nt, Homo sapiens
caucgagguuauuaauugc

SEQ ID NO: 1519736 - RNA, 19 nt, Homo sapiens
agaccaggaguuucacaaa

SEQ ID NO: 1519737 - RNA, 19 nt, Homo sapiens
ccugaucacccaucugugu

SEQ ID NO: 1519738 - RNA, 19 nt, Homo sapiens
gaauuuccccugcaagaga

SEQ ID NO: 1519739 - RNA, 19 nt, Homo sapiens
gagagguacccagaagguu

SEQ ID NO: 1519740 - RNA, 19 nt, Homo sapiens
guuacugugcugagaggua

SEQ ID NO: 1519741 - RNA, 19 nt, Homo sapiens
ggacgaacagcaccuuagc

SEQ ID NO: 1519742 - RNA, 19 nt, Homo sapiens
gggcaaaacaacuuccuuu

SEQ ID NO: 1519743 - RNA, 19 nt, Homo sapiens
gaagcaaaaccacacauca

SEQ ID NO: 1519744 - RNA, 19 nt, Homo sapiens
gcuggaaugaccacaguuc

SEQ ID NO: 1519745 - RNA, 19 nt, Homo sapiens
gagaccugaucacccaucu

SEQ ID NO: 1519746 - RNA, 19 nt, Homo sapiens
acaggacccucgcucacau

SEQ ID NO: 1519747 - RNA, 19 nt, Homo sapiens
gucacaaacaucgagguua

SEQ ID NO: 1519748 - RNA, 19 nt, Homo sapiens
aggcaaagacacucacaau

SEQ ID NO: 1519749 - RNA, 19 nt, Homo sapiens
ugaccacaguucagaccau

SEQ ID NO: 1519750 - RNA, 19 nt, Homo sapiens
guguuucaguaaagagaga

SEQ ID NO: 1519751 - RNA, 19 nt, Homo sapiens
aacagcaccuuagccaaga

SEQ ID NO: 1519752 - RNA, 19 nt, Homo sapiens
acagaagugcccgcuauga

SEQ ID NO: 1519753 - RNA, 19 nt, Homo sapiens
gggacgaacagcaccuuag

SEQ ID NO: 1519754 - RNA, 19 nt, Homo sapiens
guccucagcccucucuguu

SEQ ID NO: 1519755 - RNA, 19 nt, Homo sapiens
gagaauuuccccugcaaga

SEQ ID NO: 1519756 - RNA, 19 nt, Homo sapiens
aauugcagcaucacagaaa

SEQ ID NO: 1519757 - RNA, 19 nt, Homo sapiens
gacacucacaauggacaua

SEQ ID NO: 1519758 - RNA, 19 nt, Homo sapiens
gauaacgucuagugaauua

SEQ ID NO: 1519759 - RNA, 19 nt, Homo sapiens
ugaaagauguuaccagaua

SEQ ID NO: 1519760 - RNA, 19 nt, Homo sapiens
gaaagucuaugcugaaaug

SEQ ID NO: 1519761 - RNA, 19 nt, Homo sapiens
gaaacgagaugcacagguu

SEQ ID NO: 1519762 - RNA, 19 nt, Homo sapiens
ggagaagacgcaccuauua

SEQ ID NO: 1519763 - RNA, 19 nt, Homo sapiens
gaaagauguuaccagauaa

SEQ ID NO: 1519764 - RNA, 19 nt, Homo sapiens
gaaggaccaucuuguaaau

SEQ ID NO: 1519765 - RNA, 19 nt, Homo sapiens
aggaagaacugacuacaua

SEQ ID NO: 1519766 - RNA, 19 nt, Homo sapiens
aaagagagcuuccauccuu

SEQ ID NO: 1519767 - RNA, 19 nt, Homo sapiens
gagaagaagcagcugauua

SEQ ID NO: 1519768 - RNA, 19 nt, Homo sapiens
guaacacacugcauaaaga

SEQ ID NO: 1519769 - RNA, 19 nt, Homo sapiens
ggagaaaagucaucuaaaa

SEQ ID NO: 1519770 - RNA, 19 nt, Homo sapiens
caaaugugcgucugaauaa

SEQ ID NO: 1519771 - RNA, 19 nt, Homo sapiens
guacggaaucucuaaauaa

SEQ ID NO: 1519772 - RNA, 19 nt, Homo sapiens
gaacuucagacaaccauuu

SEQ ID NO: 1519773 - RNA, 19 nt, Homo sapiens
cggaaucucuaaauaauga

SEQ ID NO: 1519774 - RNA, 19 nt, Homo sapiens
gagaaagucuaugcugaaa

SEQ ID NO: 1519775 - RNA, 19 nt, Homo sapiens
gaacagauaacuuacauac

SEQ ID NO: 1519776 - RNA, 19 nt, Homo sapiens
caaagaaagcaacaacuaa

SEQ ID NO: 1519777 - RNA, 19 nt, Homo sapiens
gagaaggaccaucuuguaa

SEQ ID NO: 1519778 - RNA, 19 nt, Homo sapiens
aagcagaacuugaaagaug

SEQ ID NO: 1519779 - RNA, 19 nt, Homo sapiens
acagauaacuuacauacga

SEQ ID NO: 1519780 - RNA, 19 nt, Homo sapiens
agaagcagcugauuagaga

SEQ ID NO: 1519781 - RNA, 19 nt, Homo sapiens
caaaccacaugaucaaaga

SEQ ID NO: 1519782 - RNA, 19 nt, Homo sapiens
ggaaucagaacuucaaaga

SEQ ID NO: 1519783 - RNA, 19 nt, Homo sapiens
uaaggcaucuaguaugauu

SEQ ID NO: 1519784 - RNA, 19 nt, Homo sapiens
ggaauacacucagaagcuu

SEQ ID NO: 1519785 - RNA, 19 nt, Homo sapiens
gagaaggaauacacucaga

SEQ ID NO: 1519786 - RNA, 19 nt, Homo sapiens
ugaagcagauugagaagga

SEQ ID NO: 1519787 - RNA, 19 nt, Homo sapiens
gaacuugaagacaccauuu

SEQ ID NO: 1519788 - RNA, 19 nt, Homo sapiens
ugaggaagcuuugaaggaa

SEQ ID NO: 1519789 - RNA, 19 nt, Homo sapiens
gaacucagagaaagucuau

SEQ ID NO: 1519790 - RNA, 19 nt, Homo sapiens
cacaggaacagauaacuua

SEQ ID NO: 1519791 - RNA, 19 nt, Homo sapiens
caacuaagggaucaagaaa

SEQ ID NO: 1519792 - RNA, 19 nt, Homo sapiens
ucaaagaaagcaacaacua

SEQ ID NO: 1519793 - RNA, 19 nt, Homo sapiens
ucuaaggcaucuaguauga

SEQ ID NO: 1519794 - RNA, 19 nt, Homo sapiens
cagauaacgucuagugaau

SEQ ID NO: 1519795 - RNA, 19 nt, Homo sapiens
uuacagaggcagaaauuaa

SEQ ID NO: 1519796 - RNA, 19 nt, Homo sapiens
gagaagcagagaacaguaa

SEQ ID NO: 1519797 - RNA, 19 nt, Homo sapiens
caaaguacggaaucucuaa

SEQ ID NO: 1519798 - RNA, 19 nt, Homo sapiens
ucagagagacuaaagaaga

SEQ ID NO: 1519799 - RNA, 19 nt, Homo sapiens
gaggaagcuuugaaggaaa

SEQ ID NO: 1519800 - RNA, 19 nt, Homo sapiens
caucuaguaugauugaaga

SEQ ID NO: 1519801 - RNA, 19 nt, Homo sapiens
aaacagcaguuacaggaau

SEQ ID NO: 1519802 - RNA, 19 nt, Homo sapiens
gaacaugcucuuucagcuu

SEQ ID NO: 1519803 - RNA, 19 nt, Homo sapiens
acaaaugugcgucugaaua

SEQ ID NO: 1519804 - RNA, 19 nt, Homo sapiens
cagcagguuugaagauuug

SEQ ID NO: 1519805 - RNA, 19 nt, Homo sapiens
ccagcagguuugaagauuu

SEQ ID NO: 1519806 - RNA, 19 nt, Homo sapiens
uagcagaacuucagacaac

SEQ ID NO: 1519807 - RNA, 19 nt, Homo sapiens
gcaacacacugaaaacauu

SEQ ID NO: 1519808 - RNA, 19 nt, Homo sapiens
uaacuuacauacgacaaga

SEQ ID NO: 1519809 - RNA, 19 nt, Homo sapiens
ggagucacaggaacagaua

SEQ ID NO: 1519810 - RNA, 19 nt, Homo sapiens
ccacaaaccacaugaucaa

SEQ ID NO: 1519811 - RNA, 19 nt, Homo sapiens
gcagcuaacucgugugacu

SEQ ID NO: 1519812 - RNA, 19 nt, Homo sapiens
agagugaacuugauaaagg

SEQ ID NO: 1519813 - RNA, 19 nt, Homo sapiens
gcagagugaacuugauaaa

SEQ ID NO: 1519814 - RNA, 19 nt, Homo sapiens
gagugaacuugauaaagga

SEQ ID NO: 1519815 - RNA, 19 nt, Homo sapiens
acaaagaauuggagucaca

SEQ ID NO: 1519816 - RNA, 19 nt, Homo sapiens
gaucauagcagaacuucag

SEQ ID NO: 1519817 - RNA, 19 nt, Homo sapiens
gcaguuacaggaaucagaa

SEQ ID NO: 1519818 - RNA, 19 nt, Homo sapiens
gcagcugacuggagaagca

SEQ ID NO: 1519819 - RNA, 19 nt, Homo sapiens
gaagaacugacuacauauc

SEQ ID NO: 1519820 - RNA, 19 nt, Homo sapiens
cgacaagaauaugaaacaa

SEQ ID NO: 1519821 - RNA, 19 nt, Homo sapiens
ggugcgaugugcagagaaa

SEQ ID NO: 1519822 - RNA, 19 nt, Homo sapiens
agucuaugcugaaaugaaa

SEQ ID NO: 1519823 - RNA, 19 nt, Homo sapiens
gaacugacuacauaucaag

SEQ ID NO: 1519824 - RNA, 19 nt, Homo sapiens
gauaaugaccaagcaauca

SEQ ID NO: 1519825 - RNA, 19 nt, Homo sapiens
caagggaacaugagauugu

SEQ ID NO: 1519826 - RNA, 19 nt, Homo sapiens
gaaucagaacuucaaagaa

SEQ ID NO: 1519827 - RNA, 19 nt, Homo sapiens
gcugauauaaaccuucuaa

SEQ ID NO: 1519828 - RNA, 19 nt, Homo sapiens
gcagaaauggaacaggaaa

SEQ ID NO: 1519829 - RNA, 19 nt, Homo sapiens
caaguugagagaagaauug

SEQ ID NO: 1519830 - RNA, 19 nt, Homo sapiens
aguacggaaucucuaaaua

SEQ ID NO: 1519831 - RNA, 19 nt, Homo sapiens
ccagauaacgucuagugaa

SEQ ID NO: 1519832 - RNA, 19 nt, Homo sapiens
gcuccaggauguuagacaa

SEQ ID NO: 1519833 - RNA, 19 nt, Homo sapiens
cucagaagcuugccaaauc

SEQ ID NO: 1519834 - RNA, 19 nt, Homo sapiens
gagcagcuaacucguguga

SEQ ID NO: 1519835 - RNA, 19 nt, Homo sapiens
aggaccaucuuguaaauga

SEQ ID NO: 1519836 - RNA, 19 nt, Homo sapiens
agagaaggaccaucuugua

SEQ ID NO: 1519837 - RNA, 19 nt, Homo sapiens
aagcagagaacaguaauuu

SEQ ID NO: 1519838 - RNA, 19 nt, Homo sapiens
ugaauaaaauggagaguga

SEQ ID NO: 1519839 - RNA, 19 nt, Homo sapiens
caaguuaucagagagacua

SEQ ID NO: 1519840 - RNA, 19 nt, Homo sapiens
gaaggaauacacucagaag

SEQ ID NO: 1519841 - RNA, 19 nt, Homo sapiens
aagaauugcuugaggauac

SEQ ID NO: 1519842 - RNA, 19 nt, Homo sapiens
uaucagagagacuaaagaa

SEQ ID NO: 1519843 - RNA, 19 nt, Homo sapiens
ggagaagcagagaacagua

SEQ ID NO: 1519844 - RNA, 19 nt, Homo sapiens
ggaagaacugacuacauau

SEQ ID NO: 1519845 - RNA, 19 nt, Homo sapiens
gacuaaagaagaccagauu

SEQ ID NO: 1519846 - RNA, 19 nt, Homo sapiens
agaagaagcagcugauuag

SEQ ID NO: 1519847 - RNA, 19 nt, Homo sapiens
aaaggcggcuccaggaugu

SEQ ID NO: 1519848 - RNA, 19 nt, Homo sapiens
ggcagaaauuaauucaaga

SEQ ID NO: 1519849 - RNA, 19 nt, Homo sapiens
guucacaaguugagagaag

SEQ ID NO: 1519850 - RNA, 19 nt, Homo sapiens
gugaauacauggcgcaaac

SEQ ID NO: 1519851 - RNA, 19 nt, Homo sapiens
cagcaucccuaagacaaga

SEQ ID NO: 1519852 - RNA, 19 nt, Homo sapiens
agacaaccauuuccucucu

SEQ ID NO: 1519853 - RNA, 19 nt, Homo sapiens
gaagcagauugagaaggaa

SEQ ID NO: 1519854 - RNA, 19 nt, Homo sapiens
gaaacuguuacaaaccaaa

SEQ ID NO: 1519855 - RNA, 19 nt, Homo sapiens
agaaggaccaucuuguaaa

SEQ ID NO: 1519856 - RNA, 19 nt, Homo sapiens
aggcagaaauuaauucaag

SEQ ID NO: 1519857 - RNA, 19 nt, Homo sapiens
gaccaagcaaucaagguuu

SEQ ID NO: 1519858 - RNA, 19 nt, Homo sapiens
gaagaggagacgacuaaua

SEQ ID NO: 1519859 - RNA, 19 nt, Homo sapiens
ggaagagagugacggagaa

SEQ ID NO: 1519860 - RNA, 19 nt, Homo sapiens
ccaaagcgcugggauaaca

SEQ ID NO: 1519861 - RNA, 19 nt, Homo sapiens
ccagaggguuccagacaaa

SEQ ID NO: 1519862 - RNA, 19 nt, Homo sapiens
gaguaaguuucaucaggua

SEQ ID NO: 1519863 - RNA, 19 nt, Homo sapiens
gaacagggaacuuguaaaa

SEQ ID NO: 1519864 - RNA, 19 nt, Homo sapiens
aaacaacccacaaaucuga

SEQ ID NO: 1519865 - RNA, 19 nt, Homo sapiens
gcaaucaucgucugucuuc

SEQ ID NO: 1519866 - RNA, 19 nt, Homo sapiens
gaagcuguuucacuguuug

SEQ ID NO: 1519867 - RNA, 19 nt, Homo sapiens
ucacauugaugaagaugga

SEQ ID NO: 1519868 - RNA, 19 nt, Homo sapiens
ggagagagaaagagagaga

SEQ ID NO: 1519869 - RNA, 19 nt, Homo sapiens
aaagagccauuggguguuu

SEQ ID NO: 1519870 - RNA, 19 nt, Homo sapiens
gaacgaacagggaacuugu

SEQ ID NO: 1519871 - RNA, 19 nt, Homo sapiens
ggccaucccucgaguaagu

SEQ ID NO: 1519872 - RNA, 19 nt, Homo sapiens
ggagagagagagagagaga

SEQ ID NO: 1519873 - RNA, 19 nt, Homo sapiens
gaaugucacagguagacua

SEQ ID NO: 1519874 - RNA, 19 nt, Homo sapiens
gagaggagagagagaaaga

SEQ ID NO: 1519875 - RNA, 19 nt, Homo sapiens
ucacggaucgagcucuuua

SEQ ID NO: 1519876 - RNA, 19 nt, Homo sapiens
gcagcuuuauuaccuguau

SEQ ID NO: 1519877 - RNA, 19 nt, Homo sapiens
ggugauauuugccuuuagu

SEQ ID NO: 1519878 - RNA, 19 nt, Homo sapiens
cggaagaggagacgacuaa

SEQ ID NO: 1519879 - RNA, 19 nt, Homo sapiens
ggagagagagaaagaacga

SEQ ID NO: 1519880 - RNA, 19 nt, Homo sapiens
ugacggagaaggagagaaa

SEQ ID NO: 1519881 - RNA, 19 nt, Homo sapiens
ugucacagguagacuaaug

SEQ ID NO: 1519882 - RNA, 19 nt, Homo sapiens
aaucagacauccaguagca

SEQ ID NO: 1519883 - RNA, 19 nt, Homo sapiens
gagaaagaacgaacgaaca

SEQ ID NO: 1519884 - RNA, 19 nt, Homo sapiens
gccauuggguguuugaauc

SEQ ID NO: 1519885 - RNA, 19 nt, Homo sapiens
gaggagagagaaagagaga

SEQ ID NO: 1519886 - RNA, 19 nt, Homo sapiens
gagaggagagagaaagaga

SEQ ID NO: 1519887 - RNA, 19 nt, Homo sapiens
ggagaaggagagaaagaga

SEQ ID NO: 1519888 - RNA, 19 nt, Homo sapiens
gcagcaggauaguaaugau

SEQ ID NO: 1519889 - RNA, 19 nt, Homo sapiens
caucgucugucuucucugu

SEQ ID NO: 1519890 - RNA, 19 nt, Homo sapiens
ugggugauauuugccuuua

SEQ ID NO: 1519891 - RNA, 19 nt, Homo sapiens
cucagcagcagcuuuauua

SEQ ID NO: 1519892 - RNA, 19 nt, Homo sapiens
cgacuaauagaccaagaaa

SEQ ID NO: 1519893 - RNA, 19 nt, Homo sapiens
gaaagagccauuggguguu

SEQ ID NO: 1519894 - RNA, 19 nt, Homo sapiens
gccagaggguuccagacaa

SEQ ID NO: 1519895 - RNA, 19 nt, Homo sapiens
gagagaggagagagagaaa

SEQ ID NO: 1519896 - RNA, 19 nt, Homo sapiens
gagagaggagagagaaaga

SEQ ID NO: 1519897 - RNA, 19 nt, Homo sapiens
gaggcugaaucaagaaucu

SEQ ID NO: 1519898 - RNA, 19 nt, Homo sapiens
guacugugggugauauuug

SEQ ID NO: 1519899 - RNA, 19 nt, Homo sapiens
aagaggagacgacuaauag

SEQ ID NO: 1519900 - RNA, 19 nt, Homo sapiens
cagauccaauuccagaaau

SEQ ID NO: 1519901 - RNA, 19 nt, Homo sapiens
ugaugacacugaagcuguu

SEQ ID NO: 1519902 - RNA, 19 nt, Homo sapiens
caucagguagacauuaauu

SEQ ID NO: 1519903 - RNA, 19 nt, Homo sapiens
uuagugcacucuucuccuu

SEQ ID NO: 1519904 - RNA, 19 nt, Homo sapiens
gcucagcagcagcuuuauu

SEQ ID NO: 1519905 - RNA, 19 nt, Homo sapiens
ggauaguaaugaugacacu

SEQ ID NO: 1519906 - RNA, 19 nt, Homo sapiens
gguagacauuaauucuuuc

SEQ ID NO: 1519907 - RNA, 19 nt, Homo sapiens
ggagagaggagagagaaag

SEQ ID NO: 1519908 - RNA, 19 nt, Homo sapiens
gaagaaugucacagguaga

SEQ ID NO: 1519909 - RNA, 19 nt, Homo sapiens
cugcgucccuuuacagaau

SEQ ID NO: 1519910 - RNA, 19 nt, Homo sapiens
cuacguugguggaaucaca

SEQ ID NO: 1519911 - RNA, 19 nt, Homo sapiens
guuguugucgugugacuuu

SEQ ID NO: 1519912 - RNA, 19 nt, Homo sapiens
gaaugacaggcccuuacuu

SEQ ID NO: 1519913 - RNA, 19 nt, Homo sapiens
ucaguacugugggugauau

SEQ ID NO: 1519914 - RNA, 19 nt, Homo sapiens
gagagagagaggagagaga

SEQ ID NO: 1519915 - RNA, 19 nt, Homo sapiens
gagagagagaggagagaga

SEQ ID NO: 1519916 - RNA, 19 nt, Homo sapiens
uucaucagguagacauuaa

SEQ ID NO: 1519917 - RNA, 19 nt, Homo sapiens
guaaguuucaucagguaga

SEQ ID NO: 1519918 - RNA, 19 nt, Homo sapiens
acucuucuccuucacagua

SEQ ID NO: 1519919 - RNA, 19 nt, Homo sapiens
gacauccaguagcaucguu

SEQ ID NO: 1519920 - RNA, 19 nt, Homo sapiens
caaaaucagacauccagua

SEQ ID NO: 1519921 - RNA, 19 nt, Homo sapiens
cuuauugccuguucaguac

SEQ ID NO: 1519922 - RNA, 19 nt, Homo sapiens
aggcuuaacagauccaauu

SEQ ID NO: 1519923 - RNA, 19 nt, Homo sapiens
ggccuacguugguggaauc

SEQ ID NO: 1519924 - RNA, 19 nt, Homo sapiens
cgaacgaacagggaacuug

SEQ ID NO: 1519925 - RNA, 19 nt, Homo sapiens
uaguaaugaugacacugaa

SEQ ID NO: 1519926 - RNA, 19 nt, Homo sapiens
acagauccaauuccagaaa

SEQ ID NO: 1519927 - RNA, 19 nt, Homo sapiens
cuuaacagauccaauucca

SEQ ID NO: 1519928 - RNA, 19 nt, Homo sapiens
ggccagccagucccuguuu

SEQ ID NO: 1519929 - RNA, 19 nt, Homo sapiens
uuaauucuuucacgaggau

SEQ ID NO: 1519930 - RNA, 19 nt, Homo sapiens
ucagguagacauuaauucu

SEQ ID NO: 1519931 - RNA, 19 nt, Homo sapiens
gaggagacgacuaauagac

SEQ ID NO: 1519932 - RNA, 19 nt, Homo sapiens
gaggagagagagaaagaac

SEQ ID NO: 1519933 - RNA, 19 nt, Homo sapiens
gagggagggaagagaguga

SEQ ID NO: 1519934 - RNA, 19 nt, Homo sapiens
gugcaaucaucgucugucu

SEQ ID NO: 1519935 - RNA, 19 nt, Homo sapiens
agagagagagagagagaga

SEQ ID NO: 1519936 - RNA, 19 nt, Homo sapiens
agagagagagagagagaga

SEQ ID NO: 1519937 - RNA, 19 nt, Homo sapiens
caggagagagagagagaga

SEQ ID NO: 1519938 - RNA, 19 nt, Homo sapiens
cagggaacuuguaaaacua

SEQ ID NO: 1519939 - RNA, 19 nt, Homo sapiens
gagaaagagacgggagaga

SEQ ID NO: 1519940 - RNA, 19 nt, Homo sapiens
gaagagagugacggagaag

SEQ ID NO: 1519941 - RNA, 19 nt, Homo sapiens
cauccggaaugcauuaaaa

SEQ ID NO: 1519942 - RNA, 19 nt, Homo sapiens
guugguggaaucacauuga

SEQ ID NO: 1519943 - RNA, 19 nt, Homo sapiens
ucgagucagugcaaucauc

SEQ ID NO: 1519944 - RNA, 19 nt, Homo sapiens
aaugacaggcccuuacuuc

SEQ ID NO: 1519945 - RNA, 19 nt, Homo sapiens
gagagaaagaacgaacgaa

SEQ ID NO: 1519946 - RNA, 19 nt, Homo sapiens
gacgacuaauagaccaaga

SEQ ID NO: 1519947 - RNA, 19 nt, Homo sapiens
gagagagggagggaagaga

SEQ ID NO: 1519948 - RNA, 19 nt, Homo sapiens
auaguaaugaugacacuga

SEQ ID NO: 1519949 - RNA, 19 nt, Homo sapiens
cauuggguguuugaaucua

SEQ ID NO: 1519950 - RNA, 19 nt, Homo sapiens
gaggguuccagacaaagga

SEQ ID NO: 1519951 - RNA, 19 nt, Homo sapiens
acgaacagggaacuuguaa

SEQ ID NO: 1519952 - RNA, 19 nt, Homo sapiens
gagagagaggagagagaga

SEQ ID NO: 1519953 - RNA, 19 nt, Homo sapiens
ucgucugucuucucuguga

SEQ ID NO: 1519954 - RNA, 19 nt, Homo sapiens
uguugcagcaggauaguaa

SEQ ID NO: 1519955 - RNA, 19 nt, Homo sapiens
cagguagacauuaauucuu

SEQ ID NO: 1519956 - RNA, 19 nt, Homo sapiens
cacuuauucuuucgaguca

SEQ ID NO: 1519957 - RNA, 19 nt, Homo sapiens
aagaaaagccaaaaucaga

SEQ ID NO: 1519958 - RNA, 19 nt, Homo sapiens
agagagaacuggcugauua

SEQ ID NO: 1519959 - RNA, 19 nt, Homo sapiens
ugacaucgcugacaaguga

SEQ ID NO: 1519960 - RNA, 19 nt, Homo sapiens
aaagagaccuccauuaaau

SEQ ID NO: 1519961 - RNA, 19 nt, Homo sapiens
gcaaggcgcucaagguguu

SEQ ID NO: 1519962 - RNA, 19 nt, Homo sapiens
gauaaagagaccuccauua

SEQ ID NO: 1519963 - RNA, 19 nt, Homo sapiens
gaagguggcauucagauga

SEQ ID NO: 1519964 - RNA, 19 nt, Homo sapiens
caccaugccugacccauuu

SEQ ID NO: 1519965 - RNA, 19 nt, Homo sapiens
ggucuuugcuccuuuacaa

SEQ ID NO: 1519966 - RNA, 19 nt, Homo sapiens
uaaagagaccuccauuaaa

SEQ ID NO: 1519967 - RNA, 19 nt, Homo sapiens
auaaagagaccuccauuaa

SEQ ID NO: 1519968 - RNA, 19 nt, Homo sapiens
gaaacgcggcucugaauca

SEQ ID NO: 1519969 - RNA, 19 nt, Homo sapiens
gaccggaucuaccucauca

SEQ ID NO: 1519970 - RNA, 19 nt, Homo sapiens
gacggucuuugcuccuuua

SEQ ID NO: 1519971 - RNA, 19 nt, Homo sapiens
gagagaacuggcugauuaa

SEQ ID NO: 1519972 - RNA, 19 nt, Homo sapiens
gugauuuccugucucguuu

SEQ ID NO: 1519973 - RNA, 19 nt, Homo sapiens
ggaucuaccucaucaacuc

SEQ ID NO: 1519974 - RNA, 19 nt, Homo sapiens
gcagggcacccgggauaua

SEQ ID NO: 1519975 - RNA, 19 nt, Homo sapiens
agaacuggcugauuaaagg

SEQ ID NO: 1519976 - RNA, 19 nt, Homo sapiens
caggugggcugucuguaga

SEQ ID NO: 1519977 - RNA, 19 nt, Homo sapiens
gggaaacgcggcucugaau

SEQ ID NO: 1519978 - RNA, 19 nt, Homo sapiens
gagcagcacggcuuugugu

SEQ ID NO: 1519979 - RNA, 19 nt, Homo sapiens
cgggauauaucagccauga

SEQ ID NO: 1519980 - RNA, 19 nt, Homo sapiens
cgacggucuuugcuccuuu

SEQ ID NO: 1519981 - RNA, 19 nt, Homo sapiens
acacagccuucacgccauu

SEQ ID NO: 1519982 - RNA, 19 nt, Homo sapiens
cagcacggcuuuguguuca

SEQ ID NO: 1519983 - RNA, 19 nt, Homo sapiens
gcagcacggcuuuguguuc

SEQ ID NO: 1519984 - RNA, 19 nt, Homo sapiens
aagagaccuccauuaaaua

SEQ ID NO: 1519985 - RNA, 19 nt, Homo sapiens
gagaacuggcugauuaaag

SEQ ID NO: 1519986 - RNA, 19 nt, Homo sapiens
gcugacaagugaugacaac

SEQ ID NO: 1519987 - RNA, 19 nt, Homo sapiens
ggaagguggcauucagaug

SEQ ID NO: 1519988 - RNA, 19 nt, Homo sapiens
gaagcucacccuccgaucu

SEQ ID NO: 1519989 - RNA, 19 nt, Homo sapiens
gaagaggaagguggcauuc

SEQ ID NO: 1519990 - RNA, 19 nt, Homo sapiens
agccacaccuucuucauca

SEQ ID NO: 1519991 - RNA, 19 nt, Homo sapiens
ugaccgccaugugaaagaa

SEQ ID NO: 1519992 - RNA, 19 nt, Homo sapiens
gagggaaacgcggcucuga

SEQ ID NO: 1519993 - RNA, 19 nt, Homo sapiens
ucgcugacaucgcugacaa

SEQ ID NO: 1519994 - RNA, 19 nt, Homo sapiens
gaggaagguggcauucaga

SEQ ID NO: 1519995 - RNA, 19 nt, Homo sapiens
gaucucggugugauuguug

SEQ ID NO: 1519996 - RNA, 19 nt, Homo sapiens
ggacgguggaagcgugauu

SEQ ID NO: 1519997 - RNA, 19 nt, Homo sapiens
ggaaacgcggcucugaauc

SEQ ID NO: 1519998 - RNA, 19 nt, Homo sapiens
ccaccaugccugacccauu

SEQ ID NO: 1519999 - RNA, 19 nt, Homo sapiens
gcaggcggaagaagaggaa

SEQ ID NO: 1520000 - RNA, 19 nt, Homo sapiens
agaaacgucaggccuguug

SEQ ID NO: 1520001 - RNA, 19 nt, Homo sapiens
gcgugauucugcugagugu

SEQ ID NO: 1520002 - RNA, 19 nt, Homo sapiens
ugauaaagagaccuccauu

SEQ ID NO: 1520003 - RNA, 19 nt, Homo sapiens
agaggaagguggcauucag

SEQ ID NO: 1520004 - RNA, 19 nt, Homo sapiens
gugagcaggcggaagaaga

SEQ ID NO: 1520005 - RNA, 19 nt, Homo sapiens
ggugggcugucuguagaga

SEQ ID NO: 1520006 - RNA, 19 nt, Homo sapiens
gguacagcaucaucaccau

SEQ ID NO: 1520007 - RNA, 19 nt, Homo sapiens
ggaugggaaugaggacagu

SEQ ID NO: 1520008 - RNA, 19 nt, Homo sapiens
agaagaggaagguggcauu

SEQ ID NO: 1520009 - RNA, 19 nt, Homo sapiens
gaaaacgccaggucuucaa

SEQ ID NO: 1520010 - RNA, 19 nt, Homo sapiens
gggcacccgggauauauca

SEQ ID NO: 1520011 - RNA, 19 nt, Homo sapiens
ugggcugucuguagagaga

SEQ ID NO: 1520012 - RNA, 19 nt, Homo sapiens
cgaucucggugugauuguu

SEQ ID NO: 1520013 - RNA, 19 nt, Homo sapiens
agaccuccauuaaauacgu

SEQ ID NO: 1520014 - RNA, 19 nt, Homo sapiens
gugauucugcugaguguca

SEQ ID NO: 1520015 - RNA, 19 nt, Homo sapiens
gcagcuaagcagccaacug

SEQ ID NO: 1520016 - RNA, 19 nt, Homo sapiens
guagagagaacuggcugau

SEQ ID NO: 1520017 - RNA, 19 nt, Homo sapiens
cggugugauuguugugauu

SEQ ID NO: 1520018 - RNA, 19 nt, Homo sapiens
ggaccggaucuaccucauc

SEQ ID NO: 1520019 - RNA, 19 nt, Homo sapiens
gaagcucgcugauuuagaa

SEQ ID NO: 1520020 - RNA, 19 nt, Homo sapiens
ugacaucgcugacaaguga

SEQ ID NO: 1520021 - RNA, 19 nt, Homo sapiens
aaagagaccuccauuaaau

SEQ ID NO: 1520022 - RNA, 19 nt, Homo sapiens
gcaaggcgcucaagguguu

SEQ ID NO: 1520023 - RNA, 19 nt, Homo sapiens
uggagaagcucgcugauuu

SEQ ID NO: 1520024 - RNA, 19 nt, Homo sapiens
gauaaagagaccuccauua

SEQ ID NO: 1520025 - RNA, 19 nt, Homo sapiens
gaagguggcauucagauga

SEQ ID NO: 1520026 - RNA, 19 nt, Homo sapiens
ggaacacaauaaagaugua

SEQ ID NO: 1520027 - RNA, 19 nt, Homo sapiens
caacauacagcuacaggua

SEQ ID NO: 1520028 - RNA, 19 nt, Homo sapiens
acacacaccugccuaaaga

SEQ ID NO: 1520029 - RNA, 19 nt, Homo sapiens
caacauuuacguuugguua

SEQ ID NO: 1520030 - RNA, 19 nt, Homo sapiens
ggacaacucugaggcugaa

SEQ ID NO: 1520031 - RNA, 19 nt, Homo sapiens
ggagaagcucgcugauuua

SEQ ID NO: 1520032 - RNA, 19 nt, Homo sapiens
caccaugccugacccauuu

SEQ ID NO: 1520033 - RNA, 19 nt, Homo sapiens
uaaagagaccuccauuaaa

SEQ ID NO: 1520034 - RNA, 19 nt, Homo sapiens
caacaacauuggaacacaa

SEQ ID NO: 1520035 - RNA, 19 nt, Homo sapiens
gcugauuuguuucuaguuu

SEQ ID NO: 1520036 - RNA, 19 nt, Homo sapiens
aaacagguccgacucagua

SEQ ID NO: 1520037 - RNA, 19 nt, Homo sapiens
auaaagagaccuccauuaa

SEQ ID NO: 1520038 - RNA, 19 nt, Homo sapiens
ggaguguggugauugaaga

SEQ ID NO: 1520039 - RNA, 19 nt, Homo sapiens
gagcaagaccuacaaguca

SEQ ID NO: 1520040 - RNA, 19 nt, Homo sapiens
ggagugaaguggaucucuu

SEQ ID NO: 1520041 - RNA, 19 nt, Homo sapiens
ccagucagcuuuugaagua

SEQ ID NO: 1520042 - RNA, 19 nt, Homo sapiens
gaccggaucuaccucauca

SEQ ID NO: 1520043 - RNA, 19 nt, Homo sapiens
ccaaagaggacacacagaa

SEQ ID NO: 1520044 - RNA, 19 nt, Homo sapiens
gaaccugucuguggaugug

SEQ ID NO: 1520045 - RNA, 19 nt, Homo sapiens
cuagguaucuguauaaugc

SEQ ID NO: 1520046 - RNA, 19 nt, Homo sapiens
gaugggcucucucuguguu

SEQ ID NO: 1520047 - RNA, 19 nt, Homo sapiens
ugaaauguguguucugaag

SEQ ID NO: 1520048 - RNA, 19 nt, Homo sapiens
ggagaaagccccuguguug

SEQ ID NO: 1520049 - RNA, 19 nt, Homo sapiens
gcaacaacauuggaacaca

SEQ ID NO: 1520050 - RNA, 19 nt, Homo sapiens
uaacaugaagaccaaguuu

SEQ ID NO: 1520051 - RNA, 19 nt, Homo sapiens
ggaucuaccucaucaacuc

SEQ ID NO: 1520052 - RNA, 19 nt, Homo sapiens
ccaaagugcugggauuaca

SEQ ID NO: 1520053 - RNA, 19 nt, Homo sapiens
gaagaggaaucagaaagcu

SEQ ID NO: 1520054 - RNA, 19 nt, Homo sapiens
gcagggcacccgggauaua

SEQ ID NO: 1520055 - RNA, 19 nt, Homo sapiens
gguuaacauucaagcguuu

SEQ ID NO: 1520056 - RNA, 19 nt, Homo sapiens
ucagaaagcugggacaacu

SEQ ID NO: 1520057 - RNA, 19 nt, Homo sapiens
gaugaugggcucucucugu

SEQ ID NO: 1520058 - RNA, 19 nt, Homo sapiens
cugcugaaguucuggauga

SEQ ID NO: 1520059 - RNA, 19 nt, Homo sapiens
gcaucugacuugcccaauc

SEQ ID NO: 1520060 - RNA, 19 nt, Homo sapiens
auucaagcguuucuacuuu

SEQ ID NO: 1520061 - RNA, 19 nt, Homo sapiens
ccaccauccugaauaagau

SEQ ID NO: 1520062 - RNA, 19 nt, Homo sapiens
gagcagcacggcuuugugu

SEQ ID NO: 1520063 - RNA, 19 nt, Homo sapiens
ccacuaugcccagcuaauu

SEQ ID NO: 1520064 - RNA, 19 nt, Homo sapiens
uugcugcuuucaacauuua

SEQ ID NO: 1520065 - RNA, 19 nt, Homo sapiens
gaacaaagugaaggugcuu

SEQ ID NO: 1520066 - RNA, 19 nt, Homo sapiens
cgggauauaucagccauga

SEQ ID NO: 1520067 - RNA, 19 nt, Homo sapiens
ucugaaauguguguucuga

SEQ ID NO: 1520068 - RNA, 19 nt, Homo sapiens
guggaucucuuccucaucu

SEQ ID NO: 1520069 - RNA, 19 nt, Homo sapiens
ucaguaugcagucgcaaua

SEQ ID NO: 1520070 - RNA, 19 nt, Homo sapiens
gaaaggcggagggaugaug

SEQ ID NO: 1520071 - RNA, 19 nt, Homo sapiens
gguggacagucgacccaaa

SEQ ID NO: 1520072 - RNA, 19 nt, Homo sapiens
caugaagaccaaguuuaua

SEQ ID NO: 1520073 - RNA, 19 nt, Homo sapiens
caucaucccacuguacuuu

SEQ ID NO: 1520074 - RNA, 19 nt, Homo sapiens
gaggaugaccagucucuca

SEQ ID NO: 1520075 - RNA, 19 nt, Homo sapiens
acacagccuucacgccauu

SEQ ID NO: 1520076 - RNA, 19 nt, Homo sapiens
cagcacggcuuuguguuca

SEQ ID NO: 1520077 - RNA, 19 nt, Homo sapiens
gagaaacagguccgacuca

SEQ ID NO: 1520078 - RNA, 19 nt, Homo sapiens
gauggagucccugaucauu

SEQ ID NO: 1520079 - RNA, 19 nt, Homo sapiens
gaaacagguccgacucagu

SEQ ID NO: 1520080 - RNA, 19 nt, Homo sapiens
caaggaagggaaaccauca

SEQ ID NO: 1520081 - RNA, 19 nt, Homo sapiens
gcagcacggcuuuguguuc

SEQ ID NO: 1520082 - RNA, 19 nt, Homo sapiens
aagagaccuccauuaaaua

SEQ ID NO: 1520083 - RNA, 19 nt, Homo sapiens
acaugaagaccaaguuuau

SEQ ID NO: 1520084 - RNA, 19 nt, Homo sapiens
cuacaagucacaccucaug

SEQ ID NO: 1520085 - RNA, 19 nt, Homo sapiens
gcugacaagugaugacaac

SEQ ID NO: 1520086 - RNA, 19 nt, Homo sapiens
ggaagguggcauucagaug

SEQ ID NO: 1520087 - RNA, 19 nt, Homo sapiens
uugcugcaguugugaauau

SEQ ID NO: 1520088 - RNA, 19 nt, Homo sapiens
gaagaggaagguggcauuc

SEQ ID NO: 1520089 - RNA, 19 nt, Homo sapiens
gagaagcucgcugauuuag

SEQ ID NO: 1520090 - RNA, 19 nt, Homo sapiens
gggauuuucugaugguuuu

SEQ ID NO: 1520091 - RNA, 19 nt, Homo sapiens
uacguuugguuacaguuaa

SEQ ID NO: 1520092 - RNA, 19 nt, Homo sapiens
gcuuucaacauuuacguuu

SEQ ID NO: 1520093 - RNA, 19 nt, Homo sapiens
uauugcugcuuucaacauu

SEQ ID NO: 1520094 - RNA, 19 nt, Homo sapiens
caaagaggacacacagaag

SEQ ID NO: 1520095 - RNA, 19 nt, Homo sapiens
ucaagcugcugaaguucug

SEQ ID NO: 1520096 - RNA, 19 nt, Homo sapiens
aggaguggaugaacaaagu

SEQ ID NO: 1520097 - RNA, 19 nt, Homo sapiens
agccacaccuucuucauca

SEQ ID NO: 1520098 - RNA, 19 nt, Homo sapiens
uuacguuugguuacaguua

SEQ ID NO: 1520099 - RNA, 19 nt, Homo sapiens
gggcuccgcaagagacuuu

SEQ ID NO: 1520100 - RNA, 19 nt, Homo sapiens
gaggaagguggcauucaga

SEQ ID NO: 1520101 - RNA, 19 nt, Homo sapiens
ccucagaguuugcugucau

SEQ ID NO: 1520102 - RNA, 19 nt, Homo sapiens
ucgcugacaucgcugacaa

SEQ ID NO: 1520103 - RNA, 19 nt, Homo sapiens
aacaugaagaccaaguuua

SEQ ID NO: 1520104 - RNA, 19 nt, Homo sapiens
caaagugcugggauuacaa

SEQ ID NO: 1520105 - RNA, 19 nt, Homo sapiens
gacugucccuugaguuucu

SEQ ID NO: 1520106 - RNA, 19 nt, Homo sapiens
cacuaugcccagcuaauuu

SEQ ID NO: 1520107 - RNA, 19 nt, Homo sapiens
caugucugcucccgagguu

SEQ ID NO: 1520108 - RNA, 19 nt, Homo sapiens
gcucgcugauuuagaagag

SEQ ID NO: 1520109 - RNA, 19 nt, Homo sapiens
ggacgguggaagcgugauu

SEQ ID NO: 1520110 - RNA, 19 nt, Homo sapiens
ccaccaugccugacccauu

SEQ ID NO: 1520111 - RNA, 19 nt, Homo sapiens
ccacugugccuggcccuuu

SEQ ID NO: 1520112 - RNA, 19 nt, Homo sapiens
cgcugaagauggcaaugaa

SEQ ID NO: 1520113 - RNA, 19 nt, Homo sapiens
accagucucucagcaagua

SEQ ID NO: 1520114 - RNA, 19 nt, Homo sapiens
gcaggcggaagaagaggaa

SEQ ID NO: 1520115 - RNA, 19 nt, Homo sapiens
gcgugauucugcugagugu

SEQ ID NO: 1520116 - RNA, 19 nt, Homo sapiens
gaguuagggcuccgcaaga

SEQ ID NO: 1520117 - RNA, 19 nt, Homo sapiens
caagaguuucugggccuua

SEQ ID NO: 1520118 - RNA, 19 nt, Homo sapiens
agaaacgucaggccuguug

SEQ ID NO: 1520119 - RNA, 19 nt, Homo sapiens
gaaaggcccugcuccuguu

SEQ ID NO: 1520120 - RNA, 19 nt, Homo sapiens
gcaaagauauagagguaag

SEQ ID NO: 1520121 - RNA, 19 nt, Homo sapiens
gggaguuccuuacuuacua

SEQ ID NO: 1520122 - RNA, 19 nt, Homo sapiens
gggaguuccuuacuuacua

SEQ ID NO: 1520123 - RNA, 19 nt, Homo sapiens
aggcaaagauauagaggua

SEQ ID NO: 1520124 - RNA, 19 nt, Homo sapiens
uagcagaggcaaagauaua

SEQ ID NO: 1520125 - RNA, 19 nt, Homo sapiens
uaagggaguuccucugaau

SEQ ID NO: 1520126 - RNA, 19 nt, Homo sapiens
ggagguuguucugagcuua

SEQ ID NO: 1520127 - RNA, 19 nt, Homo sapiens
guaagggaguuccucugaa

SEQ ID NO: 1520128 - RNA, 19 nt, Homo sapiens
aaauugcgcuugaacugaa

SEQ ID NO: 1520129 - RNA, 19 nt, Homo sapiens
ggaguuccuuacuuacuau

SEQ ID NO: 1520130 - RNA, 19 nt, Homo sapiens
ggaguuccuuacuuacuau

SEQ ID NO: 1520131 - RNA, 19 nt, Homo sapiens
ggagagcgcagagcaggua

SEQ ID NO: 1520132 - RNA, 19 nt, Homo sapiens
ccaauaauccagugaagug

SEQ ID NO: 1520133 - RNA, 19 nt, Homo sapiens
gugccucccugguuauauu

SEQ ID NO: 1520134 - RNA, 19 nt, Homo sapiens
gguaagggaguuccucuga

SEQ ID NO: 1520135 - RNA, 19 nt, Homo sapiens
uaguggaccucauuuaauc

SEQ ID NO: 1520136 - RNA, 19 nt, Homo sapiens
ugaaguggguguuacuauc

SEQ ID NO: 1520137 - RNA, 19 nt, Homo sapiens
gcaauucccaagcuccaaa

SEQ ID NO: 1520138 - RNA, 19 nt, Homo sapiens
gcccaccucuguccgaaga

SEQ ID NO: 1520139 - RNA, 19 nt, Homo sapiens
uguaaugucuggagugagu

SEQ ID NO: 1520140 - RNA, 19 nt, Homo sapiens
acaaagauauagagguaag

SEQ ID NO: 1520141 - RNA, 19 nt, Homo sapiens
acaaagauauagagguaag

SEQ ID NO: 1520142 - RNA, 19 nt, Homo sapiens
ugacaggaaagaaaucuga

SEQ ID NO: 1520143 - RNA, 19 nt, Homo sapiens
gcuuaguggaccucauuua

SEQ ID NO: 1520144 - RNA, 19 nt, Homo sapiens
cagaggaaguguggacuca

SEQ ID NO: 1520145 - RNA, 19 nt, Homo sapiens
ccuagcagaggcaaagaua

SEQ ID NO: 1520146 - RNA, 19 nt, Homo sapiens
acacagauucucagaggaa

SEQ ID NO: 1520147 - RNA, 19 nt, Homo sapiens
gaacgucuacgaggucauc

SEQ ID NO: 1520148 - RNA, 19 nt, Homo sapiens
cuuaguggaccucauuuaa

SEQ ID NO: 1520149 - RNA, 19 nt, Homo sapiens
gcagaggcaaagauauaga

SEQ ID NO: 1520150 - RNA, 19 nt, Homo sapiens
caucagcaauucccaagcu

SEQ ID NO: 1520151 - RNA, 19 nt, Homo sapiens
ggaaucccgcucggaguuu

SEQ ID NO: 1520152 - RNA, 19 nt, Homo sapiens
gcagagauaaggcagaacu

SEQ ID NO: 1520153 - RNA, 19 nt, Homo sapiens
guuccuuacuuacuauauc

SEQ ID NO: 1520154 - RNA, 19 nt, Homo sapiens
guuccuuacuuacuauauc

SEQ ID NO: 1520155 - RNA, 19 nt, Homo sapiens
ccaccaaggcucagacaca

SEQ ID NO: 1520156 - RNA, 19 nt, Homo sapiens
ggguguuacuaucccauug

SEQ ID NO: 1520157 - RNA, 19 nt, Homo sapiens
gaggcugcuuguccagaga

SEQ ID NO: 1520158 - RNA, 19 nt, Homo sapiens
gcucagacacacagauucu

SEQ ID NO: 1520159 - RNA, 19 nt, Homo sapiens
ggcuguggcuuguaauguc

SEQ ID NO: 1520160 - RNA, 19 nt, Homo sapiens
cccaggagguggugucaag

SEQ ID NO: 1520161 - RNA, 19 nt, Homo sapiens
gguguuacuaucccauuga

SEQ ID NO: 1520162 - RNA, 19 nt, Homo sapiens
uaauccaauugguggcaaa

SEQ ID NO: 1520163 - RNA, 19 nt, Homo sapiens
cgcagucccucaucagcaa

SEQ ID NO: 1520164 - RNA, 19 nt, Homo sapiens
gcccagaggcuuuucguaa

SEQ ID NO: 1520165 - RNA, 19 nt, Homo sapiens
cuuguaaugucuggaguga

SEQ ID NO: 1520166 - RNA, 19 nt, Homo sapiens
gugaaguggguguuacuau

SEQ ID NO: 1520167 - RNA, 19 nt, Homo sapiens
uuaguggaccucauuuaau

SEQ ID NO: 1520168 - RNA, 19 nt, Homo sapiens
gcgcagcgacucagagaac

SEQ ID NO: 1520169 - RNA, 19 nt, Homo sapiens
gaaguggguguuacuaucc

SEQ ID NO: 1520170 - RNA, 19 nt, Homo sapiens
ccagugaaguggguguuac

SEQ ID NO: 1520171 - RNA, 19 nt, Homo sapiens
gcuguggcuuguaaugucu

SEQ ID NO: 1520172 - RNA, 19 nt, Homo sapiens
ccauugacaggaaagaaau

SEQ ID NO: 1520173 - RNA, 19 nt, Homo sapiens
auauagagguaagggaguu

SEQ ID NO: 1520174 - RNA, 19 nt, Homo sapiens
auauagagguaagggaguu

SEQ ID NO: 1520175 - RNA, 19 nt, Homo sapiens
auauagagguaagggaguu

SEQ ID NO: 1520176 - RNA, 19 nt, Homo sapiens
ccagagaggcagaaaauuc

SEQ ID NO: 1520177 - RNA, 19 nt, Homo sapiens
gaucagggcgaggcugcuu

SEQ ID NO: 1520178 - RNA, 19 nt, Homo sapiens
ucagacacacagauucuca

SEQ ID NO: 1520179 - RNA, 19 nt, Homo sapiens
gggaguuccucugaaucug

SEQ ID NO: 1520180 - RNA, 19 nt, Homo sapiens
cccauugacaggaaagaaa

SEQ ID NO: 1520181 - RNA, 19 nt, Homo sapiens
gaaucccgcucggaguuuu

SEQ ID NO: 1520182 - RNA, 19 nt, Homo sapiens
aggagguggugucaagaga

SEQ ID NO: 1520183 - RNA, 19 nt, Homo sapiens
ggagagggccuaguaauaa

SEQ ID NO: 1520184 - RNA, 19 nt, Homo sapiens
gagagggccuaguaauaaa

SEQ ID NO: 1520185 - RNA, 19 nt, Homo sapiens
ggacagcaguuuacacaag

SEQ ID NO: 1520186 - RNA, 19 nt, Homo sapiens
cagaugaguuccuggauga

SEQ ID NO: 1520187 - RNA, 19 nt, Homo sapiens
gggagagggccuaguaaua

SEQ ID NO: 1520188 - RNA, 19 nt, Homo sapiens
ggagcucucuugagucaug

SEQ ID NO: 1520189 - RNA, 19 nt, Homo sapiens
acaguaugcugcugaguuu

SEQ ID NO: 1520190 - RNA, 19 nt, Homo sapiens
uaagaagacucgccgaaag

SEQ ID NO: 1520191 - RNA, 19 nt, Homo sapiens
gcaagagccggaaggagaa

SEQ ID NO: 1520192 - RNA, 19 nt, Homo sapiens
ccagggagagggccuagua

SEQ ID NO: 1520193 - RNA, 19 nt, Homo sapiens
ggacggaagcaaacuaaag

SEQ ID NO: 1520194 - RNA, 19 nt, Homo sapiens
gagaacccguggaugaagu

SEQ ID NO: 1520195 - RNA, 19 nt, Homo sapiens
agucauggcuucuucaaag

SEQ ID NO: 1520196 - RNA, 19 nt, Homo sapiens
gacggaagcaaacuaaaga

SEQ ID NO: 1520197 - RNA, 19 nt, Homo sapiens
gccucaaccuggaacagua

SEQ ID NO: 1520198 - RNA, 19 nt, Homo sapiens
gagagcaggaggccaagaa

SEQ ID NO: 1520199 - RNA, 19 nt, Homo sapiens
ccggagcucucuugaguca

SEQ ID NO: 1520200 - RNA, 19 nt, Homo sapiens
ucucuuacccugucacuug

SEQ ID NO: 1520201 - RNA, 19 nt, Homo sapiens
gcagcuggacggaagcaaa

SEQ ID NO: 1520202 - RNA, 19 nt, Homo sapiens
gagcaggaggccaagaaga

SEQ ID NO: 1520203 - RNA, 19 nt, Homo sapiens
ggcaggaggccaaauguuc

SEQ ID NO: 1520204 - RNA, 19 nt, Homo sapiens
ugccggagcucucuugagu

SEQ ID NO: 1520205 - RNA, 19 nt, Homo sapiens
gaagacucgccgaaaguuc

SEQ ID NO: 1520206 - RNA, 19 nt, Homo sapiens
gccagacgcugaagaugac

SEQ ID NO: 1520207 - RNA, 19 nt, Homo sapiens
gcaggaggccaaauguucu

SEQ ID NO: 1520208 - RNA, 19 nt, Homo sapiens
gggacaugcucucucuuac

SEQ ID NO: 1520209 - RNA, 19 nt, Homo sapiens
gcgcucgccuuugcacuca

SEQ ID NO: 1520210 - RNA, 19 nt, Homo sapiens
gggcucagcaacucucaug

SEQ ID NO: 1520211 - RNA, 19 nt, Homo sapiens
cgccagacgcugaagauga

SEQ ID NO: 1520212 - RNA, 19 nt, Homo sapiens
ggaaggagaaaggcagcaa

SEQ ID NO: 1520213 - RNA, 19 nt, Homo sapiens
gcagagccucaaccuggaa

SEQ ID NO: 1520214 - RNA, 19 nt, Homo sapiens
ggccuaguaauaaauccua

SEQ ID NO: 1520215 - RNA, 19 nt, Homo sapiens
ggggacaugcucucucuua

SEQ ID NO: 1520216 - RNA, 19 nt, Homo sapiens
uccgagaacccguggauga

SEQ ID NO: 1520217 - RNA, 19 nt, Homo sapiens
gcuggacggaagcaaacua

SEQ ID NO: 1520218 - RNA, 19 nt, Homo sapiens
ugucucagucuucagauga

SEQ ID NO: 1520219 - RNA, 19 nt, Homo sapiens
auaagaagacucgccgaaa

SEQ ID NO: 1520220 - RNA, 19 nt, Homo sapiens
gaacccguggaugaaguuu

SEQ ID NO: 1520221 - RNA, 19 nt, Homo sapiens
gagucauggcuucuucaaa

SEQ ID NO: 1520222 - RNA, 19 nt, Homo sapiens
ccgagaacccguggaugaa

SEQ ID NO: 1520223 - RNA, 19 nt, Homo sapiens
cuucggcuccacccagaua

SEQ ID NO: 1520224 - RNA, 19 nt, Homo sapiens
ggagaggaauaaagagaaa

SEQ ID NO: 1520225 - RNA, 19 nt, Homo sapiens
uagacaagaugauugauug

SEQ ID NO: 1520226 - RNA, 19 nt, Homo sapiens
ggagggagaggaauaaaga

SEQ ID NO: 1520227 - RNA, 19 nt, Homo sapiens
ggacgaggccucccaucaa

SEQ ID NO: 1520228 - RNA, 19 nt, Homo sapiens
gcaucaacguggcaacuau

SEQ ID NO: 1520229 - RNA, 19 nt, Homo sapiens
ugauugggcuacucagaaa

SEQ ID NO: 1520230 - RNA, 19 nt, Homo sapiens
gaauaaagagaaacagagu

SEQ ID NO: 1520231 - RNA, 19 nt, Homo sapiens
gaaacagaguccaggaaaa

SEQ ID NO: 1520232 - RNA, 19 nt, Homo sapiens
gcauggagggagaggaaua

SEQ ID NO: 1520233 - RNA, 19 nt, Homo sapiens
caacguggcaacuaugaug

SEQ ID NO: 1520234 - RNA, 19 nt, Homo sapiens
gaaaagaggacccggauuc

SEQ ID NO: 1520235 - RNA, 19 nt, Homo sapiens
ccagaacgccuuagacaag

SEQ ID NO: 1520236 - RNA, 19 nt, Homo sapiens
cgugagauguugcaaucaa

SEQ ID NO: 1520237 - RNA, 19 nt, Homo sapiens
gagaaacagaguccaggaa

SEQ ID NO: 1520238 - RNA, 19 nt, Homo sapiens
cagaacgccuuagacaaga

SEQ ID NO: 1520239 - RNA, 19 nt, Homo sapiens
ugagauguugcaaucaaua

SEQ ID NO: 1520240 - RNA, 19 nt, Homo sapiens
gggagaggaauaaagagaa

SEQ ID NO: 1520241 - RNA, 19 nt, Homo sapiens
agaaacagaguccaggaaa

SEQ ID NO: 1520242 - RNA, 19 nt, Homo sapiens
caaccugcccuucccguau

SEQ ID NO: 1520243 - RNA, 19 nt, Homo sapiens
caucguucuugucaacauu

SEQ ID NO: 1520244 - RNA, 19 nt, Homo sapiens
gcauaacaccgugagaugu

SEQ ID NO: 1520245 - RNA, 19 nt, Homo sapiens
gacgaggccucccaucaac

SEQ ID NO: 1520246 - RNA, 19 nt, Homo sapiens
gggcauggagggagaggaa

SEQ ID NO: 1520247 - RNA, 19 nt, Homo sapiens
ugcaaucaauaccaagaaa

SEQ ID NO: 1520248 - RNA, 19 nt, Homo sapiens
ugggcuggaugcuguauga

SEQ ID NO: 1520249 - RNA, 19 nt, Homo sapiens
gugagauguugcaaucaau

SEQ ID NO: 1520250 - RNA, 19 nt, Homo sapiens
gaacgccuuagacaagaug

SEQ ID NO: 1520251 - RNA, 19 nt, Homo sapiens
ggcauaacaccgugagaug

SEQ ID NO: 1520252 - RNA, 19 nt, Homo sapiens
gaccgagaaacucaacuga

SEQ ID NO: 1520253 - RNA, 19 nt, Homo sapiens
gcuuccaccuccaccuuga

SEQ ID NO: 1520254 - RNA, 19 nt, Homo sapiens
gcaaucaauaccaagaaag

SEQ ID NO: 1520255 - RNA, 19 nt, Homo sapiens
ccaacuaccagguguacga

SEQ ID NO: 1520256 - RNA, 19 nt, Homo sapiens
ccucaucguucuugucaac

SEQ ID NO: 1520257 - RNA, 19 nt, Homo sapiens
ugaagcggcaggugcagaa

SEQ ID NO: 1520258 - RNA, 19 nt, Homo sapiens
caccugagcugcgcugcau

SEQ ID NO: 1520259 - RNA, 19 nt, Homo sapiens
cauggagggagaggaauaa

SEQ ID NO: 1520260 - RNA, 19 nt, Homo sapiens
ggagccagaccgagaaacu

SEQ ID NO: 1520261 - RNA, 19 nt, Homo sapiens
ggccucaucguucuuguca

SEQ ID NO: 1520262 - RNA, 19 nt, Homo sapiens
ccuuagacaagaugauuga

SEQ ID NO: 1520263 - RNA, 19 nt, Homo sapiens
gagauguugcaaucaauac

SEQ ID NO: 1520264 - RNA, 19 nt, Homo sapiens
gagcaccacuccccacagu

SEQ ID NO: 1520265 - RNA, 19 nt, Homo sapiens
gaugauugauugggcuacu

SEQ ID NO: 1520266 - RNA, 19 nt, Homo sapiens
guguagaggccaggucuga

SEQ ID NO: 1520267 - RNA, 19 nt, Homo sapiens
caucaacguggcaacuaug

SEQ ID NO: 1520268 - RNA, 19 nt, Homo sapiens
ggcaucaacguggcaacua

SEQ ID NO: 1520269 - RNA, 19 nt, Homo sapiens
gaaaagagcuccagaaauc

SEQ ID NO: 1520270 - RNA, 19 nt, Homo sapiens
agaaacagauggucaagua

SEQ ID NO: 1520271 - RNA, 19 nt, Homo sapiens
ggaccagccuguacaugua

SEQ ID NO: 1520272 - RNA, 19 nt, Homo sapiens
ggaccagacuuuaauguuc

SEQ ID NO: 1520273 - RNA, 19 nt, Homo sapiens
ggacccugcucucuuguuu

SEQ ID NO: 1520274 - RNA, 19 nt, Homo sapiens
ugacucaacuccagaaaug

SEQ ID NO: 1520275 - RNA, 19 nt, Homo sapiens
ggacaaaguauaugaaaca

SEQ ID NO: 1520276 - RNA, 19 nt, Homo sapiens
gcacaggguucucuugagu

SEQ ID NO: 1520277 - RNA, 19 nt, Homo sapiens
gcaaagcugagcacccuua

SEQ ID NO: 1520278 - RNA, 19 nt, Homo sapiens
ggacagggcagucuuggaa

SEQ ID NO: 1520279 - RNA, 19 nt, Homo sapiens
ucaaguagaugucuguuag

SEQ ID NO: 1520280 - RNA, 19 nt, Homo sapiens
uaaaucaccucggcagaaa

SEQ ID NO: 1520281 - RNA, 19 nt, Homo sapiens
caaaucggcuuacuuucug

SEQ ID NO: 1520282 - RNA, 19 nt, Homo sapiens
cauguaaggugaacaacuu

SEQ ID NO: 1520283 - RNA, 19 nt, Homo sapiens
ccacagcuccuccuccuuu

SEQ ID NO: 1520284 - RNA, 19 nt, Homo sapiens
gaaccugccugagaaacug

SEQ ID NO: 1520285 - RNA, 19 nt, Homo sapiens
gaagaaaacuccacaaagc

SEQ ID NO: 1520286 - RNA, 19 nt, Homo sapiens
ccacaaagccaggcaaaga

SEQ ID NO: 1520287 - RNA, 19 nt, Homo sapiens
gaggcgagcuugguaagga

SEQ ID NO: 1520288 - RNA, 19 nt, Homo sapiens
ucuagaaccugccugagaa

SEQ ID NO: 1520289 - RNA, 19 nt, Homo sapiens
gaaacugcagcuacagaaa

SEQ ID NO: 1520290 - RNA, 19 nt, Homo sapiens
agugaaggcucgucuagaa

SEQ ID NO: 1520291 - RNA, 19 nt, Homo sapiens
cacagcaccuugucacuga

SEQ ID NO: 1520292 - RNA, 19 nt, Homo sapiens
gaaauggggucucacuaug

SEQ ID NO: 1520293 - RNA, 19 nt, Homo sapiens
gacauucaguggagacuca

SEQ ID NO: 1520294 - RNA, 19 nt, Homo sapiens
ggaggaaacugcagaaaag

SEQ ID NO: 1520295 - RNA, 19 nt, Homo sapiens
gacaacuggucaaacaaga

SEQ ID NO: 1520296 - RNA, 19 nt, Homo sapiens
ccaaagugcugagaugaca

SEQ ID NO: 1520297 - RNA, 19 nt, Homo sapiens
agaaggagccggcauuuca

SEQ ID NO: 1520298 - RNA, 19 nt, Homo sapiens
guggagcccuucacccaaa

SEQ ID NO: 1520299 - RNA, 19 nt, Homo sapiens
guaaaucaccucggcagaa

SEQ ID NO: 1520300 - RNA, 19 nt, Homo sapiens
aaaccaugacugccacuua

SEQ ID NO: 1520301 - RNA, 19 nt, Homo sapiens
ggagaaaggagcauguaag

SEQ ID NO: 1520302 - RNA, 19 nt, Homo sapiens
uuacaaggaccagacuuua

SEQ ID NO: 1520303 - RNA, 19 nt, Homo sapiens
gaaaggacagggcagucuu

SEQ ID NO: 1520304 - RNA, 19 nt, Homo sapiens
gagcauguaaggugaacaa

SEQ ID NO: 1520305 - RNA, 19 nt, Homo sapiens
ccaaaucggcuuacuuucu

SEQ ID NO: 1520306 - RNA, 19 nt, Homo sapiens
aaccaaaucggcuuacuuu

SEQ ID NO: 1520307 - RNA, 19 nt, Homo sapiens
gaucgcagcccaccuuugg

SEQ ID NO: 1520308 - RNA, 19 nt, Homo sapiens
ggacaacuggucaaacaag

SEQ ID NO: 1520309 - RNA, 19 nt, Homo sapiens
aaacagauggucaaguaga

SEQ ID NO: 1520310 - RNA, 19 nt, Homo sapiens
gcagugggaucaggacagu

SEQ ID NO: 1520311 - RNA, 19 nt, Homo sapiens
gagaaacugcagcuacaga

SEQ ID NO: 1520312 - RNA, 19 nt, Homo sapiens
gaugcugucugcagugaag

SEQ ID NO: 1520313 - RNA, 19 nt, Homo sapiens
cgcacacggucaugacaua

SEQ ID NO: 1520314 - RNA, 19 nt, Homo sapiens
gagaaaggagcauguaagg

SEQ ID NO: 1520315 - RNA, 19 nt, Homo sapiens
gaaauuguagugacgaaac

SEQ ID NO: 1520316 - RNA, 19 nt, Homo sapiens
caugaccuguggcuucuga

SEQ ID NO: 1520317 - RNA, 19 nt, Homo sapiens
ggacaagcugugacugaga

SEQ ID NO: 1520318 - RNA, 19 nt, Homo sapiens
gaggagaaaggagcaugua

SEQ ID NO: 1520319 - RNA, 19 nt, Homo sapiens
cggcuuacuuucugauaau

SEQ ID NO: 1520320 - RNA, 19 nt, Homo sapiens
gcccuucacccaaacauga

SEQ ID NO: 1520321 - RNA, 19 nt, Homo sapiens
gcaugagaaucacuugaac

SEQ ID NO: 1520322 - RNA, 19 nt, Homo sapiens
ccaagagugccgaggauga

SEQ ID NO: 1520323 - RNA, 19 nt, Homo sapiens
guuacaaggaccagacuuu

SEQ ID NO: 1520324 - RNA, 19 nt, Homo sapiens
cuagaaaacuggacaaagu

SEQ ID NO: 1520325 - RNA, 19 nt, Homo sapiens
uacaaggaccagacuuuaa

SEQ ID NO: 1520326 - RNA, 19 nt, Homo sapiens
gcucucuuguuucucacua

SEQ ID NO: 1520327 - RNA, 19 nt, Homo sapiens
ggcaugagaaucacuugaa

SEQ ID NO: 1520328 - RNA, 19 nt, Homo sapiens
gcagugaaggcucgucuag

SEQ ID NO: 1520329 - RNA, 19 nt, Homo sapiens
acaaggaccagacuuuaau

SEQ ID NO: 1520330 - RNA, 19 nt, Homo sapiens
acaacuguuugcagacauu

SEQ ID NO: 1520331 - RNA, 19 nt, Homo sapiens
ucuguuagcucuuuucuug

SEQ ID NO: 1520332 - RNA, 19 nt, Homo sapiens
gaaaacuggacaaaguaua

SEQ ID NO: 1520333 - RNA, 19 nt, Homo sapiens
gaagacagguccccaaagc

SEQ ID NO: 1520334 - RNA, 19 nt, Homo sapiens
ccuguaaucccagaacuuu

SEQ ID NO: 1520335 - RNA, 19 nt, Homo sapiens
aaacugcagcuacagaaau

SEQ ID NO: 1520336 - RNA, 19 nt, Homo sapiens
ggcuuacuuucugauaaua

SEQ ID NO: 1520337 - RNA, 19 nt, Homo sapiens
uaaccaaaucggcuuacuu

SEQ ID NO: 1520338 - RNA, 19 nt, Homo sapiens
cugagaaacugcagcuaca

SEQ ID NO: 1520339 - RNA, 19 nt, Homo sapiens
gaaacagauggucaaguag

SEQ ID NO: 1520340 - RNA, 19 nt, Homo sapiens
ucacugaagcuacaggaau

SEQ ID NO: 1520341 - RNA, 19 nt, Homo sapiens
ccaggaggcgagcuuggua

SEQ ID NO: 1520342 - RNA, 19 nt, Homo sapiens
uuggacaacuggucaaaca

SEQ ID NO: 1520343 - RNA, 19 nt, Homo sapiens
ucggcuuacuuucugauaa

SEQ ID NO: 1520344 - RNA, 19 nt, Homo sapiens
aaccaugacugccacuuag

SEQ ID NO: 1520345 - RNA, 19 nt, Homo sapiens
caggacaagcugugacuga

SEQ ID NO: 1520346 - RNA, 19 nt, Homo sapiens
gguggugcaugccuguaau

SEQ ID NO: 1520347 - RNA, 19 nt, Homo sapiens
uccacacggugaccuguaa

SEQ ID NO: 1520348 - RNA, 19 nt, Homo sapiens
gaagggagacaggcaaggu

SEQ ID NO: 1520349 - RNA, 19 nt, Homo sapiens
gcacucacuucugcuucug

SEQ ID NO: 1520350 - RNA, 19 nt, Homo sapiens
cacugaagcuacaggaauc

SEQ ID NO: 1520351 - RNA, 19 nt, Homo sapiens
ggccaggaguucacaacca

SEQ ID NO: 1520352 - RNA, 19 nt, Homo sapiens
aaauaaccaaaucggcuua

SEQ ID NO: 1520353 - RNA, 19 nt, Homo sapiens
agaugucuguuagcucuuu

SEQ ID NO: 1520354 - RNA, 19 nt, Homo sapiens
gucaaguagaugucuguua

SEQ ID NO: 1520355 - RNA, 19 nt, Homo sapiens
gggcagucuuggaacuuuc

SEQ ID NO: 1520356 - RNA, 19 nt, Homo sapiens
ccugcucucuuguuucuca

SEQ ID NO: 1520357 - RNA, 19 nt, Homo sapiens
ggacauguggagguugcua

SEQ ID NO: 1520358 - RNA, 19 nt, Homo sapiens
caggugggcagcagacuug

SEQ ID NO: 1520359 - RNA, 19 nt, Homo sapiens
gccuguacauguauagaag

SEQ ID NO: 1520360 - RNA, 19 nt, Homo sapiens
ucucuugagucuguacuga

SEQ ID NO: 1520361 - RNA, 19 nt, Homo sapiens
caaggaggaaacugcagaa

SEQ ID NO: 1520362 - RNA, 19 nt, Homo sapiens
caaggaccagacuuuaaug

SEQ ID NO: 1520363 - RNA, 19 nt, Homo sapiens
gaacuccugggcucaagca

SEQ ID NO: 1520364 - RNA, 19 nt, Homo sapiens
gaccagccuguacauguau

SEQ ID NO: 1520365 - RNA, 19 nt, Homo sapiens
cagaaaagagcuccagaaa

SEQ ID NO: 1520366 - RNA, 19 nt, Homo sapiens
gaagcagagguugcaguga

SEQ ID NO: 1520367 - RNA, 19 nt, Homo sapiens
agaaacugcagcuacagaa

SEQ ID NO: 1520368 - RNA, 19 nt, Homo sapiens
aggguucucuugagucugu

SEQ ID NO: 1520369 - RNA, 19 nt, Homo sapiens
ggaaggaccugaaggauuu

SEQ ID NO: 1520370 - RNA, 19 nt, Homo sapiens
caucaaagcuggcguguga

SEQ ID NO: 1520371 - RNA, 19 nt, Homo sapiens
ucacaaagcaacaucaaua

SEQ ID NO: 1520372 - RNA, 19 nt, Homo sapiens
gggaaggaccugaaggauu

SEQ ID NO: 1520373 - RNA, 19 nt, Homo sapiens
agaagcaggccuuguguuu

SEQ ID NO: 1520374 - RNA, 19 nt, Homo sapiens
cacaaagcaacaucaauaa

SEQ ID NO: 1520375 - RNA, 19 nt, Homo sapiens
ugaaggauuuggaguugau

SEQ ID NO: 1520376 - RNA, 19 nt, Homo sapiens
gauaagaggcagggaagga

SEQ ID NO: 1520377 - RNA, 19 nt, Homo sapiens
ccugaaggauuuggaguug

SEQ ID NO: 1520378 - RNA, 19 nt, Homo sapiens
acaggcaggugcugggaaa

SEQ ID NO: 1520379 - RNA, 19 nt, Homo sapiens
gaagcaggccuuguguuuc

SEQ ID NO: 1520380 - RNA, 19 nt, Homo sapiens
ggcuauaaauuuguucuca

SEQ ID NO: 1520381 - RNA, 19 nt, Homo sapiens
ccagcggccucugauaaga

SEQ ID NO: 1520382 - RNA, 19 nt, Homo sapiens
gcacuucaaggaugacaag

SEQ ID NO: 1520383 - RNA, 19 nt, Homo sapiens
ugacaagaccaaagaagca

SEQ ID NO: 1520384 - RNA, 19 nt, Homo sapiens
gcaccugcacuucaaggau

SEQ ID NO: 1520385 - RNA, 19 nt, Homo sapiens
ucaaggaugacaagaccaa

SEQ ID NO: 1520386 - RNA, 19 nt, Homo sapiens
gaugacaagaccaaagaag

SEQ ID NO: 1520387 - RNA, 19 nt, Homo sapiens
uagccuguguguuugacaa

SEQ ID NO: 1520388 - RNA, 19 nt, Homo sapiens
ggaugacaagaccaaagaa

SEQ ID NO: 1520389 - RNA, 19 nt, Homo sapiens
uggaccagcuggagaaggu

SEQ ID NO: 1520390 - RNA, 19 nt, Homo sapiens
cccaggcuauaaauuuguu

SEQ ID NO: 1520391 - RNA, 19 nt, Homo sapiens
aagcuggcgugugaccuuu

SEQ ID NO: 1520392 - RNA, 19 nt, Homo sapiens
aagcaggccuuguguuucc

SEQ ID NO: 1520393 - RNA, 19 nt, Homo sapiens
gcugccuccugcccacauu

SEQ ID NO: 1520394 - RNA, 19 nt, Homo sapiens
gaaggauuuggaguugauu

SEQ ID NO: 1520395 - RNA, 19 nt, Homo sapiens
gagaagagauggccaagag

SEQ ID NO: 1520396 - RNA, 19 nt, Homo sapiens
ucaaggagguggagcauau

SEQ ID NO: 1520397 - RNA, 19 nt, Homo sapiens
gagaggcacuccaucauca

SEQ ID NO: 1520398 - RNA, 19 nt, Homo sapiens
gcacucacguccucagcaa

SEQ ID NO: 1520399 - RNA, 19 nt, Homo sapiens
cagaacaaguccauucaga

SEQ ID NO: 1520400 - RNA, 19 nt, Homo sapiens
caacagaacaaguccauuc

SEQ ID NO: 1520401 - RNA, 19 nt, Homo sapiens
aagagaagaugcagacaga

SEQ ID NO: 1520402 - RNA, 19 nt, Homo sapiens
ugauggagacuauugauaa

SEQ ID NO: 1520403 - RNA, 19 nt, Homo sapiens
gcaacaaccagaucaguca

SEQ ID NO: 1520404 - RNA, 19 nt, Homo sapiens
agucuaaacuccucagaga

SEQ ID NO: 1520405 - RNA, 19 nt, Homo sapiens
gaaaacuccuccaacagaa

SEQ ID NO: 1520406 - RNA, 19 nt, Homo sapiens
gcgcuugccuacagcagaa

SEQ ID NO: 1520407 - RNA, 19 nt, Homo sapiens
gauggagacuauugauaag

SEQ ID NO: 1520408 - RNA, 19 nt, Homo sapiens
cugcagagcgggagucuaa

SEQ ID NO: 1520409 - RNA, 19 nt, Homo sapiens
ccaagcaguuccucgacuu

SEQ ID NO: 1520410 - RNA, 19 nt, Homo sapiens
gaccugcgcuggaauaacg

SEQ ID NO: 1520411 - RNA, 19 nt, Homo sapiens
ccaaagcggaccuugacua

SEQ ID NO: 1520412 - RNA, 19 nt, Homo sapiens
agaacgccguccuggcuua

SEQ ID NO: 1520413 - RNA, 19 nt, Homo sapiens
cagcugggccugcaaguug

SEQ ID NO: 1520414 - RNA, 19 nt, Homo sapiens
ggaaauacagcgcguuugc

SEQ ID NO: 1520415 - RNA, 19 nt, Homo sapiens
gagcugagccgagugaaag

SEQ ID NO: 1520416 - RNA, 19 nt, Homo sapiens
ggaaaacuccuccaacaga

SEQ ID NO: 1520417 - RNA, 19 nt, Homo sapiens
ggaccuggcugggaacaac

SEQ ID NO: 1520418 - RNA, 19 nt, Homo sapiens
ggcaggagaugaccagcau

SEQ ID NO: 1520419 - RNA, 19 nt, Homo sapiens
ggacauggagaagagaaga

SEQ ID NO: 1520420 - RNA, 19 nt, Homo sapiens
cguuugcacuuugugauaa

SEQ ID NO: 1520421 - RNA, 19 nt, Homo sapiens
gauaagcagcgagaagaga

SEQ ID NO: 1520422 - RNA, 19 nt, Homo sapiens
ggacuuaaagggcaacaac

SEQ ID NO: 1520423 - RNA, 19 nt, Homo sapiens
gcguuugcacuuugugaua

SEQ ID NO: 1520424 - RNA, 19 nt, Homo sapiens
gggcgagcuuccugcagaa

SEQ ID NO: 1520425 - RNA, 19 nt, Homo sapiens
ggagaaguccaagcaguuc

SEQ ID NO: 1520426 - RNA, 19 nt, Homo sapiens
ggagcugagccgagugaaa

SEQ ID NO: 1520427 - RNA, 19 nt, Homo sapiens
gagcgccagcugaaaguga

SEQ ID NO: 1520428 - RNA, 19 nt, Homo sapiens
gcugcgcuuucuggacuua

SEQ ID NO: 1520429 - RNA, 19 nt, Homo sapiens
gaggagcugagccgaguga

SEQ ID NO: 1520430 - RNA, 19 nt, Homo sapiens
gcaguuccucgacuugaug

SEQ ID NO: 1520431 - RNA, 19 nt, Homo sapiens
gaaauacagcgcguuugca

SEQ ID NO: 1520432 - RNA, 19 nt, Homo sapiens
caaagcggaccuugacuac

SEQ ID NO: 1520433 - RNA, 19 nt, Homo sapiens
guuugcacuuugugauaaa

SEQ ID NO: 1520434 - RNA, 19 nt, Homo sapiens
uggcucaccuggaggacaa

SEQ ID NO: 1520435 - RNA, 19 nt, Homo sapiens
ccgaaagccugcgcaucaa

SEQ ID NO: 1520436 - RNA, 19 nt, Homo sapiens
gggaggagaaguccaagca

SEQ ID NO: 1520437 - RNA, 19 nt, Homo sapiens
uggagacuauugauaagca

SEQ ID NO: 1520438 - RNA, 19 nt, Homo sapiens
gagcugaucaaggccaaga

SEQ ID NO: 1520439 - RNA, 19 nt, Homo sapiens
gagcugguccugagugacu

SEQ ID NO: 1520440 - RNA, 19 nt, Homo sapiens
ucaccaccuuccaggagaa

SEQ ID NO: 1520441 - RNA, 19 nt, Homo sapiens
ccucagagccguggagcaa

SEQ ID NO: 1520442 - RNA, 19 nt, Homo sapiens
gccucacgcuggaguggaa

SEQ ID NO: 1520443 - RNA, 19 nt, Homo sapiens
auacagcgcguuugcacuu

SEQ ID NO: 1520444 - RNA, 19 nt, Homo sapiens
gcagagcgggagucuaaac

SEQ ID NO: 1520445 - RNA, 19 nt, Homo sapiens
ggacagggagagcgagaac

SEQ ID NO: 1520446 - RNA, 19 nt, Homo sapiens
uccgaaagccugcgcauca

SEQ ID NO: 1520447 - RNA, 19 nt, Homo sapiens
caucaucaacgcucucaag

SEQ ID NO: 1520448 - RNA, 19 nt, Homo sapiens
acaaccagaucagucacaa

SEQ ID NO: 1520449 - RNA, 19 nt, Homo sapiens
cuaaacuccucagagacuu

SEQ ID NO: 1520450 - RNA, 19 nt, Homo sapiens
ccaagcugcagaugacaga

SEQ ID NO: 1520451 - RNA, 19 nt, Homo sapiens
ugaaugagaggcacuccau

SEQ ID NO: 1520452 - RNA, 19 nt, Homo sapiens
cggagcugguccugaguga

SEQ ID NO: 1520453 - RNA, 19 nt, Homo sapiens
ucgacuugauggagacuau

SEQ ID NO: 1520454 - RNA, 19 nt, Homo sapiens
aggaggcgcugagggagaa

SEQ ID NO: 1520455 - RNA, 19 nt, Homo sapiens
ggcuggaccuccgcaacaa

SEQ ID NO: 1520456 - RNA, 19 nt, Homo sapiens
acagcgcguuugcacuuug

SEQ ID NO: 1520457 - RNA, 19 nt, Homo sapiens
caacaccgugcugcgcuuu

SEQ ID NO: 1520458 - RNA, 19 nt, Homo sapiens
caggagaugaccagcaugu

SEQ ID NO: 1520459 - RNA, 19 nt, Homo sapiens
aaugagaggcacuccauca

SEQ ID NO: 1520460 - RNA, 19 nt, Homo sapiens
gacuugauggagacuauug

SEQ ID NO: 1520461 - RNA, 19 nt, Homo sapiens
gcccaaagcggaccuugac

SEQ ID NO: 1520462 - RNA, 19 nt, Homo sapiens
cagcgcguuugcacuuugu

SEQ ID NO: 1520463 - RNA, 19 nt, Homo sapiens
aaaccagguagacgaguug

SEQ ID NO: 1520464 - RNA, 19 nt, Homo sapiens
cacagaggcaggccaagga

SEQ ID NO: 1520465 - RNA, 19 nt, Homo sapiens
ugagaggcacuccaucauc

SEQ ID NO: 1520466 - RNA, 19 nt, Homo sapiens
gcaaugaccuguccacuuc

SEQ ID NO: 1520467 - RNA, 19 nt, Homo sapiens
gaagacacauucagagguu

SEQ ID NO: 1520468 - RNA, 19 nt, Homo sapiens
gaaucgggauccagaauuu

SEQ ID NO: 1520469 - RNA, 19 nt, Homo sapiens
gaaggagccauuucaguua

SEQ ID NO: 1520470 - RNA, 19 nt, Homo sapiens
gacaagaccucauaacugu

SEQ ID NO: 1520471 - RNA, 19 nt, Homo sapiens
gaaaugucccuauaaagaa

SEQ ID NO: 1520472 - RNA, 19 nt, Homo sapiens
gaacucaaacucuucaauu

SEQ ID NO: 1520473 - RNA, 19 nt, Homo sapiens
uuacauagcuucuccaaca

SEQ ID NO: 1520474 - RNA, 19 nt, Homo sapiens
gcacugaacuucggcucua

SEQ ID NO: 1520475 - RNA, 19 nt, Homo sapiens
acaacaagcuucuuucuuc

SEQ ID NO: 1520476 - RNA, 19 nt, Homo sapiens
ggaaaggccauacgaagaa

SEQ ID NO: 1520477 - RNA, 19 nt, Homo sapiens
ucaguuaacucaagugaau

SEQ ID NO: 1520478 - RNA, 19 nt, Homo sapiens
ugaaaugucccuauaaaga

SEQ ID NO: 1520479 - RNA, 19 nt, Homo sapiens
gaaagaagagacagacaga

SEQ ID NO: 1520480 - RNA, 19 nt, Homo sapiens
gcaaagauugacauuauug

SEQ ID NO: 1520481 - RNA, 19 nt, Homo sapiens
gaaaggccauacgaagaaa

SEQ ID NO: 1520482 - RNA, 19 nt, Homo sapiens
ggacaagaccucauaacug

SEQ ID NO: 1520483 - RNA, 19 nt, Homo sapiens
aggcaaagauugacauuau

SEQ ID NO: 1520484 - RNA, 19 nt, Homo sapiens
gaaggaaauuggcuagucu

SEQ ID NO: 1520485 - RNA, 19 nt, Homo sapiens
gcucuacguugaugaagaa

SEQ ID NO: 1520486 - RNA, 19 nt, Homo sapiens
ggacagaggcggaucuuag

SEQ ID NO: 1520487 - RNA, 19 nt, Homo sapiens
caacaagcuucuuucuuca

SEQ ID NO: 1520488 - RNA, 19 nt, Homo sapiens
ggaaggaaauuggcuaguc

SEQ ID NO: 1520489 - RNA, 19 nt, Homo sapiens
gaucagugguaaugggaaa

SEQ ID NO: 1520490 - RNA, 19 nt, Homo sapiens
uaaagaaugagucgaacua

SEQ ID NO: 1520491 - RNA, 19 nt, Homo sapiens
ucaagugaaugaaagaguu

SEQ ID NO: 1520492 - RNA, 19 nt, Homo sapiens
gaagcgagcuaccaaaaga

SEQ ID NO: 1520493 - RNA, 19 nt, Homo sapiens
gacggcaucugcuaccuuu

SEQ ID NO: 1520494 - RNA, 19 nt, Homo sapiens
ccucauaacugugauuaau

SEQ ID NO: 1520495 - RNA, 19 nt, Homo sapiens
gcaaacugcuagaacucaa

SEQ ID NO: 1520496 - RNA, 19 nt, Homo sapiens
gaggacaacugugaacuca

SEQ ID NO: 1520497 - RNA, 19 nt, Homo sapiens
ggaaauacagauucuuugu

SEQ ID NO: 1520498 - RNA, 19 nt, Homo sapiens
ucugaaaugucccuauaaa

SEQ ID NO: 1520499 - RNA, 19 nt, Homo sapiens
uaacucaagugaaugaaag

SEQ ID NO: 1520500 - RNA, 19 nt, Homo sapiens
caaagaaggagccauuuca

SEQ ID NO: 1520501 - RNA, 19 nt, Homo sapiens
ggcaaagauugacauuauu

SEQ ID NO: 1520502 - RNA, 19 nt, Homo sapiens
gcgcugcucuucccugaga

SEQ ID NO: 1520503 - RNA, 19 nt, Homo sapiens
ucacuugggugcagcagaa

SEQ ID NO: 1520504 - RNA, 19 nt, Homo sapiens
ucucagaguuuacacauuc

SEQ ID NO: 1520505 - RNA, 19 nt, Homo sapiens
guuuauagccaucauguuu

SEQ ID NO: 1520506 - RNA, 19 nt, Homo sapiens
gaacuucagaucagggaaa

SEQ ID NO: 1520507 - RNA, 19 nt, Homo sapiens
cuacguugaugaagaagaa

SEQ ID NO: 1520508 - RNA, 19 nt, Homo sapiens
ggaggccucugcugucaau

SEQ ID NO: 1520509 - RNA, 19 nt, Homo sapiens
ucagugggauuaucaagga

SEQ ID NO: 1520510 - RNA, 19 nt, Homo sapiens
cuggagagcuuucugguau

SEQ ID NO: 1520511 - RNA, 19 nt, Homo sapiens
caacucaucauucugaaau

SEQ ID NO: 1520512 - RNA, 19 nt, Homo sapiens
ggaacuggagcaucauaaa

SEQ ID NO: 1520513 - RNA, 19 nt, Homo sapiens
caaauugugcuuucugaug

SEQ ID NO: 1520514 - RNA, 19 nt, Homo sapiens
agacgucuccuaagcauuu

SEQ ID NO: 1520515 - RNA, 19 nt, Homo sapiens
ucagggaaaucuccacuuc

SEQ ID NO: 1520516 - RNA, 19 nt, Homo sapiens
gggaaaggccauacgaaga

SEQ ID NO: 1520517 - RNA, 19 nt, Homo sapiens
caucuuggccaucacuaua

SEQ ID NO: 1520518 - RNA, 19 nt, Homo sapiens
gaagagacagacagagugu

SEQ ID NO: 1520519 - RNA, 19 nt, Homo sapiens
gggaugaggacaacuguga

SEQ ID NO: 1520520 - RNA, 19 nt, Homo sapiens
gaacuggagcaucauaaag

SEQ ID NO: 1520521 - RNA, 19 nt, Homo sapiens
ucaaggaacuucagaucag

SEQ ID NO: 1520522 - RNA, 19 nt, Homo sapiens
cugauugacucugauuaua

SEQ ID NO: 1520523 - RNA, 19 nt, Homo sapiens
cgaagaaacagcagugguu

SEQ ID NO: 1520524 - RNA, 19 nt, Homo sapiens
caagaccucauaacuguga

SEQ ID NO: 1520525 - RNA, 19 nt, Homo sapiens
gaaggcagcccaggaguca

SEQ ID NO: 1520526 - RNA, 19 nt, Homo sapiens
ccacuucaaacacagauaa

SEQ ID NO: 1520527 - RNA, 19 nt, Homo sapiens
ggaaucgggauccagaauu

SEQ ID NO: 1520528 - RNA, 19 nt, Homo sapiens
gaauuuggccauuggaauc

SEQ ID NO: 1520529 - RNA, 19 nt, Homo sapiens
agaaggagccauuucaguu

SEQ ID NO: 1520530 - RNA, 19 nt, Homo sapiens
gagcaugucuuccuuuacc

SEQ ID NO: 1520531 - RNA, 19 nt, Homo sapiens
gcccuacgcucuggccuuu

SEQ ID NO: 1520532 - RNA, 19 nt, Homo sapiens
gaacuuuccauccggauag

SEQ ID NO: 1520533 - RNA, 19 nt, Homo sapiens
ugaaucuccugcucuguga

SEQ ID NO: 1520534 - RNA, 19 nt, Homo sapiens
gaguuuacacauucaauug

SEQ ID NO: 1520535 - RNA, 19 nt, Homo sapiens
aaggagccauuucaguuaa

SEQ ID NO: 1520536 - RNA, 19 nt, Homo sapiens
gcuucuuucuucacauuaa

SEQ ID NO: 1520537 - RNA, 19 nt, Homo sapiens
gagucgaacuagaccagaa

SEQ ID NO: 1520538 - RNA, 19 nt, Homo sapiens
agauggaagucuuggcuuu

SEQ ID NO: 1520539 - RNA, 19 nt, Homo sapiens
gcgcuuuccaaauuucuua

SEQ ID NO: 1520540 - RNA, 19 nt, Homo sapiens
gaaaagacggcaucugcua

SEQ ID NO: 1520541 - RNA, 19 nt, Homo sapiens
ggugaggcauaucagagaa

SEQ ID NO: 1520542 - RNA, 19 nt, Homo sapiens
guuaaaggcacacgugaga

SEQ ID NO: 1520543 - RNA, 19 nt, Homo sapiens
auucugaaaugucccuaua

SEQ ID NO: 1520544 - RNA, 19 nt, Homo sapiens
ggaucgcacugcucaucuu

SEQ ID NO: 1520545 - RNA, 19 nt, Homo sapiens
gccuacuccuucuuacaua

SEQ ID NO: 1520546 - RNA, 19 nt, Homo sapiens
caagugaaugaaagaguuu

SEQ ID NO: 1520547 - RNA, 19 nt, Homo sapiens
ggacaacaagcuucuuucu

SEQ ID NO: 1520548 - RNA, 19 nt, Homo sapiens
ggagagcuuucugguaugg

SEQ ID NO: 1520549 - RNA, 19 nt, Homo sapiens
ggaauuuggccauuggaau

SEQ ID NO: 1520550 - RNA, 19 nt, Homo sapiens
uaaugcaaauugugcuuuc

SEQ ID NO: 1520551 - RNA, 19 nt, Homo sapiens
aagaaugagucgaacuaga

SEQ ID NO: 1520552 - RNA, 19 nt, Homo sapiens
gacagaggcggaucuuaga

SEQ ID NO: 1520553 - RNA, 19 nt, Homo sapiens
guuggcagcuuccuauugg

SEQ ID NO: 1520554 - RNA, 19 nt, Homo sapiens
ggucauggacgacaucauc

SEQ ID NO: 1520555 - RNA, 19 nt, Homo sapiens
gagguuugauugguugaga

SEQ ID NO: 1520556 - RNA, 19 nt, Homo sapiens
ggcauugcauugucagugu

SEQ ID NO: 1520557 - RNA, 19 nt, Homo sapiens
gaccucauaacugugauua

SEQ ID NO: 1520558 - RNA, 19 nt, Homo sapiens
gggcagcucucguguucgu

SEQ ID NO: 1520559 - RNA, 19 nt, Homo sapiens
aagcuucuuucuucacauu

SEQ ID NO: 1520560 - RNA, 19 nt, Homo sapiens
agacggcccuggcacugaa

SEQ ID NO: 1520561 - RNA, 19 nt, Homo sapiens
gggucucgcuguuggaguu

SEQ ID NO: 1520562 - RNA, 19 nt, Homo sapiens
ccucugcugucaauggauu

SEQ ID NO: 1520563 - RNA, 19 nt, Homo sapiens
aaagacgucuccuaagcau

SEQ ID NO: 1520564 - RNA, 19 nt, Homo sapiens
gacaacaagcuucuuucuu

SEQ ID NO: 1520565 - RNA, 19 nt, Homo sapiens
ugagaauggugaggcauau

SEQ ID NO: 1520566 - RNA, 19 nt, Homo sapiens
gaagaaaccugucauuaug

SEQ ID NO: 1520567 - RNA, 19 nt, Homo sapiens
gaacagcguuuaaugaaug

SEQ ID NO: 1520568 - RNA, 19 nt, Homo sapiens
caaauaguguguaauggua

SEQ ID NO: 1520569 - RNA, 19 nt, Homo sapiens
gaagauauaagguccauuu

SEQ ID NO: 1520570 - RNA, 19 nt, Homo sapiens
ggaagaaaccugucauuau

SEQ ID NO: 1520571 - RNA, 19 nt, Homo sapiens
ugaauacucugcacuauga

SEQ ID NO: 1520572 - RNA, 19 nt, Homo sapiens
gaaccaaccaacauaauuu

SEQ ID NO: 1520573 - RNA, 19 nt, Homo sapiens
gauauaagguccauuugug

SEQ ID NO: 1520574 - RNA, 19 nt, Homo sapiens
gaacagacauuagcuuaag

SEQ ID NO: 1520575 - RNA, 19 nt, Homo sapiens
ggaaagaguggauaauaaa

SEQ ID NO: 1520576 - RNA, 19 nt, Homo sapiens
gacaaacgcaguauuuaua

SEQ ID NO: 1520577 - RNA, 19 nt, Homo sapiens
caucaguugucuaucauua

SEQ ID NO: 1520578 - RNA, 19 nt, Homo sapiens
agacagagauguucagguu

SEQ ID NO: 1520579 - RNA, 19 nt, Homo sapiens
ggagagggaugaggaugua

SEQ ID NO: 1520580 - RNA, 19 nt, Homo sapiens
gcaccagaauuaucaguga

SEQ ID NO: 1520581 - RNA, 19 nt, Homo sapiens
ugagggaucuuacaaauag

SEQ ID NO: 1520582 - RNA, 19 nt, Homo sapiens
uagagcagcuuucagguuu

SEQ ID NO: 1520583 - RNA, 19 nt, Homo sapiens
uggaaagaguggauaauaa

SEQ ID NO: 1520584 - RNA, 19 nt, Homo sapiens
gaagguacaucugguuuua

SEQ ID NO: 1520585 - RNA, 19 nt, Homo sapiens
uaagugcugugcauaacua

SEQ ID NO: 1520586 - RNA, 19 nt, Homo sapiens
gaacacagucgugaggaua

SEQ ID NO: 1520587 - RNA, 19 nt, Homo sapiens
cuaugaagcaccagaauua

SEQ ID NO: 1520588 - RNA, 19 nt, Homo sapiens
ggaacagcguuuaaugaau

SEQ ID NO: 1520589 - RNA, 19 nt, Homo sapiens
caaauaggagugauugaaa

SEQ ID NO: 1520590 - RNA, 19 nt, Homo sapiens
gacauuugaucuggaauuu

SEQ ID NO: 1520591 - RNA, 19 nt, Homo sapiens
uaagguccauuugugaaua

SEQ ID NO: 1520592 - RNA, 19 nt, Homo sapiens
ggaaccaaccaacauaauu

SEQ ID NO: 1520593 - RNA, 19 nt, Homo sapiens
ugagguggauugaugauga

SEQ ID NO: 1520594 - RNA, 19 nt, Homo sapiens
gcaagcacauuauuuccau

SEQ ID NO: 1520595 - RNA, 19 nt, Homo sapiens
gugcauaacuauuguacau

SEQ ID NO: 1520596 - RNA, 19 nt, Homo sapiens
ggucagccuuucucacaaa

SEQ ID NO: 1520597 - RNA, 19 nt, Homo sapiens
caaggaaccaaccaacaua

SEQ ID NO: 1520598 - RNA, 19 nt, Homo sapiens
guaccugaauugaaaugaa

SEQ ID NO: 1520599 - RNA, 19 nt, Homo sapiens
ccagacaaacgcaguauuu

SEQ ID NO: 1520600 - RNA, 19 nt, Homo sapiens
gauacccucuccagacaaa

SEQ ID NO: 1520601 - RNA, 19 nt, Homo sapiens
gacauuagcuuaaguuuuc

SEQ ID NO: 1520602 - RNA, 19 nt, Homo sapiens
gaacccauuuaagucauuu

SEQ ID NO: 1520603 - RNA, 19 nt, Homo sapiens
agacagcauuucccacuuu

SEQ ID NO: 1520604 - RNA, 19 nt, Homo sapiens
gaaacucuuuaucuucuca

SEQ ID NO: 1520605 - RNA, 19 nt, Homo sapiens
cagaacagacauuagcuua

SEQ ID NO: 1520606 - RNA, 19 nt, Homo sapiens
gaaauggugguuugcuauu

SEQ ID NO: 1520607 - RNA, 19 nt, Homo sapiens
gcagcaagcacauuauuuc

SEQ ID NO: 1520608 - RNA, 19 nt, Homo sapiens
gauaaugggaauuuacuga

SEQ ID NO: 1520609 - RNA, 19 nt, Homo sapiens
gcauauuucuaucgcuuga

SEQ ID NO: 1520610 - RNA, 19 nt, Homo sapiens
gggaacagcguuuaaugaa

SEQ ID NO: 1520611 - RNA, 19 nt, Homo sapiens
aaauagcugucaucucaaa

SEQ ID NO: 1520612 - RNA, 19 nt, Homo sapiens
cauuugaucuggaauuuca

SEQ ID NO: 1520613 - RNA, 19 nt, Homo sapiens
aaauggugguuugcuauua

SEQ ID NO: 1520614 - RNA, 19 nt, Homo sapiens
gagccuuccuuccuaauca

SEQ ID NO: 1520615 - RNA, 19 nt, Homo sapiens
ucacugccuucguuaauau

SEQ ID NO: 1520616 - RNA, 19 nt, Homo sapiens
ugacaaaccaccucugcua

SEQ ID NO: 1520617 - RNA, 19 nt, Homo sapiens
gaauggaaagaguggauaa

SEQ ID NO: 1520618 - RNA, 19 nt, Homo sapiens
gagaugauccagacagaga

SEQ ID NO: 1520619 - RNA, 19 nt, Homo sapiens
gaauucagagguucaauca

SEQ ID NO: 1520620 - RNA, 19 nt, Homo sapiens
uaucagagcuuugaguaca

SEQ ID NO: 1520621 - RNA, 19 nt, Homo sapiens
uaugagggaucuuacaaau

SEQ ID NO: 1520622 - RNA, 19 nt, Homo sapiens
guuuaggucucccaagaaa

SEQ ID NO: 1520623 - RNA, 19 nt, Homo sapiens
ggaaauggugguuugcuau

SEQ ID NO: 1520624 - RNA, 19 nt, Homo sapiens
cacuuucucuauagacuua

SEQ ID NO: 1520625 - RNA, 19 nt, Homo sapiens
gaucuugugcugugucaaa

SEQ ID NO: 1520626 - RNA, 19 nt, Homo sapiens
gcugucaucucaaagaauc

SEQ ID NO: 1520627 - RNA, 19 nt, Homo sapiens
guacagagacauuugaucu

SEQ ID NO: 1520628 - RNA, 19 nt, Homo sapiens
gagcagcuuucagguuuau

SEQ ID NO: 1520629 - RNA, 19 nt, Homo sapiens
cgaccucucaggaauauuu

SEQ ID NO: 1520630 - RNA, 19 nt, Homo sapiens
ccaccacagugaccauauu

SEQ ID NO: 1520631 - RNA, 19 nt, Homo sapiens
uugccuaggugaauaaauu

SEQ ID NO: 1520632 - RNA, 19 nt, Homo sapiens
gagagaauacuuggucauu

SEQ ID NO: 1520633 - RNA, 19 nt, Homo sapiens
agauagaugugucuuggaa

SEQ ID NO: 1520634 - RNA, 19 nt, Homo sapiens
gguaaugagcaaguaaaua

SEQ ID NO: 1520635 - RNA, 19 nt, Homo sapiens
gaccuugcauucuccauca

SEQ ID NO: 1520636 - RNA, 19 nt, Homo sapiens
ggaacacgaugugaaugga

SEQ ID NO: 1520637 - RNA, 19 nt, Homo sapiens
ggagugaggaugagcuuau

SEQ ID NO: 1520638 - RNA, 19 nt, Homo sapiens
ugucuguccuugugagaua

SEQ ID NO: 1520639 - RNA, 19 nt, Homo sapiens
gauggagcaugguguuuua

SEQ ID NO: 1520640 - RNA, 19 nt, Homo sapiens
gcagcuuucagguuuauuu

SEQ ID NO: 1520641 - RNA, 19 nt, Homo sapiens
uaacaaugguccuuacacu

SEQ ID NO: 1520642 - RNA, 19 nt, Homo sapiens
gggcuacuguaaagcauau

SEQ ID NO: 1520643 - RNA, 19 nt, Homo sapiens
caaagaauccagugcuugu

SEQ ID NO: 1520644 - RNA, 19 nt, Homo sapiens
ucaaucagaacagacauua

SEQ ID NO: 1520645 - RNA, 19 nt, Homo sapiens
uugcaggucucagcuauaa

SEQ ID NO: 1520646 - RNA, 19 nt, Homo sapiens
auucagagguucaaucaga

SEQ ID NO: 1520647 - RNA, 19 nt, Homo sapiens
cagcuaggguggccaacuu

SEQ ID NO: 1520648 - RNA, 19 nt, Homo sapiens
aauggugguuugcuauuaa

SEQ ID NO: 1520649 - RNA, 19 nt, Homo sapiens
ccagugagcagacagcauu

SEQ ID NO: 1520650 - RNA, 19 nt, Homo sapiens
caaaccaccucugcuagau

SEQ ID NO: 1520651 - RNA, 19 nt, Homo sapiens
gcucagacuugacaaacca

SEQ ID NO: 1520652 - RNA, 19 nt, Homo sapiens
ugaggauaaugggaauuua

SEQ ID NO: 1520653 - RNA, 19 nt, Homo sapiens
gagguggauugaugaugaa

SEQ ID NO: 1520654 - RNA, 19 nt, Homo sapiens
guucgcaggugcugucaga

SEQ ID NO: 1520655 - RNA, 19 nt, Homo sapiens
ggcccgagauguucugguu

SEQ ID NO: 1520656 - RNA, 19 nt, Homo sapiens
caaaguaacagacuagaac

SEQ ID NO: 1520657 - RNA, 19 nt, Homo sapiens
ucagucauccuuacagaaa

SEQ ID NO: 1520658 - RNA, 19 nt, Homo sapiens
uggaagaaaccugucauua

SEQ ID NO: 1520659 - RNA, 19 nt, Homo sapiens
cgagugcauuagcucauuu

SEQ ID NO: 1520660 - RNA, 19 nt, Homo sapiens
ucauuuggguggaauacuu

SEQ ID NO: 1520661 - RNA, 19 nt, Homo sapiens
cagacaaacgcaguauuua

SEQ ID NO: 1520662 - RNA, 19 nt, Homo sapiens
gaacacgaugugaauggaa

SEQ ID NO: 1520663 - RNA, 19 nt, Homo sapiens
gagaagauauaagguccau

SEQ ID NO: 1520664 - RNA, 19 nt, Homo sapiens
gcaggucucagcuauaaca

SEQ ID NO: 1520665 - RNA, 19 nt, Homo sapiens
gaccagccaagucacauuu

SEQ ID NO: 1520666 - RNA, 19 nt, Homo sapiens
gaacuugccucuggagaug

SEQ ID NO: 1520667 - RNA, 19 nt, Homo sapiens
cugcagcucucuuuaauuu

SEQ ID NO: 1520668 - RNA, 19 nt, Homo sapiens
gcuguuggccucucuguua

SEQ ID NO: 1520669 - RNA, 19 nt, Homo sapiens
aaugagcacuugaagauuu

SEQ ID NO: 1520670 - RNA, 19 nt, Homo sapiens
gagcauaaacgcagaguuc

SEQ ID NO: 1520671 - RNA, 19 nt, Homo sapiens
cagaguagcucagauuaca

SEQ ID NO: 1520672 - RNA, 19 nt, Homo sapiens
ggacagcgugugugacaaa

SEQ ID NO: 1520673 - RNA, 19 nt, Homo sapiens
caccacgccuggcuuauga

SEQ ID NO: 1520674 - RNA, 19 nt, Homo sapiens
ggaguacaguggcacaauc

SEQ ID NO: 1520675 - RNA, 19 nt, Homo sapiens
gaagaggugcucagcugaa

SEQ ID NO: 1520676 - RNA, 19 nt, Homo sapiens
ggucauagggcagguguaa

SEQ ID NO: 1520677 - RNA, 19 nt, Homo sapiens
gaacaaugagcacuugaag

SEQ ID NO: 1520678 - RNA, 19 nt, Homo sapiens
gugcauccuuauaauugua

SEQ ID NO: 1520679 - RNA, 19 nt, Homo sapiens
gaagaaggcaugggaugga

SEQ ID NO: 1520680 - RNA, 19 nt, Homo sapiens
acaaugagcacuugaagau

SEQ ID NO: 1520681 - RNA, 19 nt, Homo sapiens
ucauguauguaggcuguua

SEQ ID NO: 1520682 - RNA, 19 nt, Homo sapiens
uagcucagauuacaguguu

SEQ ID NO: 1520683 - RNA, 19 nt, Homo sapiens
ucauagggcagguguaauu

SEQ ID NO: 1520684 - RNA, 19 nt, Homo sapiens
gaaauguuccacuucuugu

SEQ ID NO: 1520685 - RNA, 19 nt, Homo sapiens
acugauugcuguagucauu

SEQ ID NO: 1520686 - RNA, 19 nt, Homo sapiens
gaugauaagggccaaagga

SEQ ID NO: 1520687 - RNA, 19 nt, Homo sapiens
gaucacaaggucaggaguu

SEQ ID NO: 1520688 - RNA, 19 nt, Homo sapiens
ugaaauguuccacuucuug

SEQ ID NO: 1520689 - RNA, 19 nt, Homo sapiens
caccucagccuccagagua

SEQ ID NO: 1520690 - RNA, 19 nt, Homo sapiens
gccugcagcucucuuuaau

SEQ ID NO: 1520691 - RNA, 19 nt, Homo sapiens
gaggugcucagcugaagaa

SEQ ID NO: 1520692 - RNA, 19 nt, Homo sapiens
agagaacaaugagcacuug

SEQ ID NO: 1520693 - RNA, 19 nt, Homo sapiens
ggauggagcccuggcauag

SEQ ID NO: 1520694 - RNA, 19 nt, Homo sapiens
ccucaacccugucacuaag

SEQ ID NO: 1520695 - RNA, 19 nt, Homo sapiens
cauuuauggucauguaugu

SEQ ID NO: 1520696 - RNA, 19 nt, Homo sapiens
gcuagcuccuccugguuug

SEQ ID NO: 1520697 - RNA, 19 nt, Homo sapiens
guacaguggcacaaucaug

SEQ ID NO: 1520698 - RNA, 19 nt, Homo sapiens
gggauggagcccuggcaua

SEQ ID NO: 1520699 - RNA, 19 nt, Homo sapiens
ggugugguguuugccauug

SEQ ID NO: 1520700 - RNA, 19 nt, Homo sapiens
acgccuggcuuaugaugaa

SEQ ID NO: 1520701 - RNA, 19 nt, Homo sapiens
guucacuguugcagccuuu

SEQ ID NO: 1520702 - RNA, 19 nt, Homo sapiens
uuccaagggugucugcuuu

SEQ ID NO: 1520703 - RNA, 19 nt, Homo sapiens
cugaguagcugggauuaca

SEQ ID NO: 1520704 - RNA, 19 nt, Homo sapiens
ggagauggucuugcucugu

SEQ ID NO: 1520705 - RNA, 19 nt, Homo sapiens
cagcgugugugacaaaauu

SEQ ID NO: 1520706 - RNA, 19 nt, Homo sapiens
uggccucucuguuaacuca

SEQ ID NO: 1520707 - RNA, 19 nt, Homo sapiens
caccuuccaugcccucuuc

SEQ ID NO: 1520708 - RNA, 19 nt, Homo sapiens
ggcuuaugaugaauauuuc

SEQ ID NO: 1520709 - RNA, 19 nt, Homo sapiens
gcggugagccagaguaguc

SEQ ID NO: 1520710 - RNA, 19 nt, Homo sapiens
cgcaguggcucacgcuugu

SEQ ID NO: 1520711 - RNA, 19 nt, Homo sapiens
ggaccuucaucuccagcau

SEQ ID NO: 1520712 - RNA, 19 nt, Homo sapiens
gaguacaguggcacaauca

SEQ ID NO: 1520713 - RNA, 19 nt, Homo sapiens
aaacgcagaguucacuguu

SEQ ID NO: 1520714 - RNA, 19 nt, Homo sapiens
gagcaagcugccacgaaga

SEQ ID NO: 1520715 - RNA, 19 nt, Homo sapiens
cauagggcagguguaauuu

SEQ ID NO: 1520716 - RNA, 19 nt, Homo sapiens
gagaacaaugagcacuuga

SEQ ID NO: 1520717 - RNA, 19 nt, Homo sapiens
gaguagcucagauuacagu

SEQ ID NO: 1520718 - RNA, 19 nt, Homo sapiens
guccugucuuguagucuuu

SEQ ID NO: 1520719 - RNA, 19 nt, Homo sapiens
cuguuggccucucuguuaa

SEQ ID NO: 1520720 - RNA, 19 nt, Homo sapiens
ggcuagcuccuccugguuu

SEQ ID NO: 1520721 - RNA, 19 nt, Homo sapiens
caaugagcacuugaagauu

SEQ ID NO: 1520722 - RNA, 19 nt, Homo sapiens
cguccugucuuguagucuu

SEQ ID NO: 1520723 - RNA, 19 nt, Homo sapiens
caggacagcgugugugaca

SEQ ID NO: 1520724 - RNA, 19 nt, Homo sapiens
cuugaaauguuccacuucu

SEQ ID NO: 1520725 - RNA, 19 nt, Homo sapiens
cagagaacaaugagcacuu

SEQ ID NO: 1520726 - RNA, 19 nt, Homo sapiens
gugacaaaauucagaucua

SEQ ID NO: 1520727 - RNA, 19 nt, Homo sapiens
cgaggcaggcggaucacaa

SEQ ID NO: 1520728 - RNA, 19 nt, Homo sapiens
cuuguaaucccagcacuuu

SEQ ID NO: 1520729 - RNA, 19 nt, Homo sapiens
uacuugaaauguuccacuu

SEQ ID NO: 1520730 - RNA, 19 nt, Homo sapiens
ggcaugauuuugcuuguau

SEQ ID NO: 1520731 - RNA, 19 nt, Homo sapiens
ccuggcuuaugaugaauau

SEQ ID NO: 1520732 - RNA, 19 nt, Homo sapiens
ccaccacgccuggcuuaug

SEQ ID NO: 1520733 - RNA, 19 nt, Homo sapiens
caguggcucacgcuuguaa

SEQ ID NO: 1520734 - RNA, 19 nt, Homo sapiens
gcuuguauuuccggaagug

SEQ ID NO: 1520735 - RNA, 19 nt, Homo sapiens
cagagcaagcugccacgaa

SEQ ID NO: 1520736 - RNA, 19 nt, Homo sapiens
gggcaugauuuugcuugua

SEQ ID NO: 1520737 - RNA, 19 nt, Homo sapiens
ucaacccugucacuaagca

SEQ ID NO: 1520738 - RNA, 19 nt, Homo sapiens
agaacaaugagcacuugaa

SEQ ID NO: 1520739 - RNA, 19 nt, Homo sapiens
uguaggcuguuaccucaag

SEQ ID NO: 1520740 - RNA, 19 nt, Homo sapiens
uccagaguagcucagauua

SEQ ID NO: 1520741 - RNA, 19 nt, Homo sapiens
ggucuugcucugucacuca

SEQ ID NO: 1520742 - RNA, 19 nt, Homo sapiens
gaacggaacuuaauaaagg

SEQ ID NO: 1520743 - RNA, 19 nt, Homo sapiens
ugacuagcauuucugaaua

SEQ ID NO: 1520744 - RNA, 19 nt, Homo sapiens
gaacuacacgguuuaauuc

SEQ ID NO: 1520745 - RNA, 19 nt, Homo sapiens
gaacuugacuagcauuucu

SEQ ID NO: 1520746 - RNA, 19 nt, Homo sapiens
ggaccauuaucauuccuua

SEQ ID NO: 1520747 - RNA, 19 nt, Homo sapiens
uaauaaagguugccuagau

SEQ ID NO: 1520748 - RNA, 19 nt, Homo sapiens
aauaaagguugccuagaua

SEQ ID NO: 1520749 - RNA, 19 nt, Homo sapiens
cagaaacuguugauuguug

SEQ ID NO: 1520750 - RNA, 19 nt, Homo sapiens
ggaaggaccauuaucauuc

SEQ ID NO: 1520751 - RNA, 19 nt, Homo sapiens
aagaagaacuacacgguuu

SEQ ID NO: 1520752 - RNA, 19 nt, Homo sapiens
ucagaaaucuccagucaag

SEQ ID NO: 1520753 - RNA, 19 nt, Homo sapiens
aaggguaucucucggauuu

SEQ ID NO: 1520754 - RNA, 19 nt, Homo sapiens
ggaggaaggaccauuauca

SEQ ID NO: 1520755 - RNA, 19 nt, Homo sapiens
cccagaagcuugcuauuca

SEQ ID NO: 1520756 - RNA, 19 nt, Homo sapiens
gaagacagcccagaagcuu

SEQ ID NO: 1520757 - RNA, 19 nt, Homo sapiens
uggaggagccuauggauaa

SEQ ID NO: 1520758 - RNA, 19 nt, Homo sapiens
gcgaauuacuacuuugguu

SEQ ID NO: 1520759 - RNA, 19 nt, Homo sapiens
gaagaacuacacgguuuaa

SEQ ID NO: 1520760 - RNA, 19 nt, Homo sapiens
gaagcuugcuauucagaag

SEQ ID NO: 1520761 - RNA, 19 nt, Homo sapiens
ggagcuuucugaccuugaa

SEQ ID NO: 1520762 - RNA, 19 nt, Homo sapiens
gacuagcauuucugaauau

SEQ ID NO: 1520763 - RNA, 19 nt, Homo sapiens
gacaaaaccuugcuagugu

SEQ ID NO: 1520764 - RNA, 19 nt, Homo sapiens
ccaaggcgaggucauguaa

SEQ ID NO: 1520765 - RNA, 19 nt, Homo sapiens
gaagcaguauggccaagag

SEQ ID NO: 1520766 - RNA, 19 nt, Homo sapiens
ucagaaggcuuugucagau

SEQ ID NO: 1520767 - RNA, 19 nt, Homo sapiens
gaaggaccauuaucauucc

SEQ ID NO: 1520768 - RNA, 19 nt, Homo sapiens
uaaggcaguucaacaucaa

SEQ ID NO: 1520769 - RNA, 19 nt, Homo sapiens
uaaaauagcuguggaguac

SEQ ID NO: 1520770 - RNA, 19 nt, Homo sapiens
gguggaggaaggaccauua

SEQ ID NO: 1520771 - RNA, 19 nt, Homo sapiens
guugauuguuguucuagaa

SEQ ID NO: 1520772 - RNA, 19 nt, Homo sapiens
agaacuacacgguuuaauu

SEQ ID NO: 1520773 - RNA, 19 nt, Homo sapiens
uggcggaguugguaccuuu

SEQ ID NO: 1520774 - RNA, 19 nt, Homo sapiens
cagaaggcuuugucagaug

SEQ ID NO: 1520775 - RNA, 19 nt, Homo sapiens
gaggauggcggaguuggua

SEQ ID NO: 1520776 - RNA, 19 nt, Homo sapiens
cgaauuacuacuuugguuu

SEQ ID NO: 1520777 - RNA, 19 nt, Homo sapiens
uccagaaacuguugauugu

SEQ ID NO: 1520778 - RNA, 19 nt, Homo sapiens
gaauuacuacuuugguuuc

SEQ ID NO: 1520779 - RNA, 19 nt, Homo sapiens
uggguaggauugugggaua

SEQ ID NO: 1520780 - RNA, 19 nt, Homo sapiens
gaaaucuccagucaagguu

SEQ ID NO: 1520781 - RNA, 19 nt, Homo sapiens
ucuaugccgucauuaaguu

SEQ ID NO: 1520782 - RNA, 19 nt, Homo sapiens
guccgggucuucccaaaug

SEQ ID NO: 1520783 - RNA, 19 nt, Homo sapiens
gaucucgaacggaacuuaa

SEQ ID NO: 1520784 - RNA, 19 nt, Homo sapiens
ugccagaacuugacuagca

SEQ ID NO: 1520785 - RNA, 19 nt, Homo sapiens
uaaagguugccuagauaaa

SEQ ID NO: 1520786 - RNA, 19 nt, Homo sapiens
cagaugcgaagaagaacua

SEQ ID NO: 1520787 - RNA, 19 nt, Homo sapiens
ugucagaugcgaagaagaa

SEQ ID NO: 1520788 - RNA, 19 nt, Homo sapiens
guacagacccagugaagac

SEQ ID NO: 1520789 - RNA, 19 nt, Homo sapiens
gaggucauguaacuuccuu

SEQ ID NO: 1520790 - RNA, 19 nt, Homo sapiens
cuacacgguuuaauucaag

SEQ ID NO: 1520791 - RNA, 19 nt, Homo sapiens
agaagaacuacacgguuua

SEQ ID NO: 1520792 - RNA, 19 nt, Homo sapiens
ggguaucucucggauuuca

SEQ ID NO: 1520793 - RNA, 19 nt, Homo sapiens
gaagcaaagccugaaguuc

SEQ ID NO: 1520794 - RNA, 19 nt, Homo sapiens
gccgaggcuuugcaucauu

SEQ ID NO: 1520795 - RNA, 19 nt, Homo sapiens
auaaggcaguucaacauca

SEQ ID NO: 1520796 - RNA, 19 nt, Homo sapiens
guaggauugugggauaaga

SEQ ID NO: 1520797 - RNA, 19 nt, Homo sapiens
gauuguuguucuagaaagu

SEQ ID NO: 1520798 - RNA, 19 nt, Homo sapiens
gaggaaggaccauuaucau

SEQ ID NO: 1520799 - RNA, 19 nt, Homo sapiens
ggaggagccuauggauaag

SEQ ID NO: 1520800 - RNA, 19 nt, Homo sapiens
aagcaaagccugaaguucu

SEQ ID NO: 1520801 - RNA, 19 nt, Homo sapiens
gacauaaggcaguucaaca

SEQ ID NO: 1520802 - RNA, 19 nt, Homo sapiens
gcaguggcccauccugguu

SEQ ID NO: 1520803 - RNA, 19 nt, Homo sapiens
ucagaugcauuccagaaac

SEQ ID NO: 1520804 - RNA, 19 nt, Homo sapiens
gaagugguguugccauccu

SEQ ID NO: 1520805 - RNA, 19 nt, Homo sapiens
cgaagcaaagccugaaguu

SEQ ID NO: 1520806 - RNA, 19 nt, Homo sapiens
ggaucucgaacggaacuua

SEQ ID NO: 1520807 - RNA, 19 nt, Homo sapiens
ggguaggauugugggauaa

SEQ ID NO: 1520808 - RNA, 19 nt, Homo sapiens
aaaggaagacagcccagaa

SEQ ID NO: 1520809 - RNA, 19 nt, Homo sapiens
ucucgaacggaacuuaaua

SEQ ID NO: 1520810 - RNA, 19 nt, Homo sapiens
ccaagaggaggaaggguau

SEQ ID NO: 1520811 - RNA, 19 nt, Homo sapiens
ggcccauccugguuucuau

SEQ ID NO: 1520812 - RNA, 19 nt, Homo sapiens
gaaggguaucucucggauu

SEQ ID NO: 1520813 - RNA, 19 nt, Homo sapiens
caguuuggccuucuguauu

SEQ ID NO: 1520814 - RNA, 19 nt, Homo sapiens
gaaacuguugauuguuguu

SEQ ID NO: 1520815 - RNA, 19 nt, Homo sapiens
gcccagaagcuugcuauuc

SEQ ID NO: 1520816 - RNA, 19 nt, Homo sapiens
guggaggagccuauggaua

SEQ ID NO: 1520817 - RNA, 19 nt, Homo sapiens
gauagcauggugccacuuc

SEQ ID NO: 1520818 - RNA, 19 nt, Homo sapiens
guguugccauccugugauu

SEQ ID NO: 1520819 - RNA, 19 nt, Homo sapiens
caccagacauaaggcaguu

SEQ ID NO: 1520820 - RNA, 19 nt, Homo sapiens
cgaacggaacuuaauaaag

SEQ ID NO: 1520821 - RNA, 19 nt, Homo sapiens
agcaaagccugaaguucuu

SEQ ID NO: 1520822 - RNA, 19 nt, Homo sapiens
aaaggaucaucaagcuuca

SEQ ID NO: 1520823 - RNA, 19 nt, Homo sapiens
gcccuugcccugaacaguu

SEQ ID NO: 1520824 - RNA, 19 nt, Homo sapiens
aagggaggauggcggaguu

SEQ ID NO: 1520825 - RNA, 19 nt, Homo sapiens
gaguacagacccagugaag

SEQ ID NO: 1520826 - RNA, 19 nt, Homo sapiens
agaaacuguugauuguugu

SEQ ID NO: 1520827 - RNA, 19 nt, Homo sapiens
auaaagguugccuagauaa

SEQ ID NO: 1520828 - RNA, 19 nt, Homo sapiens
gccagaacuugacuagcau

SEQ ID NO: 1520829 - RNA, 19 nt, Homo sapiens
ggaagcaguauggccaaga

SEQ ID NO: 1520830 - RNA, 19 nt, Homo sapiens
ggugucagaugcgaagaag

SEQ ID NO: 1520831 - RNA, 19 nt, Homo sapiens
cagaugcauuccagaaacu

SEQ ID NO: 1520832 - RNA, 19 nt, Homo sapiens
ggaagacagcccagaagcu

SEQ ID NO: 1520833 - RNA, 19 nt, Homo sapiens
aggaaggaccauuaucauu

SEQ ID NO: 1520834 - RNA, 19 nt, Homo sapiens
gaagaaagggaaaaugaag

SEQ ID NO: 1520835 - RNA, 19 nt, Homo sapiens
ccaaaaggaucaucaagcu

SEQ ID NO: 1520836 - RNA, 19 nt, Homo sapiens
aguuuggccuucuguauuc

SEQ ID NO: 1520837 - RNA, 19 nt, Homo sapiens
aagggaggcuuggguagga

SEQ ID NO: 1520838 - RNA, 19 nt, Homo sapiens
acuacacgguuuaauucaa

SEQ ID NO: 1520839 - RNA, 19 nt, Homo sapiens
ggaguacagacccagugaa

SEQ ID NO: 1520840 - RNA, 19 nt, Homo sapiens
ccgaggcuuugcaucauuc

SEQ ID NO: 1520841 - RNA, 19 nt, Homo sapiens
agaaaucuccagucaaggu

SEQ ID NO: 1520842 - RNA, 19 nt, Homo sapiens
uaaagaagcugguuauugg

SEQ ID NO: 1520843 - RNA, 19 nt, Homo sapiens
gaccauaucuaccaugauu

SEQ ID NO: 1520844 - RNA, 19 nt, Homo sapiens
gaacaccuaccucuuauug

SEQ ID NO: 1520845 - RNA, 19 nt, Homo sapiens
ucagagagaccgaagaaua

SEQ ID NO: 1520846 - RNA, 19 nt, Homo sapiens
gagaacaccuaccucuuau

SEQ ID NO: 1520847 - RNA, 19 nt, Homo sapiens
acacaggccuuccaguuaa

SEQ ID NO: 1520848 - RNA, 19 nt, Homo sapiens
ucaaaccugucaacccuua

SEQ ID NO: 1520849 - RNA, 19 nt, Homo sapiens
agcaguagguggcaaauua

SEQ ID NO: 1520850 - RNA, 19 nt, Homo sapiens
auaaagaguuguuccauga

SEQ ID NO: 1520851 - RNA, 19 nt, Homo sapiens
gcauguugaucuuuccaua

SEQ ID NO: 1520852 - RNA, 19 nt, Homo sapiens
gaagauauuuuccuacuug

SEQ ID NO: 1520853 - RNA, 19 nt, Homo sapiens
gguuugggacugaauauua

SEQ ID NO: 1520854 - RNA, 19 nt, Homo sapiens
caugugaagcucauuguua

SEQ ID NO: 1520855 - RNA, 19 nt, Homo sapiens
gaucagagagaccgaagaa

SEQ ID NO: 1520856 - RNA, 19 nt, Homo sapiens
gcugugagccuucugugua

SEQ ID NO: 1520857 - RNA, 19 nt, Homo sapiens
uuugauggcuguauaaaga

SEQ ID NO: 1520858 - RNA, 19 nt, Homo sapiens
ccgauggcauucuuuaauu

SEQ ID NO: 1520859 - RNA, 19 nt, Homo sapiens
ggaaucuacucaacugcuu

SEQ ID NO: 1520860 - RNA, 19 nt, Homo sapiens
ggacguaacucuuuuggau

SEQ ID NO: 1520861 - RNA, 19 nt, Homo sapiens
gaagcugguuauuggaaga

SEQ ID NO: 1520862 - RNA, 19 nt, Homo sapiens
gagaagauagcuaugucua

SEQ ID NO: 1520863 - RNA, 19 nt, Homo sapiens
caagagaggaaauauugaa

SEQ ID NO: 1520864 - RNA, 19 nt, Homo sapiens
gaagaaggaggaagaacug

SEQ ID NO: 1520865 - RNA, 19 nt, Homo sapiens
gguuuagguugggcaauua

SEQ ID NO: 1520866 - RNA, 19 nt, Homo sapiens
cagaauauuugguuuaggu

SEQ ID NO: 1520867 - RNA, 19 nt, Homo sapiens
gauggaaugccuucagaaa

SEQ ID NO: 1520868 - RNA, 19 nt, Homo sapiens
gaagaacuggcuuuuguua

SEQ ID NO: 1520869 - RNA, 19 nt, Homo sapiens
gggcaauuauacugaaaga

SEQ ID NO: 1520870 - RNA, 19 nt, Homo sapiens
uggaaugccuucagaaauc

SEQ ID NO: 1520871 - RNA, 19 nt, Homo sapiens
acaccuaccucuuauugga

SEQ ID NO: 1520872 - RNA, 19 nt, Homo sapiens
caaaguacaaucugaguca

SEQ ID NO: 1520873 - RNA, 19 nt, Homo sapiens
gaagcucauuguuauacau

SEQ ID NO: 1520874 - RNA, 19 nt, Homo sapiens
ggacaugugaagcucauug

SEQ ID NO: 1520875 - RNA, 19 nt, Homo sapiens
cgauggcauucuuuaauug

SEQ ID NO: 1520876 - RNA, 19 nt, Homo sapiens
guauaaaacucccaccaaa

SEQ ID NO: 1520877 - RNA, 19 nt, Homo sapiens
guugaucuuuccauaaaug

SEQ ID NO: 1520878 - RNA, 19 nt, Homo sapiens
gaggaaauauugaaaaugg

SEQ ID NO: 1520879 - RNA, 19 nt, Homo sapiens
aaccugguccuuuaucuua

SEQ ID NO: 1520880 - RNA, 19 nt, Homo sapiens
aaagaguuguuccaugaug

SEQ ID NO: 1520881 - RNA, 19 nt, Homo sapiens
ccucagaauauuugguuua

SEQ ID NO: 1520882 - RNA, 19 nt, Homo sapiens
ggaaugccuucagaaaucu

SEQ ID NO: 1520883 - RNA, 19 nt, Homo sapiens
aguacaaucugagucauuu

SEQ ID NO: 1520884 - RNA, 19 nt, Homo sapiens
uacacaggccuuccaguua

SEQ ID NO: 1520885 - RNA, 19 nt, Homo sapiens
ggaagaaggaggaagaacu

SEQ ID NO: 1520886 - RNA, 19 nt, Homo sapiens
gguggcaaauuauuguugu

SEQ ID NO: 1520887 - RNA, 19 nt, Homo sapiens
gcaguagguggcaaauuau

SEQ ID NO: 1520888 - RNA, 19 nt, Homo sapiens
acauuaggcucggcuacua

SEQ ID NO: 1520889 - RNA, 19 nt, Homo sapiens
agacauacaacguggacua

SEQ ID NO: 1520890 - RNA, 19 nt, Homo sapiens
uagagaagauagcuauguc

SEQ ID NO: 1520891 - RNA, 19 nt, Homo sapiens
cauagacuccgauggcauu

SEQ ID NO: 1520892 - RNA, 19 nt, Homo sapiens
caaaacaaauagcaucugu

SEQ ID NO: 1520893 - RNA, 19 nt, Homo sapiens
guuugggacugaauauuag

SEQ ID NO: 1520894 - RNA, 19 nt, Homo sapiens
gaacaugggaaacccuuuu

SEQ ID NO: 1520895 - RNA, 19 nt, Homo sapiens
uagcaucauugucaaccuu

SEQ ID NO: 1520896 - RNA, 19 nt, Homo sapiens
guagagaagauagcuaugu

SEQ ID NO: 1520897 - RNA, 19 nt, Homo sapiens
guagguggcaaauuauugu

SEQ ID NO: 1520898 - RNA, 19 nt, Homo sapiens
uuccauaaaugacacauca

SEQ ID NO: 1520899 - RNA, 19 nt, Homo sapiens
uuacacaggccuuccaguu

SEQ ID NO: 1520900 - RNA, 19 nt, Homo sapiens
ccugcaagaucaaauugga

SEQ ID NO: 1520901 - RNA, 19 nt, Homo sapiens
gaaucuacucaacugcuuu

SEQ ID NO: 1520902 - RNA, 19 nt, Homo sapiens
gggaaacccuuuugguguu

SEQ ID NO: 1520903 - RNA, 19 nt, Homo sapiens
cagagagaccgaagaauac

SEQ ID NO: 1520904 - RNA, 19 nt, Homo sapiens
accaagagaggaaauauug

SEQ ID NO: 1520905 - RNA, 19 nt, Homo sapiens
gcacagcggugggguuuuc

SEQ ID NO: 1520906 - RNA, 19 nt, Homo sapiens
ggcauucuuuaauugcaaa

SEQ ID NO: 1520907 - RNA, 19 nt, Homo sapiens
agacuccgauggcauucuu

SEQ ID NO: 1520908 - RNA, 19 nt, Homo sapiens
guugggcaauuauacugaa

SEQ ID NO: 1520909 - RNA, 19 nt, Homo sapiens
uugucaaccugguccuuua

SEQ ID NO: 1520910 - RNA, 19 nt, Homo sapiens
uaacagagaacaccuaccu

SEQ ID NO: 1520911 - RNA, 19 nt, Homo sapiens
agauuuauguggcaugaca

SEQ ID NO: 1520912 - RNA, 19 nt, Homo sapiens
gaucuuuccauaaaugaca

SEQ ID NO: 1520913 - RNA, 19 nt, Homo sapiens
cauguugaucuuuccauaa

SEQ ID NO: 1520914 - RNA, 19 nt, Homo sapiens
uggauggaaugccuucaga

SEQ ID NO: 1520915 - RNA, 19 nt, Homo sapiens
ccaagagaggaaauauuga

SEQ ID NO: 1520916 - RNA, 19 nt, Homo sapiens
guacauuucgcaaucucuu

SEQ ID NO: 1520917 - RNA, 19 nt, Homo sapiens
augugaagcucauuguuau

SEQ ID NO: 1520918 - RNA, 19 nt, Homo sapiens
cauugucaaccuuagauuu

SEQ ID NO: 1520919 - RNA, 19 nt, Homo sapiens
cauaaaugacacaucaguu

SEQ ID NO: 1520920 - RNA, 19 nt, Homo sapiens
caaccugguccuuuaucuu

SEQ ID NO: 1520921 - RNA, 19 nt, Homo sapiens
gcacugggagagcucuuuc

SEQ ID NO: 1520922 - RNA, 19 nt, Homo sapiens
uaaaugacacaucaguuac

SEQ ID NO: 1520923 - RNA, 19 nt, Homo sapiens
caguagagaagauagcuau

SEQ ID NO: 1520924 - RNA, 19 nt, Homo sapiens
ugugguacauuucgcaauc

SEQ ID NO: 1520925 - RNA, 19 nt, Homo sapiens
gcacggcuaccaacuccau

SEQ ID NO: 1520926 - RNA, 19 nt, Homo sapiens
uuagauuuauguggcauga

SEQ ID NO: 1520927 - RNA, 19 nt, Homo sapiens
ucaccugcaagaucaaauu

SEQ ID NO: 1520928 - RNA, 19 nt, Homo sapiens
agaacuggcuuuuguuaug

SEQ ID NO: 1520929 - RNA, 19 nt, Homo sapiens
ggauggaaugccuucagaa

SEQ ID NO: 1520930 - RNA, 19 nt, Homo sapiens
ugucaaccuuagauuuaug

SEQ ID NO: 1520931 - RNA, 19 nt, Homo sapiens
ugaagcucauuguuauaca

SEQ ID NO: 1520932 - RNA, 19 nt, Homo sapiens
caccaagagaggaaauauu

SEQ ID NO: 1520933 - RNA, 19 nt, Homo sapiens
uuauuuggaucggaaucua

SEQ ID NO: 1520934 - RNA, 19 nt, Homo sapiens
uggagcauguugaucuuuc

SEQ ID NO: 1520935 - RNA, 19 nt, Homo sapiens
ugguuuagguugggcaauu

SEQ ID NO: 1520936 - RNA, 19 nt, Homo sapiens
gcccucagaauauuugguu

SEQ ID NO: 1520937 - RNA, 19 nt, Homo sapiens
gaucggaaucuacucaacu

SEQ ID NO: 1520938 - RNA, 19 nt, Homo sapiens
uugacuggcuuuguucuug

SEQ ID NO: 1520939 - RNA, 19 nt, Homo sapiens
ggaucggaaucuacucaac

SEQ ID NO: 1520940 - RNA, 19 nt, Homo sapiens
cuacguugaugcggaagga

SEQ ID NO: 1520941 - RNA, 19 nt, Homo sapiens
aaauaacagagaacaccua

SEQ ID NO: 1520942 - RNA, 19 nt, Homo sapiens
cagagaagcuguucaaaug

SEQ ID NO: 1520943 - RNA, 19 nt, Homo sapiens
gaagucagcucauauuaac

SEQ ID NO: 1520944 - RNA, 19 nt, Homo sapiens
gaacggcccuaugaaugua

SEQ ID NO: 1520945 - RNA, 19 nt, Homo sapiens
gugggaaguucuuuaaaua

SEQ ID NO: 1520946 - RNA, 19 nt, Homo sapiens
cuaaagagcuacagaguca

SEQ ID NO: 1520947 - RNA, 19 nt, Homo sapiens
gaaaguccauacuccagaa

SEQ ID NO: 1520948 - RNA, 19 nt, Homo sapiens
gaaaggcccuaugagugua

SEQ ID NO: 1520949 - RNA, 19 nt, Homo sapiens
agagaggucuuaugaaugu

SEQ ID NO: 1520950 - RNA, 19 nt, Homo sapiens
caaagacgcacuuguucua

SEQ ID NO: 1520951 - RNA, 19 nt, Homo sapiens
gcagaagugcuuucaagaa

SEQ ID NO: 1520952 - RNA, 19 nt, Homo sapiens
gugggaagguguucuuaaa

SEQ ID NO: 1520953 - RNA, 19 nt, Homo sapiens
ggagaacuuugcacucguu

SEQ ID NO: 1520954 - RNA, 19 nt, Homo sapiens
gcagagaagcuguucaaau

SEQ ID NO: 1520955 - RNA, 19 nt, Homo sapiens
gggaaguucuuuaaauaca

SEQ ID NO: 1520956 - RNA, 19 nt, Homo sapiens
aaacagcccauguguguaa

SEQ ID NO: 1520957 - RNA, 19 nt, Homo sapiens
ggagaaaggcccuaugagu

SEQ ID NO: 1520958 - RNA, 19 nt, Homo sapiens
caagaagucagcucauauu

SEQ ID NO: 1520959 - RNA, 19 nt, Homo sapiens
gaagugcuuucaagaaguc

SEQ ID NO: 1520960 - RNA, 19 nt, Homo sapiens
uagcauggacugucucaua

SEQ ID NO: 1520961 - RNA, 19 nt, Homo sapiens
gagaagcuguucaaaugca

SEQ ID NO: 1520962 - RNA, 19 nt, Homo sapiens
gaaaggucuuauuccagaa

SEQ ID NO: 1520963 - RNA, 19 nt, Homo sapiens
gaaugugggaaguucuuua

SEQ ID NO: 1520964 - RNA, 19 nt, Homo sapiens
gguaaaaccuucaguguuc

SEQ ID NO: 1520965 - RNA, 19 nt, Homo sapiens
cagaagugcuuucaagaag

SEQ ID NO: 1520966 - RNA, 19 nt, Homo sapiens
cugggaagguuuaccauuu

SEQ ID NO: 1520967 - RNA, 19 nt, Homo sapiens
gaaagugcacauuggagaa

SEQ ID NO: 1520968 - RNA, 19 nt, Homo sapiens
ggaaacaccagaagguuca

SEQ ID NO: 1520969 - RNA, 19 nt, Homo sapiens
ggaacggcccuaugaaugu

SEQ ID NO: 1520970 - RNA, 19 nt, Homo sapiens
uuacccagcuggaggauga

SEQ ID NO: 1520971 - RNA, 19 nt, Homo sapiens
ucacaucacugaguuuauc

SEQ ID NO: 1520972 - RNA, 19 nt, Homo sapiens
cgucuaagcugaggaaaca

SEQ ID NO: 1520973 - RNA, 19 nt, Homo sapiens
gauaacgcauucugaagag

SEQ ID NO: 1520974 - RNA, 19 nt, Homo sapiens
gcacaugggaaggucguua

SEQ ID NO: 1520975 - RNA, 19 nt, Homo sapiens
gggaagguguucuuaaagg

SEQ ID NO: 1520976 - RNA, 19 nt, Homo sapiens
gcccauguguguaaugaau

SEQ ID NO: 1520977 - RNA, 19 nt, Homo sapiens
auacugcucuggacuaugu

SEQ ID NO: 1520978 - RNA, 19 nt, Homo sapiens
agaaacagcccaugugugu

SEQ ID NO: 1520979 - RNA, 19 nt, Homo sapiens
gcucuggacuaugugguaa

SEQ ID NO: 1520980 - RNA, 19 nt, Homo sapiens
gagagugccauccgaaaga

SEQ ID NO: 1520981 - RNA, 19 nt, Homo sapiens
ccagaaaggagguuaagga

SEQ ID NO: 1520982 - RNA, 19 nt, Homo sapiens
ggagaaacagcccaugugu

SEQ ID NO: 1520983 - RNA, 19 nt, Homo sapiens
gcagaagccaggagagguu

SEQ ID NO: 1520984 - RNA, 19 nt, Homo sapiens
gggaugugaugcuggagaa

SEQ ID NO: 1520985 - RNA, 19 nt, Homo sapiens
gcaccguguucaucaggaa

SEQ ID NO: 1520986 - RNA, 19 nt, Homo sapiens
gcaaucggcaccagcaguu

SEQ ID NO: 1520987 - RNA, 19 nt, Homo sapiens
uggacuaugugguaauaaa

SEQ ID NO: 1520988 - RNA, 19 nt, Homo sapiens
gacauuacacaugguauuu

SEQ ID NO: 1520989 - RNA, 19 nt, Homo sapiens
aaacaguagagaaucguua

SEQ ID NO: 1520990 - RNA, 19 nt, Homo sapiens
gggaacggcccuaugaaug

SEQ ID NO: 1520991 - RNA, 19 nt, Homo sapiens
agaagucagcucauauuaa

SEQ ID NO: 1520992 - RNA, 19 nt, Homo sapiens
caguagagaaucguuaaua

SEQ ID NO: 1520993 - RNA, 19 nt, Homo sapiens
ugugggaaguucuuuaaau

SEQ ID NO: 1520994 - RNA, 19 nt, Homo sapiens
uugaggaugugacgguaua

SEQ ID NO: 1520995 - RNA, 19 nt, Homo sapiens
uagagaaucguuaauagug

SEQ ID NO: 1520996 - RNA, 19 nt, Homo sapiens
ccgcaaagacgcacuuguu

SEQ ID NO: 1520997 - RNA, 19 nt, Homo sapiens
cauuacacaugguauuugu

SEQ ID NO: 1520998 - RNA, 19 nt, Homo sapiens
gcuccuugcucuaaacagu

SEQ ID NO: 1520999 - RNA, 19 nt, Homo sapiens
gcaaagacgcacuuguucu

SEQ ID NO: 1521000 - RNA, 19 nt, Homo sapiens
gaagguucacacaggcaua

SEQ ID NO: 1521001 - RNA, 19 nt, Homo sapiens
gaaacagcccaugugugua

SEQ ID NO: 1521002 - RNA, 19 nt, Homo sapiens
aagaagucagcucauauua

SEQ ID NO: 1521003 - RNA, 19 nt, Homo sapiens
guagagaaucguuaauagu

SEQ ID NO: 1521004 - RNA, 19 nt, Homo sapiens
uaaggucccuacagcaagu

SEQ ID NO: 1521005 - RNA, 19 nt, Homo sapiens
cauaaggucccuacagcaa

SEQ ID NO: 1521006 - RNA, 19 nt, Homo sapiens
agaaaggcccuaugagugu

SEQ ID NO: 1521007 - RNA, 19 nt, Homo sapiens
ggaugugacgguauauuuc

SEQ ID NO: 1521008 - RNA, 19 nt, Homo sapiens
ucaagaagucagcucauau

SEQ ID NO: 1521009 - RNA, 19 nt, Homo sapiens
ggacuugcaccuucgagau

SEQ ID NO: 1521010 - RNA, 19 nt, Homo sapiens
ucuggacuaugugguaaua

SEQ ID NO: 1521011 - RNA, 19 nt, Homo sapiens
gaagcuaaaccuugcacau

SEQ ID NO: 1521012 - RNA, 19 nt, Homo sapiens
ucaguuggacccaucauug

SEQ ID NO: 1521013 - RNA, 19 nt, Homo sapiens
gaggaaacaccagaagguu

SEQ ID NO: 1521014 - RNA, 19 nt, Homo sapiens
ugauaacgcauucugaaga

SEQ ID NO: 1521015 - RNA, 19 nt, Homo sapiens
aguagagaaucguuaauag

SEQ ID NO: 1521016 - RNA, 19 nt, Homo sapiens
cauauugcacucugacuug

SEQ ID NO: 1521017 - RNA, 19 nt, Homo sapiens
caucaggaaaggucuuauu

SEQ ID NO: 1521018 - RNA, 19 nt, Homo sapiens
gggaaaaccuucacuacca

SEQ ID NO: 1521019 - RNA, 19 nt, Homo sapiens
guacagaaugugggaaguu

SEQ ID NO: 1521020 - RNA, 19 nt, Homo sapiens
ccauguguguaaugaaugu

SEQ ID NO: 1521021 - RNA, 19 nt, Homo sapiens
uucaagaagucagcucaua

SEQ ID NO: 1521022 - RNA, 19 nt, Homo sapiens
ugacauuacacaugguauu

SEQ ID NO: 1521023 - RNA, 19 nt, Homo sapiens
gagugcagcaaauguggua

SEQ ID NO: 1521024 - RNA, 19 nt, Homo sapiens
cagcccauguguguaauga

SEQ ID NO: 1521025 - RNA, 19 nt, Homo sapiens
gaacuuugcacucguuagc

SEQ ID NO: 1521026 - RNA, 19 nt, Homo sapiens
cugagcaucuaaagagcua

SEQ ID NO: 1521027 - RNA, 19 nt, Homo sapiens
ggacuaugugguaauaaag

SEQ ID NO: 1521028 - RNA, 19 nt, Homo sapiens
ccaccgccauccaccucua

SEQ ID NO: 1521029 - RNA, 19 nt, Homo sapiens
gcacaagaaaguccauacu

SEQ ID NO: 1521030 - RNA, 19 nt, Homo sapiens
gauucacacuggagaaagg

SEQ ID NO: 1521031 - RNA, 19 nt, Homo sapiens
gaccaucugauaacgcauu

SEQ ID NO: 1521032 - RNA, 19 nt, Homo sapiens
gcuggaggaugaugaacag

SEQ ID NO: 1521033 - RNA, 19 nt, Homo sapiens
gcuagcaccguguucauca

SEQ ID NO: 1521034 - RNA, 19 nt, Homo sapiens
aggcagaagugcuuucaag

SEQ ID NO: 1521035 - RNA, 19 nt, Homo sapiens
gagaggucuuaugaaugua

SEQ ID NO: 1521036 - RNA, 19 nt, Homo sapiens
gagaacuuugcacucguua

SEQ ID NO: 1521037 - RNA, 19 nt, Homo sapiens
cauggacugucucauacug

SEQ ID NO: 1521038 - RNA, 19 nt, Homo sapiens
ugucacaucacugaguuua

SEQ ID NO: 1521039 - RNA, 19 nt, Homo sapiens
uguguagaguggaggauga

SEQ ID NO: 1521040 - RNA, 19 nt, Homo sapiens
ucauggaaaugguugacau

SEQ ID NO: 1521041 - RNA, 19 nt, Homo sapiens
ggagaguggccgugagagu

SEQ ID NO: 1521042 - RNA, 19 nt, Homo sapiens
gcaaguauguauauuccua

SEQ ID NO: 1521043 - RNA, 19 nt, Homo sapiens
caagauggcuggaacaguu

SEQ ID NO: 1521044 - RNA, 19 nt, Homo sapiens
gcaagagacugaaucauca

SEQ ID NO: 1521045 - RNA, 19 nt, Homo sapiens
caagauacuuccuuagaaa

SEQ ID NO: 1521046 - RNA, 19 nt, Homo sapiens
uagaagaccugacugauga

SEQ ID NO: 1521047 - RNA, 19 nt, Homo sapiens
cagcaaggaugaaauuauu

SEQ ID NO: 1521048 - RNA, 19 nt, Homo sapiens
ucaaauaguuucccuaauc

SEQ ID NO: 1521049 - RNA, 19 nt, Homo sapiens
gauaugcccuuaagagaug

SEQ ID NO: 1521050 - RNA, 19 nt, Homo sapiens
gcauggaauuugucaguuu

SEQ ID NO: 1521051 - RNA, 19 nt, Homo sapiens
aagaauggcuuuagaucua

SEQ ID NO: 1521052 - RNA, 19 nt, Homo sapiens
guaucucugucacuuauua

SEQ ID NO: 1521053 - RNA, 19 nt, Homo sapiens
gaagauuccaucaguaauu

SEQ ID NO: 1521054 - RNA, 19 nt, Homo sapiens
gaagauuccaucaguaauu

SEQ ID NO: 1521055 - RNA, 19 nt, Homo sapiens
caaauaguuucccuaauca

SEQ ID NO: 1521056 - RNA, 19 nt, Homo sapiens
ccaagauacuuccuuagaa

SEQ ID NO: 1521057 - RNA, 19 nt, Homo sapiens
uaagagaugucauuguuca

SEQ ID NO: 1521058 - RNA, 19 nt, Homo sapiens
ugacaaagccagugugaaa

SEQ ID NO: 1521059 - RNA, 19 nt, Homo sapiens
ggacaaggauaugaagaug

SEQ ID NO: 1521060 - RNA, 19 nt, Homo sapiens
gcacagcaaggaugaaauu

SEQ ID NO: 1521061 - RNA, 19 nt, Homo sapiens
ggucugauaauguguauaa

SEQ ID NO: 1521062 - RNA, 19 nt, Homo sapiens
ucaaggcaaucaaauaguu

SEQ ID NO: 1521063 - RNA, 19 nt, Homo sapiens
ugaaacaaaucccuagaga

SEQ ID NO: 1521064 - RNA, 19 nt, Homo sapiens
gguauagaacacuguauua

SEQ ID NO: 1521065 - RNA, 19 nt, Homo sapiens
acaaggauaugaagaugaa

SEQ ID NO: 1521066 - RNA, 19 nt, Homo sapiens
cuuaagagaugucauuguu

SEQ ID NO: 1521067 - RNA, 19 nt, Homo sapiens
gaaccauauuucaguguga

SEQ ID NO: 1521068 - RNA, 19 nt, Homo sapiens
cuuauuagcucaccagaga

SEQ ID NO: 1521069 - RNA, 19 nt, Homo sapiens
caggaaggguccauaaaug

SEQ ID NO: 1521070 - RNA, 19 nt, Homo sapiens
caaaguaaagucucucuga

SEQ ID NO: 1521071 - RNA, 19 nt, Homo sapiens
ccaaucacgucuuuaaauc

SEQ ID NO: 1521072 - RNA, 19 nt, Homo sapiens
guaauucaaucaacagaca

SEQ ID NO: 1521073 - RNA, 19 nt, Homo sapiens
ccaaucacgucuuuaaauc

SEQ ID NO: 1521074 - RNA, 19 nt, Homo sapiens
guaauucaaucaacagaca

SEQ ID NO: 1521075 - RNA, 19 nt, Homo sapiens
cuaagcugcuggucugaua

SEQ ID NO: 1521076 - RNA, 19 nt, Homo sapiens
agaauaaucuuggaucaga

SEQ ID NO: 1521077 - RNA, 19 nt, Homo sapiens
gaucuaagaaccauauuuc

SEQ ID NO: 1521078 - RNA, 19 nt, Homo sapiens
aaacaaaucccuagagaca

SEQ ID NO: 1521079 - RNA, 19 nt, Homo sapiens
gaaagcuagucacacauca

SEQ ID NO: 1521080 - RNA, 19 nt, Homo sapiens
gaauaaucuuggaucagaa

SEQ ID NO: 1521081 - RNA, 19 nt, Homo sapiens
gaucagaauuugugagacu

SEQ ID NO: 1521082 - RNA, 19 nt, Homo sapiens
gagaaaagccuuauacaug

SEQ ID NO: 1521083 - RNA, 19 nt, Homo sapiens
guggaaagcuagucacaca

SEQ ID NO: 1521084 - RNA, 19 nt, Homo sapiens
gauaugaagaugaacaaga

SEQ ID NO: 1521085 - RNA, 19 nt, Homo sapiens
ggagugccguggcguaauc

SEQ ID NO: 1521086 - RNA, 19 nt, Homo sapiens
gagacugaaucaucaaagu

SEQ ID NO: 1521087 - RNA, 19 nt, Homo sapiens
uaaagaauccaccaacugu

SEQ ID NO: 1521088 - RNA, 19 nt, Homo sapiens
gaaagagaaauggaaauca

SEQ ID NO: 1521089 - RNA, 19 nt, Homo sapiens
guuauccaaucacgucuuu

SEQ ID NO: 1521090 - RNA, 19 nt, Homo sapiens
guuauccaaucacgucuuu

SEQ ID NO: 1521091 - RNA, 19 nt, Homo sapiens
agacaaguguuauccaauc

SEQ ID NO: 1521092 - RNA, 19 nt, Homo sapiens
agacaaguguuauccaauc

SEQ ID NO: 1521093 - RNA, 19 nt, Homo sapiens
auacaaaugugaagaaugc

SEQ ID NO: 1521094 - RNA, 19 nt, Homo sapiens
aaacuuggagagauucaua

SEQ ID NO: 1521095 - RNA, 19 nt, Homo sapiens
gaccugcuguucagagaga

SEQ ID NO: 1521096 - RNA, 19 nt, Homo sapiens
cgagaauaaucuuggauca

SEQ ID NO: 1521097 - RNA, 19 nt, Homo sapiens
gacugaaucaucaaaguaa

SEQ ID NO: 1521098 - RNA, 19 nt, Homo sapiens
gacuagcguuugucuuuau

SEQ ID NO: 1521099 - RNA, 19 nt, Homo sapiens
uaaaguauuccaagugguu

SEQ ID NO: 1521100 - RNA, 19 nt, Homo sapiens
ucacuaaaguauuccaagu

SEQ ID NO: 1521101 - RNA, 19 nt, Homo sapiens
gacaaguguuauccaauca

SEQ ID NO: 1521102 - RNA, 19 nt, Homo sapiens
gacaaguguuauccaauca

SEQ ID NO: 1521103 - RNA, 19 nt, Homo sapiens
ccaagaaccaauaaauuuc

SEQ ID NO: 1521104 - RNA, 19 nt, Homo sapiens
ucccagacuucccaagaua

SEQ ID NO: 1521105 - RNA, 19 nt, Homo sapiens
ccaaggaccugcuguucag

SEQ ID NO: 1521106 - RNA, 19 nt, Homo sapiens
acaaaucccuagagacaca

SEQ ID NO: 1521107 - RNA, 19 nt, Homo sapiens
cuaaggagagcauggaauu

SEQ ID NO: 1521108 - RNA, 19 nt, Homo sapiens
ggagguguuucuucugaca

SEQ ID NO: 1521109 - RNA, 19 nt, Homo sapiens
ggauaugcccuuaagagau

SEQ ID NO: 1521110 - RNA, 19 nt, Homo sapiens
cauaaauccaccugccuua

SEQ ID NO: 1521111 - RNA, 19 nt, Homo sapiens
uauaggaucuuucacucau

SEQ ID NO: 1521112 - RNA, 19 nt, Homo sapiens
ggaaagcuagucacacauc

SEQ ID NO: 1521113 - RNA, 19 nt, Homo sapiens
aaauuacccugccaagugu

SEQ ID NO: 1521114 - RNA, 19 nt, Homo sapiens
aaaccaaccugcggucuca

SEQ ID NO: 1521115 - RNA, 19 nt, Homo sapiens
ucaagaauggugcucaauu

SEQ ID NO: 1521116 - RNA, 19 nt, Homo sapiens
ggcaagagacugaaucauc

SEQ ID NO: 1521117 - RNA, 19 nt, Homo sapiens
uauccaaucacgucuuuaa

SEQ ID NO: 1521118 - RNA, 19 nt, Homo sapiens
uauccaaucacgucuuuaa

SEQ ID NO: 1521119 - RNA, 19 nt, Homo sapiens
gaacauuuccaagaaccaa

SEQ ID NO: 1521120 - RNA, 19 nt, Homo sapiens
gagcauggaauuugucagu

SEQ ID NO: 1521121 - RNA, 19 nt, Homo sapiens
ccacauaccaccgccauau

SEQ ID NO: 1521122 - RNA, 19 nt, Homo sapiens
gaacaagauggcuggaaca

SEQ ID NO: 1521123 - RNA, 19 nt, Homo sapiens
ucagagagaagaagggauu

SEQ ID NO: 1521124 - RNA, 19 nt, Homo sapiens
acagacaaguguuauccaa

SEQ ID NO: 1521125 - RNA, 19 nt, Homo sapiens
acagacaaguguuauccaa

SEQ ID NO: 1521126 - RNA, 19 nt, Homo sapiens
ugacaacccauacaacuca

SEQ ID NO: 1521127 - RNA, 19 nt, Homo sapiens
gaacgguccuaggccugaa

SEQ ID NO: 1521128 - RNA, 19 nt, Homo sapiens
gaggauaugcccuuaagag

SEQ ID NO: 1521129 - RNA, 19 nt, Homo sapiens
gaagggauuucugaguucu

SEQ ID NO: 1521130 - RNA, 19 nt, Homo sapiens
auagaacacuguauuagag

SEQ ID NO: 1521131 - RNA, 19 nt, Homo sapiens
gauaaacccaguguggaaa

SEQ ID NO: 1521132 - RNA, 19 nt, Homo sapiens
uuaggaggcacaucagaua

SEQ ID NO: 1521133 - RNA, 19 nt, Homo sapiens
uugggaaaguggaacauuu

SEQ ID NO: 1521134 - RNA, 19 nt, Homo sapiens
gagaauccacacaggagaa

SEQ ID NO: 1521135 - RNA, 19 nt, Homo sapiens
aaaggcuucuuccagauau

SEQ ID NO: 1521136 - RNA, 19 nt, Homo sapiens
ugagguacaucagaaagga

SEQ ID NO: 1521137 - RNA, 19 nt, Homo sapiens
agaaacaggacaaggauau

SEQ ID NO: 1521138 - RNA, 19 nt, Homo sapiens
agacugaaucaucaaagua

SEQ ID NO: 1521139 - RNA, 19 nt, Homo sapiens
gggauuacaggaccaguga

SEQ ID NO: 1521140 - RNA, 19 nt, Homo sapiens
acacaaggcaagagacuga

SEQ ID NO: 1521141 - RNA, 19 nt, Homo sapiens
caaggcaaucaaauaguuu

SEQ ID NO: 1521142 - RNA, 19 nt, Homo sapiens
uaacugaacugcuuauuuc

SEQ ID NO: 1521143 - RNA, 19 nt, Homo sapiens
gaagaaagcccucagaauc

SEQ ID NO: 1521144 - RNA, 19 nt, Homo sapiens
ccaaggaacugaaagagaa

SEQ ID NO: 1521145 - RNA, 19 nt, Homo sapiens
aaaggcagguuauaaguaa

SEQ ID NO: 1521146 - RNA, 19 nt, Homo sapiens
gggcaggcauuucaaguuu

SEQ ID NO: 1521147 - RNA, 19 nt, Homo sapiens
gaauaaaugucauccucuu

SEQ ID NO: 1521148 - RNA, 19 nt, Homo sapiens
aaagaacguuucccacuaa

SEQ ID NO: 1521149 - RNA, 19 nt, Homo sapiens
ggcauaggcuuaucuguga

SEQ ID NO: 1521150 - RNA, 19 nt, Homo sapiens
gaacugaaagagaauguga

SEQ ID NO: 1521151 - RNA, 19 nt, Homo sapiens
gaaagagaaugugaagcaa

SEQ ID NO: 1521152 - RNA, 19 nt, Homo sapiens
gaacugcuuauuucuguuu

SEQ ID NO: 1521153 - RNA, 19 nt, Homo sapiens
gagagacacauuccucaua

SEQ ID NO: 1521154 - RNA, 19 nt, Homo sapiens
agagacacauuccucauaa

SEQ ID NO: 1521155 - RNA, 19 nt, Homo sapiens
cuagggaacuuguaggaaa

SEQ ID NO: 1521156 - RNA, 19 nt, Homo sapiens
gugacauacucauccauua

SEQ ID NO: 1521157 - RNA, 19 nt, Homo sapiens
gcauuguccugcuuccuaa

SEQ ID NO: 1521158 - RNA, 19 nt, Homo sapiens
caaaggcagguuauaagua

SEQ ID NO: 1521159 - RNA, 19 nt, Homo sapiens
gugccgagcugcaugacua

SEQ ID NO: 1521160 - RNA, 19 nt, Homo sapiens
guaacugaacugcuuauuu

SEQ ID NO: 1521161 - RNA, 19 nt, Homo sapiens
gagcagauccuaugucucu

SEQ ID NO: 1521162 - RNA, 19 nt, Homo sapiens
ucaguaacuuucacucauu

SEQ ID NO: 1521163 - RNA, 19 nt, Homo sapiens
gagccauccucaucucauu

SEQ ID NO: 1521164 - RNA, 19 nt, Homo sapiens
ucaguugagugaauaaaug

SEQ ID NO: 1521165 - RNA, 19 nt, Homo sapiens
gagccaagucguagcauuu

SEQ ID NO: 1521166 - RNA, 19 nt, Homo sapiens
ggaaauucuuggagcugaa

SEQ ID NO: 1521167 - RNA, 19 nt, Homo sapiens
ugaguaacguggaucuuga

SEQ ID NO: 1521168 - RNA, 19 nt, Homo sapiens
aaagguggcucuaucaucu

SEQ ID NO: 1521169 - RNA, 19 nt, Homo sapiens
gcauucaggcuggaucuua

SEQ ID NO: 1521170 - RNA, 19 nt, Homo sapiens
gaacuuguaggaaauucuu

SEQ ID NO: 1521171 - RNA, 19 nt, Homo sapiens
uaucugcccucaagaacuu

SEQ ID NO: 1521172 - RNA, 19 nt, Homo sapiens
gaugacaggcacaauagaa

SEQ ID NO: 1521173 - RNA, 19 nt, Homo sapiens
gcugaaagucccacaaaga

SEQ ID NO: 1521174 - RNA, 19 nt, Homo sapiens
gagcugaaagucccacaaa

SEQ ID NO: 1521175 - RNA, 19 nt, Homo sapiens
ggagccaagucguagcauu

SEQ ID NO: 1521176 - RNA, 19 nt, Homo sapiens
gaaagguggcucuaucauc

SEQ ID NO: 1521177 - RNA, 19 nt, Homo sapiens
aauacacucuugagccuuu

SEQ ID NO: 1521178 - RNA, 19 nt, Homo sapiens
gagaaagguggcucuauca

SEQ ID NO: 1521179 - RNA, 19 nt, Homo sapiens
gcucuaucaucuuacaaug

SEQ ID NO: 1521180 - RNA, 19 nt, Homo sapiens
ugaaagagaaugugaagca

SEQ ID NO: 1521181 - RNA, 19 nt, Homo sapiens
gcauuugggccuugaucua

SEQ ID NO: 1521182 - RNA, 19 nt, Homo sapiens
ggagucagcaaacuucaga

SEQ ID NO: 1521183 - RNA, 19 nt, Homo sapiens
gcuuaucugugaugaagug

SEQ ID NO: 1521184 - RNA, 19 nt, Homo sapiens
aaggagagaaggagacaua

SEQ ID NO: 1521185 - RNA, 19 nt, Homo sapiens
gcagagccauccucaucuc

SEQ ID NO: 1521186 - RNA, 19 nt, Homo sapiens
cagcaaacuucagauuuua

SEQ ID NO: 1521187 - RNA, 19 nt, Homo sapiens
ucagcaaacuucagauuuu

SEQ ID NO: 1521188 - RNA, 19 nt, Homo sapiens
gagacacauuccucauaau

SEQ ID NO: 1521189 - RNA, 19 nt, Homo sapiens
gggaguacuucugcaucua

SEQ ID NO: 1521190 - RNA, 19 nt, Homo sapiens
uaacuucuucgaacccuuu

SEQ ID NO: 1521191 - RNA, 19 nt, Homo sapiens
gaaauucuuggagcugaaa

SEQ ID NO: 1521192 - RNA, 19 nt, Homo sapiens
uggauuuacuggugacuga

SEQ ID NO: 1521193 - RNA, 19 nt, Homo sapiens
aaaagaacguuucccacua

SEQ ID NO: 1521194 - RNA, 19 nt, Homo sapiens
gagauuugagagugacuaa

SEQ ID NO: 1521195 - RNA, 19 nt, Homo sapiens
cacagagacugguuagcaa

SEQ ID NO: 1521196 - RNA, 19 nt, Homo sapiens
ggaguacuucugcaucuau

SEQ ID NO: 1521197 - RNA, 19 nt, Homo sapiens
aaacgcacaugcccacaca

SEQ ID NO: 1521198 - RNA, 19 nt, Homo sapiens
gacauacucauccauuaga

SEQ ID NO: 1521199 - RNA, 19 nt, Homo sapiens
gacuaaaucuugguaucug

SEQ ID NO: 1521200 - RNA, 19 nt, Homo sapiens
ugagagugacuaaaucuug

SEQ ID NO: 1521201 - RNA, 19 nt, Homo sapiens
aaugaugacaggcacaaua

SEQ ID NO: 1521202 - RNA, 19 nt, Homo sapiens
gggaacauuucugcagaga

SEQ ID NO: 1521203 - RNA, 19 nt, Homo sapiens
gguaguuggcauaggcuua

SEQ ID NO: 1521204 - RNA, 19 nt, Homo sapiens
cugcaugacuacuucaaug

SEQ ID NO: 1521205 - RNA, 19 nt, Homo sapiens
gaaacaacggggaacauuu

SEQ ID NO: 1521206 - RNA, 19 nt, Homo sapiens
ggagugauagaggguuuaa

SEQ ID NO: 1521207 - RNA, 19 nt, Homo sapiens
cuacuucaauguccugagu

SEQ ID NO: 1521208 - RNA, 19 nt, Homo sapiens
ggugccagguuccagauuc

SEQ ID NO: 1521209 - RNA, 19 nt, Homo sapiens
ucuaucaucuuacaauguc

SEQ ID NO: 1521210 - RNA, 19 nt, Homo sapiens
cugaaagucccacaaagaa

SEQ ID NO: 1521211 - RNA, 19 nt, Homo sapiens
acuucaauguccugaguua

SEQ ID NO: 1521212 - RNA, 19 nt, Homo sapiens
cugaacugcuuauuucugu

SEQ ID NO: 1521213 - RNA, 19 nt, Homo sapiens
caagggagucagcaaacuu

SEQ ID NO: 1521214 - RNA, 19 nt, Homo sapiens
gagcaggaguuuugucuag

SEQ ID NO: 1521215 - RNA, 19 nt, Homo sapiens
cugcaucaauacacucuug

SEQ ID NO: 1521216 - RNA, 19 nt, Homo sapiens
ggagagaaggagacauaca

SEQ ID NO: 1521217 - RNA, 19 nt, Homo sapiens
agguggcucuaucaucuua

SEQ ID NO: 1521218 - RNA, 19 nt, Homo sapiens
ucacagagacugguuagca

SEQ ID NO: 1521219 - RNA, 19 nt, Homo sapiens
cgagcugcaugacuacuuc

SEQ ID NO: 1521220 - RNA, 19 nt, Homo sapiens
gagaaugugaagcaagguu

SEQ ID NO: 1521221 - RNA, 19 nt, Homo sapiens
uagggaacuuguaggaaau

SEQ ID NO: 1521222 - RNA, 19 nt, Homo sapiens
gugacuaaaucuugguauc

SEQ ID NO: 1521223 - RNA, 19 nt, Homo sapiens
gcaggccuagggugaguaa

SEQ ID NO: 1521224 - RNA, 19 nt, Homo sapiens
gccaaggaacugaaagaga

SEQ ID NO: 1521225 - RNA, 19 nt, Homo sapiens
ucgcugaccgugaacgaua

SEQ ID NO: 1521226 - RNA, 19 nt, Homo sapiens
ggaaugaugacaggcacaa

SEQ ID NO: 1521227 - RNA, 19 nt, Homo sapiens
aggaagagacgacaguuug

SEQ ID NO: 1521228 - RNA, 19 nt, Homo sapiens
caguaacuuucacucauuc

SEQ ID NO: 1521229 - RNA, 19 nt, Homo sapiens
uaacugcagcuucuucaca

SEQ ID NO: 1521230 - RNA, 19 nt, Homo sapiens
gcuggugucuccuccugau

SEQ ID NO: 1521231 - RNA, 19 nt, Homo sapiens
agaagaaagcccucagaau

SEQ ID NO: 1521232 - RNA, 19 nt, Homo sapiens
gucagcaaacuucagauuu

SEQ ID NO: 1521233 - RNA, 19 nt, Homo sapiens
ggaagagacgacaguuugg

SEQ ID NO: 1521234 - RNA, 19 nt, Homo sapiens
ucaaaggcagguuauaagu

SEQ ID NO: 1521235 - RNA, 19 nt, Homo sapiens
uccauuagacagccugaua

SEQ ID NO: 1521236 - RNA, 19 nt, Homo sapiens
ugacauacucauccauuag

SEQ ID NO: 1521237 - RNA, 19 nt, Homo sapiens
gcaccaagggagucagcaa

SEQ ID NO: 1521238 - RNA, 19 nt, Homo sapiens
caggaagagacgacaguuu

SEQ ID NO: 1521239 - RNA, 19 nt, Homo sapiens
auacacaggccuucaggaa

SEQ ID NO: 1521240 - RNA, 19 nt, Homo sapiens
guguguguguguucaguug

SEQ ID NO: 1521241 - RNA, 19 nt, Homo sapiens
uaaaugucauccucuucuc

SEQ ID NO: 1521242 - RNA, 19 nt, Homo sapiens
ggcaaucucuccaaucuua

SEQ ID NO: 1521243 - RNA, 19 nt, Homo sapiens
gaagugaaauguugcacaa

SEQ ID NO: 1521244 - RNA, 19 nt, Homo sapiens
ggaaacagguagucagaau

SEQ ID NO: 1521245 - RNA, 19 nt, Homo sapiens
cacaggagcuucuaucuug

SEQ ID NO: 1521246 - RNA, 19 nt, Homo sapiens
aagguucacugguguauua

SEQ ID NO: 1521247 - RNA, 19 nt, Homo sapiens
gaagaugaagauacagaua

SEQ ID NO: 1521248 - RNA, 19 nt, Homo sapiens
gcucagacuucucucuaaa

SEQ ID NO: 1521249 - RNA, 19 nt, Homo sapiens
guauggaagugaaauguug

SEQ ID NO: 1521250 - RNA, 19 nt, Homo sapiens
gcacaugguuaacauaaaa

SEQ ID NO: 1521251 - RNA, 19 nt, Homo sapiens
caagcgagauccucuagau

SEQ ID NO: 1521252 - RNA, 19 nt, Homo sapiens
gcagcacucucauaccuau

SEQ ID NO: 1521253 - RNA, 19 nt, Homo sapiens
gagcuucuaucuugcugaa

SEQ ID NO: 1521254 - RNA, 19 nt, Homo sapiens
gagauccucuagaugaaga

SEQ ID NO: 1521255 - RNA, 19 nt, Homo sapiens
gcuacucucuuccaucuuc

SEQ ID NO: 1521256 - RNA, 19 nt, Homo sapiens
agacuucucucuaaaugug

SEQ ID NO: 1521257 - RNA, 19 nt, Homo sapiens
ggaaaccgcucagacuucu

SEQ ID NO: 1521258 - RNA, 19 nt, Homo sapiens
gcgagauccucuagaugaa

SEQ ID NO: 1521259 - RNA, 19 nt, Homo sapiens
gacaugaaccucagcauca

SEQ ID NO: 1521260 - RNA, 19 nt, Homo sapiens
ucagacuucucucuaaaug

SEQ ID NO: 1521261 - RNA, 19 nt, Homo sapiens
ccggguggcugacuacauu

SEQ ID NO: 1521262 - RNA, 19 nt, Homo sapiens
gcaagaggacuguaugucu

SEQ ID NO: 1521263 - RNA, 19 nt, Homo sapiens
gcuucuaucuugcugaaau

SEQ ID NO: 1521264 - RNA, 19 nt, Homo sapiens
cuaucuugcugaaauauug

SEQ ID NO: 1521265 - RNA, 19 nt, Homo sapiens
ccaccgcaauucauaggaa

SEQ ID NO: 1521266 - RNA, 19 nt, Homo sapiens
gcggcaaucucuccaaucu

SEQ ID NO: 1521267 - RNA, 19 nt, Homo sapiens
gcacaagcgagauccucua

SEQ ID NO: 1521268 - RNA, 19 nt, Homo sapiens
agaugaagaugaagauaca

SEQ ID NO: 1521269 - RNA, 19 nt, Homo sapiens
gaaacagguagucagaaug

SEQ ID NO: 1521270 - RNA, 19 nt, Homo sapiens
gugcacaugguuaacauaa

SEQ ID NO: 1521271 - RNA, 19 nt, Homo sapiens
aaacagguagucagaaugu

SEQ ID NO: 1521272 - RNA, 19 nt, Homo sapiens
uagcuacucucuuccaucu

SEQ ID NO: 1521273 - RNA, 19 nt, Homo sapiens
aggcuacgcuucagguuau

SEQ ID NO: 1521274 - RNA, 19 nt, Homo sapiens
uaacacugguucacaucau

SEQ ID NO: 1521275 - RNA, 19 nt, Homo sapiens
gcagcucuguacagccauu

SEQ ID NO: 1521276 - RNA, 19 nt, Homo sapiens
gaaccucagcaucaucaug

SEQ ID NO: 1521277 - RNA, 19 nt, Homo sapiens
cgcuucagguuaugguuua

SEQ ID NO: 1521278 - RNA, 19 nt, Homo sapiens
cgucuucauucgcuacaaa

SEQ ID NO: 1521279 - RNA, 19 nt, Homo sapiens
cuucuaucuugcugaaaua

SEQ ID NO: 1521280 - RNA, 19 nt, Homo sapiens
aacacugguucacaucaua

SEQ ID NO: 1521281 - RNA, 19 nt, Homo sapiens
caacgugacccugcucuuc

SEQ ID NO: 1521282 - RNA, 19 nt, Homo sapiens
ugguuuagcuacucucuuc

SEQ ID NO: 1521283 - RNA, 19 nt, Homo sapiens
cugaacugcuggcaaguau

SEQ ID NO: 1521284 - RNA, 19 nt, Homo sapiens
gaccggcacuauguuagga

SEQ ID NO: 1521285 - RNA, 19 nt, Homo sapiens
caggcuacgcuucagguua

SEQ ID NO: 1521286 - RNA, 19 nt, Homo sapiens
agauaacacugguucacau

SEQ ID NO: 1521287 - RNA, 19 nt, Homo sapiens
gauggaaaccgcucagacu

SEQ ID NO: 1521288 - RNA, 19 nt, Homo sapiens
guggcugacuacauuguga

SEQ ID NO: 1521289 - RNA, 19 nt, Homo sapiens
cauguuuccuuugcuguau

SEQ ID NO: 1521290 - RNA, 19 nt, Homo sapiens
uuaugucccugcugguuga

SEQ ID NO: 1521291 - RNA, 19 nt, Homo sapiens
auaaugaccggcacuaugu

SEQ ID NO: 1521292 - RNA, 19 nt, Homo sapiens
ugacuacauugugaagguu

SEQ ID NO: 1521293 - RNA, 19 nt, Homo sapiens
guacagccauucuaaaacu

SEQ ID NO: 1521294 - RNA, 19 nt, Homo sapiens
gacuguaugucuggaaaca

SEQ ID NO: 1521295 - RNA, 19 nt, Homo sapiens
gaacugcuggcaaguaucc

SEQ ID NO: 1521296 - RNA, 19 nt, Homo sapiens
aaugaccggcacuauguua

SEQ ID NO: 1521297 - RNA, 19 nt, Homo sapiens
gauaacacugguucacauc

SEQ ID NO: 1521298 - RNA, 19 nt, Homo sapiens
cagcugggcuuggaucaac

SEQ ID NO: 1521299 - RNA, 19 nt, Homo sapiens
gaagaggaaauggcagaca

SEQ ID NO: 1521300 - RNA, 19 nt, Homo sapiens
acacaggagcuucuaucuu

SEQ ID NO: 1521301 - RNA, 19 nt, Homo sapiens
gcucuguacagccauucua

SEQ ID NO: 1521302 - RNA, 19 nt, Homo sapiens
aaguaucccugcagcuguu

SEQ ID NO: 1521303 - RNA, 19 nt, Homo sapiens
ggucucugcuagugacucu

SEQ ID NO: 1521304 - RNA, 19 nt, Homo sapiens
gagauacacaggagcuucu

SEQ ID NO: 1521305 - RNA, 19 nt, Homo sapiens
cgcucagacuucucucuaa

SEQ ID NO: 1521306 - RNA, 19 nt, Homo sapiens
agcgagauccucuagauga

SEQ ID NO: 1521307 - RNA, 19 nt, Homo sapiens
uggcagacacuuccuaugg

SEQ ID NO: 1521308 - RNA, 19 nt, Homo sapiens
gcuucuggcccucgucuug

SEQ ID NO: 1521309 - RNA, 19 nt, Homo sapiens
ugcacaugguuaacauaaa

SEQ ID NO: 1521310 - RNA, 19 nt, Homo sapiens
gugguagugcacaugguua

SEQ ID NO: 1521311 - RNA, 19 nt, Homo sapiens
gcaaucucuccaaucuuau

SEQ ID NO: 1521312 - RNA, 19 nt, Homo sapiens
gaggaaauggcagacacuu

SEQ ID NO: 1521313 - RNA, 19 nt, Homo sapiens
caaucucuccaaucuuaug

SEQ ID NO: 1521314 - RNA, 19 nt, Homo sapiens
uguauuaaccaaacguugu

SEQ ID NO: 1521315 - RNA, 19 nt, Homo sapiens
guagugcacaugguuaaca

SEQ ID NO: 1521316 - RNA, 19 nt, Homo sapiens
ccgcucagacuucucucua

SEQ ID NO: 1521317 - RNA, 19 nt, Homo sapiens
caauucauaggaagcaugu

SEQ ID NO: 1521318 - RNA, 19 nt, Homo sapiens
ugcagcuguuuaugugaua

SEQ ID NO: 1521319 - RNA, 19 nt, Homo sapiens
ggguugggcgucuucauuc

SEQ ID NO: 1521320 - RNA, 19 nt, Homo sapiens
cugcagcuguuuaugugau

SEQ ID NO: 1521321 - RNA, 19 nt, Homo sapiens
ccuguggucucugcuagug

SEQ ID NO: 1521322 - RNA, 19 nt, Homo sapiens
gauacacaggagcuucuau

SEQ ID NO: 1521323 - RNA, 19 nt, Homo sapiens
uagaugaagaugaagauac

SEQ ID NO: 1521324 - RNA, 19 nt, Homo sapiens
cuagaugaagaugaagaua

SEQ ID NO: 1521325 - RNA, 19 nt, Homo sapiens
gcagcuguuuaugugauag

SEQ ID NO: 1521326 - RNA, 19 nt, Homo sapiens
cccugcagcuguuuaugug

SEQ ID NO: 1521327 - RNA, 19 nt, Homo sapiens
cugacuacauugugaaggu

SEQ ID NO: 1521328 - RNA, 19 nt, Homo sapiens
cggguugggcgucuucauu

SEQ ID NO: 1521329 - RNA, 19 nt, Homo sapiens
uucauucgcuacaaauaca

SEQ ID NO: 1521330 - RNA, 19 nt, Homo sapiens
gaaaguaaaucggaugaaa

SEQ ID NO: 1521331 - RNA, 19 nt, Homo sapiens
ccacaccacuuaaacauaa

SEQ ID NO: 1521332 - RNA, 19 nt, Homo sapiens
gaagguagcaaagaauuua

SEQ ID NO: 1521333 - RNA, 19 nt, Homo sapiens
gaaagugacauaacaaaug

SEQ ID NO: 1521334 - RNA, 19 nt, Homo sapiens
gaagaggcauuaaugagau

SEQ ID NO: 1521335 - RNA, 19 nt, Homo sapiens
gaaagcagcaaucuauauu

SEQ ID NO: 1521336 - RNA, 19 nt, Homo sapiens
ggcaauaacugcuuuagau

SEQ ID NO: 1521337 - RNA, 19 nt, Homo sapiens
guugauacauugcaucuuu

SEQ ID NO: 1521338 - RNA, 19 nt, Homo sapiens
aaagagaacuccacauugu

SEQ ID NO: 1521339 - RNA, 19 nt, Homo sapiens
cgaagaagaagaagauaua

SEQ ID NO: 1521340 - RNA, 19 nt, Homo sapiens
gcaauaacugcuuuagaua

SEQ ID NO: 1521341 - RNA, 19 nt, Homo sapiens
caucauaaaugcaguggaa

SEQ ID NO: 1521342 - RNA, 19 nt, Homo sapiens
agaauuuccugaagguuua

SEQ ID NO: 1521343 - RNA, 19 nt, Homo sapiens
gaagauauacuggcaaguu

SEQ ID NO: 1521344 - RNA, 19 nt, Homo sapiens
gaacugaacucccuuuacc

SEQ ID NO: 1521345 - RNA, 19 nt, Homo sapiens
gguccgauguuacgucuaa

SEQ ID NO: 1521346 - RNA, 19 nt, Homo sapiens
uuaaugagaugguaucgaa

SEQ ID NO: 1521347 - RNA, 19 nt, Homo sapiens
ggaagaggcauuaaugaga

SEQ ID NO: 1521348 - RNA, 19 nt, Homo sapiens
aaacugagcuauacaaggu

SEQ ID NO: 1521349 - RNA, 19 nt, Homo sapiens
uagcagaccuugaaaauuu

SEQ ID NO: 1521350 - RNA, 19 nt, Homo sapiens
gaagucaagauaugaauga

SEQ ID NO: 1521351 - RNA, 19 nt, Homo sapiens
agagauugcugcugaauau

SEQ ID NO: 1521352 - RNA, 19 nt, Homo sapiens
gaugaccuccgauguauuu

SEQ ID NO: 1521353 - RNA, 19 nt, Homo sapiens
ggaaaguuaugcaaagaca

SEQ ID NO: 1521354 - RNA, 19 nt, Homo sapiens
gggagaaagugacauaaca

SEQ ID NO: 1521355 - RNA, 19 nt, Homo sapiens
gaaaagaucgacaucauaa

SEQ ID NO: 1521356 - RNA, 19 nt, Homo sapiens
ccaaauguauagcuaugaa

SEQ ID NO: 1521357 - RNA, 19 nt, Homo sapiens
cgaaacauguucaguugga

SEQ ID NO: 1521358 - RNA, 19 nt, Homo sapiens
gcacgaagaagaagaagau

SEQ ID NO: 1521359 - RNA, 19 nt, Homo sapiens
gaaggauacuggucuggau

SEQ ID NO: 1521360 - RNA, 19 nt, Homo sapiens
aaucauugccuguguguua

SEQ ID NO: 1521361 - RNA, 19 nt, Homo sapiens
ggcgaaacauguucaguug

SEQ ID NO: 1521362 - RNA, 19 nt, Homo sapiens
auucagagcucaaccugua

SEQ ID NO: 1521363 - RNA, 19 nt, Homo sapiens
cagcaggacuggacagguu

SEQ ID NO: 1521364 - RNA, 19 nt, Homo sapiens
uaagguauguaaaggaguu

SEQ ID NO: 1521365 - RNA, 19 nt, Homo sapiens
ucaccuaaguaacuaugua

SEQ ID NO: 1521366 - RNA, 19 nt, Homo sapiens
gaagguuuaucuauagaag

SEQ ID NO: 1521367 - RNA, 19 nt, Homo sapiens
caacgaagaguggugauuu

SEQ ID NO: 1521368 - RNA, 19 nt, Homo sapiens
ccacauuguuucaaagguu

SEQ ID NO: 1521369 - RNA, 19 nt, Homo sapiens
gagaaagugacauaacaaa

SEQ ID NO: 1521370 - RNA, 19 nt, Homo sapiens
aaucaaauaucgacacugu

SEQ ID NO: 1521371 - RNA, 19 nt, Homo sapiens
gguaauaguugcaugaaaa

SEQ ID NO: 1521372 - RNA, 19 nt, Homo sapiens
gaacucccuuuaccaucaa

SEQ ID NO: 1521373 - RNA, 19 nt, Homo sapiens
ggaguagaauuuccugaag

SEQ ID NO: 1521374 - RNA, 19 nt, Homo sapiens
ugaagaggaugaugaugga

SEQ ID NO: 1521375 - RNA, 19 nt, Homo sapiens
cauaagcacuggcugagau

SEQ ID NO: 1521376 - RNA, 19 nt, Homo sapiens
ggacagguuuuauauaaug

SEQ ID NO: 1521377 - RNA, 19 nt, Homo sapiens
aauaggagguugaaugugu

SEQ ID NO: 1521378 - RNA, 19 nt, Homo sapiens
ucucagaagucaagauaug

SEQ ID NO: 1521379 - RNA, 19 nt, Homo sapiens
uagaugcaguugauacauu

SEQ ID NO: 1521380 - RNA, 19 nt, Homo sapiens
aaacugggccauaaugauu

SEQ ID NO: 1521381 - RNA, 19 nt, Homo sapiens
uaacaaaugcagagaagga

SEQ ID NO: 1521382 - RNA, 19 nt, Homo sapiens
gcgaaagcuugaugaggaa

SEQ ID NO: 1521383 - RNA, 19 nt, Homo sapiens
gaccuccgauguauuugaa

SEQ ID NO: 1521384 - RNA, 19 nt, Homo sapiens
gcugcuuuaucgaauguua

SEQ ID NO: 1521385 - RNA, 19 nt, Homo sapiens
ugaacucccuuuaccauca

SEQ ID NO: 1521386 - RNA, 19 nt, Homo sapiens
gcucagagaaacuuccuuu

SEQ ID NO: 1521387 - RNA, 19 nt, Homo sapiens
gaagaggcaggauucaaau

SEQ ID NO: 1521388 - RNA, 19 nt, Homo sapiens
gaaacugggccauaaugau

SEQ ID NO: 1521389 - RNA, 19 nt, Homo sapiens
gaaguuaagaagaguaauc

SEQ ID NO: 1521390 - RNA, 19 nt, Homo sapiens
cuacaacucugaauaagcu

SEQ ID NO: 1521391 - RNA, 19 nt, Homo sapiens
uggaucaucuuaaaggauu

SEQ ID NO: 1521392 - RNA, 19 nt, Homo sapiens
gaaacuggauuuuacacuu

SEQ ID NO: 1521393 - RNA, 19 nt, Homo sapiens
cauaacaaaugcagagaag

SEQ ID NO: 1521394 - RNA, 19 nt, Homo sapiens
ggagaaagugacauaacaa

SEQ ID NO: 1521395 - RNA, 19 nt, Homo sapiens
gaaacauguucaguuggaa

SEQ ID NO: 1521396 - RNA, 19 nt, Homo sapiens
uuaugaagcuaacagaaug

SEQ ID NO: 1521397 - RNA, 19 nt, Homo sapiens
cgaauguuaccuaccaaua

SEQ ID NO: 1521398 - RNA, 19 nt, Homo sapiens
agacugggcugcuuuaucg

SEQ ID NO: 1521399 - RNA, 19 nt, Homo sapiens
guaauagcuuuuccugaua

SEQ ID NO: 1521400 - RNA, 19 nt, Homo sapiens
ccugaagguuuaucuauag

SEQ ID NO: 1521401 - RNA, 19 nt, Homo sapiens
aaagggagaaagugacaua

SEQ ID NO: 1521402 - RNA, 19 nt, Homo sapiens
aaacuuccuuugcuuguca

SEQ ID NO: 1521403 - RNA, 19 nt, Homo sapiens
cagguaugguuuaguauuc

SEQ ID NO: 1521404 - RNA, 19 nt, Homo sapiens
gcaaagacagaauaacucu

SEQ ID NO: 1521405 - RNA, 19 nt, Homo sapiens
aagaaacagucaccaggaa

SEQ ID NO: 1521406 - RNA, 19 nt, Homo sapiens
gucaucaaguuccuacaaa

SEQ ID NO: 1521407 - RNA, 19 nt, Homo sapiens
uugaaugugugcauggaua

SEQ ID NO: 1521408 - RNA, 19 nt, Homo sapiens
aaagcuugaugaggaauuu

SEQ ID NO: 1521409 - RNA, 19 nt, Homo sapiens
agagaacuccacauuguuu

SEQ ID NO: 1521410 - RNA, 19 nt, Homo sapiens
ggguaauaguugcaugaaa

SEQ ID NO: 1521411 - RNA, 19 nt, Homo sapiens
cagagaaacuuccuuugcu

SEQ ID NO: 1521412 - RNA, 19 nt, Homo sapiens
ggaaaagaucgacaucaua

SEQ ID NO: 1521413 - RNA, 19 nt, Homo sapiens
uagaauuuccugaagguuu

SEQ ID NO: 1521414 - RNA, 19 nt, Homo sapiens
ggcaaguucuagaaggauu

SEQ ID NO: 1521415 - RNA, 19 nt, Homo sapiens
cacauuguuucaaagguuu

SEQ ID NO: 1521416 - RNA, 19 nt, Homo sapiens
gaaacuuccuuugcuuguc

SEQ ID NO: 1521417 - RNA, 19 nt, Homo sapiens
agagaaacuuccuuugcuu

SEQ ID NO: 1521418 - RNA, 19 nt, Homo sapiens
gaauguuaccuaccaauac

SEQ ID NO: 1521419 - RNA, 19 nt, Homo sapiens
gauauacuggcaaguucua

SEQ ID NO: 1521420 - RNA, 19 nt, Homo sapiens
ggacuggacagguuuuaua

SEQ ID NO: 1521421 - RNA, 19 nt, Homo sapiens
gaggguggagguagaugua

SEQ ID NO: 1521422 - RNA, 19 nt, Homo sapiens
aaagugacauaacaaaugc

SEQ ID NO: 1521423 - RNA, 19 nt, Homo sapiens
cgauguauuugaacaaugg

SEQ ID NO: 1521424 - RNA, 19 nt, Homo sapiens
ucuagaagccuuugaaucu

SEQ ID NO: 1521425 - RNA, 19 nt, Homo sapiens
gaaacagucaccaggaagu

SEQ ID NO: 1521426 - RNA, 19 nt, Homo sapiens
caacucugaauaagcuaua

SEQ ID NO: 1521427 - RNA, 19 nt, Homo sapiens
acccuagccucacacguua

SEQ ID NO: 1521428 - RNA, 19 nt, Homo sapiens
agaauaugcugcccuggau

SEQ ID NO: 1521429 - RNA, 19 nt, Homo sapiens
uccugaagguuuaucuaua

SEQ ID NO: 1521430 - RNA, 19 nt, Homo sapiens
gaauagaaaugccgacuuu

SEQ ID NO: 1521431 - RNA, 19 nt, Homo sapiens
gaagauacacccucuguua

SEQ ID NO: 1521432 - RNA, 19 nt, Homo sapiens
gaaauucccuugcuuguca

SEQ ID NO: 1521433 - RNA, 19 nt, Homo sapiens
ccagagaggucuuuccaua

SEQ ID NO: 1521434 - RNA, 19 nt, Homo sapiens
caaacuagguuaacaacaa

SEQ ID NO: 1521435 - RNA, 19 nt, Homo sapiens
gauccaacccuaucaaaua

SEQ ID NO: 1521436 - RNA, 19 nt, Homo sapiens
uggaagagcuugauaaaug

SEQ ID NO: 1521437 - RNA, 19 nt, Homo sapiens
gcaaagcucacacuuguuu

SEQ ID NO: 1521438 - RNA, 19 nt, Homo sapiens
ugaacuacguggauaauuu

SEQ ID NO: 1521439 - RNA, 19 nt, Homo sapiens
ggauaagccucauguccua

SEQ ID NO: 1521440 - RNA, 19 nt, Homo sapiens
guacacaacuucaacagau

SEQ ID NO: 1521441 - RNA, 19 nt, Homo sapiens
guauuugccuucugaacua

SEQ ID NO: 1521442 - RNA, 19 nt, Homo sapiens
ugaaugaggcuuuguguuu

SEQ ID NO: 1521443 - RNA, 19 nt, Homo sapiens
ggaagaaugugcaauugag

SEQ ID NO: 1521444 - RNA, 19 nt, Homo sapiens
gagaaggaaucaaaucaca

SEQ ID NO: 1521445 - RNA, 19 nt, Homo sapiens
cuacuugucuccuaccuuu

SEQ ID NO: 1521446 - RNA, 19 nt, Homo sapiens
gcagugaccaucaaagaaa

SEQ ID NO: 1521447 - RNA, 19 nt, Homo sapiens
gaacagccaagccucaauu

SEQ ID NO: 1521448 - RNA, 19 nt, Homo sapiens
ccucagcucuccuuggaua

SEQ ID NO: 1521449 - RNA, 19 nt, Homo sapiens
gaaauggaagagcuugaua

SEQ ID NO: 1521450 - RNA, 19 nt, Homo sapiens
cauaugaacugggaaguga

SEQ ID NO: 1521451 - RNA, 19 nt, Homo sapiens
gaccaucaaagaaacauua

SEQ ID NO: 1521452 - RNA, 19 nt, Homo sapiens
ccaaacacagcaaguauuu

SEQ ID NO: 1521453 - RNA, 19 nt, Homo sapiens
ggaagagcuugauaaaugg

SEQ ID NO: 1521454 - RNA, 19 nt, Homo sapiens
cuacguggauaauuucaaa

SEQ ID NO: 1521455 - RNA, 19 nt, Homo sapiens
uugaacaccuggaccuuua

SEQ ID NO: 1521456 - RNA, 19 nt, Homo sapiens
aacauuugcugcucaauuu

SEQ ID NO: 1521457 - RNA, 19 nt, Homo sapiens
uggcagaucucacucauca

SEQ ID NO: 1521458 - RNA, 19 nt, Homo sapiens
aaagacagacuucauggua

SEQ ID NO: 1521459 - RNA, 19 nt, Homo sapiens
acaaguauuugccuucuga

SEQ ID NO: 1521460 - RNA, 19 nt, Homo sapiens
caacuuugcuccggaugaa

SEQ ID NO: 1521461 - RNA, 19 nt, Homo sapiens
gaaagaccaaauaaaguga

SEQ ID NO: 1521462 - RNA, 19 nt, Homo sapiens
gaacuacguggauaauuuc

SEQ ID NO: 1521463 - RNA, 19 nt, Homo sapiens
guaaccagcuuuggauaau

SEQ ID NO: 1521464 - RNA, 19 nt, Homo sapiens
gaagagaaggaaucaaauc

SEQ ID NO: 1521465 - RNA, 19 nt, Homo sapiens
gauaaauguucgucaccuu

SEQ ID NO: 1521466 - RNA, 19 nt, Homo sapiens
caacauagccuagucaaac

SEQ ID NO: 1521467 - RNA, 19 nt, Homo sapiens
cugcaaagcucacacuugu

SEQ ID NO: 1521468 - RNA, 19 nt, Homo sapiens
ggaguguuaugucauggaa

SEQ ID NO: 1521469 - RNA, 19 nt, Homo sapiens
ugaacagcaugaauagaaa

SEQ ID NO: 1521470 - RNA, 19 nt, Homo sapiens
gaaucugaaagaccaaaua

SEQ ID NO: 1521471 - RNA, 19 nt, Homo sapiens
gggaucccuuuaacaagua

SEQ ID NO: 1521472 - RNA, 19 nt, Homo sapiens
gcagaucucacucaucaug

SEQ ID NO: 1521473 - RNA, 19 nt, Homo sapiens
auacaacuguggaaucuga

SEQ ID NO: 1521474 - RNA, 19 nt, Homo sapiens
gaaaugccgacuuugaaug

SEQ ID NO: 1521475 - RNA, 19 nt, Homo sapiens
ucuuguaccuugugucuuu

SEQ ID NO: 1521476 - RNA, 19 nt, Homo sapiens
caccauaccucccuuggau

SEQ ID NO: 1521477 - RNA, 19 nt, Homo sapiens
ucacacuuguuucaccaua

SEQ ID NO: 1521478 - RNA, 19 nt, Homo sapiens
ucagagugcuuuacagaca

SEQ ID NO: 1521479 - RNA, 19 nt, Homo sapiens
auaacuagcugguuguguu

SEQ ID NO: 1521480 - RNA, 19 nt, Homo sapiens
uaaaagcaauggcacaaaa

SEQ ID NO: 1521481 - RNA, 19 nt, Homo sapiens
aaugugcaauugagaagua

SEQ ID NO: 1521482 - RNA, 19 nt, Homo sapiens
aaccagcuuuggauaauuu

SEQ ID NO: 1521483 - RNA, 19 nt, Homo sapiens
gaauggcgcucauguuuuc

SEQ ID NO: 1521484 - RNA, 19 nt, Homo sapiens
gaaugaggcuuuguguuuu

SEQ ID NO: 1521485 - RNA, 19 nt, Homo sapiens
ugaaagaccaaauaaagug

SEQ ID NO: 1521486 - RNA, 19 nt, Homo sapiens
ccaacccuaucaaauaaug

SEQ ID NO: 1521487 - RNA, 19 nt, Homo sapiens
agagaggucuuuccauaca

SEQ ID NO: 1521488 - RNA, 19 nt, Homo sapiens
uugaaagucugcccuaaug

SEQ ID NO: 1521489 - RNA, 19 nt, Homo sapiens
agaaagagacaaagaagga

SEQ ID NO: 1521490 - RNA, 19 nt, Homo sapiens
gaagaggagcaggaaauau

SEQ ID NO: 1521491 - RNA, 19 nt, Homo sapiens
cgaggaguguuaugucaug

SEQ ID NO: 1521492 - RNA, 19 nt, Homo sapiens
ucacucuggucaugauaaa

SEQ ID NO: 1521493 - RNA, 19 nt, Homo sapiens
gaaggaggcgggugaugug

SEQ ID NO: 1521494 - RNA, 19 nt, Homo sapiens
caacccaagugacagugaa

SEQ ID NO: 1521495 - RNA, 19 nt, Homo sapiens
aaacuucucaggaaacuug

SEQ ID NO: 1521496 - RNA, 19 nt, Homo sapiens
ucaagaaagagacaaagaa

SEQ ID NO: 1521497 - RNA, 19 nt, Homo sapiens
ccaagaagacacagugaga

SEQ ID NO: 1521498 - RNA, 19 nt, Homo sapiens
uggauaauuuccucugauu

SEQ ID NO: 1521499 - RNA, 19 nt, Homo sapiens
gaagaaugugcaauugaga

SEQ ID NO: 1521500 - RNA, 19 nt, Homo sapiens
ggaugaagaggauacaaau

SEQ ID NO: 1521501 - RNA, 19 nt, Homo sapiens
gaaggaagagaaggaauca

SEQ ID NO: 1521502 - RNA, 19 nt, Homo sapiens
uggaugaacagcaugaaua

SEQ ID NO: 1521503 - RNA, 19 nt, Homo sapiens
gaaacuaggaaucuucagu

SEQ ID NO: 1521504 - RNA, 19 nt, Homo sapiens
caagugacagugaauccua

SEQ ID NO: 1521505 - RNA, 19 nt, Homo sapiens
ggaagagaaggaaucaaau

SEQ ID NO: 1521506 - RNA, 19 nt, Homo sapiens
gacuuugaauguuuaccua

SEQ ID NO: 1521507 - RNA, 19 nt, Homo sapiens
gaacagcaugaauagaaau

SEQ ID NO: 1521508 - RNA, 19 nt, Homo sapiens
cagaagagccuccauuugc

SEQ ID NO: 1521509 - RNA, 19 nt, Homo sapiens
gaaagucugcccuaaugca

SEQ ID NO: 1521510 - RNA, 19 nt, Homo sapiens
gaaagagacaaagaaggaa

SEQ ID NO: 1521511 - RNA, 19 nt, Homo sapiens
uaaccagcuuuggauaauu

SEQ ID NO: 1521512 - RNA, 19 nt, Homo sapiens
gaugaagaggauacaaauu

SEQ ID NO: 1521513 - RNA, 19 nt, Homo sapiens
gauacacccucuguuaugg

SEQ ID NO: 1521514 - RNA, 19 nt, Homo sapiens
caccuggaccuuuacauuu

SEQ ID NO: 1521515 - RNA, 19 nt, Homo sapiens
ggacugcauagaacuuuga

SEQ ID NO: 1521516 - RNA, 19 nt, Homo sapiens
ggacagguaaacuacauuc

SEQ ID NO: 1521517 - RNA, 19 nt, Homo sapiens
caauugagaaguacuagga

SEQ ID NO: 1521518 - RNA, 19 nt, Homo sapiens
uaagcaaacuagguuaaca

SEQ ID NO: 1521519 - RNA, 19 nt, Homo sapiens
gacaaaaucugacuuucga

SEQ ID NO: 1521520 - RNA, 19 nt, Homo sapiens
caggguauaugaaguuagu

SEQ ID NO: 1521521 - RNA, 19 nt, Homo sapiens
ugguaaagcuauaauugug

SEQ ID NO: 1521522 - RNA, 19 nt, Homo sapiens
caaugaaagcuauaacuag

SEQ ID NO: 1521523 - RNA, 19 nt, Homo sapiens
gagaggucuuuccauacaa

SEQ ID NO: 1521524 - RNA, 19 nt, Homo sapiens
agucugcccuaaugcauaa

SEQ ID NO: 1521525 - RNA, 19 nt, Homo sapiens
aaacauuugcugcucaauu

SEQ ID NO: 1521526 - RNA, 19 nt, Homo sapiens
gaccaaauaaagugacuau

SEQ ID NO: 1521527 - RNA, 19 nt, Homo sapiens
gaaggaaucaaaucacaac

SEQ ID NO: 1521528 - RNA, 19 nt, Homo sapiens
ugguauuccuugcaacaua

SEQ ID NO: 1521529 - RNA, 19 nt, Homo sapiens
auccaacccuaucaaauaa

SEQ ID NO: 1521530 - RNA, 19 nt, Homo sapiens
gaaguacaguguugugaua

SEQ ID NO: 1521531 - RNA, 19 nt, Homo sapiens
caaauuuggugacuucuuu

SEQ ID NO: 1521532 - RNA, 19 nt, Homo sapiens
gaacauuugucucagaaga

SEQ ID NO: 1521533 - RNA, 19 nt, Homo sapiens
ggugacuucuuucgaauua

SEQ ID NO: 1521534 - RNA, 19 nt, Homo sapiens
caccacaccuggcuaauuu

SEQ ID NO: 1521535 - RNA, 19 nt, Homo sapiens
gcccaugacuguauaaaga

SEQ ID NO: 1521536 - RNA, 19 nt, Homo sapiens
aaacacaucccaaauacua

SEQ ID NO: 1521537 - RNA, 19 nt, Homo sapiens
caaugaagauggcacagaa

SEQ ID NO: 1521538 - RNA, 19 nt, Homo sapiens
cagaaacacaucccaaaua

SEQ ID NO: 1521539 - RNA, 19 nt, Homo sapiens
uugcaaagcuguaaucgaa

SEQ ID NO: 1521540 - RNA, 19 nt, Homo sapiens
augcagaacuugccaguaa

SEQ ID NO: 1521541 - RNA, 19 nt, Homo sapiens
ucaaaucacuauucacauc

SEQ ID NO: 1521542 - RNA, 19 nt, Homo sapiens
cuacuuuaauggaauggua

SEQ ID NO: 1521543 - RNA, 19 nt, Homo sapiens
agaaacacaucccaaauac

SEQ ID NO: 1521544 - RNA, 19 nt, Homo sapiens
guacaguguugugauauca

SEQ ID NO: 1521545 - RNA, 19 nt, Homo sapiens
uuaauucccuuacgucugu

SEQ ID NO: 1521546 - RNA, 19 nt, Homo sapiens
gcaaagcuguaaucgaaaa

SEQ ID NO: 1521547 - RNA, 19 nt, Homo sapiens
caucccaaauacuaugaua

SEQ ID NO: 1521548 - RNA, 19 nt, Homo sapiens
cauagugaaugcagaacuu

SEQ ID NO: 1521549 - RNA, 19 nt, Homo sapiens
aaaguauacuguagcaaug

SEQ ID NO: 1521550 - RNA, 19 nt, Homo sapiens
uaagaaggcgcuuuuguua

SEQ ID NO: 1521551 - RNA, 19 nt, Homo sapiens
cuucugagcucaagcaauc

SEQ ID NO: 1521552 - RNA, 19 nt, Homo sapiens
aaaaggagauugagaggaa

SEQ ID NO: 1521553 - RNA, 19 nt, Homo sapiens
gaacuugccaguaagaacu

SEQ ID NO: 1521554 - RNA, 19 nt, Homo sapiens
guucaguucuugacaccaa

SEQ ID NO: 1521555 - RNA, 19 nt, Homo sapiens
cauaaaguauacuguagca

SEQ ID NO: 1521556 - RNA, 19 nt, Homo sapiens
guugugauaucaguucauu

SEQ ID NO: 1521557 - RNA, 19 nt, Homo sapiens
gaagucaagcaaugaagau

SEQ ID NO: 1521558 - RNA, 19 nt, Homo sapiens
gcagaacuugccaguaaga

SEQ ID NO: 1521559 - RNA, 19 nt, Homo sapiens
cauugcaacuucugucuuc

SEQ ID NO: 1521560 - RNA, 19 nt, Homo sapiens
ugauaucaguucauugcaa

SEQ ID NO: 1521561 - RNA, 19 nt, Homo sapiens
uuauuucacugguuucaug

SEQ ID NO: 1521562 - RNA, 19 nt, Homo sapiens
gcaaugaagauggcacaga

SEQ ID NO: 1521563 - RNA, 19 nt, Homo sapiens
guagaagucaagcaaugaa

SEQ ID NO: 1521564 - RNA, 19 nt, Homo sapiens
uuucaaauuuggugacuuc

SEQ ID NO: 1521565 - RNA, 19 nt, Homo sapiens
gccaguaagaacuuucaua

SEQ ID NO: 1521566 - RNA, 19 nt, Homo sapiens
acauuugucucagaagauu

SEQ ID NO: 1521567 - RNA, 19 nt, Homo sapiens
gguagaagucaagcaauga

SEQ ID NO: 1521568 - RNA, 19 nt, Homo sapiens
aaagacaguuucgccaugu

SEQ ID NO: 1521569 - RNA, 19 nt, Homo sapiens
cacccucauuugaacauuu

SEQ ID NO: 1521570 - RNA, 19 nt, Homo sapiens
ugccucagccucucaagua

SEQ ID NO: 1521571 - RNA, 19 nt, Homo sapiens
ccaguaagaacuuucauac

SEQ ID NO: 1521572 - RNA, 19 nt, Homo sapiens
ccucaaggguaaagucaag

SEQ ID NO: 1521573 - RNA, 19 nt, Homo sapiens
ucacugguuucaugucaca

SEQ ID NO: 1521574 - RNA, 19 nt, Homo sapiens
ggacugacuacaggcauga

SEQ ID NO: 1521575 - RNA, 19 nt, Homo sapiens
ugguagaagucaagcaaug

SEQ ID NO: 1521576 - RNA, 19 nt, Homo sapiens
cuucucaaaucacuauuca

SEQ ID NO: 1521577 - RNA, 19 nt, Homo sapiens
gccauguuguacagaacua

SEQ ID NO: 1521578 - RNA, 19 nt, Homo sapiens
cacagaaacacaucccaaa

SEQ ID NO: 1521579 - RNA, 19 nt, Homo sapiens
gaagauggcacagaaacac

SEQ ID NO: 1521580 - RNA, 19 nt, Homo sapiens
ucucaaaucacuauucaca

SEQ ID NO: 1521581 - RNA, 19 nt, Homo sapiens
ccaccacaccuggcuaauu

SEQ ID NO: 1521582 - RNA, 19 nt, Homo sapiens
aggcugaaguacaguguug

SEQ ID NO: 1521583 - RNA, 19 nt, Homo sapiens
uggcacacccucauuugaa

SEQ ID NO: 1521584 - RNA, 19 nt, Homo sapiens
uuuggugacuucuuucgaa

SEQ ID NO: 1521585 - RNA, 19 nt, Homo sapiens
gaggguguggugagugaaa

SEQ ID NO: 1521586 - RNA, 19 nt, Homo sapiens
caaacacaacaaugacuca

SEQ ID NO: 1521587 - RNA, 19 nt, Homo sapiens
gugaaauggagaaggcuaa

SEQ ID NO: 1521588 - RNA, 19 nt, Homo sapiens
cuacuucucaaaucacuau

SEQ ID NO: 1521589 - RNA, 19 nt, Homo sapiens
uuacauagugaaugcagaa

SEQ ID NO: 1521590 - RNA, 19 nt, Homo sapiens
uugaacauuugucucagaa

SEQ ID NO: 1521591 - RNA, 19 nt, Homo sapiens
cauuugaacauuugucuca

SEQ ID NO: 1521592 - RNA, 19 nt, Homo sapiens
ccaaauacuaugauaccau

SEQ ID NO: 1521593 - RNA, 19 nt, Homo sapiens
ugcaacuucugucuucuga

SEQ ID NO: 1521594 - RNA, 19 nt, Homo sapiens
caaaacaugucaaaaucag

SEQ ID NO: 1521595 - RNA, 19 nt, Homo sapiens
gcauuggcacacccucauu

SEQ ID NO: 1521596 - RNA, 19 nt, Homo sapiens
gaaacacaucccaaauacu

SEQ ID NO: 1521597 - RNA, 19 nt, Homo sapiens
uuucaguucuaguucaguu

SEQ ID NO: 1521598 - RNA, 19 nt, Homo sapiens
gauuucagaggccauuaau

SEQ ID NO: 1521599 - RNA, 19 nt, Homo sapiens
acagaaacacaucccaaau

SEQ ID NO: 1521600 - RNA, 19 nt, Homo sapiens
gaacuacuucucaaaucac

SEQ ID NO: 1521601 - RNA, 19 nt, Homo sapiens
acagcgacauguugcaaag

SEQ ID NO: 1521602 - RNA, 19 nt, Homo sapiens
cguaauuacuuuucaguuc

SEQ ID NO: 1521603 - RNA, 19 nt, Homo sapiens
ccaugacuguauaaagagu

SEQ ID NO: 1521604 - RNA, 19 nt, Homo sapiens
ggcacacccucauuugaac

SEQ ID NO: 1521605 - RNA, 19 nt, Homo sapiens
cauuggcacacccucauuu

SEQ ID NO: 1521606 - RNA, 19 nt, Homo sapiens
cuauucacauccugguaga

SEQ ID NO: 1521607 - RNA, 19 nt, Homo sapiens
gcacacccucauuugaaca

SEQ ID NO: 1521608 - RNA, 19 nt, Homo sapiens
acacaucccaaauacuaug

SEQ ID NO: 1521609 - RNA, 19 nt, Homo sapiens
agaagucaagcaaugaaga

SEQ ID NO: 1521610 - RNA, 19 nt, Homo sapiens
ugauuucagaggccauuaa

SEQ ID NO: 1521611 - RNA, 19 nt, Homo sapiens
ugaaauggagaaggcuaaa

SEQ ID NO: 1521612 - RNA, 19 nt, Homo sapiens
ugacucacagcgacauguu

SEQ ID NO: 1521613 - RNA, 19 nt, Homo sapiens
cagaagauuuugacagaag

SEQ ID NO: 1521614 - RNA, 19 nt, Homo sapiens
uuugaacauuugucucaga

SEQ ID NO: 1521615 - RNA, 19 nt, Homo sapiens
ugaaguacaguguugugau

SEQ ID NO: 1521616 - RNA, 19 nt, Homo sapiens
accauaaaguauacuguag

SEQ ID NO: 1521617 - RNA, 19 nt, Homo sapiens
uuucacugguuucauguca

SEQ ID NO: 1521618 - RNA, 19 nt, Homo sapiens
gagcagaacugaaggaaau

SEQ ID NO: 1521619 - RNA, 19 nt, Homo sapiens
gauguaagaucugcuguua

SEQ ID NO: 1521620 - RNA, 19 nt, Homo sapiens
gaacugcaagguccacuua

SEQ ID NO: 1521621 - RNA, 19 nt, Homo sapiens
gaacaaagacacaacauac

SEQ ID NO: 1521622 - RNA, 19 nt, Homo sapiens
gaucugcuguuacuucuug

SEQ ID NO: 1521623 - RNA, 19 nt, Homo sapiens
caaacaagagugaagauaa

SEQ ID NO: 1521624 - RNA, 19 nt, Homo sapiens
ucaacuacauggaaacuga

SEQ ID NO: 1521625 - RNA, 19 nt, Homo sapiens
gaacugaaggaaauagaga

SEQ ID NO: 1521626 - RNA, 19 nt, Homo sapiens
uagcagaaggcaagaaaua

SEQ ID NO: 1521627 - RNA, 19 nt, Homo sapiens
gaaauagagacacacaaga

SEQ ID NO: 1521628 - RNA, 19 nt, Homo sapiens
caggaaagaucuaaaauug

SEQ ID NO: 1521629 - RNA, 19 nt, Homo sapiens
gaaggcaagaaauaacuaa

SEQ ID NO: 1521630 - RNA, 19 nt, Homo sapiens
gaaagcaggaaagaucuaa

SEQ ID NO: 1521631 - RNA, 19 nt, Homo sapiens
cacccuaacaucacaauua

SEQ ID NO: 1521632 - RNA, 19 nt, Homo sapiens
gaaggcagaaguaaagaug

SEQ ID NO: 1521633 - RNA, 19 nt, Homo sapiens
ggaaauagagacacacaag

SEQ ID NO: 1521634 - RNA, 19 nt, Homo sapiens
ugaacaaccugcuccugaa

SEQ ID NO: 1521635 - RNA, 19 nt, Homo sapiens
uaaaugcccacaagagaaa

SEQ ID NO: 1521636 - RNA, 19 nt, Homo sapiens
gaacucaggauuaagaaac

SEQ ID NO: 1521637 - RNA, 19 nt, Homo sapiens
uacuagaacucaggauuaa

SEQ ID NO: 1521638 - RNA, 19 nt, Homo sapiens
aaauagagacacacaagaa

SEQ ID NO: 1521639 - RNA, 19 nt, Homo sapiens
ugaaggaaauagagacaca

SEQ ID NO: 1521640 - RNA, 19 nt, Homo sapiens
uaaaagaacuagagaagca

SEQ ID NO: 1521641 - RNA, 19 nt, Homo sapiens
acccuaacaucacaauuaa

SEQ ID NO: 1521642 - RNA, 19 nt, Homo sapiens
gaacaaccugcuccugaau

SEQ ID NO: 1521643 - RNA, 19 nt, Homo sapiens
gcacuaaaugcccacaaga

SEQ ID NO: 1521644 - RNA, 19 nt, Homo sapiens
auacuagaacucaggauua

SEQ ID NO: 1521645 - RNA, 19 nt, Homo sapiens
ggaaagaucuaaaauugac

SEQ ID NO: 1521646 - RNA, 19 nt, Homo sapiens
guguguagagggaaauuua

SEQ ID NO: 1521647 - RNA, 19 nt, Homo sapiens
acaaccugcuccugaauga

SEQ ID NO: 1521648 - RNA, 19 nt, Homo sapiens
ggcugccucugccauguua

SEQ ID NO: 1521649 - RNA, 19 nt, Homo sapiens
uaagaucugcuguuacuuc

SEQ ID NO: 1521650 - RNA, 19 nt, Homo sapiens
gaaacacauucaaaagcua

SEQ ID NO: 1521651 - RNA, 19 nt, Homo sapiens
gcaagaggaaacacauuca

SEQ ID NO: 1521652 - RNA, 19 nt, Homo sapiens
caagagaaagcaggaaaga

SEQ ID NO: 1521653 - RNA, 19 nt, Homo sapiens
gcaaucauacuagaacuca

SEQ ID NO: 1521654 - RNA, 19 nt, Homo sapiens
ugacagugcaaucauacua

SEQ ID NO: 1521655 - RNA, 19 nt, Homo sapiens
gagcugaggcagacgaugu

SEQ ID NO: 1521656 - RNA, 19 nt, Homo sapiens
auagaccgcuagcaagauu

SEQ ID NO: 1521657 - RNA, 19 nt, Homo sapiens
gcuagcagaaggcaagaaa

SEQ ID NO: 1521658 - RNA, 19 nt, Homo sapiens
agagaaagcaggaaagauc

SEQ ID NO: 1521659 - RNA, 19 nt, Homo sapiens
agaacaaagacacaacaua

SEQ ID NO: 1521660 - RNA, 19 nt, Homo sapiens
cuagaacucaggauuaaga

SEQ ID NO: 1521661 - RNA, 19 nt, Homo sapiens
acucaaaacugcucaacua

SEQ ID NO: 1521662 - RNA, 19 nt, Homo sapiens
ggcagacgauguaagaucu

SEQ ID NO: 1521663 - RNA, 19 nt, Homo sapiens
gaagcaagaggaaacacau

SEQ ID NO: 1521664 - RNA, 19 nt, Homo sapiens
cuaaaugcccacaagagaa

SEQ ID NO: 1521665 - RNA, 19 nt, Homo sapiens
guguagagggaaauuuaua

SEQ ID NO: 1521666 - RNA, 19 nt, Homo sapiens
ggauuaagaaacucacuca

SEQ ID NO: 1521667 - RNA, 19 nt, Homo sapiens
gcagaaggcaagaaauaac

SEQ ID NO: 1521668 - RNA, 19 nt, Homo sapiens
aggcagaaguaaagauguu

SEQ ID NO: 1521669 - RNA, 19 nt, Homo sapiens
caaaaugaaggcagaagua

SEQ ID NO: 1521670 - RNA, 19 nt, Homo sapiens
ugaggcagacgauguaaga

SEQ ID NO: 1521671 - RNA, 19 nt, Homo sapiens
gacacaacauaccagaauc

SEQ ID NO: 1521672 - RNA, 19 nt, Homo sapiens
ccgcuagcaagauuaauaa

SEQ ID NO: 1521673 - RNA, 19 nt, Homo sapiens
ggaaacacauucaaaagcu

SEQ ID NO: 1521674 - RNA, 19 nt, Homo sapiens
gcaggaaagaucuaaaauu

SEQ ID NO: 1521675 - RNA, 19 nt, Homo sapiens
agacacaacauaccagaau

SEQ ID NO: 1521676 - RNA, 19 nt, Homo sapiens
aaaccaacgagaacaaaga

SEQ ID NO: 1521677 - RNA, 19 nt, Homo sapiens
gaaaccaacgagaacaaag

SEQ ID NO: 1521678 - RNA, 19 nt, Homo sapiens
cauggaaacugaacaaccu

SEQ ID NO: 1521679 - RNA, 19 nt, Homo sapiens
ccacaaacaagagugaaga

SEQ ID NO: 1521680 - RNA, 19 nt, Homo sapiens
caagaggaaacacauucaa

SEQ ID NO: 1521681 - RNA, 19 nt, Homo sapiens
acugcaagguccacuuaaa

SEQ ID NO: 1521682 - RNA, 19 nt, Homo sapiens
caaaacugcucaacuacau

SEQ ID NO: 1521683 - RNA, 19 nt, Homo sapiens
acagugcaaucauacuaga

SEQ ID NO: 1521684 - RNA, 19 nt, Homo sapiens
ggaauccaaugggaacucu

SEQ ID NO: 1521685 - RNA, 19 nt, Homo sapiens
acaaacaagagugaagaua

SEQ ID NO: 1521686 - RNA, 19 nt, Homo sapiens
ugauagaccgcuagcaaga

SEQ ID NO: 1521687 - RNA, 19 nt, Homo sapiens
gagaaagcaggaaagaucu

SEQ ID NO: 1521688 - RNA, 19 nt, Homo sapiens
cauacuagaacucaggauu

SEQ ID NO: 1521689 - RNA, 19 nt, Homo sapiens
gaaaaucaggccauguuug

SEQ ID NO: 1521690 - RNA, 19 nt, Homo sapiens
aaaugaaggcagaaguaaa

SEQ ID NO: 1521691 - RNA, 19 nt, Homo sapiens
cugcucaacuacauggaaa

SEQ ID NO: 1521692 - RNA, 19 nt, Homo sapiens
gaacucuggccaagacucu

SEQ ID NO: 1521693 - RNA, 19 nt, Homo sapiens
aaugacuacuggguacaua

SEQ ID NO: 1521694 - RNA, 19 nt, Homo sapiens
aagaggaaacacauucaaa

SEQ ID NO: 1521695 - RNA, 19 nt, Homo sapiens
caacgagaacaaagacaca

SEQ ID NO: 1521696 - RNA, 19 nt, Homo sapiens
cuacuggguacauaacaaa

SEQ ID NO: 1521697 - RNA, 19 nt, Homo sapiens
cuacauggaaacugaacaa

SEQ ID NO: 1521698 - RNA, 19 nt, Homo sapiens
cacaagagaaagcaggaaa

SEQ ID NO: 1521699 - RNA, 19 nt, Homo sapiens
agggaaauuuauagcacua

SEQ ID NO: 1521700 - RNA, 19 nt, Homo sapiens
cuacuacccagacaccaaa

SEQ ID NO: 1521701 - RNA, 19 nt, Homo sapiens
caacuacauggaaacugaa

SEQ ID NO: 1521702 - RNA, 19 nt, Homo sapiens
ccucugccauguuagaagu

SEQ ID NO: 1521703 - RNA, 19 nt, Homo sapiens
cacacaagaacccuucaaa

SEQ ID NO: 1521704 - RNA, 19 nt, Homo sapiens
gagaacaaagacacaacau

SEQ ID NO: 1521705 - RNA, 19 nt, Homo sapiens
ugaaaccaacgagaacaaa

SEQ ID NO: 1521706 - RNA, 19 nt, Homo sapiens
aaugaaggcagaaguaaag

SEQ ID NO: 1521707 - RNA, 19 nt, Homo sapiens
acuaaaugcccacaagaga

SEQ ID NO: 1521708 - RNA, 19 nt, Homo sapiens
ggaaaaucaggccauguuu

SEQ ID NO: 1521709 - RNA, 19 nt, Homo sapiens
gcagaacugaaggaaauag

SEQ ID NO: 1521710 - RNA, 19 nt, Homo sapiens
agaaggcaagaaauaacua

SEQ ID NO: 1521711 - RNA, 19 nt, Homo sapiens
gauagaccgcuagcaagau

SEQ ID NO: 1521712 - RNA, 19 nt, Homo sapiens
aaucaggccauguuugugu

SEQ ID NO: 1521713 - RNA, 19 nt, Homo sapiens
aaauugacacccuaacauc

SEQ ID NO: 1521714 - RNA, 19 nt, Homo sapiens
agaaagcaggaaagaucua

SEQ ID NO: 1521715 - RNA, 19 nt, Homo sapiens
acaaagacacaacauacca

SEQ ID NO: 1521716 - RNA, 19 nt, Homo sapiens
cgagaacaaagacacaaca

SEQ ID NO: 1521717 - RNA, 19 nt, Homo sapiens
gggaaaaucaggccauguu

SEQ ID NO: 1521718 - RNA, 19 nt, Homo sapiens
gauaauggcaucaguguua

SEQ ID NO: 1521719 - RNA, 19 nt, Homo sapiens
gaacgaagaugaccagagu

SEQ ID NO: 1521720 - RNA, 19 nt, Homo sapiens
ggauuaaacuggcuuaugu

SEQ ID NO: 1521721 - RNA, 19 nt, Homo sapiens
ugagaggucugcauuuaua

SEQ ID NO: 1521722 - RNA, 19 nt, Homo sapiens
gauaauuucuggccugauu

SEQ ID NO: 1521723 - RNA, 19 nt, Homo sapiens
caauauggcagaugauuua

SEQ ID NO: 1521724 - RNA, 19 nt, Homo sapiens
ggacuaacuuugugauaug

SEQ ID NO: 1521725 - RNA, 19 nt, Homo sapiens
gaaacccugucucuacuaa

SEQ ID NO: 1521726 - RNA, 19 nt, Homo sapiens
gcucacaccuguaaucuca

SEQ ID NO: 1521727 - RNA, 19 nt, Homo sapiens
uuacugccauuccuauuua

SEQ ID NO: 1521728 - RNA, 19 nt, Homo sapiens
cagagugucuucaggaauu

SEQ ID NO: 1521729 - RNA, 19 nt, Homo sapiens
gaagacugaucaaucuguu

SEQ ID NO: 1521730 - RNA, 19 nt, Homo sapiens
gcaaugagaagacugauca

SEQ ID NO: 1521731 - RNA, 19 nt, Homo sapiens
ggccaaagcaggagaauug

SEQ ID NO: 1521732 - RNA, 19 nt, Homo sapiens
gcauugaucuuguucuuac

SEQ ID NO: 1521733 - RNA, 19 nt, Homo sapiens
ugugguagcucuuggauug

SEQ ID NO: 1521734 - RNA, 19 nt, Homo sapiens
ugagaagacugaucaaucu

SEQ ID NO: 1521735 - RNA, 19 nt, Homo sapiens
ggauuuaaacagucaagua

SEQ ID NO: 1521736 - RNA, 19 nt, Homo sapiens
guaagccacucaacacuag

SEQ ID NO: 1521737 - RNA, 19 nt, Homo sapiens
ccacucaacacuagccuua

SEQ ID NO: 1521738 - RNA, 19 nt, Homo sapiens
gcaaauuacagcugaaauc

SEQ ID NO: 1521739 - RNA, 19 nt, Homo sapiens
gaauguguuugcucucaug

SEQ ID NO: 1521740 - RNA, 19 nt, Homo sapiens
uuugagaggucugcauuua

SEQ ID NO: 1521741 - RNA, 19 nt, Homo sapiens
ccuguaaucucagcacuuu

SEQ ID NO: 1521742 - RNA, 19 nt, Homo sapiens
gaugauuuacaguccauua

SEQ ID NO: 1521743 - RNA, 19 nt, Homo sapiens
ugaaaucugugucauggau

SEQ ID NO: 1521744 - RNA, 19 nt, Homo sapiens
ccacugcauuccagccuaa

SEQ ID NO: 1521745 - RNA, 19 nt, Homo sapiens
gaaaggaggaaaacauuaa

SEQ ID NO: 1521746 - RNA, 19 nt, Homo sapiens
acugagaccuccuaaucua

SEQ ID NO: 1521747 - RNA, 19 nt, Homo sapiens
guccuaaacuuacaaacau

SEQ ID NO: 1521748 - RNA, 19 nt, Homo sapiens
ggcagaagguggauuugau

SEQ ID NO: 1521749 - RNA, 19 nt, Homo sapiens
aaaucaagcuggguaauca

SEQ ID NO: 1521750 - RNA, 19 nt, Homo sapiens
ugucugggauugugugaaa

SEQ ID NO: 1521751 - RNA, 19 nt, Homo sapiens
cuagaaauuucacuugcaa

SEQ ID NO: 1521752 - RNA, 19 nt, Homo sapiens
ccacucauucuguuuguaa

SEQ ID NO: 1521753 - RNA, 19 nt, Homo sapiens
gaagaugaccagaguacuc

SEQ ID NO: 1521754 - RNA, 19 nt, Homo sapiens
gcaggagaauugcuugaac

SEQ ID NO: 1521755 - RNA, 19 nt, Homo sapiens
ugaucaauauggcagauga

SEQ ID NO: 1521756 - RNA, 19 nt, Homo sapiens
uucaugagcuucuagaaau

SEQ ID NO: 1521757 - RNA, 19 nt, Homo sapiens
gaacaugcaaugagaagac

SEQ ID NO: 1521758 - RNA, 19 nt, Homo sapiens
uagaauaggaagagagaaa

SEQ ID NO: 1521759 - RNA, 19 nt, Homo sapiens
gcaguuuucuguaguuuug

SEQ ID NO: 1521760 - RNA, 19 nt, Homo sapiens
uuagaaccacgcuguauuu

SEQ ID NO: 1521761 - RNA, 19 nt, Homo sapiens
uacaaacauuccacucauu

SEQ ID NO: 1521762 - RNA, 19 nt, Homo sapiens
ucaugagcuucuagaaauu

SEQ ID NO: 1521763 - RNA, 19 nt, Homo sapiens
caaccaguccucauaaugg

SEQ ID NO: 1521764 - RNA, 19 nt, Homo sapiens
gggcggauuuaaacaguca

SEQ ID NO: 1521765 - RNA, 19 nt, Homo sapiens
ggugaaacccugucucuac

SEQ ID NO: 1521766 - RNA, 19 nt, Homo sapiens
uuacaagguucaugaaagg

SEQ ID NO: 1521767 - RNA, 19 nt, Homo sapiens
uggcaucaguguuacaaug

SEQ ID NO: 1521768 - RNA, 19 nt, Homo sapiens
gaggucugcauuuauauau

SEQ ID NO: 1521769 - RNA, 19 nt, Homo sapiens
uuacaaacauuccacucau

SEQ ID NO: 1521770 - RNA, 19 nt, Homo sapiens
guuauugcauugaucuugu

SEQ ID NO: 1521771 - RNA, 19 nt, Homo sapiens
uugguagccuggaugguua

SEQ ID NO: 1521772 - RNA, 19 nt, Homo sapiens
ugagguggguggaucacuu

SEQ ID NO: 1521773 - RNA, 19 nt, Homo sapiens
gcuagaauaggaagagaga

SEQ ID NO: 1521774 - RNA, 19 nt, Homo sapiens
uggcuuauguggcuagaau

SEQ ID NO: 1521775 - RNA, 19 nt, Homo sapiens
ccauuccuauuuacaguau

SEQ ID NO: 1521776 - RNA, 19 nt, Homo sapiens
guuacugccauuccuauuu

SEQ ID NO: 1521777 - RNA, 19 nt, Homo sapiens
uggacuaacuuugugauau

SEQ ID NO: 1521778 - RNA, 19 nt, Homo sapiens
gagaccuccuaaucuaaga

SEQ ID NO: 1521779 - RNA, 19 nt, Homo sapiens
uuacugagaccuccuaauc

SEQ ID NO: 1521780 - RNA, 19 nt, Homo sapiens
gaucuuguucuuacugaga

SEQ ID NO: 1521781 - RNA, 19 nt, Homo sapiens
cauuccagccuaagcaaua

SEQ ID NO: 1521782 - RNA, 19 nt, Homo sapiens
ucaauauggcagaugauuu

SEQ ID NO: 1521783 - RNA, 19 nt, Homo sapiens
gcugauauaauccacauag

SEQ ID NO: 1521784 - RNA, 19 nt, Homo sapiens
gguagcucuuggauuguuu

SEQ ID NO: 1521785 - RNA, 19 nt, Homo sapiens
gugaauguguuugcucuca

SEQ ID NO: 1521786 - RNA, 19 nt, Homo sapiens
uuauguggcuagaauagga

SEQ ID NO: 1521787 - RNA, 19 nt, Homo sapiens
gcagaagguggauuugauc

SEQ ID NO: 1521788 - RNA, 19 nt, Homo sapiens
cacagagugucuucaggaa

SEQ ID NO: 1521789 - RNA, 19 nt, Homo sapiens
caagaucgcaccacugcau

SEQ ID NO: 1521790 - RNA, 19 nt, Homo sapiens
caaauuacagcugaaaucu

SEQ ID NO: 1521791 - RNA, 19 nt, Homo sapiens
uagaaccacgcuguauuua

SEQ ID NO: 1521792 - RNA, 19 nt, Homo sapiens
gggauugugugaaagaaaa

SEQ ID NO: 1521793 - RNA, 19 nt, Homo sapiens
gccaaccaguccucauaau

SEQ ID NO: 1521794 - RNA, 19 nt, Homo sapiens
ggaugguuauugcauugau

SEQ ID NO: 1521795 - RNA, 19 nt, Homo sapiens
gggacccucuggugauaau

SEQ ID NO: 1521796 - RNA, 19 nt, Homo sapiens
agagugucuucaggaauua

SEQ ID NO: 1521797 - RNA, 19 nt, Homo sapiens
gugaaacccugucucuacu

SEQ ID NO: 1521798 - RNA, 19 nt, Homo sapiens
ccgggacccucuggugaua

SEQ ID NO: 1521799 - RNA, 19 nt, Homo sapiens
ugccuuugcugauauaauc

SEQ ID NO: 1521800 - RNA, 19 nt, Homo sapiens
gauuugaucccugugaaug

SEQ ID NO: 1521801 - RNA, 19 nt, Homo sapiens
gauugaaggaaauuugaga

SEQ ID NO: 1521802 - RNA, 19 nt, Homo sapiens
ggaagcuucuuuucuguuc

SEQ ID NO: 1521803 - RNA, 19 nt, Homo sapiens
ccaaccaguccucauaaug

SEQ ID NO: 1521804 - RNA, 19 nt, Homo sapiens
aagccaaccaguccucaua

SEQ ID NO: 1521805 - RNA, 19 nt, Homo sapiens
ggcaucaguguuacaauga

SEQ ID NO: 1521806 - RNA, 19 nt, Homo sapiens
cuuacaagguucaugaaag

SEQ ID NO: 1521807 - RNA, 19 nt, Homo sapiens
caguauauuugagugaaug

SEQ ID NO: 1521808 - RNA, 19 nt, Homo sapiens
caugagcuucuagaaauuu

SEQ ID NO: 1521809 - RNA, 19 nt, Homo sapiens
cauggcagaagguggauuu

SEQ ID NO: 1521810 - RNA, 19 nt, Homo sapiens
agaggucugcauuuauaua

SEQ ID NO: 1521811 - RNA, 19 nt, Homo sapiens
gaugguuauugcauugauc

SEQ ID NO: 1521812 - RNA, 19 nt, Homo sapiens
uacaguccauuauaugaca

SEQ ID NO: 1521813 - RNA, 19 nt, Homo sapiens
gauaugggaagugaaaaua

SEQ ID NO: 1521814 - RNA, 19 nt, Homo sapiens
ccuggaugguuauugcauu

SEQ ID NO: 1521815 - RNA, 19 nt, Homo sapiens
uauggcagaugauuuacag

SEQ ID NO: 1521816 - RNA, 19 nt, Homo sapiens
acaaacauuccacucauuc

SEQ ID NO: 1521817 - RNA, 19 nt, Homo sapiens
guuguugucugggcggauu

SEQ ID NO: 1521818 - RNA, 19 nt, Homo sapiens
ggaaaggcaucuucuauaa

SEQ ID NO: 1521819 - RNA, 19 nt, Homo sapiens
gaaccuguguugccuauua

SEQ ID NO: 1521820 - RNA, 19 nt, Homo sapiens
ucaagaaguugcuguauau

SEQ ID NO: 1521821 - RNA, 19 nt, Homo sapiens
acaaugcgcugcugaguaa

SEQ ID NO: 1521822 - RNA, 19 nt, Homo sapiens
gaaacccugucucuacuaa

SEQ ID NO: 1521823 - RNA, 19 nt, Homo sapiens
gagacuggauucagaacua

SEQ ID NO: 1521824 - RNA, 19 nt, Homo sapiens
gaaugcauguaccauaauu

SEQ ID NO: 1521825 - RNA, 19 nt, Homo sapiens
cuaaacaacuccauaguca

SEQ ID NO: 1521826 - RNA, 19 nt, Homo sapiens
gaaugucuguuuguacuuu

SEQ ID NO: 1521827 - RNA, 19 nt, Homo sapiens
ugacuucuguggcuguuua

SEQ ID NO: 1521828 - RNA, 19 nt, Homo sapiens
gaaauuacacaaacccauu

SEQ ID NO: 1521829 - RNA, 19 nt, Homo sapiens
uuagaacccuguaaugauu

SEQ ID NO: 1521830 - RNA, 19 nt, Homo sapiens
gcagaggaacccagaguaa

SEQ ID NO: 1521831 - RNA, 19 nt, Homo sapiens
aaacagaagaugcugauuu

SEQ ID NO: 1521832 - RNA, 19 nt, Homo sapiens
gguuauaccuucaauugau

SEQ ID NO: 1521833 - RNA, 19 nt, Homo sapiens
ugauaugucuccucauuug

SEQ ID NO: 1521834 - RNA, 19 nt, Homo sapiens
gcaaggagacaccauugaa

SEQ ID NO: 1521835 - RNA, 19 nt, Homo sapiens
uuaauuaucugggcugauu

SEQ ID NO: 1521836 - RNA, 19 nt, Homo sapiens
agaaguugcuguauauuuc

SEQ ID NO: 1521837 - RNA, 19 nt, Homo sapiens
caggugugcuuuguucuua

SEQ ID NO: 1521838 - RNA, 19 nt, Homo sapiens
gauaucacccagaguauug

SEQ ID NO: 1521839 - RNA, 19 nt, Homo sapiens
ggagagccuuaucauguau

SEQ ID NO: 1521840 - RNA, 19 nt, Homo sapiens
ccugauaugucuccucauu

SEQ ID NO: 1521841 - RNA, 19 nt, Homo sapiens
gaggacaagugcccaggaa

SEQ ID NO: 1521842 - RNA, 19 nt, Homo sapiens
uaucugggcugauucugaa

SEQ ID NO: 1521843 - RNA, 19 nt, Homo sapiens
gaaaggcaucuucuauaau

SEQ ID NO: 1521844 - RNA, 19 nt, Homo sapiens
gcaggucgauacgcuacua

SEQ ID NO: 1521845 - RNA, 19 nt, Homo sapiens
uggagagccuuaucaugua

SEQ ID NO: 1521846 - RNA, 19 nt, Homo sapiens
ccagaguaauugagacuga

SEQ ID NO: 1521847 - RNA, 19 nt, Homo sapiens
gaacccagaguaauugaga

SEQ ID NO: 1521848 - RNA, 19 nt, Homo sapiens
ccacaccacucauuacaag

SEQ ID NO: 1521849 - RNA, 19 nt, Homo sapiens
cugaaugcauguaccauaa

SEQ ID NO: 1521850 - RNA, 19 nt, Homo sapiens
caacaaggcaucucaagag

SEQ ID NO: 1521851 - RNA, 19 nt, Homo sapiens
guucuuauccuaauccaaa

SEQ ID NO: 1521852 - RNA, 19 nt, Homo sapiens
gaugcugauuucuggauaa

SEQ ID NO: 1521853 - RNA, 19 nt, Homo sapiens
gaucagaggcuaaacaacu

SEQ ID NO: 1521854 - RNA, 19 nt, Homo sapiens
acucaucuguucccugaua

SEQ ID NO: 1521855 - RNA, 19 nt, Homo sapiens
ggacaagugcccaggaaau

SEQ ID NO: 1521856 - RNA, 19 nt, Homo sapiens
ucgauacgcuacuaauuug

SEQ ID NO: 1521857 - RNA, 19 nt, Homo sapiens
gcaccuuccauuagcaaua

SEQ ID NO: 1521858 - RNA, 19 nt, Homo sapiens
ugaauuugguucugacuuc

SEQ ID NO: 1521859 - RNA, 19 nt, Homo sapiens
guagaagcccggauaacuu

SEQ ID NO: 1521860 - RNA, 19 nt, Homo sapiens
gcuugugggucacuugaaa

SEQ ID NO: 1521861 - RNA, 19 nt, Homo sapiens
uaaaccagagccugauaua

SEQ ID NO: 1521862 - RNA, 19 nt, Homo sapiens
aaaccgaggcuauaacuug

SEQ ID NO: 1521863 - RNA, 19 nt, Homo sapiens
gggaaugucuguuuguacu

SEQ ID NO: 1521864 - RNA, 19 nt, Homo sapiens
gaacgaaacagaagaugcu

SEQ ID NO: 1521865 - RNA, 19 nt, Homo sapiens
guauauuucagucugguua

SEQ ID NO: 1521866 - RNA, 19 nt, Homo sapiens
gucgauacgcuacuaauuu

SEQ ID NO: 1521867 - RNA, 19 nt, Homo sapiens
aaucuucugugguuuauuc

SEQ ID NO: 1521868 - RNA, 19 nt, Homo sapiens
uagugaaucuucugugguu

SEQ ID NO: 1521869 - RNA, 19 nt, Homo sapiens
uucaagaaguugcuguaua

SEQ ID NO: 1521870 - RNA, 19 nt, Homo sapiens
aacagaagaugcugauuuc

SEQ ID NO: 1521871 - RNA, 19 nt, Homo sapiens
cuaacaagacaaucgauuu

SEQ ID NO: 1521872 - RNA, 19 nt, Homo sapiens
aaggagacaccauugaaua

SEQ ID NO: 1521873 - RNA, 19 nt, Homo sapiens
acaaacccauugaaaguuc

SEQ ID NO: 1521874 - RNA, 19 nt, Homo sapiens
uguguugccuauuauauug

SEQ ID NO: 1521875 - RNA, 19 nt, Homo sapiens
caggugaucuacuaugcaa

SEQ ID NO: 1521876 - RNA, 19 nt, Homo sapiens
gauuguaucuugaccucau

SEQ ID NO: 1521877 - RNA, 19 nt, Homo sapiens
gacaagugcccaggaaauu

SEQ ID NO: 1521878 - RNA, 19 nt, Homo sapiens
gcacuggaacucaucuguu

SEQ ID NO: 1521879 - RNA, 19 nt, Homo sapiens
acacaaacccauugaaagu

SEQ ID NO: 1521880 - RNA, 19 nt, Homo sapiens
gugaaucuucugugguuua

SEQ ID NO: 1521881 - RNA, 19 nt, Homo sapiens
uuacaguguuuguuggaaa

SEQ ID NO: 1521882 - RNA, 19 nt, Homo sapiens
cacagugcuucuccucaua

SEQ ID NO: 1521883 - RNA, 19 nt, Homo sapiens
acaagugcccaggaaauua

SEQ ID NO: 1521884 - RNA, 19 nt, Homo sapiens
ggaagaaaugcauauuaag

SEQ ID NO: 1521885 - RNA, 19 nt, Homo sapiens
guaauggaagaaaugcaua

SEQ ID NO: 1521886 - RNA, 19 nt, Homo sapiens
gcaaauuccuacaguuuuc

SEQ ID NO: 1521887 - RNA, 19 nt, Homo sapiens
gaggaacccagaguaauug

SEQ ID NO: 1521888 - RNA, 19 nt, Homo sapiens
gacagcaauugcagaggaa

SEQ ID NO: 1521889 - RNA, 19 nt, Homo sapiens
ccucagaccugggcuguca

SEQ ID NO: 1521890 - RNA, 19 nt, Homo sapiens
uuacacaaacccauugaaa

SEQ ID NO: 1521891 - RNA, 19 nt, Homo sapiens
auuacaagcucacuuuaga

SEQ ID NO: 1521892 - RNA, 19 nt, Homo sapiens
uuaaagccuuggauuauac

SEQ ID NO: 1521893 - RNA, 19 nt, Homo sapiens
gaaguugcuguauauuuca

SEQ ID NO: 1521894 - RNA, 19 nt, Homo sapiens
ggugaaacccugucucuac

SEQ ID NO: 1521895 - RNA, 19 nt, Homo sapiens
agaggaacccagaguaauu

SEQ ID NO: 1521896 - RNA, 19 nt, Homo sapiens
ucagaaaccgaggcuauaa

SEQ ID NO: 1521897 - RNA, 19 nt, Homo sapiens
guuuauucaucucguguuu

SEQ ID NO: 1521898 - RNA, 19 nt, Homo sapiens
aggaaaggcaucuucuaua

SEQ ID NO: 1521899 - RNA, 19 nt, Homo sapiens
gaucaugaggucaggaaau

SEQ ID NO: 1521900 - RNA, 19 nt, Homo sapiens
ggauaucacccagaguauu

SEQ ID NO: 1521901 - RNA, 19 nt, Homo sapiens
gaucuacuaugcaaauucc

SEQ ID NO: 1521902 - RNA, 19 nt, Homo sapiens
gcuaaaccagagccugaua

SEQ ID NO: 1521903 - RNA, 19 nt, Homo sapiens
caucucguguuuguuguuu

SEQ ID NO: 1521904 - RNA, 19 nt, Homo sapiens
cuacagucaucauagugaa

SEQ ID NO: 1521905 - RNA, 19 nt, Homo sapiens
gccacagguuccuuggaua

SEQ ID NO: 1521906 - RNA, 19 nt, Homo sapiens
agccuuggauuauacuuaa

SEQ ID NO: 1521907 - RNA, 19 nt, Homo sapiens
ggucgauacgcuacuaauu

SEQ ID NO: 1521908 - RNA, 19 nt, Homo sapiens
gugccaggcugcagugugu

SEQ ID NO: 1521909 - RNA, 19 nt, Homo sapiens
gugcuuuguucuuauccua

SEQ ID NO: 1521910 - RNA, 19 nt, Homo sapiens
ccacagguuccuuggauau

SEQ ID NO: 1521911 - RNA, 19 nt, Homo sapiens
caugaggucaggaaauuga

SEQ ID NO: 1521912 - RNA, 19 nt, Homo sapiens
uauaauccuugggaaaguu

SEQ ID NO: 1521913 - RNA, 19 nt, Homo sapiens
uaggaaaggcaucuucuau

SEQ ID NO: 1521914 - RNA, 19 nt, Homo sapiens
guuagaccgaccuguguua

SEQ ID NO: 1521915 - RNA, 19 nt, Homo sapiens
gcuaaacaacuccauaguc

SEQ ID NO: 1521916 - RNA, 19 nt, Homo sapiens
gaggcuaaacaacuccaua

SEQ ID NO: 1521917 - RNA, 19 nt, Homo sapiens
uagaagcccggauaacuug

SEQ ID NO: 1521918 - RNA, 19 nt, Homo sapiens
ggaauaagaaucaguguua

SEQ ID NO: 1521919 - RNA, 19 nt, Homo sapiens
ucacaaacuugccuuaaua

SEQ ID NO: 1521920 - RNA, 19 nt, Homo sapiens
gcucauagauuacagagaa

SEQ ID NO: 1521921 - RNA, 19 nt, Homo sapiens
aaacaaaucugccaaauac

SEQ ID NO: 1521922 - RNA, 19 nt, Homo sapiens
uaacugaggucuccuaaau

SEQ ID NO: 1521923 - RNA, 19 nt, Homo sapiens
caacaucgcuaagcaauau

SEQ ID NO: 1521924 - RNA, 19 nt, Homo sapiens
ucaaagcuguuucucauuu

SEQ ID NO: 1521925 - RNA, 19 nt, Homo sapiens
caaaggaguuaaucucauu

SEQ ID NO: 1521926 - RNA, 19 nt, Homo sapiens
gcauuacgcucuauuuaug

SEQ ID NO: 1521927 - RNA, 19 nt, Homo sapiens
ggaauuaaguccaguuucu

SEQ ID NO: 1521928 - RNA, 19 nt, Homo sapiens
gaacuggguugauguugug

SEQ ID NO: 1521929 - RNA, 19 nt, Homo sapiens
ucccaaagccuucuuaaua

SEQ ID NO: 1521930 - RNA, 19 nt, Homo sapiens
ugaagagacugaaauuguu

SEQ ID NO: 1521931 - RNA, 19 nt, Homo sapiens
ggagaaacaucugcuagug

SEQ ID NO: 1521932 - RNA, 19 nt, Homo sapiens
aagaugaacugcuuccuuu

SEQ ID NO: 1521933 - RNA, 19 nt, Homo sapiens
gaaguuaagagcaguuuga

SEQ ID NO: 1521934 - RNA, 19 nt, Homo sapiens
ccuaaaugguucaacauaa

SEQ ID NO: 1521935 - RNA, 19 nt, Homo sapiens
gaaaguucaugaagagauc

SEQ ID NO: 1521936 - RNA, 19 nt, Homo sapiens
gcuaugaccuauacauugu

SEQ ID NO: 1521937 - RNA, 19 nt, Homo sapiens
ugaacagccucaucaauau

SEQ ID NO: 1521938 - RNA, 19 nt, Homo sapiens
gaaugaugcuaguuacaug

SEQ ID NO: 1521939 - RNA, 19 nt, Homo sapiens
gacuucagcuaaauaguuu

SEQ ID NO: 1521940 - RNA, 19 nt, Homo sapiens
gaaccgcuaugaccuauac

SEQ ID NO: 1521941 - RNA, 19 nt, Homo sapiens
gaucaugagugcuuugagu

SEQ ID NO: 1521942 - RNA, 19 nt, Homo sapiens
gcaaaggaguuaaucucau

SEQ ID NO: 1521943 - RNA, 19 nt, Homo sapiens
ccaaagccuucuuaauaga

SEQ ID NO: 1521944 - RNA, 19 nt, Homo sapiens
gaacagccucaucaauauu

SEQ ID NO: 1521945 - RNA, 19 nt, Homo sapiens
ggaacuggguugauguugu

SEQ ID NO: 1521946 - RNA, 19 nt, Homo sapiens
guuuaacacucccaguaua

SEQ ID NO: 1521947 - RNA, 19 nt, Homo sapiens
gaauauggcaacuuauguu

SEQ ID NO: 1521948 - RNA, 19 nt, Homo sapiens
gaacaguuacuccauagug

SEQ ID NO: 1521949 - RNA, 19 nt, Homo sapiens
cagagaaugaugcuaguua

SEQ ID NO: 1521950 - RNA, 19 nt, Homo sapiens
gcucuaaggaugaugagua

SEQ ID NO: 1521951 - RNA, 19 nt, Homo sapiens
caaaacagaucacaaagga

SEQ ID NO: 1521952 - RNA, 19 nt, Homo sapiens
acuggaauauggcaacuua

SEQ ID NO: 1521953 - RNA, 19 nt, Homo sapiens
caaauacacuagaaagcau

SEQ ID NO: 1521954 - RNA, 19 nt, Homo sapiens
gcugguauuugaacuuuau

SEQ ID NO: 1521955 - RNA, 19 nt, Homo sapiens
cauagugcaauccauauua

SEQ ID NO: 1521956 - RNA, 19 nt, Homo sapiens
gaguagcacuuggaauuug

SEQ ID NO: 1521957 - RNA, 19 nt, Homo sapiens
gguaguauuugugguugua

SEQ ID NO: 1521958 - RNA, 19 nt, Homo sapiens
gcuaagcaauaucaucuca

SEQ ID NO: 1521959 - RNA, 19 nt, Homo sapiens
gauggaacuagaagcauua

SEQ ID NO: 1521960 - RNA, 19 nt, Homo sapiens
gaagcauuacgcucuauuu

SEQ ID NO: 1521961 - RNA, 19 nt, Homo sapiens
uaacaacaccauaucauca

SEQ ID NO: 1521962 - RNA, 19 nt, Homo sapiens
gaauaugccaaagacaaua

SEQ ID NO: 1521963 - RNA, 19 nt, Homo sapiens
uaacacucccaguauauuu

SEQ ID NO: 1521964 - RNA, 19 nt, Homo sapiens
cuaguuacaugccaaugaa

SEQ ID NO: 1521965 - RNA, 19 nt, Homo sapiens
gaacugcuuccuuuuaaua

SEQ ID NO: 1521966 - RNA, 19 nt, Homo sapiens
gaaucacaaucccaucaau

SEQ ID NO: 1521967 - RNA, 19 nt, Homo sapiens
cccaaagccuucuuaauag

SEQ ID NO: 1521968 - RNA, 19 nt, Homo sapiens
cucaaugucuguuacuuaa

SEQ ID NO: 1521969 - RNA, 19 nt, Homo sapiens
gcgcccagcuuuaagaaca

SEQ ID NO: 1521970 - RNA, 19 nt, Homo sapiens
ggacaggcauggggaauaa

SEQ ID NO: 1521971 - RNA, 19 nt, Homo sapiens
cccuugagcuuuauaaaug

SEQ ID NO: 1521972 - RNA, 19 nt, Homo sapiens
gguuguaaguugaaaguuc

SEQ ID NO: 1521973 - RNA, 19 nt, Homo sapiens
gcaacaucgcuaagcaaua

SEQ ID NO: 1521974 - RNA, 19 nt, Homo sapiens
gaagagacugaaauuguuc

SEQ ID NO: 1521975 - RNA, 19 nt, Homo sapiens
uauggcaacuuauguuuca

SEQ ID NO: 1521976 - RNA, 19 nt, Homo sapiens
agaggaaacuauuggucua

SEQ ID NO: 1521977 - RNA, 19 nt, Homo sapiens
ggaauauggcaacuuaugu

SEQ ID NO: 1521978 - RNA, 19 nt, Homo sapiens
guauaugcgcccagcuuua

SEQ ID NO: 1521979 - RNA, 19 nt, Homo sapiens
guuagugccucaaguuaca

SEQ ID NO: 1521980 - RNA, 19 nt, Homo sapiens
cuauuuaucugcuguugug

SEQ ID NO: 1521981 - RNA, 19 nt, Homo sapiens
gcacuuggaauuugagaca

SEQ ID NO: 1521982 - RNA, 19 nt, Homo sapiens
caauauaggauaggugaaa

SEQ ID NO: 1521983 - RNA, 19 nt, Homo sapiens
gcaguagaagcuaaucuug

SEQ ID NO: 1521984 - RNA, 19 nt, Homo sapiens
ugacuucagcuaaauaguu

SEQ ID NO: 1521985 - RNA, 19 nt, Homo sapiens
ugauuugggucaagauguu

SEQ ID NO: 1521986 - RNA, 19 nt, Homo sapiens
aagcauuacgcucuauuua

SEQ ID NO: 1521987 - RNA, 19 nt, Homo sapiens
aguacucagugaacaguua

SEQ ID NO: 1521988 - RNA, 19 nt, Homo sapiens
ggagcggaguacucaguga

SEQ ID NO: 1521989 - RNA, 19 nt, Homo sapiens
aguagaagcuaaucuugga

SEQ ID NO: 1521990 - RNA, 19 nt, Homo sapiens
guaaagcagaguauauuag

SEQ ID NO: 1521991 - RNA, 19 nt, Homo sapiens
uaagaaaugcuggcccuuu

SEQ ID NO: 1521992 - RNA, 19 nt, Homo sapiens
caagauguuugaucaugag

SEQ ID NO: 1521993 - RNA, 19 nt, Homo sapiens
gagaaucacaaucccauca

SEQ ID NO: 1521994 - RNA, 19 nt, Homo sapiens
ggagauggaacuagaagca

SEQ ID NO: 1521995 - RNA, 19 nt, Homo sapiens
caccauaucaucagcugua

SEQ ID NO: 1521996 - RNA, 19 nt, Homo sapiens
caauauugccgucaucugu

SEQ ID NO: 1521997 - RNA, 19 nt, Homo sapiens
acaugccaaugaacuauuu

SEQ ID NO: 1521998 - RNA, 19 nt, Homo sapiens
uuucaaagcuguuucucau

SEQ ID NO: 1521999 - RNA, 19 nt, Homo sapiens
uguuacacaugcuugauuu

SEQ ID NO: 1522000 - RNA, 19 nt, Homo sapiens
agauggaacuagaagcauu

SEQ ID NO: 1522001 - RNA, 19 nt, Homo sapiens
uauaugcgcccagcuuuaa

SEQ ID NO: 1522002 - RNA, 19 nt, Homo sapiens
uaugugugauguacaguga

SEQ ID NO: 1522003 - RNA, 19 nt, Homo sapiens
agugaacaguuacuccaua

SEQ ID NO: 1522004 - RNA, 19 nt, Homo sapiens
caauugaaacuccuaauac

SEQ ID NO: 1522005 - RNA, 19 nt, Homo sapiens
auaaagagcaguucaugga

SEQ ID NO: 1522006 - RNA, 19 nt, Homo sapiens
ucucaaugucuguuacuua

SEQ ID NO: 1522007 - RNA, 19 nt, Homo sapiens
gcuaguuacaugccaauga

SEQ ID NO: 1522008 - RNA, 19 nt, Homo sapiens
gaaauuguucaggcuuauu

SEQ ID NO: 1522009 - RNA, 19 nt, Homo sapiens
caggaccacuggaauaugg

SEQ ID NO: 1522010 - RNA, 19 nt, Homo sapiens
acauuucucuugcauauac

SEQ ID NO: 1522011 - RNA, 19 nt, Homo sapiens
gaugaacugcuuccuuuua

SEQ ID NO: 1522012 - RNA, 19 nt, Homo sapiens
uuugaaagaugaacugcuu

SEQ ID NO: 1522013 - RNA, 19 nt, Homo sapiens
gaguaaaacuggguucaaa

SEQ ID NO: 1522014 - RNA, 19 nt, Homo sapiens
ugugaagcauuuaagcaaa

SEQ ID NO: 1522015 - RNA, 19 nt, Homo sapiens
gcuguaaagcagaguauau

SEQ ID NO: 1522016 - RNA, 19 nt, Homo sapiens
aagagcaguuugagcugua

SEQ ID NO: 1522017 - RNA, 19 nt, Homo sapiens
gauaacugaggucuccuaa

SEQ ID NO: 1522018 - RNA, 19 nt, Homo sapiens
guaaagcacuucaagaguu

SEQ ID NO: 1522019 - RNA, 19 nt, Homo sapiens
uaaagcacuucaagaguua

SEQ ID NO: 1522020 - RNA, 19 nt, Homo sapiens
gaacgagcaucucauuaug

SEQ ID NO: 1522021 - RNA, 19 nt, Homo sapiens
gaagagcccauaagaguaa

SEQ ID NO: 1522022 - RNA, 19 nt, Homo sapiens
gauguggcauuuaaagaua

SEQ ID NO: 1522023 - RNA, 19 nt, Homo sapiens
ugaaguaugucuccuguuu

SEQ ID NO: 1522024 - RNA, 19 nt, Homo sapiens
uaaagaagacguucaugua

SEQ ID NO: 1522025 - RNA, 19 nt, Homo sapiens
ugaaauuccugaugaacua

SEQ ID NO: 1522026 - RNA, 19 nt, Homo sapiens
gaggaaagcuggacaucga

SEQ ID NO: 1522027 - RNA, 19 nt, Homo sapiens
gacaaccuaugcugaauuu

SEQ ID NO: 1522028 - RNA, 19 nt, Homo sapiens
gaaacuaggagcaaugaaa

SEQ ID NO: 1522029 - RNA, 19 nt, Homo sapiens
ggacaucgaauucaaagaa

SEQ ID NO: 1522030 - RNA, 19 nt, Homo sapiens
ggagauggacaacguauuu

SEQ ID NO: 1522031 - RNA, 19 nt, Homo sapiens
cagaagaauuacugguuua

SEQ ID NO: 1522032 - RNA, 19 nt, Homo sapiens
agaagacguucauguauuu

SEQ ID NO: 1522033 - RNA, 19 nt, Homo sapiens
gaagaacgagcaucucauu

SEQ ID NO: 1522034 - RNA, 19 nt, Homo sapiens
uacugaagaugcugaauua

SEQ ID NO: 1522035 - RNA, 19 nt, Homo sapiens
gcaaagcaguccugaccuu

SEQ ID NO: 1522036 - RNA, 19 nt, Homo sapiens
caacguauuuaccuuguga

SEQ ID NO: 1522037 - RNA, 19 nt, Homo sapiens
gaacagucuucucaguuau

SEQ ID NO: 1522038 - RNA, 19 nt, Homo sapiens
gaagaagaguuuacaacag

SEQ ID NO: 1522039 - RNA, 19 nt, Homo sapiens
cccauuaccugcugaagua

SEQ ID NO: 1522040 - RNA, 19 nt, Homo sapiens
gcccauaagaguaauaaua

SEQ ID NO: 1522041 - RNA, 19 nt, Homo sapiens
ucagauacuuuacgaauuc

SEQ ID NO: 1522042 - RNA, 19 nt, Homo sapiens
caaagaggaagaagaguuu

SEQ ID NO: 1522043 - RNA, 19 nt, Homo sapiens
ggaagagcccauaagagua

SEQ ID NO: 1522044 - RNA, 19 nt, Homo sapiens
aaauaucgguggugugaaa

SEQ ID NO: 1522045 - RNA, 19 nt, Homo sapiens
gacaacaggccauggauuu

SEQ ID NO: 1522046 - RNA, 19 nt, Homo sapiens
gaugauagcgcuccagaga

SEQ ID NO: 1522047 - RNA, 19 nt, Homo sapiens
gaagcaaauugaagaacga

SEQ ID NO: 1522048 - RNA, 19 nt, Homo sapiens
aagaagaguuuacaacaga

SEQ ID NO: 1522049 - RNA, 19 nt, Homo sapiens
ggaagaagaguuuacaaca

SEQ ID NO: 1522050 - RNA, 19 nt, Homo sapiens
cagccggcauuuaauauuu

SEQ ID NO: 1522051 - RNA, 19 nt, Homo sapiens
ggaugaaauuccugaugaa

SEQ ID NO: 1522052 - RNA, 19 nt, Homo sapiens
uaucggcacuucaguagaa

SEQ ID NO: 1522053 - RNA, 19 nt, Homo sapiens
guaaauaucggugguguga

SEQ ID NO: 1522054 - RNA, 19 nt, Homo sapiens
aagaagacguucauguauu

SEQ ID NO: 1522055 - RNA, 19 nt, Homo sapiens
caagaguuauacgguguua

SEQ ID NO: 1522056 - RNA, 19 nt, Homo sapiens
gcuauaauuugccugaugu

SEQ ID NO: 1522057 - RNA, 19 nt, Homo sapiens
aaugucagguucucagaua

SEQ ID NO: 1522058 - RNA, 19 nt, Homo sapiens
gacaucgaauucaaagaaa

SEQ ID NO: 1522059 - RNA, 19 nt, Homo sapiens
acacugcuaugaaguuauu

SEQ ID NO: 1522060 - RNA, 19 nt, Homo sapiens
ggaaauugagggagacuug

SEQ ID NO: 1522061 - RNA, 19 nt, Homo sapiens
ggaaaccguuguccucagu

SEQ ID NO: 1522062 - RNA, 19 nt, Homo sapiens
gggauaggauuuauucucu

SEQ ID NO: 1522063 - RNA, 19 nt, Homo sapiens
uggaugaaauuccugauga

SEQ ID NO: 1522064 - RNA, 19 nt, Homo sapiens
caacagaugaagcagauga

SEQ ID NO: 1522065 - RNA, 19 nt, Homo sapiens
cuucaaaucugacuguuuc

SEQ ID NO: 1522066 - RNA, 19 nt, Homo sapiens
uaauuugccugaugucugu

SEQ ID NO: 1522067 - RNA, 19 nt, Homo sapiens
guaugucuccuguuucuuu

SEQ ID NO: 1522068 - RNA, 19 nt, Homo sapiens
uuacacugcuaugaaguua

SEQ ID NO: 1522069 - RNA, 19 nt, Homo sapiens
guaaagaagacguucaugu

SEQ ID NO: 1522070 - RNA, 19 nt, Homo sapiens
ccacacuucugaaccaaug

SEQ ID NO: 1522071 - RNA, 19 nt, Homo sapiens
guagaucucggaguuuaua

SEQ ID NO: 1522072 - RNA, 19 nt, Homo sapiens
gaccuuucauuucuaguug

SEQ ID NO: 1522073 - RNA, 19 nt, Homo sapiens
caaaguaggagauggacaa

SEQ ID NO: 1522074 - RNA, 19 nt, Homo sapiens
gagacuauuucaucgacaa

SEQ ID NO: 1522075 - RNA, 19 nt, Homo sapiens
ccugaugucugugagauuu

SEQ ID NO: 1522076 - RNA, 19 nt, Homo sapiens
gucaugacccuguauguaa

SEQ ID NO: 1522077 - RNA, 19 nt, Homo sapiens
uccaugauguggcauuuaa

SEQ ID NO: 1522078 - RNA, 19 nt, Homo sapiens
cauaaaccaucaccuagca

SEQ ID NO: 1522079 - RNA, 19 nt, Homo sapiens
gagauggacaacguauuua

SEQ ID NO: 1522080 - RNA, 19 nt, Homo sapiens
guuaaaagcuguaaagaag

SEQ ID NO: 1522081 - RNA, 19 nt, Homo sapiens
ucaugacccuguauguaaa

SEQ ID NO: 1522082 - RNA, 19 nt, Homo sapiens
ucucggaguuuauacaaga

SEQ ID NO: 1522083 - RNA, 19 nt, Homo sapiens
agaagcaccugcaagacaa

SEQ ID NO: 1522084 - RNA, 19 nt, Homo sapiens
ugauagcgcuccagagaca

SEQ ID NO: 1522085 - RNA, 19 nt, Homo sapiens
acagugaaguggaugaaau

SEQ ID NO: 1522086 - RNA, 19 nt, Homo sapiens
gggcauuccaguaguaauu

SEQ ID NO: 1522087 - RNA, 19 nt, Homo sapiens
gcacuucaguagaaaccau

SEQ ID NO: 1522088 - RNA, 19 nt, Homo sapiens
gaaagcuggacaucgaauu

SEQ ID NO: 1522089 - RNA, 19 nt, Homo sapiens
aaagaagacguucauguau

SEQ ID NO: 1522090 - RNA, 19 nt, Homo sapiens
gaugcugucugggauaaug

SEQ ID NO: 1522091 - RNA, 19 nt, Homo sapiens
gauucugguugaucugaaa

SEQ ID NO: 1522092 - RNA, 19 nt, Homo sapiens
agaauaacaugggagagaa

SEQ ID NO: 1522093 - RNA, 19 nt, Homo sapiens
gcauuccaguaguaauuga

SEQ ID NO: 1522094 - RNA, 19 nt, Homo sapiens
uuuagaagcuacugaagau

SEQ ID NO: 1522095 - RNA, 19 nt, Homo sapiens
uacgaauucuuacauguga

SEQ ID NO: 1522096 - RNA, 19 nt, Homo sapiens
gcagugaagaugaugauag

SEQ ID NO: 1522097 - RNA, 19 nt, Homo sapiens
gaugguugcauuacucauu

SEQ ID NO: 1522098 - RNA, 19 nt, Homo sapiens
gaagaaccacccuccaucu

SEQ ID NO: 1522099 - RNA, 19 nt, Homo sapiens
ugaagaugcugaauuagcu

SEQ ID NO: 1522100 - RNA, 19 nt, Homo sapiens
ccucauaaaccaucaccua

SEQ ID NO: 1522101 - RNA, 19 nt, Homo sapiens
ucaaagaggaagaagaguu

SEQ ID NO: 1522102 - RNA, 19 nt, Homo sapiens
cagguucucagauacuuua

SEQ ID NO: 1522103 - RNA, 19 nt, Homo sapiens
uauuucagcuccaugaugu

SEQ ID NO: 1522104 - RNA, 19 nt, Homo sapiens
agaaauauuacgugggaua

SEQ ID NO: 1522105 - RNA, 19 nt, Homo sapiens
uagcuuugguguaaauuca

SEQ ID NO: 1522106 - RNA, 19 nt, Homo sapiens
ccagaauccucauaaacca

SEQ ID NO: 1522107 - RNA, 19 nt, Homo sapiens
gcaaugaaacccagaaucc

SEQ ID NO: 1522108 - RNA, 19 nt, Homo sapiens
guccugaccuuucauuucu

SEQ ID NO: 1522109 - RNA, 19 nt, Homo sapiens
aaagaugguugcauuacuc

SEQ ID NO: 1522110 - RNA, 19 nt, Homo sapiens
agaacgagcaucucauuau

SEQ ID NO: 1522111 - RNA, 19 nt, Homo sapiens
gaaauuccugaugaacuaa

SEQ ID NO: 1522112 - RNA, 19 nt, Homo sapiens
aaacccagaauccucauaa

SEQ ID NO: 1522113 - RNA, 19 nt, Homo sapiens
uacaacagaugaagcagau

SEQ ID NO: 1522114 - RNA, 19 nt, Homo sapiens
gaagaauuacugguuuaug

SEQ ID NO: 1522115 - RNA, 19 nt, Homo sapiens
gugaauaaagauggcauua

SEQ ID NO: 1522116 - RNA, 19 nt, Homo sapiens
agauguuucugacgaauau

SEQ ID NO: 1522117 - RNA, 19 nt, Homo sapiens
uugcucagcugaagauguu

SEQ ID NO: 1522118 - RNA, 19 nt, Homo sapiens
gcacagagcuuucauuguu

SEQ ID NO: 1522119 - RNA, 19 nt, Homo sapiens
gcagagcaguguuaacuuu

SEQ ID NO: 1522120 - RNA, 19 nt, Homo sapiens
gaauaacccuuaaagaugu

SEQ ID NO: 1522121 - RNA, 19 nt, Homo sapiens
guaacaagcucaauuaaag

SEQ ID NO: 1522122 - RNA, 19 nt, Homo sapiens
caaggccucuucaguauaa

SEQ ID NO: 1522123 - RNA, 19 nt, Homo sapiens
gaagauuaauguugaggaa

SEQ ID NO: 1522124 - RNA, 19 nt, Homo sapiens
gaaagaguauacacuuguu

SEQ ID NO: 1522125 - RNA, 19 nt, Homo sapiens
uaagaaacauggaacaguu

SEQ ID NO: 1522126 - RNA, 19 nt, Homo sapiens
caacagagccuaaagaaag

SEQ ID NO: 1522127 - RNA, 19 nt, Homo sapiens
gaacaugguuuggauagau

SEQ ID NO: 1522128 - RNA, 19 nt, Homo sapiens
gaaagaagagaaagaguau

SEQ ID NO: 1522129 - RNA, 19 nt, Homo sapiens
gagaaagaguauacacuug

SEQ ID NO: 1522130 - RNA, 19 nt, Homo sapiens
gaauauagagccagucuug

SEQ ID NO: 1522131 - RNA, 19 nt, Homo sapiens
gcagaugucuacagugaau

SEQ ID NO: 1522132 - RNA, 19 nt, Homo sapiens
cacaacaagucuuugcuua

SEQ ID NO: 1522133 - RNA, 19 nt, Homo sapiens
ggacaagacauauuagaug

SEQ ID NO: 1522134 - RNA, 19 nt, Homo sapiens
guacauacauaggcagaaa

SEQ ID NO: 1522135 - RNA, 19 nt, Homo sapiens
caaacaaccuauucaucaa

SEQ ID NO: 1522136 - RNA, 19 nt, Homo sapiens
uaaaguaaaugcuccaagu

SEQ ID NO: 1522137 - RNA, 19 nt, Homo sapiens
ggaaauaccuggaaaacug

SEQ ID NO: 1522138 - RNA, 19 nt, Homo sapiens
guaaaucacagaacaaaug

SEQ ID NO: 1522139 - RNA, 19 nt, Homo sapiens
gaaauugccguggauauug

SEQ ID NO: 1522140 - RNA, 19 nt, Homo sapiens
gggauuauguucauuucuu

SEQ ID NO: 1522141 - RNA, 19 nt, Homo sapiens
gaaaguaaaugggguguuu

SEQ ID NO: 1522142 - RNA, 19 nt, Homo sapiens
gcaggaacaugguuuggau

SEQ ID NO: 1522143 - RNA, 19 nt, Homo sapiens
gggcuuaccaaaugcauua

SEQ ID NO: 1522144 - RNA, 19 nt, Homo sapiens
gaagagaagcugucgaauc

SEQ ID NO: 1522145 - RNA, 19 nt, Homo sapiens
aaggaacgauucacaaauu

SEQ ID NO: 1522146 - RNA, 19 nt, Homo sapiens
gaucuucaguuccgcuuga

SEQ ID NO: 1522147 - RNA, 19 nt, Homo sapiens
gaacaaugccaccgugaau

SEQ ID NO: 1522148 - RNA, 19 nt, Homo sapiens
ccauuuaauugguggauaa

SEQ ID NO: 1522149 - RNA, 19 nt, Homo sapiens
aagcaauucugaucaguuu

SEQ ID NO: 1522150 - RNA, 19 nt, Homo sapiens
gguacuuccuugaacauaa

SEQ ID NO: 1522151 - RNA, 19 nt, Homo sapiens
gaacaaucucuuucaaaug

SEQ ID NO: 1522152 - RNA, 19 nt, Homo sapiens
cagaauaacccuuaaagau

SEQ ID NO: 1522153 - RNA, 19 nt, Homo sapiens
ccaaacaaccuauucauca

SEQ ID NO: 1522154 - RNA, 19 nt, Homo sapiens
ugacaaccguguuugcauu

SEQ ID NO: 1522155 - RNA, 19 nt, Homo sapiens
gcgaauaccaagagaauug

SEQ ID NO: 1522156 - RNA, 19 nt, Homo sapiens
ggacaugccuuugugaaac

SEQ ID NO: 1522157 - RNA, 19 nt, Homo sapiens
gcacggaggaugggcuuua

SEQ ID NO: 1522158 - RNA, 19 nt, Homo sapiens
gcaugcaauucuuauaaug

SEQ ID NO: 1522159 - RNA, 19 nt, Homo sapiens
gcuuuaauguucugacuug

SEQ ID NO: 1522160 - RNA, 19 nt, Homo sapiens
gaacgauucacaaauuaug

SEQ ID NO: 1522161 - RNA, 19 nt, Homo sapiens
aagauuguguuuccgcuua

SEQ ID NO: 1522162 - RNA, 19 nt, Homo sapiens
uuucauggcuguucucuau

SEQ ID NO: 1522163 - RNA, 19 nt, Homo sapiens
gcauuagucuuuguguuug

SEQ ID NO: 1522164 - RNA, 19 nt, Homo sapiens
gaucaucucuggguguugu

SEQ ID NO: 1522165 - RNA, 19 nt, Homo sapiens
gaagauuuccauuccuuug

SEQ ID NO: 1522166 - RNA, 19 nt, Homo sapiens
guacuuccuugaacauaau

SEQ ID NO: 1522167 - RNA, 19 nt, Homo sapiens
guucugacuuguucauuug

SEQ ID NO: 1522168 - RNA, 19 nt, Homo sapiens
gacguaaucuuuccagucu

SEQ ID NO: 1522169 - RNA, 19 nt, Homo sapiens
ccucaaggccucuucagua

SEQ ID NO: 1522170 - RNA, 19 nt, Homo sapiens
ggacauaacgcaggacaau

SEQ ID NO: 1522171 - RNA, 19 nt, Homo sapiens
ggaaaucgugccaguaugu

SEQ ID NO: 1522172 - RNA, 19 nt, Homo sapiens
caauuaaagugcaaggaau

SEQ ID NO: 1522173 - RNA, 19 nt, Homo sapiens
caacaagucuuugcuuacu

SEQ ID NO: 1522174 - RNA, 19 nt, Homo sapiens
ggacagcaacagagccuaa

SEQ ID NO: 1522175 - RNA, 19 nt, Homo sapiens
cagaagauuuccauuccuu

SEQ ID NO: 1522176 - RNA, 19 nt, Homo sapiens
agaauaacccuuaaagaug

SEQ ID NO: 1522177 - RNA, 19 nt, Homo sapiens
caauguagcuuuuaacuca

SEQ ID NO: 1522178 - RNA, 19 nt, Homo sapiens
guugauaucccugaaagua

SEQ ID NO: 1522179 - RNA, 19 nt, Homo sapiens
agaaagaagagaaagagua

SEQ ID NO: 1522180 - RNA, 19 nt, Homo sapiens
cugcagaugucuacaguga

SEQ ID NO: 1522181 - RNA, 19 nt, Homo sapiens
aggaacgauucacaaauua

SEQ ID NO: 1522182 - RNA, 19 nt, Homo sapiens
gguagcugaucgucuguuu

SEQ ID NO: 1522183 - RNA, 19 nt, Homo sapiens
ccaaacacaacccugauuu

SEQ ID NO: 1522184 - RNA, 19 nt, Homo sapiens
gcaacagagccuaaagaaa

SEQ ID NO: 1522185 - RNA, 19 nt, Homo sapiens
ggccaaguauacagaaaga

SEQ ID NO: 1522186 - RNA, 19 nt, Homo sapiens
ggauuauguucauuucuuc

SEQ ID NO: 1522187 - RNA, 19 nt, Homo sapiens
cagaagaugguacuguuaa

SEQ ID NO: 1522188 - RNA, 19 nt, Homo sapiens
ugucagaacuguccagaag

SEQ ID NO: 1522189 - RNA, 19 nt, Homo sapiens
ugagcuguaugccauuuaa

SEQ ID NO: 1522190 - RNA, 19 nt, Homo sapiens
ggcaagccguccaguaaau

SEQ ID NO: 1522191 - RNA, 19 nt, Homo sapiens
gauagugugucuaagaaac

SEQ ID NO: 1522192 - RNA, 19 nt, Homo sapiens
agcaacaacucucaaugua

SEQ ID NO: 1522193 - RNA, 19 nt, Homo sapiens
caguuccgcuugaauuauu

SEQ ID NO: 1522194 - RNA, 19 nt, Homo sapiens
cagagacgcugggcuucua

SEQ ID NO: 1522195 - RNA, 19 nt, Homo sapiens
aaacacagauccucaaaau

SEQ ID NO: 1522196 - RNA, 19 nt, Homo sapiens
uaacgcaggacaauucuga

SEQ ID NO: 1522197 - RNA, 19 nt, Homo sapiens
gugaaaccaggaaguauuu

SEQ ID NO: 1522198 - RNA, 19 nt, Homo sapiens
ucagaacuguccagaagau

SEQ ID NO: 1522199 - RNA, 19 nt, Homo sapiens
uauaaugguucaagcaaca

SEQ ID NO: 1522200 - RNA, 19 nt, Homo sapiens
ggacagacguuugcuucag

SEQ ID NO: 1522201 - RNA, 19 nt, Homo sapiens
ggaacaugguuuggauaga

SEQ ID NO: 1522202 - RNA, 19 nt, Homo sapiens
ccagaagaugguacuguua

SEQ ID NO: 1522203 - RNA, 19 nt, Homo sapiens
caggcaagccguccaguaa

SEQ ID NO: 1522204 - RNA, 19 nt, Homo sapiens
caugauguaccaccugaua

SEQ ID NO: 1522205 - RNA, 19 nt, Homo sapiens
gcccaggugugugacauuu

SEQ ID NO: 1522206 - RNA, 19 nt, Homo sapiens
uauucaggcuccucacuuu

SEQ ID NO: 1522207 - RNA, 19 nt, Homo sapiens
auaagugcaucuuguguga

SEQ ID NO: 1522208 - RNA, 19 nt, Homo sapiens
gaggguacuuccuugaaca

SEQ ID NO: 1522209 - RNA, 19 nt, Homo sapiens
uuaauguucugacuuguuc

SEQ ID NO: 1522210 - RNA, 19 nt, Homo sapiens
ggaagcagagcaguguuaa

SEQ ID NO: 1522211 - RNA, 19 nt, Homo sapiens
ccaccagaauaacccuuaa

SEQ ID NO: 1522212 - RNA, 19 nt, Homo sapiens
gaaggaagccaaaauggaa

SEQ ID NO: 1522213 - RNA, 19 nt, Homo sapiens
acaagucuuugcuuacuau

SEQ ID NO: 1522214 - RNA, 19 nt, Homo sapiens
uauguugacuacuccauga

SEQ ID NO: 1522215 - RNA, 19 nt, Homo sapiens
uuggauagaucuucaguuc

SEQ ID NO: 1522216 - RNA, 19 nt, Homo sapiens
caccgugaauggaauaguu

SEQ ID NO: 1522217 - RNA, 19 nt, Homo sapiens
guauggacaugccuuugug

SEQ ID NO: 1522218 - RNA, 19 nt, Homo sapiens
cgacaaaucuuaagaaucg

SEQ ID NO: 1522219 - RNA, 19 nt, Homo sapiens
gucggaaccuuauuauuua

SEQ ID NO: 1522220 - RNA, 19 nt, Homo sapiens
gagccucacugaaacaauu

SEQ ID NO: 1522221 - RNA, 19 nt, Homo sapiens
caucucuucugcauauuua

SEQ ID NO: 1522222 - RNA, 19 nt, Homo sapiens
aaucauacccauuccauua

SEQ ID NO: 1522223 - RNA, 19 nt, Homo sapiens
cgucggaaccuuauuauuu

SEQ ID NO: 1522224 - RNA, 19 nt, Homo sapiens
ggacagugguaccucgauu

SEQ ID NO: 1522225 - RNA, 19 nt, Homo sapiens
uauuuaugcuugccuguua

SEQ ID NO: 1522226 - RNA, 19 nt, Homo sapiens
gcauauaaaugggccuuga

SEQ ID NO: 1522227 - RNA, 19 nt, Homo sapiens
gcaggagaauggcuugaau

SEQ ID NO: 1522228 - RNA, 19 nt, Homo sapiens
caaauacucccgacaaauc

SEQ ID NO: 1522229 - RNA, 19 nt, Homo sapiens
aaacuucccuagaccuaaa

SEQ ID NO: 1522230 - RNA, 19 nt, Homo sapiens
caaauucuguugccuaagg

SEQ ID NO: 1522231 - RNA, 19 nt, Homo sapiens
gaaagacauucaguuccaa

SEQ ID NO: 1522232 - RNA, 19 nt, Homo sapiens
caagaaggaaguaggcuuu

SEQ ID NO: 1522233 - RNA, 19 nt, Homo sapiens
gaggaaagacauucaguuc

SEQ ID NO: 1522234 - RNA, 19 nt, Homo sapiens
ccacauuuauuggguuauu

SEQ ID NO: 1522235 - RNA, 19 nt, Homo sapiens
gagaaccgcauauaaaugg

SEQ ID NO: 1522236 - RNA, 19 nt, Homo sapiens
gcagccaguugucagaaug

SEQ ID NO: 1522237 - RNA, 19 nt, Homo sapiens
cagcccauauucuauuauu

SEQ ID NO: 1522238 - RNA, 19 nt, Homo sapiens
aaacaaauacucccgacaa

SEQ ID NO: 1522239 - RNA, 19 nt, Homo sapiens
ggacucagcugugcuuuug

SEQ ID NO: 1522240 - RNA, 19 nt, Homo sapiens
ggccaccacuguguccuua

SEQ ID NO: 1522241 - RNA, 19 nt, Homo sapiens
ggacuuuccucauuuucua

SEQ ID NO: 1522242 - RNA, 19 nt, Homo sapiens
caccacauuuauuggguua

SEQ ID NO: 1522243 - RNA, 19 nt, Homo sapiens
cccauuccauuauguauug

SEQ ID NO: 1522244 - RNA, 19 nt, Homo sapiens
cccaaauucuguugccuaa

SEQ ID NO: 1522245 - RNA, 19 nt, Homo sapiens
gaccauccuccaugaaauu

SEQ ID NO: 1522246 - RNA, 19 nt, Homo sapiens
gaaacuucccuagaccuaa

SEQ ID NO: 1522247 - RNA, 19 nt, Homo sapiens
uacauucccuggccucuga

SEQ ID NO: 1522248 - RNA, 19 nt, Homo sapiens
gaaaccccgugucuacuaa

SEQ ID NO: 1522249 - RNA, 19 nt, Homo sapiens
uaugaggccugaggaaaga

SEQ ID NO: 1522250 - RNA, 19 nt, Homo sapiens
aacaaauacucccgacaaa

SEQ ID NO: 1522251 - RNA, 19 nt, Homo sapiens
guccuuacuuugucgcuuu

SEQ ID NO: 1522252 - RNA, 19 nt, Homo sapiens
guuauugccuuugccuuug

SEQ ID NO: 1522253 - RNA, 19 nt, Homo sapiens
gguuauugccuuugccuuu

SEQ ID NO: 1522254 - RNA, 19 nt, Homo sapiens
gaggugagaguccaagaug

SEQ ID NO: 1522255 - RNA, 19 nt, Homo sapiens
gcgccuguauucccagcua

SEQ ID NO: 1522256 - RNA, 19 nt, Homo sapiens
gaaguaggcuuuuauugcu

SEQ ID NO: 1522257 - RNA, 19 nt, Homo sapiens
cggguuacgugauugcaaa

SEQ ID NO: 1522258 - RNA, 19 nt, Homo sapiens
cuugagaaccgcauauaaa

SEQ ID NO: 1522259 - RNA, 19 nt, Homo sapiens
uuccaucucuucugcauau

SEQ ID NO: 1522260 - RNA, 19 nt, Homo sapiens
gagcuuucuucagcccaua

SEQ ID NO: 1522261 - RNA, 19 nt, Homo sapiens
ugaccauccuccaugaaau

SEQ ID NO: 1522262 - RNA, 19 nt, Homo sapiens
ggggacagcucacaggauu

SEQ ID NO: 1522263 - RNA, 19 nt, Homo sapiens
gugccuauccuuuuaaaua

SEQ ID NO: 1522264 - RNA, 19 nt, Homo sapiens
guugaaaggaggaacauuc

SEQ ID NO: 1522265 - RNA, 19 nt, Homo sapiens
ugucgucaguagcggguua

SEQ ID NO: 1522266 - RNA, 19 nt, Homo sapiens
gacagugguaccucgauuu

SEQ ID NO: 1522267 - RNA, 19 nt, Homo sapiens
ggacagcucacaggauuac

SEQ ID NO: 1522268 - RNA, 19 nt, Homo sapiens
ugucucaccacauuuauug

SEQ ID NO: 1522269 - RNA, 19 nt, Homo sapiens
uuuacugucucaccacauu

SEQ ID NO: 1522270 - RNA, 19 nt, Homo sapiens
gaguguccuuuggcaguuu

SEQ ID NO: 1522271 - RNA, 19 nt, Homo sapiens
gcaggaggcagaggugaga

SEQ ID NO: 1522272 - RNA, 19 nt, Homo sapiens
aggcggagguugcagugaa

SEQ ID NO: 1522273 - RNA, 19 nt, Homo sapiens
ugagaaccgcauauaaaug

SEQ ID NO: 1522274 - RNA, 19 nt, Homo sapiens
ccuguaaucccagcacuuu

SEQ ID NO: 1522275 - RNA, 19 nt, Homo sapiens
gaaggaaguaggcuuuuau

SEQ ID NO: 1522276 - RNA, 19 nt, Homo sapiens
gugaccauccuccaugaaa

SEQ ID NO: 1522277 - RNA, 19 nt, Homo sapiens
cccgacaaaucuuaagaau

SEQ ID NO: 1522278 - RNA, 19 nt, Homo sapiens
gcucacaggauuacauuuu

SEQ ID NO: 1522279 - RNA, 19 nt, Homo sapiens
aguagcggguuacgugauu

SEQ ID NO: 1522280 - RNA, 19 nt, Homo sapiens
ugaggaaagacauucaguu

SEQ ID NO: 1522281 - RNA, 19 nt, Homo sapiens
uaugucaguuuccauuuac

SEQ ID NO: 1522282 - RNA, 19 nt, Homo sapiens
gcccauauucuauuauucu

SEQ ID NO: 1522283 - RNA, 19 nt, Homo sapiens
uucagcccauauucuauua

SEQ ID NO: 1522284 - RNA, 19 nt, Homo sapiens
ggcaguuuccaaagcauuu

SEQ ID NO: 1522285 - RNA, 19 nt, Homo sapiens
agaaggaaguaggcuuuua

SEQ ID NO: 1522286 - RNA, 19 nt, Homo sapiens
ggacuuuccacacugucuu

SEQ ID NO: 1522287 - RNA, 19 nt, Homo sapiens
cagcucacaggauuacauu

SEQ ID NO: 1522288 - RNA, 19 nt, Homo sapiens
augcuugccuguuacauuc

SEQ ID NO: 1522289 - RNA, 19 nt, Homo sapiens
ggaaguaggcuuuuauugc

SEQ ID NO: 1522290 - RNA, 19 nt, Homo sapiens
ugaggguucugucgucagu

SEQ ID NO: 1522291 - RNA, 19 nt, Homo sapiens
ggcagccaguugucagaau

SEQ ID NO: 1522292 - RNA, 19 nt, Homo sapiens
uuauuggguuauugccuuu

SEQ ID NO: 1522293 - RNA, 19 nt, Homo sapiens
ugaguguccuuuggcaguu

SEQ ID NO: 1522294 - RNA, 19 nt, Homo sapiens
uguuguggcuucugagcuu

SEQ ID NO: 1522295 - RNA, 19 nt, Homo sapiens
gggacagcucacaggauua

SEQ ID NO: 1522296 - RNA, 19 nt, Homo sapiens
guuacgugauugcaaacga

SEQ ID NO: 1522297 - RNA, 19 nt, Homo sapiens
ccaucucuucugcauauuu

SEQ ID NO: 1522298 - RNA, 19 nt, Homo sapiens
ccacuguguccuuacuuug

SEQ ID NO: 1522299 - RNA, 19 nt, Homo sapiens
uugagaaccgcauauaaau

SEQ ID NO: 1522300 - RNA, 19 nt, Homo sapiens
uuauugccuuugccuuuga

SEQ ID NO: 1522301 - RNA, 19 nt, Homo sapiens
auacucccgacaaaucuua

SEQ ID NO: 1522302 - RNA, 19 nt, Homo sapiens
uaaacuugagaaccgcaua

SEQ ID NO: 1522303 - RNA, 19 nt, Homo sapiens
aaagacauucaguuccaaa

SEQ ID NO: 1522304 - RNA, 19 nt, Homo sapiens
cagaauggacuuuccucau

SEQ ID NO: 1522305 - RNA, 19 nt, Homo sapiens
ccaccacuguguccuuacu

SEQ ID NO: 1522306 - RNA, 19 nt, Homo sapiens
gaaggguaggaaucccaaa

SEQ ID NO: 1522307 - RNA, 19 nt, Homo sapiens
cacauuuauuggguuauug

SEQ ID NO: 1522308 - RNA, 19 nt, Homo sapiens
uacugucucaccacauuua

SEQ ID NO: 1522309 - RNA, 19 nt, Homo sapiens
cuucagcccauauucuauu

SEQ ID NO: 1522310 - RNA, 19 nt, Homo sapiens
aaaauguuguggcuucuga

SEQ ID NO: 1522311 - RNA, 19 nt, Homo sapiens
gcaaaagcaaaacgaauuc

SEQ ID NO: 1522312 - RNA, 19 nt, Homo sapiens
ggacugggguuaggagaca

SEQ ID NO: 1522313 - RNA, 19 nt, Homo sapiens
uaugcuugccuguuacauu

SEQ ID NO: 1522314 - RNA, 19 nt, Homo sapiens
guagcggguuacgugauug

SEQ ID NO: 1522315 - RNA, 19 nt, Homo sapiens
aaacuugagaaccgcauau

SEQ ID NO: 1522316 - RNA, 19 nt, Homo sapiens
cagccuggccaacauagug

SEQ ID NO: 1522317 - RNA, 19 nt, Homo sapiens
gagcuggaaggguaggaau

SEQ ID NO: 1522318 - RNA, 19 nt, Homo sapiens
gaacuuggaaggaucauua

SEQ ID NO: 1522319 - RNA, 19 nt, Homo sapiens
gaaacugacuugacagguu

SEQ ID NO: 1522320 - RNA, 19 nt, Homo sapiens
gagccagaccuuauaauua

SEQ ID NO: 1522321 - RNA, 19 nt, Homo sapiens
gaugaacgauugaaacaga

SEQ ID NO: 1522322 - RNA, 19 nt, Homo sapiens
gaagagaaaccucagacua

SEQ ID NO: 1522323 - RNA, 19 nt, Homo sapiens
aaacugacuugacagguua

SEQ ID NO: 1522324 - RNA, 19 nt, Homo sapiens
cagaugacacuuacuauua

SEQ ID NO: 1522325 - RNA, 19 nt, Homo sapiens
ugaguaaucugugaugaua

SEQ ID NO: 1522326 - RNA, 19 nt, Homo sapiens
auacagagaugaacgauug

SEQ ID NO: 1522327 - RNA, 19 nt, Homo sapiens
gagcaauccugauaagaga

SEQ ID NO: 1522328 - RNA, 19 nt, Homo sapiens
gcagauccaugcuuucuuc

SEQ ID NO: 1522329 - RNA, 19 nt, Homo sapiens
ucacaacucugaaguagau

SEQ ID NO: 1522330 - RNA, 19 nt, Homo sapiens
gagaugaacaggugacuuu

SEQ ID NO: 1522331 - RNA, 19 nt, Homo sapiens
ggacggaagcuuacauuga

SEQ ID NO: 1522332 - RNA, 19 nt, Homo sapiens
caaacaggcuuauggaaag

SEQ ID NO: 1522333 - RNA, 19 nt, Homo sapiens
uccaaucucugcucaguua

SEQ ID NO: 1522334 - RNA, 19 nt, Homo sapiens
cagagucgcugaaacuuga

SEQ ID NO: 1522335 - RNA, 19 nt, Homo sapiens
ggacacagacucagaagga

SEQ ID NO: 1522336 - RNA, 19 nt, Homo sapiens
cagaagagcuguucaacgu

SEQ ID NO: 1522337 - RNA, 19 nt, Homo sapiens
caacaucccugcugcucuu

SEQ ID NO: 1522338 - RNA, 19 nt, Homo sapiens
gggaauauggagaaauuua

SEQ ID NO: 1522339 - RNA, 19 nt, Homo sapiens
gagaaggauuacauugauu

SEQ ID NO: 1522340 - RNA, 19 nt, Homo sapiens
gagcuucucugcaugacuu

SEQ ID NO: 1522341 - RNA, 19 nt, Homo sapiens
gauaagagacuucgcuaug

SEQ ID NO: 1522342 - RNA, 19 nt, Homo sapiens
ugacaaauuuggcaggauu

SEQ ID NO: 1522343 - RNA, 19 nt, Homo sapiens
gcaggugccuuacuuugug

SEQ ID NO: 1522344 - RNA, 19 nt, Homo sapiens
guacaaaggaucaagaaau

SEQ ID NO: 1522345 - RNA, 19 nt, Homo sapiens
gacuacauauucugcauuu

SEQ ID NO: 1522346 - RNA, 19 nt, Homo sapiens
ggaaucagguagucacaca

SEQ ID NO: 1522347 - RNA, 19 nt, Homo sapiens
gcagggagagggagcauuu

SEQ ID NO: 1522348 - RNA, 19 nt, Homo sapiens
gcucaagccuagagauaga

SEQ ID NO: 1522349 - RNA, 19 nt, Homo sapiens
uaaugaaacugacuugaca

SEQ ID NO: 1522350 - RNA, 19 nt, Homo sapiens
uacaaaggaucaagaaaug

SEQ ID NO: 1522351 - RNA, 19 nt, Homo sapiens
uagcauggcucaucaacau

SEQ ID NO: 1522352 - RNA, 19 nt, Homo sapiens
ugaauuaucaugacucuga

SEQ ID NO: 1522353 - RNA, 19 nt, Homo sapiens
gcaguuagaagaaacaaau

SEQ ID NO: 1522354 - RNA, 19 nt, Homo sapiens
gaaaagaagucugagaaug

SEQ ID NO: 1522355 - RNA, 19 nt, Homo sapiens
ccaaacaggcuuauggaaa

SEQ ID NO: 1522356 - RNA, 19 nt, Homo sapiens
ugaaguagauguauuaucc

SEQ ID NO: 1522357 - RNA, 19 nt, Homo sapiens
gaagacacaccuccugaga

SEQ ID NO: 1522358 - RNA, 19 nt, Homo sapiens
agccaaagcuuaauauuag

SEQ ID NO: 1522359 - RNA, 19 nt, Homo sapiens
gauuauauccagacuaguu

SEQ ID NO: 1522360 - RNA, 19 nt, Homo sapiens
ugacaucacuccagaagag

SEQ ID NO: 1522361 - RNA, 19 nt, Homo sapiens
uaucaugacucugaacuug

SEQ ID NO: 1522362 - RNA, 19 nt, Homo sapiens
gaaaguucuucuacacaca

SEQ ID NO: 1522363 - RNA, 19 nt, Homo sapiens
gcacuccacuccaucucaa

SEQ ID NO: 1522364 - RNA, 19 nt, Homo sapiens
gggcgaagguauaaugcaa

SEQ ID NO: 1522365 - RNA, 19 nt, Homo sapiens
gcgaagguauaaugcaaga

SEQ ID NO: 1522366 - RNA, 19 nt, Homo sapiens
gauccaugcuuucuuccuu

SEQ ID NO: 1522367 - RNA, 19 nt, Homo sapiens
gaguaguucaucuaaguua

SEQ ID NO: 1522368 - RNA, 19 nt, Homo sapiens
ugacagaugacacuuacua

SEQ ID NO: 1522369 - RNA, 19 nt, Homo sapiens
uuucaaaugugacagauga

SEQ ID NO: 1522370 - RNA, 19 nt, Homo sapiens
agccagaccuuauaauuau

SEQ ID NO: 1522371 - RNA, 19 nt, Homo sapiens
uuagagaguccagaaauua

SEQ ID NO: 1522372 - RNA, 19 nt, Homo sapiens
gagauuccuuuauuuccuu

SEQ ID NO: 1522373 - RNA, 19 nt, Homo sapiens
ccgccaagauuuagccuuu

SEQ ID NO: 1522374 - RNA, 19 nt, Homo sapiens
gaaagcagagucgcugaaa

SEQ ID NO: 1522375 - RNA, 19 nt, Homo sapiens
ugacgaagagcuuaagaaa

SEQ ID NO: 1522376 - RNA, 19 nt, Homo sapiens
uaagagacuucgcuaugau

SEQ ID NO: 1522377 - RNA, 19 nt, Homo sapiens
ucacgcugauugucuguuu

SEQ ID NO: 1522378 - RNA, 19 nt, Homo sapiens
gaauuaucaugacucugaa

SEQ ID NO: 1522379 - RNA, 19 nt, Homo sapiens
cagcagccacuuuguuuaa

SEQ ID NO: 1522380 - RNA, 19 nt, Homo sapiens
ggaggaggaagaagagaaa

SEQ ID NO: 1522381 - RNA, 19 nt, Homo sapiens
ugagcugccugaauuauca

SEQ ID NO: 1522382 - RNA, 19 nt, Homo sapiens
gacccugucuaacauaaau

SEQ ID NO: 1522383 - RNA, 19 nt, Homo sapiens
agagaaggauuacauugau

SEQ ID NO: 1522384 - RNA, 19 nt, Homo sapiens
gaugaguaaucugugauga

SEQ ID NO: 1522385 - RNA, 19 nt, Homo sapiens
agacacaccuccugagagu

SEQ ID NO: 1522386 - RNA, 19 nt, Homo sapiens
ccucaugucucaggugauu

SEQ ID NO: 1522387 - RNA, 19 nt, Homo sapiens
caucauagaacccagagaa

SEQ ID NO: 1522388 - RNA, 19 nt, Homo sapiens
agagguggcugagaggaua

SEQ ID NO: 1522389 - RNA, 19 nt, Homo sapiens
gagaugaacgauugaaaca

SEQ ID NO: 1522390 - RNA, 19 nt, Homo sapiens
gacggaagcuuacauugac

SEQ ID NO: 1522391 - RNA, 19 nt, Homo sapiens
auaagagacuucgcuauga

SEQ ID NO: 1522392 - RNA, 19 nt, Homo sapiens
gaaacaaauacccagaaga

SEQ ID NO: 1522393 - RNA, 19 nt, Homo sapiens
agagggagcauuucuagaa

SEQ ID NO: 1522394 - RNA, 19 nt, Homo sapiens
ggagagggagcauuucuag

SEQ ID NO: 1522395 - RNA, 19 nt, Homo sapiens
gcuacaccauuucuagaga

SEQ ID NO: 1522396 - RNA, 19 nt, Homo sapiens
agaaaccucagacuacaua

SEQ ID NO: 1522397 - RNA, 19 nt, Homo sapiens
ggaacuccacguacaguga

SEQ ID NO: 1522398 - RNA, 19 nt, Homo sapiens
gaaaccccaucucuacuaa

SEQ ID NO: 1522399 - RNA, 19 nt, Homo sapiens
gaaggaucauuaagugacu

SEQ ID NO: 1522400 - RNA, 19 nt, Homo sapiens
agacagauccucucuccuu

SEQ ID NO: 1522401 - RNA, 19 nt, Homo sapiens
ccuuaacccucucuccuuu

SEQ ID NO: 1522402 - RNA, 19 nt, Homo sapiens
cuauuuauguuccugauuc

SEQ ID NO: 1522403 - RNA, 19 nt, Homo sapiens
uagagaaggauuacauuga

SEQ ID NO: 1522404 - RNA, 19 nt, Homo sapiens
gaucaagaaaugcagaaau

SEQ ID NO: 1522405 - RNA, 19 nt, Homo sapiens
gaagaagagaaaccucaga

SEQ ID NO: 1522406 - RNA, 19 nt, Homo sapiens
gaaaauuggccauaaugaa

SEQ ID NO: 1522407 - RNA, 19 nt, Homo sapiens
ccacugcacuccacuccau

SEQ ID NO: 1522408 - RNA, 19 nt, Homo sapiens
cauagaacccagagaaugu

SEQ ID NO: 1522409 - RNA, 19 nt, Homo sapiens
ccacgaagccucccuacuc

SEQ ID NO: 1522410 - RNA, 19 nt, Homo sapiens
gcagagucgcugaaacuug

SEQ ID NO: 1522411 - RNA, 19 nt, Homo sapiens
gcaggauuauacagagaug

SEQ ID NO: 1522412 - RNA, 19 nt, Homo sapiens
acuccaugcuuccuucaua

SEQ ID NO: 1522413 - RNA, 19 nt, Homo sapiens
uagagaguccagaaauuaa

SEQ ID NO: 1522414 - RNA, 19 nt, Homo sapiens
caaauuuggcaggauuaua

SEQ ID NO: 1522415 - RNA, 19 nt, Homo sapiens
caauagagaaggauuacau

SEQ ID NO: 1522416 - RNA, 19 nt, Homo sapiens
cgagccagaccuuauaauu

SEQ ID NO: 1522417 - RNA, 19 nt, Homo sapiens
caagaaaugcagaaauuac

SEQ ID NO: 1522418 - RNA, 19 nt, Homo sapiens
gaaauuuccugucaacuuu

SEQ ID NO: 1522419 - RNA, 19 nt, Homo sapiens
gaaguaacauuggugauua

SEQ ID NO: 1522420 - RNA, 19 nt, Homo sapiens
gcaaaguaguguugauaua

SEQ ID NO: 1522421 - RNA, 19 nt, Homo sapiens
caaaugaauuggcaucuuu

SEQ ID NO: 1522422 - RNA, 19 nt, Homo sapiens
gcagagagaugucaaucaa

SEQ ID NO: 1522423 - RNA, 19 nt, Homo sapiens
ucaaauccauuccgaaauu

SEQ ID NO: 1522424 - RNA, 19 nt, Homo sapiens
gacaagaucugcaugaauc

SEQ ID NO: 1522425 - RNA, 19 nt, Homo sapiens
gaauaacagcuacugauuu

SEQ ID NO: 1522426 - RNA, 19 nt, Homo sapiens
aagauaaacugcaagcuuu

SEQ ID NO: 1522427 - RNA, 19 nt, Homo sapiens
agaaacagcccaacaauug

SEQ ID NO: 1522428 - RNA, 19 nt, Homo sapiens
ugaacaagguccugugaaa

SEQ ID NO: 1522429 - RNA, 19 nt, Homo sapiens
uaacuaauuuggacucuuc

SEQ ID NO: 1522430 - RNA, 19 nt, Homo sapiens
uagcagccuucucuaaaua

SEQ ID NO: 1522431 - RNA, 19 nt, Homo sapiens
gcacuucaaagcuucaaua

SEQ ID NO: 1522432 - RNA, 19 nt, Homo sapiens
gaaguuuaguagaggagua

SEQ ID NO: 1522433 - RNA, 19 nt, Homo sapiens
gaaaucacuugacuuaacu

SEQ ID NO: 1522434 - RNA, 19 nt, Homo sapiens
gacaucagcucuugugcaa

SEQ ID NO: 1522435 - RNA, 19 nt, Homo sapiens
cgaaagcugugaugagaau

SEQ ID NO: 1522436 - RNA, 19 nt, Homo sapiens
cagcagaaccagaauguaa

SEQ ID NO: 1522437 - RNA, 19 nt, Homo sapiens
gcucaacccauauuuguuu

SEQ ID NO: 1522438 - RNA, 19 nt, Homo sapiens
aaaccacccuaacuaauga

SEQ ID NO: 1522439 - RNA, 19 nt, Homo sapiens
ucaaagagcaaaccacaaa

SEQ ID NO: 1522440 - RNA, 19 nt, Homo sapiens
gaaacagcccaacaauuga

SEQ ID NO: 1522441 - RNA, 19 nt, Homo sapiens
ucaagaacagacucuauua

SEQ ID NO: 1522442 - RNA, 19 nt, Homo sapiens
gaagacacccuguaugaag

SEQ ID NO: 1522443 - RNA, 19 nt, Homo sapiens
uaagagaccugcagaagac

SEQ ID NO: 1522444 - RNA, 19 nt, Homo sapiens
ugucauugcucaacccaua

SEQ ID NO: 1522445 - RNA, 19 nt, Homo sapiens
gcagaaacugacagaauuu

SEQ ID NO: 1522446 - RNA, 19 nt, Homo sapiens
cagaagacacccuguauga

SEQ ID NO: 1522447 - RNA, 19 nt, Homo sapiens
caagaaucaugacuggaaa

SEQ ID NO: 1522448 - RNA, 19 nt, Homo sapiens
cuauuuaucuucugggaaa

SEQ ID NO: 1522449 - RNA, 19 nt, Homo sapiens
caagaacagacucuauuaa

SEQ ID NO: 1522450 - RNA, 19 nt, Homo sapiens
gcaugaaucuauguauuuc

SEQ ID NO: 1522451 - RNA, 19 nt, Homo sapiens
auaaggagguuuaguuuca

SEQ ID NO: 1522452 - RNA, 19 nt, Homo sapiens
ggaggaaacagaacauaau

SEQ ID NO: 1522453 - RNA, 19 nt, Homo sapiens
gcaguuugcacaccuguaa

SEQ ID NO: 1522454 - RNA, 19 nt, Homo sapiens
gaacguugagacugaauga

SEQ ID NO: 1522455 - RNA, 19 nt, Homo sapiens
guuauuagaccugcuauuu

SEQ ID NO: 1522456 - RNA, 19 nt, Homo sapiens
uauaaagagugcugaacaa

SEQ ID NO: 1522457 - RNA, 19 nt, Homo sapiens
agaaggaggugcccuagug

SEQ ID NO: 1522458 - RNA, 19 nt, Homo sapiens
gagguuuaguuucaauuug

SEQ ID NO: 1522459 - RNA, 19 nt, Homo sapiens
uaacagcuacugauuuaga

SEQ ID NO: 1522460 - RNA, 19 nt, Homo sapiens
caucagcucuugugcaaag

SEQ ID NO: 1522461 - RNA, 19 nt, Homo sapiens
ugcagaaacugacagaauu

SEQ ID NO: 1522462 - RNA, 19 nt, Homo sapiens
agaaaucacuugacuuaac

SEQ ID NO: 1522463 - RNA, 19 nt, Homo sapiens
agaggaacguugagacuga

SEQ ID NO: 1522464 - RNA, 19 nt, Homo sapiens
caagauacagcauauuugu

SEQ ID NO: 1522465 - RNA, 19 nt, Homo sapiens
gaaaaugcuugcuggagaa

SEQ ID NO: 1522466 - RNA, 19 nt, Homo sapiens
caguccagcugucuacuaa

SEQ ID NO: 1522467 - RNA, 19 nt, Homo sapiens
aaagagugcugaacaaggu

SEQ ID NO: 1522468 - RNA, 19 nt, Homo sapiens
ugacuaccauaccaagaaa

SEQ ID NO: 1522469 - RNA, 19 nt, Homo sapiens
ggagguuuaguuucaauuu

SEQ ID NO: 1522470 - RNA, 19 nt, Homo sapiens
uaaaccacccuaacuaaug

SEQ ID NO: 1522471 - RNA, 19 nt, Homo sapiens
cgaauaacagcuacugauu

SEQ ID NO: 1522472 - RNA, 19 nt, Homo sapiens
gggaggaaacagaacauaa

SEQ ID NO: 1522473 - RNA, 19 nt, Homo sapiens
gugaaacauucuaaacaug

SEQ ID NO: 1522474 - RNA, 19 nt, Homo sapiens
uugcacaccuguaaacuga

SEQ ID NO: 1522475 - RNA, 19 nt, Homo sapiens
caugauaacauuucacgaa

SEQ ID NO: 1522476 - RNA, 19 nt, Homo sapiens
agaagacuauagcaucaaa

SEQ ID NO: 1522477 - RNA, 19 nt, Homo sapiens
cuacugauuuagaagacua

SEQ ID NO: 1522478 - RNA, 19 nt, Homo sapiens
cgaaauuuccugucaacuu

SEQ ID NO: 1522479 - RNA, 19 nt, Homo sapiens
gcacaccuguaaacugaag

SEQ ID NO: 1522480 - RNA, 19 nt, Homo sapiens
ucaagaaucaugacuggaa

SEQ ID NO: 1522481 - RNA, 19 nt, Homo sapiens
caugaauacuaccuacuau

SEQ ID NO: 1522482 - RNA, 19 nt, Homo sapiens
uuagaagacuauagcauca

SEQ ID NO: 1522483 - RNA, 19 nt, Homo sapiens
ucaguaggaugucaaccaa

SEQ ID NO: 1522484 - RNA, 19 nt, Homo sapiens
gcaaagacaagaucugcau

SEQ ID NO: 1522485 - RNA, 19 nt, Homo sapiens
gcuuuuggauuuccuaaua

SEQ ID NO: 1522486 - RNA, 19 nt, Homo sapiens
gaggaaacagaacauaaug

SEQ ID NO: 1522487 - RNA, 19 nt, Homo sapiens
gaaggaggugcccuaguga

SEQ ID NO: 1522488 - RNA, 19 nt, Homo sapiens
guagaggaguauauguugu

SEQ ID NO: 1522489 - RNA, 19 nt, Homo sapiens
gguugccuguucaugaaua

SEQ ID NO: 1522490 - RNA, 19 nt, Homo sapiens
cacugacuguggaacauua

SEQ ID NO: 1522491 - RNA, 19 nt, Homo sapiens
gagaaaacaugguagaaag

SEQ ID NO: 1522492 - RNA, 19 nt, Homo sapiens
uaacucagaucaggcuuag

SEQ ID NO: 1522493 - RNA, 19 nt, Homo sapiens
gaccaugacuaccauacca

SEQ ID NO: 1522494 - RNA, 19 nt, Homo sapiens
cagaaacugacagaauuua

SEQ ID NO: 1522495 - RNA, 19 nt, Homo sapiens
cuauaaacaugacaucuac

SEQ ID NO: 1522496 - RNA, 19 nt, Homo sapiens
gugaugagaaugaggauga

SEQ ID NO: 1522497 - RNA, 19 nt, Homo sapiens
cagaaacagcccaacaauu

SEQ ID NO: 1522498 - RNA, 19 nt, Homo sapiens
ucuaaauacuggaggcauu

SEQ ID NO: 1522499 - RNA, 19 nt, Homo sapiens
aaagauaaacugcaagcuu

SEQ ID NO: 1522500 - RNA, 19 nt, Homo sapiens
gcagaagacacccuguaug

SEQ ID NO: 1522501 - RNA, 19 nt, Homo sapiens
ggacuuguaucuguugcau

SEQ ID NO: 1522502 - RNA, 19 nt, Homo sapiens
ugacaaaaguguaaucugu

SEQ ID NO: 1522503 - RNA, 19 nt, Homo sapiens
gcaauacaucaucgucuug

SEQ ID NO: 1522504 - RNA, 19 nt, Homo sapiens
gcagaaccagaauguaaug

SEQ ID NO: 1522505 - RNA, 19 nt, Homo sapiens
cugcaugaaucuauguauu

SEQ ID NO: 1522506 - RNA, 19 nt, Homo sapiens
guaacucagaucaggcuua

SEQ ID NO: 1522507 - RNA, 19 nt, Homo sapiens
cagcauccaauaguuguua

SEQ ID NO: 1522508 - RNA, 19 nt, Homo sapiens
ggacucuucaucacauuga

SEQ ID NO: 1522509 - RNA, 19 nt, Homo sapiens
cccaagauacagcauauuu

SEQ ID NO: 1522510 - RNA, 19 nt, Homo sapiens
gaugucaaccaaaugaaga

SEQ ID NO: 1522511 - RNA, 19 nt, Homo sapiens
gaaagcguguacggucuuc

SEQ ID NO: 1522512 - RNA, 19 nt, Homo sapiens
ugaagcagcagaaccagaa

SEQ ID NO: 1522513 - RNA, 19 nt, Homo sapiens
ucaugaauacuaccuacua

SEQ ID NO: 1522514 - RNA, 19 nt, Homo sapiens
gaggaacguugagacugaa

SEQ ID NO: 1522515 - RNA, 19 nt, Homo sapiens
gugcaaaguaguguugaua

SEQ ID NO: 1522516 - RNA, 19 nt, Homo sapiens
ggucagcauccaauaguug

SEQ ID NO: 1522517 - RNA, 19 nt, Homo sapiens
gugcagaaacugacagaau

SEQ ID NO: 1522518 - RNA, 19 nt, Homo sapiens
ggaggucacuuaaaucaaa

SEQ ID NO: 1522519 - RNA, 19 nt, Homo sapiens
gcacuacaauugacacaaa

SEQ ID NO: 1522520 - RNA, 19 nt, Homo sapiens
gaaaacaugugcugugaua

SEQ ID NO: 1522521 - RNA, 19 nt, Homo sapiens
gagcaacaauuaaugagaa

SEQ ID NO: 1522522 - RNA, 19 nt, Homo sapiens
gcagaugcuuucagaauug

SEQ ID NO: 1522523 - RNA, 19 nt, Homo sapiens
agaagaagcuuacgugaug

SEQ ID NO: 1522524 - RNA, 19 nt, Homo sapiens
cauaagagccagcaagaua

SEQ ID NO: 1522525 - RNA, 19 nt, Homo sapiens
gcagaagaguaaagaagaa

SEQ ID NO: 1522526 - RNA, 19 nt, Homo sapiens
gcucauagauuugcuuaau

SEQ ID NO: 1522527 - RNA, 19 nt, Homo sapiens
ccucaaguguccagaauuu

SEQ ID NO: 1522528 - RNA, 19 nt, Homo sapiens
gagccaaggugauuucuag

SEQ ID NO: 1522529 - RNA, 19 nt, Homo sapiens
caagauacauucccucaag

SEQ ID NO: 1522530 - RNA, 19 nt, Homo sapiens
gcagaaguauauugaguca

SEQ ID NO: 1522531 - RNA, 19 nt, Homo sapiens
caaaguagcacuguagauu

SEQ ID NO: 1522532 - RNA, 19 nt, Homo sapiens
gcguaagacuucagaauuc

SEQ ID NO: 1522533 - RNA, 19 nt, Homo sapiens
gauggcagaugcuuucaga

SEQ ID NO: 1522534 - RNA, 19 nt, Homo sapiens
aaagacaacucagagguaa

SEQ ID NO: 1522535 - RNA, 19 nt, Homo sapiens
gccaucaaguaucauauuu

SEQ ID NO: 1522536 - RNA, 19 nt, Homo sapiens
gaauuucccuuucaacaac

SEQ ID NO: 1522537 - RNA, 19 nt, Homo sapiens
caaagacacugcuucaaac

SEQ ID NO: 1522538 - RNA, 19 nt, Homo sapiens
caaaauggaugaauuggaa

SEQ ID NO: 1522539 - RNA, 19 nt, Homo sapiens
ggcagaugcuuucagaauu

SEQ ID NO: 1522540 - RNA, 19 nt, Homo sapiens
gagaaagggagaagaaaga

SEQ ID NO: 1522541 - RNA, 19 nt, Homo sapiens
cuugagaaguuguauguuu

SEQ ID NO: 1522542 - RNA, 19 nt, Homo sapiens
caaagacaacucagaggua

SEQ ID NO: 1522543 - RNA, 19 nt, Homo sapiens
ucaccaauauagcaaugua

SEQ ID NO: 1522544 - RNA, 19 nt, Homo sapiens
gcaacaaaauggaugaauu

SEQ ID NO: 1522545 - RNA, 19 nt, Homo sapiens
caugacagaaggugauuua

SEQ ID NO: 1522546 - RNA, 19 nt, Homo sapiens
gaccuuggcagaaguauau

SEQ ID NO: 1522547 - RNA, 19 nt, Homo sapiens
gagcgaaacucugucucaa

SEQ ID NO: 1522548 - RNA, 19 nt, Homo sapiens
caugugccaucucuacuaa

SEQ ID NO: 1522549 - RNA, 19 nt, Homo sapiens
acaaagacacugcuucaaa

SEQ ID NO: 1522550 - RNA, 19 nt, Homo sapiens
aaacaugugcugugauaaa

SEQ ID NO: 1522551 - RNA, 19 nt, Homo sapiens
guaaagaggaagcauugaa

SEQ ID NO: 1522552 - RNA, 19 nt, Homo sapiens
gagccgagacugugucauu

SEQ ID NO: 1522553 - RNA, 19 nt, Homo sapiens
gauccaaacuauagaacuc

SEQ ID NO: 1522554 - RNA, 19 nt, Homo sapiens
ggauuuccaucaccaagga

SEQ ID NO: 1522555 - RNA, 19 nt, Homo sapiens
uaaagaggaagcauugaaa

SEQ ID NO: 1522556 - RNA, 19 nt, Homo sapiens
gaaagggagaagaaagaaa

SEQ ID NO: 1522557 - RNA, 19 nt, Homo sapiens
aaggaaaccuggugggauu

SEQ ID NO: 1522558 - RNA, 19 nt, Homo sapiens
caaacaagaguuggaaauu

SEQ ID NO: 1522559 - RNA, 19 nt, Homo sapiens
uagaggagguagaaauguu

SEQ ID NO: 1522560 - RNA, 19 nt, Homo sapiens
agaaguauauugagucagu

SEQ ID NO: 1522561 - RNA, 19 nt, Homo sapiens
gcgaaacucugucucaaaa

SEQ ID NO: 1522562 - RNA, 19 nt, Homo sapiens
agacaagccaguugaaauu

SEQ ID NO: 1522563 - RNA, 19 nt, Homo sapiens
ucaagugucugcauuuuaa

SEQ ID NO: 1522564 - RNA, 19 nt, Homo sapiens
gguaugcucccuucagaaa

SEQ ID NO: 1522565 - RNA, 19 nt, Homo sapiens
gcaagaucaucaagugagu

SEQ ID NO: 1522566 - RNA, 19 nt, Homo sapiens
uuauuugccuuguucagua

SEQ ID NO: 1522567 - RNA, 19 nt, Homo sapiens
ggcaaagccacaagucaua

SEQ ID NO: 1522568 - RNA, 19 nt, Homo sapiens
ggcaaugucuuaaugaaac

SEQ ID NO: 1522569 - RNA, 19 nt, Homo sapiens
ggaaaccuggugggauuua

SEQ ID NO: 1522570 - RNA, 19 nt, Homo sapiens
ggagugcaguggugugauc

SEQ ID NO: 1522571 - RNA, 19 nt, Homo sapiens
gaagaagcuuuggcucauc

SEQ ID NO: 1522572 - RNA, 19 nt, Homo sapiens
gcagaggcuucaggucuug

SEQ ID NO: 1522573 - RNA, 19 nt, Homo sapiens
gcugaagucugacaaugca

SEQ ID NO: 1522574 - RNA, 19 nt, Homo sapiens
gaaauggggucucaggaau

SEQ ID NO: 1522575 - RNA, 19 nt, Homo sapiens
ccagcacucucaaauagau

SEQ ID NO: 1522576 - RNA, 19 nt, Homo sapiens
ggcagagacuguuggguau

SEQ ID NO: 1522577 - RNA, 19 nt, Homo sapiens
agaagaggaugacaugaca

SEQ ID NO: 1522578 - RNA, 19 nt, Homo sapiens
gagaauuucccuuucaaca

SEQ ID NO: 1522579 - RNA, 19 nt, Homo sapiens
caauugacacaaauggaua

SEQ ID NO: 1522580 - RNA, 19 nt, Homo sapiens
gaccaggcacuacaauuga

SEQ ID NO: 1522581 - RNA, 19 nt, Homo sapiens
gaucagauggaaagaacuu

SEQ ID NO: 1522582 - RNA, 19 nt, Homo sapiens
gaaaccuggugggauuuau

SEQ ID NO: 1522583 - RNA, 19 nt, Homo sapiens
gcaugugccaucucuacua

SEQ ID NO: 1522584 - RNA, 19 nt, Homo sapiens
gaauuggaagcaccuuaaa

SEQ ID NO: 1522585 - RNA, 19 nt, Homo sapiens
gaucaucaagugagucaga

SEQ ID NO: 1522586 - RNA, 19 nt, Homo sapiens
gcauuugagcaacaauuaa

SEQ ID NO: 1522587 - RNA, 19 nt, Homo sapiens
acucagagguaaagaggaa

SEQ ID NO: 1522588 - RNA, 19 nt, Homo sapiens
gaagcgaguuuucaguauu

SEQ ID NO: 1522589 - RNA, 19 nt, Homo sapiens
uaacaauaccuaggacuga

SEQ ID NO: 1522590 - RNA, 19 nt, Homo sapiens
gguauggccucggaaggaa

SEQ ID NO: 1522591 - RNA, 19 nt, Homo sapiens
aaagaaaugaagcgaguuu

SEQ ID NO: 1522592 - RNA, 19 nt, Homo sapiens
ggcguaagacuucagaauu

SEQ ID NO: 1522593 - RNA, 19 nt, Homo sapiens
ugaccaggcacuacaauug

SEQ ID NO: 1522594 - RNA, 19 nt, Homo sapiens
gaagauggcucaggaaaac

SEQ ID NO: 1522595 - RNA, 19 nt, Homo sapiens
gaaggugauuuaggguaug

SEQ ID NO: 1522596 - RNA, 19 nt, Homo sapiens
caagccaguugaaauugga

SEQ ID NO: 1522597 - RNA, 19 nt, Homo sapiens
cucaagagguccuuaagau

SEQ ID NO: 1522598 - RNA, 19 nt, Homo sapiens
ugaauuggaagcaccuuaa

SEQ ID NO: 1522599 - RNA, 19 nt, Homo sapiens
agaaggugauuuaggguau

SEQ ID NO: 1522600 - RNA, 19 nt, Homo sapiens
gaggaagcauugaaaauuc

SEQ ID NO: 1522601 - RNA, 19 nt, Homo sapiens
cgacaaaguagcacuguag

SEQ ID NO: 1522602 - RNA, 19 nt, Homo sapiens
guggcaagaucaucaagug

SEQ ID NO: 1522603 - RNA, 19 nt, Homo sapiens
ucugugggcugcauuuguu

SEQ ID NO: 1522604 - RNA, 19 nt, Homo sapiens
cuuaagaugcucauagauu

SEQ ID NO: 1522605 - RNA, 19 nt, Homo sapiens
uuaaaaugcugaagucuga

SEQ ID NO: 1522606 - RNA, 19 nt, Homo sapiens
cuuuagcccuccuccauuu

SEQ ID NO: 1522607 - RNA, 19 nt, Homo sapiens
cuuaacagcucuuuucauu

SEQ ID NO: 1522608 - RNA, 19 nt, Homo sapiens
ugagcaagguggcaagauc

SEQ ID NO: 1522609 - RNA, 19 nt, Homo sapiens
aaacagauccuuggagaag

SEQ ID NO: 1522610 - RNA, 19 nt, Homo sapiens
gcacuguagauucgaauuc

SEQ ID NO: 1522611 - RNA, 19 nt, Homo sapiens
gggagaagaaagaaaugaa

SEQ ID NO: 1522612 - RNA, 19 nt, Homo sapiens
gacggcauuuggcucauga

SEQ ID NO: 1522613 - RNA, 19 nt, Homo sapiens
aaagggagaagaaagaaau

SEQ ID NO: 1522614 - RNA, 19 nt, Homo sapiens
ggaccuuggcagaaguaua

SEQ ID NO: 1522615 - RNA, 19 nt, Homo sapiens
aggacugacugaauguuaa

SEQ ID NO: 1522616 - RNA, 19 nt, Homo sapiens
gaggucacuuaaaucaaau

SEQ ID NO: 1522617 - RNA, 19 nt, Homo sapiens
ggagaagaaagaaaugaag

SEQ ID NO: 1522618 - RNA, 19 nt, Homo sapiens
ggugaaaucuugaaucuua

SEQ ID NO: 1522619 - RNA, 19 nt, Homo sapiens
gaagauacaucccuaagaa

SEQ ID NO: 1522620 - RNA, 19 nt, Homo sapiens
ggacggaucuguaguguga

SEQ ID NO: 1522621 - RNA, 19 nt, Homo sapiens
gaagacggcuggaagguuu

SEQ ID NO: 1522622 - RNA, 19 nt, Homo sapiens
gaauaucccuuugccauuu

SEQ ID NO: 1522623 - RNA, 19 nt, Homo sapiens
cagcagagcuccacagguu

SEQ ID NO: 1522624 - RNA, 19 nt, Homo sapiens
acucuuagcuccaaacaua

SEQ ID NO: 1522625 - RNA, 19 nt, Homo sapiens
gcaaggcaaugcugaagaa

SEQ ID NO: 1522626 - RNA, 19 nt, Homo sapiens
ggaaaggauuugagcaaga

SEQ ID NO: 1522627 - RNA, 19 nt, Homo sapiens
ggaagaaacuccgaacaca

SEQ ID NO: 1522628 - RNA, 19 nt, Homo sapiens
ugaagggauuugaguauuu

SEQ ID NO: 1522629 - RNA, 19 nt, Homo sapiens
gaaggaagcauggauucua

SEQ ID NO: 1522630 - RNA, 19 nt, Homo sapiens
gaagggauuugaguauuuc

SEQ ID NO: 1522631 - RNA, 19 nt, Homo sapiens
uaaaccagagucaacauua

SEQ ID NO: 1522632 - RNA, 19 nt, Homo sapiens
gcaagcagaauaucccuuu

SEQ ID NO: 1522633 - RNA, 19 nt, Homo sapiens
ggaacaaacucuggacaca

SEQ ID NO: 1522634 - RNA, 19 nt, Homo sapiens
gaaaggauuugagcaagag

SEQ ID NO: 1522635 - RNA, 19 nt, Homo sapiens
caacauuacauuucccuuu

SEQ ID NO: 1522636 - RNA, 19 nt, Homo sapiens
agaaggagccugcuaauag

SEQ ID NO: 1522637 - RNA, 19 nt, Homo sapiens
gagaggaucguucauggaa

SEQ ID NO: 1522638 - RNA, 19 nt, Homo sapiens
ccaaacauagguugacuuu

SEQ ID NO: 1522639 - RNA, 19 nt, Homo sapiens
gagauuguugucacucuua

SEQ ID NO: 1522640 - RNA, 19 nt, Homo sapiens
cagcuggccugaacuugaa

SEQ ID NO: 1522641 - RNA, 19 nt, Homo sapiens
gcacguuugcucacuauug

SEQ ID NO: 1522642 - RNA, 19 nt, Homo sapiens
aaggaagcauggauucuaa

SEQ ID NO: 1522643 - RNA, 19 nt, Homo sapiens
ggaagauacaucccuaaga

SEQ ID NO: 1522644 - RNA, 19 nt, Homo sapiens
ugaagauuauggcagaauu

SEQ ID NO: 1522645 - RNA, 19 nt, Homo sapiens
cuauugcucuucuuccuaa

SEQ ID NO: 1522646 - RNA, 19 nt, Homo sapiens
ugacucagauucacuuucu

SEQ ID NO: 1522647 - RNA, 19 nt, Homo sapiens
agaagcaccuggagagaau

SEQ ID NO: 1522648 - RNA, 19 nt, Homo sapiens
gaacccaccagaaggaaga

SEQ ID NO: 1522649 - RNA, 19 nt, Homo sapiens
cacccugucuggaaaguuu

SEQ ID NO: 1522650 - RNA, 19 nt, Homo sapiens
ugaagaagcuauggaagca

SEQ ID NO: 1522651 - RNA, 19 nt, Homo sapiens
cagcucugcuucacauuug

SEQ ID NO: 1522652 - RNA, 19 nt, Homo sapiens
ggacacacugccuuuaaga

SEQ ID NO: 1522653 - RNA, 19 nt, Homo sapiens
gcagcuggccugaacuuga

SEQ ID NO: 1522654 - RNA, 19 nt, Homo sapiens
gaaagguuggaaaggauuu

SEQ ID NO: 1522655 - RNA, 19 nt, Homo sapiens
gauuauggcagaauucaau

SEQ ID NO: 1522656 - RNA, 19 nt, Homo sapiens
uuuagggcauuaccaauuu

SEQ ID NO: 1522657 - RNA, 19 nt, Homo sapiens
uguacuaacugaagggauu

SEQ ID NO: 1522658 - RNA, 19 nt, Homo sapiens
gaacaucagaaggaacaaa

SEQ ID NO: 1522659 - RNA, 19 nt, Homo sapiens
caagaaggaagcauggauu

SEQ ID NO: 1522660 - RNA, 19 nt, Homo sapiens
guucagaauuauacugugu

SEQ ID NO: 1522661 - RNA, 19 nt, Homo sapiens
gaagaaacuccgaacacau

SEQ ID NO: 1522662 - RNA, 19 nt, Homo sapiens
gacgagggccuuugucaga

SEQ ID NO: 1522663 - RNA, 19 nt, Homo sapiens
gccguugucugaaagcaaa

SEQ ID NO: 1522664 - RNA, 19 nt, Homo sapiens
ggaaagguuggaaaggauu

SEQ ID NO: 1522665 - RNA, 19 nt, Homo sapiens
ggauuugaguauuucacaa

SEQ ID NO: 1522666 - RNA, 19 nt, Homo sapiens
cacguuugcucacuauuga

SEQ ID NO: 1522667 - RNA, 19 nt, Homo sapiens
gaccaagaacccaccaauu

SEQ ID NO: 1522668 - RNA, 19 nt, Homo sapiens
gagaagcaccuggagagaa

SEQ ID NO: 1522669 - RNA, 19 nt, Homo sapiens
gaagagaagacggcuggaa

SEQ ID NO: 1522670 - RNA, 19 nt, Homo sapiens
gaggaucguucauggaaac

SEQ ID NO: 1522671 - RNA, 19 nt, Homo sapiens
ccagggaggucgguugaug

SEQ ID NO: 1522672 - RNA, 19 nt, Homo sapiens
gauacaucccuaagaaguu

SEQ ID NO: 1522673 - RNA, 19 nt, Homo sapiens
gaagauuauggcagaauuc

SEQ ID NO: 1522674 - RNA, 19 nt, Homo sapiens
acaagaaggagccugcuaa

SEQ ID NO: 1522675 - RNA, 19 nt, Homo sapiens
gaucguucauggaaacaag

SEQ ID NO: 1522676 - RNA, 19 nt, Homo sapiens
guaaaccagagucaacauu

SEQ ID NO: 1522677 - RNA, 19 nt, Homo sapiens
cacggaagcugcacacgau

SEQ ID NO: 1522678 - RNA, 19 nt, Homo sapiens
gcaagaaggaagcauggau

SEQ ID NO: 1522679 - RNA, 19 nt, Homo sapiens
gauuugagcaagagaacaa

SEQ ID NO: 1522680 - RNA, 19 nt, Homo sapiens
gaugagcagucgggaagug

SEQ ID NO: 1522681 - RNA, 19 nt, Homo sapiens
guauuucacaagcaccuua

SEQ ID NO: 1522682 - RNA, 19 nt, Homo sapiens
cagagucaacauuacauuu

SEQ ID NO: 1522683 - RNA, 19 nt, Homo sapiens
caagcagaauaucccuuug

SEQ ID NO: 1522684 - RNA, 19 nt, Homo sapiens
ggguuuacaucaagagaag

SEQ ID NO: 1522685 - RNA, 19 nt, Homo sapiens
gcuggaagguuuuagcauu

SEQ ID NO: 1522686 - RNA, 19 nt, Homo sapiens
gacuggccguugucugaaa

SEQ ID NO: 1522687 - RNA, 19 nt, Homo sapiens
uggcagaauucaauauugg

SEQ ID NO: 1522688 - RNA, 19 nt, Homo sapiens
uaacugaagggauuugagu

SEQ ID NO: 1522689 - RNA, 19 nt, Homo sapiens
aaaccagagucaacauuac

SEQ ID NO: 1522690 - RNA, 19 nt, Homo sapiens
ggacuccgcagccacuuca

SEQ ID NO: 1522691 - RNA, 19 nt, Homo sapiens
gaagucagugagaccaaga

SEQ ID NO: 1522692 - RNA, 19 nt, Homo sapiens
caagaaggagccugcuaau

SEQ ID NO: 1522693 - RNA, 19 nt, Homo sapiens
cugaagggauuugaguauu

SEQ ID NO: 1522694 - RNA, 19 nt, Homo sapiens
ccaacgcccugcuucugau

SEQ ID NO: 1522695 - RNA, 19 nt, Homo sapiens
aagaaggagccugcuaaua

SEQ ID NO: 1522696 - RNA, 19 nt, Homo sapiens
ggagaggaucguucaugga

SEQ ID NO: 1522697 - RNA, 19 nt, Homo sapiens
auacaucccuaagaaguuc

SEQ ID NO: 1522698 - RNA, 19 nt, Homo sapiens
aaacuccgaacacaucuga

SEQ ID NO: 1522699 - RNA, 19 nt, Homo sapiens
ucagaauuauacuguguag

SEQ ID NO: 1522700 - RNA, 19 nt, Homo sapiens
ugaaagcaaaccucaagga

SEQ ID NO: 1522701 - RNA, 19 nt, Homo sapiens
gcaaugcugaagaagcuau

SEQ ID NO: 1522702 - RNA, 19 nt, Homo sapiens
gacacacugccuuuaagaa

SEQ ID NO: 1522703 - RNA, 19 nt, Homo sapiens
uggaaagguuggaaaggau

SEQ ID NO: 1522704 - RNA, 19 nt, Homo sapiens
ccagcucugcuucacauuu

SEQ ID NO: 1522705 - RNA, 19 nt, Homo sapiens
gcucuucuuccuaaagcua

SEQ ID NO: 1522706 - RNA, 19 nt, Homo sapiens
gguuagaaauuagaaacag

SEQ ID NO: 1522707 - RNA, 19 nt, Homo sapiens
accaagaacccaccaauuc

SEQ ID NO: 1522708 - RNA, 19 nt, Homo sapiens
gucagggaguggaagagaa

SEQ ID NO: 1522709 - RNA, 19 nt, Homo sapiens
acacugccuuuaagaacug

SEQ ID NO: 1522710 - RNA, 19 nt, Homo sapiens
gaagcuauggaagcaagaa

SEQ ID NO: 1522711 - RNA, 19 nt, Homo sapiens
cuggugaaaucuugaaucu

SEQ ID NO: 1522712 - RNA, 19 nt, Homo sapiens
uuggaaagguuggaaagga

SEQ ID NO: 1522713 - RNA, 19 nt, Homo sapiens
guacuaacugaagggauuu

SEQ ID NO: 1522714 - RNA, 19 nt, Homo sapiens
aagaaacuccgaacacauc

SEQ ID NO: 1522715 - RNA, 19 nt, Homo sapiens
gccuuuaagaacuguaaua

SEQ ID NO: 1522716 - RNA, 19 nt, Homo sapiens
ggacuggccguugucugaa

SEQ ID NO: 1522717 - RNA, 19 nt, Homo sapiens
agaauaucccuuugccauu

SEQ ID NO: 1522718 - RNA, 19 nt, Homo sapiens
uaacaaaccugaacaugua

SEQ ID NO: 1522719 - RNA, 19 nt, Homo sapiens
gaaauaaucuguacaccaa

SEQ ID NO: 1522720 - RNA, 19 nt, Homo sapiens
guacacacaugaugaaaua

SEQ ID NO: 1522721 - RNA, 19 nt, Homo sapiens
gaaaugagacaucuucuga

SEQ ID NO: 1522722 - RNA, 19 nt, Homo sapiens
ccacacaucuccugaauca

SEQ ID NO: 1522723 - RNA, 19 nt, Homo sapiens
ucacaaguguuccuacaua

SEQ ID NO: 1522724 - RNA, 19 nt, Homo sapiens
gcucagaauuauugucaua

SEQ ID NO: 1522725 - RNA, 19 nt, Homo sapiens
ggaagcagguccucccaaa

SEQ ID NO: 1522726 - RNA, 19 nt, Homo sapiens
gcaaagacaaggaaucaaa

SEQ ID NO: 1522727 - RNA, 19 nt, Homo sapiens
guaggaauuucgcuucuuu

SEQ ID NO: 1522728 - RNA, 19 nt, Homo sapiens
uaccacauauucucacuua

SEQ ID NO: 1522729 - RNA, 19 nt, Homo sapiens
ugagacaucuucugacuau

SEQ ID NO: 1522730 - RNA, 19 nt, Homo sapiens
caugaaaucucaguugaaa

SEQ ID NO: 1522731 - RNA, 19 nt, Homo sapiens
gaacauacagaugaaauga

SEQ ID NO: 1522732 - RNA, 19 nt, Homo sapiens
acacauacaccauagaaua

SEQ ID NO: 1522733 - RNA, 19 nt, Homo sapiens
ggaaucaaacuaaauguug

SEQ ID NO: 1522734 - RNA, 19 nt, Homo sapiens
gacaaggaaucaaacuaaa

SEQ ID NO: 1522735 - RNA, 19 nt, Homo sapiens
gaacccugcccaccauuua

SEQ ID NO: 1522736 - RNA, 19 nt, Homo sapiens
ccaaaugccuagaacauca

SEQ ID NO: 1522737 - RNA, 19 nt, Homo sapiens
agugggagcuaaauaauaa

SEQ ID NO: 1522738 - RNA, 19 nt, Homo sapiens
acacagggcagucuaauuu

SEQ ID NO: 1522739 - RNA, 19 nt, Homo sapiens
guacugaugccauucuuaa

SEQ ID NO: 1522740 - RNA, 19 nt, Homo sapiens
uaaauucccaccuaaauga

SEQ ID NO: 1522741 - RNA, 19 nt, Homo sapiens
gaaguggaauggaauaaaa

SEQ ID NO: 1522742 - RNA, 19 nt, Homo sapiens
ccagugacuucucuuacua

SEQ ID NO: 1522743 - RNA, 19 nt, Homo sapiens
ccuaacagccacauuauuu

SEQ ID NO: 1522744 - RNA, 19 nt, Homo sapiens
agacaucuucugacuauua

SEQ ID NO: 1522745 - RNA, 19 nt, Homo sapiens
ccacauauucucacuuaaa

SEQ ID NO: 1522746 - RNA, 19 nt, Homo sapiens
gaaaagcuguggaaauaau

SEQ ID NO: 1522747 - RNA, 19 nt, Homo sapiens
gaaauaacacacacgacaa

SEQ ID NO: 1522748 - RNA, 19 nt, Homo sapiens
uauacacucucuccucuaa

SEQ ID NO: 1522749 - RNA, 19 nt, Homo sapiens
ggccauuucuguaggaauu

SEQ ID NO: 1522750 - RNA, 19 nt, Homo sapiens
acaaagaauuacacuguga

SEQ ID NO: 1522751 - RNA, 19 nt, Homo sapiens
caucaggacuuuaccagau

SEQ ID NO: 1522752 - RNA, 19 nt, Homo sapiens
gccauucucugggaacaua

SEQ ID NO: 1522753 - RNA, 19 nt, Homo sapiens
ggcaugaaaucucaguuga

SEQ ID NO: 1522754 - RNA, 19 nt, Homo sapiens
ggagaaaagucuguacuaa

SEQ ID NO: 1522755 - RNA, 19 nt, Homo sapiens
uaaaagagcuuccaaacuc

SEQ ID NO: 1522756 - RNA, 19 nt, Homo sapiens
gagccaucuuccagaaaua

SEQ ID NO: 1522757 - RNA, 19 nt, Homo sapiens
agacaaggaaucaaacuaa

SEQ ID NO: 1522758 - RNA, 19 nt, Homo sapiens
uaacacacacgacaacuau

SEQ ID NO: 1522759 - RNA, 19 nt, Homo sapiens
gugaauucauuaaggguaa

SEQ ID NO: 1522760 - RNA, 19 nt, Homo sapiens
aaaagaaacugcccaaaug

SEQ ID NO: 1522761 - RNA, 19 nt, Homo sapiens
aaacuaacaugggaacaga

SEQ ID NO: 1522762 - RNA, 19 nt, Homo sapiens
caaggaaucaaacuaaaug

SEQ ID NO: 1522763 - RNA, 19 nt, Homo sapiens
ugaaguuccucaagaugaa

SEQ ID NO: 1522764 - RNA, 19 nt, Homo sapiens
ucgaaaagcuguggaaaua

SEQ ID NO: 1522765 - RNA, 19 nt, Homo sapiens
guaucacuguggauuaauu

SEQ ID NO: 1522766 - RNA, 19 nt, Homo sapiens
gaauaauacuaggcuacaa

SEQ ID NO: 1522767 - RNA, 19 nt, Homo sapiens
ucacauaaggcacuaaaug

SEQ ID NO: 1522768 - RNA, 19 nt, Homo sapiens
cacaaguguuccuacauaa

SEQ ID NO: 1522769 - RNA, 19 nt, Homo sapiens
guacacauacaccauagaa

SEQ ID NO: 1522770 - RNA, 19 nt, Homo sapiens
gaucaacuguagacuggau

SEQ ID NO: 1522771 - RNA, 19 nt, Homo sapiens
ugucuuaaauucccaccua

SEQ ID NO: 1522772 - RNA, 19 nt, Homo sapiens
cccguuaucucuuuccuuu

SEQ ID NO: 1522773 - RNA, 19 nt, Homo sapiens
gaacacauggagagaagga

SEQ ID NO: 1522774 - RNA, 19 nt, Homo sapiens
gacaucuucugacuauuau

SEQ ID NO: 1522775 - RNA, 19 nt, Homo sapiens
gguaacaccaaaccacuaa

SEQ ID NO: 1522776 - RNA, 19 nt, Homo sapiens
ggaaguggaauggaauaaa

SEQ ID NO: 1522777 - RNA, 19 nt, Homo sapiens
gaaaagaaacugcccaaau

SEQ ID NO: 1522778 - RNA, 19 nt, Homo sapiens
cguuaucucuuuccuuuau

SEQ ID NO: 1522779 - RNA, 19 nt, Homo sapiens
ccagauucauauuagcuuu

SEQ ID NO: 1522780 - RNA, 19 nt, Homo sapiens
guacagaaaugucgaaaag

SEQ ID NO: 1522781 - RNA, 19 nt, Homo sapiens
cuacaaagaauuacacugu

SEQ ID NO: 1522782 - RNA, 19 nt, Homo sapiens
ggacuuuaccagauaaugu

SEQ ID NO: 1522783 - RNA, 19 nt, Homo sapiens
cuaauugcaucaggacuuu

SEQ ID NO: 1522784 - RNA, 19 nt, Homo sapiens
guguaucacuguggauuaa

SEQ ID NO: 1522785 - RNA, 19 nt, Homo sapiens
caacagcaaagacaaggaa

SEQ ID NO: 1522786 - RNA, 19 nt, Homo sapiens
uacacucucuccucuaauu

SEQ ID NO: 1522787 - RNA, 19 nt, Homo sapiens
gcacuaaaugccucauguu

SEQ ID NO: 1522788 - RNA, 19 nt, Homo sapiens
acagccacauuauuucuuu

SEQ ID NO: 1522789 - RNA, 19 nt, Homo sapiens
auacuaggcuacaaagaau

SEQ ID NO: 1522790 - RNA, 19 nt, Homo sapiens
caaacccgcauuuaccuuu

SEQ ID NO: 1522791 - RNA, 19 nt, Homo sapiens
ucagcagaaucaucuuaaa

SEQ ID NO: 1522792 - RNA, 19 nt, Homo sapiens
ugacuucucuuacuaucuc

SEQ ID NO: 1522793 - RNA, 19 nt, Homo sapiens
ccaccuuucugaauccuau

SEQ ID NO: 1522794 - RNA, 19 nt, Homo sapiens
ggagcuaaauaauaagaac

SEQ ID NO: 1522795 - RNA, 19 nt, Homo sapiens
agagagccaucuuccagaa

SEQ ID NO: 1522796 - RNA, 19 nt, Homo sapiens
ggaacauacagaugaaaug

SEQ ID NO: 1522797 - RNA, 19 nt, Homo sapiens
gaccacaaaucugcuguca

SEQ ID NO: 1522798 - RNA, 19 nt, Homo sapiens
gaugguguugccagauuua

SEQ ID NO: 1522799 - RNA, 19 nt, Homo sapiens
ccaccuaaaugaaaagaaa

SEQ ID NO: 1522800 - RNA, 19 nt, Homo sapiens
gaugccucuucaauucuua

SEQ ID NO: 1522801 - RNA, 19 nt, Homo sapiens
cauaaguucuuccacacau

SEQ ID NO: 1522802 - RNA, 19 nt, Homo sapiens
gauauugauucuuccuucu

SEQ ID NO: 1522803 - RNA, 19 nt, Homo sapiens
agggagagguucagggaaa

SEQ ID NO: 1522804 - RNA, 19 nt, Homo sapiens
gaagagcaucacacacgaa

SEQ ID NO: 1522805 - RNA, 19 nt, Homo sapiens
ggaacuauaugaaaacaca

SEQ ID NO: 1522806 - RNA, 19 nt, Homo sapiens
aaaccgauaaggaacuaua

SEQ ID NO: 1522807 - RNA, 19 nt, Homo sapiens
cauuaaggguaacaccaaa

SEQ ID NO: 1522808 - RNA, 19 nt, Homo sapiens
ucaggacuuuaccagauaa

SEQ ID NO: 1522809 - RNA, 19 nt, Homo sapiens
cagaugaaaugaccugaac

SEQ ID NO: 1522810 - RNA, 19 nt, Homo sapiens
ccuagaacaucacauaagg

SEQ ID NO: 1522811 - RNA, 19 nt, Homo sapiens
gcuguaaugugaagagcau

SEQ ID NO: 1522812 - RNA, 19 nt, Homo sapiens
ccgaugguguugccagauu

SEQ ID NO: 1522813 - RNA, 19 nt, Homo sapiens
uauuacccguuaucucuuu

SEQ ID NO: 1522814 - RNA, 19 nt, Homo sapiens
acuguagacuggauaaaga

SEQ ID NO: 1522815 - RNA, 19 nt, Homo sapiens
gcaugaaaucucaguugaa

SEQ ID NO: 1522816 - RNA, 19 nt, Homo sapiens
gauggucucugccuaucuc

SEQ ID NO: 1522817 - RNA, 19 nt, Homo sapiens
ggaaaugagacaucuucug

SEQ ID NO: 1522818 - RNA, 19 nt, Homo sapiens
ggaaggaaaucuaguguua

SEQ ID NO: 1522819 - RNA, 19 nt, Homo sapiens
gaaagaagaagaccaauua

SEQ ID NO: 1522820 - RNA, 19 nt, Homo sapiens
gcacaacaauugcaguuua

SEQ ID NO: 1522821 - RNA, 19 nt, Homo sapiens
gaagagaggcuccguaaua

SEQ ID NO: 1522822 - RNA, 19 nt, Homo sapiens
gaagaaagcucccaucaca

SEQ ID NO: 1522823 - RNA, 19 nt, Homo sapiens
gaagagauauccacagauu

SEQ ID NO: 1522824 - RNA, 19 nt, Homo sapiens
aaagaaagcuacugcauuu

SEQ ID NO: 1522825 - RNA, 19 nt, Homo sapiens
ggaagaaagugaacaaaug

SEQ ID NO: 1522826 - RNA, 19 nt, Homo sapiens
gaagagaaagccucauuua

SEQ ID NO: 1522827 - RNA, 19 nt, Homo sapiens
ccacagaaauuaaauguug

SEQ ID NO: 1522828 - RNA, 19 nt, Homo sapiens
gaagagccauggaugcuuu

SEQ ID NO: 1522829 - RNA, 19 nt, Homo sapiens
acagaaagcuccacagaaa

SEQ ID NO: 1522830 - RNA, 19 nt, Homo sapiens
cagaaucccugcauaauga

SEQ ID NO: 1522831 - RNA, 19 nt, Homo sapiens
caaaggaaguuacagaaga

SEQ ID NO: 1522832 - RNA, 19 nt, Homo sapiens
gaacaaggaagaugucauu

SEQ ID NO: 1522833 - RNA, 19 nt, Homo sapiens
gcagagauaugccagauca

SEQ ID NO: 1522834 - RNA, 19 nt, Homo sapiens
uaaaugaguugguagaaga

SEQ ID NO: 1522835 - RNA, 19 nt, Homo sapiens
gaaagaaagcuacugcauu

SEQ ID NO: 1522836 - RNA, 19 nt, Homo sapiens
gaagugaccagauguuaaa

SEQ ID NO: 1522837 - RNA, 19 nt, Homo sapiens
gaaaaugccugcugcguuu

SEQ ID NO: 1522838 - RNA, 19 nt, Homo sapiens
ggugaagacuuuacaguga

SEQ ID NO: 1522839 - RNA, 19 nt, Homo sapiens
gaaaggugguucaguagau

SEQ ID NO: 1522840 - RNA, 19 nt, Homo sapiens
gaggaaaacuguaguaaaa

SEQ ID NO: 1522841 - RNA, 19 nt, Homo sapiens
gaacagcgauuugaauuuu

SEQ ID NO: 1522842 - RNA, 19 nt, Homo sapiens
ccacaaagaccaugaaguu

SEQ ID NO: 1522843 - RNA, 19 nt, Homo sapiens
gugaacaaaugcaagauaa

SEQ ID NO: 1522844 - RNA, 19 nt, Homo sapiens
gagaaagccucauuuaaaa

SEQ ID NO: 1522845 - RNA, 19 nt, Homo sapiens
ggagacggcugacggaaau

SEQ ID NO: 1522846 - RNA, 19 nt, Homo sapiens
gaugacagcucggcaagaa

SEQ ID NO: 1522847 - RNA, 19 nt, Homo sapiens
gaauaugacuuggugaaau

SEQ ID NO: 1522848 - RNA, 19 nt, Homo sapiens
acaacaaccuccacucuuu

SEQ ID NO: 1522849 - RNA, 19 nt, Homo sapiens
caaggaagaugucauugau

SEQ ID NO: 1522850 - RNA, 19 nt, Homo sapiens
caagaaacaucacuagaag

SEQ ID NO: 1522851 - RNA, 19 nt, Homo sapiens
aaagaaggauuuccaccua

SEQ ID NO: 1522852 - RNA, 19 nt, Homo sapiens
agagaaagccucauuuaaa

SEQ ID NO: 1522853 - RNA, 19 nt, Homo sapiens
caaggaaccugaagacaca

SEQ ID NO: 1522854 - RNA, 19 nt, Homo sapiens
gcauacaguucauacuauu

SEQ ID NO: 1522855 - RNA, 19 nt, Homo sapiens
ggagaaaccuggaaaaugu

SEQ ID NO: 1522856 - RNA, 19 nt, Homo sapiens
cagaaacaccgccauauuu

SEQ ID NO: 1522857 - RNA, 19 nt, Homo sapiens
aaugauggcugcaugcaua

SEQ ID NO: 1522858 - RNA, 19 nt, Homo sapiens
gaaaugaugaagaagguuu

SEQ ID NO: 1522859 - RNA, 19 nt, Homo sapiens
ggacuccagcugaaaguua

SEQ ID NO: 1522860 - RNA, 19 nt, Homo sapiens
gauguagccugcccaguga

SEQ ID NO: 1522861 - RNA, 19 nt, Homo sapiens
acaagaugaucaagaagua

SEQ ID NO: 1522862 - RNA, 19 nt, Homo sapiens
caucugagguaguaacuga

SEQ ID NO: 1522863 - RNA, 19 nt, Homo sapiens
ccaauuaucaucugaggua

SEQ ID NO: 1522864 - RNA, 19 nt, Homo sapiens
gaaauuaacgcagugaaga

SEQ ID NO: 1522865 - RNA, 19 nt, Homo sapiens
gaaccagauuucucuuguu

SEQ ID NO: 1522866 - RNA, 19 nt, Homo sapiens
gaaauucugacacugauga

SEQ ID NO: 1522867 - RNA, 19 nt, Homo sapiens
aaaggaaacucauaagaca

SEQ ID NO: 1522868 - RNA, 19 nt, Homo sapiens
caacaaccuccacucuuua

SEQ ID NO: 1522869 - RNA, 19 nt, Homo sapiens
guagaagaauacagacuga

SEQ ID NO: 1522870 - RNA, 19 nt, Homo sapiens
uauaagugcuguaaagguu

SEQ ID NO: 1522871 - RNA, 19 nt, Homo sapiens
ggagaagagucuggaagaa

SEQ ID NO: 1522872 - RNA, 19 nt, Homo sapiens
aaacucagcugacaggaau

SEQ ID NO: 1522873 - RNA, 19 nt, Homo sapiens
gaaacuaagagcucagaaa

SEQ ID NO: 1522874 - RNA, 19 nt, Homo sapiens
ggaaccagauuucucuugu

SEQ ID NO: 1522875 - RNA, 19 nt, Homo sapiens
gagugaagcugcucucauc

SEQ ID NO: 1522876 - RNA, 19 nt, Homo sapiens
ggaaagaagaagaccaauu

SEQ ID NO: 1522877 - RNA, 19 nt, Homo sapiens
caagacauauuaucagaag

SEQ ID NO: 1522878 - RNA, 19 nt, Homo sapiens
auaaggaucuguaugaaga

SEQ ID NO: 1522879 - RNA, 19 nt, Homo sapiens
agagagauguggacucaaa

SEQ ID NO: 1522880 - RNA, 19 nt, Homo sapiens
gcaacuaugcucaauuuau

SEQ ID NO: 1522881 - RNA, 19 nt, Homo sapiens
gaaccacugucuucagcaa

SEQ ID NO: 1522882 - RNA, 19 nt, Homo sapiens
ucaaaggacuccagcugaa

SEQ ID NO: 1522883 - RNA, 19 nt, Homo sapiens
gccacaagaugaucaagaa

SEQ ID NO: 1522884 - RNA, 19 nt, Homo sapiens
gaaagcuccacagaaauua

SEQ ID NO: 1522885 - RNA, 19 nt, Homo sapiens
ccacagagauacacauuuu

SEQ ID NO: 1522886 - RNA, 19 nt, Homo sapiens
gaagaccaauuaucaucug

SEQ ID NO: 1522887 - RNA, 19 nt, Homo sapiens
gaagacacccaucauguuc

SEQ ID NO: 1522888 - RNA, 19 nt, Homo sapiens
guuaugcgguuccauuuga

SEQ ID NO: 1522889 - RNA, 19 nt, Homo sapiens
ugacacaucucuaacucaa

SEQ ID NO: 1522890 - RNA, 19 nt, Homo sapiens
ggaauuguuucagcugauu

SEQ ID NO: 1522891 - RNA, 19 nt, Homo sapiens
cagaguggcuacccagaaa

SEQ ID NO: 1522892 - RNA, 19 nt, Homo sapiens
agaaguaaaugaguuggua

SEQ ID NO: 1522893 - RNA, 19 nt, Homo sapiens
gagaaucaguagaccaugu

SEQ ID NO: 1522894 - RNA, 19 nt, Homo sapiens
aaaggaaguuacagaagaa

SEQ ID NO: 1522895 - RNA, 19 nt, Homo sapiens
ggaagagaaagccucauuu

SEQ ID NO: 1522896 - RNA, 19 nt, Homo sapiens
gaaaugccacgaucagaau

SEQ ID NO: 1522897 - RNA, 19 nt, Homo sapiens
gcugaggacuguacugugu

SEQ ID NO: 1522898 - RNA, 19 nt, Homo sapiens
ggcaagaagugaccagaug

SEQ ID NO: 1522899 - RNA, 19 nt, Homo sapiens
ucaagaaacaucacuagaa

SEQ ID NO: 1522900 - RNA, 19 nt, Homo sapiens
agucauugauccagaauuu

SEQ ID NO: 1522901 - RNA, 19 nt, Homo sapiens
uaaagucauugauccagaa

SEQ ID NO: 1522902 - RNA, 19 nt, Homo sapiens
gauauuuccuaccacuauu

SEQ ID NO: 1522903 - RNA, 19 nt, Homo sapiens
aaagagagauguggacuca

SEQ ID NO: 1522904 - RNA, 19 nt, Homo sapiens
aaagugcacuagaacauga

SEQ ID NO: 1522905 - RNA, 19 nt, Homo sapiens
gcaaucagcaugugagcaa

SEQ ID NO: 1522906 - RNA, 19 nt, Homo sapiens
gcaagaacagcgauuugaa

SEQ ID NO: 1522907 - RNA, 19 nt, Homo sapiens
gaacagaaugaggaaauga

SEQ ID NO: 1522908 - RNA, 19 nt, Homo sapiens
agaagaagaccaauuauca

SEQ ID NO: 1522909 - RNA, 19 nt, Homo sapiens
aagaugacauucuccauga

SEQ ID NO: 1522910 - RNA, 19 nt, Homo sapiens
aagaagagauauccacaga

SEQ ID NO: 1522911 - RNA, 19 nt, Homo sapiens
gaucagaagacugccuuua

SEQ ID NO: 1522912 - RNA, 19 nt, Homo sapiens
auaaagaaaugcccaagga

SEQ ID NO: 1522913 - RNA, 19 nt, Homo sapiens
gaagauacccguguaaagg

SEQ ID NO: 1522914 - RNA, 19 nt, Homo sapiens
ggugauggcugugaacuuc

SEQ ID NO: 1522915 - RNA, 19 nt, Homo sapiens
gaaacaguugcuugucaua

SEQ ID NO: 1522916 - RNA, 19 nt, Homo sapiens
gcacaucagugaaaaugaa

SEQ ID NO: 1522917 - RNA, 19 nt, Homo sapiens
ccagugaagaggauuauuu

SEQ ID NO: 1522918 - RNA, 19 nt, Homo sapiens
ugacggauaucaacaauua

SEQ ID NO: 1522919 - RNA, 19 nt, Homo sapiens
gcaaugaaguacaugaaua

SEQ ID NO: 1522920 - RNA, 19 nt, Homo sapiens
acacugaaguuucugauaa

SEQ ID NO: 1522921 - RNA, 19 nt, Homo sapiens
gcaaugaagugagaaaugu

SEQ ID NO: 1522922 - RNA, 19 nt, Homo sapiens
gagacuagauauccaacua

SEQ ID NO: 1522923 - RNA, 19 nt, Homo sapiens
ccaagaagauguacgcaau

SEQ ID NO: 1522924 - RNA, 19 nt, Homo sapiens
ugagaaaugucuucaagga

SEQ ID NO: 1522925 - RNA, 19 nt, Homo sapiens
gagcacccuuuccugguua

SEQ ID NO: 1522926 - RNA, 19 nt, Homo sapiens
uaugaagccugacaauauu

SEQ ID NO: 1522927 - RNA, 19 nt, Homo sapiens
gaagaaugauaccaagaag

SEQ ID NO: 1522928 - RNA, 19 nt, Homo sapiens
gaagaaucgagacuagaua

SEQ ID NO: 1522929 - RNA, 19 nt, Homo sapiens
gauaugaagccugacaaua

SEQ ID NO: 1522930 - RNA, 19 nt, Homo sapiens
gaacguccacuucaaggaa

SEQ ID NO: 1522931 - RNA, 19 nt, Homo sapiens
gggaaggucugcauuguac

SEQ ID NO: 1522932 - RNA, 19 nt, Homo sapiens
auuaaacgcuuacuucuug

SEQ ID NO: 1522933 - RNA, 19 nt, Homo sapiens
caacagaacguccacuuca

SEQ ID NO: 1522934 - RNA, 19 nt, Homo sapiens
ggagcacccuuuccugguu

SEQ ID NO: 1522935 - RNA, 19 nt, Homo sapiens
guuaucaccugcaacagaa

SEQ ID NO: 1522936 - RNA, 19 nt, Homo sapiens
gagcgaagauggguguuuc

SEQ ID NO: 1522937 - RNA, 19 nt, Homo sapiens
gguauuccuuccaagauga

SEQ ID NO: 1522938 - RNA, 19 nt, Homo sapiens
ucaaggaacuccagaucau

SEQ ID NO: 1522939 - RNA, 19 nt, Homo sapiens
gaaggaagaaucgagacua

SEQ ID NO: 1522940 - RNA, 19 nt, Homo sapiens
cuacaagucccacugaauu

SEQ ID NO: 1522941 - RNA, 19 nt, Homo sapiens
ggaagaaucgagacuagau

SEQ ID NO: 1522942 - RNA, 19 nt, Homo sapiens
ucuuggaguucuucucuua

SEQ ID NO: 1522943 - RNA, 19 nt, Homo sapiens
gaagauguacgcaaugaag

SEQ ID NO: 1522944 - RNA, 19 nt, Homo sapiens
gagccaacacuucaagaaa

SEQ ID NO: 1522945 - RNA, 19 nt, Homo sapiens
guggagaccugcguuauca

SEQ ID NO: 1522946 - RNA, 19 nt, Homo sapiens
ggagcgcaaugaagugaga

SEQ ID NO: 1522947 - RNA, 19 nt, Homo sapiens
caacuuugaccacuuugaa

SEQ ID NO: 1522948 - RNA, 19 nt, Homo sapiens
gcagaaccagcgcaucauu

SEQ ID NO: 1522949 - RNA, 19 nt, Homo sapiens
aagaagauguacgcaauga

SEQ ID NO: 1522950 - RNA, 19 nt, Homo sapiens
gaaaugucuucaaggaacu

SEQ ID NO: 1522951 - RNA, 19 nt, Homo sapiens
gagaaaugucuucaaggaa

SEQ ID NO: 1522952 - RNA, 19 nt, Homo sapiens
acaauuaaacgcuuacuuc

SEQ ID NO: 1522953 - RNA, 19 nt, Homo sapiens
ggagccaacacuucaagaa

SEQ ID NO: 1522954 - RNA, 19 nt, Homo sapiens
auaccuggcucuccuacaa

SEQ ID NO: 1522955 - RNA, 19 nt, Homo sapiens
ccaccaguguuugaugaaa

SEQ ID NO: 1522956 - RNA, 19 nt, Homo sapiens
agaagaaugauaccaagaa

SEQ ID NO: 1522957 - RNA, 19 nt, Homo sapiens
gacuagauauccaacuaag

SEQ ID NO: 1522958 - RNA, 19 nt, Homo sapiens
acgcuuacuucuugucaaa

SEQ ID NO: 1522959 - RNA, 19 nt, Homo sapiens
gcaacagaacguccacuuc

SEQ ID NO: 1522960 - RNA, 19 nt, Homo sapiens
acccuuuccugguuaauuu

SEQ ID NO: 1522961 - RNA, 19 nt, Homo sapiens
agaaugauaccaagaagau

SEQ ID NO: 1522962 - RNA, 19 nt, Homo sapiens
ggguguuucugcccggaua

SEQ ID NO: 1522963 - RNA, 19 nt, Homo sapiens
uuacuugacgaacaugaua

SEQ ID NO: 1522964 - RNA, 19 nt, Homo sapiens
ugaaguuucugauaaugac

SEQ ID NO: 1522965 - RNA, 19 nt, Homo sapiens
ggauaugaagccugacaau

SEQ ID NO: 1522966 - RNA, 19 nt, Homo sapiens
aaggaagaaucgagacuag

SEQ ID NO: 1522967 - RNA, 19 nt, Homo sapiens
cacugaaguuucugauaau

SEQ ID NO: 1522968 - RNA, 19 nt, Homo sapiens
ugggaggaaugaaggaaga

SEQ ID NO: 1522969 - RNA, 19 nt, Homo sapiens
aaccaccaguguuugauga

SEQ ID NO: 1522970 - RNA, 19 nt, Homo sapiens
gauaguauaaaucgaggau

SEQ ID NO: 1522971 - RNA, 19 nt, Homo sapiens
agugagaaaugucuucaag

SEQ ID NO: 1522972 - RNA, 19 nt, Homo sapiens
caagaagauguacgcaaug

SEQ ID NO: 1522973 - RNA, 19 nt, Homo sapiens
caauuaaacgcuuacuucu

SEQ ID NO: 1522974 - RNA, 19 nt, Homo sapiens
caaggaagaaacagugaag

SEQ ID NO: 1522975 - RNA, 19 nt, Homo sapiens
uaaugacggauaucaacaa

SEQ ID NO: 1522976 - RNA, 19 nt, Homo sapiens
ggucauggcccuggacuac

SEQ ID NO: 1522977 - RNA, 19 nt, Homo sapiens
aacagaacguccacuucaa

SEQ ID NO: 1522978 - RNA, 19 nt, Homo sapiens
agacuagauauccaacuaa

SEQ ID NO: 1522979 - RNA, 19 nt, Homo sapiens
agauguacgcaaugaagua

SEQ ID NO: 1522980 - RNA, 19 nt, Homo sapiens
ccuguucccuggaugaaag

SEQ ID NO: 1522981 - RNA, 19 nt, Homo sapiens
cugguuaauuugugguauu

SEQ ID NO: 1522982 - RNA, 19 nt, Homo sapiens
caugggagccaacacuuca

SEQ ID NO: 1522983 - RNA, 19 nt, Homo sapiens
aaugacggauaucaacaau

SEQ ID NO: 1522984 - RNA, 19 nt, Homo sapiens
ccaagaugaggaagacaug

SEQ ID NO: 1522985 - RNA, 19 nt, Homo sapiens
gaggaaugaaggaagaauc

SEQ ID NO: 1522986 - RNA, 19 nt, Homo sapiens
aagaaucgagacuagauau

SEQ ID NO: 1522987 - RNA, 19 nt, Homo sapiens
cagaagaaugauaccaaga

SEQ ID NO: 1522988 - RNA, 19 nt, Homo sapiens
gaaggucugcauuguacag

SEQ ID NO: 1522989 - RNA, 19 nt, Homo sapiens
gaagcccaggcacauguau

SEQ ID NO: 1522990 - RNA, 19 nt, Homo sapiens
agaaccagcgcaucauuca

SEQ ID NO: 1522991 - RNA, 19 nt, Homo sapiens
uggacuaccugcagaacca

SEQ ID NO: 1522992 - RNA, 19 nt, Homo sapiens
caaggaacuccagaucaug

SEQ ID NO: 1522993 - RNA, 19 nt, Homo sapiens
cgaagcccaggcacaugua

SEQ ID NO: 1522994 - RNA, 19 nt, Homo sapiens
uacaagucccacugaauug

SEQ ID NO: 1522995 - RNA, 19 nt, Homo sapiens
gguggagaccugcguuauc

SEQ ID NO: 1522996 - RNA, 19 nt, Homo sapiens
ugguauuccuuccaagaug

SEQ ID NO: 1522997 - RNA, 19 nt, Homo sapiens
gcucuuggaguucuucucu

SEQ ID NO: 1522998 - RNA, 19 nt, Homo sapiens
gaaugauaccaagaagaug

SEQ ID NO: 1522999 - RNA, 19 nt, Homo sapiens
uacagaagaaugauaccaa

SEQ ID NO: 1523000 - RNA, 19 nt, Homo sapiens
ggauaucaacaauuaaacg

SEQ ID NO: 1523001 - RNA, 19 nt, Homo sapiens
uuucugauaaugacggaua

SEQ ID NO: 1523002 - RNA, 19 nt, Homo sapiens
gaccgaagcccaggcacau

SEQ ID NO: 1523003 - RNA, 19 nt, Homo sapiens
cagaaccagcgcaucauuc

SEQ ID NO: 1523004 - RNA, 19 nt, Homo sapiens
gcguggagcgcaaugaagu

SEQ ID NO: 1523005 - RNA, 19 nt, Homo sapiens
aaugauaccaagaagaugu

SEQ ID NO: 1523006 - RNA, 19 nt, Homo sapiens
ugggaaggucugcauugua

SEQ ID NO: 1523007 - RNA, 19 nt, Homo sapiens
caagaaaaccaccaguguu

SEQ ID NO: 1523008 - RNA, 19 nt, Homo sapiens
caagucccacugaauugga

SEQ ID NO: 1523009 - RNA, 19 nt, Homo sapiens
gaaucgagacuagauaucc

SEQ ID NO: 1523010 - RNA, 19 nt, Homo sapiens
gaagccugacaauauuuua

SEQ ID NO: 1523011 - RNA, 19 nt, Homo sapiens
ucaaggaagaaacagugaa

SEQ ID NO: 1523012 - RNA, 19 nt, Homo sapiens
cguuaucaccugcaacaga

SEQ ID NO: 1523013 - RNA, 19 nt, Homo sapiens
cugcagaaccagcgcauca

SEQ ID NO: 1523014 - RNA, 19 nt, Homo sapiens
ggaaugaaggaagaaucga

SEQ ID NO: 1523015 - RNA, 19 nt, Homo sapiens
ggaggaaugaaggaagaau

SEQ ID NO: 1523016 - RNA, 19 nt, Homo sapiens
gagaagaacucaauggaua

SEQ ID NO: 1523017 - RNA, 19 nt, Homo sapiens
gaaaggagcagaaauaaau

SEQ ID NO: 1523018 - RNA, 19 nt, Homo sapiens
gcauccagcuuccuguuua

SEQ ID NO: 1523019 - RNA, 19 nt, Homo sapiens
ggagauggcguuucuguuu

SEQ ID NO: 1523020 - RNA, 19 nt, Homo sapiens
gacgguagauuauuucaga

SEQ ID NO: 1523021 - RNA, 19 nt, Homo sapiens
ggacagcugaucagguuua

SEQ ID NO: 1523022 - RNA, 19 nt, Homo sapiens
cagaguaaaugaacaaugu

SEQ ID NO: 1523023 - RNA, 19 nt, Homo sapiens
gaagcaagauuccauaagc

SEQ ID NO: 1523024 - RNA, 19 nt, Homo sapiens
ccaauccucuaauaugaaa

SEQ ID NO: 1523025 - RNA, 19 nt, Homo sapiens
uaugaaaggagcagaaaua

SEQ ID NO: 1523026 - RNA, 19 nt, Homo sapiens
gcuguccaauccucuaaua

SEQ ID NO: 1523027 - RNA, 19 nt, Homo sapiens
gcuagaguauucaugagaa

SEQ ID NO: 1523028 - RNA, 19 nt, Homo sapiens
guccaauccucuaauauga

SEQ ID NO: 1523029 - RNA, 19 nt, Homo sapiens
aaagaaauaccgagugaaa

SEQ ID NO: 1523030 - RNA, 19 nt, Homo sapiens
gagacaaguuuaucacagu

SEQ ID NO: 1523031 - RNA, 19 nt, Homo sapiens
gaaugaagagcagcaguaa

SEQ ID NO: 1523032 - RNA, 19 nt, Homo sapiens
cgggcuaucugauggguua

SEQ ID NO: 1523033 - RNA, 19 nt, Homo sapiens
caagaagcaagauuccaua

SEQ ID NO: 1523034 - RNA, 19 nt, Homo sapiens
cucaauagauuucuucuuc

SEQ ID NO: 1523035 - RNA, 19 nt, Homo sapiens
caacagaguaaaugaacaa

SEQ ID NO: 1523036 - RNA, 19 nt, Homo sapiens
agacaaguuuaucacagua

SEQ ID NO: 1523037 - RNA, 19 nt, Homo sapiens
uaaaagaaauaccgaguga

SEQ ID NO: 1523038 - RNA, 19 nt, Homo sapiens
gauuugcuccugucaauga

SEQ ID NO: 1523039 - RNA, 19 nt, Homo sapiens
ggaaugcaguagcgugauc

SEQ ID NO: 1523040 - RNA, 19 nt, Homo sapiens
aauaggagguuuagguuuc

SEQ ID NO: 1523041 - RNA, 19 nt, Homo sapiens
uuucauggcuagaguauuc

SEQ ID NO: 1523042 - RNA, 19 nt, Homo sapiens
gauggaaugcaccaaauau

SEQ ID NO: 1523043 - RNA, 19 nt, Homo sapiens
gugugacgguagauuauuu

SEQ ID NO: 1523044 - RNA, 19 nt, Homo sapiens
gaauuccuucuugguauua

SEQ ID NO: 1523045 - RNA, 19 nt, Homo sapiens
guaagacuguuuccugaac

SEQ ID NO: 1523046 - RNA, 19 nt, Homo sapiens
agggcuaucugauggguua

SEQ ID NO: 1523047 - RNA, 19 nt, Homo sapiens
gauuguguaugcucugaug

SEQ ID NO: 1523048 - RNA, 19 nt, Homo sapiens
cuacaggcgugcaccauca

SEQ ID NO: 1523049 - RNA, 19 nt, Homo sapiens
cuggacagcugaucagguu

SEQ ID NO: 1523050 - RNA, 19 nt, Homo sapiens
ucacuggaggaauaauuua

SEQ ID NO: 1523051 - RNA, 19 nt, Homo sapiens
caagugcugucggccauga

SEQ ID NO: 1523052 - RNA, 19 nt, Homo sapiens
ugaaaggagcagaaauaaa

SEQ ID NO: 1523053 - RNA, 19 nt, Homo sapiens
cucaauggauacuggauuu

SEQ ID NO: 1523054 - RNA, 19 nt, Homo sapiens
uauggugcuuugccuuuaa

SEQ ID NO: 1523055 - RNA, 19 nt, Homo sapiens
cuauggugcuuugccuuua

SEQ ID NO: 1523056 - RNA, 19 nt, Homo sapiens
gguauuaaagagacaaguu

SEQ ID NO: 1523057 - RNA, 19 nt, Homo sapiens
aaacaggaaguguauugaa

SEQ ID NO: 1523058 - RNA, 19 nt, Homo sapiens
ccaaauaucccaaaacuca

SEQ ID NO: 1523059 - RNA, 19 nt, Homo sapiens
agguuuagguuucauauuc

SEQ ID NO: 1523060 - RNA, 19 nt, Homo sapiens
gagauggcguuucuguuuu

SEQ ID NO: 1523061 - RNA, 19 nt, Homo sapiens
uagagugccuuugagaaga

SEQ ID NO: 1523062 - RNA, 19 nt, Homo sapiens
caauaggagguuuagguuu

SEQ ID NO: 1523063 - RNA, 19 nt, Homo sapiens
gaagcuuggacuagaauuc

SEQ ID NO: 1523064 - RNA, 19 nt, Homo sapiens
agaaugaagagcagcagua

SEQ ID NO: 1523065 - RNA, 19 nt, Homo sapiens
ugagaagggcuaucugaug

SEQ ID NO: 1523066 - RNA, 19 nt, Homo sapiens
uggauuugcuccugucaau

SEQ ID NO: 1523067 - RNA, 19 nt, Homo sapiens
uggauucguuuguguccua

SEQ ID NO: 1523068 - RNA, 19 nt, Homo sapiens
cgauggaaugcaccaaaua

SEQ ID NO: 1523069 - RNA, 19 nt, Homo sapiens
ccagggaguucucuuugag

SEQ ID NO: 1523070 - RNA, 19 nt, Homo sapiens
uauugaagcuuggacuaga

SEQ ID NO: 1523071 - RNA, 19 nt, Homo sapiens
uguugaaccuccaagcauu

SEQ ID NO: 1523072 - RNA, 19 nt, Homo sapiens
gccuuuaacuagagugugu

SEQ ID NO: 1523073 - RNA, 19 nt, Homo sapiens
agagugccuuugagaagaa

SEQ ID NO: 1523074 - RNA, 19 nt, Homo sapiens
ccagcuuccuguuuacaau

SEQ ID NO: 1523075 - RNA, 19 nt, Homo sapiens
cuccauauuuacagcuaua

SEQ ID NO: 1523076 - RNA, 19 nt, Homo sapiens
ucccaaaacucaauagauu

SEQ ID NO: 1523077 - RNA, 19 nt, Homo sapiens
ugucggccaugauugugua

SEQ ID NO: 1523078 - RNA, 19 nt, Homo sapiens
ggcauuuucuucuuaguuu

SEQ ID NO: 1523079 - RNA, 19 nt, Homo sapiens
gaguggcauuuucuucuua

SEQ ID NO: 1523080 - RNA, 19 nt, Homo sapiens
ccgauggaaugcaccaaau

SEQ ID NO: 1523081 - RNA, 19 nt, Homo sapiens
gucccaaccugaagcugaa

SEQ ID NO: 1523082 - RNA, 19 nt, Homo sapiens
ccaacagaguaaaugaaca

SEQ ID NO: 1523083 - RNA, 19 nt, Homo sapiens
uagagugugugacgguaga

SEQ ID NO: 1523084 - RNA, 19 nt, Homo sapiens
ggagguuuagguuucauau

SEQ ID NO: 1523085 - RNA, 19 nt, Homo sapiens
cagcuuccuguuuacaaua

SEQ ID NO: 1523086 - RNA, 19 nt, Homo sapiens
gcauuggcucuaugacuga

SEQ ID NO: 1523087 - RNA, 19 nt, Homo sapiens
uuuaaaggcuguccaaucc

SEQ ID NO: 1523088 - RNA, 19 nt, Homo sapiens
gugcuuugccuuuaacuag

SEQ ID NO: 1523089 - RNA, 19 nt, Homo sapiens
gagcagcaguaaaagaaau

SEQ ID NO: 1523090 - RNA, 19 nt, Homo sapiens
gaaauguggaaaagaauga

SEQ ID NO: 1523091 - RNA, 19 nt, Homo sapiens
ucuauucauuggauucguu

SEQ ID NO: 1523092 - RNA, 19 nt, Homo sapiens
acaauaggagguuuagguu

SEQ ID NO: 1523093 - RNA, 19 nt, Homo sapiens
ugaugguggugucuuacuu

SEQ ID NO: 1523094 - RNA, 19 nt, Homo sapiens
ucaagaagcaagauuccau

SEQ ID NO: 1523095 - RNA, 19 nt, Homo sapiens
gaagagcagcaguaaaaga

SEQ ID NO: 1523096 - RNA, 19 nt, Homo sapiens
caucagaggccaguagcuu

SEQ ID NO: 1523097 - RNA, 19 nt, Homo sapiens
aacaggaaguguauugaag

SEQ ID NO: 1523098 - RNA, 19 nt, Homo sapiens
gucacuggaggaauaauuu

SEQ ID NO: 1523099 - RNA, 19 nt, Homo sapiens
uccagggaguucucuuuga

SEQ ID NO: 1523100 - RNA, 19 nt, Homo sapiens
uccauaagcugagaacucu

SEQ ID NO: 1523101 - RNA, 19 nt, Homo sapiens
uguccaauccucuaauaug

SEQ ID NO: 1523102 - RNA, 19 nt, Homo sapiens
guuuaaaggcuguccaauc

SEQ ID NO: 1523103 - RNA, 19 nt, Homo sapiens
ucaaucuccuggucucaag

SEQ ID NO: 1523104 - RNA, 19 nt, Homo sapiens
gagguuuagguuucauauu

SEQ ID NO: 1523105 - RNA, 19 nt, Homo sapiens
ucagauauguauguaagac

SEQ ID NO: 1523106 - RNA, 19 nt, Homo sapiens
cgguagauuauuucagaua

SEQ ID NO: 1523107 - RNA, 19 nt, Homo sapiens
aagaagcaagauuccauaa

SEQ ID NO: 1523108 - RNA, 19 nt, Homo sapiens
guuagagugccuuugagaa

SEQ ID NO: 1523109 - RNA, 19 nt, Homo sapiens
gguuagagugccuuugaga

SEQ ID NO: 1523110 - RNA, 19 nt, Homo sapiens
guuagagugccuuugagaa

SEQ ID NO: 1523111 - RNA, 19 nt, Homo sapiens
gguuagagugccuuugaga

SEQ ID NO: 1523112 - RNA, 19 nt, Homo sapiens
ccugaacaauaagauguau

SEQ ID NO: 1523113 - RNA, 19 nt, Homo sapiens
ccuauggugcuuugccuuu

SEQ ID NO: 1523114 - RNA, 19 nt, Homo sapiens
gccauucucccaccucugu

SEQ ID NO: 1523115 - RNA, 19 nt, Homo sapiens
gaugguggugucuuacuuc

SEQ ID NO: 1523116 - RNA, 19 nt, Homo sapiens
ggacaaaguucuguauaua

SEQ ID NO: 1523117 - RNA, 19 nt, Homo sapiens
gaauacaucuuguuucuga

SEQ ID NO: 1523118 - RNA, 19 nt, Homo sapiens
ucacauagaucuagucuga

SEQ ID NO: 1523119 - RNA, 19 nt, Homo sapiens
uaaaguggcugguuaauuc

SEQ ID NO: 1523120 - RNA, 19 nt, Homo sapiens
gguaaaguguuaaggaaua

SEQ ID NO: 1523121 - RNA, 19 nt, Homo sapiens
ggaccuggcuacguaauua

SEQ ID NO: 1523122 - RNA, 19 nt, Homo sapiens
uaaaugaccucagaucuuu

SEQ ID NO: 1523123 - RNA, 19 nt, Homo sapiens
gaaagaacccucaaucaga

SEQ ID NO: 1523124 - RNA, 19 nt, Homo sapiens
gagagaaggugaaauaaag

SEQ ID NO: 1523125 - RNA, 19 nt, Homo sapiens
gaaaggauuuaaagggaaa

SEQ ID NO: 1523126 - RNA, 19 nt, Homo sapiens
cggagaagcugucgaaauu

SEQ ID NO: 1523127 - RNA, 19 nt, Homo sapiens
ggagaucaguaauuacaaa

SEQ ID NO: 1523128 - RNA, 19 nt, Homo sapiens
gaaacaggauaugcuuuaa

SEQ ID NO: 1523129 - RNA, 19 nt, Homo sapiens
caagagaggugcuaucaca

SEQ ID NO: 1523130 - RNA, 19 nt, Homo sapiens
ggucagcaguggaguuuaa

SEQ ID NO: 1523131 - RNA, 19 nt, Homo sapiens
caacaucucuugagugucu

SEQ ID NO: 1523132 - RNA, 19 nt, Homo sapiens
gcaauuaagcgaacuaaau

SEQ ID NO: 1523133 - RNA, 19 nt, Homo sapiens
uaacugugcuuguugaaug

SEQ ID NO: 1523134 - RNA, 19 nt, Homo sapiens
gugaggcccuuauauaauu

SEQ ID NO: 1523135 - RNA, 19 nt, Homo sapiens
gaugcucaccucuauauua

SEQ ID NO: 1523136 - RNA, 19 nt, Homo sapiens
gcuaacaaguuugagcuua

SEQ ID NO: 1523137 - RNA, 19 nt, Homo sapiens
ggacauguacugagacaaa

SEQ ID NO: 1523138 - RNA, 19 nt, Homo sapiens
cuaaauauguccaccaaga

SEQ ID NO: 1523139 - RNA, 19 nt, Homo sapiens
gagaagcugucgaaauuca

SEQ ID NO: 1523140 - RNA, 19 nt, Homo sapiens
gggaggaccuguuguguuc

SEQ ID NO: 1523141 - RNA, 19 nt, Homo sapiens
uuaagagccuucaauugua

SEQ ID NO: 1523142 - RNA, 19 nt, Homo sapiens
gaacugaggcaucgcgaaa

SEQ ID NO: 1523143 - RNA, 19 nt, Homo sapiens
ucgaugagguuccauguuu

SEQ ID NO: 1523144 - RNA, 19 nt, Homo sapiens
cccaggagaucaguaauua

SEQ ID NO: 1523145 - RNA, 19 nt, Homo sapiens
acagagugauuguaguuua

SEQ ID NO: 1523146 - RNA, 19 nt, Homo sapiens
uauaacaccuuaacaguca

SEQ ID NO: 1523147 - RNA, 19 nt, Homo sapiens
gaauggagaauacaucuug

SEQ ID NO: 1523148 - RNA, 19 nt, Homo sapiens
uaugucaugucuuccauua

SEQ ID NO: 1523149 - RNA, 19 nt, Homo sapiens
gcucaccucuauauuaguu

SEQ ID NO: 1523150 - RNA, 19 nt, Homo sapiens
caccaagccuguuugcuaa

SEQ ID NO: 1523151 - RNA, 19 nt, Homo sapiens
ccacuaaggugaccagagu

SEQ ID NO: 1523152 - RNA, 19 nt, Homo sapiens
acacuuuccucuucuauga

SEQ ID NO: 1523153 - RNA, 19 nt, Homo sapiens
gaccugaacugucugaaag

SEQ ID NO: 1523154 - RNA, 19 nt, Homo sapiens
caaaauaggugaggggaua

SEQ ID NO: 1523155 - RNA, 19 nt, Homo sapiens
cuaacaaguuugagcuuaa

SEQ ID NO: 1523156 - RNA, 19 nt, Homo sapiens
ggaaaccucagagcuauaa

SEQ ID NO: 1523157 - RNA, 19 nt, Homo sapiens
ggagaaaggaggagacaga

SEQ ID NO: 1523158 - RNA, 19 nt, Homo sapiens
gauaguaguggcucgauuu

SEQ ID NO: 1523159 - RNA, 19 nt, Homo sapiens
gaauuagguuucuuugaag

SEQ ID NO: 1523160 - RNA, 19 nt, Homo sapiens
ggaagaagaggcugcauuc

SEQ ID NO: 1523161 - RNA, 19 nt, Homo sapiens
cagagugauuguaguuuaa

SEQ ID NO: 1523162 - RNA, 19 nt, Homo sapiens
ggauaugcuuuaagacaga

SEQ ID NO: 1523163 - RNA, 19 nt, Homo sapiens
ccagagaguuugucgacuu

SEQ ID NO: 1523164 - RNA, 19 nt, Homo sapiens
cacaucagcugaccaucua

SEQ ID NO: 1523165 - RNA, 19 nt, Homo sapiens
agaaacaggauaugcuuua

SEQ ID NO: 1523166 - RNA, 19 nt, Homo sapiens
gcuauaaaguggagugaca

SEQ ID NO: 1523167 - RNA, 19 nt, Homo sapiens
ccaaagggccauugaucua

SEQ ID NO: 1523168 - RNA, 19 nt, Homo sapiens
ucacaccgaucauuucuca

SEQ ID NO: 1523169 - RNA, 19 nt, Homo sapiens
ggucaucucuccugugucu

SEQ ID NO: 1523170 - RNA, 19 nt, Homo sapiens
ggaaguacgucaucaacac

SEQ ID NO: 1523171 - RNA, 19 nt, Homo sapiens
ggaaugcccugaaacuacu

SEQ ID NO: 1523172 - RNA, 19 nt, Homo sapiens
ccagacagauagugaaaca

SEQ ID NO: 1523173 - RNA, 19 nt, Homo sapiens
aaacauaagcuaccugaau

SEQ ID NO: 1523174 - RNA, 19 nt, Homo sapiens
uuacugaguugcuuccaaa

SEQ ID NO: 1523175 - RNA, 19 nt, Homo sapiens
cagaaucacuacaucacaa

SEQ ID NO: 1523176 - RNA, 19 nt, Homo sapiens
ugagguggauuuacugaga

SEQ ID NO: 1523177 - RNA, 19 nt, Homo sapiens
ucaccaagccuguuugcua

SEQ ID NO: 1523178 - RNA, 19 nt, Homo sapiens
agaauggucucaguguuaa

SEQ ID NO: 1523179 - RNA, 19 nt, Homo sapiens
uaagaauggucucaguguu

SEQ ID NO: 1523180 - RNA, 19 nt, Homo sapiens
gauaauacugucuaggaaa

SEQ ID NO: 1523181 - RNA, 19 nt, Homo sapiens
gagugaaacugcgauacaa

SEQ ID NO: 1523182 - RNA, 19 nt, Homo sapiens
cagagaguuugucgacuuu

SEQ ID NO: 1523183 - RNA, 19 nt, Homo sapiens
ggucauccauaaggacuuu

SEQ ID NO: 1523184 - RNA, 19 nt, Homo sapiens
gauuaaaggauucaggaaa

SEQ ID NO: 1523185 - RNA, 19 nt, Homo sapiens
aagaauggucucaguguua

SEQ ID NO: 1523186 - RNA, 19 nt, Homo sapiens
ggaagagcauaguguuugg

SEQ ID NO: 1523187 - RNA, 19 nt, Homo sapiens
gugguaaaguguuaaggaa

SEQ ID NO: 1523188 - RNA, 19 nt, Homo sapiens
ugaggcccuuauauaauua

SEQ ID NO: 1523189 - RNA, 19 nt, Homo sapiens
caacagagagggagaaagg

SEQ ID NO: 1523190 - RNA, 19 nt, Homo sapiens
ggagaaucuuacagaguga

SEQ ID NO: 1523191 - RNA, 19 nt, Homo sapiens
uaagagccuucaauuguag

SEQ ID NO: 1523192 - RNA, 19 nt, Homo sapiens
ggccauugaucuacuacaa

SEQ ID NO: 1523193 - RNA, 19 nt, Homo sapiens
uaacugaggcuuagaaagg

SEQ ID NO: 1523194 - RNA, 19 nt, Homo sapiens
aguuugagcuuaauaccua

SEQ ID NO: 1523195 - RNA, 19 nt, Homo sapiens
acaggaggauuaaaggauu

SEQ ID NO: 1523196 - RNA, 19 nt, Homo sapiens
gaaacuacuguaucugaug

SEQ ID NO: 1523197 - RNA, 19 nt, Homo sapiens
ugaaguaacugaggcuuag

SEQ ID NO: 1523198 - RNA, 19 nt, Homo sapiens
aacaggauaugcuuuaaga

SEQ ID NO: 1523199 - RNA, 19 nt, Homo sapiens
uggacaaaguucuguauau

SEQ ID NO: 1523200 - RNA, 19 nt, Homo sapiens
aacauaagcuaccugaaug

SEQ ID NO: 1523201 - RNA, 19 nt, Homo sapiens
caaaaugucuacuguguuc

SEQ ID NO: 1523202 - RNA, 19 nt, Homo sapiens
caaggcagguagaucacuu

SEQ ID NO: 1523203 - RNA, 19 nt, Homo sapiens
ccuguaaucccaacacuuu

SEQ ID NO: 1523204 - RNA, 19 nt, Homo sapiens
uaagggaaguuuagaugag

SEQ ID NO: 1523205 - RNA, 19 nt, Homo sapiens
ccguugaguuucuaaauau

SEQ ID NO: 1523206 - RNA, 19 nt, Homo sapiens
gagauaugcauucaagaga

SEQ ID NO: 1523207 - RNA, 19 nt, Homo sapiens
acucaugacugaagggaaa

SEQ ID NO: 1523208 - RNA, 19 nt, Homo sapiens
gagaguuugucgacuuugu

SEQ ID NO: 1523209 - RNA, 19 nt, Homo sapiens
aaacuacuguaucugaugu

SEQ ID NO: 1523210 - RNA, 19 nt, Homo sapiens
guaagggaaguuuagauga

SEQ ID NO: 1523211 - RNA, 19 nt, Homo sapiens
cagagaagguagauuuuaa

SEQ ID NO: 1523212 - RNA, 19 nt, Homo sapiens
ugagagaaggugaaauaaa

SEQ ID NO: 1523213 - RNA, 19 nt, Homo sapiens
gguauuccuuuauguaucu

SEQ ID NO: 1523214 - RNA, 19 nt, Homo sapiens
ucucuuauaugccagaaug

SEQ ID NO: 1523215 - RNA, 19 nt, Homo sapiens
ugaaauacacuaacaggau

SEQ ID NO: 1523216 - RNA, 19 nt, Homo sapiens
ccaugaagcuuaugaagaa

SEQ ID NO: 1523217 - RNA, 19 nt, Homo sapiens
gauauucucuugguuguuu

SEQ ID NO: 1523218 - RNA, 19 nt, Homo sapiens
guauguagcuaacugaauu

SEQ ID NO: 1523219 - RNA, 19 nt, Homo sapiens
gacauugacacuaguauua

SEQ ID NO: 1523220 - RNA, 19 nt, Homo sapiens
ggauaacugcucaugauua

SEQ ID NO: 1523221 - RNA, 19 nt, Homo sapiens
guagcuaacugaauuuguu

SEQ ID NO: 1523222 - RNA, 19 nt, Homo sapiens
ggaacaacuacgugaauua

SEQ ID NO: 1523223 - RNA, 19 nt, Homo sapiens
gaagaagaacuaaggaaga

SEQ ID NO: 1523224 - RNA, 19 nt, Homo sapiens
ggaagaaacaggugcuaaa

SEQ ID NO: 1523225 - RNA, 19 nt, Homo sapiens
gaacaacuacgugaauuau

SEQ ID NO: 1523226 - RNA, 19 nt, Homo sapiens
uguguaagcuucucuaaau

SEQ ID NO: 1523227 - RNA, 19 nt, Homo sapiens
gcaugaauuuguuaacaga

SEQ ID NO: 1523228 - RNA, 19 nt, Homo sapiens
caugauuacucccauauau

SEQ ID NO: 1523229 - RNA, 19 nt, Homo sapiens
gauaacugcucaugauuac

SEQ ID NO: 1523230 - RNA, 19 nt, Homo sapiens
gaagcuuauucacguauga

SEQ ID NO: 1523231 - RNA, 19 nt, Homo sapiens
ugaagaggcuacaggaaga

SEQ ID NO: 1523232 - RNA, 19 nt, Homo sapiens
acaagcagcuacuguaugu

SEQ ID NO: 1523233 - RNA, 19 nt, Homo sapiens
gagauaaagcuaaggaaga

SEQ ID NO: 1523234 - RNA, 19 nt, Homo sapiens
acauaaagcucucagaaag

SEQ ID NO: 1523235 - RNA, 19 nt, Homo sapiens
ggucguggcagagguauua

SEQ ID NO: 1523236 - RNA, 19 nt, Homo sapiens
uggaagaggagaaauauuu

SEQ ID NO: 1523237 - RNA, 19 nt, Homo sapiens
ggaaaagcaugaauuuguu

SEQ ID NO: 1523238 - RNA, 19 nt, Homo sapiens
uaagugaggaugccuauga

SEQ ID NO: 1523239 - RNA, 19 nt, Homo sapiens
gcucaugauuacucccaua

SEQ ID NO: 1523240 - RNA, 19 nt, Homo sapiens
gaccucaccucaaagacaa

SEQ ID NO: 1523241 - RNA, 19 nt, Homo sapiens
guguaagcuucucuaaaua

SEQ ID NO: 1523242 - RNA, 19 nt, Homo sapiens
agauaaagcuaaggaagaa

SEQ ID NO: 1523243 - RNA, 19 nt, Homo sapiens
ggaagaggagaaauauuug

SEQ ID NO: 1523244 - RNA, 19 nt, Homo sapiens
caaacuaaacuguuacaug

SEQ ID NO: 1523245 - RNA, 19 nt, Homo sapiens
gaauaugguuaugaugaug

SEQ ID NO: 1523246 - RNA, 19 nt, Homo sapiens
gggcaaaggaucaaugaga

SEQ ID NO: 1523247 - RNA, 19 nt, Homo sapiens
ccaagucuguuuuaagaua

SEQ ID NO: 1523248 - RNA, 19 nt, Homo sapiens
guaggaugauauucucuug

SEQ ID NO: 1523249 - RNA, 19 nt, Homo sapiens
caccaacagugccaggaua

SEQ ID NO: 1523250 - RNA, 19 nt, Homo sapiens
aaacauaaagcucucagaa

SEQ ID NO: 1523251 - RNA, 19 nt, Homo sapiens
ccaacuagcagaaacuuug

SEQ ID NO: 1523252 - RNA, 19 nt, Homo sapiens
guucccgccucuccaguua

SEQ ID NO: 1523253 - RNA, 19 nt, Homo sapiens
cauaaaguuccauguguaa

SEQ ID NO: 1523254 - RNA, 19 nt, Homo sapiens
gaccagaccuaugagacuu

SEQ ID NO: 1523255 - RNA, 19 nt, Homo sapiens
caagcaguauccaaaguuc

SEQ ID NO: 1523256 - RNA, 19 nt, Homo sapiens
agaaguaucuugaugucau

SEQ ID NO: 1523257 - RNA, 19 nt, Homo sapiens
ggaauuacuuguuuucuag

SEQ ID NO: 1523258 - RNA, 19 nt, Homo sapiens
uauaaaccuuucaguagga

SEQ ID NO: 1523259 - RNA, 19 nt, Homo sapiens
aaagugugccugaauacua

SEQ ID NO: 1523260 - RNA, 19 nt, Homo sapiens
gugcaugcgucgcgccuuu

SEQ ID NO: 1523261 - RNA, 19 nt, Homo sapiens
gagcuucauguauuaauug

SEQ ID NO: 1523262 - RNA, 19 nt, Homo sapiens
gcaacaagacaaguaauag

SEQ ID NO: 1523263 - RNA, 19 nt, Homo sapiens
acaacuacgugaauuaucu

SEQ ID NO: 1523264 - RNA, 19 nt, Homo sapiens
caaauaugcccacuugagu

SEQ ID NO: 1523265 - RNA, 19 nt, Homo sapiens
ggaagcuuauucacguaug

SEQ ID NO: 1523266 - RNA, 19 nt, Homo sapiens
gcaaaggaucaaugagaga

SEQ ID NO: 1523267 - RNA, 19 nt, Homo sapiens
agagaaagauagccuggau

SEQ ID NO: 1523268 - RNA, 19 nt, Homo sapiens
gaacccaagucuguuuuaa

SEQ ID NO: 1523269 - RNA, 19 nt, Homo sapiens
aagcuucucuaaauaggaa

SEQ ID NO: 1523270 - RNA, 19 nt, Homo sapiens
ucaaugagagauaaagcua

SEQ ID NO: 1523271 - RNA, 19 nt, Homo sapiens
caacaagacaaguaauagu

SEQ ID NO: 1523272 - RNA, 19 nt, Homo sapiens
ucuaguauuucccucugua

SEQ ID NO: 1523273 - RNA, 19 nt, Homo sapiens
cagcuacgcaccagaagaa

SEQ ID NO: 1523274 - RNA, 19 nt, Homo sapiens
aaggaucaaugagagauaa

SEQ ID NO: 1523275 - RNA, 19 nt, Homo sapiens
agaaacaggugcuaaaaug

SEQ ID NO: 1523276 - RNA, 19 nt, Homo sapiens
gaaucaugguuaguaaaca

SEQ ID NO: 1523277 - RNA, 19 nt, Homo sapiens
ccugcuuuauuucuucuua

SEQ ID NO: 1523278 - RNA, 19 nt, Homo sapiens
guauguauguagcuaacug

SEQ ID NO: 1523279 - RNA, 19 nt, Homo sapiens
aaacaagcagcuacuguau

SEQ ID NO: 1523280 - RNA, 19 nt, Homo sapiens
gaagaauaugguuaugaug

SEQ ID NO: 1523281 - RNA, 19 nt, Homo sapiens
agccaaauaugcccacuug

SEQ ID NO: 1523282 - RNA, 19 nt, Homo sapiens
aauaggaaaccacaauuug

SEQ ID NO: 1523283 - RNA, 19 nt, Homo sapiens
cuaaauaggaaaccacaau

SEQ ID NO: 1523284 - RNA, 19 nt, Homo sapiens
ucuguuaguuagacaaaga

SEQ ID NO: 1523285 - RNA, 19 nt, Homo sapiens
gcuaaaagacuguaauaug

SEQ ID NO: 1523286 - RNA, 19 nt, Homo sapiens
ucuauaaaccuuucaguag

SEQ ID NO: 1523287 - RNA, 19 nt, Homo sapiens
gacauuagcaagcauaguc

SEQ ID NO: 1523288 - RNA, 19 nt, Homo sapiens
ggcgugacauugacacuag

SEQ ID NO: 1523289 - RNA, 19 nt, Homo sapiens
guauuucccucuguacugu

SEQ ID NO: 1523290 - RNA, 19 nt, Homo sapiens
ccucaaagacaauucauag

SEQ ID NO: 1523291 - RNA, 19 nt, Homo sapiens
uaugguagauauugaaggu

SEQ ID NO: 1523292 - RNA, 19 nt, Homo sapiens
gcagagggaucagaauagc

SEQ ID NO: 1523293 - RNA, 19 nt, Homo sapiens
ugaugaaauucgucaggaa

SEQ ID NO: 1523294 - RNA, 19 nt, Homo sapiens
cauaaagcucucagaaaga

SEQ ID NO: 1523295 - RNA, 19 nt, Homo sapiens
guaagcuucucuaaauagg

SEQ ID NO: 1523296 - RNA, 19 nt, Homo sapiens
cagcuacuguauguaugua

SEQ ID NO: 1523297 - RNA, 19 nt, Homo sapiens
gaacuagcugauaauaaag

SEQ ID NO: 1523298 - RNA, 19 nt, Homo sapiens
ggaugauauucucuugguu

SEQ ID NO: 1523299 - RNA, 19 nt, Homo sapiens
cuauggaagaggagaaaua

SEQ ID NO: 1523300 - RNA, 19 nt, Homo sapiens
agggauaacugcucaugau

SEQ ID NO: 1523301 - RNA, 19 nt, Homo sapiens
ccacauaaacagcaacaag

SEQ ID NO: 1523302 - RNA, 19 nt, Homo sapiens
ccaaauaugcccacuugag

SEQ ID NO: 1523303 - RNA, 19 nt, Homo sapiens
ugaaauucgucaggaacaa

SEQ ID NO: 1523304 - RNA, 19 nt, Homo sapiens
gaagaaacaggugcuaaaa

SEQ ID NO: 1523305 - RNA, 19 nt, Homo sapiens
agagaugccuaaaauguuu

SEQ ID NO: 1523306 - RNA, 19 nt, Homo sapiens
aaacacacauaaaguucca

SEQ ID NO: 1523307 - RNA, 19 nt, Homo sapiens
gggauaacugcucaugauu

SEQ ID NO: 1523308 - RNA, 19 nt, Homo sapiens
cacauaaacagcaacaaga

SEQ ID NO: 1523309 - RNA, 19 nt, Homo sapiens
ugacagcuacgcaccagaa

SEQ ID NO: 1523310 - RNA, 19 nt, Homo sapiens
guuccugacuacaaugaug

SEQ ID NO: 1523311 - RNA, 19 nt, Homo sapiens
uaaggaagaagaacuaagg

SEQ ID NO: 1523312 - RNA, 19 nt, Homo sapiens
cuuaagagaugccuaaaau

SEQ ID NO: 1523313 - RNA, 19 nt, Homo sapiens
ucaguaggaugauauucuc

SEQ ID NO: 1523314 - RNA, 19 nt, Homo sapiens
ugauuccugucaagcagua

SEQ ID NO: 1523315 - RNA, 19 nt, Homo sapiens
aagugugccugaauacuau

SEQ ID NO: 1523316 - RNA, 19 nt, Homo sapiens
uaagaaagcuccagaauuc

SEQ ID NO: 1523317 - RNA, 19 nt, Homo sapiens
gaaacacacugucauuuau

SEQ ID NO: 1523318 - RNA, 19 nt, Homo sapiens
ugacagcaguuaagaauuu

SEQ ID NO: 1523319 - RNA, 19 nt, Homo sapiens
ggaaauaacaguugaugaa

SEQ ID NO: 1523320 - RNA, 19 nt, Homo sapiens
ugaaacacacugucauuua

SEQ ID NO: 1523321 - RNA, 19 nt, Homo sapiens
cuacucagcugugaccuua

SEQ ID NO: 1523322 - RNA, 19 nt, Homo sapiens
uaucugguaugucuaagua

SEQ ID NO: 1523323 - RNA, 19 nt, Homo sapiens
cagaggaccuggauagaga

SEQ ID NO: 1523324 - RNA, 19 nt, Homo sapiens
gcagacaggcugagaauuc

SEQ ID NO: 1523325 - RNA, 19 nt, Homo sapiens
guaagaaagcuccagaauu

SEQ ID NO: 1523326 - RNA, 19 nt, Homo sapiens
gcugugaccuuacuuaugg

SEQ ID NO: 1523327 - RNA, 19 nt, Homo sapiens
ggaggacagugacaaguuc

SEQ ID NO: 1523328 - RNA, 19 nt, Homo sapiens
ggaauuuauugcuccugua

SEQ ID NO: 1523329 - RNA, 19 nt, Homo sapiens
ggaccuggauagagauguu

SEQ ID NO: 1523330 - RNA, 19 nt, Homo sapiens
ugaauuacauggaggacaa

SEQ ID NO: 1523331 - RNA, 19 nt, Homo sapiens
gaagacauaagaagccaaa

SEQ ID NO: 1523332 - RNA, 19 nt, Homo sapiens
uguaauaucugguaugucu

SEQ ID NO: 1523333 - RNA, 19 nt, Homo sapiens
agucacaccucuaaauuug

SEQ ID NO: 1523334 - RNA, 19 nt, Homo sapiens
ccacaaggauuuccagaac

SEQ ID NO: 1523335 - RNA, 19 nt, Homo sapiens
gugacaaguucauaccuaa

SEQ ID NO: 1523336 - RNA, 19 nt, Homo sapiens
gcaccuugucuuccaguua

SEQ ID NO: 1523337 - RNA, 19 nt, Homo sapiens
ggagggcagucgcuguuug

SEQ ID NO: 1523338 - RNA, 19 nt, Homo sapiens
ggacagugacaaguucaua

SEQ ID NO: 1523339 - RNA, 19 nt, Homo sapiens
uguaucagcucccaccaaa

SEQ ID NO: 1523340 - RNA, 19 nt, Homo sapiens
uagcugaaguucuggaaau

SEQ ID NO: 1523341 - RNA, 19 nt, Homo sapiens
gaaucuguguggcauuugu

SEQ ID NO: 1523342 - RNA, 19 nt, Homo sapiens
aaagagaaauagcugaagu

SEQ ID NO: 1523343 - RNA, 19 nt, Homo sapiens
gagucacaccucuaaauuu

SEQ ID NO: 1523344 - RNA, 19 nt, Homo sapiens
agaauucucuuugaucaug

SEQ ID NO: 1523345 - RNA, 19 nt, Homo sapiens
ccagcugacuuuccguaaa

SEQ ID NO: 1523346 - RNA, 19 nt, Homo sapiens
ccagagagcagucagaauc

SEQ ID NO: 1523347 - RNA, 19 nt, Homo sapiens
gagugucccuggagacuuc

SEQ ID NO: 1523348 - RNA, 19 nt, Homo sapiens
caacugaaacacacuguca

SEQ ID NO: 1523349 - RNA, 19 nt, Homo sapiens
gaauucucuuugaucauga

SEQ ID NO: 1523350 - RNA, 19 nt, Homo sapiens
uugguaaucugaagucuga

SEQ ID NO: 1523351 - RNA, 19 nt, Homo sapiens
aaacguacgugggcaugaa

SEQ ID NO: 1523352 - RNA, 19 nt, Homo sapiens
gaauuuauugcuccuguau

SEQ ID NO: 1523353 - RNA, 19 nt, Homo sapiens
ggcaacgugaucugaauua

SEQ ID NO: 1523354 - RNA, 19 nt, Homo sapiens
uaaacucgcauuaggauuc

SEQ ID NO: 1523355 - RNA, 19 nt, Homo sapiens
ccaggucaauuuaacuugu

SEQ ID NO: 1523356 - RNA, 19 nt, Homo sapiens
aaacucgcgaugaaacuua

SEQ ID NO: 1523357 - RNA, 19 nt, Homo sapiens
ugugaaaucucuucuugca

SEQ ID NO: 1523358 - RNA, 19 nt, Homo sapiens
ucugguaugucuaaguaaa

SEQ ID NO: 1523359 - RNA, 19 nt, Homo sapiens
gaugaaaacuugguaaucu

SEQ ID NO: 1523360 - RNA, 19 nt, Homo sapiens
gauguuucccugaccauug

SEQ ID NO: 1523361 - RNA, 19 nt, Homo sapiens
acaaggauuuccagaacug

SEQ ID NO: 1523362 - RNA, 19 nt, Homo sapiens
guacgugggcaugaaguaa

SEQ ID NO: 1523363 - RNA, 19 nt, Homo sapiens
gggaggacagugacaaguu

SEQ ID NO: 1523364 - RNA, 19 nt, Homo sapiens
ggaugggcuuguccucaga

SEQ ID NO: 1523365 - RNA, 19 nt, Homo sapiens
gcaggcaacgugaucugaa

SEQ ID NO: 1523366 - RNA, 19 nt, Homo sapiens
ggagaggaccacggaguga

SEQ ID NO: 1523367 - RNA, 19 nt, Homo sapiens
guugaggccacaaggauuu

SEQ ID NO: 1523368 - RNA, 19 nt, Homo sapiens
uaucagcucccaccaaauc

SEQ ID NO: 1523369 - RNA, 19 nt, Homo sapiens
gcugaaguucuggaaauaa

SEQ ID NO: 1523370 - RNA, 19 nt, Homo sapiens
gggcgguccaggucaauuu

SEQ ID NO: 1523371 - RNA, 19 nt, Homo sapiens
gcugugugcucccgaugau

SEQ ID NO: 1523372 - RNA, 19 nt, Homo sapiens
cagcugacuuuccguaaac

SEQ ID NO: 1523373 - RNA, 19 nt, Homo sapiens
gcaacgugaucugaauuac

SEQ ID NO: 1523374 - RNA, 19 nt, Homo sapiens
aggaaucuguguggcauuu

SEQ ID NO: 1523375 - RNA, 19 nt, Homo sapiens
agugacaaguucauaccua

SEQ ID NO: 1523376 - RNA, 19 nt, Homo sapiens
gcaaguggaaguucaaagc

SEQ ID NO: 1523377 - RNA, 19 nt, Homo sapiens
cagcauccaggaaagguaa

SEQ ID NO: 1523378 - RNA, 19 nt, Homo sapiens
caggcaacgugaucugaau

SEQ ID NO: 1523379 - RNA, 19 nt, Homo sapiens
aacgugaucugaauuacau

SEQ ID NO: 1523380 - RNA, 19 nt, Homo sapiens
caacgugaucugaauuaca

SEQ ID NO: 1523381 - RNA, 19 nt, Homo sapiens
gcaccaggaugggcuuguc

SEQ ID NO: 1523382 - RNA, 19 nt, Homo sapiens
gaagccaaacccacaccaa

SEQ ID NO: 1523383 - RNA, 19 nt, Homo sapiens
auugugaaaucucuucuug

SEQ ID NO: 1523384 - RNA, 19 nt, Homo sapiens
aaacacacugucauuuaug

SEQ ID NO: 1523385 - RNA, 19 nt, Homo sapiens
ccucagccuugaagagugu

SEQ ID NO: 1523386 - RNA, 19 nt, Homo sapiens
gaccuuacuuauggugaug

SEQ ID NO: 1523387 - RNA, 19 nt, Homo sapiens
aaaugcaaguggaaguuca

SEQ ID NO: 1523388 - RNA, 19 nt, Homo sapiens
caguaaaacucgcgaugaa

SEQ ID NO: 1523389 - RNA, 19 nt, Homo sapiens
caccuugucuuccaguuac

SEQ ID NO: 1523390 - RNA, 19 nt, Homo sapiens
ucagcugugaccuuacuua

SEQ ID NO: 1523391 - RNA, 19 nt, Homo sapiens
gcuguuuggguccacguua

SEQ ID NO: 1523392 - RNA, 19 nt, Homo sapiens
caagccaccagguucuaaa

SEQ ID NO: 1523393 - RNA, 19 nt, Homo sapiens
cagacaggcugagaauucu

SEQ ID NO: 1523394 - RNA, 19 nt, Homo sapiens
cauccaggaaagguaauua

SEQ ID NO: 1523395 - RNA, 19 nt, Homo sapiens
ugacaaguucauaccuaaa

SEQ ID NO: 1523396 - RNA, 19 nt, Homo sapiens
ugcuaacucucucuuacaa

SEQ ID NO: 1523397 - RNA, 19 nt, Homo sapiens
ggcgguccaggucaauuua

SEQ ID NO: 1523398 - RNA, 19 nt, Homo sapiens
guucuggaaauaacaguug

SEQ ID NO: 1523399 - RNA, 19 nt, Homo sapiens
ugaccuuacuuauggugau

SEQ ID NO: 1523400 - RNA, 19 nt, Homo sapiens
gacaagccaccagguucua

SEQ ID NO: 1523401 - RNA, 19 nt, Homo sapiens
uuaccuagaucugcuaacu

SEQ ID NO: 1523402 - RNA, 19 nt, Homo sapiens
auuuauugcuccuguauca

SEQ ID NO: 1523403 - RNA, 19 nt, Homo sapiens
aagccaaacccacaccaaa

SEQ ID NO: 1523404 - RNA, 19 nt, Homo sapiens
ccacgggaagacauaagaa

SEQ ID NO: 1523405 - RNA, 19 nt, Homo sapiens
gccacaaggauuuccagaa

SEQ ID NO: 1523406 - RNA, 19 nt, Homo sapiens
gacaaguucauaccuaaac

SEQ ID NO: 1523407 - RNA, 19 nt, Homo sapiens
gucugaauccuccuacuga

SEQ ID NO: 1523408 - RNA, 19 nt, Homo sapiens
guccucagauccaguuguc

SEQ ID NO: 1523409 - RNA, 19 nt, Homo sapiens
cagagagcagucagaauca

SEQ ID NO: 1523410 - RNA, 19 nt, Homo sapiens
gcccagagagcagucagaa

SEQ ID NO: 1523411 - RNA, 19 nt, Homo sapiens
caaagccucagccuugaag

SEQ ID NO: 1523412 - RNA, 19 nt, Homo sapiens
cugaaacacacugucauuu

SEQ ID NO: 1523413 - RNA, 19 nt, Homo sapiens
cagcugugaccuuacuuau

SEQ ID NO: 1523414 - RNA, 19 nt, Homo sapiens
cguaaacucgcauuaggau

SEQ ID NO: 1523415 - RNA, 19 nt, Homo sapiens
gaaguucuggaaauaacag

SEQ ID NO: 1523416 - RNA, 19 nt, Homo sapiens
gggaaucgcucuuauuuau

SEQ ID NO: 1523417 - RNA, 19 nt, Homo sapiens
cagcaaagaugaguaaugu

SEQ ID NO: 1523418 - RNA, 19 nt, Homo sapiens
caucaaagccgucaucuuc

SEQ ID NO: 1523419 - RNA, 19 nt, Homo sapiens
cuacgaagccuuugucauu

SEQ ID NO: 1523420 - RNA, 19 nt, Homo sapiens
ggaaucgcucuuauuuaua

SEQ ID NO: 1523421 - RNA, 19 nt, Homo sapiens
ggacugcuacgaagccuuu

SEQ ID NO: 1523422 - RNA, 19 nt, Homo sapiens
ggagcaacguuacaucauc

SEQ ID NO: 1523423 - RNA, 19 nt, Homo sapiens
gcaaagaugaguaaugucu

SEQ ID NO: 1523424 - RNA, 19 nt, Homo sapiens
acgaagccuuugucauuua

SEQ ID NO: 1523425 - RNA, 19 nt, Homo sapiens
uaccagaacuucaucaucu

SEQ ID NO: 1523426 - RNA, 19 nt, Homo sapiens
gugggaaucgcucuuauuu

SEQ ID NO: 1523427 - RNA, 19 nt, Homo sapiens
gagaagggcccacgugucu

SEQ ID NO: 1523428 - RNA, 19 nt, Homo sapiens
ccugagagcccaccuguga

SEQ ID NO: 1523429 - RNA, 19 nt, Homo sapiens
cagagaagaaggagaauuc

SEQ ID NO: 1523430 - RNA, 19 nt, Homo sapiens
uacgaagccuuugucauuu

SEQ ID NO: 1523431 - RNA, 19 nt, Homo sapiens
ucaaguuccucaccaucaa

SEQ ID NO: 1523432 - RNA, 19 nt, Homo sapiens
guggaaagcccaucaaguc

SEQ ID NO: 1523433 - RNA, 19 nt, Homo sapiens
ccaugagaaugaccagcua

SEQ ID NO: 1523434 - RNA, 19 nt, Homo sapiens
gcagagaagaaggagaauu

SEQ ID NO: 1523435 - RNA, 19 nt, Homo sapiens
gagccuguguuuccaguac

SEQ ID NO: 1523436 - RNA, 19 nt, Homo sapiens
uggcugagauucguggaaa

SEQ ID NO: 1523437 - RNA, 19 nt, Homo sapiens
caucauggcugagauucgu

SEQ ID NO: 1523438 - RNA, 19 nt, Homo sapiens
gagggcaccugagccaauc

SEQ ID NO: 1523439 - RNA, 19 nt, Homo sapiens
gcugugggaaucgcucuua

SEQ ID NO: 1523440 - RNA, 19 nt, Homo sapiens
ucggagaccaccaguacua

SEQ ID NO: 1523441 - RNA, 19 nt, Homo sapiens
ugggaaucgcucuuauuua

SEQ ID NO: 1523442 - RNA, 19 nt, Homo sapiens
ggucagacucccugguuca

SEQ ID NO: 1523443 - RNA, 19 nt, Homo sapiens
ccagcaaagaugaguaaug

SEQ ID NO: 1523444 - RNA, 19 nt, Homo sapiens
cgaagccuuugucauuuac

SEQ ID NO: 1523445 - RNA, 19 nt, Homo sapiens
gcaggacgccauccacaac

SEQ ID NO: 1523446 - RNA, 19 nt, Homo sapiens
caaguuccucaccaucaaa

SEQ ID NO: 1523447 - RNA, 19 nt, Homo sapiens
ccacguggccaugagaaug

SEQ ID NO: 1523448 - RNA, 19 nt, Homo sapiens
ggacgccauccacaacuuc

SEQ ID NO: 1523449 - RNA, 19 nt, Homo sapiens
ggccgcagauggaccacau

SEQ ID NO: 1523450 - RNA, 19 nt, Homo sapiens
caggagcaacguuacauca

SEQ ID NO: 1523451 - RNA, 19 nt, Homo sapiens
acgcagagaagaaggagaa

SEQ ID NO: 1523452 - RNA, 19 nt, Homo sapiens
caucauccuccaggcauuu

SEQ ID NO: 1523453 - RNA, 19 nt, Homo sapiens
ugccacaggagcaacguua

SEQ ID NO: 1523454 - RNA, 19 nt, Homo sapiens
cccaccaacuccugccaaa

SEQ ID NO: 1523455 - RNA, 19 nt, Homo sapiens
ucaaagccgucaucuuccu

SEQ ID NO: 1523456 - RNA, 19 nt, Homo sapiens
ccaucauccuccaggcauu

SEQ ID NO: 1523457 - RNA, 19 nt, Homo sapiens
ccacaggagcaacguuaca

SEQ ID NO: 1523458 - RNA, 19 nt, Homo sapiens
cacguggccaugagaauga

SEQ ID NO: 1523459 - RNA, 19 nt, Homo sapiens
ucaccugccaccagaucua

SEQ ID NO: 1523460 - RNA, 19 nt, Homo sapiens
uuaaacaccuuggauuuuc

SEQ ID NO: 1523461 - RNA, 19 nt, Homo sapiens
gagcugcgagugggucaga

SEQ ID NO: 1523462 - RNA, 19 nt, Homo sapiens
uaugugacccucaucuaca

SEQ ID NO: 1523463 - RNA, 19 nt, Homo sapiens
caccaacuccugccaaagg

SEQ ID NO: 1523464 - RNA, 19 nt, Homo sapiens
cggaggagcucuaccagua

SEQ ID NO: 1523465 - RNA, 19 nt, Homo sapiens
guggaccgcuacuuccuua

SEQ ID NO: 1523466 - RNA, 19 nt, Homo sapiens
gcuacuuccuuauggcuaa

SEQ ID NO: 1523467 - RNA, 19 nt, Homo sapiens
gcaagacuaccuccuguuc

SEQ ID NO: 1523468 - RNA, 19 nt, Homo sapiens
ucugggagaugcucaaguu

SEQ ID NO: 1523469 - RNA, 19 nt, Homo sapiens
ccaggaggccguguaauga

SEQ ID NO: 1523470 - RNA, 19 nt, Homo sapiens
gccaggaggccguguaaug

SEQ ID NO: 1523471 - RNA, 19 nt, Homo sapiens
ggaccgcuacuuccuuaug

SEQ ID NO: 1523472 - RNA, 19 nt, Homo sapiens
acacacuccucucaagcaa

SEQ ID NO: 1523473 - RNA, 19 nt, Homo sapiens
gaccgcuacuuccuuaugg

SEQ ID NO: 1523474 - RNA, 19 nt, Homo sapiens
acacuccucucaagcaaaa

SEQ ID NO: 1523475 - RNA, 19 nt, Homo sapiens
gaccacacacuccucucaa

SEQ ID NO: 1523476 - RNA, 19 nt, Homo sapiens
ugggagaugcucaaguuug

SEQ ID NO: 1523477 - RNA, 19 nt, Homo sapiens
gagaagcuguugauaguau

SEQ ID NO: 1523478 - RNA, 19 nt, Homo sapiens
cgaaucaacuccaguguga

SEQ ID NO: 1523479 - RNA, 19 nt, Homo sapiens
cagcugagcacccgaauaa

SEQ ID NO: 1523480 - RNA, 19 nt, Homo sapiens
ugaaucagaucaucaagga

SEQ ID NO: 1523481 - RNA, 19 nt, Homo sapiens
uaacgggagugacaacaug

SEQ ID NO: 1523482 - RNA, 19 nt, Homo sapiens
gaagaaaauugcagaaaag

SEQ ID NO: 1523483 - RNA, 19 nt, Homo sapiens
gaucaagugcugcuuccua

SEQ ID NO: 1523484 - RNA, 19 nt, Homo sapiens
gccaacgucuuccgaauca

SEQ ID NO: 1523485 - RNA, 19 nt, Homo sapiens
gcaaggagaagcuguugau

SEQ ID NO: 1523486 - RNA, 19 nt, Homo sapiens
gcuauggaguggugcagaa

SEQ ID NO: 1523487 - RNA, 19 nt, Homo sapiens
gcaauggacccgagagcuu

SEQ ID NO: 1523488 - RNA, 19 nt, Homo sapiens
cagaugccauucagugcua

SEQ ID NO: 1523489 - RNA, 19 nt, Homo sapiens
ggaguccgcugcguuguca

SEQ ID NO: 1523490 - RNA, 19 nt, Homo sapiens
aggagaagcuguugauagu

SEQ ID NO: 1523491 - RNA, 19 nt, Homo sapiens
gcagauggagagcaacuug

SEQ ID NO: 1523492 - RNA, 19 nt, Homo sapiens
aauaaaccgcuguggcuua

SEQ ID NO: 1523493 - RNA, 19 nt, Homo sapiens
caagugcugcuuccuauca

SEQ ID NO: 1523494 - RNA, 19 nt, Homo sapiens
uugccgagcuggcugauga

SEQ ID NO: 1523495 - RNA, 19 nt, Homo sapiens
gcggagccuucaguccuua

SEQ ID NO: 1523496 - RNA, 19 nt, Homo sapiens
ugaaugcgcugggcuacug

SEQ ID NO: 1523497 - RNA, 19 nt, Homo sapiens
ggagaagcuguugauagua

SEQ ID NO: 1523498 - RNA, 19 nt, Homo sapiens
ucuguaagaagaugucaua

SEQ ID NO: 1523499 - RNA, 19 nt, Homo sapiens
gauguuggaccgaguaugg

SEQ ID NO: 1523500 - RNA, 19 nt, Homo sapiens
ccuaucagcuggagucacu

SEQ ID NO: 1523501 - RNA, 19 nt, Homo sapiens
caaggagaagcuguugaua

SEQ ID NO: 1523502 - RNA, 19 nt, Homo sapiens
cgagcuggcugaugaugag

SEQ ID NO: 1523503 - RNA, 19 nt, Homo sapiens
gcucucagaugccauucag

SEQ ID NO: 1523504 - RNA, 19 nt, Homo sapiens
gaagcuguugauaguauug

SEQ ID NO: 1523505 - RNA, 19 nt, Homo sapiens
ucacugcccugcuugucau

SEQ ID NO: 1523506 - RNA, 19 nt, Homo sapiens
gcccugccaucuguaagaa

SEQ ID NO: 1523507 - RNA, 19 nt, Homo sapiens
gcacaaguggcgggaccua

SEQ ID NO: 1523508 - RNA, 19 nt, Homo sapiens
ccugccaucuguaagaaga

SEQ ID NO: 1523509 - RNA, 19 nt, Homo sapiens
gaugaugagaaggucuuua

SEQ ID NO: 1523510 - RNA, 19 nt, Homo sapiens
gcugagcacccgaauaaac

SEQ ID NO: 1523511 - RNA, 19 nt, Homo sapiens
gagcaaggagaagcuguug

SEQ ID NO: 1523512 - RNA, 19 nt, Homo sapiens
gagaccaacaagaccauug

SEQ ID NO: 1523513 - RNA, 19 nt, Homo sapiens
ccgaggugcugguguccaa

SEQ ID NO: 1523514 - RNA, 19 nt, Homo sapiens
ggcaccaacuccagagaca

SEQ ID NO: 1523515 - RNA, 19 nt, Homo sapiens
uggagucacugcccugcuu

SEQ ID NO: 1523516 - RNA, 19 nt, Homo sapiens
agaagcuguugauaguauu

SEQ ID NO: 1523517 - RNA, 19 nt, Homo sapiens
ucccggacaucacugaaga

SEQ ID NO: 1523518 - RNA, 19 nt, Homo sapiens
ucaccuggccugcaaugga

SEQ ID NO: 1523519 - RNA, 19 nt, Homo sapiens
gaugagaaggucuuuaacg

SEQ ID NO: 1523520 - RNA, 19 nt, Homo sapiens
gcacagcaggagaccaaca

SEQ ID NO: 1523521 - RNA, 19 nt, Homo sapiens
gaugucggccaacgucuuc

SEQ ID NO: 1523522 - RNA, 19 nt, Homo sapiens
caacuccagagacacaaga

SEQ ID NO: 1523523 - RNA, 19 nt, Homo sapiens
caacuugcuggaugugaau

SEQ ID NO: 1523524 - RNA, 19 nt, Homo sapiens
augaugagaaggucuuuaa

SEQ ID NO: 1523525 - RNA, 19 nt, Homo sapiens
ccaccucuguccgaaagug

SEQ ID NO: 1523526 - RNA, 19 nt, Homo sapiens
ggugucagagcaaggagaa

SEQ ID NO: 1523527 - RNA, 19 nt, Homo sapiens
aaggagaagcuguugauag

SEQ ID NO: 1523528 - RNA, 19 nt, Homo sapiens
cagcaggagaccaacaaga

SEQ ID NO: 1523529 - RNA, 19 nt, Homo sapiens
agaagaggaagcccaacuu

SEQ ID NO: 1523530 - RNA, 19 nt, Homo sapiens
cggcacagcaggagaccaa

SEQ ID NO: 1523531 - RNA, 19 nt, Homo sapiens
ccucaucacccaccauugg

SEQ ID NO: 1523532 - RNA, 19 nt, Homo sapiens
ccagcuccgugaagcagau

SEQ ID NO: 1523533 - RNA, 19 nt, Homo sapiens
cggccaacgucuuccgaau

SEQ ID NO: 1523534 - RNA, 19 nt, Homo sapiens
ccagcugagcacccgaaua

SEQ ID NO: 1523535 - RNA, 19 nt, Homo sapiens
gagcaggugguggccaaga

SEQ ID NO: 1523536 - RNA, 19 nt, Homo sapiens
aucaagugcugcuuccuau

SEQ ID NO: 1523537 - RNA, 19 nt, Homo sapiens
guauugaagccagccuuga

SEQ ID NO: 1523538 - RNA, 19 nt, Homo sapiens
cuagauguuggaccgagua

SEQ ID NO: 1523539 - RNA, 19 nt, Homo sapiens
gcuagaaacuugcuuauaa

SEQ ID NO: 1523540 - RNA, 19 nt, Homo sapiens
guaggaaucugaaaucaaa

SEQ ID NO: 1523541 - RNA, 19 nt, Homo sapiens
ugaaguaccugcaggauuu

SEQ ID NO: 1523542 - RNA, 19 nt, Homo sapiens
gagcaagguuaaccacaua

SEQ ID NO: 1523543 - RNA, 19 nt, Homo sapiens
cguaugaucuuugcauuua

SEQ ID NO: 1523544 - RNA, 19 nt, Homo sapiens
gaaugagccugguggguuu

SEQ ID NO: 1523545 - RNA, 19 nt, Homo sapiens
guagucagauuccauggua

SEQ ID NO: 1523546 - RNA, 19 nt, Homo sapiens
ucacagcacuuguucacua

SEQ ID NO: 1523547 - RNA, 19 nt, Homo sapiens
cgaguugugucacgaaaua

SEQ ID NO: 1523548 - RNA, 19 nt, Homo sapiens
cuaaguaggugaugcauug

SEQ ID NO: 1523549 - RNA, 19 nt, Homo sapiens
guuaacagcuagaaacuug

SEQ ID NO: 1523550 - RNA, 19 nt, Homo sapiens
ggucaacacuacuauucua

SEQ ID NO: 1523551 - RNA, 19 nt, Homo sapiens
guggugacauuuauaagua

SEQ ID NO: 1523552 - RNA, 19 nt, Homo sapiens
gcucugauauguauugguu

SEQ ID NO: 1523553 - RNA, 19 nt, Homo sapiens
cagaaagccugagguuuaa

SEQ ID NO: 1523554 - RNA, 19 nt, Homo sapiens
gaagagcugguucuaaaga

SEQ ID NO: 1523555 - RNA, 19 nt, Homo sapiens
agacagacauuaaaucaca

SEQ ID NO: 1523556 - RNA, 19 nt, Homo sapiens
uuaaugguuucuccacuua

SEQ ID NO: 1523557 - RNA, 19 nt, Homo sapiens
gagcaggauucgauucaga

SEQ ID NO: 1523558 - RNA, 19 nt, Homo sapiens
gggaaaugguaaagagaaa

SEQ ID NO: 1523559 - RNA, 19 nt, Homo sapiens
guaaggugguucuaacuca

SEQ ID NO: 1523560 - RNA, 19 nt, Homo sapiens
gcuagaauaugugaaugaa

SEQ ID NO: 1523561 - RNA, 19 nt, Homo sapiens
gaauguuguuuacguugaa

SEQ ID NO: 1523562 - RNA, 19 nt, Homo sapiens
caucugagagccaauagua

SEQ ID NO: 1523563 - RNA, 19 nt, Homo sapiens
agagggagguggugacauu

SEQ ID NO: 1523564 - RNA, 19 nt, Homo sapiens
gaaaugguaaagagaaaga

SEQ ID NO: 1523565 - RNA, 19 nt, Homo sapiens
gauauguauugguuucuug

SEQ ID NO: 1523566 - RNA, 19 nt, Homo sapiens
gugaugcauuguugaagua

SEQ ID NO: 1523567 - RNA, 19 nt, Homo sapiens
ggaaugggucuuaaaguca

SEQ ID NO: 1523568 - RNA, 19 nt, Homo sapiens
ucugaugucuuccgaggua

SEQ ID NO: 1523569 - RNA, 19 nt, Homo sapiens
cuuaucaucugcuaacauu

SEQ ID NO: 1523570 - RNA, 19 nt, Homo sapiens
gggagguggugacauuuau

SEQ ID NO: 1523571 - RNA, 19 nt, Homo sapiens
ggagcuagagcaagguuaa

SEQ ID NO: 1523572 - RNA, 19 nt, Homo sapiens
gagguggugacauuuauaa

SEQ ID NO: 1523573 - RNA, 19 nt, Homo sapiens
ccgcuuuccucaccacaua

SEQ ID NO: 1523574 - RNA, 19 nt, Homo sapiens
cuuaugcucugauauguau

SEQ ID NO: 1523575 - RNA, 19 nt, Homo sapiens
gcaagcauucucccuaaga

SEQ ID NO: 1523576 - RNA, 19 nt, Homo sapiens
gggagagucuuaucaucug

SEQ ID NO: 1523577 - RNA, 19 nt, Homo sapiens
guagacauuucuggaauuc

SEQ ID NO: 1523578 - RNA, 19 nt, Homo sapiens
guggugauguuucuuuaug

SEQ ID NO: 1523579 - RNA, 19 nt, Homo sapiens
guaccuacaguaugcuaua

SEQ ID NO: 1523580 - RNA, 19 nt, Homo sapiens
ccacauaugcucugguuuc

SEQ ID NO: 1523581 - RNA, 19 nt, Homo sapiens
cgugucggcugaagaugua

SEQ ID NO: 1523582 - RNA, 19 nt, Homo sapiens
gaguucauuugguguagaa

SEQ ID NO: 1523583 - RNA, 19 nt, Homo sapiens
caucagggcauuagagaga

SEQ ID NO: 1523584 - RNA, 19 nt, Homo sapiens
cuaagaauguuguuuacgu

SEQ ID NO: 1523585 - RNA, 19 nt, Homo sapiens
ccuacaguaugcuauauug

SEQ ID NO: 1523586 - RNA, 19 nt, Homo sapiens
ggugaugcauuguugaagu

SEQ ID NO: 1523587 - RNA, 19 nt, Homo sapiens
uaagcaacauagugucuuc

SEQ ID NO: 1523588 - RNA, 19 nt, Homo sapiens
ggagguggugacauuuaua

SEQ ID NO: 1523589 - RNA, 19 nt, Homo sapiens
ucacuuaugcucugauaug

SEQ ID NO: 1523590 - RNA, 19 nt, Homo sapiens
gaaaacuaauguagccaaa

SEQ ID NO: 1523591 - RNA, 19 nt, Homo sapiens
ccuggacuccuuuguauuu

SEQ ID NO: 1523592 - RNA, 19 nt, Homo sapiens
ccugguggguuuacuguga

SEQ ID NO: 1523593 - RNA, 19 nt, Homo sapiens
guagagacagacauuaaau

SEQ ID NO: 1523594 - RNA, 19 nt, Homo sapiens
uauagcauguagucagauu

SEQ ID NO: 1523595 - RNA, 19 nt, Homo sapiens
uggaaugggucuuaaaguc

SEQ ID NO: 1523596 - RNA, 19 nt, Homo sapiens
cugcuaacauuucaacaug

SEQ ID NO: 1523597 - RNA, 19 nt, Homo sapiens
gcaacauagugucuucuac

SEQ ID NO: 1523598 - RNA, 19 nt, Homo sapiens
gaacuucucccugcugucu

SEQ ID NO: 1523599 - RNA, 19 nt, Homo sapiens
gagacaguuuugcuucuua

SEQ ID NO: 1523600 - RNA, 19 nt, Homo sapiens
ggugauguuucuuuaugau

SEQ ID NO: 1523601 - RNA, 19 nt, Homo sapiens
ucauuugccuuaauugaag

SEQ ID NO: 1523602 - RNA, 19 nt, Homo sapiens
agaauguuguuuacguuga

SEQ ID NO: 1523603 - RNA, 19 nt, Homo sapiens
aggcaagcauucucccuaa

SEQ ID NO: 1523604 - RNA, 19 nt, Homo sapiens
uaguagagacagacauuaa

SEQ ID NO: 1523605 - RNA, 19 nt, Homo sapiens
gcuaacauuucaacaugag

SEQ ID NO: 1523606 - RNA, 19 nt, Homo sapiens
ucucacuuaugcucugaua

SEQ ID NO: 1523607 - RNA, 19 nt, Homo sapiens
auagaugccugaccagugu

SEQ ID NO: 1523608 - RNA, 19 nt, Homo sapiens
uuacaaauuucacgcacau

SEQ ID NO: 1523609 - RNA, 19 nt, Homo sapiens
ggucuuaaagucagguuug

SEQ ID NO: 1523610 - RNA, 19 nt, Homo sapiens
ucaguaaggugguucuaac

SEQ ID NO: 1523611 - RNA, 19 nt, Homo sapiens
uaguagacauuucuggaau

SEQ ID NO: 1523612 - RNA, 19 nt, Homo sapiens
gcacugcuuuaguagacau

SEQ ID NO: 1523613 - RNA, 19 nt, Homo sapiens
cuucugcucugaugucuuc

SEQ ID NO: 1523614 - RNA, 19 nt, Homo sapiens
ucccuaagaauguuguuua

SEQ ID NO: 1523615 - RNA, 19 nt, Homo sapiens
gaccggagcaggauucgau

SEQ ID NO: 1523616 - RNA, 19 nt, Homo sapiens
uccauuauuuccucauuug

SEQ ID NO: 1523617 - RNA, 19 nt, Homo sapiens
agagacagacauuaaauca

SEQ ID NO: 1523618 - RNA, 19 nt, Homo sapiens
gaagauggugggagagucu

SEQ ID NO: 1523619 - RNA, 19 nt, Homo sapiens
uuaaaucacagcacuuguu

SEQ ID NO: 1523620 - RNA, 19 nt, Homo sapiens
uaaaucacagcacuuguuc

SEQ ID NO: 1523621 - RNA, 19 nt, Homo sapiens
caacaugagacaccacaca

SEQ ID NO: 1523622 - RNA, 19 nt, Homo sapiens
uaucaucugcuaacauuuc

SEQ ID NO: 1523623 - RNA, 19 nt, Homo sapiens
ccaacugguuuucuucuuu

SEQ ID NO: 1523624 - RNA, 19 nt, Homo sapiens
gaagacagcgauggaggau

SEQ ID NO: 1523625 - RNA, 19 nt, Homo sapiens
uaauguagccaaaccaucu

SEQ ID NO: 1523626 - RNA, 19 nt, Homo sapiens
cuuaaugguuucuccacuu

SEQ ID NO: 1523627 - RNA, 19 nt, Homo sapiens
cuuauagcauguagucaga

SEQ ID NO: 1523628 - RNA, 19 nt, Homo sapiens
ugguuucuccacuuaauua

SEQ ID NO: 1523629 - RNA, 19 nt, Homo sapiens
gcaagguuaaccacauaug

SEQ ID NO: 1523630 - RNA, 19 nt, Homo sapiens
uggauggacuggagcuaga

SEQ ID NO: 1523631 - RNA, 19 nt, Homo sapiens
ucugauauguauugguuuc

SEQ ID NO: 1523632 - RNA, 19 nt, Homo sapiens
auucagagccaacugguuu

SEQ ID NO: 1523633 - RNA, 19 nt, Homo sapiens
gaucaaggucgaguugugu

SEQ ID NO: 1523634 - RNA, 19 nt, Homo sapiens
ugaucaaggucgaguugug

SEQ ID NO: 1523635 - RNA, 19 nt, Homo sapiens
uauccuggacuccuuugua

SEQ ID NO: 1523636 - RNA, 19 nt, Homo sapiens
aguaggugaugcauuguug

SEQ ID NO: 1523637 - RNA, 19 nt, Homo sapiens
acucauaguuguucauacu

SEQ ID NO: 1523638 - RNA, 19 nt, Homo sapiens
cacauaugcucugguuuca

SEQ ID NO: 1523639 - RNA, 19 nt, Homo sapiens
gaaagugucucucauuuag

SEQ ID NO: 1523640 - RNA, 19 nt, Homo sapiens
ggaaggaacaggaugauua

SEQ ID NO: 1523641 - RNA, 19 nt, Homo sapiens
gaacuuggauggugaugug

SEQ ID NO: 1523642 - RNA, 19 nt, Homo sapiens
uuaaagcucuugacaguga

SEQ ID NO: 1523643 - RNA, 19 nt, Homo sapiens
gauggaaucuccuuugcaa

SEQ ID NO: 1523644 - RNA, 19 nt, Homo sapiens
gaggacgggcucauuauua

SEQ ID NO: 1523645 - RNA, 19 nt, Homo sapiens
ggaaaccuauuacuacuac

SEQ ID NO: 1523646 - RNA, 19 nt, Homo sapiens
ggauauugaccuuaaauug

SEQ ID NO: 1523647 - RNA, 19 nt, Homo sapiens
gaccuuaaauuggaucuug

SEQ ID NO: 1523648 - RNA, 19 nt, Homo sapiens
ugaaucaaaugcugaacuu

SEQ ID NO: 1523649 - RNA, 19 nt, Homo sapiens
gaaaaugcauuauccagau

SEQ ID NO: 1523650 - RNA, 19 nt, Homo sapiens
gcaaagaacuggggaugaa

SEQ ID NO: 1523651 - RNA, 19 nt, Homo sapiens
gagaguuugugguggcuuu

SEQ ID NO: 1523652 - RNA, 19 nt, Homo sapiens
uaaagugguugaaggaaca

SEQ ID NO: 1523653 - RNA, 19 nt, Homo sapiens
gagggugacugauggaauc

SEQ ID NO: 1523654 - RNA, 19 nt, Homo sapiens
agucauaccugaaacaauc

SEQ ID NO: 1523655 - RNA, 19 nt, Homo sapiens
gaaggaacaggaugauuag

SEQ ID NO: 1523656 - RNA, 19 nt, Homo sapiens
gauauugaccuuaaauugg

SEQ ID NO: 1523657 - RNA, 19 nt, Homo sapiens
agaaagugucucucauuua

SEQ ID NO: 1523658 - RNA, 19 nt, Homo sapiens
agaguaaagucacugaaga

SEQ ID NO: 1523659 - RNA, 19 nt, Homo sapiens
auugagagaucacgaugua

SEQ ID NO: 1523660 - RNA, 19 nt, Homo sapiens
caggaggaauuacaacuuc

SEQ ID NO: 1523661 - RNA, 19 nt, Homo sapiens
caacauaaaugggaaaccu

SEQ ID NO: 1523662 - RNA, 19 nt, Homo sapiens
gagagaucacgauguaauu

SEQ ID NO: 1523663 - RNA, 19 nt, Homo sapiens
uguuaaagcucuugacagu

SEQ ID NO: 1523664 - RNA, 19 nt, Homo sapiens
gaaggaacagcugcucaaa

SEQ ID NO: 1523665 - RNA, 19 nt, Homo sapiens
guuugcagguccagaguaa

SEQ ID NO: 1523666 - RNA, 19 nt, Homo sapiens
uuaugaagcuguugucaag

SEQ ID NO: 1523667 - RNA, 19 nt, Homo sapiens
uggaaucuccuuugcaauu

SEQ ID NO: 1523668 - RNA, 19 nt, Homo sapiens
ggaaccagcaguggauuga

SEQ ID NO: 1523669 - RNA, 19 nt, Homo sapiens
ugaacuuccuguacugaug

SEQ ID NO: 1523670 - RNA, 19 nt, Homo sapiens
gggaaaccuauuacuacua

SEQ ID NO: 1523671 - RNA, 19 nt, Homo sapiens
gaagcuguugucaaggaua

SEQ ID NO: 1523672 - RNA, 19 nt, Homo sapiens
caguggcucuggguucaua

SEQ ID NO: 1523673 - RNA, 19 nt, Homo sapiens
gaugaaaggaaaggcguuu

SEQ ID NO: 1523674 - RNA, 19 nt, Homo sapiens
ugagagaucacgauguaau

SEQ ID NO: 1523675 - RNA, 19 nt, Homo sapiens
ggaauugucagcaccaaac

SEQ ID NO: 1523676 - RNA, 19 nt, Homo sapiens
ccuucgggcuggagaguuu

SEQ ID NO: 1523677 - RNA, 19 nt, Homo sapiens
auaauuugcuccugacagu

SEQ ID NO: 1523678 - RNA, 19 nt, Homo sapiens
gaagaguggaagcgaggaa

SEQ ID NO: 1523679 - RNA, 19 nt, Homo sapiens
aaugggaaaccuauuacua

SEQ ID NO: 1523680 - RNA, 19 nt, Homo sapiens
gagaucacgauguaauugu

SEQ ID NO: 1523681 - RNA, 19 nt, Homo sapiens
cgaggaaggaacaggauga

SEQ ID NO: 1523682 - RNA, 19 nt, Homo sapiens
aagugucucucauuuagga

SEQ ID NO: 1523683 - RNA, 19 nt, Homo sapiens
aggaacagcugcucaaagc

SEQ ID NO: 1523684 - RNA, 19 nt, Homo sapiens
guacugaugcugggaagau

SEQ ID NO: 1523685 - RNA, 19 nt, Homo sapiens
gagcaccagaugaaaggaa

SEQ ID NO: 1523686 - RNA, 19 nt, Homo sapiens
gugguccucuggugaacuu

SEQ ID NO: 1523687 - RNA, 19 nt, Homo sapiens
ggauucagauauggacuac

SEQ ID NO: 1523688 - RNA, 19 nt, Homo sapiens
cacagcuacugcaggaauu

SEQ ID NO: 1523689 - RNA, 19 nt, Homo sapiens
ccagauuucccugauguga

SEQ ID NO: 1523690 - RNA, 19 nt, Homo sapiens
gaacuggggaugaaggauu

SEQ ID NO: 1523691 - RNA, 19 nt, Homo sapiens
uugcggugauuaagauuga

SEQ ID NO: 1523692 - RNA, 19 nt, Homo sapiens
aagcuguugucaaggauau

SEQ ID NO: 1523693 - RNA, 19 nt, Homo sapiens
ugaaggaacagcugcucaa

SEQ ID NO: 1523694 - RNA, 19 nt, Homo sapiens
agauuucccugaugugagu

SEQ ID NO: 1523695 - RNA, 19 nt, Homo sapiens
ugacagugauucccuuucc

SEQ ID NO: 1523696 - RNA, 19 nt, Homo sapiens
gaucacgauguaauuguca

SEQ ID NO: 1523697 - RNA, 19 nt, Homo sapiens
gaaauaucugggucugcaa

SEQ ID NO: 1523698 - RNA, 19 nt, Homo sapiens
gagguggugcuccagaaug

SEQ ID NO: 1523699 - RNA, 19 nt, Homo sapiens
ucaggaggaauuacaacuu

SEQ ID NO: 1523700 - RNA, 19 nt, Homo sapiens
uaaaugggaaaccuauuac

SEQ ID NO: 1523701 - RNA, 19 nt, Homo sapiens
gaugugaguucugggguuu

SEQ ID NO: 1523702 - RNA, 19 nt, Homo sapiens
augaagcuguugucaagga

SEQ ID NO: 1523703 - RNA, 19 nt, Homo sapiens
guuaugaagcuguugucaa

SEQ ID NO: 1523704 - RNA, 19 nt, Homo sapiens
cuauuacuacuacaacuga

SEQ ID NO: 1523705 - RNA, 19 nt, Homo sapiens
gaguaaagucacugaagag

SEQ ID NO: 1523706 - RNA, 19 nt, Homo sapiens
cuuggauggugaugugauu

SEQ ID NO: 1523707 - RNA, 19 nt, Homo sapiens
ggaggaauuacaacuucau

SEQ ID NO: 1523708 - RNA, 19 nt, Homo sapiens
ccuuugcaauuccuucaga

SEQ ID NO: 1523709 - RNA, 19 nt, Homo sapiens
uauuaccaaugcccauguu

SEQ ID NO: 1523710 - RNA, 19 nt, Homo sapiens
aggacgggcucauuauuac

SEQ ID NO: 1523711 - RNA, 19 nt, Homo sapiens
uacaguggcucuggguuca

SEQ ID NO: 1523712 - RNA, 19 nt, Homo sapiens
uauccagauuucccugaug

SEQ ID NO: 1523713 - RNA, 19 nt, Homo sapiens
ucauugagggugacugaug

SEQ ID NO: 1523714 - RNA, 19 nt, Homo sapiens
gaauugucagcaccaaaca

SEQ ID NO: 1523715 - RNA, 19 nt, Homo sapiens
gaaaccuauuacuacuaca

SEQ ID NO: 1523716 - RNA, 19 nt, Homo sapiens
ugggaaaccuauuacuacu

SEQ ID NO: 1523717 - RNA, 19 nt, Homo sapiens
cauaaaugggaaaccuauu

SEQ ID NO: 1523718 - RNA, 19 nt, Homo sapiens
acauaaaugggaaaccuau

SEQ ID NO: 1523719 - RNA, 19 nt, Homo sapiens
agagaucacgauguaauug

SEQ ID NO: 1523720 - RNA, 19 nt, Homo sapiens
cagaguaaagucacugaag

SEQ ID NO: 1523721 - RNA, 19 nt, Homo sapiens
cagaucgaguuaggcaguu

SEQ ID NO: 1523722 - RNA, 19 nt, Homo sapiens
acacagcuacugcaggaau

SEQ ID NO: 1523723 - RNA, 19 nt, Homo sapiens
aauuggaucuugcggugau

SEQ ID NO: 1523724 - RNA, 19 nt, Homo sapiens
gcaaaugcugucccucacu

SEQ ID NO: 1523725 - RNA, 19 nt, Homo sapiens
aaauaucugggucugcaaa

SEQ ID NO: 1523726 - RNA, 19 nt, Homo sapiens
auucagauauggacuacgu

SEQ ID NO: 1523727 - RNA, 19 nt, Homo sapiens
ucaggaaccagcaguggau

SEQ ID NO: 1523728 - RNA, 19 nt, Homo sapiens
gacagugauucccuuucca

SEQ ID NO: 1523729 - RNA, 19 nt, Homo sapiens
gcuguugucaaggauauug

SEQ ID NO: 1523730 - RNA, 19 nt, Homo sapiens
ugaagcuguugucaaggau

SEQ ID NO: 1523731 - RNA, 19 nt, Homo sapiens
gaagaggaauucccaagua

SEQ ID NO: 1523732 - RNA, 19 nt, Homo sapiens
gaacuuguguacugaaaga

SEQ ID NO: 1523733 - RNA, 19 nt, Homo sapiens
gaauccaccuguauaauga

SEQ ID NO: 1523734 - RNA, 19 nt, Homo sapiens
ccaaagaaaugucaauguu

SEQ ID NO: 1523735 - RNA, 19 nt, Homo sapiens
gcagaugaauuauugcaaa

SEQ ID NO: 1523736 - RNA, 19 nt, Homo sapiens
ccaaauacguuccaaagga

SEQ ID NO: 1523737 - RNA, 19 nt, Homo sapiens
caaauugccucgaacaguu

SEQ ID NO: 1523738 - RNA, 19 nt, Homo sapiens
gaucguaauuccagagaaa

SEQ ID NO: 1523739 - RNA, 19 nt, Homo sapiens
guacauacccuacucgaaa

SEQ ID NO: 1523740 - RNA, 19 nt, Homo sapiens
gaagauauggguucaauca

SEQ ID NO: 1523741 - RNA, 19 nt, Homo sapiens
ggagggaaaugaaaucugu

SEQ ID NO: 1523742 - RNA, 19 nt, Homo sapiens
caauguguauuacucguua

SEQ ID NO: 1523743 - RNA, 19 nt, Homo sapiens
gaggaauacugcaauuuga

SEQ ID NO: 1523744 - RNA, 19 nt, Homo sapiens
ccaauggugugaagacuuu

SEQ ID NO: 1523745 - RNA, 19 nt, Homo sapiens
ugaggcagaugaauuauug

SEQ ID NO: 1523746 - RNA, 19 nt, Homo sapiens
ugcaaagacugucaaauuu

SEQ ID NO: 1523747 - RNA, 19 nt, Homo sapiens
ggacauggagugugugauu

SEQ ID NO: 1523748 - RNA, 19 nt, Homo sapiens
gaaagagcaucugggaaga

SEQ ID NO: 1523749 - RNA, 19 nt, Homo sapiens
ccagauuuauuuccucuuu

SEQ ID NO: 1523750 - RNA, 19 nt, Homo sapiens
ggaaucugcaguugaauuu

SEQ ID NO: 1523751 - RNA, 19 nt, Homo sapiens
gaaaacaccuggcuucuag

SEQ ID NO: 1523752 - RNA, 19 nt, Homo sapiens
ccuaaggccucaugauauu

SEQ ID NO: 1523753 - RNA, 19 nt, Homo sapiens
gaauugagccucuggaauc

SEQ ID NO: 1523754 - RNA, 19 nt, Homo sapiens
ggucacagcugaaagaaac

SEQ ID NO: 1523755 - RNA, 19 nt, Homo sapiens
gaaucuaaaucggaaggua

SEQ ID NO: 1523756 - RNA, 19 nt, Homo sapiens
gaaauacaaucucaaucag

SEQ ID NO: 1523757 - RNA, 19 nt, Homo sapiens
guaacaaccgcaauaguuu

SEQ ID NO: 1523758 - RNA, 19 nt, Homo sapiens
ggaacaauguguauuacuc

SEQ ID NO: 1523759 - RNA, 19 nt, Homo sapiens
ggaggcauuugcaguuauu

SEQ ID NO: 1523760 - RNA, 19 nt, Homo sapiens
uaagaggaauacugcaauu

SEQ ID NO: 1523761 - RNA, 19 nt, Homo sapiens
ggaaaagguucaagaaaug

SEQ ID NO: 1523762 - RNA, 19 nt, Homo sapiens
caaauacguuccaaaggau

SEQ ID NO: 1523763 - RNA, 19 nt, Homo sapiens
ucaauggacuuucaugcaa

SEQ ID NO: 1523764 - RNA, 19 nt, Homo sapiens
ggaauacugcaauuugaaa

SEQ ID NO: 1523765 - RNA, 19 nt, Homo sapiens
ccaaguagcgaaucuaaau

SEQ ID NO: 1523766 - RNA, 19 nt, Homo sapiens
gcuauaagccuccaaacug

SEQ ID NO: 1523767 - RNA, 19 nt, Homo sapiens
ggacugugcugcaaagacu

SEQ ID NO: 1523768 - RNA, 19 nt, Homo sapiens
gaaagaacaaccaauggau

SEQ ID NO: 1523769 - RNA, 19 nt, Homo sapiens
gaagguagcacacagacau

SEQ ID NO: 1523770 - RNA, 19 nt, Homo sapiens
ccucauugcucuuccuauu

SEQ ID NO: 1523771 - RNA, 19 nt, Homo sapiens
ccugcaagcuguugugauu

SEQ ID NO: 1523772 - RNA, 19 nt, Homo sapiens
ucugauagcaugauaguaa

SEQ ID NO: 1523773 - RNA, 19 nt, Homo sapiens
gugaugugauuuaugcuuu

SEQ ID NO: 1523774 - RNA, 19 nt, Homo sapiens
caauggacuuucaugcaaa

SEQ ID NO: 1523775 - RNA, 19 nt, Homo sapiens
aauggaagcucaccagaau

SEQ ID NO: 1523776 - RNA, 19 nt, Homo sapiens
ugucaaaugucuucagaau

SEQ ID NO: 1523777 - RNA, 19 nt, Homo sapiens
gacaguacccaaacacaaa

SEQ ID NO: 1523778 - RNA, 19 nt, Homo sapiens
ggacaguacccaaacacaa

SEQ ID NO: 1523779 - RNA, 19 nt, Homo sapiens
gcuucuagguuuccucauu

SEQ ID NO: 1523780 - RNA, 19 nt, Homo sapiens
cugcaaagacugucaaauu

SEQ ID NO: 1523781 - RNA, 19 nt, Homo sapiens
gaacugugguagggauaga

SEQ ID NO: 1523782 - RNA, 19 nt, Homo sapiens
gaauaagccacaaaugcaa

SEQ ID NO: 1523783 - RNA, 19 nt, Homo sapiens
ucaauguucacccaauuua

SEQ ID NO: 1523784 - RNA, 19 nt, Homo sapiens
caaaugacaguucagaaau

SEQ ID NO: 1523785 - RNA, 19 nt, Homo sapiens
gauuuaugcuuucguacga

SEQ ID NO: 1523786 - RNA, 19 nt, Homo sapiens
aaaugugggugucaaaugu

SEQ ID NO: 1523787 - RNA, 19 nt, Homo sapiens
gcaauccaauggugugaag

SEQ ID NO: 1523788 - RNA, 19 nt, Homo sapiens
ugccugcuaugaagaaaua

SEQ ID NO: 1523789 - RNA, 19 nt, Homo sapiens
acaaaugacaguucagaaa

SEQ ID NO: 1523790 - RNA, 19 nt, Homo sapiens
cuucagauauucagacuca

SEQ ID NO: 1523791 - RNA, 19 nt, Homo sapiens
caaacacaaagcaguagua

SEQ ID NO: 1523792 - RNA, 19 nt, Homo sapiens
uagcaaauccaaaucagaa

SEQ ID NO: 1523793 - RNA, 19 nt, Homo sapiens
ggauggaggaaucuuauau

SEQ ID NO: 1523794 - RNA, 19 nt, Homo sapiens
caauagaugagaaacugua

SEQ ID NO: 1523795 - RNA, 19 nt, Homo sapiens
ugacaucgcugaaaauugu

SEQ ID NO: 1523796 - RNA, 19 nt, Homo sapiens
ggugucaaaugucuucaga

SEQ ID NO: 1523797 - RNA, 19 nt, Homo sapiens
gaaaugucaauguucagaa

SEQ ID NO: 1523798 - RNA, 19 nt, Homo sapiens
ggaguuauggucagaugaa

SEQ ID NO: 1523799 - RNA, 19 nt, Homo sapiens
acagaagccugaaagaaca

SEQ ID NO: 1523800 - RNA, 19 nt, Homo sapiens
cagcugaaagaaacaauaa

SEQ ID NO: 1523801 - RNA, 19 nt, Homo sapiens
gaaggcaacggauaacauc

SEQ ID NO: 1523802 - RNA, 19 nt, Homo sapiens
gcaaauccaaaucagaaga

SEQ ID NO: 1523803 - RNA, 19 nt, Homo sapiens
gauacuagcaaauccaaau

SEQ ID NO: 1523804 - RNA, 19 nt, Homo sapiens
agauauggguucaaucaug

SEQ ID NO: 1523805 - RNA, 19 nt, Homo sapiens
ccuggaacaauguguauua

SEQ ID NO: 1523806 - RNA, 19 nt, Homo sapiens
gagcaucugggaagacuga

SEQ ID NO: 1523807 - RNA, 19 nt, Homo sapiens
uguggaagauuaguuugua

SEQ ID NO: 1523808 - RNA, 19 nt, Homo sapiens
cgaaagcacauccugaaug

SEQ ID NO: 1523809 - RNA, 19 nt, Homo sapiens
caaagaaaugucaauguuc

SEQ ID NO: 1523810 - RNA, 19 nt, Homo sapiens
gcacucagucugggaauau

SEQ ID NO: 1523811 - RNA, 19 nt, Homo sapiens
agauaacucuggaggcauu

SEQ ID NO: 1523812 - RNA, 19 nt, Homo sapiens
cuauugugcugucaucauu

SEQ ID NO: 1523813 - RNA, 19 nt, Homo sapiens
gggcucugauagcaugaua

SEQ ID NO: 1523814 - RNA, 19 nt, Homo sapiens
aaccagcuguuccagauuu

SEQ ID NO: 1523815 - RNA, 19 nt, Homo sapiens
ucuggaaucugcaguugaa

SEQ ID NO: 1523816 - RNA, 19 nt, Homo sapiens
gagucucgcuaagaaauga

SEQ ID NO: 1523817 - RNA, 19 nt, Homo sapiens
acacaaagcaguaguaacu

SEQ ID NO: 1523818 - RNA, 19 nt, Homo sapiens
uguguagaaucaaggauaa

SEQ ID NO: 1523819 - RNA, 19 nt, Homo sapiens
ucagaauccaccuguauaa

SEQ ID NO: 1523820 - RNA, 19 nt, Homo sapiens
ccuccaaacugccaaauac

SEQ ID NO: 1523821 - RNA, 19 nt, Homo sapiens
gacuacaaauugccucgaa

SEQ ID NO: 1523822 - RNA, 19 nt, Homo sapiens
gguccugacauaacuuuaa

SEQ ID NO: 1523823 - RNA, 19 nt, Homo sapiens
caaauacaaaugacaguuc

SEQ ID NO: 1523824 - RNA, 19 nt, Homo sapiens
gaaguugugcaauccaaug

SEQ ID NO: 1523825 - RNA, 19 nt, Homo sapiens
gacagaagccugaaagaac

SEQ ID NO: 1523826 - RNA, 19 nt, Homo sapiens
caaaccagaucagaaagca

SEQ ID NO: 1523827 - RNA, 19 nt, Homo sapiens
ugacaguucagaaauagaa

SEQ ID NO: 1523828 - RNA, 19 nt, Homo sapiens
gcaaagacugucaaauuuu

SEQ ID NO: 1523829 - RNA, 19 nt, Homo sapiens
ugacagaagccugaaagaa

SEQ ID NO: 1523830 - RNA, 19 nt, Homo sapiens
gaaggcagcacucagacau

SEQ ID NO: 1523831 - RNA, 19 nt, Homo sapiens
gaaugaaucuccagaaaua

SEQ ID NO: 1523832 - RNA, 19 nt, Homo sapiens
ggaaagccguccucccuua

SEQ ID NO: 1523833 - RNA, 19 nt, Homo sapiens
aaacagacauggagaauga

SEQ ID NO: 1523834 - RNA, 19 nt, Homo sapiens
ggaagagaaucuacuguug

SEQ ID NO: 1523835 - RNA, 19 nt, Homo sapiens
gcuaagccaugaacaguuu

SEQ ID NO: 1523836 - RNA, 19 nt, Homo sapiens
gaauguaacaccagaagua

SEQ ID NO: 1523837 - RNA, 19 nt, Homo sapiens
gagcauauguggaaaugau

SEQ ID NO: 1523838 - RNA, 19 nt, Homo sapiens
gaagucagcuuguggaaaa

SEQ ID NO: 1523839 - RNA, 19 nt, Homo sapiens
cagcagagccuacagcuaa

SEQ ID NO: 1523840 - RNA, 19 nt, Homo sapiens
gaaagaauucccaaagaga

SEQ ID NO: 1523841 - RNA, 19 nt, Homo sapiens
gaagagaaucuacuguuga

SEQ ID NO: 1523842 - RNA, 19 nt, Homo sapiens
gaagaggaccaacgcauug

SEQ ID NO: 1523843 - RNA, 19 nt, Homo sapiens
gagcauccauacuaaugaa

SEQ ID NO: 1523844 - RNA, 19 nt, Homo sapiens
ggacagaagucagcuugug

SEQ ID NO: 1523845 - RNA, 19 nt, Homo sapiens
gaugaagccucuaggaaca

SEQ ID NO: 1523846 - RNA, 19 nt, Homo sapiens
uagaaagaauucccaaaga

SEQ ID NO: 1523847 - RNA, 19 nt, Homo sapiens
gaaggauguuucuguguuc

SEQ ID NO: 1523848 - RNA, 19 nt, Homo sapiens
ggaaaagccuguuaugaau

SEQ ID NO: 1523849 - RNA, 19 nt, Homo sapiens
ggaagucaguuuguggaaa

SEQ ID NO: 1523850 - RNA, 19 nt, Homo sapiens
ggaaggaagucaguuugug

SEQ ID NO: 1523851 - RNA, 19 nt, Homo sapiens
ccagaaauauuggaaggaa

SEQ ID NO: 1523852 - RNA, 19 nt, Homo sapiens
gagagggacuggaggaauc

SEQ ID NO: 1523853 - RNA, 19 nt, Homo sapiens
ucaggagcauccauacuaa

SEQ ID NO: 1523854 - RNA, 19 nt, Homo sapiens
gagaagugguggaccuuuc

SEQ ID NO: 1523855 - RNA, 19 nt, Homo sapiens
uaaggagugugguuauaga

SEQ ID NO: 1523856 - RNA, 19 nt, Homo sapiens
uagugaagcuugugguuau

SEQ ID NO: 1523857 - RNA, 19 nt, Homo sapiens
cagcguaacuucaaaugag

SEQ ID NO: 1523858 - RNA, 19 nt, Homo sapiens
gagaugaagccucuaggaa

SEQ ID NO: 1523859 - RNA, 19 nt, Homo sapiens
caaucaggguccacagaaa

SEQ ID NO: 1523860 - RNA, 19 nt, Homo sapiens
gggaaaagguggaaacaga

SEQ ID NO: 1523861 - RNA, 19 nt, Homo sapiens
guagugaagcuugugguua

SEQ ID NO: 1523862 - RNA, 19 nt, Homo sapiens
gaaggaaagaagaaagaug

SEQ ID NO: 1523863 - RNA, 19 nt, Homo sapiens
cugcagagcuggagaaacu

SEQ ID NO: 1523864 - RNA, 19 nt, Homo sapiens
ggauguuucuguguucuug

SEQ ID NO: 1523865 - RNA, 19 nt, Homo sapiens
agaaagaauucccaaagag

SEQ ID NO: 1523866 - RNA, 19 nt, Homo sapiens
gggaagagaaucuacuguu

SEQ ID NO: 1523867 - RNA, 19 nt, Homo sapiens
guuucuguguucuugauua

SEQ ID NO: 1523868 - RNA, 19 nt, Homo sapiens
uguaaggagugugguuaua

SEQ ID NO: 1523869 - RNA, 19 nt, Homo sapiens
caggaaacauggagcagau

SEQ ID NO: 1523870 - RNA, 19 nt, Homo sapiens
ccagaaguauuggacagaa

SEQ ID NO: 1523871 - RNA, 19 nt, Homo sapiens
gggcugaaaccaaagaaga

SEQ ID NO: 1523872 - RNA, 19 nt, Homo sapiens
gcauccagcacgaaaugua

SEQ ID NO: 1523873 - RNA, 19 nt, Homo sapiens
gagcauccagcacgaaaug

SEQ ID NO: 1523874 - RNA, 19 nt, Homo sapiens
ggaaacagacauggagaau

SEQ ID NO: 1523875 - RNA, 19 nt, Homo sapiens
gcacagugggaaaggauga

SEQ ID NO: 1523876 - RNA, 19 nt, Homo sapiens
ugaagcuugugguuaugua

SEQ ID NO: 1523877 - RNA, 19 nt, Homo sapiens
ggcaggagcauauguggaa

SEQ ID NO: 1523878 - RNA, 19 nt, Homo sapiens
ggaaacauggagcagauuc

SEQ ID NO: 1523879 - RNA, 19 nt, Homo sapiens
aagagaaucuacuguugau

SEQ ID NO: 1523880 - RNA, 19 nt, Homo sapiens
gaaacagacauggagaaug

SEQ ID NO: 1523881 - RNA, 19 nt, Homo sapiens
ggagcauccauacuaauga

SEQ ID NO: 1523882 - RNA, 19 nt, Homo sapiens
gcacugggaagagaaucua

SEQ ID NO: 1523883 - RNA, 19 nt, Homo sapiens
uguaacaccagaaguauug

SEQ ID NO: 1523884 - RNA, 19 nt, Homo sapiens
aaagaauucccaaagagaa

SEQ ID NO: 1523885 - RNA, 19 nt, Homo sapiens
ugaaggggcugaaaccaaa

SEQ ID NO: 1523886 - RNA, 19 nt, Homo sapiens
gcaggagcauauguggaaa

SEQ ID NO: 1523887 - RNA, 19 nt, Homo sapiens
agaagaaacaggagaagug

SEQ ID NO: 1523888 - RNA, 19 nt, Homo sapiens
ugaagaggaccaacgcauu

SEQ ID NO: 1523889 - RNA, 19 nt, Homo sapiens
gaaacauggagcagauuca

SEQ ID NO: 1523890 - RNA, 19 nt, Homo sapiens
gcaggcagcaguagagaag

SEQ ID NO: 1523891 - RNA, 19 nt, Homo sapiens
cagaaggaaagaagaaaga

SEQ ID NO: 1523892 - RNA, 19 nt, Homo sapiens
agaaugagaaagugaguga

SEQ ID NO: 1523893 - RNA, 19 nt, Homo sapiens
gagugugguuauagagaga

SEQ ID NO: 1523894 - RNA, 19 nt, Homo sapiens
caacugcagaagaaaguga

SEQ ID NO: 1523895 - RNA, 19 nt, Homo sapiens
gugguuauguaucuuaucu

SEQ ID NO: 1523896 - RNA, 19 nt, Homo sapiens
cagcagaaggaaagaagaa

SEQ ID NO: 1523897 - RNA, 19 nt, Homo sapiens
gccaugaacaguuuucuua

SEQ ID NO: 1523898 - RNA, 19 nt, Homo sapiens
agacauggagaaugagaaa

SEQ ID NO: 1523899 - RNA, 19 nt, Homo sapiens
ccaaucaggguccacagaa

SEQ ID NO: 1523900 - RNA, 19 nt, Homo sapiens
gccuacagcuaaugguguu

SEQ ID NO: 1523901 - RNA, 19 nt, Homo sapiens
cagcagcgcccucaacaag

SEQ ID NO: 1523902 - RNA, 19 nt, Homo sapiens
uacaaaagcucaagguuuc

SEQ ID NO: 1523903 - RNA, 19 nt, Homo sapiens
gguuauagagagacuguug

SEQ ID NO: 1523904 - RNA, 19 nt, Homo sapiens
guaaggagugugguuauag

SEQ ID NO: 1523905 - RNA, 19 nt, Homo sapiens
ugaaaccaaagaagaagaa

SEQ ID NO: 1523906 - RNA, 19 nt, Homo sapiens
gaaggaauaguuggaagca

SEQ ID NO: 1523907 - RNA, 19 nt, Homo sapiens
ggaggucacugagaaucca

SEQ ID NO: 1523908 - RNA, 19 nt, Homo sapiens
gcagaaggaaagaagaaag

SEQ ID NO: 1523909 - RNA, 19 nt, Homo sapiens
ucaaccagguggcaaagag

SEQ ID NO: 1523910 - RNA, 19 nt, Homo sapiens
ggagaagugguggaccuuu

SEQ ID NO: 1523911 - RNA, 19 nt, Homo sapiens
gaaaccaaagaagaagaaa

SEQ ID NO: 1523912 - RNA, 19 nt, Homo sapiens
aaaagccuguuaugaauga

SEQ ID NO: 1523913 - RNA, 19 nt, Homo sapiens
gagaauguaacaccagaag

SEQ ID NO: 1523914 - RNA, 19 nt, Homo sapiens
gcagccacauagauagaag

SEQ ID NO: 1523915 - RNA, 19 nt, Homo sapiens
cguucugacucugcaaaua

SEQ ID NO: 1523916 - RNA, 19 nt, Homo sapiens
aggaacaacugagaacguu

SEQ ID NO: 1523917 - RNA, 19 nt, Homo sapiens
cuagaaagaauucccaaag

SEQ ID NO: 1523918 - RNA, 19 nt, Homo sapiens
ugaaucuccagaaauauug

SEQ ID NO: 1523919 - RNA, 19 nt, Homo sapiens
gaagcuugugguuauguau

SEQ ID NO: 1523920 - RNA, 19 nt, Homo sapiens
agaagaagaaacaggagaa

SEQ ID NO: 1523921 - RNA, 19 nt, Homo sapiens
gcauccauacuaaugaaga

SEQ ID NO: 1523922 - RNA, 19 nt, Homo sapiens
gcagagcuggagaaacuuc

SEQ ID NO: 1523923 - RNA, 19 nt, Homo sapiens
cacaugcacugggaagaga

SEQ ID NO: 1523924 - RNA, 19 nt, Homo sapiens
caauuuccaaagagaauga

SEQ ID NO: 1523925 - RNA, 19 nt, Homo sapiens
ggagagggacuggaggaau

SEQ ID NO: 1523926 - RNA, 19 nt, Homo sapiens
ggaaccaugagaaggaugu

SEQ ID NO: 1523927 - RNA, 19 nt, Homo sapiens
gagagacuguuggaaccau

SEQ ID NO: 1523928 - RNA, 19 nt, Homo sapiens
gaagaagaaacaggagaag

SEQ ID NO: 1523929 - RNA, 19 nt, Homo sapiens
ccauaaaacuccugaaggu

SEQ ID NO: 1523930 - RNA, 19 nt, Homo sapiens
agaaugaaucuccagaaau

SEQ ID NO: 1523931 - RNA, 19 nt, Homo sapiens
gcaaugcuaugauuaacuu

SEQ ID NO: 1523932 - RNA, 19 nt, Homo sapiens
gacagacgcugguguauag

SEQ ID NO: 1523933 - RNA, 19 nt, Homo sapiens
gaacugauaaggaugagaa

SEQ ID NO: 1523934 - RNA, 19 nt, Homo sapiens
caacaaguuuacacugauu

SEQ ID NO: 1523935 - RNA, 19 nt, Homo sapiens
caaaggcggugcccaggaa

SEQ ID NO: 1523936 - RNA, 19 nt, Homo sapiens
cgaccaaccugcauucaug

SEQ ID NO: 1523937 - RNA, 19 nt, Homo sapiens
ggacagacgcugguguaua

SEQ ID NO: 1523938 - RNA, 19 nt, Homo sapiens
gcgcaagccuaacgaccua

SEQ ID NO: 1523939 - RNA, 19 nt, Homo sapiens
gcugcaagcaccugaguua

SEQ ID NO: 1523940 - RNA, 19 nt, Homo sapiens
ugcaguaucucuucauuga

SEQ ID NO: 1523941 - RNA, 19 nt, Homo sapiens
ccucuggucuuuccuguug

SEQ ID NO: 1523942 - RNA, 19 nt, Homo sapiens
gacggugacugguacuuug

SEQ ID NO: 1523943 - RNA, 19 nt, Homo sapiens
acaauaaccugcagacacu

SEQ ID NO: 1523944 - RNA, 19 nt, Homo sapiens
acaccgaccuggaguuugu

SEQ ID NO: 1523945 - RNA, 19 nt, Homo sapiens
uauacgaaguuauggauca

SEQ ID NO: 1523946 - RNA, 19 nt, Homo sapiens
ccaacaaguuuacacugau

SEQ ID NO: 1523947 - RNA, 19 nt, Homo sapiens
uuacucaacuccaacaagu

SEQ ID NO: 1523948 - RNA, 19 nt, Homo sapiens
gcgcauaacuucguauagc

SEQ ID NO: 1523949 - RNA, 19 nt, Homo sapiens
ggucguggcccagcuguuu

SEQ ID NO: 1523950 - RNA, 19 nt, Homo sapiens
gaagugggacuauguugag

SEQ ID NO: 1523951 - RNA, 19 nt, Homo sapiens
uccaacaaguuuacacuga

SEQ ID NO: 1523952 - RNA, 19 nt, Homo sapiens
agccauaucugucaugcuu

SEQ ID NO: 1523953 - RNA, 19 nt, Homo sapiens
ggacauccugaaugacuug

SEQ ID NO: 1523954 - RNA, 19 nt, Homo sapiens
gcaagcaccugaguuaccu

SEQ ID NO: 1523955 - RNA, 19 nt, Homo sapiens
gcauacauuauacgaaguu

SEQ ID NO: 1523956 - RNA, 19 nt, Homo sapiens
ucaccaggcugcaagacau

SEQ ID NO: 1523957 - RNA, 19 nt, Homo sapiens
ggacggacacacucauuac

SEQ ID NO: 1523958 - RNA, 19 nt, Homo sapiens
ucacugcaaucagcaugaa

SEQ ID NO: 1523959 - RNA, 19 nt, Homo sapiens
gaugagggacgacagaagu

SEQ ID NO: 1523960 - RNA, 19 nt, Homo sapiens
uuuggcggcucuuacauuu

SEQ ID NO: 1523961 - RNA, 19 nt, Homo sapiens
cagcuucgagacuaugaua

SEQ ID NO: 1523962 - RNA, 19 nt, Homo sapiens
cuacuccagugaccucuau

SEQ ID NO: 1523963 - RNA, 19 nt, Homo sapiens
gggcaacucacucaacugu

SEQ ID NO: 1523964 - RNA, 19 nt, Homo sapiens
ccaggcacccgucaucuau

SEQ ID NO: 1523965 - RNA, 19 nt, Homo sapiens
cauaacuucguauagcaua

SEQ ID NO: 1523966 - RNA, 19 nt, Homo sapiens
ccuguuaccuugccucucu

SEQ ID NO: 1523967 - RNA, 19 nt, Homo sapiens
caaaucggccgagcucgaa

SEQ ID NO: 1523968 - RNA, 19 nt, Homo sapiens
aaugacaucugggcacuau

SEQ ID NO: 1523969 - RNA, 19 nt, Homo sapiens
cugcaguucuuguuacuca

SEQ ID NO: 1523970 - RNA, 19 nt, Homo sapiens
gcucacccauggacagaag

SEQ ID NO: 1523971 - RNA, 19 nt, Homo sapiens
ggacaccuaacgcccaguu

SEQ ID NO: 1523972 - RNA, 19 nt, Homo sapiens
gcacccagaagcaguuugu

SEQ ID NO: 1523973 - RNA, 19 nt, Homo sapiens
gauugcaucaccacagauu

SEQ ID NO: 1523974 - RNA, 19 nt, Homo sapiens
ggugaaugccgccuucuca

SEQ ID NO: 1523975 - RNA, 19 nt, Homo sapiens
ugaagugggacuauguuga

SEQ ID NO: 1523976 - RNA, 19 nt, Homo sapiens
caacagcagcagaagcaau

SEQ ID NO: 1523977 - RNA, 19 nt, Homo sapiens
gugcauacaagcagauuca

SEQ ID NO: 1523978 - RNA, 19 nt, Homo sapiens
ugacaccgaccuggaguuu

SEQ ID NO: 1523979 - RNA, 19 nt, Homo sapiens
ugucgcaccugcaguaucu

SEQ ID NO: 1523980 - RNA, 19 nt, Homo sapiens
cagaagaccuccccucauc

SEQ ID NO: 1523981 - RNA, 19 nt, Homo sapiens
cggacggacacacucauua

SEQ ID NO: 1523982 - RNA, 19 nt, Homo sapiens
gcugagcccuuccucuacu

SEQ ID NO: 1523983 - RNA, 19 nt, Homo sapiens
ucgauugcaucaccacaga

SEQ ID NO: 1523984 - RNA, 19 nt, Homo sapiens
aauaacaacagcagcagaa

SEQ ID NO: 1523985 - RNA, 19 nt, Homo sapiens
cggacacacucauuacaca

SEQ ID NO: 1523986 - RNA, 19 nt, Homo sapiens
aggaggacgugcaucauca

SEQ ID NO: 1523987 - RNA, 19 nt, Homo sapiens
gaagacaagcgaccaaccu

SEQ ID NO: 1523988 - RNA, 19 nt, Homo sapiens
gcaucgacggugacuggua

SEQ ID NO: 1523989 - RNA, 19 nt, Homo sapiens
uggcggcucuuacauuuac

SEQ ID NO: 1523990 - RNA, 19 nt, Homo sapiens
cccuggacauccugaauga

SEQ ID NO: 1523991 - RNA, 19 nt, Homo sapiens
gcaccugcaguaucucuuc

SEQ ID NO: 1523992 - RNA, 19 nt, Homo sapiens
gggcaaugcuaugauuaac

SEQ ID NO: 1523993 - RNA, 19 nt, Homo sapiens
ggugugaugcuccuuguag

SEQ ID NO: 1523994 - RNA, 19 nt, Homo sapiens
gagggacgacagaaguuug

SEQ ID NO: 1523995 - RNA, 19 nt, Homo sapiens
cgacggugacugguacuuu

SEQ ID NO: 1523996 - RNA, 19 nt, Homo sapiens
ucugggcacuauccaaguu

SEQ ID NO: 1523997 - RNA, 19 nt, Homo sapiens
gugcccaaauggugugaug

SEQ ID NO: 1523998 - RNA, 19 nt, Homo sapiens
cccaagcugugaaacacuu

SEQ ID NO: 1523999 - RNA, 19 nt, Homo sapiens
ccugcaguaucucuucauu

SEQ ID NO: 1524000 - RNA, 19 nt, Homo sapiens
ugaaugccgccuucucaga

SEQ ID NO: 1524001 - RNA, 19 nt, Homo sapiens
caggagcacugccuuucag

SEQ ID NO: 1524002 - RNA, 19 nt, Homo sapiens
gcccgaagcaauaacaaca

SEQ ID NO: 1524003 - RNA, 19 nt, Homo sapiens
gaccuccccucaucugaaa

SEQ ID NO: 1524004 - RNA, 19 nt, Homo sapiens
caagcgaccaaccugcauu

SEQ ID NO: 1524005 - RNA, 19 nt, Homo sapiens
ggcagugauuucuccuuca

SEQ ID NO: 1524006 - RNA, 19 nt, Homo sapiens
acugcaaggugaagugguu

SEQ ID NO: 1524007 - RNA, 19 nt, Homo sapiens
gggcuccuuggguggauua

SEQ ID NO: 1524008 - RNA, 19 nt, Homo sapiens
cggccgagcucgaauucgu

SEQ ID NO: 1524009 - RNA, 19 nt, Homo sapiens
ccucgggccuucugcuaca

SEQ ID NO: 1524010 - RNA, 19 nt, Homo sapiens
aggcacccgucaucuauca

SEQ ID NO: 1524011 - RNA, 19 nt, Homo sapiens
ccacguaugccugugugaa

SEQ ID NO: 1524012 - RNA, 19 nt, Homo sapiens
gcaccacguaugccugugu

SEQ ID NO: 1524013 - RNA, 19 nt, Homo sapiens
cgcauaacuucguauagca

SEQ ID NO: 1524014 - RNA, 19 nt, Homo sapiens
gcaagccuaacgaccuaga

SEQ ID NO: 1524015 - RNA, 19 nt, Homo sapiens
uccuguagcugucgcuuuc

SEQ ID NO: 1524016 - RNA, 19 nt, Homo sapiens
ugauaaggaugagaauggu

SEQ ID NO: 1524017 - RNA, 19 nt, Homo sapiens
gcggacggacacacucauu

SEQ ID NO: 1524018 - RNA, 19 nt, Homo sapiens
ggacgacagaaguuuguac

SEQ ID NO: 1524019 - RNA, 19 nt, Homo sapiens
ugccucagccgcuacauug

SEQ ID NO: 1524020 - RNA, 19 nt, Homo sapiens
gcggcagcuucgagacuau

SEQ ID NO: 1524021 - RNA, 19 nt, Homo sapiens
guccaucuauaaacauguc

SEQ ID NO: 1524022 - RNA, 19 nt, Homo sapiens
gugcuccaggcauuguuua

SEQ ID NO: 1524023 - RNA, 19 nt, Homo sapiens
agacgcugguguauagaca

SEQ ID NO: 1524024 - RNA, 19 nt, Homo sapiens
ugagggacgacagaaguuu

SEQ ID NO: 1524025 - RNA, 19 nt, Homo sapiens
gcauaacuucguauagcau

SEQ ID NO: 1524026 - RNA, 19 nt, Homo sapiens
caacaauaaccugcagaca

SEQ ID NO: 1524027 - RNA, 19 nt, Homo sapiens
ucugcugucugcugagaug

SEQ ID NO: 1524028 - RNA, 19 nt, Homo sapiens
ccaggagcacugccuuuca

SEQ ID NO: 1524029 - RNA, 19 nt, Homo sapiens
guguccaucuauaaacaug

SEQ ID NO: 1524030 - RNA, 19 nt, Homo sapiens
cgguguccaucuauaaaca

SEQ ID NO: 1524031 - RNA, 19 nt, Homo sapiens
gaagaccuauuguuucaua

SEQ ID NO: 1524032 - RNA, 19 nt, Homo sapiens
gaacaaguuugaagaccua

SEQ ID NO: 1524033 - RNA, 19 nt, Homo sapiens
gcagauaacuguugauagg

SEQ ID NO: 1524034 - RNA, 19 nt, Homo sapiens
uaauugagauggagucuug

SEQ ID NO: 1524035 - RNA, 19 nt, Homo sapiens
caaacucacuugaaugaug

SEQ ID NO: 1524036 - RNA, 19 nt, Homo sapiens
caagugaucugcuccugaa

SEQ ID NO: 1524037 - RNA, 19 nt, Homo sapiens
ucacuuaaccuuucugauu

SEQ ID NO: 1524038 - RNA, 19 nt, Homo sapiens
gaccaaaguucugggaauu

SEQ ID NO: 1524039 - RNA, 19 nt, Homo sapiens
aaagauugauccuguuuga

SEQ ID NO: 1524040 - RNA, 19 nt, Homo sapiens
guacucaucuuccuucaag

SEQ ID NO: 1524041 - RNA, 19 nt, Homo sapiens
cauagaagccuacauccua

SEQ ID NO: 1524042 - RNA, 19 nt, Homo sapiens
ggaccaaaguucugggaau

SEQ ID NO: 1524043 - RNA, 19 nt, Homo sapiens
gaccugaucugccacuuca

SEQ ID NO: 1524044 - RNA, 19 nt, Homo sapiens
gaagacagagacagaagaa

SEQ ID NO: 1524045 - RNA, 19 nt, Homo sapiens
aaacucacuugaaugauga

SEQ ID NO: 1524046 - RNA, 19 nt, Homo sapiens
gagaaagauugauccuguu

SEQ ID NO: 1524047 - RNA, 19 nt, Homo sapiens
gaaaagcagugguaugugu

SEQ ID NO: 1524048 - RNA, 19 nt, Homo sapiens
ccacuacuccuggauauuu

SEQ ID NO: 1524049 - RNA, 19 nt, Homo sapiens
guacacaggcugcagaaga

SEQ ID NO: 1524050 - RNA, 19 nt, Homo sapiens
cagccuggaugauucuuaa

SEQ ID NO: 1524051 - RNA, 19 nt, Homo sapiens
gcucagaggcuuccaagug

SEQ ID NO: 1524052 - RNA, 19 nt, Homo sapiens
gaaggaugccagaguguga

SEQ ID NO: 1524053 - RNA, 19 nt, Homo sapiens
ccacaaaaccccuuuauga

SEQ ID NO: 1524054 - RNA, 19 nt, Homo sapiens
cacuuaaccuuucugauug

SEQ ID NO: 1524055 - RNA, 19 nt, Homo sapiens
uauaauggguggauuggau

SEQ ID NO: 1524056 - RNA, 19 nt, Homo sapiens
uuagaacuguggacacgua

SEQ ID NO: 1524057 - RNA, 19 nt, Homo sapiens
caccaaagcuacucucucu

SEQ ID NO: 1524058 - RNA, 19 nt, Homo sapiens
ccaaaguucugggaauuuc

SEQ ID NO: 1524059 - RNA, 19 nt, Homo sapiens
gcaccacuacuccuggaua

SEQ ID NO: 1524060 - RNA, 19 nt, Homo sapiens
cuuaagcccuucuuuagga

SEQ ID NO: 1524061 - RNA, 19 nt, Homo sapiens
ggacacguauggaaagacu

SEQ ID NO: 1524062 - RNA, 19 nt, Homo sapiens
ccaaagugcugggauuaca

SEQ ID NO: 1524063 - RNA, 19 nt, Homo sapiens
caaaaccccuuuaugaguu

SEQ ID NO: 1524064 - RNA, 19 nt, Homo sapiens
gggcagauaacuguugaua

SEQ ID NO: 1524065 - RNA, 19 nt, Homo sapiens
gaucugcugcuuccaaguu

SEQ ID NO: 1524066 - RNA, 19 nt, Homo sapiens
ucugggaauuucuagcuua

SEQ ID NO: 1524067 - RNA, 19 nt, Homo sapiens
ccaccuagguucaagugau

SEQ ID NO: 1524068 - RNA, 19 nt, Homo sapiens
ccaguuguguguugucaug

SEQ ID NO: 1524069 - RNA, 19 nt, Homo sapiens
caaauugcuuuccaaacuc

SEQ ID NO: 1524070 - RNA, 19 nt, Homo sapiens
gcugcucucugccuccuuu

SEQ ID NO: 1524071 - RNA, 19 nt, Homo sapiens
ccaaacgcaucuaaaggau

SEQ ID NO: 1524072 - RNA, 19 nt, Homo sapiens
gcugaugguuacagagcua

SEQ ID NO: 1524073 - RNA, 19 nt, Homo sapiens
guuugaagaccuauuguuu

SEQ ID NO: 1524074 - RNA, 19 nt, Homo sapiens
gauaacuguugauaggaau

SEQ ID NO: 1524075 - RNA, 19 nt, Homo sapiens
caccuagguucaagugauu

SEQ ID NO: 1524076 - RNA, 19 nt, Homo sapiens
ucaguuugcccaucaauau

SEQ ID NO: 1524077 - RNA, 19 nt, Homo sapiens
gaaagauugauccuguuug

SEQ ID NO: 1524078 - RNA, 19 nt, Homo sapiens
gcucauagaagccuacauc

SEQ ID NO: 1524079 - RNA, 19 nt, Homo sapiens
ggacacccuuggacagaag

SEQ ID NO: 1524080 - RNA, 19 nt, Homo sapiens
caaguuugaagaccuauug

SEQ ID NO: 1524081 - RNA, 19 nt, Homo sapiens
gacagagacagaagaaaga

SEQ ID NO: 1524082 - RNA, 19 nt, Homo sapiens
aaacuuggccucagaugau

SEQ ID NO: 1524083 - RNA, 19 nt, Homo sapiens
caagaccaaacgcaucuaa

SEQ ID NO: 1524084 - RNA, 19 nt, Homo sapiens
gaucugcuccugaacaagu

SEQ ID NO: 1524085 - RNA, 19 nt, Homo sapiens
agauguagaacaaugguua

SEQ ID NO: 1524086 - RNA, 19 nt, Homo sapiens
agauaacuguugauaggaa

SEQ ID NO: 1524087 - RNA, 19 nt, Homo sapiens
gacagagacuacaccuugu

SEQ ID NO: 1524088 - RNA, 19 nt, Homo sapiens
guucugauguuuuauggua

SEQ ID NO: 1524089 - RNA, 19 nt, Homo sapiens
cucagaggcuuccaaguga

SEQ ID NO: 1524090 - RNA, 19 nt, Homo sapiens
gaucaagggcagauaacug

SEQ ID NO: 1524091 - RNA, 19 nt, Homo sapiens
caaauuauguguccaaaac

SEQ ID NO: 1524092 - RNA, 19 nt, Homo sapiens
gaacuguggacacguaugg

SEQ ID NO: 1524093 - RNA, 19 nt, Homo sapiens
acuucaagcuguguaauuu

SEQ ID NO: 1524094 - RNA, 19 nt, Homo sapiens
gauugauccuguuugacuu

SEQ ID NO: 1524095 - RNA, 19 nt, Homo sapiens
gcagaagacagagacagaa

SEQ ID NO: 1524096 - RNA, 19 nt, Homo sapiens
cccaagaccuagccuuugu

SEQ ID NO: 1524097 - RNA, 19 nt, Homo sapiens
gugaucugcuccugaacaa

SEQ ID NO: 1524098 - RNA, 19 nt, Homo sapiens
guccuggaaugaaguguga

SEQ ID NO: 1524099 - RNA, 19 nt, Homo sapiens
uugcagaagcugaugguua

SEQ ID NO: 1524100 - RNA, 19 nt, Homo sapiens
ugauucagcuuugguuugu

SEQ ID NO: 1524101 - RNA, 19 nt, Homo sapiens
gcuagacuguaaacuccuu

SEQ ID NO: 1524102 - RNA, 19 nt, Homo sapiens
ccaggagacaugaagauga

SEQ ID NO: 1524103 - RNA, 19 nt, Homo sapiens
gaccuggaccugcuaagga

SEQ ID NO: 1524104 - RNA, 19 nt, Homo sapiens
gcucucugccuccuuuaaa

SEQ ID NO: 1524105 - RNA, 19 nt, Homo sapiens
gaagcagauugagccaguu

SEQ ID NO: 1524106 - RNA, 19 nt, Homo sapiens
uuucuuaagcccuucuuua

SEQ ID NO: 1524107 - RNA, 19 nt, Homo sapiens
agaaagauugauccuguuu

SEQ ID NO: 1524108 - RNA, 19 nt, Homo sapiens
agaagaaggccaacaccaa

SEQ ID NO: 1524109 - RNA, 19 nt, Homo sapiens
gaacccaggagacaugaag

SEQ ID NO: 1524110 - RNA, 19 nt, Homo sapiens
gcuagucccaccaaagcua

SEQ ID NO: 1524111 - RNA, 19 nt, Homo sapiens
caccacuacuccuggauau

SEQ ID NO: 1524112 - RNA, 19 nt, Homo sapiens
uuuccaaacucacuugaau

SEQ ID NO: 1524113 - RNA, 19 nt, Homo sapiens
uaaagugggucuggugaac

SEQ ID NO: 1524114 - RNA, 19 nt, Homo sapiens
gcccuuggccuaucuaucu

SEQ ID NO: 1524115 - RNA, 19 nt, Homo sapiens
caugcacgcuugugguugu

SEQ ID NO: 1524116 - RNA, 19 nt, Homo sapiens
caagggcagauaacuguug

SEQ ID NO: 1524117 - RNA, 19 nt, Homo sapiens
agagugugauucagcuuug

SEQ ID NO: 1524118 - RNA, 19 nt, Homo sapiens
agacagagacagaagaaag

SEQ ID NO: 1524119 - RNA, 19 nt, Homo sapiens
agaagcugaugguuacaga

SEQ ID NO: 1524120 - RNA, 19 nt, Homo sapiens
ugcagaagcugaugguuac

SEQ ID NO: 1524121 - RNA, 19 nt, Homo sapiens
ugccucagccucccaagua

SEQ ID NO: 1524122 - RNA, 19 nt, Homo sapiens
agagaucaagggcagauaa

SEQ ID NO: 1524123 - RNA, 19 nt, Homo sapiens
cuuggccuaucuaucuuua

SEQ ID NO: 1524124 - RNA, 19 nt, Homo sapiens
ucaauauaauggguggauu

SEQ ID NO: 1524125 - RNA, 19 nt, Homo sapiens
caguuugcccaucaauaua

SEQ ID NO: 1524126 - RNA, 19 nt, Homo sapiens
cugaucauguucaagaaau

SEQ ID NO: 1524127 - RNA, 19 nt, Homo sapiens
uccaaacucacuugaauga

SEQ ID NO: 1524128 - RNA, 19 nt, Homo sapiens
aaauugcuuuccaaacuca

SEQ ID NO: 1524129 - RNA, 19 nt, Homo sapiens
gcaauucuuguccuaacga

SEQ ID NO: 1524130 - RNA, 19 nt, Homo sapiens
ggcaaauuauguguccaaa

SEQ ID NO: 1524131 - RNA, 19 nt, Homo sapiens
gcagugaugucgacucuuu

SEQ ID NO: 1524132 - RNA, 19 nt, Homo sapiens
agauauagcugauacagua

SEQ ID NO: 1524133 - RNA, 19 nt, Homo sapiens
ggagaaauccuucgaaaug

SEQ ID NO: 1524134 - RNA, 19 nt, Homo sapiens
gaacagugccuggaacaua

SEQ ID NO: 1524135 - RNA, 19 nt, Homo sapiens
gggacaacauuacguauuu

SEQ ID NO: 1524136 - RNA, 19 nt, Homo sapiens
caaaucaccuuuauuagca

SEQ ID NO: 1524137 - RNA, 19 nt, Homo sapiens
gaucagggucagaguauua

SEQ ID NO: 1524138 - RNA, 19 nt, Homo sapiens
gaaaauguccagaagauua

SEQ ID NO: 1524139 - RNA, 19 nt, Homo sapiens
uggcaaaucaccuuuauua

SEQ ID NO: 1524140 - RNA, 19 nt, Homo sapiens
cgaauucucuauacaccua

SEQ ID NO: 1524141 - RNA, 19 nt, Homo sapiens
gcaguggaguuuaguacuu

SEQ ID NO: 1524142 - RNA, 19 nt, Homo sapiens
agacagagauugcuuuaag

SEQ ID NO: 1524143 - RNA, 19 nt, Homo sapiens
gaacuguugcuuaaauuug

SEQ ID NO: 1524144 - RNA, 19 nt, Homo sapiens
gaagaucagggucagagua

SEQ ID NO: 1524145 - RNA, 19 nt, Homo sapiens
gcacagagagaauggaaga

SEQ ID NO: 1524146 - RNA, 19 nt, Homo sapiens
cagcacauauggacuauca

SEQ ID NO: 1524147 - RNA, 19 nt, Homo sapiens
caaccacacucuaaaugga

SEQ ID NO: 1524148 - RNA, 19 nt, Homo sapiens
cuaacagaauccuuucaua

SEQ ID NO: 1524149 - RNA, 19 nt, Homo sapiens
gagaagugauuccuguaau

SEQ ID NO: 1524150 - RNA, 19 nt, Homo sapiens
gcucaccuaugacaagauu

SEQ ID NO: 1524151 - RNA, 19 nt, Homo sapiens
ggagaagugauuccuguaa

SEQ ID NO: 1524152 - RNA, 19 nt, Homo sapiens
uaauggaacugcuuucauc

SEQ ID NO: 1524153 - RNA, 19 nt, Homo sapiens
caagacagagauugcuuua

SEQ ID NO: 1524154 - RNA, 19 nt, Homo sapiens
gaaagagaggugcgucaaa

SEQ ID NO: 1524155 - RNA, 19 nt, Homo sapiens
guugagugccuacauguua

SEQ ID NO: 1524156 - RNA, 19 nt, Homo sapiens
gcucauagcuaacauuucc

SEQ ID NO: 1524157 - RNA, 19 nt, Homo sapiens
cauuaaagcuaacagaauc

SEQ ID NO: 1524158 - RNA, 19 nt, Homo sapiens
ggacaacauuacguauuug

SEQ ID NO: 1524159 - RNA, 19 nt, Homo sapiens
gaaaagggagugauuauug

SEQ ID NO: 1524160 - RNA, 19 nt, Homo sapiens
ccuauuuccucaucuguaa

SEQ ID NO: 1524161 - RNA, 19 nt, Homo sapiens
gacaagauuuggaagaaag

SEQ ID NO: 1524162 - RNA, 19 nt, Homo sapiens
auacaguacucaaugauga

SEQ ID NO: 1524163 - RNA, 19 nt, Homo sapiens
caguguuccugaagaaaua

SEQ ID NO: 1524164 - RNA, 19 nt, Homo sapiens
uuacguauuugaacuguug

SEQ ID NO: 1524165 - RNA, 19 nt, Homo sapiens
cauauaauccggaaaggaa

SEQ ID NO: 1524166 - RNA, 19 nt, Homo sapiens
gaguguguguugauagauu

SEQ ID NO: 1524167 - RNA, 19 nt, Homo sapiens
cauagaguguguguugaua

SEQ ID NO: 1524168 - RNA, 19 nt, Homo sapiens
caguggaguuuaguacuua

SEQ ID NO: 1524169 - RNA, 19 nt, Homo sapiens
gcacauauggacuaucaau

SEQ ID NO: 1524170 - RNA, 19 nt, Homo sapiens
gaguggugcuauagaugua

SEQ ID NO: 1524171 - RNA, 19 nt, Homo sapiens
cagacucccuggauuaaug

SEQ ID NO: 1524172 - RNA, 19 nt, Homo sapiens
gcaaaucaccuuuauuagc

SEQ ID NO: 1524173 - RNA, 19 nt, Homo sapiens
acuaguugcuuuacaugua

SEQ ID NO: 1524174 - RNA, 19 nt, Homo sapiens
aacagugccuggaacauaa

SEQ ID NO: 1524175 - RNA, 19 nt, Homo sapiens
gcuaacauuuccuauuuac

SEQ ID NO: 1524176 - RNA, 19 nt, Homo sapiens
aauaguaccuaauguguag

SEQ ID NO: 1524177 - RNA, 19 nt, Homo sapiens
guauuugaacuguugcuua

SEQ ID NO: 1524178 - RNA, 19 nt, Homo sapiens
ugacaagauuuggaagaaa

SEQ ID NO: 1524179 - RNA, 19 nt, Homo sapiens
ucaauuauacuuccacaga

SEQ ID NO: 1524180 - RNA, 19 nt, Homo sapiens
ggaacugcuuucaucuaug

SEQ ID NO: 1524181 - RNA, 19 nt, Homo sapiens
cagagagaauggaagauca

SEQ ID NO: 1524182 - RNA, 19 nt, Homo sapiens
guaauaguaccuaaugugu

SEQ ID NO: 1524183 - RNA, 19 nt, Homo sapiens
uaaguuguacuguagauga

SEQ ID NO: 1524184 - RNA, 19 nt, Homo sapiens
ugauaucuccggagcauuu

SEQ ID NO: 1524185 - RNA, 19 nt, Homo sapiens
gagaaauccuucgaaaugc

SEQ ID NO: 1524186 - RNA, 19 nt, Homo sapiens
uggaacugcuuucaucuau

SEQ ID NO: 1524187 - RNA, 19 nt, Homo sapiens
agaagugauuccuguaaug

SEQ ID NO: 1524188 - RNA, 19 nt, Homo sapiens
gcauaaggaaagacaagaa

SEQ ID NO: 1524189 - RNA, 19 nt, Homo sapiens
uagaguguguguugauaga

SEQ ID NO: 1524190 - RNA, 19 nt, Homo sapiens
gacaaguuccgcccacgua

SEQ ID NO: 1524191 - RNA, 19 nt, Homo sapiens
gcuugauucugguuucuug

SEQ ID NO: 1524192 - RNA, 19 nt, Homo sapiens
gacagagauugcuuuaagu

SEQ ID NO: 1524193 - RNA, 19 nt, Homo sapiens
uaaaagaugacgcuugaua

SEQ ID NO: 1524194 - RNA, 19 nt, Homo sapiens
ggucagaguauuauuccaa

SEQ ID NO: 1524195 - RNA, 19 nt, Homo sapiens
cuacauguuaguuccuuua

SEQ ID NO: 1524196 - RNA, 19 nt, Homo sapiens
cauaaggaaagacaagaaa

SEQ ID NO: 1524197 - RNA, 19 nt, Homo sapiens
cagcugucaugaaggcuuu

SEQ ID NO: 1524198 - RNA, 19 nt, Homo sapiens
cuaguugcuuuacauguau

SEQ ID NO: 1524199 - RNA, 19 nt, Homo sapiens
ugauucugguuucuuguuu

SEQ ID NO: 1524200 - RNA, 19 nt, Homo sapiens
ggacuaucaauuauacuuc

SEQ ID NO: 1524201 - RNA, 19 nt, Homo sapiens
gcagagaguggugcuauag

SEQ ID NO: 1524202 - RNA, 19 nt, Homo sapiens
cguaaaagaugacgcuuga

SEQ ID NO: 1524203 - RNA, 19 nt, Homo sapiens
gcugauacaguacucaaug

SEQ ID NO: 1524204 - RNA, 19 nt, Homo sapiens
aaagagaggugcgucaaac

SEQ ID NO: 1524205 - RNA, 19 nt, Homo sapiens
gaagugauuccuguaaugg

SEQ ID NO: 1524206 - RNA, 19 nt, Homo sapiens
agagaguggugcuauagau

SEQ ID NO: 1524207 - RNA, 19 nt, Homo sapiens
gacaacauuacguauuuga

SEQ ID NO: 1524208 - RNA, 19 nt, Homo sapiens
gauacaguacucaaugaug

SEQ ID NO: 1524209 - RNA, 19 nt, Homo sapiens
ccaagacagagauugcuuu

SEQ ID NO: 1524210 - RNA, 19 nt, Homo sapiens
ggaaaggaagaauauggau

SEQ ID NO: 1524211 - RNA, 19 nt, Homo sapiens
aguguguguugauagauua

SEQ ID NO: 1524212 - RNA, 19 nt, Homo sapiens
gggagugauuauuguuuca

SEQ ID NO: 1524213 - RNA, 19 nt, Homo sapiens
ggaguuuaguacuuaagag

SEQ ID NO: 1524214 - RNA, 19 nt, Homo sapiens
gaguuuccaucccagacaa

SEQ ID NO: 1524215 - RNA, 19 nt, Homo sapiens
gguguuauuccauuugcua

SEQ ID NO: 1524216 - RNA, 19 nt, Homo sapiens
aaggcuuucuucucaagua

SEQ ID NO: 1524217 - RNA, 19 nt, Homo sapiens
cugauacaguacucaauga

SEQ ID NO: 1524218 - RNA, 19 nt, Homo sapiens
cuucauagaguguguguug

SEQ ID NO: 1524219 - RNA, 19 nt, Homo sapiens
gacaauauucuugguccua

SEQ ID NO: 1524220 - RNA, 19 nt, Homo sapiens
auaaagcacuuagaacagu

SEQ ID NO: 1524221 - RNA, 19 nt, Homo sapiens
guacuguagaugaacuuaa

SEQ ID NO: 1524222 - RNA, 19 nt, Homo sapiens
caacauuacguauuugaac

SEQ ID NO: 1524223 - RNA, 19 nt, Homo sapiens
aaagcuggaugaagcagau

SEQ ID NO: 1524224 - RNA, 19 nt, Homo sapiens
cgucaaacagcgacaaguu

SEQ ID NO: 1524225 - RNA, 19 nt, Homo sapiens
caaguuccgcccacguaaa

SEQ ID NO: 1524226 - RNA, 19 nt, Homo sapiens
gauaaugugacaguuggaa

SEQ ID NO: 1524227 - RNA, 19 nt, Homo sapiens
gagaguggugcuauagaug

SEQ ID NO: 1524228 - RNA, 19 nt, Homo sapiens
caaggugcccgaauucucu

SEQ ID NO: 1524229 - RNA, 19 nt, Homo sapiens
gcaaggugcccgaauucuc

SEQ ID NO: 1524230 - RNA, 19 nt, Homo sapiens
aagaguuugugcccuuaaa

SEQ ID NO: 1524231 - RNA, 19 nt, Homo sapiens
gcaaacagacucaagauuu

SEQ ID NO: 1524232 - RNA, 19 nt, Homo sapiens
caacagagauccuaauucu

SEQ ID NO: 1524233 - RNA, 19 nt, Homo sapiens
gcacaauaaucaacucaaa

SEQ ID NO: 1524234 - RNA, 19 nt, Homo sapiens
guaaaucagucuaaagcua

SEQ ID NO: 1524235 - RNA, 19 nt, Homo sapiens
gcaaguggccaauaaguaa

SEQ ID NO: 1524236 - RNA, 19 nt, Homo sapiens
agaaagaccuaaugccaua

SEQ ID NO: 1524237 - RNA, 19 nt, Homo sapiens
uaaggaagaugcaguaaau

SEQ ID NO: 1524238 - RNA, 19 nt, Homo sapiens
aaaggcaacuuguggaaua

SEQ ID NO: 1524239 - RNA, 19 nt, Homo sapiens
gcaaugaauaugcaacuua

SEQ ID NO: 1524240 - RNA, 19 nt, Homo sapiens
gaacucauacaacacaaua

SEQ ID NO: 1524241 - RNA, 19 nt, Homo sapiens
gcacaaaugcuauugaaug

SEQ ID NO: 1524242 - RNA, 19 nt, Homo sapiens
cagaauuuguggacauuua

SEQ ID NO: 1524243 - RNA, 19 nt, Homo sapiens
gaaccuuugugcacuauug

SEQ ID NO: 1524244 - RNA, 19 nt, Homo sapiens
gaggaaauguuuauacaca

SEQ ID NO: 1524245 - RNA, 19 nt, Homo sapiens
caaccuaaguguccucuga

SEQ ID NO: 1524246 - RNA, 19 nt, Homo sapiens
caaagaauguguugcuaau

SEQ ID NO: 1524247 - RNA, 19 nt, Homo sapiens
gcaggaguauuacauaugu

SEQ ID NO: 1524248 - RNA, 19 nt, Homo sapiens
ccacagaugccuuacauuu

SEQ ID NO: 1524249 - RNA, 19 nt, Homo sapiens
gaaggguuaucuacaaaug

SEQ ID NO: 1524250 - RNA, 19 nt, Homo sapiens
gcuuagaggucacagaauu

SEQ ID NO: 1524251 - RNA, 19 nt, Homo sapiens
cacaguagcaggaguauua

SEQ ID NO: 1524252 - RNA, 19 nt, Homo sapiens
ggacagaggaaauguuuau

SEQ ID NO: 1524253 - RNA, 19 nt, Homo sapiens
acagagauccuaauucuuu

SEQ ID NO: 1524254 - RNA, 19 nt, Homo sapiens
gcaauaaucaguucuaugg

SEQ ID NO: 1524255 - RNA, 19 nt, Homo sapiens
gauggagaguuucaaagaa

SEQ ID NO: 1524256 - RNA, 19 nt, Homo sapiens
cacaaaugcuauugaauga

SEQ ID NO: 1524257 - RNA, 19 nt, Homo sapiens
gauaucacaucacaacugu

SEQ ID NO: 1524258 - RNA, 19 nt, Homo sapiens
cuaaauugaucacccauga

SEQ ID NO: 1524259 - RNA, 19 nt, Homo sapiens
ggauggcuauuaccagaaa

SEQ ID NO: 1524260 - RNA, 19 nt, Homo sapiens
uaucacaucacaacuguua

SEQ ID NO: 1524261 - RNA, 19 nt, Homo sapiens
cauguucauuguagcauua

SEQ ID NO: 1524262 - RNA, 19 nt, Homo sapiens
gaaaugaaaccguugucuu

SEQ ID NO: 1524263 - RNA, 19 nt, Homo sapiens
guggaaauguaaauuggua

SEQ ID NO: 1524264 - RNA, 19 nt, Homo sapiens
ggaaauguuuauacacaca

SEQ ID NO: 1524265 - RNA, 19 nt, Homo sapiens
gaucacccaugagaaguuu

SEQ ID NO: 1524266 - RNA, 19 nt, Homo sapiens
uacaagacgucauugguaa

SEQ ID NO: 1524267 - RNA, 19 nt, Homo sapiens
acaaugagauaucacauca

SEQ ID NO: 1524268 - RNA, 19 nt, Homo sapiens
gagaagcuguuaagagucu

SEQ ID NO: 1524269 - RNA, 19 nt, Homo sapiens
gugaagaacuaaauaaugc

SEQ ID NO: 1524270 - RNA, 19 nt, Homo sapiens
uggcaaggauguagagaaa

SEQ ID NO: 1524271 - RNA, 19 nt, Homo sapiens
ucaguuggcucaccaguuc

SEQ ID NO: 1524272 - RNA, 19 nt, Homo sapiens
guaaggaguuuaauaucca

SEQ ID NO: 1524273 - RNA, 19 nt, Homo sapiens
ccaguaaggaguuuaauau

SEQ ID NO: 1524274 - RNA, 19 nt, Homo sapiens
ggaaugacuucacccuaca

SEQ ID NO: 1524275 - RNA, 19 nt, Homo sapiens
cacaacaacuacaggaauu

SEQ ID NO: 1524276 - RNA, 19 nt, Homo sapiens
ccaagacaagcauaaauuu

SEQ ID NO: 1524277 - RNA, 19 nt, Homo sapiens
cagaggaaauguuuauaca

SEQ ID NO: 1524278 - RNA, 19 nt, Homo sapiens
gaaagguguuauugcuguu

SEQ ID NO: 1524279 - RNA, 19 nt, Homo sapiens
cuuacaacaugcacaauaa

SEQ ID NO: 1524280 - RNA, 19 nt, Homo sapiens
acagaugccuuacauuugu

SEQ ID NO: 1524281 - RNA, 19 nt, Homo sapiens
ugacagcaguuagaagaaa

SEQ ID NO: 1524282 - RNA, 19 nt, Homo sapiens
caaaugcuauugaaugaac

SEQ ID NO: 1524283 - RNA, 19 nt, Homo sapiens
caaacagacucaagauuuu

SEQ ID NO: 1524284 - RNA, 19 nt, Homo sapiens
gggaagagcaggcacaaau

SEQ ID NO: 1524285 - RNA, 19 nt, Homo sapiens
caaacgaagugugaaugaa

SEQ ID NO: 1524286 - RNA, 19 nt, Homo sapiens
gaauucaaacgaaguguga

SEQ ID NO: 1524287 - RNA, 19 nt, Homo sapiens
caugacaacuuaagugaca

SEQ ID NO: 1524288 - RNA, 19 nt, Homo sapiens
aagaauguguugcuaauca

SEQ ID NO: 1524289 - RNA, 19 nt, Homo sapiens
gacaaagaauguguugcua

SEQ ID NO: 1524290 - RNA, 19 nt, Homo sapiens
ggauggagaguuucaaaga

SEQ ID NO: 1524291 - RNA, 19 nt, Homo sapiens
auaaggaacucauacaaca

SEQ ID NO: 1524292 - RNA, 19 nt, Homo sapiens
uggagaagcuguuaagagu

SEQ ID NO: 1524293 - RNA, 19 nt, Homo sapiens
ggaaaacaguauggaauuu

SEQ ID NO: 1524294 - RNA, 19 nt, Homo sapiens
uuaccuggauggagaguuu

SEQ ID NO: 1524295 - RNA, 19 nt, Homo sapiens
gcaaagauggagcugagaa

SEQ ID NO: 1524296 - RNA, 19 nt, Homo sapiens
gcacaacaacuacaggaau

SEQ ID NO: 1524297 - RNA, 19 nt, Homo sapiens
ggaaaggcaacuuguggaa

SEQ ID NO: 1524298 - RNA, 19 nt, Homo sapiens
gcaaaagaaugaaauugga

SEQ ID NO: 1524299 - RNA, 19 nt, Homo sapiens
gaauugaagaagagaacua

SEQ ID NO: 1524300 - RNA, 19 nt, Homo sapiens
uaaacacacuggcccugaa

SEQ ID NO: 1524301 - RNA, 19 nt, Homo sapiens
guaaagcagauccaaauuc

SEQ ID NO: 1524302 - RNA, 19 nt, Homo sapiens
ggauugauacguauauuuc

SEQ ID NO: 1524303 - RNA, 19 nt, Homo sapiens
ucacaauagccaagauaua

SEQ ID NO: 1524304 - RNA, 19 nt, Homo sapiens
ugguauagcuauuauggaa

SEQ ID NO: 1524305 - RNA, 19 nt, Homo sapiens
agauggagcugagaagaaa

SEQ ID NO: 1524306 - RNA, 19 nt, Homo sapiens
gaaagugcaugugaagaac

SEQ ID NO: 1524307 - RNA, 19 nt, Homo sapiens
ccaaagaacacaugcaagu

SEQ ID NO: 1524308 - RNA, 19 nt, Homo sapiens
gugcaguggugugaucaua

SEQ ID NO: 1524309 - RNA, 19 nt, Homo sapiens
ugaaagugcaugugaagaa

SEQ ID NO: 1524310 - RNA, 19 nt, Homo sapiens
aaacgaagugugaaugaaa

SEQ ID NO: 1524311 - RNA, 19 nt, Homo sapiens
gcaagaggaagccaagaug

SEQ ID NO: 1524312 - RNA, 19 nt, Homo sapiens
uguaauaauuccacagaug

SEQ ID NO: 1524313 - RNA, 19 nt, Homo sapiens
gauuaaggaagaugcagua

SEQ ID NO: 1524314 - RNA, 19 nt, Homo sapiens
gcaccaccauacccagcua

SEQ ID NO: 1524315 - RNA, 19 nt, Homo sapiens
gugguagcaugccagguua

SEQ ID NO: 1524316 - RNA, 19 nt, Homo sapiens
gaagugugaaugaaaugaa

SEQ ID NO: 1524317 - RNA, 19 nt, Homo sapiens
gcacagcaucguugcagaa

SEQ ID NO: 1524318 - RNA, 19 nt, Homo sapiens
uagcaggaguauuacauau

SEQ ID NO: 1524319 - RNA, 19 nt, Homo sapiens
aaaugaaaccguugucuug

SEQ ID NO: 1524320 - RNA, 19 nt, Homo sapiens
acaugcaaguggccaauaa

SEQ ID NO: 1524321 - RNA, 19 nt, Homo sapiens
guacacaauguuagaaaga

SEQ ID NO: 1524322 - RNA, 19 nt, Homo sapiens
cuaaagcuaaguacaauga

SEQ ID NO: 1524323 - RNA, 19 nt, Homo sapiens
gaagaugcaguaaaucagu

SEQ ID NO: 1524324 - RNA, 19 nt, Homo sapiens
aaggaaggguuaucuacaa

SEQ ID NO: 1524325 - RNA, 19 nt, Homo sapiens
gaacaggcacaacaacuac

SEQ ID NO: 1524326 - RNA, 19 nt, Homo sapiens
gcaugugaagaacuaaaua

SEQ ID NO: 1524327 - RNA, 19 nt, Homo sapiens
caugagaaguuugaaagug

SEQ ID NO: 1524328 - RNA, 19 nt, Homo sapiens
guauaccucugcacaguag

SEQ ID NO: 1524329 - RNA, 19 nt, Homo sapiens
gcagcaaacagacucaaga

SEQ ID NO: 1524330 - RNA, 19 nt, Homo sapiens
ucaacaccgcuaaccauua

SEQ ID NO: 1524331 - RNA, 19 nt, Homo sapiens
ggacagcgaugaugacuuu

SEQ ID NO: 1524332 - RNA, 19 nt, Homo sapiens
gcagggaggucaacauuaa

SEQ ID NO: 1524333 - RNA, 19 nt, Homo sapiens
caaguuagaugaugagaaa

SEQ ID NO: 1524334 - RNA, 19 nt, Homo sapiens
ggugugaucuguccuaauu

SEQ ID NO: 1524335 - RNA, 19 nt, Homo sapiens
ggcaagggcuuccaacuga

SEQ ID NO: 1524336 - RNA, 19 nt, Homo sapiens
gaaggacggcuaccgguua

SEQ ID NO: 1524337 - RNA, 19 nt, Homo sapiens
gagugagacuguuggcuua

SEQ ID NO: 1524338 - RNA, 19 nt, Homo sapiens
ggaggcugcuucccaguaa

SEQ ID NO: 1524339 - RNA, 19 nt, Homo sapiens
ggaguugugugucucugua

SEQ ID NO: 1524340 - RNA, 19 nt, Homo sapiens
cagcugaaauuauguugaa

SEQ ID NO: 1524341 - RNA, 19 nt, Homo sapiens
ggagcaagcuuuggugaau

SEQ ID NO: 1524342 - RNA, 19 nt, Homo sapiens
caugagccguguauaauau

SEQ ID NO: 1524343 - RNA, 19 nt, Homo sapiens
gcagaucaaccaagauuug

SEQ ID NO: 1524344 - RNA, 19 nt, Homo sapiens
gagcagaucaaccaagauu

SEQ ID NO: 1524345 - RNA, 19 nt, Homo sapiens
gaugaugacuuugacaugu

SEQ ID NO: 1524346 - RNA, 19 nt, Homo sapiens
ggaagaaucuaggccuuag

SEQ ID NO: 1524347 - RNA, 19 nt, Homo sapiens
caaccaagauuugaacauc

SEQ ID NO: 1524348 - RNA, 19 nt, Homo sapiens
guuggaggguugucuauug

SEQ ID NO: 1524349 - RNA, 19 nt, Homo sapiens
ggaccugucucuccucagu

SEQ ID NO: 1524350 - RNA, 19 nt, Homo sapiens
agacaugagccguguauaa

SEQ ID NO: 1524351 - RNA, 19 nt, Homo sapiens
gaagacaugagccguguau

SEQ ID NO: 1524352 - RNA, 19 nt, Homo sapiens
gaagguguguggaagacau

SEQ ID NO: 1524353 - RNA, 19 nt, Homo sapiens
ccagguggaucaucucaug

SEQ ID NO: 1524354 - RNA, 19 nt, Homo sapiens
gaaagcacagauagccuaa

SEQ ID NO: 1524355 - RNA, 19 nt, Homo sapiens
caucauccuugguugugua

SEQ ID NO: 1524356 - RNA, 19 nt, Homo sapiens
gacccaaguuagaugauga

SEQ ID NO: 1524357 - RNA, 19 nt, Homo sapiens
ucuccgugcucacuaauuu

SEQ ID NO: 1524358 - RNA, 19 nt, Homo sapiens
ccagagcccugaugagaag

SEQ ID NO: 1524359 - RNA, 19 nt, Homo sapiens
gaccagagcccugaugaga

SEQ ID NO: 1524360 - RNA, 19 nt, Homo sapiens
ccuuguagauacugccuua

SEQ ID NO: 1524361 - RNA, 19 nt, Homo sapiens
aagcacagauagccuaaga

SEQ ID NO: 1524362 - RNA, 19 nt, Homo sapiens
cgugcucacuaauuuauuu

SEQ ID NO: 1524363 - RNA, 19 nt, Homo sapiens
cauuuagacugcugccuuu

SEQ ID NO: 1524364 - RNA, 19 nt, Homo sapiens
gcacauguggcucuguuug

SEQ ID NO: 1524365 - RNA, 19 nt, Homo sapiens
ggaggguugucuauugugu

SEQ ID NO: 1524366 - RNA, 19 nt, Homo sapiens
gggaagaaucuaggccuua

SEQ ID NO: 1524367 - RNA, 19 nt, Homo sapiens
ccacaggacauacuaguuc

SEQ ID NO: 1524368 - RNA, 19 nt, Homo sapiens
ggacccaaguuagaugaug

SEQ ID NO: 1524369 - RNA, 19 nt, Homo sapiens
gacaugagccguguauaau

SEQ ID NO: 1524370 - RNA, 19 nt, Homo sapiens
ccgccaaccucguauaaca

SEQ ID NO: 1524371 - RNA, 19 nt, Homo sapiens
gcacagauagccuaagacu

SEQ ID NO: 1524372 - RNA, 19 nt, Homo sapiens
acuuugacaugucuagaua

SEQ ID NO: 1524373 - RNA, 19 nt, Homo sapiens
gugccuguguggucuguuu

SEQ ID NO: 1524374 - RNA, 19 nt, Homo sapiens
caagaagaacaaugucaug

SEQ ID NO: 1524375 - RNA, 19 nt, Homo sapiens
uguuugggauuacguguuu

SEQ ID NO: 1524376 - RNA, 19 nt, Homo sapiens
agucauugcuuccuccuau

SEQ ID NO: 1524377 - RNA, 19 nt, Homo sapiens
cuauggaugugguuguuug

SEQ ID NO: 1524378 - RNA, 19 nt, Homo sapiens
ugagccguguauaauauuu

SEQ ID NO: 1524379 - RNA, 19 nt, Homo sapiens
aaaggcuacuccucacuug

SEQ ID NO: 1524380 - RNA, 19 nt, Homo sapiens
gagcaagcuuuggugaauc

SEQ ID NO: 1524381 - RNA, 19 nt, Homo sapiens
gaauccaggagcaagcuuu

SEQ ID NO: 1524382 - RNA, 19 nt, Homo sapiens
ucggaucacugccuucuuc

SEQ ID NO: 1524383 - RNA, 19 nt, Homo sapiens
acaugagccguguauaaua

SEQ ID NO: 1524384 - RNA, 19 nt, Homo sapiens
uagggugucuguagaucaa

SEQ ID NO: 1524385 - RNA, 19 nt, Homo sapiens
ggagggagugagacuguug

SEQ ID NO: 1524386 - RNA, 19 nt, Homo sapiens
gguggaucaucucaugcua

SEQ ID NO: 1524387 - RNA, 19 nt, Homo sapiens
cuggaaagcugagacugaa

SEQ ID NO: 1524388 - RNA, 19 nt, Homo sapiens
cuucugcuauugcugguuu

SEQ ID NO: 1524389 - RNA, 19 nt, Homo sapiens
uguauagggugucuguaga

SEQ ID NO: 1524390 - RNA, 19 nt, Homo sapiens
uauuguguguggcuguaua

SEQ ID NO: 1524391 - RNA, 19 nt, Homo sapiens
ggcagggaggucaacauua

SEQ ID NO: 1524392 - RNA, 19 nt, Homo sapiens
cugagcagaucaaccaaga

SEQ ID NO: 1524393 - RNA, 19 nt, Homo sapiens
gguuguguaucguguaaca

SEQ ID NO: 1524394 - RNA, 19 nt, Homo sapiens
gcugaaauuauguugaaga

SEQ ID NO: 1524395 - RNA, 19 nt, Homo sapiens
ccauguuucuauuugcauu

SEQ ID NO: 1524396 - RNA, 19 nt, Homo sapiens
guaccucuguguguucaug

SEQ ID NO: 1524397 - RNA, 19 nt, Homo sapiens
ggaggugggagcuggaaug

SEQ ID NO: 1524398 - RNA, 19 nt, Homo sapiens
gcagugcaaugggcugaca

SEQ ID NO: 1524399 - RNA, 19 nt, Homo sapiens
uguagauacugccuuaaca

SEQ ID NO: 1524400 - RNA, 19 nt, Homo sapiens
gcucaccuuucuagaacau

SEQ ID NO: 1524401 - RNA, 19 nt, Homo sapiens
gcagggacccaaguuagau

SEQ ID NO: 1524402 - RNA, 19 nt, Homo sapiens
gaggagggagugagacugu

SEQ ID NO: 1524403 - RNA, 19 nt, Homo sapiens
guggcucuguuugggauua

SEQ ID NO: 1524404 - RNA, 19 nt, Homo sapiens
cggcccauguuucuauuug

SEQ ID NO: 1524405 - RNA, 19 nt, Homo sapiens
uaaaggcuacuccucacuu

SEQ ID NO: 1524406 - RNA, 19 nt, Homo sapiens
ugccuuugcugcugacuug

SEQ ID NO: 1524407 - RNA, 19 nt, Homo sapiens
uaucaggacuguguauguc

SEQ ID NO: 1524408 - RNA, 19 nt, Homo sapiens
ucagucuauuccugucaua

SEQ ID NO: 1524409 - RNA, 19 nt, Homo sapiens
gugaauguguguguguguu

SEQ ID NO: 1524410 - RNA, 19 nt, Homo sapiens
gcagcugaaauuauguuga

SEQ ID NO: 1524411 - RNA, 19 nt, Homo sapiens
ucauggagcuggagaaacc

SEQ ID NO: 1524412 - RNA, 19 nt, Homo sapiens
gaucaucucaugcuaacac

SEQ ID NO: 1524413 - RNA, 19 nt, Homo sapiens
ggaaagcugagacugaaaa

SEQ ID NO: 1524414 - RNA, 19 nt, Homo sapiens
acacggacagcgaugauga

SEQ ID NO: 1524415 - RNA, 19 nt, Homo sapiens
gaugugggugucccuggua

SEQ ID NO: 1524416 - RNA, 19 nt, Homo sapiens
uagcagaauguguguguau

SEQ ID NO: 1524417 - RNA, 19 nt, Homo sapiens
acagacaggcugagguuug

SEQ ID NO: 1524418 - RNA, 19 nt, Homo sapiens
gcccauguuucuauuugca

SEQ ID NO: 1524419 - RNA, 19 nt, Homo sapiens
ccaagaagaacaaugucau

SEQ ID NO: 1524420 - RNA, 19 nt, Homo sapiens
uacagcugcuucugcuauu

SEQ ID NO: 1524421 - RNA, 19 nt, Homo sapiens
gucuguagaucaagaugug

SEQ ID NO: 1524422 - RNA, 19 nt, Homo sapiens
uuacguguuugucugugaa

SEQ ID NO: 1524423 - RNA, 19 nt, Homo sapiens
gcagaauguguguguaucu

SEQ ID NO: 1524424 - RNA, 19 nt, Homo sapiens
ccacgcuucugcucauugg

SEQ ID NO: 1524425 - RNA, 19 nt, Homo sapiens
uuacagacaggcugagguu

SEQ ID NO: 1524426 - RNA, 19 nt, Homo sapiens
guuucuccgugcucacuaa

SEQ ID NO: 1524427 - RNA, 19 nt, Homo sapiens
ggcaaggacagagaaggua

SEQ ID NO: 1524428 - RNA, 19 nt, Homo sapiens
aaacaaagggaggcaagga

SEQ ID NO: 1524429 - RNA, 19 nt, Homo sapiens
ccacuccgccaacccauuc

SEQ ID NO: 1524430 - RNA, 19 nt, Homo sapiens
ugagacuguuggcuuagga

SEQ ID NO: 1524431 - RNA, 19 nt, Homo sapiens
ccugaggacuucuguuuaa

SEQ ID NO: 1524432 - RNA, 19 nt, Homo sapiens
gaccaccgcucaaggauca

SEQ ID NO: 1524433 - RNA, 19 nt, Homo sapiens
gacaaagucucugaaacug

SEQ ID NO: 1524434 - RNA, 19 nt, Homo sapiens
cauggaaccuagcuacuuc

SEQ ID NO: 1524435 - RNA, 19 nt, Homo sapiens
gggaggagcccacaaacug

SEQ ID NO: 1524436 - RNA, 19 nt, Homo sapiens
ggaggagguuggugacagu

SEQ ID NO: 1524437 - RNA, 19 nt, Homo sapiens
gaaggucgacuaaaacaaa

SEQ ID NO: 1524438 - RNA, 19 nt, Homo sapiens
ggauauggaggcuucagaa

SEQ ID NO: 1524439 - RNA, 19 nt, Homo sapiens
agacagagcagcaccugaa

SEQ ID NO: 1524440 - RNA, 19 nt, Homo sapiens
caaagucuguuuucaugaa

SEQ ID NO: 1524441 - RNA, 19 nt, Homo sapiens
gaggacuucuguuuaaagg

SEQ ID NO: 1524442 - RNA, 19 nt, Homo sapiens
gcaagccggacaaggauau

SEQ ID NO: 1524443 - RNA, 19 nt, Homo sapiens
gggcgcaguuucgcucuug

SEQ ID NO: 1524444 - RNA, 19 nt, Homo sapiens
gcaggagcuucugaacaug

SEQ ID NO: 1524445 - RNA, 19 nt, Homo sapiens
uauggaggcuucagaacca

SEQ ID NO: 1524446 - RNA, 19 nt, Homo sapiens
uccacgagcugcugcaaga

SEQ ID NO: 1524447 - RNA, 19 nt, Homo sapiens
cagagcagcaccugaacaa

SEQ ID NO: 1524448 - RNA, 19 nt, Homo sapiens
agcaggagcuucugaacau

SEQ ID NO: 1524449 - RNA, 19 nt, Homo sapiens
cacgagcugcugcaagaua

SEQ ID NO: 1524450 - RNA, 19 nt, Homo sapiens
gcaccugaacaaccugaug

SEQ ID NO: 1524451 - RNA, 19 nt, Homo sapiens
gcacagagacauggaaccu

SEQ ID NO: 1524452 - RNA, 19 nt, Homo sapiens
cugaggacuucuguuuaaa

SEQ ID NO: 1524453 - RNA, 19 nt, Homo sapiens
ugcuggagguggagacaaa

SEQ ID NO: 1524454 - RNA, 19 nt, Homo sapiens
caggagcuucugaacauga

SEQ ID NO: 1524455 - RNA, 19 nt, Homo sapiens
cagcaggagcuucugaaca

SEQ ID NO: 1524456 - RNA, 19 nt, Homo sapiens
ggagcacagagacauggaa

SEQ ID NO: 1524457 - RNA, 19 nt, Homo sapiens
cucugaaacuggaacauuc

SEQ ID NO: 1524458 - RNA, 19 nt, Homo sapiens
auagcaagccggacaagga

SEQ ID NO: 1524459 - RNA, 19 nt, Homo sapiens
ccacaaacuggagcacaga

SEQ ID NO: 1524460 - RNA, 19 nt, Homo sapiens
ggaggacgaggaggagguu

SEQ ID NO: 1524461 - RNA, 19 nt, Homo sapiens
ucucugaaacuggaacauu

SEQ ID NO: 1524462 - RNA, 19 nt, Homo sapiens
gcacugcgcuuccuuccua

SEQ ID NO: 1524463 - RNA, 19 nt, Homo sapiens
gcacaaagcccaguucauu

SEQ ID NO: 1524464 - RNA, 19 nt, Homo sapiens
gaagggaaauccacacaga

SEQ ID NO: 1524465 - RNA, 19 nt, Homo sapiens
ugaaggagcugggaauuaa

SEQ ID NO: 1524466 - RNA, 19 nt, Homo sapiens
ggaaaccauucacaacuuu

SEQ ID NO: 1524467 - RNA, 19 nt, Homo sapiens
cgucaggccuguuaaauuu

SEQ ID NO: 1524468 - RNA, 19 nt, Homo sapiens
gaacugacuggaauccuua

SEQ ID NO: 1524469 - RNA, 19 nt, Homo sapiens
guaaagagaccugauguuu

SEQ ID NO: 1524470 - RNA, 19 nt, Homo sapiens
ggauuuagacccugccuua

SEQ ID NO: 1524471 - RNA, 19 nt, Homo sapiens
guaaaugccuccugaagag

SEQ ID NO: 1524472 - RNA, 19 nt, Homo sapiens
ggauaacgcugaccuguac

SEQ ID NO: 1524473 - RNA, 19 nt, Homo sapiens
gcagacagaaagaaagaua

SEQ ID NO: 1524474 - RNA, 19 nt, Homo sapiens
ugacuggaauccuuaagaa

SEQ ID NO: 1524475 - RNA, 19 nt, Homo sapiens
ugacaaccaugcuucgaaa

SEQ ID NO: 1524476 - RNA, 19 nt, Homo sapiens
aaagauaguuugaccaagu

SEQ ID NO: 1524477 - RNA, 19 nt, Homo sapiens
ggaaauccacacagaauca

SEQ ID NO: 1524478 - RNA, 19 nt, Homo sapiens
gcagggacuuaauucuuug

SEQ ID NO: 1524479 - RNA, 19 nt, Homo sapiens
ggacuggcuugcagaagga

SEQ ID NO: 1524480 - RNA, 19 nt, Homo sapiens
guccauuccuagcaaguua

SEQ ID NO: 1524481 - RNA, 19 nt, Homo sapiens
gaaauuggagaccagcaaa

SEQ ID NO: 1524482 - RNA, 19 nt, Homo sapiens
gaacuuccacuaccuccaa

SEQ ID NO: 1524483 - RNA, 19 nt, Homo sapiens
gggcucugcuccuccuuaa

SEQ ID NO: 1524484 - RNA, 19 nt, Homo sapiens
ggacgcgagagacaaauuu

SEQ ID NO: 1524485 - RNA, 19 nt, Homo sapiens
ugcagggacuuaauucuuu

SEQ ID NO: 1524486 - RNA, 19 nt, Homo sapiens
ugagaaauaucagcccauu

SEQ ID NO: 1524487 - RNA, 19 nt, Homo sapiens
ggaccugcccuccaaaugu

SEQ ID NO: 1524488 - RNA, 19 nt, Homo sapiens
uuuagacccugccuuaauu

SEQ ID NO: 1524489 - RNA, 19 nt, Homo sapiens
gaccugcccuccaaaugug

SEQ ID NO: 1524490 - RNA, 19 nt, Homo sapiens
ccgcucagguggcagcaua

SEQ ID NO: 1524491 - RNA, 19 nt, Homo sapiens
gcagcgauuucugaacuga

SEQ ID NO: 1524492 - RNA, 19 nt, Homo sapiens
gggacuuaauucuuugaaa

SEQ ID NO: 1524493 - RNA, 19 nt, Homo sapiens
aaagagaccugauguuuuc

SEQ ID NO: 1524494 - RNA, 19 nt, Homo sapiens
cuggaauccuuaagaaauu

SEQ ID NO: 1524495 - RNA, 19 nt, Homo sapiens
caacuuucacucuuccuuu

SEQ ID NO: 1524496 - RNA, 19 nt, Homo sapiens
gaagcguuccucacacuga

SEQ ID NO: 1524497 - RNA, 19 nt, Homo sapiens
ugaacugacuggaauccuu

SEQ ID NO: 1524498 - RNA, 19 nt, Homo sapiens
gccggaggcuggacaacuu

SEQ ID NO: 1524499 - RNA, 19 nt, Homo sapiens
aacaagagguggacaugga

SEQ ID NO: 1524500 - RNA, 19 nt, Homo sapiens
gacccugucuccaccucua

SEQ ID NO: 1524501 - RNA, 19 nt, Homo sapiens
gcuggacaacuuuggauaa

SEQ ID NO: 1524502 - RNA, 19 nt, Homo sapiens
gaggaugaacugacuggaa

SEQ ID NO: 1524503 - RNA, 19 nt, Homo sapiens
gaccugauguuuucccuaa

SEQ ID NO: 1524504 - RNA, 19 nt, Homo sapiens
ccaagggagugucuauuuu

SEQ ID NO: 1524505 - RNA, 19 nt, Homo sapiens
caucggagcccacagaagu

SEQ ID NO: 1524506 - RNA, 19 nt, Homo sapiens
gcucugcuccuccuuaaca

SEQ ID NO: 1524507 - RNA, 19 nt, Homo sapiens
gaacucgucccuuuuauuc

SEQ ID NO: 1524508 - RNA, 19 nt, Homo sapiens
aggaugaacugacuggaau

SEQ ID NO: 1524509 - RNA, 19 nt, Homo sapiens
gcaguggcaccaucacaga

SEQ ID NO: 1524510 - RNA, 19 nt, Homo sapiens
gcagaguccucagugucuu

SEQ ID NO: 1524511 - RNA, 19 nt, Homo sapiens
gccuguguauauuaaauga

SEQ ID NO: 1524512 - RNA, 19 nt, Homo sapiens
aggaaaccauucacaacuu

SEQ ID NO: 1524513 - RNA, 19 nt, Homo sapiens
gcaagggacgcgagagaca

SEQ ID NO: 1524514 - RNA, 19 nt, Homo sapiens
aaaagcagccggauuauug

SEQ ID NO: 1524515 - RNA, 19 nt, Homo sapiens
cccaagggagugucuauuu

SEQ ID NO: 1524516 - RNA, 19 nt, Homo sapiens
agaaagauaguuugaccaa

SEQ ID NO: 1524517 - RNA, 19 nt, Homo sapiens
gggcauggccauccuugug

SEQ ID NO: 1524518 - RNA, 19 nt, Homo sapiens
aguuaaucgugucuuguua

SEQ ID NO: 1524519 - RNA, 19 nt, Homo sapiens
ggaacaagagguggacaug

SEQ ID NO: 1524520 - RNA, 19 nt, Homo sapiens
gugcagggacuuaauucuu

SEQ ID NO: 1524521 - RNA, 19 nt, Homo sapiens
uguauucacugccaagagu

SEQ ID NO: 1524522 - RNA, 19 nt, Homo sapiens
guggagccaucucgcauca

SEQ ID NO: 1524523 - RNA, 19 nt, Homo sapiens
aaucgugucuuguuaacca

SEQ ID NO: 1524524 - RNA, 19 nt, Homo sapiens
cagaaagaaagauaguuug

SEQ ID NO: 1524525 - RNA, 19 nt, Homo sapiens
uaaagagaccugauguuuu

SEQ ID NO: 1524526 - RNA, 19 nt, Homo sapiens
caaccacucgccucauuca

SEQ ID NO: 1524527 - RNA, 19 nt, Homo sapiens
cacaaagcccaguucauug

SEQ ID NO: 1524528 - RNA, 19 nt, Homo sapiens
agagcugccugaagacaug

SEQ ID NO: 1524529 - RNA, 19 nt, Homo sapiens
ggaaugauagaagggaaau

SEQ ID NO: 1524530 - RNA, 19 nt, Homo sapiens
gaaagaaagauaguuugac

SEQ ID NO: 1524531 - RNA, 19 nt, Homo sapiens
gagacaaauuuuacaggaa

SEQ ID NO: 1524532 - RNA, 19 nt, Homo sapiens
ugacugacggugacuugaa

SEQ ID NO: 1524533 - RNA, 19 nt, Homo sapiens
gagcacaaagcccaguuca

SEQ ID NO: 1524534 - RNA, 19 nt, Homo sapiens
gauuuagacccugccuuaa

SEQ ID NO: 1524535 - RNA, 19 nt, Homo sapiens
uaacaugcagccuaagagu

SEQ ID NO: 1524536 - RNA, 19 nt, Homo sapiens
gcaggacuggcuugcagaa

SEQ ID NO: 1524537 - RNA, 19 nt, Homo sapiens
ugccaauucuggaaacuuc

SEQ ID NO: 1524538 - RNA, 19 nt, Homo sapiens
gucggccuguguauauuaa

SEQ ID NO: 1524539 - RNA, 19 nt, Homo sapiens
ccucccagguucccauuuc

SEQ ID NO: 1524540 - RNA, 19 nt, Homo sapiens
cagccuaagaguggauuua

SEQ ID NO: 1524541 - RNA, 19 nt, Homo sapiens
gacccuuccugggagaauu

SEQ ID NO: 1524542 - RNA, 19 nt, Homo sapiens
uggcagcgauuucugaacu

SEQ ID NO: 1524543 - RNA, 19 nt, Homo sapiens
gacugacggugacuugaag

SEQ ID NO: 1524544 - RNA, 19 nt, Homo sapiens
ugucggccuguguauauua

SEQ ID NO: 1524545 - RNA, 19 nt, Homo sapiens
gggaaugauagaagggaaa

SEQ ID NO: 1524546 - RNA, 19 nt, Homo sapiens
gacccugccuuaauuucag

SEQ ID NO: 1524547 - RNA, 19 nt, Homo sapiens
cuaauaaagcugauaacag

SEQ ID NO: 1524548 - RNA, 19 nt, Homo sapiens
ccugauguuuucccuaaua

SEQ ID NO: 1524549 - RNA, 19 nt, Homo sapiens
cauggcagacagaaagaaa

SEQ ID NO: 1524550 - RNA, 19 nt, Homo sapiens
auucacaacuuucacucuu

SEQ ID NO: 1524551 - RNA, 19 nt, Homo sapiens
uugaaggagcugggaauua

SEQ ID NO: 1524552 - RNA, 19 nt, Homo sapiens
gacuggaauccuuaagaaa

SEQ ID NO: 1524553 - RNA, 19 nt, Homo sapiens
ucgcuguccuuguccauuc

SEQ ID NO: 1524554 - RNA, 19 nt, Homo sapiens
caaguaaaugccuccugaa

SEQ ID NO: 1524555 - RNA, 19 nt, Homo sapiens
cggccuguguauauuaaau

SEQ ID NO: 1524556 - RNA, 19 nt, Homo sapiens
aguaaaugccuccugaaga

SEQ ID NO: 1524557 - RNA, 19 nt, Homo sapiens
uggauaacgcugaccugua

SEQ ID NO: 1524558 - RNA, 19 nt, Homo sapiens
uucaaccacucgccucauu

SEQ ID NO: 1524559 - RNA, 19 nt, Homo sapiens
gggaaauccacacagaauc

SEQ ID NO: 1524560 - RNA, 19 nt, Homo sapiens
uccuuaacaugcagccuaa

SEQ ID NO: 1524561 - RNA, 19 nt, Homo sapiens
gacagaaagaaagauaguu

SEQ ID NO: 1524562 - RNA, 19 nt, Homo sapiens
guacuaaacucaaagauga

SEQ ID NO: 1524563 - RNA, 19 nt, Homo sapiens
gaaccaaucugcauucuuc

SEQ ID NO: 1524564 - RNA, 19 nt, Homo sapiens
gaagugagguaucagugua

SEQ ID NO: 1524565 - RNA, 19 nt, Homo sapiens
gggaauaacuucacuuuca

SEQ ID NO: 1524566 - RNA, 19 nt, Homo sapiens
cagcaaagauugaauguau

SEQ ID NO: 1524567 - RNA, 19 nt, Homo sapiens
guuauaagcuccauggaaa

SEQ ID NO: 1524568 - RNA, 19 nt, Homo sapiens
caacugggaugcagagauu

SEQ ID NO: 1524569 - RNA, 19 nt, Homo sapiens
ggacaucaccuccuauuug

SEQ ID NO: 1524570 - RNA, 19 nt, Homo sapiens
gcaaugccauccacuguga

SEQ ID NO: 1524571 - RNA, 19 nt, Homo sapiens
caaaugcguucaucaguga

SEQ ID NO: 1524572 - RNA, 19 nt, Homo sapiens
gaagugcugugcaguauag

SEQ ID NO: 1524573 - RNA, 19 nt, Homo sapiens
gaaggugccucuccaaugg

SEQ ID NO: 1524574 - RNA, 19 nt, Homo sapiens
gcaagaagacgacaugaug

SEQ ID NO: 1524575 - RNA, 19 nt, Homo sapiens
uuacagggcccuuccauua

SEQ ID NO: 1524576 - RNA, 19 nt, Homo sapiens
gcaaagagaccagguguga

SEQ ID NO: 1524577 - RNA, 19 nt, Homo sapiens
ugaauacacuugcaaugaa

SEQ ID NO: 1524578 - RNA, 19 nt, Homo sapiens
gaacaccucagcaaagauu

SEQ ID NO: 1524579 - RNA, 19 nt, Homo sapiens
ggaguuaacauaucaguau

SEQ ID NO: 1524580 - RNA, 19 nt, Homo sapiens
gaaugacucuuucccuguu

SEQ ID NO: 1524581 - RNA, 19 nt, Homo sapiens
gcaaguggaucaaacuaca

SEQ ID NO: 1524582 - RNA, 19 nt, Homo sapiens
ugacauacuuucuuacaug

SEQ ID NO: 1524583 - RNA, 19 nt, Homo sapiens
ccacaccaguaauugaaua

SEQ ID NO: 1524584 - RNA, 19 nt, Homo sapiens
gcuaaaaccugggaaaaua

SEQ ID NO: 1524585 - RNA, 19 nt, Homo sapiens
gcaauggaaugacucuuuc

SEQ ID NO: 1524586 - RNA, 19 nt, Homo sapiens
cagaauggcuucaugaaag

SEQ ID NO: 1524587 - RNA, 19 nt, Homo sapiens
gggcuuaccuaccuuucua

SEQ ID NO: 1524588 - RNA, 19 nt, Homo sapiens
gcacacaccuaugaaagug

SEQ ID NO: 1524589 - RNA, 19 nt, Homo sapiens
gcaaagauugaauguauga

SEQ ID NO: 1524590 - RNA, 19 nt, Homo sapiens
ccaaagugcuggaauuaca

SEQ ID NO: 1524591 - RNA, 19 nt, Homo sapiens
gcaaagaaaguccaacaug

SEQ ID NO: 1524592 - RNA, 19 nt, Homo sapiens
gaaugugacuugccuacug

SEQ ID NO: 1524593 - RNA, 19 nt, Homo sapiens
gguaggaguugugacauuu

SEQ ID NO: 1524594 - RNA, 19 nt, Homo sapiens
ugggaaagcugacauugaa

SEQ ID NO: 1524595 - RNA, 19 nt, Homo sapiens
gaacaugccaggaugacaa

SEQ ID NO: 1524596 - RNA, 19 nt, Homo sapiens
gccagaauguguuccagua

SEQ ID NO: 1524597 - RNA, 19 nt, Homo sapiens
ggaaauucaucaagaaggu

SEQ ID NO: 1524598 - RNA, 19 nt, Homo sapiens
gaagauggaacuaggaaug

SEQ ID NO: 1524599 - RNA, 19 nt, Homo sapiens
gaaauacuaccacccuuug

SEQ ID NO: 1524600 - RNA, 19 nt, Homo sapiens
gcaguggaguaguccuaua

SEQ ID NO: 1524601 - RNA, 19 nt, Homo sapiens
gaggaguguuuguuuagaa

SEQ ID NO: 1524602 - RNA, 19 nt, Homo sapiens
agaaugcucugcugucuga

SEQ ID NO: 1524603 - RNA, 19 nt, Homo sapiens
ggaaauacuaccacccuuu

SEQ ID NO: 1524604 - RNA, 19 nt, Homo sapiens
ccaaauccaugcccuguuc

SEQ ID NO: 1524605 - RNA, 19 nt, Homo sapiens
gcagcuggcucaguuguga

SEQ ID NO: 1524606 - RNA, 19 nt, Homo sapiens
gcaaauggaauaagaaguc

SEQ ID NO: 1524607 - RNA, 19 nt, Homo sapiens
ccugaggaguguuuguuua

SEQ ID NO: 1524608 - RNA, 19 nt, Homo sapiens
gaggcacacugcacagaaa

SEQ ID NO: 1524609 - RNA, 19 nt, Homo sapiens
caacagaggcuacagucuu

SEQ ID NO: 1524610 - RNA, 19 nt, Homo sapiens
guuauacgauggauacaga

SEQ ID NO: 1524611 - RNA, 19 nt, Homo sapiens
uaucagugcuuuccugguu

SEQ ID NO: 1524612 - RNA, 19 nt, Homo sapiens
acacauaccugagcacguu

SEQ ID NO: 1524613 - RNA, 19 nt, Homo sapiens
caucaaacuuucuguaugg

SEQ ID NO: 1524614 - RNA, 19 nt, Homo sapiens
ggaaaaccagcuaguauua

SEQ ID NO: 1524615 - RNA, 19 nt, Homo sapiens
gacccaacgugguauauuc

SEQ ID NO: 1524616 - RNA, 19 nt, Homo sapiens
ggauacagauacagauaca

SEQ ID NO: 1524617 - RNA, 19 nt, Homo sapiens
gaaagugaagugaaacuca

SEQ ID NO: 1524618 - RNA, 19 nt, Homo sapiens
gcagaccugugaagaguca

SEQ ID NO: 1524619 - RNA, 19 nt, Homo sapiens
agucggaaguccuguauuu

SEQ ID NO: 1524620 - RNA, 19 nt, Homo sapiens
gaaucauccugucuugcua

SEQ ID NO: 1524621 - RNA, 19 nt, Homo sapiens
gacgagacguggacacaga

SEQ ID NO: 1524622 - RNA, 19 nt, Homo sapiens
cagaauguguccaucaaau

SEQ ID NO: 1524623 - RNA, 19 nt, Homo sapiens
gcaaguuucugugucaugu

SEQ ID NO: 1524624 - RNA, 19 nt, Homo sapiens
gaauacacuugcaaugaag

SEQ ID NO: 1524625 - RNA, 19 nt, Homo sapiens
ucaggaacaccgucacuua

SEQ ID NO: 1524626 - RNA, 19 nt, Homo sapiens
gagaggcacacaccuauga

SEQ ID NO: 1524627 - RNA, 19 nt, Homo sapiens
cauggaaauucaucaagaa

SEQ ID NO: 1524628 - RNA, 19 nt, Homo sapiens
ccauggaaauucaucaaga

SEQ ID NO: 1524629 - RNA, 19 nt, Homo sapiens
gggaagugcugugcaguau

SEQ ID NO: 1524630 - RNA, 19 nt, Homo sapiens
guugugagcuuuaaaugca

SEQ ID NO: 1524631 - RNA, 19 nt, Homo sapiens
gaagaaccaaucugcauuc

SEQ ID NO: 1524632 - RNA, 19 nt, Homo sapiens
aaagagaccaggugugaaa

SEQ ID NO: 1524633 - RNA, 19 nt, Homo sapiens
gaccagcucuuggaaggaa

SEQ ID NO: 1524634 - RNA, 19 nt, Homo sapiens
gcccaugguuucccuaaug

SEQ ID NO: 1524635 - RNA, 19 nt, Homo sapiens
caaauccagucaugaaugg

SEQ ID NO: 1524636 - RNA, 19 nt, Homo sapiens
ggaauaacuucacuuucag

SEQ ID NO: 1524637 - RNA, 19 nt, Homo sapiens
aggcguacauuaucaauau

SEQ ID NO: 1524638 - RNA, 19 nt, Homo sapiens
cuaugaaagugaagugaaa

SEQ ID NO: 1524639 - RNA, 19 nt, Homo sapiens
gcaccauccugcauuucaa

SEQ ID NO: 1524640 - RNA, 19 nt, Homo sapiens
ucaaagaugaccagggaua

SEQ ID NO: 1524641 - RNA, 19 nt, Homo sapiens
gcaaagaaggcuauacucu

SEQ ID NO: 1524642 - RNA, 19 nt, Homo sapiens
cuugugacauacuuucuua

SEQ ID NO: 1524643 - RNA, 19 nt, Homo sapiens
gaauguguccaucaaaugu

SEQ ID NO: 1524644 - RNA, 19 nt, Homo sapiens
gaaagcacgauuauuuauc

SEQ ID NO: 1524645 - RNA, 19 nt, Homo sapiens
ugagggaguuaacauauca

SEQ ID NO: 1524646 - RNA, 19 nt, Homo sapiens
gauguggguuucgccauuu

SEQ ID NO: 1524647 - RNA, 19 nt, Homo sapiens
ccagugaaguguucuaguc

SEQ ID NO: 1524648 - RNA, 19 nt, Homo sapiens
ggacgggacauaacuguuc

SEQ ID NO: 1524649 - RNA, 19 nt, Homo sapiens
gaagugaaacucagauguc

SEQ ID NO: 1524650 - RNA, 19 nt, Homo sapiens
cagaauguguuccaguaga

SEQ ID NO: 1524651 - RNA, 19 nt, Homo sapiens
gauccagaauggcuucaug

SEQ ID NO: 1524652 - RNA, 19 nt, Homo sapiens
agaaccaccugccaucaaa

SEQ ID NO: 1524653 - RNA, 19 nt, Homo sapiens
acagggcccuuccauuauu

SEQ ID NO: 1524654 - RNA, 19 nt, Homo sapiens
gaauuggugggaaauacua

SEQ ID NO: 1524655 - RNA, 19 nt, Homo sapiens
ggaguugaccaccgaggua

SEQ ID NO: 1524656 - RNA, 19 nt, Homo sapiens
gcaggaucuuugagaguga

SEQ ID NO: 1524657 - RNA, 19 nt, Homo sapiens
gauacauguuggaggguuu

SEQ ID NO: 1524658 - RNA, 19 nt, Homo sapiens
gcaguaaauacaccuuuga

SEQ ID NO: 1524659 - RNA, 19 nt, Homo sapiens
ggauacagauguggguuuc

SEQ ID NO: 1524660 - RNA, 19 nt, Homo sapiens
gaggagacgaguacacauu

SEQ ID NO: 1524661 - RNA, 19 nt, Homo sapiens
cauccugcauuucaauuga

SEQ ID NO: 1524662 - RNA, 19 nt, Homo sapiens
ggucccagcugaaagauga

SEQ ID NO: 1524663 - RNA, 19 nt, Homo sapiens
gcugaaagaugaggacuug

SEQ ID NO: 1524664 - RNA, 19 nt, Homo sapiens
uaaagagacugggaaaugu

SEQ ID NO: 1524665 - RNA, 19 nt, Homo sapiens
gggccaagcugacauccaa

SEQ ID NO: 1524666 - RNA, 19 nt, Homo sapiens
cuaacuagcauuccuuuaa

SEQ ID NO: 1524667 - RNA, 19 nt, Homo sapiens
uagcauuccuuuaaagaga

SEQ ID NO: 1524668 - RNA, 19 nt, Homo sapiens
gcaagcaaccuuccaaguc

SEQ ID NO: 1524669 - RNA, 19 nt, Homo sapiens
ccacaggaaugccacaaca

SEQ ID NO: 1524670 - RNA, 19 nt, Homo sapiens
cacaacagcccgcagcaua

SEQ ID NO: 1524671 - RNA, 19 nt, Homo sapiens
gugaucgccuccauuguga

SEQ ID NO: 1524672 - RNA, 19 nt, Homo sapiens
gcaauaaacuucuuuucag

SEQ ID NO: 1524673 - RNA, 19 nt, Homo sapiens
gaaucagcuuccaggugua

SEQ ID NO: 1524674 - RNA, 19 nt, Homo sapiens
uuaaagagacugggaaaug

SEQ ID NO: 1524675 - RNA, 19 nt, Homo sapiens
ucaagugcgugaagaagag

SEQ ID NO: 1524676 - RNA, 19 nt, Homo sapiens
ccucaagcacuucaacaaa

SEQ ID NO: 1524677 - RNA, 19 nt, Homo sapiens
ccacuacugaggguaauuu

SEQ ID NO: 1524678 - RNA, 19 nt, Homo sapiens
ugaaagaugaggacuugga

SEQ ID NO: 1524679 - RNA, 19 nt, Homo sapiens
caacagcccgcagcauaug

SEQ ID NO: 1524680 - RNA, 19 nt, Homo sapiens
ccaaguccuucguggcaau

SEQ ID NO: 1524681 - RNA, 19 nt, Homo sapiens
ccgcauaccuuggccucaa

SEQ ID NO: 1524682 - RNA, 19 nt, Homo sapiens
aaaccacuacugaggguaa

SEQ ID NO: 1524683 - RNA, 19 nt, Homo sapiens
ggacuacuugaaaccacua

SEQ ID NO: 1524684 - RNA, 19 nt, Homo sapiens
guuauggacuacuugaaac

SEQ ID NO: 1524685 - RNA, 19 nt, Homo sapiens
cacgagaccuuuggcuuca

SEQ ID NO: 1524686 - RNA, 19 nt, Homo sapiens
aaagagacugggaaauguu

SEQ ID NO: 1524687 - RNA, 19 nt, Homo sapiens
uauccuggccguaacgauu

SEQ ID NO: 1524688 - RNA, 19 nt, Homo sapiens
gggaaauguuuuaagcaaa

SEQ ID NO: 1524689 - RNA, 19 nt, Homo sapiens
gccaucauccugcucaugu

SEQ ID NO: 1524690 - RNA, 19 nt, Homo sapiens
aguguucuguuccggcaua

SEQ ID NO: 1524691 - RNA, 19 nt, Homo sapiens
gccgugaucgccuccauug

SEQ ID NO: 1524692 - RNA, 19 nt, Homo sapiens
cagcuacaacuccacauca

SEQ ID NO: 1524693 - RNA, 19 nt, Homo sapiens
cgugaucgccuccauugug

SEQ ID NO: 1524694 - RNA, 19 nt, Homo sapiens
aagagacugggaaauguuu

SEQ ID NO: 1524695 - RNA, 19 nt, Homo sapiens
ccacuaacuagcauuccuu

SEQ ID NO: 1524696 - RNA, 19 nt, Homo sapiens
acaacagcccgcagcauau

SEQ ID NO: 1524697 - RNA, 19 nt, Homo sapiens
agacggugcaggccgcaua

SEQ ID NO: 1524698 - RNA, 19 nt, Homo sapiens
cgagaccuuuggcuucaag

SEQ ID NO: 1524699 - RNA, 19 nt, Homo sapiens
cucaagcacuucaacaaac

SEQ ID NO: 1524700 - RNA, 19 nt, Homo sapiens
ccugcugccuccucaagug

SEQ ID NO: 1524701 - RNA, 19 nt, Homo sapiens
gagacugggaaauguuuua

SEQ ID NO: 1524702 - RNA, 19 nt, Homo sapiens
aguuauggacuacuugaaa

SEQ ID NO: 1524703 - RNA, 19 nt, Homo sapiens
gcuucaagguggccgugau

SEQ ID NO: 1524704 - RNA, 19 nt, Homo sapiens
ugugagcugugccaucauc

SEQ ID NO: 1524705 - RNA, 19 nt, Homo sapiens
auugugagcugugccauca

SEQ ID NO: 1524706 - RNA, 19 nt, Homo sapiens
ggugcaggccgcauaccuu

SEQ ID NO: 1524707 - RNA, 19 nt, Homo sapiens
ccaaagaccuucugauuga

SEQ ID NO: 1524708 - RNA, 19 nt, Homo sapiens
ccacugagcuauaaauuga

SEQ ID NO: 1524709 - RNA, 19 nt, Homo sapiens
gcaccuaucuaugcauuua

SEQ ID NO: 1524710 - RNA, 19 nt, Homo sapiens
uaccaugacugcuuaauua

SEQ ID NO: 1524711 - RNA, 19 nt, Homo sapiens
caacaagaguguaucauga

SEQ ID NO: 1524712 - RNA, 19 nt, Homo sapiens
gaacuuugcuaaugucugu

SEQ ID NO: 1524713 - RNA, 19 nt, Homo sapiens
ccacagaacuuugcuaaug

SEQ ID NO: 1524714 - RNA, 19 nt, Homo sapiens
gugaacaccugcacuauga

SEQ ID NO: 1524715 - RNA, 19 nt, Homo sapiens
gaaagacaguuuauaccau

SEQ ID NO: 1524716 - RNA, 19 nt, Homo sapiens
gaccugagacuuuccaaua

SEQ ID NO: 1524717 - RNA, 19 nt, Homo sapiens
gagaaucugucuuuaucaa

SEQ ID NO: 1524718 - RNA, 19 nt, Homo sapiens
caccacaccuagcuaauuu

SEQ ID NO: 1524719 - RNA, 19 nt, Homo sapiens
acacacacauacacuuaua

SEQ ID NO: 1524720 - RNA, 19 nt, Homo sapiens
uagaaaggaucaaauggaa

SEQ ID NO: 1524721 - RNA, 19 nt, Homo sapiens
ugaaguggcugaguggaua

SEQ ID NO: 1524722 - RNA, 19 nt, Homo sapiens
gcaaauuuguugugcuguu

SEQ ID NO: 1524723 - RNA, 19 nt, Homo sapiens
caguguaaauuaugccuua

SEQ ID NO: 1524724 - RNA, 19 nt, Homo sapiens
aaacauggcaccaaagaaa

SEQ ID NO: 1524725 - RNA, 19 nt, Homo sapiens
ucucaaagaugucccaguu

SEQ ID NO: 1524726 - RNA, 19 nt, Homo sapiens
gaaaggaucaaauggaaca

SEQ ID NO: 1524727 - RNA, 19 nt, Homo sapiens
ccaaagcgcuaggauuaga

SEQ ID NO: 1524728 - RNA, 19 nt, Homo sapiens
ccagagaguugggaccaua

SEQ ID NO: 1524729 - RNA, 19 nt, Homo sapiens
caaagcaacagguaauuga

SEQ ID NO: 1524730 - RNA, 19 nt, Homo sapiens
ggaguacaaugacacaauc

SEQ ID NO: 1524731 - RNA, 19 nt, Homo sapiens
agauaaauguagccucaua

SEQ ID NO: 1524732 - RNA, 19 nt, Homo sapiens
aaacugaugucccugugaa

SEQ ID NO: 1524733 - RNA, 19 nt, Homo sapiens
cgagaaaacugaagccuaa

SEQ ID NO: 1524734 - RNA, 19 nt, Homo sapiens
gaggagggaugagaagcua

SEQ ID NO: 1524735 - RNA, 19 nt, Homo sapiens
ucccaaagcgcuaggauua

SEQ ID NO: 1524736 - RNA, 19 nt, Homo sapiens
cuacugggcucaagacauc

SEQ ID NO: 1524737 - RNA, 19 nt, Homo sapiens
gaacauuuaggaagcaaga

SEQ ID NO: 1524738 - RNA, 19 nt, Homo sapiens
cacauacacuuauacauag

SEQ ID NO: 1524739 - RNA, 19 nt, Homo sapiens
gcaaucacagauaaaugua

SEQ ID NO: 1524740 - RNA, 19 nt, Homo sapiens
ccaauuuacugaagauagu

SEQ ID NO: 1524741 - RNA, 19 nt, Homo sapiens
ucaggauuguuccacuuua

SEQ ID NO: 1524742 - RNA, 19 nt, Homo sapiens
gcauugccaugacaucuca

SEQ ID NO: 1524743 - RNA, 19 nt, Homo sapiens
ugagaagguuucccaacaa

SEQ ID NO: 1524744 - RNA, 19 nt, Homo sapiens
gaugagaagcuacugcuau

SEQ ID NO: 1524745 - RNA, 19 nt, Homo sapiens
gauaaauguagccucauaa

SEQ ID NO: 1524746 - RNA, 19 nt, Homo sapiens
guaacuguuucgcaacuga

SEQ ID NO: 1524747 - RNA, 19 nt, Homo sapiens
gagaagguuucccaacaag

SEQ ID NO: 1524748 - RNA, 19 nt, Homo sapiens
auagaaacauggcaccaaa

SEQ ID NO: 1524749 - RNA, 19 nt, Homo sapiens
gaacaccugcacuaugaga

SEQ ID NO: 1524750 - RNA, 19 nt, Homo sapiens
cuaaucaucuguaucaaac

SEQ ID NO: 1524751 - RNA, 19 nt, Homo sapiens
gagacuaugcccaugauau

SEQ ID NO: 1524752 - RNA, 19 nt, Homo sapiens
caaguuauucucaaagaug

SEQ ID NO: 1524753 - RNA, 19 nt, Homo sapiens
caaagaccuucugauugaa

SEQ ID NO: 1524754 - RNA, 19 nt, Homo sapiens
uuuauaccaugacugcuua

SEQ ID NO: 1524755 - RNA, 19 nt, Homo sapiens
gaaacauggcaccaaagaa

SEQ ID NO: 1524756 - RNA, 19 nt, Homo sapiens
caauuuacgcucugaauag

SEQ ID NO: 1524757 - RNA, 19 nt, Homo sapiens
ggaacuagaagugcacuga

SEQ ID NO: 1524758 - RNA, 19 nt, Homo sapiens
aggaguagauguccauuuc

SEQ ID NO: 1524759 - RNA, 19 nt, Homo sapiens
cacagaacuuugcuaaugu

SEQ ID NO: 1524760 - RNA, 19 nt, Homo sapiens
gccaugacaucucaaagca

SEQ ID NO: 1524761 - RNA, 19 nt, Homo sapiens
gcucuggaauggauugaca

SEQ ID NO: 1524762 - RNA, 19 nt, Homo sapiens
auacacacacauacacuua

SEQ ID NO: 1524763 - RNA, 19 nt, Homo sapiens
gucaaguuauucucaaaga

SEQ ID NO: 1524764 - RNA, 19 nt, Homo sapiens
ucagaaagacaguuuauac

SEQ ID NO: 1524765 - RNA, 19 nt, Homo sapiens
uaucaccauuguaguagaa

SEQ ID NO: 1524766 - RNA, 19 nt, Homo sapiens
caaauuuguugugcuguuc

SEQ ID NO: 1524767 - RNA, 19 nt, Homo sapiens
uagcaccuaucuaugcauu

SEQ ID NO: 1524768 - RNA, 19 nt, Homo sapiens
gaacauuugacacacauac

SEQ ID NO: 1524769 - RNA, 19 nt, Homo sapiens
ucacugcagccuuuaacua

SEQ ID NO: 1524770 - RNA, 19 nt, Homo sapiens
caacgucagccuaguuuca

SEQ ID NO: 1524771 - RNA, 19 nt, Homo sapiens
aaauguagccucauaacug

SEQ ID NO: 1524772 - RNA, 19 nt, Homo sapiens
gaguagauguccauuucuc

SEQ ID NO: 1524773 - RNA, 19 nt, Homo sapiens
guaacugacuauaaacacu

SEQ ID NO: 1524774 - RNA, 19 nt, Homo sapiens
acaauuuacgcucugaaua

SEQ ID NO: 1524775 - RNA, 19 nt, Homo sapiens
ccaacaagaguguaucaug

SEQ ID NO: 1524776 - RNA, 19 nt, Homo sapiens
gaagguuucccaacaagag

SEQ ID NO: 1524777 - RNA, 19 nt, Homo sapiens
ugucuccacugagcuauaa

SEQ ID NO: 1524778 - RNA, 19 nt, Homo sapiens
acaguucaguggccuaaau

SEQ ID NO: 1524779 - RNA, 19 nt, Homo sapiens
gaagucauguacaguucag

SEQ ID NO: 1524780 - RNA, 19 nt, Homo sapiens
uaaaagcuaucaccauugu

SEQ ID NO: 1524781 - RNA, 19 nt, Homo sapiens
uacauucugucuccacuga

SEQ ID NO: 1524782 - RNA, 19 nt, Homo sapiens
uacugaagauaguuccaua

SEQ ID NO: 1524783 - RNA, 19 nt, Homo sapiens
ccaguugccuagaaaggau

SEQ ID NO: 1524784 - RNA, 19 nt, Homo sapiens
uugcaagccuacucugaaa

SEQ ID NO: 1524785 - RNA, 19 nt, Homo sapiens
acaagaguguaucaugaug

SEQ ID NO: 1524786 - RNA, 19 nt, Homo sapiens
gggagacuaugcccaugau

SEQ ID NO: 1524787 - RNA, 19 nt, Homo sapiens
aauguagccucauaacugu

SEQ ID NO: 1524788 - RNA, 19 nt, Homo sapiens
uuuacgcucugaauagaaa

SEQ ID NO: 1524789 - RNA, 19 nt, Homo sapiens
gaauuauguuuagcaccuu

SEQ ID NO: 1524790 - RNA, 19 nt, Homo sapiens
gaggaguagauguccauuu

SEQ ID NO: 1524791 - RNA, 19 nt, Homo sapiens
gacccucuccuuucccuuu

SEQ ID NO: 1524792 - RNA, 19 nt, Homo sapiens
cuggcucccuucuuguuua

SEQ ID NO: 1524793 - RNA, 19 nt, Homo sapiens
cuagaaaggaucaaaugga

SEQ ID NO: 1524794 - RNA, 19 nt, Homo sapiens
cuacagaccucaucaaaac

SEQ ID NO: 1524795 - RNA, 19 nt, Homo sapiens
gggaggucuugcuauguug

SEQ ID NO: 1524796 - RNA, 19 nt, Homo sapiens
ccaccacaccuagcuaauu

SEQ ID NO: 1524797 - RNA, 19 nt, Homo sapiens
caguuugaccugagacuuu

SEQ ID NO: 1524798 - RNA, 19 nt, Homo sapiens
cagccuaguuucacucagu

SEQ ID NO: 1524799 - RNA, 19 nt, Homo sapiens
gagaagcuacugcuaucug

SEQ ID NO: 1524800 - RNA, 19 nt, Homo sapiens
uuuccaccauuguaacaua

SEQ ID NO: 1524801 - RNA, 19 nt, Homo sapiens
agagagagauuuucgguau

SEQ ID NO: 1524802 - RNA, 19 nt, Homo sapiens
cccaaagaccuucugauug

SEQ ID NO: 1524803 - RNA, 19 nt, Homo sapiens
ggaagcaagaugucuagca

SEQ ID NO: 1524804 - RNA, 19 nt, Homo sapiens
cugcugcucugggaaauga

SEQ ID NO: 1524805 - RNA, 19 nt, Homo sapiens
acacuuauacauagagaga

SEQ ID NO: 1524806 - RNA, 19 nt, Homo sapiens
ccuaaucaucuguaucaaa

SEQ ID NO: 1524807 - RNA, 19 nt, Homo sapiens
ggaauaagcuguucuuugg

SEQ ID NO: 1524808 - RNA, 19 nt, Homo sapiens
gagauuugcuguuucauaa

SEQ ID NO: 1524809 - RNA, 19 nt, Homo sapiens
gggcagacaugcugaagua

SEQ ID NO: 1524810 - RNA, 19 nt, Homo sapiens
ggaggcacauuucgucuaa

SEQ ID NO: 1524811 - RNA, 19 nt, Homo sapiens
ggagagauuugcuguuuca

SEQ ID NO: 1524812 - RNA, 19 nt, Homo sapiens
gaaacaaacgccauaccua

SEQ ID NO: 1524813 - RNA, 19 nt, Homo sapiens
caggagagauuugcuguuu

SEQ ID NO: 1524814 - RNA, 19 nt, Homo sapiens
guacuuaaguugaacaucu

SEQ ID NO: 1524815 - RNA, 19 nt, Homo sapiens
gcagagcacuccuaugucu

SEQ ID NO: 1524816 - RNA, 19 nt, Homo sapiens
ggaagacgguggcgaucaa

SEQ ID NO: 1524817 - RNA, 19 nt, Homo sapiens
gaacaucuaggucuaugaa

SEQ ID NO: 1524818 - RNA, 19 nt, Homo sapiens
gcugaaguaugucaucaaa

SEQ ID NO: 1524819 - RNA, 19 nt, Homo sapiens
aaacaaacgccauaccuaa

SEQ ID NO: 1524820 - RNA, 19 nt, Homo sapiens
caaccgcucucugcuugua

SEQ ID NO: 1524821 - RNA, 19 nt, Homo sapiens
gagagaagaggaggagaua

SEQ ID NO: 1524822 - RNA, 19 nt, Homo sapiens
cagcagagcacuccuaugu

SEQ ID NO: 1524823 - RNA, 19 nt, Homo sapiens
gcacuccuaugucuugauc

SEQ ID NO: 1524824 - RNA, 19 nt, Homo sapiens
acacuugauugaguacuua

SEQ ID NO: 1524825 - RNA, 19 nt, Homo sapiens
cauagacacuugauugagu

SEQ ID NO: 1524826 - RNA, 19 nt, Homo sapiens
ggacagugccagugugguu

SEQ ID NO: 1524827 - RNA, 19 nt, Homo sapiens
gaccagggcacaccaaaga

SEQ ID NO: 1524828 - RNA, 19 nt, Homo sapiens
uaucagaguugaaacaaac

SEQ ID NO: 1524829 - RNA, 19 nt, Homo sapiens
uugagagacuuuaccagua

SEQ ID NO: 1524830 - RNA, 19 nt, Homo sapiens
caucuaggucuaugaauga

SEQ ID NO: 1524831 - RNA, 19 nt, Homo sapiens
ccugugagcuagaaaguag

SEQ ID NO: 1524832 - RNA, 19 nt, Homo sapiens
cuacaugaugacagaauua

SEQ ID NO: 1524833 - RNA, 19 nt, Homo sapiens
gggagaguauaucauuuua

SEQ ID NO: 1524834 - RNA, 19 nt, Homo sapiens
gcagacaugcugaaguaug

SEQ ID NO: 1524835 - RNA, 19 nt, Homo sapiens
gaaauugggagaguauauc

SEQ ID NO: 1524836 - RNA, 19 nt, Homo sapiens
ugagagacuuuaccaguac

SEQ ID NO: 1524837 - RNA, 19 nt, Homo sapiens
gacacuugauugaguacuu

SEQ ID NO: 1524838 - RNA, 19 nt, Homo sapiens
auagacacuugauugagua

SEQ ID NO: 1524839 - RNA, 19 nt, Homo sapiens
gguuaaaacuacaugauga

SEQ ID NO: 1524840 - RNA, 19 nt, Homo sapiens
gggcugagucuucacuuug

SEQ ID NO: 1524841 - RNA, 19 nt, Homo sapiens
ggaaacaagacagauggaa

SEQ ID NO: 1524842 - RNA, 19 nt, Homo sapiens
aguaucuggugcacaaaua

SEQ ID NO: 1524843 - RNA, 19 nt, Homo sapiens
acaucuaggucuaugaaug

SEQ ID NO: 1524844 - RNA, 19 nt, Homo sapiens
gauggaagucccggaguuu

SEQ ID NO: 1524845 - RNA, 19 nt, Homo sapiens
aggaguaucuggugcacaa

SEQ ID NO: 1524846 - RNA, 19 nt, Homo sapiens
gcuuguauuugccuaguuc

SEQ ID NO: 1524847 - RNA, 19 nt, Homo sapiens
gugacaagugccaguguua

SEQ ID NO: 1524848 - RNA, 19 nt, Homo sapiens
agagauuugcuguuucaua

SEQ ID NO: 1524849 - RNA, 19 nt, Homo sapiens
uacaggaaauaaacugguu

SEQ ID NO: 1524850 - RNA, 19 nt, Homo sapiens
aaacaagacagauggaagu

SEQ ID NO: 1524851 - RNA, 19 nt, Homo sapiens
gucagugucuguugcacaa

SEQ ID NO: 1524852 - RNA, 19 nt, Homo sapiens
aaagaaauugggagaguau

SEQ ID NO: 1524853 - RNA, 19 nt, Homo sapiens
gcuguucuuuggagguuug

SEQ ID NO: 1524854 - RNA, 19 nt, Homo sapiens
uggaauaagcuguucuuug

SEQ ID NO: 1524855 - RNA, 19 nt, Homo sapiens
caaacgccauaccuaagca

SEQ ID NO: 1524856 - RNA, 19 nt, Homo sapiens
uaucuguguuccaguucua

SEQ ID NO: 1524857 - RNA, 19 nt, Homo sapiens
ucaaaggaaacaagacaga

SEQ ID NO: 1524858 - RNA, 19 nt, Homo sapiens
gagcuuccucccugagauu

SEQ ID NO: 1524859 - RNA, 19 nt, Homo sapiens
ucucagugauuuagcuuuc

SEQ ID NO: 1524860 - RNA, 19 nt, Homo sapiens
ugauuacucuggacucgau

SEQ ID NO: 1524861 - RNA, 19 nt, Homo sapiens
gagcacuccuaugucuuga

SEQ ID NO: 1524862 - RNA, 19 nt, Homo sapiens
gcucucugcuuguauuugc

SEQ ID NO: 1524863 - RNA, 19 nt, Homo sapiens
gauugaguacuuaaguuga

SEQ ID NO: 1524864 - RNA, 19 nt, Homo sapiens
caggaaauaaacugguuaa

SEQ ID NO: 1524865 - RNA, 19 nt, Homo sapiens
ucagugauuuagcuuucaa

SEQ ID NO: 1524866 - RNA, 19 nt, Homo sapiens
gcugagucuucacuuuguu

SEQ ID NO: 1524867 - RNA, 19 nt, Homo sapiens
gucuuuggguucuaucuga

SEQ ID NO: 1524868 - RNA, 19 nt, Homo sapiens
ugaaguaugucaucaaaag

SEQ ID NO: 1524869 - RNA, 19 nt, Homo sapiens
gaauaagcuguucuuugga

SEQ ID NO: 1524870 - RNA, 19 nt, Homo sapiens
ccaguucuauuugucuuuc

SEQ ID NO: 1524871 - RNA, 19 nt, Homo sapiens
ccaaugcaagugccaguug

SEQ ID NO: 1524872 - RNA, 19 nt, Homo sapiens
gcauuggaauaagcuguuc

SEQ ID NO: 1524873 - RNA, 19 nt, Homo sapiens
gaagacgguggcgaucaaa

SEQ ID NO: 1524874 - RNA, 19 nt, Homo sapiens
gaugaucauuuuacaggaa

SEQ ID NO: 1524875 - RNA, 19 nt, Homo sapiens
ggcugagucuucacuuugu

SEQ ID NO: 1524876 - RNA, 19 nt, Homo sapiens
agauggaagucccggaguu

SEQ ID NO: 1524877 - RNA, 19 nt, Homo sapiens
aaaggaaacaagacagaug

SEQ ID NO: 1524878 - RNA, 19 nt, Homo sapiens
aaaacuacaugaugacaga

SEQ ID NO: 1524879 - RNA, 19 nt, Homo sapiens
caucugaccuccccgaguu

SEQ ID NO: 1524880 - RNA, 19 nt, Homo sapiens
gagagacuuuaccaguaca

SEQ ID NO: 1524881 - RNA, 19 nt, Homo sapiens
uaaaagaaauugggagagu

SEQ ID NO: 1524882 - RNA, 19 nt, Homo sapiens
gcucucaaaggaaacaaga

SEQ ID NO: 1524883 - RNA, 19 nt, Homo sapiens
ccuaugucuugaucagaaa

SEQ ID NO: 1524884 - RNA, 19 nt, Homo sapiens
ggagguuugagagacuuua

SEQ ID NO: 1524885 - RNA, 19 nt, Homo sapiens
agaaauugggagaguauau

SEQ ID NO: 1524886 - RNA, 19 nt, Homo sapiens
ugauugaguacuuaaguug

SEQ ID NO: 1524887 - RNA, 19 nt, Homo sapiens
aaucgauccugcccugguu

SEQ ID NO: 1524888 - RNA, 19 nt, Homo sapiens
uccuaugucuugaucagaa

SEQ ID NO: 1524889 - RNA, 19 nt, Homo sapiens
gccuguaacuuauuauagc

SEQ ID NO: 1524890 - RNA, 19 nt, Homo sapiens
aaaagaaauugggagagua

SEQ ID NO: 1524891 - RNA, 19 nt, Homo sapiens
gcaggagagauuugcuguu

SEQ ID NO: 1524892 - RNA, 19 nt, Homo sapiens
gugcugggguccugacuuu

SEQ ID NO: 1524893 - RNA, 19 nt, Homo sapiens
gcuggagcaaguaucagua

SEQ ID NO: 1524894 - RNA, 19 nt, Homo sapiens
cgugacaagugccaguguu

SEQ ID NO: 1524895 - RNA, 19 nt, Homo sapiens
ggaagucccggaguuugug

SEQ ID NO: 1524896 - RNA, 19 nt, Homo sapiens
acucuggacucgaucuuca

SEQ ID NO: 1524897 - RNA, 19 nt, Homo sapiens
guuagucuuuggguucuau

SEQ ID NO: 1524898 - RNA, 19 nt, Homo sapiens
acccggcuccugaugauua

SEQ ID NO: 1524899 - RNA, 19 nt, Homo sapiens
gaugacagaauuauaucag

SEQ ID NO: 1524900 - RNA, 19 nt, Homo sapiens
acuacaugaugacagaauu

SEQ ID NO: 1524901 - RNA, 19 nt, Homo sapiens
cagugugguugcaaucuca

SEQ ID NO: 1524902 - RNA, 19 nt, Homo sapiens
gacaagugccaguguuagu

SEQ ID NO: 1524903 - RNA, 19 nt, Homo sapiens
caaaggaaacaagacagau

SEQ ID NO: 1524904 - RNA, 19 nt, Homo sapiens
gauuuagcuuucaauuugc

SEQ ID NO: 1524905 - RNA, 19 nt, Homo sapiens
gcaaucccacgcucuaggu

SEQ ID NO: 1524906 - RNA, 19 nt, Homo sapiens
gcucaucaccaaagcuagu

SEQ ID NO: 1524907 - RNA, 19 nt, Homo sapiens
gaagaaaucgugaugaaau

SEQ ID NO: 1524908 - RNA, 19 nt, Homo sapiens
gagcugaacugggaugaaa

SEQ ID NO: 1524909 - RNA, 19 nt, Homo sapiens
gcaaucaacugcccacaca

SEQ ID NO: 1524910 - RNA, 19 nt, Homo sapiens
caaccuaucugaucucauc

SEQ ID NO: 1524911 - RNA, 19 nt, Homo sapiens
aagcauagcuguuaaacug

SEQ ID NO: 1524912 - RNA, 19 nt, Homo sapiens
gacugaaccugaugacuuu

SEQ ID NO: 1524913 - RNA, 19 nt, Homo sapiens
ggcaauugcuucucaggua

SEQ ID NO: 1524914 - RNA, 19 nt, Homo sapiens
uugaagagcuccaguuuga

SEQ ID NO: 1524915 - RNA, 19 nt, Homo sapiens
aguaauaucuucccucuga

SEQ ID NO: 1524916 - RNA, 19 nt, Homo sapiens
ggaaggaucucacaaacac

SEQ ID NO: 1524917 - RNA, 19 nt, Homo sapiens
ggacuuagcagccuccuau

SEQ ID NO: 1524918 - RNA, 19 nt, Homo sapiens
ccagugaccucuugauaau

SEQ ID NO: 1524919 - RNA, 19 nt, Homo sapiens
uagaagaaaucgugaugaa

SEQ ID NO: 1524920 - RNA, 19 nt, Homo sapiens
cuaagucucugaaugugua

SEQ ID NO: 1524921 - RNA, 19 nt, Homo sapiens
ggcaaccugucuucuguua

SEQ ID NO: 1524922 - RNA, 19 nt, Homo sapiens
gaaacagcauugaucauac

SEQ ID NO: 1524923 - RNA, 19 nt, Homo sapiens
gagcuccaguuugacauua

SEQ ID NO: 1524924 - RNA, 19 nt, Homo sapiens
cagccaagcuccuggacua

SEQ ID NO: 1524925 - RNA, 19 nt, Homo sapiens
gcacaaaggccgcuuaugc

SEQ ID NO: 1524926 - RNA, 19 nt, Homo sapiens
ugguucagcuguauaguua

SEQ ID NO: 1524927 - RNA, 19 nt, Homo sapiens
caacgacucugccucuuag

SEQ ID NO: 1524928 - RNA, 19 nt, Homo sapiens
gcaccacgauacccucuga

SEQ ID NO: 1524929 - RNA, 19 nt, Homo sapiens
ccacgauacccucugauua

SEQ ID NO: 1524930 - RNA, 19 nt, Homo sapiens
gguuagaggcuacagauuu

SEQ ID NO: 1524931 - RNA, 19 nt, Homo sapiens
cgacggccauccacuuauu

SEQ ID NO: 1524932 - RNA, 19 nt, Homo sapiens
gaugaacugucucacacaa

SEQ ID NO: 1524933 - RNA, 19 nt, Homo sapiens
gguagcaaauugucaaauc

SEQ ID NO: 1524934 - RNA, 19 nt, Homo sapiens
guagcaaauugucaaauca

SEQ ID NO: 1524935 - RNA, 19 nt, Homo sapiens
ggaaacaucaccuguccaa

SEQ ID NO: 1524936 - RNA, 19 nt, Homo sapiens
gggccaaucuacaaauaug

SEQ ID NO: 1524937 - RNA, 19 nt, Homo sapiens
ggcaacaucuuuuacauaa

SEQ ID NO: 1524938 - RNA, 19 nt, Homo sapiens
agaaacagcauugaucaua

SEQ ID NO: 1524939 - RNA, 19 nt, Homo sapiens
cccagaagcuuccugaguu

SEQ ID NO: 1524940 - RNA, 19 nt, Homo sapiens
gauucaggcuccuacagaa

SEQ ID NO: 1524941 - RNA, 19 nt, Homo sapiens
guuagaggcuacagauuuc

SEQ ID NO: 1524942 - RNA, 19 nt, Homo sapiens
ggaauccauuggcuugaga

SEQ ID NO: 1524943 - RNA, 19 nt, Homo sapiens
gaagagcuccaguuugaca

SEQ ID NO: 1524944 - RNA, 19 nt, Homo sapiens
gcaucagccuggaagagaa

SEQ ID NO: 1524945 - RNA, 19 nt, Homo sapiens
ccaguucuauacaagauga

SEQ ID NO: 1524946 - RNA, 19 nt, Homo sapiens
gcaccuguaucccacugaa

SEQ ID NO: 1524947 - RNA, 19 nt, Homo sapiens
gcaccagaauaccaggaaa

SEQ ID NO: 1524948 - RNA, 19 nt, Homo sapiens
cacuauggcuuacuguuga

SEQ ID NO: 1524949 - RNA, 19 nt, Homo sapiens
caauauccaugucucauac

SEQ ID NO: 1524950 - RNA, 19 nt, Homo sapiens
ccaauauccaugucucaua

SEQ ID NO: 1524951 - RNA, 19 nt, Homo sapiens
gugggccaaucuacaaaua

SEQ ID NO: 1524952 - RNA, 19 nt, Homo sapiens
ggaaacugcagcacagcua

SEQ ID NO: 1524953 - RNA, 19 nt, Homo sapiens
cccaagagcccaagaauuc

SEQ ID NO: 1524954 - RNA, 19 nt, Homo sapiens
caauacacaugagaauaga

SEQ ID NO: 1524955 - RNA, 19 nt, Homo sapiens
aggcacagguggaauagaa

SEQ ID NO: 1524956 - RNA, 19 nt, Homo sapiens
cacccaggaugccacaaua

SEQ ID NO: 1524957 - RNA, 19 nt, Homo sapiens
caaauuggaaaccauguug

SEQ ID NO: 1524958 - RNA, 19 nt, Homo sapiens
gauccaauuucaagaaggu

SEQ ID NO: 1524959 - RNA, 19 nt, Homo sapiens
uuagcagccuccuauauug

SEQ ID NO: 1524960 - RNA, 19 nt, Homo sapiens
ggguagauccuguguccua

SEQ ID NO: 1524961 - RNA, 19 nt, Homo sapiens
caacugggaagaagauaau

SEQ ID NO: 1524962 - RNA, 19 nt, Homo sapiens
gaaauccaacugggaagaa

SEQ ID NO: 1524963 - RNA, 19 nt, Homo sapiens
caauacacuuuaaccuuca

SEQ ID NO: 1524964 - RNA, 19 nt, Homo sapiens
cuguuaaacugacuugauu

SEQ ID NO: 1524965 - RNA, 19 nt, Homo sapiens
gcaugccucuaucucagaa

SEQ ID NO: 1524966 - RNA, 19 nt, Homo sapiens
gauacccucugauuauugg

SEQ ID NO: 1524967 - RNA, 19 nt, Homo sapiens
gcuccaguuugacauuauu

SEQ ID NO: 1524968 - RNA, 19 nt, Homo sapiens
cauccaggccugccaguaa

SEQ ID NO: 1524969 - RNA, 19 nt, Homo sapiens
ccaccaaccuaucugaucu

SEQ ID NO: 1524970 - RNA, 19 nt, Homo sapiens
uauacaagaugaacugucu

SEQ ID NO: 1524971 - RNA, 19 nt, Homo sapiens
ccuggagggucuaauaguu

SEQ ID NO: 1524972 - RNA, 19 nt, Homo sapiens
ccaaacauagaauggagua

SEQ ID NO: 1524973 - RNA, 19 nt, Homo sapiens
aaacaucaccuguccaagu

SEQ ID NO: 1524974 - RNA, 19 nt, Homo sapiens
agagaagccugaucccaau

SEQ ID NO: 1524975 - RNA, 19 nt, Homo sapiens
ccagaagcuuccugaguuc

SEQ ID NO: 1524976 - RNA, 19 nt, Homo sapiens
gcacagguggaauagaaga

SEQ ID NO: 1524977 - RNA, 19 nt, Homo sapiens
acacaugacccaaacauag

SEQ ID NO: 1524978 - RNA, 19 nt, Homo sapiens
cacgauacccucugauuau

SEQ ID NO: 1524979 - RNA, 19 nt, Homo sapiens
aacaucaccuguccaaguu

SEQ ID NO: 1524980 - RNA, 19 nt, Homo sapiens
ucacugagccugacaucug

SEQ ID NO: 1524981 - RNA, 19 nt, Homo sapiens
ggagacaucagcagcuuca

SEQ ID NO: 1524982 - RNA, 19 nt, Homo sapiens
gacucugccucuuagauga

SEQ ID NO: 1524983 - RNA, 19 nt, Homo sapiens
ucaggaaggaucucacaaa

SEQ ID NO: 1524984 - RNA, 19 nt, Homo sapiens
ucauacccauuuccucaaa

SEQ ID NO: 1524985 - RNA, 19 nt, Homo sapiens
agacugaaccugaugacuu

SEQ ID NO: 1524986 - RNA, 19 nt, Homo sapiens
cuacugaacaucuugcuau

SEQ ID NO: 1524987 - RNA, 19 nt, Homo sapiens
ggccauccacuuauuaaug

SEQ ID NO: 1524988 - RNA, 19 nt, Homo sapiens
caagaugaacugucucaca

SEQ ID NO: 1524989 - RNA, 19 nt, Homo sapiens
aucagcagcuucagaguuu

SEQ ID NO: 1524990 - RNA, 19 nt, Homo sapiens
acaacgacucugccucuua

SEQ ID NO: 1524991 - RNA, 19 nt, Homo sapiens
gacacaugacccaaacaua

SEQ ID NO: 1524992 - RNA, 19 nt, Homo sapiens
aaacagcauugaucauacu

SEQ ID NO: 1524993 - RNA, 19 nt, Homo sapiens
ugcaguggcugauggaaga

SEQ ID NO: 1524994 - RNA, 19 nt, Homo sapiens
caggaaggaucucacaaac

SEQ ID NO: 1524995 - RNA, 19 nt, Homo sapiens
acaauacacaugagaauag

SEQ ID NO: 1524996 - RNA, 19 nt, Homo sapiens
ucacaaacacccacccaau

SEQ ID NO: 1524997 - RNA, 19 nt, Homo sapiens
ccaagcuccuggacuaagu

SEQ ID NO: 1524998 - RNA, 19 nt, Homo sapiens
gugguuauccuggucauuu

SEQ ID NO: 1524999 - RNA, 19 nt, Homo sapiens
gaaggucuugccaguucua

SEQ ID NO: 1525000 - RNA, 19 nt, Homo sapiens
ccuccuauauuguucugaa

SEQ ID NO: 1525001 - RNA, 19 nt, Homo sapiens
ggacccauaacuaaggaaa

SEQ ID NO: 1525002 - RNA, 19 nt, Homo sapiens
gcaaauugucaaaucauac

SEQ ID NO: 1525003 - RNA, 19 nt, Homo sapiens
aaagaugguggaggacuua

SEQ ID NO: 1525004 - RNA, 19 nt, Homo sapiens
cugcggaacuguuuuaauu

SEQ ID NO: 1525005 - RNA, 19 nt, Homo sapiens
caucaccuguccaaguuca

SEQ ID NO: 1525006 - RNA, 19 nt, Homo sapiens
gcaagcaaugguagauuca

SEQ ID NO: 1525007 - RNA, 19 nt, Homo sapiens
ggaaacagguggagaauaa

SEQ ID NO: 1525008 - RNA, 19 nt, Homo sapiens
gcaagagaguuuguaauua

SEQ ID NO: 1525009 - RNA, 19 nt, Homo sapiens
gaaaggagacagugaauuu

SEQ ID NO: 1525010 - RNA, 19 nt, Homo sapiens
gguaagaacuggguuauuu

SEQ ID NO: 1525011 - RNA, 19 nt, Homo sapiens
ccucauagaugucauaauu

SEQ ID NO: 1525012 - RNA, 19 nt, Homo sapiens
gcaaaugucucuuggaaca

SEQ ID NO: 1525013 - RNA, 19 nt, Homo sapiens
ggaaacaggucuuacacaa

SEQ ID NO: 1525014 - RNA, 19 nt, Homo sapiens
gaagugaggcuccagauaa

SEQ ID NO: 1525015 - RNA, 19 nt, Homo sapiens
gaauaaagcggaaauguau

SEQ ID NO: 1525016 - RNA, 19 nt, Homo sapiens
gagacuauguauccauuua

SEQ ID NO: 1525017 - RNA, 19 nt, Homo sapiens
caacugcucuguauuuaug

SEQ ID NO: 1525018 - RNA, 19 nt, Homo sapiens
gagaagaaccucacaaaug

SEQ ID NO: 1525019 - RNA, 19 nt, Homo sapiens
ugucauggaucaagucuua

SEQ ID NO: 1525020 - RNA, 19 nt, Homo sapiens
aaacaggucuuacacaaau

SEQ ID NO: 1525021 - RNA, 19 nt, Homo sapiens
gaacagugccuuagaaugg

SEQ ID NO: 1525022 - RNA, 19 nt, Homo sapiens
caagguauaugaauuguag

SEQ ID NO: 1525023 - RNA, 19 nt, Homo sapiens
ggaagcuaguaaagaaaua

SEQ ID NO: 1525024 - RNA, 19 nt, Homo sapiens
gaaacaagucggaaucuga

SEQ ID NO: 1525025 - RNA, 19 nt, Homo sapiens
gacccaggauguaucuuua

SEQ ID NO: 1525026 - RNA, 19 nt, Homo sapiens
ugaaugcacuguauguaaa

SEQ ID NO: 1525027 - RNA, 19 nt, Homo sapiens
guucagaccuuuauagaca

SEQ ID NO: 1525028 - RNA, 19 nt, Homo sapiens
ggaaauguaugugcucuuc

SEQ ID NO: 1525029 - RNA, 19 nt, Homo sapiens
ggaggagucugaauguaga

SEQ ID NO: 1525030 - RNA, 19 nt, Homo sapiens
gaccaagccucguuauuca

SEQ ID NO: 1525031 - RNA, 19 nt, Homo sapiens
gauagaagacuuacagaga

SEQ ID NO: 1525032 - RNA, 19 nt, Homo sapiens
acacacacauacuacuuua

SEQ ID NO: 1525033 - RNA, 19 nt, Homo sapiens
caaggcaacuguaucauag

SEQ ID NO: 1525034 - RNA, 19 nt, Homo sapiens
gauacugacugugaaguuu

SEQ ID NO: 1525035 - RNA, 19 nt, Homo sapiens
gaaucaaggcucuguguuu

SEQ ID NO: 1525036 - RNA, 19 nt, Homo sapiens
aaacccaucuuccaaggua

SEQ ID NO: 1525037 - RNA, 19 nt, Homo sapiens
gaaguucucgagagugaua

SEQ ID NO: 1525038 - RNA, 19 nt, Homo sapiens
acacacugcuacuuauaua

SEQ ID NO: 1525039 - RNA, 19 nt, Homo sapiens
ccacugaaauuuguuaugu

SEQ ID NO: 1525040 - RNA, 19 nt, Homo sapiens
gagaauagagaaagaguug

SEQ ID NO: 1525041 - RNA, 19 nt, Homo sapiens
gcucuguguuucaagaaua

SEQ ID NO: 1525042 - RNA, 19 nt, Homo sapiens
ccagaacagugccuuagaa

SEQ ID NO: 1525043 - RNA, 19 nt, Homo sapiens
cuaguuaucuccaguuguu

SEQ ID NO: 1525044 - RNA, 19 nt, Homo sapiens
gaaacaggucuuacacaaa

SEQ ID NO: 1525045 - RNA, 19 nt, Homo sapiens
ggaucaggcucauaaagau

SEQ ID NO: 1525046 - RNA, 19 nt, Homo sapiens
gagcugaacuauggugcua

SEQ ID NO: 1525047 - RNA, 19 nt, Homo sapiens
gaauggaugugcccaacug

SEQ ID NO: 1525048 - RNA, 19 nt, Homo sapiens
caggauguaucuuuaauuc

SEQ ID NO: 1525049 - RNA, 19 nt, Homo sapiens
gaauaaugcaagagaguuu

SEQ ID NO: 1525050 - RNA, 19 nt, Homo sapiens
ggaacacacugccuuaaac

SEQ ID NO: 1525051 - RNA, 19 nt, Homo sapiens
agagaaaccucaccgaugu

SEQ ID NO: 1525052 - RNA, 19 nt, Homo sapiens
aauaagacauucaggcauu

SEQ ID NO: 1525053 - RNA, 19 nt, Homo sapiens
gagccuaguuccuuguuau

SEQ ID NO: 1525054 - RNA, 19 nt, Homo sapiens
gaagagagaccuuuuaaau

SEQ ID NO: 1525055 - RNA, 19 nt, Homo sapiens
ggagagacccuaugaaugc

SEQ ID NO: 1525056 - RNA, 19 nt, Homo sapiens
ugaauaaagcggaaaugua

SEQ ID NO: 1525057 - RNA, 19 nt, Homo sapiens
acacacacacugcuacuua

SEQ ID NO: 1525058 - RNA, 19 nt, Homo sapiens
ccaggucacucacuuuaga

SEQ ID NO: 1525059 - RNA, 19 nt, Homo sapiens
gaggaucacuaauucagau

SEQ ID NO: 1525060 - RNA, 19 nt, Homo sapiens
gguguaaacauaaagcaua

SEQ ID NO: 1525061 - RNA, 19 nt, Homo sapiens
ggauuuacagacagauuua

SEQ ID NO: 1525062 - RNA, 19 nt, Homo sapiens
caacauaugaugcugcuau

SEQ ID NO: 1525063 - RNA, 19 nt, Homo sapiens
ccaaggcaacuguaucaua

SEQ ID NO: 1525064 - RNA, 19 nt, Homo sapiens
agaagaaccucacaaaugc

SEQ ID NO: 1525065 - RNA, 19 nt, Homo sapiens
caccggagcugaacuaugg

SEQ ID NO: 1525066 - RNA, 19 nt, Homo sapiens
acagagagaacuugagaua

SEQ ID NO: 1525067 - RNA, 19 nt, Homo sapiens
uaacuauccugcccacaga

SEQ ID NO: 1525068 - RNA, 19 nt, Homo sapiens
ugacagcucuuacuuugca

SEQ ID NO: 1525069 - RNA, 19 nt, Homo sapiens
gugaaggaauuacaggauu

SEQ ID NO: 1525070 - RNA, 19 nt, Homo sapiens
uguauaaguuucccaguga

SEQ ID NO: 1525071 - RNA, 19 nt, Homo sapiens
gaugucauuugccugguaa

SEQ ID NO: 1525072 - RNA, 19 nt, Homo sapiens
ggaugucauuugccuggua

SEQ ID NO: 1525073 - RNA, 19 nt, Homo sapiens
acucggcggucacaucuua

SEQ ID NO: 1525074 - RNA, 19 nt, Homo sapiens
auucaaagcuuuagaugug

SEQ ID NO: 1525075 - RNA, 19 nt, Homo sapiens
gagguagggucaauauagu

SEQ ID NO: 1525076 - RNA, 19 nt, Homo sapiens
ucacaaaugcccugaaugu

SEQ ID NO: 1525077 - RNA, 19 nt, Homo sapiens
gaaagaguugugucacuga

SEQ ID NO: 1525078 - RNA, 19 nt, Homo sapiens
gggugaggaucauuaauuc

SEQ ID NO: 1525079 - RNA, 19 nt, Homo sapiens
aagaaccucucaacccuaa

SEQ ID NO: 1525080 - RNA, 19 nt, Homo sapiens
gagaaagaguugugucacu

SEQ ID NO: 1525081 - RNA, 19 nt, Homo sapiens
uaauauaggaggagucuga

SEQ ID NO: 1525082 - RNA, 19 nt, Homo sapiens
ccuaguuccuuguuauaaa

SEQ ID NO: 1525083 - RNA, 19 nt, Homo sapiens
gaacacacugccuuaaaca

SEQ ID NO: 1525084 - RNA, 19 nt, Homo sapiens
caagaaaggagacagugaa

SEQ ID NO: 1525085 - RNA, 19 nt, Homo sapiens
gcaagaaaggagacaguga

SEQ ID NO: 1525086 - RNA, 19 nt, Homo sapiens
gagcuuauaagaacauaga

SEQ ID NO: 1525087 - RNA, 19 nt, Homo sapiens
caagauagguuuugagauc

SEQ ID NO: 1525088 - RNA, 19 nt, Homo sapiens
gcccaacugcucuguauuu

SEQ ID NO: 1525089 - RNA, 19 nt, Homo sapiens
ucagacguauugauuauag

SEQ ID NO: 1525090 - RNA, 19 nt, Homo sapiens
ggagaagccauacaagugu

SEQ ID NO: 1525091 - RNA, 19 nt, Homo sapiens
gggagaagccauacaagug

SEQ ID NO: 1525092 - RNA, 19 nt, Homo sapiens
ggagaagaaccucacaaau

SEQ ID NO: 1525093 - RNA, 19 nt, Homo sapiens
aguggaagcuaguaaagaa

SEQ ID NO: 1525094 - RNA, 19 nt, Homo sapiens
aaacaagaguugggaaaca

SEQ ID NO: 1525095 - RNA, 19 nt, Homo sapiens
caugguaacagcucaaauu

SEQ ID NO: 1525096 - RNA, 19 nt, Homo sapiens
cugcaaaugucucuuggaa

SEQ ID NO: 1525097 - RNA, 19 nt, Homo sapiens
gcaguacuauaguuauucu

SEQ ID NO: 1525098 - RNA, 19 nt, Homo sapiens
gaauagagaaagaguugug

SEQ ID NO: 1525099 - RNA, 19 nt, Homo sapiens
gagaguuuguaauuaagug

SEQ ID NO: 1525100 - RNA, 19 nt, Homo sapiens
ccaauaauaagcuacagaa

SEQ ID NO: 1525101 - RNA, 19 nt, Homo sapiens
acugacagcucuuacuuug

SEQ ID NO: 1525102 - RNA, 19 nt, Homo sapiens
gagcacugcccagagaaua

SEQ ID NO: 1525103 - RNA, 19 nt, Homo sapiens
ucuacuaugugccuaacua

SEQ ID NO: 1525104 - RNA, 19 nt, Homo sapiens
gagacacacacacauacua

SEQ ID NO: 1525105 - RNA, 19 nt, Homo sapiens
acacugccuuaaacagaua

SEQ ID NO: 1525106 - RNA, 19 nt, Homo sapiens
gguauucaaucaugugucu

SEQ ID NO: 1525107 - RNA, 19 nt, Homo sapiens
gcuacaaccuuccuucuua

SEQ ID NO: 1525108 - RNA, 19 nt, Homo sapiens
aaacuaagauugaggauga

SEQ ID NO: 1525109 - RNA, 19 nt, Homo sapiens
ggaacucaaucgugucaua

SEQ ID NO: 1525110 - RNA, 19 nt, Homo sapiens
caaaaccacuccacaauua

SEQ ID NO: 1525111 - RNA, 19 nt, Homo sapiens
uagcagaguuguucuauga

SEQ ID NO: 1525112 - RNA, 19 nt, Homo sapiens
ucaacaagcuguccuguau

SEQ ID NO: 1525113 - RNA, 19 nt, Homo sapiens
gccaaaagcuuauuaauga

SEQ ID NO: 1525114 - RNA, 19 nt, Homo sapiens
gguugaaucugcugccuua

SEQ ID NO: 1525115 - RNA, 19 nt, Homo sapiens
gcaaaggagugguugaauc

SEQ ID NO: 1525116 - RNA, 19 nt, Homo sapiens
gugaagagauuccaaaaua

SEQ ID NO: 1525117 - RNA, 19 nt, Homo sapiens
gaacaugaccaaguacgua

SEQ ID NO: 1525118 - RNA, 19 nt, Homo sapiens
gaugagcuguugucuguug

SEQ ID NO: 1525119 - RNA, 19 nt, Homo sapiens
ggauuuagaggaagaagua

SEQ ID NO: 1525120 - RNA, 19 nt, Homo sapiens
ggccgcagcuuccugagua

SEQ ID NO: 1525121 - RNA, 19 nt, Homo sapiens
gagaauaaggaucugauuu

SEQ ID NO: 1525122 - RNA, 19 nt, Homo sapiens
gaauacaacacugagaaua

SEQ ID NO: 1525123 - RNA, 19 nt, Homo sapiens
cagcaggaguuugggauua

SEQ ID NO: 1525124 - RNA, 19 nt, Homo sapiens
gggcaaagcuguggagauc

SEQ ID NO: 1525125 - RNA, 19 nt, Homo sapiens
aaacagcaccuuacagauu

SEQ ID NO: 1525126 - RNA, 19 nt, Homo sapiens
acgaaagccucaagaaauu

SEQ ID NO: 1525127 - RNA, 19 nt, Homo sapiens
gcuaacguuuggagucaua

SEQ ID NO: 1525128 - RNA, 19 nt, Homo sapiens
gcagaguuguucuaugaug

SEQ ID NO: 1525129 - RNA, 19 nt, Homo sapiens
uaauaaagccucugagugu

SEQ ID NO: 1525130 - RNA, 19 nt, Homo sapiens
aacuuuagcuucuccaaua

SEQ ID NO: 1525131 - RNA, 19 nt, Homo sapiens
uggagaacaugaccaagua

SEQ ID NO: 1525132 - RNA, 19 nt, Homo sapiens
ggaaaggguuaccugaaca

SEQ ID NO: 1525133 - RNA, 19 nt, Homo sapiens
ggacguauuugugauguuc

SEQ ID NO: 1525134 - RNA, 19 nt, Homo sapiens
caaaguggacauuaccaua

SEQ ID NO: 1525135 - RNA, 19 nt, Homo sapiens
gcaaagcuguggagaucau

SEQ ID NO: 1525136 - RNA, 19 nt, Homo sapiens
gauagaagaggaagugcua

SEQ ID NO: 1525137 - RNA, 19 nt, Homo sapiens
auuauaagcuggcaucaaa

SEQ ID NO: 1525138 - RNA, 19 nt, Homo sapiens
ggaagaaguagcagaguug

SEQ ID NO: 1525139 - RNA, 19 nt, Homo sapiens
gaaauggacgugucuucaa

SEQ ID NO: 1525140 - RNA, 19 nt, Homo sapiens
ggucaucguuggcuucuuc

SEQ ID NO: 1525141 - RNA, 19 nt, Homo sapiens
cuacaaccuuccuucuuaa

SEQ ID NO: 1525142 - RNA, 19 nt, Homo sapiens
aacaagcuguccuguauaa

SEQ ID NO: 1525143 - RNA, 19 nt, Homo sapiens
gaacucaaucgugucauaa

SEQ ID NO: 1525144 - RNA, 19 nt, Homo sapiens
caacaaacaggaacucaau

SEQ ID NO: 1525145 - RNA, 19 nt, Homo sapiens
ggacgugucuucaaguacu

SEQ ID NO: 1525146 - RNA, 19 nt, Homo sapiens
gagcuaacguuuggaguca

SEQ ID NO: 1525147 - RNA, 19 nt, Homo sapiens
aaagggaccuccagugcaa

SEQ ID NO: 1525148 - RNA, 19 nt, Homo sapiens
gaaaaggacguauuuguga

SEQ ID NO: 1525149 - RNA, 19 nt, Homo sapiens
aaacaucaauccagugaag

SEQ ID NO: 1525150 - RNA, 19 nt, Homo sapiens
ggaacgcagucuccuagug

SEQ ID NO: 1525151 - RNA, 19 nt, Homo sapiens
gaaagccucaagaaauuug

SEQ ID NO: 1525152 - RNA, 19 nt, Homo sapiens
caaauuagccagaaagcau

SEQ ID NO: 1525153 - RNA, 19 nt, Homo sapiens
aacagcaccuuacagauuu

SEQ ID NO: 1525154 - RNA, 19 nt, Homo sapiens
gcgagcagguggcagaguu

SEQ ID NO: 1525155 - RNA, 19 nt, Homo sapiens
aggaugagcuguugucugu

SEQ ID NO: 1525156 - RNA, 19 nt, Homo sapiens
ggaugaggaugagcuguug

SEQ ID NO: 1525157 - RNA, 19 nt, Homo sapiens
gcuguugucuguugagcaa

SEQ ID NO: 1525158 - RNA, 19 nt, Homo sapiens
caacaagcuguccuguaua

SEQ ID NO: 1525159 - RNA, 19 nt, Homo sapiens
guccaaauccuaaacuuga

SEQ ID NO: 1525160 - RNA, 19 nt, Homo sapiens
ugguugagacgacaaauua

SEQ ID NO: 1525161 - RNA, 19 nt, Homo sapiens
gauaauaaagccucugagu

SEQ ID NO: 1525162 - RNA, 19 nt, Homo sapiens
gaggaaaggguuaccugaa

SEQ ID NO: 1525163 - RNA, 19 nt, Homo sapiens
ggacagccauggaccuacu

SEQ ID NO: 1525164 - RNA, 19 nt, Homo sapiens
caaggaagaacuuuagcuu

SEQ ID NO: 1525165 - RNA, 19 nt, Homo sapiens
cuacgaaagccucaagaaa

SEQ ID NO: 1525166 - RNA, 19 nt, Homo sapiens
caaagaaaaggacguauuu

SEQ ID NO: 1525167 - RNA, 19 nt, Homo sapiens
ugacauaaccuacgaaagc

SEQ ID NO: 1525168 - RNA, 19 nt, Homo sapiens
gcagacgaacccagaaaug

SEQ ID NO: 1525169 - RNA, 19 nt, Homo sapiens
uaaugacaguaccaacaaa

SEQ ID NO: 1525170 - RNA, 19 nt, Homo sapiens
gaacuuuagcuucuccaau

SEQ ID NO: 1525171 - RNA, 19 nt, Homo sapiens
gaaaaggaggugccuauga

SEQ ID NO: 1525172 - RNA, 19 nt, Homo sapiens
caaaggaauuccaaaacaa

SEQ ID NO: 1525173 - RNA, 19 nt, Homo sapiens
gaauaaggaucugauuucc

SEQ ID NO: 1525174 - RNA, 19 nt, Homo sapiens
uggcagaguuugugauauc

SEQ ID NO: 1525175 - RNA, 19 nt, Homo sapiens
gguggcagaguuugugaua

SEQ ID NO: 1525176 - RNA, 19 nt, Homo sapiens
caaaggagugguugaaucu

SEQ ID NO: 1525177 - RNA, 19 nt, Homo sapiens
ccaggaacuuggcggaaga

SEQ ID NO: 1525178 - RNA, 19 nt, Homo sapiens
gagguuaacgccgguguuu

SEQ ID NO: 1525179 - RNA, 19 nt, Homo sapiens
cagaugacauaaccuacga

SEQ ID NO: 1525180 - RNA, 19 nt, Homo sapiens
ggguagggguggauaauaa

SEQ ID NO: 1525181 - RNA, 19 nt, Homo sapiens
uacgaaagccucaagaaau

SEQ ID NO: 1525182 - RNA, 19 nt, Homo sapiens
agaauaaggaucugauuuc

SEQ ID NO: 1525183 - RNA, 19 nt, Homo sapiens
ggacauuaccauagagaag

SEQ ID NO: 1525184 - RNA, 19 nt, Homo sapiens
gaagagcccgcugggaaga

SEQ ID NO: 1525185 - RNA, 19 nt, Homo sapiens
cgccugagcuggagaacau

SEQ ID NO: 1525186 - RNA, 19 nt, Homo sapiens
ccacagcucaccagagguu

SEQ ID NO: 1525187 - RNA, 19 nt, Homo sapiens
uaaccaagccugugcacau

SEQ ID NO: 1525188 - RNA, 19 nt, Homo sapiens
ggaucugauuuccgaguug

SEQ ID NO: 1525189 - RNA, 19 nt, Homo sapiens
gacgacaaauuagccagaa

SEQ ID NO: 1525190 - RNA, 19 nt, Homo sapiens
ucaaagcaauccaggaacu

SEQ ID NO: 1525191 - RNA, 19 nt, Homo sapiens
gaugacauaaccuacgaaa

SEQ ID NO: 1525192 - RNA, 19 nt, Homo sapiens
ugaaucugcugccuuaguc

SEQ ID NO: 1525193 - RNA, 19 nt, Homo sapiens
caacccauccucaaagcaa

SEQ ID NO: 1525194 - RNA, 19 nt, Homo sapiens
cuuaagggccacagaguuu

SEQ ID NO: 1525195 - RNA, 19 nt, Homo sapiens
ccucaaagcaauccaggaa

SEQ ID NO: 1525196 - RNA, 19 nt, Homo sapiens
gaaagccacaucaaaacua

SEQ ID NO: 1525197 - RNA, 19 nt, Homo sapiens
gauaucccauccguccaaa

SEQ ID NO: 1525198 - RNA, 19 nt, Homo sapiens
guagcagaguuguucuaug

SEQ ID NO: 1525199 - RNA, 19 nt, Homo sapiens
ccaaguacguauccaagcu

SEQ ID NO: 1525200 - RNA, 19 nt, Homo sapiens
ugagcaaaaugaagugaua

SEQ ID NO: 1525201 - RNA, 19 nt, Homo sapiens
cgaaagccucaagaaauuu

SEQ ID NO: 1525202 - RNA, 19 nt, Homo sapiens
cagaguuguucuaugaugu

SEQ ID NO: 1525203 - RNA, 19 nt, Homo sapiens
ggaagaagaaaacaucuga

SEQ ID NO: 1525204 - RNA, 19 nt, Homo sapiens
ggaccgguacccauucuuc

SEQ ID NO: 1525205 - RNA, 19 nt, Homo sapiens
ggaauugggcagaaaauau

SEQ ID NO: 1525206 - RNA, 19 nt, Homo sapiens
ccauggaccuacucuggau

SEQ ID NO: 1525207 - RNA, 19 nt, Homo sapiens
gaacaauacucugacuuua

SEQ ID NO: 1525208 - RNA, 19 nt, Homo sapiens
caacauaagauucgaguua

SEQ ID NO: 1525209 - RNA, 19 nt, Homo sapiens
caacugcacucuuauauca

SEQ ID NO: 1525210 - RNA, 19 nt, Homo sapiens
ggaagagggagauauauuu

SEQ ID NO: 1525211 - RNA, 19 nt, Homo sapiens
aaacaaagagccacuuaua

SEQ ID NO: 1525212 - RNA, 19 nt, Homo sapiens
gaagaagaauuugugaaga

SEQ ID NO: 1525213 - RNA, 19 nt, Homo sapiens
ucauggagguuacaguuua

SEQ ID NO: 1525214 - RNA, 19 nt, Homo sapiens
gaagcaagauggcagaauc

SEQ ID NO: 1525215 - RNA, 19 nt, Homo sapiens
gcuagaagagugcauguua

SEQ ID NO: 1525216 - RNA, 19 nt, Homo sapiens
caucccaacugcacucuua

SEQ ID NO: 1525217 - RNA, 19 nt, Homo sapiens
gagcccacaugccaaauaa

SEQ ID NO: 1525218 - RNA, 19 nt, Homo sapiens
acaaugaccuuaaugguau

SEQ ID NO: 1525219 - RNA, 19 nt, Homo sapiens
ucagccagguucaauaaua

SEQ ID NO: 1525220 - RNA, 19 nt, Homo sapiens
gcagcgauaucugucaaua

SEQ ID NO: 1525221 - RNA, 19 nt, Homo sapiens
gcugaugacuguaaaggaa

SEQ ID NO: 1525222 - RNA, 19 nt, Homo sapiens
gacaaugaccuuaauggua

SEQ ID NO: 1525223 - RNA, 19 nt, Homo sapiens
agacucaacuugcuucaaa

SEQ ID NO: 1525224 - RNA, 19 nt, Homo sapiens
cgaguuaaaugucaaugaa

SEQ ID NO: 1525225 - RNA, 19 nt, Homo sapiens
gcaagagaauuaggacuau

SEQ ID NO: 1525226 - RNA, 19 nt, Homo sapiens
gagcaacacucauaaagac

SEQ ID NO: 1525227 - RNA, 19 nt, Homo sapiens
acaaggaauuucagaguuu

SEQ ID NO: 1525228 - RNA, 19 nt, Homo sapiens
gacaaggaauuucagaguu

SEQ ID NO: 1525229 - RNA, 19 nt, Homo sapiens
caacuagaccuguguguga

SEQ ID NO: 1525230 - RNA, 19 nt, Homo sapiens
ggaugaacauacuguguga

SEQ ID NO: 1525231 - RNA, 19 nt, Homo sapiens
ggcagaacaugaucucgua

SEQ ID NO: 1525232 - RNA, 19 nt, Homo sapiens
guacguccauuucccuaaa

SEQ ID NO: 1525233 - RNA, 19 nt, Homo sapiens
gaaaggauucugucuaaag

SEQ ID NO: 1525234 - RNA, 19 nt, Homo sapiens
ugggauacaugaaacauuu

SEQ ID NO: 1525235 - RNA, 19 nt, Homo sapiens
gcaaacaggagaaagauuc

SEQ ID NO: 1525236 - RNA, 19 nt, Homo sapiens
uaaagaccguuacaaguuc

SEQ ID NO: 1525237 - RNA, 19 nt, Homo sapiens
ccucagauguguuggguuu

SEQ ID NO: 1525238 - RNA, 19 nt, Homo sapiens
gaaacuuggucuuuaaagg

SEQ ID NO: 1525239 - RNA, 19 nt, Homo sapiens
cuaaagcccuggagcauuc

SEQ ID NO: 1525240 - RNA, 19 nt, Homo sapiens
ggacuuggacaacauaaga

SEQ ID NO: 1525241 - RNA, 19 nt, Homo sapiens
ggagagagagcaucuggaa

SEQ ID NO: 1525242 - RNA, 19 nt, Homo sapiens
caagagaauuaggacuaua

SEQ ID NO: 1525243 - RNA, 19 nt, Homo sapiens
gccaugagaacgucaaaua

SEQ ID NO: 1525244 - RNA, 19 nt, Homo sapiens
uaacuggccugaacacaca

SEQ ID NO: 1525245 - RNA, 19 nt, Homo sapiens
caggguugaucucauauuu

SEQ ID NO: 1525246 - RNA, 19 nt, Homo sapiens
gcagagaguauaaagagaa

SEQ ID NO: 1525247 - RNA, 19 nt, Homo sapiens
ugacugggaugcaagagaa

SEQ ID NO: 1525248 - RNA, 19 nt, Homo sapiens
gaagaccucagauguguug

SEQ ID NO: 1525249 - RNA, 19 nt, Homo sapiens
guaguugggcuuccauuaa

SEQ ID NO: 1525250 - RNA, 19 nt, Homo sapiens
cuagaagagugcauguuaa

SEQ ID NO: 1525251 - RNA, 19 nt, Homo sapiens
aauagaagaugcaggaaug

SEQ ID NO: 1525252 - RNA, 19 nt, Homo sapiens
ggaagaagaauuugugaag

SEQ ID NO: 1525253 - RNA, 19 nt, Homo sapiens
guacagccauugcauuucu

SEQ ID NO: 1525254 - RNA, 19 nt, Homo sapiens
gcaggaggacuguuucuga

SEQ ID NO: 1525255 - RNA, 19 nt, Homo sapiens
gaaucgggaagaagaauuu

SEQ ID NO: 1525256 - RNA, 19 nt, Homo sapiens
gaucagcccagauugugua

SEQ ID NO: 1525257 - RNA, 19 nt, Homo sapiens
uggcaggguugaucucaua

SEQ ID NO: 1525258 - RNA, 19 nt, Homo sapiens
caguuuaccuucaaucaga

SEQ ID NO: 1525259 - RNA, 19 nt, Homo sapiens
ucaauuagccuaugauucu

SEQ ID NO: 1525260 - RNA, 19 nt, Homo sapiens
ggacaguauauauggaaua

SEQ ID NO: 1525261 - RNA, 19 nt, Homo sapiens
ucucuugccucuguucuua

SEQ ID NO: 1525262 - RNA, 19 nt, Homo sapiens
gaaucucagugacaaggaa

SEQ ID NO: 1525263 - RNA, 19 nt, Homo sapiens
ucugaaacuuggucuuuaa

SEQ ID NO: 1525264 - RNA, 19 nt, Homo sapiens
cauucuagcuguaaacuuc

SEQ ID NO: 1525265 - RNA, 19 nt, Homo sapiens
gugaagaccucagaugugu

SEQ ID NO: 1525266 - RNA, 19 nt, Homo sapiens
gcaaacaaucucaaugugu

SEQ ID NO: 1525267 - RNA, 19 nt, Homo sapiens
ugaagagccuugucuacug

SEQ ID NO: 1525268 - RNA, 19 nt, Homo sapiens
guucagcgcaucuuucaaa

SEQ ID NO: 1525269 - RNA, 19 nt, Homo sapiens
gauuguggaugcucucaug

SEQ ID NO: 1525270 - RNA, 19 nt, Homo sapiens
gaaaguucccauuccaguu

SEQ ID NO: 1525271 - RNA, 19 nt, Homo sapiens
uaacagcacccagaaaguu

SEQ ID NO: 1525272 - RNA, 19 nt, Homo sapiens
ggugagauguggcagaaca

SEQ ID NO: 1525273 - RNA, 19 nt, Homo sapiens
aaaggaaggcagagaaauu

SEQ ID NO: 1525274 - RNA, 19 nt, Homo sapiens
caacaaaacacuagaaaga

SEQ ID NO: 1525275 - RNA, 19 nt, Homo sapiens
gcuauguggugguuugaga

SEQ ID NO: 1525276 - RNA, 19 nt, Homo sapiens
gggaagagggagauauauu

SEQ ID NO: 1525277 - RNA, 19 nt, Homo sapiens
uuauaaaucuggcuguguu

SEQ ID NO: 1525278 - RNA, 19 nt, Homo sapiens
gaaaauucaugcugcaaug

SEQ ID NO: 1525279 - RNA, 19 nt, Homo sapiens
agaacuggcuaacguguug

SEQ ID NO: 1525280 - RNA, 19 nt, Homo sapiens
ggguugaucucauauuucu

SEQ ID NO: 1525281 - RNA, 19 nt, Homo sapiens
guaaucggagccugacaua

SEQ ID NO: 1525282 - RNA, 19 nt, Homo sapiens
auaaagaccguuacaaguu

SEQ ID NO: 1525283 - RNA, 19 nt, Homo sapiens
ccaaacacccacugaucua

SEQ ID NO: 1525284 - RNA, 19 nt, Homo sapiens
ucaaggcuuuggcucguaa

SEQ ID NO: 1525285 - RNA, 19 nt, Homo sapiens
cugcauaucuuugacaaug

SEQ ID NO: 1525286 - RNA, 19 nt, Homo sapiens
aagaagaacuggcuaacgu

SEQ ID NO: 1525287 - RNA, 19 nt, Homo sapiens
gguaguugggcuuccauua

SEQ ID NO: 1525288 - RNA, 19 nt, Homo sapiens
gaagagugcauguuaacca

SEQ ID NO: 1525289 - RNA, 19 nt, Homo sapiens
acaaagagccacuuauaag

SEQ ID NO: 1525290 - RNA, 19 nt, Homo sapiens
ugaucuacaugcccacuuu

SEQ ID NO: 1525291 - RNA, 19 nt, Homo sapiens
aggaagaucuuuguaggaa

SEQ ID NO: 1525292 - RNA, 19 nt, Homo sapiens
agaacaauacucugacuuu

SEQ ID NO: 1525293 - RNA, 19 nt, Homo sapiens
gaaauacucgugggucugu

SEQ ID NO: 1525294 - RNA, 19 nt, Homo sapiens
ggagcauucuagcuguaaa

SEQ ID NO: 1525295 - RNA, 19 nt, Homo sapiens
gccaacugcuagucaaaug

SEQ ID NO: 1525296 - RNA, 19 nt, Homo sapiens
gcuaacguguugccaaucu

SEQ ID NO: 1525297 - RNA, 19 nt, Homo sapiens
gaccugcugugguaucuag

SEQ ID NO: 1525298 - RNA, 19 nt, Homo sapiens
cagcaaacaaucucaaugu

SEQ ID NO: 1525299 - RNA, 19 nt, Homo sapiens
caauuagccuaugauucua

SEQ ID NO: 1525300 - RNA, 19 nt, Homo sapiens
guaaggaagaucuuuguag

SEQ ID NO: 1525301 - RNA, 19 nt, Homo sapiens
gucugaaacuuggucuuua

SEQ ID NO: 1525302 - RNA, 19 nt, Homo sapiens
cagcccagauuguguacuu

SEQ ID NO: 1525303 - RNA, 19 nt, Homo sapiens
gcugugguaucuagagaau

SEQ ID NO: 1525304 - RNA, 19 nt, Homo sapiens
gcaguacccaacuaucuga

SEQ ID NO: 1525305 - RNA, 19 nt, Homo sapiens
ccagaaaguucccauucca

SEQ ID NO: 1525306 - RNA, 19 nt, Homo sapiens
gcauguuggugaauauugg

SEQ ID NO: 1525307 - RNA, 19 nt, Homo sapiens
gagcagaacuuauaugauu

SEQ ID NO: 1525308 - RNA, 19 nt, Homo sapiens
caacagagauccuaauuug

SEQ ID NO: 1525309 - RNA, 19 nt, Homo sapiens
cuacagagcuccugaaauu

SEQ ID NO: 1525310 - RNA, 19 nt, Homo sapiens
ggucuaaugucaucaguua

SEQ ID NO: 1525311 - RNA, 19 nt, Homo sapiens
gcacaaccacucaaucuua

SEQ ID NO: 1525312 - RNA, 19 nt, Homo sapiens
gcaaucagcucaauacagu

SEQ ID NO: 1525313 - RNA, 19 nt, Homo sapiens
gcaaucauguuaagucuug

SEQ ID NO: 1525314 - RNA, 19 nt, Homo sapiens
ggauaaugcuguaccaauu

SEQ ID NO: 1525315 - RNA, 19 nt, Homo sapiens
gagaauacauugaucuguu

SEQ ID NO: 1525316 - RNA, 19 nt, Homo sapiens
caacaaagcauucuggauu

SEQ ID NO: 1525317 - RNA, 19 nt, Homo sapiens
ucagaugucucacuacuaa

SEQ ID NO: 1525318 - RNA, 19 nt, Homo sapiens
gcacaaaucuaaccaugag

SEQ ID NO: 1525319 - RNA, 19 nt, Homo sapiens
caacuccucucaccaggua

SEQ ID NO: 1525320 - RNA, 19 nt, Homo sapiens
aaucacaccugccuuguuu

SEQ ID NO: 1525321 - RNA, 19 nt, Homo sapiens
gaggauggauaaugcugua

SEQ ID NO: 1525322 - RNA, 19 nt, Homo sapiens
caauagcuaugaagucuug

SEQ ID NO: 1525323 - RNA, 19 nt, Homo sapiens
caucacagcugcaaguguu

SEQ ID NO: 1525324 - RNA, 19 nt, Homo sapiens
ccaaggaaauuguggcuau

SEQ ID NO: 1525325 - RNA, 19 nt, Homo sapiens
gcuaugaagucuuggaguu

SEQ ID NO: 1525326 - RNA, 19 nt, Homo sapiens
gcagucagcuccagucucu

SEQ ID NO: 1525327 - RNA, 19 nt, Homo sapiens
uaagacaccugaagaacau

SEQ ID NO: 1525328 - RNA, 19 nt, Homo sapiens
guagcaacgacaaauauua

SEQ ID NO: 1525329 - RNA, 19 nt, Homo sapiens
uaauucagaugucucacua

SEQ ID NO: 1525330 - RNA, 19 nt, Homo sapiens
gaagaagaauaagcaguca

SEQ ID NO: 1525331 - RNA, 19 nt, Homo sapiens
ucaauacagugcacaauca

SEQ ID NO: 1525332 - RNA, 19 nt, Homo sapiens
gaacuggagacuggaauaa

SEQ ID NO: 1525333 - RNA, 19 nt, Homo sapiens
caccacaucuucuuauaau

SEQ ID NO: 1525334 - RNA, 19 nt, Homo sapiens
gcaccacaucuucuuauaa

SEQ ID NO: 1525335 - RNA, 19 nt, Homo sapiens
ccaagucuauucucugguu

SEQ ID NO: 1525336 - RNA, 19 nt, Homo sapiens
caaguccucucuagauguu

SEQ ID NO: 1525337 - RNA, 19 nt, Homo sapiens
gaaggcagaccgaagagaa

SEQ ID NO: 1525338 - RNA, 19 nt, Homo sapiens
ugacauggcucaggugaau

SEQ ID NO: 1525339 - RNA, 19 nt, Homo sapiens
gagauccuuugcucuauga

SEQ ID NO: 1525340 - RNA, 19 nt, Homo sapiens
gcggugcccuuuacucuga

SEQ ID NO: 1525341 - RNA, 19 nt, Homo sapiens
gauccacgcugaccuuaag

SEQ ID NO: 1525342 - RNA, 19 nt, Homo sapiens
ggacugaagccaaggucua

SEQ ID NO: 1525343 - RNA, 19 nt, Homo sapiens
cgaagaaacugaaaauaga

SEQ ID NO: 1525344 - RNA, 19 nt, Homo sapiens
ccaacagacauuuauagua

SEQ ID NO: 1525345 - RNA, 19 nt, Homo sapiens
ucagacagauccauuccaa

SEQ ID NO: 1525346 - RNA, 19 nt, Homo sapiens
ggaaauuguggcuauuaaa

SEQ ID NO: 1525347 - RNA, 19 nt, Homo sapiens
ccaguucccucccuucgaa

SEQ ID NO: 1525348 - RNA, 19 nt, Homo sapiens
aggaagaggacaacaaaua

SEQ ID NO: 1525349 - RNA, 19 nt, Homo sapiens
uaaacuaccagucagcuuu

SEQ ID NO: 1525350 - RNA, 19 nt, Homo sapiens
gcggaggguucacauguau

SEQ ID NO: 1525351 - RNA, 19 nt, Homo sapiens
caaauucuccugccuucaa

SEQ ID NO: 1525352 - RNA, 19 nt, Homo sapiens
gggaagcuguacaccacua

SEQ ID NO: 1525353 - RNA, 19 nt, Homo sapiens
gauaaugcuguaccaauug

SEQ ID NO: 1525354 - RNA, 19 nt, Homo sapiens
ugaugaagcucaagagucu

SEQ ID NO: 1525355 - RNA, 19 nt, Homo sapiens
aaauguggauugaaacgaa

SEQ ID NO: 1525356 - RNA, 19 nt, Homo sapiens
gguagcaaauuucaacauc

SEQ ID NO: 1525357 - RNA, 19 nt, Homo sapiens
ccacaucuucuuauaauuc

SEQ ID NO: 1525358 - RNA, 19 nt, Homo sapiens
gcacucagacagauccauu

SEQ ID NO: 1525359 - RNA, 19 nt, Homo sapiens
ccaaauacaagcacaaauc

SEQ ID NO: 1525360 - RNA, 19 nt, Homo sapiens
ggaagaggacaacaaauac

SEQ ID NO: 1525361 - RNA, 19 nt, Homo sapiens
gaucaagagucccuucacu

SEQ ID NO: 1525362 - RNA, 19 nt, Homo sapiens
guacaucagaccaaucuug

SEQ ID NO: 1525363 - RNA, 19 nt, Homo sapiens
gaagaggacaacaaauaca

SEQ ID NO: 1525364 - RNA, 19 nt, Homo sapiens
ugacucaccuuuuggauuu

SEQ ID NO: 1525365 - RNA, 19 nt, Homo sapiens
gacaaugacucaccuuuug

SEQ ID NO: 1525366 - RNA, 19 nt, Homo sapiens
gaagagaauacauugaucu

SEQ ID NO: 1525367 - RNA, 19 nt, Homo sapiens
gugaagcuauugauaugug

SEQ ID NO: 1525368 - RNA, 19 nt, Homo sapiens
gcacuguuguuacuuucug

SEQ ID NO: 1525369 - RNA, 19 nt, Homo sapiens
ggaggguucacauguauga

SEQ ID NO: 1525370 - RNA, 19 nt, Homo sapiens
gaagcucggaaguacauuu

SEQ ID NO: 1525371 - RNA, 19 nt, Homo sapiens
caaggaaauuguggcuauu

SEQ ID NO: 1525372 - RNA, 19 nt, Homo sapiens
gaagaggagcaccaaggaa

SEQ ID NO: 1525373 - RNA, 19 nt, Homo sapiens
ggaagaggagcaccaagga

SEQ ID NO: 1525374 - RNA, 19 nt, Homo sapiens
caugagauccuuugcucua

SEQ ID NO: 1525375 - RNA, 19 nt, Homo sapiens
gccagucgcuucagugagu

SEQ ID NO: 1525376 - RNA, 19 nt, Homo sapiens
ggaggaaugcccacucuca

SEQ ID NO: 1525377 - RNA, 19 nt, Homo sapiens
ggacuacaagcaacaacaa

SEQ ID NO: 1525378 - RNA, 19 nt, Homo sapiens
acagauccauuccaacaga

SEQ ID NO: 1525379 - RNA, 19 nt, Homo sapiens
gaguagcaacgacaaauau

SEQ ID NO: 1525380 - RNA, 19 nt, Homo sapiens
ugaaaaugcugaugaguau

SEQ ID NO: 1525381 - RNA, 19 nt, Homo sapiens
cauugugccuccacugaaa

SEQ ID NO: 1525382 - RNA, 19 nt, Homo sapiens
cagagcuccugaaauuauu

SEQ ID NO: 1525383 - RNA, 19 nt, Homo sapiens
gugaggaaguugacagcaa

SEQ ID NO: 1525384 - RNA, 19 nt, Homo sapiens
gccaaggucuaaugucauc

SEQ ID NO: 1525385 - RNA, 19 nt, Homo sapiens
gcucacaauugaugcagau

SEQ ID NO: 1525386 - RNA, 19 nt, Homo sapiens
agaaaaugcucacaauuga

SEQ ID NO: 1525387 - RNA, 19 nt, Homo sapiens
cgaagagaauacauugauc

SEQ ID NO: 1525388 - RNA, 19 nt, Homo sapiens
uuucuuugcuugagccaua

SEQ ID NO: 1525389 - RNA, 19 nt, Homo sapiens
gggcuacugccuucuguuu

SEQ ID NO: 1525390 - RNA, 19 nt, Homo sapiens
gacucugacucuucuuuga

SEQ ID NO: 1525391 - RNA, 19 nt, Homo sapiens
aagccaaggucuaauguca

SEQ ID NO: 1525392 - RNA, 19 nt, Homo sapiens
ugaggaagaggacaacaaa

SEQ ID NO: 1525393 - RNA, 19 nt, Homo sapiens
gaccgaagagaauacauug

SEQ ID NO: 1525394 - RNA, 19 nt, Homo sapiens
acagagcuccugaaauuau

SEQ ID NO: 1525395 - RNA, 19 nt, Homo sapiens
aggaaauuguggcuauuaa

SEQ ID NO: 1525396 - RNA, 19 nt, Homo sapiens
ucaaguagccaccaucaca

SEQ ID NO: 1525397 - RNA, 19 nt, Homo sapiens
gaaucacaccugccuuguu

SEQ ID NO: 1525398 - RNA, 19 nt, Homo sapiens
ccacaaagaguagcaguuc

SEQ ID NO: 1525399 - RNA, 19 nt, Homo sapiens
gcuacugccuucuguuugg

SEQ ID NO: 1525400 - RNA, 19 nt, Homo sapiens
ggcaauaguggauccguuu

SEQ ID NO: 1525401 - RNA, 19 nt, Homo sapiens
gcuccagucucuuccaagu

SEQ ID NO: 1525402 - RNA, 19 nt, Homo sapiens
caaacuggacuacaagcaa

SEQ ID NO: 1525403 - RNA, 19 nt, Homo sapiens
ucaaguacaucagaccaau

SEQ ID NO: 1525404 - RNA, 19 nt, Homo sapiens
gaggagcaccaaggaaauu

SEQ ID NO: 1525405 - RNA, 19 nt, Homo sapiens
gcaguggagcauauuguug

SEQ ID NO: 1525406 - RNA, 19 nt, Homo sapiens
gaugcugaauaaagccaaa

SEQ ID NO: 1525407 - RNA, 19 nt, Homo sapiens
gaaguaagaugauguuuca

SEQ ID NO: 1525408 - RNA, 19 nt, Homo sapiens
gugaagaucuggaaagaaa

SEQ ID NO: 1525409 - RNA, 19 nt, Homo sapiens
caaacaugguucacauuua

SEQ ID NO: 1525410 - RNA, 19 nt, Homo sapiens
gaaaguguuugaagacuau

SEQ ID NO: 1525411 - RNA, 19 nt, Homo sapiens
ggacauaugacccagauuu

SEQ ID NO: 1525412 - RNA, 19 nt, Homo sapiens
ggaccagcaucuuuauauu

SEQ ID NO: 1525413 - RNA, 19 nt, Homo sapiens
gaaagagcuuguaccauca

SEQ ID NO: 1525414 - RNA, 19 nt, Homo sapiens
gcaaagccauuggauaugu

SEQ ID NO: 1525415 - RNA, 19 nt, Homo sapiens
caacaaacaugguucacau

SEQ ID NO: 1525416 - RNA, 19 nt, Homo sapiens
gaccagcaucuuuauauua

SEQ ID NO: 1525417 - RNA, 19 nt, Homo sapiens
gauguucugugcuguauga

SEQ ID NO: 1525418 - RNA, 19 nt, Homo sapiens
gaagaggacuuuggugauc

SEQ ID NO: 1525419 - RNA, 19 nt, Homo sapiens
ggaaauggagggacaagaa

SEQ ID NO: 1525420 - RNA, 19 nt, Homo sapiens
guaagaugauguuucaaga

SEQ ID NO: 1525421 - RNA, 19 nt, Homo sapiens
gaacacauugucuaaauuc

SEQ ID NO: 1525422 - RNA, 19 nt, Homo sapiens
gaagcaaagccauuggaua

SEQ ID NO: 1525423 - RNA, 19 nt, Homo sapiens
gauaauacucugcaucauu

SEQ ID NO: 1525424 - RNA, 19 nt, Homo sapiens
cagaacacauugucuaaau

SEQ ID NO: 1525425 - RNA, 19 nt, Homo sapiens
ggaauuauagguuauggaa

SEQ ID NO: 1525426 - RNA, 19 nt, Homo sapiens
gauugaaaguguuugaaga

SEQ ID NO: 1525427 - RNA, 19 nt, Homo sapiens
guacaccaaucuucaggaa

SEQ ID NO: 1525428 - RNA, 19 nt, Homo sapiens
ucaaucugcugaugagaaa

SEQ ID NO: 1525429 - RNA, 19 nt, Homo sapiens
caacugaaauugccaaagc

SEQ ID NO: 1525430 - RNA, 19 nt, Homo sapiens
gaaaugauggaguaagaga

SEQ ID NO: 1525431 - RNA, 19 nt, Homo sapiens
auaauacucugcaucauug

SEQ ID NO: 1525432 - RNA, 19 nt, Homo sapiens
gaagggcacucccaaugag

SEQ ID NO: 1525433 - RNA, 19 nt, Homo sapiens
uugaagaaaugauggagua

SEQ ID NO: 1525434 - RNA, 19 nt, Homo sapiens
ugaaaguguuugaagacua

SEQ ID NO: 1525435 - RNA, 19 nt, Homo sapiens
uaacuuugcuuucuauggu

SEQ ID NO: 1525436 - RNA, 19 nt, Homo sapiens
gaaaugauggauccacaga

SEQ ID NO: 1525437 - RNA, 19 nt, Homo sapiens
acaaggaccagcaucuuua

SEQ ID NO: 1525438 - RNA, 19 nt, Homo sapiens
gaaggaagcaaagccauug

SEQ ID NO: 1525439 - RNA, 19 nt, Homo sapiens
aaugauggauccacagaaa

SEQ ID NO: 1525440 - RNA, 19 nt, Homo sapiens
ucuaguugcuggaaguaua

SEQ ID NO: 1525441 - RNA, 19 nt, Homo sapiens
gaaaguugcaguuacagau

SEQ ID NO: 1525442 - RNA, 19 nt, Homo sapiens
gugcauucgcuacuuauua

SEQ ID NO: 1525443 - RNA, 19 nt, Homo sapiens
aaacuucgucauugcauua

SEQ ID NO: 1525444 - RNA, 19 nt, Homo sapiens
gguauuggauucucauugg

SEQ ID NO: 1525445 - RNA, 19 nt, Homo sapiens
uguaugaucuuccuacugu

SEQ ID NO: 1525446 - RNA, 19 nt, Homo sapiens
gaucaagaagcaacuaguu

SEQ ID NO: 1525447 - RNA, 19 nt, Homo sapiens
gaagaucuggaaagaaaug

SEQ ID NO: 1525448 - RNA, 19 nt, Homo sapiens
aagaaaugauggaguaaga

SEQ ID NO: 1525449 - RNA, 19 nt, Homo sapiens
caacuuauuugucuuucuc

SEQ ID NO: 1525450 - RNA, 19 nt, Homo sapiens
gcaguuacagaugaaguua

SEQ ID NO: 1525451 - RNA, 19 nt, Homo sapiens
ccuagcauuuggaucuuua

SEQ ID NO: 1525452 - RNA, 19 nt, Homo sapiens
guacaucccuaccuuccau

SEQ ID NO: 1525453 - RNA, 19 nt, Homo sapiens
ggaaggaagcaaagccauu

SEQ ID NO: 1525454 - RNA, 19 nt, Homo sapiens
gaugauguuucaagaugga

SEQ ID NO: 1525455 - RNA, 19 nt, Homo sapiens
aagaugauguuucaagaug

SEQ ID NO: 1525456 - RNA, 19 nt, Homo sapiens
ggaaguaagaugauguuuc

SEQ ID NO: 1525457 - RNA, 19 nt, Homo sapiens
cagaaaugccuauauuaug

SEQ ID NO: 1525458 - RNA, 19 nt, Homo sapiens
cacaggaucccuagcauuu

SEQ ID NO: 1525459 - RNA, 19 nt, Homo sapiens
gucuuucucuggcuuauaa

SEQ ID NO: 1525460 - RNA, 19 nt, Homo sapiens
aagcaaagccauuggauau

SEQ ID NO: 1525461 - RNA, 19 nt, Homo sapiens
caagaaguguuguagaacu

SEQ ID NO: 1525462 - RNA, 19 nt, Homo sapiens
cacauugucuaaauuccua

SEQ ID NO: 1525463 - RNA, 19 nt, Homo sapiens
cuuauaaacuucgucauug

SEQ ID NO: 1525464 - RNA, 19 nt, Homo sapiens
caaagccauuggauauguu

SEQ ID NO: 1525465 - RNA, 19 nt, Homo sapiens
gcuuauaaacuucgucauu

SEQ ID NO: 1525466 - RNA, 19 nt, Homo sapiens
caauaaacuucuugaugca

SEQ ID NO: 1525467 - RNA, 19 nt, Homo sapiens
gcaaaugguaucaauaaac

SEQ ID NO: 1525468 - RNA, 19 nt, Homo sapiens
ggagggacaagaaguguug

SEQ ID NO: 1525469 - RNA, 19 nt, Homo sapiens
ggaagacuaccgucaguuc

SEQ ID NO: 1525470 - RNA, 19 nt, Homo sapiens
cuacagugcugccugagau

SEQ ID NO: 1525471 - RNA, 19 nt, Homo sapiens
acgcccaaguucuguauua

SEQ ID NO: 1525472 - RNA, 19 nt, Homo sapiens
uaaccuauguggaaaugca

SEQ ID NO: 1525473 - RNA, 19 nt, Homo sapiens
gagguucaguguugaugga

SEQ ID NO: 1525474 - RNA, 19 nt, Homo sapiens
cugcaaaugguaucaauaa

SEQ ID NO: 1525475 - RNA, 19 nt, Homo sapiens
ugauggaguuauugaagaa

SEQ ID NO: 1525476 - RNA, 19 nt, Homo sapiens
acaaacaugguucacauuu

SEQ ID NO: 1525477 - RNA, 19 nt, Homo sapiens
guaccuguauacaaaguca

SEQ ID NO: 1525478 - RNA, 19 nt, Homo sapiens
gggauucagacuaacauaa

SEQ ID NO: 1525479 - RNA, 19 nt, Homo sapiens
ggaugaugauuguccaaca

SEQ ID NO: 1525480 - RNA, 19 nt, Homo sapiens
gcacaaggaccagcaucuu

SEQ ID NO: 1525481 - RNA, 19 nt, Homo sapiens
uaaacuucgucauugcauu

SEQ ID NO: 1525482 - RNA, 19 nt, Homo sapiens
ggaagaggacuuuggugau

SEQ ID NO: 1525483 - RNA, 19 nt, Homo sapiens
cagcgucuaugcaaugugu

SEQ ID NO: 1525484 - RNA, 19 nt, Homo sapiens
ggacgagccauacgauauc

SEQ ID NO: 1525485 - RNA, 19 nt, Homo sapiens
gaauccgagucgccauuau

SEQ ID NO: 1525486 - RNA, 19 nt, Homo sapiens
gguccuuaguuggauauuu

SEQ ID NO: 1525487 - RNA, 19 nt, Homo sapiens
gaaauggagggacaagaag

SEQ ID NO: 1525488 - RNA, 19 nt, Homo sapiens
cccagaagcagaaagagua

SEQ ID NO: 1525489 - RNA, 19 nt, Homo sapiens
gaccaccgucuuaaacgua

SEQ ID NO: 1525490 - RNA, 19 nt, Homo sapiens
ggaccaccgucuuaaacgu

SEQ ID NO: 1525491 - RNA, 19 nt, Homo sapiens
acaucgggauucagacuaa

SEQ ID NO: 1525492 - RNA, 19 nt, Homo sapiens
guucaguguugauggaguu

SEQ ID NO: 1525493 - RNA, 19 nt, Homo sapiens
guucugugcuguaugaucu

SEQ ID NO: 1525494 - RNA, 19 nt, Homo sapiens
acaauaggaaguaagauga

SEQ ID NO: 1525495 - RNA, 19 nt, Homo sapiens
guucuggccuuccuauucu

SEQ ID NO: 1525496 - RNA, 19 nt, Homo sapiens
auuagucuauccagcuuua

SEQ ID NO: 1525497 - RNA, 19 nt, Homo sapiens
uauggaauauggcacuguu

SEQ ID NO: 1525498 - RNA, 19 nt, Homo sapiens
cagaagggcacucccaaug

SEQ ID NO: 1525499 - RNA, 19 nt, Homo sapiens
gaucuggaaagaaaugaug

SEQ ID NO: 1525500 - RNA, 19 nt, Homo sapiens
cacaaggaccagcaucuuu

SEQ ID NO: 1525501 - RNA, 19 nt, Homo sapiens
uaccgucaguucuguaaga

SEQ ID NO: 1525502 - RNA, 19 nt, Homo sapiens
ggauucagacuaacauaag

SEQ ID NO: 1525503 - RNA, 19 nt, Homo sapiens
cuucaugauuggugugauu

SEQ ID NO: 1525504 - RNA, 19 nt, Homo sapiens
gaugaugauuguccaacag

SEQ ID NO: 1525505 - RNA, 19 nt, Homo sapiens
guaccagucccuccguauu

SEQ ID NO: 1525506 - RNA, 19 nt, Homo sapiens
cauaugacccagauuucaa

SEQ ID NO: 1525507 - RNA, 19 nt, Homo sapiens
ggaaagaccuucaucaagu

SEQ ID NO: 1525508 - RNA, 19 nt, Homo sapiens
agaaagagcugcacauugu

SEQ ID NO: 1525509 - RNA, 19 nt, Homo sapiens
caacagauacuuccgguaa

SEQ ID NO: 1525510 - RNA, 19 nt, Homo sapiens
ggacucaaaucucuaucuu

SEQ ID NO: 1525511 - RNA, 19 nt, Homo sapiens
gacgagggcuacuaugauu

SEQ ID NO: 1525512 - RNA, 19 nt, Homo sapiens
gaaagaccuucaucaaguc

SEQ ID NO: 1525513 - RNA, 19 nt, Homo sapiens
gaccagaggugucgagauc

SEQ ID NO: 1525514 - RNA, 19 nt, Homo sapiens
gaaacaagacugaggacuu

SEQ ID NO: 1525515 - RNA, 19 nt, Homo sapiens
gaagaucagcucaaacgaa

SEQ ID NO: 1525516 - RNA, 19 nt, Homo sapiens
gaagaggauuucccugaag

SEQ ID NO: 1525517 - RNA, 19 nt, Homo sapiens
gcagagcacagcaccagua

SEQ ID NO: 1525518 - RNA, 19 nt, Homo sapiens
ggcuagggcuugaaacuga

SEQ ID NO: 1525519 - RNA, 19 nt, Homo sapiens
gcagagagccaaugagucu

SEQ ID NO: 1525520 - RNA, 19 nt, Homo sapiens
gagaaagagcugcacauug

SEQ ID NO: 1525521 - RNA, 19 nt, Homo sapiens
gaggaaagaccuucaucaa

SEQ ID NO: 1525522 - RNA, 19 nt, Homo sapiens
gaaagagcugcacauugua

SEQ ID NO: 1525523 - RNA, 19 nt, Homo sapiens
ggagaaagagcugcacauu

SEQ ID NO: 1525524 - RNA, 19 nt, Homo sapiens
ggaagcagagagccaauga

SEQ ID NO: 1525525 - RNA, 19 nt, Homo sapiens
gaagugcuuucggaaccua

SEQ ID NO: 1525526 - RNA, 19 nt, Homo sapiens
gaucgacuaccgccacuuu

SEQ ID NO: 1525527 - RNA, 19 nt, Homo sapiens
gacacgaggucacucugaa

SEQ ID NO: 1525528 - RNA, 19 nt, Homo sapiens
ccaagagcaucccgaggaa

SEQ ID NO: 1525529 - RNA, 19 nt, Homo sapiens
ugaagaggcccaagaagug

SEQ ID NO: 1525530 - RNA, 19 nt, Homo sapiens
ccaccuagcugcuccucau

SEQ ID NO: 1525531 - RNA, 19 nt, Homo sapiens
gaaggcuuguucuccucua

SEQ ID NO: 1525532 - RNA, 19 nt, Homo sapiens
gggagguguucgcagauga

SEQ ID NO: 1525533 - RNA, 19 nt, Homo sapiens
aaagagcugcacauuguaa

SEQ ID NO: 1525534 - RNA, 19 nt, Homo sapiens
gcaaggagugccugcugaa

SEQ ID NO: 1525535 - RNA, 19 nt, Homo sapiens
gccauagucccaaguguug

SEQ ID NO: 1525536 - RNA, 19 nt, Homo sapiens
ggaacugcaugugucuuca

SEQ ID NO: 1525537 - RNA, 19 nt, Homo sapiens
ucaaaccggugcgaaagug

SEQ ID NO: 1525538 - RNA, 19 nt, Homo sapiens
ggagagccuaggacucaaa

SEQ ID NO: 1525539 - RNA, 19 nt, Homo sapiens
gaauccguguccacaagug

SEQ ID NO: 1525540 - RNA, 19 nt, Homo sapiens
aagaggauuucccugaaga

SEQ ID NO: 1525541 - RNA, 19 nt, Homo sapiens
gagcacagcaccaguagac

SEQ ID NO: 1525542 - RNA, 19 nt, Homo sapiens
gagccuaggacucaaaucu

SEQ ID NO: 1525543 - RNA, 19 nt, Homo sapiens
caggagagccuaggacuca

SEQ ID NO: 1525544 - RNA, 19 nt, Homo sapiens
acacugagcucgccaucac

SEQ ID NO: 1525545 - RNA, 19 nt, Homo sapiens
gagcugaagagaggaaaga

SEQ ID NO: 1525546 - RNA, 19 nt, Homo sapiens
ccucugacuucaccagguu

SEQ ID NO: 1525547 - RNA, 19 nt, Homo sapiens
gugacgagggcuacuauga

SEQ ID NO: 1525548 - RNA, 19 nt, Homo sapiens
gaagagacacgaggucacu

SEQ ID NO: 1525549 - RNA, 19 nt, Homo sapiens
gcaagacucacgacagcau

SEQ ID NO: 1525550 - RNA, 19 nt, Homo sapiens
gcagaggguagcauguuca

SEQ ID NO: 1525551 - RNA, 19 nt, Homo sapiens
gccuaggacucaaaucucu

SEQ ID NO: 1525552 - RNA, 19 nt, Homo sapiens
caugggcagugggcucuuu

SEQ ID NO: 1525553 - RNA, 19 nt, Homo sapiens
caagugacgagggcuacua

SEQ ID NO: 1525554 - RNA, 19 nt, Homo sapiens
gcgaagcugcaaccaccua

SEQ ID NO: 1525555 - RNA, 19 nt, Homo sapiens
gccugggccucacuuugaa

SEQ ID NO: 1525556 - RNA, 19 nt, Homo sapiens
ccgaauccguguccacaag

SEQ ID NO: 1525557 - RNA, 19 nt, Homo sapiens
agaaugaagccucugacuu

SEQ ID NO: 1525558 - RNA, 19 nt, Homo sapiens
ccuggccgaugcauccuuu

SEQ ID NO: 1525559 - RNA, 19 nt, Homo sapiens
gaaagccugggccucacuu

SEQ ID NO: 1525560 - RNA, 19 nt, Homo sapiens
cgacagaugccccaacaaa

SEQ ID NO: 1525561 - RNA, 19 nt, Homo sapiens
gaacugcaugugucuucau

SEQ ID NO: 1525562 - RNA, 19 nt, Homo sapiens
aacagauacuuccgguaaa

SEQ ID NO: 1525563 - RNA, 19 nt, Homo sapiens
ugacgagggcuacuaugau

SEQ ID NO: 1525564 - RNA, 19 nt, Homo sapiens
caaaagacgcaaucccaaa

SEQ ID NO: 1525565 - RNA, 19 nt, Homo sapiens
gacucaaaucucuaucuuu

SEQ ID NO: 1525566 - RNA, 19 nt, Homo sapiens
gaccugugcgugucugaga

SEQ ID NO: 1525567 - RNA, 19 nt, Homo sapiens
gagaggaaagaccuucauc

SEQ ID NO: 1525568 - RNA, 19 nt, Homo sapiens
ccagaggugucgagaucgu

SEQ ID NO: 1525569 - RNA, 19 nt, Homo sapiens
ccacuucgacaacagauac

SEQ ID NO: 1525570 - RNA, 19 nt, Homo sapiens
gaucagcucaaacgaacag

SEQ ID NO: 1525571 - RNA, 19 nt, Homo sapiens
cuagggcacccacagagaa

SEQ ID NO: 1525572 - RNA, 19 nt, Homo sapiens
ugccaucucuagagcugaa

SEQ ID NO: 1525573 - RNA, 19 nt, Homo sapiens
cgacuaccgccacuuugug

SEQ ID NO: 1525574 - RNA, 19 nt, Homo sapiens
caaguguugagaauccaaa

SEQ ID NO: 1525575 - RNA, 19 nt, Homo sapiens
aagcagagagccaaugagu

SEQ ID NO: 1525576 - RNA, 19 nt, Homo sapiens
aagagcaucccgaggaaga

SEQ ID NO: 1525577 - RNA, 19 nt, Homo sapiens
aaagacgcaaucccaaaug

SEQ ID NO: 1525578 - RNA, 19 nt, Homo sapiens
ccaaagacagcgcgaagcu

SEQ ID NO: 1525579 - RNA, 19 nt, Homo sapiens
cugaagaggcccaagaagu

SEQ ID NO: 1525580 - RNA, 19 nt, Homo sapiens
gagucugccugggaugugu

SEQ ID NO: 1525581 - RNA, 19 nt, Homo sapiens
ccagggccaccauccagaa

SEQ ID NO: 1525582 - RNA, 19 nt, Homo sapiens
ccuugcagcucagcacaga

SEQ ID NO: 1525583 - RNA, 19 nt, Homo sapiens
gcagccacuucgacaacag

SEQ ID NO: 1525584 - RNA, 19 nt, Homo sapiens
caagggacuggcacacugu

SEQ ID NO: 1525585 - RNA, 19 nt, Homo sapiens
cacauucggagaaacaaga

SEQ ID NO: 1525586 - RNA, 19 nt, Homo sapiens
cgcaaucccaaaugccaua

SEQ ID NO: 1525587 - RNA, 19 nt, Homo sapiens
gagagccuaggacucaaau

SEQ ID NO: 1525588 - RNA, 19 nt, Homo sapiens
gcucggugccaucucuaga

SEQ ID NO: 1525589 - RNA, 19 nt, Homo sapiens
ggaaauacuuguuggaaua

SEQ ID NO: 1525590 - RNA, 19 nt, Homo sapiens
ggccagaacucaagaauuu

SEQ ID NO: 1525591 - RNA, 19 nt, Homo sapiens
caaaggaccuggugauuag

SEQ ID NO: 1525592 - RNA, 19 nt, Homo sapiens
gaaccaggcuugccacaca

SEQ ID NO: 1525593 - RNA, 19 nt, Homo sapiens
gaucaccaauggccaauga

SEQ ID NO: 1525594 - RNA, 19 nt, Homo sapiens
gaaaugacuucuucuugca

SEQ ID NO: 1525595 - RNA, 19 nt, Homo sapiens
gaacaucuggcacacagua

SEQ ID NO: 1525596 - RNA, 19 nt, Homo sapiens
caagugaucugccuaccuu

SEQ ID NO: 1525597 - RNA, 19 nt, Homo sapiens
ugagagagacugugcuuua

SEQ ID NO: 1525598 - RNA, 19 nt, Homo sapiens
gagaguaagauccuugaua

SEQ ID NO: 1525599 - RNA, 19 nt, Homo sapiens
gcauauagacuaccggaaa

SEQ ID NO: 1525600 - RNA, 19 nt, Homo sapiens
gaagaugcauauagacuac

SEQ ID NO: 1525601 - RNA, 19 nt, Homo sapiens
gaagagaaugggagacaaa

SEQ ID NO: 1525602 - RNA, 19 nt, Homo sapiens
ugauugagcuucuggauag

SEQ ID NO: 1525603 - RNA, 19 nt, Homo sapiens
uaaugaagcuuccguaaaa

SEQ ID NO: 1525604 - RNA, 19 nt, Homo sapiens
agaaugugguggacagaua

SEQ ID NO: 1525605 - RNA, 19 nt, Homo sapiens
guaaugaagcuuccguaaa

SEQ ID NO: 1525606 - RNA, 19 nt, Homo sapiens
uggagcagcuuacauucua

SEQ ID NO: 1525607 - RNA, 19 nt, Homo sapiens
acaaaggaccuggugauua

SEQ ID NO: 1525608 - RNA, 19 nt, Homo sapiens
gaguguugcuuguugaaga

SEQ ID NO: 1525609 - RNA, 19 nt, Homo sapiens
gcaguuguccgugcuagua

SEQ ID NO: 1525610 - RNA, 19 nt, Homo sapiens
aaaggaggcugcaggacaa

SEQ ID NO: 1525611 - RNA, 19 nt, Homo sapiens
gccagucacucccauucua

SEQ ID NO: 1525612 - RNA, 19 nt, Homo sapiens
uguaaggcaucaacaagaa

SEQ ID NO: 1525613 - RNA, 19 nt, Homo sapiens
cauucuggcugcuguauug

SEQ ID NO: 1525614 - RNA, 19 nt, Homo sapiens
gagaaugggagacaaagga

SEQ ID NO: 1525615 - RNA, 19 nt, Homo sapiens
ggaagagaaugggagacaa

SEQ ID NO: 1525616 - RNA, 19 nt, Homo sapiens
aguaugcacugaggaaaua

SEQ ID NO: 1525617 - RNA, 19 nt, Homo sapiens
cgagacagaugggacuauu

SEQ ID NO: 1525618 - RNA, 19 nt, Homo sapiens
gaacaggcccagcgagagu

SEQ ID NO: 1525619 - RNA, 19 nt, Homo sapiens
agaguaagauccuugauac

SEQ ID NO: 1525620 - RNA, 19 nt, Homo sapiens
ccaaagugcugggauuaca

SEQ ID NO: 1525621 - RNA, 19 nt, Homo sapiens
gagacagaugggacuauua

SEQ ID NO: 1525622 - RNA, 19 nt, Homo sapiens
aaacagggguuaccagaaa

SEQ ID NO: 1525623 - RNA, 19 nt, Homo sapiens
aaucaguuaugccuaugua

SEQ ID NO: 1525624 - RNA, 19 nt, Homo sapiens
gauacuggcucagcaugga

SEQ ID NO: 1525625 - RNA, 19 nt, Homo sapiens
gagagagacugugcuuuac

SEQ ID NO: 1525626 - RNA, 19 nt, Homo sapiens
gacuucuucuugcacuuua

SEQ ID NO: 1525627 - RNA, 19 nt, Homo sapiens
uguaaucaguuaugccuau

SEQ ID NO: 1525628 - RNA, 19 nt, Homo sapiens
gaggaaauacuuguuggaa

SEQ ID NO: 1525629 - RNA, 19 nt, Homo sapiens
gcacugaggaaauacuugu

SEQ ID NO: 1525630 - RNA, 19 nt, Homo sapiens
agccuucgcuucuggagua

SEQ ID NO: 1525631 - RNA, 19 nt, Homo sapiens
cuggauagcuaaacaugug

SEQ ID NO: 1525632 - RNA, 19 nt, Homo sapiens
gcaguaaacagcccauucu

SEQ ID NO: 1525633 - RNA, 19 nt, Homo sapiens
ugaagaugcauauagacua

SEQ ID NO: 1525634 - RNA, 19 nt, Homo sapiens
acagagcggugaagagcuu

SEQ ID NO: 1525635 - RNA, 19 nt, Homo sapiens
gcaaacaggcaguaaacag

SEQ ID NO: 1525636 - RNA, 19 nt, Homo sapiens
uguugaagaugcauauaga

SEQ ID NO: 1525637 - RNA, 19 nt, Homo sapiens
ggaccuggccugagacucu

SEQ ID NO: 1525638 - RNA, 19 nt, Homo sapiens
uuaauuugaucaccaaugg

SEQ ID NO: 1525639 - RNA, 19 nt, Homo sapiens
aguauacaauggagacaaa

SEQ ID NO: 1525640 - RNA, 19 nt, Homo sapiens
gacaaaggaccuggugauu

SEQ ID NO: 1525641 - RNA, 19 nt, Homo sapiens
ggaauaaucagugaaucau

SEQ ID NO: 1525642 - RNA, 19 nt, Homo sapiens
gacaggguuucaccauguu

SEQ ID NO: 1525643 - RNA, 19 nt, Homo sapiens
cauauagacuaccggaaag

SEQ ID NO: 1525644 - RNA, 19 nt, Homo sapiens
gaagcauggaaaccugaua

SEQ ID NO: 1525645 - RNA, 19 nt, Homo sapiens
gaaugugguggacagauau

SEQ ID NO: 1525646 - RNA, 19 nt, Homo sapiens
uuauugagcccuuguucua

SEQ ID NO: 1525647 - RNA, 19 nt, Homo sapiens
ccagaacucaagaauuuau

SEQ ID NO: 1525648 - RNA, 19 nt, Homo sapiens
gagaggacacugcaguugu

SEQ ID NO: 1525649 - RNA, 19 nt, Homo sapiens
ggauucaccaguauacaau

SEQ ID NO: 1525650 - RNA, 19 nt, Homo sapiens
gggauucaccaguauacaa

SEQ ID NO: 1525651 - RNA, 19 nt, Homo sapiens
cacuugggauucaccagua

SEQ ID NO: 1525652 - RNA, 19 nt, Homo sapiens
uccaaucccugaagucugu

SEQ ID NO: 1525653 - RNA, 19 nt, Homo sapiens
gggguuaccagaaaauuua

SEQ ID NO: 1525654 - RNA, 19 nt, Homo sapiens
cugggaaagucuucaguug

SEQ ID NO: 1525655 - RNA, 19 nt, Homo sapiens
guggacagauauagaagca

SEQ ID NO: 1525656 - RNA, 19 nt, Homo sapiens
gcucagaggaagagaaugg

SEQ ID NO: 1525657 - RNA, 19 nt, Homo sapiens
guaaggcaucaacaagaaa

SEQ ID NO: 1525658 - RNA, 19 nt, Homo sapiens
guaaucaguuaugccuaug

SEQ ID NO: 1525659 - RNA, 19 nt, Homo sapiens
ccuggaguguugcuuguug

SEQ ID NO: 1525660 - RNA, 19 nt, Homo sapiens
cuauugcaaucacucagaa

SEQ ID NO: 1525661 - RNA, 19 nt, Homo sapiens
agauauagaagcauggaaa

SEQ ID NO: 1525662 - RNA, 19 nt, Homo sapiens
guucuaggcacuugggauu

SEQ ID NO: 1525663 - RNA, 19 nt, Homo sapiens
agacagaugggacuauuag

SEQ ID NO: 1525664 - RNA, 19 nt, Homo sapiens
ggaccuguuggaagcagua

SEQ ID NO: 1525665 - RNA, 19 nt, Homo sapiens
ccaauggccaaugauguaa

SEQ ID NO: 1525666 - RNA, 19 nt, Homo sapiens
gaggagaaaggaccugaag

SEQ ID NO: 1525667 - RNA, 19 nt, Homo sapiens
ggagcagcuuacauucuag

SEQ ID NO: 1525668 - RNA, 19 nt, Homo sapiens
aggaaauacuuguuggaau

SEQ ID NO: 1525669 - RNA, 19 nt, Homo sapiens
guccaaagccugggaaagu

SEQ ID NO: 1525670 - RNA, 19 nt, Homo sapiens
ggauggugguccuaaacag

SEQ ID NO: 1525671 - RNA, 19 nt, Homo sapiens
ucaguuaugccuauguaau

SEQ ID NO: 1525672 - RNA, 19 nt, Homo sapiens
gccagaacucaagaauuua

SEQ ID NO: 1525673 - RNA, 19 nt, Homo sapiens
gggccagaacucaagaauu

SEQ ID NO: 1525674 - RNA, 19 nt, Homo sapiens
caguuaugccuauguaaug

SEQ ID NO: 1525675 - RNA, 19 nt, Homo sapiens
gcuauugcaaucacucaga

SEQ ID NO: 1525676 - RNA, 19 nt, Homo sapiens
uagcuaaacauguggaagu

SEQ ID NO: 1525677 - RNA, 19 nt, Homo sapiens
uaaggcaucaacaagaaau

SEQ ID NO: 1525678 - RNA, 19 nt, Homo sapiens
gaaaauacagagcggugaa

SEQ ID NO: 1525679 - RNA, 19 nt, Homo sapiens
accaauggccaaugaugua

SEQ ID NO: 1525680 - RNA, 19 nt, Homo sapiens
ccugaagguuaauuugauc

SEQ ID NO: 1525681 - RNA, 19 nt, Homo sapiens
gugguggacagauauagaa

SEQ ID NO: 1525682 - RNA, 19 nt, Homo sapiens
gcuugugucucggguggaa

SEQ ID NO: 1525683 - RNA, 19 nt, Homo sapiens
ugacuucuucuugcacuuu

SEQ ID NO: 1525684 - RNA, 19 nt, Homo sapiens
ugggaaagucuucaguuga

SEQ ID NO: 1525685 - RNA, 19 nt, Homo sapiens
uguaaugaagcuuccguaa

SEQ ID NO: 1525686 - RNA, 19 nt, Homo sapiens
ggaggagaaaggaccugaa

SEQ ID NO: 1525687 - RNA, 19 nt, Homo sapiens
ucuaggcacuugggauuca

SEQ ID NO: 1525688 - RNA, 19 nt, Homo sapiens
gcacucagccaacauuccu

SEQ ID NO: 1525689 - RNA, 19 nt, Homo sapiens
gaaguaacaugcugcuuua

SEQ ID NO: 1525690 - RNA, 19 nt, Homo sapiens
gaaaggagcacaagaaauu

SEQ ID NO: 1525691 - RNA, 19 nt, Homo sapiens
cagaagaccuagauuuaua

SEQ ID NO: 1525692 - RNA, 19 nt, Homo sapiens
gaauggguauuaagaguaa

SEQ ID NO: 1525693 - RNA, 19 nt, Homo sapiens
gaaaggaucaacuuggaua

SEQ ID NO: 1525694 - RNA, 19 nt, Homo sapiens
gaacauagaugcuuuuauc

SEQ ID NO: 1525695 - RNA, 19 nt, Homo sapiens
cagcaugaauguauaauug

SEQ ID NO: 1525696 - RNA, 19 nt, Homo sapiens
ggaagaacauaagcacuuu

SEQ ID NO: 1525697 - RNA, 19 nt, Homo sapiens
gcaggugacuagccaaauu

SEQ ID NO: 1525698 - RNA, 19 nt, Homo sapiens
ggaaguaacaugcugcuuu

SEQ ID NO: 1525699 - RNA, 19 nt, Homo sapiens
gcuuaacacugcuacauaa

SEQ ID NO: 1525700 - RNA, 19 nt, Homo sapiens
gagaaauccagaucuaaua

SEQ ID NO: 1525701 - RNA, 19 nt, Homo sapiens
guaaacuccuugacucauu

SEQ ID NO: 1525702 - RNA, 19 nt, Homo sapiens
uaauaaugcugaggagaua

SEQ ID NO: 1525703 - RNA, 19 nt, Homo sapiens
caaccaacauugacauugu

SEQ ID NO: 1525704 - RNA, 19 nt, Homo sapiens
ccaaguacgugauccaaug

SEQ ID NO: 1525705 - RNA, 19 nt, Homo sapiens
caagaaagacaagaacaua

SEQ ID NO: 1525706 - RNA, 19 nt, Homo sapiens
acacaaaacugccaucaua

SEQ ID NO: 1525707 - RNA, 19 nt, Homo sapiens
ugaaauagcagggaaguaa

SEQ ID NO: 1525708 - RNA, 19 nt, Homo sapiens
gugagcaguuuguuguuua

SEQ ID NO: 1525709 - RNA, 19 nt, Homo sapiens
gcaauacuuggguuacuua

SEQ ID NO: 1525710 - RNA, 19 nt, Homo sapiens
guaacaugcugcuuuagga

SEQ ID NO: 1525711 - RNA, 19 nt, Homo sapiens
cuacagagcaaauuucaaa

SEQ ID NO: 1525712 - RNA, 19 nt, Homo sapiens
ugaaagaagccaagaaaga

SEQ ID NO: 1525713 - RNA, 19 nt, Homo sapiens
caaggugguuuguaauaau

SEQ ID NO: 1525714 - RNA, 19 nt, Homo sapiens
gagcaguuauuaauuugga

SEQ ID NO: 1525715 - RNA, 19 nt, Homo sapiens
gaucuuggauuggaaagga

SEQ ID NO: 1525716 - RNA, 19 nt, Homo sapiens
aaacaggaauuaucguuca

SEQ ID NO: 1525717 - RNA, 19 nt, Homo sapiens
caguaaagguuguguuguu

SEQ ID NO: 1525718 - RNA, 19 nt, Homo sapiens
gaacagcaucucuaaaugg

SEQ ID NO: 1525719 - RNA, 19 nt, Homo sapiens
gaaacagauuccauagauc

SEQ ID NO: 1525720 - RNA, 19 nt, Homo sapiens
acaagaacauagaugcuuu

SEQ ID NO: 1525721 - RNA, 19 nt, Homo sapiens
aaacugccaucauagcaaa

SEQ ID NO: 1525722 - RNA, 19 nt, Homo sapiens
aagaguaagucaccaggua

SEQ ID NO: 1525723 - RNA, 19 nt, Homo sapiens
gcacgugccuuuaguucca

SEQ ID NO: 1525724 - RNA, 19 nt, Homo sapiens
ccacaaguguacaauagug

SEQ ID NO: 1525725 - RNA, 19 nt, Homo sapiens
auucauagcugcauuguca

SEQ ID NO: 1525726 - RNA, 19 nt, Homo sapiens
gauaaugggauguaauuca

SEQ ID NO: 1525727 - RNA, 19 nt, Homo sapiens
acacucauguaacaccuua

SEQ ID NO: 1525728 - RNA, 19 nt, Homo sapiens
ucaugagagucaacauaua

SEQ ID NO: 1525729 - RNA, 19 nt, Homo sapiens
uccaguaugugaaugcuua

SEQ ID NO: 1525730 - RNA, 19 nt, Homo sapiens
ggugagcaguuuguuguuu

SEQ ID NO: 1525731 - RNA, 19 nt, Homo sapiens
ggaagcaauacuuggguua

SEQ ID NO: 1525732 - RNA, 19 nt, Homo sapiens
gauaaaauguucccgaaug

SEQ ID NO: 1525733 - RNA, 19 nt, Homo sapiens
cagaacagcaucucuaaau

SEQ ID NO: 1525734 - RNA, 19 nt, Homo sapiens
cccagaagaccuagauuua

SEQ ID NO: 1525735 - RNA, 19 nt, Homo sapiens
gaaugugagcaguuauuaa

SEQ ID NO: 1525736 - RNA, 19 nt, Homo sapiens
gugcagaauuaccaugaaa

SEQ ID NO: 1525737 - RNA, 19 nt, Homo sapiens
gaauuaucguucacacuca

SEQ ID NO: 1525738 - RNA, 19 nt, Homo sapiens
gaauaaggacuccauagca

SEQ ID NO: 1525739 - RNA, 19 nt, Homo sapiens
aguaagacauuuagcagaa

SEQ ID NO: 1525740 - RNA, 19 nt, Homo sapiens
uaaaauagcugaguuacug

SEQ ID NO: 1525741 - RNA, 19 nt, Homo sapiens
ccaaauguccacaagugua

SEQ ID NO: 1525742 - RNA, 19 nt, Homo sapiens
gcaaagguacgaugcuguu

SEQ ID NO: 1525743 - RNA, 19 nt, Homo sapiens
aguguaaugugcaauagua

SEQ ID NO: 1525744 - RNA, 19 nt, Homo sapiens
gcacaaacaggaauuaucg

SEQ ID NO: 1525745 - RNA, 19 nt, Homo sapiens
gaaagaagccaagaaagac

SEQ ID NO: 1525746 - RNA, 19 nt, Homo sapiens
gauugugccuuugucauga

SEQ ID NO: 1525747 - RNA, 19 nt, Homo sapiens
uagcugaguuacugaauuc

SEQ ID NO: 1525748 - RNA, 19 nt, Homo sapiens
auucagagauucaugagaa

SEQ ID NO: 1525749 - RNA, 19 nt, Homo sapiens
uuucaugugucaccaagua

SEQ ID NO: 1525750 - RNA, 19 nt, Homo sapiens
ggauugaguuagaauuagu

SEQ ID NO: 1525751 - RNA, 19 nt, Homo sapiens
caggguucaugaaguauuu

SEQ ID NO: 1525752 - RNA, 19 nt, Homo sapiens
aaauucagcugcuaugaca

SEQ ID NO: 1525753 - RNA, 19 nt, Homo sapiens
gcacaaauucagcugcuau

SEQ ID NO: 1525754 - RNA, 19 nt, Homo sapiens
cagauaaugggauguaauu

SEQ ID NO: 1525755 - RNA, 19 nt, Homo sapiens
acacaauacugacuuugga

SEQ ID NO: 1525756 - RNA, 19 nt, Homo sapiens
ccauagaucuaagucaaug

SEQ ID NO: 1525757 - RNA, 19 nt, Homo sapiens
ggaaaggagcacaagaaau

SEQ ID NO: 1525758 - RNA, 19 nt, Homo sapiens
aaaagacacugaagcuuaa

SEQ ID NO: 1525759 - RNA, 19 nt, Homo sapiens
cacugaagcuuaauaccuu

SEQ ID NO: 1525760 - RNA, 19 nt, Homo sapiens
gggaaaguuugaagacaca

SEQ ID NO: 1525761 - RNA, 19 nt, Homo sapiens
gagagucaacauauauuug

SEQ ID NO: 1525762 - RNA, 19 nt, Homo sapiens
guacgaugcuguuuucuau

SEQ ID NO: 1525763 - RNA, 19 nt, Homo sapiens
guaauaaugcugaggagau

SEQ ID NO: 1525764 - RNA, 19 nt, Homo sapiens
gugagcaguuauuaauuug

SEQ ID NO: 1525765 - RNA, 19 nt, Homo sapiens
gaaagacaagaacauagau

SEQ ID NO: 1525766 - RNA, 19 nt, Homo sapiens
cauguugaauggguauuaa

SEQ ID NO: 1525767 - RNA, 19 nt, Homo sapiens
guccacaaguguacaauag

SEQ ID NO: 1525768 - RNA, 19 nt, Homo sapiens
agaacagcaucucuaaaug

SEQ ID NO: 1525769 - RNA, 19 nt, Homo sapiens
gcagaacagcaucucuaaa

SEQ ID NO: 1525770 - RNA, 19 nt, Homo sapiens
caugagagucaacauauau

SEQ ID NO: 1525771 - RNA, 19 nt, Homo sapiens
gugacuagccaaauucauu

SEQ ID NO: 1525772 - RNA, 19 nt, Homo sapiens
agaacacaauacugacuuu

SEQ ID NO: 1525773 - RNA, 19 nt, Homo sapiens
ccacagcaugaauguauaa

SEQ ID NO: 1525774 - RNA, 19 nt, Homo sapiens
uggcuaaauucacauguau

SEQ ID NO: 1525775 - RNA, 19 nt, Homo sapiens
agaccuagauuuauaaagc

SEQ ID NO: 1525776 - RNA, 19 nt, Homo sapiens
uaaacuccuugacucauuc

SEQ ID NO: 1525777 - RNA, 19 nt, Homo sapiens
ugaaugugagcaguuauua

SEQ ID NO: 1525778 - RNA, 19 nt, Homo sapiens
aaagugaggaccugugaaa

SEQ ID NO: 1525779 - RNA, 19 nt, Homo sapiens
ccaaauauucagagauuca

SEQ ID NO: 1525780 - RNA, 19 nt, Homo sapiens
caccacagcaugaauguau

SEQ ID NO: 1525781 - RNA, 19 nt, Homo sapiens
ggauugugccuuugucaug

SEQ ID NO: 1525782 - RNA, 19 nt, Homo sapiens
guaagacauuuagcagaau

SEQ ID NO: 1525783 - RNA, 19 nt, Homo sapiens
ccagaagaccuagauuuau

SEQ ID NO: 1525784 - RNA, 19 nt, Homo sapiens
uuugagaaauccagaucua

SEQ ID NO: 1525785 - RNA, 19 nt, Homo sapiens
cacuuaagcacuauuguuu

SEQ ID NO: 1525786 - RNA, 19 nt, Homo sapiens
agaaagacaagaacauaga

SEQ ID NO: 1525787 - RNA, 19 nt, Homo sapiens
gaacacaauacugacuuug

SEQ ID NO: 1525788 - RNA, 19 nt, Homo sapiens
ugaauggguauuaagagua

SEQ ID NO: 1525789 - RNA, 19 nt, Homo sapiens
ggauaaugcuuucauguua

SEQ ID NO: 1525790 - RNA, 19 nt, Homo sapiens
uaagagcucuccauuauaa

SEQ ID NO: 1525791 - RNA, 19 nt, Homo sapiens
gguaagagcucuccauuau

SEQ ID NO: 1525792 - RNA, 19 nt, Homo sapiens
ggagggagcucgagaguug

SEQ ID NO: 1525793 - RNA, 19 nt, Homo sapiens
guagugagcucuagacuga

SEQ ID NO: 1525794 - RNA, 19 nt, Homo sapiens
gaaauagcauuaacuagga

SEQ ID NO: 1525795 - RNA, 19 nt, Homo sapiens
ggaaaugagucugauagua

SEQ ID NO: 1525796 - RNA, 19 nt, Homo sapiens
gccaaacacucaccucuua

SEQ ID NO: 1525797 - RNA, 19 nt, Homo sapiens
gaacaugacauacgguuaa

SEQ ID NO: 1525798 - RNA, 19 nt, Homo sapiens
cagaacagcuuacaaacaa

SEQ ID NO: 1525799 - RNA, 19 nt, Homo sapiens
caagugaaauugccaaaga

SEQ ID NO: 1525800 - RNA, 19 nt, Homo sapiens
gaagaaugguggcuguaaa

SEQ ID NO: 1525801 - RNA, 19 nt, Homo sapiens
ggaaauagcagaacagcuu

SEQ ID NO: 1525802 - RNA, 19 nt, Homo sapiens
ugaccucgcuuggcaauua

SEQ ID NO: 1525803 - RNA, 19 nt, Homo sapiens
gaaugguggcuguaaauua

SEQ ID NO: 1525804 - RNA, 19 nt, Homo sapiens
gugaauaccuagcacaauu

SEQ ID NO: 1525805 - RNA, 19 nt, Homo sapiens
ggucagcuacuuauucuua

SEQ ID NO: 1525806 - RNA, 19 nt, Homo sapiens
caaaagaacugcgugaaua

SEQ ID NO: 1525807 - RNA, 19 nt, Homo sapiens
guacuuaguuugcauuuac

SEQ ID NO: 1525808 - RNA, 19 nt, Homo sapiens
gaugaagguuggccauuug

SEQ ID NO: 1525809 - RNA, 19 nt, Homo sapiens
gaaaugagucugauaguac

SEQ ID NO: 1525810 - RNA, 19 nt, Homo sapiens
ugauaaacuugcacugaua

SEQ ID NO: 1525811 - RNA, 19 nt, Homo sapiens
gaaauagcagaacagcuua

SEQ ID NO: 1525812 - RNA, 19 nt, Homo sapiens
caaagagguugucugucua

SEQ ID NO: 1525813 - RNA, 19 nt, Homo sapiens
uacuguagguguucauuua

SEQ ID NO: 1525814 - RNA, 19 nt, Homo sapiens
gggagcaccuuuuauauuu

SEQ ID NO: 1525815 - RNA, 19 nt, Homo sapiens
gcauuuaagugcuuggaau

SEQ ID NO: 1525816 - RNA, 19 nt, Homo sapiens
gaaagugauuaaaguaugc

SEQ ID NO: 1525817 - RNA, 19 nt, Homo sapiens
guuaagcuauuggaaauga

SEQ ID NO: 1525818 - RNA, 19 nt, Homo sapiens
uaacuaggauaaugcuuuc

SEQ ID NO: 1525819 - RNA, 19 nt, Homo sapiens
gaagcgcuauggcagauuc

SEQ ID NO: 1525820 - RNA, 19 nt, Homo sapiens
gacuaucacuaacagguaa

SEQ ID NO: 1525821 - RNA, 19 nt, Homo sapiens
gugaaucucuugcauuuac

SEQ ID NO: 1525822 - RNA, 19 nt, Homo sapiens
uaucaaaggguacuuggua

SEQ ID NO: 1525823 - RNA, 19 nt, Homo sapiens
gcacugauagaucuuaaug

SEQ ID NO: 1525824 - RNA, 19 nt, Homo sapiens
gaacagcuuacaaacaaug

SEQ ID NO: 1525825 - RNA, 19 nt, Homo sapiens
aaugguggcuguaaauuau

SEQ ID NO: 1525826 - RNA, 19 nt, Homo sapiens
aaauagaauuggucagcua

SEQ ID NO: 1525827 - RNA, 19 nt, Homo sapiens
uaaugcauaugccaaagaa

SEQ ID NO: 1525828 - RNA, 19 nt, Homo sapiens
gccaauaauuagaagugua

SEQ ID NO: 1525829 - RNA, 19 nt, Homo sapiens
gguagucuauggugaacuu

SEQ ID NO: 1525830 - RNA, 19 nt, Homo sapiens
gaagugugauugcaauugc

SEQ ID NO: 1525831 - RNA, 19 nt, Homo sapiens
guaagagcucuccauuaua

SEQ ID NO: 1525832 - RNA, 19 nt, Homo sapiens
gaauaccuagcacaauuaa

SEQ ID NO: 1525833 - RNA, 19 nt, Homo sapiens
ggaagaaugguggcuguaa

SEQ ID NO: 1525834 - RNA, 19 nt, Homo sapiens
ucacuuugcuaucaagaug

SEQ ID NO: 1525835 - RNA, 19 nt, Homo sapiens
gauguagugugcaguagug

SEQ ID NO: 1525836 - RNA, 19 nt, Homo sapiens
agaaaugugugggcucuuu

SEQ ID NO: 1525837 - RNA, 19 nt, Homo sapiens
gggcaggauucccagguuu

SEQ ID NO: 1525838 - RNA, 19 nt, Homo sapiens
gauaguacauuggcuugug

SEQ ID NO: 1525839 - RNA, 19 nt, Homo sapiens
gcagaacagcuuacaaaca

SEQ ID NO: 1525840 - RNA, 19 nt, Homo sapiens
uagcagaacagcuuacaaa

SEQ ID NO: 1525841 - RNA, 19 nt, Homo sapiens
aaucgggcaucauaacuuu

SEQ ID NO: 1525842 - RNA, 19 nt, Homo sapiens
ggaaugcuugaguggauua

SEQ ID NO: 1525843 - RNA, 19 nt, Homo sapiens
caugaugcuucugcaaaua

SEQ ID NO: 1525844 - RNA, 19 nt, Homo sapiens
gaugauaaacuugcacuga

SEQ ID NO: 1525845 - RNA, 19 nt, Homo sapiens
gaaagcaaguuugaugacu

SEQ ID NO: 1525846 - RNA, 19 nt, Homo sapiens
ugaugaagguuggccauuu

SEQ ID NO: 1525847 - RNA, 19 nt, Homo sapiens
guacauauuuacuguuagg

SEQ ID NO: 1525848 - RNA, 19 nt, Homo sapiens
ugaauaccuagcacaauua

SEQ ID NO: 1525849 - RNA, 19 nt, Homo sapiens
caauuacuaugcuguuugu

SEQ ID NO: 1525850 - RNA, 19 nt, Homo sapiens
gggaaaaguugagaagaua

SEQ ID NO: 1525851 - RNA, 19 nt, Homo sapiens
caugacauacgguuaagua

SEQ ID NO: 1525852 - RNA, 19 nt, Homo sapiens
ggaugaagucaauaaaguu

SEQ ID NO: 1525853 - RNA, 19 nt, Homo sapiens
gguacuuaguuugcauuua

SEQ ID NO: 1525854 - RNA, 19 nt, Homo sapiens
gguaugaaagcaaguuuga

SEQ ID NO: 1525855 - RNA, 19 nt, Homo sapiens
cuaucaagauguucacuau

SEQ ID NO: 1525856 - RNA, 19 nt, Homo sapiens
uaaaguaugcacaaccaaa

SEQ ID NO: 1525857 - RNA, 19 nt, Homo sapiens
uaaguaacaacgugaggua

SEQ ID NO: 1525858 - RNA, 19 nt, Homo sapiens
aaauugggauguaugguau

SEQ ID NO: 1525859 - RNA, 19 nt, Homo sapiens
cagcggugauugcuacuug

SEQ ID NO: 1525860 - RNA, 19 nt, Homo sapiens
gagguugucugucuauggu

SEQ ID NO: 1525861 - RNA, 19 nt, Homo sapiens
cuucugauguguaggguuu

SEQ ID NO: 1525862 - RNA, 19 nt, Homo sapiens
ucucuugcauuuacuuuga

SEQ ID NO: 1525863 - RNA, 19 nt, Homo sapiens
cagcaacuauuuauuaagc

SEQ ID NO: 1525864 - RNA, 19 nt, Homo sapiens
gguagccauuguuugaauu

SEQ ID NO: 1525865 - RNA, 19 nt, Homo sapiens
gaauuggucagcuacuuau

SEQ ID NO: 1525866 - RNA, 19 nt, Homo sapiens
ccaagauaguaaugcauau

SEQ ID NO: 1525867 - RNA, 19 nt, Homo sapiens
caugaaguuuggcauaugu

SEQ ID NO: 1525868 - RNA, 19 nt, Homo sapiens
gaugggaagguaaucauug

SEQ ID NO: 1525869 - RNA, 19 nt, Homo sapiens
gcaauuaauggaaauagca

SEQ ID NO: 1525870 - RNA, 19 nt, Homo sapiens
ggaagugugauugcaauug

SEQ ID NO: 1525871 - RNA, 19 nt, Homo sapiens
gguugucugucuaugguuu

SEQ ID NO: 1525872 - RNA, 19 nt, Homo sapiens
uugugaaucucuugcauuu

SEQ ID NO: 1525873 - RNA, 19 nt, Homo sapiens
gaccucgcuuggcaauuaa

SEQ ID NO: 1525874 - RNA, 19 nt, Homo sapiens
acacucaccucuuacucaa

SEQ ID NO: 1525875 - RNA, 19 nt, Homo sapiens
ggaggaugaagucaauaaa

SEQ ID NO: 1525876 - RNA, 19 nt, Homo sapiens
cagaucuuccugauuauuu

SEQ ID NO: 1525877 - RNA, 19 nt, Homo sapiens
agaauuggucagcuacuua

SEQ ID NO: 1525878 - RNA, 19 nt, Homo sapiens
acaguuauaucccucuaug

SEQ ID NO: 1525879 - RNA, 19 nt, Homo sapiens
ugggauguaugguaugaaa

SEQ ID NO: 1525880 - RNA, 19 nt, Homo sapiens
caacuggcccucaaugaag

SEQ ID NO: 1525881 - RNA, 19 nt, Homo sapiens
gcugcuacauacugucuga

SEQ ID NO: 1525882 - RNA, 19 nt, Homo sapiens
gaagguuggccauuugcaa

SEQ ID NO: 1525883 - RNA, 19 nt, Homo sapiens
aaucauugcccauuaauag

SEQ ID NO: 1525884 - RNA, 19 nt, Homo sapiens
caaguuugaugacugugau

SEQ ID NO: 1525885 - RNA, 19 nt, Homo sapiens
gcaaguuugaugacuguga

SEQ ID NO: 1525886 - RNA, 19 nt, Homo sapiens
gcuuggcaauuaauggaaa

SEQ ID NO: 1525887 - RNA, 19 nt, Homo sapiens
gaaaauugccaaacacuca

SEQ ID NO: 1525888 - RNA, 19 nt, Homo sapiens
acaccuaaucucauguuua

SEQ ID NO: 1525889 - RNA, 19 nt, Homo sapiens
guacagagcugauucauga

SEQ ID NO: 1525890 - RNA, 19 nt, Homo sapiens
gaaaguauuugcugacuga

SEQ ID NO: 1525891 - RNA, 19 nt, Homo sapiens
gcaaggagcuuaguuuaga

SEQ ID NO: 1525892 - RNA, 19 nt, Homo sapiens
ggaagaggauuuacaagga

SEQ ID NO: 1525893 - RNA, 19 nt, Homo sapiens
caaaggauauaauggagua

SEQ ID NO: 1525894 - RNA, 19 nt, Homo sapiens
gaagaaguauggcaguuug

SEQ ID NO: 1525895 - RNA, 19 nt, Homo sapiens
gaaauggaauacuggguuu

SEQ ID NO: 1525896 - RNA, 19 nt, Homo sapiens
gcagaugguuuguuacuug

SEQ ID NO: 1525897 - RNA, 19 nt, Homo sapiens
gcaagugccucgccuuaga

SEQ ID NO: 1525898 - RNA, 19 nt, Homo sapiens
uagaugagguuaugaagaa

SEQ ID NO: 1525899 - RNA, 19 nt, Homo sapiens
caacuuaaccaacauagaa

SEQ ID NO: 1525900 - RNA, 19 nt, Homo sapiens
aaacguggaucaaggauga

SEQ ID NO: 1525901 - RNA, 19 nt, Homo sapiens
cagagaagcuguugucauc

SEQ ID NO: 1525902 - RNA, 19 nt, Homo sapiens
gaggaaaggaauccacuua

SEQ ID NO: 1525903 - RNA, 19 nt, Homo sapiens
gaaguccacuggucucuca

SEQ ID NO: 1525904 - RNA, 19 nt, Homo sapiens
gcaguggacucaaacuaga

SEQ ID NO: 1525905 - RNA, 19 nt, Homo sapiens
uggagcagaugguuuguua

SEQ ID NO: 1525906 - RNA, 19 nt, Homo sapiens
uaaccaacauagaaggaua

SEQ ID NO: 1525907 - RNA, 19 nt, Homo sapiens
gaaaggacgcuaaacacuu

SEQ ID NO: 1525908 - RNA, 19 nt, Homo sapiens
ggaaagaacagucagaaag

SEQ ID NO: 1525909 - RNA, 19 nt, Homo sapiens
agaaguccuuggaagauua

SEQ ID NO: 1525910 - RNA, 19 nt, Homo sapiens
gaacaccuuugugcuaaga

SEQ ID NO: 1525911 - RNA, 19 nt, Homo sapiens
cagcuaccauguacuauug

SEQ ID NO: 1525912 - RNA, 19 nt, Homo sapiens
ccaaaaggcuguucaaaau

SEQ ID NO: 1525913 - RNA, 19 nt, Homo sapiens
gaaggccaguuacuuggaa

SEQ ID NO: 1525914 - RNA, 19 nt, Homo sapiens
caacacuugugcauucuga

SEQ ID NO: 1525915 - RNA, 19 nt, Homo sapiens
ccaaacacuuaguugaauu

SEQ ID NO: 1525916 - RNA, 19 nt, Homo sapiens
gggcaaggagcuuaguuua

SEQ ID NO: 1525917 - RNA, 19 nt, Homo sapiens
caaagaauucugaccauga

SEQ ID NO: 1525918 - RNA, 19 nt, Homo sapiens
gaugaacaccuuugugcua

SEQ ID NO: 1525919 - RNA, 19 nt, Homo sapiens
uaacuuccguaucuucuau

SEQ ID NO: 1525920 - RNA, 19 nt, Homo sapiens
uaucuccucuuaugaugua

SEQ ID NO: 1525921 - RNA, 19 nt, Homo sapiens
gaacaaccauaagagaaag

SEQ ID NO: 1525922 - RNA, 19 nt, Homo sapiens
aaagaauucugaccaugaa

SEQ ID NO: 1525923 - RNA, 19 nt, Homo sapiens
ccacuauuguuaccucaaa

SEQ ID NO: 1525924 - RNA, 19 nt, Homo sapiens
aaauguaacuuccguaucu

SEQ ID NO: 1525925 - RNA, 19 nt, Homo sapiens
gaagcuggguacagaaagu

SEQ ID NO: 1525926 - RNA, 19 nt, Homo sapiens
aaaggacgcuaaacacuuc

SEQ ID NO: 1525927 - RNA, 19 nt, Homo sapiens
aagcagagcauucuuaguu

SEQ ID NO: 1525928 - RNA, 19 nt, Homo sapiens
uuacugacuuuccaucaaa

SEQ ID NO: 1525929 - RNA, 19 nt, Homo sapiens
caccaacacuugugcauuc

SEQ ID NO: 1525930 - RNA, 19 nt, Homo sapiens
ggaaaggaauccacuuagc

SEQ ID NO: 1525931 - RNA, 19 nt, Homo sapiens
gacacucucuaaucgaauu

SEQ ID NO: 1525932 - RNA, 19 nt, Homo sapiens
gcauccagaucucauuaug

SEQ ID NO: 1525933 - RNA, 19 nt, Homo sapiens
gagcaugcagugaagagua

SEQ ID NO: 1525934 - RNA, 19 nt, Homo sapiens
ucaaacgcaugcauauaga

SEQ ID NO: 1525935 - RNA, 19 nt, Homo sapiens
caaguucugucagugauga

SEQ ID NO: 1525936 - RNA, 19 nt, Homo sapiens
cuaauaccauguucauuuc

SEQ ID NO: 1525937 - RNA, 19 nt, Homo sapiens
gguagccacuucagaggaa

SEQ ID NO: 1525938 - RNA, 19 nt, Homo sapiens
auaaacacaugcuggauau

SEQ ID NO: 1525939 - RNA, 19 nt, Homo sapiens
cagccguacuuuccagaua

SEQ ID NO: 1525940 - RNA, 19 nt, Homo sapiens
cccacaaccuucugacuuu

SEQ ID NO: 1525941 - RNA, 19 nt, Homo sapiens
cgaaguguauuccacaaca

SEQ ID NO: 1525942 - RNA, 19 nt, Homo sapiens
guccacuggucucucauua

SEQ ID NO: 1525943 - RNA, 19 nt, Homo sapiens
gcucauggacugaaacuca

SEQ ID NO: 1525944 - RNA, 19 nt, Homo sapiens
agagcagccuuuccaguuu

SEQ ID NO: 1525945 - RNA, 19 nt, Homo sapiens
ggugugcaguggacucaaa

SEQ ID NO: 1525946 - RNA, 19 nt, Homo sapiens
gcacgauuguggucaccuu

SEQ ID NO: 1525947 - RNA, 19 nt, Homo sapiens
caugaauacugcagagaga

SEQ ID NO: 1525948 - RNA, 19 nt, Homo sapiens
ggaauagacaguugagaca

SEQ ID NO: 1525949 - RNA, 19 nt, Homo sapiens
ugggaagucugaccaaguu

SEQ ID NO: 1525950 - RNA, 19 nt, Homo sapiens
gaaagaacagucagaaagc

SEQ ID NO: 1525951 - RNA, 19 nt, Homo sapiens
ugaacaaccauaagagaaa

SEQ ID NO: 1525952 - RNA, 19 nt, Homo sapiens
aauagacaguugagacauu

SEQ ID NO: 1525953 - RNA, 19 nt, Homo sapiens
agacagagcaugcagugaa

SEQ ID NO: 1525954 - RNA, 19 nt, Homo sapiens
gugacacucucuaaucgaa

SEQ ID NO: 1525955 - RNA, 19 nt, Homo sapiens
ccacuggucucucauuacu

SEQ ID NO: 1525956 - RNA, 19 nt, Homo sapiens
gcuaagaccaaguucaaug

SEQ ID NO: 1525957 - RNA, 19 nt, Homo sapiens
gaugguuuguuacuugaau

SEQ ID NO: 1525958 - RNA, 19 nt, Homo sapiens
gcagagcauucuuaguucu

SEQ ID NO: 1525959 - RNA, 19 nt, Homo sapiens
aaagaaaggacgcuaaaca

SEQ ID NO: 1525960 - RNA, 19 nt, Homo sapiens
gaaaagaaaggacgcuaaa

SEQ ID NO: 1525961 - RNA, 19 nt, Homo sapiens
guuaguacuuuguccucua

SEQ ID NO: 1525962 - RNA, 19 nt, Homo sapiens
agaaagcucuucaaaucca

SEQ ID NO: 1525963 - RNA, 19 nt, Homo sapiens
uuacuugaaucuccaaaca

SEQ ID NO: 1525964 - RNA, 19 nt, Homo sapiens
ggagcuuaguuuagacgaa

SEQ ID NO: 1525965 - RNA, 19 nt, Homo sapiens
gguacaggauucucagauc

SEQ ID NO: 1525966 - RNA, 19 nt, Homo sapiens
gagaagcuguugucaucag

SEQ ID NO: 1525967 - RNA, 19 nt, Homo sapiens
gcuaaacacuucauuuccu

SEQ ID NO: 1525968 - RNA, 19 nt, Homo sapiens
cagaugguuuguuacuuga

SEQ ID NO: 1525969 - RNA, 19 nt, Homo sapiens
aauaaacacaugcuggaua

SEQ ID NO: 1525970 - RNA, 19 nt, Homo sapiens
gaaguccuuggaagauuaa

SEQ ID NO: 1525971 - RNA, 19 nt, Homo sapiens
aaaaggcuguucaaaauga

SEQ ID NO: 1525972 - RNA, 19 nt, Homo sapiens
uugaaucuccaaacacuua

SEQ ID NO: 1525973 - RNA, 19 nt, Homo sapiens
agacugcuguuacgaagug

SEQ ID NO: 1525974 - RNA, 19 nt, Homo sapiens
gaaguauggcaguuugguu

SEQ ID NO: 1525975 - RNA, 19 nt, Homo sapiens
guuacugacuuuccaucaa

SEQ ID NO: 1525976 - RNA, 19 nt, Homo sapiens
ccaggucauuaauauguau

SEQ ID NO: 1525977 - RNA, 19 nt, Homo sapiens
uagagcagccuuuccaguu

SEQ ID NO: 1525978 - RNA, 19 nt, Homo sapiens
ucugagaaauggaauacug

SEQ ID NO: 1525979 - RNA, 19 nt, Homo sapiens
auagacaguugagacauuu

SEQ ID NO: 1525980 - RNA, 19 nt, Homo sapiens
gaccagucauccuguucuu

SEQ ID NO: 1525981 - RNA, 19 nt, Homo sapiens
gacuuuccaucaaauagug

SEQ ID NO: 1525982 - RNA, 19 nt, Homo sapiens
gacagagcaugcagugaag

SEQ ID NO: 1525983 - RNA, 19 nt, Homo sapiens
gcuaccauguacuauuguu

SEQ ID NO: 1525984 - RNA, 19 nt, Homo sapiens
guaaccaaaggauauaaug

SEQ ID NO: 1525985 - RNA, 19 nt, Homo sapiens
ggaugcagucccagacaaa

SEQ ID NO: 1525986 - RNA, 19 nt, Homo sapiens
aagaaguccuuggaagauu

SEQ ID NO: 1525987 - RNA, 19 nt, Homo sapiens
gcgaagcuggguacagaaa

SEQ ID NO: 1525988 - RNA, 19 nt, Homo sapiens
gcagagaagcuguugucau

SEQ ID NO: 1525989 - RNA, 19 nt, Homo sapiens
ccagagacauuuaacauug

SEQ ID NO: 1525990 - RNA, 19 nt, Homo sapiens
ccagaaaguuggagaacaa

SEQ ID NO: 1525991 - RNA, 19 nt, Homo sapiens
gcagauaucauucuacaau

SEQ ID NO: 1525992 - RNA, 19 nt, Homo sapiens
ucacagaccugaguuuaug

SEQ ID NO: 1525993 - RNA, 19 nt, Homo sapiens
gcaaaauacuccuuagaaa

SEQ ID NO: 1525994 - RNA, 19 nt, Homo sapiens
ggagagagaacauggagaa

SEQ ID NO: 1525995 - RNA, 19 nt, Homo sapiens
gagagaacauggagaaacu

SEQ ID NO: 1525996 - RNA, 19 nt, Homo sapiens
uguguaaacuaacccaaua

SEQ ID NO: 1525997 - RNA, 19 nt, Homo sapiens
gggcagauaucauucuaca

SEQ ID NO: 1525998 - RNA, 19 nt, Homo sapiens
acaagaggcugcugagaau

SEQ ID NO: 1525999 - RNA, 19 nt, Homo sapiens
cauauugacugaugagcaa

SEQ ID NO: 1526000 - RNA, 19 nt, Homo sapiens
gaaugcauaucugacuuga

SEQ ID NO: 1526001 - RNA, 19 nt, Homo sapiens
gaacacaucgagggagaaa

SEQ ID NO: 1526002 - RNA, 19 nt, Homo sapiens
ggacucagcagcauguuca

SEQ ID NO: 1526003 - RNA, 19 nt, Homo sapiens
gaacauggagaaacugaag

SEQ ID NO: 1526004 - RNA, 19 nt, Homo sapiens
caagaaagaauggcgauga

SEQ ID NO: 1526005 - RNA, 19 nt, Homo sapiens
acuaugagauugagacaug

SEQ ID NO: 1526006 - RNA, 19 nt, Homo sapiens
ccaccgagcuagaggagau

SEQ ID NO: 1526007 - RNA, 19 nt, Homo sapiens
caggaaauauugaacacau

SEQ ID NO: 1526008 - RNA, 19 nt, Homo sapiens
ggagaacaagacuuugaaa

SEQ ID NO: 1526009 - RNA, 19 nt, Homo sapiens
aagaggcugcugagaauua

SEQ ID NO: 1526010 - RNA, 19 nt, Homo sapiens
caacaugguccuucuugug

SEQ ID NO: 1526011 - RNA, 19 nt, Homo sapiens
uaucacagaccugaguuua

SEQ ID NO: 1526012 - RNA, 19 nt, Homo sapiens
ugaagcagcuaaaagcaua

SEQ ID NO: 1526013 - RNA, 19 nt, Homo sapiens
ccugagaacuaugagauug

SEQ ID NO: 1526014 - RNA, 19 nt, Homo sapiens
gacuugaaccugagagaaa

SEQ ID NO: 1526015 - RNA, 19 nt, Homo sapiens
gagaauuacaggaaguuau

SEQ ID NO: 1526016 - RNA, 19 nt, Homo sapiens
gguggcaagugggcauaua

SEQ ID NO: 1526017 - RNA, 19 nt, Homo sapiens
ggaaugcauaucugacuug

SEQ ID NO: 1526018 - RNA, 19 nt, Homo sapiens
gaaacuugaagcagcuaaa

SEQ ID NO: 1526019 - RNA, 19 nt, Homo sapiens
gagaacauggagaaacuga

SEQ ID NO: 1526020 - RNA, 19 nt, Homo sapiens
gagucugaguauaguauga

SEQ ID NO: 1526021 - RNA, 19 nt, Homo sapiens
ggaagaggaacaaaauuuu

SEQ ID NO: 1526022 - RNA, 19 nt, Homo sapiens
agaugucccucauuuacaa

SEQ ID NO: 1526023 - RNA, 19 nt, Homo sapiens
agacuccgguuguugaaug

SEQ ID NO: 1526024 - RNA, 19 nt, Homo sapiens
guacuccagagacauuuaa

SEQ ID NO: 1526025 - RNA, 19 nt, Homo sapiens
ucagaguacuccagagaca

SEQ ID NO: 1526026 - RNA, 19 nt, Homo sapiens
cagcaggaaugcauaucug

SEQ ID NO: 1526027 - RNA, 19 nt, Homo sapiens
gaugauugagucugaguau

SEQ ID NO: 1526028 - RNA, 19 nt, Homo sapiens
gaacacgggcagauaucau

SEQ ID NO: 1526029 - RNA, 19 nt, Homo sapiens
accgagaugucccucauuu

SEQ ID NO: 1526030 - RNA, 19 nt, Homo sapiens
guaugagacuccgguuguu

SEQ ID NO: 1526031 - RNA, 19 nt, Homo sapiens
uacaagaggcugcugagaa

SEQ ID NO: 1526032 - RNA, 19 nt, Homo sapiens
cgagaugucccucauuuac

SEQ ID NO: 1526033 - RNA, 19 nt, Homo sapiens
gaacuaugagauugagaca

SEQ ID NO: 1526034 - RNA, 19 nt, Homo sapiens
gaggaccugagaacuauga

SEQ ID NO: 1526035 - RNA, 19 nt, Homo sapiens
cugaggaccugagaacuau

SEQ ID NO: 1526036 - RNA, 19 nt, Homo sapiens
uaagaggacucagcagcau

SEQ ID NO: 1526037 - RNA, 19 nt, Homo sapiens
gcugagaauuacaggaagu

SEQ ID NO: 1526038 - RNA, 19 nt, Homo sapiens
guuguugaaugaagagugu

SEQ ID NO: 1526039 - RNA, 19 nt, Homo sapiens
cagacucccucaccaucuu

SEQ ID NO: 1526040 - RNA, 19 nt, Homo sapiens
aacauuggauccugaaaca

SEQ ID NO: 1526041 - RNA, 19 nt, Homo sapiens
aagaaagaauggcgaugau

SEQ ID NO: 1526042 - RNA, 19 nt, Homo sapiens
gagaugucccucauuuaca

SEQ ID NO: 1526043 - RNA, 19 nt, Homo sapiens
gaccugagaacuaugagau

SEQ ID NO: 1526044 - RNA, 19 nt, Homo sapiens
caucguggagcuugagaaa

SEQ ID NO: 1526045 - RNA, 19 nt, Homo sapiens
gagacagcaggaaugcaua

SEQ ID NO: 1526046 - RNA, 19 nt, Homo sapiens
gauugagucugaguauagu

SEQ ID NO: 1526047 - RNA, 19 nt, Homo sapiens
aaaagaugauugagucuga

SEQ ID NO: 1526048 - RNA, 19 nt, Homo sapiens
gaauuuguguaaacuaacc

SEQ ID NO: 1526049 - RNA, 19 nt, Homo sapiens
gaaaguuggagaacaagac

SEQ ID NO: 1526050 - RNA, 19 nt, Homo sapiens
ugaagagugugagcagaau

SEQ ID NO: 1526051 - RNA, 19 nt, Homo sapiens
ucugaggaccugagaacua

SEQ ID NO: 1526052 - RNA, 19 nt, Homo sapiens
cagagacauuuaacauugg

SEQ ID NO: 1526053 - RNA, 19 nt, Homo sapiens
guucagaguacuccagaga

SEQ ID NO: 1526054 - RNA, 19 nt, Homo sapiens
gcucaagaaugcaaaauac

SEQ ID NO: 1526055 - RNA, 19 nt, Homo sapiens
ccacgagacaccagaaagu

SEQ ID NO: 1526056 - RNA, 19 nt, Homo sapiens
augcauaucugacuugaac

SEQ ID NO: 1526057 - RNA, 19 nt, Homo sapiens
cccuuaaucuucugugugu

SEQ ID NO: 1526058 - RNA, 19 nt, Homo sapiens
ugaccgagaugucccucau

SEQ ID NO: 1526059 - RNA, 19 nt, Homo sapiens
ggacacaguugggguuuuc

SEQ ID NO: 1526060 - RNA, 19 nt, Homo sapiens
ugauugagucugaguauag

SEQ ID NO: 1526061 - RNA, 19 nt, Homo sapiens
cuaaaagcauauugacuga

SEQ ID NO: 1526062 - RNA, 19 nt, Homo sapiens
cuuaaucuucuguguguaa

SEQ ID NO: 1526063 - RNA, 19 nt, Homo sapiens
ccgagaugucccucauuua

SEQ ID NO: 1526064 - RNA, 19 nt, Homo sapiens
gaaugcaaaauacuccuua

SEQ ID NO: 1526065 - RNA, 19 nt, Homo sapiens
aaaagcauauugacugaug

SEQ ID NO: 1526066 - RNA, 19 nt, Homo sapiens
caugguccuucuugugaug

SEQ ID NO: 1526067 - RNA, 19 nt, Homo sapiens
ccaaauggagacacaaguc

SEQ ID NO: 1526068 - RNA, 19 nt, Homo sapiens
uggcgaugauucaggaaga

SEQ ID NO: 1526069 - RNA, 19 nt, Homo sapiens
uggcaacccagaaagauug

SEQ ID NO: 1526070 - RNA, 19 nt, Homo sapiens
aaagcauauugacugauga

SEQ ID NO: 1526071 - RNA, 19 nt, Homo sapiens
cagcagcauguucagagua

SEQ ID NO: 1526072 - RNA, 19 nt, Homo sapiens
gagagagaacauggagaaa

SEQ ID NO: 1526073 - RNA, 19 nt, Homo sapiens
caucgagggagaaacuuga

SEQ ID NO: 1526074 - RNA, 19 nt, Homo sapiens
ugucccucauuuacaauuu

SEQ ID NO: 1526075 - RNA, 19 nt, Homo sapiens
aaaagaaguuggacacagu

SEQ ID NO: 1526076 - RNA, 19 nt, Homo sapiens
agagacauuuaacauugga

SEQ ID NO: 1526077 - RNA, 19 nt, Homo sapiens
ugagaauuacaggaaguua

SEQ ID NO: 1526078 - RNA, 19 nt, Homo sapiens
gacuccgguuguugaauga

SEQ ID NO: 1526079 - RNA, 19 nt, Homo sapiens
acuguuagcccuuaaucuu

SEQ ID NO: 1526080 - RNA, 19 nt, Homo sapiens
aacaugguccuucuuguga

SEQ ID NO: 1526081 - RNA, 19 nt, Homo sapiens
gaugauucaggaagaggaa

SEQ ID NO: 1526082 - RNA, 19 nt, Homo sapiens
agaguacuccagagacauu

SEQ ID NO: 1526083 - RNA, 19 nt, Homo sapiens
cccaggagcacaaacauca

SEQ ID NO: 1526084 - RNA, 19 nt, Homo sapiens
gaccacgagacaccagaaa

SEQ ID NO: 1526085 - RNA, 19 nt, Homo sapiens
ggagcacaaacaucacaug

SEQ ID NO: 1526086 - RNA, 19 nt, Homo sapiens
gaaacugaaggagagugaa

SEQ ID NO: 1526087 - RNA, 19 nt, Homo sapiens
gaaauauugaacacaucga

SEQ ID NO: 1526088 - RNA, 19 nt, Homo sapiens
guguaaacuaacccaauaa

SEQ ID NO: 1526089 - RNA, 19 nt, Homo sapiens
gcacuccucuugcauauua

SEQ ID NO: 1526090 - RNA, 19 nt, Homo sapiens
ggaaagaugucacuucaug

SEQ ID NO: 1526091 - RNA, 19 nt, Homo sapiens
gcaaugagcugcagcaaag

SEQ ID NO: 1526092 - RNA, 19 nt, Homo sapiens
ggaagaaacuaaaucaaca

SEQ ID NO: 1526093 - RNA, 19 nt, Homo sapiens
gaagcuaagugccaggaua

SEQ ID NO: 1526094 - RNA, 19 nt, Homo sapiens
gaucaaagcagcaaaguau

SEQ ID NO: 1526095 - RNA, 19 nt, Homo sapiens
ggaacucuuugacauauuu

SEQ ID NO: 1526096 - RNA, 19 nt, Homo sapiens
ugaaacagcacuugaguua

SEQ ID NO: 1526097 - RNA, 19 nt, Homo sapiens
ccagggaucuuguuucuga

SEQ ID NO: 1526098 - RNA, 19 nt, Homo sapiens
ugggacaucuuguuaaaua

SEQ ID NO: 1526099 - RNA, 19 nt, Homo sapiens
ucagugcacucaagucaua

SEQ ID NO: 1526100 - RNA, 19 nt, Homo sapiens
aaagacccauggauacuua

SEQ ID NO: 1526101 - RNA, 19 nt, Homo sapiens
gcucuaauaucacuggaaa

SEQ ID NO: 1526102 - RNA, 19 nt, Homo sapiens
gaggugaacaucuaugaua

SEQ ID NO: 1526103 - RNA, 19 nt, Homo sapiens
gaccaugacugggugauuu

SEQ ID NO: 1526104 - RNA, 19 nt, Homo sapiens
aaccguaacuacagauuua

SEQ ID NO: 1526105 - RNA, 19 nt, Homo sapiens
cagcaaagacccauggaua

SEQ ID NO: 1526106 - RNA, 19 nt, Homo sapiens
gaugaucuauggaggcauu

SEQ ID NO: 1526107 - RNA, 19 nt, Homo sapiens
cauggauacuuaacagaua

SEQ ID NO: 1526108 - RNA, 19 nt, Homo sapiens
ggagaaccguaacuacaga

SEQ ID NO: 1526109 - RNA, 19 nt, Homo sapiens
ugaaauacaggaacucuuu

SEQ ID NO: 1526110 - RNA, 19 nt, Homo sapiens
gcacaucuccauucacuuc

SEQ ID NO: 1526111 - RNA, 19 nt, Homo sapiens
gcaaaguauucccagaaau

SEQ ID NO: 1526112 - RNA, 19 nt, Homo sapiens
acacauggauugucccuau

SEQ ID NO: 1526113 - RNA, 19 nt, Homo sapiens
guuauaaucccacagaauu

SEQ ID NO: 1526114 - RNA, 19 nt, Homo sapiens
ugccaaugcugcuguauuu

SEQ ID NO: 1526115 - RNA, 19 nt, Homo sapiens
aaacagcacuugaguuaac

SEQ ID NO: 1526116 - RNA, 19 nt, Homo sapiens
caaaguauucccagaaaug

SEQ ID NO: 1526117 - RNA, 19 nt, Homo sapiens
gaaccguaacuacagauuu

SEQ ID NO: 1526118 - RNA, 19 nt, Homo sapiens
guaccuugcugaagaagau

SEQ ID NO: 1526119 - RNA, 19 nt, Homo sapiens
ggccauagaugaccagagu

SEQ ID NO: 1526120 - RNA, 19 nt, Homo sapiens
gaugcuuucuuguuucuug

SEQ ID NO: 1526121 - RNA, 19 nt, Homo sapiens
cauaauauccucagagaag

SEQ ID NO: 1526122 - RNA, 19 nt, Homo sapiens
gacuggauauuauagaguu

SEQ ID NO: 1526123 - RNA, 19 nt, Homo sapiens
gaccagaguacaguuauuu

SEQ ID NO: 1526124 - RNA, 19 nt, Homo sapiens
caggaacucuuugacauau

SEQ ID NO: 1526125 - RNA, 19 nt, Homo sapiens
ccaugaagguggaaaauuu

SEQ ID NO: 1526126 - RNA, 19 nt, Homo sapiens
ggugaacaucuaugauaua

SEQ ID NO: 1526127 - RNA, 19 nt, Homo sapiens
gaugaccagaguacaguua

SEQ ID NO: 1526128 - RNA, 19 nt, Homo sapiens
cuacagauuuacagauugu

SEQ ID NO: 1526129 - RNA, 19 nt, Homo sapiens
acagauauauggaguaugc

SEQ ID NO: 1526130 - RNA, 19 nt, Homo sapiens
gaaacagcacuugaguuaa

SEQ ID NO: 1526131 - RNA, 19 nt, Homo sapiens
uacauaauauccucagaga

SEQ ID NO: 1526132 - RNA, 19 nt, Homo sapiens
uuucugaggugaacaucua

SEQ ID NO: 1526133 - RNA, 19 nt, Homo sapiens
gaaauacaggaacucuuug

SEQ ID NO: 1526134 - RNA, 19 nt, Homo sapiens
caucuccauucacuucuaa

SEQ ID NO: 1526135 - RNA, 19 nt, Homo sapiens
ccuaaacucccaagaaaug

SEQ ID NO: 1526136 - RNA, 19 nt, Homo sapiens
gaagaaaagauucaacuug

SEQ ID NO: 1526137 - RNA, 19 nt, Homo sapiens
cuaaggcuauuccuguuau

SEQ ID NO: 1526138 - RNA, 19 nt, Homo sapiens
cagcacuccucuugcauau

SEQ ID NO: 1526139 - RNA, 19 nt, Homo sapiens
cagcacaucuccauucacu

SEQ ID NO: 1526140 - RNA, 19 nt, Homo sapiens
gauaaagagugggacaucu

SEQ ID NO: 1526141 - RNA, 19 nt, Homo sapiens
ggcauacagucuugguaaa

SEQ ID NO: 1526142 - RNA, 19 nt, Homo sapiens
agacugcaguucauugaug

SEQ ID NO: 1526143 - RNA, 19 nt, Homo sapiens
ugggaaagaugucacuuca

SEQ ID NO: 1526144 - RNA, 19 nt, Homo sapiens
ggagaaacacauagcuugu

SEQ ID NO: 1526145 - RNA, 19 nt, Homo sapiens
gaagacauuuuccuacuca

SEQ ID NO: 1526146 - RNA, 19 nt, Homo sapiens
gagugccauucuucucaua

SEQ ID NO: 1526147 - RNA, 19 nt, Homo sapiens
ggacucuucuaaccagcaa

SEQ ID NO: 1526148 - RNA, 19 nt, Homo sapiens
ccucuugcauauuauaaug

SEQ ID NO: 1526149 - RNA, 19 nt, Homo sapiens
caagugaaauacaggaacu

SEQ ID NO: 1526150 - RNA, 19 nt, Homo sapiens
cuacuggcgucaugaaaca

SEQ ID NO: 1526151 - RNA, 19 nt, Homo sapiens
caagucauauuugaagaca

SEQ ID NO: 1526152 - RNA, 19 nt, Homo sapiens
aaagaugucacuucauguu

SEQ ID NO: 1526153 - RNA, 19 nt, Homo sapiens
gugccauucuucucauauu

SEQ ID NO: 1526154 - RNA, 19 nt, Homo sapiens
caacuuacagacaauaaag

SEQ ID NO: 1526155 - RNA, 19 nt, Homo sapiens
agagugggacaucuuguua

SEQ ID NO: 1526156 - RNA, 19 nt, Homo sapiens
agagguaccuauuaaagag

SEQ ID NO: 1526157 - RNA, 19 nt, Homo sapiens
cuagagcuguggccaugaa

SEQ ID NO: 1526158 - RNA, 19 nt, Homo sapiens
aaaugcaaguuucagauuc

SEQ ID NO: 1526159 - RNA, 19 nt, Homo sapiens
uggauugucccuauucuuu

SEQ ID NO: 1526160 - RNA, 19 nt, Homo sapiens
cccggaugcuuucuuguuu

SEQ ID NO: 1526161 - RNA, 19 nt, Homo sapiens
gaaagaugucacuucaugu

SEQ ID NO: 1526162 - RNA, 19 nt, Homo sapiens
uguaguuuguucacaguuu

SEQ ID NO: 1526163 - RNA, 19 nt, Homo sapiens
gcugaagaagaugaaauua

SEQ ID NO: 1526164 - RNA, 19 nt, Homo sapiens
ggaacuacacaaccuuuag

SEQ ID NO: 1526165 - RNA, 19 nt, Homo sapiens
cccacagaauuuacuuuaa

SEQ ID NO: 1526166 - RNA, 19 nt, Homo sapiens
acaggaacucuuugacaua

SEQ ID NO: 1526167 - RNA, 19 nt, Homo sapiens
gauaaauuagguuggaaga

SEQ ID NO: 1526168 - RNA, 19 nt, Homo sapiens
cagcaaaguauucccagaa

SEQ ID NO: 1526169 - RNA, 19 nt, Homo sapiens
ucaaagcagcaaaguauuc

SEQ ID NO: 1526170 - RNA, 19 nt, Homo sapiens
ugaccagaguacaguuauu

SEQ ID NO: 1526171 - RNA, 19 nt, Homo sapiens
gaggaacaccagaggauca

SEQ ID NO: 1526172 - RNA, 19 nt, Homo sapiens
agugggacaucuuguuaaa

SEQ ID NO: 1526173 - RNA, 19 nt, Homo sapiens
uacaggaacucuuugacau

SEQ ID NO: 1526174 - RNA, 19 nt, Homo sapiens
gugaucacuuuaaaugugu

SEQ ID NO: 1526175 - RNA, 19 nt, Homo sapiens
uaaaagguauggaacacaa

SEQ ID NO: 1526176 - RNA, 19 nt, Homo sapiens
guaaccagggaucuuguuu

SEQ ID NO: 1526177 - RNA, 19 nt, Homo sapiens
auccuaaacucccaagaaa

SEQ ID NO: 1526178 - RNA, 19 nt, Homo sapiens
caucagcacaucuccauuc

SEQ ID NO: 1526179 - RNA, 19 nt, Homo sapiens
gcaaagacccauggauacu

SEQ ID NO: 1526180 - RNA, 19 nt, Homo sapiens
aaagagguaccuauuaaag

SEQ ID NO: 1526181 - RNA, 19 nt, Homo sapiens
gauugucccuauucuuugg

SEQ ID NO: 1526182 - RNA, 19 nt, Homo sapiens
ugaaacaggagccauuuua

SEQ ID NO: 1526183 - RNA, 19 nt, Homo sapiens
ucccacagaauuuacuuua

SEQ ID NO: 1526184 - RNA, 19 nt, Homo sapiens
ucagucacauuuauuacuc

SEQ ID NO: 1526185 - RNA, 19 nt, Homo sapiens
caugccaacuuacagacaa

SEQ ID NO: 1526186 - RNA, 19 nt, Homo sapiens
gguauggaacacaaucauu

SEQ ID NO: 1526187 - RNA, 19 nt, Homo sapiens
gagugggacaucuuguuaa

SEQ ID NO: 1526188 - RNA, 19 nt, Homo sapiens
ccuaaggcuauuccuguua

SEQ ID NO: 1526189 - RNA, 19 nt, Homo sapiens
gaaaugugcucaccacuuc

SEQ ID NO: 1526190 - RNA, 19 nt, Homo sapiens
gcacaguucacuuuauuua

SEQ ID NO: 1526191 - RNA, 19 nt, Homo sapiens
gaccuacccucucuucuuu

SEQ ID NO: 1526192 - RNA, 19 nt, Homo sapiens
ucagaaggaucuacuaguu

SEQ ID NO: 1526193 - RNA, 19 nt, Homo sapiens
gcucaccuguaccuauuua

SEQ ID NO: 1526194 - RNA, 19 nt, Homo sapiens
ccaaugggaccaccaauaa

SEQ ID NO: 1526195 - RNA, 19 nt, Homo sapiens
caacaugguuccagaccuu

SEQ ID NO: 1526196 - RNA, 19 nt, Homo sapiens
gcucccaucuucaucaauu

SEQ ID NO: 1526197 - RNA, 19 nt, Homo sapiens
gcaccucgcccaacucauu

SEQ ID NO: 1526198 - RNA, 19 nt, Homo sapiens
gaagacguguuguggacuu

SEQ ID NO: 1526199 - RNA, 19 nt, Homo sapiens
gaacuauuccuuucaaugg

SEQ ID NO: 1526200 - RNA, 19 nt, Homo sapiens
gcagaagugcuacuaguga

SEQ ID NO: 1526201 - RNA, 19 nt, Homo sapiens
gcccaacccuggaacuauu

SEQ ID NO: 1526202 - RNA, 19 nt, Homo sapiens
gcagagacuucggaaugaa

SEQ ID NO: 1526203 - RNA, 19 nt, Homo sapiens
gaaggauccucggaaguuc

SEQ ID NO: 1526204 - RNA, 19 nt, Homo sapiens
ccuaugaggcucucuauga

SEQ ID NO: 1526205 - RNA, 19 nt, Homo sapiens
guuucuggcugacaacuuu

SEQ ID NO: 1526206 - RNA, 19 nt, Homo sapiens
ggucaaagcaauagcacaa

SEQ ID NO: 1526207 - RNA, 19 nt, Homo sapiens
aggcauagauuaaguaacu

SEQ ID NO: 1526208 - RNA, 19 nt, Homo sapiens
gaccuugauccaccuguua

SEQ ID NO: 1526209 - RNA, 19 nt, Homo sapiens
cugcacaguucacuuuauu

SEQ ID NO: 1526210 - RNA, 19 nt, Homo sapiens
gagcugauccggccaagca

SEQ ID NO: 1526211 - RNA, 19 nt, Homo sapiens
gccaaugggaccaccaaua

SEQ ID NO: 1526212 - RNA, 19 nt, Homo sapiens
gcaaugcucccaucuucau

SEQ ID NO: 1526213 - RNA, 19 nt, Homo sapiens
gcaauagcacaacaugguu

SEQ ID NO: 1526214 - RNA, 19 nt, Homo sapiens
ucaaagcaauagcacaaca

SEQ ID NO: 1526215 - RNA, 19 nt, Homo sapiens
gguccaggcucugaggaaa

SEQ ID NO: 1526216 - RNA, 19 nt, Homo sapiens
ccucagagccucagguaug

SEQ ID NO: 1526217 - RNA, 19 nt, Homo sapiens
caguuaagcugcuguacuc

SEQ ID NO: 1526218 - RNA, 19 nt, Homo sapiens
ugugauguauggacuagaa

SEQ ID NO: 1526219 - RNA, 19 nt, Homo sapiens
gcauggguauccuggugaa

SEQ ID NO: 1526220 - RNA, 19 nt, Homo sapiens
ccaccugugccuucauaua

SEQ ID NO: 1526221 - RNA, 19 nt, Homo sapiens
ugaaggauccucggaaguu

SEQ ID NO: 1526222 - RNA, 19 nt, Homo sapiens
ucgcucaccuguaccuauu

SEQ ID NO: 1526223 - RNA, 19 nt, Homo sapiens
gccgcaggcugaauaaauc

SEQ ID NO: 1526224 - RNA, 19 nt, Homo sapiens
ggucaccaccuucuacuca

SEQ ID NO: 1526225 - RNA, 19 nt, Homo sapiens
ccuacgcacuccaguucua

SEQ ID NO: 1526226 - RNA, 19 nt, Homo sapiens
gaucuaccaguucauuguu

SEQ ID NO: 1526227 - RNA, 19 nt, Homo sapiens
accaauaacugccacaaca

SEQ ID NO: 1526228 - RNA, 19 nt, Homo sapiens
ggauucugcugugucuauu

SEQ ID NO: 1526229 - RNA, 19 nt, Homo sapiens
uuucuugccuuguuucaga

SEQ ID NO: 1526230 - RNA, 19 nt, Homo sapiens
gguuguaccagucaguuaa

SEQ ID NO: 1526231 - RNA, 19 nt, Homo sapiens
gcaauuuggagcuaauauc

SEQ ID NO: 1526232 - RNA, 19 nt, Homo sapiens
gucaugaucuaccaguuca

SEQ ID NO: 1526233 - RNA, 19 nt, Homo sapiens
guggacuucuuccugauug

SEQ ID NO: 1526234 - RNA, 19 nt, Homo sapiens
ggccaggcauagauuaagu

SEQ ID NO: 1526235 - RNA, 19 nt, Homo sapiens
ggaccuaugaggcucucua

SEQ ID NO: 1526236 - RNA, 19 nt, Homo sapiens
caauaacugccacaacaau

SEQ ID NO: 1526237 - RNA, 19 nt, Homo sapiens
gggauucugcugugucuau

SEQ ID NO: 1526238 - RNA, 19 nt, Homo sapiens
cccguuaccuguccucaga

SEQ ID NO: 1526239 - RNA, 19 nt, Homo sapiens
cagaaggaucuacuaguug

SEQ ID NO: 1526240 - RNA, 19 nt, Homo sapiens
uaauauccaaggcagcaua

SEQ ID NO: 1526241 - RNA, 19 nt, Homo sapiens
caacuuuaaacaggugaua

SEQ ID NO: 1526242 - RNA, 19 nt, Homo sapiens
cgcagagacuucggaauga

SEQ ID NO: 1526243 - RNA, 19 nt, Homo sapiens
uggaagaccuacccucucu

SEQ ID NO: 1526244 - RNA, 19 nt, Homo sapiens
ucagcuuggucaugaucua

SEQ ID NO: 1526245 - RNA, 19 nt, Homo sapiens
ugaaaugugcucaccacuu

SEQ ID NO: 1526246 - RNA, 19 nt, Homo sapiens
ugccaucgcucaccuguac

SEQ ID NO: 1526247 - RNA, 19 nt, Homo sapiens
ggucaugaucuaccaguuc

SEQ ID NO: 1526248 - RNA, 19 nt, Homo sapiens
acaaugagacggugauucu

SEQ ID NO: 1526249 - RNA, 19 nt, Homo sapiens
ccaauaacugccacaacaa

SEQ ID NO: 1526250 - RNA, 19 nt, Homo sapiens
gggcuucuuucucaucucu

SEQ ID NO: 1526251 - RNA, 19 nt, Homo sapiens
ucaauggugucuuuucuug

SEQ ID NO: 1526252 - RNA, 19 nt, Homo sapiens
ccaggcauagauuaaguaa

SEQ ID NO: 1526253 - RNA, 19 nt, Homo sapiens
ucaccaccuucuacucaga

SEQ ID NO: 1526254 - RNA, 19 nt, Homo sapiens
caggcugaauaaauccuuu

SEQ ID NO: 1526255 - RNA, 19 nt, Homo sapiens
cuaugaggcucucuaugag

SEQ ID NO: 1526256 - RNA, 19 nt, Homo sapiens
acgcagagacuucggaaug

SEQ ID NO: 1526257 - RNA, 19 nt, Homo sapiens
cuggucagcuuggucauga

SEQ ID NO: 1526258 - RNA, 19 nt, Homo sapiens
cagacacgcagaagugcua

SEQ ID NO: 1526259 - RNA, 19 nt, Homo sapiens
caccugugccuucauauag

SEQ ID NO: 1526260 - RNA, 19 nt, Homo sapiens
cuaguuggcccuaucuugu

SEQ ID NO: 1526261 - RNA, 19 nt, Homo sapiens
gauuauggugauacuguga

SEQ ID NO: 1526262 - RNA, 19 nt, Homo sapiens
uggguauccuggugaaaug

SEQ ID NO: 1526263 - RNA, 19 nt, Homo sapiens
gcccaacucauucuuacug

SEQ ID NO: 1526264 - RNA, 19 nt, Homo sapiens
agaccuacccucucuucuu

SEQ ID NO: 1526265 - RNA, 19 nt, Homo sapiens
ggacucgcgacucuacaug

SEQ ID NO: 1526266 - RNA, 19 nt, Homo sapiens
aaugagacggugauucuga

SEQ ID NO: 1526267 - RNA, 19 nt, Homo sapiens
caacaaugagacggugauu

SEQ ID NO: 1526268 - RNA, 19 nt, Homo sapiens
gccaggcauagauuaagua

SEQ ID NO: 1526269 - RNA, 19 nt, Homo sapiens
acgcagaagugcuacuagu

SEQ ID NO: 1526270 - RNA, 19 nt, Homo sapiens
gacucuacaugcucuccuu

SEQ ID NO: 1526271 - RNA, 19 nt, Homo sapiens
uuccaccugugccuucaua

SEQ ID NO: 1526272 - RNA, 19 nt, Homo sapiens
cggaaggccucaacaaccu

SEQ ID NO: 1526273 - RNA, 19 nt, Homo sapiens
auaacugccacaacaauga

SEQ ID NO: 1526274 - RNA, 19 nt, Homo sapiens
uggcagacacgcagaagug

SEQ ID NO: 1526275 - RNA, 19 nt, Homo sapiens
gaccuaugaggcucucuau

SEQ ID NO: 1526276 - RNA, 19 nt, Homo sapiens
ugauagaagcggccaaugg

SEQ ID NO: 1526277 - RNA, 19 nt, Homo sapiens
caagacugacagcaaggaa

SEQ ID NO: 1526278 - RNA, 19 nt, Homo sapiens
cuauuuacacccagaacuu

SEQ ID NO: 1526279 - RNA, 19 nt, Homo sapiens
gguaugguccaggcucuga

SEQ ID NO: 1526280 - RNA, 19 nt, Homo sapiens
gugccaagacugacagcaa

SEQ ID NO: 1526281 - RNA, 19 nt, Homo sapiens
agaccuugauccaccuguu

SEQ ID NO: 1526282 - RNA, 19 nt, Homo sapiens
gacguguuguggacuucuu

SEQ ID NO: 1526283 - RNA, 19 nt, Homo sapiens
caccuacgcacuccaguuc

SEQ ID NO: 1526284 - RNA, 19 nt, Homo sapiens
uuaagcugcuguacuccau

SEQ ID NO: 1526285 - RNA, 19 nt, Homo sapiens
caaagcaauagcacaacau

SEQ ID NO: 1526286 - RNA, 19 nt, Homo sapiens
uaccugcaauuuggagcua

SEQ ID NO: 1526287 - RNA, 19 nt, Homo sapiens
uccuuucaauggugucuuu

SEQ ID NO: 1526288 - RNA, 19 nt, Homo sapiens
gggcccaacccuggaacua

SEQ ID NO: 1526289 - RNA, 19 nt, Homo sapiens
ggacuuugcugccuaaauu

SEQ ID NO: 1526290 - RNA, 19 nt, Homo sapiens
cagacuagcugccacauua

SEQ ID NO: 1526291 - RNA, 19 nt, Homo sapiens
gaacggacccauauacuuu

SEQ ID NO: 1526292 - RNA, 19 nt, Homo sapiens
ggaaagccgugguacauga

SEQ ID NO: 1526293 - RNA, 19 nt, Homo sapiens
cugcagagcuucaagauaa

SEQ ID NO: 1526294 - RNA, 19 nt, Homo sapiens
gaaaggugccauccaguua

SEQ ID NO: 1526295 - RNA, 19 nt, Homo sapiens
gcaaggcucuuaguuugua

SEQ ID NO: 1526296 - RNA, 19 nt, Homo sapiens
agaagcagcuccucuuuaa

SEQ ID NO: 1526297 - RNA, 19 nt, Homo sapiens
ggaaagcgguugaacuugu

SEQ ID NO: 1526298 - RNA, 19 nt, Homo sapiens
cagaagaccuggaacaaga

SEQ ID NO: 1526299 - RNA, 19 nt, Homo sapiens
caauauagaucaugcacaa

SEQ ID NO: 1526300 - RNA, 19 nt, Homo sapiens
gcagugagccgcugauuga

SEQ ID NO: 1526301 - RNA, 19 nt, Homo sapiens
gcagaaagcaaggcucuua

SEQ ID NO: 1526302 - RNA, 19 nt, Homo sapiens
gaauagggaaucaacauuu

SEQ ID NO: 1526303 - RNA, 19 nt, Homo sapiens
uuaagacacuccaacauaa

SEQ ID NO: 1526304 - RNA, 19 nt, Homo sapiens
ggaaagaugacaugcauug

SEQ ID NO: 1526305 - RNA, 19 nt, Homo sapiens
agucagaguucacccauua

SEQ ID NO: 1526306 - RNA, 19 nt, Homo sapiens
agaaaccgauggaucauuu

SEQ ID NO: 1526307 - RNA, 19 nt, Homo sapiens
aaacacaggguaccacuua

SEQ ID NO: 1526308 - RNA, 19 nt, Homo sapiens
gaucuagacuucuuacaag

SEQ ID NO: 1526309 - RNA, 19 nt, Homo sapiens
gacaguagguuagcccaua

SEQ ID NO: 1526310 - RNA, 19 nt, Homo sapiens
gaagaagagccuccuauuc

SEQ ID NO: 1526311 - RNA, 19 nt, Homo sapiens
gcaagaacauucggauugu

SEQ ID NO: 1526312 - RNA, 19 nt, Homo sapiens
acaccugacuguaauaauu

SEQ ID NO: 1526313 - RNA, 19 nt, Homo sapiens
uaugaagacuuaccaaaug

SEQ ID NO: 1526314 - RNA, 19 nt, Homo sapiens
aagcaaggcucuuaguuug

SEQ ID NO: 1526315 - RNA, 19 nt, Homo sapiens
gcagagaaguuggaaaugg

SEQ ID NO: 1526316 - RNA, 19 nt, Homo sapiens
ggaacaagauucugcuucu

SEQ ID NO: 1526317 - RNA, 19 nt, Homo sapiens
gcaacgcaguauuuaagaa

SEQ ID NO: 1526318 - RNA, 19 nt, Homo sapiens
ggaaaggaauagggaauca

SEQ ID NO: 1526319 - RNA, 19 nt, Homo sapiens
gaggaaagcgguugaacuu

SEQ ID NO: 1526320 - RNA, 19 nt, Homo sapiens
caggagagacaacauauaa

SEQ ID NO: 1526321 - RNA, 19 nt, Homo sapiens
gaaagcgguugaacuugug

SEQ ID NO: 1526322 - RNA, 19 nt, Homo sapiens
gaaagcaaggcucuuaguu

SEQ ID NO: 1526323 - RNA, 19 nt, Homo sapiens
ccaugugucugucagcaua

SEQ ID NO: 1526324 - RNA, 19 nt, Homo sapiens
uguaaucucuguauagguu

SEQ ID NO: 1526325 - RNA, 19 nt, Homo sapiens
gaaaaggcaugaccaggaa

SEQ ID NO: 1526326 - RNA, 19 nt, Homo sapiens
ggauaaggguguuuaacca

SEQ ID NO: 1526327 - RNA, 19 nt, Homo sapiens
ccacuuauucuucaaacua

SEQ ID NO: 1526328 - RNA, 19 nt, Homo sapiens
gggagacaguggauucuug

SEQ ID NO: 1526329 - RNA, 19 nt, Homo sapiens
gcacagcaccaaauuucaa

SEQ ID NO: 1526330 - RNA, 19 nt, Homo sapiens
gcagacagguggcaagaac

SEQ ID NO: 1526331 - RNA, 19 nt, Homo sapiens
ucaggcauauuguugaauu

SEQ ID NO: 1526332 - RNA, 19 nt, Homo sapiens
ggucuuagggaaaggaaua

SEQ ID NO: 1526333 - RNA, 19 nt, Homo sapiens
uuaaccaccucccaacuuu

SEQ ID NO: 1526334 - RNA, 19 nt, Homo sapiens
ggaggccgaugaccauaug

SEQ ID NO: 1526335 - RNA, 19 nt, Homo sapiens
gcacaacgagagcccuuaa

SEQ ID NO: 1526336 - RNA, 19 nt, Homo sapiens
ggaaaaggcaaaugcaaua

SEQ ID NO: 1526337 - RNA, 19 nt, Homo sapiens
ggaauagggaaucaacauu

SEQ ID NO: 1526338 - RNA, 19 nt, Homo sapiens
uaucuaaacuagucaugga

SEQ ID NO: 1526339 - RNA, 19 nt, Homo sapiens
ugacaacaaugaagaaagg

SEQ ID NO: 1526340 - RNA, 19 nt, Homo sapiens
gaagagccacgguguuugu

SEQ ID NO: 1526341 - RNA, 19 nt, Homo sapiens
gaagaaaaccccuguaauc

SEQ ID NO: 1526342 - RNA, 19 nt, Homo sapiens
gaggugcacucuccaucuu

SEQ ID NO: 1526343 - RNA, 19 nt, Homo sapiens
aaagcaaggcucuuaguuu

SEQ ID NO: 1526344 - RNA, 19 nt, Homo sapiens
cagaagcagcuccucuuua

SEQ ID NO: 1526345 - RNA, 19 nt, Homo sapiens
gcaacuccugcauuacuua

SEQ ID NO: 1526346 - RNA, 19 nt, Homo sapiens
aguggcaacuccugcauua

SEQ ID NO: 1526347 - RNA, 19 nt, Homo sapiens
caucugaggugccuuaugc

SEQ ID NO: 1526348 - RNA, 19 nt, Homo sapiens
caggaaagaugacaugcau

SEQ ID NO: 1526349 - RNA, 19 nt, Homo sapiens
gagccacgguguuugugaa

SEQ ID NO: 1526350 - RNA, 19 nt, Homo sapiens
cagaagagccacgguguuu

SEQ ID NO: 1526351 - RNA, 19 nt, Homo sapiens
ggcaagaacauucggauug

SEQ ID NO: 1526352 - RNA, 19 nt, Homo sapiens
gagguuauccuguaaagca

SEQ ID NO: 1526353 - RNA, 19 nt, Homo sapiens
aaagacacguggagaagau

SEQ ID NO: 1526354 - RNA, 19 nt, Homo sapiens
aaacuugaauguacagagu

SEQ ID NO: 1526355 - RNA, 19 nt, Homo sapiens
uacauugugucuuuccaua

SEQ ID NO: 1526356 - RNA, 19 nt, Homo sapiens
gcgcacagcaccaaauuuc

SEQ ID NO: 1526357 - RNA, 19 nt, Homo sapiens
gaaaaccccuguaaucucu

SEQ ID NO: 1526358 - RNA, 19 nt, Homo sapiens
ggacuuggcaguuuucuuu

SEQ ID NO: 1526359 - RNA, 19 nt, Homo sapiens
gcgcaaagccucagaagac

SEQ ID NO: 1526360 - RNA, 19 nt, Homo sapiens
uacaaugccuuccguuuca

SEQ ID NO: 1526361 - RNA, 19 nt, Homo sapiens
ccaauaaagauaccugcua

SEQ ID NO: 1526362 - RNA, 19 nt, Homo sapiens
ucuauuugcuucuacuuug

SEQ ID NO: 1526363 - RNA, 19 nt, Homo sapiens
aaugaagugucucuauuug

SEQ ID NO: 1526364 - RNA, 19 nt, Homo sapiens
uuaaacuccucaucucuug

SEQ ID NO: 1526365 - RNA, 19 nt, Homo sapiens
ggaagaggcggauggaaag

SEQ ID NO: 1526366 - RNA, 19 nt, Homo sapiens
auucuucucuguccucaua

SEQ ID NO: 1526367 - RNA, 19 nt, Homo sapiens
gugguucccuguucuaugu

SEQ ID NO: 1526368 - RNA, 19 nt, Homo sapiens
caaaggcucaaccuacaaa

SEQ ID NO: 1526369 - RNA, 19 nt, Homo sapiens
uaaauucuuuggacuguac

SEQ ID NO: 1526370 - RNA, 19 nt, Homo sapiens
ccagaacccucggacuuug

SEQ ID NO: 1526371 - RNA, 19 nt, Homo sapiens
ccagaaguguugacgagau

SEQ ID NO: 1526372 - RNA, 19 nt, Homo sapiens
gaacaagauucugcuucuc

SEQ ID NO: 1526373 - RNA, 19 nt, Homo sapiens
ccacagccauggaauucau

SEQ ID NO: 1526374 - RNA, 19 nt, Homo sapiens
gaaaggagacaggaacaag

SEQ ID NO: 1526375 - RNA, 19 nt, Homo sapiens
caucugauccuuccacugu

SEQ ID NO: 1526376 - RNA, 19 nt, Homo sapiens
ucuacagucuuacacguuu

SEQ ID NO: 1526377 - RNA, 19 nt, Homo sapiens
ggagagacaacauauaaaa

SEQ ID NO: 1526378 - RNA, 19 nt, Homo sapiens
aaguugagguuauccugua

SEQ ID NO: 1526379 - RNA, 19 nt, Homo sapiens
gagggagggcugggucuua

SEQ ID NO: 1526380 - RNA, 19 nt, Homo sapiens
ucuuaaggcugaaggaaug

SEQ ID NO: 1526381 - RNA, 19 nt, Homo sapiens
ccaaauuucaagccaguuu

SEQ ID NO: 1526382 - RNA, 19 nt, Homo sapiens
cauaugcuaacuacaagua

SEQ ID NO: 1526383 - RNA, 19 nt, Homo sapiens
gcuucaagauaauggacua

SEQ ID NO: 1526384 - RNA, 19 nt, Homo sapiens
uaagacacuccaacauaaa

SEQ ID NO: 1526385 - RNA, 19 nt, Homo sapiens
aaacgaacggacccauaua

SEQ ID NO: 1526386 - RNA, 19 nt, Homo sapiens
ggagacaggaacaaggaaa

SEQ ID NO: 1526387 - RNA, 19 nt, Homo sapiens
gaagacuuaccaaaugaau

SEQ ID NO: 1526388 - RNA, 19 nt, Homo sapiens
ugaagaagagccuccuauu

SEQ ID NO: 1526389 - RNA, 19 nt, Homo sapiens
gggaacaucucuauuauua

SEQ ID NO: 1526390 - RNA, 19 nt, Homo sapiens
ggaaaggacuucuguuuaa

SEQ ID NO: 1526391 - RNA, 19 nt, Homo sapiens
ggacaaggauucagcuuua

SEQ ID NO: 1526392 - RNA, 19 nt, Homo sapiens
gaacaacguugguuucuuu

SEQ ID NO: 1526393 - RNA, 19 nt, Homo sapiens
ucaaauggcucacauauaa

SEQ ID NO: 1526394 - RNA, 19 nt, Homo sapiens
uaacaacucugaauggaua

SEQ ID NO: 1526395 - RNA, 19 nt, Homo sapiens
ugaaacaccuuacaacuuu

SEQ ID NO: 1526396 - RNA, 19 nt, Homo sapiens
ggaaauaauucaugaagug

SEQ ID NO: 1526397 - RNA, 19 nt, Homo sapiens
aagaacagcugacuaauuu

SEQ ID NO: 1526398 - RNA, 19 nt, Homo sapiens
gguagaaccuuauauauca

SEQ ID NO: 1526399 - RNA, 19 nt, Homo sapiens
gcacaagacuggccauaau

SEQ ID NO: 1526400 - RNA, 19 nt, Homo sapiens
gaaccaaucuaaggacuuu

SEQ ID NO: 1526401 - RNA, 19 nt, Homo sapiens
gcugauggguucaaauaua

SEQ ID NO: 1526402 - RNA, 19 nt, Homo sapiens
gcacagaaauaggaucuuu

SEQ ID NO: 1526403 - RNA, 19 nt, Homo sapiens
gggaagauguccacaguuu

SEQ ID NO: 1526404 - RNA, 19 nt, Homo sapiens
gcaagaaccuacagacaga

SEQ ID NO: 1526405 - RNA, 19 nt, Homo sapiens
gcagacagcucacauucuu

SEQ ID NO: 1526406 - RNA, 19 nt, Homo sapiens
uaacuagucuccaugaauu

SEQ ID NO: 1526407 - RNA, 19 nt, Homo sapiens
ggaagucacuggauaagga

SEQ ID NO: 1526408 - RNA, 19 nt, Homo sapiens
gcuuggaacuuaaaugaua

SEQ ID NO: 1526409 - RNA, 19 nt, Homo sapiens
ggaaauaacuaggaaagug

SEQ ID NO: 1526410 - RNA, 19 nt, Homo sapiens
gcucaugucuucuuccuuu

SEQ ID NO: 1526411 - RNA, 19 nt, Homo sapiens
gaagaaaccuaaauuugag

SEQ ID NO: 1526412 - RNA, 19 nt, Homo sapiens
gaaaugcgauagcucagaa

SEQ ID NO: 1526413 - RNA, 19 nt, Homo sapiens
ucacaaacuuccuauauga

SEQ ID NO: 1526414 - RNA, 19 nt, Homo sapiens
gcaaaggugugguauaauc

SEQ ID NO: 1526415 - RNA, 19 nt, Homo sapiens
gcacacagcaauaccuuua

SEQ ID NO: 1526416 - RNA, 19 nt, Homo sapiens
caauagaaaugucagauga

SEQ ID NO: 1526417 - RNA, 19 nt, Homo sapiens
uagaagaccuauuggauaa

SEQ ID NO: 1526418 - RNA, 19 nt, Homo sapiens
gaccaagcaucauuccuua

SEQ ID NO: 1526419 - RNA, 19 nt, Homo sapiens
cgaaucagcuaaauuguga

SEQ ID NO: 1526420 - RNA, 19 nt, Homo sapiens
ggacuucuaugcuuuguau

SEQ ID NO: 1526421 - RNA, 19 nt, Homo sapiens
gccaaugacuuccauaauu

SEQ ID NO: 1526422 - RNA, 19 nt, Homo sapiens
gaacaagcauauuauugga

SEQ ID NO: 1526423 - RNA, 19 nt, Homo sapiens
ucacuaaacuucaucuuug

SEQ ID NO: 1526424 - RNA, 19 nt, Homo sapiens
ucagaaaguugguguauga

SEQ ID NO: 1526425 - RNA, 19 nt, Homo sapiens
gcucagauguggcucuuaa

SEQ ID NO: 1526426 - RNA, 19 nt, Homo sapiens
ggaaaggacaguacaauug

SEQ ID NO: 1526427 - RNA, 19 nt, Homo sapiens
gaaaguggucugcauaauu

SEQ ID NO: 1526428 - RNA, 19 nt, Homo sapiens
ucaaacagcugcucauaau

SEQ ID NO: 1526429 - RNA, 19 nt, Homo sapiens
ggaaucaguuugaagaaga

SEQ ID NO: 1526430 - RNA, 19 nt, Homo sapiens
gaacagauccugaacucuu

SEQ ID NO: 1526431 - RNA, 19 nt, Homo sapiens
gcaccugaauuuauuagaa

SEQ ID NO: 1526432 - RNA, 19 nt, Homo sapiens
ggaaucccaucaugacuuu

SEQ ID NO: 1526433 - RNA, 19 nt, Homo sapiens
gaggauuacuccagaauga

SEQ ID NO: 1526434 - RNA, 19 nt, Homo sapiens
ggacagcaccugaauuuau

SEQ ID NO: 1526435 - RNA, 19 nt, Homo sapiens
guagaacucugcuauaauc

SEQ ID NO: 1526436 - RNA, 19 nt, Homo sapiens
gaaaacaaguggcaucuuu

SEQ ID NO: 1526437 - RNA, 19 nt, Homo sapiens
gagauuaguuggugcuauu

SEQ ID NO: 1526438 - RNA, 19 nt, Homo sapiens
gaagcaagccuuuccugua

SEQ ID NO: 1526439 - RNA, 19 nt, Homo sapiens
gagacauucuuguguuaua

SEQ ID NO: 1526440 - RNA, 19 nt, Homo sapiens
cauaguagauuucacagaa

SEQ ID NO: 1526441 - RNA, 19 nt, Homo sapiens
gaaaggacaguacaauuga

SEQ ID NO: 1526442 - RNA, 19 nt, Homo sapiens
gagaagaaaccuaaauuug

SEQ ID NO: 1526443 - RNA, 19 nt, Homo sapiens
gcuaagagaagcaauagua

SEQ ID NO: 1526444 - RNA, 19 nt, Homo sapiens
gcaacgaagugauuuggaa

SEQ ID NO: 1526445 - RNA, 19 nt, Homo sapiens
guuuauggcuguaugauuu

SEQ ID NO: 1526446 - RNA, 19 nt, Homo sapiens
gaagugagcugaccuacac

SEQ ID NO: 1526447 - RNA, 19 nt, Homo sapiens
ugaagaauaucaccaaguu

SEQ ID NO: 1526448 - RNA, 19 nt, Homo sapiens
ccacaaagauguuauugca

SEQ ID NO: 1526449 - RNA, 19 nt, Homo sapiens
gaacuuguacugaauguga

SEQ ID NO: 1526450 - RNA, 19 nt, Homo sapiens
acaagcacauuccaaguua

SEQ ID NO: 1526451 - RNA, 19 nt, Homo sapiens
acaaaggcaugaaugauuu

SEQ ID NO: 1526452 - RNA, 19 nt, Homo sapiens
gacagcaccugaauuuauu

SEQ ID NO: 1526453 - RNA, 19 nt, Homo sapiens
cauaagauauuaccguuug

SEQ ID NO: 1526454 - RNA, 19 nt, Homo sapiens
gcaauuccauuuaucacuu

SEQ ID NO: 1526455 - RNA, 19 nt, Homo sapiens
ucaauccacuacugaaaua

SEQ ID NO: 1526456 - RNA, 19 nt, Homo sapiens
agaaagagaugauugacuu

SEQ ID NO: 1526457 - RNA, 19 nt, Homo sapiens
caacagagauggcaagacu

SEQ ID NO: 1526458 - RNA, 19 nt, Homo sapiens
gauacugaccuucaaauaa

SEQ ID NO: 1526459 - RNA, 19 nt, Homo sapiens
ugaaagaccuaacccaaga

SEQ ID NO: 1526460 - RNA, 19 nt, Homo sapiens
ggacuguugugcuauugua

SEQ ID NO: 1526461 - RNA, 19 nt, Homo sapiens
ugaaucuccuuguuaguua

SEQ ID NO: 1526462 - RNA, 19 nt, Homo sapiens
gcagcaaacucuacaaucu

SEQ ID NO: 1526463 - RNA, 19 nt, Homo sapiens
gauaaggcaucucauuuua

SEQ ID NO: 1526464 - RNA, 19 nt, Homo sapiens
caagacagauugaugaaca

SEQ ID NO: 1526465 - RNA, 19 nt, Homo sapiens
gaauggaaauaacuaggaa

SEQ ID NO: 1526466 - RNA, 19 nt, Homo sapiens
ggaaaccauaucucaauua

SEQ ID NO: 1526467 - RNA, 19 nt, Homo sapiens
uaaagcacaugaacucuug

SEQ ID NO: 1526468 - RNA, 19 nt, Homo sapiens
gaaauaccugggaggauua

SEQ ID NO: 1526469 - RNA, 19 nt, Homo sapiens
ugugggaacuggcaauuua

SEQ ID NO: 1526470 - RNA, 19 nt, Homo sapiens
cagaugaaauuccuaauca

SEQ ID NO: 1526471 - RNA, 19 nt, Homo sapiens
caaagcaccuucuaaugau

SEQ ID NO: 1526472 - RNA, 19 nt, Homo sapiens
gaaguggcccaauauguaa

SEQ ID NO: 1526473 - RNA, 19 nt, Homo sapiens
gacaccagcuucuuuguga

SEQ ID NO: 1526474 - RNA, 19 nt, Homo sapiens
gagcugaccuacaccauuc

SEQ ID NO: 1526475 - RNA, 19 nt, Homo sapiens
gaagaacuauggcccaagu

SEQ ID NO: 1526476 - RNA, 19 nt, Homo sapiens
ccaguauacuugaucauuu

SEQ ID NO: 1526477 - RNA, 19 nt, Homo sapiens
caacuuaacaacagacuuu

SEQ ID NO: 1526478 - RNA, 19 nt, Homo sapiens
guagaagaccuauuggaua

SEQ ID NO: 1526479 - RNA, 19 nt, Homo sapiens
caagagaguuuccagaaca

SEQ ID NO: 1526480 - RNA, 19 nt, Homo sapiens
ugaaggagauucccacaga

SEQ ID NO: 1526481 - RNA, 19 nt, Homo sapiens
gaggaaaggacuucuguuu

SEQ ID NO: 1526482 - RNA, 19 nt, Homo sapiens
gagacuauauaucaccuaa

SEQ ID NO: 1526483 - RNA, 19 nt, Homo sapiens
ucacuuagcuaguuaccuu

SEQ ID NO: 1526484 - RNA, 19 nt, Homo sapiens
gaacauagauuuuguacgu

SEQ ID NO: 1526485 - RNA, 19 nt, Homo sapiens
ucaagugggucuuuacuau

SEQ ID NO: 1526486 - RNA, 19 nt, Homo sapiens
uggcaaaggugugguauaa

SEQ ID NO: 1526487 - RNA, 19 nt, Homo sapiens
ugaaagacauggcuugugu

SEQ ID NO: 1526488 - RNA, 19 nt, Homo sapiens
gaauagcucucuggaggaa

SEQ ID NO: 1526489 - RNA, 19 nt, Homo sapiens
ggacagauccuucaaguug

SEQ ID NO: 1526490 - RNA, 19 nt, Homo sapiens
gaaggcaucuuuagugauc

SEQ ID NO: 1526491 - RNA, 19 nt, Homo sapiens
gguagaagaugucccugua

SEQ ID NO: 1526492 - RNA, 19 nt, Homo sapiens
gagcagcuuuggccaagua

SEQ ID NO: 1526493 - RNA, 19 nt, Homo sapiens
ggacagaaccuaagcuuuc

SEQ ID NO: 1526494 - RNA, 19 nt, Homo sapiens
aaccuaagcuuucuucauu

SEQ ID NO: 1526495 - RNA, 19 nt, Homo sapiens
ccacaggacugacgcauca

SEQ ID NO: 1526496 - RNA, 19 nt, Homo sapiens
gcucuaagaaaucauguua

SEQ ID NO: 1526497 - RNA, 19 nt, Homo sapiens
gcagagacaccaccaggua

SEQ ID NO: 1526498 - RNA, 19 nt, Homo sapiens
ggacuaugguuaacuuauc

SEQ ID NO: 1526499 - RNA, 19 nt, Homo sapiens
gaauguguuugacugauga

SEQ ID NO: 1526500 - RNA, 19 nt, Homo sapiens
gagaggaagacaauauuaa

SEQ ID NO: 1526501 - RNA, 19 nt, Homo sapiens
gaaacuagcccagaacuca

SEQ ID NO: 1526502 - RNA, 19 nt, Homo sapiens
gaagguuuguagccuauug

SEQ ID NO: 1526503 - RNA, 19 nt, Homo sapiens
gcagggagccagaagguuu

SEQ ID NO: 1526504 - RNA, 19 nt, Homo sapiens
cagaaggcaucuuuaguga

SEQ ID NO: 1526505 - RNA, 19 nt, Homo sapiens
gaacucagaccaccaguag

SEQ ID NO: 1526506 - RNA, 19 nt, Homo sapiens
gcagaaggcaucuuuagug

SEQ ID NO: 1526507 - RNA, 19 nt, Homo sapiens
gaaaggaaaggacagaugu

SEQ ID NO: 1526508 - RNA, 19 nt, Homo sapiens
ucacuugguucaggaauaa

SEQ ID NO: 1526509 - RNA, 19 nt, Homo sapiens
gccaaagccugguagaaga

SEQ ID NO: 1526510 - RNA, 19 nt, Homo sapiens
gagcaaggguggccagagu

SEQ ID NO: 1526511 - RNA, 19 nt, Homo sapiens
gaccgaaccuuccuucagu

SEQ ID NO: 1526512 - RNA, 19 nt, Homo sapiens
gcacacaacauugcagaaa

SEQ ID NO: 1526513 - RNA, 19 nt, Homo sapiens
ggaagacaauauuaaucug

SEQ ID NO: 1526514 - RNA, 19 nt, Homo sapiens
gcaaacauuggacaaauuc

SEQ ID NO: 1526515 - RNA, 19 nt, Homo sapiens
gcuccuugcugcucacaaa

SEQ ID NO: 1526516 - RNA, 19 nt, Homo sapiens
uagaagaugucccuguaga

SEQ ID NO: 1526517 - RNA, 19 nt, Homo sapiens
gggcucaccugaauguguu

SEQ ID NO: 1526518 - RNA, 19 nt, Homo sapiens
uaaguugggucuccuucuu

SEQ ID NO: 1526519 - RNA, 19 nt, Homo sapiens
gagcaaagucaaagucaug

SEQ ID NO: 1526520 - RNA, 19 nt, Homo sapiens
gcaaccaccucggacagaa

SEQ ID NO: 1526521 - RNA, 19 nt, Homo sapiens
ggcagaaacuagcccagaa

SEQ ID NO: 1526522 - RNA, 19 nt, Homo sapiens
ucucaaagaccuagaaaga

SEQ ID NO: 1526523 - RNA, 19 nt, Homo sapiens
ugagaggaagacaauauua

SEQ ID NO: 1526524 - RNA, 19 nt, Homo sapiens
ggaaaggaaaggacagaug

SEQ ID NO: 1526525 - RNA, 19 nt, Homo sapiens
aauaucaccugguuucaug

SEQ ID NO: 1526526 - RNA, 19 nt, Homo sapiens
caucagggcugcauuucca

SEQ ID NO: 1526527 - RNA, 19 nt, Homo sapiens
gcucugaucccaugcaugu

SEQ ID NO: 1526528 - RNA, 19 nt, Homo sapiens
gugcaaacauuggacaaau

SEQ ID NO: 1526529 - RNA, 19 nt, Homo sapiens
ccucugggcucaccugaau

SEQ ID NO: 1526530 - RNA, 19 nt, Homo sapiens
gaaccuaagcuuucuucau

SEQ ID NO: 1526531 - RNA, 19 nt, Homo sapiens
gcagcacccuggcaaagca

SEQ ID NO: 1526532 - RNA, 19 nt, Homo sapiens
ccuccggcauguaguauuu

SEQ ID NO: 1526533 - RNA, 19 nt, Homo sapiens
aaacaaagcaggcucuaag

SEQ ID NO: 1526534 - RNA, 19 nt, Homo sapiens
cuuuagugauccaagauua

SEQ ID NO: 1526535 - RNA, 19 nt, Homo sapiens
ccacacaguuggaagacau

SEQ ID NO: 1526536 - RNA, 19 nt, Homo sapiens
caacaucaacccauuaacu

SEQ ID NO: 1526537 - RNA, 19 nt, Homo sapiens
gacuaugguuaacuuauca

SEQ ID NO: 1526538 - RNA, 19 nt, Homo sapiens
ggccagggacuaugguuaa

SEQ ID NO: 1526539 - RNA, 19 nt, Homo sapiens
gaagcgcacuaucacaaac

SEQ ID NO: 1526540 - RNA, 19 nt, Homo sapiens
cagaagguuuguagccuau

SEQ ID NO: 1526541 - RNA, 19 nt, Homo sapiens
cugaaacucugccaacuca

SEQ ID NO: 1526542 - RNA, 19 nt, Homo sapiens
ccuggcaccucuuuaucua

SEQ ID NO: 1526543 - RNA, 19 nt, Homo sapiens
aaaucucgcugcuguggaa

SEQ ID NO: 1526544 - RNA, 19 nt, Homo sapiens
ucagaggccugcaguguac

SEQ ID NO: 1526545 - RNA, 19 nt, Homo sapiens
ugacaucagggcugcauuu

SEQ ID NO: 1526546 - RNA, 19 nt, Homo sapiens
ugaauguguuugacugaug

SEQ ID NO: 1526547 - RNA, 19 nt, Homo sapiens
gaggaagacaauauuaauc

SEQ ID NO: 1526548 - RNA, 19 nt, Homo sapiens
ggagcaaagucaaagucau

SEQ ID NO: 1526549 - RNA, 19 nt, Homo sapiens
uaucaacaucaacccauua

SEQ ID NO: 1526550 - RNA, 19 nt, Homo sapiens
gcauguaguauuuaucuag

SEQ ID NO: 1526551 - RNA, 19 nt, Homo sapiens
ugcaaacauuggacaaauu

SEQ ID NO: 1526552 - RNA, 19 nt, Homo sapiens
cagggacuaugguuaacuu

SEQ ID NO: 1526553 - RNA, 19 nt, Homo sapiens
gcaugaauggcccagguuu

SEQ ID NO: 1526554 - RNA, 19 nt, Homo sapiens
uaaggacguccgcguguuu

SEQ ID NO: 1526555 - RNA, 19 nt, Homo sapiens
ucagcugccuugcucagaa

SEQ ID NO: 1526556 - RNA, 19 nt, Homo sapiens
cagcuuuggccaaguaauu

SEQ ID NO: 1526557 - RNA, 19 nt, Homo sapiens
cccauuaacuagucacugu

SEQ ID NO: 1526558 - RNA, 19 nt, Homo sapiens
gucacuugguucaggaaua

SEQ ID NO: 1526559 - RNA, 19 nt, Homo sapiens
gcucauggaccagcucuga

SEQ ID NO: 1526560 - RNA, 19 nt, Homo sapiens
gggaagggacagaagcaaa

SEQ ID NO: 1526561 - RNA, 19 nt, Homo sapiens
gccuauuggugcaaacauu

SEQ ID NO: 1526562 - RNA, 19 nt, Homo sapiens
uggcaaagcgugaagauag

SEQ ID NO: 1526563 - RNA, 19 nt, Homo sapiens
gaaggugaaacagcugaaa

SEQ ID NO: 1526564 - RNA, 19 nt, Homo sapiens
gcaaagcagcucacacacu

SEQ ID NO: 1526565 - RNA, 19 nt, Homo sapiens
caaacaaagcaggcucuaa

SEQ ID NO: 1526566 - RNA, 19 nt, Homo sapiens
agagagagaagaacucaga

SEQ ID NO: 1526567 - RNA, 19 nt, Homo sapiens
gcagagagagaagaacuca

SEQ ID NO: 1526568 - RNA, 19 nt, Homo sapiens
guagcaaccucuucauucc

SEQ ID NO: 1526569 - RNA, 19 nt, Homo sapiens
aaaggagccugugguguuc

SEQ ID NO: 1526570 - RNA, 19 nt, Homo sapiens
ggacugacgcaucacaucu

SEQ ID NO: 1526571 - RNA, 19 nt, Homo sapiens
aaacaggcucuaagaaauc

SEQ ID NO: 1526572 - RNA, 19 nt, Homo sapiens
aaaacaggcucuaagaaau

SEQ ID NO: 1526573 - RNA, 19 nt, Homo sapiens
gggccagggacuaugguua

SEQ ID NO: 1526574 - RNA, 19 nt, Homo sapiens
uagaagcgcacuaucacaa

SEQ ID NO: 1526575 - RNA, 19 nt, Homo sapiens
gcaaacaaagcaggcucua

SEQ ID NO: 1526576 - RNA, 19 nt, Homo sapiens
acaaauuccugugucuuuc

SEQ ID NO: 1526577 - RNA, 19 nt, Homo sapiens
ggucagaggccugcagugu

SEQ ID NO: 1526578 - RNA, 19 nt, Homo sapiens
ccuaauaucaccugguuuc

SEQ ID NO: 1526579 - RNA, 19 nt, Homo sapiens
ggucacccugucccuaaua

SEQ ID NO: 1526580 - RNA, 19 nt, Homo sapiens
aacaucaacccauuaacua

SEQ ID NO: 1526581 - RNA, 19 nt, Homo sapiens
gacaggauguugggaaagg

SEQ ID NO: 1526582 - RNA, 19 nt, Homo sapiens
gaacagcacggaggucaac

SEQ ID NO: 1526583 - RNA, 19 nt, Homo sapiens
ucccuaauaucaccugguu

SEQ ID NO: 1526584 - RNA, 19 nt, Homo sapiens
ggcauguaguauuuaucua

SEQ ID NO: 1526585 - RNA, 19 nt, Homo sapiens
cuaugucccuuuagucaca

SEQ ID NO: 1526586 - RNA, 19 nt, Homo sapiens
ccuccaccuucaagcauaa

SEQ ID NO: 1526587 - RNA, 19 nt, Homo sapiens
gccugaagcugaagucacu

SEQ ID NO: 1526588 - RNA, 19 nt, Homo sapiens
ggaccgaaccuuccuucag

SEQ ID NO: 1526589 - RNA, 19 nt, Homo sapiens
gaacagcuauggaucaaau

SEQ ID NO: 1526590 - RNA, 19 nt, Homo sapiens
ggagagagaauaaaucuuu

SEQ ID NO: 1526591 - RNA, 19 nt, Homo sapiens
gaugaggucuccuguuuga

SEQ ID NO: 1526592 - RNA, 19 nt, Homo sapiens
agagauagauguuggguuu

SEQ ID NO: 1526593 - RNA, 19 nt, Homo sapiens
gcucaauccuuugguguua

SEQ ID NO: 1526594 - RNA, 19 nt, Homo sapiens
gaacauggaugaccuucag

SEQ ID NO: 1526595 - RNA, 19 nt, Homo sapiens
gugcagaaguucaagauga

SEQ ID NO: 1526596 - RNA, 19 nt, Homo sapiens
uuacaugacugcuagauug

SEQ ID NO: 1526597 - RNA, 19 nt, Homo sapiens
gaacggagagagaauaaau

SEQ ID NO: 1526598 - RNA, 19 nt, Homo sapiens
caggugccauaaauaauua

SEQ ID NO: 1526599 - RNA, 19 nt, Homo sapiens
ccucagaaccuauaaauau

SEQ ID NO: 1526600 - RNA, 19 nt, Homo sapiens
guacagaagacaagauauu

SEQ ID NO: 1526601 - RNA, 19 nt, Homo sapiens
ucacaggugccauaaauaa

SEQ ID NO: 1526602 - RNA, 19 nt, Homo sapiens
gaagauuccucuccauguc

SEQ ID NO: 1526603 - RNA, 19 nt, Homo sapiens
cagcaaagccaaacaaguu

SEQ ID NO: 1526604 - RNA, 19 nt, Homo sapiens
uggaugaggucuccuguuu

SEQ ID NO: 1526605 - RNA, 19 nt, Homo sapiens
gaacgacaaaguggaauuu

SEQ ID NO: 1526606 - RNA, 19 nt, Homo sapiens
uggcaugcauguuaucaua

SEQ ID NO: 1526607 - RNA, 19 nt, Homo sapiens
agacuuggcaugcauguua

SEQ ID NO: 1526608 - RNA, 19 nt, Homo sapiens
ccucugacgucuugacuuu

SEQ ID NO: 1526609 - RNA, 19 nt, Homo sapiens
gacagagacuggagugaug

SEQ ID NO: 1526610 - RNA, 19 nt, Homo sapiens
gaggucuccuguuugauuu

SEQ ID NO: 1526611 - RNA, 19 nt, Homo sapiens
ucaagaagccaaauaaaca

SEQ ID NO: 1526612 - RNA, 19 nt, Homo sapiens
ggaaauguauacagcuucu

SEQ ID NO: 1526613 - RNA, 19 nt, Homo sapiens
gaagaagauuccucuccau

SEQ ID NO: 1526614 - RNA, 19 nt, Homo sapiens
gaguacagaagacaagaua

SEQ ID NO: 1526615 - RNA, 19 nt, Homo sapiens
ugagaugggucauuaugga

SEQ ID NO: 1526616 - RNA, 19 nt, Homo sapiens
guacaaaaguuccaagaga

SEQ ID NO: 1526617 - RNA, 19 nt, Homo sapiens
aaccagagauggauucgaa

SEQ ID NO: 1526618 - RNA, 19 nt, Homo sapiens
gauguuggguuuucaaauu

SEQ ID NO: 1526619 - RNA, 19 nt, Homo sapiens
gagagagaauaaaucuuuc

SEQ ID NO: 1526620 - RNA, 19 nt, Homo sapiens
ugucacaggugccauaaau

SEQ ID NO: 1526621 - RNA, 19 nt, Homo sapiens
gagaaaguacuguguauac

SEQ ID NO: 1526622 - RNA, 19 nt, Homo sapiens
guacauccuugguauagag

SEQ ID NO: 1526623 - RNA, 19 nt, Homo sapiens
agacugcgguguuugaguu

SEQ ID NO: 1526624 - RNA, 19 nt, Homo sapiens
ucgcugagcugaacaugga

SEQ ID NO: 1526625 - RNA, 19 nt, Homo sapiens
acaaauugguagucacuug

SEQ ID NO: 1526626 - RNA, 19 nt, Homo sapiens
gcugcaauguccucucuga

SEQ ID NO: 1526627 - RNA, 19 nt, Homo sapiens
ugacuuggcuuccaugacu

SEQ ID NO: 1526628 - RNA, 19 nt, Homo sapiens
ucuaagaguugugagauga

SEQ ID NO: 1526629 - RNA, 19 nt, Homo sapiens
cgaggguucuuaucagaga

SEQ ID NO: 1526630 - RNA, 19 nt, Homo sapiens
gaauguaaaccgcugaaca

SEQ ID NO: 1526631 - RNA, 19 nt, Homo sapiens
gaagcaugccacugucaaa

SEQ ID NO: 1526632 - RNA, 19 nt, Homo sapiens
gaugugacccugugauauc

SEQ ID NO: 1526633 - RNA, 19 nt, Homo sapiens
gagauggauucgaagaaca

SEQ ID NO: 1526634 - RNA, 19 nt, Homo sapiens
ggacaggcaggaaggauuc

SEQ ID NO: 1526635 - RNA, 19 nt, Homo sapiens
caagauauucgugugauga

SEQ ID NO: 1526636 - RNA, 19 nt, Homo sapiens
guagagggagauuugagua

SEQ ID NO: 1526637 - RNA, 19 nt, Homo sapiens
caggaaauguauacagcuu

SEQ ID NO: 1526638 - RNA, 19 nt, Homo sapiens
ccacccgucuggcgaagaa

SEQ ID NO: 1526639 - RNA, 19 nt, Homo sapiens
gacaagauauucgugugau

SEQ ID NO: 1526640 - RNA, 19 nt, Homo sapiens
cuacgagccugcacuccuu

SEQ ID NO: 1526641 - RNA, 19 nt, Homo sapiens
gcagccaugucgccauugu

SEQ ID NO: 1526642 - RNA, 19 nt, Homo sapiens
gaugggucauuauggauca

SEQ ID NO: 1526643 - RNA, 19 nt, Homo sapiens
ugucaaauccgagaaugua

SEQ ID NO: 1526644 - RNA, 19 nt, Homo sapiens
cagcuguggucuaagaguu

SEQ ID NO: 1526645 - RNA, 19 nt, Homo sapiens
gaucaucccagugaaccua

SEQ ID NO: 1526646 - RNA, 19 nt, Homo sapiens
ugaggucuccuguuugauu

SEQ ID NO: 1526647 - RNA, 19 nt, Homo sapiens
cgaagcaucuggcgagacu

SEQ ID NO: 1526648 - RNA, 19 nt, Homo sapiens
uguauuguuuggccucuuu

SEQ ID NO: 1526649 - RNA, 19 nt, Homo sapiens
gcuagauuguucccagaug

SEQ ID NO: 1526650 - RNA, 19 nt, Homo sapiens
ugugaagacugcgguguuu

SEQ ID NO: 1526651 - RNA, 19 nt, Homo sapiens
cuucucggcugguugcuuu

SEQ ID NO: 1526652 - RNA, 19 nt, Homo sapiens
gcaugccuguaccuuagaa

SEQ ID NO: 1526653 - RNA, 19 nt, Homo sapiens
gcaaccacaggaaauguau

SEQ ID NO: 1526654 - RNA, 19 nt, Homo sapiens
ccagaacggagagagaaua

SEQ ID NO: 1526655 - RNA, 19 nt, Homo sapiens
gaccgugucgcuauaguga

SEQ ID NO: 1526656 - RNA, 19 nt, Homo sapiens
gaacauuucggccugaacu

SEQ ID NO: 1526657 - RNA, 19 nt, Homo sapiens
uuaaggcuccaacaaauug

SEQ ID NO: 1526658 - RNA, 19 nt, Homo sapiens
cagaacggagagagaauaa

SEQ ID NO: 1526659 - RNA, 19 nt, Homo sapiens
ggaaauaaugacagcaaag

SEQ ID NO: 1526660 - RNA, 19 nt, Homo sapiens
ucaaaugguagcccucaaa

SEQ ID NO: 1526661 - RNA, 19 nt, Homo sapiens
acaggugccauaaauaauu

SEQ ID NO: 1526662 - RNA, 19 nt, Homo sapiens
ggucuucaaccauaaacuu

SEQ ID NO: 1526663 - RNA, 19 nt, Homo sapiens
ccugugauauccugucuca

SEQ ID NO: 1526664 - RNA, 19 nt, Homo sapiens
gacaaaaucccacugacua

SEQ ID NO: 1526665 - RNA, 19 nt, Homo sapiens
ggagugaugccaccacaag

SEQ ID NO: 1526666 - RNA, 19 nt, Homo sapiens
gagauuugaguacagaaga

SEQ ID NO: 1526667 - RNA, 19 nt, Homo sapiens
ucaaauccgagaauguaaa

SEQ ID NO: 1526668 - RNA, 19 nt, Homo sapiens
cagauggcauuggcuauuc

SEQ ID NO: 1526669 - RNA, 19 nt, Homo sapiens
caugacugcuagauuguuc

SEQ ID NO: 1526670 - RNA, 19 nt, Homo sapiens
uggcaugccuguaccuuag

SEQ ID NO: 1526671 - RNA, 19 nt, Homo sapiens
uggaaauaaugacagcaaa

SEQ ID NO: 1526672 - RNA, 19 nt, Homo sapiens
cacgaggguucuuaucaga

SEQ ID NO: 1526673 - RNA, 19 nt, Homo sapiens
uuccugcacucacucauuu

SEQ ID NO: 1526674 - RNA, 19 nt, Homo sapiens
ugaagacugcgguguuuga

SEQ ID NO: 1526675 - RNA, 19 nt, Homo sapiens
ggcaguuugugcagaaguu

SEQ ID NO: 1526676 - RNA, 19 nt, Homo sapiens
gggaagguugcccugauaa

SEQ ID NO: 1526677 - RNA, 19 nt, Homo sapiens
ugagaaaguacuguguaua

SEQ ID NO: 1526678 - RNA, 19 nt, Homo sapiens
ucaauccuuugguguuaga

SEQ ID NO: 1526679 - RNA, 19 nt, Homo sapiens
gaccugaccgugucgcuau

SEQ ID NO: 1526680 - RNA, 19 nt, Homo sapiens
ggcauuggcuauucuacag

SEQ ID NO: 1526681 - RNA, 19 nt, Homo sapiens
aauugguagucacuuguua

SEQ ID NO: 1526682 - RNA, 19 nt, Homo sapiens
gaaauaaugacagcaaagc

SEQ ID NO: 1526683 - RNA, 19 nt, Homo sapiens
gugugagccuugcuugcua

SEQ ID NO: 1526684 - RNA, 19 nt, Homo sapiens
gggcugcaauguccucucu

SEQ ID NO: 1526685 - RNA, 19 nt, Homo sapiens
ccaaagugcccaguuguca

SEQ ID NO: 1526686 - RNA, 19 nt, Homo sapiens
caagaagccaaauaaacau

SEQ ID NO: 1526687 - RNA, 19 nt, Homo sapiens
ggggaagguugcccugaua

SEQ ID NO: 1526688 - RNA, 19 nt, Homo sapiens
ucacgaggguucuuaucag

SEQ ID NO: 1526689 - RNA, 19 nt, Homo sapiens
gcaagacauuucuacauua

SEQ ID NO: 1526690 - RNA, 19 nt, Homo sapiens
aaacagaaguugcagaaua

SEQ ID NO: 1526691 - RNA, 19 nt, Homo sapiens
uuacucagcucuuauguua

SEQ ID NO: 1526692 - RNA, 19 nt, Homo sapiens
gcuaaucucuguagaauau

SEQ ID NO: 1526693 - RNA, 19 nt, Homo sapiens
gaaaucauguuaagcaaga

SEQ ID NO: 1526694 - RNA, 19 nt, Homo sapiens
ggaaucauauacacuagua

SEQ ID NO: 1526695 - RNA, 19 nt, Homo sapiens
gaucaagauuccaaacuaa

SEQ ID NO: 1526696 - RNA, 19 nt, Homo sapiens
gaaugaauaugccuuccua

SEQ ID NO: 1526697 - RNA, 19 nt, Homo sapiens
ggaaagaagcuaucacuug

SEQ ID NO: 1526698 - RNA, 19 nt, Homo sapiens
ggaagggucuaaacaguau

SEQ ID NO: 1526699 - RNA, 19 nt, Homo sapiens
cgagaggucuugcaauuug

SEQ ID NO: 1526700 - RNA, 19 nt, Homo sapiens
guuacugacucuacaauuu

SEQ ID NO: 1526701 - RNA, 19 nt, Homo sapiens
gagacgauaugacauguau

SEQ ID NO: 1526702 - RNA, 19 nt, Homo sapiens
gagacaaauuucaacauga

SEQ ID NO: 1526703 - RNA, 19 nt, Homo sapiens
caaggaagcacaacucauu

SEQ ID NO: 1526704 - RNA, 19 nt, Homo sapiens
cauuauggcuaaccucuaa

SEQ ID NO: 1526705 - RNA, 19 nt, Homo sapiens
guaggagcauuacuguuaa

SEQ ID NO: 1526706 - RNA, 19 nt, Homo sapiens
ggauaaaugucaaauugca

SEQ ID NO: 1526707 - RNA, 19 nt, Homo sapiens
gaugggaacuuauucuaca

SEQ ID NO: 1526708 - RNA, 19 nt, Homo sapiens
caucauaacugucuauagg

SEQ ID NO: 1526709 - RNA, 19 nt, Homo sapiens
ggaggagaauugcaggaaa

SEQ ID NO: 1526710 - RNA, 19 nt, Homo sapiens
ccaugucuauuacaaagua

SEQ ID NO: 1526711 - RNA, 19 nt, Homo sapiens
ccgcagagcuuggcacaaa

SEQ ID NO: 1526712 - RNA, 19 nt, Homo sapiens
uguaggagcauuacuguua

SEQ ID NO: 1526713 - RNA, 19 nt, Homo sapiens
gaacauagaaagagugucu

SEQ ID NO: 1526714 - RNA, 19 nt, Homo sapiens
gcagaaaucauguuaagca

SEQ ID NO: 1526715 - RNA, 19 nt, Homo sapiens
gaaguuggucuuuacacua

SEQ ID NO: 1526716 - RNA, 19 nt, Homo sapiens
gacgauaugacauguauaa

SEQ ID NO: 1526717 - RNA, 19 nt, Homo sapiens
gaaauagaaguuggucuuu

SEQ ID NO: 1526718 - RNA, 19 nt, Homo sapiens
aauggaagcuuuacagaau

SEQ ID NO: 1526719 - RNA, 19 nt, Homo sapiens
gcuaaccucuaauuacaga

SEQ ID NO: 1526720 - RNA, 19 nt, Homo sapiens
aaauagagcaguacuuuga

SEQ ID NO: 1526721 - RNA, 19 nt, Homo sapiens
gaauguuauuuggcucuua

SEQ ID NO: 1526722 - RNA, 19 nt, Homo sapiens
caagguguauggagaugaa

SEQ ID NO: 1526723 - RNA, 19 nt, Homo sapiens
caagacagcgcaaggugua

SEQ ID NO: 1526724 - RNA, 19 nt, Homo sapiens
aagacaagaugggaacuua

SEQ ID NO: 1526725 - RNA, 19 nt, Homo sapiens
cugggaaccugaaagcuua

SEQ ID NO: 1526726 - RNA, 19 nt, Homo sapiens
caagaacugugaaaacuuu

SEQ ID NO: 1526727 - RNA, 19 nt, Homo sapiens
gauaugacauguauaacac

SEQ ID NO: 1526728 - RNA, 19 nt, Homo sapiens
ccuaacacaucuccuagaa

SEQ ID NO: 1526729 - RNA, 19 nt, Homo sapiens
gaaaauguagucaggaaua

SEQ ID NO: 1526730 - RNA, 19 nt, Homo sapiens
guucaaacucuucugcuua

SEQ ID NO: 1526731 - RNA, 19 nt, Homo sapiens
gauauccacuggucacauc

SEQ ID NO: 1526732 - RNA, 19 nt, Homo sapiens
gacaggauguugacagcaa

SEQ ID NO: 1526733 - RNA, 19 nt, Homo sapiens
uaaaagaacuggaaagaag

SEQ ID NO: 1526734 - RNA, 19 nt, Homo sapiens
agaucaagauuccaaacua

SEQ ID NO: 1526735 - RNA, 19 nt, Homo sapiens
gaauaggaagagacaaauu

SEQ ID NO: 1526736 - RNA, 19 nt, Homo sapiens
gacaagaugggaacuuauu

SEQ ID NO: 1526737 - RNA, 19 nt, Homo sapiens
uggaaaguauagugaauga

SEQ ID NO: 1526738 - RNA, 19 nt, Homo sapiens
agagacaaauuucaacaug

SEQ ID NO: 1526739 - RNA, 19 nt, Homo sapiens
gaagagacaaauuucaaca

SEQ ID NO: 1526740 - RNA, 19 nt, Homo sapiens
gugccaaacugaaggaaau

SEQ ID NO: 1526741 - RNA, 19 nt, Homo sapiens
ucucauggcacuuucauaa

SEQ ID NO: 1526742 - RNA, 19 nt, Homo sapiens
aagcacaacucauuuccuu

SEQ ID NO: 1526743 - RNA, 19 nt, Homo sapiens
uugcuggacucuuggaaua

SEQ ID NO: 1526744 - RNA, 19 nt, Homo sapiens
gauuauaugguucuucuga

SEQ ID NO: 1526745 - RNA, 19 nt, Homo sapiens
ucaggaaaguggaccauuc

SEQ ID NO: 1526746 - RNA, 19 nt, Homo sapiens
aacagaaguugcagaauau

SEQ ID NO: 1526747 - RNA, 19 nt, Homo sapiens
gaacuuauucuacacuucu

SEQ ID NO: 1526748 - RNA, 19 nt, Homo sapiens
gaaugaauuacaagccuuu

SEQ ID NO: 1526749 - RNA, 19 nt, Homo sapiens
uggcuaaccucuaauuaca

SEQ ID NO: 1526750 - RNA, 19 nt, Homo sapiens
ggauccaugucuauuacaa

SEQ ID NO: 1526751 - RNA, 19 nt, Homo sapiens
uggaagcuuuacagaauaa

SEQ ID NO: 1526752 - RNA, 19 nt, Homo sapiens
ccugaaagcuuagaagaca

SEQ ID NO: 1526753 - RNA, 19 nt, Homo sapiens
guaggaacauagaaagagu

SEQ ID NO: 1526754 - RNA, 19 nt, Homo sapiens
auagagcaguacuuugaua

SEQ ID NO: 1526755 - RNA, 19 nt, Homo sapiens
gaaauugcagaaaucaugu

SEQ ID NO: 1526756 - RNA, 19 nt, Homo sapiens
agcaagacauuucuacauu

SEQ ID NO: 1526757 - RNA, 19 nt, Homo sapiens
gaagugguaggaacauaga

SEQ ID NO: 1526758 - RNA, 19 nt, Homo sapiens
cagaagugguaggaacaua

SEQ ID NO: 1526759 - RNA, 19 nt, Homo sapiens
aaaggcaaacugauaguaa

SEQ ID NO: 1526760 - RNA, 19 nt, Homo sapiens
gaaguuucauugauaucca

SEQ ID NO: 1526761 - RNA, 19 nt, Homo sapiens
ucauggcacuuucauaaca

SEQ ID NO: 1526762 - RNA, 19 nt, Homo sapiens
ugaaggcccucuggcauau

SEQ ID NO: 1526763 - RNA, 19 nt, Homo sapiens
gcaagcuaaucucuguaga

SEQ ID NO: 1526764 - RNA, 19 nt, Homo sapiens
uccgagaggucuugcaauu

SEQ ID NO: 1526765 - RNA, 19 nt, Homo sapiens
uagguuugcuggacucuug

SEQ ID NO: 1526766 - RNA, 19 nt, Homo sapiens
uuaaugaccuaacacaucu

SEQ ID NO: 1526767 - RNA, 19 nt, Homo sapiens
ggaacuuauucuacacuuc

SEQ ID NO: 1526768 - RNA, 19 nt, Homo sapiens
aagcuaaucucuguagaau

SEQ ID NO: 1526769 - RNA, 19 nt, Homo sapiens
ggaaauacacagaacuuuu

SEQ ID NO: 1526770 - RNA, 19 nt, Homo sapiens
cagaaaucauguuaagcaa

SEQ ID NO: 1526771 - RNA, 19 nt, Homo sapiens
aaggcaaacugauaguaaa

SEQ ID NO: 1526772 - RNA, 19 nt, Homo sapiens
caaaggcaaacugauagua

SEQ ID NO: 1526773 - RNA, 19 nt, Homo sapiens
gaacuuuucugucauuugg

SEQ ID NO: 1526774 - RNA, 19 nt, Homo sapiens
ucccagaaaugaauguuau

SEQ ID NO: 1526775 - RNA, 19 nt, Homo sapiens
aguagacgauucccacaaa

SEQ ID NO: 1526776 - RNA, 19 nt, Homo sapiens
ucacuuggauaaaugucaa

SEQ ID NO: 1526777 - RNA, 19 nt, Homo sapiens
gaauauggaacagaggaaa

SEQ ID NO: 1526778 - RNA, 19 nt, Homo sapiens
cauggaaaguauagugaau

SEQ ID NO: 1526779 - RNA, 19 nt, Homo sapiens
aauccaaacuacaaagaug

SEQ ID NO: 1526780 - RNA, 19 nt, Homo sapiens
uggcuuuacucagcucuua

SEQ ID NO: 1526781 - RNA, 19 nt, Homo sapiens
ucauuuggauccaugucua

SEQ ID NO: 1526782 - RNA, 19 nt, Homo sapiens
caaguucacaucccaccua

SEQ ID NO: 1526783 - RNA, 19 nt, Homo sapiens
ugaaauagaaguuggucuu

SEQ ID NO: 1526784 - RNA, 19 nt, Homo sapiens
caaaauagagcaguacuuu

SEQ ID NO: 1526785 - RNA, 19 nt, Homo sapiens
ggacucuuggaauaucuua

SEQ ID NO: 1526786 - RNA, 19 nt, Homo sapiens
gaggagaauugcaggaaaa

SEQ ID NO: 1526787 - RNA, 19 nt, Homo sapiens
caaaguaaagagagucaau

SEQ ID NO: 1526788 - RNA, 19 nt, Homo sapiens
gcacaaaguggagucaauc

SEQ ID NO: 1526789 - RNA, 19 nt, Homo sapiens
uaauaaagcugccuucaaa

SEQ ID NO: 1526790 - RNA, 19 nt, Homo sapiens
gauaagucccugagaauua

SEQ ID NO: 1526791 - RNA, 19 nt, Homo sapiens
caagauaagucccugagaa

SEQ ID NO: 1526792 - RNA, 19 nt, Homo sapiens
uaaagcugccuucaaauua

SEQ ID NO: 1526793 - RNA, 19 nt, Homo sapiens
ggaaaccacuaaaguaagu

SEQ ID NO: 1526794 - RNA, 19 nt, Homo sapiens
gaucguauuuguuugaugu

SEQ ID NO: 1526795 - RNA, 19 nt, Homo sapiens
uaagagucaugccuggaua

SEQ ID NO: 1526796 - RNA, 19 nt, Homo sapiens
ggagugagaugcccagaac

SEQ ID NO: 1526797 - RNA, 19 nt, Homo sapiens
gcaagccggcucugucuaa

SEQ ID NO: 1526798 - RNA, 19 nt, Homo sapiens
ugaaggaaccgcugaagaa

SEQ ID NO: 1526799 - RNA, 19 nt, Homo sapiens
ugaccaaccuuccaucuag

SEQ ID NO: 1526800 - RNA, 19 nt, Homo sapiens
gcagaucguauuuguuuga

SEQ ID NO: 1526801 - RNA, 19 nt, Homo sapiens
cggcagaucguauuuguuu

SEQ ID NO: 1526802 - RNA, 19 nt, Homo sapiens
aaacagaacuuagccaaac

SEQ ID NO: 1526803 - RNA, 19 nt, Homo sapiens
aaagcugccuucaaauuau

SEQ ID NO: 1526804 - RNA, 19 nt, Homo sapiens
gggauaagccagugucuag

SEQ ID NO: 1526805 - RNA, 19 nt, Homo sapiens
uuacuugccuuugcagaaa

SEQ ID NO: 1526806 - RNA, 19 nt, Homo sapiens
acaccuaucuacaggaguu

SEQ ID NO: 1526807 - RNA, 19 nt, Homo sapiens
gggacgcgcucuaugaucu

SEQ ID NO: 1526808 - RNA, 19 nt, Homo sapiens
uagccaaaccuaaguaaga

SEQ ID NO: 1526809 - RNA, 19 nt, Homo sapiens
gguuucuccucucaagaua

SEQ ID NO: 1526810 - RNA, 19 nt, Homo sapiens
ggacgacaccuaucuacag

SEQ ID NO: 1526811 - RNA, 19 nt, Homo sapiens
auaaagcugccuucaaauu

SEQ ID NO: 1526812 - RNA, 19 nt, Homo sapiens
ccuggaaaccacuaaagua

SEQ ID NO: 1526813 - RNA, 19 nt, Homo sapiens
gacucuaagaucccuauua

SEQ ID NO: 1526814 - RNA, 19 nt, Homo sapiens
gaccggauaacaccagaaa

SEQ ID NO: 1526815 - RNA, 19 nt, Homo sapiens
cuggaaaccacuaaaguaa

SEQ ID NO: 1526816 - RNA, 19 nt, Homo sapiens
ccaagcacccggagaagga

SEQ ID NO: 1526817 - RNA, 19 nt, Homo sapiens
gaaaagcuuugacucucuu

SEQ ID NO: 1526818 - RNA, 19 nt, Homo sapiens
cuucuuuccucuuuccuuu

SEQ ID NO: 1526819 - RNA, 19 nt, Homo sapiens
caagccggcucugucuaaa

SEQ ID NO: 1526820 - RNA, 19 nt, Homo sapiens
aagcugccuucaaauuauu

SEQ ID NO: 1526821 - RNA, 19 nt, Homo sapiens
ccggauaacaccagaaaga

SEQ ID NO: 1526822 - RNA, 19 nt, Homo sapiens
gcaucaagcaccugaccaa

SEQ ID NO: 1526823 - RNA, 19 nt, Homo sapiens
gcugaaggacucuaagauc

SEQ ID NO: 1526824 - RNA, 19 nt, Homo sapiens
ucucgcugcugaagaagaa

SEQ ID NO: 1526825 - RNA, 19 nt, Homo sapiens
gccuucaaauuauucaaga

SEQ ID NO: 1526826 - RNA, 19 nt, Homo sapiens
agucaugccuggauauugg

SEQ ID NO: 1526827 - RNA, 19 nt, Homo sapiens
ggagaaggagcagcaggaa

SEQ ID NO: 1526828 - RNA, 19 nt, Homo sapiens
guaagagucaugccuggau

SEQ ID NO: 1526829 - RNA, 19 nt, Homo sapiens
gauaagccagugucuagag

SEQ ID NO: 1526830 - RNA, 19 nt, Homo sapiens
caagacacguuuccuuccu

SEQ ID NO: 1526831 - RNA, 19 nt, Homo sapiens
gaaggaaccgcugaagaac

SEQ ID NO: 1526832 - RNA, 19 nt, Homo sapiens
uuaauaaagcugccuucaa

SEQ ID NO: 1526833 - RNA, 19 nt, Homo sapiens
ucaagcaccugaccaaccu

SEQ ID NO: 1526834 - RNA, 19 nt, Homo sapiens
ugccaaggaauacaacuuu

SEQ ID NO: 1526835 - RNA, 19 nt, Homo sapiens
gcaggucccagcugugaca

SEQ ID NO: 1526836 - RNA, 19 nt, Homo sapiens
gucggcagaucguauuugu

SEQ ID NO: 1526837 - RNA, 19 nt, Homo sapiens
gcucuaugaucucuaugcu

SEQ ID NO: 1526838 - RNA, 19 nt, Homo sapiens
aagauaagucccugagaau

SEQ ID NO: 1526839 - RNA, 19 nt, Homo sapiens
aggaaccgcugaagaacca

SEQ ID NO: 1526840 - RNA, 19 nt, Homo sapiens
ggauaagccagugucuaga

SEQ ID NO: 1526841 - RNA, 19 nt, Homo sapiens
gugcugguccgcagaguca

SEQ ID NO: 1526842 - RNA, 19 nt, Homo sapiens
gugagaugcccagaacaaa

SEQ ID NO: 1526843 - RNA, 19 nt, Homo sapiens
ggcagaucguauuuguuug

SEQ ID NO: 1526844 - RNA, 19 nt, Homo sapiens
agauaagucccugagaauu

SEQ ID NO: 1526845 - RNA, 19 nt, Homo sapiens
ggguuucuccucucaagau

SEQ ID NO: 1526846 - RNA, 19 nt, Homo sapiens
gaaaccacuaaaguaaguu

SEQ ID NO: 1526847 - RNA, 19 nt, Homo sapiens
gccaaggaauacaacuuuu

SEQ ID NO: 1526848 - RNA, 19 nt, Homo sapiens
ccaagucgcacagcuucuu

SEQ ID NO: 1526849 - RNA, 19 nt, Homo sapiens
cuucccuucuuuccucuuu

SEQ ID NO: 1526850 - RNA, 19 nt, Homo sapiens
aaacaaaggggacgggaaa

SEQ ID NO: 1526851 - RNA, 19 nt, Homo sapiens
cuaaggaggagcccaagca

SEQ ID NO: 1526852 - RNA, 19 nt, Homo sapiens
ucaaccggauucccaucga

SEQ ID NO: 1526853 - RNA, 19 nt, Homo sapiens
ugaagaaccagaggagauc

SEQ ID NO: 1526854 - RNA, 19 nt, Homo sapiens
gagucaugccuggauauug

SEQ ID NO: 1526855 - RNA, 19 nt, Homo sapiens
aaaucccgguuuccaaagu

SEQ ID NO: 1526856 - RNA, 19 nt, Homo sapiens
gcuuuaauauacugaacac

SEQ ID NO: 1526857 - RNA, 19 nt, Homo sapiens
cagaucguauuuguuugau

SEQ ID NO: 1526858 - RNA, 19 nt, Homo sapiens
gaacaaagaucauggaaau

SEQ ID NO: 1526859 - RNA, 19 nt, Homo sapiens
gcacagaaccugcagagua

SEQ ID NO: 1526860 - RNA, 19 nt, Homo sapiens
gaggagauauuucaucaaa

SEQ ID NO: 1526861 - RNA, 19 nt, Homo sapiens
gcaaaugugauuagacuua

SEQ ID NO: 1526862 - RNA, 19 nt, Homo sapiens
caaauguucugcaucagua

SEQ ID NO: 1526863 - RNA, 19 nt, Homo sapiens
gauaaggaaucaaauguuc

SEQ ID NO: 1526864 - RNA, 19 nt, Homo sapiens
ggauauggcuuuggagauu

SEQ ID NO: 1526865 - RNA, 19 nt, Homo sapiens
ggagaaggcauauaaagaa

SEQ ID NO: 1526866 - RNA, 19 nt, Homo sapiens
gagaaggcauauaaagaaa

SEQ ID NO: 1526867 - RNA, 19 nt, Homo sapiens
ccaagacucuccuuccuaa

SEQ ID NO: 1526868 - RNA, 19 nt, Homo sapiens
ucacauggauuccuuugaa

SEQ ID NO: 1526869 - RNA, 19 nt, Homo sapiens
gaguuuauguguugcuuaa

SEQ ID NO: 1526870 - RNA, 19 nt, Homo sapiens
gaauguguacgaaucaaua

SEQ ID NO: 1526871 - RNA, 19 nt, Homo sapiens
aaacacaguuguauagguu

SEQ ID NO: 1526872 - RNA, 19 nt, Homo sapiens
gauauggcuuuggagauua

SEQ ID NO: 1526873 - RNA, 19 nt, Homo sapiens
cuaaagagguuaacacuac

SEQ ID NO: 1526874 - RNA, 19 nt, Homo sapiens
gagcaaaugugauuagacu

SEQ ID NO: 1526875 - RNA, 19 nt, Homo sapiens
gagaggauauggcuuugga

SEQ ID NO: 1526876 - RNA, 19 nt, Homo sapiens
uagcaagucuccagaaugu

SEQ ID NO: 1526877 - RNA, 19 nt, Homo sapiens
ggcaugaguuuauguguug

SEQ ID NO: 1526878 - RNA, 19 nt, Homo sapiens
gaaaggaacugauuuuguc

SEQ ID NO: 1526879 - RNA, 19 nt, Homo sapiens
gagauuaaacacaguugua

SEQ ID NO: 1526880 - RNA, 19 nt, Homo sapiens
gccacaagcuguucaagga

SEQ ID NO: 1526881 - RNA, 19 nt, Homo sapiens
ucagcgaguuauucacuua

SEQ ID NO: 1526882 - RNA, 19 nt, Homo sapiens
ggaaucaaauguucugcau

SEQ ID NO: 1526883 - RNA, 19 nt, Homo sapiens
cacaaagacuaaacagauu

SEQ ID NO: 1526884 - RNA, 19 nt, Homo sapiens
cacagaaccugcagaguau

SEQ ID NO: 1526885 - RNA, 19 nt, Homo sapiens
gcgaguuauucacuuauuu

SEQ ID NO: 1526886 - RNA, 19 nt, Homo sapiens
aaacgaaguucucuuacug

SEQ ID NO: 1526887 - RNA, 19 nt, Homo sapiens
gauuacaguucuuccuaaa

SEQ ID NO: 1526888 - RNA, 19 nt, Homo sapiens
gauaagccuugcccuuguu

SEQ ID NO: 1526889 - RNA, 19 nt, Homo sapiens
aaucaaauguucugcauca

SEQ ID NO: 1526890 - RNA, 19 nt, Homo sapiens
ugauuagacuuauggauga

SEQ ID NO: 1526891 - RNA, 19 nt, Homo sapiens
gcaccgagcaaaugugauu

SEQ ID NO: 1526892 - RNA, 19 nt, Homo sapiens
ggugauccacuuccacuua

SEQ ID NO: 1526893 - RNA, 19 nt, Homo sapiens
gggcaugaguuuauguguu

SEQ ID NO: 1526894 - RNA, 19 nt, Homo sapiens
gaaggcauauaaagaaacu

SEQ ID NO: 1526895 - RNA, 19 nt, Homo sapiens
caucaaauacuccagacua

SEQ ID NO: 1526896 - RNA, 19 nt, Homo sapiens
gaccaacccugagaaagga

SEQ ID NO: 1526897 - RNA, 19 nt, Homo sapiens
gaaccaaguaaacgaaguu

SEQ ID NO: 1526898 - RNA, 19 nt, Homo sapiens
gcaaugauuugggaaacau

SEQ ID NO: 1526899 - RNA, 19 nt, Homo sapiens
gaugagaagggcaaugauu

SEQ ID NO: 1526900 - RNA, 19 nt, Homo sapiens
gugauccacuuccacuuaa

SEQ ID NO: 1526901 - RNA, 19 nt, Homo sapiens
cauagcaaaccaugauaua

SEQ ID NO: 1526902 - RNA, 19 nt, Homo sapiens
aaacaccuaguccagauua

SEQ ID NO: 1526903 - RNA, 19 nt, Homo sapiens
gaacugauuuugucuucaa

SEQ ID NO: 1526904 - RNA, 19 nt, Homo sapiens
gauccacuuccacuuaaua

SEQ ID NO: 1526905 - RNA, 19 nt, Homo sapiens
caaaagagcuucuccucau

SEQ ID NO: 1526906 - RNA, 19 nt, Homo sapiens
gaagacacccagaaugaag

SEQ ID NO: 1526907 - RNA, 19 nt, Homo sapiens
guaaacacauccugcaaaa

SEQ ID NO: 1526908 - RNA, 19 nt, Homo sapiens
caaugaggaugaagaccuu

SEQ ID NO: 1526909 - RNA, 19 nt, Homo sapiens
gcaagucuccagaaugugu

SEQ ID NO: 1526910 - RNA, 19 nt, Homo sapiens
gagagcaucuugucuucca

SEQ ID NO: 1526911 - RNA, 19 nt, Homo sapiens
caaagcagugcaguucuua

SEQ ID NO: 1526912 - RNA, 19 nt, Homo sapiens
aaacaaagcagugcaguuc

SEQ ID NO: 1526913 - RNA, 19 nt, Homo sapiens
acacaaagacuaaacagau

SEQ ID NO: 1526914 - RNA, 19 nt, Homo sapiens
caacaugauuuggacacaa

SEQ ID NO: 1526915 - RNA, 19 nt, Homo sapiens
ucacuuauuugaugagaag

SEQ ID NO: 1526916 - RNA, 19 nt, Homo sapiens
ugauuacaguucuuccuaa

SEQ ID NO: 1526917 - RNA, 19 nt, Homo sapiens
gguaaacacauccugcaaa

SEQ ID NO: 1526918 - RNA, 19 nt, Homo sapiens
cugcaguccuuuaaacaaa

SEQ ID NO: 1526919 - RNA, 19 nt, Homo sapiens
aguaaacgaaguucucuua

SEQ ID NO: 1526920 - RNA, 19 nt, Homo sapiens
ggaccaacccugagaaagg

SEQ ID NO: 1526921 - RNA, 19 nt, Homo sapiens
gcacaguuguccccuauug

SEQ ID NO: 1526922 - RNA, 19 nt, Homo sapiens
gguuaacacuacaaacugu

SEQ ID NO: 1526923 - RNA, 19 nt, Homo sapiens
uaaacacaguuguauaggu

SEQ ID NO: 1526924 - RNA, 19 nt, Homo sapiens
gugagacuuuguuucauug

SEQ ID NO: 1526925 - RNA, 19 nt, Homo sapiens
acaaagcagugcaguucuu

SEQ ID NO: 1526926 - RNA, 19 nt, Homo sapiens
uaaacgaaguucucuuacu

SEQ ID NO: 1526927 - RNA, 19 nt, Homo sapiens
gcuuaaggaacuugcguua

SEQ ID NO: 1526928 - RNA, 19 nt, Homo sapiens
uggaggagauauuucauca

SEQ ID NO: 1526929 - RNA, 19 nt, Homo sapiens
gaaaagcuuuaaugugugu

SEQ ID NO: 1526930 - RNA, 19 nt, Homo sapiens
cagauucagcaguggauua

SEQ ID NO: 1526931 - RNA, 19 nt, Homo sapiens
ucaaauguucccaugcuaa

SEQ ID NO: 1526932 - RNA, 19 nt, Homo sapiens
gugaagacaaugaggauga

SEQ ID NO: 1526933 - RNA, 19 nt, Homo sapiens
gaggagaaggcauauaaag

SEQ ID NO: 1526934 - RNA, 19 nt, Homo sapiens
ggucugcaguccuuuaaac

SEQ ID NO: 1526935 - RNA, 19 nt, Homo sapiens
ccagauuaccauaaagaaa

SEQ ID NO: 1526936 - RNA, 19 nt, Homo sapiens
uuaguaacguuggaagaaa

SEQ ID NO: 1526937 - RNA, 19 nt, Homo sapiens
cuccguggcuuaagacuug

SEQ ID NO: 1526938 - RNA, 19 nt, Homo sapiens
uauagcaagucuccagaau

SEQ ID NO: 1526939 - RNA, 19 nt, Homo sapiens
ugaagacaaugaggaugaa

SEQ ID NO: 1526940 - RNA, 19 nt, Homo sapiens
agugagacuuuguuucauu

SEQ ID NO: 1526941 - RNA, 19 nt, Homo sapiens
cuagugagacuuuguuuca

SEQ ID NO: 1526942 - RNA, 19 nt, Homo sapiens
acaacagcaugccuaguga

SEQ ID NO: 1526943 - RNA, 19 nt, Homo sapiens
ggaaacaugcaccgagcaa

SEQ ID NO: 1526944 - RNA, 19 nt, Homo sapiens
agacucuccuuccuaauuc

SEQ ID NO: 1526945 - RNA, 19 nt, Homo sapiens
uaaagagguuaacacuaca

SEQ ID NO: 1526946 - RNA, 19 nt, Homo sapiens
ccacuuccacuuaauagga

SEQ ID NO: 1526947 - RNA, 19 nt, Homo sapiens
ucaaauauuggacaacaug

SEQ ID NO: 1526948 - RNA, 19 nt, Homo sapiens
cugaagacacccagaauga

SEQ ID NO: 1526949 - RNA, 19 nt, Homo sapiens
ggaugaagaccuuuauggu

SEQ ID NO: 1526950 - RNA, 19 nt, Homo sapiens
aggaaaagcuuuaaugugu

SEQ ID NO: 1526951 - RNA, 19 nt, Homo sapiens
caaauacuccagacuaugc

SEQ ID NO: 1526952 - RNA, 19 nt, Homo sapiens
aaacaugcaccgagcaaau

SEQ ID NO: 1526953 - RNA, 19 nt, Homo sapiens
gagguuaacacuacaaacu

SEQ ID NO: 1526954 - RNA, 19 nt, Homo sapiens
uaaggaacuugcguuaaag

SEQ ID NO: 1526955 - RNA, 19 nt, Homo sapiens
cagauuaccauaaagaaag

SEQ ID NO: 1526956 - RNA, 19 nt, Homo sapiens
ugagaagggcaaugauuug

SEQ ID NO: 1526957 - RNA, 19 nt, Homo sapiens
guucaaauguucccaugcu

SEQ ID NO: 1526958 - RNA, 19 nt, Homo sapiens
aaagaacccucacaaguua

SEQ ID NO: 1526959 - RNA, 19 nt, Homo sapiens
gagagugacuuugacauua

SEQ ID NO: 1526960 - RNA, 19 nt, Homo sapiens
guaguagacuuacauauug

SEQ ID NO: 1526961 - RNA, 19 nt, Homo sapiens
gacauuagguccuuuguug

SEQ ID NO: 1526962 - RNA, 19 nt, Homo sapiens
ggacucauccugugacuuu

SEQ ID NO: 1526963 - RNA, 19 nt, Homo sapiens
uagaagaacugcuuaagga

SEQ ID NO: 1526964 - RNA, 19 nt, Homo sapiens
gaaaucaucaguccaguga

SEQ ID NO: 1526965 - RNA, 19 nt, Homo sapiens
ggaaguguguuucaaaaua

SEQ ID NO: 1526966 - RNA, 19 nt, Homo sapiens
uaaccacacucauuccuuu

SEQ ID NO: 1526967 - RNA, 19 nt, Homo sapiens
ccaccgagcugcuguguca

SEQ ID NO: 1526968 - RNA, 19 nt, Homo sapiens
gaggaaagcaauagaagaa

SEQ ID NO: 1526969 - RNA, 19 nt, Homo sapiens
aaacacagaggaggaauua

SEQ ID NO: 1526970 - RNA, 19 nt, Homo sapiens
caaagugucugagcauaug

SEQ ID NO: 1526971 - RNA, 19 nt, Homo sapiens
aaaccuguauuccuucuuu

SEQ ID NO: 1526972 - RNA, 19 nt, Homo sapiens
gcacaaagucauggaguuu

SEQ ID NO: 1526973 - RNA, 19 nt, Homo sapiens
ucgagaagcucuuugauag

SEQ ID NO: 1526974 - RNA, 19 nt, Homo sapiens
gcaauagaagaacugcuua

SEQ ID NO: 1526975 - RNA, 19 nt, Homo sapiens
acacauugcccucucauaa

SEQ ID NO: 1526976 - RNA, 19 nt, Homo sapiens
gaaauagcacaaagucaug

SEQ ID NO: 1526977 - RNA, 19 nt, Homo sapiens
ggaaagcaauagaagaacu

SEQ ID NO: 1526978 - RNA, 19 nt, Homo sapiens
ggugaacaauguaggaaau

SEQ ID NO: 1526979 - RNA, 19 nt, Homo sapiens
ugauagcucugcauuuguu

SEQ ID NO: 1526980 - RNA, 19 nt, Homo sapiens
acacagaggaggaauuauu

SEQ ID NO: 1526981 - RNA, 19 nt, Homo sapiens
agaaggaaauacauccaaa

SEQ ID NO: 1526982 - RNA, 19 nt, Homo sapiens
gaagagccaggcccagaaa

SEQ ID NO: 1526983 - RNA, 19 nt, Homo sapiens
ggagaggaaagcaauagaa

SEQ ID NO: 1526984 - RNA, 19 nt, Homo sapiens
uccaaggucugggaauuua

SEQ ID NO: 1526985 - RNA, 19 nt, Homo sapiens
uuucaaaccuguauuccuu

SEQ ID NO: 1526986 - RNA, 19 nt, Homo sapiens
cagcuaaagacuugugaua

SEQ ID NO: 1526987 - RNA, 19 nt, Homo sapiens
uuacaaaccuuucaaaccu

SEQ ID NO: 1526988 - RNA, 19 nt, Homo sapiens
ccuagcaacucuugaggaa

SEQ ID NO: 1526989 - RNA, 19 nt, Homo sapiens
aaagcugaauugugucaaa

SEQ ID NO: 1526990 - RNA, 19 nt, Homo sapiens
uaguauaguuguuccagaa

SEQ ID NO: 1526991 - RNA, 19 nt, Homo sapiens
aacuagagcugaaacaaug

SEQ ID NO: 1526992 - RNA, 19 nt, Homo sapiens
gaggaauuauugcuucauc

SEQ ID NO: 1526993 - RNA, 19 nt, Homo sapiens
uuugauagcucugcauuug

SEQ ID NO: 1526994 - RNA, 19 nt, Homo sapiens
ggcaaacaccugagaguga

SEQ ID NO: 1526995 - RNA, 19 nt, Homo sapiens
uggaugaaguguccucuug

SEQ ID NO: 1526996 - RNA, 19 nt, Homo sapiens
gaauuauugcuucaucuga

SEQ ID NO: 1526997 - RNA, 19 nt, Homo sapiens
ggagcagccaggacaagua

SEQ ID NO: 1526998 - RNA, 19 nt, Homo sapiens
gagcaagaccaugaacaaa

SEQ ID NO: 1526999 - RNA, 19 nt, Homo sapiens
ucccuuaggugaacaaugu

SEQ ID NO: 1527000 - RNA, 19 nt, Homo sapiens
auaaagagcaagaccauga

SEQ ID NO: 1527001 - RNA, 19 nt, Homo sapiens
guuagaaacuagaauagac

SEQ ID NO: 1527002 - RNA, 19 nt, Homo sapiens
gaagccauccuuacaagca

SEQ ID NO: 1527003 - RNA, 19 nt, Homo sapiens
uagcaacucuugaggaaac

SEQ ID NO: 1527004 - RNA, 19 nt, Homo sapiens
cagaagccauccuuacaag

SEQ ID NO: 1527005 - RNA, 19 nt, Homo sapiens
guauaguuguuccagaaau

SEQ ID NO: 1527006 - RNA, 19 nt, Homo sapiens
caauagaagaacugcuuaa

SEQ ID NO: 1527007 - RNA, 19 nt, Homo sapiens
gcuaaagacuugugauacc

SEQ ID NO: 1527008 - RNA, 19 nt, Homo sapiens
gaauuuaaugcuccacuuc

SEQ ID NO: 1527009 - RNA, 19 nt, Homo sapiens
gaaagcaauagaagaacug

SEQ ID NO: 1527010 - RNA, 19 nt, Homo sapiens
gcauuggaguguuagaaac

SEQ ID NO: 1527011 - RNA, 19 nt, Homo sapiens
ccaaagugucugagcauau

SEQ ID NO: 1527012 - RNA, 19 nt, Homo sapiens
aaaggaagaagaugaagau

SEQ ID NO: 1527013 - RNA, 19 nt, Homo sapiens
ugaauuuaaugcuccacuu

SEQ ID NO: 1527014 - RNA, 19 nt, Homo sapiens
ucaguccagugaccauauu

SEQ ID NO: 1527015 - RNA, 19 nt, Homo sapiens
ugagagugacuuugacauu

SEQ ID NO: 1527016 - RNA, 19 nt, Homo sapiens
gagccaggcccagaaagaa

SEQ ID NO: 1527017 - RNA, 19 nt, Homo sapiens
agaaauagcacaaagucau

SEQ ID NO: 1527018 - RNA, 19 nt, Homo sapiens
ccacacucauuccuuucaa

SEQ ID NO: 1527019 - RNA, 19 nt, Homo sapiens
agagugacuuugacauuag

SEQ ID NO: 1527020 - RNA, 19 nt, Homo sapiens
ggaauuauugcuucaucug

SEQ ID NO: 1527021 - RNA, 19 nt, Homo sapiens
aaacuagagcugaaacaau

SEQ ID NO: 1527022 - RNA, 19 nt, Homo sapiens
gaagaaaacccgaagaaac

SEQ ID NO: 1527023 - RNA, 19 nt, Homo sapiens
gagaggaaagcaauagaag

SEQ ID NO: 1527024 - RNA, 19 nt, Homo sapiens
gauaaggaaccagcgaaga

SEQ ID NO: 1527025 - RNA, 19 nt, Homo sapiens
cacauugcccucucauaaa

SEQ ID NO: 1527026 - RNA, 19 nt, Homo sapiens
aguuagcauuggaguguua

SEQ ID NO: 1527027 - RNA, 19 nt, Homo sapiens
gaagaugaagauucugucu

SEQ ID NO: 1527028 - RNA, 19 nt, Homo sapiens
gacuugugauaccacuaua

SEQ ID NO: 1527029 - RNA, 19 nt, Homo sapiens
ccuccaaggucugggaauu

SEQ ID NO: 1527030 - RNA, 19 nt, Homo sapiens
aaacacagaagccauccuu

SEQ ID NO: 1527031 - RNA, 19 nt, Homo sapiens
gaugaaguguccucuugcu

SEQ ID NO: 1527032 - RNA, 19 nt, Homo sapiens
caaacacagaggaggaauu

SEQ ID NO: 1527033 - RNA, 19 nt, Homo sapiens
ccuguauuccuucuuuaua

SEQ ID NO: 1527034 - RNA, 19 nt, Homo sapiens
uauaguuguuccagaaauc

SEQ ID NO: 1527035 - RNA, 19 nt, Homo sapiens
cuugugauaccacuauaua

SEQ ID NO: 1527036 - RNA, 19 nt, Homo sapiens
aaaagaacccucacaaguu

SEQ ID NO: 1527037 - RNA, 19 nt, Homo sapiens
gcaaaacgugggaaaacua

SEQ ID NO: 1527038 - RNA, 19 nt, Homo sapiens
caccugagagugacuuuga

SEQ ID NO: 1527039 - RNA, 19 nt, Homo sapiens
uaaagagcaagaccaugaa

SEQ ID NO: 1527040 - RNA, 19 nt, Homo sapiens
acauugcccucucauaaag

SEQ ID NO: 1527041 - RNA, 19 nt, Homo sapiens
cacagaggaggaauuauug

SEQ ID NO: 1527042 - RNA, 19 nt, Homo sapiens
aaaguuagcauuggagugu

SEQ ID NO: 1527043 - RNA, 19 nt, Homo sapiens
gggaauuuaucgagaagcu

SEQ ID NO: 1527044 - RNA, 19 nt, Homo sapiens
cauuagguccuuuguuguu

SEQ ID NO: 1527045 - RNA, 19 nt, Homo sapiens
aucaggagcuggagaggaa

SEQ ID NO: 1527046 - RNA, 19 nt, Homo sapiens
guuauguauuggccuaaau

SEQ ID NO: 1527047 - RNA, 19 nt, Homo sapiens
ucaguuaccagagguuaaa

SEQ ID NO: 1527048 - RNA, 19 nt, Homo sapiens
auagaaguguuuacaaugc

SEQ ID NO: 1527049 - RNA, 19 nt, Homo sapiens
cuaaagacuugugauacca

SEQ ID NO: 1527050 - RNA, 19 nt, Homo sapiens
aagaguuguuucagugcua

SEQ ID NO: 1527051 - RNA, 19 nt, Homo sapiens
ucugggaauuuaucgagaa

SEQ ID NO: 1527052 - RNA, 19 nt, Homo sapiens
cgaagagccaggcccagaa

SEQ ID NO: 1527053 - RNA, 19 nt, Homo sapiens
cacacucauuccuuucaaa

SEQ ID NO: 1527054 - RNA, 19 nt, Homo sapiens
gaaggaaauacauccaaaa

SEQ ID NO: 1527055 - RNA, 19 nt, Homo sapiens
uaaugcuccacuucaguua

SEQ ID NO: 1527056 - RNA, 19 nt, Homo sapiens
gcucgagguuccgccaguu

SEQ ID NO: 1527057 - RNA, 19 nt, Homo sapiens
uccaaagugucugagcaua

SEQ ID NO: 1527058 - RNA, 19 nt, Homo sapiens
ucaccucugugucuuauua

SEQ ID NO: 1527059 - RNA, 19 nt, Homo sapiens
gaacaggcauuggcgugua

SEQ ID NO: 1527060 - RNA, 19 nt, Homo sapiens
gcagaacagucuaaucuca

SEQ ID NO: 1527061 - RNA, 19 nt, Homo sapiens
uaacguugaugaggaauaa

SEQ ID NO: 1527062 - RNA, 19 nt, Homo sapiens
uaacuggaaugaugaguau

SEQ ID NO: 1527063 - RNA, 19 nt, Homo sapiens
gaaagggcaagcacauuaa

SEQ ID NO: 1527064 - RNA, 19 nt, Homo sapiens
acacagaugucuuucuuug

SEQ ID NO: 1527065 - RNA, 19 nt, Homo sapiens
ucacagcugucucagaauu

SEQ ID NO: 1527066 - RNA, 19 nt, Homo sapiens
gaaacaauguacaguaggu

SEQ ID NO: 1527067 - RNA, 19 nt, Homo sapiens
gcaagcacauuaaaucucu

SEQ ID NO: 1527068 - RNA, 19 nt, Homo sapiens
caauucaucugcuucaaga

SEQ ID NO: 1527069 - RNA, 19 nt, Homo sapiens
gauggagucucgcuuuguu

SEQ ID NO: 1527070 - RNA, 19 nt, Homo sapiens
ggaauaaauugguuucacu

SEQ ID NO: 1527071 - RNA, 19 nt, Homo sapiens
gcguaaacaucacgacuga

SEQ ID NO: 1527072 - RNA, 19 nt, Homo sapiens
gacaugauccugacuguga

SEQ ID NO: 1527073 - RNA, 19 nt, Homo sapiens
gaugaggaauaaauugguu

SEQ ID NO: 1527074 - RNA, 19 nt, Homo sapiens
agaaagggcaagcacauua

SEQ ID NO: 1527075 - RNA, 19 nt, Homo sapiens
ugacugugauggccuauga

SEQ ID NO: 1527076 - RNA, 19 nt, Homo sapiens
ucucacagcugucucagaa

SEQ ID NO: 1527077 - RNA, 19 nt, Homo sapiens
gaacuacccaggcaucaug

SEQ ID NO: 1527078 - RNA, 19 nt, Homo sapiens
ggcaguuguuugcuuauuu

SEQ ID NO: 1527079 - RNA, 19 nt, Homo sapiens
gcacagcagaacagucuaa

SEQ ID NO: 1527080 - RNA, 19 nt, Homo sapiens
ccucagaugggaauuauaa

SEQ ID NO: 1527081 - RNA, 19 nt, Homo sapiens
ucacaaccaucuuuucaua

SEQ ID NO: 1527082 - RNA, 19 nt, Homo sapiens
guaaacaucacgacugaau

SEQ ID NO: 1527083 - RNA, 19 nt, Homo sapiens
gauccuuuguuuagcguaa

SEQ ID NO: 1527084 - RNA, 19 nt, Homo sapiens
cugaguagcugggacuaua

SEQ ID NO: 1527085 - RNA, 19 nt, Homo sapiens
ugaaaucacaaccaucuuu

SEQ ID NO: 1527086 - RNA, 19 nt, Homo sapiens
cauuaaaucucuacaucug

SEQ ID NO: 1527087 - RNA, 19 nt, Homo sapiens
gauggccuaugacugguuu

SEQ ID NO: 1527088 - RNA, 19 nt, Homo sapiens
gccuuuaacuggaaugaug

SEQ ID NO: 1527089 - RNA, 19 nt, Homo sapiens
ccaccgugcugggauaauu

SEQ ID NO: 1527090 - RNA, 19 nt, Homo sapiens
cacauuaaaucucuacauc

SEQ ID NO: 1527091 - RNA, 19 nt, Homo sapiens
ccuggcaguuguuugcuua

SEQ ID NO: 1527092 - RNA, 19 nt, Homo sapiens
auucccagcugcacaauuu

SEQ ID NO: 1527093 - RNA, 19 nt, Homo sapiens
acagaugucuuucuuuguc

SEQ ID NO: 1527094 - RNA, 19 nt, Homo sapiens
ccaagaugauugaggagau

SEQ ID NO: 1527095 - RNA, 19 nt, Homo sapiens
gcaguuguuugcuuauuuu

SEQ ID NO: 1527096 - RNA, 19 nt, Homo sapiens
ucaaagugcugggauuaca

SEQ ID NO: 1527097 - RNA, 19 nt, Homo sapiens
cagcagaacagucuaaucu

SEQ ID NO: 1527098 - RNA, 19 nt, Homo sapiens
ucaagaauguggaaaucuc

SEQ ID NO: 1527099 - RNA, 19 nt, Homo sapiens
caagaugauugaggagaug

SEQ ID NO: 1527100 - RNA, 19 nt, Homo sapiens
gaaacagggacauucaaag

SEQ ID NO: 1527101 - RNA, 19 nt, Homo sapiens
cagauggagucucgcuuug

SEQ ID NO: 1527102 - RNA, 19 nt, Homo sapiens
acagugacaucaauaacau

SEQ ID NO: 1527103 - RNA, 19 nt, Homo sapiens
uggaaacaauguacaguag

SEQ ID NO: 1527104 - RNA, 19 nt, Homo sapiens
auucugggauccuuuguuu

SEQ ID NO: 1527105 - RNA, 19 nt, Homo sapiens
caugaucuguuccauccuu

SEQ ID NO: 1527106 - RNA, 19 nt, Homo sapiens
gaacagucuaaucucauga

SEQ ID NO: 1527107 - RNA, 19 nt, Homo sapiens
ccagauggagucucgcuuu

SEQ ID NO: 1527108 - RNA, 19 nt, Homo sapiens
caugaauccucaccucugu

SEQ ID NO: 1527109 - RNA, 19 nt, Homo sapiens
cuaccuagguggccuccuu

SEQ ID NO: 1527110 - RNA, 19 nt, Homo sapiens
aaacagggacauucaaagu

SEQ ID NO: 1527111 - RNA, 19 nt, Homo sapiens
uacaguagguccuccaaca

SEQ ID NO: 1527112 - RNA, 19 nt, Homo sapiens
agaacagucuaaucucaug

SEQ ID NO: 1527113 - RNA, 19 nt, Homo sapiens
caaaagagccacagaaucu

SEQ ID NO: 1527114 - RNA, 19 nt, Homo sapiens
uagguggccuccuuugguu

SEQ ID NO: 1527115 - RNA, 19 nt, Homo sapiens
uuauaacguugaugaggaa

SEQ ID NO: 1527116 - RNA, 19 nt, Homo sapiens
agucuaaucucaugaucug

SEQ ID NO: 1527117 - RNA, 19 nt, Homo sapiens
gagaaacagggacauucaa

SEQ ID NO: 1527118 - RNA, 19 nt, Homo sapiens
gacagugacaucaauaaca

SEQ ID NO: 1527119 - RNA, 19 nt, Homo sapiens
gggacugccugacacagau

SEQ ID NO: 1527120 - RNA, 19 nt, Homo sapiens
gcacauuaaaucucuacau

SEQ ID NO: 1527121 - RNA, 19 nt, Homo sapiens
gaugugguggcgucaguaa

SEQ ID NO: 1527122 - RNA, 19 nt, Homo sapiens
gaaaucacaaccaucuuuu

SEQ ID NO: 1527123 - RNA, 19 nt, Homo sapiens
agaaacagggacauucaaa

SEQ ID NO: 1527124 - RNA, 19 nt, Homo sapiens
gcucucgccuggcaguugu

SEQ ID NO: 1527125 - RNA, 19 nt, Homo sapiens
ucucaaagugcugggauua

SEQ ID NO: 1527126 - RNA, 19 nt, Homo sapiens
uaagaauuccauccucaga

SEQ ID NO: 1527127 - RNA, 19 nt, Homo sapiens
cagggauccuuuuguguua

SEQ ID NO: 1527128 - RNA, 19 nt, Homo sapiens
gugaauauugucuucuuug

SEQ ID NO: 1527129 - RNA, 19 nt, Homo sapiens
caagcacauuaaaucucua

SEQ ID NO: 1527130 - RNA, 19 nt, Homo sapiens
ugagaaacagggacauuca

SEQ ID NO: 1527131 - RNA, 19 nt, Homo sapiens
cauccucgcugggcucuuc

SEQ ID NO: 1527132 - RNA, 19 nt, Homo sapiens
gaaucucacagcugucuca

SEQ ID NO: 1527133 - RNA, 19 nt, Homo sapiens
cucugugucuuauuaguuu

SEQ ID NO: 1527134 - RNA, 19 nt, Homo sapiens
acugaauccucucuaccua

SEQ ID NO: 1527135 - RNA, 19 nt, Homo sapiens
uaguagagacgguguuuca

SEQ ID NO: 1527136 - RNA, 19 nt, Homo sapiens
gaauguggaaaucucuaau

SEQ ID NO: 1527137 - RNA, 19 nt, Homo sapiens
ggccuccuuugguuucuga

SEQ ID NO: 1527138 - RNA, 19 nt, Homo sapiens
uuaacuggaaugaugagua

SEQ ID NO: 1527139 - RNA, 19 nt, Homo sapiens
gggcaagcacauuaaaucu

SEQ ID NO: 1527140 - RNA, 19 nt, Homo sapiens
cuaaucucaugaucuguuc

SEQ ID NO: 1527141 - RNA, 19 nt, Homo sapiens
ccucaccucugugucuuau

SEQ ID NO: 1527142 - RNA, 19 nt, Homo sapiens
aaagggcaagcacauuaaa

SEQ ID NO: 1527143 - RNA, 19 nt, Homo sapiens
ggaauuauaaagccuucuc

SEQ ID NO: 1527144 - RNA, 19 nt, Homo sapiens
guugaugaggaauaaauug

SEQ ID NO: 1527145 - RNA, 19 nt, Homo sapiens
uuugguuucugagcaauaa

SEQ ID NO: 1527146 - RNA, 19 nt, Homo sapiens
cuaugugaauauugucuuc

SEQ ID NO: 1527147 - RNA, 19 nt, Homo sapiens
aaccuugccuguucugaca

SEQ ID NO: 1527148 - RNA, 19 nt, Homo sapiens
cuucaagaauguggaaauc

SEQ ID NO: 1527149 - RNA, 19 nt, Homo sapiens
ggaaccugcucauuauccu

SEQ ID NO: 1527150 - RNA, 19 nt, Homo sapiens
ucagaugggaauuauaaag

SEQ ID NO: 1527151 - RNA, 19 nt, Homo sapiens
agaauguggaaaucucuaa

SEQ ID NO: 1527152 - RNA, 19 nt, Homo sapiens
uagccaggauggucucgau

SEQ ID NO: 1527153 - RNA, 19 nt, Homo sapiens
ucugggauccuuuguuuag

SEQ ID NO: 1527154 - RNA, 19 nt, Homo sapiens
ucuaaucucaugaucuguu

SEQ ID NO: 1527155 - RNA, 19 nt, Homo sapiens
uggcaguuguuugcuuauu

SEQ ID NO: 1527156 - RNA, 19 nt, Homo sapiens
uuccuuagccuguuggauu

SEQ ID NO: 1527157 - RNA, 19 nt, Homo sapiens
aaagagccacagaaucuca

SEQ ID NO: 1527158 - RNA, 19 nt, Homo sapiens
gcagagagauugagagauu

SEQ ID NO: 1527159 - RNA, 19 nt, Homo sapiens
gaagggaaauacaucauug

SEQ ID NO: 1527160 - RNA, 19 nt, Homo sapiens
ggacaaaccuugggucaca

SEQ ID NO: 1527161 - RNA, 19 nt, Homo sapiens
ggaaauaugagcaagcuuu

SEQ ID NO: 1527162 - RNA, 19 nt, Homo sapiens
gaagaggcacuuucgagua

SEQ ID NO: 1527163 - RNA, 19 nt, Homo sapiens
ucacuccacuuguuaguuu

SEQ ID NO: 1527164 - RNA, 19 nt, Homo sapiens
ggacuugagugcagggaaa

SEQ ID NO: 1527165 - RNA, 19 nt, Homo sapiens
acacugggcuggaaauaug

SEQ ID NO: 1527166 - RNA, 19 nt, Homo sapiens
auaaagugcuugagucuau

SEQ ID NO: 1527167 - RNA, 19 nt, Homo sapiens
caaacacgaugagcuuauu

SEQ ID NO: 1527168 - RNA, 19 nt, Homo sapiens
caaggugacuucuauuucu

SEQ ID NO: 1527169 - RNA, 19 nt, Homo sapiens
ggaaagagaagagagaaga

SEQ ID NO: 1527170 - RNA, 19 nt, Homo sapiens
gagccuaccuguuuaacuc

SEQ ID NO: 1527171 - RNA, 19 nt, Homo sapiens
cagaacagcagaugagaaa

SEQ ID NO: 1527172 - RNA, 19 nt, Homo sapiens
ggaagggaaauacaucauu

SEQ ID NO: 1527173 - RNA, 19 nt, Homo sapiens
ggccgagccuaccuguuua

SEQ ID NO: 1527174 - RNA, 19 nt, Homo sapiens
acgaugagcuuauuuccaa

SEQ ID NO: 1527175 - RNA, 19 nt, Homo sapiens
ggacaacggcugggacuga

SEQ ID NO: 1527176 - RNA, 19 nt, Homo sapiens
gugcacaccuggccaaaca

SEQ ID NO: 1527177 - RNA, 19 nt, Homo sapiens
ugaaggagcggaaagagaa

SEQ ID NO: 1527178 - RNA, 19 nt, Homo sapiens
gagcagagagauugagaga

SEQ ID NO: 1527179 - RNA, 19 nt, Homo sapiens
ccauuucacuccacuuguu

SEQ ID NO: 1527180 - RNA, 19 nt, Homo sapiens
gaucauggaccacagaaca

SEQ ID NO: 1527181 - RNA, 19 nt, Homo sapiens
aagaggcacuuucgaguau

SEQ ID NO: 1527182 - RNA, 19 nt, Homo sapiens
ccaagauccugaacaugga

SEQ ID NO: 1527183 - RNA, 19 nt, Homo sapiens
gggaaauacaucauugaaa

SEQ ID NO: 1527184 - RNA, 19 nt, Homo sapiens
gaaguacaaggaagggaaa

SEQ ID NO: 1527185 - RNA, 19 nt, Homo sapiens
agagagagagagagagaua

SEQ ID NO: 1527186 - RNA, 19 nt, Homo sapiens
gaggggagguggaaaauca

SEQ ID NO: 1527187 - RNA, 19 nt, Homo sapiens
ugacuucuauuucuaucug

SEQ ID NO: 1527188 - RNA, 19 nt, Homo sapiens
gcacugaagaggcacuuuc

SEQ ID NO: 1527189 - RNA, 19 nt, Homo sapiens
caacacacagccacauuca

SEQ ID NO: 1527190 - RNA, 19 nt, Homo sapiens
uaaagugcuugagucuauu

SEQ ID NO: 1527191 - RNA, 19 nt, Homo sapiens
agaguaagcagucuuuaug

SEQ ID NO: 1527192 - RNA, 19 nt, Homo sapiens
uaguuuaucuuggcacuga

SEQ ID NO: 1527193 - RNA, 19 nt, Homo sapiens
caccagcgaaugaaacuuu

SEQ ID NO: 1527194 - RNA, 19 nt, Homo sapiens
gacuuggguuggagugaaa

SEQ ID NO: 1527195 - RNA, 19 nt, Homo sapiens
auugagagauugagagaga

SEQ ID NO: 1527196 - RNA, 19 nt, Homo sapiens
uggccgagccuaccuguuu

SEQ ID NO: 1527197 - RNA, 19 nt, Homo sapiens
ucacagggcaaguagauca

SEQ ID NO: 1527198 - RNA, 19 nt, Homo sapiens
aaggugacuucuauuucua

SEQ ID NO: 1527199 - RNA, 19 nt, Homo sapiens
ccacagaacagcagaugag

SEQ ID NO: 1527200 - RNA, 19 nt, Homo sapiens
gguugugggucuuucuguu

SEQ ID NO: 1527201 - RNA, 19 nt, Homo sapiens
ggucacagggcaaguagau

SEQ ID NO: 1527202 - RNA, 19 nt, Homo sapiens
aaaccacacugggcuggaa

SEQ ID NO: 1527203 - RNA, 19 nt, Homo sapiens
cagaguaagcagucuuuau

SEQ ID NO: 1527204 - RNA, 19 nt, Homo sapiens
guacagaacgagagacaac

SEQ ID NO: 1527205 - RNA, 19 nt, Homo sapiens
gaagcgauggcagggcaua

SEQ ID NO: 1527206 - RNA, 19 nt, Homo sapiens
gaaagagaagagagaagag

SEQ ID NO: 1527207 - RNA, 19 nt, Homo sapiens
ccaaacacgaugagcuuau

SEQ ID NO: 1527208 - RNA, 19 nt, Homo sapiens
caaggaagggaaauacauc

SEQ ID NO: 1527209 - RNA, 19 nt, Homo sapiens
guacaaggaagggaaauac

SEQ ID NO: 1527210 - RNA, 19 nt, Homo sapiens
gagacgagccagaaguaca

SEQ ID NO: 1527211 - RNA, 19 nt, Homo sapiens
gaaauaugagcaagcuuuu

SEQ ID NO: 1527212 - RNA, 19 nt, Homo sapiens
ccaagacuuuccgcagcua

SEQ ID NO: 1527213 - RNA, 19 nt, Homo sapiens
uagcugacauuuucuguga

SEQ ID NO: 1527214 - RNA, 19 nt, Homo sapiens
agaccgagguacagaacga

SEQ ID NO: 1527215 - RNA, 19 nt, Homo sapiens
cagagagauugagagauug

SEQ ID NO: 1527216 - RNA, 19 nt, Homo sapiens
gacagcugcucgcggaaca

SEQ ID NO: 1527217 - RNA, 19 nt, Homo sapiens
guaucuaacuuuugccauu

SEQ ID NO: 1527218 - RNA, 19 nt, Homo sapiens
ucaaaggguuuuccauuuc

SEQ ID NO: 1527219 - RNA, 19 nt, Homo sapiens
ccugggaaauaguaaaaua

SEQ ID NO: 1527220 - RNA, 19 nt, Homo sapiens
gaaguuuccuaccccuauu

SEQ ID NO: 1527221 - RNA, 19 nt, Homo sapiens
gagugaaauucuggucuca

SEQ ID NO: 1527222 - RNA, 19 nt, Homo sapiens
agacuuggguuggagugaa

SEQ ID NO: 1527223 - RNA, 19 nt, Homo sapiens
ggccaaacacgaugagcuu

SEQ ID NO: 1527224 - RNA, 19 nt, Homo sapiens
ucaaggugacuucuauuuc

SEQ ID NO: 1527225 - RNA, 19 nt, Homo sapiens
ugagagagagagagagaga

SEQ ID NO: 1527226 - RNA, 19 nt, Homo sapiens
aaacacgaugagcuuauuu

SEQ ID NO: 1527227 - RNA, 19 nt, Homo sapiens
cauuucacuccacuuguua

SEQ ID NO: 1527228 - RNA, 19 nt, Homo sapiens
ugagugaacagaggacaaa

SEQ ID NO: 1527229 - RNA, 19 nt, Homo sapiens
gcagucagggagagacaga

SEQ ID NO: 1527230 - RNA, 19 nt, Homo sapiens
ccacuaccaggcacccuuu

SEQ ID NO: 1527231 - RNA, 19 nt, Homo sapiens
agagaagagugagcagaga

SEQ ID NO: 1527232 - RNA, 19 nt, Homo sapiens
ccacacugggcuggaaaua

SEQ ID NO: 1527233 - RNA, 19 nt, Homo sapiens
agagugagcagagagauug

SEQ ID NO: 1527234 - RNA, 19 nt, Homo sapiens
caaaggguuuuccauuuca

SEQ ID NO: 1527235 - RNA, 19 nt, Homo sapiens
ccaggcacccuuuagaaca

SEQ ID NO: 1527236 - RNA, 19 nt, Homo sapiens
gucuauaccagcaugagua

SEQ ID NO: 1527237 - RNA, 19 nt, Homo sapiens
ccacagaccgagguacaga

SEQ ID NO: 1527238 - RNA, 19 nt, Homo sapiens
gccaaacacgaugagcuua

SEQ ID NO: 1527239 - RNA, 19 nt, Homo sapiens
gaggcacuuucgaguaucu

SEQ ID NO: 1527240 - RNA, 19 nt, Homo sapiens
gaacagcagaugagaaaag

SEQ ID NO: 1527241 - RNA, 19 nt, Homo sapiens
gaaaccuggcuccaaccaa

SEQ ID NO: 1527242 - RNA, 19 nt, Homo sapiens
agagagagagagagauaga

SEQ ID NO: 1527243 - RNA, 19 nt, Homo sapiens
gucggcugcuuccagagua

SEQ ID NO: 1527244 - RNA, 19 nt, Homo sapiens
agacgagccagaaguacaa

SEQ ID NO: 1527245 - RNA, 19 nt, Homo sapiens
agagaagagagaagaguga

SEQ ID NO: 1527246 - RNA, 19 nt, Homo sapiens
acacuucuccugcccugaa

SEQ ID NO: 1527247 - RNA, 19 nt, Homo sapiens
aaagugcuugagucuauuu

SEQ ID NO: 1527248 - RNA, 19 nt, Homo sapiens
guagaucauggaccacaga

SEQ ID NO: 1527249 - RNA, 19 nt, Homo sapiens
uaccaggcacccuuuagaa

SEQ ID NO: 1527250 - RNA, 19 nt, Homo sapiens
gagccagaaguacaaggaa

SEQ ID NO: 1527251 - RNA, 19 nt, Homo sapiens
gaagagugagcagagagau

SEQ ID NO: 1527252 - RNA, 19 nt, Homo sapiens
cauaaagugcuugagucua

SEQ ID NO: 1527253 - RNA, 19 nt, Homo sapiens
gaguaagcagucuuuaugg

SEQ ID NO: 1527254 - RNA, 19 nt, Homo sapiens
ggugacuucuauuucuauc

SEQ ID NO: 1527255 - RNA, 19 nt, Homo sapiens
cuaccaggcacccuuuaga

SEQ ID NO: 1527256 - RNA, 19 nt, Homo sapiens
ccagaguaagcagucuuua

SEQ ID NO: 1527257 - RNA, 19 nt, Homo sapiens
gaccacagaacagcagaug

SEQ ID NO: 1527258 - RNA, 19 nt, Homo sapiens
ggaagaaggugaaggagaa

SEQ ID NO: 1527259 - RNA, 19 nt, Homo sapiens
ggaacaagccuauaauaaa

SEQ ID NO: 1527260 - RNA, 19 nt, Homo sapiens
gcacgaaucugaucacaca

SEQ ID NO: 1527261 - RNA, 19 nt, Homo sapiens
guacugaaccugcugauaa

SEQ ID NO: 1527262 - RNA, 19 nt, Homo sapiens
gcucuggacuccuaaauuc

SEQ ID NO: 1527263 - RNA, 19 nt, Homo sapiens
caaggcagguugcagguuu

SEQ ID NO: 1527264 - RNA, 19 nt, Homo sapiens
caauuugucugauuuagga

SEQ ID NO: 1527265 - RNA, 19 nt, Homo sapiens
ccaggaagcuuacaauuuu

SEQ ID NO: 1527266 - RNA, 19 nt, Homo sapiens
ggaagaagaaagagaagaa

SEQ ID NO: 1527267 - RNA, 19 nt, Homo sapiens
gaagaaagagaagaagaaa

SEQ ID NO: 1527268 - RNA, 19 nt, Homo sapiens
cagcaccucuguauccuuu

SEQ ID NO: 1527269 - RNA, 19 nt, Homo sapiens
gaauuucacggcacuguuu

SEQ ID NO: 1527270 - RNA, 19 nt, Homo sapiens
ccuaaugucuccuacagaa

SEQ ID NO: 1527271 - RNA, 19 nt, Homo sapiens
gcagcagccuacgcuaaua

SEQ ID NO: 1527272 - RNA, 19 nt, Homo sapiens
guucuuacccugcuucuuu

SEQ ID NO: 1527273 - RNA, 19 nt, Homo sapiens
ugaaggagaagcuaaguaa

SEQ ID NO: 1527274 - RNA, 19 nt, Homo sapiens
gaucacacacuacaacuug

SEQ ID NO: 1527275 - RNA, 19 nt, Homo sapiens
uaaauacccuagaguucuu

SEQ ID NO: 1527276 - RNA, 19 nt, Homo sapiens
ccaguuaaguuccguaugg

SEQ ID NO: 1527277 - RNA, 19 nt, Homo sapiens
uaggaccacuggacucuuu

SEQ ID NO: 1527278 - RNA, 19 nt, Homo sapiens
ucauaacaguagaggauuu

SEQ ID NO: 1527279 - RNA, 19 nt, Homo sapiens
gaagaaaccaauguacugu

SEQ ID NO: 1527280 - RNA, 19 nt, Homo sapiens
gaagaagaauaagcacaag

SEQ ID NO: 1527281 - RNA, 19 nt, Homo sapiens
cgaaucugaucacacacua

SEQ ID NO: 1527282 - RNA, 19 nt, Homo sapiens
ugaagaagaaaccaaugua

SEQ ID NO: 1527283 - RNA, 19 nt, Homo sapiens
uggaacaagccuauaauaa

SEQ ID NO: 1527284 - RNA, 19 nt, Homo sapiens
aggguacgauggagaauuu

SEQ ID NO: 1527285 - RNA, 19 nt, Homo sapiens
gaagaagaaaccaauguac

SEQ ID NO: 1527286 - RNA, 19 nt, Homo sapiens
gguaaacccaguuaaguuc

SEQ ID NO: 1527287 - RNA, 19 nt, Homo sapiens
ggagcagugucgucugaug

SEQ ID NO: 1527288 - RNA, 19 nt, Homo sapiens
agucuucagugguucauaa

SEQ ID NO: 1527289 - RNA, 19 nt, Homo sapiens
agaauaagcacaagcacaa

SEQ ID NO: 1527290 - RNA, 19 nt, Homo sapiens
ccaagaagaagaauaagca

SEQ ID NO: 1527291 - RNA, 19 nt, Homo sapiens
uacugaaccugcugauaaa

SEQ ID NO: 1527292 - RNA, 19 nt, Homo sapiens
aaaggaagaagaaagagaa

SEQ ID NO: 1527293 - RNA, 19 nt, Homo sapiens
ggaaaaggaagaagaaaga

SEQ ID NO: 1527294 - RNA, 19 nt, Homo sapiens
cucaguagcucuuucaauc

SEQ ID NO: 1527295 - RNA, 19 nt, Homo sapiens
cccaggaagcuuacaauuu

SEQ ID NO: 1527296 - RNA, 19 nt, Homo sapiens
agaagaaagagaagaagaa

SEQ ID NO: 1527297 - RNA, 19 nt, Homo sapiens
ccuguagucuucagugguu

SEQ ID NO: 1527298 - RNA, 19 nt, Homo sapiens
caguugagacuaaguaaau

SEQ ID NO: 1527299 - RNA, 19 nt, Homo sapiens
guucauaacaguagaggau

SEQ ID NO: 1527300 - RNA, 19 nt, Homo sapiens
gaauaagcacaagcacaaa

SEQ ID NO: 1527301 - RNA, 19 nt, Homo sapiens
agaaacaccaucugauuca

SEQ ID NO: 1527302 - RNA, 19 nt, Homo sapiens
gcaccucuguauccuuucu

SEQ ID NO: 1527303 - RNA, 19 nt, Homo sapiens
cagcagcagccuacgcuaa

SEQ ID NO: 1527304 - RNA, 19 nt, Homo sapiens
uauccuuucuggccauuug

SEQ ID NO: 1527305 - RNA, 19 nt, Homo sapiens
agaagaagaauaagcacaa

SEQ ID NO: 1527306 - RNA, 19 nt, Homo sapiens
ccggagcagugucgucuga

SEQ ID NO: 1527307 - RNA, 19 nt, Homo sapiens
ugugcaauuugucugauuu

SEQ ID NO: 1527308 - RNA, 19 nt, Homo sapiens
uagaggauuuugagcuuua

SEQ ID NO: 1527309 - RNA, 19 nt, Homo sapiens
aauaaauucugugggaaga

SEQ ID NO: 1527310 - RNA, 19 nt, Homo sapiens
guagcucuuucaauccuau

SEQ ID NO: 1527311 - RNA, 19 nt, Homo sapiens
gccacaacccagugaguuu

SEQ ID NO: 1527312 - RNA, 19 nt, Homo sapiens
gaacggaaaaggaagaaga

SEQ ID NO: 1527313 - RNA, 19 nt, Homo sapiens
agaggauccugaacggaaa

SEQ ID NO: 1527314 - RNA, 19 nt, Homo sapiens
aauguacuguggucucuug

SEQ ID NO: 1527315 - RNA, 19 nt, Homo sapiens
gugcaauuugucugauuua

SEQ ID NO: 1527316 - RNA, 19 nt, Homo sapiens
gaaggugaaggagaagcua

SEQ ID NO: 1527317 - RNA, 19 nt, Homo sapiens
agaagaaaccaauguacug

SEQ ID NO: 1527318 - RNA, 19 nt, Homo sapiens
guagaguagaggccuauug

SEQ ID NO: 1527319 - RNA, 19 nt, Homo sapiens
gaagaagaaagagaagaag

SEQ ID NO: 1527320 - RNA, 19 nt, Homo sapiens
agagagagggacaugcuuu

SEQ ID NO: 1527321 - RNA, 19 nt, Homo sapiens
gugaaggagaagcuaagua

SEQ ID NO: 1527322 - RNA, 19 nt, Homo sapiens
acaggcagcacgaaucuga

SEQ ID NO: 1527323 - RNA, 19 nt, Homo sapiens
ggagagagagggacaugcu

SEQ ID NO: 1527324 - RNA, 19 nt, Homo sapiens
cagaucacaagaagaagaa

SEQ ID NO: 1527325 - RNA, 19 nt, Homo sapiens
auucagaucacaagaagaa

SEQ ID NO: 1527326 - RNA, 19 nt, Homo sapiens
cugccugguucccaugaua

SEQ ID NO: 1527327 - RNA, 19 nt, Homo sapiens
gcaauuugucugauuuagg

SEQ ID NO: 1527328 - RNA, 19 nt, Homo sapiens
ccuaaauacccuagaguuc

SEQ ID NO: 1527329 - RNA, 19 nt, Homo sapiens
ucagaucacaagaagaaga

SEQ ID NO: 1527330 - RNA, 19 nt, Homo sapiens
ccaauguacuguggucucu

SEQ ID NO: 1527331 - RNA, 19 nt, Homo sapiens
agagggacaugcuuuugua

SEQ ID NO: 1527332 - RNA, 19 nt, Homo sapiens
cuaaauacccuagaguucu

SEQ ID NO: 1527333 - RNA, 19 nt, Homo sapiens
ccagguaaacccaguuaag

SEQ ID NO: 1527334 - RNA, 19 nt, Homo sapiens
cauauucagccucccaaga

SEQ ID NO: 1527335 - RNA, 19 nt, Homo sapiens
gaggguacgauggagaauu

SEQ ID NO: 1527336 - RNA, 19 nt, Homo sapiens
aaaagaagguagaguagag

SEQ ID NO: 1527337 - RNA, 19 nt, Homo sapiens
ugccagggaugauugaucu

SEQ ID NO: 1527338 - RNA, 19 nt, Homo sapiens
agccuccgcucucucauug

SEQ ID NO: 1527339 - RNA, 19 nt, Homo sapiens
ucuagcagcaccucuguau

SEQ ID NO: 1527340 - RNA, 19 nt, Homo sapiens
uaaauuccccugaagaaga

SEQ ID NO: 1527341 - RNA, 19 nt, Homo sapiens
uaccuaaugucuccuacag

SEQ ID NO: 1527342 - RNA, 19 nt, Homo sapiens
ggauuuuccuguagucuuc

SEQ ID NO: 1527343 - RNA, 19 nt, Homo sapiens
uuggaacaagccuauaaua

SEQ ID NO: 1527344 - RNA, 19 nt, Homo sapiens
cagguaaacccaguuaagu

SEQ ID NO: 1527345 - RNA, 19 nt, Homo sapiens
auauucagccucccaagaa

SEQ ID NO: 1527346 - RNA, 19 nt, Homo sapiens
gagagagagggacaugcuu

SEQ ID NO: 1527347 - RNA, 19 nt, Homo sapiens
guccagaccacccagguau

SEQ ID NO: 1527348 - RNA, 19 nt, Homo sapiens
aagaagaaagagaagaaga

SEQ ID NO: 1527349 - RNA, 19 nt, Homo sapiens
uguggucucuugggacuug

SEQ ID NO: 1527350 - RNA, 19 nt, Homo sapiens
cucccaagaagaagaauaa

SEQ ID NO: 1527351 - RNA, 19 nt, Homo sapiens
agugucgucugaugcauau

SEQ ID NO: 1527352 - RNA, 19 nt, Homo sapiens
gagaauuucacggcacugu

SEQ ID NO: 1527353 - RNA, 19 nt, Homo sapiens
ccacaacccagugaguuuc

SEQ ID NO: 1527354 - RNA, 19 nt, Homo sapiens
gaaggagaagcuaaguaac

SEQ ID NO: 1527355 - RNA, 19 nt, Homo sapiens
gugggaagaaggugaagga

SEQ ID NO: 1527356 - RNA, 19 nt, Homo sapiens
agaagaauaagcacaagca

SEQ ID NO: 1527357 - RNA, 19 nt, Homo sapiens
ucaguugagacuaaguaaa

SEQ ID NO: 1527358 - RNA, 19 nt, Homo sapiens
gcaauuaccugcacuuuca

SEQ ID NO: 1527359 - RNA, 19 nt, Homo sapiens
uaaaggaggucaucacaga

SEQ ID NO: 1527360 - RNA, 19 nt, Homo sapiens
ugucaaagaugaaacagua

SEQ ID NO: 1527361 - RNA, 19 nt, Homo sapiens
gaaaagauguugcugacua

SEQ ID NO: 1527362 - RNA, 19 nt, Homo sapiens
gaaaguaggcacuaaagga

SEQ ID NO: 1527363 - RNA, 19 nt, Homo sapiens
gagaagcagugacaggauu

SEQ ID NO: 1527364 - RNA, 19 nt, Homo sapiens
gagguacccuggcagcaua

SEQ ID NO: 1527365 - RNA, 19 nt, Homo sapiens
aaacacgaguucaucagua

SEQ ID NO: 1527366 - RNA, 19 nt, Homo sapiens
cagcgacacucucuacaaa

SEQ ID NO: 1527367 - RNA, 19 nt, Homo sapiens
ugacuacuaugaacaaaug

SEQ ID NO: 1527368 - RNA, 19 nt, Homo sapiens
gacuacaccuaaagaaauu

SEQ ID NO: 1527369 - RNA, 19 nt, Homo sapiens
aaacaacgacuacaccuaa

SEQ ID NO: 1527370 - RNA, 19 nt, Homo sapiens
uaaauaagacuccucaugu

SEQ ID NO: 1527371 - RNA, 19 nt, Homo sapiens
ccacuuccauucugcauau

SEQ ID NO: 1527372 - RNA, 19 nt, Homo sapiens
gugcaaauccgaagaauuc

SEQ ID NO: 1527373 - RNA, 19 nt, Homo sapiens
acaagcaaauguagaaaga

SEQ ID NO: 1527374 - RNA, 19 nt, Homo sapiens
gaaauuccuucuugauagg

SEQ ID NO: 1527375 - RNA, 19 nt, Homo sapiens
gaaacaacgacuacaccua

SEQ ID NO: 1527376 - RNA, 19 nt, Homo sapiens
ccuggcagcauaaauauua

SEQ ID NO: 1527377 - RNA, 19 nt, Homo sapiens
caggauugcugcucaucua

SEQ ID NO: 1527378 - RNA, 19 nt, Homo sapiens
gcuaaaagcuggaaucauc

SEQ ID NO: 1527379 - RNA, 19 nt, Homo sapiens
guucaucaguaaagaggua

SEQ ID NO: 1527380 - RNA, 19 nt, Homo sapiens
gaagagaaacaacgacuac

SEQ ID NO: 1527381 - RNA, 19 nt, Homo sapiens
ccaugucucuuaaggaguu

SEQ ID NO: 1527382 - RNA, 19 nt, Homo sapiens
uaaaguacuugugcaaauc

SEQ ID NO: 1527383 - RNA, 19 nt, Homo sapiens
ggauugagagggauaaugu

SEQ ID NO: 1527384 - RNA, 19 nt, Homo sapiens
gguauggccugcuccuuca

SEQ ID NO: 1527385 - RNA, 19 nt, Homo sapiens
gcgacacucucuacaaagu

SEQ ID NO: 1527386 - RNA, 19 nt, Homo sapiens
cgacuacaccuaaagaaau

SEQ ID NO: 1527387 - RNA, 19 nt, Homo sapiens
ccacuggaaccucuucuuu

SEQ ID NO: 1527388 - RNA, 19 nt, Homo sapiens
ggacccggcaacauuuaua

SEQ ID NO: 1527389 - RNA, 19 nt, Homo sapiens
uauaauagacccauacaca

SEQ ID NO: 1527390 - RNA, 19 nt, Homo sapiens
gggauaaugugcccauguc

SEQ ID NO: 1527391 - RNA, 19 nt, Homo sapiens
cacacaaacucauaaacug

SEQ ID NO: 1527392 - RNA, 19 nt, Homo sapiens
gacacucucuacaaaguuc

SEQ ID NO: 1527393 - RNA, 19 nt, Homo sapiens
caacgacuacaccuaaaga

SEQ ID NO: 1527394 - RNA, 19 nt, Homo sapiens
uuauguaucucgacgaugu

SEQ ID NO: 1527395 - RNA, 19 nt, Homo sapiens
aaauaagacuccucauguc

SEQ ID NO: 1527396 - RNA, 19 nt, Homo sapiens
aacacgaguucaucaguaa

SEQ ID NO: 1527397 - RNA, 19 nt, Homo sapiens
gaaacaucaccuaggagaa

SEQ ID NO: 1527398 - RNA, 19 nt, Homo sapiens
agauguugcugacuacuau

SEQ ID NO: 1527399 - RNA, 19 nt, Homo sapiens
uaagacuccucauguccuu

SEQ ID NO: 1527400 - RNA, 19 nt, Homo sapiens
ggcaacauuuauaaacaug

SEQ ID NO: 1527401 - RNA, 19 nt, Homo sapiens
caaauccgaagaauucaug

SEQ ID NO: 1527402 - RNA, 19 nt, Homo sapiens
cucauaaacugucacucua

SEQ ID NO: 1527403 - RNA, 19 nt, Homo sapiens
uagauuauauuggccaugu

SEQ ID NO: 1527404 - RNA, 19 nt, Homo sapiens
ggacaggugcgugacagaa

SEQ ID NO: 1527405 - RNA, 19 nt, Homo sapiens
acacaucacucuggauucu

SEQ ID NO: 1527406 - RNA, 19 nt, Homo sapiens
uaauagacccauacacauc

SEQ ID NO: 1527407 - RNA, 19 nt, Homo sapiens
acaucacucuggauucuga

SEQ ID NO: 1527408 - RNA, 19 nt, Homo sapiens
ccaaguugcaccugaccua

SEQ ID NO: 1527409 - RNA, 19 nt, Homo sapiens
uuugaaacaucaccuagga

SEQ ID NO: 1527410 - RNA, 19 nt, Homo sapiens
acaaauguuucagucaguu

SEQ ID NO: 1527411 - RNA, 19 nt, Homo sapiens
uacccuggcagcauaaaua

SEQ ID NO: 1527412 - RNA, 19 nt, Homo sapiens
aagcuggaaucaucuggaa

SEQ ID NO: 1527413 - RNA, 19 nt, Homo sapiens
ggaguuugugcuacuuaaa

SEQ ID NO: 1527414 - RNA, 19 nt, Homo sapiens
ggccugcuccuucacguuu

SEQ ID NO: 1527415 - RNA, 19 nt, Homo sapiens
cauguauaauagacccaua

SEQ ID NO: 1527416 - RNA, 19 nt, Homo sapiens
gacccggcaacauuuauaa

SEQ ID NO: 1527417 - RNA, 19 nt, Homo sapiens
ucauggacccggcaacauu

SEQ ID NO: 1527418 - RNA, 19 nt, Homo sapiens
uggcauguuucagugauaa

SEQ ID NO: 1527419 - RNA, 19 nt, Homo sapiens
caaauguuucagucaguuu

SEQ ID NO: 1527420 - RNA, 19 nt, Homo sapiens
gaguuugugcuacuuaaau

SEQ ID NO: 1527421 - RNA, 19 nt, Homo sapiens
aaugugcccaugucucuua

SEQ ID NO: 1527422 - RNA, 19 nt, Homo sapiens
cggcaacauuuauaaacau

SEQ ID NO: 1527423 - RNA, 19 nt, Homo sapiens
cuaaaggaccaggcgauaa

SEQ ID NO: 1527424 - RNA, 19 nt, Homo sapiens
ccggcaacauuuauaaaca

SEQ ID NO: 1527425 - RNA, 19 nt, Homo sapiens
ucacacaaacucauaaacu

SEQ ID NO: 1527426 - RNA, 19 nt, Homo sapiens
uggccaagauacaagcaaa

SEQ ID NO: 1527427 - RNA, 19 nt, Homo sapiens
ccagaacaaaucauaaagu

SEQ ID NO: 1527428 - RNA, 19 nt, Homo sapiens
cuaugaaaguaggcacuaa

SEQ ID NO: 1527429 - RNA, 19 nt, Homo sapiens
aaacugucacucuaccuuu

SEQ ID NO: 1527430 - RNA, 19 nt, Homo sapiens
caagucccacguagcaauu

SEQ ID NO: 1527431 - RNA, 19 nt, Homo sapiens
uaccugcacuuucaagaag

SEQ ID NO: 1527432 - RNA, 19 nt, Homo sapiens
cauggacccggcaacauuu

SEQ ID NO: 1527433 - RNA, 19 nt, Homo sapiens
uaaaggaccaggcgauaac

SEQ ID NO: 1527434 - RNA, 19 nt, Homo sapiens
uaaggaguuugugcuacuu

SEQ ID NO: 1527435 - RNA, 19 nt, Homo sapiens
cauaaaguacuugugcaaa

SEQ ID NO: 1527436 - RNA, 19 nt, Homo sapiens
caucacagauuuucucaca

SEQ ID NO: 1527437 - RNA, 19 nt, Homo sapiens
ggagaagcagugacaggau

SEQ ID NO: 1527438 - RNA, 19 nt, Homo sapiens
gcugacuacuaugaacaaa

SEQ ID NO: 1527439 - RNA, 19 nt, Homo sapiens
auaaauaagacuccucaug

SEQ ID NO: 1527440 - RNA, 19 nt, Homo sapiens
ucaagaagagaaacaacga

SEQ ID NO: 1527441 - RNA, 19 nt, Homo sapiens
uaugaaaguaggcacuaaa

SEQ ID NO: 1527442 - RNA, 19 nt, Homo sapiens
gauuauauuggccauguca

SEQ ID NO: 1527443 - RNA, 19 nt, Homo sapiens
aaacaucaccuaggagaag

SEQ ID NO: 1527444 - RNA, 19 nt, Homo sapiens
auacacaucacucuggauu

SEQ ID NO: 1527445 - RNA, 19 nt, Homo sapiens
gcaaauccgaagaauucau

SEQ ID NO: 1527446 - RNA, 19 nt, Homo sapiens
ccucccagaacaaaucaua

SEQ ID NO: 1527447 - RNA, 19 nt, Homo sapiens
aggaccaggcgauaacuua

SEQ ID NO: 1527448 - RNA, 19 nt, Homo sapiens
uaaacugucacucuaccuu

SEQ ID NO: 1527449 - RNA, 19 nt, Homo sapiens
acacaaacucauaaacugu

SEQ ID NO: 1527450 - RNA, 19 nt, Homo sapiens
aggaggucaucacagauuu

SEQ ID NO: 1527451 - RNA, 19 nt, Homo sapiens
uuaaggaguuugugcuacu

SEQ ID NO: 1527452 - RNA, 19 nt, Homo sapiens
gugauaaaaguuccaguua

SEQ ID NO: 1527453 - RNA, 19 nt, Homo sapiens
ggagccugauggaggacaa

SEQ ID NO: 1527454 - RNA, 19 nt, Homo sapiens
aacaacgacuacaccuaaa

SEQ ID NO: 1527455 - RNA, 19 nt, Homo sapiens
ucccagaacaaaucauaaa

SEQ ID NO: 1527456 - RNA, 19 nt, Homo sapiens
acaaacucauaaacuguca

SEQ ID NO: 1527457 - RNA, 19 nt, Homo sapiens
gccaagauacaagcaaaug

SEQ ID NO: 1527458 - RNA, 19 nt, Homo sapiens
ggaaauauccuaaaucuga

SEQ ID NO: 1527459 - RNA, 19 nt, Homo sapiens
gaaggaaacuacacucuga

SEQ ID NO: 1527460 - RNA, 19 nt, Homo sapiens
gaaagagcauuuauugauc

SEQ ID NO: 1527461 - RNA, 19 nt, Homo sapiens
gcaaaugaauacgcuuaua

SEQ ID NO: 1527462 - RNA, 19 nt, Homo sapiens
guaugucacucaaagaaua

SEQ ID NO: 1527463 - RNA, 19 nt, Homo sapiens
ggaaagagcauuuauugau

SEQ ID NO: 1527464 - RNA, 19 nt, Homo sapiens
ggaccuggcuuuacuggaa

SEQ ID NO: 1527465 - RNA, 19 nt, Homo sapiens
gauagcagcuggagaggaa

SEQ ID NO: 1527466 - RNA, 19 nt, Homo sapiens
gagcagcuguuguucauga

SEQ ID NO: 1527467 - RNA, 19 nt, Homo sapiens
gcacagaagcuccuagaaa

SEQ ID NO: 1527468 - RNA, 19 nt, Homo sapiens
gaaggcaaaucucuuuaug

SEQ ID NO: 1527469 - RNA, 19 nt, Homo sapiens
gaggagggaugguguuuga

SEQ ID NO: 1527470 - RNA, 19 nt, Homo sapiens
gacaaaagguugaagauaa

SEQ ID NO: 1527471 - RNA, 19 nt, Homo sapiens
gaaaugaagacauacaguu

SEQ ID NO: 1527472 - RNA, 19 nt, Homo sapiens
gagacucuguauugaauuu

SEQ ID NO: 1527473 - RNA, 19 nt, Homo sapiens
cacaggaaaugaagacaua

SEQ ID NO: 1527474 - RNA, 19 nt, Homo sapiens
gcagagcacgguauacuaa

SEQ ID NO: 1527475 - RNA, 19 nt, Homo sapiens
gaaauugcuuccaaguuca

SEQ ID NO: 1527476 - RNA, 19 nt, Homo sapiens
aaagggaaauucucucuga

SEQ ID NO: 1527477 - RNA, 19 nt, Homo sapiens
gaauuugugugguauguca

SEQ ID NO: 1527478 - RNA, 19 nt, Homo sapiens
gagcauuuauugauccauu

SEQ ID NO: 1527479 - RNA, 19 nt, Homo sapiens
agaaauugcuuccaaguuc

SEQ ID NO: 1527480 - RNA, 19 nt, Homo sapiens
ccaaugaagugacgagaau

SEQ ID NO: 1527481 - RNA, 19 nt, Homo sapiens
gaagacauacaguuuauca

SEQ ID NO: 1527482 - RNA, 19 nt, Homo sapiens
ccaaaggagucauucucua

SEQ ID NO: 1527483 - RNA, 19 nt, Homo sapiens
guauugaauuuguguggua

SEQ ID NO: 1527484 - RNA, 19 nt, Homo sapiens
aggcaaaucucuuuaugaa

SEQ ID NO: 1527485 - RNA, 19 nt, Homo sapiens
gcagagacuuugagugaag

SEQ ID NO: 1527486 - RNA, 19 nt, Homo sapiens
gaaguagccuaagaggauu

SEQ ID NO: 1527487 - RNA, 19 nt, Homo sapiens
ugacgagaauuuacaaugu

SEQ ID NO: 1527488 - RNA, 19 nt, Homo sapiens
caaaguguccuacaauguu

SEQ ID NO: 1527489 - RNA, 19 nt, Homo sapiens
gaagauaaaguucuaguac

SEQ ID NO: 1527490 - RNA, 19 nt, Homo sapiens
uuacagaaauugcuuccaa

SEQ ID NO: 1527491 - RNA, 19 nt, Homo sapiens
aagaaaguaugcugacaaa

SEQ ID NO: 1527492 - RNA, 19 nt, Homo sapiens
ugacucaucuauagaagga

SEQ ID NO: 1527493 - RNA, 19 nt, Homo sapiens
uaugaaacauccacaggaa

SEQ ID NO: 1527494 - RNA, 19 nt, Homo sapiens
gguugaagauaaaguucua

SEQ ID NO: 1527495 - RNA, 19 nt, Homo sapiens
guggaaauauccuaaaucu

SEQ ID NO: 1527496 - RNA, 19 nt, Homo sapiens
gaugugaagagacagauuu

SEQ ID NO: 1527497 - RNA, 19 nt, Homo sapiens
gauauuaccaaaucuggaa

SEQ ID NO: 1527498 - RNA, 19 nt, Homo sapiens
ugaaguagccuaagaggau

SEQ ID NO: 1527499 - RNA, 19 nt, Homo sapiens
uggcguggcuuauauuaau

SEQ ID NO: 1527500 - RNA, 19 nt, Homo sapiens
agaccuagaagaacaauuu

SEQ ID NO: 1527501 - RNA, 19 nt, Homo sapiens
ugagugaaguagccuaaga

SEQ ID NO: 1527502 - RNA, 19 nt, Homo sapiens
gcgagagacuccaggacuu

SEQ ID NO: 1527503 - RNA, 19 nt, Homo sapiens
gaaaguaugcugacaaaau

SEQ ID NO: 1527504 - RNA, 19 nt, Homo sapiens
gacgagaauuuacaaugug

SEQ ID NO: 1527505 - RNA, 19 nt, Homo sapiens
gagcguggcguggcuuaua

SEQ ID NO: 1527506 - RNA, 19 nt, Homo sapiens
gaagugacgagaauuuaca

SEQ ID NO: 1527507 - RNA, 19 nt, Homo sapiens
gcacauccacucuaccaau

SEQ ID NO: 1527508 - RNA, 19 nt, Homo sapiens
ccaguuggauacuaugaug

SEQ ID NO: 1527509 - RNA, 19 nt, Homo sapiens
cagcaaaugaauacgcuua

SEQ ID NO: 1527510 - RNA, 19 nt, Homo sapiens
aagcugggaugcagaagaa

SEQ ID NO: 1527511 - RNA, 19 nt, Homo sapiens
uggcuuuacuggaaacuuu

SEQ ID NO: 1527512 - RNA, 19 nt, Homo sapiens
caaaugaauacgcuuauag

SEQ ID NO: 1527513 - RNA, 19 nt, Homo sapiens
gaugcucuguuugauauug

SEQ ID NO: 1527514 - RNA, 19 nt, Homo sapiens
gaauuuggucuucuugguu

SEQ ID NO: 1527515 - RNA, 19 nt, Homo sapiens
aagcaacccaauauuguua

SEQ ID NO: 1527516 - RNA, 19 nt, Homo sapiens
caaauugggaucuggaaau

SEQ ID NO: 1527517 - RNA, 19 nt, Homo sapiens
caaauacucacuaccacaa

SEQ ID NO: 1527518 - RNA, 19 nt, Homo sapiens
caagcagccacaacaagua

SEQ ID NO: 1527519 - RNA, 19 nt, Homo sapiens
ugagcuagccaauuccaua

SEQ ID NO: 1527520 - RNA, 19 nt, Homo sapiens
cagcggcuauccacuguau

SEQ ID NO: 1527521 - RNA, 19 nt, Homo sapiens
ggcagaggauaauucaaga

SEQ ID NO: 1527522 - RNA, 19 nt, Homo sapiens
cacagaagcuccuagaaaa

SEQ ID NO: 1527523 - RNA, 19 nt, Homo sapiens
gaauuuaugaugcucuguu

SEQ ID NO: 1527524 - RNA, 19 nt, Homo sapiens
uuaaauaucaccucacugu

SEQ ID NO: 1527525 - RNA, 19 nt, Homo sapiens
guggagaccuagaagaaca

SEQ ID NO: 1527526 - RNA, 19 nt, Homo sapiens
aaaguguccuacaauguug

SEQ ID NO: 1527527 - RNA, 19 nt, Homo sapiens
gaaggguggagaccuagaa

SEQ ID NO: 1527528 - RNA, 19 nt, Homo sapiens
ugugauagguacucucaga

SEQ ID NO: 1527529 - RNA, 19 nt, Homo sapiens
cagguuacccagcaaauga

SEQ ID NO: 1527530 - RNA, 19 nt, Homo sapiens
agacccugcugacuacuuu

SEQ ID NO: 1527531 - RNA, 19 nt, Homo sapiens
cugcagagacuuugaguga

SEQ ID NO: 1527532 - RNA, 19 nt, Homo sapiens
gcuagccaauuccauagug

SEQ ID NO: 1527533 - RNA, 19 nt, Homo sapiens
gcaaauugggaucuggaaa

SEQ ID NO: 1527534 - RNA, 19 nt, Homo sapiens
aaggaaggguggagaccua

SEQ ID NO: 1527535 - RNA, 19 nt, Homo sapiens
gaccuggcuuuacuggaaa

SEQ ID NO: 1527536 - RNA, 19 nt, Homo sapiens
gcguggaaauauccuaaau

SEQ ID NO: 1527537 - RNA, 19 nt, Homo sapiens
ccagacgguuggaaucuuc

SEQ ID NO: 1527538 - RNA, 19 nt, Homo sapiens
caaaagcaacccaauauug

SEQ ID NO: 1527539 - RNA, 19 nt, Homo sapiens
uaagaaaguaugcugacaa

SEQ ID NO: 1527540 - RNA, 19 nt, Homo sapiens
uguuugagcuagccaauuc

SEQ ID NO: 1527541 - RNA, 19 nt, Homo sapiens
gggcagaggauaauucaag

SEQ ID NO: 1527542 - RNA, 19 nt, Homo sapiens
ugaaacauccacaggaaau

SEQ ID NO: 1527543 - RNA, 19 nt, Homo sapiens
gaaacugugaggagcuuug

SEQ ID NO: 1527544 - RNA, 19 nt, Homo sapiens
gaguggagcagcuguuguu

SEQ ID NO: 1527545 - RNA, 19 nt, Homo sapiens
aaauugggaucuggaaaug

SEQ ID NO: 1527546 - RNA, 19 nt, Homo sapiens
auucaagacuccuucaaga

SEQ ID NO: 1527547 - RNA, 19 nt, Homo sapiens
cauccacucuaccaaugaa

SEQ ID NO: 1527548 - RNA, 19 nt, Homo sapiens
gauacuaugaugcacagaa

SEQ ID NO: 1527549 - RNA, 19 nt, Homo sapiens
aaucugauguucugaggau

SEQ ID NO: 1527550 - RNA, 19 nt, Homo sapiens
ccauuaggguuaccagaca

SEQ ID NO: 1527551 - RNA, 19 nt, Homo sapiens
cauaugaguugguggaaaa

SEQ ID NO: 1527552 - RNA, 19 nt, Homo sapiens
ggguggagaccuagaagaa

SEQ ID NO: 1527553 - RNA, 19 nt, Homo sapiens
agauaaaguucuaguacuc

SEQ ID NO: 1527554 - RNA, 19 nt, Homo sapiens
caaaggagucauucucuac

SEQ ID NO: 1527555 - RNA, 19 nt, Homo sapiens
cuggaaagagcauuuauug

SEQ ID NO: 1527556 - RNA, 19 nt, Homo sapiens
ggaaaugaagacauacagu

SEQ ID NO: 1527557 - RNA, 19 nt, Homo sapiens
guaucacagugucuaugaa

SEQ ID NO: 1527558 - RNA, 19 nt, Homo sapiens
gaaggaaucucauuugaua

SEQ ID NO: 1527559 - RNA, 19 nt, Homo sapiens
ggaauggauuucucuauua

SEQ ID NO: 1527560 - RNA, 19 nt, Homo sapiens
gaaauaggaccaacacauu

SEQ ID NO: 1527561 - RNA, 19 nt, Homo sapiens
cauaacagccucugaauuu

SEQ ID NO: 1527562 - RNA, 19 nt, Homo sapiens
gaacugagcaagugauaga

SEQ ID NO: 1527563 - RNA, 19 nt, Homo sapiens
agacauggauccuuuaguu

SEQ ID NO: 1527564 - RNA, 19 nt, Homo sapiens
gaagaaggaaucucauuug

SEQ ID NO: 1527565 - RNA, 19 nt, Homo sapiens
ggaagaaggaaucucauuu

SEQ ID NO: 1527566 - RNA, 19 nt, Homo sapiens
ggagagugaugcuaaacuu

SEQ ID NO: 1527567 - RNA, 19 nt, Homo sapiens
gauaggaacugagcaagug

SEQ ID NO: 1527568 - RNA, 19 nt, Homo sapiens
gagguuggaucaagaacaa

SEQ ID NO: 1527569 - RNA, 19 nt, Homo sapiens
ggaagaaauugugauagga

SEQ ID NO: 1527570 - RNA, 19 nt, Homo sapiens
ccucagacauggauccuuu

SEQ ID NO: 1527571 - RNA, 19 nt, Homo sapiens
gaagaaauugugauaggaa

SEQ ID NO: 1527572 - RNA, 19 nt, Homo sapiens
caaauccggucuccgaaga

SEQ ID NO: 1527573 - RNA, 19 nt, Homo sapiens
caaggagagugaugcuaaa

SEQ ID NO: 1527574 - RNA, 19 nt, Homo sapiens
gagaaguuauggcugaaau

SEQ ID NO: 1527575 - RNA, 19 nt, Homo sapiens
ggaagaggccuuuaaugca

SEQ ID NO: 1527576 - RNA, 19 nt, Homo sapiens
aagaaggaaucucauuuga

SEQ ID NO: 1527577 - RNA, 19 nt, Homo sapiens
gggaagaaauugugauagg

SEQ ID NO: 1527578 - RNA, 19 nt, Homo sapiens
ggacuggaauaucuuugau

SEQ ID NO: 1527579 - RNA, 19 nt, Homo sapiens
ugauagagguugucaaguc

SEQ ID NO: 1527580 - RNA, 19 nt, Homo sapiens
gaagagguuggaucaagaa

SEQ ID NO: 1527581 - RNA, 19 nt, Homo sapiens
ugaagagguuggaucaaga

SEQ ID NO: 1527582 - RNA, 19 nt, Homo sapiens
gcauucagaccgagauaaa

SEQ ID NO: 1527583 - RNA, 19 nt, Homo sapiens
gauagagguugucaagucu

SEQ ID NO: 1527584 - RNA, 19 nt, Homo sapiens
auaacagccucugaauuua

SEQ ID NO: 1527585 - RNA, 19 nt, Homo sapiens
augcuaaacuucacagaaa

SEQ ID NO: 1527586 - RNA, 19 nt, Homo sapiens
ggccuuuaaugcacgaaua

SEQ ID NO: 1527587 - RNA, 19 nt, Homo sapiens
cuagcuaugucacuucaaa

SEQ ID NO: 1527588 - RNA, 19 nt, Homo sapiens
aggaauggauuucucuauu

SEQ ID NO: 1527589 - RNA, 19 nt, Homo sapiens
uuuaaaggaugccauucua

SEQ ID NO: 1527590 - RNA, 19 nt, Homo sapiens
gaaguuauggcugaaauag

SEQ ID NO: 1527591 - RNA, 19 nt, Homo sapiens
gcaccaaguguaaugagaa

SEQ ID NO: 1527592 - RNA, 19 nt, Homo sapiens
uaacagccucugaauuuau

SEQ ID NO: 1527593 - RNA, 19 nt, Homo sapiens
auacggaaaugaagagguu

SEQ ID NO: 1527594 - RNA, 19 nt, Homo sapiens
acaaggagagugaugcuaa

SEQ ID NO: 1527595 - RNA, 19 nt, Homo sapiens
gcugaaaacugagaauauu

SEQ ID NO: 1527596 - RNA, 19 nt, Homo sapiens
cagcuuauuucaacacuac

SEQ ID NO: 1527597 - RNA, 19 nt, Homo sapiens
ggaccaacacauucgcaaa

SEQ ID NO: 1527598 - RNA, 19 nt, Homo sapiens
uggaucaagucacagauga

SEQ ID NO: 1527599 - RNA, 19 nt, Homo sapiens
aaucagugcuggaucaagu

SEQ ID NO: 1527600 - RNA, 19 nt, Homo sapiens
cagggaagaaauugugaua

SEQ ID NO: 1527601 - RNA, 19 nt, Homo sapiens
aguuauggcugaaauagga

SEQ ID NO: 1527602 - RNA, 19 nt, Homo sapiens
gaauuuauugcaccaagug

SEQ ID NO: 1527603 - RNA, 19 nt, Homo sapiens
gaugcuaaacuucacagaa

SEQ ID NO: 1527604 - RNA, 19 nt, Homo sapiens
gcuauacgaguuuauguuc

SEQ ID NO: 1527605 - RNA, 19 nt, Homo sapiens
acuacaagcuauacgaguu

SEQ ID NO: 1527606 - RNA, 19 nt, Homo sapiens
uaaaaucagugcuggauca

SEQ ID NO: 1527607 - RNA, 19 nt, Homo sapiens
ggauuucucuauuauucag

SEQ ID NO: 1527608 - RNA, 19 nt, Homo sapiens
cgucgugucuccaucacuu

SEQ ID NO: 1527609 - RNA, 19 nt, Homo sapiens
gaggaauggauuucucuau

SEQ ID NO: 1527610 - RNA, 19 nt, Homo sapiens
uacaagcuauacgaguuua

SEQ ID NO: 1527611 - RNA, 19 nt, Homo sapiens
aacagccucugaauuuauu

SEQ ID NO: 1527612 - RNA, 19 nt, Homo sapiens
aaaggaugccauucuacua

SEQ ID NO: 1527613 - RNA, 19 nt, Homo sapiens
ugauaguccuuugacguuu

SEQ ID NO: 1527614 - RNA, 19 nt, Homo sapiens
ugaaauaggaccaacacau

SEQ ID NO: 1527615 - RNA, 19 nt, Homo sapiens
uaaaauggcuuggagaagu

SEQ ID NO: 1527616 - RNA, 19 nt, Homo sapiens
ccauaacagccucugaauu

SEQ ID NO: 1527617 - RNA, 19 nt, Homo sapiens
gaaaaccaagcccaacuuu

SEQ ID NO: 1527618 - RNA, 19 nt, Homo sapiens
gaaauugugauaggaacug

SEQ ID NO: 1527619 - RNA, 19 nt, Homo sapiens
cuacaagcuauacgaguuu

SEQ ID NO: 1527620 - RNA, 19 nt, Homo sapiens
uuucaacacuacaagcuau

SEQ ID NO: 1527621 - RNA, 19 nt, Homo sapiens
gauaguccuuugacguuuu

SEQ ID NO: 1527622 - RNA, 19 nt, Homo sapiens
gacauggauccuuuaguug

SEQ ID NO: 1527623 - RNA, 19 nt, Homo sapiens
aauauuggauacggaaaug

SEQ ID NO: 1527624 - RNA, 19 nt, Homo sapiens
acuggaauaucuuugaugu

SEQ ID NO: 1527625 - RNA, 19 nt, Homo sapiens
agugaggacuggaauaucu

SEQ ID NO: 1527626 - RNA, 19 nt, Homo sapiens
cacuacauauguccuuaga

SEQ ID NO: 1527627 - RNA, 19 nt, Homo sapiens
ucccaaauccucuggaaga

SEQ ID NO: 1527628 - RNA, 19 nt, Homo sapiens
uaucucccaucccauaaca

SEQ ID NO: 1527629 - RNA, 19 nt, Homo sapiens
ugacuuuacuagcuauguc

SEQ ID NO: 1527630 - RNA, 19 nt, Homo sapiens
aaaugaagagguuggauca

SEQ ID NO: 1527631 - RNA, 19 nt, Homo sapiens
ggagaaguuauggcugaaa

SEQ ID NO: 1527632 - RNA, 19 nt, Homo sapiens
gggcuagaggaauggauuu

SEQ ID NO: 1527633 - RNA, 19 nt, Homo sapiens
aaacaagccaaugcuauca

SEQ ID NO: 1527634 - RNA, 19 nt, Homo sapiens
aaauaggaccaacacauuc

SEQ ID NO: 1527635 - RNA, 19 nt, Homo sapiens
gagagugaugcuaaacuuc

SEQ ID NO: 1527636 - RNA, 19 nt, Homo sapiens
uaaaggaugccauucuacu

SEQ ID NO: 1527637 - RNA, 19 nt, Homo sapiens
caauauuggauacggaaau

SEQ ID NO: 1527638 - RNA, 19 nt, Homo sapiens
cccaaauccucuggaagaa

SEQ ID NO: 1527639 - RNA, 19 nt, Homo sapiens
cauguggcccuuucccaaa

SEQ ID NO: 1527640 - RNA, 19 nt, Homo sapiens
caagcuauacgaguuuaug

SEQ ID NO: 1527641 - RNA, 19 nt, Homo sapiens
ugaauuuauugcaccaagu

SEQ ID NO: 1527642 - RNA, 19 nt, Homo sapiens
gcuaucucccaucccauaa

SEQ ID NO: 1527643 - RNA, 19 nt, Homo sapiens
gagcgucgugucuccauca

SEQ ID NO: 1527644 - RNA, 19 nt, Homo sapiens
gcuaaacuucacagaaaca

SEQ ID NO: 1527645 - RNA, 19 nt, Homo sapiens
agaaguuauggcugaaaua

SEQ ID NO: 1527646 - RNA, 19 nt, Homo sapiens
cuagaggaauggauuucuc

SEQ ID NO: 1527647 - RNA, 19 nt, Homo sapiens
uacaggaagaggccuuuaa

SEQ ID NO: 1527648 - RNA, 19 nt, Homo sapiens
aacacuacauauguccuua

SEQ ID NO: 1527649 - RNA, 19 nt, Homo sapiens
aaacuucacagaaacaaac

SEQ ID NO: 1527650 - RNA, 19 nt, Homo sapiens
caggaagaggccuuuaaug

SEQ ID NO: 1527651 - RNA, 19 nt, Homo sapiens
acaggaagaggccuuuaau

SEQ ID NO: 1527652 - RNA, 19 nt, Homo sapiens
agaccgagauaaacgaaaa

SEQ ID NO: 1527653 - RNA, 19 nt, Homo sapiens
agagugaggacuggaauau

SEQ ID NO: 1527654 - RNA, 19 nt, Homo sapiens
uuuauugcaccaaguguaa

SEQ ID NO: 1527655 - RNA, 19 nt, Homo sapiens
agagugaugcuaaacuuca

SEQ ID NO: 1527656 - RNA, 19 nt, Homo sapiens
uggaagaaggaaucucauu

SEQ ID NO: 1527657 - RNA, 19 nt, Homo sapiens
aaaauggcuuggagaaguu

SEQ ID NO: 1527658 - RNA, 19 nt, Homo sapiens
gaacugggucucuugauuu

SEQ ID NO: 1527659 - RNA, 19 nt, Homo sapiens
gaguuacagugaaguguua

SEQ ID NO: 1527660 - RNA, 19 nt, Homo sapiens
aaagugaccuugccaguga

SEQ ID NO: 1527661 - RNA, 19 nt, Homo sapiens
gcacuaaauugacugugaa

SEQ ID NO: 1527662 - RNA, 19 nt, Homo sapiens
caggugccauugagaauua

SEQ ID NO: 1527663 - RNA, 19 nt, Homo sapiens
gaaauucaguguuuaccau

SEQ ID NO: 1527664 - RNA, 19 nt, Homo sapiens
gaccucggcucaagucuuu

SEQ ID NO: 1527665 - RNA, 19 nt, Homo sapiens
gcaagagaauaucaaacaa

SEQ ID NO: 1527666 - RNA, 19 nt, Homo sapiens
gggaagcuauaauucgaua

SEQ ID NO: 1527667 - RNA, 19 nt, Homo sapiens
agacuugaaucuacucuaa

SEQ ID NO: 1527668 - RNA, 19 nt, Homo sapiens
gcgagggccugacuccaua

SEQ ID NO: 1527669 - RNA, 19 nt, Homo sapiens
acaaagauuucuggaagua

SEQ ID NO: 1527670 - RNA, 19 nt, Homo sapiens
gaacuacauucagaaggaa

SEQ ID NO: 1527671 - RNA, 19 nt, Homo sapiens
gcaagguccugggcuacua

SEQ ID NO: 1527672 - RNA, 19 nt, Homo sapiens
guagacagcauauuauuca

SEQ ID NO: 1527673 - RNA, 19 nt, Homo sapiens
ggaaauauugucuacauag

SEQ ID NO: 1527674 - RNA, 19 nt, Homo sapiens
ggccacaggugcacuaaau

SEQ ID NO: 1527675 - RNA, 19 nt, Homo sapiens
caacaaaggacacuacauc

SEQ ID NO: 1527676 - RNA, 19 nt, Homo sapiens
gcuguguccuggagcuuua

SEQ ID NO: 1527677 - RNA, 19 nt, Homo sapiens
ucacaacacugaauuuggu

SEQ ID NO: 1527678 - RNA, 19 nt, Homo sapiens
aauccaaccucacuacauu

SEQ ID NO: 1527679 - RNA, 19 nt, Homo sapiens
ccacugcccugccaucugu

SEQ ID NO: 1527680 - RNA, 19 nt, Homo sapiens
gaaauauagccucuucaug

SEQ ID NO: 1527681 - RNA, 19 nt, Homo sapiens
gagcagagggcccauuuca

SEQ ID NO: 1527682 - RNA, 19 nt, Homo sapiens
ugacaucacuggcauugca

SEQ ID NO: 1527683 - RNA, 19 nt, Homo sapiens
cggcucgccuauagaaaua

SEQ ID NO: 1527684 - RNA, 19 nt, Homo sapiens
ugaaguugguacauaauuc

SEQ ID NO: 1527685 - RNA, 19 nt, Homo sapiens
agaacugggucucuugauu

SEQ ID NO: 1527686 - RNA, 19 nt, Homo sapiens
acagaaugcuggagagaug

SEQ ID NO: 1527687 - RNA, 19 nt, Homo sapiens
gaggauaacaaacagcauu

SEQ ID NO: 1527688 - RNA, 19 nt, Homo sapiens
gacagcauauuauucaagu

SEQ ID NO: 1527689 - RNA, 19 nt, Homo sapiens
gcaauucuuuaagccauau

SEQ ID NO: 1527690 - RNA, 19 nt, Homo sapiens
gagagcagagggcccauuu

SEQ ID NO: 1527691 - RNA, 19 nt, Homo sapiens
gaguuauacuugacacaga

SEQ ID NO: 1527692 - RNA, 19 nt, Homo sapiens
ugaaucuacucuaaacgaa

SEQ ID NO: 1527693 - RNA, 19 nt, Homo sapiens
ccacugaggauaacaaaca

SEQ ID NO: 1527694 - RNA, 19 nt, Homo sapiens
caagaaaugagccugaaau

SEQ ID NO: 1527695 - RNA, 19 nt, Homo sapiens
ccacaggugcacuaaauug

SEQ ID NO: 1527696 - RNA, 19 nt, Homo sapiens
caaaggacacuacaucaag

SEQ ID NO: 1527697 - RNA, 19 nt, Homo sapiens
cauacccucugagcacuua

SEQ ID NO: 1527698 - RNA, 19 nt, Homo sapiens
gguuugcccuguauggaaa

SEQ ID NO: 1527699 - RNA, 19 nt, Homo sapiens
caaacaaagauuucuggaa

SEQ ID NO: 1527700 - RNA, 19 nt, Homo sapiens
ggcaagagaauaucaaaca

SEQ ID NO: 1527701 - RNA, 19 nt, Homo sapiens
caauaguucuacuugugaa

SEQ ID NO: 1527702 - RNA, 19 nt, Homo sapiens
cagcgugucuguucuagca

SEQ ID NO: 1527703 - RNA, 19 nt, Homo sapiens
guucuuguccuguauuuau

SEQ ID NO: 1527704 - RNA, 19 nt, Homo sapiens
aauauguucuuguccugua

SEQ ID NO: 1527705 - RNA, 19 nt, Homo sapiens
gagcaacaguguguacaag

SEQ ID NO: 1527706 - RNA, 19 nt, Homo sapiens
gggcaggagugcaucaagu

SEQ ID NO: 1527707 - RNA, 19 nt, Homo sapiens
guauuaaguagacagcaua

SEQ ID NO: 1527708 - RNA, 19 nt, Homo sapiens
gaaagugugugguuuuagu

SEQ ID NO: 1527709 - RNA, 19 nt, Homo sapiens
ggugagcagccuuguauug

SEQ ID NO: 1527710 - RNA, 19 nt, Homo sapiens
gaagcuauaauucgauaca

SEQ ID NO: 1527711 - RNA, 19 nt, Homo sapiens
gggaaagugugugguuuua

SEQ ID NO: 1527712 - RNA, 19 nt, Homo sapiens
aaacagcauuguaauccau

SEQ ID NO: 1527713 - RNA, 19 nt, Homo sapiens
acauaauucugaugaggaa

SEQ ID NO: 1527714 - RNA, 19 nt, Homo sapiens
agaaggaaauauugucuac

SEQ ID NO: 1527715 - RNA, 19 nt, Homo sapiens
aaagauggagugaguguau

SEQ ID NO: 1527716 - RNA, 19 nt, Homo sapiens
ggaguuacagugaaguguu

SEQ ID NO: 1527717 - RNA, 19 nt, Homo sapiens
auagaaauauagccucuuc

SEQ ID NO: 1527718 - RNA, 19 nt, Homo sapiens
gcucuguuguucugggauu

SEQ ID NO: 1527719 - RNA, 19 nt, Homo sapiens
ccaccagacugccuuaggu

SEQ ID NO: 1527720 - RNA, 19 nt, Homo sapiens
gagaggcgcugagcaacag

SEQ ID NO: 1527721 - RNA, 19 nt, Homo sapiens
gcucuuagcguccuugucu

SEQ ID NO: 1527722 - RNA, 19 nt, Homo sapiens
gaguacaagugucccaagu

SEQ ID NO: 1527723 - RNA, 19 nt, Homo sapiens
gggauggcauuccguugug

SEQ ID NO: 1527724 - RNA, 19 nt, Homo sapiens
guccuugucuugugugugu

SEQ ID NO: 1527725 - RNA, 19 nt, Homo sapiens
gaaguugguacauaauucu

SEQ ID NO: 1527726 - RNA, 19 nt, Homo sapiens
guugggagauaaugguguu

SEQ ID NO: 1527727 - RNA, 19 nt, Homo sapiens
gcacugcuaaagagaaugu

SEQ ID NO: 1527728 - RNA, 19 nt, Homo sapiens
ucaccgagcacuucucaga

SEQ ID NO: 1527729 - RNA, 19 nt, Homo sapiens
cagcuuauuugacuaacca

SEQ ID NO: 1527730 - RNA, 19 nt, Homo sapiens
caaacagcauuguaaucca

SEQ ID NO: 1527731 - RNA, 19 nt, Homo sapiens
aagggaagcuauaauucga

SEQ ID NO: 1527732 - RNA, 19 nt, Homo sapiens
ucaauaguucuacuuguga

SEQ ID NO: 1527733 - RNA, 19 nt, Homo sapiens
ggacaaucgcuugcaguug

SEQ ID NO: 1527734 - RNA, 19 nt, Homo sapiens
gaaaaugcuuuguacaacu

SEQ ID NO: 1527735 - RNA, 19 nt, Homo sapiens
ccaguugccuuuuguauuc

SEQ ID NO: 1527736 - RNA, 19 nt, Homo sapiens
caggagggcaagagaauau

SEQ ID NO: 1527737 - RNA, 19 nt, Homo sapiens
cauuucagcucuguuguuc

SEQ ID NO: 1527738 - RNA, 19 nt, Homo sapiens
gcacagaaugcuggagaga

SEQ ID NO: 1527739 - RNA, 19 nt, Homo sapiens
gccucuucaugcuguauua

SEQ ID NO: 1527740 - RNA, 19 nt, Homo sapiens
acuaugcuuuggucuguaa

SEQ ID NO: 1527741 - RNA, 19 nt, Homo sapiens
gcgcugagcaacagugugu

SEQ ID NO: 1527742 - RNA, 19 nt, Homo sapiens
gaugggaaagugugugguu

SEQ ID NO: 1527743 - RNA, 19 nt, Homo sapiens
gaacuccugggccaacaug

SEQ ID NO: 1527744 - RNA, 19 nt, Homo sapiens
caacgacuaacccugaaau

SEQ ID NO: 1527745 - RNA, 19 nt, Homo sapiens
gcaccuucuucuucuuauc

SEQ ID NO: 1527746 - RNA, 19 nt, Homo sapiens
gcauuguaauccauucucu

SEQ ID NO: 1527747 - RNA, 19 nt, Homo sapiens
ggagaggcgcugagcaaca

SEQ ID NO: 1527748 - RNA, 19 nt, Homo sapiens
uuacuaugcuuuggucugu

SEQ ID NO: 1527749 - RNA, 19 nt, Homo sapiens
gugcagagccagccaccuu

SEQ ID NO: 1527750 - RNA, 19 nt, Homo sapiens
cauccuaccgcacugcuaa

SEQ ID NO: 1527751 - RNA, 19 nt, Homo sapiens
ugcacuaaauugacuguga

SEQ ID NO: 1527752 - RNA, 19 nt, Homo sapiens
gcuccgacgucuccgaagu

SEQ ID NO: 1527753 - RNA, 19 nt, Homo sapiens
caccagcccuccagcaucu

SEQ ID NO: 1527754 - RNA, 19 nt, Homo sapiens
caccugugcuucaacaaag

SEQ ID NO: 1527755 - RNA, 19 nt, Homo sapiens
gggacaaucgcuugcaguu

SEQ ID NO: 1527756 - RNA, 19 nt, Homo sapiens
uggagacaauaauuuccua

SEQ ID NO: 1527757 - RNA, 19 nt, Homo sapiens
ggccucaguuuccccauua

SEQ ID NO: 1527758 - RNA, 19 nt, Homo sapiens
gaacacagcuauacaggaa

SEQ ID NO: 1527759 - RNA, 19 nt, Homo sapiens
ggaaguagaacuagcuuua

SEQ ID NO: 1527760 - RNA, 19 nt, Homo sapiens
gacaauauccuacccauuu

SEQ ID NO: 1527761 - RNA, 19 nt, Homo sapiens
cugaauaucuuugcucuua

SEQ ID NO: 1527762 - RNA, 19 nt, Homo sapiens
aaacaggguugguuauauu

SEQ ID NO: 1527763 - RNA, 19 nt, Homo sapiens
uaaaggaaauggugcaaug

SEQ ID NO: 1527764 - RNA, 19 nt, Homo sapiens
uaucgugguuuaucucuua

SEQ ID NO: 1527765 - RNA, 19 nt, Homo sapiens
ugccaaacauuauaccuua

SEQ ID NO: 1527766 - RNA, 19 nt, Homo sapiens
ggucugaugccuacuauuu

SEQ ID NO: 1527767 - RNA, 19 nt, Homo sapiens
uuacaagcauuuaggagua

SEQ ID NO: 1527768 - RNA, 19 nt, Homo sapiens
gaaggugguuucuuuggau

SEQ ID NO: 1527769 - RNA, 19 nt, Homo sapiens
ggaaauggugcaaugauga

SEQ ID NO: 1527770 - RNA, 19 nt, Homo sapiens
ugaagaagcuggacauggu

SEQ ID NO: 1527771 - RNA, 19 nt, Homo sapiens
ggaaggugguuucuuugga

SEQ ID NO: 1527772 - RNA, 19 nt, Homo sapiens
gaacugcuuaccauacuuu

SEQ ID NO: 1527773 - RNA, 19 nt, Homo sapiens
uaaacaggguugguuauau

SEQ ID NO: 1527774 - RNA, 19 nt, Homo sapiens
gaaguagaacuagcuuuaa

SEQ ID NO: 1527775 - RNA, 19 nt, Homo sapiens
cuacgaagcugggaauuuc

SEQ ID NO: 1527776 - RNA, 19 nt, Homo sapiens
cagcaguuaucuguacuua

SEQ ID NO: 1527777 - RNA, 19 nt, Homo sapiens
gaugauuugcucuauagua

SEQ ID NO: 1527778 - RNA, 19 nt, Homo sapiens
acacuucuuuccuucauuu

SEQ ID NO: 1527779 - RNA, 19 nt, Homo sapiens
gcagguaugacagcaguua

SEQ ID NO: 1527780 - RNA, 19 nt, Homo sapiens
gcaauagcgcagacaauau

SEQ ID NO: 1527781 - RNA, 19 nt, Homo sapiens
gcaguuaucuguacuuacc

SEQ ID NO: 1527782 - RNA, 19 nt, Homo sapiens
gcaauaugaagacguagaa

SEQ ID NO: 1527783 - RNA, 19 nt, Homo sapiens
acacagcuauacaggaauu

SEQ ID NO: 1527784 - RNA, 19 nt, Homo sapiens
caacuaguucuuccaugua

SEQ ID NO: 1527785 - RNA, 19 nt, Homo sapiens
ucaacuaguucuuccaugu

SEQ ID NO: 1527786 - RNA, 19 nt, Homo sapiens
aaauaaacaggguugguua

SEQ ID NO: 1527787 - RNA, 19 nt, Homo sapiens
gucaugcuguucaaaguuu

SEQ ID NO: 1527788 - RNA, 19 nt, Homo sapiens
aaucagaacugcuuaccau

SEQ ID NO: 1527789 - RNA, 19 nt, Homo sapiens
ucacaaaucagaacugcuu

SEQ ID NO: 1527790 - RNA, 19 nt, Homo sapiens
ccaaagugcugggauuaca

SEQ ID NO: 1527791 - RNA, 19 nt, Homo sapiens
guacuuacccucuugacau

SEQ ID NO: 1527792 - RNA, 19 nt, Homo sapiens
ggucaugugcacagauuaa

SEQ ID NO: 1527793 - RNA, 19 nt, Homo sapiens
caugaaaccccacuuaaua

SEQ ID NO: 1527794 - RNA, 19 nt, Homo sapiens
aaaggacucuaucgugguu

SEQ ID NO: 1527795 - RNA, 19 nt, Homo sapiens
aagucuugcucaaauguua

SEQ ID NO: 1527796 - RNA, 19 nt, Homo sapiens
caucagacaauccuaaugu

SEQ ID NO: 1527797 - RNA, 19 nt, Homo sapiens
auaugcagguguuucauuu

SEQ ID NO: 1527798 - RNA, 19 nt, Homo sapiens
gaaauggugcaaugaugau

SEQ ID NO: 1527799 - RNA, 19 nt, Homo sapiens
ugaagacguagaaauguaa

SEQ ID NO: 1527800 - RNA, 19 nt, Homo sapiens
gaaacagccagcauugaca

SEQ ID NO: 1527801 - RNA, 19 nt, Homo sapiens
cacaagagccacugguauu

SEQ ID NO: 1527802 - RNA, 19 nt, Homo sapiens
acaauauccuacccauuug

SEQ ID NO: 1527803 - RNA, 19 nt, Homo sapiens
caggucaugugcacagauu

SEQ ID NO: 1527804 - RNA, 19 nt, Homo sapiens
uuauggcauuugagcauua

SEQ ID NO: 1527805 - RNA, 19 nt, Homo sapiens
gaggcgggauggaggaguu

SEQ ID NO: 1527806 - RNA, 19 nt, Homo sapiens
gaggucugaugccuacuau

SEQ ID NO: 1527807 - RNA, 19 nt, Homo sapiens
gugcaaugaugauucgaau

SEQ ID NO: 1527808 - RNA, 19 nt, Homo sapiens
uaugaaguaugucuaugga

SEQ ID NO: 1527809 - RNA, 19 nt, Homo sapiens
caauccaguuuauggcauu

SEQ ID NO: 1527810 - RNA, 19 nt, Homo sapiens
gaagacguagaaauguaaa

SEQ ID NO: 1527811 - RNA, 19 nt, Homo sapiens
augaagacguagaaaugua

SEQ ID NO: 1527812 - RNA, 19 nt, Homo sapiens
uuuguuaucucucuucuca

SEQ ID NO: 1527813 - RNA, 19 nt, Homo sapiens
caauagcgcagacaauauc

SEQ ID NO: 1527814 - RNA, 19 nt, Homo sapiens
cuaagcugaugcuggcuaa

SEQ ID NO: 1527815 - RNA, 19 nt, Homo sapiens
aaacacuucuuuccuucau

SEQ ID NO: 1527816 - RNA, 19 nt, Homo sapiens
uauuuacccugucacaaga

SEQ ID NO: 1527817 - RNA, 19 nt, Homo sapiens
cgugguuuaucucuuaauu

SEQ ID NO: 1527818 - RNA, 19 nt, Homo sapiens
cgaaugcaauuaggaacug

SEQ ID NO: 1527819 - RNA, 19 nt, Homo sapiens
gaacuccugaccucaagug

SEQ ID NO: 1527820 - RNA, 19 nt, Homo sapiens
ucuggaagcugaggugaga

SEQ ID NO: 1527821 - RNA, 19 nt, Homo sapiens
gaaggggccugagcaguga

SEQ ID NO: 1527822 - RNA, 19 nt, Homo sapiens
ucacuugagcccuggaauu

SEQ ID NO: 1527823 - RNA, 19 nt, Homo sapiens
gagguugccauuagcuuug

SEQ ID NO: 1527824 - RNA, 19 nt, Homo sapiens
uucaagagguugccauuag

SEQ ID NO: 1527825 - RNA, 19 nt, Homo sapiens
guucaagagguugccauua

SEQ ID NO: 1527826 - RNA, 19 nt, Homo sapiens
ccaaacauuauaccuuaga

SEQ ID NO: 1527827 - RNA, 19 nt, Homo sapiens
aacuaguucuuccauguaa

SEQ ID NO: 1527828 - RNA, 19 nt, Homo sapiens
gagguacuaugagugacuu

SEQ ID NO: 1527829 - RNA, 19 nt, Homo sapiens
cagaacugcuuaccauacu

SEQ ID NO: 1527830 - RNA, 19 nt, Homo sapiens
ucacaagagccacugguau

SEQ ID NO: 1527831 - RNA, 19 nt, Homo sapiens
aggacucuaucgugguuua

SEQ ID NO: 1527832 - RNA, 19 nt, Homo sapiens
aagcucacaaucaccauua

SEQ ID NO: 1527833 - RNA, 19 nt, Homo sapiens
agugcaauaugaagacgua

SEQ ID NO: 1527834 - RNA, 19 nt, Homo sapiens
uaugagguacuaugaguga

SEQ ID NO: 1527835 - RNA, 19 nt, Homo sapiens
aaagguagccauguagaga

SEQ ID NO: 1527836 - RNA, 19 nt, Homo sapiens
acaagagccacugguauuu

SEQ ID NO: 1527837 - RNA, 19 nt, Homo sapiens
ggacaccauggaauucgaa

SEQ ID NO: 1527838 - RNA, 19 nt, Homo sapiens
gagcaauagcgcagacaau

SEQ ID NO: 1527839 - RNA, 19 nt, Homo sapiens
ucugaugccuacuauuuua

SEQ ID NO: 1527840 - RNA, 19 nt, Homo sapiens
auucgaaucuuucccuaug

SEQ ID NO: 1527841 - RNA, 19 nt, Homo sapiens
ucuaagguauuaugaugca

SEQ ID NO: 1527842 - RNA, 19 nt, Homo sapiens
aagagccacugguauuuua

SEQ ID NO: 1527843 - RNA, 19 nt, Homo sapiens
aggaaauggugcaaugaug

SEQ ID NO: 1527844 - RNA, 19 nt, Homo sapiens
uaugaaacagccagcauug

SEQ ID NO: 1527845 - RNA, 19 nt, Homo sapiens
agcaauagcgcagacaaua

SEQ ID NO: 1527846 - RNA, 19 nt, Homo sapiens
ugagugacuuacauguguu

SEQ ID NO: 1527847 - RNA, 19 nt, Homo sapiens
ucucucuucucacaauuau

SEQ ID NO: 1527848 - RNA, 19 nt, Homo sapiens
gaaugcaauuaggaacugu

SEQ ID NO: 1527849 - RNA, 19 nt, Homo sapiens
cauaugcagguguuucauu

SEQ ID NO: 1527850 - RNA, 19 nt, Homo sapiens
cagcuauacaggaauuauu

SEQ ID NO: 1527851 - RNA, 19 nt, Homo sapiens
uguuaucucucuucucaca

SEQ ID NO: 1527852 - RNA, 19 nt, Homo sapiens
uaccuuagaacauugaaga

SEQ ID NO: 1527853 - RNA, 19 nt, Homo sapiens
caauauccuacccauuuga

SEQ ID NO: 1527854 - RNA, 19 nt, Homo sapiens
uaucuguacuuacccucuu

SEQ ID NO: 1527855 - RNA, 19 nt, Homo sapiens
auaugaagacguagaaaug

SEQ ID NO: 1527856 - RNA, 19 nt, Homo sapiens
gccagccuaugcaacauca

SEQ ID NO: 1527857 - RNA, 19 nt, Homo sapiens
gggcauguggucccagcua

SEQ ID NO: 1527858 - RNA, 19 nt, Homo sapiens
ggaguugccuuaaauguua

SEQ ID NO: 1527859 - RNA, 19 nt, Homo sapiens
gggaagaggugcauaaaga

SEQ ID NO: 1527860 - RNA, 19 nt, Homo sapiens
gugcauaucugguuauuug

SEQ ID NO: 1527861 - RNA, 19 nt, Homo sapiens
ggaagaauggguagaauaa

SEQ ID NO: 1527862 - RNA, 19 nt, Homo sapiens
guagacaccugaaacuaaa

SEQ ID NO: 1527863 - RNA, 19 nt, Homo sapiens
uaagaaagcagcuaugaaa

SEQ ID NO: 1527864 - RNA, 19 nt, Homo sapiens
gaugaaaggcuucuauuug

SEQ ID NO: 1527865 - RNA, 19 nt, Homo sapiens
ugucacaccugaauacaua

SEQ ID NO: 1527866 - RNA, 19 nt, Homo sapiens
agaagacacuguauacauu

SEQ ID NO: 1527867 - RNA, 19 nt, Homo sapiens
gaagacaacuuacaaaauc

SEQ ID NO: 1527868 - RNA, 19 nt, Homo sapiens
cauaacagcugguauagag

SEQ ID NO: 1527869 - RNA, 19 nt, Homo sapiens
gagcaugaauuaagagaca

SEQ ID NO: 1527870 - RNA, 19 nt, Homo sapiens
aaucuggccuuccuuuaua

SEQ ID NO: 1527871 - RNA, 19 nt, Homo sapiens
gaaacgaggaaauaaagaa

SEQ ID NO: 1527872 - RNA, 19 nt, Homo sapiens
gaagacacuguauacauuu

SEQ ID NO: 1527873 - RNA, 19 nt, Homo sapiens
gcaaaucccuagucuucau

SEQ ID NO: 1527874 - RNA, 19 nt, Homo sapiens
uaacuuagggcagauauaa

SEQ ID NO: 1527875 - RNA, 19 nt, Homo sapiens
caaccucgauacucuuauu

SEQ ID NO: 1527876 - RNA, 19 nt, Homo sapiens
gaagaaagggacggagaua

SEQ ID NO: 1527877 - RNA, 19 nt, Homo sapiens
gaacacgacauuggcauaa

SEQ ID NO: 1527878 - RNA, 19 nt, Homo sapiens
cagauucucucucucuuga

SEQ ID NO: 1527879 - RNA, 19 nt, Homo sapiens
aggaugagauguuuaggua

SEQ ID NO: 1527880 - RNA, 19 nt, Homo sapiens
ccacaacucacuaugcaua

SEQ ID NO: 1527881 - RNA, 19 nt, Homo sapiens
caaagaagauccgcaagca

SEQ ID NO: 1527882 - RNA, 19 nt, Homo sapiens
gaugagauguuuagguaag

SEQ ID NO: 1527883 - RNA, 19 nt, Homo sapiens
caaacuaacuccaaaucuc

SEQ ID NO: 1527884 - RNA, 19 nt, Homo sapiens
gaagaaagggaggcaguuu

SEQ ID NO: 1527885 - RNA, 19 nt, Homo sapiens
gcacuggucauauuguauu

SEQ ID NO: 1527886 - RNA, 19 nt, Homo sapiens
gaaacauucccauccauug

SEQ ID NO: 1527887 - RNA, 19 nt, Homo sapiens
uuucugagcuccacaaaug

SEQ ID NO: 1527888 - RNA, 19 nt, Homo sapiens
gacauuggcauaauugaaa

SEQ ID NO: 1527889 - RNA, 19 nt, Homo sapiens
gaacuggagacaagcauga

SEQ ID NO: 1527890 - RNA, 19 nt, Homo sapiens
gagagaaccugugguccuu

SEQ ID NO: 1527891 - RNA, 19 nt, Homo sapiens
caacagcacaacuuugaaa

SEQ ID NO: 1527892 - RNA, 19 nt, Homo sapiens
guuccaaaguacaucaaua

SEQ ID NO: 1527893 - RNA, 19 nt, Homo sapiens
gaaucuggccuuccuuuau

SEQ ID NO: 1527894 - RNA, 19 nt, Homo sapiens
ggucuacaguguuguccua

SEQ ID NO: 1527895 - RNA, 19 nt, Homo sapiens
ucugauuacuuuagccuua

SEQ ID NO: 1527896 - RNA, 19 nt, Homo sapiens
guaacacuguauaugauga

SEQ ID NO: 1527897 - RNA, 19 nt, Homo sapiens
gaagaaaugaaacaacuag

SEQ ID NO: 1527898 - RNA, 19 nt, Homo sapiens
caagaagacuaugaucguu

SEQ ID NO: 1527899 - RNA, 19 nt, Homo sapiens
uaacauagcaguacuuugc

SEQ ID NO: 1527900 - RNA, 19 nt, Homo sapiens
gagaagacacuguauacau

SEQ ID NO: 1527901 - RNA, 19 nt, Homo sapiens
ugaaaaggcucuccgauga

SEQ ID NO: 1527902 - RNA, 19 nt, Homo sapiens
uaaagaaagcccaagaaga

SEQ ID NO: 1527903 - RNA, 19 nt, Homo sapiens
ucacaucacauuuccauga

SEQ ID NO: 1527904 - RNA, 19 nt, Homo sapiens
gauauuaugcuuugaaguc

SEQ ID NO: 1527905 - RNA, 19 nt, Homo sapiens
aaugguugguugcuauuua

SEQ ID NO: 1527906 - RNA, 19 nt, Homo sapiens
caagaaugguugguugcua

SEQ ID NO: 1527907 - RNA, 19 nt, Homo sapiens
ggaagaggugcauaaagaa

SEQ ID NO: 1527908 - RNA, 19 nt, Homo sapiens
gugcauuuauaaccucaua

SEQ ID NO: 1527909 - RNA, 19 nt, Homo sapiens
uuauagcacuggucauauu

SEQ ID NO: 1527910 - RNA, 19 nt, Homo sapiens
aaacuuguccauaugagua

SEQ ID NO: 1527911 - RNA, 19 nt, Homo sapiens
ucugagaucugcacacaug

SEQ ID NO: 1527912 - RNA, 19 nt, Homo sapiens
gccuagaaaugaugcauau

SEQ ID NO: 1527913 - RNA, 19 nt, Homo sapiens
acacgacauuggcauaauu

SEQ ID NO: 1527914 - RNA, 19 nt, Homo sapiens
gaaaugaaacaacuagaac

SEQ ID NO: 1527915 - RNA, 19 nt, Homo sapiens
gaagaggugcauaaagaau

SEQ ID NO: 1527916 - RNA, 19 nt, Homo sapiens
uaaaagaacuggagacaag

SEQ ID NO: 1527917 - RNA, 19 nt, Homo sapiens
aaaugcagcugauaucauc

SEQ ID NO: 1527918 - RNA, 19 nt, Homo sapiens
gaacauuucaagcuuaugg

SEQ ID NO: 1527919 - RNA, 19 nt, Homo sapiens
gaauuuggaagccuuauag

SEQ ID NO: 1527920 - RNA, 19 nt, Homo sapiens
caugacauuugcaguuauu

SEQ ID NO: 1527921 - RNA, 19 nt, Homo sapiens
cccaugacauuugcaguua

SEQ ID NO: 1527922 - RNA, 19 nt, Homo sapiens
uagcacuggucauauugua

SEQ ID NO: 1527923 - RNA, 19 nt, Homo sapiens
gaagaauggguagaauaaa

SEQ ID NO: 1527924 - RNA, 19 nt, Homo sapiens
uaacuggcauucccauagu

SEQ ID NO: 1527925 - RNA, 19 nt, Homo sapiens
gagugggaguugccuuaaa

SEQ ID NO: 1527926 - RNA, 19 nt, Homo sapiens
gacaaauucucacuuacca

SEQ ID NO: 1527927 - RNA, 19 nt, Homo sapiens
gcuggaagaagaaaugaaa

SEQ ID NO: 1527928 - RNA, 19 nt, Homo sapiens
gggaagcagugaagaaagg

SEQ ID NO: 1527929 - RNA, 19 nt, Homo sapiens
guccauaugaguaucuuua

SEQ ID NO: 1527930 - RNA, 19 nt, Homo sapiens
ugaaaggcuucuauuugga

SEQ ID NO: 1527931 - RNA, 19 nt, Homo sapiens
gcaagcagaggcuggaaga

SEQ ID NO: 1527932 - RNA, 19 nt, Homo sapiens
gagaaccugugguccuuca

SEQ ID NO: 1527933 - RNA, 19 nt, Homo sapiens
agaagacuaugaucguuau

SEQ ID NO: 1527934 - RNA, 19 nt, Homo sapiens
aaagaaagcccaagaagac

SEQ ID NO: 1527935 - RNA, 19 nt, Homo sapiens
gugaaaugauugcuauaca

SEQ ID NO: 1527936 - RNA, 19 nt, Homo sapiens
uaaacugucuccaacacau

SEQ ID NO: 1527937 - RNA, 19 nt, Homo sapiens
ggaagaagaaaugaaacaa

SEQ ID NO: 1527938 - RNA, 19 nt, Homo sapiens
gaaagcccaagaagacuau

SEQ ID NO: 1527939 - RNA, 19 nt, Homo sapiens
caucagcucacaucacauu

SEQ ID NO: 1527940 - RNA, 19 nt, Homo sapiens
gcagcuaguuugacuuggu

SEQ ID NO: 1527941 - RNA, 19 nt, Homo sapiens
ccauacacauacauaccua

SEQ ID NO: 1527942 - RNA, 19 nt, Homo sapiens
gcaguuauucccagugaga

SEQ ID NO: 1527943 - RNA, 19 nt, Homo sapiens
caauaacgcaugauaccaa

SEQ ID NO: 1527944 - RNA, 19 nt, Homo sapiens
uaacagcugguauagagaa

SEQ ID NO: 1527945 - RNA, 19 nt, Homo sapiens
caucacauuuccaugacaa

SEQ ID NO: 1527946 - RNA, 19 nt, Homo sapiens
aagaauggguagaauaaag

SEQ ID NO: 1527947 - RNA, 19 nt, Homo sapiens
uuggacagcugaccaguga

SEQ ID NO: 1527948 - RNA, 19 nt, Homo sapiens
ugaggaugauuaaggagaa

SEQ ID NO: 1527949 - RNA, 19 nt, Homo sapiens
uaagcgaaacgaggaaaua

SEQ ID NO: 1527950 - RNA, 19 nt, Homo sapiens
gggaguugccuuaaauguu

SEQ ID NO: 1527951 - RNA, 19 nt, Homo sapiens
acucagggacccagacuua

SEQ ID NO: 1527952 - RNA, 19 nt, Homo sapiens
aagaaugguugguugcuau

SEQ ID NO: 1527953 - RNA, 19 nt, Homo sapiens
uagcauaccaaccucgaua

SEQ ID NO: 1527954 - RNA, 19 nt, Homo sapiens
cauugaggaugauuaagga

SEQ ID NO: 1527955 - RNA, 19 nt, Homo sapiens
gauccaacgugcucuucug

SEQ ID NO: 1527956 - RNA, 19 nt, Homo sapiens
caggacuaguuccaaagua

SEQ ID NO: 1527957 - RNA, 19 nt, Homo sapiens
gggacaaacaucugacuug

SEQ ID NO: 1527958 - RNA, 19 nt, Homo sapiens
gaagauaaaucagauguug

SEQ ID NO: 1527959 - RNA, 19 nt, Homo sapiens
gcaccaaacuguugccuuu

SEQ ID NO: 1527960 - RNA, 19 nt, Homo sapiens
caacgcugcuacaguauua

SEQ ID NO: 1527961 - RNA, 19 nt, Homo sapiens
ggaguuagaugucaugaau

SEQ ID NO: 1527962 - RNA, 19 nt, Homo sapiens
ugcaauaccuccuaucuua

SEQ ID NO: 1527963 - RNA, 19 nt, Homo sapiens
gaaauacuguucucagcaa

SEQ ID NO: 1527964 - RNA, 19 nt, Homo sapiens
gaaggaagcucugacaaag

SEQ ID NO: 1527965 - RNA, 19 nt, Homo sapiens
ggaaugcauuuacaacuug

SEQ ID NO: 1527966 - RNA, 19 nt, Homo sapiens
gcagaaaacucuacaauuc

SEQ ID NO: 1527967 - RNA, 19 nt, Homo sapiens
gaaguuaacguaucaggaa

SEQ ID NO: 1527968 - RNA, 19 nt, Homo sapiens
gauaaggagucucgaacaa

SEQ ID NO: 1527969 - RNA, 19 nt, Homo sapiens
ccaguaaagugcaaauauu

SEQ ID NO: 1527970 - RNA, 19 nt, Homo sapiens
uaauaaaccuccugucuag

SEQ ID NO: 1527971 - RNA, 19 nt, Homo sapiens
ggauuggaccaucuuauua

SEQ ID NO: 1527972 - RNA, 19 nt, Homo sapiens
gaacaaugcuaagagacaa

SEQ ID NO: 1527973 - RNA, 19 nt, Homo sapiens
ggauguguuugacccauua

SEQ ID NO: 1527974 - RNA, 19 nt, Homo sapiens
ccuacgggcuguacucuua

SEQ ID NO: 1527975 - RNA, 19 nt, Homo sapiens
ggacugaguuaagaaauuc

SEQ ID NO: 1527976 - RNA, 19 nt, Homo sapiens
gagcuaaacuucaagaacu

SEQ ID NO: 1527977 - RNA, 19 nt, Homo sapiens
gacaaaguauuucuucuuc

SEQ ID NO: 1527978 - RNA, 19 nt, Homo sapiens
gaagaaaugcuacuaugau

SEQ ID NO: 1527979 - RNA, 19 nt, Homo sapiens
aagagaaacuaccugauuu

SEQ ID NO: 1527980 - RNA, 19 nt, Homo sapiens
gcugacggccaaugaauua

SEQ ID NO: 1527981 - RNA, 19 nt, Homo sapiens
gaaauucacuguguacacu

SEQ ID NO: 1527982 - RNA, 19 nt, Homo sapiens
ugaagaaguuaacguauca

SEQ ID NO: 1527983 - RNA, 19 nt, Homo sapiens
uaaggagucucgaacaaug

SEQ ID NO: 1527984 - RNA, 19 nt, Homo sapiens
aaacaugucugcagaguac

SEQ ID NO: 1527985 - RNA, 19 nt, Homo sapiens
uaaagcaugugaagccauu

SEQ ID NO: 1527986 - RNA, 19 nt, Homo sapiens
ggacaaaguauuucuucuu

SEQ ID NO: 1527987 - RNA, 19 nt, Homo sapiens
uugaggaucuggcaaagua

SEQ ID NO: 1527988 - RNA, 19 nt, Homo sapiens
gaaagaggaggaagagguu

SEQ ID NO: 1527989 - RNA, 19 nt, Homo sapiens
aagaagaacucuauggaau

SEQ ID NO: 1527990 - RNA, 19 nt, Homo sapiens
ggaauccuggcuucuaaua

SEQ ID NO: 1527991 - RNA, 19 nt, Homo sapiens
ggauuuggaucucccauag

SEQ ID NO: 1527992 - RNA, 19 nt, Homo sapiens
gaagaacucuauggaaugc

SEQ ID NO: 1527993 - RNA, 19 nt, Homo sapiens
ccagcucgcuccagaagaa

SEQ ID NO: 1527994 - RNA, 19 nt, Homo sapiens
ggaagagguuaugguggua

SEQ ID NO: 1527995 - RNA, 19 nt, Homo sapiens
gauuggaccaucuuauuaa

SEQ ID NO: 1527996 - RNA, 19 nt, Homo sapiens
caugugaagccauuuauaa

SEQ ID NO: 1527997 - RNA, 19 nt, Homo sapiens
cuaagacauucuccaaauu

SEQ ID NO: 1527998 - RNA, 19 nt, Homo sapiens
acaagaaauucacugugua

SEQ ID NO: 1527999 - RNA, 19 nt, Homo sapiens
aagagaggcucaaacaaga

SEQ ID NO: 1528000 - RNA, 19 nt, Homo sapiens
aaagagaaacuaccugauu

SEQ ID NO: 1528001 - RNA, 19 nt, Homo sapiens
ugccaacgcugcuacagua

SEQ ID NO: 1528002 - RNA, 19 nt, Homo sapiens
uggcaaaccuaaccacuug

SEQ ID NO: 1528003 - RNA, 19 nt, Homo sapiens
ugaaggagcucugcuuaca

SEQ ID NO: 1528004 - RNA, 19 nt, Homo sapiens
uaaaccuccugucuaguaa

SEQ ID NO: 1528005 - RNA, 19 nt, Homo sapiens
cagguggacugaugaaguu

SEQ ID NO: 1528006 - RNA, 19 nt, Homo sapiens
gcugggaacuucacauaag

SEQ ID NO: 1528007 - RNA, 19 nt, Homo sapiens
ggcaaaguauguagcagaa

SEQ ID NO: 1528008 - RNA, 19 nt, Homo sapiens
gcuaagagacaaucaagga

SEQ ID NO: 1528009 - RNA, 19 nt, Homo sapiens
gcaaacaugucugcagagu

SEQ ID NO: 1528010 - RNA, 19 nt, Homo sapiens
ucuaagacauucuccaaau

SEQ ID NO: 1528011 - RNA, 19 nt, Homo sapiens
caagagaggcucaaacaag

SEQ ID NO: 1528012 - RNA, 19 nt, Homo sapiens
ucaaggcucuggcugauag

SEQ ID NO: 1528013 - RNA, 19 nt, Homo sapiens
aggaagcucugacaaagaa

SEQ ID NO: 1528014 - RNA, 19 nt, Homo sapiens
gcuguacucuuaaucaaca

SEQ ID NO: 1528015 - RNA, 19 nt, Homo sapiens
ucagugaggcagcuuauaa

SEQ ID NO: 1528016 - RNA, 19 nt, Homo sapiens
gauagccaauugccuugaa

SEQ ID NO: 1528017 - RNA, 19 nt, Homo sapiens
ccuagaaacuaaggaauug

SEQ ID NO: 1528018 - RNA, 19 nt, Homo sapiens
gucagaauauccagugauu

SEQ ID NO: 1528019 - RNA, 19 nt, Homo sapiens
aaacaacccuccuugaacu

SEQ ID NO: 1528020 - RNA, 19 nt, Homo sapiens
ccaauugccuugaagacau

SEQ ID NO: 1528021 - RNA, 19 nt, Homo sapiens
gaaguagagccuccuccua

SEQ ID NO: 1528022 - RNA, 19 nt, Homo sapiens
uaaaugcaauaccuccuau

SEQ ID NO: 1528023 - RNA, 19 nt, Homo sapiens
aagaagaaaugcuacuaug

SEQ ID NO: 1528024 - RNA, 19 nt, Homo sapiens
gaagucaugcugcagaaug

SEQ ID NO: 1528025 - RNA, 19 nt, Homo sapiens
uguaugaggugaccaaauc

SEQ ID NO: 1528026 - RNA, 19 nt, Homo sapiens
cagcaacugugguguuaau

SEQ ID NO: 1528027 - RNA, 19 nt, Homo sapiens
uaagacauucuccaaauug

SEQ ID NO: 1528028 - RNA, 19 nt, Homo sapiens
guacgugauugaccucaug

SEQ ID NO: 1528029 - RNA, 19 nt, Homo sapiens
gguuauggacaaaguauuu

SEQ ID NO: 1528030 - RNA, 19 nt, Homo sapiens
gaaacuaaggaauugaaug

SEQ ID NO: 1528031 - RNA, 19 nt, Homo sapiens
uaaagaagaacucuaugga

SEQ ID NO: 1528032 - RNA, 19 nt, Homo sapiens
caaaguauguagcagaaaa

SEQ ID NO: 1528033 - RNA, 19 nt, Homo sapiens
ccaaaucaauacugccaau

SEQ ID NO: 1528034 - RNA, 19 nt, Homo sapiens
ugaaggaagcucugacaaa

SEQ ID NO: 1528035 - RNA, 19 nt, Homo sapiens
gauaaaucccggcaccaaa

SEQ ID NO: 1528036 - RNA, 19 nt, Homo sapiens
gcuacaguauuaacaaaca

SEQ ID NO: 1528037 - RNA, 19 nt, Homo sapiens
uugaagacauggauacuau

SEQ ID NO: 1528038 - RNA, 19 nt, Homo sapiens
gucgagaggcugaucuuua

SEQ ID NO: 1528039 - RNA, 19 nt, Homo sapiens
gauuucagcugggaacuuc

SEQ ID NO: 1528040 - RNA, 19 nt, Homo sapiens
acgauggauucuaugauua

SEQ ID NO: 1528041 - RNA, 19 nt, Homo sapiens
gacauucuccaaauugauu

SEQ ID NO: 1528042 - RNA, 19 nt, Homo sapiens
gcaugugaagccauuuaua

SEQ ID NO: 1528043 - RNA, 19 nt, Homo sapiens
gggcuguacucuuaaucaa

SEQ ID NO: 1528044 - RNA, 19 nt, Homo sapiens
aacaagaaauucacugugu

SEQ ID NO: 1528045 - RNA, 19 nt, Homo sapiens
ggacugaugaaguugagaa

SEQ ID NO: 1528046 - RNA, 19 nt, Homo sapiens
aacgauggauucuaugauu

SEQ ID NO: 1528047 - RNA, 19 nt, Homo sapiens
caucaugcaugccaucauc

SEQ ID NO: 1528048 - RNA, 19 nt, Homo sapiens
uggaaugcauuuacaacuu

SEQ ID NO: 1528049 - RNA, 19 nt, Homo sapiens
aauccuggcuucuaauaau

SEQ ID NO: 1528050 - RNA, 19 nt, Homo sapiens
ugaggugaccaaaucaaua

SEQ ID NO: 1528051 - RNA, 19 nt, Homo sapiens
auaacaaucuuucccugaa

SEQ ID NO: 1528052 - RNA, 19 nt, Homo sapiens
cggacugaguuaagaaauu

SEQ ID NO: 1528053 - RNA, 19 nt, Homo sapiens
uuaauaaaccuccugucua

SEQ ID NO: 1528054 - RNA, 19 nt, Homo sapiens
acaacuuggugcaggauuu

SEQ ID NO: 1528055 - RNA, 19 nt, Homo sapiens
aagaaguaguuauccauga

SEQ ID NO: 1528056 - RNA, 19 nt, Homo sapiens
guaagaagaaaugcuacua

SEQ ID NO: 1528057 - RNA, 19 nt, Homo sapiens
auaaaccuccugucuagua

SEQ ID NO: 1528058 - RNA, 19 nt, Homo sapiens
gcaagcugcuggccaaaua

SEQ ID NO: 1528059 - RNA, 19 nt, Homo sapiens
ccacagagcucaccugcaa

SEQ ID NO: 1528060 - RNA, 19 nt, Homo sapiens
gcacauacccuagcgauuu

SEQ ID NO: 1528061 - RNA, 19 nt, Homo sapiens
ggacgcugcucgacucuaa

SEQ ID NO: 1528062 - RNA, 19 nt, Homo sapiens
uggaauggcucaagaauga

SEQ ID NO: 1528063 - RNA, 19 nt, Homo sapiens
caaguacaauucagacaaa

SEQ ID NO: 1528064 - RNA, 19 nt, Homo sapiens
ccacacagaucuacuucaa

SEQ ID NO: 1528065 - RNA, 19 nt, Homo sapiens
gagagucaaguacaauuua

SEQ ID NO: 1528066 - RNA, 19 nt, Homo sapiens
gcacagaagcucucuaugg

SEQ ID NO: 1528067 - RNA, 19 nt, Homo sapiens
gaagggacccagacaguau

SEQ ID NO: 1528068 - RNA, 19 nt, Homo sapiens
ucuaagaacugcacagaug

SEQ ID NO: 1528069 - RNA, 19 nt, Homo sapiens
uaaguuccguucuucguuu

SEQ ID NO: 1528070 - RNA, 19 nt, Homo sapiens
gaaaauccauguacucugu

SEQ ID NO: 1528071 - RNA, 19 nt, Homo sapiens
cacagaagcucucuaugga

SEQ ID NO: 1528072 - RNA, 19 nt, Homo sapiens
cgaaaccgcuaauguucaa

SEQ ID NO: 1528073 - RNA, 19 nt, Homo sapiens
gagcucaccugcaagaucu

SEQ ID NO: 1528074 - RNA, 19 nt, Homo sapiens
ucuuugggcuggaggauua

SEQ ID NO: 1528075 - RNA, 19 nt, Homo sapiens
uaguaaggcucaaagaaga

SEQ ID NO: 1528076 - RNA, 19 nt, Homo sapiens
gaaacgcaaacgauuuauu

SEQ ID NO: 1528077 - RNA, 19 nt, Homo sapiens
cauguacucuguuguuaga

SEQ ID NO: 1528078 - RNA, 19 nt, Homo sapiens
ggcaaugacuggcggaugu

SEQ ID NO: 1528079 - RNA, 19 nt, Homo sapiens
agacaucacugacucaucu

SEQ ID NO: 1528080 - RNA, 19 nt, Homo sapiens
gaagagucaaguacaauuc

SEQ ID NO: 1528081 - RNA, 19 nt, Homo sapiens
gaugggcugugcaugcaaa

SEQ ID NO: 1528082 - RNA, 19 nt, Homo sapiens
gagguggaauggcucaaga

SEQ ID NO: 1528083 - RNA, 19 nt, Homo sapiens
ggaaagaaagaaagcuuca

SEQ ID NO: 1528084 - RNA, 19 nt, Homo sapiens
ugaauuacuuugccaccaa

SEQ ID NO: 1528085 - RNA, 19 nt, Homo sapiens
ccacaggacgccuacauug

SEQ ID NO: 1528086 - RNA, 19 nt, Homo sapiens
gcaaacgauuuauuaucca

SEQ ID NO: 1528087 - RNA, 19 nt, Homo sapiens
gcaaaggaaagaaagaaag

SEQ ID NO: 1528088 - RNA, 19 nt, Homo sapiens
ugagaucucugugcaggaa

SEQ ID NO: 1528089 - RNA, 19 nt, Homo sapiens
gcuaguaaggcucaaagaa

SEQ ID NO: 1528090 - RNA, 19 nt, Homo sapiens
cagagccgcugcccuacuu

SEQ ID NO: 1528091 - RNA, 19 nt, Homo sapiens
gcaggacuccaccgacaaa

SEQ ID NO: 1528092 - RNA, 19 nt, Homo sapiens
ggccaggcauuccagaaga

SEQ ID NO: 1528093 - RNA, 19 nt, Homo sapiens
aggaaacgcaaacgauuua

SEQ ID NO: 1528094 - RNA, 19 nt, Homo sapiens
caggacgccuacauuguga

SEQ ID NO: 1528095 - RNA, 19 nt, Homo sapiens
gagccgaaaccgcuaaugu

SEQ ID NO: 1528096 - RNA, 19 nt, Homo sapiens
cguuauugauuucuccuuu

SEQ ID NO: 1528097 - RNA, 19 nt, Homo sapiens
gagaugggcaagagugaga

SEQ ID NO: 1528098 - RNA, 19 nt, Homo sapiens
gaccuuaugccuucaagau

SEQ ID NO: 1528099 - RNA, 19 nt, Homo sapiens
gcccgugacuggaucuuuc

SEQ ID NO: 1528100 - RNA, 19 nt, Homo sapiens
gcgagugggucagccagaa

SEQ ID NO: 1528101 - RNA, 19 nt, Homo sapiens
uaggaaacgcaaacgauuu

SEQ ID NO: 1528102 - RNA, 19 nt, Homo sapiens
gaaagaaagaaagcuucaa

SEQ ID NO: 1528103 - RNA, 19 nt, Homo sapiens
caaggacaguuaccacaac

SEQ ID NO: 1528104 - RNA, 19 nt, Homo sapiens
guacaauucagacaaacug

SEQ ID NO: 1528105 - RNA, 19 nt, Homo sapiens
gcagguggaggagcucuuu

SEQ ID NO: 1528106 - RNA, 19 nt, Homo sapiens
gaccaugaccagccuuaga

SEQ ID NO: 1528107 - RNA, 19 nt, Homo sapiens
ugaagagucaaguacaauu

SEQ ID NO: 1528108 - RNA, 19 nt, Homo sapiens
ugagagucaaguacaauuu

SEQ ID NO: 1528109 - RNA, 19 nt, Homo sapiens
cuuccuccguuauugauuu

SEQ ID NO: 1528110 - RNA, 19 nt, Homo sapiens
uccauguacucuguuguua

SEQ ID NO: 1528111 - RNA, 19 nt, Homo sapiens
gcccuccacugcacuuuca

SEQ ID NO: 1528112 - RNA, 19 nt, Homo sapiens
cacauacccuagcgauuuc

SEQ ID NO: 1528113 - RNA, 19 nt, Homo sapiens
ggcaaaggaaagaaagaaa

SEQ ID NO: 1528114 - RNA, 19 nt, Homo sapiens
guuauugauuucuccuuuc

SEQ ID NO: 1528115 - RNA, 19 nt, Homo sapiens
gaaccaagauggggcugaa

SEQ ID NO: 1528116 - RNA, 19 nt, Homo sapiens
gcaaguucuacgagaugua

SEQ ID NO: 1528117 - RNA, 19 nt, Homo sapiens
acgccuacauugugaagaa

SEQ ID NO: 1528118 - RNA, 19 nt, Homo sapiens
gucggacacugccaacuau

SEQ ID NO: 1528119 - RNA, 19 nt, Homo sapiens
ucaaguacaauucagacaa

SEQ ID NO: 1528120 - RNA, 19 nt, Homo sapiens
uagcacagaagcucucuau

SEQ ID NO: 1528121 - RNA, 19 nt, Homo sapiens
gccgaaaccgcuaauguuc

SEQ ID NO: 1528122 - RNA, 19 nt, Homo sapiens
cgcaaacgauuuauuaucc

SEQ ID NO: 1528123 - RNA, 19 nt, Homo sapiens
uaauguucaaggacaguua

SEQ ID NO: 1528124 - RNA, 19 nt, Homo sapiens
caaguucuacgagauguau

SEQ ID NO: 1528125 - RNA, 19 nt, Homo sapiens
ccagaacgaccacgucaca

SEQ ID NO: 1528126 - RNA, 19 nt, Homo sapiens
gauaugcaacagccuagau

SEQ ID NO: 1528127 - RNA, 19 nt, Homo sapiens
ggaaggggagggccagaua

SEQ ID NO: 1528128 - RNA, 19 nt, Homo sapiens
gccgugacuucgacacaga

SEQ ID NO: 1528129 - RNA, 19 nt, Homo sapiens
cagaugggcugugcaugca

SEQ ID NO: 1528130 - RNA, 19 nt, Homo sapiens
ggacggaguggagcaagug

SEQ ID NO: 1528131 - RNA, 19 nt, Homo sapiens
uuaggaaacgcaaacgauu

SEQ ID NO: 1528132 - RNA, 19 nt, Homo sapiens
cuaguaaggcucaaagaag

SEQ ID NO: 1528133 - RNA, 19 nt, Homo sapiens
accgguaccugaauuacuu

SEQ ID NO: 1528134 - RNA, 19 nt, Homo sapiens
cagauauuccagcugcaua

SEQ ID NO: 1528135 - RNA, 19 nt, Homo sapiens
gagccaagcaggcacugau

SEQ ID NO: 1528136 - RNA, 19 nt, Homo sapiens
ggaggacacgccuguagca

SEQ ID NO: 1528137 - RNA, 19 nt, Homo sapiens
gggcaaguucuacgagaug

SEQ ID NO: 1528138 - RNA, 19 nt, Homo sapiens
ucgccuaccugcgcaagaa

SEQ ID NO: 1528139 - RNA, 19 nt, Homo sapiens
caaugacuggcggauguua

SEQ ID NO: 1528140 - RNA, 19 nt, Homo sapiens
ucaaggacaguuaccacaa

SEQ ID NO: 1528141 - RNA, 19 nt, Homo sapiens
agaagggacccagacagua

SEQ ID NO: 1528142 - RNA, 19 nt, Homo sapiens
uguaucuacucaucaacaa

SEQ ID NO: 1528143 - RNA, 19 nt, Homo sapiens
ggucguggcaauccucaug

SEQ ID NO: 1528144 - RNA, 19 nt, Homo sapiens
ccaguucacagccagaguu

SEQ ID NO: 1528145 - RNA, 19 nt, Homo sapiens
gcugggcaccuacguguuc

SEQ ID NO: 1528146 - RNA, 19 nt, Homo sapiens
cagaagggacccagacagu

SEQ ID NO: 1528147 - RNA, 19 nt, Homo sapiens
gcaaugacuggcggauguu

SEQ ID NO: 1528148 - RNA, 19 nt, Homo sapiens
acaggacgccuacauugug

SEQ ID NO: 1528149 - RNA, 19 nt, Homo sapiens
caaaggaaagaaagaaagc

SEQ ID NO: 1528150 - RNA, 19 nt, Homo sapiens
guuagagggcccagaguuc

SEQ ID NO: 1528151 - RNA, 19 nt, Homo sapiens
aaauccauguacucuguug

SEQ ID NO: 1528152 - RNA, 19 nt, Homo sapiens
caucaacaaggcagaaagu

SEQ ID NO: 1528153 - RNA, 19 nt, Homo sapiens
gcaacugccgugacuucga

SEQ ID NO: 1528154 - RNA, 19 nt, Homo sapiens
auaccugcguggccaagaa

SEQ ID NO: 1528155 - RNA, 19 nt, Homo sapiens
ggaaacgcaaacgauuuau

SEQ ID NO: 1528156 - RNA, 19 nt, Homo sapiens
caauucagacaaacugcuu

SEQ ID NO: 1528157 - RNA, 19 nt, Homo sapiens
ccaacuuccugcucaccau

SEQ ID NO: 1528158 - RNA, 19 nt, Homo sapiens
caaagacucagaagaauua

SEQ ID NO: 1528159 - RNA, 19 nt, Homo sapiens
gaaagcauguugagauaug

SEQ ID NO: 1528160 - RNA, 19 nt, Homo sapiens
gaagacgagugaucugaaa

SEQ ID NO: 1528161 - RNA, 19 nt, Homo sapiens
gguaauuccugaagucuug

SEQ ID NO: 1528162 - RNA, 19 nt, Homo sapiens
gggaauaugugcgauuaaa

SEQ ID NO: 1528163 - RNA, 19 nt, Homo sapiens
ggcaggagauaguggaaua

SEQ ID NO: 1528164 - RNA, 19 nt, Homo sapiens
gaccaggccuuguaucaga

SEQ ID NO: 1528165 - RNA, 19 nt, Homo sapiens
gaagaagaacccaguguug

SEQ ID NO: 1528166 - RNA, 19 nt, Homo sapiens
agaaugaaguggaagauga

SEQ ID NO: 1528167 - RNA, 19 nt, Homo sapiens
ggagauaguggaauagauu

SEQ ID NO: 1528168 - RNA, 19 nt, Homo sapiens
gcagaauccauuuacauaa

SEQ ID NO: 1528169 - RNA, 19 nt, Homo sapiens
agacaaagacucagaagaa

SEQ ID NO: 1528170 - RNA, 19 nt, Homo sapiens
guugagauaugaaguguau

SEQ ID NO: 1528171 - RNA, 19 nt, Homo sapiens
uggaaagcauguugagaua

SEQ ID NO: 1528172 - RNA, 19 nt, Homo sapiens
acucacaucuaauuccuua

SEQ ID NO: 1528173 - RNA, 19 nt, Homo sapiens
gucaaccacucacaucuaa

SEQ ID NO: 1528174 - RNA, 19 nt, Homo sapiens
gaaaguuguggccuaaauu

SEQ ID NO: 1528175 - RNA, 19 nt, Homo sapiens
gacaaagacucagaagaau

SEQ ID NO: 1528176 - RNA, 19 nt, Homo sapiens
gaagcagaauccauuuaca

SEQ ID NO: 1528177 - RNA, 19 nt, Homo sapiens
gcugaaaguuguggccuaa

SEQ ID NO: 1528178 - RNA, 19 nt, Homo sapiens
uaaccucucugcugaaagu

SEQ ID NO: 1528179 - RNA, 19 nt, Homo sapiens
gcuuguagauuaguggaua

SEQ ID NO: 1528180 - RNA, 19 nt, Homo sapiens
gcugaacaaccuaaugaua

SEQ ID NO: 1528181 - RNA, 19 nt, Homo sapiens
gccacuggaugcauuauga

SEQ ID NO: 1528182 - RNA, 19 nt, Homo sapiens
caaccacucacaucuaauu

SEQ ID NO: 1528183 - RNA, 19 nt, Homo sapiens
agucugggaucuaauaauu

SEQ ID NO: 1528184 - RNA, 19 nt, Homo sapiens
ccaagaaccuaaccucucu

SEQ ID NO: 1528185 - RNA, 19 nt, Homo sapiens
cuaaugaaguccaucuaau

SEQ ID NO: 1528186 - RNA, 19 nt, Homo sapiens
ugaaaguuguggccuaaau

SEQ ID NO: 1528187 - RNA, 19 nt, Homo sapiens
ugaaguguaugguggagaa

SEQ ID NO: 1528188 - RNA, 19 nt, Homo sapiens
gaagaacccaguguugcua

SEQ ID NO: 1528189 - RNA, 19 nt, Homo sapiens
aagcugaagucauacaaga

SEQ ID NO: 1528190 - RNA, 19 nt, Homo sapiens
aagacaagcugcaagacaa

SEQ ID NO: 1528191 - RNA, 19 nt, Homo sapiens
uaacacaauacaccaguuu

SEQ ID NO: 1528192 - RNA, 19 nt, Homo sapiens
cgaacacccucugcuugua

SEQ ID NO: 1528193 - RNA, 19 nt, Homo sapiens
cugaacaaccuaaugauaa

SEQ ID NO: 1528194 - RNA, 19 nt, Homo sapiens
cauuaaagaugggaauaug

SEQ ID NO: 1528195 - RNA, 19 nt, Homo sapiens
gaggaugacauuucugaga

SEQ ID NO: 1528196 - RNA, 19 nt, Homo sapiens
ccaaacagacuccgcauag

SEQ ID NO: 1528197 - RNA, 19 nt, Homo sapiens
uuucaacacuucacauaug

SEQ ID NO: 1528198 - RNA, 19 nt, Homo sapiens
gauggugccuguaguucau

SEQ ID NO: 1528199 - RNA, 19 nt, Homo sapiens
agacucagaagaauuauug

SEQ ID NO: 1528200 - RNA, 19 nt, Homo sapiens
cgugaacccuuuaagacaa

SEQ ID NO: 1528201 - RNA, 19 nt, Homo sapiens
cucaggauguccaauauga

SEQ ID NO: 1528202 - RNA, 19 nt, Homo sapiens
caaagagccauaugcugaa

SEQ ID NO: 1528203 - RNA, 19 nt, Homo sapiens
guaaagccaaagagccaua

SEQ ID NO: 1528204 - RNA, 19 nt, Homo sapiens
ggugaaagccaagaaccua

SEQ ID NO: 1528205 - RNA, 19 nt, Homo sapiens
cuacaagccuagaaaauga

SEQ ID NO: 1528206 - RNA, 19 nt, Homo sapiens
ggaagcagaauccauuuac

SEQ ID NO: 1528207 - RNA, 19 nt, Homo sapiens
uaaauuguuugggagauuc

SEQ ID NO: 1528208 - RNA, 19 nt, Homo sapiens
ggaauaugugcgauuaaau

SEQ ID NO: 1528209 - RNA, 19 nt, Homo sapiens
ugaacacagucacuuggaa

SEQ ID NO: 1528210 - RNA, 19 nt, Homo sapiens
ggagucagaguccucagaa

SEQ ID NO: 1528211 - RNA, 19 nt, Homo sapiens
agaaaugaaugcuacaaac

SEQ ID NO: 1528212 - RNA, 19 nt, Homo sapiens
gagacuacaagccuagaaa

SEQ ID NO: 1528213 - RNA, 19 nt, Homo sapiens
gaacacccucugcuuguag

SEQ ID NO: 1528214 - RNA, 19 nt, Homo sapiens
aagccuagguccuuggauu

SEQ ID NO: 1528215 - RNA, 19 nt, Homo sapiens
augaacagcuuucuaacga

SEQ ID NO: 1528216 - RNA, 19 nt, Homo sapiens
gcaaaaugaugguaaaugc

SEQ ID NO: 1528217 - RNA, 19 nt, Homo sapiens
ccaguaaaauuuucuccua

SEQ ID NO: 1528218 - RNA, 19 nt, Homo sapiens
ucugggaucuaauaauuca

SEQ ID NO: 1528219 - RNA, 19 nt, Homo sapiens
acaauacaccaguuucaaa

SEQ ID NO: 1528220 - RNA, 19 nt, Homo sapiens
cgaagaagaacccaguguu

SEQ ID NO: 1528221 - RNA, 19 nt, Homo sapiens
ccuaaccucucugcugaaa

SEQ ID NO: 1528222 - RNA, 19 nt, Homo sapiens
ggaagccagggaaaucauu

SEQ ID NO: 1528223 - RNA, 19 nt, Homo sapiens
gaugauggugccuguaguu

SEQ ID NO: 1528224 - RNA, 19 nt, Homo sapiens
acccucugcuuguagauua

SEQ ID NO: 1528225 - RNA, 19 nt, Homo sapiens
caaacagacuccgcauagu

SEQ ID NO: 1528226 - RNA, 19 nt, Homo sapiens
gaaugaaguggaagaugau

SEQ ID NO: 1528227 - RNA, 19 nt, Homo sapiens
guaucagaaugaaguggaa

SEQ ID NO: 1528228 - RNA, 19 nt, Homo sapiens
uuacauaaaugacccuacu

SEQ ID NO: 1528229 - RNA, 19 nt, Homo sapiens
gaagucauacaagacacua

SEQ ID NO: 1528230 - RNA, 19 nt, Homo sapiens
acaaagacucagaagaauu

SEQ ID NO: 1528231 - RNA, 19 nt, Homo sapiens
ugagguaauuccugaaguc

SEQ ID NO: 1528232 - RNA, 19 nt, Homo sapiens
ggaaagcauguugagauau

SEQ ID NO: 1528233 - RNA, 19 nt, Homo sapiens
gacauuaaagaugggaaua

SEQ ID NO: 1528234 - RNA, 19 nt, Homo sapiens
uaacuccagucauaaacgu

SEQ ID NO: 1528235 - RNA, 19 nt, Homo sapiens
caguguugcuaaaugugua

SEQ ID NO: 1528236 - RNA, 19 nt, Homo sapiens
accgcuaacuccagucaua

SEQ ID NO: 1528237 - RNA, 19 nt, Homo sapiens
gcagucaaccacucacauc

SEQ ID NO: 1528238 - RNA, 19 nt, Homo sapiens
gacaagacaaagacucaga

SEQ ID NO: 1528239 - RNA, 19 nt, Homo sapiens
ugaaguccaucuaauuuug

SEQ ID NO: 1528240 - RNA, 19 nt, Homo sapiens
ggaaagaagccagcuagcu

SEQ ID NO: 1528241 - RNA, 19 nt, Homo sapiens
gugaaagccaagaaccuaa

SEQ ID NO: 1528242 - RNA, 19 nt, Homo sapiens
agaggaggaugacauuucu

SEQ ID NO: 1528243 - RNA, 19 nt, Homo sapiens
cacaucuaauuccuuacua

SEQ ID NO: 1528244 - RNA, 19 nt, Homo sapiens
ggcucaggauguccaauau

SEQ ID NO: 1528245 - RNA, 19 nt, Homo sapiens
gaacccaguguugcuaaau

SEQ ID NO: 1528246 - RNA, 19 nt, Homo sapiens
gaaaugaaugcuacaaacc

SEQ ID NO: 1528247 - RNA, 19 nt, Homo sapiens
agcagaauccauuuacaua

SEQ ID NO: 1528248 - RNA, 19 nt, Homo sapiens
gccuguaguucauuauauc

SEQ ID NO: 1528249 - RNA, 19 nt, Homo sapiens
uaagacaagcugcaagaca

SEQ ID NO: 1528250 - RNA, 19 nt, Homo sapiens
augggaauaugugcgauua

SEQ ID NO: 1528251 - RNA, 19 nt, Homo sapiens
cagcauggcaggagauagu

SEQ ID NO: 1528252 - RNA, 19 nt, Homo sapiens
gcacaauggagaggguuga

SEQ ID NO: 1528253 - RNA, 19 nt, Homo sapiens
uagaggaggaugacauuuc

SEQ ID NO: 1528254 - RNA, 19 nt, Homo sapiens
ggccuuguaucagaaugaa

SEQ ID NO: 1528255 - RNA, 19 nt, Homo sapiens
caguuggcgugaacccuuu

SEQ ID NO: 1528256 - RNA, 19 nt, Homo sapiens
uuaaagaugggaauaugug

SEQ ID NO: 1528257 - RNA, 19 nt, Homo sapiens
cuucacauaugccaguguu

SEQ ID NO: 1528258 - RNA, 19 nt, Homo sapiens
ccaauucucucaauccuuu

SEQ ID NO: 1528259 - RNA, 19 nt, Homo sapiens
gguaguggcauucuauuua

SEQ ID NO: 1528260 - RNA, 19 nt, Homo sapiens
gcgaugcccuucccaauuc

SEQ ID NO: 1528261 - RNA, 19 nt, Homo sapiens
guaguggcauucuauuuau

SEQ ID NO: 1528262 - RNA, 19 nt, Homo sapiens
ggcauucuauuuauuguga

SEQ ID NO: 1528263 - RNA, 19 nt, Homo sapiens
ugugagagcaggcauauuu

SEQ ID NO: 1528264 - RNA, 19 nt, Homo sapiens
gggaaaucgugcaggauga

SEQ ID NO: 1528265 - RNA, 19 nt, Homo sapiens
gagcaggacuugggcuuag

SEQ ID NO: 1528266 - RNA, 19 nt, Homo sapiens
gcaagccucccucaauuuc

SEQ ID NO: 1528267 - RNA, 19 nt, Homo sapiens
cugcaagccucccucaauu

SEQ ID NO: 1528268 - RNA, 19 nt, Homo sapiens
agacguuaguccagcauuu

SEQ ID NO: 1528269 - RNA, 19 nt, Homo sapiens
gacaagugguaguggcauu

SEQ ID NO: 1528270 - RNA, 19 nt, Homo sapiens
gugcggaucuuggccaaug

SEQ ID NO: 1528271 - RNA, 19 nt, Homo sapiens
cagcgugggucaccucugu

SEQ ID NO: 1528272 - RNA, 19 nt, Homo sapiens
gcuacuuuauuguuuagga

SEQ ID NO: 1528273 - RNA, 19 nt, Homo sapiens
ggagcaggacuugggcuua

SEQ ID NO: 1528274 - RNA, 19 nt, Homo sapiens
ucagcuggaugccaacaug

SEQ ID NO: 1528275 - RNA, 19 nt, Homo sapiens
uugaagguaugaucagaga

SEQ ID NO: 1528276 - RNA, 19 nt, Homo sapiens
gagagcaggcauauuugga

SEQ ID NO: 1528277 - RNA, 19 nt, Homo sapiens
ccaccaagagguagcauuc

SEQ ID NO: 1528278 - RNA, 19 nt, Homo sapiens
ggaggauggugcggaucuu

SEQ ID NO: 1528279 - RNA, 19 nt, Homo sapiens
guccagcauuuccaaagug

SEQ ID NO: 1528280 - RNA, 19 nt, Homo sapiens
gaucugguggugccuugaa

SEQ ID NO: 1528281 - RNA, 19 nt, Homo sapiens
gcugggccuuggugugaga

SEQ ID NO: 1528282 - RNA, 19 nt, Homo sapiens
uccguugguucccgagaua

SEQ ID NO: 1528283 - RNA, 19 nt, Homo sapiens
gcagacacagcaucuacuc

SEQ ID NO: 1528284 - RNA, 19 nt, Homo sapiens
gcacaaaaucagagcaaga

SEQ ID NO: 1528285 - RNA, 19 nt, Homo sapiens
gagauacuuuuagguggua

SEQ ID NO: 1528286 - RNA, 19 nt, Homo sapiens
gggcuuagggcagguggaa

SEQ ID NO: 1528287 - RNA, 19 nt, Homo sapiens
ggugugagagcaggcauau

SEQ ID NO: 1528288 - RNA, 19 nt, Homo sapiens
gguagcauuccucgacaga

SEQ ID NO: 1528289 - RNA, 19 nt, Homo sapiens
gcuggaugccaacauguuc

SEQ ID NO: 1528290 - RNA, 19 nt, Homo sapiens
gaggauggugcggaucuug

SEQ ID NO: 1528291 - RNA, 19 nt, Homo sapiens
gugagagcaggcauauuug

SEQ ID NO: 1528292 - RNA, 19 nt, Homo sapiens
ugcaagccucccucaauuu

SEQ ID NO: 1528293 - RNA, 19 nt, Homo sapiens
aagccucccucaauuucug

SEQ ID NO: 1528294 - RNA, 19 nt, Homo sapiens
guggguggguccguugguu

SEQ ID NO: 1528295 - RNA, 19 nt, Homo sapiens
agacucagcuguauuguuu

SEQ ID NO: 1528296 - RNA, 19 nt, Homo sapiens
ggacucagcuuccuuagca

SEQ ID NO: 1528297 - RNA, 19 nt, Homo sapiens
gcacuagacucagcuguau

SEQ ID NO: 1528298 - RNA, 19 nt, Homo sapiens
gcaacacccgggacaauaa

SEQ ID NO: 1528299 - RNA, 19 nt, Homo sapiens
ggaaaccuccuuggcauaa

SEQ ID NO: 1528300 - RNA, 19 nt, Homo sapiens
ggaggcggaucaacugaga

SEQ ID NO: 1528301 - RNA, 19 nt, Homo sapiens
gcacuccugggucuucaua

SEQ ID NO: 1528302 - RNA, 19 nt, Homo sapiens
gguccucgcucgcuagcuu

SEQ ID NO: 1528303 - RNA, 19 nt, Homo sapiens
caggagacaugucccuaug

SEQ ID NO: 1528304 - RNA, 19 nt, Homo sapiens
ugagagcgcugggcugguu

SEQ ID NO: 1528305 - RNA, 19 nt, Homo sapiens
gaauggcacgcccguaaug

SEQ ID NO: 1528306 - RNA, 19 nt, Homo sapiens
gugaauggcacgcccguaa

SEQ ID NO: 1528307 - RNA, 19 nt, Homo sapiens
ggagacaugucccuaugac

SEQ ID NO: 1528308 - RNA, 19 nt, Homo sapiens
ggugggcuuuggcgucuuu

SEQ ID NO: 1528309 - RNA, 19 nt, Homo sapiens
gaaaccuccuuggcauaau

SEQ ID NO: 1528310 - RNA, 19 nt, Homo sapiens
ccgcugagcacuuccauga

SEQ ID NO: 1528311 - RNA, 19 nt, Homo sapiens
gggaauaaacaugaucuau

SEQ ID NO: 1528312 - RNA, 19 nt, Homo sapiens
aggaggaccuggaugaugu

SEQ ID NO: 1528313 - RNA, 19 nt, Homo sapiens
ggguagaacaugucugguu

SEQ ID NO: 1528314 - RNA, 19 nt, Homo sapiens
ccaagaguguggccaucug

SEQ ID NO: 1528315 - RNA, 19 nt, Homo sapiens
gacgguggccucaggauuc

SEQ ID NO: 1528316 - RNA, 19 nt, Homo sapiens
cuuagcaucucagcagaaa

SEQ ID NO: 1528317 - RNA, 19 nt, Homo sapiens
aaaccuccuuggcauaauc

SEQ ID NO: 1528318 - RNA, 19 nt, Homo sapiens
gaggcuguguuaccaccuu

SEQ ID NO: 1528319 - RNA, 19 nt, Homo sapiens
gaggaggaccuggaugaug

SEQ ID NO: 1528320 - RNA, 19 nt, Homo sapiens
gacagaagggacagaaaca

SEQ ID NO: 1528321 - RNA, 19 nt, Homo sapiens
gagacagaagggacagaaa

SEQ ID NO: 1528322 - RNA, 19 nt, Homo sapiens
cccgacaucuuucucaaca

SEQ ID NO: 1528323 - RNA, 19 nt, Homo sapiens
caacacccgggacaauaau

SEQ ID NO: 1528324 - RNA, 19 nt, Homo sapiens
gguuggggcuugggaauaa

SEQ ID NO: 1528325 - RNA, 19 nt, Homo sapiens
ggcauaaucaccagcaaca

SEQ ID NO: 1528326 - RNA, 19 nt, Homo sapiens
uguaggaagugauguugag

SEQ ID NO: 1528327 - RNA, 19 nt, Homo sapiens
gaggaggcggaucaacuga

SEQ ID NO: 1528328 - RNA, 19 nt, Homo sapiens
cagcuuccuuagcaucuca

SEQ ID NO: 1528329 - RNA, 19 nt, Homo sapiens
ucucaucuccacccacuga

SEQ ID NO: 1528330 - RNA, 19 nt, Homo sapiens
cagccagacccaagaccua

SEQ ID NO: 1528331 - RNA, 19 nt, Homo sapiens
gcggaacaguggcgcuucu

SEQ ID NO: 1528332 - RNA, 19 nt, Homo sapiens
ccacuccaacugcacagaa

SEQ ID NO: 1528333 - RNA, 19 nt, Homo sapiens
cgaggaggcggaucaacug

SEQ ID NO: 1528334 - RNA, 19 nt, Homo sapiens
gggcuugggaauaaacaug

SEQ ID NO: 1528335 - RNA, 19 nt, Homo sapiens
ugacacugugccuucauuu

SEQ ID NO: 1528336 - RNA, 19 nt, Homo sapiens
acuagacucagcuguauug

SEQ ID NO: 1528337 - RNA, 19 nt, Homo sapiens
uggaggaggaccuggauga

SEQ ID NO: 1528338 - RNA, 19 nt, Homo sapiens
acuccugggucuucauaug

SEQ ID NO: 1528339 - RNA, 19 nt, Homo sapiens
ggacgaggaggcggaucaa

SEQ ID NO: 1528340 - RNA, 19 nt, Homo sapiens
cagcaacacccgggacaau

SEQ ID NO: 1528341 - RNA, 19 nt, Homo sapiens
ggaggaggaccuggaugau

SEQ ID NO: 1528342 - RNA, 19 nt, Homo sapiens
ugacgguggccucaggauu

SEQ ID NO: 1528343 - RNA, 19 nt, Homo sapiens
ucaggagacaugucccuau

SEQ ID NO: 1528344 - RNA, 19 nt, Homo sapiens
gcuugggaauaaacaugau

SEQ ID NO: 1528345 - RNA, 19 nt, Homo sapiens
uguguuaccaccuuuggaa

SEQ ID NO: 1528346 - RNA, 19 nt, Homo sapiens
cggcuguggugcaggugaa

SEQ ID NO: 1528347 - RNA, 19 nt, Homo sapiens
gcaaauacauagagagauu

SEQ ID NO: 1528348 - RNA, 19 nt, Homo sapiens
gagagauucuguacauuua

SEQ ID NO: 1528349 - RNA, 19 nt, Homo sapiens
gagaaacccuauaaaugua

SEQ ID NO: 1528350 - RNA, 19 nt, Homo sapiens
caaagacacugguagauau

SEQ ID NO: 1528351 - RNA, 19 nt, Homo sapiens
gagaaacccuuugaaugua

SEQ ID NO: 1528352 - RNA, 19 nt, Homo sapiens
ggagaaacccuauaaaugu

SEQ ID NO: 1528353 - RNA, 19 nt, Homo sapiens
ccuaagaucuagcacuuua

SEQ ID NO: 1528354 - RNA, 19 nt, Homo sapiens
gaagcaacauggcauaguu

SEQ ID NO: 1528355 - RNA, 19 nt, Homo sapiens
gaagucagcccucacagua

SEQ ID NO: 1528356 - RNA, 19 nt, Homo sapiens
ggagaaacccuuugaaugu

SEQ ID NO: 1528357 - RNA, 19 nt, Homo sapiens
gagaaagccugugaaugua

SEQ ID NO: 1528358 - RNA, 19 nt, Homo sapiens
ggaaacaguuauacuacaa

SEQ ID NO: 1528359 - RNA, 19 nt, Homo sapiens
gcaaagacacugguagaua

SEQ ID NO: 1528360 - RNA, 19 nt, Homo sapiens
caaaugcagucuucaaguu

SEQ ID NO: 1528361 - RNA, 19 nt, Homo sapiens
gaagcaagauaccaggaaa

SEQ ID NO: 1528362 - RNA, 19 nt, Homo sapiens
agacagaucuggcccacua

SEQ ID NO: 1528363 - RNA, 19 nt, Homo sapiens
gguaauaacuaauccuuca

SEQ ID NO: 1528364 - RNA, 19 nt, Homo sapiens
gaaaccacaucucacagaa

SEQ ID NO: 1528365 - RNA, 19 nt, Homo sapiens
gaggaaugcugagaaguaa

SEQ ID NO: 1528366 - RNA, 19 nt, Homo sapiens
gaauucaguccucagauua

SEQ ID NO: 1528367 - RNA, 19 nt, Homo sapiens
gagaaacccuaugaaugua

SEQ ID NO: 1528368 - RNA, 19 nt, Homo sapiens
gagaaacccuaugaaugua

SEQ ID NO: 1528369 - RNA, 19 nt, Homo sapiens
gggaaauucucuugacuga

SEQ ID NO: 1528370 - RNA, 19 nt, Homo sapiens
ggagaaaccuuuugaaugu

SEQ ID NO: 1528371 - RNA, 19 nt, Homo sapiens
gcauuuguauuuaguguga

SEQ ID NO: 1528372 - RNA, 19 nt, Homo sapiens
gcagaagucaugcaaauug

SEQ ID NO: 1528373 - RNA, 19 nt, Homo sapiens
ggagaaacccuaugagugu

SEQ ID NO: 1528374 - RNA, 19 nt, Homo sapiens
gagcauucaugaucuagaa

SEQ ID NO: 1528375 - RNA, 19 nt, Homo sapiens
gaaguagaauuuccacauc

SEQ ID NO: 1528376 - RNA, 19 nt, Homo sapiens
gaagaggaaugcugagaag

SEQ ID NO: 1528377 - RNA, 19 nt, Homo sapiens
gaagaccuauggagcauuc

SEQ ID NO: 1528378 - RNA, 19 nt, Homo sapiens
gaaauuucuugauggaaug

SEQ ID NO: 1528379 - RNA, 19 nt, Homo sapiens
cuagaaaucucuuuacaca

SEQ ID NO: 1528380 - RNA, 19 nt, Homo sapiens
gaagucugcccucauagua

SEQ ID NO: 1528381 - RNA, 19 nt, Homo sapiens
guaaauggauauagacagu

SEQ ID NO: 1528382 - RNA, 19 nt, Homo sapiens
aaucagaccucacuaaaca

SEQ ID NO: 1528383 - RNA, 19 nt, Homo sapiens
gagagaaacccuaugaaug

SEQ ID NO: 1528384 - RNA, 19 nt, Homo sapiens
gagagaaacccuaugaaug

SEQ ID NO: 1528385 - RNA, 19 nt, Homo sapiens
acacaagagcuauauguua

SEQ ID NO: 1528386 - RNA, 19 nt, Homo sapiens
gaagucaugcaaauuguaa

SEQ ID NO: 1528387 - RNA, 19 nt, Homo sapiens
uaauauagauggcagaagu

SEQ ID NO: 1528388 - RNA, 19 nt, Homo sapiens
ggaaauucuucucuaggaa

SEQ ID NO: 1528389 - RNA, 19 nt, Homo sapiens
uaagaugaguugggaaauu

SEQ ID NO: 1528390 - RNA, 19 nt, Homo sapiens
gggaaauucuucucuagga

SEQ ID NO: 1528391 - RNA, 19 nt, Homo sapiens
gggagaaacccuauaaaug

SEQ ID NO: 1528392 - RNA, 19 nt, Homo sapiens
ucaaagggauaacugcaaa

SEQ ID NO: 1528393 - RNA, 19 nt, Homo sapiens
gaagucacaccucacagua

SEQ ID NO: 1528394 - RNA, 19 nt, Homo sapiens
gagaaacccuaugagugua

SEQ ID NO: 1528395 - RNA, 19 nt, Homo sapiens
caaggaagaauggaaguua

SEQ ID NO: 1528396 - RNA, 19 nt, Homo sapiens
agagcuaucugcauuugua

SEQ ID NO: 1528397 - RNA, 19 nt, Homo sapiens
ucaaaugucagucaaguuu

SEQ ID NO: 1528398 - RNA, 19 nt, Homo sapiens
gauauagacagugguaaua

SEQ ID NO: 1528399 - RNA, 19 nt, Homo sapiens
gagggaaacaguuauacua

SEQ ID NO: 1528400 - RNA, 19 nt, Homo sapiens
agacagugguaauaacuaa

SEQ ID NO: 1528401 - RNA, 19 nt, Homo sapiens
aauuggagcucauguacua

SEQ ID NO: 1528402 - RNA, 19 nt, Homo sapiens
ugaauucaguccucagauu

SEQ ID NO: 1528403 - RNA, 19 nt, Homo sapiens
gggagaagcccuaugaaug

SEQ ID NO: 1528404 - RNA, 19 nt, Homo sapiens
ggagagaaacccuaugaau

SEQ ID NO: 1528405 - RNA, 19 nt, Homo sapiens
ggagagaaacccuaugaau

SEQ ID NO: 1528406 - RNA, 19 nt, Homo sapiens
gaaaugaugcauacagcaa

SEQ ID NO: 1528407 - RNA, 19 nt, Homo sapiens
cacaagagcuauauguuag

SEQ ID NO: 1528408 - RNA, 19 nt, Homo sapiens
ggcaacaucauuaaacaua

SEQ ID NO: 1528409 - RNA, 19 nt, Homo sapiens
uuuggaagguguucaauaa

SEQ ID NO: 1528410 - RNA, 19 nt, Homo sapiens
gaucacugguacuuggaua

SEQ ID NO: 1528411 - RNA, 19 nt, Homo sapiens
ucagauaauucacacaaga

SEQ ID NO: 1528412 - RNA, 19 nt, Homo sapiens
gggcaaauccuaugacugu

SEQ ID NO: 1528413 - RNA, 19 nt, Homo sapiens
agagaaagccugugaaugu

SEQ ID NO: 1528414 - RNA, 19 nt, Homo sapiens
gauggaauguagcaguaaa

SEQ ID NO: 1528415 - RNA, 19 nt, Homo sapiens
gcaaaagccugagcuguuu

SEQ ID NO: 1528416 - RNA, 19 nt, Homo sapiens
caaaugagaagcuccuuga

SEQ ID NO: 1528417 - RNA, 19 nt, Homo sapiens
caaaucauguugcagaucu

SEQ ID NO: 1528418 - RNA, 19 nt, Homo sapiens
augagaagcuccuugagua

SEQ ID NO: 1528419 - RNA, 19 nt, Homo sapiens
ucacuaaacaucagagaaa

SEQ ID NO: 1528420 - RNA, 19 nt, Homo sapiens
cagcagaguugaguaguug

SEQ ID NO: 1528421 - RNA, 19 nt, Homo sapiens
aaugguacauagcgaaaua

SEQ ID NO: 1528422 - RNA, 19 nt, Homo sapiens
ggagaagcccuaugagugu

SEQ ID NO: 1528423 - RNA, 19 nt, Homo sapiens
gaaacccuaugaauguaau

SEQ ID NO: 1528424 - RNA, 19 nt, Homo sapiens
gaaaacaaauagugcaaug

SEQ ID NO: 1528425 - RNA, 19 nt, Homo sapiens
cgagauugcucuauuuuaa

SEQ ID NO: 1528426 - RNA, 19 nt, Homo sapiens
gggaaaccuuuauccagaa

SEQ ID NO: 1528427 - RNA, 19 nt, Homo sapiens
uaaaucagaccucacuaaa

SEQ ID NO: 1528428 - RNA, 19 nt, Homo sapiens
cuaaaugguugaaagaauc

SEQ ID NO: 1528429 - RNA, 19 nt, Homo sapiens
gagcucauguacuagagaa

SEQ ID NO: 1528430 - RNA, 19 nt, Homo sapiens
agaaacccuuugaauguaa

SEQ ID NO: 1528431 - RNA, 19 nt, Homo sapiens
gggagaaacccuuugaaug

SEQ ID NO: 1528432 - RNA, 19 nt, Homo sapiens
gaaagccugugaauguaag

SEQ ID NO: 1528433 - RNA, 19 nt, Homo sapiens
gaaaagagccauggauauu

SEQ ID NO: 1528434 - RNA, 19 nt, Homo sapiens
ugacucugguuguuaauau

SEQ ID NO: 1528435 - RNA, 19 nt, Homo sapiens
guaugugagugugcuauaa

SEQ ID NO: 1528436 - RNA, 19 nt, Homo sapiens
aaaggaaaccugcaaaugu

SEQ ID NO: 1528437 - RNA, 19 nt, Homo sapiens
guccucagauuacaucaaa

SEQ ID NO: 1528438 - RNA, 19 nt, Homo sapiens
agagaaacccuaugaaugu

SEQ ID NO: 1528439 - RNA, 19 nt, Homo sapiens
ccagggacccgugacauua

SEQ ID NO: 1528440 - RNA, 19 nt, Homo sapiens
agagaaacccuaugaaugu

SEQ ID NO: 1528441 - RNA, 19 nt, Homo sapiens
aagccaagcuggaaauuca

SEQ ID NO: 1528442 - RNA, 19 nt, Homo sapiens
ggaaugcugagaaguaaga

SEQ ID NO: 1528443 - RNA, 19 nt, Homo sapiens
gcaaauccuaugacuguga

SEQ ID NO: 1528444 - RNA, 19 nt, Homo sapiens
aaagagccauggauauuag

SEQ ID NO: 1528445 - RNA, 19 nt, Homo sapiens
cacaugcccuugagccuaa

SEQ ID NO: 1528446 - RNA, 19 nt, Homo sapiens
ucaaagcacuuagaauagu

SEQ ID NO: 1528447 - RNA, 19 nt, Homo sapiens
gaggaucguuugagaauau

SEQ ID NO: 1528448 - RNA, 19 nt, Homo sapiens
gcaggaggaucguuugaga

SEQ ID NO: 1528449 - RNA, 19 nt, Homo sapiens
acacgaagauuccggauga

SEQ ID NO: 1528450 - RNA, 19 nt, Homo sapiens
gcucacaccuuuaagucuu

SEQ ID NO: 1528451 - RNA, 19 nt, Homo sapiens
ucagaccuuugcuuucuua

SEQ ID NO: 1528452 - RNA, 19 nt, Homo sapiens
gcacuacuuucucuuugga

SEQ ID NO: 1528453 - RNA, 19 nt, Homo sapiens
gaccuuugcuuucuuaucu

SEQ ID NO: 1528454 - RNA, 19 nt, Homo sapiens
ggaggaucguuugagaaua

SEQ ID NO: 1528455 - RNA, 19 nt, Homo sapiens
gcucagaccuuugcuuucu

SEQ ID NO: 1528456 - RNA, 19 nt, Homo sapiens
ccuguaaucccaacacuuu

SEQ ID NO: 1528457 - RNA, 19 nt, Homo sapiens
ggaaggcguggacuugcua

SEQ ID NO: 1528458 - RNA, 19 nt, Homo sapiens
gaagauuccggaugaggau

SEQ ID NO: 1528459 - RNA, 19 nt, Homo sapiens
gcuaggguuucucaucauc

SEQ ID NO: 1528460 - RNA, 19 nt, Homo sapiens
cggaugaggaugagaguga

SEQ ID NO: 1528461 - RNA, 19 nt, Homo sapiens
gcgaaaagcugggcagaca

SEQ ID NO: 1528462 - RNA, 19 nt, Homo sapiens
ggacgagcaggagagguuu

SEQ ID NO: 1528463 - RNA, 19 nt, Homo sapiens
uugcuaggguuucucauca

SEQ ID NO: 1528464 - RNA, 19 nt, Homo sapiens
aaaauuagcugggcacagu

SEQ ID NO: 1528465 - RNA, 19 nt, Homo sapiens
ccaggcaggaggaucguuu

SEQ ID NO: 1528466 - RNA, 19 nt, Homo sapiens
gcgccaauguuugcuacga

SEQ ID NO: 1528467 - RNA, 19 nt, Homo sapiens
uggcucagaccuuugcuuu

SEQ ID NO: 1528468 - RNA, 19 nt, Homo sapiens
ggaugagagugaggugaca

SEQ ID NO: 1528469 - RNA, 19 nt, Homo sapiens
ugagagccaggaagucuga

SEQ ID NO: 1528470 - RNA, 19 nt, Homo sapiens
gagcaggagagguuugucu

SEQ ID NO: 1528471 - RNA, 19 nt, Homo sapiens
ggaugcuggugauugucuu

SEQ ID NO: 1528472 - RNA, 19 nt, Homo sapiens
acuccuggcucagaccuuu

SEQ ID NO: 1528473 - RNA, 19 nt, Homo sapiens
agaagucccugcugaugcu

SEQ ID NO: 1528474 - RNA, 19 nt, Homo sapiens
gguuucucaucaucacauu

SEQ ID NO: 1528475 - RNA, 19 nt, Homo sapiens
cauggaaggcguggacuug

SEQ ID NO: 1528476 - RNA, 19 nt, Homo sapiens
ccucgucucuacaaaauau

SEQ ID NO: 1528477 - RNA, 19 nt, Homo sapiens
ugucagggcacacgaagau

SEQ ID NO: 1528478 - RNA, 19 nt, Homo sapiens
agucuuauguaguuaaagg

SEQ ID NO: 1528479 - RNA, 19 nt, Homo sapiens
acuacuuucucuuuggauu

SEQ ID NO: 1528480 - RNA, 19 nt, Homo sapiens
uugcacuacuuucucuuug

SEQ ID NO: 1528481 - RNA, 19 nt, Homo sapiens
gcauggaaggcguggacuu

SEQ ID NO: 1528482 - RNA, 19 nt, Homo sapiens
cagccuggacaacauaaug

SEQ ID NO: 1528483 - RNA, 19 nt, Homo sapiens
gaucguuugagaauauauc

SEQ ID NO: 1528484 - RNA, 19 nt, Homo sapiens
gaagucugaguggguguga

SEQ ID NO: 1528485 - RNA, 19 nt, Homo sapiens
cuccagcucacaccuuuaa

SEQ ID NO: 1528486 - RNA, 19 nt, Homo sapiens
ucagggcacacgaagauuc

SEQ ID NO: 1528487 - RNA, 19 nt, Homo sapiens
gggaugcgccaauguuugc

SEQ ID NO: 1528488 - RNA, 19 nt, Homo sapiens
cagcucacaccuuuaaguc

SEQ ID NO: 1528489 - RNA, 19 nt, Homo sapiens
ugggaaagcucugguucgu

SEQ ID NO: 1528490 - RNA, 19 nt, Homo sapiens
gaaggaugcucuuagauau

SEQ ID NO: 1528491 - RNA, 19 nt, Homo sapiens
ggaaggaugcucuuagaua

SEQ ID NO: 1528492 - RNA, 19 nt, Homo sapiens
ggagagggcucacaagcuu

SEQ ID NO: 1528493 - RNA, 19 nt, Homo sapiens
gcacaauauuccucaguaa

SEQ ID NO: 1528494 - RNA, 19 nt, Homo sapiens
gaacauagacgauuugaac

SEQ ID NO: 1528495 - RNA, 19 nt, Homo sapiens
caaccaaaccucaaguaua

SEQ ID NO: 1528496 - RNA, 19 nt, Homo sapiens
gcgcagacuuccaaauaaa

SEQ ID NO: 1528497 - RNA, 19 nt, Homo sapiens
gggagaacauagacgauuu

SEQ ID NO: 1528498 - RNA, 19 nt, Homo sapiens
ggaauucaauccuucagau

SEQ ID NO: 1528499 - RNA, 19 nt, Homo sapiens
ggacaaauagcaaggaaau

SEQ ID NO: 1528500 - RNA, 19 nt, Homo sapiens
gcagacuuccaaauaaaua

SEQ ID NO: 1528501 - RNA, 19 nt, Homo sapiens
guacaaggaccuaagaaga

SEQ ID NO: 1528502 - RNA, 19 nt, Homo sapiens
gagcgacaguuucuugaau

SEQ ID NO: 1528503 - RNA, 19 nt, Homo sapiens
gggcugugcuuguuccauu

SEQ ID NO: 1528504 - RNA, 19 nt, Homo sapiens
ggcgcagacuuccaaauaa

SEQ ID NO: 1528505 - RNA, 19 nt, Homo sapiens
uaggagccauuucuuugua

SEQ ID NO: 1528506 - RNA, 19 nt, Homo sapiens
ucccuuaguuucuccuuua

SEQ ID NO: 1528507 - RNA, 19 nt, Homo sapiens
aaccaaaccucaaguauac

SEQ ID NO: 1528508 - RNA, 19 nt, Homo sapiens
cuucaacaauggcgaaauu

SEQ ID NO: 1528509 - RNA, 19 nt, Homo sapiens
cagagcagaagcagauuua

SEQ ID NO: 1528510 - RNA, 19 nt, Homo sapiens
caagcaauauucuucucaa

SEQ ID NO: 1528511 - RNA, 19 nt, Homo sapiens
uaacauacgcagagauaga

SEQ ID NO: 1528512 - RNA, 19 nt, Homo sapiens
gccaccagauuaugacaaa

SEQ ID NO: 1528513 - RNA, 19 nt, Homo sapiens
gggccaguguguccuguaa

SEQ ID NO: 1528514 - RNA, 19 nt, Homo sapiens
gcgacaguuucuugaauug

SEQ ID NO: 1528515 - RNA, 19 nt, Homo sapiens
aggaugcucuuagauauuu

SEQ ID NO: 1528516 - RNA, 19 nt, Homo sapiens
gcagagugcugggcaugug

SEQ ID NO: 1528517 - RNA, 19 nt, Homo sapiens
ccauuucuguacacccuua

SEQ ID NO: 1528518 - RNA, 19 nt, Homo sapiens
ugaccaggcuguauggaau

SEQ ID NO: 1528519 - RNA, 19 nt, Homo sapiens
gaguaggagccauuucuuu

SEQ ID NO: 1528520 - RNA, 19 nt, Homo sapiens
gaccugaaguuguuguuac

SEQ ID NO: 1528521 - RNA, 19 nt, Homo sapiens
ccagugggcugugcuuguu

SEQ ID NO: 1528522 - RNA, 19 nt, Homo sapiens
cauagacgauuugaacaug

SEQ ID NO: 1528523 - RNA, 19 nt, Homo sapiens
gccaguguguccuguaaga

SEQ ID NO: 1528524 - RNA, 19 nt, Homo sapiens
gccaucaucucuuaacuac

SEQ ID NO: 1528525 - RNA, 19 nt, Homo sapiens
caauauuccucaguaaauc

SEQ ID NO: 1528526 - RNA, 19 nt, Homo sapiens
ccgaagugccaccagauua

SEQ ID NO: 1528527 - RNA, 19 nt, Homo sapiens
gaacauucuagaucacaug

SEQ ID NO: 1528528 - RNA, 19 nt, Homo sapiens
uggcgcagacuuccaaaua

SEQ ID NO: 1528529 - RNA, 19 nt, Homo sapiens
gugucgcucuugcaauaua

SEQ ID NO: 1528530 - RNA, 19 nt, Homo sapiens
gcgaacaaccugagcuuuc

SEQ ID NO: 1528531 - RNA, 19 nt, Homo sapiens
ggagaacauagacgauuug

SEQ ID NO: 1528532 - RNA, 19 nt, Homo sapiens
gaacauggaauucaauccu

SEQ ID NO: 1528533 - RNA, 19 nt, Homo sapiens
cuuaguuucuccuuuaguu

SEQ ID NO: 1528534 - RNA, 19 nt, Homo sapiens
gugucuaugccaaguauua

SEQ ID NO: 1528535 - RNA, 19 nt, Homo sapiens
cgaagugccaccagauuau

SEQ ID NO: 1528536 - RNA, 19 nt, Homo sapiens
gcacagucagucaaccaaa

SEQ ID NO: 1528537 - RNA, 19 nt, Homo sapiens
ggacaaguacaaggaccua

SEQ ID NO: 1528538 - RNA, 19 nt, Homo sapiens
gcagggagagggcucacaa

SEQ ID NO: 1528539 - RNA, 19 nt, Homo sapiens
cgagcuagagcgacaguuu

SEQ ID NO: 1528540 - RNA, 19 nt, Homo sapiens
uauggaauguggauuacug

SEQ ID NO: 1528541 - RNA, 19 nt, Homo sapiens
aaacagggacccagaugga

SEQ ID NO: 1528542 - RNA, 19 nt, Homo sapiens
caggacaaauagcaaggaa

SEQ ID NO: 1528543 - RNA, 19 nt, Homo sapiens
gcaagcaauauucuucuca

SEQ ID NO: 1528544 - RNA, 19 nt, Homo sapiens
uggaggaaguggacucgaa

SEQ ID NO: 1528545 - RNA, 19 nt, Homo sapiens
ccacaccaucccuuaguuu

SEQ ID NO: 1528546 - RNA, 19 nt, Homo sapiens
caaguacaaggaccuaaga

SEQ ID NO: 1528547 - RNA, 19 nt, Homo sapiens
gaaaaucuucacccucuuu

SEQ ID NO: 1528548 - RNA, 19 nt, Homo sapiens
gaagugccaccagauuaug

SEQ ID NO: 1528549 - RNA, 19 nt, Homo sapiens
gccacaccaucccuuaguu

SEQ ID NO: 1528550 - RNA, 19 nt, Homo sapiens
gaggccacaccaucccuua

SEQ ID NO: 1528551 - RNA, 19 nt, Homo sapiens
acaaggaccuaagaagauc

SEQ ID NO: 1528552 - RNA, 19 nt, Homo sapiens
augugucgcucuugcaaua

SEQ ID NO: 1528553 - RNA, 19 nt, Homo sapiens
caaauagcaaggaaauaca

SEQ ID NO: 1528554 - RNA, 19 nt, Homo sapiens
gacaaauagcaaggaaaua

SEQ ID NO: 1528555 - RNA, 19 nt, Homo sapiens
ucugcgcgcugucuucuga

SEQ ID NO: 1528556 - RNA, 19 nt, Homo sapiens
cacaauauuccucaguaaa

SEQ ID NO: 1528557 - RNA, 19 nt, Homo sapiens
ccuccaaggugugggauga

SEQ ID NO: 1528558 - RNA, 19 nt, Homo sapiens
uuuaacauacgcagagaua

SEQ ID NO: 1528559 - RNA, 19 nt, Homo sapiens
guaggagccauuucuuugu

SEQ ID NO: 1528560 - RNA, 19 nt, Homo sapiens
ucauuucucuccgcacuau

SEQ ID NO: 1528561 - RNA, 19 nt, Homo sapiens
cagugucuaugccaaguau

SEQ ID NO: 1528562 - RNA, 19 nt, Homo sapiens
gauggaaggaugcucuuag

SEQ ID NO: 1528563 - RNA, 19 nt, Homo sapiens
acaaauagcaaggaaauac

SEQ ID NO: 1528564 - RNA, 19 nt, Homo sapiens
uuccugaccugaaguuguu

SEQ ID NO: 1528565 - RNA, 19 nt, Homo sapiens
ggaggaaguggacucgaau

SEQ ID NO: 1528566 - RNA, 19 nt, Homo sapiens
gcgaggacaaguacaagga

SEQ ID NO: 1528567 - RNA, 19 nt, Homo sapiens
ggacaugaacgagcuagag

SEQ ID NO: 1528568 - RNA, 19 nt, Homo sapiens
gggaugaccaggcuguaug

SEQ ID NO: 1528569 - RNA, 19 nt, Homo sapiens
ccaaaccucaaguauacaa

SEQ ID NO: 1528570 - RNA, 19 nt, Homo sapiens
aggaggaaauaaagggaaa

SEQ ID NO: 1528571 - RNA, 19 nt, Homo sapiens
gaauucaauccuucagauc

SEQ ID NO: 1528572 - RNA, 19 nt, Homo sapiens
cuagagcgacaguuucuug

SEQ ID NO: 1528573 - RNA, 19 nt, Homo sapiens
gagcuagagcgacaguuuc

SEQ ID NO: 1528574 - RNA, 19 nt, Homo sapiens
gguguaccuugaaagacuu

SEQ ID NO: 1528575 - RNA, 19 nt, Homo sapiens
agcacaauauuccucagua

SEQ ID NO: 1528576 - RNA, 19 nt, Homo sapiens
gagaacauagacgauuuga

SEQ ID NO: 1528577 - RNA, 19 nt, Homo sapiens
guaucccuuucccuccuua

SEQ ID NO: 1528578 - RNA, 19 nt, Homo sapiens
uacaaggaccuaagaagau

SEQ ID NO: 1528579 - RNA, 19 nt, Homo sapiens
ccagagcagaagcagauuu

SEQ ID NO: 1528580 - RNA, 19 nt, Homo sapiens
cagauuaugacaaacacaa

SEQ ID NO: 1528581 - RNA, 19 nt, Homo sapiens
uagacgauuugaacaugga

SEQ ID NO: 1528582 - RNA, 19 nt, Homo sapiens
ucaguaaaucucagacaga

SEQ ID NO: 1528583 - RNA, 19 nt, Homo sapiens
uaagaagauccgcgaggaa

SEQ ID NO: 1528584 - RNA, 19 nt, Homo sapiens
gacaguuucuugaauugcu

SEQ ID NO: 1528585 - RNA, 19 nt, Homo sapiens
gucccaagcuccggaggaa

SEQ ID NO: 1528586 - RNA, 19 nt, Homo sapiens
aguaggagccauuucuuug

SEQ ID NO: 1528587 - RNA, 19 nt, Homo sapiens
ggcugugcuuguuccauuu

SEQ ID NO: 1528588 - RNA, 19 nt, Homo sapiens
ucaauguuccuuccagugu

SEQ ID NO: 1528589 - RNA, 19 nt, Homo sapiens
ucaaccaaaccucaaguau

SEQ ID NO: 1528590 - RNA, 19 nt, Homo sapiens
gcauaacacuuacuaguuu

SEQ ID NO: 1528591 - RNA, 19 nt, Homo sapiens
gaaagacucugaucacuuc

SEQ ID NO: 1528592 - RNA, 19 nt, Homo sapiens
gauaagccaugguauaauu

SEQ ID NO: 1528593 - RNA, 19 nt, Homo sapiens
gaucauagauguucuuagu

SEQ ID NO: 1528594 - RNA, 19 nt, Homo sapiens
gaaauuaccuagcaguugu

SEQ ID NO: 1528595 - RNA, 19 nt, Homo sapiens
uaacacagaucaauugguu

SEQ ID NO: 1528596 - RNA, 19 nt, Homo sapiens
caaacuaccuuuacauuca

SEQ ID NO: 1528597 - RNA, 19 nt, Homo sapiens
ggaaucaguuuaaucagaa

SEQ ID NO: 1528598 - RNA, 19 nt, Homo sapiens
caucggagcuacagaaauu

SEQ ID NO: 1528599 - RNA, 19 nt, Homo sapiens
gaaacaaacuaccuuuaca

SEQ ID NO: 1528600 - RNA, 19 nt, Homo sapiens
guagccaucuucacuguua

SEQ ID NO: 1528601 - RNA, 19 nt, Homo sapiens
ggauaaggaugccaagaaa

SEQ ID NO: 1528602 - RNA, 19 nt, Homo sapiens
gcagucaaguauuucuuua

SEQ ID NO: 1528603 - RNA, 19 nt, Homo sapiens
gaugugaugugaaauuuga

SEQ ID NO: 1528604 - RNA, 19 nt, Homo sapiens
guuaagcagucaaguauuu

SEQ ID NO: 1528605 - RNA, 19 nt, Homo sapiens
gaagcugucuugaauuaga

SEQ ID NO: 1528606 - RNA, 19 nt, Homo sapiens
gcucucaucuauuguuuaa

SEQ ID NO: 1528607 - RNA, 19 nt, Homo sapiens
gaaaccaccuuuguucuug

SEQ ID NO: 1528608 - RNA, 19 nt, Homo sapiens
uggaagcugucuugaauua

SEQ ID NO: 1528609 - RNA, 19 nt, Homo sapiens
ucagaggcauuauagaaua

SEQ ID NO: 1528610 - RNA, 19 nt, Homo sapiens
gcugacacguuuaauaauu

SEQ ID NO: 1528611 - RNA, 19 nt, Homo sapiens
uaauguaccucccucagua

SEQ ID NO: 1528612 - RNA, 19 nt, Homo sapiens
ggauauaaauuacguaguc

SEQ ID NO: 1528613 - RNA, 19 nt, Homo sapiens
agaaggcucucauaaguuu

SEQ ID NO: 1528614 - RNA, 19 nt, Homo sapiens
cagcauuucuuugaucuua

SEQ ID NO: 1528615 - RNA, 19 nt, Homo sapiens
gaagaugugaugugaaauu

SEQ ID NO: 1528616 - RNA, 19 nt, Homo sapiens
gaagcacuguugugaagaa

SEQ ID NO: 1528617 - RNA, 19 nt, Homo sapiens
ggagaagguuguauugugu

SEQ ID NO: 1528618 - RNA, 19 nt, Homo sapiens
uagaaggucugauuaguug

SEQ ID NO: 1528619 - RNA, 19 nt, Homo sapiens
gaacugcucugcaagaaaa

SEQ ID NO: 1528620 - RNA, 19 nt, Homo sapiens
cagaggaaauugaagcuaa

SEQ ID NO: 1528621 - RNA, 19 nt, Homo sapiens
guagagaucaucacaugua

SEQ ID NO: 1528622 - RNA, 19 nt, Homo sapiens
gaaaauaaguucagugcuu

SEQ ID NO: 1528623 - RNA, 19 nt, Homo sapiens
gcaguuuggugcaauuuau

SEQ ID NO: 1528624 - RNA, 19 nt, Homo sapiens
gaaauuauagggcaguuug

SEQ ID NO: 1528625 - RNA, 19 nt, Homo sapiens
ugucagcucuugauaauau

SEQ ID NO: 1528626 - RNA, 19 nt, Homo sapiens
ccuaaggaguguaguuaua

SEQ ID NO: 1528627 - RNA, 19 nt, Homo sapiens
caaauuauucggucucuuu

SEQ ID NO: 1528628 - RNA, 19 nt, Homo sapiens
caagugagccauuacauga

SEQ ID NO: 1528629 - RNA, 19 nt, Homo sapiens
gggccagacuuucagauaa

SEQ ID NO: 1528630 - RNA, 19 nt, Homo sapiens
gagaaacaaacuaccuuua

SEQ ID NO: 1528631 - RNA, 19 nt, Homo sapiens
gagagaggccuacuaauca

SEQ ID NO: 1528632 - RNA, 19 nt, Homo sapiens
aaacuuccauucagcuuaa

SEQ ID NO: 1528633 - RNA, 19 nt, Homo sapiens
gagcuaauguguuugauac

SEQ ID NO: 1528634 - RNA, 19 nt, Homo sapiens
gagcccaagucauguaauu

SEQ ID NO: 1528635 - RNA, 19 nt, Homo sapiens
aaagacaagucaucauuug

SEQ ID NO: 1528636 - RNA, 19 nt, Homo sapiens
caaacaggauuauaaaguc

SEQ ID NO: 1528637 - RNA, 19 nt, Homo sapiens
uuagagaaaugguagauga

SEQ ID NO: 1528638 - RNA, 19 nt, Homo sapiens
gaugagcccugaaauacug

SEQ ID NO: 1528639 - RNA, 19 nt, Homo sapiens
gcgaggagguaaacucuau

SEQ ID NO: 1528640 - RNA, 19 nt, Homo sapiens
cuaagaaacucaagacauc

SEQ ID NO: 1528641 - RNA, 19 nt, Homo sapiens
guugaugccuuccuuuauu

SEQ ID NO: 1528642 - RNA, 19 nt, Homo sapiens
cuagaaggcucucauaagu

SEQ ID NO: 1528643 - RNA, 19 nt, Homo sapiens
gaaguggauuucucuuuua

SEQ ID NO: 1528644 - RNA, 19 nt, Homo sapiens
agaagaggaugaugaaaug

SEQ ID NO: 1528645 - RNA, 19 nt, Homo sapiens
aaugggagcuaauguguuu

SEQ ID NO: 1528646 - RNA, 19 nt, Homo sapiens
gugcaaugcucgacuaaug

SEQ ID NO: 1528647 - RNA, 19 nt, Homo sapiens
gcaguuugcucuugagaca

SEQ ID NO: 1528648 - RNA, 19 nt, Homo sapiens
gacaagucaucauuugaaa

SEQ ID NO: 1528649 - RNA, 19 nt, Homo sapiens
uaaaggagagguagauuga

SEQ ID NO: 1528650 - RNA, 19 nt, Homo sapiens
gagcauugauucaccuaug

SEQ ID NO: 1528651 - RNA, 19 nt, Homo sapiens
caaccucagucuaccauga

SEQ ID NO: 1528652 - RNA, 19 nt, Homo sapiens
ggaaagugcugaggauagu

SEQ ID NO: 1528653 - RNA, 19 nt, Homo sapiens
agauaaagguggaagugua

SEQ ID NO: 1528654 - RNA, 19 nt, Homo sapiens
uggaagaugugaugugaaa

SEQ ID NO: 1528655 - RNA, 19 nt, Homo sapiens
gauauucagucgcuacuag

SEQ ID NO: 1528656 - RNA, 19 nt, Homo sapiens
gagaaaugguagaugaaau

SEQ ID NO: 1528657 - RNA, 19 nt, Homo sapiens
ggagaaauagauuaaguga

SEQ ID NO: 1528658 - RNA, 19 nt, Homo sapiens
gcacuguugugaagaacuu

SEQ ID NO: 1528659 - RNA, 19 nt, Homo sapiens
cucaagacaucuauaagua

SEQ ID NO: 1528660 - RNA, 19 nt, Homo sapiens
ggccagacuuucagauaaa

SEQ ID NO: 1528661 - RNA, 19 nt, Homo sapiens
gaacgaacagcauguaaag

SEQ ID NO: 1528662 - RNA, 19 nt, Homo sapiens
ccacuaaauuauugagcua

SEQ ID NO: 1528663 - RNA, 19 nt, Homo sapiens
gagaagaaaguacuauaug

SEQ ID NO: 1528664 - RNA, 19 nt, Homo sapiens
gacccaaacaggauuauaa

SEQ ID NO: 1528665 - RNA, 19 nt, Homo sapiens
ggaagugaguagcugauca

SEQ ID NO: 1528666 - RNA, 19 nt, Homo sapiens
cgaaugaggcacaacuaua

SEQ ID NO: 1528667 - RNA, 19 nt, Homo sapiens
uuuaugagcuuucacauuc

SEQ ID NO: 1528668 - RNA, 19 nt, Homo sapiens
gaucaucacauguauggaa

SEQ ID NO: 1528669 - RNA, 19 nt, Homo sapiens
ggagguaauuuccauagca

SEQ ID NO: 1528670 - RNA, 19 nt, Homo sapiens
ggagguaaacucuauuguu

SEQ ID NO: 1528671 - RNA, 19 nt, Homo sapiens
aaagucaagugaggaauaa

SEQ ID NO: 1528672 - RNA, 19 nt, Homo sapiens
guagaugaaaugcucuuua

SEQ ID NO: 1528673 - RNA, 19 nt, Homo sapiens
ucacgacgcuaugccauuu

SEQ ID NO: 1528674 - RNA, 19 nt, Homo sapiens
gaacagcauguaaaggaaa

SEQ ID NO: 1528675 - RNA, 19 nt, Homo sapiens
gguaaucucuuaauguaac

SEQ ID NO: 1528676 - RNA, 19 nt, Homo sapiens
gcaguaaauuagguacgua

SEQ ID NO: 1528677 - RNA, 19 nt, Homo sapiens
guuuagugauccagaauuu

SEQ ID NO: 1528678 - RNA, 19 nt, Homo sapiens
aauggaagcugucuugaau

SEQ ID NO: 1528679 - RNA, 19 nt, Homo sapiens
ugucauugccacuaaauua

SEQ ID NO: 1528680 - RNA, 19 nt, Homo sapiens
gugcuaauuuccauuguga

SEQ ID NO: 1528681 - RNA, 19 nt, Homo sapiens
gcaagaggcaguuucuaga

SEQ ID NO: 1528682 - RNA, 19 nt, Homo sapiens
cuugaaaguuuaacggaua

SEQ ID NO: 1528683 - RNA, 19 nt, Homo sapiens
ggaaagacucugaucacuu

SEQ ID NO: 1528684 - RNA, 19 nt, Homo sapiens
uggcucaguuggauuauuu

SEQ ID NO: 1528685 - RNA, 19 nt, Homo sapiens
ucacauguauggaaaccuu

SEQ ID NO: 1528686 - RNA, 19 nt, Homo sapiens
uaaagucaagugaggaaua

SEQ ID NO: 1528687 - RNA, 19 nt, Homo sapiens
uaucaacucuaaugcauca

SEQ ID NO: 1528688 - RNA, 19 nt, Homo sapiens
ggaaaccaccuuuguucuu

SEQ ID NO: 1528689 - RNA, 19 nt, Homo sapiens
gcauuugcaggauuucuua

SEQ ID NO: 1528690 - RNA, 19 nt, Homo sapiens
aaacgaagauaucaccuuu

SEQ ID NO: 1528691 - RNA, 19 nt, Homo sapiens
gcacuggccuuuagucugu

SEQ ID NO: 1528692 - RNA, 19 nt, Homo sapiens
gcaaaguacucagcagaga

SEQ ID NO: 1528693 - RNA, 19 nt, Homo sapiens
ggaagaaggaguugaagga

SEQ ID NO: 1528694 - RNA, 19 nt, Homo sapiens
gaaaagaucagcaaacuug

SEQ ID NO: 1528695 - RNA, 19 nt, Homo sapiens
gcaugaaccuccucaagag

SEQ ID NO: 1528696 - RNA, 19 nt, Homo sapiens
aggaugaacugaagaagaa

SEQ ID NO: 1528697 - RNA, 19 nt, Homo sapiens
gaacugaagaagaaagaga

SEQ ID NO: 1528698 - RNA, 19 nt, Homo sapiens
ggcuacagauguucaauug

SEQ ID NO: 1528699 - RNA, 19 nt, Homo sapiens
uaagugcacuggccuuuag

SEQ ID NO: 1528700 - RNA, 19 nt, Homo sapiens
ccacauauccuguucucaa

SEQ ID NO: 1528701 - RNA, 19 nt, Homo sapiens
caaggaggaugaacugaag

SEQ ID NO: 1528702 - RNA, 19 nt, Homo sapiens
cagcagggcuucucguaca

SEQ ID NO: 1528703 - RNA, 19 nt, Homo sapiens
gagccacccugcagucaau

SEQ ID NO: 1528704 - RNA, 19 nt, Homo sapiens
uacaauggcuacagauguu

SEQ ID NO: 1528705 - RNA, 19 nt, Homo sapiens
gcacgugacccacauccaa

SEQ ID NO: 1528706 - RNA, 19 nt, Homo sapiens
ucaauuggcugguuaucca

SEQ ID NO: 1528707 - RNA, 19 nt, Homo sapiens
ccucaacgcuaguauuaag

SEQ ID NO: 1528708 - RNA, 19 nt, Homo sapiens
ucacagcaguaccugauuc

SEQ ID NO: 1528709 - RNA, 19 nt, Homo sapiens
agaaagagaaggagcagaa

SEQ ID NO: 1528710 - RNA, 19 nt, Homo sapiens
gaggaugaacugaagaaga

SEQ ID NO: 1528711 - RNA, 19 nt, Homo sapiens
acgaagauaucaccuuuua

SEQ ID NO: 1528712 - RNA, 19 nt, Homo sapiens
uaagugagaguuccuguuc

SEQ ID NO: 1528713 - RNA, 19 nt, Homo sapiens
gagaguuccuguucugcau

SEQ ID NO: 1528714 - RNA, 19 nt, Homo sapiens
gagaguuccuguucugcau

SEQ ID NO: 1528715 - RNA, 19 nt, Homo sapiens
gaagauaucaccuuuuaca

SEQ ID NO: 1528716 - RNA, 19 nt, Homo sapiens
uccaaaggcugagcugaaa

SEQ ID NO: 1528717 - RNA, 19 nt, Homo sapiens
gauguucaauuggcugguu

SEQ ID NO: 1528718 - RNA, 19 nt, Homo sapiens
ccucaacacuaguauuaag

SEQ ID NO: 1528719 - RNA, 19 nt, Homo sapiens
cagagaagaagacaucgaa

SEQ ID NO: 1528720 - RNA, 19 nt, Homo sapiens
ccaaggaggaugaacugaa

SEQ ID NO: 1528721 - RNA, 19 nt, Homo sapiens
gaacacagagaagaagaca

SEQ ID NO: 1528722 - RNA, 19 nt, Homo sapiens
gcuaagcgcaauccaguuc

SEQ ID NO: 1528723 - RNA, 19 nt, Homo sapiens
gagcugaaacuggagaaga

SEQ ID NO: 1528724 - RNA, 19 nt, Homo sapiens
cgugaaaacucuuacuaaa

SEQ ID NO: 1528725 - RNA, 19 nt, Homo sapiens
acacagagaagaagacauc

SEQ ID NO: 1528726 - RNA, 19 nt, Homo sapiens
ggaaacagacuugcuaagc

SEQ ID NO: 1528727 - RNA, 19 nt, Homo sapiens
gacagcagggcuucucgua

SEQ ID NO: 1528728 - RNA, 19 nt, Homo sapiens
ucaaggaugucuggagcuu

SEQ ID NO: 1528729 - RNA, 19 nt, Homo sapiens
gauuguagcaucucaguac

SEQ ID NO: 1528730 - RNA, 19 nt, Homo sapiens
cauauccuguucucaagau

SEQ ID NO: 1528731 - RNA, 19 nt, Homo sapiens
ugaagaagaaagagaagga

SEQ ID NO: 1528732 - RNA, 19 nt, Homo sapiens
cccaguaccugacaucaag

SEQ ID NO: 1528733 - RNA, 19 nt, Homo sapiens
cugauucccuaccgugaaa

SEQ ID NO: 1528734 - RNA, 19 nt, Homo sapiens
gaagaaaacgaagauauca

SEQ ID NO: 1528735 - RNA, 19 nt, Homo sapiens
gucagauccuggaaacaga

SEQ ID NO: 1528736 - RNA, 19 nt, Homo sapiens
gaaagaaaagaucagcaaa

SEQ ID NO: 1528737 - RNA, 19 nt, Homo sapiens
gccagaacacagagaagaa

SEQ ID NO: 1528738 - RNA, 19 nt, Homo sapiens
guccaaaggcugagcugaa

SEQ ID NO: 1528739 - RNA, 19 nt, Homo sapiens
cgugagaguuccuguucug

SEQ ID NO: 1528740 - RNA, 19 nt, Homo sapiens
ggaaagaaaagaucagcaa

SEQ ID NO: 1528741 - RNA, 19 nt, Homo sapiens
gucuggagcuuccuuuuaa

SEQ ID NO: 1528742 - RNA, 19 nt, Homo sapiens
uagcaucucaguacucuag

SEQ ID NO: 1528743 - RNA, 19 nt, Homo sapiens
gauccuggaaacagacuug

SEQ ID NO: 1528744 - RNA, 19 nt, Homo sapiens
ccgggaagccugucugugu

SEQ ID NO: 1528745 - RNA, 19 nt, Homo sapiens
gaaacuggagaagaaguca

SEQ ID NO: 1528746 - RNA, 19 nt, Homo sapiens
caagccagaacacagagaa

SEQ ID NO: 1528747 - RNA, 19 nt, Homo sapiens
caaguccuccagaugcauu

SEQ ID NO: 1528748 - RNA, 19 nt, Homo sapiens
gaaagagaaggagcagaag

SEQ ID NO: 1528749 - RNA, 19 nt, Homo sapiens
cacauauccuguucucaag

SEQ ID NO: 1528750 - RNA, 19 nt, Homo sapiens
agcugaaacuggagaagaa

SEQ ID NO: 1528751 - RNA, 19 nt, Homo sapiens
guacauuggagaagcucaa

SEQ ID NO: 1528752 - RNA, 19 nt, Homo sapiens
ccuggaaacagacuugcua

SEQ ID NO: 1528753 - RNA, 19 nt, Homo sapiens
ugacccacauccaagaucu

SEQ ID NO: 1528754 - RNA, 19 nt, Homo sapiens
uccuggagcuccuguguca

SEQ ID NO: 1528755 - RNA, 19 nt, Homo sapiens
ggauacccaccaucucugu

SEQ ID NO: 1528756 - RNA, 19 nt, Homo sapiens
auccucaacacuaguauua

SEQ ID NO: 1528757 - RNA, 19 nt, Homo sapiens
uaagcgcaauccaguucug

SEQ ID NO: 1528758 - RNA, 19 nt, Homo sapiens
aagagaaggagcagaagga

SEQ ID NO: 1528759 - RNA, 19 nt, Homo sapiens
ccuggcaccuacugcuuug

SEQ ID NO: 1528760 - RNA, 19 nt, Homo sapiens
ccacugaugaguccaaagg

SEQ ID NO: 1528761 - RNA, 19 nt, Homo sapiens
uuaagugcacuggccuuua

SEQ ID NO: 1528762 - RNA, 19 nt, Homo sapiens
ugcaugaaccuccucaaga

SEQ ID NO: 1528763 - RNA, 19 nt, Homo sapiens
auccucaacgcuaguauua

SEQ ID NO: 1528764 - RNA, 19 nt, Homo sapiens
aagcucaaguccuccagau

SEQ ID NO: 1528765 - RNA, 19 nt, Homo sapiens
gcaucucaguacucuagag

SEQ ID NO: 1528766 - RNA, 19 nt, Homo sapiens
caaaggcugagcugaaacu

SEQ ID NO: 1528767 - RNA, 19 nt, Homo sapiens
caccaucucuguccccauu

SEQ ID NO: 1528768 - RNA, 19 nt, Homo sapiens
cauacaauggcuacagaug

SEQ ID NO: 1528769 - RNA, 19 nt, Homo sapiens
cagaacacagagaagaaga

SEQ ID NO: 1528770 - RNA, 19 nt, Homo sapiens
ccuggaagaaggaguugaa

SEQ ID NO: 1528771 - RNA, 19 nt, Homo sapiens
gcccaguaccugacaucaa

SEQ ID NO: 1528772 - RNA, 19 nt, Homo sapiens
auacaauggcuacagaugu

SEQ ID NO: 1528773 - RNA, 19 nt, Homo sapiens
agugagaguuccuguucug

SEQ ID NO: 1528774 - RNA, 19 nt, Homo sapiens
acacuuccaccaccaguuc

SEQ ID NO: 1528775 - RNA, 19 nt, Homo sapiens
gaagaaagacgcacaggaa

SEQ ID NO: 1528776 - RNA, 19 nt, Homo sapiens
gaaaagaaauggugcaaau

SEQ ID NO: 1528777 - RNA, 19 nt, Homo sapiens
gaacaaaagugccuugaau

SEQ ID NO: 1528778 - RNA, 19 nt, Homo sapiens
ggacuuggguuuuacauuu

SEQ ID NO: 1528779 - RNA, 19 nt, Homo sapiens
gagaucaggugggaaguuu

SEQ ID NO: 1528780 - RNA, 19 nt, Homo sapiens
ggagaugguuccaggagaa

SEQ ID NO: 1528781 - RNA, 19 nt, Homo sapiens
gaagucagcagaaagaaga

SEQ ID NO: 1528782 - RNA, 19 nt, Homo sapiens
gaaagacgcacaggaaaga

SEQ ID NO: 1528783 - RNA, 19 nt, Homo sapiens
guccaaagaucacugaguu

SEQ ID NO: 1528784 - RNA, 19 nt, Homo sapiens
gagaagaggccaauagaca

SEQ ID NO: 1528785 - RNA, 19 nt, Homo sapiens
ccuauaaucccaacacuuu

SEQ ID NO: 1528786 - RNA, 19 nt, Homo sapiens
ccugucaacuccaccuuua

SEQ ID NO: 1528787 - RNA, 19 nt, Homo sapiens
ccaaagaucacugaguuaa

SEQ ID NO: 1528788 - RNA, 19 nt, Homo sapiens
ccucaacuauuaauggaaa

SEQ ID NO: 1528789 - RNA, 19 nt, Homo sapiens
uugggagccucaacuauua

SEQ ID NO: 1528790 - RNA, 19 nt, Homo sapiens
agacacaacuggcuucauc

SEQ ID NO: 1528791 - RNA, 19 nt, Homo sapiens
caaguucucuggaucacau

SEQ ID NO: 1528792 - RNA, 19 nt, Homo sapiens
gaaagaacugauucauaga

SEQ ID NO: 1528793 - RNA, 19 nt, Homo sapiens
aaagugccuugaauaaaga

SEQ ID NO: 1528794 - RNA, 19 nt, Homo sapiens
agaaggaagucagcagaaa

SEQ ID NO: 1528795 - RNA, 19 nt, Homo sapiens
caaagaucacugaguuaaa

SEQ ID NO: 1528796 - RNA, 19 nt, Homo sapiens
acaacuggcuucaucuuca

SEQ ID NO: 1528797 - RNA, 19 nt, Homo sapiens
gaucaggugggaaguuuau

SEQ ID NO: 1528798 - RNA, 19 nt, Homo sapiens
aaagaucacugaguuaaac

SEQ ID NO: 1528799 - RNA, 19 nt, Homo sapiens
gcaggagaauugcuugaac

SEQ ID NO: 1528800 - RNA, 19 nt, Homo sapiens
gaaaccccaucucuacuaa

SEQ ID NO: 1528801 - RNA, 19 nt, Homo sapiens
gaaaccccaucucuacuaa

SEQ ID NO: 1528802 - RNA, 19 nt, Homo sapiens
aaagaaauggugcaaaugu

SEQ ID NO: 1528803 - RNA, 19 nt, Homo sapiens
ccagcggagucuuuauuga

SEQ ID NO: 1528804 - RNA, 19 nt, Homo sapiens
acacuugcuuuggcuauuu

SEQ ID NO: 1528805 - RNA, 19 nt, Homo sapiens
ggaaguuuauccugucaac

SEQ ID NO: 1528806 - RNA, 19 nt, Homo sapiens
gaagaaagagacagagacu

SEQ ID NO: 1528807 - RNA, 19 nt, Homo sapiens
gaagaggccaauagacaca

SEQ ID NO: 1528808 - RNA, 19 nt, Homo sapiens
gguacuuggugccgaagaa

SEQ ID NO: 1528809 - RNA, 19 nt, Homo sapiens
gagaaggaagucagcagaa

SEQ ID NO: 1528810 - RNA, 19 nt, Homo sapiens
gaucacaaggucaggaguu

SEQ ID NO: 1528811 - RNA, 19 nt, Homo sapiens
ccacaaggacugaaacucu

SEQ ID NO: 1528812 - RNA, 19 nt, Homo sapiens
gaaggaagucagcagaaag

SEQ ID NO: 1528813 - RNA, 19 nt, Homo sapiens
uagcagaagccaagaacaa

SEQ ID NO: 1528814 - RNA, 19 nt, Homo sapiens
cacaaauucucuaguagca

SEQ ID NO: 1528815 - RNA, 19 nt, Homo sapiens
cagcggagucuuuauugaa

SEQ ID NO: 1528816 - RNA, 19 nt, Homo sapiens
gccggacgcuagcuuccua

SEQ ID NO: 1528817 - RNA, 19 nt, Homo sapiens
cgcgguagcucacgccuau

SEQ ID NO: 1528818 - RNA, 19 nt, Homo sapiens
aaaagugccuugaauaaag

SEQ ID NO: 1528819 - RNA, 19 nt, Homo sapiens
uuucuugaguuucagauga

SEQ ID NO: 1528820 - RNA, 19 nt, Homo sapiens
aagaaauggugcaaaugug

SEQ ID NO: 1528821 - RNA, 19 nt, Homo sapiens
gaaacagagaugguacuug

SEQ ID NO: 1528822 - RNA, 19 nt, Homo sapiens
ucgagaccauccuggcuaa

SEQ ID NO: 1528823 - RNA, 19 nt, Homo sapiens
gcacacuugcuuuggcuau

SEQ ID NO: 1528824 - RNA, 19 nt, Homo sapiens
gacuuggguuuuacauuua

SEQ ID NO: 1528825 - RNA, 19 nt, Homo sapiens
aaagagagaaggguagcua

SEQ ID NO: 1528826 - RNA, 19 nt, Homo sapiens
agacagagacugggaagga

SEQ ID NO: 1528827 - RNA, 19 nt, Homo sapiens
cagaagccaagaacaaguu

SEQ ID NO: 1528828 - RNA, 19 nt, Homo sapiens
gcagaagccaagaacaagu

SEQ ID NO: 1528829 - RNA, 19 nt, Homo sapiens
ggagaauugcuugaaccua

SEQ ID NO: 1528830 - RNA, 19 nt, Homo sapiens
caaaagugccuugaauaaa

SEQ ID NO: 1528831 - RNA, 19 nt, Homo sapiens
gagccucaacuauuaaugg

SEQ ID NO: 1528832 - RNA, 19 nt, Homo sapiens
ggaagucagcagaaagaag

SEQ ID NO: 1528833 - RNA, 19 nt, Homo sapiens
acaaaagugccuugaauaa

SEQ ID NO: 1528834 - RNA, 19 nt, Homo sapiens
gucaggagaucgagaccau

SEQ ID NO: 1528835 - RNA, 19 nt, Homo sapiens
agcggagucuuuauugaaa

SEQ ID NO: 1528836 - RNA, 19 nt, Homo sapiens
caacuggcuucaucuucag

SEQ ID NO: 1528837 - RNA, 19 nt, Homo sapiens
gaugguuccaggagaagaa

SEQ ID NO: 1528838 - RNA, 19 nt, Homo sapiens
agaccagccugaccaacau

SEQ ID NO: 1528839 - RNA, 19 nt, Homo sapiens
gaggugggcagaucacaag

SEQ ID NO: 1528840 - RNA, 19 nt, Homo sapiens
cuugggagccucaacuauu

SEQ ID NO: 1528841 - RNA, 19 nt, Homo sapiens
ggagccacaaggacugaaa

SEQ ID NO: 1528842 - RNA, 19 nt, Homo sapiens
agagagaaggguagcuaaa

SEQ ID NO: 1528843 - RNA, 19 nt, Homo sapiens
aagaaagacgcacaggaaa

SEQ ID NO: 1528844 - RNA, 19 nt, Homo sapiens
ugccuugaauaaagacgua

SEQ ID NO: 1528845 - RNA, 19 nt, Homo sapiens
cgguagcucacgccuauaa

SEQ ID NO: 1528846 - RNA, 19 nt, Homo sapiens
gaggugggcggaucucagu

SEQ ID NO: 1528847 - RNA, 19 nt, Homo sapiens
gaaggcugaggcaggagaa

SEQ ID NO: 1528848 - RNA, 19 nt, Homo sapiens
guacuuggugccgaagaaa

SEQ ID NO: 1528849 - RNA, 19 nt, Homo sapiens
ucagggacacccaauaucu

SEQ ID NO: 1528850 - RNA, 19 nt, Homo sapiens
aaggaagucagcagaaaga

SEQ ID NO: 1528851 - RNA, 19 nt, Homo sapiens
guagcucacgccuauaauc

SEQ ID NO: 1528852 - RNA, 19 nt, Homo sapiens
ccgagggacuuggguuuua

SEQ ID NO: 1528853 - RNA, 19 nt, Homo sapiens
gagagaaggguagcuaaaa

SEQ ID NO: 1528854 - RNA, 19 nt, Homo sapiens
ggcugaggcaggagaauug

SEQ ID NO: 1528855 - RNA, 19 nt, Homo sapiens
gagaccauccuggcuaaca

SEQ ID NO: 1528856 - RNA, 19 nt, Homo sapiens
cuucagggacacccaauau

SEQ ID NO: 1528857 - RNA, 19 nt, Homo sapiens
ggagaagaggccaauagac

SEQ ID NO: 1528858 - RNA, 19 nt, Homo sapiens
ugucaacuccaccuuuaga

SEQ ID NO: 1528859 - RNA, 19 nt, Homo sapiens
uggagaagaggccaauaga

SEQ ID NO: 1528860 - RNA, 19 nt, Homo sapiens
cagagacccaccacugaug

SEQ ID NO: 1528861 - RNA, 19 nt, Homo sapiens
gaaggguagcuaaaagaaa

SEQ ID NO: 1528862 - RNA, 19 nt, Homo sapiens
cacacuugcuuuggcuauu

SEQ ID NO: 1528863 - RNA, 19 nt, Homo sapiens
ggccgagggacuuggguuu

SEQ ID NO: 1528864 - RNA, 19 nt, Homo sapiens
agacugggaaggagaagga

SEQ ID NO: 1528865 - RNA, 19 nt, Homo sapiens
agaaagacgcacaggaaag

SEQ ID NO: 1528866 - RNA, 19 nt, Homo sapiens
uccaaagaucacugaguua

SEQ ID NO: 1528867 - RNA, 19 nt, Homo sapiens
guaaucccagccacucaga

SEQ ID NO: 1528868 - RNA, 19 nt, Homo sapiens
gcuguugcuuuagccauca

SEQ ID NO: 1528869 - RNA, 19 nt, Homo sapiens
guucaacggaaauucacaa

SEQ ID NO: 1528870 - RNA, 19 nt, Homo sapiens
ccaucaggcucaggaacug

SEQ ID NO: 1528871 - RNA, 19 nt, Homo sapiens
gagaaggguagcuaaaaga

SEQ ID NO: 1528872 - RNA, 19 nt, Homo sapiens
ggcaggagaauugcuugaa

SEQ ID NO: 1528873 - RNA, 19 nt, Homo sapiens
caaggucaggaguucaaga

SEQ ID NO: 1528874 - RNA, 19 nt, Homo sapiens
cacaaggucaggaguucaa

SEQ ID NO: 1528875 - RNA, 19 nt, Homo sapiens
gaaaugcuguggacuaauu

SEQ ID NO: 1528876 - RNA, 19 nt, Homo sapiens
gaacagcucuggaagugaa

SEQ ID NO: 1528877 - RNA, 19 nt, Homo sapiens
ggagaauccuaucacauua

SEQ ID NO: 1528878 - RNA, 19 nt, Homo sapiens
gcacagugauaauccauuu

SEQ ID NO: 1528879 - RNA, 19 nt, Homo sapiens
gcacggaaaucaaauuaau

SEQ ID NO: 1528880 - RNA, 19 nt, Homo sapiens
ggagggaacuugccagaga

SEQ ID NO: 1528881 - RNA, 19 nt, Homo sapiens
gcacacaaauuuggguuaa

SEQ ID NO: 1528882 - RNA, 19 nt, Homo sapiens
ugacaucccuguuccuuaa

SEQ ID NO: 1528883 - RNA, 19 nt, Homo sapiens
ccacaaacauuaccuguca

SEQ ID NO: 1528884 - RNA, 19 nt, Homo sapiens
cagcaacacuguggaauaa

SEQ ID NO: 1528885 - RNA, 19 nt, Homo sapiens
ccagaaggcacacaaauuu

SEQ ID NO: 1528886 - RNA, 19 nt, Homo sapiens
ggaugugcaugccauagua

SEQ ID NO: 1528887 - RNA, 19 nt, Homo sapiens
gaacagucuuugucagaug

SEQ ID NO: 1528888 - RNA, 19 nt, Homo sapiens
gcaggcagaucuggcauuu

SEQ ID NO: 1528889 - RNA, 19 nt, Homo sapiens
ccacaagccuaaggaagua

SEQ ID NO: 1528890 - RNA, 19 nt, Homo sapiens
cuaauuccaugguuacuuu

SEQ ID NO: 1528891 - RNA, 19 nt, Homo sapiens
ugacaucucugccauuuua

SEQ ID NO: 1528892 - RNA, 19 nt, Homo sapiens
ucacagaccaagcccauua

SEQ ID NO: 1528893 - RNA, 19 nt, Homo sapiens
ggacagcgcggaucucaga

SEQ ID NO: 1528894 - RNA, 19 nt, Homo sapiens
ccuaguauguggaauuauu

SEQ ID NO: 1528895 - RNA, 19 nt, Homo sapiens
uagaaaugcuguggacuaa

SEQ ID NO: 1528896 - RNA, 19 nt, Homo sapiens
uuaaacacgucaucaauuc

SEQ ID NO: 1528897 - RNA, 19 nt, Homo sapiens
gcaacacuguggaauaagu

SEQ ID NO: 1528898 - RNA, 19 nt, Homo sapiens
aaagugagccgcacaguga

SEQ ID NO: 1528899 - RNA, 19 nt, Homo sapiens
acugggagauuuagcaaua

SEQ ID NO: 1528900 - RNA, 19 nt, Homo sapiens
caugacaucucugccauuu

SEQ ID NO: 1528901 - RNA, 19 nt, Homo sapiens
gcagaggugugcgagauga

SEQ ID NO: 1528902 - RNA, 19 nt, Homo sapiens
gaaauccuaauguucauga

SEQ ID NO: 1528903 - RNA, 19 nt, Homo sapiens
acacagcguucucugauug

SEQ ID NO: 1528904 - RNA, 19 nt, Homo sapiens
gaagauguaugaaaaguca

SEQ ID NO: 1528905 - RNA, 19 nt, Homo sapiens
uuugauaucuggagagaaa

SEQ ID NO: 1528906 - RNA, 19 nt, Homo sapiens
gagcaucuuuccugucugu

SEQ ID NO: 1528907 - RNA, 19 nt, Homo sapiens
gguaacaccuccucacucu

SEQ ID NO: 1528908 - RNA, 19 nt, Homo sapiens
caugguuacuuugucauua

SEQ ID NO: 1528909 - RNA, 19 nt, Homo sapiens
gggcacggaaaucaaauua

SEQ ID NO: 1528910 - RNA, 19 nt, Homo sapiens
ucacagaagauguaugaaa

SEQ ID NO: 1528911 - RNA, 19 nt, Homo sapiens
gcagagagagaaggauuaa

SEQ ID NO: 1528912 - RNA, 19 nt, Homo sapiens
uggaauaaguguaaugugu

SEQ ID NO: 1528913 - RNA, 19 nt, Homo sapiens
agaccaagcccauuauuga

SEQ ID NO: 1528914 - RNA, 19 nt, Homo sapiens
uaacucauuuccaggauuc

SEQ ID NO: 1528915 - RNA, 19 nt, Homo sapiens
cauccuaugcuccacauua

SEQ ID NO: 1528916 - RNA, 19 nt, Homo sapiens
acugagaggucaccauaaa

SEQ ID NO: 1528917 - RNA, 19 nt, Homo sapiens
uacaaacacugggagauuu

SEQ ID NO: 1528918 - RNA, 19 nt, Homo sapiens
cuaagaagccgcagugaug

SEQ ID NO: 1528919 - RNA, 19 nt, Homo sapiens
cccgugagcuugugacuga

SEQ ID NO: 1528920 - RNA, 19 nt, Homo sapiens
gaaaggagcgcaggcagau

SEQ ID NO: 1528921 - RNA, 19 nt, Homo sapiens
gcacacagcguucucugau

SEQ ID NO: 1528922 - RNA, 19 nt, Homo sapiens
gaaacacguacccuagaaa

SEQ ID NO: 1528923 - RNA, 19 nt, Homo sapiens
agaaacacguacccuagaa

SEQ ID NO: 1528924 - RNA, 19 nt, Homo sapiens
ggugagugccuuucaggua

SEQ ID NO: 1528925 - RNA, 19 nt, Homo sapiens
gcugggagcuggacaacgu

SEQ ID NO: 1528926 - RNA, 19 nt, Homo sapiens
gggagcaucuuuccugucu

SEQ ID NO: 1528927 - RNA, 19 nt, Homo sapiens
gaguauuggcuguucauuu

SEQ ID NO: 1528928 - RNA, 19 nt, Homo sapiens
aaacaccgacugugaaguu

SEQ ID NO: 1528929 - RNA, 19 nt, Homo sapiens
ggaaucauaauggcaguuu

SEQ ID NO: 1528930 - RNA, 19 nt, Homo sapiens
guuaagagcagauauaagg

SEQ ID NO: 1528931 - RNA, 19 nt, Homo sapiens
gcaaggcccaugauaguag

SEQ ID NO: 1528932 - RNA, 19 nt, Homo sapiens
gagaaacacguacccuaga

SEQ ID NO: 1528933 - RNA, 19 nt, Homo sapiens
gagagaguauuggcuguuc

SEQ ID NO: 1528934 - RNA, 19 nt, Homo sapiens
gcaguuugcaccucuguug

SEQ ID NO: 1528935 - RNA, 19 nt, Homo sapiens
gaccugggcaagcucuuua

SEQ ID NO: 1528936 - RNA, 19 nt, Homo sapiens
gagagagaaggauuaaaug

SEQ ID NO: 1528937 - RNA, 19 nt, Homo sapiens
ucgcuuggcuuacuugcaa

SEQ ID NO: 1528938 - RNA, 19 nt, Homo sapiens
agagagagaaggauuaaau

SEQ ID NO: 1528939 - RNA, 19 nt, Homo sapiens
caacagaaggugaguuugg

SEQ ID NO: 1528940 - RNA, 19 nt, Homo sapiens
ggcaacagaaggugaguuu

SEQ ID NO: 1528941 - RNA, 19 nt, Homo sapiens
gccagaaggcacacaaauu

SEQ ID NO: 1528942 - RNA, 19 nt, Homo sapiens
gaaucauaauggcaguuug

SEQ ID NO: 1528943 - RNA, 19 nt, Homo sapiens
gcugagcucugccgucuac

SEQ ID NO: 1528944 - RNA, 19 nt, Homo sapiens
gcagauauuaggcccgauu

SEQ ID NO: 1528945 - RNA, 19 nt, Homo sapiens
acaaacacugggagauuua

SEQ ID NO: 1528946 - RNA, 19 nt, Homo sapiens
cauguuacucuacagguua

SEQ ID NO: 1528947 - RNA, 19 nt, Homo sapiens
gcgcggaucucagaacagu

SEQ ID NO: 1528948 - RNA, 19 nt, Homo sapiens
gggcugagggcuagaauca

SEQ ID NO: 1528949 - RNA, 19 nt, Homo sapiens
ccuccucacucuggaauuu

SEQ ID NO: 1528950 - RNA, 19 nt, Homo sapiens
gauauuaggcccgauucaa

SEQ ID NO: 1528951 - RNA, 19 nt, Homo sapiens
gauuaaaugguguuucaug

SEQ ID NO: 1528952 - RNA, 19 nt, Homo sapiens
cuagaaaugcuguggacua

SEQ ID NO: 1528953 - RNA, 19 nt, Homo sapiens
gaggagcgagagaguauug

SEQ ID NO: 1528954 - RNA, 19 nt, Homo sapiens
uaauaccucgcuuggcuua

SEQ ID NO: 1528955 - RNA, 19 nt, Homo sapiens
aaagggagacagaauucua

SEQ ID NO: 1528956 - RNA, 19 nt, Homo sapiens
aggauuaaaugguguuuca

SEQ ID NO: 1528957 - RNA, 19 nt, Homo sapiens
gcuucuggcugcacaacaa

SEQ ID NO: 1528958 - RNA, 19 nt, Homo sapiens
ggauugguauagguuaaga

SEQ ID NO: 1528959 - RNA, 19 nt, Homo sapiens
guggaaauccuaauguuca

SEQ ID NO: 1528960 - RNA, 19 nt, Homo sapiens
gggucucuuuccuauauaa

SEQ ID NO: 1528961 - RNA, 19 nt, Homo sapiens
cugggucucuuuccuauau

SEQ ID NO: 1528962 - RNA, 19 nt, Homo sapiens
gagaccacauggcuugcaa

SEQ ID NO: 1528963 - RNA, 19 nt, Homo sapiens
ucagcaacacuguggaaua

SEQ ID NO: 1528964 - RNA, 19 nt, Homo sapiens
uaacuagcccugucuccuu

SEQ ID NO: 1528965 - RNA, 19 nt, Homo sapiens
cacagaagauguaugaaaa

SEQ ID NO: 1528966 - RNA, 19 nt, Homo sapiens
gagagaaggauuaaauggu

SEQ ID NO: 1528967 - RNA, 19 nt, Homo sapiens
ggaagugaagugugugugu

SEQ ID NO: 1528968 - RNA, 19 nt, Homo sapiens
gaaaagggcacggaaauca

SEQ ID NO: 1528969 - RNA, 19 nt, Homo sapiens
ucucacagaagauguauga

SEQ ID NO: 1528970 - RNA, 19 nt, Homo sapiens
cagaaacaccgacugugaa

SEQ ID NO: 1528971 - RNA, 19 nt, Homo sapiens
ccagccaucuugguucuga

SEQ ID NO: 1528972 - RNA, 19 nt, Homo sapiens
caaggcccaugauaguaga

SEQ ID NO: 1528973 - RNA, 19 nt, Homo sapiens
ggcagagagagaaggauua

SEQ ID NO: 1528974 - RNA, 19 nt, Homo sapiens
ggacuaauuccaugguuac

SEQ ID NO: 1528975 - RNA, 19 nt, Homo sapiens
ggacaaauaugggcuaaua

SEQ ID NO: 1528976 - RNA, 19 nt, Homo sapiens
gcauuacacuuaccaauua

SEQ ID NO: 1528977 - RNA, 19 nt, Homo sapiens
gagauaaccuagcucuuua

SEQ ID NO: 1528978 - RNA, 19 nt, Homo sapiens
gaagagagcuguguugcaa

SEQ ID NO: 1528979 - RNA, 19 nt, Homo sapiens
gacaaaggcugaugaaugu

SEQ ID NO: 1528980 - RNA, 19 nt, Homo sapiens
uaaagaaguugaugaguug

SEQ ID NO: 1528981 - RNA, 19 nt, Homo sapiens
uaaccuagcucuuuauauc

SEQ ID NO: 1528982 - RNA, 19 nt, Homo sapiens
ggaaugggcucuccagcuu

SEQ ID NO: 1528983 - RNA, 19 nt, Homo sapiens
gaaacccugucucuauuaa

SEQ ID NO: 1528984 - RNA, 19 nt, Homo sapiens
gaaaggugcugcgcagaaa

SEQ ID NO: 1528985 - RNA, 19 nt, Homo sapiens
caaggaaucuucauuugau

SEQ ID NO: 1528986 - RNA, 19 nt, Homo sapiens
uaauauggauccagaagaa

SEQ ID NO: 1528987 - RNA, 19 nt, Homo sapiens
guagaaagcaggaguaaga

SEQ ID NO: 1528988 - RNA, 19 nt, Homo sapiens
gacaaggaaucuucauuug

SEQ ID NO: 1528989 - RNA, 19 nt, Homo sapiens
guaaggacuucaccuauca

SEQ ID NO: 1528990 - RNA, 19 nt, Homo sapiens
agaaacaacugucuugaga

SEQ ID NO: 1528991 - RNA, 19 nt, Homo sapiens
ccacucaaauccagcaauu

SEQ ID NO: 1528992 - RNA, 19 nt, Homo sapiens
ggagagaagcccaaucuau

SEQ ID NO: 1528993 - RNA, 19 nt, Homo sapiens
uaacaagcaugaugauaca

SEQ ID NO: 1528994 - RNA, 19 nt, Homo sapiens
ggucuuuccuagcuauaua

SEQ ID NO: 1528995 - RNA, 19 nt, Homo sapiens
gugaaacccugucucuauu

SEQ ID NO: 1528996 - RNA, 19 nt, Homo sapiens
cccaaacaauuaucuagua

SEQ ID NO: 1528997 - RNA, 19 nt, Homo sapiens
aaaguaaugucccuucaga

SEQ ID NO: 1528998 - RNA, 19 nt, Homo sapiens
ccaaaccucagcauauaua

SEQ ID NO: 1528999 - RNA, 19 nt, Homo sapiens
ccaaggaauuucucaagau

SEQ ID NO: 1529000 - RNA, 19 nt, Homo sapiens
gaaagccagugaugaagag

SEQ ID NO: 1529001 - RNA, 19 nt, Homo sapiens
gagcuguguugcaaucaaa

SEQ ID NO: 1529002 - RNA, 19 nt, Homo sapiens
cagaugauacuuccaaauu

SEQ ID NO: 1529003 - RNA, 19 nt, Homo sapiens
ucacauugguaucagauga

SEQ ID NO: 1529004 - RNA, 19 nt, Homo sapiens
gguaaggacuucaccuauc

SEQ ID NO: 1529005 - RNA, 19 nt, Homo sapiens
ccacaugaauaccaaggaa

SEQ ID NO: 1529006 - RNA, 19 nt, Homo sapiens
uaacagaugagucgauuau

SEQ ID NO: 1529007 - RNA, 19 nt, Homo sapiens
aauaugaucccuacaguaa

SEQ ID NO: 1529008 - RNA, 19 nt, Homo sapiens
gagagaagcccaaucuauc

SEQ ID NO: 1529009 - RNA, 19 nt, Homo sapiens
ggaguaagaguggaaauga

SEQ ID NO: 1529010 - RNA, 19 nt, Homo sapiens
ggugaaacccugucucuau

SEQ ID NO: 1529011 - RNA, 19 nt, Homo sapiens
gcaauugcaagauaaauca

SEQ ID NO: 1529012 - RNA, 19 nt, Homo sapiens
aagcuucccuucccucuuu

SEQ ID NO: 1529013 - RNA, 19 nt, Homo sapiens
gaguaagaguggaaaugaa

SEQ ID NO: 1529014 - RNA, 19 nt, Homo sapiens
ugagauaaccuagcucuuu

SEQ ID NO: 1529015 - RNA, 19 nt, Homo sapiens
caaggaauuucucaagauc

SEQ ID NO: 1529016 - RNA, 19 nt, Homo sapiens
gcugaugaauguacaguuc

SEQ ID NO: 1529017 - RNA, 19 nt, Homo sapiens
cccaaucuauccaauauga

SEQ ID NO: 1529018 - RNA, 19 nt, Homo sapiens
aaacaacugucuugagaag

SEQ ID NO: 1529019 - RNA, 19 nt, Homo sapiens
agacaaggaaucuucauuu

SEQ ID NO: 1529020 - RNA, 19 nt, Homo sapiens
agacaaaggcugaugaaug

SEQ ID NO: 1529021 - RNA, 19 nt, Homo sapiens
acagaugagucgauuauca

SEQ ID NO: 1529022 - RNA, 19 nt, Homo sapiens
uaaugucccuucagaaaca

SEQ ID NO: 1529023 - RNA, 19 nt, Homo sapiens
caacuacaguacccacaug

SEQ ID NO: 1529024 - RNA, 19 nt, Homo sapiens
ggacuucaccuaucauugg

SEQ ID NO: 1529025 - RNA, 19 nt, Homo sapiens
guugugaccuugcaaaugg

SEQ ID NO: 1529026 - RNA, 19 nt, Homo sapiens
agaaguugaugaguugaua

SEQ ID NO: 1529027 - RNA, 19 nt, Homo sapiens
gaugauacuuccaaauugc

SEQ ID NO: 1529028 - RNA, 19 nt, Homo sapiens
aaacuucuuucacaggauu

SEQ ID NO: 1529029 - RNA, 19 nt, Homo sapiens
gcacgcgccuguaauacca

SEQ ID NO: 1529030 - RNA, 19 nt, Homo sapiens
gauaaaccaacaacaccua

SEQ ID NO: 1529031 - RNA, 19 nt, Homo sapiens
gaaagcaauauuugaguuc

SEQ ID NO: 1529032 - RNA, 19 nt, Homo sapiens
gaaacaacugucuugagaa

SEQ ID NO: 1529033 - RNA, 19 nt, Homo sapiens
caggaucucugggacuuaa

SEQ ID NO: 1529034 - RNA, 19 nt, Homo sapiens
guacccacauguagaaagu

SEQ ID NO: 1529035 - RNA, 19 nt, Homo sapiens
gaaugggcucuccagcuua

SEQ ID NO: 1529036 - RNA, 19 nt, Homo sapiens
gaaguugaugaguugauaa

SEQ ID NO: 1529037 - RNA, 19 nt, Homo sapiens
ccaguugaaagcaauauuu

SEQ ID NO: 1529038 - RNA, 19 nt, Homo sapiens
ugaaacccugucucuauua

SEQ ID NO: 1529039 - RNA, 19 nt, Homo sapiens
gaagguggcaagacaguag

SEQ ID NO: 1529040 - RNA, 19 nt, Homo sapiens
ggcauuacacuuaccaauu

SEQ ID NO: 1529041 - RNA, 19 nt, Homo sapiens
agaugauacuuccaaauug

SEQ ID NO: 1529042 - RNA, 19 nt, Homo sapiens
aaagagugguuaacaagca

SEQ ID NO: 1529043 - RNA, 19 nt, Homo sapiens
ccaauaugaucccuacagu

SEQ ID NO: 1529044 - RNA, 19 nt, Homo sapiens
gcagaagguccuacagugu

SEQ ID NO: 1529045 - RNA, 19 nt, Homo sapiens
ccaaauugccacucaaauc

SEQ ID NO: 1529046 - RNA, 19 nt, Homo sapiens
gaaagcagaagguccuaca

SEQ ID NO: 1529047 - RNA, 19 nt, Homo sapiens
gguuaggaguucaagauca

SEQ ID NO: 1529048 - RNA, 19 nt, Homo sapiens
ucacaggauuguuugagau

SEQ ID NO: 1529049 - RNA, 19 nt, Homo sapiens
ccaaacaauuaucuaguac

SEQ ID NO: 1529050 - RNA, 19 nt, Homo sapiens
gacugggacucaauacguu

SEQ ID NO: 1529051 - RNA, 19 nt, Homo sapiens
aaauuuaaccuaccacaug

SEQ ID NO: 1529052 - RNA, 19 nt, Homo sapiens
gaagcccaaucuauccaau

SEQ ID NO: 1529053 - RNA, 19 nt, Homo sapiens
ggaaaugaaagcagaaggu

SEQ ID NO: 1529054 - RNA, 19 nt, Homo sapiens
aaaccaacaacaccuaauu

SEQ ID NO: 1529055 - RNA, 19 nt, Homo sapiens
cuagcuauauaucacauug

SEQ ID NO: 1529056 - RNA, 19 nt, Homo sapiens
gcaggagagucacuugaac

SEQ ID NO: 1529057 - RNA, 19 nt, Homo sapiens
aauuuaaccuaccacauga

SEQ ID NO: 1529058 - RNA, 19 nt, Homo sapiens
ggaaguauuaguaacagau

SEQ ID NO: 1529059 - RNA, 19 nt, Homo sapiens
caauaugaucccuacagua

SEQ ID NO: 1529060 - RNA, 19 nt, Homo sapiens
gagguuaggaguucaagau

SEQ ID NO: 1529061 - RNA, 19 nt, Homo sapiens
aauaugaguugcugugcuu

SEQ ID NO: 1529062 - RNA, 19 nt, Homo sapiens
agacccaaguccuuuauuc

SEQ ID NO: 1529063 - RNA, 19 nt, Homo sapiens
uaaccuaccacaugaauac

SEQ ID NO: 1529064 - RNA, 19 nt, Homo sapiens
uaugaucccuacaguaaag

SEQ ID NO: 1529065 - RNA, 19 nt, Homo sapiens
gggaagcaauggaagaacu

SEQ ID NO: 1529066 - RNA, 19 nt, Homo sapiens
auccaaaccucagcauaua

SEQ ID NO: 1529067 - RNA, 19 nt, Homo sapiens
gaagaucauagaaaggaau

SEQ ID NO: 1529068 - RNA, 19 nt, Homo sapiens
ggacugggacucaauacgu

SEQ ID NO: 1529069 - RNA, 19 nt, Homo sapiens
acaaggaaucuucauuuga

SEQ ID NO: 1529070 - RNA, 19 nt, Homo sapiens
gaaguauuaguaacagaug

SEQ ID NO: 1529071 - RNA, 19 nt, Homo sapiens
ggagaugucaggagagaag

SEQ ID NO: 1529072 - RNA, 19 nt, Homo sapiens
ccuugcaaauggugucaua

SEQ ID NO: 1529073 - RNA, 19 nt, Homo sapiens
ggaaucuucauuugauguu

SEQ ID NO: 1529074 - RNA, 19 nt, Homo sapiens
uugcugggcauuacacuua

SEQ ID NO: 1529075 - RNA, 19 nt, Homo sapiens
ggaaucagcugcacagauc

SEQ ID NO: 1529076 - RNA, 19 nt, Homo sapiens
gauggcgccugauuauuua

SEQ ID NO: 1529077 - RNA, 19 nt, Homo sapiens
gauaacagcuuugucugaa

SEQ ID NO: 1529078 - RNA, 19 nt, Homo sapiens
gaaccaaagaagcaaguua

SEQ ID NO: 1529079 - RNA, 19 nt, Homo sapiens
cauuauaacccaagucuua

SEQ ID NO: 1529080 - RNA, 19 nt, Homo sapiens
acuaaugccuuucuucuaa

SEQ ID NO: 1529081 - RNA, 19 nt, Homo sapiens
ggauggagaccguuaauga

SEQ ID NO: 1529082 - RNA, 19 nt, Homo sapiens
ccaacagucucuauccuuu

SEQ ID NO: 1529083 - RNA, 19 nt, Homo sapiens
ggacuaaugucuggagaau

SEQ ID NO: 1529084 - RNA, 19 nt, Homo sapiens
acuaaugucuggagaauga

SEQ ID NO: 1529085 - RNA, 19 nt, Homo sapiens
gagagaagguuuggauauc

SEQ ID NO: 1529086 - RNA, 19 nt, Homo sapiens
caacagagucguuuuauuu

SEQ ID NO: 1529087 - RNA, 19 nt, Homo sapiens
ggagagaagguuuggauau

SEQ ID NO: 1529088 - RNA, 19 nt, Homo sapiens
gcuggugggugacagagua

SEQ ID NO: 1529089 - RNA, 19 nt, Homo sapiens
gcacaaccaucaccaacag

SEQ ID NO: 1529090 - RNA, 19 nt, Homo sapiens
gcacagaucaggagagaag

SEQ ID NO: 1529091 - RNA, 19 nt, Homo sapiens
gaugagagaauggucguua

SEQ ID NO: 1529092 - RNA, 19 nt, Homo sapiens
gaagggauggagaccguua

SEQ ID NO: 1529093 - RNA, 19 nt, Homo sapiens
aaacacaucugcacaacca

SEQ ID NO: 1529094 - RNA, 19 nt, Homo sapiens
caacauggaauaugcaaau

SEQ ID NO: 1529095 - RNA, 19 nt, Homo sapiens
ccagucagccuccguaauu

SEQ ID NO: 1529096 - RNA, 19 nt, Homo sapiens
caaagaagcaaguuaugga

SEQ ID NO: 1529097 - RNA, 19 nt, Homo sapiens
ucaaagagcacaacaugga

SEQ ID NO: 1529098 - RNA, 19 nt, Homo sapiens
ucacugggacucaacauuu

SEQ ID NO: 1529099 - RNA, 19 nt, Homo sapiens
gugcuuugguuucuuacua

SEQ ID NO: 1529100 - RNA, 19 nt, Homo sapiens
gagccuugguuuccucauu

SEQ ID NO: 1529101 - RNA, 19 nt, Homo sapiens
ugauggcgccugauuauuu

SEQ ID NO: 1529102 - RNA, 19 nt, Homo sapiens
gcaauucucccacaguugu

SEQ ID NO: 1529103 - RNA, 19 nt, Homo sapiens
ucaaauccagcucuagaua

SEQ ID NO: 1529104 - RNA, 19 nt, Homo sapiens
cauggaauaugcaaauuag

SEQ ID NO: 1529105 - RNA, 19 nt, Homo sapiens
cauacuugcuggacuaaug

SEQ ID NO: 1529106 - RNA, 19 nt, Homo sapiens
cuaagaaccuaagaaccua

SEQ ID NO: 1529107 - RNA, 19 nt, Homo sapiens
gucuuaggguucauuauaa

SEQ ID NO: 1529108 - RNA, 19 nt, Homo sapiens
ggaguggaaaguaauuaaa

SEQ ID NO: 1529109 - RNA, 19 nt, Homo sapiens
ccaaugugauacuucagaa

SEQ ID NO: 1529110 - RNA, 19 nt, Homo sapiens
uagcaauucucccacaguu

SEQ ID NO: 1529111 - RNA, 19 nt, Homo sapiens
agagacacaugcacaucua

SEQ ID NO: 1529112 - RNA, 19 nt, Homo sapiens
ggagaccaaugugauacuu

SEQ ID NO: 1529113 - RNA, 19 nt, Homo sapiens
uaugcuacgugcucaauga

SEQ ID NO: 1529114 - RNA, 19 nt, Homo sapiens
ggccagccuuuauuuaugu

SEQ ID NO: 1529115 - RNA, 19 nt, Homo sapiens
gcccaagcccucaugcaua

SEQ ID NO: 1529116 - RNA, 19 nt, Homo sapiens
ugucuuaggguucauuaua

SEQ ID NO: 1529117 - RNA, 19 nt, Homo sapiens
caaauggucaugcgggaaa

SEQ ID NO: 1529118 - RNA, 19 nt, Homo sapiens
caacauuuccugacacaca

SEQ ID NO: 1529119 - RNA, 19 nt, Homo sapiens
ucucagcagucaaggcuaa

SEQ ID NO: 1529120 - RNA, 19 nt, Homo sapiens
acaucuaguuucucucuuu

SEQ ID NO: 1529121 - RNA, 19 nt, Homo sapiens
cccaagcccucaugcauau

SEQ ID NO: 1529122 - RNA, 19 nt, Homo sapiens
gaacaaugagccaccuuag

SEQ ID NO: 1529123 - RNA, 19 nt, Homo sapiens
uaacccaagucuuaaugga

SEQ ID NO: 1529124 - RNA, 19 nt, Homo sapiens
gggaguggcagcuucguuu

SEQ ID NO: 1529125 - RNA, 19 nt, Homo sapiens
ugaauagcaugaagaggau

SEQ ID NO: 1529126 - RNA, 19 nt, Homo sapiens
cuaaugccuuucuucuaaa

SEQ ID NO: 1529127 - RNA, 19 nt, Homo sapiens
cagucagccuccguaauua

SEQ ID NO: 1529128 - RNA, 19 nt, Homo sapiens
cuucaugaguugcuuucua

SEQ ID NO: 1529129 - RNA, 19 nt, Homo sapiens
gacaacaucccaagguuuc

SEQ ID NO: 1529130 - RNA, 19 nt, Homo sapiens
ucacagaaccaaagaagca

SEQ ID NO: 1529131 - RNA, 19 nt, Homo sapiens
gcauauucauccugcuuca

SEQ ID NO: 1529132 - RNA, 19 nt, Homo sapiens
gaguucaaauccagcucua

SEQ ID NO: 1529133 - RNA, 19 nt, Homo sapiens
uucaugaguugcuuucuaa

SEQ ID NO: 1529134 - RNA, 19 nt, Homo sapiens
gcacaucuaguuucucucu

SEQ ID NO: 1529135 - RNA, 19 nt, Homo sapiens
ucaggagaccaaugugaua

SEQ ID NO: 1529136 - RNA, 19 nt, Homo sapiens
gccuugguuuccucauuua

SEQ ID NO: 1529137 - RNA, 19 nt, Homo sapiens
caagaaaggaaaggaauca

SEQ ID NO: 1529138 - RNA, 19 nt, Homo sapiens
uaacagcuuugucugaaaa

SEQ ID NO: 1529139 - RNA, 19 nt, Homo sapiens
gcuacgugcucaaugaagu

SEQ ID NO: 1529140 - RNA, 19 nt, Homo sapiens
auaggcaggugcagggaua

SEQ ID NO: 1529141 - RNA, 19 nt, Homo sapiens
gaucaggagagaagguuug

SEQ ID NO: 1529142 - RNA, 19 nt, Homo sapiens
agaccaaugugauacuuca

SEQ ID NO: 1529143 - RNA, 19 nt, Homo sapiens
acacaugcacaucuaguuu

SEQ ID NO: 1529144 - RNA, 19 nt, Homo sapiens
aaauccagcucuagauaca

SEQ ID NO: 1529145 - RNA, 19 nt, Homo sapiens
agagaagguuuggauauca

SEQ ID NO: 1529146 - RNA, 19 nt, Homo sapiens
gcaagaaaggaaaggaauc

SEQ ID NO: 1529147 - RNA, 19 nt, Homo sapiens
gcuaagaaccuaagaaccu

SEQ ID NO: 1529148 - RNA, 19 nt, Homo sapiens
ccaaaguguugccugaucu

SEQ ID NO: 1529149 - RNA, 19 nt, Homo sapiens
gagcacaacauggaauaug

SEQ ID NO: 1529150 - RNA, 19 nt, Homo sapiens
gggaagccaaggccacuuu

SEQ ID NO: 1529151 - RNA, 19 nt, Homo sapiens
agagauacuugcguucuug

SEQ ID NO: 1529152 - RNA, 19 nt, Homo sapiens
gaagagauacuugcguucu

SEQ ID NO: 1529153 - RNA, 19 nt, Homo sapiens
guucaaauccagcucuaga

SEQ ID NO: 1529154 - RNA, 19 nt, Homo sapiens
gagaagguuuggauaucag

SEQ ID NO: 1529155 - RNA, 19 nt, Homo sapiens
uuucauacuugcuggacua

SEQ ID NO: 1529156 - RNA, 19 nt, Homo sapiens
ugacaacaucccaagguuu

SEQ ID NO: 1529157 - RNA, 19 nt, Homo sapiens
caaagagcacaacauggaa

SEQ ID NO: 1529158 - RNA, 19 nt, Homo sapiens
ugucugagccugagguuug

SEQ ID NO: 1529159 - RNA, 19 nt, Homo sapiens
aaaugcagauggucaaguc

SEQ ID NO: 1529160 - RNA, 19 nt, Homo sapiens
guccuaugcucuccguuga

SEQ ID NO: 1529161 - RNA, 19 nt, Homo sapiens
uaacuuccuucccuuuguc

SEQ ID NO: 1529162 - RNA, 19 nt, Homo sapiens
cagccuuuauuuaugugua

SEQ ID NO: 1529163 - RNA, 19 nt, Homo sapiens
agaauggucguuaggguuu

SEQ ID NO: 1529164 - RNA, 19 nt, Homo sapiens
ggcgccugauuauuuauuu

SEQ ID NO: 1529165 - RNA, 19 nt, Homo sapiens
auccagcucuagauacaua

SEQ ID NO: 1529166 - RNA, 19 nt, Homo sapiens
agucaaggcuaagaaccua

SEQ ID NO: 1529167 - RNA, 19 nt, Homo sapiens
gauuaacuuccuucccuuu

SEQ ID NO: 1529168 - RNA, 19 nt, Homo sapiens
ccagagaacaggaaaauga

SEQ ID NO: 1529169 - RNA, 19 nt, Homo sapiens
caucuaguuucucucuuuc

SEQ ID NO: 1529170 - RNA, 19 nt, Homo sapiens
agaacaaugagccaccuua

SEQ ID NO: 1529171 - RNA, 19 nt, Homo sapiens
cguuaggguuucugucuga

SEQ ID NO: 1529172 - RNA, 19 nt, Homo sapiens
cagcucuagauacauauua

SEQ ID NO: 1529173 - RNA, 19 nt, Homo sapiens
ugccugaucugacaacauc

SEQ ID NO: 1529174 - RNA, 19 nt, Homo sapiens
gauacuugcguucuugaug

SEQ ID NO: 1529175 - RNA, 19 nt, Homo sapiens
gggaagagcuuaugacuuu

SEQ ID NO: 1529176 - RNA, 19 nt, Homo sapiens
aaagggagcuucucauuua

SEQ ID NO: 1529177 - RNA, 19 nt, Homo sapiens
ggaaacagaugcguucuua

SEQ ID NO: 1529178 - RNA, 19 nt, Homo sapiens
gaagugagauuguuaggaa

SEQ ID NO: 1529179 - RNA, 19 nt, Homo sapiens
ggaauggucacaauuaaua

SEQ ID NO: 1529180 - RNA, 19 nt, Homo sapiens
gcagauguuuauucucuua

SEQ ID NO: 1529181 - RNA, 19 nt, Homo sapiens
gcaacaugcuucucuacua

SEQ ID NO: 1529182 - RNA, 19 nt, Homo sapiens
gauguaaucccuuucuuua

SEQ ID NO: 1529183 - RNA, 19 nt, Homo sapiens
ccaggagaguugagaauua

SEQ ID NO: 1529184 - RNA, 19 nt, Homo sapiens
caaggaaucuucacaggaa

SEQ ID NO: 1529185 - RNA, 19 nt, Homo sapiens
ggaagacauugauaaacua

SEQ ID NO: 1529186 - RNA, 19 nt, Homo sapiens
gaacugaucacuaaauaug

SEQ ID NO: 1529187 - RNA, 19 nt, Homo sapiens
ggaguuguguuuauuaaug

SEQ ID NO: 1529188 - RNA, 19 nt, Homo sapiens
guuagaaccucgaagagua

SEQ ID NO: 1529189 - RNA, 19 nt, Homo sapiens
aagaguagauguagaauga

SEQ ID NO: 1529190 - RNA, 19 nt, Homo sapiens
ggaagaagugagauuguua

SEQ ID NO: 1529191 - RNA, 19 nt, Homo sapiens
ccucagggcucuccuauga

SEQ ID NO: 1529192 - RNA, 19 nt, Homo sapiens
caacaugcuucucuacuau

SEQ ID NO: 1529193 - RNA, 19 nt, Homo sapiens
gaggaguuguguuuauuaa

SEQ ID NO: 1529194 - RNA, 19 nt, Homo sapiens
ggccugacuucauaaauaa

SEQ ID NO: 1529195 - RNA, 19 nt, Homo sapiens
ggacugaaauacgaaaguu

SEQ ID NO: 1529196 - RNA, 19 nt, Homo sapiens
gaaugcaguuauuaucuga

SEQ ID NO: 1529197 - RNA, 19 nt, Homo sapiens
aaggaaagaugacaaagaa

SEQ ID NO: 1529198 - RNA, 19 nt, Homo sapiens
gaguagauguagaaugaaa

SEQ ID NO: 1529199 - RNA, 19 nt, Homo sapiens
gaaguuucaugcaaguauu

SEQ ID NO: 1529200 - RNA, 19 nt, Homo sapiens
ggaaagaugacaaagaaau

SEQ ID NO: 1529201 - RNA, 19 nt, Homo sapiens
guacagcucucgggcauug

SEQ ID NO: 1529202 - RNA, 19 nt, Homo sapiens
gaagaaguuucaugcaagu

SEQ ID NO: 1529203 - RNA, 19 nt, Homo sapiens
gagcauguguacuuauaga

SEQ ID NO: 1529204 - RNA, 19 nt, Homo sapiens
gcagaaaguguguaaguga

SEQ ID NO: 1529205 - RNA, 19 nt, Homo sapiens
caugaaauaugucagauuc

SEQ ID NO: 1529206 - RNA, 19 nt, Homo sapiens
gaaacagugucuuguccuu

SEQ ID NO: 1529207 - RNA, 19 nt, Homo sapiens
aaacagaugcguucuuauu

SEQ ID NO: 1529208 - RNA, 19 nt, Homo sapiens
gggaagacauugauaaacu

SEQ ID NO: 1529209 - RNA, 19 nt, Homo sapiens
uaauugagcccuuugcuuu

SEQ ID NO: 1529210 - RNA, 19 nt, Homo sapiens
ugagagauacuuagcauaa

SEQ ID NO: 1529211 - RNA, 19 nt, Homo sapiens
ucaauuuaguugccucaua

SEQ ID NO: 1529212 - RNA, 19 nt, Homo sapiens
gaauguauuuccucauauc

SEQ ID NO: 1529213 - RNA, 19 nt, Homo sapiens
agaacagucugaucucuuu

SEQ ID NO: 1529214 - RNA, 19 nt, Homo sapiens
guguguaagugaaguauuu

SEQ ID NO: 1529215 - RNA, 19 nt, Homo sapiens
gugggagacuugagagaua

SEQ ID NO: 1529216 - RNA, 19 nt, Homo sapiens
cuacaggaguuaccagauu

SEQ ID NO: 1529217 - RNA, 19 nt, Homo sapiens
gcagaaggcagaacaaaca

SEQ ID NO: 1529218 - RNA, 19 nt, Homo sapiens
cgaaggaaauugguaauag

SEQ ID NO: 1529219 - RNA, 19 nt, Homo sapiens
auacgaaaguuaggaguua

SEQ ID NO: 1529220 - RNA, 19 nt, Homo sapiens
gaacagcuguggaauaacc

SEQ ID NO: 1529221 - RNA, 19 nt, Homo sapiens
gggagcuucucauuuaauu

SEQ ID NO: 1529222 - RNA, 19 nt, Homo sapiens
cagaugaguuugagagaga

SEQ ID NO: 1529223 - RNA, 19 nt, Homo sapiens
gcaacagugucaugaagau

SEQ ID NO: 1529224 - RNA, 19 nt, Homo sapiens
uaaacagggugacaaggaa

SEQ ID NO: 1529225 - RNA, 19 nt, Homo sapiens
acaaagaaaucaccgacuu

SEQ ID NO: 1529226 - RNA, 19 nt, Homo sapiens
uugaacagcuguggaauaa

SEQ ID NO: 1529227 - RNA, 19 nt, Homo sapiens
guaaagggagcuucucauu

SEQ ID NO: 1529228 - RNA, 19 nt, Homo sapiens
caauuuaguugccucauag

SEQ ID NO: 1529229 - RNA, 19 nt, Homo sapiens
gggugaaccugugaagaua

SEQ ID NO: 1529230 - RNA, 19 nt, Homo sapiens
ucagggcucuccuaugaaa

SEQ ID NO: 1529231 - RNA, 19 nt, Homo sapiens
guggaauggucacaauuaa

SEQ ID NO: 1529232 - RNA, 19 nt, Homo sapiens
gcauuguaauugaugguuu

SEQ ID NO: 1529233 - RNA, 19 nt, Homo sapiens
uaaagggagcuucucauuu

SEQ ID NO: 1529234 - RNA, 19 nt, Homo sapiens
aaucagauguaaucccuuu

SEQ ID NO: 1529235 - RNA, 19 nt, Homo sapiens
uaaacuaucuguggugugu

SEQ ID NO: 1529236 - RNA, 19 nt, Homo sapiens
acaugugguuuaccuaaua

SEQ ID NO: 1529237 - RNA, 19 nt, Homo sapiens
cauuagggauggagauaaa

SEQ ID NO: 1529238 - RNA, 19 nt, Homo sapiens
gaagugccauucagguauc

SEQ ID NO: 1529239 - RNA, 19 nt, Homo sapiens
ucaugaagauugaaacugu

SEQ ID NO: 1529240 - RNA, 19 nt, Homo sapiens
uuaggugacuuguaaauuc

SEQ ID NO: 1529241 - RNA, 19 nt, Homo sapiens
guaaucccuuucuuuaaug

SEQ ID NO: 1529242 - RNA, 19 nt, Homo sapiens
uguaaaagcuaguuccuua

SEQ ID NO: 1529243 - RNA, 19 nt, Homo sapiens
ggagacgguccacaugaua

SEQ ID NO: 1529244 - RNA, 19 nt, Homo sapiens
uaaaauuggugcuguguaa

SEQ ID NO: 1529245 - RNA, 19 nt, Homo sapiens
cauuaaagguggaaaccaa

SEQ ID NO: 1529246 - RNA, 19 nt, Homo sapiens
uuaaugcacuucagguuug

SEQ ID NO: 1529247 - RNA, 19 nt, Homo sapiens
ggaucaaccuaguggaaga

SEQ ID NO: 1529248 - RNA, 19 nt, Homo sapiens
aggccugacuucauaaaua

SEQ ID NO: 1529249 - RNA, 19 nt, Homo sapiens
gaaagaugacaaagaaauc

SEQ ID NO: 1529250 - RNA, 19 nt, Homo sapiens
agaccuguuucuucuguua

SEQ ID NO: 1529251 - RNA, 19 nt, Homo sapiens
cagaaaguguguaagugaa

SEQ ID NO: 1529252 - RNA, 19 nt, Homo sapiens
gggacuuugugauaucaua

SEQ ID NO: 1529253 - RNA, 19 nt, Homo sapiens
uggcagaacuaaagaaaca

SEQ ID NO: 1529254 - RNA, 19 nt, Homo sapiens
gaaggaaauugguaauagc

SEQ ID NO: 1529255 - RNA, 19 nt, Homo sapiens
gagcgaaggaaauugguaa

SEQ ID NO: 1529256 - RNA, 19 nt, Homo sapiens
ggccaacaaucauuugaau

SEQ ID NO: 1529257 - RNA, 19 nt, Homo sapiens
gcagaacaaacacuuaugu

SEQ ID NO: 1529258 - RNA, 19 nt, Homo sapiens
gagcuucucauuuaauuca

SEQ ID NO: 1529259 - RNA, 19 nt, Homo sapiens
uaaguggaauggucacaau

SEQ ID NO: 1529260 - RNA, 19 nt, Homo sapiens
gaaaguguguaagugaagu

SEQ ID NO: 1529261 - RNA, 19 nt, Homo sapiens
caaguguacuaguguugaa

SEQ ID NO: 1529262 - RNA, 19 nt, Homo sapiens
agacuggacugaaauacga

SEQ ID NO: 1529263 - RNA, 19 nt, Homo sapiens
caugaagauugaaacugua

SEQ ID NO: 1529264 - RNA, 19 nt, Homo sapiens
uaugaggaguuguguuuau

SEQ ID NO: 1529265 - RNA, 19 nt, Homo sapiens
guucuucuauuccuuuguu

SEQ ID NO: 1529266 - RNA, 19 nt, Homo sapiens
ccaccugugucauccauug

SEQ ID NO: 1529267 - RNA, 19 nt, Homo sapiens
cagcggaauuggccacauu

SEQ ID NO: 1529268 - RNA, 19 nt, Homo sapiens
ugaggagccugaugauuca

SEQ ID NO: 1529269 - RNA, 19 nt, Homo sapiens
gcauguguacuuauagauu

SEQ ID NO: 1529270 - RNA, 19 nt, Homo sapiens
caauuacuggucugaguua

SEQ ID NO: 1529271 - RNA, 19 nt, Homo sapiens
aaagauggaucaaccuagu

SEQ ID NO: 1529272 - RNA, 19 nt, Homo sapiens
guaggugcuuuguguaugu

SEQ ID NO: 1529273 - RNA, 19 nt, Homo sapiens
gaacuagaucuuucugaca

SEQ ID NO: 1529274 - RNA, 19 nt, Homo sapiens
uggaagaaguuucaugcaa

SEQ ID NO: 1529275 - RNA, 19 nt, Homo sapiens
ggaagagcaucaagaagua

SEQ ID NO: 1529276 - RNA, 19 nt, Homo sapiens
gcuagaggguuauuauuga

SEQ ID NO: 1529277 - RNA, 19 nt, Homo sapiens
caauacaccucuccaaguu

SEQ ID NO: 1529278 - RNA, 19 nt, Homo sapiens
caacggacaucucaaaaua

SEQ ID NO: 1529279 - RNA, 19 nt, Homo sapiens
uauauuggcuucauugaug

SEQ ID NO: 1529280 - RNA, 19 nt, Homo sapiens
ggagugcaguuccugguuu

SEQ ID NO: 1529281 - RNA, 19 nt, Homo sapiens
caauaaagggcuaaaugua

SEQ ID NO: 1529282 - RNA, 19 nt, Homo sapiens
ugaggaacuuggaaugaua

SEQ ID NO: 1529283 - RNA, 19 nt, Homo sapiens
ggaggaagagcaucaagaa

SEQ ID NO: 1529284 - RNA, 19 nt, Homo sapiens
agucaucgcuagaggguua

SEQ ID NO: 1529285 - RNA, 19 nt, Homo sapiens
cuauaggccucuccgcuua

SEQ ID NO: 1529286 - RNA, 19 nt, Homo sapiens
cacccaggcucacccaaua

SEQ ID NO: 1529287 - RNA, 19 nt, Homo sapiens
gaaaugaggauauauacac

SEQ ID NO: 1529288 - RNA, 19 nt, Homo sapiens
cagccauacuuaaauagaa

SEQ ID NO: 1529289 - RNA, 19 nt, Homo sapiens
gaauaagcaccgaagcuau

SEQ ID NO: 1529290 - RNA, 19 nt, Homo sapiens
gaacggcagcugaaacaca

SEQ ID NO: 1529291 - RNA, 19 nt, Homo sapiens
gauaaauacagccauacuu

SEQ ID NO: 1529292 - RNA, 19 nt, Homo sapiens
uagggugcauccuuuguuu

SEQ ID NO: 1529293 - RNA, 19 nt, Homo sapiens
ggaaauaugacuguuacau

SEQ ID NO: 1529294 - RNA, 19 nt, Homo sapiens
aaacacaacggacaucuca

SEQ ID NO: 1529295 - RNA, 19 nt, Homo sapiens
gaggaacuuggaaugauaa

SEQ ID NO: 1529296 - RNA, 19 nt, Homo sapiens
ucaauaaagggcuaaaugu

SEQ ID NO: 1529297 - RNA, 19 nt, Homo sapiens
ugaauaagcaccgaagcua

SEQ ID NO: 1529298 - RNA, 19 nt, Homo sapiens
cagauuauggauuggguua

SEQ ID NO: 1529299 - RNA, 19 nt, Homo sapiens
acacaacggacaucucaaa

SEQ ID NO: 1529300 - RNA, 19 nt, Homo sapiens
gauuauggauuggguuaag

SEQ ID NO: 1529301 - RNA, 19 nt, Homo sapiens
guucauguccugugucuca

SEQ ID NO: 1529302 - RNA, 19 nt, Homo sapiens
ccaaguucauguccugugu

SEQ ID NO: 1529303 - RNA, 19 nt, Homo sapiens
guuggaaauaugacuguua

SEQ ID NO: 1529304 - RNA, 19 nt, Homo sapiens
ggcuggcucucgcucuaua

SEQ ID NO: 1529305 - RNA, 19 nt, Homo sapiens
ccauggaguccucucuaua

SEQ ID NO: 1529306 - RNA, 19 nt, Homo sapiens
ccaauacaccucuccaagu

SEQ ID NO: 1529307 - RNA, 19 nt, Homo sapiens
gaggguuauuauugacauu

SEQ ID NO: 1529308 - RNA, 19 nt, Homo sapiens
auacaccucuccaaguuca

SEQ ID NO: 1529309 - RNA, 19 nt, Homo sapiens
ggcucucgcucuauauuuc

SEQ ID NO: 1529310 - RNA, 19 nt, Homo sapiens
agggcuaaauguauugaaa

SEQ ID NO: 1529311 - RNA, 19 nt, Homo sapiens
cauggaguccucucuauag

SEQ ID NO: 1529312 - RNA, 19 nt, Homo sapiens
gagugcaguuccugguuuc

SEQ ID NO: 1529313 - RNA, 19 nt, Homo sapiens
uaaagggcuaaauguauug

SEQ ID NO: 1529314 - RNA, 19 nt, Homo sapiens
guggcuggcucucgcucua

SEQ ID NO: 1529315 - RNA, 19 nt, Homo sapiens
gaccaguugcuaacauguu

SEQ ID NO: 1529316 - RNA, 19 nt, Homo sapiens
gcauggaggaagagcauca

SEQ ID NO: 1529317 - RNA, 19 nt, Homo sapiens
gcuuauauuggcuucauug

SEQ ID NO: 1529318 - RNA, 19 nt, Homo sapiens
gaaacacaacggacaucuc

SEQ ID NO: 1529319 - RNA, 19 nt, Homo sapiens
aacggcagcugaaacacaa

SEQ ID NO: 1529320 - RNA, 19 nt, Homo sapiens
ggagaagcaggcggaguga

SEQ ID NO: 1529321 - RNA, 19 nt, Homo sapiens
guuuccaguuuacaacauu

SEQ ID NO: 1529322 - RNA, 19 nt, Homo sapiens
uuuacaacauugaccaguu

SEQ ID NO: 1529323 - RNA, 19 nt, Homo sapiens
aauaagcaccgaagcuaug

SEQ ID NO: 1529324 - RNA, 19 nt, Homo sapiens
aaggcuugcuccagauuau

SEQ ID NO: 1529325 - RNA, 19 nt, Homo sapiens
aggaagagcaucaagaagu

SEQ ID NO: 1529326 - RNA, 19 nt, Homo sapiens
cccauggaguccucucuau

SEQ ID NO: 1529327 - RNA, 19 nt, Homo sapiens
acccagugcuguuuucuua

SEQ ID NO: 1529328 - RNA, 19 nt, Homo sapiens
ggcugcaucuggcgcuuug

SEQ ID NO: 1529329 - RNA, 19 nt, Homo sapiens
cuacuucaucuucgacuug

SEQ ID NO: 1529330 - RNA, 19 nt, Homo sapiens
gcuacuucaucuucgacuu

SEQ ID NO: 1529331 - RNA, 19 nt, Homo sapiens
auaggccucuccgcuuaua

SEQ ID NO: 1529332 - RNA, 19 nt, Homo sapiens
cgcuagaggguuauuauug

SEQ ID NO: 1529333 - RNA, 19 nt, Homo sapiens
cugaggaacuuggaaugau

SEQ ID NO: 1529334 - RNA, 19 nt, Homo sapiens
gugaggaacggcagcugaa

SEQ ID NO: 1529335 - RNA, 19 nt, Homo sapiens
uguuaucucugaggaacuu

SEQ ID NO: 1529336 - RNA, 19 nt, Homo sapiens
uuggaaauaugacuguuac

SEQ ID NO: 1529337 - RNA, 19 nt, Homo sapiens
gaggaagagcaucaagaag

SEQ ID NO: 1529338 - RNA, 19 nt, Homo sapiens
auucuuggccguguagaua

SEQ ID NO: 1529339 - RNA, 19 nt, Homo sapiens
gguuggaaauaugacuguu

SEQ ID NO: 1529340 - RNA, 19 nt, Homo sapiens
gaagagcaucaagaaguac

SEQ ID NO: 1529341 - RNA, 19 nt, Homo sapiens
gguuuccaguuuacaacau

SEQ ID NO: 1529342 - RNA, 19 nt, Homo sapiens
gagcaaaugugaaggaaau

SEQ ID NO: 1529343 - RNA, 19 nt, Homo sapiens
ucacaugccuuguagcuaa

SEQ ID NO: 1529344 - RNA, 19 nt, Homo sapiens
gaaauggugucuggaagaa

SEQ ID NO: 1529345 - RNA, 19 nt, Homo sapiens
gcccuaggcugguugguaa

SEQ ID NO: 1529346 - RNA, 19 nt, Homo sapiens
gagauucgauccucuuaag

SEQ ID NO: 1529347 - RNA, 19 nt, Homo sapiens
ggagaagaaagaucuguuu

SEQ ID NO: 1529348 - RNA, 19 nt, Homo sapiens
ucaccugccugcacaacua

SEQ ID NO: 1529349 - RNA, 19 nt, Homo sapiens
gcaaggcgguguucuccau

SEQ ID NO: 1529350 - RNA, 19 nt, Homo sapiens
ggaaauggugucuggaaga

SEQ ID NO: 1529351 - RNA, 19 nt, Homo sapiens
gaagagcccuccacaaaag

SEQ ID NO: 1529352 - RNA, 19 nt, Homo sapiens
gcaggcacauggacaucuu

SEQ ID NO: 1529353 - RNA, 19 nt, Homo sapiens
gaugugggcuaccucuuca

SEQ ID NO: 1529354 - RNA, 19 nt, Homo sapiens
cuuaaggcauuaucaguga

SEQ ID NO: 1529355 - RNA, 19 nt, Homo sapiens
aggaagagcccuccacaaa

SEQ ID NO: 1529356 - RNA, 19 nt, Homo sapiens
ccaagcccaucgucuacuu

SEQ ID NO: 1529357 - RNA, 19 nt, Homo sapiens
gcgccaagcccaucgucua

SEQ ID NO: 1529358 - RNA, 19 nt, Homo sapiens
gguguccuccaucuacuua

SEQ ID NO: 1529359 - RNA, 19 nt, Homo sapiens
ucacugaccugugcaucug

SEQ ID NO: 1529360 - RNA, 19 nt, Homo sapiens
gccuggagauggcuggaaa

SEQ ID NO: 1529361 - RNA, 19 nt, Homo sapiens
ggaaugggcaccugcuucu

SEQ ID NO: 1529362 - RNA, 19 nt, Homo sapiens
gggcucugcauguuccuua

SEQ ID NO: 1529363 - RNA, 19 nt, Homo sapiens
ccauacaggagaagaaaga

SEQ ID NO: 1529364 - RNA, 19 nt, Homo sapiens
ccaacacagucaccaugga

SEQ ID NO: 1529365 - RNA, 19 nt, Homo sapiens
ggaagagcccuccacaaaa

SEQ ID NO: 1529366 - RNA, 19 nt, Homo sapiens
caacuacuucugcguguuc

SEQ ID NO: 1529367 - RNA, 19 nt, Homo sapiens
ucgauccucuuaaggcauu

SEQ ID NO: 1529368 - RNA, 19 nt, Homo sapiens
gcagcacgcccaacacagu

SEQ ID NO: 1529369 - RNA, 19 nt, Homo sapiens
gaaaguucugguucacaug

SEQ ID NO: 1529370 - RNA, 19 nt, Homo sapiens
gggaacgccuccugagacu

SEQ ID NO: 1529371 - RNA, 19 nt, Homo sapiens
gugagcaaaugugaaggaa

SEQ ID NO: 1529372 - RNA, 19 nt, Homo sapiens
uaucagugagcaaauguga

SEQ ID NO: 1529373 - RNA, 19 nt, Homo sapiens
gcagccaccagcaaacaga

SEQ ID NO: 1529374 - RNA, 19 nt, Homo sapiens
gaucgacugguuccucuuc

SEQ ID NO: 1529375 - RNA, 19 nt, Homo sapiens
uagcuaagucuuucugcaa

SEQ ID NO: 1529376 - RNA, 19 nt, Homo sapiens
gcaggugggugugcagacu

SEQ ID NO: 1529377 - RNA, 19 nt, Homo sapiens
cgucaugaacuacaucuuc

SEQ ID NO: 1529378 - RNA, 19 nt, Homo sapiens
cgggagcacuugagguauc

SEQ ID NO: 1529379 - RNA, 19 nt, Homo sapiens
aauggugucuggaagaaag

SEQ ID NO: 1529380 - RNA, 19 nt, Homo sapiens
ucagggcuguuccagagau

SEQ ID NO: 1529381 - RNA, 19 nt, Homo sapiens
gaccucuuguacagaaguu

SEQ ID NO: 1529382 - RNA, 19 nt, Homo sapiens
gcaaaugugaaggaaaugg

SEQ ID NO: 1529383 - RNA, 19 nt, Homo sapiens
ccucaucccugccauucag

SEQ ID NO: 1529384 - RNA, 19 nt, Homo sapiens
cuacucugagcuccuauuu

SEQ ID NO: 1529385 - RNA, 19 nt, Homo sapiens
acucugagcuccuauuuuc

SEQ ID NO: 1529386 - RNA, 19 nt, Homo sapiens
ggugcacaguggcccaaug

SEQ ID NO: 1529387 - RNA, 19 nt, Homo sapiens
gauuucugguuaugucaag

SEQ ID NO: 1529388 - RNA, 19 nt, Homo sapiens
cuaagucuuucugcaaaca

SEQ ID NO: 1529389 - RNA, 19 nt, Homo sapiens
gcuaagucuuucugcaaac

SEQ ID NO: 1529390 - RNA, 19 nt, Homo sapiens
ucagugagcaaaugugaag

SEQ ID NO: 1529391 - RNA, 19 nt, Homo sapiens
ggcauuaucagugagcaaa

SEQ ID NO: 1529392 - RNA, 19 nt, Homo sapiens
gcuucuccaucaagaggaa

SEQ ID NO: 1529393 - RNA, 19 nt, Homo sapiens
gcacguuugccgacuacau

SEQ ID NO: 1529394 - RNA, 19 nt, Homo sapiens
ugggcuaccucuucagcaa

SEQ ID NO: 1529395 - RNA, 19 nt, Homo sapiens
caauguggccaacggaagu

SEQ ID NO: 1529396 - RNA, 19 nt, Homo sapiens
acuuagggaucgacugguu

SEQ ID NO: 1529397 - RNA, 19 nt, Homo sapiens
agcuaagucuuucugcaaa

SEQ ID NO: 1529398 - RNA, 19 nt, Homo sapiens
ggccauggucuccgucuuc

SEQ ID NO: 1529399 - RNA, 19 nt, Homo sapiens
ccuuguagcuaagucuuuc

SEQ ID NO: 1529400 - RNA, 19 nt, Homo sapiens
caaaugugaaggaaauggu

SEQ ID NO: 1529401 - RNA, 19 nt, Homo sapiens
aaugggcaccugcuucuga

SEQ ID NO: 1529402 - RNA, 19 nt, Homo sapiens
cgaugugggcuaccucuuc

SEQ ID NO: 1529403 - RNA, 19 nt, Homo sapiens
gcuccuggacagccucuug

SEQ ID NO: 1529404 - RNA, 19 nt, Homo sapiens
gugcacaguggcccaaugu

SEQ ID NO: 1529405 - RNA, 19 nt, Homo sapiens
uccgggagcacuugaggua

SEQ ID NO: 1529406 - RNA, 19 nt, Homo sapiens
aaggaaauggugucuggaa

SEQ ID NO: 1529407 - RNA, 19 nt, Homo sapiens
gagagaaccuugacugugu

SEQ ID NO: 1529408 - RNA, 19 nt, Homo sapiens
cugcagaacuccucuauga

SEQ ID NO: 1529409 - RNA, 19 nt, Homo sapiens
ggaagccuguuucugauga

SEQ ID NO: 1529410 - RNA, 19 nt, Homo sapiens
gggagaggcugaccuacuu

SEQ ID NO: 1529411 - RNA, 19 nt, Homo sapiens
ugacagaagugugguuaaa

SEQ ID NO: 1529412 - RNA, 19 nt, Homo sapiens
caacaacuucgaugacuuu

SEQ ID NO: 1529413 - RNA, 19 nt, Homo sapiens
gcagaacuccucuaugaug

SEQ ID NO: 1529414 - RNA, 19 nt, Homo sapiens
ugaagaagaccuugaaaug

SEQ ID NO: 1529415 - RNA, 19 nt, Homo sapiens
cuacguauuugccaucauu

SEQ ID NO: 1529416 - RNA, 19 nt, Homo sapiens
gggaucaacuuguuuagag

SEQ ID NO: 1529417 - RNA, 19 nt, Homo sapiens
caacggacuuugagcuuca

SEQ ID NO: 1529418 - RNA, 19 nt, Homo sapiens
acagaagugugguuaaaga

SEQ ID NO: 1529419 - RNA, 19 nt, Homo sapiens
gcaaagaaugggauuguca

SEQ ID NO: 1529420 - RNA, 19 nt, Homo sapiens
gcaaaccugguguccauuu

SEQ ID NO: 1529421 - RNA, 19 nt, Homo sapiens
ucucaacucuggcugugua

SEQ ID NO: 1529422 - RNA, 19 nt, Homo sapiens
cagaacuccucuaugauga

SEQ ID NO: 1529423 - RNA, 19 nt, Homo sapiens
gacuggguguguuucuuua

SEQ ID NO: 1529424 - RNA, 19 nt, Homo sapiens
ggugggaccucugcauuga

SEQ ID NO: 1529425 - RNA, 19 nt, Homo sapiens
aagaagaccuugaaaugca

SEQ ID NO: 1529426 - RNA, 19 nt, Homo sapiens
ggaacuugaugguggugaa

SEQ ID NO: 1529427 - RNA, 19 nt, Homo sapiens
gcuggucgcugccggaaau

SEQ ID NO: 1529428 - RNA, 19 nt, Homo sapiens
acagggaccuuucagacaa

SEQ ID NO: 1529429 - RNA, 19 nt, Homo sapiens
gaagaagaccuugaaaugc

SEQ ID NO: 1529430 - RNA, 19 nt, Homo sapiens
gagcuucaccaucuucuug

SEQ ID NO: 1529431 - RNA, 19 nt, Homo sapiens
gaacuccucuaugaugaag

SEQ ID NO: 1529432 - RNA, 19 nt, Homo sapiens
guacugggccaacaacuuc

SEQ ID NO: 1529433 - RNA, 19 nt, Homo sapiens
gguggucuacuacguauuu

SEQ ID NO: 1529434 - RNA, 19 nt, Homo sapiens
ggacagcucccacaaacag

SEQ ID NO: 1529435 - RNA, 19 nt, Homo sapiens
cagcuuccguggugccuuu

SEQ ID NO: 1529436 - RNA, 19 nt, Homo sapiens
ucgaagaugcuauucagua

SEQ ID NO: 1529437 - RNA, 19 nt, Homo sapiens
cgaagaugcuauucaguac

SEQ ID NO: 1529438 - RNA, 19 nt, Homo sapiens
ccagcucgauguggcuuua

SEQ ID NO: 1529439 - RNA, 19 nt, Homo sapiens
ggguucugauugccaguua

SEQ ID NO: 1529440 - RNA, 19 nt, Homo sapiens
gaaccuugacuguguuuua

SEQ ID NO: 1529441 - RNA, 19 nt, Homo sapiens
gaggccaccuaccagauga

SEQ ID NO: 1529442 - RNA, 19 nt, Homo sapiens
auaggaagccuguuucuga

SEQ ID NO: 1529443 - RNA, 19 nt, Homo sapiens
ucauugggaucaacuuguu

SEQ ID NO: 1529444 - RNA, 19 nt, Homo sapiens
caacgagcuugacagaagu

SEQ ID NO: 1529445 - RNA, 19 nt, Homo sapiens
ccacaaacaggccaugaug

SEQ ID NO: 1529446 - RNA, 19 nt, Homo sapiens
ccaacaacuucgaugacuu

SEQ ID NO: 1529447 - RNA, 19 nt, Homo sapiens
gaagccuguuucugaugaa

SEQ ID NO: 1529448 - RNA, 19 nt, Homo sapiens
uauagcugcuucagugaga

SEQ ID NO: 1529449 - RNA, 19 nt, Homo sapiens
gauugucauucuucacuuc

SEQ ID NO: 1529450 - RNA, 19 nt, Homo sapiens
ggauugucauucuucacuu

SEQ ID NO: 1529451 - RNA, 19 nt, Homo sapiens
gaggaugagcucacagaga

SEQ ID NO: 1529452 - RNA, 19 nt, Homo sapiens
cuggagaacuuccuucaca

SEQ ID NO: 1529453 - RNA, 19 nt, Homo sapiens
uggcaaaccugguguccau

SEQ ID NO: 1529454 - RNA, 19 nt, Homo sapiens
ugacagccaucaucuacag

SEQ ID NO: 1529455 - RNA, 19 nt, Homo sapiens
ugugaaggguuaccuguuc

SEQ ID NO: 1529456 - RNA, 19 nt, Homo sapiens
ugacuggguguguuucuuu

SEQ ID NO: 1529457 - RNA, 19 nt, Homo sapiens
ucgagcagcuggaguacug

SEQ ID NO: 1529458 - RNA, 19 nt, Homo sapiens
caacugcgucuucauugug

SEQ ID NO: 1529459 - RNA, 19 nt, Homo sapiens
ucaacugcgucuucauugu

SEQ ID NO: 1529460 - RNA, 19 nt, Homo sapiens
uggagaaggugcguuccua

SEQ ID NO: 1529461 - RNA, 19 nt, Homo sapiens
gaugaagaagaccuugaaa

SEQ ID NO: 1529462 - RNA, 19 nt, Homo sapiens
gcuggugguuugacaugga

SEQ ID NO: 1529463 - RNA, 19 nt, Homo sapiens
cagggaccuuucagacaaa

SEQ ID NO: 1529464 - RNA, 19 nt, Homo sapiens
uaggaagccuguuucugau

SEQ ID NO: 1529465 - RNA, 19 nt, Homo sapiens
uguacuaccuguuggagau

SEQ ID NO: 1529466 - RNA, 19 nt, Homo sapiens
gguccaagaucuauuuugu

SEQ ID NO: 1529467 - RNA, 19 nt, Homo sapiens
ggugguggucuacuacgua

SEQ ID NO: 1529468 - RNA, 19 nt, Homo sapiens
gccaucaucuacagucagu

SEQ ID NO: 1529469 - RNA, 19 nt, Homo sapiens
cggccgaccucucugugaa

SEQ ID NO: 1529470 - RNA, 19 nt, Homo sapiens
cagguuaaccgucagacuu

SEQ ID NO: 1529471 - RNA, 19 nt, Homo sapiens
ccaccuaccagaugacugu

SEQ ID NO: 1529472 - RNA, 19 nt, Homo sapiens
ggagaacuuccuucacaag

SEQ ID NO: 1529473 - RNA, 19 nt, Homo sapiens
gugcagaacaugcgugcuu

SEQ ID NO: 1529474 - RNA, 19 nt, Homo sapiens
cuccagaccucgcuguuuc

SEQ ID NO: 1529475 - RNA, 19 nt, Homo sapiens
cuacacaggugcccgucau

SEQ ID NO: 1529476 - RNA, 19 nt, Homo sapiens
gcuucgagcagcuggagua

SEQ ID NO: 1529477 - RNA, 19 nt, Homo sapiens
gugguggucuacuacguau

SEQ ID NO: 1529478 - RNA, 19 nt, Homo sapiens
ggugcuggaugcagaugug

SEQ ID NO: 1529479 - RNA, 19 nt, Homo sapiens
gaguaccagucuccguuuc

SEQ ID NO: 1529480 - RNA, 19 nt, Homo sapiens
gguauuacucgaacguaug

SEQ ID NO: 1529481 - RNA, 19 nt, Homo sapiens
caacaaccccgaugugaug

SEQ ID NO: 1529482 - RNA, 19 nt, Homo sapiens
gagugugacuggguguguu

SEQ ID NO: 1529483 - RNA, 19 nt, Homo sapiens
agagaaccuugacuguguu

SEQ ID NO: 1529484 - RNA, 19 nt, Homo sapiens
gcacagguuaaccgucaga

SEQ ID NO: 1529485 - RNA, 19 nt, Homo sapiens
caucugggucaaccuguuu

SEQ ID NO: 1529486 - RNA, 19 nt, Homo sapiens
gggccaacaacuucgauga

SEQ ID NO: 1529487 - RNA, 19 nt, Homo sapiens
ccacuacuacuuugacuac

SEQ ID NO: 1529488 - RNA, 19 nt, Homo sapiens
guaccagucuccguuucug

SEQ ID NO: 1529489 - RNA, 19 nt, Homo sapiens
caaagaaugggauugucau

SEQ ID NO: 1529490 - RNA, 19 nt, Homo sapiens
ccuugacuguguuuuauua

SEQ ID NO: 1529491 - RNA, 19 nt, Homo sapiens
gagaaccuugacuguguuu

SEQ ID NO: 1529492 - RNA, 19 nt, Homo sapiens
ggaugcuggugguuugaca

SEQ ID NO: 1529493 - RNA, 19 nt, Homo sapiens
cgaggaggaugagcucaca

SEQ ID NO: 1529494 - RNA, 19 nt, Homo sapiens
uggagaacuuccuucacaa

SEQ ID NO: 1529495 - RNA, 19 nt, Homo sapiens
gccaacaacuucgaugacu

SEQ ID NO: 1529496 - RNA, 19 nt, Homo sapiens
ucucaacugcgucuucauu

SEQ ID NO: 1529497 - RNA, 19 nt, Homo sapiens
acuuugagcuucaccaucu

SEQ ID NO: 1529498 - RNA, 19 nt, Homo sapiens
gguuugacauggagagaac

SEQ ID NO: 1529499 - RNA, 19 nt, Homo sapiens
caucaucuacagucaguuc

SEQ ID NO: 1529500 - RNA, 19 nt, Homo sapiens
ugugauaggaagccuguuu

SEQ ID NO: 1529501 - RNA, 19 nt, Homo sapiens
ugaugaagaagaccuugaa

SEQ ID NO: 1529502 - RNA, 19 nt, Homo sapiens
acuccucuaugaugaagaa

SEQ ID NO: 1529503 - RNA, 19 nt, Homo sapiens
guucugauugccaguuauu

SEQ ID NO: 1529504 - RNA, 19 nt, Homo sapiens
cgguauuacucgaacguau

SEQ ID NO: 1529505 - RNA, 19 nt, Homo sapiens
uggagaugcugcucaaggu

SEQ ID NO: 1529506 - RNA, 19 nt, Homo sapiens
gcgucuucauuguguacua

SEQ ID NO: 1529507 - RNA, 19 nt, Homo sapiens
cgacauggauuguguauau

SEQ ID NO: 1529508 - RNA, 19 nt, Homo sapiens
gcucaggacuucaguauga

SEQ ID NO: 1529509 - RNA, 19 nt, Homo sapiens
aaagagaugugcuguuuaa

SEQ ID NO: 1529510 - RNA, 19 nt, Homo sapiens
cgaagcauaucccgucuua

SEQ ID NO: 1529511 - RNA, 19 nt, Homo sapiens
gggagaagauguccacuga

SEQ ID NO: 1529512 - RNA, 19 nt, Homo sapiens
gcagcaaccuguaucagaa

SEQ ID NO: 1529513 - RNA, 19 nt, Homo sapiens
auaaagagaugugcuguuu

SEQ ID NO: 1529514 - RNA, 19 nt, Homo sapiens
gguauacauucaaagauga

SEQ ID NO: 1529515 - RNA, 19 nt, Homo sapiens
gagaagauguccacugacu

SEQ ID NO: 1529516 - RNA, 19 nt, Homo sapiens
gagccacacucguaucuuc

SEQ ID NO: 1529517 - RNA, 19 nt, Homo sapiens
ggacauugacguuguggaa

SEQ ID NO: 1529518 - RNA, 19 nt, Homo sapiens
gaauccaguucauaagaug

SEQ ID NO: 1529519 - RNA, 19 nt, Homo sapiens
gaacugcgaauaaagagau

SEQ ID NO: 1529520 - RNA, 19 nt, Homo sapiens
acacgaauccaguucauaa

SEQ ID NO: 1529521 - RNA, 19 nt, Homo sapiens
ccagagauguggugaagca

SEQ ID NO: 1529522 - RNA, 19 nt, Homo sapiens
ggaaggagggagccaagaa

SEQ ID NO: 1529523 - RNA, 19 nt, Homo sapiens
gggcuucccuuccuaccaa

SEQ ID NO: 1529524 - RNA, 19 nt, Homo sapiens
cgaauccaguucauaagau

SEQ ID NO: 1529525 - RNA, 19 nt, Homo sapiens
ugucagcacuggagucuuc

SEQ ID NO: 1529526 - RNA, 19 nt, Homo sapiens
gcauaucccgucuuacaga

SEQ ID NO: 1529527 - RNA, 19 nt, Homo sapiens
caucaugcgagaucgaaua

SEQ ID NO: 1529528 - RNA, 19 nt, Homo sapiens
ugaagcaccaccucucuaa

SEQ ID NO: 1529529 - RNA, 19 nt, Homo sapiens
gcugaacugcgaauaaaga

SEQ ID NO: 1529530 - RNA, 19 nt, Homo sapiens
ggccugguauacauucaaa

SEQ ID NO: 1529531 - RNA, 19 nt, Homo sapiens
gcaggugagacgaagcaua

SEQ ID NO: 1529532 - RNA, 19 nt, Homo sapiens
gcacuggagucuucuugcu

SEQ ID NO: 1529533 - RNA, 19 nt, Homo sapiens
gacauggauuguguauauu

SEQ ID NO: 1529534 - RNA, 19 nt, Homo sapiens
guucggacauugacguugu

SEQ ID NO: 1529535 - RNA, 19 nt, Homo sapiens
caggugagacgaagcauau

SEQ ID NO: 1529536 - RNA, 19 nt, Homo sapiens
ugguauacauucaaagaug

SEQ ID NO: 1529537 - RNA, 19 nt, Homo sapiens
gauaauuacgacauggauu

SEQ ID NO: 1529538 - RNA, 19 nt, Homo sapiens
aaagugaggcugugucugu

SEQ ID NO: 1529539 - RNA, 19 nt, Homo sapiens
uugcugaacugcgaauaaa

SEQ ID NO: 1529540 - RNA, 19 nt, Homo sapiens
uggauuguguauauucuug

SEQ ID NO: 1529541 - RNA, 19 nt, Homo sapiens
aagcauaucccgucuuaca

SEQ ID NO: 1529542 - RNA, 19 nt, Homo sapiens
caugcgagaucgaauagag

SEQ ID NO: 1529543 - RNA, 19 nt, Homo sapiens
gaaggagggagccaagaag

SEQ ID NO: 1529544 - RNA, 19 nt, Homo sapiens
gcugagagcaacagaugga

SEQ ID NO: 1529545 - RNA, 19 nt, Homo sapiens
guauauucuugcucggaaa

SEQ ID NO: 1529546 - RNA, 19 nt, Homo sapiens
gagcaacagauggagcuuu

SEQ ID NO: 1529547 - RNA, 19 nt, Homo sapiens
ugucucagcucaggacuuc

SEQ ID NO: 1529548 - RNA, 19 nt, Homo sapiens
gaggacaucaugcgagauc

SEQ ID NO: 1529549 - RNA, 19 nt, Homo sapiens
agauggagccacacucgua

SEQ ID NO: 1529550 - RNA, 19 nt, Homo sapiens
ggaaagugaggcugugucu

SEQ ID NO: 1529551 - RNA, 19 nt, Homo sapiens
ggagucuucuugcugaacu

SEQ ID NO: 1529552 - RNA, 19 nt, Homo sapiens
agcaacagauggagcuuug

SEQ ID NO: 1529553 - RNA, 19 nt, Homo sapiens
cucuaagucugauuuguug

SEQ ID NO: 1529554 - RNA, 19 nt, Homo sapiens
uuacagggagucaucauca

SEQ ID NO: 1529555 - RNA, 19 nt, Homo sapiens
auaauuacgacauggauug

SEQ ID NO: 1529556 - RNA, 19 nt, Homo sapiens
cagcucaggacuucaguau

SEQ ID NO: 1529557 - RNA, 19 nt, Homo sapiens
uaucccgucuuacagaugu

SEQ ID NO: 1529558 - RNA, 19 nt, Homo sapiens
gauggagccacacucguau

SEQ ID NO: 1529559 - RNA, 19 nt, Homo sapiens
gaggagagaacacgaaucc

SEQ ID NO: 1529560 - RNA, 19 nt, Homo sapiens
ucucuaagucugauuuguu

SEQ ID NO: 1529561 - RNA, 19 nt, Homo sapiens
cuacaucauugguugaaaa

SEQ ID NO: 1529562 - RNA, 19 nt, Homo sapiens
aauaaccaguucggacauu

SEQ ID NO: 1529563 - RNA, 19 nt, Homo sapiens
cauaucccgucuuacagau

SEQ ID NO: 1529564 - RNA, 19 nt, Homo sapiens
uaaccaguucggacauuga

SEQ ID NO: 1529565 - RNA, 19 nt, Homo sapiens
aggaaaagcuguccaucaa

SEQ ID NO: 1529566 - RNA, 19 nt, Homo sapiens
guacuacaucauugguuga

SEQ ID NO: 1529567 - RNA, 19 nt, Homo sapiens
acauugacguuguggaaag

SEQ ID NO: 1529568 - RNA, 19 nt, Homo sapiens
gagcaggugagacgaagca

SEQ ID NO: 1529569 - RNA, 19 nt, Homo sapiens
ggacaucaugcgagaucga

SEQ ID NO: 1529570 - RNA, 19 nt, Homo sapiens
gagccaagagguccuagag

SEQ ID NO: 1529571 - RNA, 19 nt, Homo sapiens
caaccuguaucagaagaac

SEQ ID NO: 1529572 - RNA, 19 nt, Homo sapiens
ccaagugccaagugagaug

SEQ ID NO: 1529573 - RNA, 19 nt, Homo sapiens
acacucguaucuuccaagu

SEQ ID NO: 1529574 - RNA, 19 nt, Homo sapiens
ccacacucguaucuuccaa

SEQ ID NO: 1529575 - RNA, 19 nt, Homo sapiens
gugaagcaccaccucucua

SEQ ID NO: 1529576 - RNA, 19 nt, Homo sapiens
gacauugacguuguggaaa

SEQ ID NO: 1529577 - RNA, 19 nt, Homo sapiens
aagugaggcugugucugua

SEQ ID NO: 1529578 - RNA, 19 nt, Homo sapiens
ccacgugaccagagaugug

SEQ ID NO: 1529579 - RNA, 19 nt, Homo sapiens
ccugguauacauucaaaga

SEQ ID NO: 1529580 - RNA, 19 nt, Homo sapiens
gguguaagggagaagaugu

SEQ ID NO: 1529581 - RNA, 19 nt, Homo sapiens
cauggauuguguauauucu

SEQ ID NO: 1529582 - RNA, 19 nt, Homo sapiens
caagugccaagugagauga

SEQ ID NO: 1529583 - RNA, 19 nt, Homo sapiens
agaugauaauuacgacaug

SEQ ID NO: 1529584 - RNA, 19 nt, Homo sapiens
gaagcaccaccucucuaag

SEQ ID NO: 1529585 - RNA, 19 nt, Homo sapiens
gcaaccuguaucagaagaa

SEQ ID NO: 1529586 - RNA, 19 nt, Homo sapiens
agagaacacgaauccaguu

SEQ ID NO: 1529587 - RNA, 19 nt, Homo sapiens
gaaagaagcugaagugcua

SEQ ID NO: 1529588 - RNA, 19 nt, Homo sapiens
gagaggagcuugaaauaua

SEQ ID NO: 1529589 - RNA, 19 nt, Homo sapiens
gcagguagauuacaugaaa

SEQ ID NO: 1529590 - RNA, 19 nt, Homo sapiens
gagcaucccugaauccaua

SEQ ID NO: 1529591 - RNA, 19 nt, Homo sapiens
caagaaauguuguugauug

SEQ ID NO: 1529592 - RNA, 19 nt, Homo sapiens
caaagcuccugacaaauua

SEQ ID NO: 1529593 - RNA, 19 nt, Homo sapiens
gaacgucugguuuaauuua

SEQ ID NO: 1529594 - RNA, 19 nt, Homo sapiens
uaagaaagguugcaacuuc

SEQ ID NO: 1529595 - RNA, 19 nt, Homo sapiens
caccaaagcuccugacaaa

SEQ ID NO: 1529596 - RNA, 19 nt, Homo sapiens
ugacagacaucucagaauu

SEQ ID NO: 1529597 - RNA, 19 nt, Homo sapiens
caaagaaacuucagaucau

SEQ ID NO: 1529598 - RNA, 19 nt, Homo sapiens
gcaacacuuucuuaaauga

SEQ ID NO: 1529599 - RNA, 19 nt, Homo sapiens
cacaagaccucaaguaaug

SEQ ID NO: 1529600 - RNA, 19 nt, Homo sapiens
guagaugccuggccagauu

SEQ ID NO: 1529601 - RNA, 19 nt, Homo sapiens
gaugaaagaugaccaggau

SEQ ID NO: 1529602 - RNA, 19 nt, Homo sapiens
ccaaagcuccugacaaauu

SEQ ID NO: 1529603 - RNA, 19 nt, Homo sapiens
guaaucagcugggagcaaa

SEQ ID NO: 1529604 - RNA, 19 nt, Homo sapiens
cuacaggucuacaaagaaa

SEQ ID NO: 1529605 - RNA, 19 nt, Homo sapiens
ucaaacauguucuuagaug

SEQ ID NO: 1529606 - RNA, 19 nt, Homo sapiens
cuacaaagccugugauuuc

SEQ ID NO: 1529607 - RNA, 19 nt, Homo sapiens
cggcaacacuuucuuaaau

SEQ ID NO: 1529608 - RNA, 19 nt, Homo sapiens
uacaggcacugaacaauuu

SEQ ID NO: 1529609 - RNA, 19 nt, Homo sapiens
cagcuugucucuuggauug

SEQ ID NO: 1529610 - RNA, 19 nt, Homo sapiens
caaagccugugauuucuug

SEQ ID NO: 1529611 - RNA, 19 nt, Homo sapiens
aagcugaagugcuacauaa

SEQ ID NO: 1529612 - RNA, 19 nt, Homo sapiens
acagacaucucagaauuaa

SEQ ID NO: 1529613 - RNA, 19 nt, Homo sapiens
gaacgguccugugaguuga

SEQ ID NO: 1529614 - RNA, 19 nt, Homo sapiens
gugccaagauaacccuuua

SEQ ID NO: 1529615 - RNA, 19 nt, Homo sapiens
uguagaagcugcucaauac

SEQ ID NO: 1529616 - RNA, 19 nt, Homo sapiens
ggaguuauuugaaguggau

SEQ ID NO: 1529617 - RNA, 19 nt, Homo sapiens
gacagacaucucagaauua

SEQ ID NO: 1529618 - RNA, 19 nt, Homo sapiens
uaacggcaacacuuucuua

SEQ ID NO: 1529619 - RNA, 19 nt, Homo sapiens
cuucuccucuguauucuua

SEQ ID NO: 1529620 - RNA, 19 nt, Homo sapiens
gaaaagagcaucccugaau

SEQ ID NO: 1529621 - RNA, 19 nt, Homo sapiens
gauccaagguugccaagag

SEQ ID NO: 1529622 - RNA, 19 nt, Homo sapiens
gcuuuaugcuuaacaguga

SEQ ID NO: 1529623 - RNA, 19 nt, Homo sapiens
auaaguuccugaagcuuua

SEQ ID NO: 1529624 - RNA, 19 nt, Homo sapiens
ggaugaugauaacaagaaa

SEQ ID NO: 1529625 - RNA, 19 nt, Homo sapiens
aacaggagaugaaagauga

SEQ ID NO: 1529626 - RNA, 19 nt, Homo sapiens
aaucauuagugccaagaua

SEQ ID NO: 1529627 - RNA, 19 nt, Homo sapiens
caagauggaguuauuugaa

SEQ ID NO: 1529628 - RNA, 19 nt, Homo sapiens
ggcaacacuuucuuaaaug

SEQ ID NO: 1529629 - RNA, 19 nt, Homo sapiens
ggaacgguccugugaguug

SEQ ID NO: 1529630 - RNA, 19 nt, Homo sapiens
gaugauaacaagaaaggaa

SEQ ID NO: 1529631 - RNA, 19 nt, Homo sapiens
aaacacaagaccucaagua

SEQ ID NO: 1529632 - RNA, 19 nt, Homo sapiens
gaagcugaagugcuacaua

SEQ ID NO: 1529633 - RNA, 19 nt, Homo sapiens
gcuacaagagguuauauau

SEQ ID NO: 1529634 - RNA, 19 nt, Homo sapiens
gcauugugaucuacauuag

SEQ ID NO: 1529635 - RNA, 19 nt, Homo sapiens
gaacgcugccuccaggauu

SEQ ID NO: 1529636 - RNA, 19 nt, Homo sapiens
ggucucauaauuuccuuua

SEQ ID NO: 1529637 - RNA, 19 nt, Homo sapiens
gaaagguugcaacuucaaa

SEQ ID NO: 1529638 - RNA, 19 nt, Homo sapiens
augcaggucuugugaauga

SEQ ID NO: 1529639 - RNA, 19 nt, Homo sapiens
guucuuagaugcuucacau

SEQ ID NO: 1529640 - RNA, 19 nt, Homo sapiens
acaaagaaacuucagauca

SEQ ID NO: 1529641 - RNA, 19 nt, Homo sapiens
ggaucuguguauuacuuaa

SEQ ID NO: 1529642 - RNA, 19 nt, Homo sapiens
gccuacaggucuacaaaga

SEQ ID NO: 1529643 - RNA, 19 nt, Homo sapiens
uauuugaaguggaugauga

SEQ ID NO: 1529644 - RNA, 19 nt, Homo sapiens
guaaugacaagauggaguu

SEQ ID NO: 1529645 - RNA, 19 nt, Homo sapiens
caacauggaggugcuggua

SEQ ID NO: 1529646 - RNA, 19 nt, Homo sapiens
uaggaucuguguauuacuu

SEQ ID NO: 1529647 - RNA, 19 nt, Homo sapiens
cauaaguuccugaagcuuu

SEQ ID NO: 1529648 - RNA, 19 nt, Homo sapiens
ugaaguggaugaugauaac

SEQ ID NO: 1529649 - RNA, 19 nt, Homo sapiens
gaaugaacacugggccuuu

SEQ ID NO: 1529650 - RNA, 19 nt, Homo sapiens
agaaacaggagaugaaaga

SEQ ID NO: 1529651 - RNA, 19 nt, Homo sapiens
cacccaaagccaaucauua

SEQ ID NO: 1529652 - RNA, 19 nt, Homo sapiens
agaggagcuugaaauauau

SEQ ID NO: 1529653 - RNA, 19 nt, Homo sapiens
gacaagauggaguuauuug

SEQ ID NO: 1529654 - RNA, 19 nt, Homo sapiens
gaaaaccauccucuuuaua

SEQ ID NO: 1529655 - RNA, 19 nt, Homo sapiens
uaccaacacuuaccacauc

SEQ ID NO: 1529656 - RNA, 19 nt, Homo sapiens
cugaauccauaaagguaua

SEQ ID NO: 1529657 - RNA, 19 nt, Homo sapiens
gcugaagugcuacauaaga

SEQ ID NO: 1529658 - RNA, 19 nt, Homo sapiens
gugagucaguugaauuuua

SEQ ID NO: 1529659 - RNA, 19 nt, Homo sapiens
cuacaggcacugaacaauu

SEQ ID NO: 1529660 - RNA, 19 nt, Homo sapiens
uaucuaggaucuguguauu

SEQ ID NO: 1529661 - RNA, 19 nt, Homo sapiens
gaguugagaauggguuaua

SEQ ID NO: 1529662 - RNA, 19 nt, Homo sapiens
acacugggccuuugggaaa

SEQ ID NO: 1529663 - RNA, 19 nt, Homo sapiens
uaauuuacaggaacccaua

SEQ ID NO: 1529664 - RNA, 19 nt, Homo sapiens
guccauagaguauuagcua

SEQ ID NO: 1529665 - RNA, 19 nt, Homo sapiens
cccaagaaauguuguugau

SEQ ID NO: 1529666 - RNA, 19 nt, Homo sapiens
guuauacuguccccaaaua

SEQ ID NO: 1529667 - RNA, 19 nt, Homo sapiens
ggaugaagcaauaagaaag

SEQ ID NO: 1529668 - RNA, 19 nt, Homo sapiens
uaccacaucuucaccaaag

SEQ ID NO: 1529669 - RNA, 19 nt, Homo sapiens
ugaaagaugaccaggauca

SEQ ID NO: 1529670 - RNA, 19 nt, Homo sapiens
gaauuaaaaucacccaaag

SEQ ID NO: 1529671 - RNA, 19 nt, Homo sapiens
ccugugauuucuugucuau

SEQ ID NO: 1529672 - RNA, 19 nt, Homo sapiens
aaagaaacuucagaucauc

SEQ ID NO: 1529673 - RNA, 19 nt, Homo sapiens
ccaaagccaaucauuagug

SEQ ID NO: 1529674 - RNA, 19 nt, Homo sapiens
guuaccaucuugaaaagua

SEQ ID NO: 1529675 - RNA, 19 nt, Homo sapiens
uuacaggaacccauaaguu

SEQ ID NO: 1529676 - RNA, 19 nt, Homo sapiens
caaaaucagugcagguaga

SEQ ID NO: 1529677 - RNA, 19 nt, Homo sapiens
aagaaagguugcaacuuca

SEQ ID NO: 1529678 - RNA, 19 nt, Homo sapiens
uucaguccauagaguauua

SEQ ID NO: 1529679 - RNA, 19 nt, Homo sapiens
gcaacugauuaucuaggau

SEQ ID NO: 1529680 - RNA, 19 nt, Homo sapiens
caaguaaugacaagaugga

SEQ ID NO: 1529681 - RNA, 19 nt, Homo sapiens
acacaagaccucaaguaau

SEQ ID NO: 1529682 - RNA, 19 nt, Homo sapiens
ugaaaaccauccucuuuau

SEQ ID NO: 1529683 - RNA, 19 nt, Homo sapiens
auaagaugcuugugcuuca

SEQ ID NO: 1529684 - RNA, 19 nt, Homo sapiens
ccauugccauacugagaaa

SEQ ID NO: 1529685 - RNA, 19 nt, Homo sapiens
ggcagauaauaaugagaaa

SEQ ID NO: 1529686 - RNA, 19 nt, Homo sapiens
ucucuuggauugugaugga

SEQ ID NO: 1529687 - RNA, 19 nt, Homo sapiens
caaaccagcugauguauuu

SEQ ID NO: 1529688 - RNA, 19 nt, Homo sapiens
gaaagacguuaucuccuaa

SEQ ID NO: 1529689 - RNA, 19 nt, Homo sapiens
gaaauugccuggacaagag

SEQ ID NO: 1529690 - RNA, 19 nt, Homo sapiens
uagcauguaugacaacuua

SEQ ID NO: 1529691 - RNA, 19 nt, Homo sapiens
gaacaaguuuggccuguca

SEQ ID NO: 1529692 - RNA, 19 nt, Homo sapiens
ugaaagacguuaucuccua

SEQ ID NO: 1529693 - RNA, 19 nt, Homo sapiens
gaauagaaacuuccaaaug

SEQ ID NO: 1529694 - RNA, 19 nt, Homo sapiens
uagaagagccaauuaagua

SEQ ID NO: 1529695 - RNA, 19 nt, Homo sapiens
gauaaaagaucuccaaaug

SEQ ID NO: 1529696 - RNA, 19 nt, Homo sapiens
gaacugcugucuuuacuac

SEQ ID NO: 1529697 - RNA, 19 nt, Homo sapiens
caagaaggaugcacaagau

SEQ ID NO: 1529698 - RNA, 19 nt, Homo sapiens
gaaccucccuuuccuuauc

SEQ ID NO: 1529699 - RNA, 19 nt, Homo sapiens
ggacacaacucaccuccau

SEQ ID NO: 1529700 - RNA, 19 nt, Homo sapiens
ggacggaggugauguucau

SEQ ID NO: 1529701 - RNA, 19 nt, Homo sapiens
ccacugcucuaugaaauuu

SEQ ID NO: 1529702 - RNA, 19 nt, Homo sapiens
gagaaugguugcccguauu

SEQ ID NO: 1529703 - RNA, 19 nt, Homo sapiens
ggaaaugccuacagugucu

SEQ ID NO: 1529704 - RNA, 19 nt, Homo sapiens
gcaagcagcugacauucuc

SEQ ID NO: 1529705 - RNA, 19 nt, Homo sapiens
gaauaugcuuugccucaga

SEQ ID NO: 1529706 - RNA, 19 nt, Homo sapiens
guaugcagcacguuuaaua

SEQ ID NO: 1529707 - RNA, 19 nt, Homo sapiens
gaaauuuggcugggugaua

SEQ ID NO: 1529708 - RNA, 19 nt, Homo sapiens
gacagguuaugguauuuaa

SEQ ID NO: 1529709 - RNA, 19 nt, Homo sapiens
aaucagaacucuuaauugg

SEQ ID NO: 1529710 - RNA, 19 nt, Homo sapiens
aguguaaucucucccuuua

SEQ ID NO: 1529711 - RNA, 19 nt, Homo sapiens
gugaagaccuacagaguuc

SEQ ID NO: 1529712 - RNA, 19 nt, Homo sapiens
caagagaggccuagugaug

SEQ ID NO: 1529713 - RNA, 19 nt, Homo sapiens
gccaugaucuuucucacuu

SEQ ID NO: 1529714 - RNA, 19 nt, Homo sapiens
ugggaucgauuccuguuua

SEQ ID NO: 1529715 - RNA, 19 nt, Homo sapiens
caucaccaauggaguguuu

SEQ ID NO: 1529716 - RNA, 19 nt, Homo sapiens
cuaaugaaccuaccucaaa

SEQ ID NO: 1529717 - RNA, 19 nt, Homo sapiens
ggauggaucugaaguucug

SEQ ID NO: 1529718 - RNA, 19 nt, Homo sapiens
ggccuggguuugaauaauu

SEQ ID NO: 1529719 - RNA, 19 nt, Homo sapiens
acacauagauacacacaca

SEQ ID NO: 1529720 - RNA, 19 nt, Homo sapiens
uaaaagaucuccaaaugug

SEQ ID NO: 1529721 - RNA, 19 nt, Homo sapiens
ggacagguuaugguauuua

SEQ ID NO: 1529722 - RNA, 19 nt, Homo sapiens
caaccagacuaaggaguuu

SEQ ID NO: 1529723 - RNA, 19 nt, Homo sapiens
acacaaaccagcugaugua

SEQ ID NO: 1529724 - RNA, 19 nt, Homo sapiens
ugaacuugcuggagacaaa

SEQ ID NO: 1529725 - RNA, 19 nt, Homo sapiens
gaccugcccuaauggauga

SEQ ID NO: 1529726 - RNA, 19 nt, Homo sapiens
gaagagcgaccugcccuaa

SEQ ID NO: 1529727 - RNA, 19 nt, Homo sapiens
gcuacagaaucaacacaaa

SEQ ID NO: 1529728 - RNA, 19 nt, Homo sapiens
gacaagagaggccuaguga

SEQ ID NO: 1529729 - RNA, 19 nt, Homo sapiens
ggaaauugccuggacaaga

SEQ ID NO: 1529730 - RNA, 19 nt, Homo sapiens
gacguuaucuccuaagucu

SEQ ID NO: 1529731 - RNA, 19 nt, Homo sapiens
ggagggacagguuauggua

SEQ ID NO: 1529732 - RNA, 19 nt, Homo sapiens
aagccaaucucuauaccua

SEQ ID NO: 1529733 - RNA, 19 nt, Homo sapiens
caaaccagcucugcagugu

SEQ ID NO: 1529734 - RNA, 19 nt, Homo sapiens
gaugaccacuuuguacaga

SEQ ID NO: 1529735 - RNA, 19 nt, Homo sapiens
gaagaaauacaaggugaug

SEQ ID NO: 1529736 - RNA, 19 nt, Homo sapiens
gaggguccuuaaagaauga

SEQ ID NO: 1529737 - RNA, 19 nt, Homo sapiens
gaagagccaauuaaguaga

SEQ ID NO: 1529738 - RNA, 19 nt, Homo sapiens
aguaagauccucuguuaaa

SEQ ID NO: 1529739 - RNA, 19 nt, Homo sapiens
guucagacccugcuacaga

SEQ ID NO: 1529740 - RNA, 19 nt, Homo sapiens
cgaaacaacacaugguuau

SEQ ID NO: 1529741 - RNA, 19 nt, Homo sapiens
caacuucaccuaucauugg

SEQ ID NO: 1529742 - RNA, 19 nt, Homo sapiens
uuaccuagcuucccucuac

SEQ ID NO: 1529743 - RNA, 19 nt, Homo sapiens
gauuacagcccugaagaaa

SEQ ID NO: 1529744 - RNA, 19 nt, Homo sapiens
uguaaucucucccuuuauc

SEQ ID NO: 1529745 - RNA, 19 nt, Homo sapiens
ccuaauggaugacagaaag

SEQ ID NO: 1529746 - RNA, 19 nt, Homo sapiens
ccuauaagccagugcaauu

SEQ ID NO: 1529747 - RNA, 19 nt, Homo sapiens
ccaugaucuuucucacuua

SEQ ID NO: 1529748 - RNA, 19 nt, Homo sapiens
gauauacacacacacauag

SEQ ID NO: 1529749 - RNA, 19 nt, Homo sapiens
ucacugcugugcuccagaa

SEQ ID NO: 1529750 - RNA, 19 nt, Homo sapiens
gugcugccaugcuuacuga

SEQ ID NO: 1529751 - RNA, 19 nt, Homo sapiens
cgucgacucuugcaucaga

SEQ ID NO: 1529752 - RNA, 19 nt, Homo sapiens
uucuuuaccuucuguguua

SEQ ID NO: 1529753 - RNA, 19 nt, Homo sapiens
gagccguggugaagaccua

SEQ ID NO: 1529754 - RNA, 19 nt, Homo sapiens
uaaugaaccuaccucaaag

SEQ ID NO: 1529755 - RNA, 19 nt, Homo sapiens
caucuuccaucagugagua

SEQ ID NO: 1529756 - RNA, 19 nt, Homo sapiens
agagcgaccugcccuaaug

SEQ ID NO: 1529757 - RNA, 19 nt, Homo sapiens
gauugaugcuguugugaca

SEQ ID NO: 1529758 - RNA, 19 nt, Homo sapiens
gcacgggucccuggauuug

SEQ ID NO: 1529759 - RNA, 19 nt, Homo sapiens
cuacugaccauuuccacua

SEQ ID NO: 1529760 - RNA, 19 nt, Homo sapiens
uaucugggauggaucugaa

SEQ ID NO: 1529761 - RNA, 19 nt, Homo sapiens
ggugaagaccuacagaguu

SEQ ID NO: 1529762 - RNA, 19 nt, Homo sapiens
ggacaagagaggccuagug

SEQ ID NO: 1529763 - RNA, 19 nt, Homo sapiens
ugagaaaaccuacagcuua

SEQ ID NO: 1529764 - RNA, 19 nt, Homo sapiens
caucagagacagcaacaga

SEQ ID NO: 1529765 - RNA, 19 nt, Homo sapiens
caaccaggaagucugaauu

SEQ ID NO: 1529766 - RNA, 19 nt, Homo sapiens
ucaagaaggaugcacaaga

SEQ ID NO: 1529767 - RNA, 19 nt, Homo sapiens
gcagcugacauucucauga

SEQ ID NO: 1529768 - RNA, 19 nt, Homo sapiens
gaagaugaucgggaccuuu

SEQ ID NO: 1529769 - RNA, 19 nt, Homo sapiens
gagugaggaugaugagaca

SEQ ID NO: 1529770 - RNA, 19 nt, Homo sapiens
cagcuucacccaacagauu

SEQ ID NO: 1529771 - RNA, 19 nt, Homo sapiens
gcaaucaaccagacuaagg

SEQ ID NO: 1529772 - RNA, 19 nt, Homo sapiens
caagauauacacacacaca

SEQ ID NO: 1529773 - RNA, 19 nt, Homo sapiens
gaagucagcaucggaaucu

SEQ ID NO: 1529774 - RNA, 19 nt, Homo sapiens
uauuaucucuuccuuacug

SEQ ID NO: 1529775 - RNA, 19 nt, Homo sapiens
uuucugcuguucuuacuuu

SEQ ID NO: 1529776 - RNA, 19 nt, Homo sapiens
caaucucuauaccuacaaa

SEQ ID NO: 1529777 - RNA, 19 nt, Homo sapiens
gaucauguguauccgaaaa

SEQ ID NO: 1529778 - RNA, 19 nt, Homo sapiens
gagcagucaucaagaucau

SEQ ID NO: 1529779 - RNA, 19 nt, Homo sapiens
gggacagguuaugguauuu

SEQ ID NO: 1529780 - RNA, 19 nt, Homo sapiens
acaggguacuugagccuuu

SEQ ID NO: 1529781 - RNA, 19 nt, Homo sapiens
gaaacaacacaugguuaug

SEQ ID NO: 1529782 - RNA, 19 nt, Homo sapiens
gauuguagccugccaaagg

SEQ ID NO: 1529783 - RNA, 19 nt, Homo sapiens
gcaauuugagggcucuuug

SEQ ID NO: 1529784 - RNA, 19 nt, Homo sapiens
ggauugguucuaauuaaug

SEQ ID NO: 1529785 - RNA, 19 nt, Homo sapiens
uuacauggccuucgugauc

SEQ ID NO: 1529786 - RNA, 19 nt, Homo sapiens
gaguaugcagcacguuuaa

SEQ ID NO: 1529787 - RNA, 19 nt, Homo sapiens
ggguauggcugauuaauuu

SEQ ID NO: 1529788 - RNA, 19 nt, Homo sapiens
gauaagaaccuccaauaaa

SEQ ID NO: 1529789 - RNA, 19 nt, Homo sapiens
ggacaaggguaguuucuga

SEQ ID NO: 1529790 - RNA, 19 nt, Homo sapiens
gccaagauacuguuuauua

SEQ ID NO: 1529791 - RNA, 19 nt, Homo sapiens
gcagauacuuuaauucaug

SEQ ID NO: 1529792 - RNA, 19 nt, Homo sapiens
caaaucggauacauacaua

SEQ ID NO: 1529793 - RNA, 19 nt, Homo sapiens
gaauugaacugugccauug

SEQ ID NO: 1529794 - RNA, 19 nt, Homo sapiens
gacaacagcagaagaguua

SEQ ID NO: 1529795 - RNA, 19 nt, Homo sapiens
cauauuaacucucacgaaa

SEQ ID NO: 1529796 - RNA, 19 nt, Homo sapiens
gaauagagagagacauaua

SEQ ID NO: 1529797 - RNA, 19 nt, Homo sapiens
caaggaauauagaucauga

SEQ ID NO: 1529798 - RNA, 19 nt, Homo sapiens
guaaagguccugauuaguu

SEQ ID NO: 1529799 - RNA, 19 nt, Homo sapiens
uuaagucucugguuucuaa

SEQ ID NO: 1529800 - RNA, 19 nt, Homo sapiens
uaacaauaaugccauguga

SEQ ID NO: 1529801 - RNA, 19 nt, Homo sapiens
uaaagguccugauuaguug

SEQ ID NO: 1529802 - RNA, 19 nt, Homo sapiens
gacaaugacuugaucuaau

SEQ ID NO: 1529803 - RNA, 19 nt, Homo sapiens
gcuccucgcugucuugauu

SEQ ID NO: 1529804 - RNA, 19 nt, Homo sapiens
gauguuagguuucccuugu

SEQ ID NO: 1529805 - RNA, 19 nt, Homo sapiens
ucaaguaaccacuaccuua

SEQ ID NO: 1529806 - RNA, 19 nt, Homo sapiens
gcagaagaguuaggauuau

SEQ ID NO: 1529807 - RNA, 19 nt, Homo sapiens
ucaguaaaguugaauccua

SEQ ID NO: 1529808 - RNA, 19 nt, Homo sapiens
ccuaagagcauucauuaaa

SEQ ID NO: 1529809 - RNA, 19 nt, Homo sapiens
caguaaaguugaauccuaa

SEQ ID NO: 1529810 - RNA, 19 nt, Homo sapiens
caaagacaaugacuugauc

SEQ ID NO: 1529811 - RNA, 19 nt, Homo sapiens
aaaccgagcuguacuuuac

SEQ ID NO: 1529812 - RNA, 19 nt, Homo sapiens
caaguaaccacuaccuuaa

SEQ ID NO: 1529813 - RNA, 19 nt, Homo sapiens
gaucaugacccucaggaaa

SEQ ID NO: 1529814 - RNA, 19 nt, Homo sapiens
aagcugguguuauguauuu

SEQ ID NO: 1529815 - RNA, 19 nt, Homo sapiens
guauaucucuccuuaaguc

SEQ ID NO: 1529816 - RNA, 19 nt, Homo sapiens
gcugagaaccuccauguga

SEQ ID NO: 1529817 - RNA, 19 nt, Homo sapiens
cauggagucuaaauaugua

SEQ ID NO: 1529818 - RNA, 19 nt, Homo sapiens
caccuaagagcauucauua

SEQ ID NO: 1529819 - RNA, 19 nt, Homo sapiens
gugacaaccuauuuagauu

SEQ ID NO: 1529820 - RNA, 19 nt, Homo sapiens
aaggagaaauggaaacuug

SEQ ID NO: 1529821 - RNA, 19 nt, Homo sapiens
gcaaaucggauacauacau

SEQ ID NO: 1529822 - RNA, 19 nt, Homo sapiens
gaaggucuccauggcguua

SEQ ID NO: 1529823 - RNA, 19 nt, Homo sapiens
cugauuaguugauuaguga

SEQ ID NO: 1529824 - RNA, 19 nt, Homo sapiens
gaaccuccaugugaaaaua

SEQ ID NO: 1529825 - RNA, 19 nt, Homo sapiens
gguccugauuaguugauua

SEQ ID NO: 1529826 - RNA, 19 nt, Homo sapiens
caguaaagguccugauuag

SEQ ID NO: 1529827 - RNA, 19 nt, Homo sapiens
cagaagaguuaggauuauu

SEQ ID NO: 1529828 - RNA, 19 nt, Homo sapiens
gaaccuccaauaaauaugu

SEQ ID NO: 1529829 - RNA, 19 nt, Homo sapiens
ugaauuacaucugggaaug

SEQ ID NO: 1529830 - RNA, 19 nt, Homo sapiens
cuucugauuugguagauuu

SEQ ID NO: 1529831 - RNA, 19 nt, Homo sapiens
cuuuaaacauggagucuaa

SEQ ID NO: 1529832 - RNA, 19 nt, Homo sapiens
gaguuauccugccaccuaa

SEQ ID NO: 1529833 - RNA, 19 nt, Homo sapiens
ggagaaauggaaacuugaa

SEQ ID NO: 1529834 - RNA, 19 nt, Homo sapiens
aagaauagagagagacaua

SEQ ID NO: 1529835 - RNA, 19 nt, Homo sapiens
ugauaagaaccuccaauaa

SEQ ID NO: 1529836 - RNA, 19 nt, Homo sapiens
gugcagauacuuuaauuca

SEQ ID NO: 1529837 - RNA, 19 nt, Homo sapiens
agagagagacauauaaaug

SEQ ID NO: 1529838 - RNA, 19 nt, Homo sapiens
caggaagaauaaagaauag

SEQ ID NO: 1529839 - RNA, 19 nt, Homo sapiens
guguauaucucuccuuaag

SEQ ID NO: 1529840 - RNA, 19 nt, Homo sapiens
ggaaaucaguguggcuuac

SEQ ID NO: 1529841 - RNA, 19 nt, Homo sapiens
ugguguauaucucuccuua

SEQ ID NO: 1529842 - RNA, 19 nt, Homo sapiens
guagggguauggcugauua

SEQ ID NO: 1529843 - RNA, 19 nt, Homo sapiens
guauauauuugcggaugaa

SEQ ID NO: 1529844 - RNA, 19 nt, Homo sapiens
ugaagcugguguuauguau

SEQ ID NO: 1529845 - RNA, 19 nt, Homo sapiens
caaaccgagcuguacuuua

SEQ ID NO: 1529846 - RNA, 19 nt, Homo sapiens
guugauuagugaaugugua

SEQ ID NO: 1529847 - RNA, 19 nt, Homo sapiens
ggauuauuaucuucuaguc

SEQ ID NO: 1529848 - RNA, 19 nt, Homo sapiens
uaaccacuaccuuaacuga

SEQ ID NO: 1529849 - RNA, 19 nt, Homo sapiens
cugagaaccuccaugugaa

SEQ ID NO: 1529850 - RNA, 19 nt, Homo sapiens
ggaagaauaaagaauagag

SEQ ID NO: 1529851 - RNA, 19 nt, Homo sapiens
agaguuauccugccaccua

SEQ ID NO: 1529852 - RNA, 19 nt, Homo sapiens
gagcucaaguaaccacuac

SEQ ID NO: 1529853 - RNA, 19 nt, Homo sapiens
ccaugugacaaccuauuua

SEQ ID NO: 1529854 - RNA, 19 nt, Homo sapiens
aaacuugaagcugguguua

SEQ ID NO: 1529855 - RNA, 19 nt, Homo sapiens
gcuaaaggagaaauggaaa

SEQ ID NO: 1529856 - RNA, 19 nt, Homo sapiens
ccaccuacuuuauacuauc

SEQ ID NO: 1529857 - RNA, 19 nt, Homo sapiens
ccacuaccuuaacugaaau

SEQ ID NO: 1529858 - RNA, 19 nt, Homo sapiens
accacuaccuuaacugaaa

SEQ ID NO: 1529859 - RNA, 19 nt, Homo sapiens
gguauggcugauuaauuua

SEQ ID NO: 1529860 - RNA, 19 nt, Homo sapiens
gaagcugguguuauguauu

SEQ ID NO: 1529861 - RNA, 19 nt, Homo sapiens
acuugaagcugguguuaug

SEQ ID NO: 1529862 - RNA, 19 nt, Homo sapiens
cagcagaagaguuaggauu

SEQ ID NO: 1529863 - RNA, 19 nt, Homo sapiens
aaggguaguuucugaggaa

SEQ ID NO: 1529864 - RNA, 19 nt, Homo sapiens
agacaaugacuugaucuaa

SEQ ID NO: 1529865 - RNA, 19 nt, Homo sapiens
cuucaaagacaaugacuug

SEQ ID NO: 1529866 - RNA, 19 nt, Homo sapiens
gaaauggaaacuugaagcu

SEQ ID NO: 1529867 - RNA, 19 nt, Homo sapiens
ccaccuaagagcauucauu

SEQ ID NO: 1529868 - RNA, 19 nt, Homo sapiens
uugauaagaaccuccaaua

SEQ ID NO: 1529869 - RNA, 19 nt, Homo sapiens
cuccuuaagucucugguuu

SEQ ID NO: 1529870 - RNA, 19 nt, Homo sapiens
agcagaagaguuaggauua

SEQ ID NO: 1529871 - RNA, 19 nt, Homo sapiens
uauuaacucucacgaaagg

SEQ ID NO: 1529872 - RNA, 19 nt, Homo sapiens
guugauggccucaguuauc

SEQ ID NO: 1529873 - RNA, 19 nt, Homo sapiens
gaaugguugaguugguuaa

SEQ ID NO: 1529874 - RNA, 19 nt, Homo sapiens
aaacuuugagcauagugua

SEQ ID NO: 1529875 - RNA, 19 nt, Homo sapiens
uaaaugugcaagaggcaaa

SEQ ID NO: 1529876 - RNA, 19 nt, Homo sapiens
gaaacuugaagcugguguu

SEQ ID NO: 1529877 - RNA, 19 nt, Homo sapiens
gccaugugacaaccuauuu

SEQ ID NO: 1529878 - RNA, 19 nt, Homo sapiens
guugcucucuggacugguu

SEQ ID NO: 1529879 - RNA, 19 nt, Homo sapiens
acaauaaugccaugugaca

SEQ ID NO: 1529880 - RNA, 19 nt, Homo sapiens
uaaguucuuucuguucugu

SEQ ID NO: 1529881 - RNA, 19 nt, Homo sapiens
ccugauuaguugauuagug

SEQ ID NO: 1529882 - RNA, 19 nt, Homo sapiens
gaaaucaguguggcuuaca

SEQ ID NO: 1529883 - RNA, 19 nt, Homo sapiens
aacauggagucuaaauaug

SEQ ID NO: 1529884 - RNA, 19 nt, Homo sapiens
uaaagaauagagagagaca

SEQ ID NO: 1529885 - RNA, 19 nt, Homo sapiens
ucaaaccgagcuguacuuu

SEQ ID NO: 1529886 - RNA, 19 nt, Homo sapiens
ugagaaccuccaugugaaa

SEQ ID NO: 1529887 - RNA, 19 nt, Homo sapiens
gaacucagguuuccuauuu

SEQ ID NO: 1529888 - RNA, 19 nt, Homo sapiens
ggacaaggcuaccacagaa

SEQ ID NO: 1529889 - RNA, 19 nt, Homo sapiens
ggacaucucucccacacuu

SEQ ID NO: 1529890 - RNA, 19 nt, Homo sapiens
gaggaaaacucaucaauuu

SEQ ID NO: 1529891 - RNA, 19 nt, Homo sapiens
gaucagcucuguccuuugu

SEQ ID NO: 1529892 - RNA, 19 nt, Homo sapiens
gcacagcaguggcaguuug

SEQ ID NO: 1529893 - RNA, 19 nt, Homo sapiens
ggaggagccugcuucauca

SEQ ID NO: 1529894 - RNA, 19 nt, Homo sapiens
gggaaauccuggccucauu

SEQ ID NO: 1529895 - RNA, 19 nt, Homo sapiens
aaauaaaccauguggcuua

SEQ ID NO: 1529896 - RNA, 19 nt, Homo sapiens
gagaagaaccacaccaguu

SEQ ID NO: 1529897 - RNA, 19 nt, Homo sapiens
uaaaccauguggcuuaaau

SEQ ID NO: 1529898 - RNA, 19 nt, Homo sapiens
ccaaggagucgucugagua

SEQ ID NO: 1529899 - RNA, 19 nt, Homo sapiens
gcauuucucugcucauugg

SEQ ID NO: 1529900 - RNA, 19 nt, Homo sapiens
ggacagccauucugcucau

SEQ ID NO: 1529901 - RNA, 19 nt, Homo sapiens
agaaggaaauaaaccaugu

SEQ ID NO: 1529902 - RNA, 19 nt, Homo sapiens
uagaugagauggcuugucu

SEQ ID NO: 1529903 - RNA, 19 nt, Homo sapiens
aagaucagcucuguccuuu

SEQ ID NO: 1529904 - RNA, 19 nt, Homo sapiens
gggaggagccugcuucauc

SEQ ID NO: 1529905 - RNA, 19 nt, Homo sapiens
ggaaauccuggccucauug

SEQ ID NO: 1529906 - RNA, 19 nt, Homo sapiens
ccagugcuuucuuucuaaa

SEQ ID NO: 1529907 - RNA, 19 nt, Homo sapiens
uuccuugucuguaauauga

SEQ ID NO: 1529908 - RNA, 19 nt, Homo sapiens
aauaaaccauguggcuuaa

SEQ ID NO: 1529909 - RNA, 19 nt, Homo sapiens
agaagaaccacaccaguug

SEQ ID NO: 1529910 - RNA, 19 nt, Homo sapiens
aaacuagaguguugaacca

SEQ ID NO: 1529911 - RNA, 19 nt, Homo sapiens
ccacagaggugccgauacc

SEQ ID NO: 1529912 - RNA, 19 nt, Homo sapiens
ucacuguccuggaguucuu

SEQ ID NO: 1529913 - RNA, 19 nt, Homo sapiens
guaauaugaagucagcauu

SEQ ID NO: 1529914 - RNA, 19 nt, Homo sapiens
caagaucagcucuguccuu

SEQ ID NO: 1529915 - RNA, 19 nt, Homo sapiens
caccacagaaggaaauaaa

SEQ ID NO: 1529916 - RNA, 19 nt, Homo sapiens
ggucagagagcccggaauc

SEQ ID NO: 1529917 - RNA, 19 nt, Homo sapiens
uaauaugaagucagcauug

SEQ ID NO: 1529918 - RNA, 19 nt, Homo sapiens
uuuggaaacuagaguguug

SEQ ID NO: 1529919 - RNA, 19 nt, Homo sapiens
gccuugaaguuacgcuuga

SEQ ID NO: 1529920 - RNA, 19 nt, Homo sapiens
ggaggaaaacucaucaauu

SEQ ID NO: 1529921 - RNA, 19 nt, Homo sapiens
cccagugcuuucuuucuaa

SEQ ID NO: 1529922 - RNA, 19 nt, Homo sapiens
gcucauggauuuugguguu

SEQ ID NO: 1529923 - RNA, 19 nt, Homo sapiens
ggagccugcuucaucaucu

SEQ ID NO: 1529924 - RNA, 19 nt, Homo sapiens
caaggagucgucugaguag

SEQ ID NO: 1529925 - RNA, 19 nt, Homo sapiens
gaaggaaauaaaccaugug

SEQ ID NO: 1529926 - RNA, 19 nt, Homo sapiens
ccacaccacagaaggaaau

SEQ ID NO: 1529927 - RNA, 19 nt, Homo sapiens
cacauacuccggcaucuga

SEQ ID NO: 1529928 - RNA, 19 nt, Homo sapiens
uaucuggccgugcuuacua

SEQ ID NO: 1529929 - RNA, 19 nt, Homo sapiens
aaccauguggcuuaaauuu

SEQ ID NO: 1529930 - RNA, 19 nt, Homo sapiens
ugucaucuguugccacauc

SEQ ID NO: 1529931 - RNA, 19 nt, Homo sapiens
caacauccucagcgucaug

SEQ ID NO: 1529932 - RNA, 19 nt, Homo sapiens
gggcacagcaguggcaguu

SEQ ID NO: 1529933 - RNA, 19 nt, Homo sapiens
ccacgugggcaucuucuuc

SEQ ID NO: 1529934 - RNA, 19 nt, Homo sapiens
ucagcucuguccuuuguca

SEQ ID NO: 1529935 - RNA, 19 nt, Homo sapiens
gaaauccuggccucauugg

SEQ ID NO: 1529936 - RNA, 19 nt, Homo sapiens
acacccaccuugugcaucu

SEQ ID NO: 1529937 - RNA, 19 nt, Homo sapiens
ccagugcaccugugaucuu

SEQ ID NO: 1529938 - RNA, 19 nt, Homo sapiens
ccggaauccuccagaaugg

SEQ ID NO: 1529939 - RNA, 19 nt, Homo sapiens
caccacaucuacacauacu

SEQ ID NO: 1529940 - RNA, 19 nt, Homo sapiens
ggacacccaccuugugcau

SEQ ID NO: 1529941 - RNA, 19 nt, Homo sapiens
cucaccacaucuacacaua

SEQ ID NO: 1529942 - RNA, 19 nt, Homo sapiens
cuagaguguugaaccagau

SEQ ID NO: 1529943 - RNA, 19 nt, Homo sapiens
gcucuguccuuugucaucu

SEQ ID NO: 1529944 - RNA, 19 nt, Homo sapiens
cagcgcagacuucaacauc

SEQ ID NO: 1529945 - RNA, 19 nt, Homo sapiens
aauaugaagucagcauugg

SEQ ID NO: 1529946 - RNA, 19 nt, Homo sapiens
ugaaguuacgcuugaagga

SEQ ID NO: 1529947 - RNA, 19 nt, Homo sapiens
ccaggacacccaccuugug

SEQ ID NO: 1529948 - RNA, 19 nt, Homo sapiens
aaaccauguggcuuaaauu

SEQ ID NO: 1529949 - RNA, 19 nt, Homo sapiens
ucauuuuccuugucuguaa

SEQ ID NO: 1529950 - RNA, 19 nt, Homo sapiens
ccuugugcaucuaagcauu

SEQ ID NO: 1529951 - RNA, 19 nt, Homo sapiens
ggucauugccaugcacuuc

SEQ ID NO: 1529952 - RNA, 19 nt, Homo sapiens
cagugcaccugugaucuuc

SEQ ID NO: 1529953 - RNA, 19 nt, Homo sapiens
ggccgugcuuacuaucuuc

SEQ ID NO: 1529954 - RNA, 19 nt, Homo sapiens
uggccgugcuuacuaucuu

SEQ ID NO: 1529955 - RNA, 19 nt, Homo sapiens
ggucuaggccaggcauugu

SEQ ID NO: 1529956 - RNA, 19 nt, Homo sapiens
cccaaggagucgucugagu

SEQ ID NO: 1529957 - RNA, 19 nt, Homo sapiens
ggaaugugcuguaagaaug

SEQ ID NO: 1529958 - RNA, 19 nt, Homo sapiens
gaaggaagguggcgaaugg

SEQ ID NO: 1529959 - RNA, 19 nt, Homo sapiens
gaacacagaagguggguuu

SEQ ID NO: 1529960 - RNA, 19 nt, Homo sapiens
gcacuccuguguagaugua

SEQ ID NO: 1529961 - RNA, 19 nt, Homo sapiens
ggacauagcccuccuucug

SEQ ID NO: 1529962 - RNA, 19 nt, Homo sapiens
ggaagaguccaccauguaa

SEQ ID NO: 1529963 - RNA, 19 nt, Homo sapiens
ggacagagccuggguguuc

SEQ ID NO: 1529964 - RNA, 19 nt, Homo sapiens
ccaauucccuccagagaug

SEQ ID NO: 1529965 - RNA, 19 nt, Homo sapiens
gacggaagcuucagcacuu

SEQ ID NO: 1529966 - RNA, 19 nt, Homo sapiens
gaguacggcugugaccuua

SEQ ID NO: 1529967 - RNA, 19 nt, Homo sapiens
ucucugagguuuccugauu

SEQ ID NO: 1529968 - RNA, 19 nt, Homo sapiens
gggaagaguccaccaugua

SEQ ID NO: 1529969 - RNA, 19 nt, Homo sapiens
ggacagugcugcccagacu

SEQ ID NO: 1529970 - RNA, 19 nt, Homo sapiens
gaacuggcuuccaccuuca

SEQ ID NO: 1529971 - RNA, 19 nt, Homo sapiens
acacagacuuuaccuacaa

SEQ ID NO: 1529972 - RNA, 19 nt, Homo sapiens
gcugugaccuuaccugcaa

SEQ ID NO: 1529973 - RNA, 19 nt, Homo sapiens
ggaaacguguccugcaucu

SEQ ID NO: 1529974 - RNA, 19 nt, Homo sapiens
ccaagacacugacgaaugc

SEQ ID NO: 1529975 - RNA, 19 nt, Homo sapiens
caucagguguacagacauu

SEQ ID NO: 1529976 - RNA, 19 nt, Homo sapiens
gaagucguuuccacuguca

SEQ ID NO: 1529977 - RNA, 19 nt, Homo sapiens
gaguguaccaccuguguuu

SEQ ID NO: 1529978 - RNA, 19 nt, Homo sapiens
uaagaacgaacuugaugaa

SEQ ID NO: 1529979 - RNA, 19 nt, Homo sapiens
gagguuuccugauuaaagg

SEQ ID NO: 1529980 - RNA, 19 nt, Homo sapiens
gaacgaacuugaugaaaac

SEQ ID NO: 1529981 - RNA, 19 nt, Homo sapiens
ucgacaggcugcucucuug

SEQ ID NO: 1529982 - RNA, 19 nt, Homo sapiens
uaaagguugucucgguuuc

SEQ ID NO: 1529983 - RNA, 19 nt, Homo sapiens
ucugagguuuccugauuaa

SEQ ID NO: 1529984 - RNA, 19 nt, Homo sapiens
ccagugagaugcuauuucc

SEQ ID NO: 1529985 - RNA, 19 nt, Homo sapiens
ggcaucagguguacagaca

SEQ ID NO: 1529986 - RNA, 19 nt, Homo sapiens
agaacgaacuugaugaaaa

SEQ ID NO: 1529987 - RNA, 19 nt, Homo sapiens
cugcaucucuccugagugu

SEQ ID NO: 1529988 - RNA, 19 nt, Homo sapiens
ggaguacggcugugaccuu

SEQ ID NO: 1529989 - RNA, 19 nt, Homo sapiens
cguccaagaugcuucuguu

SEQ ID NO: 1529990 - RNA, 19 nt, Homo sapiens
cccgugggcuucucgauga

SEQ ID NO: 1529991 - RNA, 19 nt, Homo sapiens
ggauugcuguacuuguguu

SEQ ID NO: 1529992 - RNA, 19 nt, Homo sapiens
gcaacacccguccaagaug

SEQ ID NO: 1529993 - RNA, 19 nt, Homo sapiens
gccaagacacugacgaaug

SEQ ID NO: 1529994 - RNA, 19 nt, Homo sapiens
cgccacagcugccaagaca

SEQ ID NO: 1529995 - RNA, 19 nt, Homo sapiens
cuucagcacuuuccaugau

SEQ ID NO: 1529996 - RNA, 19 nt, Homo sapiens
ggagaggugagcugugaga

SEQ ID NO: 1529997 - RNA, 19 nt, Homo sapiens
ugggagaggugagcuguga

SEQ ID NO: 1529998 - RNA, 19 nt, Homo sapiens
ccaagaugcuucuguugcu

SEQ ID NO: 1529999 - RNA, 19 nt, Homo sapiens
gcuguuggcaucaggugua

SEQ ID NO: 1530000 - RNA, 19 nt, Homo sapiens
gcugcucucuugacgacaa

SEQ ID NO: 1530001 - RNA, 19 nt, Homo sapiens
caagaugcuucuguugcuu

SEQ ID NO: 1530002 - RNA, 19 nt, Homo sapiens
gaugaaaacacagacuuua

SEQ ID NO: 1530003 - RNA, 19 nt, Homo sapiens
ggugagcugugagaagguu

SEQ ID NO: 1530004 - RNA, 19 nt, Homo sapiens
gugcuggacccaugucuga

SEQ ID NO: 1530005 - RNA, 19 nt, Homo sapiens
cugcaucgcucccaauguc

SEQ ID NO: 1530006 - RNA, 19 nt, Homo sapiens
gaauggaggaagucguuuc

SEQ ID NO: 1530007 - RNA, 19 nt, Homo sapiens
uuuggaaugugcuguaaga

SEQ ID NO: 1530008 - RNA, 19 nt, Homo sapiens
ggaaggaagguggcgaaug

SEQ ID NO: 1530009 - RNA, 19 nt, Homo sapiens
gaagaguccaccauguaag

SEQ ID NO: 1530010 - RNA, 19 nt, Homo sapiens
cuacacaggcagaaucuuc

SEQ ID NO: 1530011 - RNA, 19 nt, Homo sapiens
gugaaaaggugagguguga

SEQ ID NO: 1530012 - RNA, 19 nt, Homo sapiens
ggcaacacccguccaagau

SEQ ID NO: 1530013 - RNA, 19 nt, Homo sapiens
gugggcagcuuccuaugca

SEQ ID NO: 1530014 - RNA, 19 nt, Homo sapiens
aggcgagucugucaccauu

SEQ ID NO: 1530015 - RNA, 19 nt, Homo sapiens
caaccggcacuccugugua

SEQ ID NO: 1530016 - RNA, 19 nt, Homo sapiens
ggguugaguuuccgauugg

SEQ ID NO: 1530017 - RNA, 19 nt, Homo sapiens
caccauuccugccacaaca

SEQ ID NO: 1530018 - RNA, 19 nt, Homo sapiens
aaacguguccugcaucucu

SEQ ID NO: 1530019 - RNA, 19 nt, Homo sapiens
gcaaccggcacuccugugu

SEQ ID NO: 1530020 - RNA, 19 nt, Homo sapiens
ccaccuguguuugccagaa

SEQ ID NO: 1530021 - RNA, 19 nt, Homo sapiens
cggcaacacccguccaaga

SEQ ID NO: 1530022 - RNA, 19 nt, Homo sapiens
uacaaguguuccugucgaa

SEQ ID NO: 1530023 - RNA, 19 nt, Homo sapiens
uuaagaacgaacuugauga

SEQ ID NO: 1530024 - RNA, 19 nt, Homo sapiens
gcaacuacgagggaaggaa

SEQ ID NO: 1530025 - RNA, 19 nt, Homo sapiens
ucaccuguaccuacccuuu

SEQ ID NO: 1530026 - RNA, 19 nt, Homo sapiens
cucugagguuuccugauua

SEQ ID NO: 1530027 - RNA, 19 nt, Homo sapiens
gagggccacugugugaaca

SEQ ID NO: 1530028 - RNA, 19 nt, Homo sapiens
aagaauggaggaagucguu

SEQ ID NO: 1530029 - RNA, 19 nt, Homo sapiens
cauguaaggaggucacugu

SEQ ID NO: 1530030 - RNA, 19 nt, Homo sapiens
ccucagccaccuccuguga

SEQ ID NO: 1530031 - RNA, 19 nt, Homo sapiens
cgaggccggugcuucaucu

SEQ ID NO: 1530032 - RNA, 19 nt, Homo sapiens
gagccugcauggagacacu

SEQ ID NO: 1530033 - RNA, 19 nt, Homo sapiens
acggauugcuguacuugug

SEQ ID NO: 1530034 - RNA, 19 nt, Homo sapiens
cagacggauugcuguacuu

SEQ ID NO: 1530035 - RNA, 19 nt, Homo sapiens
gaaugugcuguaagaaugg

SEQ ID NO: 1530036 - RNA, 19 nt, Homo sapiens
gcagggcagcuccaaggau

SEQ ID NO: 1530037 - RNA, 19 nt, Homo sapiens
gcagcuuccuaugcacaug

SEQ ID NO: 1530038 - RNA, 19 nt, Homo sapiens
aaccggcacuccuguguag

SEQ ID NO: 1530039 - RNA, 19 nt, Homo sapiens
ggcuggauguaaccuuguu

SEQ ID NO: 1530040 - RNA, 19 nt, Homo sapiens
gcgaauggccagguguuca

SEQ ID NO: 1530041 - RNA, 19 nt, Homo sapiens
uuaaagguugucucgguuu

SEQ ID NO: 1530042 - RNA, 19 nt, Homo sapiens
ugagguuuccugauuaaag

SEQ ID NO: 1530043 - RNA, 19 nt, Homo sapiens
gggcagcuccaaggaugaa

SEQ ID NO: 1530044 - RNA, 19 nt, Homo sapiens
cgacaggcugcucucuuga

SEQ ID NO: 1530045 - RNA, 19 nt, Homo sapiens
gcauuggcagcuacaagug

SEQ ID NO: 1530046 - RNA, 19 nt, Homo sapiens
gugucugucuggcuggaaa

SEQ ID NO: 1530047 - RNA, 19 nt, Homo sapiens
uggaaugugcuguaagaau

SEQ ID NO: 1530048 - RNA, 19 nt, Homo sapiens
caucuccuccagcuccuuu

SEQ ID NO: 1530049 - RNA, 19 nt, Homo sapiens
ccugucagcagagauguaa

SEQ ID NO: 1530050 - RNA, 19 nt, Homo sapiens
ucagguguacagacauuga

SEQ ID NO: 1530051 - RNA, 19 nt, Homo sapiens
gaccgcguguccugugaag

SEQ ID NO: 1530052 - RNA, 19 nt, Homo sapiens
guacggcugugaccuuacc

SEQ ID NO: 1530053 - RNA, 19 nt, Homo sapiens
uuuaagaacgaacuugaug

SEQ ID NO: 1530054 - RNA, 19 nt, Homo sapiens
guguucaccuuggaugaug

SEQ ID NO: 1530055 - RNA, 19 nt, Homo sapiens
gcaccuacacaggcagaau

SEQ ID NO: 1530056 - RNA, 19 nt, Homo sapiens
caaggagucgcuggacaga

SEQ ID NO: 1530057 - RNA, 19 nt, Homo sapiens
ggaagggucuugcuccuaa

SEQ ID NO: 1530058 - RNA, 19 nt, Homo sapiens
gcauuucacugguuuauga

SEQ ID NO: 1530059 - RNA, 19 nt, Homo sapiens
gcucgaguuucauuaaaua

SEQ ID NO: 1530060 - RNA, 19 nt, Homo sapiens
gcagaagggcuaauauuga

SEQ ID NO: 1530061 - RNA, 19 nt, Homo sapiens
gaagcucgaguuucauuaa

SEQ ID NO: 1530062 - RNA, 19 nt, Homo sapiens
gcuguucuguuucguauug

SEQ ID NO: 1530063 - RNA, 19 nt, Homo sapiens
guacuggcgugguggcuuu

SEQ ID NO: 1530064 - RNA, 19 nt, Homo sapiens
agacugcugugcuuaguaa

SEQ ID NO: 1530065 - RNA, 19 nt, Homo sapiens
gagcuguucuguuucguau

SEQ ID NO: 1530066 - RNA, 19 nt, Homo sapiens
cugcaaauguuaagugauu

SEQ ID NO: 1530067 - RNA, 19 nt, Homo sapiens
gcaggcagcccuacaaauc

SEQ ID NO: 1530068 - RNA, 19 nt, Homo sapiens
ccaugcagcugaugccaaa

SEQ ID NO: 1530069 - RNA, 19 nt, Homo sapiens
gcaggcgacuuucuuccaa

SEQ ID NO: 1530070 - RNA, 19 nt, Homo sapiens
guaggcauuucacugguuu

SEQ ID NO: 1530071 - RNA, 19 nt, Homo sapiens
ccacagagcaggcuucauc

SEQ ID NO: 1530072 - RNA, 19 nt, Homo sapiens
ccauaaaggugugcauuuc

SEQ ID NO: 1530073 - RNA, 19 nt, Homo sapiens
gcuccugucugaagaaauc

SEQ ID NO: 1530074 - RNA, 19 nt, Homo sapiens
ggugaguccugcaaauguu

SEQ ID NO: 1530075 - RNA, 19 nt, Homo sapiens
gugaagagcugggacucaa

SEQ ID NO: 1530076 - RNA, 19 nt, Homo sapiens
gcaucuacauguucaacug

SEQ ID NO: 1530077 - RNA, 19 nt, Homo sapiens
ggcagaagggcuaauauug

SEQ ID NO: 1530078 - RNA, 19 nt, Homo sapiens
gaaggacugccaaccucua

SEQ ID NO: 1530079 - RNA, 19 nt, Homo sapiens
ggcccaaacugcccuggaa

SEQ ID NO: 1530080 - RNA, 19 nt, Homo sapiens
uaagugauuugcucaaggu

SEQ ID NO: 1530081 - RNA, 19 nt, Homo sapiens
gguaggcauuucacugguu

SEQ ID NO: 1530082 - RNA, 19 nt, Homo sapiens
ggucuggccuugcucucuu

SEQ ID NO: 1530083 - RNA, 19 nt, Homo sapiens
ggccuuucccugugacuua

SEQ ID NO: 1530084 - RNA, 19 nt, Homo sapiens
cagaagggcuaauauugac

SEQ ID NO: 1530085 - RNA, 19 nt, Homo sapiens
ccucucagguccuccauuc

SEQ ID NO: 1530086 - RNA, 19 nt, Homo sapiens
ucucugagccuaucauuag

SEQ ID NO: 1530087 - RNA, 19 nt, Homo sapiens
cagacugauuuccucuuaa

SEQ ID NO: 1530088 - RNA, 19 nt, Homo sapiens
gaccugcucucccaagaac

SEQ ID NO: 1530089 - RNA, 19 nt, Homo sapiens
gaagagcugggacucaagu

SEQ ID NO: 1530090 - RNA, 19 nt, Homo sapiens
agacugauuuccucuuaag

SEQ ID NO: 1530091 - RNA, 19 nt, Homo sapiens
aagcucgaguuucauuaaa

SEQ ID NO: 1530092 - RNA, 19 nt, Homo sapiens
cuaaaggagugcgugauca

SEQ ID NO: 1530093 - RNA, 19 nt, Homo sapiens
gguuucagcaggcgacuuu

SEQ ID NO: 1530094 - RNA, 19 nt, Homo sapiens
gggcaucaccacugucuuc

SEQ ID NO: 1530095 - RNA, 19 nt, Homo sapiens
gcauggugguauucuaugg

SEQ ID NO: 1530096 - RNA, 19 nt, Homo sapiens
ggcagcaucuacauguuca

SEQ ID NO: 1530097 - RNA, 19 nt, Homo sapiens
gcuaauauugaccgucuug

SEQ ID NO: 1530098 - RNA, 19 nt, Homo sapiens
gcugagacccacauugcuu

SEQ ID NO: 1530099 - RNA, 19 nt, Homo sapiens
agagguggcuguggacuuc

SEQ ID NO: 1530100 - RNA, 19 nt, Homo sapiens
aaggugugcauuucaguua

SEQ ID NO: 1530101 - RNA, 19 nt, Homo sapiens
guccaucgcauccgucauu

SEQ ID NO: 1530102 - RNA, 19 nt, Homo sapiens
cuagggauguggugaagag

SEQ ID NO: 1530103 - RNA, 19 nt, Homo sapiens
gugaguccugcaaauguua

SEQ ID NO: 1530104 - RNA, 19 nt, Homo sapiens
gcccaggccaguucucuga

SEQ ID NO: 1530105 - RNA, 19 nt, Homo sapiens
ggaauggcagcaucuacau

SEQ ID NO: 1530106 - RNA, 19 nt, Homo sapiens
gcuaaaggagugcgugauc

SEQ ID NO: 1530107 - RNA, 19 nt, Homo sapiens
gaauggcagcaucuacaug

SEQ ID NO: 1530108 - RNA, 19 nt, Homo sapiens
cauaaaggugugcauuuca

SEQ ID NO: 1530109 - RNA, 19 nt, Homo sapiens
gggcauuaaugagaagcuu

SEQ ID NO: 1530110 - RNA, 19 nt, Homo sapiens
guugcugucuuuacguuuc

SEQ ID NO: 1530111 - RNA, 19 nt, Homo sapiens
uggcagaagggcuaauauu

SEQ ID NO: 1530112 - RNA, 19 nt, Homo sapiens
gaagggucuugcuccuaag

SEQ ID NO: 1530113 - RNA, 19 nt, Homo sapiens
gagccgccauccucucucu

SEQ ID NO: 1530114 - RNA, 19 nt, Homo sapiens
guuaagugauuugcucaag

SEQ ID NO: 1530115 - RNA, 19 nt, Homo sapiens
gugccaugcuagagcuuga

SEQ ID NO: 1530116 - RNA, 19 nt, Homo sapiens
ccaguucucugagccuauc

SEQ ID NO: 1530117 - RNA, 19 nt, Homo sapiens
gggucuugcuccuaagugu

SEQ ID NO: 1530118 - RNA, 19 nt, Homo sapiens
cagcugaugccaaaguugu

SEQ ID NO: 1530119 - RNA, 19 nt, Homo sapiens
gcuguggacuuccucuacu

SEQ ID NO: 1530120 - RNA, 19 nt, Homo sapiens
cccauaaaggugugcauuu

SEQ ID NO: 1530121 - RNA, 19 nt, Homo sapiens
ugagguguccguccacuuc

SEQ ID NO: 1530122 - RNA, 19 nt, Homo sapiens
uuucgggcauuaaugagaa

SEQ ID NO: 1530123 - RNA, 19 nt, Homo sapiens
gggugaguccugcaaaugu

SEQ ID NO: 1530124 - RNA, 19 nt, Homo sapiens
gcuucagacugcugugcuu

SEQ ID NO: 1530125 - RNA, 19 nt, Homo sapiens
gggaagggucuugcuccua

SEQ ID NO: 1530126 - RNA, 19 nt, Homo sapiens
ucguauugcugcucugugu

SEQ ID NO: 1530127 - RNA, 19 nt, Homo sapiens
gaggcggucuuugccaaca

SEQ ID NO: 1530128 - RNA, 19 nt, Homo sapiens
gugaccugcucucccaaga

SEQ ID NO: 1530129 - RNA, 19 nt, Homo sapiens
gugucugcauguauuguga

SEQ ID NO: 1530130 - RNA, 19 nt, Homo sapiens
gcucugugucugcauguau

SEQ ID NO: 1530131 - RNA, 19 nt, Homo sapiens
ucaccacugucuuccucuu

SEQ ID NO: 1530132 - RNA, 19 nt, Homo sapiens
guuuaugaagcucgaguuu

SEQ ID NO: 1530133 - RNA, 19 nt, Homo sapiens
guuggcagaagggcuaaua

SEQ ID NO: 1530134 - RNA, 19 nt, Homo sapiens
ccauuucgcaggaauugga

SEQ ID NO: 1530135 - RNA, 19 nt, Homo sapiens
cuugcugccugucugcuuu

SEQ ID NO: 1530136 - RNA, 19 nt, Homo sapiens
cuugcugccugucugcuuu

SEQ ID NO: 1530137 - RNA, 19 nt, Homo sapiens
cuugcugccugucugcuuu

SEQ ID NO: 1530138 - RNA, 19 nt, Homo sapiens
gcugguugcugucuuuacg

SEQ ID NO: 1530139 - RNA, 19 nt, Homo sapiens
ggagugcgugaucagaaug

SEQ ID NO: 1530140 - RNA, 19 nt, Homo sapiens
ggacugccaaccucuacuc

SEQ ID NO: 1530141 - RNA, 19 nt, Homo sapiens
ucagacugcugugcuuagu

SEQ ID NO: 1530142 - RNA, 19 nt, Homo sapiens
ucuggacgguucuacuugu

SEQ ID NO: 1530143 - RNA, 19 nt, Homo sapiens
auaaaggugugcauuucag

SEQ ID NO: 1530144 - RNA, 19 nt, Homo sapiens
cuacauccuucuggcuuca

SEQ ID NO: 1530145 - RNA, 19 nt, Homo sapiens
ccagugaggcggucuuugc

SEQ ID NO: 1530146 - RNA, 19 nt, Homo sapiens
gaggugcgucacuggugua

SEQ ID NO: 1530147 - RNA, 19 nt, Homo sapiens
aggagugcgugaucagaau

SEQ ID NO: 1530148 - RNA, 19 nt, Homo sapiens
ggcccaaccuagcguucug

SEQ ID NO: 1530149 - RNA, 19 nt, Homo sapiens
gcagcugaugccaaaguug

SEQ ID NO: 1530150 - RNA, 19 nt, Homo sapiens
aaaggugugcauuucaguu

SEQ ID NO: 1530151 - RNA, 19 nt, Homo sapiens
gcauuaaugagaagcuuuu

SEQ ID NO: 1530152 - RNA, 19 nt, Homo sapiens
ggcauuaaugagaagcuuu

SEQ ID NO: 1530153 - RNA, 19 nt, Homo sapiens
gcccaaacugcccuggaaa

SEQ ID NO: 1530154 - RNA, 19 nt, Homo sapiens
gugguggcuuugccuggaa

SEQ ID NO: 1530155 - RNA, 19 nt, Homo sapiens
ggaguacaauuccaaguau

SEQ ID NO: 1530156 - RNA, 19 nt, Homo sapiens
gaaauaaagagcauugaag

SEQ ID NO: 1530157 - RNA, 19 nt, Homo sapiens
ccagcuacuuuccuaauga

SEQ ID NO: 1530158 - RNA, 19 nt, Homo sapiens
ccacaggguucagccuuaa

SEQ ID NO: 1530159 - RNA, 19 nt, Homo sapiens
gaacaccccugcccagcua

SEQ ID NO: 1530160 - RNA, 19 nt, Homo sapiens
cgggagaacuuccgacaug

SEQ ID NO: 1530161 - RNA, 19 nt, Homo sapiens
gaacaagcccaggaccauu

SEQ ID NO: 1530162 - RNA, 19 nt, Homo sapiens
gggaguggcuucaccaaac

SEQ ID NO: 1530163 - RNA, 19 nt, Homo sapiens
gacaaacguugcccugcuu

SEQ ID NO: 1530164 - RNA, 19 nt, Homo sapiens
ggaguggcuucaccaaaca

SEQ ID NO: 1530165 - RNA, 19 nt, Homo sapiens
cgacauggcccacgcuuca

SEQ ID NO: 1530166 - RNA, 19 nt, Homo sapiens
agaaaucgaucggcgcaaa

SEQ ID NO: 1530167 - RNA, 19 nt, Homo sapiens
gcccugagcccuugguuug

SEQ ID NO: 1530168 - RNA, 19 nt, Homo sapiens
caggagggcuggcuucucu

SEQ ID NO: 1530169 - RNA, 19 nt, Homo sapiens
cagcuacuuuccuaaugaa

SEQ ID NO: 1530170 - RNA, 19 nt, Homo sapiens
ccaaggagguccggaaggu

SEQ ID NO: 1530171 - RNA, 19 nt, Homo sapiens
cggaguacaauuccaagua

SEQ ID NO: 1530172 - RNA, 19 nt, Homo sapiens
ugacagggaucagcgauac

SEQ ID NO: 1530173 - RNA, 19 nt, Homo sapiens
cccacaggguucagccuua

SEQ ID NO: 1530174 - RNA, 19 nt, Homo sapiens
ccgagggaaugaaaggauu

SEQ ID NO: 1530175 - RNA, 19 nt, Homo sapiens
gaugaguuccuaccugugu

SEQ ID NO: 1530176 - RNA, 19 nt, Homo sapiens
agcgauaccugaccaccua

SEQ ID NO: 1530177 - RNA, 19 nt, Homo sapiens
acauggagaugaguuccua

SEQ ID NO: 1530178 - RNA, 19 nt, Homo sapiens
caaggguacuuugagaaca

SEQ ID NO: 1530179 - RNA, 19 nt, Homo sapiens
ugacgucggaguacaauuc

SEQ ID NO: 1530180 - RNA, 19 nt, Homo sapiens
ggaacaagcccaggaccau

SEQ ID NO: 1530181 - RNA, 19 nt, Homo sapiens
aaccaaggguacuuugaga

SEQ ID NO: 1530182 - RNA, 19 nt, Homo sapiens
gaguacaauuccaaguauc

SEQ ID NO: 1530183 - RNA, 19 nt, Homo sapiens
ccaggaccauuuccagucu

SEQ ID NO: 1530184 - RNA, 19 nt, Homo sapiens
ucaccuacauggagaugag

SEQ ID NO: 1530185 - RNA, 19 nt, Homo sapiens
gcaccggcuacaaaucaaa

SEQ ID NO: 1530186 - RNA, 19 nt, Homo sapiens
gccagagugucaccaaguc

SEQ ID NO: 1530187 - RNA, 19 nt, Homo sapiens
caaccaaggguacuuugag

SEQ ID NO: 1530188 - RNA, 19 nt, Homo sapiens
cagaccagcucaggcuaug

SEQ ID NO: 1530189 - RNA, 19 nt, Homo sapiens
cugcccagcuacuuuccua

SEQ ID NO: 1530190 - RNA, 19 nt, Homo sapiens
gaaaucgaucggcgcaaag

SEQ ID NO: 1530191 - RNA, 19 nt, Homo sapiens
cuacaaccaaggguacuuu

SEQ ID NO: 1530192 - RNA, 19 nt, Homo sapiens
aacaagcccaggaccauuu

SEQ ID NO: 1530193 - RNA, 19 nt, Homo sapiens
cccagcuacuuuccuaaug

SEQ ID NO: 1530194 - RNA, 19 nt, Homo sapiens
ggcaccggcuacaaaucaa

SEQ ID NO: 1530195 - RNA, 19 nt, Homo sapiens
agaccagccagauuucuug

SEQ ID NO: 1530196 - RNA, 19 nt, Homo sapiens
ccucuagaccagccagauu

SEQ ID NO: 1530197 - RNA, 19 nt, Homo sapiens
uaccagaacacaccucaca

SEQ ID NO: 1530198 - RNA, 19 nt, Homo sapiens
ugagucaccagcaguuuca

SEQ ID NO: 1530199 - RNA, 19 nt, Homo sapiens
gcccagcuacuuuccuaau

SEQ ID NO: 1530200 - RNA, 19 nt, Homo sapiens
gcccuugguuugucaaucc

SEQ ID NO: 1530201 - RNA, 19 nt, Homo sapiens
aaggguacuuugagaacau

SEQ ID NO: 1530202 - RNA, 19 nt, Homo sapiens
ccaaggguacuuugagaac

SEQ ID NO: 1530203 - RNA, 19 nt, Homo sapiens
gaagagauaugucagaaua

SEQ ID NO: 1530204 - RNA, 19 nt, Homo sapiens
gaauggauguggagaaaua

SEQ ID NO: 1530205 - RNA, 19 nt, Homo sapiens
gaagagaucugcauguugu

SEQ ID NO: 1530206 - RNA, 19 nt, Homo sapiens
acacagagcuauucuauug

SEQ ID NO: 1530207 - RNA, 19 nt, Homo sapiens
gcaaugcucugaccacaaa

SEQ ID NO: 1530208 - RNA, 19 nt, Homo sapiens
caacaagaguuaccaagaa

SEQ ID NO: 1530209 - RNA, 19 nt, Homo sapiens
cagaaacacuggacaauga

SEQ ID NO: 1530210 - RNA, 19 nt, Homo sapiens
gaaaugccaauuacagaua

SEQ ID NO: 1530211 - RNA, 19 nt, Homo sapiens
gaauucacuugcauuguuu

SEQ ID NO: 1530212 - RNA, 19 nt, Homo sapiens
guucagaagucaaauguug

SEQ ID NO: 1530213 - RNA, 19 nt, Homo sapiens
gcugaucucuuugaugaua

SEQ ID NO: 1530214 - RNA, 19 nt, Homo sapiens
ucaggaaacuucaguguga

SEQ ID NO: 1530215 - RNA, 19 nt, Homo sapiens
gaucucagcagcacauaua

SEQ ID NO: 1530216 - RNA, 19 nt, Homo sapiens
gaucugccauucucugaaa

SEQ ID NO: 1530217 - RNA, 19 nt, Homo sapiens
gaaccaagaugacaguuuu

SEQ ID NO: 1530218 - RNA, 19 nt, Homo sapiens
cauggagccuuguuucaua

SEQ ID NO: 1530219 - RNA, 19 nt, Homo sapiens
gcaggaaacuuacauaucc

SEQ ID NO: 1530220 - RNA, 19 nt, Homo sapiens
ugaauucacuugcauuguu

SEQ ID NO: 1530221 - RNA, 19 nt, Homo sapiens
gaaaugccuugcugccuau

SEQ ID NO: 1530222 - RNA, 19 nt, Homo sapiens
ugagaucacuuucugaaga

SEQ ID NO: 1530223 - RNA, 19 nt, Homo sapiens
gaacaaguuucuggcaguu

SEQ ID NO: 1530224 - RNA, 19 nt, Homo sapiens
gauggugacccucaaauuu

SEQ ID NO: 1530225 - RNA, 19 nt, Homo sapiens
uaaagaacuuggcuuacaa

SEQ ID NO: 1530226 - RNA, 19 nt, Homo sapiens
ccaagcagcugguauuaca

SEQ ID NO: 1530227 - RNA, 19 nt, Homo sapiens
gaaguugcuuagauacauu

SEQ ID NO: 1530228 - RNA, 19 nt, Homo sapiens
gaacagaagacgaaaauuu

SEQ ID NO: 1530229 - RNA, 19 nt, Homo sapiens
ggagagaagcaaauugaaa

SEQ ID NO: 1530230 - RNA, 19 nt, Homo sapiens
uagcaaagaugacuuccuu

SEQ ID NO: 1530231 - RNA, 19 nt, Homo sapiens
ugacaacucuguguuauag

SEQ ID NO: 1530232 - RNA, 19 nt, Homo sapiens
gaacccaauuccugaacuu

SEQ ID NO: 1530233 - RNA, 19 nt, Homo sapiens
gcuauucuauugguuauga

SEQ ID NO: 1530234 - RNA, 19 nt, Homo sapiens
gaaaguccaucuccauugc

SEQ ID NO: 1530235 - RNA, 19 nt, Homo sapiens
gaaagucacccuucagagu

SEQ ID NO: 1530236 - RNA, 19 nt, Homo sapiens
auucagaucuugaugguaa

SEQ ID NO: 1530237 - RNA, 19 nt, Homo sapiens
uaagaagacuaucagaauc

SEQ ID NO: 1530238 - RNA, 19 nt, Homo sapiens
ggaaguugcuuagauacau

SEQ ID NO: 1530239 - RNA, 19 nt, Homo sapiens
gggaacaucuuuggcagaa

SEQ ID NO: 1530240 - RNA, 19 nt, Homo sapiens
cugcugaucucuuugauga

SEQ ID NO: 1530241 - RNA, 19 nt, Homo sapiens
uaacacagagcuauucuau

SEQ ID NO: 1530242 - RNA, 19 nt, Homo sapiens
gaaacucuuugcaauaguc

SEQ ID NO: 1530243 - RNA, 19 nt, Homo sapiens
ucucugaucuuugcaaauu

SEQ ID NO: 1530244 - RNA, 19 nt, Homo sapiens
gaagagacagccagcaguu

SEQ ID NO: 1530245 - RNA, 19 nt, Homo sapiens
guugagcacuuuaucuuau

SEQ ID NO: 1530246 - RNA, 19 nt, Homo sapiens
ggacauugcaacugagauu

SEQ ID NO: 1530247 - RNA, 19 nt, Homo sapiens
acaaccagauaacaaagua

SEQ ID NO: 1530248 - RNA, 19 nt, Homo sapiens
gauaaacagagcuuucaaa

SEQ ID NO: 1530249 - RNA, 19 nt, Homo sapiens
ucacugagaucacuuucug

SEQ ID NO: 1530250 - RNA, 19 nt, Homo sapiens
gaaagugagauugcuguaa

SEQ ID NO: 1530251 - RNA, 19 nt, Homo sapiens
ucaagaacaugcucuccaa

SEQ ID NO: 1530252 - RNA, 19 nt, Homo sapiens
uagaaacucuuugcaauag

SEQ ID NO: 1530253 - RNA, 19 nt, Homo sapiens
acaauuugcaggaaacuua

SEQ ID NO: 1530254 - RNA, 19 nt, Homo sapiens
gaaguauaaugaugucucu

SEQ ID NO: 1530255 - RNA, 19 nt, Homo sapiens
ugacagcacuucugauuuu

SEQ ID NO: 1530256 - RNA, 19 nt, Homo sapiens
guugaaacuugcuuuguug

SEQ ID NO: 1530257 - RNA, 19 nt, Homo sapiens
gagcuauucuauugguuau

SEQ ID NO: 1530258 - RNA, 19 nt, Homo sapiens
gcagaugucaguaguagga

SEQ ID NO: 1530259 - RNA, 19 nt, Homo sapiens
cugaaagccugaacaaguu

SEQ ID NO: 1530260 - RNA, 19 nt, Homo sapiens
ggguaaagaacuuggcuua

SEQ ID NO: 1530261 - RNA, 19 nt, Homo sapiens
ucacuuacuugcuuuagau

SEQ ID NO: 1530262 - RNA, 19 nt, Homo sapiens
gaaacacuggacaaugaua

SEQ ID NO: 1530263 - RNA, 19 nt, Homo sapiens
ccacugguuugcacaggua

SEQ ID NO: 1530264 - RNA, 19 nt, Homo sapiens
ucacauauacauccagaaa

SEQ ID NO: 1530265 - RNA, 19 nt, Homo sapiens
gcauaggucuagggaaaug

SEQ ID NO: 1530266 - RNA, 19 nt, Homo sapiens
ggaaaucuaaguccuagug

SEQ ID NO: 1530267 - RNA, 19 nt, Homo sapiens
acagugcaguggaaauuaa

SEQ ID NO: 1530268 - RNA, 19 nt, Homo sapiens
aggcauaggucuagggaaa

SEQ ID NO: 1530269 - RNA, 19 nt, Homo sapiens
caagaaagaaacugaaaca

SEQ ID NO: 1530270 - RNA, 19 nt, Homo sapiens
ccuauuguaucugguauuu

SEQ ID NO: 1530271 - RNA, 19 nt, Homo sapiens
cagaagcccuauuguaucu

SEQ ID NO: 1530272 - RNA, 19 nt, Homo sapiens
aacaagaauucaugggaua

SEQ ID NO: 1530273 - RNA, 19 nt, Homo sapiens
aaugaugucucugaucuuu

SEQ ID NO: 1530274 - RNA, 19 nt, Homo sapiens
caaagcaaacuguagcaaa

SEQ ID NO: 1530275 - RNA, 19 nt, Homo sapiens
cuucagauaugcuuggauu

SEQ ID NO: 1530276 - RNA, 19 nt, Homo sapiens
gaaauuggaguuaaugacu

SEQ ID NO: 1530277 - RNA, 19 nt, Homo sapiens
acagucaacuccaauuuca

SEQ ID NO: 1530278 - RNA, 19 nt, Homo sapiens
aaagcaaacuguagcaaag

SEQ ID NO: 1530279 - RNA, 19 nt, Homo sapiens
gcuuuaagaucaucacaag

SEQ ID NO: 1530280 - RNA, 19 nt, Homo sapiens
gggaugaucugccauucuc

SEQ ID NO: 1530281 - RNA, 19 nt, Homo sapiens
gcaauaguccaaauagaag

SEQ ID NO: 1530282 - RNA, 19 nt, Homo sapiens
uggcaguucuugaaaguga

SEQ ID NO: 1530283 - RNA, 19 nt, Homo sapiens
gaaacauauuagacaagga

SEQ ID NO: 1530284 - RNA, 19 nt, Homo sapiens
ucauuucccugaucaacaa

SEQ ID NO: 1530285 - RNA, 19 nt, Homo sapiens
ccaugaaacugauagugau

SEQ ID NO: 1530286 - RNA, 19 nt, Homo sapiens
aaucagaagcccuauugua

SEQ ID NO: 1530287 - RNA, 19 nt, Homo sapiens
ugauacaacucagaaucua

SEQ ID NO: 1530288 - RNA, 19 nt, Homo sapiens
uuuggaaguugcuuagaua

SEQ ID NO: 1530289 - RNA, 19 nt, Homo sapiens
ggaaaugccaauuacagau

SEQ ID NO: 1530290 - RNA, 19 nt, Homo sapiens
gagcuacugugccuuuuaa

SEQ ID NO: 1530291 - RNA, 19 nt, Homo sapiens
aaagucaccugaacccaau

SEQ ID NO: 1530292 - RNA, 19 nt, Homo sapiens
caccucagcugcacccuau

SEQ ID NO: 1530293 - RNA, 19 nt, Homo sapiens
aacaagaguuaccaagaaa

SEQ ID NO: 1530294 - RNA, 19 nt, Homo sapiens
ucacuugcauuguuucaca

SEQ ID NO: 1530295 - RNA, 19 nt, Homo sapiens
caagaguuaccaagaaaga

SEQ ID NO: 1530296 - RNA, 19 nt, Homo sapiens
gcagaccacagcaguuuau

SEQ ID NO: 1530297 - RNA, 19 nt, Homo sapiens
ggagccuuguuucauauau

SEQ ID NO: 1530298 - RNA, 19 nt, Homo sapiens
caacuaacagauaaugaug

SEQ ID NO: 1530299 - RNA, 19 nt, Homo sapiens
uuagguaguugagcacuuu

SEQ ID NO: 1530300 - RNA, 19 nt, Homo sapiens
gccaugaaacugauaguga

SEQ ID NO: 1530301 - RNA, 19 nt, Homo sapiens
caucaugaaauuggaguua

SEQ ID NO: 1530302 - RNA, 19 nt, Homo sapiens
cagauacaaacuuuccuua

SEQ ID NO: 1530303 - RNA, 19 nt, Homo sapiens
gaaggaaguugaagaauua

SEQ ID NO: 1530304 - RNA, 19 nt, Homo sapiens
gaagauagauaaagaggaa

SEQ ID NO: 1530305 - RNA, 19 nt, Homo sapiens
ggaaggaaguugaagaauu

SEQ ID NO: 1530306 - RNA, 19 nt, Homo sapiens
gcagagggauugccaguug

SEQ ID NO: 1530307 - RNA, 19 nt, Homo sapiens
gaacagauuuggcacauac

SEQ ID NO: 1530308 - RNA, 19 nt, Homo sapiens
ugaaagaaauagccgcuua

SEQ ID NO: 1530309 - RNA, 19 nt, Homo sapiens
gaucaacuauccaacugua

SEQ ID NO: 1530310 - RNA, 19 nt, Homo sapiens
gauaugcgcaugcaaauaa

SEQ ID NO: 1530311 - RNA, 19 nt, Homo sapiens
agaaggauuucaaggauua

SEQ ID NO: 1530312 - RNA, 19 nt, Homo sapiens
ggaagauacuagaaagaaa

SEQ ID NO: 1530313 - RNA, 19 nt, Homo sapiens
gaaagccacaucacauaua

SEQ ID NO: 1530314 - RNA, 19 nt, Homo sapiens
gagugaagcuuaugagugu

SEQ ID NO: 1530315 - RNA, 19 nt, Homo sapiens
uaaagagaaugcagagaaa

SEQ ID NO: 1530316 - RNA, 19 nt, Homo sapiens
gaagaucuccaguauguga

SEQ ID NO: 1530317 - RNA, 19 nt, Homo sapiens
gcacauacggcaucuacua

SEQ ID NO: 1530318 - RNA, 19 nt, Homo sapiens
caucgaagaucuccaguau

SEQ ID NO: 1530319 - RNA, 19 nt, Homo sapiens
uaaaggaacugagugaaga

SEQ ID NO: 1530320 - RNA, 19 nt, Homo sapiens
agaaaugucuuuggaauug

SEQ ID NO: 1530321 - RNA, 19 nt, Homo sapiens
ccaauucuccguaguuuaa

SEQ ID NO: 1530322 - RNA, 19 nt, Homo sapiens
cauauaagaugaugaaguc

SEQ ID NO: 1530323 - RNA, 19 nt, Homo sapiens
caacacaguuaaagagaau

SEQ ID NO: 1530324 - RNA, 19 nt, Homo sapiens
guauauccguugcccauuu

SEQ ID NO: 1530325 - RNA, 19 nt, Homo sapiens
gagaaggauuucaaggauu

SEQ ID NO: 1530326 - RNA, 19 nt, Homo sapiens
ucgaagaucuccaguaugu

SEQ ID NO: 1530327 - RNA, 19 nt, Homo sapiens
ucaaagguauucagcuauu

SEQ ID NO: 1530328 - RNA, 19 nt, Homo sapiens
gaugaagucuuuucucuaa

SEQ ID NO: 1530329 - RNA, 19 nt, Homo sapiens
gaaagaaauagccgcuuaa

SEQ ID NO: 1530330 - RNA, 19 nt, Homo sapiens
ccacagaaguagaaaguag

SEQ ID NO: 1530331 - RNA, 19 nt, Homo sapiens
aaucaaagguauucagcua

SEQ ID NO: 1530332 - RNA, 19 nt, Homo sapiens
uaaaccagcuguuauuucu

SEQ ID NO: 1530333 - RNA, 19 nt, Homo sapiens
caaggaaacuuuguugcaa

SEQ ID NO: 1530334 - RNA, 19 nt, Homo sapiens
aaagccacaucacauauaa

SEQ ID NO: 1530335 - RNA, 19 nt, Homo sapiens
gaagagaagucagaauugc

SEQ ID NO: 1530336 - RNA, 19 nt, Homo sapiens
gaaauuaaacugccuacca

SEQ ID NO: 1530337 - RNA, 19 nt, Homo sapiens
gagaaugacuggcucaaaa

SEQ ID NO: 1530338 - RNA, 19 nt, Homo sapiens
guauuagucuguucucaug

SEQ ID NO: 1530339 - RNA, 19 nt, Homo sapiens
agcacuaucuuacaucuua

SEQ ID NO: 1530340 - RNA, 19 nt, Homo sapiens
caagagaggauguugaaga

SEQ ID NO: 1530341 - RNA, 19 nt, Homo sapiens
gaaaggcaggcucugaauu

SEQ ID NO: 1530342 - RNA, 19 nt, Homo sapiens
ccaagcugcuggacuagaa

SEQ ID NO: 1530343 - RNA, 19 nt, Homo sapiens
cagaaagccacaucacaua

SEQ ID NO: 1530344 - RNA, 19 nt, Homo sapiens
gaaguauucagaagcauga

SEQ ID NO: 1530345 - RNA, 19 nt, Homo sapiens
gguauucagcuauucauuu

SEQ ID NO: 1530346 - RNA, 19 nt, Homo sapiens
acggaaagcugcaaaggaa

SEQ ID NO: 1530347 - RNA, 19 nt, Homo sapiens
caaauaaagacacuuagga

SEQ ID NO: 1530348 - RNA, 19 nt, Homo sapiens
gagcaauucauguuucaaa

SEQ ID NO: 1530349 - RNA, 19 nt, Homo sapiens
cagucaaacucuauaaaga

SEQ ID NO: 1530350 - RNA, 19 nt, Homo sapiens
ggaaugggccacacagaau

SEQ ID NO: 1530351 - RNA, 19 nt, Homo sapiens
aaaggcaggcucugaauuu

SEQ ID NO: 1530352 - RNA, 19 nt, Homo sapiens
uaaacucauuaccuccuua

SEQ ID NO: 1530353 - RNA, 19 nt, Homo sapiens
ggagugaacgacaugcuaa

SEQ ID NO: 1530354 - RNA, 19 nt, Homo sapiens
gaagaagcgaugaaggaaa

SEQ ID NO: 1530355 - RNA, 19 nt, Homo sapiens
aagagaggauguugaagaa

SEQ ID NO: 1530356 - RNA, 19 nt, Homo sapiens
aaccagcuguuauuucuaa

SEQ ID NO: 1530357 - RNA, 19 nt, Homo sapiens
ugagaaggauuucaaggau

SEQ ID NO: 1530358 - RNA, 19 nt, Homo sapiens
uagaagagaagucagaauu

SEQ ID NO: 1530359 - RNA, 19 nt, Homo sapiens
gcagaaaauuuggugcuua

SEQ ID NO: 1530360 - RNA, 19 nt, Homo sapiens
cuagagaucugggagaaug

SEQ ID NO: 1530361 - RNA, 19 nt, Homo sapiens
gaaaaugucagaacacuau

SEQ ID NO: 1530362 - RNA, 19 nt, Homo sapiens
uuugggaacugaaguauau

SEQ ID NO: 1530363 - RNA, 19 nt, Homo sapiens
cucauuaccuccuuacaaa

SEQ ID NO: 1530364 - RNA, 19 nt, Homo sapiens
ggaacugagugaagagaag

SEQ ID NO: 1530365 - RNA, 19 nt, Homo sapiens
gucaaacucuauaaagaug

SEQ ID NO: 1530366 - RNA, 19 nt, Homo sapiens
uacccaagcugcuggacua

SEQ ID NO: 1530367 - RNA, 19 nt, Homo sapiens
guucucaugcugcuaauaa

SEQ ID NO: 1530368 - RNA, 19 nt, Homo sapiens
gaugagagcacuaucuuac

SEQ ID NO: 1530369 - RNA, 19 nt, Homo sapiens
gccagaaacacauauagaa

SEQ ID NO: 1530370 - RNA, 19 nt, Homo sapiens
ucaacacaguuaaagagaa

SEQ ID NO: 1530371 - RNA, 19 nt, Homo sapiens
aguuuaacccuguguauua

SEQ ID NO: 1530372 - RNA, 19 nt, Homo sapiens
gacaagggcaguuaucuag

SEQ ID NO: 1530373 - RNA, 19 nt, Homo sapiens
gcauagcauugucuacaca

SEQ ID NO: 1530374 - RNA, 19 nt, Homo sapiens
gugauuccaguaugaaaua

SEQ ID NO: 1530375 - RNA, 19 nt, Homo sapiens
caagguagucucugagguu

SEQ ID NO: 1530376 - RNA, 19 nt, Homo sapiens
cagaaacacauauagaaga

SEQ ID NO: 1530377 - RNA, 19 nt, Homo sapiens
gaauugccagaaacacaua

SEQ ID NO: 1530378 - RNA, 19 nt, Homo sapiens
cuguaaagcucauugacaa

SEQ ID NO: 1530379 - RNA, 19 nt, Homo sapiens
uuaaagagaaugcagagaa

SEQ ID NO: 1530380 - RNA, 19 nt, Homo sapiens
cgacaugcuaaacucauua

SEQ ID NO: 1530381 - RNA, 19 nt, Homo sapiens
uuucuacacugaaguauuc

SEQ ID NO: 1530382 - RNA, 19 nt, Homo sapiens
gaaauuccagucaaacucu

SEQ ID NO: 1530383 - RNA, 19 nt, Homo sapiens
caagggcaguuaucuagag

SEQ ID NO: 1530384 - RNA, 19 nt, Homo sapiens
gaaacucagugaaaaggaa

SEQ ID NO: 1530385 - RNA, 19 nt, Homo sapiens
gaaauagccgcuuaaaaga

SEQ ID NO: 1530386 - RNA, 19 nt, Homo sapiens
ggauuucaaggauuaugua

SEQ ID NO: 1530387 - RNA, 19 nt, Homo sapiens
ugagagcacuaucuuacau

SEQ ID NO: 1530388 - RNA, 19 nt, Homo sapiens
gaagugccaccugaagaaa

SEQ ID NO: 1530389 - RNA, 19 nt, Homo sapiens
gaacgacaugcuaaacuca

SEQ ID NO: 1530390 - RNA, 19 nt, Homo sapiens
aauggaaguuugaaagaga

SEQ ID NO: 1530391 - RNA, 19 nt, Homo sapiens
gaaaauagcaucgaagauc

SEQ ID NO: 1530392 - RNA, 19 nt, Homo sapiens
gaggaugcucaaugugaua

SEQ ID NO: 1530393 - RNA, 19 nt, Homo sapiens
caagauacccaggcgacua

SEQ ID NO: 1530394 - RNA, 19 nt, Homo sapiens
ugacaagggcaguuaucua

SEQ ID NO: 1530395 - RNA, 19 nt, Homo sapiens
ugacaucaacacaguuaaa

SEQ ID NO: 1530396 - RNA, 19 nt, Homo sapiens
ggcaggcucugaauuugau

SEQ ID NO: 1530397 - RNA, 19 nt, Homo sapiens
gguucaagguagucucuga

SEQ ID NO: 1530398 - RNA, 19 nt, Homo sapiens
cccaggcgacuauaucuua

SEQ ID NO: 1530399 - RNA, 19 nt, Homo sapiens
ggagaaugacuggcucaaa

SEQ ID NO: 1530400 - RNA, 19 nt, Homo sapiens
caaagguauucagcuauuc

SEQ ID NO: 1530401 - RNA, 19 nt, Homo sapiens
gcaacccacagaaguagaa

SEQ ID NO: 1530402 - RNA, 19 nt, Homo sapiens
gaaugggccacacagaaug

SEQ ID NO: 1530403 - RNA, 19 nt, Homo sapiens
gcagagcccucgugcauug

SEQ ID NO: 1530404 - RNA, 19 nt, Homo sapiens
uaaacuccaugaagacuua

SEQ ID NO: 1530405 - RNA, 19 nt, Homo sapiens
gaugagcuuugcagcauua

SEQ ID NO: 1530406 - RNA, 19 nt, Homo sapiens
ggaaggcaguuguucauug

SEQ ID NO: 1530407 - RNA, 19 nt, Homo sapiens
ccuaguagcugggauuaua

SEQ ID NO: 1530408 - RNA, 19 nt, Homo sapiens
gaaauucccuuaugaugac

SEQ ID NO: 1530409 - RNA, 19 nt, Homo sapiens
gaggauggaugaacagaga

SEQ ID NO: 1530410 - RNA, 19 nt, Homo sapiens
gcagaagguuccggacuuu

SEQ ID NO: 1530411 - RNA, 19 nt, Homo sapiens
aaccaaagaccaaauguua

SEQ ID NO: 1530412 - RNA, 19 nt, Homo sapiens
gaagaaaggccaaccugau

SEQ ID NO: 1530413 - RNA, 19 nt, Homo sapiens
gaaggcaguuguucauugg

SEQ ID NO: 1530414 - RNA, 19 nt, Homo sapiens
gaagaaggcaguaguuugg

SEQ ID NO: 1530415 - RNA, 19 nt, Homo sapiens
ccagaaagcauguccgaaa

SEQ ID NO: 1530416 - RNA, 19 nt, Homo sapiens
gagaaggacagcagaaaga

SEQ ID NO: 1530417 - RNA, 19 nt, Homo sapiens
gaacgucgaggaacagaug

SEQ ID NO: 1530418 - RNA, 19 nt, Homo sapiens
ccaaagugcuggaauugca

SEQ ID NO: 1530419 - RNA, 19 nt, Homo sapiens
gaaagcauguccgaaagca

SEQ ID NO: 1530420 - RNA, 19 nt, Homo sapiens
gaaccaaagaccaaauguu

SEQ ID NO: 1530421 - RNA, 19 nt, Homo sapiens
cagccagacuuuaaaauua

SEQ ID NO: 1530422 - RNA, 19 nt, Homo sapiens
ggucugagaucgggugcua

SEQ ID NO: 1530423 - RNA, 19 nt, Homo sapiens
caagauggguguuauucuc

SEQ ID NO: 1530424 - RNA, 19 nt, Homo sapiens
cuaccaaagugcuggaauu

SEQ ID NO: 1530425 - RNA, 19 nt, Homo sapiens
acgauaaacuccaugaaga

SEQ ID NO: 1530426 - RNA, 19 nt, Homo sapiens
gaugaaggucuuagaauca

SEQ ID NO: 1530427 - RNA, 19 nt, Homo sapiens
cgaauguccuaguggauug

SEQ ID NO: 1530428 - RNA, 19 nt, Homo sapiens
gaaagcaguccaggagauu

SEQ ID NO: 1530429 - RNA, 19 nt, Homo sapiens
gugcaccgcucguuuguag

SEQ ID NO: 1530430 - RNA, 19 nt, Homo sapiens
cgaaagcaguccaggagau

SEQ ID NO: 1530431 - RNA, 19 nt, Homo sapiens
gcguauagccuccugcauu

SEQ ID NO: 1530432 - RNA, 19 nt, Homo sapiens
caugaagacuuagacaaga

SEQ ID NO: 1530433 - RNA, 19 nt, Homo sapiens
gcuggcaucuccucauugu

SEQ ID NO: 1530434 - RNA, 19 nt, Homo sapiens
gcaguccaggagauuauua

SEQ ID NO: 1530435 - RNA, 19 nt, Homo sapiens
gcgaugagcuuugcagcau

SEQ ID NO: 1530436 - RNA, 19 nt, Homo sapiens
ccacacaugcccuuuguug

SEQ ID NO: 1530437 - RNA, 19 nt, Homo sapiens
gagugguggucauauguga

SEQ ID NO: 1530438 - RNA, 19 nt, Homo sapiens
ggacccagacauauccuuu

SEQ ID NO: 1530439 - RNA, 19 nt, Homo sapiens
gcacccagcagcagagcua

SEQ ID NO: 1530440 - RNA, 19 nt, Homo sapiens
gggauugccuggucuaagg

SEQ ID NO: 1530441 - RNA, 19 nt, Homo sapiens
agaaauucccuuaugauga

SEQ ID NO: 1530442 - RNA, 19 nt, Homo sapiens
gcagaagcuuugagaacca

SEQ ID NO: 1530443 - RNA, 19 nt, Homo sapiens
gaccgaacgucgaggaaca

SEQ ID NO: 1530444 - RNA, 19 nt, Homo sapiens
gaaggucuuagaaucauug

SEQ ID NO: 1530445 - RNA, 19 nt, Homo sapiens
cguauagccuccugcauuc

SEQ ID NO: 1530446 - RNA, 19 nt, Homo sapiens
ggaguuggcucuggauagg

SEQ ID NO: 1530447 - RNA, 19 nt, Homo sapiens
ugugugacguguuuagaaa

SEQ ID NO: 1530448 - RNA, 19 nt, Homo sapiens
gugcuggcaucuccucauu

SEQ ID NO: 1530449 - RNA, 19 nt, Homo sapiens
gaacucccagccugaaaug

SEQ ID NO: 1530450 - RNA, 19 nt, Homo sapiens
gaucucggcucacuguaac

SEQ ID NO: 1530451 - RNA, 19 nt, Homo sapiens
cagaaagcauguccgaaag

SEQ ID NO: 1530452 - RNA, 19 nt, Homo sapiens
ggcaguaguuuggguguga

SEQ ID NO: 1530453 - RNA, 19 nt, Homo sapiens
gauggguguuauucucauu

SEQ ID NO: 1530454 - RNA, 19 nt, Homo sapiens
agaugaaggucuuagaauc

SEQ ID NO: 1530455 - RNA, 19 nt, Homo sapiens
gauggcggaugagagguuu

SEQ ID NO: 1530456 - RNA, 19 nt, Homo sapiens
ugaagaaggcaguaguuug

SEQ ID NO: 1530457 - RNA, 19 nt, Homo sapiens
ugaggaggauggaugaaca

SEQ ID NO: 1530458 - RNA, 19 nt, Homo sapiens
uccagaaauucccuuauga

SEQ ID NO: 1530459 - RNA, 19 nt, Homo sapiens
gaaggacagcagaaagaug

SEQ ID NO: 1530460 - RNA, 19 nt, Homo sapiens
cacgguggcucgcuuuguu

SEQ ID NO: 1530461 - RNA, 19 nt, Homo sapiens
uagacaagaucagaggaaa

SEQ ID NO: 1530462 - RNA, 19 nt, Homo sapiens
ccuaguggauuguguugug

SEQ ID NO: 1530463 - RNA, 19 nt, Homo sapiens
gggcacagaugagcagagu

SEQ ID NO: 1530464 - RNA, 19 nt, Homo sapiens
ugacccuacuuacgauaaa

SEQ ID NO: 1530465 - RNA, 19 nt, Homo sapiens
gaagcugccgggucugcua

SEQ ID NO: 1530466 - RNA, 19 nt, Homo sapiens
cagaaauucccuuaugaug

SEQ ID NO: 1530467 - RNA, 19 nt, Homo sapiens
gaagggauugccuggucua

SEQ ID NO: 1530468 - RNA, 19 nt, Homo sapiens
guucguuacucaauguuca

SEQ ID NO: 1530469 - RNA, 19 nt, Homo sapiens
cuuaugaugacccuacuua

SEQ ID NO: 1530470 - RNA, 19 nt, Homo sapiens
ugaauccacuuugguuuua

SEQ ID NO: 1530471 - RNA, 19 nt, Homo sapiens
gacauauccuuugcacugu

SEQ ID NO: 1530472 - RNA, 19 nt, Homo sapiens
cuaccaagguuuugcuuuu

SEQ ID NO: 1530473 - RNA, 19 nt, Homo sapiens
ccacaagauggguguuauu

SEQ ID NO: 1530474 - RNA, 19 nt, Homo sapiens
aaggacagcagaaagauga

SEQ ID NO: 1530475 - RNA, 19 nt, Homo sapiens
gcaggagccagagaaguga

SEQ ID NO: 1530476 - RNA, 19 nt, Homo sapiens
ccucccguguguuauuuaa

SEQ ID NO: 1530477 - RNA, 19 nt, Homo sapiens
caagaucagaggaaaauuu

SEQ ID NO: 1530478 - RNA, 19 nt, Homo sapiens
ugccucagccucccuagua

SEQ ID NO: 1530479 - RNA, 19 nt, Homo sapiens
ccaugaauccacuuugguu

SEQ ID NO: 1530480 - RNA, 19 nt, Homo sapiens
ggcgagugguggucauaug

SEQ ID NO: 1530481 - RNA, 19 nt, Homo sapiens
ccaaagaccaaauguuagg

SEQ ID NO: 1530482 - RNA, 19 nt, Homo sapiens
ugugacguguuuagaaaug

SEQ ID NO: 1530483 - RNA, 19 nt, Homo sapiens
ggaacagauguguguguga

SEQ ID NO: 1530484 - RNA, 19 nt, Homo sapiens
ccagaaauucccuuaugau

SEQ ID NO: 1530485 - RNA, 19 nt, Homo sapiens
ugaaggucuuagaaucauu

SEQ ID NO: 1530486 - RNA, 19 nt, Homo sapiens
uuacgaggcgucauacaga

SEQ ID NO: 1530487 - RNA, 19 nt, Homo sapiens
agucugugguggccaguuu

SEQ ID NO: 1530488 - RNA, 19 nt, Homo sapiens
ccaugaagacuuagacaag

SEQ ID NO: 1530489 - RNA, 19 nt, Homo sapiens
gcagucaggacauauucga

SEQ ID NO: 1530490 - RNA, 19 nt, Homo sapiens
cuccugaauucaagugauu

SEQ ID NO: 1530491 - RNA, 19 nt, Homo sapiens
caugaauccacuuugguuu

SEQ ID NO: 1530492 - RNA, 19 nt, Homo sapiens
gagcuuugcagcauuaaaa

SEQ ID NO: 1530493 - RNA, 19 nt, Homo sapiens
gaggaacagaugugugugu

SEQ ID NO: 1530494 - RNA, 19 nt, Homo sapiens
ugcagaagguuccggacuu

SEQ ID NO: 1530495 - RNA, 19 nt, Homo sapiens
ucgggaaggcuaugaagaa

SEQ ID NO: 1530496 - RNA, 19 nt, Homo sapiens
cgaucucggcucacuguaa

SEQ ID NO: 1530497 - RNA, 19 nt, Homo sapiens
cgaugagcuuugcagcauu

SEQ ID NO: 1530498 - RNA, 19 nt, Homo sapiens
gcugugcaccgcucguuug

SEQ ID NO: 1530499 - RNA, 19 nt, Homo sapiens
ccaccacgcccaaguaacu

SEQ ID NO: 1530500 - RNA, 19 nt, Homo sapiens
aaagcaguccaggagauua

SEQ ID NO: 1530501 - RNA, 19 nt, Homo sapiens
guccuuacgaggcgucaua

SEQ ID NO: 1530502 - RNA, 19 nt, Homo sapiens
uauauuugcagaagcuuug

SEQ ID NO: 1530503 - RNA, 19 nt, Homo sapiens
ggagagguguguuguaaga

SEQ ID NO: 1530504 - RNA, 19 nt, Homo sapiens
gggaaggccucuauucuug

SEQ ID NO: 1530505 - RNA, 19 nt, Homo sapiens
gaaggccucuauucuugua

SEQ ID NO: 1530506 - RNA, 19 nt, Homo sapiens
gaggaaaccuggacagaca

SEQ ID NO: 1530507 - RNA, 19 nt, Homo sapiens
ggagaggccucaggagaaa

SEQ ID NO: 1530508 - RNA, 19 nt, Homo sapiens
ccacacaccuugcuuucuu

SEQ ID NO: 1530509 - RNA, 19 nt, Homo sapiens
ccagaauggugagaaauaa

SEQ ID NO: 1530510 - RNA, 19 nt, Homo sapiens
ggagugagagugucuuaaa

SEQ ID NO: 1530511 - RNA, 19 nt, Homo sapiens
guagaaccuucauaaauag

SEQ ID NO: 1530512 - RNA, 19 nt, Homo sapiens
guaagcaagucauaagugu

SEQ ID NO: 1530513 - RNA, 19 nt, Homo sapiens
ccacugggaugcucugcua

SEQ ID NO: 1530514 - RNA, 19 nt, Homo sapiens
gcaaaugaaguuuaggaaa

SEQ ID NO: 1530515 - RNA, 19 nt, Homo sapiens
ggaaacagaggcucgaaga

SEQ ID NO: 1530516 - RNA, 19 nt, Homo sapiens
gaacacagcccgaccucau

SEQ ID NO: 1530517 - RNA, 19 nt, Homo sapiens
ccacaacggugagagaaug

SEQ ID NO: 1530518 - RNA, 19 nt, Homo sapiens
aaggagagguguguuguaa

SEQ ID NO: 1530519 - RNA, 19 nt, Homo sapiens
gaaggagagguguguugua

SEQ ID NO: 1530520 - RNA, 19 nt, Homo sapiens
gaagaaaccgagugaggau

SEQ ID NO: 1530521 - RNA, 19 nt, Homo sapiens
aacagaggcucgaagauga

SEQ ID NO: 1530522 - RNA, 19 nt, Homo sapiens
gcucugcuauuugcacauu

SEQ ID NO: 1530523 - RNA, 19 nt, Homo sapiens
ggagguaagcaagucauaa

SEQ ID NO: 1530524 - RNA, 19 nt, Homo sapiens
gaaccuucauaaauaggau

SEQ ID NO: 1530525 - RNA, 19 nt, Homo sapiens
ccucuauucuuguaaugaa

SEQ ID NO: 1530526 - RNA, 19 nt, Homo sapiens
gguaaaagcagccguauug

SEQ ID NO: 1530527 - RNA, 19 nt, Homo sapiens
gagaaaagcaaaugaaguu

SEQ ID NO: 1530528 - RNA, 19 nt, Homo sapiens
ggagguggguagugagaag

SEQ ID NO: 1530529 - RNA, 19 nt, Homo sapiens
guguagaaccuucauaaau

SEQ ID NO: 1530530 - RNA, 19 nt, Homo sapiens
aaacagaggcucgaagaug

SEQ ID NO: 1530531 - RNA, 19 nt, Homo sapiens
gagguguguuguaagaaga

SEQ ID NO: 1530532 - RNA, 19 nt, Homo sapiens
gggaugcucugcuauuugc

SEQ ID NO: 1530533 - RNA, 19 nt, Homo sapiens
cuaguaaacuggagcugau

SEQ ID NO: 1530534 - RNA, 19 nt, Homo sapiens
gagugagagugucuuaaag

SEQ ID NO: 1530535 - RNA, 19 nt, Homo sapiens
caacggugagagaauguuu

SEQ ID NO: 1530536 - RNA, 19 nt, Homo sapiens
gaaacagaggcucgaagau

SEQ ID NO: 1530537 - RNA, 19 nt, Homo sapiens
gaaaggagagaaaagcaaa

SEQ ID NO: 1530538 - RNA, 19 nt, Homo sapiens
gaucuaagcaccagaaccu

SEQ ID NO: 1530539 - RNA, 19 nt, Homo sapiens
gcaagucauaaguguagaa

SEQ ID NO: 1530540 - RNA, 19 nt, Homo sapiens
gguaagcaagucauaagug

SEQ ID NO: 1530541 - RNA, 19 nt, Homo sapiens
gagguaagcaagucauaag

SEQ ID NO: 1530542 - RNA, 19 nt, Homo sapiens
acaccuugcuuucuuccuu

SEQ ID NO: 1530543 - RNA, 19 nt, Homo sapiens
uguaaugaaccaaacguuu

SEQ ID NO: 1530544 - RNA, 19 nt, Homo sapiens
ccuccagaauggugagaaa

SEQ ID NO: 1530545 - RNA, 19 nt, Homo sapiens
uaaacuggagcugaucuaa

SEQ ID NO: 1530546 - RNA, 19 nt, Homo sapiens
gcaaaagaaaggagagaaa

SEQ ID NO: 1530547 - RNA, 19 nt, Homo sapiens
ccacgggaguagucaacug

SEQ ID NO: 1530548 - RNA, 19 nt, Homo sapiens
uccagaauggugagaaaua

SEQ ID NO: 1530549 - RNA, 19 nt, Homo sapiens
uaagcaagucauaagugua

SEQ ID NO: 1530550 - RNA, 19 nt, Homo sapiens
ggaaggccucuauucuugu

SEQ ID NO: 1530551 - RNA, 19 nt, Homo sapiens
guaaacuggagcugaucua

SEQ ID NO: 1530552 - RNA, 19 nt, Homo sapiens
gcaggacacagucuagagu

SEQ ID NO: 1530553 - RNA, 19 nt, Homo sapiens
ggacagacaggaagaaacc

SEQ ID NO: 1530554 - RNA, 19 nt, Homo sapiens
cagaauggugagaaauaaa

SEQ ID NO: 1530555 - RNA, 19 nt, Homo sapiens
gcagugagccaugauugca

SEQ ID NO: 1530556 - RNA, 19 nt, Homo sapiens
gcuuaaugaccucagauga

SEQ ID NO: 1530557 - RNA, 19 nt, Homo sapiens
ugagggagaugagaguauc

SEQ ID NO: 1530558 - RNA, 19 nt, Homo sapiens
cugggaugcucugcuauuu

SEQ ID NO: 1530559 - RNA, 19 nt, Homo sapiens
gggagguaagcaagucaua

SEQ ID NO: 1530560 - RNA, 19 nt, Homo sapiens
agaaaccgagugaggauga

SEQ ID NO: 1530561 - RNA, 19 nt, Homo sapiens
guacccugguuucagacuu

SEQ ID NO: 1530562 - RNA, 19 nt, Homo sapiens
gaaauuggagguggguagu

SEQ ID NO: 1530563 - RNA, 19 nt, Homo sapiens
aaguguagaaccuucauaa

SEQ ID NO: 1530564 - RNA, 19 nt, Homo sapiens
ggagagaaaagcaaaugaa

SEQ ID NO: 1530565 - RNA, 19 nt, Homo sapiens
ggaaaaccagcuucuguug

SEQ ID NO: 1530566 - RNA, 19 nt, Homo sapiens
cugguacccugguuucaga

SEQ ID NO: 1530567 - RNA, 19 nt, Homo sapiens
aauuggagguggguaguga

SEQ ID NO: 1530568 - RNA, 19 nt, Homo sapiens
agagguguguuguaagaag

SEQ ID NO: 1530569 - RNA, 19 nt, Homo sapiens
aagcaagucauaaguguag

SEQ ID NO: 1530570 - RNA, 19 nt, Homo sapiens
caaaagaaaggagagaaaa

SEQ ID NO: 1530571 - RNA, 19 nt, Homo sapiens
uggaagacacggauucugu

SEQ ID NO: 1530572 - RNA, 19 nt, Homo sapiens
gaaaacggagugagagugu

SEQ ID NO: 1530573 - RNA, 19 nt, Homo sapiens
caccagaaccugagcugau

SEQ ID NO: 1530574 - RNA, 19 nt, Homo sapiens
gcugaucuaagcaccagaa

SEQ ID NO: 1530575 - RNA, 19 nt, Homo sapiens
gugaaggagagguguguug

SEQ ID NO: 1530576 - RNA, 19 nt, Homo sapiens
uaaguguagaaccuucaua

SEQ ID NO: 1530577 - RNA, 19 nt, Homo sapiens
cccugacagugcuuaauga

SEQ ID NO: 1530578 - RNA, 19 nt, Homo sapiens
gcagcaggacacagucuag

SEQ ID NO: 1530579 - RNA, 19 nt, Homo sapiens
acaggaagaaaccgaguga

SEQ ID NO: 1530580 - RNA, 19 nt, Homo sapiens
agucauaaguguagaaccu

SEQ ID NO: 1530581 - RNA, 19 nt, Homo sapiens
aagcaaaugaaguuuagga

SEQ ID NO: 1530582 - RNA, 19 nt, Homo sapiens
gaccccaucuauacagaaa

SEQ ID NO: 1530583 - RNA, 19 nt, Homo sapiens
ggccucuauucuuguaaug

SEQ ID NO: 1530584 - RNA, 19 nt, Homo sapiens
caccugcucccaugcaaau

SEQ ID NO: 1530585 - RNA, 19 nt, Homo sapiens
aggagaggccucaggagaa

SEQ ID NO: 1530586 - RNA, 19 nt, Homo sapiens
cuugugacuuggaggauuc

SEQ ID NO: 1530587 - RNA, 19 nt, Homo sapiens
gcaaguagcucuagccuuu

SEQ ID NO: 1530588 - RNA, 19 nt, Homo sapiens
ccaagaagauggccuauga

SEQ ID NO: 1530589 - RNA, 19 nt, Homo sapiens
ccaaguagcugggacuaua

SEQ ID NO: 1530590 - RNA, 19 nt, Homo sapiens
cagcaugguuugacaauaa

SEQ ID NO: 1530591 - RNA, 19 nt, Homo sapiens
caccaugacuggcuaauuu

SEQ ID NO: 1530592 - RNA, 19 nt, Homo sapiens
ggaucgaccuguccuuuaa

SEQ ID NO: 1530593 - RNA, 19 nt, Homo sapiens
gaacaaacgggacuauaug

SEQ ID NO: 1530594 - RNA, 19 nt, Homo sapiens
caaaguaauuccauucugu

SEQ ID NO: 1530595 - RNA, 19 nt, Homo sapiens
gaaaggguauaggcaauau

SEQ ID NO: 1530596 - RNA, 19 nt, Homo sapiens
gaucucggcucacugcaaa

SEQ ID NO: 1530597 - RNA, 19 nt, Homo sapiens
gugcuaggauuacaggaua

SEQ ID NO: 1530598 - RNA, 19 nt, Homo sapiens
ggaaacgcaugaacaucaa

SEQ ID NO: 1530599 - RNA, 19 nt, Homo sapiens
uucaagaucugguaaauga

SEQ ID NO: 1530600 - RNA, 19 nt, Homo sapiens
gagaaaggguauaggcaau

SEQ ID NO: 1530601 - RNA, 19 nt, Homo sapiens
ccaaagugcugggauuaga

SEQ ID NO: 1530602 - RNA, 19 nt, Homo sapiens
ggccagcucuagucuuauu

SEQ ID NO: 1530603 - RNA, 19 nt, Homo sapiens
uaccacgccuggcuaauuu

SEQ ID NO: 1530604 - RNA, 19 nt, Homo sapiens
caaccugaguguccucuau

SEQ ID NO: 1530605 - RNA, 19 nt, Homo sapiens
ggauucugcuuaagauuuc

SEQ ID NO: 1530606 - RNA, 19 nt, Homo sapiens
gggacuauaugaacacuuc

SEQ ID NO: 1530607 - RNA, 19 nt, Homo sapiens
ccacuucaaucagaucaaa

SEQ ID NO: 1530608 - RNA, 19 nt, Homo sapiens
ucaaugaucugagagacuu

SEQ ID NO: 1530609 - RNA, 19 nt, Homo sapiens
gggauucugcuuaagauuu

SEQ ID NO: 1530610 - RNA, 19 nt, Homo sapiens
gaucaguaauuuccaaacu

SEQ ID NO: 1530611 - RNA, 19 nt, Homo sapiens
guagaucaguaauuuccaa

SEQ ID NO: 1530612 - RNA, 19 nt, Homo sapiens
cccaguagcugugauuaaa

SEQ ID NO: 1530613 - RNA, 19 nt, Homo sapiens
ggguuaaaguagaucagua

SEQ ID NO: 1530614 - RNA, 19 nt, Homo sapiens
gauggccuaugaucucuga

SEQ ID NO: 1530615 - RNA, 19 nt, Homo sapiens
gggaggcaauugagggaaa

SEQ ID NO: 1530616 - RNA, 19 nt, Homo sapiens
cagagaaccuggccuggau

SEQ ID NO: 1530617 - RNA, 19 nt, Homo sapiens
gaucaaaguaauuccauuc

SEQ ID NO: 1530618 - RNA, 19 nt, Homo sapiens
acacagccuugggaaauuu

SEQ ID NO: 1530619 - RNA, 19 nt, Homo sapiens
cuggccagcucuagucuua

SEQ ID NO: 1530620 - RNA, 19 nt, Homo sapiens
gaacaucaagcccaagaag

SEQ ID NO: 1530621 - RNA, 19 nt, Homo sapiens
aaacgggacuauaugaaca

SEQ ID NO: 1530622 - RNA, 19 nt, Homo sapiens
ggccugaacuaugaacaaa

SEQ ID NO: 1530623 - RNA, 19 nt, Homo sapiens
gacaagguuucgccauguu

SEQ ID NO: 1530624 - RNA, 19 nt, Homo sapiens
caagcagaauacacuuuga

SEQ ID NO: 1530625 - RNA, 19 nt, Homo sapiens
gguuaaaguagaucaguaa

SEQ ID NO: 1530626 - RNA, 19 nt, Homo sapiens
uuaaugaccugacuuccau

SEQ ID NO: 1530627 - RNA, 19 nt, Homo sapiens
ugaacaaacgggacuauau

SEQ ID NO: 1530628 - RNA, 19 nt, Homo sapiens
ccuaacaacuuucuucaac

SEQ ID NO: 1530629 - RNA, 19 nt, Homo sapiens
gggaguauuuccauuuuaa

SEQ ID NO: 1530630 - RNA, 19 nt, Homo sapiens
gcaccugcuugcaccuuug

SEQ ID NO: 1530631 - RNA, 19 nt, Homo sapiens
ugaaugauggccugaacua

SEQ ID NO: 1530632 - RNA, 19 nt, Homo sapiens
ccacacagccuugggaaau

SEQ ID NO: 1530633 - RNA, 19 nt, Homo sapiens
caggugauccgucugcuuu

SEQ ID NO: 1530634 - RNA, 19 nt, Homo sapiens
uaccacauccagcuaauuu

SEQ ID NO: 1530635 - RNA, 19 nt, Homo sapiens
gcauagacagcaugguuug

SEQ ID NO: 1530636 - RNA, 19 nt, Homo sapiens
ccuaaaggccuaagcauag

SEQ ID NO: 1530637 - RNA, 19 nt, Homo sapiens
ggaccaagcagaauacacu

SEQ ID NO: 1530638 - RNA, 19 nt, Homo sapiens
gcauccacgucauucaaga

SEQ ID NO: 1530639 - RNA, 19 nt, Homo sapiens
guaccagggucuguagaga

SEQ ID NO: 1530640 - RNA, 19 nt, Homo sapiens
cuaaaggccuaagcauaga

SEQ ID NO: 1530641 - RNA, 19 nt, Homo sapiens
gaacccacaggaaugaaug

SEQ ID NO: 1530642 - RNA, 19 nt, Homo sapiens
ccaaagugcuaggauuaca

SEQ ID NO: 1530643 - RNA, 19 nt, Homo sapiens
ggaggaagagaaaggguau

SEQ ID NO: 1530644 - RNA, 19 nt, Homo sapiens
augauggccugaacuauga

SEQ ID NO: 1530645 - RNA, 19 nt, Homo sapiens
ucaaaguaauuccauucug

SEQ ID NO: 1530646 - RNA, 19 nt, Homo sapiens
ccaagcagaauacacuuug

SEQ ID NO: 1530647 - RNA, 19 nt, Homo sapiens
ucaguaauuuccaaacucu

SEQ ID NO: 1530648 - RNA, 19 nt, Homo sapiens
ucccaaagugcuaggauua

SEQ ID NO: 1530649 - RNA, 19 nt, Homo sapiens
aaacuccgccuuccagguu

SEQ ID NO: 1530650 - RNA, 19 nt, Homo sapiens
uaacaacuuucuucaaccu

SEQ ID NO: 1530651 - RNA, 19 nt, Homo sapiens
acaauguucucaaugaucu

SEQ ID NO: 1530652 - RNA, 19 nt, Homo sapiens
uuuccaaacucuucacaga

SEQ ID NO: 1530653 - RNA, 19 nt, Homo sapiens
caaagugcugggauuagaa

SEQ ID NO: 1530654 - RNA, 19 nt, Homo sapiens
cauugacccuguccuaaca

SEQ ID NO: 1530655 - RNA, 19 nt, Homo sapiens
ucaaccagguggcuucaca

SEQ ID NO: 1530656 - RNA, 19 nt, Homo sapiens
gcucuagccuuuucuuuuc

SEQ ID NO: 1530657 - RNA, 19 nt, Homo sapiens
cacacagccuugggaaauu

SEQ ID NO: 1530658 - RNA, 19 nt, Homo sapiens
uaaaggcgccugccaccau

SEQ ID NO: 1530659 - RNA, 19 nt, Homo sapiens
ugaguguccucuaucuuca

SEQ ID NO: 1530660 - RNA, 19 nt, Homo sapiens
gcugggauucugcuuaaga

SEQ ID NO: 1530661 - RNA, 19 nt, Homo sapiens
agacaagguuucgccaugu

SEQ ID NO: 1530662 - RNA, 19 nt, Homo sapiens
cugaguagcugggauuaca

SEQ ID NO: 1530663 - RNA, 19 nt, Homo sapiens
aagcauagacagcaugguu

SEQ ID NO: 1530664 - RNA, 19 nt, Homo sapiens
cauucaagaucugguaaau

SEQ ID NO: 1530665 - RNA, 19 nt, Homo sapiens
augcugggauucugcuuaa

SEQ ID NO: 1530666 - RNA, 19 nt, Homo sapiens
ccuaugaucucugaaacca

SEQ ID NO: 1530667 - RNA, 19 nt, Homo sapiens
ugccucagccucccaagua

SEQ ID NO: 1530668 - RNA, 19 nt, Homo sapiens
uggaaacgcaugaacauca

SEQ ID NO: 1530669 - RNA, 19 nt, Homo sapiens
aggaaugaaugccuaaugg

SEQ ID NO: 1530670 - RNA, 19 nt, Homo sapiens
ccacgucauucaagaucug

SEQ ID NO: 1530671 - RNA, 19 nt, Homo sapiens
caugacaggccaagaagau

SEQ ID NO: 1530672 - RNA, 19 nt, Homo sapiens
ggcaccugcuugcaccuuu

SEQ ID NO: 1530673 - RNA, 19 nt, Homo sapiens
gcuaccacauccagcuaau

SEQ ID NO: 1530674 - RNA, 19 nt, Homo sapiens
gagcagaugagaagucacu

SEQ ID NO: 1530675 - RNA, 19 nt, Homo sapiens
cagaagcauccacgucauu

SEQ ID NO: 1530676 - RNA, 19 nt, Homo sapiens
agaaaggguauaggcaaua

SEQ ID NO: 1530677 - RNA, 19 nt, Homo sapiens
gacccuguccuaacaacuu

SEQ ID NO: 1530678 - RNA, 19 nt, Homo sapiens
gaguuucagccaucaguga

SEQ ID NO: 1530679 - RNA, 19 nt, Homo sapiens
guaaaugaggagccaagga

SEQ ID NO: 1530680 - RNA, 19 nt, Homo sapiens
ggaaugaaugccuaauggu

SEQ ID NO: 1530681 - RNA, 19 nt, Homo sapiens
cuaccacgccuggcuaauu

SEQ ID NO: 1530682 - RNA, 19 nt, Homo sapiens
acagcaugguuugacaaua

SEQ ID NO: 1530683 - RNA, 19 nt, Homo sapiens
ggggaguauuuccauuuua

SEQ ID NO: 1530684 - RNA, 19 nt, Homo sapiens
gaaugauggccugaacuau

SEQ ID NO: 1530685 - RNA, 19 nt, Homo sapiens
ccucuugacuacuccuuca

SEQ ID NO: 1530686 - RNA, 19 nt, Homo sapiens
caaacgggacuauaugaac

SEQ ID NO: 1530687 - RNA, 19 nt, Homo sapiens
acaagaggcuggccaagga

SEQ ID NO: 1530688 - RNA, 19 nt, Homo sapiens
caacucacauugcacucaa

SEQ ID NO: 1530689 - RNA, 19 nt, Homo sapiens
gaugucaccucuggaaugu

SEQ ID NO: 1530690 - RNA, 19 nt, Homo sapiens
agcagaagcuggucauuga

SEQ ID NO: 1530691 - RNA, 19 nt, Homo sapiens
gcucagagagaaaccauga

SEQ ID NO: 1530692 - RNA, 19 nt, Homo sapiens
gaagauggucagcaacaug

SEQ ID NO: 1530693 - RNA, 19 nt, Homo sapiens
gcacucaaggccaaauuau

SEQ ID NO: 1530694 - RNA, 19 nt, Homo sapiens
gaucugaaagccuagaaau

SEQ ID NO: 1530695 - RNA, 19 nt, Homo sapiens
ggaagauggucagcaacau

SEQ ID NO: 1530696 - RNA, 19 nt, Homo sapiens
gcacuccuauccacugaac

SEQ ID NO: 1530697 - RNA, 19 nt, Homo sapiens
ucugaaagccuagaaauuc

SEQ ID NO: 1530698 - RNA, 19 nt, Homo sapiens
ggccaaauuauacaagaaa

SEQ ID NO: 1530699 - RNA, 19 nt, Homo sapiens
gugaccaacuucugcauag

SEQ ID NO: 1530700 - RNA, 19 nt, Homo sapiens
ugucaccucuggaauguuc

SEQ ID NO: 1530701 - RNA, 19 nt, Homo sapiens
cagcacuccuauccacuga

SEQ ID NO: 1530702 - RNA, 19 nt, Homo sapiens
ggaauguucugaguguuuu

SEQ ID NO: 1530703 - RNA, 19 nt, Homo sapiens
ccugucagaugccucauuc

SEQ ID NO: 1530704 - RNA, 19 nt, Homo sapiens
acaaggcccugugggagaa

SEQ ID NO: 1530705 - RNA, 19 nt, Homo sapiens
cgccacugcugcacaaaga

SEQ ID NO: 1530706 - RNA, 19 nt, Homo sapiens
ccuagaaauuccaaucagu

SEQ ID NO: 1530707 - RNA, 19 nt, Homo sapiens
ggugaccaacuucugcaua

SEQ ID NO: 1530708 - RNA, 19 nt, Homo sapiens
gaggagcucuacgccuuca

SEQ ID NO: 1530709 - RNA, 19 nt, Homo sapiens
ucccgaggcuccacaacuu

SEQ ID NO: 1530710 - RNA, 19 nt, Homo sapiens
ucuggaauguucugagugu

SEQ ID NO: 1530711 - RNA, 19 nt, Homo sapiens
ccagccaguucguaccuau

SEQ ID NO: 1530712 - RNA, 19 nt, Homo sapiens
gaaagccuagaaauuccaa

SEQ ID NO: 1530713 - RNA, 19 nt, Homo sapiens
gaccaacuucugcauagga

SEQ ID NO: 1530714 - RNA, 19 nt, Homo sapiens
caccugugaugcucagaga

SEQ ID NO: 1530715 - RNA, 19 nt, Homo sapiens
gcucagcgacgagauguuc

SEQ ID NO: 1530716 - RNA, 19 nt, Homo sapiens
cccuggagguggugaagaa

SEQ ID NO: 1530717 - RNA, 19 nt, Homo sapiens
cacucaaggccaaauuaua

SEQ ID NO: 1530718 - RNA, 19 nt, Homo sapiens
uggaauguucugaguguuu

SEQ ID NO: 1530719 - RNA, 19 nt, Homo sapiens
gggagaacaacaagcugaa

SEQ ID NO: 1530720 - RNA, 19 nt, Homo sapiens
gccaguucguaccuauuga

SEQ ID NO: 1530721 - RNA, 19 nt, Homo sapiens
ggagcucuacgccuucaug

SEQ ID NO: 1530722 - RNA, 19 nt, Homo sapiens
ccucuggaauguucugagu

SEQ ID NO: 1530723 - RNA, 19 nt, Homo sapiens
cagccuuccuaaacucaga

SEQ ID NO: 1530724 - RNA, 19 nt, Homo sapiens
uggagguggugaagaagga

SEQ ID NO: 1530725 - RNA, 19 nt, Homo sapiens
accacaagcugcaccacaa

SEQ ID NO: 1530726 - RNA, 19 nt, Homo sapiens
acucaaggccaaauuauac

SEQ ID NO: 1530727 - RNA, 19 nt, Homo sapiens
guucguaccuauugaaaag

SEQ ID NO: 1530728 - RNA, 19 nt, Homo sapiens
gcagcucagcgacgagaug

SEQ ID NO: 1530729 - RNA, 19 nt, Homo sapiens
aaggccaaauuauacaaga

SEQ ID NO: 1530730 - RNA, 19 nt, Homo sapiens
accuauaccuggcaacuca

SEQ ID NO: 1530731 - RNA, 19 nt, Homo sapiens
uagcagccuuccuaaacuc

SEQ ID NO: 1530732 - RNA, 19 nt, Homo sapiens
ccucgccacugcugcacaa

SEQ ID NO: 1530733 - RNA, 19 nt, Homo sapiens
accuggagcuggacuacaa

SEQ ID NO: 1530734 - RNA, 19 nt, Homo sapiens
ccaguucguaccuauugaa

SEQ ID NO: 1530735 - RNA, 19 nt, Homo sapiens
ugcggaagauggucagcaa

SEQ ID NO: 1530736 - RNA, 19 nt, Homo sapiens
ugaugucaccucuggaaug

SEQ ID NO: 1530737 - RNA, 19 nt, Homo sapiens
uagaaauuccaaucagugu

SEQ ID NO: 1530738 - RNA, 19 nt, Homo sapiens
ggcgcuggguaaaugagaa

SEQ ID NO: 1530739 - RNA, 19 nt, Homo sapiens
gccuagaaauuccaaucag

SEQ ID NO: 1530740 - RNA, 19 nt, Homo sapiens
aggccaaauuauacaagaa

SEQ ID NO: 1530741 - RNA, 19 nt, Homo sapiens
ucagcaaggagaacaagau

SEQ ID NO: 1530742 - RNA, 19 nt, Homo sapiens
uccaaucagugugguucua

SEQ ID NO: 1530743 - RNA, 19 nt, Homo sapiens
gcaggaggagaacaagucu

SEQ ID NO: 1530744 - RNA, 19 nt, Homo sapiens
ucaaggccaaauuauacaa

SEQ ID NO: 1530745 - RNA, 19 nt, Homo sapiens
cauguugccuguuccuuua

SEQ ID NO: 1530746 - RNA, 19 nt, Homo sapiens
caggugagcuuuccguuga

SEQ ID NO: 1530747 - RNA, 19 nt, Homo sapiens
ggaacaagauccuccuaca

SEQ ID NO: 1530748 - RNA, 19 nt, Homo sapiens
cacaaagggugcauaagaa

SEQ ID NO: 1530749 - RNA, 19 nt, Homo sapiens
ccacugagcacaccacauu

SEQ ID NO: 1530750 - RNA, 19 nt, Homo sapiens
ccacagcucccaugcgaua

SEQ ID NO: 1530751 - RNA, 19 nt, Homo sapiens
ggaggaauucuacaucuga

SEQ ID NO: 1530752 - RNA, 19 nt, Homo sapiens
gcagacugauggagacaug

SEQ ID NO: 1530753 - RNA, 19 nt, Homo sapiens
gcacaccacauucuucaug

SEQ ID NO: 1530754 - RNA, 19 nt, Homo sapiens
ugaaugcccucugcucuug

SEQ ID NO: 1530755 - RNA, 19 nt, Homo sapiens
gaggaauucuacaucugaa

SEQ ID NO: 1530756 - RNA, 19 nt, Homo sapiens
gggcuucccucccuuucuu

SEQ ID NO: 1530757 - RNA, 19 nt, Homo sapiens
caucaugccuccgagaaga

SEQ ID NO: 1530758 - RNA, 19 nt, Homo sapiens
guacacacggugacaaaga

SEQ ID NO: 1530759 - RNA, 19 nt, Homo sapiens
ugaaaagacugcccuguga

SEQ ID NO: 1530760 - RNA, 19 nt, Homo sapiens
gagcacaccacauucuuca

SEQ ID NO: 1530761 - RNA, 19 nt, Homo sapiens
auaacgacauggaggaauu

SEQ ID NO: 1530762 - RNA, 19 nt, Homo sapiens
gugcuggaguuccgaguga

SEQ ID NO: 1530763 - RNA, 19 nt, Homo sapiens
uccuaaaccuggcagagua

SEQ ID NO: 1530764 - RNA, 19 nt, Homo sapiens
gcauaagaaguuuccuaaa

SEQ ID NO: 1530765 - RNA, 19 nt, Homo sapiens
gaacaagauccuccuacag

SEQ ID NO: 1530766 - RNA, 19 nt, Homo sapiens
gagaagaaacgucauucca

SEQ ID NO: 1530767 - RNA, 19 nt, Homo sapiens
gaugccauguugccuguuc

SEQ ID NO: 1530768 - RNA, 19 nt, Homo sapiens
cgaaacacacaaacucaga

SEQ ID NO: 1530769 - RNA, 19 nt, Homo sapiens
ugucuguggucucugcaua

SEQ ID NO: 1530770 - RNA, 19 nt, Homo sapiens
gggcagcucacaaggauuc

SEQ ID NO: 1530771 - RNA, 19 nt, Homo sapiens
aaacgucauuccacuccuu

SEQ ID NO: 1530772 - RNA, 19 nt, Homo sapiens
uacacacggugacaaagaa

SEQ ID NO: 1530773 - RNA, 19 nt, Homo sapiens
cacaccacauucuucauga

SEQ ID NO: 1530774 - RNA, 19 nt, Homo sapiens
cgacauggaggaauucuac

SEQ ID NO: 1530775 - RNA, 19 nt, Homo sapiens
gcgcuucaccgucuacugu

SEQ ID NO: 1530776 - RNA, 19 nt, Homo sapiens
ucagcagggugaccacaga

SEQ ID NO: 1530777 - RNA, 19 nt, Homo sapiens
aaagggugcauaagaaguu

SEQ ID NO: 1530778 - RNA, 19 nt, Homo sapiens
gcaccuccacccucacaga

SEQ ID NO: 1530779 - RNA, 19 nt, Homo sapiens
ccauguugccuguuccuuu

SEQ ID NO: 1530780 - RNA, 19 nt, Homo sapiens
ggagacagacguggacaca

SEQ ID NO: 1530781 - RNA, 19 nt, Homo sapiens
gcacuacggcaaggaaauc

SEQ ID NO: 1530782 - RNA, 19 nt, Homo sapiens
ggaccacugcccacuguca

SEQ ID NO: 1530783 - RNA, 19 nt, Homo sapiens
gugcauaagaaguuuccua

SEQ ID NO: 1530784 - RNA, 19 nt, Homo sapiens
aaagcggacuucugcaucu

SEQ ID NO: 1530785 - RNA, 19 nt, Homo sapiens
ggucagcauccacauaauc

SEQ ID NO: 1530786 - RNA, 19 nt, Homo sapiens
ccacugggcagcucacaag

SEQ ID NO: 1530787 - RNA, 19 nt, Homo sapiens
ugcauaagaaguuuccuaa

SEQ ID NO: 1530788 - RNA, 19 nt, Homo sapiens
cauucuucaugauccauuu

SEQ ID NO: 1530789 - RNA, 19 nt, Homo sapiens
aaacacacaaacucagaga

SEQ ID NO: 1530790 - RNA, 19 nt, Homo sapiens
ggauaacgacauggaggaa

SEQ ID NO: 1530791 - RNA, 19 nt, Homo sapiens
ucuguggucucugcauauu

SEQ ID NO: 1530792 - RNA, 19 nt, Homo sapiens
caaagggugcauaagaagu

SEQ ID NO: 1530793 - RNA, 19 nt, Homo sapiens
uucugcaucuucccuauuu

SEQ ID NO: 1530794 - RNA, 19 nt, Homo sapiens
gcaggaggccaucgacaac

SEQ ID NO: 1530795 - RNA, 19 nt, Homo sapiens
acacacaaacucagagaca

SEQ ID NO: 1530796 - RNA, 19 nt, Homo sapiens
aagaggcgcaggacccuuu

SEQ ID NO: 1530797 - RNA, 19 nt, Homo sapiens
gcagacggaggaccaugau

SEQ ID NO: 1530798 - RNA, 19 nt, Homo sapiens
cuggucagcauccacauaa

SEQ ID NO: 1530799 - RNA, 19 nt, Homo sapiens
ggaggaguacggcgaagag

SEQ ID NO: 1530800 - RNA, 19 nt, Homo sapiens
ccacauucuucaugaucca

SEQ ID NO: 1530801 - RNA, 19 nt, Homo sapiens
gcauauucugcacccagua

SEQ ID NO: 1530802 - RNA, 19 nt, Homo sapiens
uguggucucugcauauucu

SEQ ID NO: 1530803 - RNA, 19 nt, Homo sapiens
gggcacagggcaucagagu

SEQ ID NO: 1530804 - RNA, 19 nt, Homo sapiens
ugccuaccacccacucuua

SEQ ID NO: 1530805 - RNA, 19 nt, Homo sapiens
cugggcagcucacaaggau

SEQ ID NO: 1530806 - RNA, 19 nt, Homo sapiens
ggcagacggaggaccauga

SEQ ID NO: 1530807 - RNA, 19 nt, Homo sapiens
acucagagacacagacuca

SEQ ID NO: 1530808 - RNA, 19 nt, Homo sapiens
uggaggaauucuacaucug

SEQ ID NO: 1530809 - RNA, 19 nt, Homo sapiens
gauaacgacauggaggaau

SEQ ID NO: 1530810 - RNA, 19 nt, Homo sapiens
cuccaucgaugaccuagag

SEQ ID NO: 1530811 - RNA, 19 nt, Homo sapiens
ccaacccucccuggucuuu

SEQ ID NO: 1530812 - RNA, 19 nt, Homo sapiens
aagggugcauaagaaguuu

SEQ ID NO: 1530813 - RNA, 19 nt, Homo sapiens
gaaagauggugcuuacuua

SEQ ID NO: 1530814 - RNA, 19 nt, Homo sapiens
gcaagaagcugaaguaugg

SEQ ID NO: 1530815 - RNA, 19 nt, Homo sapiens
gaaagaaaccucaaugauu

SEQ ID NO: 1530816 - RNA, 19 nt, Homo sapiens
gcaagaaaccugauaauau

SEQ ID NO: 1530817 - RNA, 19 nt, Homo sapiens
gcagagagcauuccucaua

SEQ ID NO: 1530818 - RNA, 19 nt, Homo sapiens
gaacaggaccguaagauga

SEQ ID NO: 1530819 - RNA, 19 nt, Homo sapiens
gaaucaagcuguauagguu

SEQ ID NO: 1530820 - RNA, 19 nt, Homo sapiens
ggagaaagaaaccaauuua

SEQ ID NO: 1530821 - RNA, 19 nt, Homo sapiens
caaaugagccugcugauga

SEQ ID NO: 1530822 - RNA, 19 nt, Homo sapiens
ggagauauauacaugagaa

SEQ ID NO: 1530823 - RNA, 19 nt, Homo sapiens
gagcuuagagagcauauua

SEQ ID NO: 1530824 - RNA, 19 nt, Homo sapiens
gaaaguuaaugacugaguu

SEQ ID NO: 1530825 - RNA, 19 nt, Homo sapiens
ucaaaucacuacuaacuga

SEQ ID NO: 1530826 - RNA, 19 nt, Homo sapiens
gaaagaaaaugcucacaaa

SEQ ID NO: 1530827 - RNA, 19 nt, Homo sapiens
gaaaugaacagugaauuga

SEQ ID NO: 1530828 - RNA, 19 nt, Homo sapiens
ggaaagaacaagugaguga

SEQ ID NO: 1530829 - RNA, 19 nt, Homo sapiens
guagacaaaugugaaagua

SEQ ID NO: 1530830 - RNA, 19 nt, Homo sapiens
gauucaugcugcuaaguua

SEQ ID NO: 1530831 - RNA, 19 nt, Homo sapiens
gagcuucuccagauuauuu

SEQ ID NO: 1530832 - RNA, 19 nt, Homo sapiens
ggaaaugauaccaaagaua

SEQ ID NO: 1530833 - RNA, 19 nt, Homo sapiens
gcagaaagcgagccaaaga

SEQ ID NO: 1530834 - RNA, 19 nt, Homo sapiens
ucagaaacuucaacagaaa

SEQ ID NO: 1530835 - RNA, 19 nt, Homo sapiens
gaaacucuacaggaaauua

SEQ ID NO: 1530836 - RNA, 19 nt, Homo sapiens
caagaugcuucgagugaaa

SEQ ID NO: 1530837 - RNA, 19 nt, Homo sapiens
gcacuugauguuccaaaua

SEQ ID NO: 1530838 - RNA, 19 nt, Homo sapiens
aaaugaaacucuacaggaa

SEQ ID NO: 1530839 - RNA, 19 nt, Homo sapiens
gaacuugagagaacuauuc

SEQ ID NO: 1530840 - RNA, 19 nt, Homo sapiens
gcuguuacuucagugauua

SEQ ID NO: 1530841 - RNA, 19 nt, Homo sapiens
aaucagagguccguuguuu

SEQ ID NO: 1530842 - RNA, 19 nt, Homo sapiens
gaugguaacuuggaauuag

SEQ ID NO: 1530843 - RNA, 19 nt, Homo sapiens
caagaacuguauuuacugu

SEQ ID NO: 1530844 - RNA, 19 nt, Homo sapiens
gucaaugccuucagaaaug

SEQ ID NO: 1530845 - RNA, 19 nt, Homo sapiens
acagaaaguuaaugacuga

SEQ ID NO: 1530846 - RNA, 19 nt, Homo sapiens
uaaaguagacgaaaugauc

SEQ ID NO: 1530847 - RNA, 19 nt, Homo sapiens
ugacugaguuauaucaaga

SEQ ID NO: 1530848 - RNA, 19 nt, Homo sapiens
guugaaguaucugcuguua

SEQ ID NO: 1530849 - RNA, 19 nt, Homo sapiens
caaaguacacgcagaacaa

SEQ ID NO: 1530850 - RNA, 19 nt, Homo sapiens
gauggugcuuacuuagaua

SEQ ID NO: 1530851 - RNA, 19 nt, Homo sapiens
ucagggagauauauacaug

SEQ ID NO: 1530852 - RNA, 19 nt, Homo sapiens
aagaagacauaacggauga

SEQ ID NO: 1530853 - RNA, 19 nt, Homo sapiens
acugaacgcuugcuaaaga

SEQ ID NO: 1530854 - RNA, 19 nt, Homo sapiens
uaauaagccuccuuuggau

SEQ ID NO: 1530855 - RNA, 19 nt, Homo sapiens
ggagauaggaauacaagau

SEQ ID NO: 1530856 - RNA, 19 nt, Homo sapiens
ccucaaugauuuaaggaaa

SEQ ID NO: 1530857 - RNA, 19 nt, Homo sapiens
gaagaagaacuugagagaa

SEQ ID NO: 1530858 - RNA, 19 nt, Homo sapiens
cagagagcauuccucauau

SEQ ID NO: 1530859 - RNA, 19 nt, Homo sapiens
aagaagaacuugagagaac

SEQ ID NO: 1530860 - RNA, 19 nt, Homo sapiens
gcuuagagagcauauuaaa

SEQ ID NO: 1530861 - RNA, 19 nt, Homo sapiens
ggucaaugccuucagaaau

SEQ ID NO: 1530862 - RNA, 19 nt, Homo sapiens
uuaauaagccuccuuugga

SEQ ID NO: 1530863 - RNA, 19 nt, Homo sapiens
gaagaacuugagagaacua

SEQ ID NO: 1530864 - RNA, 19 nt, Homo sapiens
ggaacaggaccguaagaug

SEQ ID NO: 1530865 - RNA, 19 nt, Homo sapiens
gagauaggaauacaagaug

SEQ ID NO: 1530866 - RNA, 19 nt, Homo sapiens
agaaacagcuuuugcaaga

SEQ ID NO: 1530867 - RNA, 19 nt, Homo sapiens
aaaugagccugcugaugaa

SEQ ID NO: 1530868 - RNA, 19 nt, Homo sapiens
gaguggcccuggcuuuguu

SEQ ID NO: 1530869 - RNA, 19 nt, Homo sapiens
aaauguggcugauucaucu

SEQ ID NO: 1530870 - RNA, 19 nt, Homo sapiens
ugaagaagaacuugagaga

SEQ ID NO: 1530871 - RNA, 19 nt, Homo sapiens
gaacagugaauugaaagau

SEQ ID NO: 1530872 - RNA, 19 nt, Homo sapiens
gaaagaacaagugagugaa

SEQ ID NO: 1530873 - RNA, 19 nt, Homo sapiens
ugaaagaaaccucaaugau

SEQ ID NO: 1530874 - RNA, 19 nt, Homo sapiens
ugacugaacgcuugcuaaa

SEQ ID NO: 1530875 - RNA, 19 nt, Homo sapiens
caguggaaaugauaccaaa

SEQ ID NO: 1530876 - RNA, 19 nt, Homo sapiens
agaaaaugcucacaaaaga

SEQ ID NO: 1530877 - RNA, 19 nt, Homo sapiens
caacagaaaguuaaugacu

SEQ ID NO: 1530878 - RNA, 19 nt, Homo sapiens
ugaaagauggugcuuacuu

SEQ ID NO: 1530879 - RNA, 19 nt, Homo sapiens
gcugcuaaguuaaaugcuu

SEQ ID NO: 1530880 - RNA, 19 nt, Homo sapiens
agaaaugaacagugaauug

SEQ ID NO: 1530881 - RNA, 19 nt, Homo sapiens
ggaugaugguaacuuggaa

SEQ ID NO: 1530882 - RNA, 19 nt, Homo sapiens
ccacuauuaucuaaacagu

SEQ ID NO: 1530883 - RNA, 19 nt, Homo sapiens
gauagagugaguucccuuu

SEQ ID NO: 1530884 - RNA, 19 nt, Homo sapiens
acuacuaacugaagccaaa

SEQ ID NO: 1530885 - RNA, 19 nt, Homo sapiens
ccaaggaagaggagaauca

SEQ ID NO: 1530886 - RNA, 19 nt, Homo sapiens
acaaaggcaagacagauuu

SEQ ID NO: 1530887 - RNA, 19 nt, Homo sapiens
agaggagaaucaagcugua

SEQ ID NO: 1530888 - RNA, 19 nt, Homo sapiens
aaucagaaacuucaacaga

SEQ ID NO: 1530889 - RNA, 19 nt, Homo sapiens
agacggaacaagcaucuuu

SEQ ID NO: 1530890 - RNA, 19 nt, Homo sapiens
gaagagcuuagagagcaua

SEQ ID NO: 1530891 - RNA, 19 nt, Homo sapiens
gagaggaagagacccaaga

SEQ ID NO: 1530892 - RNA, 19 nt, Homo sapiens
ggaaccauguuuggagcuu

SEQ ID NO: 1530893 - RNA, 19 nt, Homo sapiens
aaaccucaaugauuuaagg

SEQ ID NO: 1530894 - RNA, 19 nt, Homo sapiens
gaagacauaacggaugaug

SEQ ID NO: 1530895 - RNA, 19 nt, Homo sapiens
gaacgcuugcuaaagauca

SEQ ID NO: 1530896 - RNA, 19 nt, Homo sapiens
uccaagaacuguauuuacu

SEQ ID NO: 1530897 - RNA, 19 nt, Homo sapiens
uacaagaugcuucgaguga

SEQ ID NO: 1530898 - RNA, 19 nt, Homo sapiens
gaaggagaaagaaaccaau

SEQ ID NO: 1530899 - RNA, 19 nt, Homo sapiens
gcugaaguauggaaagaac

SEQ ID NO: 1530900 - RNA, 19 nt, Homo sapiens
ugaugaagauccagaacca

SEQ ID NO: 1530901 - RNA, 19 nt, Homo sapiens
uagagugaguucccuuuag

SEQ ID NO: 1530902 - RNA, 19 nt, Homo sapiens
gaaagcgagccaaagaucu

SEQ ID NO: 1530903 - RNA, 19 nt, Homo sapiens
guggaaaugauaccaaaga

SEQ ID NO: 1530904 - RNA, 19 nt, Homo sapiens
ggagaaucaagcuguauag

SEQ ID NO: 1530905 - RNA, 19 nt, Homo sapiens
gcugaaagaaaccucaaug

SEQ ID NO: 1530906 - RNA, 19 nt, Homo sapiens
ggaauuagaaaugaacagu

SEQ ID NO: 1530907 - RNA, 19 nt, Homo sapiens
caucgagacucugacugaa

SEQ ID NO: 1530908 - RNA, 19 nt, Homo sapiens
uaaaauggaugggucaaug

SEQ ID NO: 1530909 - RNA, 19 nt, Homo sapiens
agagagcauuccucauaug

SEQ ID NO: 1530910 - RNA, 19 nt, Homo sapiens
uguauuuacugugguugua

SEQ ID NO: 1530911 - RNA, 19 nt, Homo sapiens
guggugagguuuuaaauuc

SEQ ID NO: 1530912 - RNA, 19 nt, Homo sapiens
uaucugcuguuacuucagu

SEQ ID NO: 1530913 - RNA, 19 nt, Homo sapiens
acacaaagcuccuaaauuc

SEQ ID NO: 1530914 - RNA, 19 nt, Homo sapiens
gcaaagaaguauuaaggaa

SEQ ID NO: 1530915 - RNA, 19 nt, Homo sapiens
caauuaugcucucauguua

SEQ ID NO: 1530916 - RNA, 19 nt, Homo sapiens
caagaaguuucacguguua

SEQ ID NO: 1530917 - RNA, 19 nt, Homo sapiens
gaccuauucuuguuucuua

SEQ ID NO: 1530918 - RNA, 19 nt, Homo sapiens
ggacuuacucguuauguua

SEQ ID NO: 1530919 - RNA, 19 nt, Homo sapiens
gaacaauuaugcucucaug

SEQ ID NO: 1530920 - RNA, 19 nt, Homo sapiens
guacagaugugauauugga

SEQ ID NO: 1530921 - RNA, 19 nt, Homo sapiens
uaaagaagccucccaaaga

SEQ ID NO: 1530922 - RNA, 19 nt, Homo sapiens
gggagcagcuuaccugaaa

SEQ ID NO: 1530923 - RNA, 19 nt, Homo sapiens
cgucagaucuggaacaauu

SEQ ID NO: 1530924 - RNA, 19 nt, Homo sapiens
aaagaucacuagugucuaa

SEQ ID NO: 1530925 - RNA, 19 nt, Homo sapiens
caccaugccuggcuaauuu

SEQ ID NO: 1530926 - RNA, 19 nt, Homo sapiens
gcauuucagucuauaggua

SEQ ID NO: 1530927 - RNA, 19 nt, Homo sapiens
cuaaugaggucacucuuga

SEQ ID NO: 1530928 - RNA, 19 nt, Homo sapiens
gaucacuagugucuaaauu

SEQ ID NO: 1530929 - RNA, 19 nt, Homo sapiens
ccaggaaccuaccuugaaa

SEQ ID NO: 1530930 - RNA, 19 nt, Homo sapiens
gacauaauccguuaacuau

SEQ ID NO: 1530931 - RNA, 19 nt, Homo sapiens
gaugugauauuggaagaaa

SEQ ID NO: 1530932 - RNA, 19 nt, Homo sapiens
gaagaaccaaucaaaguug

SEQ ID NO: 1530933 - RNA, 19 nt, Homo sapiens
ggagauuugugucaauaau

SEQ ID NO: 1530934 - RNA, 19 nt, Homo sapiens
ucaaugguguuccuucgua

SEQ ID NO: 1530935 - RNA, 19 nt, Homo sapiens
guacaugaaaucccgcuua

SEQ ID NO: 1530936 - RNA, 19 nt, Homo sapiens
gaagaagauuacaaagaca

SEQ ID NO: 1530937 - RNA, 19 nt, Homo sapiens
gaaauucaguaucaagaac

SEQ ID NO: 1530938 - RNA, 19 nt, Homo sapiens
ucacaaagaccacaucaug

SEQ ID NO: 1530939 - RNA, 19 nt, Homo sapiens
ggagacaguuuaucaucug

SEQ ID NO: 1530940 - RNA, 19 nt, Homo sapiens
gagacaggaucuugcuuug

SEQ ID NO: 1530941 - RNA, 19 nt, Homo sapiens
ugaagaagauuacaaagac

SEQ ID NO: 1530942 - RNA, 19 nt, Homo sapiens
caacaaggcaguaauuagu

SEQ ID NO: 1530943 - RNA, 19 nt, Homo sapiens
aaacguuccuucccauuug

SEQ ID NO: 1530944 - RNA, 19 nt, Homo sapiens
aacaagacauaauccguua

SEQ ID NO: 1530945 - RNA, 19 nt, Homo sapiens
caccacaccugaccuauuc

SEQ ID NO: 1530946 - RNA, 19 nt, Homo sapiens
gaaaucaacaaggcaguaa

SEQ ID NO: 1530947 - RNA, 19 nt, Homo sapiens
gugacgcacuccagcuuua

SEQ ID NO: 1530948 - RNA, 19 nt, Homo sapiens
acaaggcaguaauuaguaa

SEQ ID NO: 1530949 - RNA, 19 nt, Homo sapiens
gagcaaagaaguauuaagg

SEQ ID NO: 1530950 - RNA, 19 nt, Homo sapiens
ggaaauucaguaucaagaa

SEQ ID NO: 1530951 - RNA, 19 nt, Homo sapiens
gaaccuaccuugaaaacug

SEQ ID NO: 1530952 - RNA, 19 nt, Homo sapiens
uaaccugagucccuuguga

SEQ ID NO: 1530953 - RNA, 19 nt, Homo sapiens
ggguacagaugugauauug

SEQ ID NO: 1530954 - RNA, 19 nt, Homo sapiens
ccaaagugauggaguacau

SEQ ID NO: 1530955 - RNA, 19 nt, Homo sapiens
cagcuuaccugaaaugcau

SEQ ID NO: 1530956 - RNA, 19 nt, Homo sapiens
agacauaauccguuaacua

SEQ ID NO: 1530957 - RNA, 19 nt, Homo sapiens
gaguugaugugauaaugug

SEQ ID NO: 1530958 - RNA, 19 nt, Homo sapiens
acaagaaguuucacguguu

SEQ ID NO: 1530959 - RNA, 19 nt, Homo sapiens
uacaugaaaucccgcuuaa

SEQ ID NO: 1530960 - RNA, 19 nt, Homo sapiens
aaagaagccucccaaagag

SEQ ID NO: 1530961 - RNA, 19 nt, Homo sapiens
ucaaggaacucugugaauc

SEQ ID NO: 1530962 - RNA, 19 nt, Homo sapiens
gagaggggcuggagauuug

SEQ ID NO: 1530963 - RNA, 19 nt, Homo sapiens
ccuggaagcuggauuugga

SEQ ID NO: 1530964 - RNA, 19 nt, Homo sapiens
ccaacaggguauagaguau

SEQ ID NO: 1530965 - RNA, 19 nt, Homo sapiens
ccaaagagcaaagaaguau

SEQ ID NO: 1530966 - RNA, 19 nt, Homo sapiens
caagaacaaaccaacaauu

SEQ ID NO: 1530967 - RNA, 19 nt, Homo sapiens
gacacaaagcuccuaaauu

SEQ ID NO: 1530968 - RNA, 19 nt, Homo sapiens
guucuaguauuuggucuuu

SEQ ID NO: 1530969 - RNA, 19 nt, Homo sapiens
gaugaagaaacgaaggaua

SEQ ID NO: 1530970 - RNA, 19 nt, Homo sapiens
gaaaucccgcuuaaccuau

SEQ ID NO: 1530971 - RNA, 19 nt, Homo sapiens
ccauuugccucaaguaaca

SEQ ID NO: 1530972 - RNA, 19 nt, Homo sapiens
ggaacucugugaaucucuu

SEQ ID NO: 1530973 - RNA, 19 nt, Homo sapiens
caacaauucacucaaggaa

SEQ ID NO: 1530974 - RNA, 19 nt, Homo sapiens
uuauugggcuuucguauag

SEQ ID NO: 1530975 - RNA, 19 nt, Homo sapiens
caccugaccuauucuuguu

SEQ ID NO: 1530976 - RNA, 19 nt, Homo sapiens
ccaaagugcugggauuaca

SEQ ID NO: 1530977 - RNA, 19 nt, Homo sapiens
ggggaggacuuacucguua

SEQ ID NO: 1530978 - RNA, 19 nt, Homo sapiens
aaaucccgcuuaaccuaua

SEQ ID NO: 1530979 - RNA, 19 nt, Homo sapiens
guaaagaagccucccaaag

SEQ ID NO: 1530980 - RNA, 19 nt, Homo sapiens
ucuaguauuuggucuuuga

SEQ ID NO: 1530981 - RNA, 19 nt, Homo sapiens
gaagcuggauuuggagaca

SEQ ID NO: 1530982 - RNA, 19 nt, Homo sapiens
ugaaaucccgcuuaaccua

SEQ ID NO: 1530983 - RNA, 19 nt, Homo sapiens
acaaagacauagaacaucu

SEQ ID NO: 1530984 - RNA, 19 nt, Homo sapiens
caaagaccacaucaugauu

SEQ ID NO: 1530985 - RNA, 19 nt, Homo sapiens
acaccagucuguaaacuuc

SEQ ID NO: 1530986 - RNA, 19 nt, Homo sapiens
uaucucggcucgcugcaaa

SEQ ID NO: 1530987 - RNA, 19 nt, Homo sapiens
uaccaaaggucguuauuuu

SEQ ID NO: 1530988 - RNA, 19 nt, Homo sapiens
ugaagaaccaaucaaaguu

SEQ ID NO: 1530989 - RNA, 19 nt, Homo sapiens
gaccacaucaugauuggaa

SEQ ID NO: 1530990 - RNA, 19 nt, Homo sapiens
gagacaguuuaucaucuga

SEQ ID NO: 1530991 - RNA, 19 nt, Homo sapiens
gauggcauuucagucuaua

SEQ ID NO: 1530992 - RNA, 19 nt, Homo sapiens
uuugaaagcugacaagaag

SEQ ID NO: 1530993 - RNA, 19 nt, Homo sapiens
aguggaagcugacauaaag

SEQ ID NO: 1530994 - RNA, 19 nt, Homo sapiens
caacagagcgagacuccau

SEQ ID NO: 1530995 - RNA, 19 nt, Homo sapiens
gaacaaaccaacaauucac

SEQ ID NO: 1530996 - RNA, 19 nt, Homo sapiens
caucaugauuggaaguuuc

SEQ ID NO: 1530997 - RNA, 19 nt, Homo sapiens
caacggagacugcgguauc

SEQ ID NO: 1530998 - RNA, 19 nt, Homo sapiens
gaguacaucuuuuguucua

SEQ ID NO: 1530999 - RNA, 19 nt, Homo sapiens
gguguuccuucguacauga

SEQ ID NO: 1531000 - RNA, 19 nt, Homo sapiens
cccaggcccuuuggacuua

SEQ ID NO: 1531001 - RNA, 19 nt, Homo sapiens
uauaguggaagcugacaua

SEQ ID NO: 1531002 - RNA, 19 nt, Homo sapiens
gaaccugaacccguaaaga

SEQ ID NO: 1531003 - RNA, 19 nt, Homo sapiens
guucaucuguauccuuugu

SEQ ID NO: 1531004 - RNA, 19 nt, Homo sapiens
caaagcuccuaaauuccuu

SEQ ID NO: 1531005 - RNA, 19 nt, Homo sapiens
cuaaaacccuuguaauuuc

SEQ ID NO: 1531006 - RNA, 19 nt, Homo sapiens
cagcuacucaggagaauug

SEQ ID NO: 1531007 - RNA, 19 nt, Homo sapiens
gccaggaaccuaccuugaa

SEQ ID NO: 1531008 - RNA, 19 nt, Homo sapiens
acaauuaugcucucauguu

SEQ ID NO: 1531009 - RNA, 19 nt, Homo sapiens
gaaagcugacaagaaguuu

SEQ ID NO: 1531010 - RNA, 19 nt, Homo sapiens
aagaaacuguggccaggaa

SEQ ID NO: 1531011 - RNA, 19 nt, Homo sapiens
aaacuucaaccuguaauga

SEQ ID NO: 1531012 - RNA, 19 nt, Homo sapiens
acaauucacucaaggaacu

SEQ ID NO: 1531013 - RNA, 19 nt, Homo sapiens
gaacaggacuugaacauga

SEQ ID NO: 1531014 - RNA, 19 nt, Homo sapiens
ggagacagcuuguggauga

SEQ ID NO: 1531015 - RNA, 19 nt, Homo sapiens
gaacuuaacugugaagaga

SEQ ID NO: 1531016 - RNA, 19 nt, Homo sapiens
gaacagaagauauaccaua

SEQ ID NO: 1531017 - RNA, 19 nt, Homo sapiens
gagaagauaugauaagaga

SEQ ID NO: 1531018 - RNA, 19 nt, Homo sapiens
gugcaaggguuuaucauua

SEQ ID NO: 1531019 - RNA, 19 nt, Homo sapiens
agaaagagcugauggagaa

SEQ ID NO: 1531020 - RNA, 19 nt, Homo sapiens
gaacagaaacacauaaaug

SEQ ID NO: 1531021 - RNA, 19 nt, Homo sapiens
ggaagaacgugcuauggaa

SEQ ID NO: 1531022 - RNA, 19 nt, Homo sapiens
caaagaaguuggcugagaa

SEQ ID NO: 1531023 - RNA, 19 nt, Homo sapiens
gaaaugcaauugaagaaag

SEQ ID NO: 1531024 - RNA, 19 nt, Homo sapiens
gcaaagaaguuggcugaga

SEQ ID NO: 1531025 - RNA, 19 nt, Homo sapiens
cacaaugacugcaagauuu

SEQ ID NO: 1531026 - RNA, 19 nt, Homo sapiens
gauaagagaacagaagaua

SEQ ID NO: 1531027 - RNA, 19 nt, Homo sapiens
aagcacagauugcauuuaa

SEQ ID NO: 1531028 - RNA, 19 nt, Homo sapiens
ggagaaagaauuugacaga

SEQ ID NO: 1531029 - RNA, 19 nt, Homo sapiens
gaagaaagacgaaauaagc

SEQ ID NO: 1531030 - RNA, 19 nt, Homo sapiens
gugaagagaaggagaauuu

SEQ ID NO: 1531031 - RNA, 19 nt, Homo sapiens
gcacaaugacugcaagauu

SEQ ID NO: 1531032 - RNA, 19 nt, Homo sapiens
gagaaagaauuugacagaa

SEQ ID NO: 1531033 - RNA, 19 nt, Homo sapiens
ggaaagcacagauugcauu

SEQ ID NO: 1531034 - RNA, 19 nt, Homo sapiens
caagagaggauagaacaua

SEQ ID NO: 1531035 - RNA, 19 nt, Homo sapiens
gaggucauguguacaagaa

SEQ ID NO: 1531036 - RNA, 19 nt, Homo sapiens
gaacaggauaugcuaaaga

SEQ ID NO: 1531037 - RNA, 19 nt, Homo sapiens
ggagcuccguguugaauug

SEQ ID NO: 1531038 - RNA, 19 nt, Homo sapiens
gcaacgagaagcuaaagaa

SEQ ID NO: 1531039 - RNA, 19 nt, Homo sapiens
gagcagauguucuccaaac

SEQ ID NO: 1531040 - RNA, 19 nt, Homo sapiens
gaaagcacagauugcauuu

SEQ ID NO: 1531041 - RNA, 19 nt, Homo sapiens
gcaggaaacuaggaccauu

SEQ ID NO: 1531042 - RNA, 19 nt, Homo sapiens
uaaagaaacagaaggcaaa

SEQ ID NO: 1531043 - RNA, 19 nt, Homo sapiens
uaacaacgcacagauuaaa

SEQ ID NO: 1531044 - RNA, 19 nt, Homo sapiens
gcuccguguugaauuguua

SEQ ID NO: 1531045 - RNA, 19 nt, Homo sapiens
gaagagaaacgccgagagu

SEQ ID NO: 1531046 - RNA, 19 nt, Homo sapiens
acgcacagauuaaacauga

SEQ ID NO: 1531047 - RNA, 19 nt, Homo sapiens
gcaagacgccaacguuuag

SEQ ID NO: 1531048 - RNA, 19 nt, Homo sapiens
gaaggggacucgaaaaugu

SEQ ID NO: 1531049 - RNA, 19 nt, Homo sapiens
ugaauaaaccugugccuau

SEQ ID NO: 1531050 - RNA, 19 nt, Homo sapiens
gaacaggaagaacgugcua

SEQ ID NO: 1531051 - RNA, 19 nt, Homo sapiens
gaacaugaagcucgugcaa

SEQ ID NO: 1531052 - RNA, 19 nt, Homo sapiens
gaaugaacaggauaugcua

SEQ ID NO: 1531053 - RNA, 19 nt, Homo sapiens
gagcugagcaccaucuaga

SEQ ID NO: 1531054 - RNA, 19 nt, Homo sapiens
gaagauaugauaagagaac

SEQ ID NO: 1531055 - RNA, 19 nt, Homo sapiens
gugaggagcuccguguuga

SEQ ID NO: 1531056 - RNA, 19 nt, Homo sapiens
gaaaguaacaacgcacaga

SEQ ID NO: 1531057 - RNA, 19 nt, Homo sapiens
ugcaaggguuuaucauuaa

SEQ ID NO: 1531058 - RNA, 19 nt, Homo sapiens
guaacaacgcacagauuaa

SEQ ID NO: 1531059 - RNA, 19 nt, Homo sapiens
gcagccaucagaagcauaa

SEQ ID NO: 1531060 - RNA, 19 nt, Homo sapiens
ggaguucacagacuuacaa

SEQ ID NO: 1531061 - RNA, 19 nt, Homo sapiens
ucccugaguuuguguaauu

SEQ ID NO: 1531062 - RNA, 19 nt, Homo sapiens
gauccaagccuccuaaagg

SEQ ID NO: 1531063 - RNA, 19 nt, Homo sapiens
aacaggauaugcuaaagaa

SEQ ID NO: 1531064 - RNA, 19 nt, Homo sapiens
ccaaggagcugagcaccau

SEQ ID NO: 1531065 - RNA, 19 nt, Homo sapiens
gcacagauuaaacaugaga

SEQ ID NO: 1531066 - RNA, 19 nt, Homo sapiens
ggcaaaagcugguggaaga

SEQ ID NO: 1531067 - RNA, 19 nt, Homo sapiens
aaagauaggaugagagaga

SEQ ID NO: 1531068 - RNA, 19 nt, Homo sapiens
gaagaaagaaaccauugag

SEQ ID NO: 1531069 - RNA, 19 nt, Homo sapiens
gaaggagaauuuugcaaga

SEQ ID NO: 1531070 - RNA, 19 nt, Homo sapiens
gagcggaaagcacagauug

SEQ ID NO: 1531071 - RNA, 19 nt, Homo sapiens
aagaaaccauugaggagaa

SEQ ID NO: 1531072 - RNA, 19 nt, Homo sapiens
aguaacaacgcacagauua

SEQ ID NO: 1531073 - RNA, 19 nt, Homo sapiens
aaucaaggaugcugugcaa

SEQ ID NO: 1531074 - RNA, 19 nt, Homo sapiens
acagagacgugaggaagaa

SEQ ID NO: 1531075 - RNA, 19 nt, Homo sapiens
gagaggauagaacauauuc

SEQ ID NO: 1531076 - RNA, 19 nt, Homo sapiens
guucacagacuuacaaauc

SEQ ID NO: 1531077 - RNA, 19 nt, Homo sapiens
ccaagaagcagagaaggaa

SEQ ID NO: 1531078 - RNA, 19 nt, Homo sapiens
gaagacaaggcaaagaagu

SEQ ID NO: 1531079 - RNA, 19 nt, Homo sapiens
acaugaagcucgugcaaag

SEQ ID NO: 1531080 - RNA, 19 nt, Homo sapiens
gcaggaauacagagacgaa

SEQ ID NO: 1531081 - RNA, 19 nt, Homo sapiens
ggaacagaaacacauaaau

SEQ ID NO: 1531082 - RNA, 19 nt, Homo sapiens
gagacgaacaggacuugaa

SEQ ID NO: 1531083 - RNA, 19 nt, Homo sapiens
aagagaggauagaacauau

SEQ ID NO: 1531084 - RNA, 19 nt, Homo sapiens
ggguuuaucauuaacauug

SEQ ID NO: 1531085 - RNA, 19 nt, Homo sapiens
caagauguguuuggacaag

SEQ ID NO: 1531086 - RNA, 19 nt, Homo sapiens
gcaaagcaggaaacuagga

SEQ ID NO: 1531087 - RNA, 19 nt, Homo sapiens
acaguaugcuuguaugcuu

SEQ ID NO: 1531088 - RNA, 19 nt, Homo sapiens
caucaagugcugccucaaa

SEQ ID NO: 1531089 - RNA, 19 nt, Homo sapiens
gcugagcaccaucuagaaa

SEQ ID NO: 1531090 - RNA, 19 nt, Homo sapiens
cguguugaauuguuaucua

SEQ ID NO: 1531091 - RNA, 19 nt, Homo sapiens
gagaacagaagauauacca

SEQ ID NO: 1531092 - RNA, 19 nt, Homo sapiens
ugagcaccaucuagaaaga

SEQ ID NO: 1531093 - RNA, 19 nt, Homo sapiens
ugacagaauauuagaggaa

SEQ ID NO: 1531094 - RNA, 19 nt, Homo sapiens
cagaaaugcaauugaagaa

SEQ ID NO: 1531095 - RNA, 19 nt, Homo sapiens
gcaaggguuuaucauuaac

SEQ ID NO: 1531096 - RNA, 19 nt, Homo sapiens
gauaugauaagagaacaga

SEQ ID NO: 1531097 - RNA, 19 nt, Homo sapiens
aagagcagauguucuccaa

SEQ ID NO: 1531098 - RNA, 19 nt, Homo sapiens
cagcagcagucccaagaag

SEQ ID NO: 1531099 - RNA, 19 nt, Homo sapiens
ugcaagacgccaacguuua

SEQ ID NO: 1531100 - RNA, 19 nt, Homo sapiens
ggacaaggagcugagacuu

SEQ ID NO: 1531101 - RNA, 19 nt, Homo sapiens
gcccagaucaccagcauca

SEQ ID NO: 1531102 - RNA, 19 nt, Homo sapiens
ugaagaaagaaaccauuga

SEQ ID NO: 1531103 - RNA, 19 nt, Homo sapiens
aagcagagaaggaagagaa

SEQ ID NO: 1531104 - RNA, 19 nt, Homo sapiens
acaggaagaggcagauaaa

SEQ ID NO: 1531105 - RNA, 19 nt, Homo sapiens
cagauguucuccaaacucu

SEQ ID NO: 1531106 - RNA, 19 nt, Homo sapiens
agaaagacgaaauaagcua

SEQ ID NO: 1531107 - RNA, 19 nt, Homo sapiens
caggaaacuaggaccauuu

SEQ ID NO: 1531108 - RNA, 19 nt, Homo sapiens
aagauaggaugagagagaa

SEQ ID NO: 1531109 - RNA, 19 nt, Homo sapiens
gaagagaaggagaauuuug

SEQ ID NO: 1531110 - RNA, 19 nt, Homo sapiens
ggucauguguacaagaaaa

SEQ ID NO: 1531111 - RNA, 19 nt, Homo sapiens
ggaagacaaggcaaagaag

SEQ ID NO: 1531112 - RNA, 19 nt, Homo sapiens
gaggauagaacauauucag

SEQ ID NO: 1531113 - RNA, 19 nt, Homo sapiens
uaacugaacugcacaauau

SEQ ID NO: 1531114 - RNA, 19 nt, Homo sapiens
gagaaggacuauucacuuu

SEQ ID NO: 1531115 - RNA, 19 nt, Homo sapiens
gacaggauaugcucacuua

SEQ ID NO: 1531116 - RNA, 19 nt, Homo sapiens
caucguagcugcauauaaa

SEQ ID NO: 1531117 - RNA, 19 nt, Homo sapiens
caaaucguaugaacaguua

SEQ ID NO: 1531118 - RNA, 19 nt, Homo sapiens
gaacagcguuggugaaauc

SEQ ID NO: 1531119 - RNA, 19 nt, Homo sapiens
cgccaaaccuggauauuua

SEQ ID NO: 1531120 - RNA, 19 nt, Homo sapiens
caaaggacccagaagguua

SEQ ID NO: 1531121 - RNA, 19 nt, Homo sapiens
ugagcaacaugaaagauua

SEQ ID NO: 1531122 - RNA, 19 nt, Homo sapiens
aaaggcagcuuauuucaga

SEQ ID NO: 1531123 - RNA, 19 nt, Homo sapiens
gauaugcucacuuaaauug

SEQ ID NO: 1531124 - RNA, 19 nt, Homo sapiens
caaugcagaucacucauga

SEQ ID NO: 1531125 - RNA, 19 nt, Homo sapiens
gagagccgcuguugacuag

SEQ ID NO: 1531126 - RNA, 19 nt, Homo sapiens
ggaccaggcucaaugacau

SEQ ID NO: 1531127 - RNA, 19 nt, Homo sapiens
acaguaagcucugcaaaug

SEQ ID NO: 1531128 - RNA, 19 nt, Homo sapiens
gcagaucacucaugaaaau

SEQ ID NO: 1531129 - RNA, 19 nt, Homo sapiens
uaaacccagugacaauuaa

SEQ ID NO: 1531130 - RNA, 19 nt, Homo sapiens
guggcuaaguccuuuauuu

SEQ ID NO: 1531131 - RNA, 19 nt, Homo sapiens
gcacaaugcagaucacuca

SEQ ID NO: 1531132 - RNA, 19 nt, Homo sapiens
gaagaccaauugcaguaca

SEQ ID NO: 1531133 - RNA, 19 nt, Homo sapiens
ggagaaggacuauucacuu

SEQ ID NO: 1531134 - RNA, 19 nt, Homo sapiens
gaaagauuagugcuagaaa

SEQ ID NO: 1531135 - RNA, 19 nt, Homo sapiens
gcaagcaccucugcaugga

SEQ ID NO: 1531136 - RNA, 19 nt, Homo sapiens
cgaagacauuugccuguga

SEQ ID NO: 1531137 - RNA, 19 nt, Homo sapiens
gcaaaggacccagaagguu

SEQ ID NO: 1531138 - RNA, 19 nt, Homo sapiens
guucugacagggauaaaua

SEQ ID NO: 1531139 - RNA, 19 nt, Homo sapiens
uggcuaaguccuuuauuua

SEQ ID NO: 1531140 - RNA, 19 nt, Homo sapiens
guaacugaacugcacaaua

SEQ ID NO: 1531141 - RNA, 19 nt, Homo sapiens
gaaauucagaacacacuau

SEQ ID NO: 1531142 - RNA, 19 nt, Homo sapiens
ggccauagcugagcaacau

SEQ ID NO: 1531143 - RNA, 19 nt, Homo sapiens
ugacagggauaaauacagu

SEQ ID NO: 1531144 - RNA, 19 nt, Homo sapiens
ucacaucacucgucagaac

SEQ ID NO: 1531145 - RNA, 19 nt, Homo sapiens
gggaacagaaugagagauu

SEQ ID NO: 1531146 - RNA, 19 nt, Homo sapiens
gaguucugcuuccuugauu

SEQ ID NO: 1531147 - RNA, 19 nt, Homo sapiens
ggugaaaucuacaguuugc

SEQ ID NO: 1531148 - RNA, 19 nt, Homo sapiens
caggauaugcucacuuaaa

SEQ ID NO: 1531149 - RNA, 19 nt, Homo sapiens
guagacaaauggauauugc

SEQ ID NO: 1531150 - RNA, 19 nt, Homo sapiens
cagacaagcuugacugaac

SEQ ID NO: 1531151 - RNA, 19 nt, Homo sapiens
gauuagugcuagaaaugga

SEQ ID NO: 1531152 - RNA, 19 nt, Homo sapiens
ggacccagaagguuagaaa

SEQ ID NO: 1531153 - RNA, 19 nt, Homo sapiens
gagauacggucgggacuca

SEQ ID NO: 1531154 - RNA, 19 nt, Homo sapiens
uaaauaaacccagugacaa

SEQ ID NO: 1531155 - RNA, 19 nt, Homo sapiens
gcuccagccucauccaaug

SEQ ID NO: 1531156 - RNA, 19 nt, Homo sapiens
gauucaacguguaucuuau

SEQ ID NO: 1531157 - RNA, 19 nt, Homo sapiens
gaugggcaccucucacuga

SEQ ID NO: 1531158 - RNA, 19 nt, Homo sapiens
aagcuugacugaaccaaug

SEQ ID NO: 1531159 - RNA, 19 nt, Homo sapiens
ggaaggagaaaugaucuau

SEQ ID NO: 1531160 - RNA, 19 nt, Homo sapiens
ugaaaugggucggcucuag

SEQ ID NO: 1531161 - RNA, 19 nt, Homo sapiens
gaaggacuauucacuuuuc

SEQ ID NO: 1531162 - RNA, 19 nt, Homo sapiens
ggauauuuauggugaaugc

SEQ ID NO: 1531163 - RNA, 19 nt, Homo sapiens
ggauaugcucacuuaaauu

SEQ ID NO: 1531164 - RNA, 19 nt, Homo sapiens
aggauaugcucacuuaaau

SEQ ID NO: 1531165 - RNA, 19 nt, Homo sapiens
uuggugaaaucuacaguuu

SEQ ID NO: 1531166 - RNA, 19 nt, Homo sapiens
auaaacccagugacaauua

SEQ ID NO: 1531167 - RNA, 19 nt, Homo sapiens
ccaaaucguaugaacaguu

SEQ ID NO: 1531168 - RNA, 19 nt, Homo sapiens
ugacacaggagaaggacua

SEQ ID NO: 1531169 - RNA, 19 nt, Homo sapiens
guacuggcaucacaucacu

SEQ ID NO: 1531170 - RNA, 19 nt, Homo sapiens
gaauccaaaucguaugaac

SEQ ID NO: 1531171 - RNA, 19 nt, Homo sapiens
cagaacagcguuggugaaa

SEQ ID NO: 1531172 - RNA, 19 nt, Homo sapiens
ugaaacaucgaagacauuu

SEQ ID NO: 1531173 - RNA, 19 nt, Homo sapiens
gacauuugccugugaguca

SEQ ID NO: 1531174 - RNA, 19 nt, Homo sapiens
aaauaaacccagugacaau

SEQ ID NO: 1531175 - RNA, 19 nt, Homo sapiens
gcuguugacuagagagaca

SEQ ID NO: 1531176 - RNA, 19 nt, Homo sapiens
caucacaucacucgucaga

SEQ ID NO: 1531177 - RNA, 19 nt, Homo sapiens
gaacugcacaauaucaaaa

SEQ ID NO: 1531178 - RNA, 19 nt, Homo sapiens
agacaaauggauauugcua

SEQ ID NO: 1531179 - RNA, 19 nt, Homo sapiens
ccagugacaauuaaaggaa

SEQ ID NO: 1531180 - RNA, 19 nt, Homo sapiens
cguagcugcauauaaauaa

SEQ ID NO: 1531181 - RNA, 19 nt, Homo sapiens
gacaauuaaaggaacauga

SEQ ID NO: 1531182 - RNA, 19 nt, Homo sapiens
ggcuaaguccuuuauuuau

SEQ ID NO: 1531183 - RNA, 19 nt, Homo sapiens
uggaagaccaauugcagua

SEQ ID NO: 1531184 - RNA, 19 nt, Homo sapiens
ccacaaugccaaggucaaa

SEQ ID NO: 1531185 - RNA, 19 nt, Homo sapiens
ugacaucguagcugcauau

SEQ ID NO: 1531186 - RNA, 19 nt, Homo sapiens
gagccgcuguugacuagag

SEQ ID NO: 1531187 - RNA, 19 nt, Homo sapiens
gaaggagaaaugaucuauc

SEQ ID NO: 1531188 - RNA, 19 nt, Homo sapiens
gacaaauggauauugcuau

SEQ ID NO: 1531189 - RNA, 19 nt, Homo sapiens
guguguguguguagacaaa

SEQ ID NO: 1531190 - RNA, 19 nt, Homo sapiens
ucaaacaagggaaggagaa

SEQ ID NO: 1531191 - RNA, 19 nt, Homo sapiens
cagaacacacuauuaagca

SEQ ID NO: 1531192 - RNA, 19 nt, Homo sapiens
ggaguucugcuuccuugau

SEQ ID NO: 1531193 - RNA, 19 nt, Homo sapiens
cagcguuggugaaaucuac

SEQ ID NO: 1531194 - RNA, 19 nt, Homo sapiens
cacaggagaaggacuauuc

SEQ ID NO: 1531195 - RNA, 19 nt, Homo sapiens
auaaauaaacccagugaca

SEQ ID NO: 1531196 - RNA, 19 nt, Homo sapiens
uagaauccaaaucguauga

SEQ ID NO: 1531197 - RNA, 19 nt, Homo sapiens
ugaaagauuagugcuagaa

SEQ ID NO: 1531198 - RNA, 19 nt, Homo sapiens
caaacaagggaaggagaaa

SEQ ID NO: 1531199 - RNA, 19 nt, Homo sapiens
aaaccuggauauuuauggu

SEQ ID NO: 1531200 - RNA, 19 nt, Homo sapiens
guguguagacaaauggaua

SEQ ID NO: 1531201 - RNA, 19 nt, Homo sapiens
gagugcagcgggaacagaa

SEQ ID NO: 1531202 - RNA, 19 nt, Homo sapiens
gcucuacucgugugugugu

SEQ ID NO: 1531203 - RNA, 19 nt, Homo sapiens
gaaacaucgaagacauuug

SEQ ID NO: 1531204 - RNA, 19 nt, Homo sapiens
cacagacauuucccagcua

SEQ ID NO: 1531205 - RNA, 19 nt, Homo sapiens
uuugcaaggucauggguuu

SEQ ID NO: 1531206 - RNA, 19 nt, Homo sapiens
ugaaaucuacaguuugcaa

SEQ ID NO: 1531207 - RNA, 19 nt, Homo sapiens
aagauuagugcuagaaaug

SEQ ID NO: 1531208 - RNA, 19 nt, Homo sapiens
acagggauaaauacaguaa

SEQ ID NO: 1531209 - RNA, 19 nt, Homo sapiens
ugagagauucaacguguau

SEQ ID NO: 1531210 - RNA, 19 nt, Homo sapiens
ggucauggguuugguucgu

SEQ ID NO: 1531211 - RNA, 19 nt, Homo sapiens
gggaaggagaaaugaucua

SEQ ID NO: 1531212 - RNA, 19 nt, Homo sapiens
aaacaucgaagacauuugc

SEQ ID NO: 1531213 - RNA, 19 nt, Homo sapiens
guacgagacccugcagaug

SEQ ID NO: 1531214 - RNA, 19 nt, Homo sapiens
gagaagaccaucaaccuua

SEQ ID NO: 1531215 - RNA, 19 nt, Homo sapiens
uuacauuucuggcccaaua

SEQ ID NO: 1531216 - RNA, 19 nt, Homo sapiens
agaagaagcucccuuuaca

SEQ ID NO: 1531217 - RNA, 19 nt, Homo sapiens
caagaucaccguauacaga

SEQ ID NO: 1531218 - RNA, 19 nt, Homo sapiens
ggaaacagaagaagcuaga

SEQ ID NO: 1531219 - RNA, 19 nt, Homo sapiens
gaagcucccuuuacaucau

SEQ ID NO: 1531220 - RNA, 19 nt, Homo sapiens
uggaauacauggaucagaa

SEQ ID NO: 1531221 - RNA, 19 nt, Homo sapiens
gcagacacccucccucgaa

SEQ ID NO: 1531222 - RNA, 19 nt, Homo sapiens
uauagguugugcccucuua

SEQ ID NO: 1531223 - RNA, 19 nt, Homo sapiens
cgcauuugcuuccgguuua

SEQ ID NO: 1531224 - RNA, 19 nt, Homo sapiens
gcuguguccucacuuggua

SEQ ID NO: 1531225 - RNA, 19 nt, Homo sapiens
gcacauaauccgcgagcaa

SEQ ID NO: 1531226 - RNA, 19 nt, Homo sapiens
gaagucggcucugcuuucu

SEQ ID NO: 1531227 - RNA, 19 nt, Homo sapiens
cuuaggaccacauagauua

SEQ ID NO: 1531228 - RNA, 19 nt, Homo sapiens
gcaagccccuccucaauga

SEQ ID NO: 1531229 - RNA, 19 nt, Homo sapiens
gaccguauccgacucuuug

SEQ ID NO: 1531230 - RNA, 19 nt, Homo sapiens
cuaauugucugcacuagag

SEQ ID NO: 1531231 - RNA, 19 nt, Homo sapiens
caaccuuacuguagaugug

SEQ ID NO: 1531232 - RNA, 19 nt, Homo sapiens
ggaagucggcucugcuuuc

SEQ ID NO: 1531233 - RNA, 19 nt, Homo sapiens
aaacagaagaagcuagaaa

SEQ ID NO: 1531234 - RNA, 19 nt, Homo sapiens
gaccaucaaccuuacugua

SEQ ID NO: 1531235 - RNA, 19 nt, Homo sapiens
gaaugaugaccgccugaaa

SEQ ID NO: 1531236 - RNA, 19 nt, Homo sapiens
ccaucaaccuuacuguaga

SEQ ID NO: 1531237 - RNA, 19 nt, Homo sapiens
ggagaagaccaucaaccuu

SEQ ID NO: 1531238 - RNA, 19 nt, Homo sapiens
gaaaccgggucgcauuugc

SEQ ID NO: 1531239 - RNA, 19 nt, Homo sapiens
aggaccacauagauuauua

SEQ ID NO: 1531240 - RNA, 19 nt, Homo sapiens
gaagaagcucccuuuacau

SEQ ID NO: 1531241 - RNA, 19 nt, Homo sapiens
ggaggcggcaguguugaua

SEQ ID NO: 1531242 - RNA, 19 nt, Homo sapiens
uauggaaacuaacaucagu

SEQ ID NO: 1531243 - RNA, 19 nt, Homo sapiens
ggugaaaccgggucgcauu

SEQ ID NO: 1531244 - RNA, 19 nt, Homo sapiens
gcuggugucucggguguga

SEQ ID NO: 1531245 - RNA, 19 nt, Homo sapiens
gaauacauggaucagaaug

SEQ ID NO: 1531246 - RNA, 19 nt, Homo sapiens
ccgaugagggcaccuauga

SEQ ID NO: 1531247 - RNA, 19 nt, Homo sapiens
ggaauacauggaucagaau

SEQ ID NO: 1531248 - RNA, 19 nt, Homo sapiens
caucaaccuuacuguagau

SEQ ID NO: 1531249 - RNA, 19 nt, Homo sapiens
acagaagaagcucccuuua

SEQ ID NO: 1531250 - RNA, 19 nt, Homo sapiens
gaucaccguauacagaaga

SEQ ID NO: 1531251 - RNA, 19 nt, Homo sapiens
cagaagaagcucccuuuac

SEQ ID NO: 1531252 - RNA, 19 nt, Homo sapiens
cagccugccugucaagauc

SEQ ID NO: 1531253 - RNA, 19 nt, Homo sapiens
gugaaaccgggucgcauuu

SEQ ID NO: 1531254 - RNA, 19 nt, Homo sapiens
ccuaugaggucgagaucuc

SEQ ID NO: 1531255 - RNA, 19 nt, Homo sapiens
ucucgggugugaacgugua

SEQ ID NO: 1531256 - RNA, 19 nt, Homo sapiens
ggagaacgccacccaaaau

SEQ ID NO: 1531257 - RNA, 19 nt, Homo sapiens
gaacgccacccaaaaugaa

SEQ ID NO: 1531258 - RNA, 19 nt, Homo sapiens
agaagaagcuagaaaagca

SEQ ID NO: 1531259 - RNA, 19 nt, Homo sapiens
gaaacagaagaagcuagaa

SEQ ID NO: 1531260 - RNA, 19 nt, Homo sapiens
cugucaagaucaccguaua

SEQ ID NO: 1531261 - RNA, 19 nt, Homo sapiens
uacagaagaagcucccuuu

SEQ ID NO: 1531262 - RNA, 19 nt, Homo sapiens
agucggcucugcuuucugu

SEQ ID NO: 1531263 - RNA, 19 nt, Homo sapiens
ccucuuaggaccacauaga

SEQ ID NO: 1531264 - RNA, 19 nt, Homo sapiens
uacaucaucuugucuacag

SEQ ID NO: 1531265 - RNA, 19 nt, Homo sapiens
aagaagcucccuuuacauc

SEQ ID NO: 1531266 - RNA, 19 nt, Homo sapiens
agaagaccaucaaccuuac

SEQ ID NO: 1531267 - RNA, 19 nt, Homo sapiens
guagaugugcccauuucga

SEQ ID NO: 1531268 - RNA, 19 nt, Homo sapiens
cguauccgacucuuugaaa

SEQ ID NO: 1531269 - RNA, 19 nt, Homo sapiens
gcuaauugucugcacuaga

SEQ ID NO: 1531270 - RNA, 19 nt, Homo sapiens
cucaaugacucgagaaugc

SEQ ID NO: 1531271 - RNA, 19 nt, Homo sapiens
cuguagaugugcccauuuc

SEQ ID NO: 1531272 - RNA, 19 nt, Homo sapiens
aagcaaaacucccuggaau

SEQ ID NO: 1531273 - RNA, 19 nt, Homo sapiens
ggaggaugacgaccuguac

SEQ ID NO: 1531274 - RNA, 19 nt, Homo sapiens
gcaccaagcccagcuacac

SEQ ID NO: 1531275 - RNA, 19 nt, Homo sapiens
aagaucaccguauacagaa

SEQ ID NO: 1531276 - RNA, 19 nt, Homo sapiens
gggagaagaccaucaaccu

SEQ ID NO: 1531277 - RNA, 19 nt, Homo sapiens
gggaagucggcucugcuuu

SEQ ID NO: 1531278 - RNA, 19 nt, Homo sapiens
gcaaaacucccuggaauac

SEQ ID NO: 1531279 - RNA, 19 nt, Homo sapiens
aaaggaaacagaagaagcu

SEQ ID NO: 1531280 - RNA, 19 nt, Homo sapiens
gaccacauagauuauuaca

SEQ ID NO: 1531281 - RNA, 19 nt, Homo sapiens
aggcggcaguguugauaug

SEQ ID NO: 1531282 - RNA, 19 nt, Homo sapiens
agcgaggccuucaccuuga

SEQ ID NO: 1531283 - RNA, 19 nt, Homo sapiens
gcaguguugauauggugaa

SEQ ID NO: 1531284 - RNA, 19 nt, Homo sapiens
ucgaaguggugagcaggaa

SEQ ID NO: 1531285 - RNA, 19 nt, Homo sapiens
acagcugcgugguggagaa

SEQ ID NO: 1531286 - RNA, 19 nt, Homo sapiens
ccaaggagcuggccgauau

SEQ ID NO: 1531287 - RNA, 19 nt, Homo sapiens
ggacagagagggugccuuu

SEQ ID NO: 1531288 - RNA, 19 nt, Homo sapiens
ggaaauagaacugucguaa

SEQ ID NO: 1531289 - RNA, 19 nt, Homo sapiens
gaaauagaacugucguaaa

SEQ ID NO: 1531290 - RNA, 19 nt, Homo sapiens
ggaaacggccucuucagaa

SEQ ID NO: 1531291 - RNA, 19 nt, Homo sapiens
aaauagaacugucguaaag

SEQ ID NO: 1531292 - RNA, 19 nt, Homo sapiens
gaacugucguaaaggugua

SEQ ID NO: 1531293 - RNA, 19 nt, Homo sapiens
gcacuucuccugagcuauu

SEQ ID NO: 1531294 - RNA, 19 nt, Homo sapiens
gccaaggucuggaguaugu

SEQ ID NO: 1531295 - RNA, 19 nt, Homo sapiens
ucgcgcaucugcaagaaua

SEQ ID NO: 1531296 - RNA, 19 nt, Homo sapiens
gaauugcccuugcuguauc

SEQ ID NO: 1531297 - RNA, 19 nt, Homo sapiens
ggaggugguuugaaugcaa

SEQ ID NO: 1531298 - RNA, 19 nt, Homo sapiens
gagccaaggucuggaguau

SEQ ID NO: 1531299 - RNA, 19 nt, Homo sapiens
gcaagcgggaguccaagua

SEQ ID NO: 1531300 - RNA, 19 nt, Homo sapiens
gaaacaacgucggcuuugg

SEQ ID NO: 1531301 - RNA, 19 nt, Homo sapiens
gcacaaaaccucugagaug

SEQ ID NO: 1531302 - RNA, 19 nt, Homo sapiens
ccaggaugcuuaguuucua

SEQ ID NO: 1531303 - RNA, 19 nt, Homo sapiens
ggagcuggccgauaucaug

SEQ ID NO: 1531304 - RNA, 19 nt, Homo sapiens
cagcacuucuccugagcua

SEQ ID NO: 1531305 - RNA, 19 nt, Homo sapiens
cggcuuugcugccuaugaa

SEQ ID NO: 1531306 - RNA, 19 nt, Homo sapiens
gagcggcuuugcugccuau

SEQ ID NO: 1531307 - RNA, 19 nt, Homo sapiens
ggagauaggcacugaagac

SEQ ID NO: 1531308 - RNA, 19 nt, Homo sapiens
acagagagggugccuuuga

SEQ ID NO: 1531309 - RNA, 19 nt, Homo sapiens
uagagugguuggcacaguu

SEQ ID NO: 1531310 - RNA, 19 nt, Homo sapiens
uugaggaggugguuugaau

SEQ ID NO: 1531311 - RNA, 19 nt, Homo sapiens
guuuggcugugcugaauug

SEQ ID NO: 1531312 - RNA, 19 nt, Homo sapiens
gcaagaauaaggagaagcu

SEQ ID NO: 1531313 - RNA, 19 nt, Homo sapiens
cagaucgggcugucucuuu

SEQ ID NO: 1531314 - RNA, 19 nt, Homo sapiens
caaggucuggaguauguaa

SEQ ID NO: 1531315 - RNA, 19 nt, Homo sapiens
guagaagggagagaaguug

SEQ ID NO: 1531316 - RNA, 19 nt, Homo sapiens
uggugcaugugaucaagua

SEQ ID NO: 1531317 - RNA, 19 nt, Homo sapiens
ugaauugcccuugcuguau

SEQ ID NO: 1531318 - RNA, 19 nt, Homo sapiens
ucuagacccugcuugaaag

SEQ ID NO: 1531319 - RNA, 19 nt, Homo sapiens
ggacaccaagucugagcuu

SEQ ID NO: 1531320 - RNA, 19 nt, Homo sapiens
cagagagggugccuuugag

SEQ ID NO: 1531321 - RNA, 19 nt, Homo sapiens
gaggagauaggcacugaag

SEQ ID NO: 1531322 - RNA, 19 nt, Homo sapiens
ggagccaaggucuggagua

SEQ ID NO: 1531323 - RNA, 19 nt, Homo sapiens
cgaaacaacgucggcuuug

SEQ ID NO: 1531324 - RNA, 19 nt, Homo sapiens
ggucuggaguauguaagga

SEQ ID NO: 1531325 - RNA, 19 nt, Homo sapiens
ugcuggaacuccuggauga

SEQ ID NO: 1531326 - RNA, 19 nt, Homo sapiens
gcucugcugguaccacauu

SEQ ID NO: 1531327 - RNA, 19 nt, Homo sapiens
auagaacugucguaaaggu

SEQ ID NO: 1531328 - RNA, 19 nt, Homo sapiens
ggaggaguuuucccgcuuu

SEQ ID NO: 1531329 - RNA, 19 nt, Homo sapiens
cggcagcuuuggugcaugu

SEQ ID NO: 1531330 - RNA, 19 nt, Homo sapiens
cugaauugcccuugcugua

SEQ ID NO: 1531331 - RNA, 19 nt, Homo sapiens
caggaugcuuaguuucuag

SEQ ID NO: 1531332 - RNA, 19 nt, Homo sapiens
uggaaacggccucuucaga

SEQ ID NO: 1531333 - RNA, 19 nt, Homo sapiens
ggcccaugcugcuccacaa

SEQ ID NO: 1531334 - RNA, 19 nt, Homo sapiens
cagcagcuucauucaagaa

SEQ ID NO: 1531335 - RNA, 19 nt, Homo sapiens
ucagcagcuucauucaaga

SEQ ID NO: 1531336 - RNA, 19 nt, Homo sapiens
cagcuuuggugcaugugau

SEQ ID NO: 1531337 - RNA, 19 nt, Homo sapiens
guguuuggcugugcugaau

SEQ ID NO: 1531338 - RNA, 19 nt, Homo sapiens
agaucgggcugucucuuuc

SEQ ID NO: 1531339 - RNA, 19 nt, Homo sapiens
aggaggagauaggcacuga

SEQ ID NO: 1531340 - RNA, 19 nt, Homo sapiens
ccauggaaacggccucuuc

SEQ ID NO: 1531341 - RNA, 19 nt, Homo sapiens
gaaugcaacagcacuucuc

SEQ ID NO: 1531342 - RNA, 19 nt, Homo sapiens
uucagcagcuucauucaag

SEQ ID NO: 1531343 - RNA, 19 nt, Homo sapiens
cagcugccucuuucccuaa

SEQ ID NO: 1531344 - RNA, 19 nt, Homo sapiens
ggaaacgccgaaacaacgu

SEQ ID NO: 1531345 - RNA, 19 nt, Homo sapiens
uguagaagggagagaaguu

SEQ ID NO: 1531346 - RNA, 19 nt, Homo sapiens
gaggagguggagcggcuuu

SEQ ID NO: 1531347 - RNA, 19 nt, Homo sapiens
gcuggaaacgccgaaacaa

SEQ ID NO: 1531348 - RNA, 19 nt, Homo sapiens
cauggaaacggccucuuca

SEQ ID NO: 1531349 - RNA, 19 nt, Homo sapiens
gaggaggugguuugaaugc

SEQ ID NO: 1531350 - RNA, 19 nt, Homo sapiens
gaguggcagucguccaaac

SEQ ID NO: 1531351 - RNA, 19 nt, Homo sapiens
uaucaugggccaggacuuc

SEQ ID NO: 1531352 - RNA, 19 nt, Homo sapiens
gguaagagcuggcuucugu

SEQ ID NO: 1531353 - RNA, 19 nt, Homo sapiens
gcaaguaccugcagaagca

SEQ ID NO: 1531354 - RNA, 19 nt, Homo sapiens
gaaggucaguguauuuagu

SEQ ID NO: 1531355 - RNA, 19 nt, Homo sapiens
ccaccugucccuucuauuu

SEQ ID NO: 1531356 - RNA, 19 nt, Homo sapiens
gaccagaggagucaagaaa

SEQ ID NO: 1531357 - RNA, 19 nt, Homo sapiens
gcgaaggucaguguauuua

SEQ ID NO: 1531358 - RNA, 19 nt, Homo sapiens
ggacaagggcugcuguuuc

SEQ ID NO: 1531359 - RNA, 19 nt, Homo sapiens
gucaguguauuuaguguaa

SEQ ID NO: 1531360 - RNA, 19 nt, Homo sapiens
caucagguguccuacgauu

SEQ ID NO: 1531361 - RNA, 19 nt, Homo sapiens
gaucuacucagcuucauug

SEQ ID NO: 1531362 - RNA, 19 nt, Homo sapiens
gacaagggcugcuguuucg

SEQ ID NO: 1531363 - RNA, 19 nt, Homo sapiens
gaagaacgaugggaaaaug

SEQ ID NO: 1531364 - RNA, 19 nt, Homo sapiens
cagcgaaggucaguguauu

SEQ ID NO: 1531365 - RNA, 19 nt, Homo sapiens
cuacucagcuucauugacu

SEQ ID NO: 1531366 - RNA, 19 nt, Homo sapiens
aucacaaccucaaguguua

SEQ ID NO: 1531367 - RNA, 19 nt, Homo sapiens
gaggcacgcuucccuucau

SEQ ID NO: 1531368 - RNA, 19 nt, Homo sapiens
ggguuucuccuaaaucuga

SEQ ID NO: 1531369 - RNA, 19 nt, Homo sapiens
acacguuuguagguucuua

SEQ ID NO: 1531370 - RNA, 19 nt, Homo sapiens
gcaaucugccuccguccuu

SEQ ID NO: 1531371 - RNA, 19 nt, Homo sapiens
aaaugcacguggagaugaa

SEQ ID NO: 1531372 - RNA, 19 nt, Homo sapiens
ucuaaacaguguccuaguc

SEQ ID NO: 1531373 - RNA, 19 nt, Homo sapiens
gcacgcuucccuucauuag

SEQ ID NO: 1531374 - RNA, 19 nt, Homo sapiens
aaucacaaccucaaguguu

SEQ ID NO: 1531375 - RNA, 19 nt, Homo sapiens
uccuaaaucugaagaacga

SEQ ID NO: 1531376 - RNA, 19 nt, Homo sapiens
ggucaguguauuuagugua

SEQ ID NO: 1531377 - RNA, 19 nt, Homo sapiens
ggagaugaaaccagauuuu

SEQ ID NO: 1531378 - RNA, 19 nt, Homo sapiens
cuccguggguuucuccuaa

SEQ ID NO: 1531379 - RNA, 19 nt, Homo sapiens
guggguuucuccuaaaucu

SEQ ID NO: 1531380 - RNA, 19 nt, Homo sapiens
gaagacgaguuggggauug

SEQ ID NO: 1531381 - RNA, 19 nt, Homo sapiens
aaagagaugaagacgaguu

SEQ ID NO: 1531382 - RNA, 19 nt, Homo sapiens
gcaccgggacugacuucga

SEQ ID NO: 1531383 - RNA, 19 nt, Homo sapiens
ggaggcggcagucuugcuu

SEQ ID NO: 1531384 - RNA, 19 nt, Homo sapiens
guagccaccugucccuucu

SEQ ID NO: 1531385 - RNA, 19 nt, Homo sapiens
guaagagcuggcuucugua

SEQ ID NO: 1531386 - RNA, 19 nt, Homo sapiens
ggaccagaggagucaagaa

SEQ ID NO: 1531387 - RNA, 19 nt, Homo sapiens
guaauuaccccuucuaaac

SEQ ID NO: 1531388 - RNA, 19 nt, Homo sapiens
uaagagcuggcuucuguag

SEQ ID NO: 1531389 - RNA, 19 nt, Homo sapiens
ccagaggagucaagaaacc

SEQ ID NO: 1531390 - RNA, 19 nt, Homo sapiens
acgcuucccuucauuagag

SEQ ID NO: 1531391 - RNA, 19 nt, Homo sapiens
ggcacgcuucccuucauua

SEQ ID NO: 1531392 - RNA, 19 nt, Homo sapiens
cccaucagguguccuacga

SEQ ID NO: 1531393 - RNA, 19 nt, Homo sapiens
ggagucaagaaaccaagau

SEQ ID NO: 1531394 - RNA, 19 nt, Homo sapiens
gaaaaugcacguggagaug

SEQ ID NO: 1531395 - RNA, 19 nt, Homo sapiens
guggagaugaaaccagauu

SEQ ID NO: 1531396 - RNA, 19 nt, Homo sapiens
ggugggaaaccuacuguac

SEQ ID NO: 1531397 - RNA, 19 nt, Homo sapiens
gcaagucgaagcggaaggu

SEQ ID NO: 1531398 - RNA, 19 nt, Homo sapiens
ucagguguccuacgauuac

SEQ ID NO: 1531399 - RNA, 19 nt, Homo sapiens
cggaggccguggaguucuu

SEQ ID NO: 1531400 - RNA, 19 nt, Homo sapiens
gcaaagugcuucagaacaa

SEQ ID NO: 1531401 - RNA, 19 nt, Homo sapiens
gcaaauaucaguagcuuaa

SEQ ID NO: 1531402 - RNA, 19 nt, Homo sapiens
ccucagauaucuucauuua

SEQ ID NO: 1531403 - RNA, 19 nt, Homo sapiens
gcugaaggcuaccaaguua

SEQ ID NO: 1531404 - RNA, 19 nt, Homo sapiens
ggauuuagaugugcaauaa

SEQ ID NO: 1531405 - RNA, 19 nt, Homo sapiens
gcaaacauguaucagcaua

SEQ ID NO: 1531406 - RNA, 19 nt, Homo sapiens
gaagaccuguccaccaauu

SEQ ID NO: 1531407 - RNA, 19 nt, Homo sapiens
gacgugaucuauagaguaa

SEQ ID NO: 1531408 - RNA, 19 nt, Homo sapiens
gcaacacccugcagcguuu

SEQ ID NO: 1531409 - RNA, 19 nt, Homo sapiens
gcagugagaugugccauug

SEQ ID NO: 1531410 - RNA, 19 nt, Homo sapiens
guagauaguuaggcuuaua

SEQ ID NO: 1531411 - RNA, 19 nt, Homo sapiens
gaaacuagaggaacgcuuu

SEQ ID NO: 1531412 - RNA, 19 nt, Homo sapiens
gagaucaaguucuuuaaca

SEQ ID NO: 1531413 - RNA, 19 nt, Homo sapiens
cacaagauuugccagauuu

SEQ ID NO: 1531414 - RNA, 19 nt, Homo sapiens
uagcagacgugaucuauag

SEQ ID NO: 1531415 - RNA, 19 nt, Homo sapiens
gaacaaacaggcagagauc

SEQ ID NO: 1531416 - RNA, 19 nt, Homo sapiens
gagaauagcagccucuuca

SEQ ID NO: 1531417 - RNA, 19 nt, Homo sapiens
ucugcaagcuuagauaaua

SEQ ID NO: 1531418 - RNA, 19 nt, Homo sapiens
uaaauuagcagcuucuaug

SEQ ID NO: 1531419 - RNA, 19 nt, Homo sapiens
gacagcaacuugagaguca

SEQ ID NO: 1531420 - RNA, 19 nt, Homo sapiens
guaaagaugauaucccauu

SEQ ID NO: 1531421 - RNA, 19 nt, Homo sapiens
gaccgucacuagagagaaa

SEQ ID NO: 1531422 - RNA, 19 nt, Homo sapiens
cuaccaaguuacauaauga

SEQ ID NO: 1531423 - RNA, 19 nt, Homo sapiens
ccaauuacagggcuccuua

SEQ ID NO: 1531424 - RNA, 19 nt, Homo sapiens
ugaggaggcgaaaguauua

SEQ ID NO: 1531425 - RNA, 19 nt, Homo sapiens
gccaggcucugaaggauga

SEQ ID NO: 1531426 - RNA, 19 nt, Homo sapiens
gcuaccaaguuacauaaug

SEQ ID NO: 1531427 - RNA, 19 nt, Homo sapiens
ggagaggugugcucaggau

SEQ ID NO: 1531428 - RNA, 19 nt, Homo sapiens
acacaagauuugccagauu

SEQ ID NO: 1531429 - RNA, 19 nt, Homo sapiens
ccagaaggccuacgaugaa

SEQ ID NO: 1531430 - RNA, 19 nt, Homo sapiens
caaagugcuucagaacaaa

SEQ ID NO: 1531431 - RNA, 19 nt, Homo sapiens
gaagaggagacggaguuua

SEQ ID NO: 1531432 - RNA, 19 nt, Homo sapiens
caugaaugcuuugcagaaa

SEQ ID NO: 1531433 - RNA, 19 nt, Homo sapiens
cagcuucuaugauuuaagu

SEQ ID NO: 1531434 - RNA, 19 nt, Homo sapiens
uagcagcuucuaugauuua

SEQ ID NO: 1531435 - RNA, 19 nt, Homo sapiens
uaucuucuccuacccauaa

SEQ ID NO: 1531436 - RNA, 19 nt, Homo sapiens
cuuauagucucccauaguu

SEQ ID NO: 1531437 - RNA, 19 nt, Homo sapiens
gagaugugccauugugaaa

SEQ ID NO: 1531438 - RNA, 19 nt, Homo sapiens
caaucuaagugcagugaga

SEQ ID NO: 1531439 - RNA, 19 nt, Homo sapiens
augcagagcuggaggagaa

SEQ ID NO: 1531440 - RNA, 19 nt, Homo sapiens
gaauaccucucaaaauaga

SEQ ID NO: 1531441 - RNA, 19 nt, Homo sapiens
auuagcagcuucuaugauu

SEQ ID NO: 1531442 - RNA, 19 nt, Homo sapiens
ggagauagcaaaugaagac

SEQ ID NO: 1531443 - RNA, 19 nt, Homo sapiens
aagaggagacggaguuuaa

SEQ ID NO: 1531444 - RNA, 19 nt, Homo sapiens
aauaugacuuggugccuuu

SEQ ID NO: 1531445 - RNA, 19 nt, Homo sapiens
cuaguaguaucuucuccua

SEQ ID NO: 1531446 - RNA, 19 nt, Homo sapiens
cugaagaccuguccaccaa

SEQ ID NO: 1531447 - RNA, 19 nt, Homo sapiens
gcacaauuacccacuguag

SEQ ID NO: 1531448 - RNA, 19 nt, Homo sapiens
gcaagaguaaagaugauau

SEQ ID NO: 1531449 - RNA, 19 nt, Homo sapiens
ggagacggaguuuaaggaa

SEQ ID NO: 1531450 - RNA, 19 nt, Homo sapiens
gauuguaagcaaacaugua

SEQ ID NO: 1531451 - RNA, 19 nt, Homo sapiens
uaguugagauuguaagcaa

SEQ ID NO: 1531452 - RNA, 19 nt, Homo sapiens
cuagaggaacgcuuuauga

SEQ ID NO: 1531453 - RNA, 19 nt, Homo sapiens
gcacaaaaggcaacucaaa

SEQ ID NO: 1531454 - RNA, 19 nt, Homo sapiens
cugcagcuguccauugaaa

SEQ ID NO: 1531455 - RNA, 19 nt, Homo sapiens
ucccauaguugagauugua

SEQ ID NO: 1531456 - RNA, 19 nt, Homo sapiens
ccuagaauacacaagauuu

SEQ ID NO: 1531457 - RNA, 19 nt, Homo sapiens
guucucaaagguaguuaua

SEQ ID NO: 1531458 - RNA, 19 nt, Homo sapiens
aaaggcaacucaaagaaaa

SEQ ID NO: 1531459 - RNA, 19 nt, Homo sapiens
gcaaggagagagaacucaa

SEQ ID NO: 1531460 - RNA, 19 nt, Homo sapiens
ugaguacagucggaaacua

SEQ ID NO: 1531461 - RNA, 19 nt, Homo sapiens
gagauuguaagcaaacaug

SEQ ID NO: 1531462 - RNA, 19 nt, Homo sapiens
uacccacuguagauaguua

SEQ ID NO: 1531463 - RNA, 19 nt, Homo sapiens
gcacagcuuggaucuuuua

SEQ ID NO: 1531464 - RNA, 19 nt, Homo sapiens
ggaagaggagacggaguuu

SEQ ID NO: 1531465 - RNA, 19 nt, Homo sapiens
uauagucucccauaguuga

SEQ ID NO: 1531466 - RNA, 19 nt, Homo sapiens
caauuacccacuguagaua

SEQ ID NO: 1531467 - RNA, 19 nt, Homo sapiens
gcaauaaugcaaauaucag

SEQ ID NO: 1531468 - RNA, 19 nt, Homo sapiens
caaacauguaucagcauaa

SEQ ID NO: 1531469 - RNA, 19 nt, Homo sapiens
acaauuacccacuguagau

SEQ ID NO: 1531470 - RNA, 19 nt, Homo sapiens
aaccucagauaucuucauu

SEQ ID NO: 1531471 - RNA, 19 nt, Homo sapiens
gagagaacucaauggcaaa

SEQ ID NO: 1531472 - RNA, 19 nt, Homo sapiens
ccaagagacccuagcaaca

SEQ ID NO: 1531473 - RNA, 19 nt, Homo sapiens
gaugaggaggcgaaaguau

SEQ ID NO: 1531474 - RNA, 19 nt, Homo sapiens
aaacuagaggaacgcuuua

SEQ ID NO: 1531475 - RNA, 19 nt, Homo sapiens
gaaggucaauuuuauucug

SEQ ID NO: 1531476 - RNA, 19 nt, Homo sapiens
gagcuucagcgcaaaguag

SEQ ID NO: 1531477 - RNA, 19 nt, Homo sapiens
aguuggagauagcaaauga

SEQ ID NO: 1531478 - RNA, 19 nt, Homo sapiens
gaaaguauuacagcucaca

SEQ ID NO: 1531479 - RNA, 19 nt, Homo sapiens
aagcugaggcuggagaaua

SEQ ID NO: 1531480 - RNA, 19 nt, Homo sapiens
uauuugcgucuuagcauua

SEQ ID NO: 1531481 - RNA, 19 nt, Homo sapiens
ggaugaggaggcgaaagua

SEQ ID NO: 1531482 - RNA, 19 nt, Homo sapiens
cugcaagcuuagauaauau

SEQ ID NO: 1531483 - RNA, 19 nt, Homo sapiens
cagcauaauagcaugaaug

SEQ ID NO: 1531484 - RNA, 19 nt, Homo sapiens
ugaagaacgcuuagagaag

SEQ ID NO: 1531485 - RNA, 19 nt, Homo sapiens
uuagcagcuucuaugauuu

SEQ ID NO: 1531486 - RNA, 19 nt, Homo sapiens
ugagggaggagaaugagaa

SEQ ID NO: 1531487 - RNA, 19 nt, Homo sapiens
cugaagaacgcuuagagaa

SEQ ID NO: 1531488 - RNA, 19 nt, Homo sapiens
agacgugaucuauagagua

SEQ ID NO: 1531489 - RNA, 19 nt, Homo sapiens
aaaagaggauuuagaugug

SEQ ID NO: 1531490 - RNA, 19 nt, Homo sapiens
uguaugagcaauaugauuc

SEQ ID NO: 1531491 - RNA, 19 nt, Homo sapiens
ggcaagaguaaagaugaua

SEQ ID NO: 1531492 - RNA, 19 nt, Homo sapiens
gaucugccagcuugaggaa

SEQ ID NO: 1531493 - RNA, 19 nt, Homo sapiens
cuagaauacacaagauuug

SEQ ID NO: 1531494 - RNA, 19 nt, Homo sapiens
acaccuagaauacacaaga

SEQ ID NO: 1531495 - RNA, 19 nt, Homo sapiens
cgccuaugcuccagaaaca

SEQ ID NO: 1531496 - RNA, 19 nt, Homo sapiens
ugagggaagccuuggcaaa

SEQ ID NO: 1531497 - RNA, 19 nt, Homo sapiens
acauguaucagcauaauag

SEQ ID NO: 1531498 - RNA, 19 nt, Homo sapiens
aaauuagcagcuucuauga

SEQ ID NO: 1531499 - RNA, 19 nt, Homo sapiens
cuagagagaaagaggaguu

SEQ ID NO: 1531500 - RNA, 19 nt, Homo sapiens
caagaaagguggcaaggua

SEQ ID NO: 1531501 - RNA, 19 nt, Homo sapiens
gaacaagugucuccaaugu

SEQ ID NO: 1531502 - RNA, 19 nt, Homo sapiens
gugcaaaucuguagaguaa

SEQ ID NO: 1531503 - RNA, 19 nt, Homo sapiens
ggacuccacuuauaaauau

SEQ ID NO: 1531504 - RNA, 19 nt, Homo sapiens
gaagaaagaucugcuacaa

SEQ ID NO: 1531505 - RNA, 19 nt, Homo sapiens
gacaaggacuccacuuaua

SEQ ID NO: 1531506 - RNA, 19 nt, Homo sapiens
ggaaauauuugaacaagug

SEQ ID NO: 1531507 - RNA, 19 nt, Homo sapiens
gaaacccagucuucauuua

SEQ ID NO: 1531508 - RNA, 19 nt, Homo sapiens
gaagaaagcucagucucaa

SEQ ID NO: 1531509 - RNA, 19 nt, Homo sapiens
gcaugugcauucagaaaua

SEQ ID NO: 1531510 - RNA, 19 nt, Homo sapiens
aaacaaagaugcucuguag

SEQ ID NO: 1531511 - RNA, 19 nt, Homo sapiens
gcaugagaauucaacauaa

SEQ ID NO: 1531512 - RNA, 19 nt, Homo sapiens
caacaugucuugcauuucu

SEQ ID NO: 1531513 - RNA, 19 nt, Homo sapiens
ugaaaugacugacccugua

SEQ ID NO: 1531514 - RNA, 19 nt, Homo sapiens
gggcaacacugaccauuug

SEQ ID NO: 1531515 - RNA, 19 nt, Homo sapiens
ugucagaucuguuucaauu

SEQ ID NO: 1531516 - RNA, 19 nt, Homo sapiens
guauuuaaguccugcauuu

SEQ ID NO: 1531517 - RNA, 19 nt, Homo sapiens
gcucucaucuaacuucuuu

SEQ ID NO: 1531518 - RNA, 19 nt, Homo sapiens
gaagaucuccuguauuuua

SEQ ID NO: 1531519 - RNA, 19 nt, Homo sapiens
caagauaccaggugaauug

SEQ ID NO: 1531520 - RNA, 19 nt, Homo sapiens
gcucaaauucccaauauaa

SEQ ID NO: 1531521 - RNA, 19 nt, Homo sapiens
uaaaugcgguagauucaaa

SEQ ID NO: 1531522 - RNA, 19 nt, Homo sapiens
caauauaaguggaccaguu

SEQ ID NO: 1531523 - RNA, 19 nt, Homo sapiens
gcaauaaaccgagaaauca

SEQ ID NO: 1531524 - RNA, 19 nt, Homo sapiens
acaaguacgugauaaauuc

SEQ ID NO: 1531525 - RNA, 19 nt, Homo sapiens
agaaagaucugcuacaagu

SEQ ID NO: 1531526 - RNA, 19 nt, Homo sapiens
gguagauucuugaccuuaa

SEQ ID NO: 1531527 - RNA, 19 nt, Homo sapiens
ugacugacccuguaguaua

SEQ ID NO: 1531528 - RNA, 19 nt, Homo sapiens
uguaagcucuugggcauua

SEQ ID NO: 1531529 - RNA, 19 nt, Homo sapiens
uauagaugcucaugaagaa

SEQ ID NO: 1531530 - RNA, 19 nt, Homo sapiens
cauaaacugucaaauguuc

SEQ ID NO: 1531531 - RNA, 19 nt, Homo sapiens
gauaccaggugaauuguuc

SEQ ID NO: 1531532 - RNA, 19 nt, Homo sapiens
cacaacaugucuugcauuu

SEQ ID NO: 1531533 - RNA, 19 nt, Homo sapiens
gcaaaucuguagaguaaaa

SEQ ID NO: 1531534 - RNA, 19 nt, Homo sapiens
cagcucaaauucccaauau

SEQ ID NO: 1531535 - RNA, 19 nt, Homo sapiens
gaauuccuguuuccucuug

SEQ ID NO: 1531536 - RNA, 19 nt, Homo sapiens
cgagaaaucaugagaaaug

SEQ ID NO: 1531537 - RNA, 19 nt, Homo sapiens
ggugacagauacagaaaug

SEQ ID NO: 1531538 - RNA, 19 nt, Homo sapiens
ugaagcaagugguauguga

SEQ ID NO: 1531539 - RNA, 19 nt, Homo sapiens
gcaacagcuuggaagauga

SEQ ID NO: 1531540 - RNA, 19 nt, Homo sapiens
ggugugcacugucaucuug

SEQ ID NO: 1531541 - RNA, 19 nt, Homo sapiens
uauaguacgugauagaguu

SEQ ID NO: 1531542 - RNA, 19 nt, Homo sapiens
ccaguuagaauuccuguuu

SEQ ID NO: 1531543 - RNA, 19 nt, Homo sapiens
ggcaugagaauucaacaua

SEQ ID NO: 1531544 - RNA, 19 nt, Homo sapiens
cuuuacagcucucaucuaa

SEQ ID NO: 1531545 - RNA, 19 nt, Homo sapiens
aaugugaccuucucuaaau

SEQ ID NO: 1531546 - RNA, 19 nt, Homo sapiens
caagccaucucacaaaaua

SEQ ID NO: 1531547 - RNA, 19 nt, Homo sapiens
gaggaaauauuugaacaag

SEQ ID NO: 1531548 - RNA, 19 nt, Homo sapiens
aagcagggcuaauuccaaa

SEQ ID NO: 1531549 - RNA, 19 nt, Homo sapiens
gcaaauggagaguaacaga

SEQ ID NO: 1531550 - RNA, 19 nt, Homo sapiens
gagaaaucaugagaaaugu

SEQ ID NO: 1531551 - RNA, 19 nt, Homo sapiens
guagauucuugaccuuaaa

SEQ ID NO: 1531552 - RNA, 19 nt, Homo sapiens
gaaagaucugcuacaagua

SEQ ID NO: 1531553 - RNA, 19 nt, Homo sapiens
gagaguaacagaagagugu

SEQ ID NO: 1531554 - RNA, 19 nt, Homo sapiens
acaagugucuccaaugugu

SEQ ID NO: 1531555 - RNA, 19 nt, Homo sapiens
uguauucaauggacuguaa

SEQ ID NO: 1531556 - RNA, 19 nt, Homo sapiens
ggaagaugauugcaugcau

SEQ ID NO: 1531557 - RNA, 19 nt, Homo sapiens
ggcaacagcuuggaagaug

SEQ ID NO: 1531558 - RNA, 19 nt, Homo sapiens
gaugcucuguagacaagua

SEQ ID NO: 1531559 - RNA, 19 nt, Homo sapiens
caaagaugcucuguagaca

SEQ ID NO: 1531560 - RNA, 19 nt, Homo sapiens
gcaugcauccucauaauca

SEQ ID NO: 1531561 - RNA, 19 nt, Homo sapiens
gaauuguucugaguguuga

SEQ ID NO: 1531562 - RNA, 19 nt, Homo sapiens
gcagguugaugaugagauc

SEQ ID NO: 1531563 - RNA, 19 nt, Homo sapiens
uaaauggccugugauucuu

SEQ ID NO: 1531564 - RNA, 19 nt, Homo sapiens
agaggcaaauggagaguaa

SEQ ID NO: 1531565 - RNA, 19 nt, Homo sapiens
acugcuggcuucuuuauuu

SEQ ID NO: 1531566 - RNA, 19 nt, Homo sapiens
gauauccuguggcugaaga

SEQ ID NO: 1531567 - RNA, 19 nt, Homo sapiens
gcugaauacuauccucuau

SEQ ID NO: 1531568 - RNA, 19 nt, Homo sapiens
acaaggacuccacuuauaa

SEQ ID NO: 1531569 - RNA, 19 nt, Homo sapiens
caaggacuccacuuauaaa

SEQ ID NO: 1531570 - RNA, 19 nt, Homo sapiens
uuacagcucucaucuaacu

SEQ ID NO: 1531571 - RNA, 19 nt, Homo sapiens
cucauaaacugucaaaugu

SEQ ID NO: 1531572 - RNA, 19 nt, Homo sapiens
ucuccaauguguuguguuu

SEQ ID NO: 1531573 - RNA, 19 nt, Homo sapiens
gaugagaucccagugagaa

SEQ ID NO: 1531574 - RNA, 19 nt, Homo sapiens
ccucauaaacugucaaaug

SEQ ID NO: 1531575 - RNA, 19 nt, Homo sapiens
aaacuaacagcucaaauuc

SEQ ID NO: 1531576 - RNA, 19 nt, Homo sapiens
gaaaucaugagaaaugucu

SEQ ID NO: 1531577 - RNA, 19 nt, Homo sapiens
caucaaacuucccagcaau

SEQ ID NO: 1531578 - RNA, 19 nt, Homo sapiens
gacugacccuguaguauag

SEQ ID NO: 1531579 - RNA, 19 nt, Homo sapiens
gugacaaggacuccacuua

SEQ ID NO: 1531580 - RNA, 19 nt, Homo sapiens
gagacucggugacagauac

SEQ ID NO: 1531581 - RNA, 19 nt, Homo sapiens
gaauuaaaccugcgaaucc

SEQ ID NO: 1531582 - RNA, 19 nt, Homo sapiens
gaccaucccugcugaacag

SEQ ID NO: 1531583 - RNA, 19 nt, Homo sapiens
ucagaucuguuucaauuac

SEQ ID NO: 1531584 - RNA, 19 nt, Homo sapiens
ugacagauacagaaaugaa

SEQ ID NO: 1531585 - RNA, 19 nt, Homo sapiens
agaaagcucagucucaauu

SEQ ID NO: 1531586 - RNA, 19 nt, Homo sapiens
aagcuaauacugcuaauug

SEQ ID NO: 1531587 - RNA, 19 nt, Homo sapiens
gaaagacaagcagggcuaa

SEQ ID NO: 1531588 - RNA, 19 nt, Homo sapiens
ugacaaggacuccacuuau

SEQ ID NO: 1531589 - RNA, 19 nt, Homo sapiens
guggaccaguuccucauaa

SEQ ID NO: 1531590 - RNA, 19 nt, Homo sapiens
caaauucccaauauaagug

SEQ ID NO: 1531591 - RNA, 19 nt, Homo sapiens
gaaagcucagucucaauug

SEQ ID NO: 1531592 - RNA, 19 nt, Homo sapiens
gaguuaagccaguuagaau

SEQ ID NO: 1531593 - RNA, 19 nt, Homo sapiens
ccaugaguguugugacuga

SEQ ID NO: 1531594 - RNA, 19 nt, Homo sapiens
gcacugcuggcuucuuuau

SEQ ID NO: 1531595 - RNA, 19 nt, Homo sapiens
caaacaaagaugcucugua

SEQ ID NO: 1531596 - RNA, 19 nt, Homo sapiens
caggagggcgcuuggauuu

SEQ ID NO: 1531597 - RNA, 19 nt, Homo sapiens
ucuugugggugccaacuua

SEQ ID NO: 1531598 - RNA, 19 nt, Homo sapiens
ccugugagcuugccauuac

SEQ ID NO: 1531599 - RNA, 19 nt, Homo sapiens
acuaaugugugugaugaua

SEQ ID NO: 1531600 - RNA, 19 nt, Homo sapiens
gaacaaauauguagugagu

SEQ ID NO: 1531601 - RNA, 19 nt, Homo sapiens
gcaaguugauucucauuaa

SEQ ID NO: 1531602 - RNA, 19 nt, Homo sapiens
gaacuuggaugccagcaaa

SEQ ID NO: 1531603 - RNA, 19 nt, Homo sapiens
caaaugaacuugcuugugu

SEQ ID NO: 1531604 - RNA, 19 nt, Homo sapiens
guccagauaugaacaaaua

SEQ ID NO: 1531605 - RNA, 19 nt, Homo sapiens
caagagaggugaagaaagu

SEQ ID NO: 1531606 - RNA, 19 nt, Homo sapiens
gaucagauguaaaugaguu

SEQ ID NO: 1531607 - RNA, 19 nt, Homo sapiens
gagaacacaugcaaaugaa

SEQ ID NO: 1531608 - RNA, 19 nt, Homo sapiens
gaaagguuaucuuaaaugg

SEQ ID NO: 1531609 - RNA, 19 nt, Homo sapiens
ggaggcaucuuacauuuag

SEQ ID NO: 1531610 - RNA, 19 nt, Homo sapiens
gcucacauguaaucccuua

SEQ ID NO: 1531611 - RNA, 19 nt, Homo sapiens
gggaugacaugauaugcua

SEQ ID NO: 1531612 - RNA, 19 nt, Homo sapiens
uaacuaagcauuuguguuc

SEQ ID NO: 1531613 - RNA, 19 nt, Homo sapiens
aaacacaucccagacauua

SEQ ID NO: 1531614 - RNA, 19 nt, Homo sapiens
caguauggaugaagacuuu

SEQ ID NO: 1531615 - RNA, 19 nt, Homo sapiens
gaaaguggaugugcagagu

SEQ ID NO: 1531616 - RNA, 19 nt, Homo sapiens
ugaaagggaggcucucuua

SEQ ID NO: 1531617 - RNA, 19 nt, Homo sapiens
gaugagauauacuacuguu

SEQ ID NO: 1531618 - RNA, 19 nt, Homo sapiens
uaucuuaaauggcuaccua

SEQ ID NO: 1531619 - RNA, 19 nt, Homo sapiens
ccauuagccuguaaacaaa

SEQ ID NO: 1531620 - RNA, 19 nt, Homo sapiens
gaagaagacagcacugaug

SEQ ID NO: 1531621 - RNA, 19 nt, Homo sapiens
ggagacagauaaguauaga

SEQ ID NO: 1531622 - RNA, 19 nt, Homo sapiens
gaacuugcuuguguguauu

SEQ ID NO: 1531623 - RNA, 19 nt, Homo sapiens
acaaugcacugacuuuaga

SEQ ID NO: 1531624 - RNA, 19 nt, Homo sapiens
gcucuggcuuucugauuaa

SEQ ID NO: 1531625 - RNA, 19 nt, Homo sapiens
gggaggagacagauaagua

SEQ ID NO: 1531626 - RNA, 19 nt, Homo sapiens
gaaagggaggcucucuuaa

SEQ ID NO: 1531627 - RNA, 19 nt, Homo sapiens
cuuaagcgauuucaauuug

SEQ ID NO: 1531628 - RNA, 19 nt, Homo sapiens
gggaagaugagauauacua

SEQ ID NO: 1531629 - RNA, 19 nt, Homo sapiens
caagcaauccuccugagua

SEQ ID NO: 1531630 - RNA, 19 nt, Homo sapiens
gggagcaguugccaauauu

SEQ ID NO: 1531631 - RNA, 19 nt, Homo sapiens
guggaggcaucuuacauuu

SEQ ID NO: 1531632 - RNA, 19 nt, Homo sapiens
ggcaauggcuacagcaaug

SEQ ID NO: 1531633 - RNA, 19 nt, Homo sapiens
ggaaagguuaucuuaaaug

SEQ ID NO: 1531634 - RNA, 19 nt, Homo sapiens
caguagucauugaaaguua

SEQ ID NO: 1531635 - RNA, 19 nt, Homo sapiens
ugaacuugcuuguguguau

SEQ ID NO: 1531636 - RNA, 19 nt, Homo sapiens
agacagcacugaugaccaa

SEQ ID NO: 1531637 - RNA, 19 nt, Homo sapiens
aagcauuuguguucugaua

SEQ ID NO: 1531638 - RNA, 19 nt, Homo sapiens
gcaauggucagcuuggaaa

SEQ ID NO: 1531639 - RNA, 19 nt, Homo sapiens
gcacugaugaccaaagaga

SEQ ID NO: 1531640 - RNA, 19 nt, Homo sapiens
caacaaagaagcuggaucu

SEQ ID NO: 1531641 - RNA, 19 nt, Homo sapiens
ucacauguaaucccuuaua

SEQ ID NO: 1531642 - RNA, 19 nt, Homo sapiens
gcagcacacucuugagcuu

SEQ ID NO: 1531643 - RNA, 19 nt, Homo sapiens
guaaaugaucaguggauaa

SEQ ID NO: 1531644 - RNA, 19 nt, Homo sapiens
aagggaggcucucuuaaga

SEQ ID NO: 1531645 - RNA, 19 nt, Homo sapiens
cuuccacccuuccugauua

SEQ ID NO: 1531646 - RNA, 19 nt, Homo sapiens
uuaaaugccuucccacaca

SEQ ID NO: 1531647 - RNA, 19 nt, Homo sapiens
auagcuagaucaccaguuu

SEQ ID NO: 1531648 - RNA, 19 nt, Homo sapiens
ggaggagacagauaaguau

SEQ ID NO: 1531649 - RNA, 19 nt, Homo sapiens
gcauuuguguucugauauc

SEQ ID NO: 1531650 - RNA, 19 nt, Homo sapiens
gucuagggaugacaugaua

SEQ ID NO: 1531651 - RNA, 19 nt, Homo sapiens
uguaagacccacugcuuua

SEQ ID NO: 1531652 - RNA, 19 nt, Homo sapiens
cuuauaggauuccaaaguu

SEQ ID NO: 1531653 - RNA, 19 nt, Homo sapiens
ccucauagguaguaauuac

SEQ ID NO: 1531654 - RNA, 19 nt, Homo sapiens
caagcaguauggaugaaga

SEQ ID NO: 1531655 - RNA, 19 nt, Homo sapiens
caccgacucugccuacauu

SEQ ID NO: 1531656 - RNA, 19 nt, Homo sapiens
gcucugcuguguugucuuc

SEQ ID NO: 1531657 - RNA, 19 nt, Homo sapiens
gaggagacagauaaguaua

SEQ ID NO: 1531658 - RNA, 19 nt, Homo sapiens
gcacaauuucugccaaaga

SEQ ID NO: 1531659 - RNA, 19 nt, Homo sapiens
cuaauaaugcucuggcuuu

SEQ ID NO: 1531660 - RNA, 19 nt, Homo sapiens
aaagcaagaucaugaaggu

SEQ ID NO: 1531661 - RNA, 19 nt, Homo sapiens
cagcacugaugaccaaaga

SEQ ID NO: 1531662 - RNA, 19 nt, Homo sapiens
gcaugaagcauauggcaau

SEQ ID NO: 1531663 - RNA, 19 nt, Homo sapiens
gggaucagauguaaaugag

SEQ ID NO: 1531664 - RNA, 19 nt, Homo sapiens
gagcaguugccaauauuug

SEQ ID NO: 1531665 - RNA, 19 nt, Homo sapiens
ggugugcaaaugauucuua

SEQ ID NO: 1531666 - RNA, 19 nt, Homo sapiens
ucaggcagaucccaccauu

SEQ ID NO: 1531667 - RNA, 19 nt, Homo sapiens
cauguaaucccuuauagga

SEQ ID NO: 1531668 - RNA, 19 nt, Homo sapiens
guuucuguguuucauguua

SEQ ID NO: 1531669 - RNA, 19 nt, Homo sapiens
ugacaaugcacugacuuua

SEQ ID NO: 1531670 - RNA, 19 nt, Homo sapiens
agagaacacaugcaaauga

SEQ ID NO: 1531671 - RNA, 19 nt, Homo sapiens
guagugaguauagaguuua

SEQ ID NO: 1531672 - RNA, 19 nt, Homo sapiens
gaaaccacagugaagaaga

SEQ ID NO: 1531673 - RNA, 19 nt, Homo sapiens
cuacagcaauggucagcuu

SEQ ID NO: 1531674 - RNA, 19 nt, Homo sapiens
ugagggaggagacagauaa

SEQ ID NO: 1531675 - RNA, 19 nt, Homo sapiens
gaacacaugcaaaugaacu

SEQ ID NO: 1531676 - RNA, 19 nt, Homo sapiens
gaaggugugcaaaugauuc

SEQ ID NO: 1531677 - RNA, 19 nt, Homo sapiens
ucaugaaggugugcaaaug

SEQ ID NO: 1531678 - RNA, 19 nt, Homo sapiens
accgagagguugaugcaua

SEQ ID NO: 1531679 - RNA, 19 nt, Homo sapiens
aagaugagauauacuacug

SEQ ID NO: 1531680 - RNA, 19 nt, Homo sapiens
guuguacccugugguguuu

SEQ ID NO: 1531681 - RNA, 19 nt, Homo sapiens
agccuaacaugcugauuaa

SEQ ID NO: 1531682 - RNA, 19 nt, Homo sapiens
gccaauauuugcaccaucu

SEQ ID NO: 1531683 - RNA, 19 nt, Homo sapiens
uguagugaguauagaguuu

SEQ ID NO: 1531684 - RNA, 19 nt, Homo sapiens
guaguaagaagaacuugga

SEQ ID NO: 1531685 - RNA, 19 nt, Homo sapiens
uguaaacucugcagcauac

SEQ ID NO: 1531686 - RNA, 19 nt, Homo sapiens
guauagacuugguauucug

SEQ ID NO: 1531687 - RNA, 19 nt, Homo sapiens
ggguguaccuguuuaucug

SEQ ID NO: 1531688 - RNA, 19 nt, Homo sapiens
uaaauggcuaccuaaauug

SEQ ID NO: 1531689 - RNA, 19 nt, Homo sapiens
aaagagagaacacaugcaa

SEQ ID NO: 1531690 - RNA, 19 nt, Homo sapiens
gaagucucaugcaaguugu

SEQ ID NO: 1531691 - RNA, 19 nt, Homo sapiens
ugaagucucaugcaaguug

SEQ ID NO: 1531692 - RNA, 19 nt, Homo sapiens
uguaaaugaucaguggaua

SEQ ID NO: 1531693 - RNA, 19 nt, Homo sapiens
uagacuugguauucugaua

SEQ ID NO: 1531694 - RNA, 19 nt, Homo sapiens
gagacccaguagaaagaaa

SEQ ID NO: 1531695 - RNA, 19 nt, Homo sapiens
ucacucagcgcuaacauca

SEQ ID NO: 1531696 - RNA, 19 nt, Homo sapiens
aaguggaugugcagaguuu

SEQ ID NO: 1531697 - RNA, 19 nt, Homo sapiens
uagaugagcaugagagugu

SEQ ID NO: 1531698 - RNA, 19 nt, Homo sapiens
cuaaagugcugggauuaca

SEQ ID NO: 1531699 - RNA, 19 nt, Homo sapiens
aaacucugcagcauacuaa

SEQ ID NO: 1531700 - RNA, 19 nt, Homo sapiens
gaauugggaugacauagaa

SEQ ID NO: 1531701 - RNA, 19 nt, Homo sapiens
gcauggagauuucuucuau

SEQ ID NO: 1531702 - RNA, 19 nt, Homo sapiens
gaacugacuugaagaugug

SEQ ID NO: 1531703 - RNA, 19 nt, Homo sapiens
cccgaucacuuaacaauua

SEQ ID NO: 1531704 - RNA, 19 nt, Homo sapiens
uaagacagcuggaaagauc

SEQ ID NO: 1531705 - RNA, 19 nt, Homo sapiens
ggaacugacuugaagaugu

SEQ ID NO: 1531706 - RNA, 19 nt, Homo sapiens
agaggaagauguuacagua

SEQ ID NO: 1531707 - RNA, 19 nt, Homo sapiens
gaaagugaagucccuauug

SEQ ID NO: 1531708 - RNA, 19 nt, Homo sapiens
gagaagagauagccaggau

SEQ ID NO: 1531709 - RNA, 19 nt, Homo sapiens
gaucagcaaugccuacuag

SEQ ID NO: 1531710 - RNA, 19 nt, Homo sapiens
gcagacaucuaacccugaa

SEQ ID NO: 1531711 - RNA, 19 nt, Homo sapiens
aaagauuccuccauuaguu

SEQ ID NO: 1531712 - RNA, 19 nt, Homo sapiens
ugaagucccuauugugaaa

SEQ ID NO: 1531713 - RNA, 19 nt, Homo sapiens
gaagagauagccaggauca

SEQ ID NO: 1531714 - RNA, 19 nt, Homo sapiens
uuaaagagcaggaagacua

SEQ ID NO: 1531715 - RNA, 19 nt, Homo sapiens
gacuuucucuugauuguug

SEQ ID NO: 1531716 - RNA, 19 nt, Homo sapiens
cgauguagcaggagagaua

SEQ ID NO: 1531717 - RNA, 19 nt, Homo sapiens
ggucagacaccaacacuug

SEQ ID NO: 1531718 - RNA, 19 nt, Homo sapiens
aaagugaagucccuauugu

SEQ ID NO: 1531719 - RNA, 19 nt, Homo sapiens
ggaauugggaugacauaga

SEQ ID NO: 1531720 - RNA, 19 nt, Homo sapiens
cagcagagccucccgauca

SEQ ID NO: 1531721 - RNA, 19 nt, Homo sapiens
ccaaaagauuccuccauua

SEQ ID NO: 1531722 - RNA, 19 nt, Homo sapiens
ggagagauagauucaguga

SEQ ID NO: 1531723 - RNA, 19 nt, Homo sapiens
ucaaacaccggauuaaaga

SEQ ID NO: 1531724 - RNA, 19 nt, Homo sapiens
gcagcauaguguugacgua

SEQ ID NO: 1531725 - RNA, 19 nt, Homo sapiens
ggaagcagcauaguguuga

SEQ ID NO: 1531726 - RNA, 19 nt, Homo sapiens
gggaugacauagaaagcaa

SEQ ID NO: 1531727 - RNA, 19 nt, Homo sapiens
ucaguaggcagacaucuaa

SEQ ID NO: 1531728 - RNA, 19 nt, Homo sapiens
agacaaagaucggaauugg

SEQ ID NO: 1531729 - RNA, 19 nt, Homo sapiens
agagauagauucagugacu

SEQ ID NO: 1531730 - RNA, 19 nt, Homo sapiens
gaagacuacauccgagauu

SEQ ID NO: 1531731 - RNA, 19 nt, Homo sapiens
caaauuaagagccgaaagu

SEQ ID NO: 1531732 - RNA, 19 nt, Homo sapiens
gauaagacagcuggaaaga

SEQ ID NO: 1531733 - RNA, 19 nt, Homo sapiens
caggagagauagauucagu

SEQ ID NO: 1531734 - RNA, 19 nt, Homo sapiens
ggaagaggaagauguuaca

SEQ ID NO: 1531735 - RNA, 19 nt, Homo sapiens
cuggaaagaucagaauauu

SEQ ID NO: 1531736 - RNA, 19 nt, Homo sapiens
ggaaacaacggucgaucug

SEQ ID NO: 1531737 - RNA, 19 nt, Homo sapiens
gaaagccucaacuuccaaa

SEQ ID NO: 1531738 - RNA, 19 nt, Homo sapiens
gaauauuggaagcagcaua

SEQ ID NO: 1531739 - RNA, 19 nt, Homo sapiens
acuugaagaugugugauua

SEQ ID NO: 1531740 - RNA, 19 nt, Homo sapiens
ggagaucaacgauguagca

SEQ ID NO: 1531741 - RNA, 19 nt, Homo sapiens
cagcaaugccuacuaguuc

SEQ ID NO: 1531742 - RNA, 19 nt, Homo sapiens
gcagcugaauuugagaaug

SEQ ID NO: 1531743 - RNA, 19 nt, Homo sapiens
gaacuuuggaggcucugaa

SEQ ID NO: 1531744 - RNA, 19 nt, Homo sapiens
gcuggaaagaucagaauau

SEQ ID NO: 1531745 - RNA, 19 nt, Homo sapiens
cuaagaagauaagacaauc

SEQ ID NO: 1531746 - RNA, 19 nt, Homo sapiens
ugucauccgucuuucaguu

SEQ ID NO: 1531747 - RNA, 19 nt, Homo sapiens
ccuacuaguucuucauuca

SEQ ID NO: 1531748 - RNA, 19 nt, Homo sapiens
uccauuaguucauuccaaa

SEQ ID NO: 1531749 - RNA, 19 nt, Homo sapiens
cagcugaauuugagaaugc

SEQ ID NO: 1531750 - RNA, 19 nt, Homo sapiens
gaucggaauugggaugaca

SEQ ID NO: 1531751 - RNA, 19 nt, Homo sapiens
ggauuaaagagcaggaaga

SEQ ID NO: 1531752 - RNA, 19 nt, Homo sapiens
uaucuuacaggaacugaaa

SEQ ID NO: 1531753 - RNA, 19 nt, Homo sapiens
uagauucagugacuucauc

SEQ ID NO: 1531754 - RNA, 19 nt, Homo sapiens
ggacugcucaucgagaaga

SEQ ID NO: 1531755 - RNA, 19 nt, Homo sapiens
gagauagauucagugacuu

SEQ ID NO: 1531756 - RNA, 19 nt, Homo sapiens
uaugauugauccugaugga

SEQ ID NO: 1531757 - RNA, 19 nt, Homo sapiens
uagauaagacagcuggaaa

SEQ ID NO: 1531758 - RNA, 19 nt, Homo sapiens
gaaguccagcccugugaau

SEQ ID NO: 1531759 - RNA, 19 nt, Homo sapiens
gaaaagcagcuacaagcaa

SEQ ID NO: 1531760 - RNA, 19 nt, Homo sapiens
cgaaagugaagucccuauu

SEQ ID NO: 1531761 - RNA, 19 nt, Homo sapiens
aggaagauguuacaguaca

SEQ ID NO: 1531762 - RNA, 19 nt, Homo sapiens
gcagcuacaagcaaucaau

SEQ ID NO: 1531763 - RNA, 19 nt, Homo sapiens
ccucgagcauggagauuuc

SEQ ID NO: 1531764 - RNA, 19 nt, Homo sapiens
guugccaucuccaccgaaa

SEQ ID NO: 1531765 - RNA, 19 nt, Homo sapiens
gaacugaaaagaguagaaa

SEQ ID NO: 1531766 - RNA, 19 nt, Homo sapiens
auuaagagccgaaagugaa

SEQ ID NO: 1531767 - RNA, 19 nt, Homo sapiens
ggaagacuacauccgagau

SEQ ID NO: 1531768 - RNA, 19 nt, Homo sapiens
gaagucaugggagauaauc

SEQ ID NO: 1531769 - RNA, 19 nt, Homo sapiens
cacauugguugaucguguu

SEQ ID NO: 1531770 - RNA, 19 nt, Homo sapiens
ucauucaaacaccggauua

SEQ ID NO: 1531771 - RNA, 19 nt, Homo sapiens
uggaggcucugaacaacau

SEQ ID NO: 1531772 - RNA, 19 nt, Homo sapiens
ucagcaaugccuacuaguu

SEQ ID NO: 1531773 - RNA, 19 nt, Homo sapiens
gaaggaaacaacggucgau

SEQ ID NO: 1531774 - RNA, 19 nt, Homo sapiens
caucuccaccgaaacagaa

SEQ ID NO: 1531775 - RNA, 19 nt, Homo sapiens
aagacuacauccgagauug

SEQ ID NO: 1531776 - RNA, 19 nt, Homo sapiens
gaugacauagaaagcaaau

SEQ ID NO: 1531777 - RNA, 19 nt, Homo sapiens
aaagacaaagaucggaauu

SEQ ID NO: 1531778 - RNA, 19 nt, Homo sapiens
gcaaugccuacuaguucuu

SEQ ID NO: 1531779 - RNA, 19 nt, Homo sapiens
gauaaucugcugcugucau

SEQ ID NO: 1531780 - RNA, 19 nt, Homo sapiens
acaauuacaaggcggagaa

SEQ ID NO: 1531781 - RNA, 19 nt, Homo sapiens
gagccucccgaucacuuaa

SEQ ID NO: 1531782 - RNA, 19 nt, Homo sapiens
agugaagucccuauuguga

SEQ ID NO: 1531783 - RNA, 19 nt, Homo sapiens
uaaagacaaagaucggaau

SEQ ID NO: 1531784 - RNA, 19 nt, Homo sapiens
gcugcugucauccgucuuu

SEQ ID NO: 1531785 - RNA, 19 nt, Homo sapiens
gaagcagcauaguguugac

SEQ ID NO: 1531786 - RNA, 19 nt, Homo sapiens
gacuugaagaugugugauu

SEQ ID NO: 1531787 - RNA, 19 nt, Homo sapiens
aguccagcccugugaauaa

SEQ ID NO: 1531788 - RNA, 19 nt, Homo sapiens
cagaaguccagcccuguga

SEQ ID NO: 1531789 - RNA, 19 nt, Homo sapiens
aaaagcagcuacaagcaau

SEQ ID NO: 1531790 - RNA, 19 nt, Homo sapiens
gugaagucccuauugugaa

SEQ ID NO: 1531791 - RNA, 19 nt, Homo sapiens
gauugauccugauggaacu

SEQ ID NO: 1531792 - RNA, 19 nt, Homo sapiens
auaaucugcugcugucauc

SEQ ID NO: 1531793 - RNA, 19 nt, Homo sapiens
caaaagauuccuccauuag

SEQ ID NO: 1531794 - RNA, 19 nt, Homo sapiens
gggaagaggaagauguuac

SEQ ID NO: 1531795 - RNA, 19 nt, Homo sapiens
uugagaaugcugaaucuga

SEQ ID NO: 1531796 - RNA, 19 nt, Homo sapiens
ggauuucccagugcuaugu

SEQ ID NO: 1531797 - RNA, 19 nt, Homo sapiens
gagcauggagauuucuucu

SEQ ID NO: 1531798 - RNA, 19 nt, Homo sapiens
ugaugaaagccucaacuuc

SEQ ID NO: 1531799 - RNA, 19 nt, Homo sapiens
ggaucagcaaugccuacua

SEQ ID NO: 1531800 - RNA, 19 nt, Homo sapiens
uaacagagcccaacuuuga

SEQ ID NO: 1531801 - RNA, 19 nt, Homo sapiens
gcaaacagcacuuuacaga

SEQ ID NO: 1531802 - RNA, 19 nt, Homo sapiens
ggacaggugacuauuuaua

SEQ ID NO: 1531803 - RNA, 19 nt, Homo sapiens
gaagaagacgaccagauaa

SEQ ID NO: 1531804 - RNA, 19 nt, Homo sapiens
ugaagaagacgaccagaua

SEQ ID NO: 1531805 - RNA, 19 nt, Homo sapiens
gagaugguauugaaacaga

SEQ ID NO: 1531806 - RNA, 19 nt, Homo sapiens
aaacagcacuuuacagaag

SEQ ID NO: 1531807 - RNA, 19 nt, Homo sapiens
uaaaguguaugugcaauug

SEQ ID NO: 1531808 - RNA, 19 nt, Homo sapiens
ggacuaaauuggugguugu

SEQ ID NO: 1531809 - RNA, 19 nt, Homo sapiens
gagaagacuuugggacauu

SEQ ID NO: 1531810 - RNA, 19 nt, Homo sapiens
cuggacaggugacuauuua

SEQ ID NO: 1531811 - RNA, 19 nt, Homo sapiens
gcugcgagcucugcaagua

SEQ ID NO: 1531812 - RNA, 19 nt, Homo sapiens
ugaaggaaauuguuuacug

SEQ ID NO: 1531813 - RNA, 19 nt, Homo sapiens
ugaagacacuggagcagaa

SEQ ID NO: 1531814 - RNA, 19 nt, Homo sapiens
ggacguuagugcauuagug

SEQ ID NO: 1531815 - RNA, 19 nt, Homo sapiens
gaagauucccucugcauca

SEQ ID NO: 1531816 - RNA, 19 nt, Homo sapiens
gggaagaacagaaugagaa

SEQ ID NO: 1531817 - RNA, 19 nt, Homo sapiens
gaguuugucaucuguaaua

SEQ ID NO: 1531818 - RNA, 19 nt, Homo sapiens
gaaguaagaccaaagaaaa

SEQ ID NO: 1531819 - RNA, 19 nt, Homo sapiens
gauaagagguugggaugag

SEQ ID NO: 1531820 - RNA, 19 nt, Homo sapiens
agaaaucauucacgucuga

SEQ ID NO: 1531821 - RNA, 19 nt, Homo sapiens
uaaggcagcuccgcacuug

SEQ ID NO: 1531822 - RNA, 19 nt, Homo sapiens
augaagagcugaaggaaau

SEQ ID NO: 1531823 - RNA, 19 nt, Homo sapiens
guucaaaacuguccagaaa

SEQ ID NO: 1531824 - RNA, 19 nt, Homo sapiens
gagcugaaggaaauuguuu

SEQ ID NO: 1531825 - RNA, 19 nt, Homo sapiens
agaggacguuagugcauua

SEQ ID NO: 1531826 - RNA, 19 nt, Homo sapiens
gagcugaaugagagaauaa

SEQ ID NO: 1531827 - RNA, 19 nt, Homo sapiens
gaacagaaugagaagacuu

SEQ ID NO: 1531828 - RNA, 19 nt, Homo sapiens
gcucugugguggcgcauga

SEQ ID NO: 1531829 - RNA, 19 nt, Homo sapiens
ugggagaaguugcagauga

SEQ ID NO: 1531830 - RNA, 19 nt, Homo sapiens
agagugaucuauguucaaa

SEQ ID NO: 1531831 - RNA, 19 nt, Homo sapiens
ggagagggaagaacagaau

SEQ ID NO: 1531832 - RNA, 19 nt, Homo sapiens
guauagggcuguggauauc

SEQ ID NO: 1531833 - RNA, 19 nt, Homo sapiens
agaaaucuucccuuccuua

SEQ ID NO: 1531834 - RNA, 19 nt, Homo sapiens
cccaggagaugguauugaa

SEQ ID NO: 1531835 - RNA, 19 nt, Homo sapiens
ccaauuguauaccuuucuu

SEQ ID NO: 1531836 - RNA, 19 nt, Homo sapiens
gagcccaacuuugaaaaua

SEQ ID NO: 1531837 - RNA, 19 nt, Homo sapiens
gagcaaacagcacuuuaca

SEQ ID NO: 1531838 - RNA, 19 nt, Homo sapiens
gguauagggcuguggauau

SEQ ID NO: 1531839 - RNA, 19 nt, Homo sapiens
guggauaucgucaguuuga

SEQ ID NO: 1531840 - RNA, 19 nt, Homo sapiens
gaauggcccuuuuggacua

SEQ ID NO: 1531841 - RNA, 19 nt, Homo sapiens
cuacagaaguaagaccaaa

SEQ ID NO: 1531842 - RNA, 19 nt, Homo sapiens
agacucaaggccuauaaua

SEQ ID NO: 1531843 - RNA, 19 nt, Homo sapiens
aagaucaugugcucaguga

SEQ ID NO: 1531844 - RNA, 19 nt, Homo sapiens
gaagagcugaaggaaauug

SEQ ID NO: 1531845 - RNA, 19 nt, Homo sapiens
guaaaguguaugugcaauu

SEQ ID NO: 1531846 - RNA, 19 nt, Homo sapiens
gcuuaccacugacuauugu

SEQ ID NO: 1531847 - RNA, 19 nt, Homo sapiens
caaacagcacuuuacagaa

SEQ ID NO: 1531848 - RNA, 19 nt, Homo sapiens
gaucaugugcucagugaca

SEQ ID NO: 1531849 - RNA, 19 nt, Homo sapiens
caggacaucugcaggaucu

SEQ ID NO: 1531850 - RNA, 19 nt, Homo sapiens
guuagugcauuagugauga

SEQ ID NO: 1531851 - RNA, 19 nt, Homo sapiens
agaaguaagaccaaagaaa

SEQ ID NO: 1531852 - RNA, 19 nt, Homo sapiens
gaagacgaccagauaagag

SEQ ID NO: 1531853 - RNA, 19 nt, Homo sapiens
ccagcgggauugacacuca

SEQ ID NO: 1531854 - RNA, 19 nt, Homo sapiens
ugagcugaaugagagaaua

SEQ ID NO: 1531855 - RNA, 19 nt, Homo sapiens
ccuuguaugugcucauuga

SEQ ID NO: 1531856 - RNA, 19 nt, Homo sapiens
gaucugccacugugaagga

SEQ ID NO: 1531857 - RNA, 19 nt, Homo sapiens
uggaguuugucaucuguaa

SEQ ID NO: 1531858 - RNA, 19 nt, Homo sapiens
gcacaggaagccuccacuu

SEQ ID NO: 1531859 - RNA, 19 nt, Homo sapiens
agaagacuuugggacauuu

SEQ ID NO: 1531860 - RNA, 19 nt, Homo sapiens
uaugugcaauuguggaaga

SEQ ID NO: 1531861 - RNA, 19 nt, Homo sapiens
uagaggacguuagugcauu

SEQ ID NO: 1531862 - RNA, 19 nt, Homo sapiens
uauguucaguguaaagugu

SEQ ID NO: 1531863 - RNA, 19 nt, Homo sapiens
gacguuagugcauuaguga

SEQ ID NO: 1531864 - RNA, 19 nt, Homo sapiens
ggaagaacagaaugagaag

SEQ ID NO: 1531865 - RNA, 19 nt, Homo sapiens
ugaaauccauggcccaaaa

SEQ ID NO: 1531866 - RNA, 19 nt, Homo sapiens
gaagacacuggagcagaaa

SEQ ID NO: 1531867 - RNA, 19 nt, Homo sapiens
ccacgucauugccaucaca

SEQ ID NO: 1531868 - RNA, 19 nt, Homo sapiens
gggagaaguugcagaugac

SEQ ID NO: 1531869 - RNA, 19 nt, Homo sapiens
gaaaucuucccuuccuuac

SEQ ID NO: 1531870 - RNA, 19 nt, Homo sapiens
ggucuugagcugaaugaga

SEQ ID NO: 1531871 - RNA, 19 nt, Homo sapiens
cuguggauaucgucaguuu

SEQ ID NO: 1531872 - RNA, 19 nt, Homo sapiens
ggaagaucaugugcucagu

SEQ ID NO: 1531873 - RNA, 19 nt, Homo sapiens
gagaagauucccucugcau

SEQ ID NO: 1531874 - RNA, 19 nt, Homo sapiens
ccauggaguuugucaucug

SEQ ID NO: 1531875 - RNA, 19 nt, Homo sapiens
gaagagacucaaggccuau

SEQ ID NO: 1531876 - RNA, 19 nt, Homo sapiens
gaagaacagaaugagaaga

SEQ ID NO: 1531877 - RNA, 19 nt, Homo sapiens
gcagcucugugggaaagug

SEQ ID NO: 1531878 - RNA, 19 nt, Homo sapiens
uuagaaaucuucccuuccu

SEQ ID NO: 1531879 - RNA, 19 nt, Homo sapiens
ugagaagacuuugggacau

SEQ ID NO: 1531880 - RNA, 19 nt, Homo sapiens
caugaagagcugaaggaaa

SEQ ID NO: 1531881 - RNA, 19 nt, Homo sapiens
acuaacagagcccaacuuu

SEQ ID NO: 1531882 - RNA, 19 nt, Homo sapiens
ucaaaacuguccagaaaca

SEQ ID NO: 1531883 - RNA, 19 nt, Homo sapiens
ucauugccaucacaugugu

SEQ ID NO: 1531884 - RNA, 19 nt, Homo sapiens
ucaguuugaccaaguauuc

SEQ ID NO: 1531885 - RNA, 19 nt, Homo sapiens
cccauggucuugagcugaa

SEQ ID NO: 1531886 - RNA, 19 nt, Homo sapiens
guaucuccuuuacaucaug

SEQ ID NO: 1531887 - RNA, 19 nt, Homo sapiens
gcuccgcacuugaaaucca

SEQ ID NO: 1531888 - RNA, 19 nt, Homo sapiens
agacuggacaggugacuau

SEQ ID NO: 1531889 - RNA, 19 nt, Homo sapiens
cacuggagcagaaaucauu

SEQ ID NO: 1531890 - RNA, 19 nt, Homo sapiens
cauggaguuugucaucugu

SEQ ID NO: 1531891 - RNA, 19 nt, Homo sapiens
agaagacgaccagauaaga

SEQ ID NO: 1531892 - RNA, 19 nt, Homo sapiens
ucaagcaacauuucuaagg

SEQ ID NO: 1531893 - RNA, 19 nt, Homo sapiens
acagaaguaagaccaaaga

SEQ ID NO: 1531894 - RNA, 19 nt, Homo sapiens
uaucuccuuuacaucauga

SEQ ID NO: 1531895 - RNA, 19 nt, Homo sapiens
cuuauguccuuuaauagca

SEQ ID NO: 1531896 - RNA, 19 nt, Homo sapiens
gcccaacuuugaaaauaaa

SEQ ID NO: 1531897 - RNA, 19 nt, Homo sapiens
guccuuguaugugcucauu

SEQ ID NO: 1531898 - RNA, 19 nt, Homo sapiens
aacagaaugagaagacuuu

SEQ ID NO: 1531899 - RNA, 19 nt, Homo sapiens
uguaauagaggacguuagu

SEQ ID NO: 1531900 - RNA, 19 nt, Homo sapiens
guaaauagcuguugaauga

SEQ ID NO: 1531901 - RNA, 19 nt, Homo sapiens
gagaguaucuggacuauug

SEQ ID NO: 1531902 - RNA, 19 nt, Homo sapiens
gaagucaccuuaauuauca

SEQ ID NO: 1531903 - RNA, 19 nt, Homo sapiens
gcacuuagcacaauguaua

SEQ ID NO: 1531904 - RNA, 19 nt, Homo sapiens
gaaaugagagucguuguua

SEQ ID NO: 1531905 - RNA, 19 nt, Homo sapiens
gaacagacacucaguaaau

SEQ ID NO: 1531906 - RNA, 19 nt, Homo sapiens
cacagaagcucacauguaa

SEQ ID NO: 1531907 - RNA, 19 nt, Homo sapiens
guaauccucuuaaaccuaa

SEQ ID NO: 1531908 - RNA, 19 nt, Homo sapiens
ccuagaaacugcauacuuu

SEQ ID NO: 1531909 - RNA, 19 nt, Homo sapiens
ggccagagaucuagaaaug

SEQ ID NO: 1531910 - RNA, 19 nt, Homo sapiens
ugaccugccugaaguaaua

SEQ ID NO: 1531911 - RNA, 19 nt, Homo sapiens
ccaaaugaauuccugauau

SEQ ID NO: 1531912 - RNA, 19 nt, Homo sapiens
ccacaacggucccacguaa

SEQ ID NO: 1531913 - RNA, 19 nt, Homo sapiens
ucaaaggcuucccaacuua

SEQ ID NO: 1531914 - RNA, 19 nt, Homo sapiens
gaaccaggaugauaagaca

SEQ ID NO: 1531915 - RNA, 19 nt, Homo sapiens
ccagagguaugucaacuaa

SEQ ID NO: 1531916 - RNA, 19 nt, Homo sapiens
guaauacagugguuuguug

SEQ ID NO: 1531917 - RNA, 19 nt, Homo sapiens
caucuuaucuucugguuau

SEQ ID NO: 1531918 - RNA, 19 nt, Homo sapiens
uaucauaucugucuugcaa

SEQ ID NO: 1531919 - RNA, 19 nt, Homo sapiens
accaauggcugauggauua

SEQ ID NO: 1531920 - RNA, 19 nt, Homo sapiens
agacgaaagucaggaaaua

SEQ ID NO: 1531921 - RNA, 19 nt, Homo sapiens
caaaugaauuccugauauc

SEQ ID NO: 1531922 - RNA, 19 nt, Homo sapiens
ccacagaagcucacaugua

SEQ ID NO: 1531923 - RNA, 19 nt, Homo sapiens
uaaaugagguaauguaagg

SEQ ID NO: 1531924 - RNA, 19 nt, Homo sapiens
gcugaagacucccgcauug

SEQ ID NO: 1531925 - RNA, 19 nt, Homo sapiens
ugaaugaggucuggacaaa

SEQ ID NO: 1531926 - RNA, 19 nt, Homo sapiens
cuuagaaucuccaaaguga

SEQ ID NO: 1531927 - RNA, 19 nt, Homo sapiens
caaaugcucuuguaacacu

SEQ ID NO: 1531928 - RNA, 19 nt, Homo sapiens
cucaugaucugucucuuua

SEQ ID NO: 1531929 - RNA, 19 nt, Homo sapiens
gaaagcagguaggguuuua

SEQ ID NO: 1531930 - RNA, 19 nt, Homo sapiens
gcuguugaaugaaugaauu

SEQ ID NO: 1531931 - RNA, 19 nt, Homo sapiens
ccaaaggacuggguucaga

SEQ ID NO: 1531932 - RNA, 19 nt, Homo sapiens
gguaaacgaggauggauuu

SEQ ID NO: 1531933 - RNA, 19 nt, Homo sapiens
caacuaaagcauuggguaa

SEQ ID NO: 1531934 - RNA, 19 nt, Homo sapiens
cauaaaagcucccaaagga

SEQ ID NO: 1531935 - RNA, 19 nt, Homo sapiens
gaccacagcaggauuagaa

SEQ ID NO: 1531936 - RNA, 19 nt, Homo sapiens
gaaguaauacagugguuug

SEQ ID NO: 1531937 - RNA, 19 nt, Homo sapiens
guuacaaagucuccauaaa

SEQ ID NO: 1531938 - RNA, 19 nt, Homo sapiens
ccaccaaccguaagagaua

SEQ ID NO: 1531939 - RNA, 19 nt, Homo sapiens
gaggcuaaacuaagucaua

SEQ ID NO: 1531940 - RNA, 19 nt, Homo sapiens
gaucaugucauucauuugu

SEQ ID NO: 1531941 - RNA, 19 nt, Homo sapiens
gaagacucccgcauuggua

SEQ ID NO: 1531942 - RNA, 19 nt, Homo sapiens
ugagagucguuguuacuuu

SEQ ID NO: 1531943 - RNA, 19 nt, Homo sapiens
uaacacagaagaaaugaga

SEQ ID NO: 1531944 - RNA, 19 nt, Homo sapiens
ucacuguugucucuucuuu

SEQ ID NO: 1531945 - RNA, 19 nt, Homo sapiens
gaaccaaggcucagagaag

SEQ ID NO: 1531946 - RNA, 19 nt, Homo sapiens
ugaaguggaucaccaaugg

SEQ ID NO: 1531947 - RNA, 19 nt, Homo sapiens
gagggcaacugaaggugaa

SEQ ID NO: 1531948 - RNA, 19 nt, Homo sapiens
gcuggugguuggagaguuu

SEQ ID NO: 1531949 - RNA, 19 nt, Homo sapiens
gggaacagacacucaguaa

SEQ ID NO: 1531950 - RNA, 19 nt, Homo sapiens
cacgaagucaccuuaauua

SEQ ID NO: 1531951 - RNA, 19 nt, Homo sapiens
gggacugucugcucuaugu

SEQ ID NO: 1531952 - RNA, 19 nt, Homo sapiens
aaugaggucuggacaaaga

SEQ ID NO: 1531953 - RNA, 19 nt, Homo sapiens
gcugaugaguugacugaug

SEQ ID NO: 1531954 - RNA, 19 nt, Homo sapiens
gaauagcaugucccaagua

SEQ ID NO: 1531955 - RNA, 19 nt, Homo sapiens
ccagagaucuagaaauggu

SEQ ID NO: 1531956 - RNA, 19 nt, Homo sapiens
uuagaaggauggcaauuuc

SEQ ID NO: 1531957 - RNA, 19 nt, Homo sapiens
aacagacacucaguaaaua

SEQ ID NO: 1531958 - RNA, 19 nt, Homo sapiens
aaagaccacagcaggauua

SEQ ID NO: 1531959 - RNA, 19 nt, Homo sapiens
gguggaggcuaaacuaagu

SEQ ID NO: 1531960 - RNA, 19 nt, Homo sapiens
aagcacagauuaucauauc

SEQ ID NO: 1531961 - RNA, 19 nt, Homo sapiens
ucugucggcuucaucguua

SEQ ID NO: 1531962 - RNA, 19 nt, Homo sapiens
guaauaaaccaggaaaugu

SEQ ID NO: 1531963 - RNA, 19 nt, Homo sapiens
gaaagaccacagcaggauu

SEQ ID NO: 1531964 - RNA, 19 nt, Homo sapiens
ggacaucccaaaccuaaca

SEQ ID NO: 1531965 - RNA, 19 nt, Homo sapiens
caagaugggagugguuaua

SEQ ID NO: 1531966 - RNA, 19 nt, Homo sapiens
gagaaagcagguaggguuu

SEQ ID NO: 1531967 - RNA, 19 nt, Homo sapiens
ggacuauugcagugauuaa

SEQ ID NO: 1531968 - RNA, 19 nt, Homo sapiens
cuggauaccugaacacaug

SEQ ID NO: 1531969 - RNA, 19 nt, Homo sapiens
uaugucaacuaaagcauug

SEQ ID NO: 1531970 - RNA, 19 nt, Homo sapiens
guauaacacagaagaaaug

SEQ ID NO: 1531971 - RNA, 19 nt, Homo sapiens
ucacgaagucaccuuaauu

SEQ ID NO: 1531972 - RNA, 19 nt, Homo sapiens
gagauucuuggugguauua

SEQ ID NO: 1531973 - RNA, 19 nt, Homo sapiens
cuaggaaccaggaugauaa

SEQ ID NO: 1531974 - RNA, 19 nt, Homo sapiens
agagguaugucaacuaaag

SEQ ID NO: 1531975 - RNA, 19 nt, Homo sapiens
ggaacagacacucaguaaa

SEQ ID NO: 1531976 - RNA, 19 nt, Homo sapiens
cauagaagggccagaggua

SEQ ID NO: 1531977 - RNA, 19 nt, Homo sapiens
gcacaauguauaacacaga

SEQ ID NO: 1531978 - RNA, 19 nt, Homo sapiens
cgaagucaccuuaauuauc

SEQ ID NO: 1531979 - RNA, 19 nt, Homo sapiens
ggagcugucucugcauaug

SEQ ID NO: 1531980 - RNA, 19 nt, Homo sapiens
agucauagguucauucucu

SEQ ID NO: 1531981 - RNA, 19 nt, Homo sapiens
cccaucaucuuuccaguug

SEQ ID NO: 1531982 - RNA, 19 nt, Homo sapiens
ggaaagaccacagcaggau

SEQ ID NO: 1531983 - RNA, 19 nt, Homo sapiens
gagcagagccacagaagcu

SEQ ID NO: 1531984 - RNA, 19 nt, Homo sapiens
gaagcacagauuaucauau

SEQ ID NO: 1531985 - RNA, 19 nt, Homo sapiens
caacacuuccacugcuaua

SEQ ID NO: 1531986 - RNA, 19 nt, Homo sapiens
aaucaugccuguguuacaa

SEQ ID NO: 1531987 - RNA, 19 nt, Homo sapiens
uuuauaugcugaugaguug

SEQ ID NO: 1531988 - RNA, 19 nt, Homo sapiens
gauucuuggugguauuauu

SEQ ID NO: 1531989 - RNA, 19 nt, Homo sapiens
gacgaaagucaggaaauaa

SEQ ID NO: 1531990 - RNA, 19 nt, Homo sapiens
cacaauguauaacacagaa

SEQ ID NO: 1531991 - RNA, 19 nt, Homo sapiens
ucauaucugucuugcaaau

SEQ ID NO: 1531992 - RNA, 19 nt, Homo sapiens
gggugaagaucccaucauc

SEQ ID NO: 1531993 - RNA, 19 nt, Homo sapiens
cguaagagauaggaauugu

SEQ ID NO: 1531994 - RNA, 19 nt, Homo sapiens
ccacguaauguuagagaaa

SEQ ID NO: 1531995 - RNA, 19 nt, Homo sapiens
gagagucguuguuacuuuu

SEQ ID NO: 1531996 - RNA, 19 nt, Homo sapiens
gcagugauuaaaugaggua

SEQ ID NO: 1531997 - RNA, 19 nt, Homo sapiens
uaauaaaccaggaaaugug

SEQ ID NO: 1531998 - RNA, 19 nt, Homo sapiens
caucacaucccagaagaaa

SEQ ID NO: 1531999 - RNA, 19 nt, Homo sapiens
ccacugauguugacuugac

SEQ ID NO: 1532000 - RNA, 19 nt, Homo sapiens
acaaagagcucaacccuua

SEQ ID NO: 1532001 - RNA, 19 nt, Homo sapiens
gcaaacagccuuauagaug

SEQ ID NO: 1532002 - RNA, 19 nt, Homo sapiens
gaaauacucuguacuucug

SEQ ID NO: 1532003 - RNA, 19 nt, Homo sapiens
ccacagagaagaacuauaa

SEQ ID NO: 1532004 - RNA, 19 nt, Homo sapiens
gaaagagccaugaaaugua

SEQ ID NO: 1532005 - RNA, 19 nt, Homo sapiens
gcucaacucuuauuaguca

SEQ ID NO: 1532006 - RNA, 19 nt, Homo sapiens
aagaagcacucaacguuua

SEQ ID NO: 1532007 - RNA, 19 nt, Homo sapiens
ggacaucagagaauucaua

SEQ ID NO: 1532008 - RNA, 19 nt, Homo sapiens
gaacaucagagacuccaua

SEQ ID NO: 1532009 - RNA, 19 nt, Homo sapiens
gugggaaagucuucaaaua

SEQ ID NO: 1532010 - RNA, 19 nt, Homo sapiens
gaggauuacugguuugaaa

SEQ ID NO: 1532011 - RNA, 19 nt, Homo sapiens
gaagaagcacucaacguuu

SEQ ID NO: 1532012 - RNA, 19 nt, Homo sapiens
gggaaagucuucaaauaca

SEQ ID NO: 1532013 - RNA, 19 nt, Homo sapiens
ggaaagccuucgcucagaa

SEQ ID NO: 1532014 - RNA, 19 nt, Homo sapiens
caaacagccuuauagaugu

SEQ ID NO: 1532015 - RNA, 19 nt, Homo sapiens
ggcagaagcuccacagaga

SEQ ID NO: 1532016 - RNA, 19 nt, Homo sapiens
gagcucaacucuuauuagu

SEQ ID NO: 1532017 - RNA, 19 nt, Homo sapiens
ggaaagucuucaaauacaa

SEQ ID NO: 1532018 - RNA, 19 nt, Homo sapiens
agaaugagguggagcugua

SEQ ID NO: 1532019 - RNA, 19 nt, Homo sapiens
gugaggauauucauuguga

SEQ ID NO: 1532020 - RNA, 19 nt, Homo sapiens
ggaaauaaaccguaucagu

SEQ ID NO: 1532021 - RNA, 19 nt, Homo sapiens
gagaagccauaucagugua

SEQ ID NO: 1532022 - RNA, 19 nt, Homo sapiens
caaauacaauucguccuuu

SEQ ID NO: 1532023 - RNA, 19 nt, Homo sapiens
ccagaaacccuacaaaugu

SEQ ID NO: 1532024 - RNA, 19 nt, Homo sapiens
caucauagaggagacauua

SEQ ID NO: 1532025 - RNA, 19 nt, Homo sapiens
ggagagcuuucagggauaa

SEQ ID NO: 1532026 - RNA, 19 nt, Homo sapiens
cacaugcagucgaggauua

SEQ ID NO: 1532027 - RNA, 19 nt, Homo sapiens
ggauguggcuguggccuuu

SEQ ID NO: 1532028 - RNA, 19 nt, Homo sapiens
aaacagccuuauagaugua

SEQ ID NO: 1532029 - RNA, 19 nt, Homo sapiens
uagcaagacuccaucucua

SEQ ID NO: 1532030 - RNA, 19 nt, Homo sapiens
ggaaguacuuauagcauac

SEQ ID NO: 1532031 - RNA, 19 nt, Homo sapiens
uggaaguacuuauagcaua

SEQ ID NO: 1532032 - RNA, 19 nt, Homo sapiens
gcagaguaguuuauuccuu

SEQ ID NO: 1532033 - RNA, 19 nt, Homo sapiens
acaaagaugucagcccuaa

SEQ ID NO: 1532034 - RNA, 19 nt, Homo sapiens
agaaguauacccaugauaa

SEQ ID NO: 1532035 - RNA, 19 nt, Homo sapiens
caacguuuaucaaccauca

SEQ ID NO: 1532036 - RNA, 19 nt, Homo sapiens
gaaguauacccaugauaau

SEQ ID NO: 1532037 - RNA, 19 nt, Homo sapiens
cuaaauguaugucaguaug

SEQ ID NO: 1532038 - RNA, 19 nt, Homo sapiens
ggauauucauugugagguu

SEQ ID NO: 1532039 - RNA, 19 nt, Homo sapiens
uaaagaaagagccaugaaa

SEQ ID NO: 1532040 - RNA, 19 nt, Homo sapiens
gcacagcucaggccuuguu

SEQ ID NO: 1532041 - RNA, 19 nt, Homo sapiens
agaccaaucuuaacagcaa

SEQ ID NO: 1532042 - RNA, 19 nt, Homo sapiens
gcugagacaggauugcuua

SEQ ID NO: 1532043 - RNA, 19 nt, Homo sapiens
aaagagccaugaaauguag

SEQ ID NO: 1532044 - RNA, 19 nt, Homo sapiens
gagaauucauacuggagaa

SEQ ID NO: 1532045 - RNA, 19 nt, Homo sapiens
gagagaagccuuuuaaaug

SEQ ID NO: 1532046 - RNA, 19 nt, Homo sapiens
ugaagaagcacucaacguu

SEQ ID NO: 1532047 - RNA, 19 nt, Homo sapiens
guucagcccuuaagcaaca

SEQ ID NO: 1532048 - RNA, 19 nt, Homo sapiens
gggaaagccuucgcucaga

SEQ ID NO: 1532049 - RNA, 19 nt, Homo sapiens
ugagagaacacaucacuug

SEQ ID NO: 1532050 - RNA, 19 nt, Homo sapiens
caugaaauguaguuagugu

SEQ ID NO: 1532051 - RNA, 19 nt, Homo sapiens
gggagagcuuucagggaua

SEQ ID NO: 1532052 - RNA, 19 nt, Homo sapiens
ccaauauacccuuguuaaa

SEQ ID NO: 1532053 - RNA, 19 nt, Homo sapiens
ccauaucaguguaaugaau

SEQ ID NO: 1532054 - RNA, 19 nt, Homo sapiens
gccagaaacccuacaaaug

SEQ ID NO: 1532055 - RNA, 19 nt, Homo sapiens
ggacaaauaaagaccaauc

SEQ ID NO: 1532056 - RNA, 19 nt, Homo sapiens
caacauagcaagacuccau

SEQ ID NO: 1532057 - RNA, 19 nt, Homo sapiens
cauacugugugcuaauuga

SEQ ID NO: 1532058 - RNA, 19 nt, Homo sapiens
gagaagccuuuuaaaugua

SEQ ID NO: 1532059 - RNA, 19 nt, Homo sapiens
gccaugaaauguaguuagu

SEQ ID NO: 1532060 - RNA, 19 nt, Homo sapiens
aaagaaagagccaugaaau

SEQ ID NO: 1532061 - RNA, 19 nt, Homo sapiens
gggaugugaugcuggagaa

SEQ ID NO: 1532062 - RNA, 19 nt, Homo sapiens
agguauagcucauccuuug

SEQ ID NO: 1532063 - RNA, 19 nt, Homo sapiens
uaucaaccaucagagaauu

SEQ ID NO: 1532064 - RNA, 19 nt, Homo sapiens
gaugucagcccuaaagcaa

SEQ ID NO: 1532065 - RNA, 19 nt, Homo sapiens
caauauacccuuguuaaag

SEQ ID NO: 1532066 - RNA, 19 nt, Homo sapiens
caaauugugcagaguaguu

SEQ ID NO: 1532067 - RNA, 19 nt, Homo sapiens
agaaagagccaugaaaugu

SEQ ID NO: 1532068 - RNA, 19 nt, Homo sapiens
caucagagacuccauacug

SEQ ID NO: 1532069 - RNA, 19 nt, Homo sapiens
gaacuauaagugcaaggaa

SEQ ID NO: 1532070 - RNA, 19 nt, Homo sapiens
aagacuccaucucuaagua

SEQ ID NO: 1532071 - RNA, 19 nt, Homo sapiens
guaaugcacuaugauugug

SEQ ID NO: 1532072 - RNA, 19 nt, Homo sapiens
caugaaagaauacauagug

SEQ ID NO: 1532073 - RNA, 19 nt, Homo sapiens
gggaucgccuuuaugaaca

SEQ ID NO: 1532074 - RNA, 19 nt, Homo sapiens
gugagaaaccacauaaaug

SEQ ID NO: 1532075 - RNA, 19 nt, Homo sapiens
ccagugagaaaccacauaa

SEQ ID NO: 1532076 - RNA, 19 nt, Homo sapiens
guagaaguauacccaugau

SEQ ID NO: 1532077 - RNA, 19 nt, Homo sapiens
ucauagaggagacauuaaa

SEQ ID NO: 1532078 - RNA, 19 nt, Homo sapiens
gcucuuacucgucaugaaa

SEQ ID NO: 1532079 - RNA, 19 nt, Homo sapiens
gcucagaaugcagcucuua

SEQ ID NO: 1532080 - RNA, 19 nt, Homo sapiens
guucaucccuuuuaaauca

SEQ ID NO: 1532081 - RNA, 19 nt, Homo sapiens
gaaugugggaucgccuuua

SEQ ID NO: 1532082 - RNA, 19 nt, Homo sapiens
caaggaaugugggaaaguc

SEQ ID NO: 1532083 - RNA, 19 nt, Homo sapiens
gaaguucagcccuuaagca

SEQ ID NO: 1532084 - RNA, 19 nt, Homo sapiens
caucagagaauucauacug

SEQ ID NO: 1532085 - RNA, 19 nt, Homo sapiens
gggcuucucucuuccaaac

SEQ ID NO: 1532086 - RNA, 19 nt, Homo sapiens
cgucaugaaagaauacaua

SEQ ID NO: 1532087 - RNA, 19 nt, Homo sapiens
caucagagaauucauacug

SEQ ID NO: 1532088 - RNA, 19 nt, Homo sapiens
uaaagcaaagcacuucuga

SEQ ID NO: 1532089 - RNA, 19 nt, Homo sapiens
agucgaggauuacugguuu

SEQ ID NO: 1532090 - RNA, 19 nt, Homo sapiens
gagacaggauugcuuaagc

SEQ ID NO: 1532091 - RNA, 19 nt, Homo sapiens
ggagaacuaugggaaucug

SEQ ID NO: 1532092 - RNA, 19 nt, Homo sapiens
cagagaagaacuauaagug

SEQ ID NO: 1532093 - RNA, 19 nt, Homo sapiens
ggaguuugagucuguaaug

SEQ ID NO: 1532094 - RNA, 19 nt, Homo sapiens
gaagccauaucaguguaau

SEQ ID NO: 1532095 - RNA, 19 nt, Homo sapiens
guaugucaguauggaagua

SEQ ID NO: 1532096 - RNA, 19 nt, Homo sapiens
gugggaaggccuuuacaaa

SEQ ID NO: 1532097 - RNA, 19 nt, Homo sapiens
aaauaaaccguaucagugu

SEQ ID NO: 1532098 - RNA, 19 nt, Homo sapiens
gcacucaacguuuaucaac

SEQ ID NO: 1532099 - RNA, 19 nt, Homo sapiens
uaagguucaugcaggcaaa

SEQ ID NO: 1532100 - RNA, 19 nt, Homo sapiens
ggacauacuugcuucaaua

SEQ ID NO: 1532101 - RNA, 19 nt, Homo sapiens
acaagaagauucagaguua

SEQ ID NO: 1532102 - RNA, 19 nt, Homo sapiens
gcaaaucauucuucaacua

SEQ ID NO: 1532103 - RNA, 19 nt, Homo sapiens
ggaagagccugaagacauu

SEQ ID NO: 1532104 - RNA, 19 nt, Homo sapiens
gagcuagucuugaaaccua

SEQ ID NO: 1532105 - RNA, 19 nt, Homo sapiens
ggacguacaucuucaccuu

SEQ ID NO: 1532106 - RNA, 19 nt, Homo sapiens
gagaaaggcuuaaaacuug

SEQ ID NO: 1532107 - RNA, 19 nt, Homo sapiens
gaagugagccuuugaguac

SEQ ID NO: 1532108 - RNA, 19 nt, Homo sapiens
gcaggagccuugaucaaug

SEQ ID NO: 1532109 - RNA, 19 nt, Homo sapiens
gauaguacauauugcuuug

SEQ ID NO: 1532110 - RNA, 19 nt, Homo sapiens
guaauuauuucacgcauca

SEQ ID NO: 1532111 - RNA, 19 nt, Homo sapiens
ccagacagauccaugaguu

SEQ ID NO: 1532112 - RNA, 19 nt, Homo sapiens
ggaagugagccuuugagua

SEQ ID NO: 1532113 - RNA, 19 nt, Homo sapiens
gaacuucaacuccaugaug

SEQ ID NO: 1532114 - RNA, 19 nt, Homo sapiens
caucaaccuuuggcacuua

SEQ ID NO: 1532115 - RNA, 19 nt, Homo sapiens
aggccaagcugaagucuuu

SEQ ID NO: 1532116 - RNA, 19 nt, Homo sapiens
uauuugagaugaacucuga

SEQ ID NO: 1532117 - RNA, 19 nt, Homo sapiens
ucccaaagcuccuggaaga

SEQ ID NO: 1532118 - RNA, 19 nt, Homo sapiens
ggucaagacagccaaguuu

SEQ ID NO: 1532119 - RNA, 19 nt, Homo sapiens
agauaaaacugcccaaaua

SEQ ID NO: 1532120 - RNA, 19 nt, Homo sapiens
gauaggacguacaucuuca

SEQ ID NO: 1532121 - RNA, 19 nt, Homo sapiens
ggaagcacgugcacuaacu

SEQ ID NO: 1532122 - RNA, 19 nt, Homo sapiens
gcacuaacuggguuuaaau

SEQ ID NO: 1532123 - RNA, 19 nt, Homo sapiens
gaaaggaggaaaucuaaaa

SEQ ID NO: 1532124 - RNA, 19 nt, Homo sapiens
guggugacauuuagagcua

SEQ ID NO: 1532125 - RNA, 19 nt, Homo sapiens
caacgggcacauuaacuuu

SEQ ID NO: 1532126 - RNA, 19 nt, Homo sapiens
acacugagcugugaugaag

SEQ ID NO: 1532127 - RNA, 19 nt, Homo sapiens
ggaccacccuucugaacag

SEQ ID NO: 1532128 - RNA, 19 nt, Homo sapiens
gcauuuacccugaggacuu

SEQ ID NO: 1532129 - RNA, 19 nt, Homo sapiens
gagaauggcacagugaaga

SEQ ID NO: 1532130 - RNA, 19 nt, Homo sapiens
gacaagaagauucagaguu

SEQ ID NO: 1532131 - RNA, 19 nt, Homo sapiens
ccuaugacuuccaggauga

SEQ ID NO: 1532132 - RNA, 19 nt, Homo sapiens
uacauacccugauuugaug

SEQ ID NO: 1532133 - RNA, 19 nt, Homo sapiens
guuuaugucuuugagauga

SEQ ID NO: 1532134 - RNA, 19 nt, Homo sapiens
ugacugauguggguugaga

SEQ ID NO: 1532135 - RNA, 19 nt, Homo sapiens
gaaggccauugcccagaug

SEQ ID NO: 1532136 - RNA, 19 nt, Homo sapiens
gugucugucugcuacuuua

SEQ ID NO: 1532137 - RNA, 19 nt, Homo sapiens
gagaaggacaagaagauuc

SEQ ID NO: 1532138 - RNA, 19 nt, Homo sapiens
ggacccgcauguuggaguu

SEQ ID NO: 1532139 - RNA, 19 nt, Homo sapiens
gacauacuugcuucaauaa

SEQ ID NO: 1532140 - RNA, 19 nt, Homo sapiens
gccaacagcagccgugaaa

SEQ ID NO: 1532141 - RNA, 19 nt, Homo sapiens
gacagggucagcagcauuu

SEQ ID NO: 1532142 - RNA, 19 nt, Homo sapiens
ggacagggucagcagcauu

SEQ ID NO: 1532143 - RNA, 19 nt, Homo sapiens
gcaucaaccuuuggcacuu

SEQ ID NO: 1532144 - RNA, 19 nt, Homo sapiens
gcauggaguugucaguuuu

SEQ ID NO: 1532145 - RNA, 19 nt, Homo sapiens
caaauacugagagguguuu

SEQ ID NO: 1532146 - RNA, 19 nt, Homo sapiens
gcuggagcccauucagaua

SEQ ID NO: 1532147 - RNA, 19 nt, Homo sapiens
gcagcgcccuaauuggaau

SEQ ID NO: 1532148 - RNA, 19 nt, Homo sapiens
gaggaaaucuaaaauaagg

SEQ ID NO: 1532149 - RNA, 19 nt, Homo sapiens
auacauacccugauuugau

SEQ ID NO: 1532150 - RNA, 19 nt, Homo sapiens
cgggugaucaguucuagua

SEQ ID NO: 1532151 - RNA, 19 nt, Homo sapiens
gagaugagaaaggcuuaaa

SEQ ID NO: 1532152 - RNA, 19 nt, Homo sapiens
ggguggagcaggaauaguu

SEQ ID NO: 1532153 - RNA, 19 nt, Homo sapiens
gagaguaucaugggagaug

SEQ ID NO: 1532154 - RNA, 19 nt, Homo sapiens
gaggagaauggcacaguga

SEQ ID NO: 1532155 - RNA, 19 nt, Homo sapiens
ucugucugcuacuuuauuu

SEQ ID NO: 1532156 - RNA, 19 nt, Homo sapiens
gaggaagcacgugcacuaa

SEQ ID NO: 1532157 - RNA, 19 nt, Homo sapiens
gcaugcugguggccacuga

SEQ ID NO: 1532158 - RNA, 19 nt, Homo sapiens
gguucuagcuaguacagau

SEQ ID NO: 1532159 - RNA, 19 nt, Homo sapiens
gaaagcacacggucaaucc

SEQ ID NO: 1532160 - RNA, 19 nt, Homo sapiens
ucagaaagcacacggucaa

SEQ ID NO: 1532161 - RNA, 19 nt, Homo sapiens
ccaggguggugacauuuag

SEQ ID NO: 1532162 - RNA, 19 nt, Homo sapiens
agaggaagcacgugcacua

SEQ ID NO: 1532163 - RNA, 19 nt, Homo sapiens
ccaacgggcacauuaacuu

SEQ ID NO: 1532164 - RNA, 19 nt, Homo sapiens
uguucaaccucuucguuaa

SEQ ID NO: 1532165 - RNA, 19 nt, Homo sapiens
guguucaaccucuucguua

SEQ ID NO: 1532166 - RNA, 19 nt, Homo sapiens
uaugacaacugguucaacu

SEQ ID NO: 1532167 - RNA, 19 nt, Homo sapiens
ucagccacauggacucauu

SEQ ID NO: 1532168 - RNA, 19 nt, Homo sapiens
ugaaaccuaucaucuacag

SEQ ID NO: 1532169 - RNA, 19 nt, Homo sapiens
cagcaaaucauucuucaac

SEQ ID NO: 1532170 - RNA, 19 nt, Homo sapiens
caauguguccagcaaauca

SEQ ID NO: 1532171 - RNA, 19 nt, Homo sapiens
uguuggaguucuucauuga

SEQ ID NO: 1532172 - RNA, 19 nt, Homo sapiens
gcagaucgucagccacaug

SEQ ID NO: 1532173 - RNA, 19 nt, Homo sapiens
gaauacaucacucccaaaa

SEQ ID NO: 1532174 - RNA, 19 nt, Homo sapiens
uuugauacauacccugauu

SEQ ID NO: 1532175 - RNA, 19 nt, Homo sapiens
acugagcugugaugaagaa

SEQ ID NO: 1532176 - RNA, 19 nt, Homo sapiens
caaaucauucuucaacuac

SEQ ID NO: 1532177 - RNA, 19 nt, Homo sapiens
gcaccuggcagcauauuuu

SEQ ID NO: 1532178 - RNA, 19 nt, Homo sapiens
ggacaagaagauucagagu

SEQ ID NO: 1532179 - RNA, 19 nt, Homo sapiens
uagaguguccuuucgagaa

SEQ ID NO: 1532180 - RNA, 19 nt, Homo sapiens
ccagcaacuucugcaacua

SEQ ID NO: 1532181 - RNA, 19 nt, Homo sapiens
cagccaaguuugaugucuu

SEQ ID NO: 1532182 - RNA, 19 nt, Homo sapiens
uaaugcagggcgucaguuu

SEQ ID NO: 1532183 - RNA, 19 nt, Homo sapiens
cuugaaaccuaucaucuac

SEQ ID NO: 1532184 - RNA, 19 nt, Homo sapiens
uacgggcuguccaaaguuu

SEQ ID NO: 1532185 - RNA, 19 nt, Homo sapiens
uggaagagccugaagacau

SEQ ID NO: 1532186 - RNA, 19 nt, Homo sapiens
auuuagagcuagucuugaa

SEQ ID NO: 1532187 - RNA, 19 nt, Homo sapiens
ugacugaaagacacacuga

SEQ ID NO: 1532188 - RNA, 19 nt, Homo sapiens
aaagugagggucccgagaa

SEQ ID NO: 1532189 - RNA, 19 nt, Homo sapiens
caagacagccaaguuugau

SEQ ID NO: 1532190 - RNA, 19 nt, Homo sapiens
gccggguggugaagaagaa

SEQ ID NO: 1532191 - RNA, 19 nt, Homo sapiens
ugauacauacccugauuug

SEQ ID NO: 1532192 - RNA, 19 nt, Homo sapiens
ggguuuaaauuuugacuga

SEQ ID NO: 1532193 - RNA, 19 nt, Homo sapiens
cauguuggaguucuucauu

SEQ ID NO: 1532194 - RNA, 19 nt, Homo sapiens
cauuuacccugaggacuug

SEQ ID NO: 1532195 - RNA, 19 nt, Homo sapiens
caggagccuugaucaaugg

SEQ ID NO: 1532196 - RNA, 19 nt, Homo sapiens
agcauggaguugucaguuu

SEQ ID NO: 1532197 - RNA, 19 nt, Homo sapiens
ggagggaagcauggaguug

SEQ ID NO: 1532198 - RNA, 19 nt, Homo sapiens
cgagaaggacaagaagauu

SEQ ID NO: 1532199 - RNA, 19 nt, Homo sapiens
ugacauggacacagguaga

SEQ ID NO: 1532200 - RNA, 19 nt, Homo sapiens
gaaacaggcuuuacaggaa

SEQ ID NO: 1532201 - RNA, 19 nt, Homo sapiens
ggagagagcuguaaaugau

SEQ ID NO: 1532202 - RNA, 19 nt, Homo sapiens
ccacucaacugaugaauuu

SEQ ID NO: 1532203 - RNA, 19 nt, Homo sapiens
ggacaaaggacaagugaua

SEQ ID NO: 1532204 - RNA, 19 nt, Homo sapiens
gaagaaaccuauggacauu

SEQ ID NO: 1532205 - RNA, 19 nt, Homo sapiens
gaaaagagaugcuaauaga

SEQ ID NO: 1532206 - RNA, 19 nt, Homo sapiens
ugaaaugaauggaggaaua

SEQ ID NO: 1532207 - RNA, 19 nt, Homo sapiens
gaaaguagcacgucuggaa

SEQ ID NO: 1532208 - RNA, 19 nt, Homo sapiens
gaacugaagaaucgccuua

SEQ ID NO: 1532209 - RNA, 19 nt, Homo sapiens
ggagaagaaccauuuguaa

SEQ ID NO: 1532210 - RNA, 19 nt, Homo sapiens
acaaacagaugcaguguga

SEQ ID NO: 1532211 - RNA, 19 nt, Homo sapiens
gagaagaaccauuuguaaa

SEQ ID NO: 1532212 - RNA, 19 nt, Homo sapiens
gaacaaagaaagcugugaa

SEQ ID NO: 1532213 - RNA, 19 nt, Homo sapiens
ugaaagucauguugucuaa

SEQ ID NO: 1532214 - RNA, 19 nt, Homo sapiens
gaaaugaauggaggaauaa

SEQ ID NO: 1532215 - RNA, 19 nt, Homo sapiens
guuagaugcugaauacaaa

SEQ ID NO: 1532216 - RNA, 19 nt, Homo sapiens
aagaagaugucuccagaaa

SEQ ID NO: 1532217 - RNA, 19 nt, Homo sapiens
ucaaucagauggaagaaau

SEQ ID NO: 1532218 - RNA, 19 nt, Homo sapiens
ccaagaauauccacagauc

SEQ ID NO: 1532219 - RNA, 19 nt, Homo sapiens
aagaagcacuuaaagaaga

SEQ ID NO: 1532220 - RNA, 19 nt, Homo sapiens
agaagaagcacuuaaagaa

SEQ ID NO: 1532221 - RNA, 19 nt, Homo sapiens
gcaaguggguaauagucaa

SEQ ID NO: 1532222 - RNA, 19 nt, Homo sapiens
gggaggugcuggagucuga

SEQ ID NO: 1532223 - RNA, 19 nt, Homo sapiens
gaagcccacucaacugaug

SEQ ID NO: 1532224 - RNA, 19 nt, Homo sapiens
ggaagaaaccuauggacau

SEQ ID NO: 1532225 - RNA, 19 nt, Homo sapiens
ccuaagaucuccaccaaca

SEQ ID NO: 1532226 - RNA, 19 nt, Homo sapiens
uagcacgucuggaaauuga

SEQ ID NO: 1532227 - RNA, 19 nt, Homo sapiens
gcccaaagcggaagacuga

SEQ ID NO: 1532228 - RNA, 19 nt, Homo sapiens
gaagaagcacuuaaagaag

SEQ ID NO: 1532229 - RNA, 19 nt, Homo sapiens
gcuagaagaagcacuuaaa

SEQ ID NO: 1532230 - RNA, 19 nt, Homo sapiens
gcucggaauugucaucuuc

SEQ ID NO: 1532231 - RNA, 19 nt, Homo sapiens
gaagaaccauuuguaaagc

SEQ ID NO: 1532232 - RNA, 19 nt, Homo sapiens
gaacuuacuaccagaagau

SEQ ID NO: 1532233 - RNA, 19 nt, Homo sapiens
caacaaugcaaguggguaa

SEQ ID NO: 1532234 - RNA, 19 nt, Homo sapiens
aagaugaaaugaucggaaa

SEQ ID NO: 1532235 - RNA, 19 nt, Homo sapiens
gcaauugaaacaggcuuua

SEQ ID NO: 1532236 - RNA, 19 nt, Homo sapiens
aaacagaugcagugugauu

SEQ ID NO: 1532237 - RNA, 19 nt, Homo sapiens
gcuggagucugaggaguuu

SEQ ID NO: 1532238 - RNA, 19 nt, Homo sapiens
aaacagaggucuaaauccu

SEQ ID NO: 1532239 - RNA, 19 nt, Homo sapiens
gcaggucaaucagauggaa

SEQ ID NO: 1532240 - RNA, 19 nt, Homo sapiens
gaagccaagucaguaacaa

SEQ ID NO: 1532241 - RNA, 19 nt, Homo sapiens
aagaaucgccuuaaacaga

SEQ ID NO: 1532242 - RNA, 19 nt, Homo sapiens
ggagaguccuggcuuugca

SEQ ID NO: 1532243 - RNA, 19 nt, Homo sapiens
guuccagcauuaacuacua

SEQ ID NO: 1532244 - RNA, 19 nt, Homo sapiens
uaaagaaaaucgaccagaa

SEQ ID NO: 1532245 - RNA, 19 nt, Homo sapiens
ugaagaaucgccuuaaaca

SEQ ID NO: 1532246 - RNA, 19 nt, Homo sapiens
gaaauaguaaggcuuguac

SEQ ID NO: 1532247 - RNA, 19 nt, Homo sapiens
gcacuuaaagaagaacaaa

SEQ ID NO: 1532248 - RNA, 19 nt, Homo sapiens
gacaaaggacaagugauaa

SEQ ID NO: 1532249 - RNA, 19 nt, Homo sapiens
uaguaaggcuuguacaaag

SEQ ID NO: 1532250 - RNA, 19 nt, Homo sapiens
guccuaagaucuccaccaa

SEQ ID NO: 1532251 - RNA, 19 nt, Homo sapiens
aguccuggcuuugcacuua

SEQ ID NO: 1532252 - RNA, 19 nt, Homo sapiens
gcggaagacugauugaaaa

SEQ ID NO: 1532253 - RNA, 19 nt, Homo sapiens
aaagaaagcugugaaaaca

SEQ ID NO: 1532254 - RNA, 19 nt, Homo sapiens
uagaagaagcacuuaaaga

SEQ ID NO: 1532255 - RNA, 19 nt, Homo sapiens
gaugguuguuuccacuuug

SEQ ID NO: 1532256 - RNA, 19 nt, Homo sapiens
cugccgcucuccucuauuu

SEQ ID NO: 1532257 - RNA, 19 nt, Homo sapiens
gaucaaguacagaaaguag

SEQ ID NO: 1532258 - RNA, 19 nt, Homo sapiens
uuaaugccauguugaaagu

SEQ ID NO: 1532259 - RNA, 19 nt, Homo sapiens
gauuuaaugccauguugaa

SEQ ID NO: 1532260 - RNA, 19 nt, Homo sapiens
uugaagaacugaagaaucg

SEQ ID NO: 1532261 - RNA, 19 nt, Homo sapiens
cgaguaagacaaagaacuu

SEQ ID NO: 1532262 - RNA, 19 nt, Homo sapiens
caaagcggaagacugauug

SEQ ID NO: 1532263 - RNA, 19 nt, Homo sapiens
gcaucaacuuaacuauuuc

SEQ ID NO: 1532264 - RNA, 19 nt, Homo sapiens
aaagagaugcuaauagagu

SEQ ID NO: 1532265 - RNA, 19 nt, Homo sapiens
ccaaagcggaagacugauu

SEQ ID NO: 1532266 - RNA, 19 nt, Homo sapiens
ccacagaucacugcccaaa

SEQ ID NO: 1532267 - RNA, 19 nt, Homo sapiens
aagaagauuuggaucaagu

SEQ ID NO: 1532268 - RNA, 19 nt, Homo sapiens
agaagaaccauuuguaaag

SEQ ID NO: 1532269 - RNA, 19 nt, Homo sapiens
guaacaaaucggcaaaugu

SEQ ID NO: 1532270 - RNA, 19 nt, Homo sapiens
ucccaaaccuucagagagu

SEQ ID NO: 1532271 - RNA, 19 nt, Homo sapiens
aagagaugcuaauagaguu

SEQ ID NO: 1532272 - RNA, 19 nt, Homo sapiens
gcagugugauuuucaguug

SEQ ID NO: 1532273 - RNA, 19 nt, Homo sapiens
gaugcugaauacaaacaga

SEQ ID NO: 1532274 - RNA, 19 nt, Homo sapiens
agaagcacuuaaagaagaa

SEQ ID NO: 1532275 - RNA, 19 nt, Homo sapiens
gaaauaccuuggaaaaguc

SEQ ID NO: 1532276 - RNA, 19 nt, Homo sapiens
ugaaauaccuuggaaaagu

SEQ ID NO: 1532277 - RNA, 19 nt, Homo sapiens
acaaaggacaagugauaaa

SEQ ID NO: 1532278 - RNA, 19 nt, Homo sapiens
acaagaaaaucacugguuu

SEQ ID NO: 1532279 - RNA, 19 nt, Homo sapiens
gaucaaguuuuguuagaug

SEQ ID NO: 1532280 - RNA, 19 nt, Homo sapiens
uacaugguauugcuuacaa

SEQ ID NO: 1532281 - RNA, 19 nt, Homo sapiens
ggagaaagaaacaagaaaa

SEQ ID NO: 1532282 - RNA, 19 nt, Homo sapiens
caaugcaaguggguaauag

SEQ ID NO: 1532283 - RNA, 19 nt, Homo sapiens
ggaaauugagaacaaaguc

SEQ ID NO: 1532284 - RNA, 19 nt, Homo sapiens
agagagcuguaaaugauca

SEQ ID NO: 1532285 - RNA, 19 nt, Homo sapiens
uagaagcccacucaacuga

SEQ ID NO: 1532286 - RNA, 19 nt, Homo sapiens
gaaagucauguugucuaaa

SEQ ID NO: 1532287 - RNA, 19 nt, Homo sapiens
uggagaagaaccauuugua

SEQ ID NO: 1532288 - RNA, 19 nt, Homo sapiens
cgaucagaauggagaagaa

SEQ ID NO: 1532289 - RNA, 19 nt, Homo sapiens
acugaagaaucgccuuaaa

SEQ ID NO: 1532290 - RNA, 19 nt, Homo sapiens
aguaaggcuuguacaaaga

SEQ ID NO: 1532291 - RNA, 19 nt, Homo sapiens
uuuguuagaugcugaauac

SEQ ID NO: 1532292 - RNA, 19 nt, Homo sapiens
aaaccaggcaaauauguug

SEQ ID NO: 1532293 - RNA, 19 nt, Homo sapiens
gaaccacaaacugcucauu

SEQ ID NO: 1532294 - RNA, 19 nt, Homo sapiens
gugaaagucauguugucua

SEQ ID NO: 1532295 - RNA, 19 nt, Homo sapiens
uuaaacagaggucuaaauc

SEQ ID NO: 1532296 - RNA, 19 nt, Homo sapiens
caccugagcuaaaggaaaa

SEQ ID NO: 1532297 - RNA, 19 nt, Homo sapiens
gcacgucuggaaauugaga

SEQ ID NO: 1532298 - RNA, 19 nt, Homo sapiens
guugaaggacaaagagaaa

SEQ ID NO: 1532299 - RNA, 19 nt, Homo sapiens
gcaacagaaccacaaacug

SEQ ID NO: 1532300 - RNA, 19 nt, Homo sapiens
ggaaugaauuugagaacuu

SEQ ID NO: 1532301 - RNA, 19 nt, Homo sapiens
gagagaauauuacgaggaa

SEQ ID NO: 1532302 - RNA, 19 nt, Homo sapiens
cauguuugcuuauggcuua

SEQ ID NO: 1532303 - RNA, 19 nt, Homo sapiens
agaaucacauguuugcuua

SEQ ID NO: 1532304 - RNA, 19 nt, Homo sapiens
ggaaucagaugccucgaau

SEQ ID NO: 1532305 - RNA, 19 nt, Homo sapiens
ggaacaaaggaaugaauuu

SEQ ID NO: 1532306 - RNA, 19 nt, Homo sapiens
gaaugaauuugagaacuuc

SEQ ID NO: 1532307 - RNA, 19 nt, Homo sapiens
aaucagaugccucgaauuu

SEQ ID NO: 1532308 - RNA, 19 nt, Homo sapiens
agucaagaaucacauguuu

SEQ ID NO: 1532309 - RNA, 19 nt, Homo sapiens
aagaaucagucaagaauca

SEQ ID NO: 1532310 - RNA, 19 nt, Homo sapiens
ggcagaagcuucggguuga

SEQ ID NO: 1532311 - RNA, 19 nt, Homo sapiens
gagaagaggcgagugaaga

SEQ ID NO: 1532312 - RNA, 19 nt, Homo sapiens
gcagauggcgggagaagag

SEQ ID NO: 1532313 - RNA, 19 nt, Homo sapiens
gcaaaagaaucagucaaga

SEQ ID NO: 1532314 - RNA, 19 nt, Homo sapiens
caucugaggugagcaacug

SEQ ID NO: 1532315 - RNA, 19 nt, Homo sapiens
gcacccauccuaucucuac

SEQ ID NO: 1532316 - RNA, 19 nt, Homo sapiens
gagaauauuacgaggaaca

SEQ ID NO: 1532317 - RNA, 19 nt, Homo sapiens
gaacuucguggaggaacaa

SEQ ID NO: 1532318 - RNA, 19 nt, Homo sapiens
aaucacauguuugcuuaug

SEQ ID NO: 1532319 - RNA, 19 nt, Homo sapiens
caaagcuuguagcaccauu

SEQ ID NO: 1532320 - RNA, 19 nt, Homo sapiens
gaggaacaaaggaaugaau

SEQ ID NO: 1532321 - RNA, 19 nt, Homo sapiens
gaugagcugcggagagaau

SEQ ID NO: 1532322 - RNA, 19 nt, Homo sapiens
uugaugagcugcggagaga

SEQ ID NO: 1532323 - RNA, 19 nt, Homo sapiens
gcagaagcuucggguugau

SEQ ID NO: 1532324 - RNA, 19 nt, Homo sapiens
ucagaugccucgaauuucc

SEQ ID NO: 1532325 - RNA, 19 nt, Homo sapiens
gaagaggcgagugaagaug

SEQ ID NO: 1532326 - RNA, 19 nt, Homo sapiens
gaauauuacgaggaacaaa

SEQ ID NO: 1532327 - RNA, 19 nt, Homo sapiens
gagcugcggagagaauauu

SEQ ID NO: 1532328 - RNA, 19 nt, Homo sapiens
gagagagggaaccagugua

SEQ ID NO: 1532329 - RNA, 19 nt, Homo sapiens
ucaagaaucacauguuugc

SEQ ID NO: 1532330 - RNA, 19 nt, Homo sapiens
caaaagaaucagucaagaa

SEQ ID NO: 1532331 - RNA, 19 nt, Homo sapiens
ccucgaauuuccucaagag

SEQ ID NO: 1532332 - RNA, 19 nt, Homo sapiens
gcuccugucuaugcugaga

SEQ ID NO: 1532333 - RNA, 19 nt, Homo sapiens
ggagaagaggcgagugaag

SEQ ID NO: 1532334 - RNA, 19 nt, Homo sapiens
agagagggaaccaguguau

SEQ ID NO: 1532335 - RNA, 19 nt, Homo sapiens
aagaaucacauguuugcuu

SEQ ID NO: 1532336 - RNA, 19 nt, Homo sapiens
gccagcagcucuugaaaag

SEQ ID NO: 1532337 - RNA, 19 nt, Homo sapiens
ugagagagggaaccagugu

SEQ ID NO: 1532338 - RNA, 19 nt, Homo sapiens
gcaaucuuucccaugcaaa

SEQ ID NO: 1532339 - RNA, 19 nt, Homo sapiens
ccguggugcuccugucuau

SEQ ID NO: 1532340 - RNA, 19 nt, Homo sapiens
gaugaggucaauguggaaa

SEQ ID NO: 1532341 - RNA, 19 nt, Homo sapiens
gaaucagaugccucgaauu

SEQ ID NO: 1532342 - RNA, 19 nt, Homo sapiens
caaagaugacuuggagaca

SEQ ID NO: 1532343 - RNA, 19 nt, Homo sapiens
gcaguggccagcagcucuu

SEQ ID NO: 1532344 - RNA, 19 nt, Homo sapiens
gaaucagucaagaaucaca

SEQ ID NO: 1532345 - RNA, 19 nt, Homo sapiens
agaagaggcgagugaagau

SEQ ID NO: 1532346 - RNA, 19 nt, Homo sapiens
cacgugaucccauccugaa

SEQ ID NO: 1532347 - RNA, 19 nt, Homo sapiens
aggaacaaaggaaugaauu

SEQ ID NO: 1532348 - RNA, 19 nt, Homo sapiens
agagggaaccaguguaucu

SEQ ID NO: 1532349 - RNA, 19 nt, Homo sapiens
gaaucacauguuugcuuau

SEQ ID NO: 1532350 - RNA, 19 nt, Homo sapiens
caucaucugaggugagcaa

SEQ ID NO: 1532351 - RNA, 19 nt, Homo sapiens
acaaaacgaugagcaggaa

SEQ ID NO: 1532352 - RNA, 19 nt, Homo sapiens
gucccgagaugaggucaau

SEQ ID NO: 1532353 - RNA, 19 nt, Homo sapiens
gaaccuaacuguccauaag

SEQ ID NO: 1532354 - RNA, 19 nt, Homo sapiens
gaagacauguuccucuaug

SEQ ID NO: 1532355 - RNA, 19 nt, Homo sapiens
guaaagugcaguaugauuu

SEQ ID NO: 1532356 - RNA, 19 nt, Homo sapiens
gaccuaggcaaguuuauua

SEQ ID NO: 1532357 - RNA, 19 nt, Homo sapiens
uuacguaucugccuccuuu

SEQ ID NO: 1532358 - RNA, 19 nt, Homo sapiens
cugaagaucuuaugaccua

SEQ ID NO: 1532359 - RNA, 19 nt, Homo sapiens
uuauuaaccuccucuauga

SEQ ID NO: 1532360 - RNA, 19 nt, Homo sapiens
guaccuauguagaaccuaa

SEQ ID NO: 1532361 - RNA, 19 nt, Homo sapiens
gagaaaggcaguaagaguu

SEQ ID NO: 1532362 - RNA, 19 nt, Homo sapiens
caaagaucauuggagguua

SEQ ID NO: 1532363 - RNA, 19 nt, Homo sapiens
agacacaggaaucuaauua

SEQ ID NO: 1532364 - RNA, 19 nt, Homo sapiens
ucaggaaucuggaucuguu

SEQ ID NO: 1532365 - RNA, 19 nt, Homo sapiens
gcucuggguugaaauccua

SEQ ID NO: 1532366 - RNA, 19 nt, Homo sapiens
gguuccagauuuauaguuu

SEQ ID NO: 1532367 - RNA, 19 nt, Homo sapiens
cagcuugcauuuccaaaga

SEQ ID NO: 1532368 - RNA, 19 nt, Homo sapiens
gaucuacccuuggccagaa

SEQ ID NO: 1532369 - RNA, 19 nt, Homo sapiens
aaacaucagccauuacauu

SEQ ID NO: 1532370 - RNA, 19 nt, Homo sapiens
caacagcugcacagaauau

SEQ ID NO: 1532371 - RNA, 19 nt, Homo sapiens
gacggcagguugcuucuga

SEQ ID NO: 1532372 - RNA, 19 nt, Homo sapiens
gguauaguuucugugauuu

SEQ ID NO: 1532373 - RNA, 19 nt, Homo sapiens
ccaaagugcugggauuaca

SEQ ID NO: 1532374 - RNA, 19 nt, Homo sapiens
ggguugaaauccuaacuuc

SEQ ID NO: 1532375 - RNA, 19 nt, Homo sapiens
aacaucagccauuacauua

SEQ ID NO: 1532376 - RNA, 19 nt, Homo sapiens
caucaucucggcuuacauu

SEQ ID NO: 1532377 - RNA, 19 nt, Homo sapiens
aaagagaaaggcaguaaga

SEQ ID NO: 1532378 - RNA, 19 nt, Homo sapiens
aaggagacauccauacguu

SEQ ID NO: 1532379 - RNA, 19 nt, Homo sapiens
acagguuuguguuucauaa

SEQ ID NO: 1532380 - RNA, 19 nt, Homo sapiens
ugguauaguuucugugauu

SEQ ID NO: 1532381 - RNA, 19 nt, Homo sapiens
gagcagugcagguuucguu

SEQ ID NO: 1532382 - RNA, 19 nt, Homo sapiens
acaacgaggcccaaucuuu

SEQ ID NO: 1532383 - RNA, 19 nt, Homo sapiens
gugcggaacacauaguuaa

SEQ ID NO: 1532384 - RNA, 19 nt, Homo sapiens
ccuccucuaugacgugaua

SEQ ID NO: 1532385 - RNA, 19 nt, Homo sapiens
uuacuuggcucuggguuga

SEQ ID NO: 1532386 - RNA, 19 nt, Homo sapiens
cccuaagguuccagauuua

SEQ ID NO: 1532387 - RNA, 19 nt, Homo sapiens
gacacaggaaucuaauuaa

SEQ ID NO: 1532388 - RNA, 19 nt, Homo sapiens
gguaaagugcaguaugauu

SEQ ID NO: 1532389 - RNA, 19 nt, Homo sapiens
aggguaaagugcaguauga

SEQ ID NO: 1532390 - RNA, 19 nt, Homo sapiens
ccaccagcccagcuaauuu

SEQ ID NO: 1532391 - RNA, 19 nt, Homo sapiens
gaaaagagaaaggcaguaa

SEQ ID NO: 1532392 - RNA, 19 nt, Homo sapiens
gaaauccuaacuucaucaa

SEQ ID NO: 1532393 - RNA, 19 nt, Homo sapiens
gagaugacagugaguuugu

SEQ ID NO: 1532394 - RNA, 19 nt, Homo sapiens
gaaggaguaugggguaaaa

SEQ ID NO: 1532395 - RNA, 19 nt, Homo sapiens
aaagacaaauagagacaca

SEQ ID NO: 1532396 - RNA, 19 nt, Homo sapiens
ucaaagaucauuggagguu

SEQ ID NO: 1532397 - RNA, 19 nt, Homo sapiens
gcaacagcugcacagaaua

SEQ ID NO: 1532398 - RNA, 19 nt, Homo sapiens
gcaguaagaguugccuuga

SEQ ID NO: 1532399 - RNA, 19 nt, Homo sapiens
gacagugaguuugugagaa

SEQ ID NO: 1532400 - RNA, 19 nt, Homo sapiens
caacgaggcccaaucuuuu

SEQ ID NO: 1532401 - RNA, 19 nt, Homo sapiens
caucagccauuacauuacu

SEQ ID NO: 1532402 - RNA, 19 nt, Homo sapiens
cuaagguuccagauuuaua

SEQ ID NO: 1532403 - RNA, 19 nt, Homo sapiens
acaaauagagacacaggaa

SEQ ID NO: 1532404 - RNA, 19 nt, Homo sapiens
cggaacacauaguuaagug

SEQ ID NO: 1532405 - RNA, 19 nt, Homo sapiens
agcaacagcugcacagaau

SEQ ID NO: 1532406 - RNA, 19 nt, Homo sapiens
gggcaauaaugcagggaau

SEQ ID NO: 1532407 - RNA, 19 nt, Homo sapiens
acauguuccucuaugcuaa

SEQ ID NO: 1532408 - RNA, 19 nt, Homo sapiens
gacauguuccucuaugcua

SEQ ID NO: 1532409 - RNA, 19 nt, Homo sapiens
cagccucuaugauuucaau

SEQ ID NO: 1532410 - RNA, 19 nt, Homo sapiens
gaaaacaucagccauuaca

SEQ ID NO: 1532411 - RNA, 19 nt, Homo sapiens
ugagcaucaucucggcuua

SEQ ID NO: 1532412 - RNA, 19 nt, Homo sapiens
gaaggagacauccauacgu

SEQ ID NO: 1532413 - RNA, 19 nt, Homo sapiens
uagcuaugaugaacugcaa

SEQ ID NO: 1532414 - RNA, 19 nt, Homo sapiens
ugaguuagcuaugaugaac

SEQ ID NO: 1532415 - RNA, 19 nt, Homo sapiens
gugcccagccucuaugauu

SEQ ID NO: 1532416 - RNA, 19 nt, Homo sapiens
aguaagaguugccuugagu

SEQ ID NO: 1532417 - RNA, 19 nt, Homo sapiens
guuccucuaugcuaagaug

SEQ ID NO: 1532418 - RNA, 19 nt, Homo sapiens
uggaaaacaucagccauua

SEQ ID NO: 1532419 - RNA, 19 nt, Homo sapiens
gaugacagugaguuuguga

SEQ ID NO: 1532420 - RNA, 19 nt, Homo sapiens
ugcccagccucuaugauuu

SEQ ID NO: 1532421 - RNA, 19 nt, Homo sapiens
gcaauaaugcagggaaucu

SEQ ID NO: 1532422 - RNA, 19 nt, Homo sapiens
ccucuaugcuaagaugauu

SEQ ID NO: 1532423 - RNA, 19 nt, Homo sapiens
aauccuaacuucaucaacu

SEQ ID NO: 1532424 - RNA, 19 nt, Homo sapiens
guaaugggaaggagacauc

SEQ ID NO: 1532425 - RNA, 19 nt, Homo sapiens
ccaaagacaaauagagaca

SEQ ID NO: 1532426 - RNA, 19 nt, Homo sapiens
agaaaggcaguaagaguug

SEQ ID NO: 1532427 - RNA, 19 nt, Homo sapiens
uauggcaaauccagucuca

SEQ ID NO: 1532428 - RNA, 19 nt, Homo sapiens
cauaguuaagugcuugaua

SEQ ID NO: 1532429 - RNA, 19 nt, Homo sapiens
cuuaugaccuaggcaaguu

SEQ ID NO: 1532430 - RNA, 19 nt, Homo sapiens
gaucauuggagguuacaca

SEQ ID NO: 1532431 - RNA, 19 nt, Homo sapiens
cggauuagaagacauguuc

SEQ ID NO: 1532432 - RNA, 19 nt, Homo sapiens
gcagugcagguuucguuau

SEQ ID NO: 1532433 - RNA, 19 nt, Homo sapiens
guuucguuauccuguguua

SEQ ID NO: 1532434 - RNA, 19 nt, Homo sapiens
guuccagauuuauaguuug

SEQ ID NO: 1532435 - RNA, 19 nt, Homo sapiens
uaagguuccagauuuauag

SEQ ID NO: 1532436 - RNA, 19 nt, Homo sapiens
ggagacauccauacguuuu

SEQ ID NO: 1532437 - RNA, 19 nt, Homo sapiens
ggaaggagacauccauacg

SEQ ID NO: 1532438 - RNA, 19 nt, Homo sapiens
gagacacaggaaucuaauu

SEQ ID NO: 1532439 - RNA, 19 nt, Homo sapiens
caaauagagacacaggaau

SEQ ID NO: 1532440 - RNA, 19 nt, Homo sapiens
aaagggagaaggaguaugg

SEQ ID NO: 1532441 - RNA, 19 nt, Homo sapiens
acagugaguuugugagaac

SEQ ID NO: 1532442 - RNA, 19 nt, Homo sapiens
ugacagugaguuugugaga

SEQ ID NO: 1532443 - RNA, 19 nt, Homo sapiens
aaagaucauuggagguuac

SEQ ID NO: 1532444 - RNA, 19 nt, Homo sapiens
uaaugagccuccuccuucu

SEQ ID NO: 1532445 - RNA, 19 nt, Homo sapiens
ccgcgaaaaucaagauaaa

SEQ ID NO: 1532446 - RNA, 19 nt, Homo sapiens
ccccuaagguuccagauuu

SEQ ID NO: 1532447 - RNA, 19 nt, Homo sapiens
aaauagagacacaggaauc

SEQ ID NO: 1532448 - RNA, 19 nt, Homo sapiens
ggauuacaggcaugagcua

SEQ ID NO: 1532449 - RNA, 19 nt, Homo sapiens
gguugcuucugaccuaaug

SEQ ID NO: 1532450 - RNA, 19 nt, Homo sapiens
gcucaggaaucuggaucug

SEQ ID NO: 1532451 - RNA, 19 nt, Homo sapiens
guccauaaguaaacacaac

SEQ ID NO: 1532452 - RNA, 19 nt, Homo sapiens
cagugcagguuucguuauc

SEQ ID NO: 1532453 - RNA, 19 nt, Homo sapiens
aaaggaagcuuguuuguaa

SEQ ID NO: 1532454 - RNA, 19 nt, Homo sapiens
gaacuaagacuuucuagaa

SEQ ID NO: 1532455 - RNA, 19 nt, Homo sapiens
ggaaacagacuucgcauuu

SEQ ID NO: 1532456 - RNA, 19 nt, Homo sapiens
gaagggcucuuaugaguca

SEQ ID NO: 1532457 - RNA, 19 nt, Homo sapiens
gcaguuaaauuaucucugu

SEQ ID NO: 1532458 - RNA, 19 nt, Homo sapiens
gcacugagcugagauuaag

SEQ ID NO: 1532459 - RNA, 19 nt, Homo sapiens
gcucaugccuguaauccua

SEQ ID NO: 1532460 - RNA, 19 nt, Homo sapiens
gaggugaacacaauuauuu

SEQ ID NO: 1532461 - RNA, 19 nt, Homo sapiens
ccaaggaaguuguguaaau

SEQ ID NO: 1532462 - RNA, 19 nt, Homo sapiens
gcaaagggagagaaucaua

SEQ ID NO: 1532463 - RNA, 19 nt, Homo sapiens
ggaguaacaugaaauaaac

SEQ ID NO: 1532464 - RNA, 19 nt, Homo sapiens
gaauuguccuuauagcauu

SEQ ID NO: 1532465 - RNA, 19 nt, Homo sapiens
guauacagaucaaagcaaa

SEQ ID NO: 1532466 - RNA, 19 nt, Homo sapiens
cgaaauaccucccagaaac

SEQ ID NO: 1532467 - RNA, 19 nt, Homo sapiens
caagaggaguaacaugaaa

SEQ ID NO: 1532468 - RNA, 19 nt, Homo sapiens
gaaaggccguagcaguuug

SEQ ID NO: 1532469 - RNA, 19 nt, Homo sapiens
aaauagaggugaacacaau

SEQ ID NO: 1532470 - RNA, 19 nt, Homo sapiens
aaacagacuucgcauuuca

SEQ ID NO: 1532471 - RNA, 19 nt, Homo sapiens
aacaacaaguucugaguua

SEQ ID NO: 1532472 - RNA, 19 nt, Homo sapiens
caaggaaguuguguaaaug

SEQ ID NO: 1532473 - RNA, 19 nt, Homo sapiens
caacagugauaccuacgaa

SEQ ID NO: 1532474 - RNA, 19 nt, Homo sapiens
cgacuucgaugccaaggaa

SEQ ID NO: 1532475 - RNA, 19 nt, Homo sapiens
ccagaaacaugaagcaauc

SEQ ID NO: 1532476 - RNA, 19 nt, Homo sapiens
ggaaagacuuaaccuaaaa

SEQ ID NO: 1532477 - RNA, 19 nt, Homo sapiens
gcaagaaagcauuaguaaa

SEQ ID NO: 1532478 - RNA, 19 nt, Homo sapiens
gacaagaacugugaaagag

SEQ ID NO: 1532479 - RNA, 19 nt, Homo sapiens
gcagagucauuaaacaauc

SEQ ID NO: 1532480 - RNA, 19 nt, Homo sapiens
ucacauggcuacugggaau

SEQ ID NO: 1532481 - RNA, 19 nt, Homo sapiens
caucgaagacucacuggua

SEQ ID NO: 1532482 - RNA, 19 nt, Homo sapiens
gaacacguauacuuuugua

SEQ ID NO: 1532483 - RNA, 19 nt, Homo sapiens
caaagggagagaaucauaa

SEQ ID NO: 1532484 - RNA, 19 nt, Homo sapiens
gcaagaggaguaacaugaa

SEQ ID NO: 1532485 - RNA, 19 nt, Homo sapiens
gaagccauguguaacaaag

SEQ ID NO: 1532486 - RNA, 19 nt, Homo sapiens
ucuaggagauucugccaaa

SEQ ID NO: 1532487 - RNA, 19 nt, Homo sapiens
gaaacgcacaggaacgaaa

SEQ ID NO: 1532488 - RNA, 19 nt, Homo sapiens
aggaaagacuuaaccuaaa

SEQ ID NO: 1532489 - RNA, 19 nt, Homo sapiens
guucguuucuucucacauu

SEQ ID NO: 1532490 - RNA, 19 nt, Homo sapiens
ggaauuguccuuauagcau

SEQ ID NO: 1532491 - RNA, 19 nt, Homo sapiens
cagaaaggccguagcaguu

SEQ ID NO: 1532492 - RNA, 19 nt, Homo sapiens
gaaauaccucccagaaaca

SEQ ID NO: 1532493 - RNA, 19 nt, Homo sapiens
ccuguaauccuaacacuuu

SEQ ID NO: 1532494 - RNA, 19 nt, Homo sapiens
cgaagacucacugguaaua

SEQ ID NO: 1532495 - RNA, 19 nt, Homo sapiens
acaaauuccugauagaaca

SEQ ID NO: 1532496 - RNA, 19 nt, Homo sapiens
uguaauacgugugcauaaa

SEQ ID NO: 1532497 - RNA, 19 nt, Homo sapiens
aaaccucaacuguguauuu

SEQ ID NO: 1532498 - RNA, 19 nt, Homo sapiens
gggagagaaucauaacauc

SEQ ID NO: 1532499 - RNA, 19 nt, Homo sapiens
gcaggagaauugauugaac

SEQ ID NO: 1532500 - RNA, 19 nt, Homo sapiens
cagcaagaaagcauuagua

SEQ ID NO: 1532501 - RNA, 19 nt, Homo sapiens
guaugccucugccugaauu

SEQ ID NO: 1532502 - RNA, 19 nt, Homo sapiens
guucugaguuacuuaggaa

SEQ ID NO: 1532503 - RNA, 19 nt, Homo sapiens
aagacucacugguaauauu

SEQ ID NO: 1532504 - RNA, 19 nt, Homo sapiens
cuagacaaauuccugauag

SEQ ID NO: 1532505 - RNA, 19 nt, Homo sapiens
agagcaaggucuaaacuuc

SEQ ID NO: 1532506 - RNA, 19 nt, Homo sapiens
aaucacaguucguuucuuc

SEQ ID NO: 1532507 - RNA, 19 nt, Homo sapiens
cuaaugaacacguauacuu

SEQ ID NO: 1532508 - RNA, 19 nt, Homo sapiens
gagagaaucauaacaucug

SEQ ID NO: 1532509 - RNA, 19 nt, Homo sapiens
agacuucgcauuucaauca

SEQ ID NO: 1532510 - RNA, 19 nt, Homo sapiens
gggcaaagggagagaauca

SEQ ID NO: 1532511 - RNA, 19 nt, Homo sapiens
agacaagaacugugaaaga

SEQ ID NO: 1532512 - RNA, 19 nt, Homo sapiens
gagauucugccaaaggauu

SEQ ID NO: 1532513 - RNA, 19 nt, Homo sapiens
ggcaaaaccuuaagauugu

SEQ ID NO: 1532514 - RNA, 19 nt, Homo sapiens
aaucucugcuguauccuuu

SEQ ID NO: 1532515 - RNA, 19 nt, Homo sapiens
aagauuccguucccaagaa

SEQ ID NO: 1532516 - RNA, 19 nt, Homo sapiens
gaaaccccgucucuacuaa

SEQ ID NO: 1532517 - RNA, 19 nt, Homo sapiens
cuaaacuucuggcuucuag

SEQ ID NO: 1532518 - RNA, 19 nt, Homo sapiens
ccacagagcaaggucuaaa

SEQ ID NO: 1532519 - RNA, 19 nt, Homo sapiens
gaacugugaaagagagaga

SEQ ID NO: 1532520 - RNA, 19 nt, Homo sapiens
caaagagaaaugugcaaau

SEQ ID NO: 1532521 - RNA, 19 nt, Homo sapiens
aaacaacaaguucugaguu

SEQ ID NO: 1532522 - RNA, 19 nt, Homo sapiens
cagagucauuaaacaauca

SEQ ID NO: 1532523 - RNA, 19 nt, Homo sapiens
agaggaguaacaugaaaua

SEQ ID NO: 1532524 - RNA, 19 nt, Homo sapiens
gaagacucacugguaauau

SEQ ID NO: 1532525 - RNA, 19 nt, Homo sapiens
uagacaaauuccugauaga

SEQ ID NO: 1532526 - RNA, 19 nt, Homo sapiens
auaggcagcuuuccuucuu

SEQ ID NO: 1532527 - RNA, 19 nt, Homo sapiens
agagaaucauaacaucuga

SEQ ID NO: 1532528 - RNA, 19 nt, Homo sapiens
gcaugaggcuuuuaugaca

SEQ ID NO: 1532529 - RNA, 19 nt, Homo sapiens
aaagaagccauguguaaca

SEQ ID NO: 1532530 - RNA, 19 nt, Homo sapiens
ggccuuugcuguuguggau

SEQ ID NO: 1532531 - RNA, 19 nt, Homo sapiens
ggaagcuuguuuguaauac

SEQ ID NO: 1532532 - RNA, 19 nt, Homo sapiens
ggagagaaucauaacaucu

SEQ ID NO: 1532533 - RNA, 19 nt, Homo sapiens
caagauuccguucccaaga

SEQ ID NO: 1532534 - RNA, 19 nt, Homo sapiens
gaugaaaacuccagaaacg

SEQ ID NO: 1532535 - RNA, 19 nt, Homo sapiens
guagacaagaacugugaaa

SEQ ID NO: 1532536 - RNA, 19 nt, Homo sapiens
cguagcaguuugacgauag

SEQ ID NO: 1532537 - RNA, 19 nt, Homo sapiens
gcuacugggaauauaaauu

SEQ ID NO: 1532538 - RNA, 19 nt, Homo sapiens
gaggaguaacaugaaauaa

SEQ ID NO: 1532539 - RNA, 19 nt, Homo sapiens
agacucacugguaauauuu

SEQ ID NO: 1532540 - RNA, 19 nt, Homo sapiens
augaagggcucuuaugagu

SEQ ID NO: 1532541 - RNA, 19 nt, Homo sapiens
agacaaauuccugauagaa

SEQ ID NO: 1532542 - RNA, 19 nt, Homo sapiens
uagcauugcauacacaaga

SEQ ID NO: 1532543 - RNA, 19 nt, Homo sapiens
agaaaggccguagcaguuu

SEQ ID NO: 1532544 - RNA, 19 nt, Homo sapiens
gcacaggaacgaaauaccu

SEQ ID NO: 1532545 - RNA, 19 nt, Homo sapiens
gagcaaggucuaaacuucu

SEQ ID NO: 1532546 - RNA, 19 nt, Homo sapiens
auagaggugaacacaauua

SEQ ID NO: 1532547 - RNA, 19 nt, Homo sapiens
uaaauagaggugaacacaa

SEQ ID NO: 1532548 - RNA, 19 nt, Homo sapiens
guucaacaauaagggcaaa

SEQ ID NO: 1532549 - RNA, 19 nt, Homo sapiens
aagaagccauguguaacaa

SEQ ID NO: 1532550 - RNA, 19 nt, Homo sapiens
uaaaaucucugcuguaucc

SEQ ID NO: 1532551 - RNA, 19 nt, Homo sapiens
guccuuauagcauugcaua

SEQ ID NO: 1532552 - RNA, 19 nt, Homo sapiens
acugcaauguuuaggaauu

SEQ ID NO: 1532553 - RNA, 19 nt, Homo sapiens
gaucagggcuauucuaauu

SEQ ID NO: 1532554 - RNA, 19 nt, Homo sapiens
ggacaaagcucucaguauc

SEQ ID NO: 1532555 - RNA, 19 nt, Homo sapiens
gaggagaacuacaggcuua

SEQ ID NO: 1532556 - RNA, 19 nt, Homo sapiens
gaagaaauuccuuugguua

SEQ ID NO: 1532557 - RNA, 19 nt, Homo sapiens
ugaaccagaugcacuauua

SEQ ID NO: 1532558 - RNA, 19 nt, Homo sapiens
gaacuacaggcuuaucuua

SEQ ID NO: 1532559 - RNA, 19 nt, Homo sapiens
gaaaugugcuuccggacaa

SEQ ID NO: 1532560 - RNA, 19 nt, Homo sapiens
gaaagcaaaggucauauuu

SEQ ID NO: 1532561 - RNA, 19 nt, Homo sapiens
ggucauauuuggaaacuga

SEQ ID NO: 1532562 - RNA, 19 nt, Homo sapiens
gggacagccugcauaauuu

SEQ ID NO: 1532563 - RNA, 19 nt, Homo sapiens
cuaccacucuggagaaaua

SEQ ID NO: 1532564 - RNA, 19 nt, Homo sapiens
gccauuagcuuguuagcaa

SEQ ID NO: 1532565 - RNA, 19 nt, Homo sapiens
guuaguaaauucugcauga

SEQ ID NO: 1532566 - RNA, 19 nt, Homo sapiens
caacgacccuggaugaugu

SEQ ID NO: 1532567 - RNA, 19 nt, Homo sapiens
cagaaguacuuguaucaaa

SEQ ID NO: 1532568 - RNA, 19 nt, Homo sapiens
gcucuggacuuucuaugaa

SEQ ID NO: 1532569 - RNA, 19 nt, Homo sapiens
caaguuaagugacaagcaa

SEQ ID NO: 1532570 - RNA, 19 nt, Homo sapiens
gcugggauguucuuauauu

SEQ ID NO: 1532571 - RNA, 19 nt, Homo sapiens
aaaguacgcuuccucaguu

SEQ ID NO: 1532572 - RNA, 19 nt, Homo sapiens
gaagugguccagagaguuu

SEQ ID NO: 1532573 - RNA, 19 nt, Homo sapiens
acuaauagcuggaggaaau

SEQ ID NO: 1532574 - RNA, 19 nt, Homo sapiens
gaaauuccuuugguuacaa

SEQ ID NO: 1532575 - RNA, 19 nt, Homo sapiens
cagacuacuuuacagaaua

SEQ ID NO: 1532576 - RNA, 19 nt, Homo sapiens
caacaugaguaauaaagag

SEQ ID NO: 1532577 - RNA, 19 nt, Homo sapiens
ugaaaugcuuccugaaaug

SEQ ID NO: 1532578 - RNA, 19 nt, Homo sapiens
ccacuacgauugcuaucuu

SEQ ID NO: 1532579 - RNA, 19 nt, Homo sapiens
gcaggaagccccagaauuu

SEQ ID NO: 1532580 - RNA, 19 nt, Homo sapiens
gaaaguacgcuuccucagu

SEQ ID NO: 1532581 - RNA, 19 nt, Homo sapiens
gcagugaaggugcuaauga

SEQ ID NO: 1532582 - RNA, 19 nt, Homo sapiens
guggagauauuucuacaga

SEQ ID NO: 1532583 - RNA, 19 nt, Homo sapiens
ugaagaaauuccuuugguu

SEQ ID NO: 1532584 - RNA, 19 nt, Homo sapiens
agacuguccuuaauugaaa

SEQ ID NO: 1532585 - RNA, 19 nt, Homo sapiens
caaagccaguguauggaaa

SEQ ID NO: 1532586 - RNA, 19 nt, Homo sapiens
gaaaugcuuccugaaauga

SEQ ID NO: 1532587 - RNA, 19 nt, Homo sapiens
ccagaugcacuauuacuaa

SEQ ID NO: 1532588 - RNA, 19 nt, Homo sapiens
gugacaagcaaauguaaua

SEQ ID NO: 1532589 - RNA, 19 nt, Homo sapiens
aaacugaugggauuaauug

SEQ ID NO: 1532590 - RNA, 19 nt, Homo sapiens
cagcugcuccugccacuua

SEQ ID NO: 1532591 - RNA, 19 nt, Homo sapiens
cugcugggauguucuuaua

SEQ ID NO: 1532592 - RNA, 19 nt, Homo sapiens
gugaggaucuucaacaucu

SEQ ID NO: 1532593 - RNA, 19 nt, Homo sapiens
gaaacugaugggauuaauu

SEQ ID NO: 1532594 - RNA, 19 nt, Homo sapiens
ggaaacugaugggauuaau

SEQ ID NO: 1532595 - RNA, 19 nt, Homo sapiens
gaagaucagcuuagagaag

SEQ ID NO: 1532596 - RNA, 19 nt, Homo sapiens
ugaaaucccacaugaaaug

SEQ ID NO: 1532597 - RNA, 19 nt, Homo sapiens
cagccaugaucauuacuuu

SEQ ID NO: 1532598 - RNA, 19 nt, Homo sapiens
ggaggaagcguggaaaugu

SEQ ID NO: 1532599 - RNA, 19 nt, Homo sapiens
gcaacacacucaccuccau

SEQ ID NO: 1532600 - RNA, 19 nt, Homo sapiens
ucguuuaucuuucuucuga

SEQ ID NO: 1532601 - RNA, 19 nt, Homo sapiens
uaacugccuucaugggauu

SEQ ID NO: 1532602 - RNA, 19 nt, Homo sapiens
aaggaggacuuuaagcaaa

SEQ ID NO: 1532603 - RNA, 19 nt, Homo sapiens
cuccuucucuauuacauua

SEQ ID NO: 1532604 - RNA, 19 nt, Homo sapiens
gaggaagcguggaaaugug

SEQ ID NO: 1532605 - RNA, 19 nt, Homo sapiens
uaagugacaagcaaaugua

SEQ ID NO: 1532606 - RNA, 19 nt, Homo sapiens
gagcagccuucucaucauc

SEQ ID NO: 1532607 - RNA, 19 nt, Homo sapiens
cagugaaggugcuaaugaa

SEQ ID NO: 1532608 - RNA, 19 nt, Homo sapiens
ccugugcaauuauaaacua

SEQ ID NO: 1532609 - RNA, 19 nt, Homo sapiens
gcucuuggcuauauaugag

SEQ ID NO: 1532610 - RNA, 19 nt, Homo sapiens
gaugauguuucuccugcaa

SEQ ID NO: 1532611 - RNA, 19 nt, Homo sapiens
uuuauaagcucccuaacug

SEQ ID NO: 1532612 - RNA, 19 nt, Homo sapiens
ugaaggugcuaaugaaagu

SEQ ID NO: 1532613 - RNA, 19 nt, Homo sapiens
cagaagggccucucacuca

SEQ ID NO: 1532614 - RNA, 19 nt, Homo sapiens
gaccagaaguacuuguauc

SEQ ID NO: 1532615 - RNA, 19 nt, Homo sapiens
uaucuugugucaugaaauc

SEQ ID NO: 1532616 - RNA, 19 nt, Homo sapiens
ccagacuacuuuacagaau

SEQ ID NO: 1532617 - RNA, 19 nt, Homo sapiens
acacaacgacccuggauga

SEQ ID NO: 1532618 - RNA, 19 nt, Homo sapiens
guugaaaugcuuccugaaa

SEQ ID NO: 1532619 - RNA, 19 nt, Homo sapiens
gauuauacauuggccuuuc

SEQ ID NO: 1532620 - RNA, 19 nt, Homo sapiens
gugcacagucaaagaauuu

SEQ ID NO: 1532621 - RNA, 19 nt, Homo sapiens
gaagggccucucacucauu

SEQ ID NO: 1532622 - RNA, 19 nt, Homo sapiens
ucagggcuauucuaauuuc

SEQ ID NO: 1532623 - RNA, 19 nt, Homo sapiens
aagaucagcuuagagaaga

SEQ ID NO: 1532624 - RNA, 19 nt, Homo sapiens
gaggagaaacggaaugcaa

SEQ ID NO: 1532625 - RNA, 19 nt, Homo sapiens
ugaaauacucuccaggauu

SEQ ID NO: 1532626 - RNA, 19 nt, Homo sapiens
uaucagaacuagaccaacu

SEQ ID NO: 1532627 - RNA, 19 nt, Homo sapiens
agaaugagacagaagauau

SEQ ID NO: 1532628 - RNA, 19 nt, Homo sapiens
gaacuuuguaacugugaaa

SEQ ID NO: 1532629 - RNA, 19 nt, Homo sapiens
cgugucagcugauccaugu

SEQ ID NO: 1532630 - RNA, 19 nt, Homo sapiens
gcuaucuugugucaugaaa

SEQ ID NO: 1532631 - RNA, 19 nt, Homo sapiens
cauaggagcagccuucuca

SEQ ID NO: 1532632 - RNA, 19 nt, Homo sapiens
ggcaguacuuugacacuuc

SEQ ID NO: 1532633 - RNA, 19 nt, Homo sapiens
gauccuagguuggcuuucu

SEQ ID NO: 1532634 - RNA, 19 nt, Homo sapiens
ggagcagccuucucaucau

SEQ ID NO: 1532635 - RNA, 19 nt, Homo sapiens
ugaaagcaaaggucauauu

SEQ ID NO: 1532636 - RNA, 19 nt, Homo sapiens
gccucucacucauuucuaa

SEQ ID NO: 1532637 - RNA, 19 nt, Homo sapiens
ucaagaagccucaucaaaa

SEQ ID NO: 1532638 - RNA, 19 nt, Homo sapiens
uaucagacuguccuuaauu

SEQ ID NO: 1532639 - RNA, 19 nt, Homo sapiens
gaggaucuucaacaucuuu

SEQ ID NO: 1532640 - RNA, 19 nt, Homo sapiens
agacuuugccgugcucuua

SEQ ID NO: 1532641 - RNA, 19 nt, Homo sapiens
gaaugagacagaagauauc

SEQ ID NO: 1532642 - RNA, 19 nt, Homo sapiens
gugaaauacucuccaggau

SEQ ID NO: 1532643 - RNA, 19 nt, Homo sapiens
aagugugucucuuucaauu

SEQ ID NO: 1532644 - RNA, 19 nt, Homo sapiens
uugaaaugcuuccugaaau

SEQ ID NO: 1532645 - RNA, 19 nt, Homo sapiens
uaugacagccuccaacaga

SEQ ID NO: 1532646 - RNA, 19 nt, Homo sapiens
gaaaagcccagaagauuca

SEQ ID NO: 1532647 - RNA, 19 nt, Homo sapiens
cuaggcagcugguggagau

SEQ ID NO: 1532648 - RNA, 19 nt, Homo sapiens
ccucuuuccuuucacagaa

SEQ ID NO: 1532649 - RNA, 19 nt, Homo sapiens
cgauugcuaucuuguguca

SEQ ID NO: 1532650 - RNA, 19 nt, Homo sapiens
ccaaggaccaacaagcaaa

SEQ ID NO: 1532651 - RNA, 19 nt, Homo sapiens
caaaugaguccagggauca

SEQ ID NO: 1532652 - RNA, 19 nt, Homo sapiens
ggaccagaaguacuuguau

SEQ ID NO: 1532653 - RNA, 19 nt, Homo sapiens
gaaagaagcugacuggaua

SEQ ID NO: 1532654 - RNA, 19 nt, Homo sapiens
gaaagugacugcccuguuu

SEQ ID NO: 1532655 - RNA, 19 nt, Homo sapiens
gaacagcuuugucaagaug

SEQ ID NO: 1532656 - RNA, 19 nt, Homo sapiens
gaacuuccuuacacuuauu

SEQ ID NO: 1532657 - RNA, 19 nt, Homo sapiens
ucagagaggauauaacuua

SEQ ID NO: 1532658 - RNA, 19 nt, Homo sapiens
gcuaucaucuuuaggcaaa

SEQ ID NO: 1532659 - RNA, 19 nt, Homo sapiens
ggaguccuauuaaaugaaa

SEQ ID NO: 1532660 - RNA, 19 nt, Homo sapiens
gagaacuuccuuacacuua

SEQ ID NO: 1532661 - RNA, 19 nt, Homo sapiens
ugacugcccuguuuacuga

SEQ ID NO: 1532662 - RNA, 19 nt, Homo sapiens
gaagcugacuggauauugg

SEQ ID NO: 1532663 - RNA, 19 nt, Homo sapiens
gaacaaagagcaucaucuc

SEQ ID NO: 1532664 - RNA, 19 nt, Homo sapiens
ggagcaaaccuuccacuga

SEQ ID NO: 1532665 - RNA, 19 nt, Homo sapiens
gagaggguguguaugaaau

SEQ ID NO: 1532666 - RNA, 19 nt, Homo sapiens
agaaagauaccauggagua

SEQ ID NO: 1532667 - RNA, 19 nt, Homo sapiens
gaaucacuauggaaccaaa

SEQ ID NO: 1532668 - RNA, 19 nt, Homo sapiens
uaucagcaaccaagacuua

SEQ ID NO: 1532669 - RNA, 19 nt, Homo sapiens
ggaacaaaaucuucugaaa

SEQ ID NO: 1532670 - RNA, 19 nt, Homo sapiens
gaauaccacucuagagaac

SEQ ID NO: 1532671 - RNA, 19 nt, Homo sapiens
caaagaauaccacucuaga

SEQ ID NO: 1532672 - RNA, 19 nt, Homo sapiens
gcugcuagaucucaugaug

SEQ ID NO: 1532673 - RNA, 19 nt, Homo sapiens
gaagauacccuuggaucau

SEQ ID NO: 1532674 - RNA, 19 nt, Homo sapiens
gcacauuugagaugagaaa

SEQ ID NO: 1532675 - RNA, 19 nt, Homo sapiens
ugacagagaggguguguau

SEQ ID NO: 1532676 - RNA, 19 nt, Homo sapiens
acagagaguuuguguucaa

SEQ ID NO: 1532677 - RNA, 19 nt, Homo sapiens
ugacagagaguuuguguuc

SEQ ID NO: 1532678 - RNA, 19 nt, Homo sapiens
ggaacagcuuugucaagau

SEQ ID NO: 1532679 - RNA, 19 nt, Homo sapiens
uaucuagggucuguuugua

SEQ ID NO: 1532680 - RNA, 19 nt, Homo sapiens
cauuugagaugagaaagaa

SEQ ID NO: 1532681 - RNA, 19 nt, Homo sapiens
cauuauugcuucacuaagu

SEQ ID NO: 1532682 - RNA, 19 nt, Homo sapiens
uggaacagcuuugucaaga

SEQ ID NO: 1532683 - RNA, 19 nt, Homo sapiens
acagagaggguguguauga

SEQ ID NO: 1532684 - RNA, 19 nt, Homo sapiens
ggaaagugacugcccuguu

SEQ ID NO: 1532685 - RNA, 19 nt, Homo sapiens
gagugaagauacccuugga

SEQ ID NO: 1532686 - RNA, 19 nt, Homo sapiens
ggaagaacaaagagcauca

SEQ ID NO: 1532687 - RNA, 19 nt, Homo sapiens
aagauaccauggaguaguu

SEQ ID NO: 1532688 - RNA, 19 nt, Homo sapiens
cagcuuggaguccuauuaa

SEQ ID NO: 1532689 - RNA, 19 nt, Homo sapiens
cuagggaggugccccauua

SEQ ID NO: 1532690 - RNA, 19 nt, Homo sapiens
gcaaaccuuccacugagaa

SEQ ID NO: 1532691 - RNA, 19 nt, Homo sapiens
gagagagaagcuucacuga

SEQ ID NO: 1532692 - RNA, 19 nt, Homo sapiens
gagugaaccugaccuuucg

SEQ ID NO: 1532693 - RNA, 19 nt, Homo sapiens
aagaauaccacucuagaga

SEQ ID NO: 1532694 - RNA, 19 nt, Homo sapiens
cugcggagcucgcuuaguc

SEQ ID NO: 1532695 - RNA, 19 nt, Homo sapiens
ugaaagaagcugacuggau

SEQ ID NO: 1532696 - RNA, 19 nt, Homo sapiens
cagagaggguguguaugaa

SEQ ID NO: 1532697 - RNA, 19 nt, Homo sapiens
acacgcacauuugagauga

SEQ ID NO: 1532698 - RNA, 19 nt, Homo sapiens
caaccaagacuuacagcau

SEQ ID NO: 1532699 - RNA, 19 nt, Homo sapiens
ggaaggagcgacacaagcu

SEQ ID NO: 1532700 - RNA, 19 nt, Homo sapiens
gaugaugaacccucacuag

SEQ ID NO: 1532701 - RNA, 19 nt, Homo sapiens
ggagaacuuccuuacacuu

SEQ ID NO: 1532702 - RNA, 19 nt, Homo sapiens
caucagagaggauauaacu

SEQ ID NO: 1532703 - RNA, 19 nt, Homo sapiens
gaacaaaaucuucugaaag

SEQ ID NO: 1532704 - RNA, 19 nt, Homo sapiens
gaaagccagcaacucaugu

SEQ ID NO: 1532705 - RNA, 19 nt, Homo sapiens
ccagcuuggaguccuauua

SEQ ID NO: 1532706 - RNA, 19 nt, Homo sapiens
ccaaagaauaccacucuag

SEQ ID NO: 1532707 - RNA, 19 nt, Homo sapiens
agaacuuccuuacacuuau

SEQ ID NO: 1532708 - RNA, 19 nt, Homo sapiens
aaagugacugcccuguuua

SEQ ID NO: 1532709 - RNA, 19 nt, Homo sapiens
gaggguguguaugaaauca

SEQ ID NO: 1532710 - RNA, 19 nt, Homo sapiens
aaugaaagccagcaacuca

SEQ ID NO: 1532711 - RNA, 19 nt, Homo sapiens
gguauggagaacuuccuua

SEQ ID NO: 1532712 - RNA, 19 nt, Homo sapiens
gagagugaaccugaccuuu

SEQ ID NO: 1532713 - RNA, 19 nt, Homo sapiens
aaagaagccaccaccagaa

SEQ ID NO: 1532714 - RNA, 19 nt, Homo sapiens
gaaagauaccauggaguag

SEQ ID NO: 1532715 - RNA, 19 nt, Homo sapiens
gcuuggaguccuauuaaau

SEQ ID NO: 1532716 - RNA, 19 nt, Homo sapiens
ccacaccuucaacuccuua

SEQ ID NO: 1532717 - RNA, 19 nt, Homo sapiens
cacgagugauugacagaga

SEQ ID NO: 1532718 - RNA, 19 nt, Homo sapiens
agagccaucuccaccagaa

SEQ ID NO: 1532719 - RNA, 19 nt, Homo sapiens
aagauacccuuggaucaug

SEQ ID NO: 1532720 - RNA, 19 nt, Homo sapiens
uccuuacucugcaaucuuu

SEQ ID NO: 1532721 - RNA, 19 nt, Homo sapiens
gagcaucaucucucugaca

SEQ ID NO: 1532722 - RNA, 19 nt, Homo sapiens
uuggaguccuauuaaauga

SEQ ID NO: 1532723 - RNA, 19 nt, Homo sapiens
caagugcgccuuccugacu

SEQ ID NO: 1532724 - RNA, 19 nt, Homo sapiens
aaacagaggaccggcauca

SEQ ID NO: 1532725 - RNA, 19 nt, Homo sapiens
gacagagaguuuguguuca

SEQ ID NO: 1532726 - RNA, 19 nt, Homo sapiens
agaauaccacucuagagaa

SEQ ID NO: 1532727 - RNA, 19 nt, Homo sapiens
ugaagauacccuuggauca

SEQ ID NO: 1532728 - RNA, 19 nt, Homo sapiens
ucuagggucuguuuguauc

SEQ ID NO: 1532729 - RNA, 19 nt, Homo sapiens
ugaaagccagcaacucaug

SEQ ID NO: 1532730 - RNA, 19 nt, Homo sapiens
ucagagcuuugagagagaa

SEQ ID NO: 1532731 - RNA, 19 nt, Homo sapiens
agagugaaccugaccuuuc

SEQ ID NO: 1532732 - RNA, 19 nt, Homo sapiens
gcccaaagaauaccacucu

SEQ ID NO: 1532733 - RNA, 19 nt, Homo sapiens
gcaucgagugcccaaagaa

SEQ ID NO: 1532734 - RNA, 19 nt, Homo sapiens
acagaggaccggcaucaga

SEQ ID NO: 1532735 - RNA, 19 nt, Homo sapiens
gauauuggaacagcuuugu

SEQ ID NO: 1532736 - RNA, 19 nt, Homo sapiens
gcgccuuccugacuuacug

SEQ ID NO: 1532737 - RNA, 19 nt, Homo sapiens
uggcuuuguugacgugaaa

SEQ ID NO: 1532738 - RNA, 19 nt, Homo sapiens
ugcuagaucucaugaugug

SEQ ID NO: 1532739 - RNA, 19 nt, Homo sapiens
gaagccaccaccagaagag

SEQ ID NO: 1532740 - RNA, 19 nt, Homo sapiens
uaaaugaaagccagcaacu

SEQ ID NO: 1532741 - RNA, 19 nt, Homo sapiens
cauucuaggccuccuuaaa

SEQ ID NO: 1532742 - RNA, 19 nt, Homo sapiens
cuagagaaccgagagugaa

SEQ ID NO: 1532743 - RNA, 19 nt, Homo sapiens
guggaaagagugaagauac

SEQ ID NO: 1532744 - RNA, 19 nt, Homo sapiens
caagacuuacagcauggua

SEQ ID NO: 1532745 - RNA, 19 nt, Homo sapiens
cccaaagaauaccacucua

SEQ ID NO: 1532746 - RNA, 19 nt, Homo sapiens
cccaaguccuaccggguuu

SEQ ID NO: 1532747 - RNA, 19 nt, Homo sapiens
agagaggguguguaugaaa

SEQ ID NO: 1532748 - RNA, 19 nt, Homo sapiens
caccugcggagcucgcuua

SEQ ID NO: 1532749 - RNA, 19 nt, Homo sapiens
ccuuacacuuauucaagaa

SEQ ID NO: 1532750 - RNA, 19 nt, Homo sapiens
gaagaacaaagagcaucau

SEQ ID NO: 1532751 - RNA, 19 nt, Homo sapiens
gucagagcuuugagagaga

SEQ ID NO: 1532752 - RNA, 19 nt, Homo sapiens
uccuuacacuuauucaaga

SEQ ID NO: 1532753 - RNA, 19 nt, Homo sapiens
gaagagaauuggcaacuga

SEQ ID NO: 1532754 - RNA, 19 nt, Homo sapiens
caaaugaguuucgcuguua

SEQ ID NO: 1532755 - RNA, 19 nt, Homo sapiens
ggacuuacccgaaagaauu

SEQ ID NO: 1532756 - RNA, 19 nt, Homo sapiens
gaaggaacccugucacauu

SEQ ID NO: 1532757 - RNA, 19 nt, Homo sapiens
gcuguuaugugaauuauga

SEQ ID NO: 1532758 - RNA, 19 nt, Homo sapiens
gcaaaugaguuucgcuguu

SEQ ID NO: 1532759 - RNA, 19 nt, Homo sapiens
gaguuucgcuguuauguga

SEQ ID NO: 1532760 - RNA, 19 nt, Homo sapiens
gcgaggaugauaaauauaa

SEQ ID NO: 1532761 - RNA, 19 nt, Homo sapiens
uagcagcucuccaggaauu

SEQ ID NO: 1532762 - RNA, 19 nt, Homo sapiens
ucagagagcugugcagaga

SEQ ID NO: 1532763 - RNA, 19 nt, Homo sapiens
gaaagaauugcugcacaua

SEQ ID NO: 1532764 - RNA, 19 nt, Homo sapiens
gauuacagacggugacaua

SEQ ID NO: 1532765 - RNA, 19 nt, Homo sapiens
gugaagaugugcacguuug

SEQ ID NO: 1532766 - RNA, 19 nt, Homo sapiens
ugagugauuuggaagauga

SEQ ID NO: 1532767 - RNA, 19 nt, Homo sapiens
ggacugugggaucugauua

SEQ ID NO: 1532768 - RNA, 19 nt, Homo sapiens
ggaggcaauugcagcugua

SEQ ID NO: 1532769 - RNA, 19 nt, Homo sapiens
caucggaaaccgucaagua

SEQ ID NO: 1532770 - RNA, 19 nt, Homo sapiens
ggaggaaugucucagaaaa

SEQ ID NO: 1532771 - RNA, 19 nt, Homo sapiens
gagaggaguuuauuuucua

SEQ ID NO: 1532772 - RNA, 19 nt, Homo sapiens
ggaagaacaggcagcagaa

SEQ ID NO: 1532773 - RNA, 19 nt, Homo sapiens
gcacguuuguuccaagaca

SEQ ID NO: 1532774 - RNA, 19 nt, Homo sapiens
gaauugcugcacauaguuu

SEQ ID NO: 1532775 - RNA, 19 nt, Homo sapiens
cgaaagaauugcugcacau

SEQ ID NO: 1532776 - RNA, 19 nt, Homo sapiens
ccauuggacuuacccgaaa

SEQ ID NO: 1532777 - RNA, 19 nt, Homo sapiens
agagagcugugcagagaaa

SEQ ID NO: 1532778 - RNA, 19 nt, Homo sapiens
aggcgaggaugauaaauau

SEQ ID NO: 1532779 - RNA, 19 nt, Homo sapiens
gagugaagaugugcacguu

SEQ ID NO: 1532780 - RNA, 19 nt, Homo sapiens
ggacuggguuauaaacaac

SEQ ID NO: 1532781 - RNA, 19 nt, Homo sapiens
caggcgaggaugauaaaua

SEQ ID NO: 1532782 - RNA, 19 nt, Homo sapiens
cuuagcagcucuccaggaa

SEQ ID NO: 1532783 - RNA, 19 nt, Homo sapiens
aaggaacccugucacauuc

SEQ ID NO: 1532784 - RNA, 19 nt, Homo sapiens
aagaauugcugcacauagu

SEQ ID NO: 1532785 - RNA, 19 nt, Homo sapiens
ggcagaaucgcauguguga

SEQ ID NO: 1532786 - RNA, 19 nt, Homo sapiens
ugacauaacacaggaagga

SEQ ID NO: 1532787 - RNA, 19 nt, Homo sapiens
caacuugugaaaugaguga

SEQ ID NO: 1532788 - RNA, 19 nt, Homo sapiens
ggaaggaacccugucacau

SEQ ID NO: 1532789 - RNA, 19 nt, Homo sapiens
uacagacggugacauaaca

SEQ ID NO: 1532790 - RNA, 19 nt, Homo sapiens
aauugcagcuguaggagaa

SEQ ID NO: 1532791 - RNA, 19 nt, Homo sapiens
gagcaaaagcaacaaauug

SEQ ID NO: 1532792 - RNA, 19 nt, Homo sapiens
gaagaugugcacguuuguu

SEQ ID NO: 1532793 - RNA, 19 nt, Homo sapiens
cagaaucgcaugugugagu

SEQ ID NO: 1532794 - RNA, 19 nt, Homo sapiens
uggacuggguuauaaacaa

SEQ ID NO: 1532795 - RNA, 19 nt, Homo sapiens
uaaagugugcgaucuccaa

SEQ ID NO: 1532796 - RNA, 19 nt, Homo sapiens
ggagaggaguuuauuuucu

SEQ ID NO: 1532797 - RNA, 19 nt, Homo sapiens
aggagaagguggcagaauc

SEQ ID NO: 1532798 - RNA, 19 nt, Homo sapiens
gcuggacugugggaucuga

SEQ ID NO: 1532799 - RNA, 19 nt, Homo sapiens
cccggaacuuggcaaauga

SEQ ID NO: 1532800 - RNA, 19 nt, Homo sapiens
gugcacguuuguuccaaga

SEQ ID NO: 1532801 - RNA, 19 nt, Homo sapiens
ucggaggaaugucucagaa

SEQ ID NO: 1532802 - RNA, 19 nt, Homo sapiens
guauggagaggaguuuauu

SEQ ID NO: 1532803 - RNA, 19 nt, Homo sapiens
gagccaggcgaggaugaua

SEQ ID NO: 1532804 - RNA, 19 nt, Homo sapiens
gcuuucugcccaugccuua

SEQ ID NO: 1532805 - RNA, 19 nt, Homo sapiens
gggcuggacugugggaucu

SEQ ID NO: 1532806 - RNA, 19 nt, Homo sapiens
aaaugaguuucgcuguuau

SEQ ID NO: 1532807 - RNA, 19 nt, Homo sapiens
uuuggaagaugaugagaca

SEQ ID NO: 1532808 - RNA, 19 nt, Homo sapiens
ggcaauugcagcuguagga

SEQ ID NO: 1532809 - RNA, 19 nt, Homo sapiens
gccaggcgaggaugauaaa

SEQ ID NO: 1532810 - RNA, 19 nt, Homo sapiens
caagacacacccggaacuu

SEQ ID NO: 1532811 - RNA, 19 nt, Homo sapiens
gaugagacaccccagcuuu

SEQ ID NO: 1532812 - RNA, 19 nt, Homo sapiens
ggagaagguggcagaaucg

SEQ ID NO: 1532813 - RNA, 19 nt, Homo sapiens
cgaggaugauaaauauaac

SEQ ID NO: 1532814 - RNA, 19 nt, Homo sapiens
acccggaacuuggcaaaug

SEQ ID NO: 1532815 - RNA, 19 nt, Homo sapiens
agaagagaauuggcaacug

SEQ ID NO: 1532816 - RNA, 19 nt, Homo sapiens
aaagaauugcugcacauag

SEQ ID NO: 1532817 - RNA, 19 nt, Homo sapiens
gacuuacccgaaagaauug

SEQ ID NO: 1532818 - RNA, 19 nt, Homo sapiens
gacauaacacaggaaggaa

SEQ ID NO: 1532819 - RNA, 19 nt, Homo sapiens
uauggagaggaguuuauuu

SEQ ID NO: 1532820 - RNA, 19 nt, Homo sapiens
aaugagugauuuggaagau

SEQ ID NO: 1532821 - RNA, 19 nt, Homo sapiens
aaacaucggaaaccgucaa

SEQ ID NO: 1532822 - RNA, 19 nt, Homo sapiens
gagaguauuuccagaagua

SEQ ID NO: 1532823 - RNA, 19 nt, Homo sapiens
aaaccuagcuacuccaaua

SEQ ID NO: 1532824 - RNA, 19 nt, Homo sapiens
guguguaacuccuaaauua

SEQ ID NO: 1532825 - RNA, 19 nt, Homo sapiens
gaauuucacucucucuaaa

SEQ ID NO: 1532826 - RNA, 19 nt, Homo sapiens
ggaaguaggacaaguaauu

SEQ ID NO: 1532827 - RNA, 19 nt, Homo sapiens
cagaaugguuuaaguagua

SEQ ID NO: 1532828 - RNA, 19 nt, Homo sapiens
gaagagcccguaauuguaa

SEQ ID NO: 1532829 - RNA, 19 nt, Homo sapiens
gaaagcggaugauguuaau

SEQ ID NO: 1532830 - RNA, 19 nt, Homo sapiens
caccuacgauuucuucuua

SEQ ID NO: 1532831 - RNA, 19 nt, Homo sapiens
gaagauauucuccagcuuu

SEQ ID NO: 1532832 - RNA, 19 nt, Homo sapiens
ggaagagcccguaauugua

SEQ ID NO: 1532833 - RNA, 19 nt, Homo sapiens
caacagaaugguuuaagua

SEQ ID NO: 1532834 - RNA, 19 nt, Homo sapiens
gaucguacuucguugguuu

SEQ ID NO: 1532835 - RNA, 19 nt, Homo sapiens
uggagaacuugucaaauua

SEQ ID NO: 1532836 - RNA, 19 nt, Homo sapiens
ggaauuugaugcaguaaag

SEQ ID NO: 1532837 - RNA, 19 nt, Homo sapiens
acacaugcuuugagaauuu

SEQ ID NO: 1532838 - RNA, 19 nt, Homo sapiens
ggaaagcggaugauguuaa

SEQ ID NO: 1532839 - RNA, 19 nt, Homo sapiens
guccacaacuuucagauuu

SEQ ID NO: 1532840 - RNA, 19 nt, Homo sapiens
gcuggaaaguauuaucuaa

SEQ ID NO: 1532841 - RNA, 19 nt, Homo sapiens
guacagcuggaaaguauua

SEQ ID NO: 1532842 - RNA, 19 nt, Homo sapiens
gcugucagguugugaguuu

SEQ ID NO: 1532843 - RNA, 19 nt, Homo sapiens
agacugaugugaaagauga

SEQ ID NO: 1532844 - RNA, 19 nt, Homo sapiens
gaaguaggacaaguaauuu

SEQ ID NO: 1532845 - RNA, 19 nt, Homo sapiens
caacaaguauuaugucaac

SEQ ID NO: 1532846 - RNA, 19 nt, Homo sapiens
gaacagcauagcuuuggua

SEQ ID NO: 1532847 - RNA, 19 nt, Homo sapiens
gaggaaagcggaugauguu

SEQ ID NO: 1532848 - RNA, 19 nt, Homo sapiens
aauccaggcucaaugauaa

SEQ ID NO: 1532849 - RNA, 19 nt, Homo sapiens
gcaagaagccauuaacucu

SEQ ID NO: 1532850 - RNA, 19 nt, Homo sapiens
gagaagaaacaacaaguau

SEQ ID NO: 1532851 - RNA, 19 nt, Homo sapiens
uuggagaacuugucaaauu

SEQ ID NO: 1532852 - RNA, 19 nt, Homo sapiens
gaauccaggcucaaugaua

SEQ ID NO: 1532853 - RNA, 19 nt, Homo sapiens
gaaguaggaagaaaguauu

SEQ ID NO: 1532854 - RNA, 19 nt, Homo sapiens
agaaggcauugauuucaua

SEQ ID NO: 1532855 - RNA, 19 nt, Homo sapiens
ccacguaguccacaacuuu

SEQ ID NO: 1532856 - RNA, 19 nt, Homo sapiens
gcaagcaguuguauuucug

SEQ ID NO: 1532857 - RNA, 19 nt, Homo sapiens
aaagaggacugagaacuga

SEQ ID NO: 1532858 - RNA, 19 nt, Homo sapiens
gaacaacuauaaggaagag

SEQ ID NO: 1532859 - RNA, 19 nt, Homo sapiens
acagaucccucuucaccua

SEQ ID NO: 1532860 - RNA, 19 nt, Homo sapiens
uaaggaagagcccguaauu

SEQ ID NO: 1532861 - RNA, 19 nt, Homo sapiens
gacccagaguugucuaauu

SEQ ID NO: 1532862 - RNA, 19 nt, Homo sapiens
aagaagccauuaacucuga

SEQ ID NO: 1532863 - RNA, 19 nt, Homo sapiens
gaagaugcaguugcuguuu

SEQ ID NO: 1532864 - RNA, 19 nt, Homo sapiens
caucguaucccaaguucua

SEQ ID NO: 1532865 - RNA, 19 nt, Homo sapiens
gaagacugaugugaaagau

SEQ ID NO: 1532866 - RNA, 19 nt, Homo sapiens
agaguaaucuagcaaagga

SEQ ID NO: 1532867 - RNA, 19 nt, Homo sapiens
caacaggaacaccaguuaa

SEQ ID NO: 1532868 - RNA, 19 nt, Homo sapiens
ucagacacaugcuuugaga

SEQ ID NO: 1532869 - RNA, 19 nt, Homo sapiens
gcagaguaaucuagcaaag

SEQ ID NO: 1532870 - RNA, 19 nt, Homo sapiens
guauauaaauccacagaac

SEQ ID NO: 1532871 - RNA, 19 nt, Homo sapiens
aaguacagcuggaaaguau

SEQ ID NO: 1532872 - RNA, 19 nt, Homo sapiens
gcccagucauucacucuuu

SEQ ID NO: 1532873 - RNA, 19 nt, Homo sapiens
ccauugugcucuauuaauc

SEQ ID NO: 1532874 - RNA, 19 nt, Homo sapiens
cauggcagcugaccucuca

SEQ ID NO: 1532875 - RNA, 19 nt, Homo sapiens
cagcauagcuuugguaucc

SEQ ID NO: 1532876 - RNA, 19 nt, Homo sapiens
ccagaaguauggauauagu

SEQ ID NO: 1532877 - RNA, 19 nt, Homo sapiens
gauaaagcaagauuggaaa

SEQ ID NO: 1532878 - RNA, 19 nt, Homo sapiens
ggauauaguccacguguca

SEQ ID NO: 1532879 - RNA, 19 nt, Homo sapiens
gaauauaccaacucuccuu

SEQ ID NO: 1532880 - RNA, 19 nt, Homo sapiens
guugcaagcaguuguauuu

SEQ ID NO: 1532881 - RNA, 19 nt, Homo sapiens
uaaagguguuugcuacuca

SEQ ID NO: 1532882 - RNA, 19 nt, Homo sapiens
gucauucacucuuuaagga

SEQ ID NO: 1532883 - RNA, 19 nt, Homo sapiens
uuuaaacguugacccauuu

SEQ ID NO: 1532884 - RNA, 19 nt, Homo sapiens
caacacagaaacugaacaa

SEQ ID NO: 1532885 - RNA, 19 nt, Homo sapiens
uaagagaguauuuccagaa

SEQ ID NO: 1532886 - RNA, 19 nt, Homo sapiens
guacaucguaucccaaguu

SEQ ID NO: 1532887 - RNA, 19 nt, Homo sapiens
acccagaguugucuaauug

SEQ ID NO: 1532888 - RNA, 19 nt, Homo sapiens
gaugucagcaacaaagaaa

SEQ ID NO: 1532889 - RNA, 19 nt, Homo sapiens
gaaggcauugauuucauaa

SEQ ID NO: 1532890 - RNA, 19 nt, Homo sapiens
ggccauagaugcagaaucc

SEQ ID NO: 1532891 - RNA, 19 nt, Homo sapiens
ucagaaaacugucaccaaa

SEQ ID NO: 1532892 - RNA, 19 nt, Homo sapiens
ugagaagaaacaacaagua

SEQ ID NO: 1532893 - RNA, 19 nt, Homo sapiens
cccaguagacccugaauuu

SEQ ID NO: 1532894 - RNA, 19 nt, Homo sapiens
ggguaacuauauacuguga

SEQ ID NO: 1532895 - RNA, 19 nt, Homo sapiens
ccaggaaguaggacaagua

SEQ ID NO: 1532896 - RNA, 19 nt, Homo sapiens
aagccgagcuggaccgauu

SEQ ID NO: 1532897 - RNA, 19 nt, Homo sapiens
cuacuccaauagcaauuaa

SEQ ID NO: 1532898 - RNA, 19 nt, Homo sapiens
gacacaugcuuugagaauu

SEQ ID NO: 1532899 - RNA, 19 nt, Homo sapiens
caaggagagugaugauucu

SEQ ID NO: 1532900 - RNA, 19 nt, Homo sapiens
ucucuuaugucagcucuuu

SEQ ID NO: 1532901 - RNA, 19 nt, Homo sapiens
caagaaggcauugauuuca

SEQ ID NO: 1532902 - RNA, 19 nt, Homo sapiens
uuacccagcuuaaucaaca

SEQ ID NO: 1532903 - RNA, 19 nt, Homo sapiens
accaaacaaucacuaguaa

SEQ ID NO: 1532904 - RNA, 19 nt, Homo sapiens
cacaggcagugaacaacua

SEQ ID NO: 1532905 - RNA, 19 nt, Homo sapiens
cuggguaguuguaaguaua

SEQ ID NO: 1532906 - RNA, 19 nt, Homo sapiens
uguccauugugcucuauua

SEQ ID NO: 1532907 - RNA, 19 nt, Homo sapiens
caacaaaaguacuaaugga

SEQ ID NO: 1532908 - RNA, 19 nt, Homo sapiens
cacaugcuuugagaauuua

SEQ ID NO: 1532909 - RNA, 19 nt, Homo sapiens
guacuucguugguuuuaaa

SEQ ID NO: 1532910 - RNA, 19 nt, Homo sapiens
auccacaaauuacccauua

SEQ ID NO: 1532911 - RNA, 19 nt, Homo sapiens
uaccaaacaaucacuagua

SEQ ID NO: 1532912 - RNA, 19 nt, Homo sapiens
ucaaggagagugaugauuc

SEQ ID NO: 1532913 - RNA, 19 nt, Homo sapiens
ccagugaaguaggaagaaa

SEQ ID NO: 1532914 - RNA, 19 nt, Homo sapiens
ucaacagaaugguuuaagu

SEQ ID NO: 1532915 - RNA, 19 nt, Homo sapiens
cggaugauguuaauauucu

SEQ ID NO: 1532916 - RNA, 19 nt, Homo sapiens
gaaauguauaccagccuuu

SEQ ID NO: 1532917 - RNA, 19 nt, Homo sapiens
uaugucagcucuuucuauc

SEQ ID NO: 1532918 - RNA, 19 nt, Homo sapiens
gguguuugcuacucagaug

SEQ ID NO: 1532919 - RNA, 19 nt, Homo sapiens
acaaagaacagcauagcuu

SEQ ID NO: 1532920 - RNA, 19 nt, Homo sapiens
ugaaguaggaagaaaguau

SEQ ID NO: 1532921 - RNA, 19 nt, Homo sapiens
uguaugccauugacucuga

SEQ ID NO: 1532922 - RNA, 19 nt, Homo sapiens
caagaacucucaaacaaua

SEQ ID NO: 1532923 - RNA, 19 nt, Homo sapiens
gaaauaagcaugucuugua

SEQ ID NO: 1532924 - RNA, 19 nt, Homo sapiens
uaagagagcugugaaagua

SEQ ID NO: 1532925 - RNA, 19 nt, Homo sapiens
gaaagaaccugaaauuaac

SEQ ID NO: 1532926 - RNA, 19 nt, Homo sapiens
gacaagaacucucaaacaa

SEQ ID NO: 1532927 - RNA, 19 nt, Homo sapiens
uaacacaacucuucagaug

SEQ ID NO: 1532928 - RNA, 19 nt, Homo sapiens
ggaagugugugaagaaaga

SEQ ID NO: 1532929 - RNA, 19 nt, Homo sapiens
gaaauuaacacaacucuuc

SEQ ID NO: 1532930 - RNA, 19 nt, Homo sapiens
gaaauggaauuccuucagu

SEQ ID NO: 1532931 - RNA, 19 nt, Homo sapiens
cagaaugcaucgagguuua

SEQ ID NO: 1532932 - RNA, 19 nt, Homo sapiens
gaaagaaagcauuaaagga

SEQ ID NO: 1532933 - RNA, 19 nt, Homo sapiens
ucagagaccuuggcgauaa

SEQ ID NO: 1532934 - RNA, 19 nt, Homo sapiens
gggaaaccgucucuucgua

SEQ ID NO: 1532935 - RNA, 19 nt, Homo sapiens
cauguaaacuucaauguuc

SEQ ID NO: 1532936 - RNA, 19 nt, Homo sapiens
gaaaguagcaacaggacaa

SEQ ID NO: 1532937 - RNA, 19 nt, Homo sapiens
ccaugcagauguucaguuu

SEQ ID NO: 1532938 - RNA, 19 nt, Homo sapiens
ggagagagcauuaguuugg

SEQ ID NO: 1532939 - RNA, 19 nt, Homo sapiens
ugcagaagaucauaaguaa

SEQ ID NO: 1532940 - RNA, 19 nt, Homo sapiens
gaaacaagcuggaaaaggu

SEQ ID NO: 1532941 - RNA, 19 nt, Homo sapiens
ggacaagaacucucaaaca

SEQ ID NO: 1532942 - RNA, 19 nt, Homo sapiens
gaacaugaaggagaauauu

SEQ ID NO: 1532943 - RNA, 19 nt, Homo sapiens
gcauuaguuuggaugaauu

SEQ ID NO: 1532944 - RNA, 19 nt, Homo sapiens
cagaaggccuagauuugaa

SEQ ID NO: 1532945 - RNA, 19 nt, Homo sapiens
ucauugauauucuguguga

SEQ ID NO: 1532946 - RNA, 19 nt, Homo sapiens
aaagaagucuggaaacaag

SEQ ID NO: 1532947 - RNA, 19 nt, Homo sapiens
ggaaaccgucucuucguaa

SEQ ID NO: 1532948 - RNA, 19 nt, Homo sapiens
gugaagaaagaaagcauua

SEQ ID NO: 1532949 - RNA, 19 nt, Homo sapiens
gugaaagaaccugaaauua

SEQ ID NO: 1532950 - RNA, 19 nt, Homo sapiens
ggauacagaugguaaugag

SEQ ID NO: 1532951 - RNA, 19 nt, Homo sapiens
guacuugcuuucugauuca

SEQ ID NO: 1532952 - RNA, 19 nt, Homo sapiens
cuaauaggcuaaaugaagu

SEQ ID NO: 1532953 - RNA, 19 nt, Homo sapiens
caggagagagcauuaguuu

SEQ ID NO: 1532954 - RNA, 19 nt, Homo sapiens
cuucuuaagucuucauuga

SEQ ID NO: 1532955 - RNA, 19 nt, Homo sapiens
gaaaccgucucuucguaag

SEQ ID NO: 1532956 - RNA, 19 nt, Homo sapiens
agaaagcauuaaaggagua

SEQ ID NO: 1532957 - RNA, 19 nt, Homo sapiens
gguuugaguuucaugagaa

SEQ ID NO: 1532958 - RNA, 19 nt, Homo sapiens
cagaugcguuucuuuggaa

SEQ ID NO: 1532959 - RNA, 19 nt, Homo sapiens
gauaaagggcuaauuucau

SEQ ID NO: 1532960 - RNA, 19 nt, Homo sapiens
guacuucgguaagauggaa

SEQ ID NO: 1532961 - RNA, 19 nt, Homo sapiens
ggugaugaaugucuuaguc

SEQ ID NO: 1532962 - RNA, 19 nt, Homo sapiens
gagcauuaguuuggaugaa

SEQ ID NO: 1532963 - RNA, 19 nt, Homo sapiens
gguaaugagaugauugaaa

SEQ ID NO: 1532964 - RNA, 19 nt, Homo sapiens
gaauuucgaagauuuaugg

SEQ ID NO: 1532965 - RNA, 19 nt, Homo sapiens
ggcgauaaagggcuaauuu

SEQ ID NO: 1532966 - RNA, 19 nt, Homo sapiens
ucucaucuguaccuuauau

SEQ ID NO: 1532967 - RNA, 19 nt, Homo sapiens
ucagaaggccuagauuuga

SEQ ID NO: 1532968 - RNA, 19 nt, Homo sapiens
ugauuuggauggugaugaa

SEQ ID NO: 1532969 - RNA, 19 nt, Homo sapiens
ucuaaagguuugaguuuca

SEQ ID NO: 1532970 - RNA, 19 nt, Homo sapiens
ucagaugcguuucuuugga

SEQ ID NO: 1532971 - RNA, 19 nt, Homo sapiens
ucaggaagcaauagugaaa

SEQ ID NO: 1532972 - RNA, 19 nt, Homo sapiens
uuucuucacucgaacauga

SEQ ID NO: 1532973 - RNA, 19 nt, Homo sapiens
ccacgagacuuccucuucu

SEQ ID NO: 1532974 - RNA, 19 nt, Homo sapiens
ggacaaagaaaacuucauu

SEQ ID NO: 1532975 - RNA, 19 nt, Homo sapiens
uaaugaaacuggauaucag

SEQ ID NO: 1532976 - RNA, 19 nt, Homo sapiens
cagaagaucauaaguaaac

SEQ ID NO: 1532977 - RNA, 19 nt, Homo sapiens
gagagagcauuaguuugga

SEQ ID NO: 1532978 - RNA, 19 nt, Homo sapiens
gaaccugaaauuaacacaa

SEQ ID NO: 1532979 - RNA, 19 nt, Homo sapiens
caucgaggauacacuguca

SEQ ID NO: 1532980 - RNA, 19 nt, Homo sapiens
gaccaaggccagcaucaau

SEQ ID NO: 1532981 - RNA, 19 nt, Homo sapiens
aaauggaauuccuucaguu

SEQ ID NO: 1532982 - RNA, 19 nt, Homo sapiens
cagagaccuuggcgauaaa

SEQ ID NO: 1532983 - RNA, 19 nt, Homo sapiens
caucuucauguuccuaaua

SEQ ID NO: 1532984 - RNA, 19 nt, Homo sapiens
gauaugcuuucuggaagga

SEQ ID NO: 1532985 - RNA, 19 nt, Homo sapiens
caaacagagauucaagaaa

SEQ ID NO: 1532986 - RNA, 19 nt, Homo sapiens
gacuuccucuucucaguga

SEQ ID NO: 1532987 - RNA, 19 nt, Homo sapiens
gcagaagaucauaaguaaa

SEQ ID NO: 1532988 - RNA, 19 nt, Homo sapiens
cgauaaagggcuaauuuca

SEQ ID NO: 1532989 - RNA, 19 nt, Homo sapiens
gaaagcauuaaaggaguaa

SEQ ID NO: 1532990 - RNA, 19 nt, Homo sapiens
caucagaguauacaagaau

SEQ ID NO: 1532991 - RNA, 19 nt, Homo sapiens
gcaggagagagcauuaguu

SEQ ID NO: 1532992 - RNA, 19 nt, Homo sapiens
cagcaucaauuccagacau

SEQ ID NO: 1532993 - RNA, 19 nt, Homo sapiens
uaugauaugcuuucuggaa

SEQ ID NO: 1532994 - RNA, 19 nt, Homo sapiens
auaagcaugucuuguacuu

SEQ ID NO: 1532995 - RNA, 19 nt, Homo sapiens
aaauaagcaugucuuguac

SEQ ID NO: 1532996 - RNA, 19 nt, Homo sapiens
caacaucagaguauacaag

SEQ ID NO: 1532997 - RNA, 19 nt, Homo sapiens
cugcagaagaucauaagua

SEQ ID NO: 1532998 - RNA, 19 nt, Homo sapiens
cauucuggauuucauguug

SEQ ID NO: 1532999 - RNA, 19 nt, Homo sapiens
ggauggugaugaaugucuu

SEQ ID NO: 1533000 - RNA, 19 nt, Homo sapiens
acaaacagagauucaagaa

SEQ ID NO: 1533001 - RNA, 19 nt, Homo sapiens
acucgaacaugaaggagaa

SEQ ID NO: 1533002 - RNA, 19 nt, Homo sapiens
gaguaucuuuucuugcuua

SEQ ID NO: 1533003 - RNA, 19 nt, Homo sapiens
gucagaaggccuagauuug

SEQ ID NO: 1533004 - RNA, 19 nt, Homo sapiens
ugucagaaggccuagauuu

SEQ ID NO: 1533005 - RNA, 19 nt, Homo sapiens
uaaaagaagucuggaaaca

SEQ ID NO: 1533006 - RNA, 19 nt, Homo sapiens
caacccacuuggaagacuu

SEQ ID NO: 1533007 - RNA, 19 nt, Homo sapiens
caagucauuuugccauuuu

SEQ ID NO: 1533008 - RNA, 19 nt, Homo sapiens
gcgauaaagggcuaauuuc

SEQ ID NO: 1533009 - RNA, 19 nt, Homo sapiens
gcuuagcuguuuauugucu

SEQ ID NO: 1533010 - RNA, 19 nt, Homo sapiens
uaugcuuucuggaaggaua

SEQ ID NO: 1533011 - RNA, 19 nt, Homo sapiens
gauggugaugaaugucuua

SEQ ID NO: 1533012 - RNA, 19 nt, Homo sapiens
agugaaagaaccugaaauu

SEQ ID NO: 1533013 - RNA, 19 nt, Homo sapiens
uuucucaucuguaccuuau

SEQ ID NO: 1533014 - RNA, 19 nt, Homo sapiens
gaaguacuugcuauuuauc

SEQ ID NO: 1533015 - RNA, 19 nt, Homo sapiens
uuggaagacuuugcuauug

SEQ ID NO: 1533016 - RNA, 19 nt, Homo sapiens
gcaguuuucuucacucgaa

SEQ ID NO: 1533017 - RNA, 19 nt, Homo sapiens
aggaagcaauagugaaaga

SEQ ID NO: 1533018 - RNA, 19 nt, Homo sapiens
gaacguaaaacuucaguca

SEQ ID NO: 1533019 - RNA, 19 nt, Homo sapiens
cuaaugaaacuggauauca

SEQ ID NO: 1533020 - RNA, 19 nt, Homo sapiens
uguacuugcuuucugauuc

SEQ ID NO: 1533021 - RNA, 19 nt, Homo sapiens
guaccacaacaucagagua

SEQ ID NO: 1533022 - RNA, 19 nt, Homo sapiens
gaagaaacuugccauguua

SEQ ID NO: 1533023 - RNA, 19 nt, Homo sapiens
ggaaucaccuucagucuuu

SEQ ID NO: 1533024 - RNA, 19 nt, Homo sapiens
ucaaugagcugaucaguga

SEQ ID NO: 1533025 - RNA, 19 nt, Homo sapiens
gagcagaaaucacaucuug

SEQ ID NO: 1533026 - RNA, 19 nt, Homo sapiens
gaggaucacuucugcauuu

SEQ ID NO: 1533027 - RNA, 19 nt, Homo sapiens
guacagacauuucuuugaa

SEQ ID NO: 1533028 - RNA, 19 nt, Homo sapiens
ugaaagaccuugagaaaca

SEQ ID NO: 1533029 - RNA, 19 nt, Homo sapiens
gcagggacaugcuguacua

SEQ ID NO: 1533030 - RNA, 19 nt, Homo sapiens
gaccgaagcucagaauuga

SEQ ID NO: 1533031 - RNA, 19 nt, Homo sapiens
gagagaaggucuuggaauc

SEQ ID NO: 1533032 - RNA, 19 nt, Homo sapiens
gaacugucuuuguuucuug

SEQ ID NO: 1533033 - RNA, 19 nt, Homo sapiens
agaagaaacuugccauguu

SEQ ID NO: 1533034 - RNA, 19 nt, Homo sapiens
ccacagacgagguuuauuu

SEQ ID NO: 1533035 - RNA, 19 nt, Homo sapiens
cuaagaaacugcuaugcaa

SEQ ID NO: 1533036 - RNA, 19 nt, Homo sapiens
caagcaaaguggagagaaa

SEQ ID NO: 1533037 - RNA, 19 nt, Homo sapiens
gaccauggaugaccaggaa

SEQ ID NO: 1533038 - RNA, 19 nt, Homo sapiens
agacgagguuuauuuguuu

SEQ ID NO: 1533039 - RNA, 19 nt, Homo sapiens
caacauaaaggcagcauau

SEQ ID NO: 1533040 - RNA, 19 nt, Homo sapiens
ggaucuugcuuucuucaaa

SEQ ID NO: 1533041 - RNA, 19 nt, Homo sapiens
ugaaauaggaucuugcuuu

SEQ ID NO: 1533042 - RNA, 19 nt, Homo sapiens
gaacuggacaaucuucuga

SEQ ID NO: 1533043 - RNA, 19 nt, Homo sapiens
gaggaggacuucagcuaug

SEQ ID NO: 1533044 - RNA, 19 nt, Homo sapiens
ggagggacuggauaucuua

SEQ ID NO: 1533045 - RNA, 19 nt, Homo sapiens
agacaagcguggccaauau

SEQ ID NO: 1533046 - RNA, 19 nt, Homo sapiens
cagacgagguuuauuuguu

SEQ ID NO: 1533047 - RNA, 19 nt, Homo sapiens
ggagagcaucgacaagaua

SEQ ID NO: 1533048 - RNA, 19 nt, Homo sapiens
caacguuucuucagaugga

SEQ ID NO: 1533049 - RNA, 19 nt, Homo sapiens
ggacaucugugagggcuau

SEQ ID NO: 1533050 - RNA, 19 nt, Homo sapiens
gcucuaaagcgagugauua

SEQ ID NO: 1533051 - RNA, 19 nt, Homo sapiens
ggagcugggugucaagaga

SEQ ID NO: 1533052 - RNA, 19 nt, Homo sapiens
ggacguucuuccuguuuga

SEQ ID NO: 1533053 - RNA, 19 nt, Homo sapiens
gggagcagcuggccaucaa

SEQ ID NO: 1533054 - RNA, 19 nt, Homo sapiens
acacagaugcuaacuggua

SEQ ID NO: 1533055 - RNA, 19 nt, Homo sapiens
cauaugaggccaugaagaa

SEQ ID NO: 1533056 - RNA, 19 nt, Homo sapiens
ggucacacuuagaaauuga

SEQ ID NO: 1533057 - RNA, 19 nt, Homo sapiens
caagagggcuuugccaucu

SEQ ID NO: 1533058 - RNA, 19 nt, Homo sapiens
aauaggaucuugcuuucuu

SEQ ID NO: 1533059 - RNA, 19 nt, Homo sapiens
gagaaacaguacaacaaag

SEQ ID NO: 1533060 - RNA, 19 nt, Homo sapiens
gagacaagcguggccaaua

SEQ ID NO: 1533061 - RNA, 19 nt, Homo sapiens
gaaauugagcucuuacucu

SEQ ID NO: 1533062 - RNA, 19 nt, Homo sapiens
ggucaugacacaaagcuuu

SEQ ID NO: 1533063 - RNA, 19 nt, Homo sapiens
gagaugggaauggaaauuu

SEQ ID NO: 1533064 - RNA, 19 nt, Homo sapiens
gggagggacuggauaucuu

SEQ ID NO: 1533065 - RNA, 19 nt, Homo sapiens
gaauguggccugucugauc

SEQ ID NO: 1533066 - RNA, 19 nt, Homo sapiens
uaagugaaauaggaucuug

SEQ ID NO: 1533067 - RNA, 19 nt, Homo sapiens
uggacacgcugacuuugua

SEQ ID NO: 1533068 - RNA, 19 nt, Homo sapiens
aaacacccgugacccacua

SEQ ID NO: 1533069 - RNA, 19 nt, Homo sapiens
caaguacagacauuucuuu

SEQ ID NO: 1533070 - RNA, 19 nt, Homo sapiens
gcgcagcuagccacuauuu

SEQ ID NO: 1533071 - RNA, 19 nt, Homo sapiens
cauccaacguuucuucaga

SEQ ID NO: 1533072 - RNA, 19 nt, Homo sapiens
cggaggaacuggacaaucu

SEQ ID NO: 1533073 - RNA, 19 nt, Homo sapiens
ggcaggacauggaaaguca

SEQ ID NO: 1533074 - RNA, 19 nt, Homo sapiens
aaacuugccauguuaaaug

SEQ ID NO: 1533075 - RNA, 19 nt, Homo sapiens
ugagaaacaguacaacaaa

SEQ ID NO: 1533076 - RNA, 19 nt, Homo sapiens
cuuagaaauugagcucuua

SEQ ID NO: 1533077 - RNA, 19 nt, Homo sapiens
gcaggccugugcagaugaa

SEQ ID NO: 1533078 - RNA, 19 nt, Homo sapiens
ggaccacagacgagguuua

SEQ ID NO: 1533079 - RNA, 19 nt, Homo sapiens
ugaagaauguggccugucu

SEQ ID NO: 1533080 - RNA, 19 nt, Homo sapiens
ccuaaggagugaugagguu

SEQ ID NO: 1533081 - RNA, 19 nt, Homo sapiens
ggacagaggcacagagaac

SEQ ID NO: 1533082 - RNA, 19 nt, Homo sapiens
gagguuagaggaucacuuc

SEQ ID NO: 1533083 - RNA, 19 nt, Homo sapiens
gaaacuugccauguuaaau

SEQ ID NO: 1533084 - RNA, 19 nt, Homo sapiens
gcaaaguggagagaaagaa

SEQ ID NO: 1533085 - RNA, 19 nt, Homo sapiens
ggagagaaggucuuggaau

SEQ ID NO: 1533086 - RNA, 19 nt, Homo sapiens
ggugauuacagcaacauaa

SEQ ID NO: 1533087 - RNA, 19 nt, Homo sapiens
ucugaaagaccuugagaaa

SEQ ID NO: 1533088 - RNA, 19 nt, Homo sapiens
gugcuucaauccagggaaa

SEQ ID NO: 1533089 - RNA, 19 nt, Homo sapiens
ggagaugggaauggaaauu

SEQ ID NO: 1533090 - RNA, 19 nt, Homo sapiens
ucacaccagugcagaagau

SEQ ID NO: 1533091 - RNA, 19 nt, Homo sapiens
agcccagucucuacuaaua

SEQ ID NO: 1533092 - RNA, 19 nt, Homo sapiens
gcucuuacucucuucugua

SEQ ID NO: 1533093 - RNA, 19 nt, Homo sapiens
ucacuucugcauuugauuu

SEQ ID NO: 1533094 - RNA, 19 nt, Homo sapiens
gacacaaagcuuuauccua

SEQ ID NO: 1533095 - RNA, 19 nt, Homo sapiens
acaaggagaugggaaugga

SEQ ID NO: 1533096 - RNA, 19 nt, Homo sapiens
gcaaguacagacauuucuu

SEQ ID NO: 1533097 - RNA, 19 nt, Homo sapiens
gaaagaccuugagaaacag

SEQ ID NO: 1533098 - RNA, 19 nt, Homo sapiens
gagacggucaugacacaaa

SEQ ID NO: 1533099 - RNA, 19 nt, Homo sapiens
cagcugguguccugcaaga

SEQ ID NO: 1533100 - RNA, 19 nt, Homo sapiens
gagcauccaacguuucuuc

SEQ ID NO: 1533101 - RNA, 19 nt, Homo sapiens
aaagcccagucucuacuaa

SEQ ID NO: 1533102 - RNA, 19 nt, Homo sapiens
agacccagcugccuuugug

SEQ ID NO: 1533103 - RNA, 19 nt, Homo sapiens
uggaugagauggagcuugu

SEQ ID NO: 1533104 - RNA, 19 nt, Homo sapiens
gugauuacagcaacauaaa

SEQ ID NO: 1533105 - RNA, 19 nt, Homo sapiens
aggaagagcugucggaaaa

SEQ ID NO: 1533106 - RNA, 19 nt, Homo sapiens
ccucaagaauccacugcuu

SEQ ID NO: 1533107 - RNA, 19 nt, Homo sapiens
uaacugguagugcaaaugu

SEQ ID NO: 1533108 - RNA, 19 nt, Homo sapiens
gggaauggaaauuucagaa

SEQ ID NO: 1533109 - RNA, 19 nt, Homo sapiens
cacaggaacacggugauua

SEQ ID NO: 1533110 - RNA, 19 nt, Homo sapiens
agaaacaguacaacaaaga

SEQ ID NO: 1533111 - RNA, 19 nt, Homo sapiens
ggucaggaguucgagacaa

SEQ ID NO: 1533112 - RNA, 19 nt, Homo sapiens
gcuguaaccuaagaaacug

SEQ ID NO: 1533113 - RNA, 19 nt, Homo sapiens
aaucacaucuugcccacau

SEQ ID NO: 1533114 - RNA, 19 nt, Homo sapiens
ccgaagcucagaauugauu

SEQ ID NO: 1533115 - RNA, 19 nt, Homo sapiens
gaucuugcuuucuucaaaa

SEQ ID NO: 1533116 - RNA, 19 nt, Homo sapiens
caaagcccagucucuacua

SEQ ID NO: 1533117 - RNA, 19 nt, Homo sapiens
gcuaacugguagugcaaau

SEQ ID NO: 1533118 - RNA, 19 nt, Homo sapiens
gcuuuauccuacacagaaa

SEQ ID NO: 1533119 - RNA, 19 nt, Homo sapiens
gaccacagacgagguuuau

SEQ ID NO: 1533120 - RNA, 19 nt, Homo sapiens
agaccgaagcucagaauug

SEQ ID NO: 1533121 - RNA, 19 nt, Homo sapiens
ucaaacaccucagggacau

SEQ ID NO: 1533122 - RNA, 19 nt, Homo sapiens
ggacugaggugaucaagua

SEQ ID NO: 1533123 - RNA, 19 nt, Homo sapiens
ggaagaagaagaacuauaa

SEQ ID NO: 1533124 - RNA, 19 nt, Homo sapiens
gcaggaggcuggacaagaa

SEQ ID NO: 1533125 - RNA, 19 nt, Homo sapiens
gaaggucucccaugaguuu

SEQ ID NO: 1533126 - RNA, 19 nt, Homo sapiens
gggaagggcuugauuacga

SEQ ID NO: 1533127 - RNA, 19 nt, Homo sapiens
gcagauggaucgaguacga

SEQ ID NO: 1533128 - RNA, 19 nt, Homo sapiens
cagcugggcuuccuuuguu

SEQ ID NO: 1533129 - RNA, 19 nt, Homo sapiens
ggacagaaaccgcgaucaa

SEQ ID NO: 1533130 - RNA, 19 nt, Homo sapiens
cgacagugauaagauguuu

SEQ ID NO: 1533131 - RNA, 19 nt, Homo sapiens
gcucagguguggaugguau

SEQ ID NO: 1533132 - RNA, 19 nt, Homo sapiens
gaacaugcacgcucacucu

SEQ ID NO: 1533133 - RNA, 19 nt, Homo sapiens
ggaagggcuugauuacgau

SEQ ID NO: 1533134 - RNA, 19 nt, Homo sapiens
ccaagaagcagaggaagaa

SEQ ID NO: 1533135 - RNA, 19 nt, Homo sapiens
cauguucaccguuggaaua

SEQ ID NO: 1533136 - RNA, 19 nt, Homo sapiens
aaagagaccuuggccaaag

SEQ ID NO: 1533137 - RNA, 19 nt, Homo sapiens
cuacgacagugauaagaug

SEQ ID NO: 1533138 - RNA, 19 nt, Homo sapiens
caagauaaaccgagacuac

SEQ ID NO: 1533139 - RNA, 19 nt, Homo sapiens
ccacaggacugaggugauc

SEQ ID NO: 1533140 - RNA, 19 nt, Homo sapiens
gcaguucguucccuuucga

SEQ ID NO: 1533141 - RNA, 19 nt, Homo sapiens
gcacgaucgucuccagcaa

SEQ ID NO: 1533142 - RNA, 19 nt, Homo sapiens
gugcaguauuucaagcaua

SEQ ID NO: 1533143 - RNA, 19 nt, Homo sapiens
ugcaguauuucaagcauaa

SEQ ID NO: 1533144 - RNA, 19 nt, Homo sapiens
ggucaugugcuacgacuau

SEQ ID NO: 1533145 - RNA, 19 nt, Homo sapiens
cuacuggaccgggauguua

SEQ ID NO: 1533146 - RNA, 19 nt, Homo sapiens
ccuuugccauucuuaagua

SEQ ID NO: 1533147 - RNA, 19 nt, Homo sapiens
gaauaucugucggccaucu

SEQ ID NO: 1533148 - RNA, 19 nt, Homo sapiens
ccucgacccuuccucuuug

SEQ ID NO: 1533149 - RNA, 19 nt, Homo sapiens
ggacggccacgcaguacuu

SEQ ID NO: 1533150 - RNA, 19 nt, Homo sapiens
agaggaagaagaagaacua

SEQ ID NO: 1533151 - RNA, 19 nt, Homo sapiens
acuggaaggucucccauga

SEQ ID NO: 1533152 - RNA, 19 nt, Homo sapiens
guggaauuguuauugagaa

SEQ ID NO: 1533153 - RNA, 19 nt, Homo sapiens
ggacuacgacagugauaag

SEQ ID NO: 1533154 - RNA, 19 nt, Homo sapiens
cugcgauccugcaagauaa

SEQ ID NO: 1533155 - RNA, 19 nt, Homo sapiens
gcagaucauucaggacuac

SEQ ID NO: 1533156 - RNA, 19 nt, Homo sapiens
ccauccaggucaugugcua

SEQ ID NO: 1533157 - RNA, 19 nt, Homo sapiens
agaaguucgugcuugacua

SEQ ID NO: 1533158 - RNA, 19 nt, Homo sapiens
uggaaggucucccaugagu

SEQ ID NO: 1533159 - RNA, 19 nt, Homo sapiens
ccugcgauccugcaagaua

SEQ ID NO: 1533160 - RNA, 19 nt, Homo sapiens
ucuacgguccuaccaauuu

SEQ ID NO: 1533161 - RNA, 19 nt, Homo sapiens
ggcagaucauucaggacua

SEQ ID NO: 1533162 - RNA, 19 nt, Homo sapiens
agaagcagaggaagaagaa

SEQ ID NO: 1533163 - RNA, 19 nt, Homo sapiens
cagaaaccgcgaucaacaa

SEQ ID NO: 1533164 - RNA, 19 nt, Homo sapiens
gagacuacuccuuccuuga

SEQ ID NO: 1533165 - RNA, 19 nt, Homo sapiens
ggaccucuuugggaaguca

SEQ ID NO: 1533166 - RNA, 19 nt, Homo sapiens
gaaguucgugcuugacuac

SEQ ID NO: 1533167 - RNA, 19 nt, Homo sapiens
cuacgguccuaccaauuuc

SEQ ID NO: 1533168 - RNA, 19 nt, Homo sapiens
gcuacgacuaugacaauga

SEQ ID NO: 1533169 - RNA, 19 nt, Homo sapiens
uugccauucuuaaguauug

SEQ ID NO: 1533170 - RNA, 19 nt, Homo sapiens
caaguugugcaguauuuca

SEQ ID NO: 1533171 - RNA, 19 nt, Homo sapiens
cccaugaguuugccaucaa

SEQ ID NO: 1533172 - RNA, 19 nt, Homo sapiens
gugcuacgacuaugacaau

SEQ ID NO: 1533173 - RNA, 19 nt, Homo sapiens
gaguacgacaggacagaaa

SEQ ID NO: 1533174 - RNA, 19 nt, Homo sapiens
cgacaaccgcgucaucaca

SEQ ID NO: 1533175 - RNA, 19 nt, Homo sapiens
gaucgucuccagcaagaag

SEQ ID NO: 1533176 - RNA, 19 nt, Homo sapiens
acagaaaccgcgaucaaca

SEQ ID NO: 1533177 - RNA, 19 nt, Homo sapiens
gcucaaguucgcgcucuuu

SEQ ID NO: 1533178 - RNA, 19 nt, Homo sapiens
ggaaggucucccaugaguu

SEQ ID NO: 1533179 - RNA, 19 nt, Homo sapiens
cuuccaagcugcccauguc

SEQ ID NO: 1533180 - RNA, 19 nt, Homo sapiens
gagaacaauggcagaugga

SEQ ID NO: 1533181 - RNA, 19 nt, Homo sapiens
cuucuacgguccuaccaau

SEQ ID NO: 1533182 - RNA, 19 nt, Homo sapiens
aagcagaggaagaagaaga

SEQ ID NO: 1533183 - RNA, 19 nt, Homo sapiens
caaccgcgucaucacacua

SEQ ID NO: 1533184 - RNA, 19 nt, Homo sapiens
ggccucugcugcugcugaa

SEQ ID NO: 1533185 - RNA, 19 nt, Homo sapiens
ccagcaagaagaucacuag

SEQ ID NO: 1533186 - RNA, 19 nt, Homo sapiens
ccaccuuugccauucuuaa

SEQ ID NO: 1533187 - RNA, 19 nt, Homo sapiens
guacuucauccuccucauc

SEQ ID NO: 1533188 - RNA, 19 nt, Homo sapiens
gcccaggcguacucagcuu

SEQ ID NO: 1533189 - RNA, 19 nt, Homo sapiens
uaugggcaccaacgaauau

SEQ ID NO: 1533190 - RNA, 19 nt, Homo sapiens
cuaugggcaccaacgaaua

SEQ ID NO: 1533191 - RNA, 19 nt, Homo sapiens
ggaguucgagugcaucaac

SEQ ID NO: 1533192 - RNA, 19 nt, Homo sapiens
ugcacuauaucaacccuau

SEQ ID NO: 1533193 - RNA, 19 nt, Homo sapiens
gcaagauaaaccgagacua

SEQ ID NO: 1533194 - RNA, 19 nt, Homo sapiens
aggaagaagaagaacuaua

SEQ ID NO: 1533195 - RNA, 19 nt, Homo sapiens
gcaagguggagcugucagu

SEQ ID NO: 1533196 - RNA, 19 nt, Homo sapiens
cuacgacuaugacaaugac

SEQ ID NO: 1533197 - RNA, 19 nt, Homo sapiens
aaaccgcgaucaacaaccu

SEQ ID NO: 1533198 - RNA, 19 nt, Homo sapiens
acgaucgucuccagcaaga

SEQ ID NO: 1533199 - RNA, 19 nt, Homo sapiens
gcccauguccaucaucauc

SEQ ID NO: 1533200 - RNA, 19 nt, Homo sapiens
cuuccucuuugcacuauau

SEQ ID NO: 1533201 - RNA, 19 nt, Homo sapiens
guucaccguuggaauagac

SEQ ID NO: 1533202 - RNA, 19 nt, Homo sapiens
agaccucagugucacagau

SEQ ID NO: 1533203 - RNA, 19 nt, Homo sapiens
gcuguugggcagaucauuc

SEQ ID NO: 1533204 - RNA, 19 nt, Homo sapiens
caaguucgcgcucuuugac

SEQ ID NO: 1533205 - RNA, 19 nt, Homo sapiens
gaccucagugucacagaug

SEQ ID NO: 1533206 - RNA, 19 nt, Homo sapiens
gagacgauggcaaguggau

SEQ ID NO: 1533207 - RNA, 19 nt, Homo sapiens
gcuggacgagcaugacuuc

SEQ ID NO: 1533208 - RNA, 19 nt, Homo sapiens
ggcaggaggcuggacaaga

SEQ ID NO: 1533209 - RNA, 19 nt, Homo sapiens
guuccagaccucaguguca

SEQ ID NO: 1533210 - RNA, 19 nt, Homo sapiens
gcaugggucucgaaucuua

SEQ ID NO: 1533211 - RNA, 19 nt, Homo sapiens
gggaagaacuccugagcua

SEQ ID NO: 1533212 - RNA, 19 nt, Homo sapiens
gcacaggccuggugauauc

SEQ ID NO: 1533213 - RNA, 19 nt, Homo sapiens
cagaguaagugcucaguaa

SEQ ID NO: 1533214 - RNA, 19 nt, Homo sapiens
acucaucucugcugaauaa

SEQ ID NO: 1533215 - RNA, 19 nt, Homo sapiens
gcaaccaccucaccuacuu

SEQ ID NO: 1533216 - RNA, 19 nt, Homo sapiens
guacauuucuagaugcaaa

SEQ ID NO: 1533217 - RNA, 19 nt, Homo sapiens
gcagauauguguucaagcu

SEQ ID NO: 1533218 - RNA, 19 nt, Homo sapiens
gaaaggcaagacacgcuua

SEQ ID NO: 1533219 - RNA, 19 nt, Homo sapiens
ggccauaguuucagagaau

SEQ ID NO: 1533220 - RNA, 19 nt, Homo sapiens
caucucugcugaauaacua

SEQ ID NO: 1533221 - RNA, 19 nt, Homo sapiens
caacucaucucugcugaau

SEQ ID NO: 1533222 - RNA, 19 nt, Homo sapiens
uaaagagacuuggcacaga

SEQ ID NO: 1533223 - RNA, 19 nt, Homo sapiens
gauugaauuugcccaggua

SEQ ID NO: 1533224 - RNA, 19 nt, Homo sapiens
uaacacgcauccacaugaa

SEQ ID NO: 1533225 - RNA, 19 nt, Homo sapiens
gcacaggcuuccagaacau

SEQ ID NO: 1533226 - RNA, 19 nt, Homo sapiens
cuacuuugcuguucucaug

SEQ ID NO: 1533227 - RNA, 19 nt, Homo sapiens
ugagcuacauggagaauau

SEQ ID NO: 1533228 - RNA, 19 nt, Homo sapiens
gaagaacuccugagcuaca

SEQ ID NO: 1533229 - RNA, 19 nt, Homo sapiens
gcucuacgguuucuuccuu

SEQ ID NO: 1533230 - RNA, 19 nt, Homo sapiens
gcucaucuguaucuacuuc

SEQ ID NO: 1533231 - RNA, 19 nt, Homo sapiens
gcucuucuguacauuucua

SEQ ID NO: 1533232 - RNA, 19 nt, Homo sapiens
ccaguucucuguccuuauc

SEQ ID NO: 1533233 - RNA, 19 nt, Homo sapiens
gcccaguucucuguccuua

SEQ ID NO: 1533234 - RNA, 19 nt, Homo sapiens
caacagagacaugggaaga

SEQ ID NO: 1533235 - RNA, 19 nt, Homo sapiens
gcagcuccuuucagaguga

SEQ ID NO: 1533236 - RNA, 19 nt, Homo sapiens
ggaccucaguuucucaucu

SEQ ID NO: 1533237 - RNA, 19 nt, Homo sapiens
gaagcucaggccauaguuu

SEQ ID NO: 1533238 - RNA, 19 nt, Homo sapiens
gaaggagggagccaggaaa

SEQ ID NO: 1533239 - RNA, 19 nt, Homo sapiens
ggaccuggcacacaguuug

SEQ ID NO: 1533240 - RNA, 19 nt, Homo sapiens
ucacaguccugcugcacuu

SEQ ID NO: 1533241 - RNA, 19 nt, Homo sapiens
gcuacaaccugaccuugca

SEQ ID NO: 1533242 - RNA, 19 nt, Homo sapiens
gccugugccuucugacuuu

SEQ ID NO: 1533243 - RNA, 19 nt, Homo sapiens
agagugaccuggauuggau

SEQ ID NO: 1533244 - RNA, 19 nt, Homo sapiens
ggaaggaggggcaauuuaa

SEQ ID NO: 1533245 - RNA, 19 nt, Homo sapiens
guagagaucugugcuuuug

SEQ ID NO: 1533246 - RNA, 19 nt, Homo sapiens
gcacuggccauacccaugu

SEQ ID NO: 1533247 - RNA, 19 nt, Homo sapiens
uaacccaggagcuuaguaa

SEQ ID NO: 1533248 - RNA, 19 nt, Homo sapiens
guucaagcuuggugugcua

SEQ ID NO: 1533249 - RNA, 19 nt, Homo sapiens
gggcacaggccuggugaua

SEQ ID NO: 1533250 - RNA, 19 nt, Homo sapiens
ggaaggagggagccaggaa

SEQ ID NO: 1533251 - RNA, 19 nt, Homo sapiens
uuucagagaaucacccuua

SEQ ID NO: 1533252 - RNA, 19 nt, Homo sapiens
ccuacugagugacccauuu

SEQ ID NO: 1533253 - RNA, 19 nt, Homo sapiens
auucgaagcucaggccaua

SEQ ID NO: 1533254 - RNA, 19 nt, Homo sapiens
ggacaagugaagagagguu

SEQ ID NO: 1533255 - RNA, 19 nt, Homo sapiens
gccuucagcuccucccaaa

SEQ ID NO: 1533256 - RNA, 19 nt, Homo sapiens
ugaccugugucuucuggaa

SEQ ID NO: 1533257 - RNA, 19 nt, Homo sapiens
ucaugaagccagugcguuu

SEQ ID NO: 1533258 - RNA, 19 nt, Homo sapiens
cccaggcucugagacuuua

SEQ ID NO: 1533259 - RNA, 19 nt, Homo sapiens
ggcacaggcuuccagaaca

SEQ ID NO: 1533260 - RNA, 19 nt, Homo sapiens
gggcgugucuacaacaucu

SEQ ID NO: 1533261 - RNA, 19 nt, Homo sapiens
ccuggucccugcagaguug

SEQ ID NO: 1533262 - RNA, 19 nt, Homo sapiens
gcacaaccaaagccuggaa

SEQ ID NO: 1533263 - RNA, 19 nt, Homo sapiens
aauagaggccauaguggua

SEQ ID NO: 1533264 - RNA, 19 nt, Homo sapiens
cgccaagacugcaucuaga

SEQ ID NO: 1533265 - RNA, 19 nt, Homo sapiens
gccagugcguuucccagaa

SEQ ID NO: 1533266 - RNA, 19 nt, Homo sapiens
ggaccuacccaggcucuga

SEQ ID NO: 1533267 - RNA, 19 nt, Homo sapiens
gcugagcugugacuucucu

SEQ ID NO: 1533268 - RNA, 19 nt, Homo sapiens
gcaucaggaagccaaguuu

SEQ ID NO: 1533269 - RNA, 19 nt, Homo sapiens
gaguugcuggcaccucuua

SEQ ID NO: 1533270 - RNA, 19 nt, Homo sapiens
gaccucaguuucucaucug

SEQ ID NO: 1533271 - RNA, 19 nt, Homo sapiens
gcugugagacuguggacaa

SEQ ID NO: 1533272 - RNA, 19 nt, Homo sapiens
gcggugcacuuucgcucuu

SEQ ID NO: 1533273 - RNA, 19 nt, Homo sapiens
cugcugcacuuccauuuca

SEQ ID NO: 1533274 - RNA, 19 nt, Homo sapiens
cucaguuucucaucuguaa

SEQ ID NO: 1533275 - RNA, 19 nt, Homo sapiens
gugauauccuggugagcaa

SEQ ID NO: 1533276 - RNA, 19 nt, Homo sapiens
ggaagccaaguuucaagga

SEQ ID NO: 1533277 - RNA, 19 nt, Homo sapiens
guaccuauuuugaagacua

SEQ ID NO: 1533278 - RNA, 19 nt, Homo sapiens
caucuucugcucuucugua

SEQ ID NO: 1533279 - RNA, 19 nt, Homo sapiens
gcgccaagacugcaucuag

SEQ ID NO: 1533280 - RNA, 19 nt, Homo sapiens
gaguguggguuuuaaauuc

SEQ ID NO: 1533281 - RNA, 19 nt, Homo sapiens
guuggcagcuccacaucug

SEQ ID NO: 1533282 - RNA, 19 nt, Homo sapiens
gagacuuggcacagaguaa

SEQ ID NO: 1533283 - RNA, 19 nt, Homo sapiens
uaaaauagaggccauagug

SEQ ID NO: 1533284 - RNA, 19 nt, Homo sapiens
ggaaggcauugcucuaccu

SEQ ID NO: 1533285 - RNA, 19 nt, Homo sapiens
uccagaacauguccauaug

SEQ ID NO: 1533286 - RNA, 19 nt, Homo sapiens
aggcaugggucucgaaucu

SEQ ID NO: 1533287 - RNA, 19 nt, Homo sapiens
ggacaucuucugcucuucu

SEQ ID NO: 1533288 - RNA, 19 nt, Homo sapiens
caucuagaaucgcucaaac

SEQ ID NO: 1533289 - RNA, 19 nt, Homo sapiens
gccaagacugcaucuagaa

SEQ ID NO: 1533290 - RNA, 19 nt, Homo sapiens
gaaggaggggcaauuuaaa

SEQ ID NO: 1533291 - RNA, 19 nt, Homo sapiens
ugaggccucuuuuccuuua

SEQ ID NO: 1533292 - RNA, 19 nt, Homo sapiens
agacuuuacuggccuaugc

SEQ ID NO: 1533293 - RNA, 19 nt, Homo sapiens
cuacggcuccugcuagaga

SEQ ID NO: 1533294 - RNA, 19 nt, Homo sapiens
ccgcagauauguguucaag

SEQ ID NO: 1533295 - RNA, 19 nt, Homo sapiens
ucacgucccucuucaaccu

SEQ ID NO: 1533296 - RNA, 19 nt, Homo sapiens
cagaacauguccauaugcu

SEQ ID NO: 1533297 - RNA, 19 nt, Homo sapiens
uuaacacgcauccacauga

SEQ ID NO: 1533298 - RNA, 19 nt, Homo sapiens
cuucugcucuucuguacau

SEQ ID NO: 1533299 - RNA, 19 nt, Homo sapiens
gcaucuagaaucgcucaaa

SEQ ID NO: 1533300 - RNA, 19 nt, Homo sapiens
caagacugcaucuagaauc

SEQ ID NO: 1533301 - RNA, 19 nt, Homo sapiens
ggugauugggcaagauuga

SEQ ID NO: 1533302 - RNA, 19 nt, Homo sapiens
cagaaugcaacaacagaga

SEQ ID NO: 1533303 - RNA, 19 nt, Homo sapiens
uggcaccucuuacguacau

SEQ ID NO: 1533304 - RNA, 19 nt, Homo sapiens
caaccaccucaccuacuuu

SEQ ID NO: 1533305 - RNA, 19 nt, Homo sapiens
gaaugcaacaacagagaca

SEQ ID NO: 1533306 - RNA, 19 nt, Homo sapiens
gugcagcuccuuucagagu

SEQ ID NO: 1533307 - RNA, 19 nt, Homo sapiens
ugggacaucuucugcucuu

SEQ ID NO: 1533308 - RNA, 19 nt, Homo sapiens
ggcgugagaguguggguuu

SEQ ID NO: 1533309 - RNA, 19 nt, Homo sapiens
gcggugcucccaagacuuc

SEQ ID NO: 1533310 - RNA, 19 nt, Homo sapiens
gaaguuaucuuucugugau

SEQ ID NO: 1533311 - RNA, 19 nt, Homo sapiens
gccggaagaugaugaaaua

SEQ ID NO: 1533312 - RNA, 19 nt, Homo sapiens
gaaugauccuuacagaauu

SEQ ID NO: 1533313 - RNA, 19 nt, Homo sapiens
ggaaugauccuuacagaau

SEQ ID NO: 1533314 - RNA, 19 nt, Homo sapiens
gcucuuagaucaacacaug

SEQ ID NO: 1533315 - RNA, 19 nt, Homo sapiens
ggaagaugaugaaauacug

SEQ ID NO: 1533316 - RNA, 19 nt, Homo sapiens
cagcuggacuugaacauga

SEQ ID NO: 1533317 - RNA, 19 nt, Homo sapiens
ggacagagacucaaagaac

SEQ ID NO: 1533318 - RNA, 19 nt, Homo sapiens
gaaauacugggcuaccuuu

SEQ ID NO: 1533319 - RNA, 19 nt, Homo sapiens
gcacaucccgccucaguau

SEQ ID NO: 1533320 - RNA, 19 nt, Homo sapiens
uaaugagccucuagaucua

SEQ ID NO: 1533321 - RNA, 19 nt, Homo sapiens
gcaggugguugcacauuuc

SEQ ID NO: 1533322 - RNA, 19 nt, Homo sapiens
gaucacagcucgauaucac

SEQ ID NO: 1533323 - RNA, 19 nt, Homo sapiens
uuacugagccggaagauga

SEQ ID NO: 1533324 - RNA, 19 nt, Homo sapiens
uaaagcaauuccuuccauu

SEQ ID NO: 1533325 - RNA, 19 nt, Homo sapiens
cagaaagcauuuaaagcaa

SEQ ID NO: 1533326 - RNA, 19 nt, Homo sapiens
caaggugcauuacccgaaa

SEQ ID NO: 1533327 - RNA, 19 nt, Homo sapiens
gcuuggagauguguucuuu

SEQ ID NO: 1533328 - RNA, 19 nt, Homo sapiens
gcaauuccuuccauuaucg

SEQ ID NO: 1533329 - RNA, 19 nt, Homo sapiens
ggacuugcuuggagaugug

SEQ ID NO: 1533330 - RNA, 19 nt, Homo sapiens
ucagaaagcauuuaaagca

SEQ ID NO: 1533331 - RNA, 19 nt, Homo sapiens
cuagaucuauugucucaga

SEQ ID NO: 1533332 - RNA, 19 nt, Homo sapiens
aucauuagcuucuuucuga

SEQ ID NO: 1533333 - RNA, 19 nt, Homo sapiens
gauggugcuuucuuuccua

SEQ ID NO: 1533334 - RNA, 19 nt, Homo sapiens
gaaauucggagugucagaa

SEQ ID NO: 1533335 - RNA, 19 nt, Homo sapiens
cauaauuucucccgcaauc

SEQ ID NO: 1533336 - RNA, 19 nt, Homo sapiens
ggacaaaacccuccaagga

SEQ ID NO: 1533337 - RNA, 19 nt, Homo sapiens
aaagcaauuccuuccauua

SEQ ID NO: 1533338 - RNA, 19 nt, Homo sapiens
gguugauggugcuuucuuu

SEQ ID NO: 1533339 - RNA, 19 nt, Homo sapiens
ccacggaggaggagaaguu

SEQ ID NO: 1533340 - RNA, 19 nt, Homo sapiens
cuaaugagccucuagaucu

SEQ ID NO: 1533341 - RNA, 19 nt, Homo sapiens
ggguggccaucaucccuua

SEQ ID NO: 1533342 - RNA, 19 nt, Homo sapiens
gcucgaaccgggaauccua

SEQ ID NO: 1533343 - RNA, 19 nt, Homo sapiens
gaucuauugucucagaaag

SEQ ID NO: 1533344 - RNA, 19 nt, Homo sapiens
gauccuuacagaauucuuu

SEQ ID NO: 1533345 - RNA, 19 nt, Homo sapiens
gaaccgggaauccuaaugg

SEQ ID NO: 1533346 - RNA, 19 nt, Homo sapiens
ggugcuuucuuuccuaaug

SEQ ID NO: 1533347 - RNA, 19 nt, Homo sapiens
auucagcauuugccuguua

SEQ ID NO: 1533348 - RNA, 19 nt, Homo sapiens
aggaauauuugguuucuuc

SEQ ID NO: 1533349 - RNA, 19 nt, Homo sapiens
caggccagauccuaauuug

SEQ ID NO: 1533350 - RNA, 19 nt, Homo sapiens
cagcuuauaaucugacuga

SEQ ID NO: 1533351 - RNA, 19 nt, Homo sapiens
ugaggugccugaggacaaa

SEQ ID NO: 1533352 - RNA, 19 nt, Homo sapiens
ccaaaggcuuauuccacaa

SEQ ID NO: 1533353 - RNA, 19 nt, Homo sapiens
ugggauaacuugcgagaag

SEQ ID NO: 1533354 - RNA, 19 nt, Homo sapiens
gugcuuucuuuccuaauga

SEQ ID NO: 1533355 - RNA, 19 nt, Homo sapiens
uuuauggacuuaggaauga

SEQ ID NO: 1533356 - RNA, 19 nt, Homo sapiens
gcaggcaggcagccaaaug

SEQ ID NO: 1533357 - RNA, 19 nt, Homo sapiens
caaaggcuuauuccacaaa

SEQ ID NO: 1533358 - RNA, 19 nt, Homo sapiens
ccauaaguguuucuagucu

SEQ ID NO: 1533359 - RNA, 19 nt, Homo sapiens
gcugggaucccugcgauuu

SEQ ID NO: 1533360 - RNA, 19 nt, Homo sapiens
gccucuaccugaacaucua

SEQ ID NO: 1533361 - RNA, 19 nt, Homo sapiens
gaagcccugugccugugaa

SEQ ID NO: 1533362 - RNA, 19 nt, Homo sapiens
uuaaagcaauuccuuccau

SEQ ID NO: 1533363 - RNA, 19 nt, Homo sapiens
gcauuuaaagcaauuccuu

SEQ ID NO: 1533364 - RNA, 19 nt, Homo sapiens
gcgggagccauaaguguuu

SEQ ID NO: 1533365 - RNA, 19 nt, Homo sapiens
gcacugaucacagcucgau

SEQ ID NO: 1533366 - RNA, 19 nt, Homo sapiens
uaacaaugcgucagacucu

SEQ ID NO: 1533367 - RNA, 19 nt, Homo sapiens
cauaaguguuucuagucuu

SEQ ID NO: 1533368 - RNA, 19 nt, Homo sapiens
gcucagccuccaucuuuga

SEQ ID NO: 1533369 - RNA, 19 nt, Homo sapiens
gcucagcugcuuucuaugg

SEQ ID NO: 1533370 - RNA, 19 nt, Homo sapiens
cgcaaucauuagcuucuuu

SEQ ID NO: 1533371 - RNA, 19 nt, Homo sapiens
ggcuaggaauauuugguuu

SEQ ID NO: 1533372 - RNA, 19 nt, Homo sapiens
cuaaugaauacuuccauga

SEQ ID NO: 1533373 - RNA, 19 nt, Homo sapiens
ucccauggccaaaggcuua

SEQ ID NO: 1533374 - RNA, 19 nt, Homo sapiens
guaccggcuaggaauauuu

SEQ ID NO: 1533375 - RNA, 19 nt, Homo sapiens
ccaguaccggcuaggaaua

SEQ ID NO: 1533376 - RNA, 19 nt, Homo sapiens
gggaacgaccugucucugu

SEQ ID NO: 1533377 - RNA, 19 nt, Homo sapiens
gcaaucauuagcuucuuuc

SEQ ID NO: 1533378 - RNA, 19 nt, Homo sapiens
aaugaauacuuccaugaca

SEQ ID NO: 1533379 - RNA, 19 nt, Homo sapiens
ggaggcccaugauuaugag

SEQ ID NO: 1533380 - RNA, 19 nt, Homo sapiens
acaguccucuuucuuccuu

SEQ ID NO: 1533381 - RNA, 19 nt, Homo sapiens
uuggagauguguucuuugu

SEQ ID NO: 1533382 - RNA, 19 nt, Homo sapiens
aagcaauuccuuccauuau

SEQ ID NO: 1533383 - RNA, 19 nt, Homo sapiens
gcacccaggccagauccua

SEQ ID NO: 1533384 - RNA, 19 nt, Homo sapiens
gaggaggagaaguuacuga

SEQ ID NO: 1533385 - RNA, 19 nt, Homo sapiens
guggccagcuuauaaucug

SEQ ID NO: 1533386 - RNA, 19 nt, Homo sapiens
acauuucugugguaacaau

SEQ ID NO: 1533387 - RNA, 19 nt, Homo sapiens
ccuggaggcccaugauuau

SEQ ID NO: 1533388 - RNA, 19 nt, Homo sapiens
cugcaucgcccugggauaa

SEQ ID NO: 1533389 - RNA, 19 nt, Homo sapiens
aaugauccuuacagaauuc

SEQ ID NO: 1533390 - RNA, 19 nt, Homo sapiens
ccuuguggcuaaugaauac

SEQ ID NO: 1533391 - RNA, 19 nt, Homo sapiens
cuaggaauauuugguuucu

SEQ ID NO: 1533392 - RNA, 19 nt, Homo sapiens
ccaggccagauccuaauuu

SEQ ID NO: 1533393 - RNA, 19 nt, Homo sapiens
gccugccuauucagcauuu

SEQ ID NO: 1533394 - RNA, 19 nt, Homo sapiens
caggcaggcagccaaauga

SEQ ID NO: 1533395 - RNA, 19 nt, Homo sapiens
gaagggccacagaggaaca

SEQ ID NO: 1533396 - RNA, 19 nt, Homo sapiens
uggaggcccaugauuauga

SEQ ID NO: 1533397 - RNA, 19 nt, Homo sapiens
cccaggaggugccuucaag

SEQ ID NO: 1533398 - RNA, 19 nt, Homo sapiens
aagacugccucuaccugaa

SEQ ID NO: 1533399 - RNA, 19 nt, Homo sapiens
ccaccuccuacccuaauuu

SEQ ID NO: 1533400 - RNA, 19 nt, Homo sapiens
gcuccacaguccucuuucu

SEQ ID NO: 1533401 - RNA, 19 nt, Homo sapiens
ugaaauacugggcuaccuu

SEQ ID NO: 1533402 - RNA, 19 nt, Homo sapiens
uaacaggaagcucuuucug

SEQ ID NO: 1533403 - RNA, 19 nt, Homo sapiens
ucucagaaagcauuuaaag

SEQ ID NO: 1533404 - RNA, 19 nt, Homo sapiens
gauccuaauuugggcuauc

SEQ ID NO: 1533405 - RNA, 19 nt, Homo sapiens
ccagcucugugaccaucuu

SEQ ID NO: 1533406 - RNA, 19 nt, Homo sapiens
gcugauauuuuauggacuu

SEQ ID NO: 1533407 - RNA, 19 nt, Homo sapiens
augaauacuuccaugacaa

SEQ ID NO: 1533408 - RNA, 19 nt, Homo sapiens
caucccgccucaguauuug

SEQ ID NO: 1533409 - RNA, 19 nt, Homo sapiens
cgccgucaauguucacaga

SEQ ID NO: 1533410 - RNA, 19 nt, Homo sapiens
cagagaagaugacaaguua

SEQ ID NO: 1533411 - RNA, 19 nt, Homo sapiens
gaacuugucuccaauuuag

SEQ ID NO: 1533412 - RNA, 19 nt, Homo sapiens
gaaaggagaucacuaagcu

SEQ ID NO: 1533413 - RNA, 19 nt, Homo sapiens
ucacaaggauggaaauuau

SEQ ID NO: 1533414 - RNA, 19 nt, Homo sapiens
gaggaaaggagaucacuaa

SEQ ID NO: 1533415 - RNA, 19 nt, Homo sapiens
ggauggaaauuaucugguu

SEQ ID NO: 1533416 - RNA, 19 nt, Homo sapiens
ggagagaucagaggucaua

SEQ ID NO: 1533417 - RNA, 19 nt, Homo sapiens
cuucauagacugugcauua

SEQ ID NO: 1533418 - RNA, 19 nt, Homo sapiens
gcaggaagaaccuuucaaa

SEQ ID NO: 1533419 - RNA, 19 nt, Homo sapiens
ggaagaaagccacaugguu

SEQ ID NO: 1533420 - RNA, 19 nt, Homo sapiens
gugaagcaccuuuggauaa

SEQ ID NO: 1533421 - RNA, 19 nt, Homo sapiens
gaaggaagcaaggaagaaa

SEQ ID NO: 1533422 - RNA, 19 nt, Homo sapiens
ucagcagccuucugguuua

SEQ ID NO: 1533423 - RNA, 19 nt, Homo sapiens
ccugaaagccuaagauuga

SEQ ID NO: 1533424 - RNA, 19 nt, Homo sapiens
ucaauagaauguugcaguu

SEQ ID NO: 1533425 - RNA, 19 nt, Homo sapiens
ugaagcaccuuuggauaaa

SEQ ID NO: 1533426 - RNA, 19 nt, Homo sapiens
ucacagaguggcacaagua

SEQ ID NO: 1533427 - RNA, 19 nt, Homo sapiens
ccacaugguugucaaagag

SEQ ID NO: 1533428 - RNA, 19 nt, Homo sapiens
ggaaugauggacucugauu

SEQ ID NO: 1533429 - RNA, 19 nt, Homo sapiens
gugaacuugucuccaauuu

SEQ ID NO: 1533430 - RNA, 19 nt, Homo sapiens
gaaugauggacucugauuu

SEQ ID NO: 1533431 - RNA, 19 nt, Homo sapiens
gauaaacggcagggacuuu

SEQ ID NO: 1533432 - RNA, 19 nt, Homo sapiens
ggagaucacuaagcuggau

SEQ ID NO: 1533433 - RNA, 19 nt, Homo sapiens
aauaaagcaugcaggaaga

SEQ ID NO: 1533434 - RNA, 19 nt, Homo sapiens
cauagacugugcauuauac

SEQ ID NO: 1533435 - RNA, 19 nt, Homo sapiens
gucccuuucuugugaguua

SEQ ID NO: 1533436 - RNA, 19 nt, Homo sapiens
uacaugcucucaaugaaga

SEQ ID NO: 1533437 - RNA, 19 nt, Homo sapiens
gcagccuucugguuuauca

SEQ ID NO: 1533438 - RNA, 19 nt, Homo sapiens
cggcagggacuuuggauuu

SEQ ID NO: 1533439 - RNA, 19 nt, Homo sapiens
aaacagagaagaugacaag

SEQ ID NO: 1533440 - RNA, 19 nt, Homo sapiens
ccugugaacuugucuccaa

SEQ ID NO: 1533441 - RNA, 19 nt, Homo sapiens
gauucuacaugcucucaau

SEQ ID NO: 1533442 - RNA, 19 nt, Homo sapiens
gaaagcaggagauggaaac

SEQ ID NO: 1533443 - RNA, 19 nt, Homo sapiens
ggaaagcaggagauggaaa

SEQ ID NO: 1533444 - RNA, 19 nt, Homo sapiens
gaaccagacugcccuucac

SEQ ID NO: 1533445 - RNA, 19 nt, Homo sapiens
gacagugguuagagugaga

SEQ ID NO: 1533446 - RNA, 19 nt, Homo sapiens
uaauuucucccuagugcua

SEQ ID NO: 1533447 - RNA, 19 nt, Homo sapiens
ugaacuugucuccaauuua

SEQ ID NO: 1533448 - RNA, 19 nt, Homo sapiens
cauuauacaugccaucucu

SEQ ID NO: 1533449 - RNA, 19 nt, Homo sapiens
cagcugaggcauccugaaa

SEQ ID NO: 1533450 - RNA, 19 nt, Homo sapiens
gcagggaaguggcaaaaca

SEQ ID NO: 1533451 - RNA, 19 nt, Homo sapiens
ucauagacugugcauuaua

SEQ ID NO: 1533452 - RNA, 19 nt, Homo sapiens
cagaguggcacaaguacaa

SEQ ID NO: 1533453 - RNA, 19 nt, Homo sapiens
gaauguugcaguuuuagua

SEQ ID NO: 1533454 - RNA, 19 nt, Homo sapiens
gagaagaugacaaguuagg

SEQ ID NO: 1533455 - RNA, 19 nt, Homo sapiens
acagagaagaugacaaguu

SEQ ID NO: 1533456 - RNA, 19 nt, Homo sapiens
gccacaugguugucaaaga

SEQ ID NO: 1533457 - RNA, 19 nt, Homo sapiens
gaaagccacaugguuguca

SEQ ID NO: 1533458 - RNA, 19 nt, Homo sapiens
caaggaagaaagccacaug

SEQ ID NO: 1533459 - RNA, 19 nt, Homo sapiens
cagccacacuuacaaaggu

SEQ ID NO: 1533460 - RNA, 19 nt, Homo sapiens
gucagcagccuucugguuu

SEQ ID NO: 1533461 - RNA, 19 nt, Homo sapiens
ggaaccagacugcccuuca

SEQ ID NO: 1533462 - RNA, 19 nt, Homo sapiens
caauagaauguugcaguuu

SEQ ID NO: 1533463 - RNA, 19 nt, Homo sapiens
gagaucagaggucauacug

SEQ ID NO: 1533464 - RNA, 19 nt, Homo sapiens
agaagacagugguuagagu

SEQ ID NO: 1533465 - RNA, 19 nt, Homo sapiens
ggucagcagccuucugguu

SEQ ID NO: 1533466 - RNA, 19 nt, Homo sapiens
ucuacaugcucucaaugaa

SEQ ID NO: 1533467 - RNA, 19 nt, Homo sapiens
cagccugccuugcauccaa

SEQ ID NO: 1533468 - RNA, 19 nt, Homo sapiens
ggaaaggagaucacuaagc

SEQ ID NO: 1533469 - RNA, 19 nt, Homo sapiens
cagauuggccagugacuca

SEQ ID NO: 1533470 - RNA, 19 nt, Homo sapiens
caauuuagucugucaaggu

SEQ ID NO: 1533471 - RNA, 19 nt, Homo sapiens
gugcaaagcgucagaagac

SEQ ID NO: 1533472 - RNA, 19 nt, Homo sapiens
cagcagccuucugguuuau

SEQ ID NO: 1533473 - RNA, 19 nt, Homo sapiens
gaguuaauuucucccuagu

SEQ ID NO: 1533474 - RNA, 19 nt, Homo sapiens
cgucagaagacagugguua

SEQ ID NO: 1533475 - RNA, 19 nt, Homo sapiens
gcaugcaggaagaaccuuu

SEQ ID NO: 1533476 - RNA, 19 nt, Homo sapiens
uaucagccacacuuacaaa

SEQ ID NO: 1533477 - RNA, 19 nt, Homo sapiens
ucugcgaccugcaaagaug

SEQ ID NO: 1533478 - RNA, 19 nt, Homo sapiens
gaagcaccuuuggauaaac

SEQ ID NO: 1533479 - RNA, 19 nt, Homo sapiens
uggaugacguuuucuguuu

SEQ ID NO: 1533480 - RNA, 19 nt, Homo sapiens
gcugaggcauccugaaagc

SEQ ID NO: 1533481 - RNA, 19 nt, Homo sapiens
ucagaggucauacugugaa

SEQ ID NO: 1533482 - RNA, 19 nt, Homo sapiens
gagaagaggaaaggagauc

SEQ ID NO: 1533483 - RNA, 19 nt, Homo sapiens
agacugugcauuauacaug

SEQ ID NO: 1533484 - RNA, 19 nt, Homo sapiens
ugaucaaccuucauagacu

SEQ ID NO: 1533485 - RNA, 19 nt, Homo sapiens
guucacucuccauuuauuu

SEQ ID NO: 1533486 - RNA, 19 nt, Homo sapiens
aaugauggacucugauuuc

SEQ ID NO: 1533487 - RNA, 19 nt, Homo sapiens
gcaaagaugaaaagggaaa

SEQ ID NO: 1533488 - RNA, 19 nt, Homo sapiens
ucaaagagaagaggaaagg

SEQ ID NO: 1533489 - RNA, 19 nt, Homo sapiens
caaagcgucagaagacagu

SEQ ID NO: 1533490 - RNA, 19 nt, Homo sapiens
ugugaagcaccuuuggaua

SEQ ID NO: 1533491 - RNA, 19 nt, Homo sapiens
gaggucauacugugaagca

SEQ ID NO: 1533492 - RNA, 19 nt, Homo sapiens
ugaaggaagcaaggaagaa

SEQ ID NO: 1533493 - RNA, 19 nt, Homo sapiens
uggauaugaucaaccuuca

SEQ ID NO: 1533494 - RNA, 19 nt, Homo sapiens
ggacuuuggauuuucuuuu

SEQ ID NO: 1533495 - RNA, 19 nt, Homo sapiens
cagauuccaggaccacuga

SEQ ID NO: 1533496 - RNA, 19 nt, Homo sapiens
caaccagagaccugaagga

SEQ ID NO: 1533497 - RNA, 19 nt, Homo sapiens
acaaaggucaaaugugcaa

SEQ ID NO: 1533498 - RNA, 19 nt, Homo sapiens
ugucuccaauuuagucugu

SEQ ID NO: 1533499 - RNA, 19 nt, Homo sapiens
aaagccacaugguugucaa

SEQ ID NO: 1533500 - RNA, 19 nt, Homo sapiens
gguuuaucagccacacuua

SEQ ID NO: 1533501 - RNA, 19 nt, Homo sapiens
aguucacucuccauuuauu

SEQ ID NO: 1533502 - RNA, 19 nt, Homo sapiens
aagcauaauccauugaaag

SEQ ID NO: 1533503 - RNA, 19 nt, Homo sapiens
ggcagggacuuuggauuuu

SEQ ID NO: 1533504 - RNA, 19 nt, Homo sapiens
uagugcuacuucucagauu

SEQ ID NO: 1533505 - RNA, 19 nt, Homo sapiens
ugcucucaaugaagaauaa

SEQ ID NO: 1533506 - RNA, 19 nt, Homo sapiens
gauuccaggaccacugaaa

SEQ ID NO: 1533507 - RNA, 19 nt, Homo sapiens
ucagaagacagugguuaga

SEQ ID NO: 1533508 - RNA, 19 nt, Homo sapiens
ggauaaacggcagggacuu

SEQ ID NO: 1533509 - RNA, 19 nt, Homo sapiens
uaagcuggaugacguuuuc

SEQ ID NO: 1533510 - RNA, 19 nt, Homo sapiens
agacaaagcugaaagauuu

SEQ ID NO: 1533511 - RNA, 19 nt, Homo sapiens
gaauguagcuguaguuuau

SEQ ID NO: 1533512 - RNA, 19 nt, Homo sapiens
ggucaaaucuggaauguug

SEQ ID NO: 1533513 - RNA, 19 nt, Homo sapiens
guacauguccugugaauuu

SEQ ID NO: 1533514 - RNA, 19 nt, Homo sapiens
gaucauggcuaaagacaga

SEQ ID NO: 1533515 - RNA, 19 nt, Homo sapiens
gaggagcucuuuaugauug

SEQ ID NO: 1533516 - RNA, 19 nt, Homo sapiens
ccugaaaccugauguuaua

SEQ ID NO: 1533517 - RNA, 19 nt, Homo sapiens
gaacuugucauaaagcuaa

SEQ ID NO: 1533518 - RNA, 19 nt, Homo sapiens
gaaaccagguguugggaaa

SEQ ID NO: 1533519 - RNA, 19 nt, Homo sapiens
gaucagcggucaaagcauu

SEQ ID NO: 1533520 - RNA, 19 nt, Homo sapiens
ccuauuagcuuucuugguu

SEQ ID NO: 1533521 - RNA, 19 nt, Homo sapiens
ggaagaagagcaagaagaa

SEQ ID NO: 1533522 - RNA, 19 nt, Homo sapiens
ggaguuauguugcaaucaa

SEQ ID NO: 1533523 - RNA, 19 nt, Homo sapiens
gaaaccgaaucaggaguua

SEQ ID NO: 1533524 - RNA, 19 nt, Homo sapiens
ggaaauguauucguguuga

SEQ ID NO: 1533525 - RNA, 19 nt, Homo sapiens
ggaagcauacauccaaaua

SEQ ID NO: 1533526 - RNA, 19 nt, Homo sapiens
gaagaagaggcauuuauug

SEQ ID NO: 1533527 - RNA, 19 nt, Homo sapiens
ccagaggccugaagauuau

SEQ ID NO: 1533528 - RNA, 19 nt, Homo sapiens
uaaaguguccugacuauga

SEQ ID NO: 1533529 - RNA, 19 nt, Homo sapiens
ucaaagugcuguugcauuc

SEQ ID NO: 1533530 - RNA, 19 nt, Homo sapiens
uauaaucacuccuguccua

SEQ ID NO: 1533531 - RNA, 19 nt, Homo sapiens
cuaacuaucugucuaucua

SEQ ID NO: 1533532 - RNA, 19 nt, Homo sapiens
aaggaaaggugacuaacua

SEQ ID NO: 1533533 - RNA, 19 nt, Homo sapiens
gaugguggcugaaauucuu

SEQ ID NO: 1533534 - RNA, 19 nt, Homo sapiens
gggcaaagacagcacaaua

SEQ ID NO: 1533535 - RNA, 19 nt, Homo sapiens
ggaccaccauguaaaguau

SEQ ID NO: 1533536 - RNA, 19 nt, Homo sapiens
caaagacagcacaauaaua

SEQ ID NO: 1533537 - RNA, 19 nt, Homo sapiens
gaaauguauucguguugaa

SEQ ID NO: 1533538 - RNA, 19 nt, Homo sapiens
gagcagcuauucuaaccaa

SEQ ID NO: 1533539 - RNA, 19 nt, Homo sapiens
gcagauauauuugaugaag

SEQ ID NO: 1533540 - RNA, 19 nt, Homo sapiens
gguaaaaucuacugucuuu

SEQ ID NO: 1533541 - RNA, 19 nt, Homo sapiens
gaaaccugauguuauaauc

SEQ ID NO: 1533542 - RNA, 19 nt, Homo sapiens
acacaggcauggaaaugua

SEQ ID NO: 1533543 - RNA, 19 nt, Homo sapiens
aaacaacauuagcccguua

SEQ ID NO: 1533544 - RNA, 19 nt, Homo sapiens
aaaggugacuaacuaacua

SEQ ID NO: 1533545 - RNA, 19 nt, Homo sapiens
ggaagaaauuaaugacaca

SEQ ID NO: 1533546 - RNA, 19 nt, Homo sapiens
ggaaacaauucuccaaacu

SEQ ID NO: 1533547 - RNA, 19 nt, Homo sapiens
gcaaagacagcacaauaau

SEQ ID NO: 1533548 - RNA, 19 nt, Homo sapiens
ggucaaagcauuccagaug

SEQ ID NO: 1533549 - RNA, 19 nt, Homo sapiens
gaagggcaccaucuuugua

SEQ ID NO: 1533550 - RNA, 19 nt, Homo sapiens
ucauaaagcuaauguugga

SEQ ID NO: 1533551 - RNA, 19 nt, Homo sapiens
ggcacaagaucauggcuaa

SEQ ID NO: 1533552 - RNA, 19 nt, Homo sapiens
gaaacaauucuccaaacuu

SEQ ID NO: 1533553 - RNA, 19 nt, Homo sapiens
uauaaaguguccugacuau

SEQ ID NO: 1533554 - RNA, 19 nt, Homo sapiens
acagaaagguguuagaagu

SEQ ID NO: 1533555 - RNA, 19 nt, Homo sapiens
ucuccaaacuuuagaagaa

SEQ ID NO: 1533556 - RNA, 19 nt, Homo sapiens
guugaagcuuugccaauuu

SEQ ID NO: 1533557 - RNA, 19 nt, Homo sapiens
cagacgcccucucauguuu

SEQ ID NO: 1533558 - RNA, 19 nt, Homo sapiens
guuagaaguuguucaaagu

SEQ ID NO: 1533559 - RNA, 19 nt, Homo sapiens
caagagugauagcaguaaa

SEQ ID NO: 1533560 - RNA, 19 nt, Homo sapiens
gaagaagaagaggcauuua

SEQ ID NO: 1533561 - RNA, 19 nt, Homo sapiens
ggcaaagacagcacaauaa

SEQ ID NO: 1533562 - RNA, 19 nt, Homo sapiens
gaacagauugcugcugaaa

SEQ ID NO: 1533563 - RNA, 19 nt, Homo sapiens
aacauuagcccguuacaua

SEQ ID NO: 1533564 - RNA, 19 nt, Homo sapiens
ggcauucacuuccauacuu

SEQ ID NO: 1533565 - RNA, 19 nt, Homo sapiens
gcagaugguggcugaaauu

SEQ ID NO: 1533566 - RNA, 19 nt, Homo sapiens
gguaaccacugcccagaau

SEQ ID NO: 1533567 - RNA, 19 nt, Homo sapiens
agauacagauggcaaagaa

SEQ ID NO: 1533568 - RNA, 19 nt, Homo sapiens
aguaauggcugaacacaau

SEQ ID NO: 1533569 - RNA, 19 nt, Homo sapiens
ucaaagcauuccagaugaa

SEQ ID NO: 1533570 - RNA, 19 nt, Homo sapiens
ccacauuugagcacuaaua

SEQ ID NO: 1533571 - RNA, 19 nt, Homo sapiens
gaaagguguuagaaguugu

SEQ ID NO: 1533572 - RNA, 19 nt, Homo sapiens
ugaugaagaugaaacugaa

SEQ ID NO: 1533573 - RNA, 19 nt, Homo sapiens
ggaagaagaggaagaagag

SEQ ID NO: 1533574 - RNA, 19 nt, Homo sapiens
caaauaccauaggcuaguu

SEQ ID NO: 1533575 - RNA, 19 nt, Homo sapiens
cuaacuaacuaucugucua

SEQ ID NO: 1533576 - RNA, 19 nt, Homo sapiens
caauaauacgggauacaua

SEQ ID NO: 1533577 - RNA, 19 nt, Homo sapiens
gcaauucaggccacagaaa

SEQ ID NO: 1533578 - RNA, 19 nt, Homo sapiens
gccugaagauuauuuggaa

SEQ ID NO: 1533579 - RNA, 19 nt, Homo sapiens
gaagucauugagaaucaua

SEQ ID NO: 1533580 - RNA, 19 nt, Homo sapiens
gucaaagcauuccagauga

SEQ ID NO: 1533581 - RNA, 19 nt, Homo sapiens
uaaccacugcccagaauuu

SEQ ID NO: 1533582 - RNA, 19 nt, Homo sapiens
agaaagguguuagaaguug

SEQ ID NO: 1533583 - RNA, 19 nt, Homo sapiens
gaaaggugacuaacuaacu

SEQ ID NO: 1533584 - RNA, 19 nt, Homo sapiens
gaugagcuauuucguacuc

SEQ ID NO: 1533585 - RNA, 19 nt, Homo sapiens
gugcagaggaagaaauuaa

SEQ ID NO: 1533586 - RNA, 19 nt, Homo sapiens
gaugagggauuggaaugug

SEQ ID NO: 1533587 - RNA, 19 nt, Homo sapiens
cuuggugauuucaguauua

SEQ ID NO: 1533588 - RNA, 19 nt, Homo sapiens
gaacccacgucccuaucug

SEQ ID NO: 1533589 - RNA, 19 nt, Homo sapiens
gaaauuaaugacacaaugg

SEQ ID NO: 1533590 - RNA, 19 nt, Homo sapiens
agaagaagaggcauuuauu

SEQ ID NO: 1533591 - RNA, 19 nt, Homo sapiens
aaucacuccuguccuaauu

SEQ ID NO: 1533592 - RNA, 19 nt, Homo sapiens
aaagacagcacaauaauac

SEQ ID NO: 1533593 - RNA, 19 nt, Homo sapiens
gcauucacuuccauacuuc

SEQ ID NO: 1533594 - RNA, 19 nt, Homo sapiens
gaaggaauggcacaagauc

SEQ ID NO: 1533595 - RNA, 19 nt, Homo sapiens
gaaauucuucaucaucuag

SEQ ID NO: 1533596 - RNA, 19 nt, Homo sapiens
ggauacauauacaguagag

SEQ ID NO: 1533597 - RNA, 19 nt, Homo sapiens
gauuugugccagagaauuu

SEQ ID NO: 1533598 - RNA, 19 nt, Homo sapiens
gcgaagggcaccaucuuug

SEQ ID NO: 1533599 - RNA, 19 nt, Homo sapiens
cgaaucaggaguuauguug

SEQ ID NO: 1533600 - RNA, 19 nt, Homo sapiens
gacaagagugauagcagua

SEQ ID NO: 1533601 - RNA, 19 nt, Homo sapiens
guucuccacucucaguaaa

SEQ ID NO: 1533602 - RNA, 19 nt, Homo sapiens
cuugacaccucccucagua

SEQ ID NO: 1533603 - RNA, 19 nt, Homo sapiens
uacauguccugugaauuua

SEQ ID NO: 1533604 - RNA, 19 nt, Homo sapiens
gcagaggaagaaauuaaug

SEQ ID NO: 1533605 - RNA, 19 nt, Homo sapiens
uccagaggccugaagauua

SEQ ID NO: 1533606 - RNA, 19 nt, Homo sapiens
agacagaagaguauccuuu

SEQ ID NO: 1533607 - RNA, 19 nt, Homo sapiens
aagaaggaauggcacaaga

SEQ ID NO: 1533608 - RNA, 19 nt, Homo sapiens
uguuauggaucgacuuaaa

SEQ ID NO: 1533609 - RNA, 19 nt, Homo sapiens
guauucguguugaagcuuu

SEQ ID NO: 1533610 - RNA, 19 nt, Homo sapiens
gcacugccaucucuggaua

SEQ ID NO: 1533611 - RNA, 19 nt, Homo sapiens
gcagauauuuacauaguug

SEQ ID NO: 1533612 - RNA, 19 nt, Homo sapiens
gaagacuccuugguuuaua

SEQ ID NO: 1533613 - RNA, 19 nt, Homo sapiens
ccaaauaaguugucuuuac

SEQ ID NO: 1533614 - RNA, 19 nt, Homo sapiens
gcucgucacuauaguaauu

SEQ ID NO: 1533615 - RNA, 19 nt, Homo sapiens
ccaggcagauauuuacaua

SEQ ID NO: 1533616 - RNA, 19 nt, Homo sapiens
gaagugaagacccauauau

SEQ ID NO: 1533617 - RNA, 19 nt, Homo sapiens
ccucuggacuacaaauuua

SEQ ID NO: 1533618 - RNA, 19 nt, Homo sapiens
gaaaggguacuauaaggaa

SEQ ID NO: 1533619 - RNA, 19 nt, Homo sapiens
ggaaaacuguggaauauau

SEQ ID NO: 1533620 - RNA, 19 nt, Homo sapiens
cagcaugcauucagauauu

SEQ ID NO: 1533621 - RNA, 19 nt, Homo sapiens
gcuaaagaaugcugggaaa

SEQ ID NO: 1533622 - RNA, 19 nt, Homo sapiens
acagaagacuccuugguuu

SEQ ID NO: 1533623 - RNA, 19 nt, Homo sapiens
gccaggagcucuucugugu

SEQ ID NO: 1533624 - RNA, 19 nt, Homo sapiens
uuacagcacuauugcaauu

SEQ ID NO: 1533625 - RNA, 19 nt, Homo sapiens
agacuucucugcgaauaua

SEQ ID NO: 1533626 - RNA, 19 nt, Homo sapiens
uaacaaaacugaacaaugg

SEQ ID NO: 1533627 - RNA, 19 nt, Homo sapiens
gagaaaggguacuauaagg

SEQ ID NO: 1533628 - RNA, 19 nt, Homo sapiens
uuacauaguuguccugaau

SEQ ID NO: 1533629 - RNA, 19 nt, Homo sapiens
agacacugauauccaaaua

SEQ ID NO: 1533630 - RNA, 19 nt, Homo sapiens
ugaagcaaucgcagaauua

SEQ ID NO: 1533631 - RNA, 19 nt, Homo sapiens
cagaagacuccuugguuua

SEQ ID NO: 1533632 - RNA, 19 nt, Homo sapiens
gccaggugguggacuauuu

SEQ ID NO: 1533633 - RNA, 19 nt, Homo sapiens
gcaaauaauggcacuguuc

SEQ ID NO: 1533634 - RNA, 19 nt, Homo sapiens
ggagaaaggguacuauaag

SEQ ID NO: 1533635 - RNA, 19 nt, Homo sapiens
guagacuucucugcgaaua

SEQ ID NO: 1533636 - RNA, 19 nt, Homo sapiens
ggacuacaaauuuacaaga

SEQ ID NO: 1533637 - RNA, 19 nt, Homo sapiens
ggaacgcuguccaccucua

SEQ ID NO: 1533638 - RNA, 19 nt, Homo sapiens
acacugauauccaaauaag

SEQ ID NO: 1533639 - RNA, 19 nt, Homo sapiens
gaacuuccuuaaacuugca

SEQ ID NO: 1533640 - RNA, 19 nt, Homo sapiens
gauuacaaaugcauugaag

SEQ ID NO: 1533641 - RNA, 19 nt, Homo sapiens
gaggaugggauuucuguug

SEQ ID NO: 1533642 - RNA, 19 nt, Homo sapiens
aaagagauccaggcagaua

SEQ ID NO: 1533643 - RNA, 19 nt, Homo sapiens
acccauauaugcaguuaaa

SEQ ID NO: 1533644 - RNA, 19 nt, Homo sapiens
ggauuucuguugcaaaggu

SEQ ID NO: 1533645 - RNA, 19 nt, Homo sapiens
gaaaaugacuggcaaaccu

SEQ ID NO: 1533646 - RNA, 19 nt, Homo sapiens
agaggcauauggcaagaaa

SEQ ID NO: 1533647 - RNA, 19 nt, Homo sapiens
gcagaggcauauggcaaga

SEQ ID NO: 1533648 - RNA, 19 nt, Homo sapiens
ccaggugguggacuauuua

SEQ ID NO: 1533649 - RNA, 19 nt, Homo sapiens
agaauuaccucuggacuac

SEQ ID NO: 1533650 - RNA, 19 nt, Homo sapiens
gacagcaugcauucagaua

SEQ ID NO: 1533651 - RNA, 19 nt, Homo sapiens
aggcagauauuuacauagu

SEQ ID NO: 1533652 - RNA, 19 nt, Homo sapiens
gugguggacuauuuaacaa

SEQ ID NO: 1533653 - RNA, 19 nt, Homo sapiens
uugaagcaaucgcagaauu

SEQ ID NO: 1533654 - RNA, 19 nt, Homo sapiens
agacccauauaugcaguua

SEQ ID NO: 1533655 - RNA, 19 nt, Homo sapiens
cuauugcaauuccaaguau

SEQ ID NO: 1533656 - RNA, 19 nt, Homo sapiens
uguaagagaaucaguacuu

SEQ ID NO: 1533657 - RNA, 19 nt, Homo sapiens
gaaggcacgaggagucaga

SEQ ID NO: 1533658 - RNA, 19 nt, Homo sapiens
gaacgcuguccaccucuau

SEQ ID NO: 1533659 - RNA, 19 nt, Homo sapiens
gaugggauuucuguugcaa

SEQ ID NO: 1533660 - RNA, 19 nt, Homo sapiens
ggacacucgagaaugauga

SEQ ID NO: 1533661 - RNA, 19 nt, Homo sapiens
ggcagauauuuacauaguu

SEQ ID NO: 1533662 - RNA, 19 nt, Homo sapiens
cagcucgucacuauaguaa

SEQ ID NO: 1533663 - RNA, 19 nt, Homo sapiens
aaagaaugcugggaaaauu

SEQ ID NO: 1533664 - RNA, 19 nt, Homo sapiens
uaaggaaaacuguggaaua

SEQ ID NO: 1533665 - RNA, 19 nt, Homo sapiens
aaacugaacaauggucaaa

SEQ ID NO: 1533666 - RNA, 19 nt, Homo sapiens
ggugguggacuauuuaaca

SEQ ID NO: 1533667 - RNA, 19 nt, Homo sapiens
gcauauggcaagaaagagu

SEQ ID NO: 1533668 - RNA, 19 nt, Homo sapiens
gaaggagaaaggguacuau

SEQ ID NO: 1533669 - RNA, 19 nt, Homo sapiens
uccggacacucgagaauga

SEQ ID NO: 1533670 - RNA, 19 nt, Homo sapiens
ugggaaaauucuucuguua

SEQ ID NO: 1533671 - RNA, 19 nt, Homo sapiens
gauccaggcagauauuuac

SEQ ID NO: 1533672 - RNA, 19 nt, Homo sapiens
ugaagugaagacccauaua

SEQ ID NO: 1533673 - RNA, 19 nt, Homo sapiens
aggagaaaggguacuauaa

SEQ ID NO: 1533674 - RNA, 19 nt, Homo sapiens
caaauaauggcacuguucu

SEQ ID NO: 1533675 - RNA, 19 nt, Homo sapiens
gacacugauauccaaauaa

SEQ ID NO: 1533676 - RNA, 19 nt, Homo sapiens
gaugagacacugauaucca

SEQ ID NO: 1533677 - RNA, 19 nt, Homo sapiens
gaagcaaucgcagaauuac

SEQ ID NO: 1533678 - RNA, 19 nt, Homo sapiens
uuucccagcucgucacuau

SEQ ID NO: 1533679 - RNA, 19 nt, Homo sapiens
gugacagcaugcauucaga

SEQ ID NO: 1533680 - RNA, 19 nt, Homo sapiens
uacagaagacuccuugguu

SEQ ID NO: 1533681 - RNA, 19 nt, Homo sapiens
gaaaauaugagggaccaaa

SEQ ID NO: 1533682 - RNA, 19 nt, Homo sapiens
ccaccucuaugaacuucug

SEQ ID NO: 1533683 - RNA, 19 nt, Homo sapiens
uuaauuaccaguucucaca

SEQ ID NO: 1533684 - RNA, 19 nt, Homo sapiens
aaggagaaaggguacuaua

SEQ ID NO: 1533685 - RNA, 19 nt, Homo sapiens
gagauccaggcagauauuu

SEQ ID NO: 1533686 - RNA, 19 nt, Homo sapiens
aaaggguacuauaaggaau

SEQ ID NO: 1533687 - RNA, 19 nt, Homo sapiens
gcaagaaagaguggaagca

SEQ ID NO: 1533688 - RNA, 19 nt, Homo sapiens
gguggacuauuuaacaaaa

SEQ ID NO: 1533689 - RNA, 19 nt, Homo sapiens
gugaagacccauauaugca

SEQ ID NO: 1533690 - RNA, 19 nt, Homo sapiens
aauuaccucuggacuacaa

SEQ ID NO: 1533691 - RNA, 19 nt, Homo sapiens
gagaagaaaggaaaauaug

SEQ ID NO: 1533692 - RNA, 19 nt, Homo sapiens
uggauaaaccuggcuggua

SEQ ID NO: 1533693 - RNA, 19 nt, Homo sapiens
agugauuacuguagacuuc

SEQ ID NO: 1533694 - RNA, 19 nt, Homo sapiens
agaaaggguacuauaagga

SEQ ID NO: 1533695 - RNA, 19 nt, Homo sapiens
acagcuggcuacuauccaa

SEQ ID NO: 1533696 - RNA, 19 nt, Homo sapiens
guacuuacagcacuauugc

SEQ ID NO: 1533697 - RNA, 19 nt, Homo sapiens
agaagacuccuugguuuau

SEQ ID NO: 1533698 - RNA, 19 nt, Homo sapiens
gggaaaauucuucuguuaa

SEQ ID NO: 1533699 - RNA, 19 nt, Homo sapiens
ggaugggauuucuguugca

SEQ ID NO: 1533700 - RNA, 19 nt, Homo sapiens
aaggaaaacuguggaauau

SEQ ID NO: 1533701 - RNA, 19 nt, Homo sapiens
gcugcuauacaacacaauu

SEQ ID NO: 1533702 - RNA, 19 nt, Homo sapiens
gugaugagacacugauauc

SEQ ID NO: 1533703 - RNA, 19 nt, Homo sapiens
gauuucuguugcaaagguu

SEQ ID NO: 1533704 - RNA, 19 nt, Homo sapiens
cugcuauacaacacaauua

SEQ ID NO: 1533705 - RNA, 19 nt, Homo sapiens
aagagaaucaguacuuaca

SEQ ID NO: 1533706 - RNA, 19 nt, Homo sapiens
ccagcucgucacuauagua

SEQ ID NO: 1533707 - RNA, 19 nt, Homo sapiens
aggcauauggcaagaaaga

SEQ ID NO: 1533708 - RNA, 19 nt, Homo sapiens
gagacacugauauccaaau

SEQ ID NO: 1533709 - RNA, 19 nt, Homo sapiens
augagacacugauauccaa

SEQ ID NO: 1533710 - RNA, 19 nt, Homo sapiens
gcaggaagcucuugaguua

SEQ ID NO: 1533711 - RNA, 19 nt, Homo sapiens
gaagacagaucaagaggua

SEQ ID NO: 1533712 - RNA, 19 nt, Homo sapiens
gaagucacauggaaauuug

SEQ ID NO: 1533713 - RNA, 19 nt, Homo sapiens
guaaguccaucucaaauau

SEQ ID NO: 1533714 - RNA, 19 nt, Homo sapiens
uaacugagccuuucacuug

SEQ ID NO: 1533715 - RNA, 19 nt, Homo sapiens
uaaaccugcuccuuucuua

SEQ ID NO: 1533716 - RNA, 19 nt, Homo sapiens
cauggaaauuugcaucuua

SEQ ID NO: 1533717 - RNA, 19 nt, Homo sapiens
ugucaggacuggaaagaua

SEQ ID NO: 1533718 - RNA, 19 nt, Homo sapiens
gaaauuugcaucuuaguuc

SEQ ID NO: 1533719 - RNA, 19 nt, Homo sapiens
uuacucagcuuucuuuaug

SEQ ID NO: 1533720 - RNA, 19 nt, Homo sapiens
gcuaaugaauguuacuuuc

SEQ ID NO: 1533721 - RNA, 19 nt, Homo sapiens
gguaaugccuagaguggaa

SEQ ID NO: 1533722 - RNA, 19 nt, Homo sapiens
ggagacaaauacaaaccaa

SEQ ID NO: 1533723 - RNA, 19 nt, Homo sapiens
gcacagugucuuucauaaa

SEQ ID NO: 1533724 - RNA, 19 nt, Homo sapiens
cuaaauaucugaccuuuug

SEQ ID NO: 1533725 - RNA, 19 nt, Homo sapiens
uauauaaaccugcuccuuu

SEQ ID NO: 1533726 - RNA, 19 nt, Homo sapiens
ccagccaccuccagaauga

SEQ ID NO: 1533727 - RNA, 19 nt, Homo sapiens
ucaccucucugcaacauug

SEQ ID NO: 1533728 - RNA, 19 nt, Homo sapiens
cccuggagcuugacauaua

SEQ ID NO: 1533729 - RNA, 19 nt, Homo sapiens
ggaugaggauaaugaggaa

SEQ ID NO: 1533730 - RNA, 19 nt, Homo sapiens
gaauguuacuuucucucuu

SEQ ID NO: 1533731 - RNA, 19 nt, Homo sapiens
guaauaaacaacagugaga

SEQ ID NO: 1533732 - RNA, 19 nt, Homo sapiens
aaaccaauguguaaaugug

SEQ ID NO: 1533733 - RNA, 19 nt, Homo sapiens
gugaauaacugagccuuuc

SEQ ID NO: 1533734 - RNA, 19 nt, Homo sapiens
ugucuucuauucaccauuu

SEQ ID NO: 1533735 - RNA, 19 nt, Homo sapiens
ggaaauuugcaucuuaguu

SEQ ID NO: 1533736 - RNA, 19 nt, Homo sapiens
caggauaaacccaaaugua

SEQ ID NO: 1533737 - RNA, 19 nt, Homo sapiens
ggaagcaagaauuggauaa

SEQ ID NO: 1533738 - RNA, 19 nt, Homo sapiens
uuccaaagcugaauuguag

SEQ ID NO: 1533739 - RNA, 19 nt, Homo sapiens
cuagagcuauuaugagaau

SEQ ID NO: 1533740 - RNA, 19 nt, Homo sapiens
caucuuaguucuguuacuu

SEQ ID NO: 1533741 - RNA, 19 nt, Homo sapiens
gcagauacuuggcuuuuau

SEQ ID NO: 1533742 - RNA, 19 nt, Homo sapiens
gcauaaagaagcuauuugg

SEQ ID NO: 1533743 - RNA, 19 nt, Homo sapiens
aaacacauccgcauuccuu

SEQ ID NO: 1533744 - RNA, 19 nt, Homo sapiens
ugaagucacauggaaauuu

SEQ ID NO: 1533745 - RNA, 19 nt, Homo sapiens
cguaaguccaucucaaaua

SEQ ID NO: 1533746 - RNA, 19 nt, Homo sapiens
gauuacagcaccuuucaug

SEQ ID NO: 1533747 - RNA, 19 nt, Homo sapiens
gugaagacgucaaacacau

SEQ ID NO: 1533748 - RNA, 19 nt, Homo sapiens
gcauuuauacucuguccuu

SEQ ID NO: 1533749 - RNA, 19 nt, Homo sapiens
ccacagcuaguuaaaugaa

SEQ ID NO: 1533750 - RNA, 19 nt, Homo sapiens
uagcacagugucuuucaua

SEQ ID NO: 1533751 - RNA, 19 nt, Homo sapiens
aagcaagaauuggauaaga

SEQ ID NO: 1533752 - RNA, 19 nt, Homo sapiens
ggagugaagacgucaaaca

SEQ ID NO: 1533753 - RNA, 19 nt, Homo sapiens
acaaaccaauguguaaaug

SEQ ID NO: 1533754 - RNA, 19 nt, Homo sapiens
caaauacaaaccaaugugu

SEQ ID NO: 1533755 - RNA, 19 nt, Homo sapiens
ugaccuaaguugccaccuu

SEQ ID NO: 1533756 - RNA, 19 nt, Homo sapiens
auauaaaccugcuccuuuc

SEQ ID NO: 1533757 - RNA, 19 nt, Homo sapiens
gagcuugacauauauaaac

SEQ ID NO: 1533758 - RNA, 19 nt, Homo sapiens
agacaaauacaaaccaaug

SEQ ID NO: 1533759 - RNA, 19 nt, Homo sapiens
uuacguaaguccaucucaa

SEQ ID NO: 1533760 - RNA, 19 nt, Homo sapiens
ccaaauguagcagcaaauu

SEQ ID NO: 1533761 - RNA, 19 nt, Homo sapiens
uuccacagcuaguuaaaug

SEQ ID NO: 1533762 - RNA, 19 nt, Homo sapiens
ccacauuuguccugacucu

SEQ ID NO: 1533763 - RNA, 19 nt, Homo sapiens
gauaaacccaaauguagca

SEQ ID NO: 1533764 - RNA, 19 nt, Homo sapiens
ccaaagcugaauuguagaa

SEQ ID NO: 1533765 - RNA, 19 nt, Homo sapiens
cuaauccaguaacauguga

SEQ ID NO: 1533766 - RNA, 19 nt, Homo sapiens
cacagugucuuucauaaaa

SEQ ID NO: 1533767 - RNA, 19 nt, Homo sapiens
ucaauguaaucucuucauc

SEQ ID NO: 1533768 - RNA, 19 nt, Homo sapiens
agacagaucaagagguauu

SEQ ID NO: 1533769 - RNA, 19 nt, Homo sapiens
gcaggacagaaaccucuuu

SEQ ID NO: 1533770 - RNA, 19 nt, Homo sapiens
uccuagagcuauuaugaga

SEQ ID NO: 1533771 - RNA, 19 nt, Homo sapiens
gccaaucucucauuuugaa

SEQ ID NO: 1533772 - RNA, 19 nt, Homo sapiens
augcaugggugaugacuug

SEQ ID NO: 1533773 - RNA, 19 nt, Homo sapiens
uuguagaaccgcauuuaua

SEQ ID NO: 1533774 - RNA, 19 nt, Homo sapiens
ccuuuaugcuuaauggauu

SEQ ID NO: 1533775 - RNA, 19 nt, Homo sapiens
ccuccuagagcuauuauga

SEQ ID NO: 1533776 - RNA, 19 nt, Homo sapiens
ccugcuccuuucuuaauuu

SEQ ID NO: 1533777 - RNA, 19 nt, Homo sapiens
ggagcuugacauauauaaa

SEQ ID NO: 1533778 - RNA, 19 nt, Homo sapiens
ggaccagccaccuccagaa

SEQ ID NO: 1533779 - RNA, 19 nt, Homo sapiens
ucaugagucagguugcuua

SEQ ID NO: 1533780 - RNA, 19 nt, Homo sapiens
ugaggaagacagaucaaga

SEQ ID NO: 1533781 - RNA, 19 nt, Homo sapiens
ggauaaugaggaagacaga

SEQ ID NO: 1533782 - RNA, 19 nt, Homo sapiens
ggagaagcccaugcaggaa

SEQ ID NO: 1533783 - RNA, 19 nt, Homo sapiens
guagcugugugaaaauuaa

SEQ ID NO: 1533784 - RNA, 19 nt, Homo sapiens
cagcaccuuucaugaguca

SEQ ID NO: 1533785 - RNA, 19 nt, Homo sapiens
gaggaagacagaucaagag

SEQ ID NO: 1533786 - RNA, 19 nt, Homo sapiens
gcuccuuucuuaauuucau

SEQ ID NO: 1533787 - RNA, 19 nt, Homo sapiens
ccuggagcuugacauauau

SEQ ID NO: 1533788 - RNA, 19 nt, Homo sapiens
uacagcaccuuucaugagu

SEQ ID NO: 1533789 - RNA, 19 nt, Homo sapiens
gaagcaagaauuggauaag

SEQ ID NO: 1533790 - RNA, 19 nt, Homo sapiens
acucagcuuucuuuauguu

SEQ ID NO: 1533791 - RNA, 19 nt, Homo sapiens
gacaaauacaaaccaaugu

SEQ ID NO: 1533792 - RNA, 19 nt, Homo sapiens
gcaagaauuggauaagacu

SEQ ID NO: 1533793 - RNA, 19 nt, Homo sapiens
cuaccugguuuguugugaa

SEQ ID NO: 1533794 - RNA, 19 nt, Homo sapiens
ggugaauaacugagccuuu

SEQ ID NO: 1533795 - RNA, 19 nt, Homo sapiens
gugccaaucucucauuuug

SEQ ID NO: 1533796 - RNA, 19 nt, Homo sapiens
aaccauugcugccuuaguc

SEQ ID NO: 1533797 - RNA, 19 nt, Homo sapiens
ccuccacgaucccaucaug

SEQ ID NO: 1533798 - RNA, 19 nt, Homo sapiens
gaguuacuguacuauagca

SEQ ID NO: 1533799 - RNA, 19 nt, Homo sapiens
uugaguuacuguacuauag

SEQ ID NO: 1533800 - RNA, 19 nt, Homo sapiens
ggguggaugaggauaauga

SEQ ID NO: 1533801 - RNA, 19 nt, Homo sapiens
ucucagucuuccauucauu

SEQ ID NO: 1533802 - RNA, 19 nt, Homo sapiens
gaauuguagaaccgcauuu

SEQ ID NO: 1533803 - RNA, 19 nt, Homo sapiens
caaaccaauguguaaaugu

SEQ ID NO: 1533804 - RNA, 19 nt, Homo sapiens
cacagcuaguuaaaugaaa

SEQ ID NO: 1533805 - RNA, 19 nt, Homo sapiens
gcucuugaguuacuguacu

SEQ ID NO: 1533806 - RNA, 19 nt, Homo sapiens
cauuccaugucuucuauuc

SEQ ID NO: 1533807 - RNA, 19 nt, Homo sapiens
ugcauuccaugucuucuau

SEQ ID NO: 1533808 - RNA, 19 nt, Homo sapiens
aggauaaacccaaauguag

SEQ ID NO: 1533809 - RNA, 19 nt, Homo sapiens
gaccagccaccuccagaau

SEQ ID NO: 1533810 - RNA, 19 nt, Homo sapiens
gaacuuaacugaaucuaga

SEQ ID NO: 1533811 - RNA, 19 nt, Homo sapiens
caugaaagcucaccuaauu

SEQ ID NO: 1533812 - RNA, 19 nt, Homo sapiens
gaggagaucugaagaauca

SEQ ID NO: 1533813 - RNA, 19 nt, Homo sapiens
caacaacaacuacgaaaua

SEQ ID NO: 1533814 - RNA, 19 nt, Homo sapiens
gaagaaugccuccaucuga

SEQ ID NO: 1533815 - RNA, 19 nt, Homo sapiens
gcagagacaauaugguuua

SEQ ID NO: 1533816 - RNA, 19 nt, Homo sapiens
gagaaaagcugauaugaug

SEQ ID NO: 1533817 - RNA, 19 nt, Homo sapiens
gggcucauauguacaaauu

SEQ ID NO: 1533818 - RNA, 19 nt, Homo sapiens
gaggauaaauacaguacaa

SEQ ID NO: 1533819 - RNA, 19 nt, Homo sapiens
gaacuguuauuggaauuga

SEQ ID NO: 1533820 - RNA, 19 nt, Homo sapiens
gguaaagugucauauuguu

SEQ ID NO: 1533821 - RNA, 19 nt, Homo sapiens
uauggaaacucaugugaaa

SEQ ID NO: 1533822 - RNA, 19 nt, Homo sapiens
gaacuucagauaacaagaa

SEQ ID NO: 1533823 - RNA, 19 nt, Homo sapiens
gagacaauaugguuuagau

SEQ ID NO: 1533824 - RNA, 19 nt, Homo sapiens
gauuggagcaugugaagua

SEQ ID NO: 1533825 - RNA, 19 nt, Homo sapiens
gugaagauauggaaacuca

SEQ ID NO: 1533826 - RNA, 19 nt, Homo sapiens
gagaagauuccuugaagaa

SEQ ID NO: 1533827 - RNA, 19 nt, Homo sapiens
gaaaauuccugaaaaguag

SEQ ID NO: 1533828 - RNA, 19 nt, Homo sapiens
aaaccgaacauuaugcuua

SEQ ID NO: 1533829 - RNA, 19 nt, Homo sapiens
ucaggaacauguugacuug

SEQ ID NO: 1533830 - RNA, 19 nt, Homo sapiens
aaacaaagcaugccaaucu

SEQ ID NO: 1533831 - RNA, 19 nt, Homo sapiens
caauauggaacuucagaua

SEQ ID NO: 1533832 - RNA, 19 nt, Homo sapiens
gcauuucagugauugagaa

SEQ ID NO: 1533833 - RNA, 19 nt, Homo sapiens
cuaauucuuuccucgguua

SEQ ID NO: 1533834 - RNA, 19 nt, Homo sapiens
gaacaaaggccuggauugg

SEQ ID NO: 1533835 - RNA, 19 nt, Homo sapiens
gcucauauguacaaauuac

SEQ ID NO: 1533836 - RNA, 19 nt, Homo sapiens
ugucaggugugaauuauga

SEQ ID NO: 1533837 - RNA, 19 nt, Homo sapiens
gaagauauggaaacucaug

SEQ ID NO: 1533838 - RNA, 19 nt, Homo sapiens
cgaacauuaugcuuacuaa

SEQ ID NO: 1533839 - RNA, 19 nt, Homo sapiens
caucuaaaccuccuaucua

SEQ ID NO: 1533840 - RNA, 19 nt, Homo sapiens
cauaagcaauaccagauau

SEQ ID NO: 1533841 - RNA, 19 nt, Homo sapiens
caacaacuacgaaauaugg

SEQ ID NO: 1533842 - RNA, 19 nt, Homo sapiens
acaauuggcucaccagcuu

SEQ ID NO: 1533843 - RNA, 19 nt, Homo sapiens
ggaagacugugaucaacca

SEQ ID NO: 1533844 - RNA, 19 nt, Homo sapiens
gaagaaucaagacaagaaa

SEQ ID NO: 1533845 - RNA, 19 nt, Homo sapiens
gaaagaggagaucugaaga

SEQ ID NO: 1533846 - RNA, 19 nt, Homo sapiens
gcaagaagaagacagaaag

SEQ ID NO: 1533847 - RNA, 19 nt, Homo sapiens
gcagaauacacuugaaaga

SEQ ID NO: 1533848 - RNA, 19 nt, Homo sapiens
gagcagaauacacuugaaa

SEQ ID NO: 1533849 - RNA, 19 nt, Homo sapiens
agaagggaguccaaaggua

SEQ ID NO: 1533850 - RNA, 19 nt, Homo sapiens
cuucauagguauuaucaga

SEQ ID NO: 1533851 - RNA, 19 nt, Homo sapiens
ucgcuuauuugaauggaua

SEQ ID NO: 1533852 - RNA, 19 nt, Homo sapiens
uacacacccucgcuuauuu

SEQ ID NO: 1533853 - RNA, 19 nt, Homo sapiens
gcacagugaagauauggaa

SEQ ID NO: 1533854 - RNA, 19 nt, Homo sapiens
ggagcacagugaagauaug

SEQ ID NO: 1533855 - RNA, 19 nt, Homo sapiens
gaauacacuugaaagaaac

SEQ ID NO: 1533856 - RNA, 19 nt, Homo sapiens
guagauauugaacuccuua

SEQ ID NO: 1533857 - RNA, 19 nt, Homo sapiens
cgagaagauuccuugaaga

SEQ ID NO: 1533858 - RNA, 19 nt, Homo sapiens
acaagcuucucaagucuuu

SEQ ID NO: 1533859 - RNA, 19 nt, Homo sapiens
guacacacccucgcuuauu

SEQ ID NO: 1533860 - RNA, 19 nt, Homo sapiens
ggagauagaaguaaauagg

SEQ ID NO: 1533861 - RNA, 19 nt, Homo sapiens
auaccaugcuuuccuguaa

SEQ ID NO: 1533862 - RNA, 19 nt, Homo sapiens
gguaguguguacaucuaaa

SEQ ID NO: 1533863 - RNA, 19 nt, Homo sapiens
gagcaugugaaguauauau

SEQ ID NO: 1533864 - RNA, 19 nt, Homo sapiens
aagaaugccuccaucugaa

SEQ ID NO: 1533865 - RNA, 19 nt, Homo sapiens
ucaagcaacuucggaaauc

SEQ ID NO: 1533866 - RNA, 19 nt, Homo sapiens
cgagaaaugcagaaauuau

SEQ ID NO: 1533867 - RNA, 19 nt, Homo sapiens
ggaacaaaggccuggauug

SEQ ID NO: 1533868 - RNA, 19 nt, Homo sapiens
uacgaaauauggagauaga

SEQ ID NO: 1533869 - RNA, 19 nt, Homo sapiens
ugaagaaucaagacaagaa

SEQ ID NO: 1533870 - RNA, 19 nt, Homo sapiens
ugacuugcauuuggaagaa

SEQ ID NO: 1533871 - RNA, 19 nt, Homo sapiens
cauuuaagcauuucaguga

SEQ ID NO: 1533872 - RNA, 19 nt, Homo sapiens
ccgagaagauuccuugaag

SEQ ID NO: 1533873 - RNA, 19 nt, Homo sapiens
ucagaaugcugccacagau

SEQ ID NO: 1533874 - RNA, 19 nt, Homo sapiens
gaaauauggagauagaagu

SEQ ID NO: 1533875 - RNA, 19 nt, Homo sapiens
gaacauguugacuugcauu

SEQ ID NO: 1533876 - RNA, 19 nt, Homo sapiens
gauauggaaacucauguga

SEQ ID NO: 1533877 - RNA, 19 nt, Homo sapiens
gaggagcacagugaagaua

SEQ ID NO: 1533878 - RNA, 19 nt, Homo sapiens
cagaauacacuugaaagaa

SEQ ID NO: 1533879 - RNA, 19 nt, Homo sapiens
aggguaaagugucauauug

SEQ ID NO: 1533880 - RNA, 19 nt, Homo sapiens
uggagcaugugaaguauau

SEQ ID NO: 1533881 - RNA, 19 nt, Homo sapiens
gacgauugcuuaaaaggua

SEQ ID NO: 1533882 - RNA, 19 nt, Homo sapiens
guaaggaagugcuuuugaa

SEQ ID NO: 1533883 - RNA, 19 nt, Homo sapiens
ucaccuaauuguucacaug

SEQ ID NO: 1533884 - RNA, 19 nt, Homo sapiens
gaaucaagcauuuaagcau

SEQ ID NO: 1533885 - RNA, 19 nt, Homo sapiens
cucgagaaaugcagaaauu

SEQ ID NO: 1533886 - RNA, 19 nt, Homo sapiens
cacccucgcuuauuugaau

SEQ ID NO: 1533887 - RNA, 19 nt, Homo sapiens
ggaagaaugccuccaucug

SEQ ID NO: 1533888 - RNA, 19 nt, Homo sapiens
auacaguccuccugaaugu

SEQ ID NO: 1533889 - RNA, 19 nt, Homo sapiens
gacaugaaagcucaccuaa

SEQ ID NO: 1533890 - RNA, 19 nt, Homo sapiens
cauacuucauuguuuggua

SEQ ID NO: 1533891 - RNA, 19 nt, Homo sapiens
gugaaacaguaaccucaga

SEQ ID NO: 1533892 - RNA, 19 nt, Homo sapiens
cuaucuaucuucagcauca

SEQ ID NO: 1533893 - RNA, 19 nt, Homo sapiens
guaaagugucauauuguug

SEQ ID NO: 1533894 - RNA, 19 nt, Homo sapiens
gguugugguuacagaaauu

SEQ ID NO: 1533895 - RNA, 19 nt, Homo sapiens
gaagacagaaagaggagau

SEQ ID NO: 1533896 - RNA, 19 nt, Homo sapiens
aaauagaggagcacaguga

SEQ ID NO: 1533897 - RNA, 19 nt, Homo sapiens
gaaagcucaccuaauuguu

SEQ ID NO: 1533898 - RNA, 19 nt, Homo sapiens
ggguguggcuuucuucagu

SEQ ID NO: 1533899 - RNA, 19 nt, Homo sapiens
ugaaagcucaccuaauugu

SEQ ID NO: 1533900 - RNA, 19 nt, Homo sapiens
aagcugauaugauggaauc

SEQ ID NO: 1533901 - RNA, 19 nt, Homo sapiens
gaaugccuccaucugaauu

SEQ ID NO: 1533902 - RNA, 19 nt, Homo sapiens
caucaggccaggagaggua

SEQ ID NO: 1533903 - RNA, 19 nt, Homo sapiens
cauguugacuugcauuugg

SEQ ID NO: 1533904 - RNA, 19 nt, Homo sapiens
guggaucacuuucauucau

SEQ ID NO: 1533905 - RNA, 19 nt, Homo sapiens
gugaucaaccacucuauga

SEQ ID NO: 1533906 - RNA, 19 nt, Homo sapiens
ccuaauuguucacauggaa

SEQ ID NO: 1533907 - RNA, 19 nt, Homo sapiens
aaacaacaacaacuacgaa

SEQ ID NO: 1533908 - RNA, 19 nt, Homo sapiens
aagaggagaucugaagaau

SEQ ID NO: 1533909 - RNA, 19 nt, Homo sapiens
caagaagaagacagaaaga

SEQ ID NO: 1533910 - RNA, 19 nt, Homo sapiens
gcacauagaucaugagaca

SEQ ID NO: 1533911 - RNA, 19 nt, Homo sapiens
gaacagugcugcugagaga

SEQ ID NO: 1533912 - RNA, 19 nt, Homo sapiens
ggauagaaaucugccauua

SEQ ID NO: 1533913 - RNA, 19 nt, Homo sapiens
ucacauaucuuuggucuaa

SEQ ID NO: 1533914 - RNA, 19 nt, Homo sapiens
gacacacgguuuaaauuua

SEQ ID NO: 1533915 - RNA, 19 nt, Homo sapiens
ggagaggccuuaauagaau

SEQ ID NO: 1533916 - RNA, 19 nt, Homo sapiens
gguaugagcucaauuugug

SEQ ID NO: 1533917 - RNA, 19 nt, Homo sapiens
cuaguuaccuuccuaauga

SEQ ID NO: 1533918 - RNA, 19 nt, Homo sapiens
gaaaucauguucuuguuag

SEQ ID NO: 1533919 - RNA, 19 nt, Homo sapiens
ggucuaagguuauuaagug

SEQ ID NO: 1533920 - RNA, 19 nt, Homo sapiens
ccacagggacuuuauaauu

SEQ ID NO: 1533921 - RNA, 19 nt, Homo sapiens
ggacacucuucuccuguua

SEQ ID NO: 1533922 - RNA, 19 nt, Homo sapiens
gaaaucugccauuauauug

SEQ ID NO: 1533923 - RNA, 19 nt, Homo sapiens
caaacugaauggauagaaa

SEQ ID NO: 1533924 - RNA, 19 nt, Homo sapiens
ugaguugccucuuguguuu

SEQ ID NO: 1533925 - RNA, 19 nt, Homo sapiens
gaaucaagaucuuccuaau

SEQ ID NO: 1533926 - RNA, 19 nt, Homo sapiens
gccauuauauugcuacuug

SEQ ID NO: 1533927 - RNA, 19 nt, Homo sapiens
ggcuacauauuucuaguua

SEQ ID NO: 1533928 - RNA, 19 nt, Homo sapiens
uacaagaaaugcugguaua

SEQ ID NO: 1533929 - RNA, 19 nt, Homo sapiens
cacagggacuuuauaauug

SEQ ID NO: 1533930 - RNA, 19 nt, Homo sapiens
ggccaugacugguuuguau

SEQ ID NO: 1533931 - RNA, 19 nt, Homo sapiens
cuguauagcuguauucaaa

SEQ ID NO: 1533932 - RNA, 19 nt, Homo sapiens
gcagcaaacuuccauaaaa

SEQ ID NO: 1533933 - RNA, 19 nt, Homo sapiens
gaaagccaaaccugauaua

SEQ ID NO: 1533934 - RNA, 19 nt, Homo sapiens
uaucuuuggucuaagguua

SEQ ID NO: 1533935 - RNA, 19 nt, Homo sapiens
uauccuauccugcuauuua

SEQ ID NO: 1533936 - RNA, 19 nt, Homo sapiens
ggaauuacuuagauuggau

SEQ ID NO: 1533937 - RNA, 19 nt, Homo sapiens
aaucagaucuagcuuacuu

SEQ ID NO: 1533938 - RNA, 19 nt, Homo sapiens
uuuaugagcuuguaaggaa

SEQ ID NO: 1533939 - RNA, 19 nt, Homo sapiens
guagguaugagcucaauuu

SEQ ID NO: 1533940 - RNA, 19 nt, Homo sapiens
guuacuaaaugcucaagaa

SEQ ID NO: 1533941 - RNA, 19 nt, Homo sapiens
gaucuuaccuggguuuuaa

SEQ ID NO: 1533942 - RNA, 19 nt, Homo sapiens
gcaaaugugaagaaugaaa

SEQ ID NO: 1533943 - RNA, 19 nt, Homo sapiens
acuaaaugcucaagaagaa

SEQ ID NO: 1533944 - RNA, 19 nt, Homo sapiens
agucaggguuuauuaauga

SEQ ID NO: 1533945 - RNA, 19 nt, Homo sapiens
ggaauuaugcuggccauga

SEQ ID NO: 1533946 - RNA, 19 nt, Homo sapiens
caaauuccucagucucuua

SEQ ID NO: 1533947 - RNA, 19 nt, Homo sapiens
caagaaaugcugguauaaa

SEQ ID NO: 1533948 - RNA, 19 nt, Homo sapiens
gaaaccucgucucugcuaa

SEQ ID NO: 1533949 - RNA, 19 nt, Homo sapiens
augcaaaugugaagaauga

SEQ ID NO: 1533950 - RNA, 19 nt, Homo sapiens
gaacaaucacauaucuuug

SEQ ID NO: 1533951 - RNA, 19 nt, Homo sapiens
gaacaaaacuaccgaacag

SEQ ID NO: 1533952 - RNA, 19 nt, Homo sapiens
gauagaaaucugccauuau

SEQ ID NO: 1533953 - RNA, 19 nt, Homo sapiens
gagaggccuuaauagaauu

SEQ ID NO: 1533954 - RNA, 19 nt, Homo sapiens
gagacacacgguuuaaauu

SEQ ID NO: 1533955 - RNA, 19 nt, Homo sapiens
uaaugacacuguagaaucu

SEQ ID NO: 1533956 - RNA, 19 nt, Homo sapiens
gcaaauuccucagucucuu

SEQ ID NO: 1533957 - RNA, 19 nt, Homo sapiens
caucauauccauugccaaa

SEQ ID NO: 1533958 - RNA, 19 nt, Homo sapiens
gcuuaucaguggagagaaa

SEQ ID NO: 1533959 - RNA, 19 nt, Homo sapiens
agacacacgguuuaaauuu

SEQ ID NO: 1533960 - RNA, 19 nt, Homo sapiens
ugaaacagcagcaaacuuc

SEQ ID NO: 1533961 - RNA, 19 nt, Homo sapiens
acagggacuuuauaauuga

SEQ ID NO: 1533962 - RNA, 19 nt, Homo sapiens
gcagguggcauugcacuaa

SEQ ID NO: 1533963 - RNA, 19 nt, Homo sapiens
agagacaugcggaacauua

SEQ ID NO: 1533964 - RNA, 19 nt, Homo sapiens
uggcauccauccaguauau

SEQ ID NO: 1533965 - RNA, 19 nt, Homo sapiens
guuuguaucuucucuguuc

SEQ ID NO: 1533966 - RNA, 19 nt, Homo sapiens
aaauuuggcuauggaguuu

SEQ ID NO: 1533967 - RNA, 19 nt, Homo sapiens
gcugugaucuggacacucu

SEQ ID NO: 1533968 - RNA, 19 nt, Homo sapiens
cagcacccauuauauugaa

SEQ ID NO: 1533969 - RNA, 19 nt, Homo sapiens
gcauccauccaguauauuu

SEQ ID NO: 1533970 - RNA, 19 nt, Homo sapiens
gcagcagcuuggcauuaaa

SEQ ID NO: 1533971 - RNA, 19 nt, Homo sapiens
cuaagguuauuaaguguga

SEQ ID NO: 1533972 - RNA, 19 nt, Homo sapiens
cugcauggguuucgaguga

SEQ ID NO: 1533973 - RNA, 19 nt, Homo sapiens
agccaaaccugauauaauc

SEQ ID NO: 1533974 - RNA, 19 nt, Homo sapiens
ccaagauugugccacugua

SEQ ID NO: 1533975 - RNA, 19 nt, Homo sapiens
ucaaacauuuacagcaaga

SEQ ID NO: 1533976 - RNA, 19 nt, Homo sapiens
uaucuucucuguucaugau

SEQ ID NO: 1533977 - RNA, 19 nt, Homo sapiens
ugucagguauggcaaauuc

SEQ ID NO: 1533978 - RNA, 19 nt, Homo sapiens
guauacagcuacugaugca

SEQ ID NO: 1533979 - RNA, 19 nt, Homo sapiens
gaugaaagccaaaccugau

SEQ ID NO: 1533980 - RNA, 19 nt, Homo sapiens
cagagcacauagaucauga

SEQ ID NO: 1533981 - RNA, 19 nt, Homo sapiens
guauagcuguauucaaaca

SEQ ID NO: 1533982 - RNA, 19 nt, Homo sapiens
gaccgaagcugucaaaagu

SEQ ID NO: 1533983 - RNA, 19 nt, Homo sapiens
acacacgguuuaaauuuag

SEQ ID NO: 1533984 - RNA, 19 nt, Homo sapiens
gcagcacccauuauauuga

SEQ ID NO: 1533985 - RNA, 19 nt, Homo sapiens
gauaauguugggagacaaa

SEQ ID NO: 1533986 - RNA, 19 nt, Homo sapiens
ccucgucucugcuaacaau

SEQ ID NO: 1533987 - RNA, 19 nt, Homo sapiens
acugagaaguauaacgaua

SEQ ID NO: 1533988 - RNA, 19 nt, Homo sapiens
gaauuaugcuggccaugac

SEQ ID NO: 1533989 - RNA, 19 nt, Homo sapiens
uggaagagaugauguuagg

SEQ ID NO: 1533990 - RNA, 19 nt, Homo sapiens
gcaggagaaucgcuugaac

SEQ ID NO: 1533991 - RNA, 19 nt, Homo sapiens
cagcagcaaacuuccauaa

SEQ ID NO: 1533992 - RNA, 19 nt, Homo sapiens
caguggagaggccuuaaua

SEQ ID NO: 1533993 - RNA, 19 nt, Homo sapiens
gucaagagaucgagaccau

SEQ ID NO: 1533994 - RNA, 19 nt, Homo sapiens
gaauauggaagagaugaug

SEQ ID NO: 1533995 - RNA, 19 nt, Homo sapiens
uggagaggccuuaauagaa

SEQ ID NO: 1533996 - RNA, 19 nt, Homo sapiens
guggagaggccuuaauaga

SEQ ID NO: 1533997 - RNA, 19 nt, Homo sapiens
agaaucagaucuagcuuac

SEQ ID NO: 1533998 - RNA, 19 nt, Homo sapiens
ugccaaggcuacauauuuc

SEQ ID NO: 1533999 - RNA, 19 nt, Homo sapiens
aaacugccaaagacaauuu

SEQ ID NO: 1534000 - RNA, 19 nt, Homo sapiens
gcagugagccaagauugug

SEQ ID NO: 1534001 - RNA, 19 nt, Homo sapiens
uuacaggucagcaggcaua

SEQ ID NO: 1534002 - RNA, 19 nt, Homo sapiens
gcagagcacauagaucaug

SEQ ID NO: 1534003 - RNA, 19 nt, Homo sapiens
ugcagcagcuuggcauuaa

SEQ ID NO: 1534004 - RNA, 19 nt, Homo sapiens
ucacugaaagcccaucuga

SEQ ID NO: 1534005 - RNA, 19 nt, Homo sapiens
ccauauccuuggccaaugu

SEQ ID NO: 1534006 - RNA, 19 nt, Homo sapiens
gagccacagggacuuuaua

SEQ ID NO: 1534007 - RNA, 19 nt, Homo sapiens
uguaaggaaucaagaucuu

SEQ ID NO: 1534008 - RNA, 19 nt, Homo sapiens
ugagacacacgguuuaaau

SEQ ID NO: 1534009 - RNA, 19 nt, Homo sapiens
gguuucgagugagugauua

SEQ ID NO: 1534010 - RNA, 19 nt, Homo sapiens
ggaaacaacuuauguaaca

SEQ ID NO: 1534011 - RNA, 19 nt, Homo sapiens
agucagagcucuuaucaua

SEQ ID NO: 1534012 - RNA, 19 nt, Homo sapiens
caaagcaccuucaauucua

SEQ ID NO: 1534013 - RNA, 19 nt, Homo sapiens
ccauaagucuugcuugaua

SEQ ID NO: 1534014 - RNA, 19 nt, Homo sapiens
gagaaacaguuccagauug

SEQ ID NO: 1534015 - RNA, 19 nt, Homo sapiens
ggucaugcuucaaguguua

SEQ ID NO: 1534016 - RNA, 19 nt, Homo sapiens
ccaacaagcuugcugaaga

SEQ ID NO: 1534017 - RNA, 19 nt, Homo sapiens
ugaagaagcugcauguaga

SEQ ID NO: 1534018 - RNA, 19 nt, Homo sapiens
aaacaaagcaccuucaauu

SEQ ID NO: 1534019 - RNA, 19 nt, Homo sapiens
auagauaguuggucgauua

SEQ ID NO: 1534020 - RNA, 19 nt, Homo sapiens
ccuaacacaucguauauaa

SEQ ID NO: 1534021 - RNA, 19 nt, Homo sapiens
ccagacauguucuaacuuu

SEQ ID NO: 1534022 - RNA, 19 nt, Homo sapiens
caaauaagcaugcaauaug

SEQ ID NO: 1534023 - RNA, 19 nt, Homo sapiens
aaucuuaacucucaggaua

SEQ ID NO: 1534024 - RNA, 19 nt, Homo sapiens
uagcagaaaugaacugaaa

SEQ ID NO: 1534025 - RNA, 19 nt, Homo sapiens
caacaagcuugcugaagaa

SEQ ID NO: 1534026 - RNA, 19 nt, Homo sapiens
gaagccaaauuuaagcaaa

SEQ ID NO: 1534027 - RNA, 19 nt, Homo sapiens
cuaaacaacuguaccaaga

SEQ ID NO: 1534028 - RNA, 19 nt, Homo sapiens
gcaaauaugagaacaacaa

SEQ ID NO: 1534029 - RNA, 19 nt, Homo sapiens
gcaaauagugacauggaua

SEQ ID NO: 1534030 - RNA, 19 nt, Homo sapiens
gauaaucacacacaugaaa

SEQ ID NO: 1534031 - RNA, 19 nt, Homo sapiens
aaucaugucuaaccaagua

SEQ ID NO: 1534032 - RNA, 19 nt, Homo sapiens
ccagugacuucccauuaua

SEQ ID NO: 1534033 - RNA, 19 nt, Homo sapiens
gcaauaugguuucuuugga

SEQ ID NO: 1534034 - RNA, 19 nt, Homo sapiens
caacaugcaguaauucuaa

SEQ ID NO: 1534035 - RNA, 19 nt, Homo sapiens
ggacaaagcuguaaaacca

SEQ ID NO: 1534036 - RNA, 19 nt, Homo sapiens
guaccaagaagccaaauuu

SEQ ID NO: 1534037 - RNA, 19 nt, Homo sapiens
caagaaaucauaggaguaa

SEQ ID NO: 1534038 - RNA, 19 nt, Homo sapiens
ggacagagagacccauauu

SEQ ID NO: 1534039 - RNA, 19 nt, Homo sapiens
caauaugguuucuuuggaa

SEQ ID NO: 1534040 - RNA, 19 nt, Homo sapiens
agaaacaguuccagauuga

SEQ ID NO: 1534041 - RNA, 19 nt, Homo sapiens
gcccauagguuagucauug

SEQ ID NO: 1534042 - RNA, 19 nt, Homo sapiens
gaugauguuucaauuagga

SEQ ID NO: 1534043 - RNA, 19 nt, Homo sapiens
gcacaaagucauguuuaaa

SEQ ID NO: 1534044 - RNA, 19 nt, Homo sapiens
gaaauuaccaauacacaag

SEQ ID NO: 1534045 - RNA, 19 nt, Homo sapiens
cagaugaaauuaccaauac

SEQ ID NO: 1534046 - RNA, 19 nt, Homo sapiens
gcacaugcuugcaaaagua

SEQ ID NO: 1534047 - RNA, 19 nt, Homo sapiens
caugcaauaugguuucuuu

SEQ ID NO: 1534048 - RNA, 19 nt, Homo sapiens
gcaucaaaccagagaauuu

SEQ ID NO: 1534049 - RNA, 19 nt, Homo sapiens
gacauguucuaacuuugua

SEQ ID NO: 1534050 - RNA, 19 nt, Homo sapiens
caaauagugacauggauaa

SEQ ID NO: 1534051 - RNA, 19 nt, Homo sapiens
agaaugaaguccaagaaau

SEQ ID NO: 1534052 - RNA, 19 nt, Homo sapiens
gcaucaauaucaccuaaca

SEQ ID NO: 1534053 - RNA, 19 nt, Homo sapiens
caauacggaugauguuuca

SEQ ID NO: 1534054 - RNA, 19 nt, Homo sapiens
gaaugaaguccaagaaauc

SEQ ID NO: 1534055 - RNA, 19 nt, Homo sapiens
cauaagucuugcuugauaa

SEQ ID NO: 1534056 - RNA, 19 nt, Homo sapiens
agacagacaugugcaguga

SEQ ID NO: 1534057 - RNA, 19 nt, Homo sapiens
ugacuucccauuauaguuu

SEQ ID NO: 1534058 - RNA, 19 nt, Homo sapiens
cagaauagcaucaucuuca

SEQ ID NO: 1534059 - RNA, 19 nt, Homo sapiens
gauaguuggucgauuacau

SEQ ID NO: 1534060 - RNA, 19 nt, Homo sapiens
acaaacacccggaaagaaa

SEQ ID NO: 1534061 - RNA, 19 nt, Homo sapiens
gaaacaaagcaccuucaau

SEQ ID NO: 1534062 - RNA, 19 nt, Homo sapiens
acagguaucugaaacaaag

SEQ ID NO: 1534063 - RNA, 19 nt, Homo sapiens
ccaagaagccaaauuuaag

SEQ ID NO: 1534064 - RNA, 19 nt, Homo sapiens
guucaccaguuuccuuaaa

SEQ ID NO: 1534065 - RNA, 19 nt, Homo sapiens
uaacaaacacccggaaaga

SEQ ID NO: 1534066 - RNA, 19 nt, Homo sapiens
gaagagccuuuggcagaau

SEQ ID NO: 1534067 - RNA, 19 nt, Homo sapiens
gcaaugcgaagccauacuu

SEQ ID NO: 1534068 - RNA, 19 nt, Homo sapiens
ggugucagguugucacaug

SEQ ID NO: 1534069 - RNA, 19 nt, Homo sapiens
gaaucagaaugaaguccaa

SEQ ID NO: 1534070 - RNA, 19 nt, Homo sapiens
ucacccaguuugaagaauu

SEQ ID NO: 1534071 - RNA, 19 nt, Homo sapiens
cggaugauguuucaauuag

SEQ ID NO: 1534072 - RNA, 19 nt, Homo sapiens
gcagacagaugaaauuacc

SEQ ID NO: 1534073 - RNA, 19 nt, Homo sapiens
ucaccuaacacaucguaua

SEQ ID NO: 1534074 - RNA, 19 nt, Homo sapiens
aagcaucaauaucaccuaa

SEQ ID NO: 1534075 - RNA, 19 nt, Homo sapiens
aaauaagcaugcaauaugg

SEQ ID NO: 1534076 - RNA, 19 nt, Homo sapiens
aaagcaccuucaauucuaa

SEQ ID NO: 1534077 - RNA, 19 nt, Homo sapiens
gaaaucauaggaguaacaa

SEQ ID NO: 1534078 - RNA, 19 nt, Homo sapiens
ugaaguccaagaaaucaua

SEQ ID NO: 1534079 - RNA, 19 nt, Homo sapiens
gcaaaauccucuacuucaa

SEQ ID NO: 1534080 - RNA, 19 nt, Homo sapiens
ugaagagccuuuggcagaa

SEQ ID NO: 1534081 - RNA, 19 nt, Homo sapiens
cagagacaauggacucaga

SEQ ID NO: 1534082 - RNA, 19 nt, Homo sapiens
uguaacauuugcuaccuuu

SEQ ID NO: 1534083 - RNA, 19 nt, Homo sapiens
gugcacaaagucauguuua

SEQ ID NO: 1534084 - RNA, 19 nt, Homo sapiens
uuacauugcuauacugcuu

SEQ ID NO: 1534085 - RNA, 19 nt, Homo sapiens
ucaauuaggagaaugauag

SEQ ID NO: 1534086 - RNA, 19 nt, Homo sapiens
ggaagaauugugcgccaaa

SEQ ID NO: 1534087 - RNA, 19 nt, Homo sapiens
gugcagacagaugaaauua

SEQ ID NO: 1534088 - RNA, 19 nt, Homo sapiens
acacaugaaaguaccauuu

SEQ ID NO: 1534089 - RNA, 19 nt, Homo sapiens
caauaucaccuaacacauc

SEQ ID NO: 1534090 - RNA, 19 nt, Homo sapiens
aaacaacuguaccaagaag

SEQ ID NO: 1534091 - RNA, 19 nt, Homo sapiens
ccaagaaaucauaggagua

SEQ ID NO: 1534092 - RNA, 19 nt, Homo sapiens
aaacaguuccagauugaaa

SEQ ID NO: 1534093 - RNA, 19 nt, Homo sapiens
ugagcuacguccagaauag

SEQ ID NO: 1534094 - RNA, 19 nt, Homo sapiens
ugagaaacaguuccagauu

SEQ ID NO: 1534095 - RNA, 19 nt, Homo sapiens
uggcagaauugucaaagga

SEQ ID NO: 1534096 - RNA, 19 nt, Homo sapiens
ugcacaaagucauguuuaa

SEQ ID NO: 1534097 - RNA, 19 nt, Homo sapiens
uaccagugacuucccauua

SEQ ID NO: 1534098 - RNA, 19 nt, Homo sapiens
gaaaagaacagagacaaug

SEQ ID NO: 1534099 - RNA, 19 nt, Homo sapiens
guagauuccacccucagua

SEQ ID NO: 1534100 - RNA, 19 nt, Homo sapiens
gaagaagcugcauguagau

SEQ ID NO: 1534101 - RNA, 19 nt, Homo sapiens
uaccaagaagccaaauuua

SEQ ID NO: 1534102 - RNA, 19 nt, Homo sapiens
uugcuauacugcuuaguuu

SEQ ID NO: 1534103 - RNA, 19 nt, Homo sapiens
gauagauaguuggucgauu

SEQ ID NO: 1534104 - RNA, 19 nt, Homo sapiens
uuacagguaucugaaacaa

SEQ ID NO: 1534105 - RNA, 19 nt, Homo sapiens
cacaagcagucacccaguu

SEQ ID NO: 1534106 - RNA, 19 nt, Homo sapiens
guuucaaaguuuaguguug

SEQ ID NO: 1534107 - RNA, 19 nt, Homo sapiens
uaccagacauguucuaacu

SEQ ID NO: 1534108 - RNA, 19 nt, Homo sapiens
cagaaugaaguccaagaaa

SEQ ID NO: 1534109 - RNA, 19 nt, Homo sapiens
ccuuaaagccugaggaaga

SEQ ID NO: 1534110 - RNA, 19 nt, Homo sapiens
gcugagauguuguuaauuu

SEQ ID NO: 1534111 - RNA, 19 nt, Homo sapiens
gacaagaucuccugaguug

SEQ ID NO: 1534112 - RNA, 19 nt, Homo sapiens
uuacuugucuccauucuua

SEQ ID NO: 1534113 - RNA, 19 nt, Homo sapiens
gaaagccucuugcaguuga

SEQ ID NO: 1534114 - RNA, 19 nt, Homo sapiens
uuaaucaccuguuuacuug

SEQ ID NO: 1534115 - RNA, 19 nt, Homo sapiens
caugagacaucaaucaaau

SEQ ID NO: 1534116 - RNA, 19 nt, Homo sapiens
gcaguugauugaaagaguu

SEQ ID NO: 1534117 - RNA, 19 nt, Homo sapiens
gugaaacgcuguaaaauau

SEQ ID NO: 1534118 - RNA, 19 nt, Homo sapiens
gugauagucugaaauaugg

SEQ ID NO: 1534119 - RNA, 19 nt, Homo sapiens
gaaugacgguguguggauu

SEQ ID NO: 1534120 - RNA, 19 nt, Homo sapiens
ugcaggaugugccuuguua

SEQ ID NO: 1534121 - RNA, 19 nt, Homo sapiens
gaccuguacuuuaaacaau

SEQ ID NO: 1534122 - RNA, 19 nt, Homo sapiens
aaagagagaucagacuguu

SEQ ID NO: 1534123 - RNA, 19 nt, Homo sapiens
gaccuucuccuuauuauca

SEQ ID NO: 1534124 - RNA, 19 nt, Homo sapiens
guauaaagcccgauuguac

SEQ ID NO: 1534125 - RNA, 19 nt, Homo sapiens
gaacugaaugucuccguau

SEQ ID NO: 1534126 - RNA, 19 nt, Homo sapiens
gacacuggguggaugauau

SEQ ID NO: 1534127 - RNA, 19 nt, Homo sapiens
gacauaagagacuccauuu

SEQ ID NO: 1534128 - RNA, 19 nt, Homo sapiens
guacauuuguucaauucug

SEQ ID NO: 1534129 - RNA, 19 nt, Homo sapiens
aaagcccgauuguacauuu

SEQ ID NO: 1534130 - RNA, 19 nt, Homo sapiens
gagaucagacuguuacugu

SEQ ID NO: 1534131 - RNA, 19 nt, Homo sapiens
gaaagagagaucagacugu

SEQ ID NO: 1534132 - RNA, 19 nt, Homo sapiens
acagacaccucccugcauu

SEQ ID NO: 1534133 - RNA, 19 nt, Homo sapiens
ggacaagaucuccugaguu

SEQ ID NO: 1534134 - RNA, 19 nt, Homo sapiens
caagcaguauaguugguaa

SEQ ID NO: 1534135 - RNA, 19 nt, Homo sapiens
guacgcaguuccacuuuac

SEQ ID NO: 1534136 - RNA, 19 nt, Homo sapiens
cuuaguaggugcacaacaa

SEQ ID NO: 1534137 - RNA, 19 nt, Homo sapiens
gggacaagaucuccugagu

SEQ ID NO: 1534138 - RNA, 19 nt, Homo sapiens
gugaagcaauggagaaagu

SEQ ID NO: 1534139 - RNA, 19 nt, Homo sapiens
ugagaaagggugaggcuaa

SEQ ID NO: 1534140 - RNA, 19 nt, Homo sapiens
guagaaagggaagacauaa

SEQ ID NO: 1534141 - RNA, 19 nt, Homo sapiens
gaauuaguauacugagucu

SEQ ID NO: 1534142 - RNA, 19 nt, Homo sapiens
gaaacgggguauucauuug

SEQ ID NO: 1534143 - RNA, 19 nt, Homo sapiens
gcaguuccacuuuacauuc

SEQ ID NO: 1534144 - RNA, 19 nt, Homo sapiens
agaaagggaagacauaaga

SEQ ID NO: 1534145 - RNA, 19 nt, Homo sapiens
ccuggaagcuccuuauuuu

SEQ ID NO: 1534146 - RNA, 19 nt, Homo sapiens
ggacuguggucuggacuag

SEQ ID NO: 1534147 - RNA, 19 nt, Homo sapiens
gacgccaccucaccugaaa

SEQ ID NO: 1534148 - RNA, 19 nt, Homo sapiens
cugaaugucuccguauaaa

SEQ ID NO: 1534149 - RNA, 19 nt, Homo sapiens
aggaaagccucuugcaguu

SEQ ID NO: 1534150 - RNA, 19 nt, Homo sapiens
gagaaagggugaggcuaag

SEQ ID NO: 1534151 - RNA, 19 nt, Homo sapiens
gccauucucuagucucaau

SEQ ID NO: 1534152 - RNA, 19 nt, Homo sapiens
uugcugagauguuguuaau

SEQ ID NO: 1534153 - RNA, 19 nt, Homo sapiens
gaucagacuguuacugugu

SEQ ID NO: 1534154 - RNA, 19 nt, Homo sapiens
uuaaggugguugggauaua

SEQ ID NO: 1534155 - RNA, 19 nt, Homo sapiens
auacagcccucaggagauu

SEQ ID NO: 1534156 - RNA, 19 nt, Homo sapiens
uccagaaccucacacagaa

SEQ ID NO: 1534157 - RNA, 19 nt, Homo sapiens
guucaauucugagauagga

SEQ ID NO: 1534158 - RNA, 19 nt, Homo sapiens
ggagacaugagacaucaau

SEQ ID NO: 1534159 - RNA, 19 nt, Homo sapiens
caagaucuccugaguuguc

SEQ ID NO: 1534160 - RNA, 19 nt, Homo sapiens
ggaaugacgguguguggau

SEQ ID NO: 1534161 - RNA, 19 nt, Homo sapiens
ggaaagccucuugcaguug

SEQ ID NO: 1534162 - RNA, 19 nt, Homo sapiens
uaaggugguugggauauag

SEQ ID NO: 1534163 - RNA, 19 nt, Homo sapiens
caacggagucccacagaca

SEQ ID NO: 1534164 - RNA, 19 nt, Homo sapiens
cacgugauagucugaaaua

SEQ ID NO: 1534165 - RNA, 19 nt, Homo sapiens
gacaugagacaucaaucaa

SEQ ID NO: 1534166 - RNA, 19 nt, Homo sapiens
gaaugucuccguauaaagc

SEQ ID NO: 1534167 - RNA, 19 nt, Homo sapiens
agacauaagagacuccauu

SEQ ID NO: 1534168 - RNA, 19 nt, Homo sapiens
ugaccaauggccugugaua

SEQ ID NO: 1534169 - RNA, 19 nt, Homo sapiens
cuggguggaugauauggua

SEQ ID NO: 1534170 - RNA, 19 nt, Homo sapiens
gugguugggauauaguuua

SEQ ID NO: 1534171 - RNA, 19 nt, Homo sapiens
gggaacgugugcuuaaggu

SEQ ID NO: 1534172 - RNA, 19 nt, Homo sapiens
ggacgccaccucaccugaa

SEQ ID NO: 1534173 - RNA, 19 nt, Homo sapiens
gaaagggugaggcuaaggu

SEQ ID NO: 1534174 - RNA, 19 nt, Homo sapiens
guggauuucuugugugcuu

SEQ ID NO: 1534175 - RNA, 19 nt, Homo sapiens
acaauugcuugcugagaug

SEQ ID NO: 1534176 - RNA, 19 nt, Homo sapiens
uguagaaagggaagacaua

SEQ ID NO: 1534177 - RNA, 19 nt, Homo sapiens
caaaugugagugaccaaug

SEQ ID NO: 1534178 - RNA, 19 nt, Homo sapiens
gauagaggaaggccacugu

SEQ ID NO: 1534179 - RNA, 19 nt, Homo sapiens
ccagggcugugcaggaugu

SEQ ID NO: 1534180 - RNA, 19 nt, Homo sapiens
cauaagagacuccauuuug

SEQ ID NO: 1534181 - RNA, 19 nt, Homo sapiens
cagaaaggcaggacaacug

SEQ ID NO: 1534182 - RNA, 19 nt, Homo sapiens
gaagacucacuccggaaga

SEQ ID NO: 1534183 - RNA, 19 nt, Homo sapiens
uaaaccagaggcacaaugu

SEQ ID NO: 1534184 - RNA, 19 nt, Homo sapiens
aacaauugcuugcugagau

SEQ ID NO: 1534185 - RNA, 19 nt, Homo sapiens
gaaagggaagacauaagag

SEQ ID NO: 1534186 - RNA, 19 nt, Homo sapiens
aguacgcaguuccacuuua

SEQ ID NO: 1534187 - RNA, 19 nt, Homo sapiens
acuguggucuggacuagaa

SEQ ID NO: 1534188 - RNA, 19 nt, Homo sapiens
gacgguguguggauuucuu

SEQ ID NO: 1534189 - RNA, 19 nt, Homo sapiens
cgugauagucugaaauaug

SEQ ID NO: 1534190 - RNA, 19 nt, Homo sapiens
agacaugagacaucaauca

SEQ ID NO: 1534191 - RNA, 19 nt, Homo sapiens
ugguugggauauaguuuaa

SEQ ID NO: 1534192 - RNA, 19 nt, Homo sapiens
ggaagcuccuuauuuuaau

SEQ ID NO: 1534193 - RNA, 19 nt, Homo sapiens
gugcuuauucguaggauug

SEQ ID NO: 1534194 - RNA, 19 nt, Homo sapiens
guguguggauuucuugugu

SEQ ID NO: 1534195 - RNA, 19 nt, Homo sapiens
ccuguacuuuaaacaauug

SEQ ID NO: 1534196 - RNA, 19 nt, Homo sapiens
ggcaguugauugaaagagu

SEQ ID NO: 1534197 - RNA, 19 nt, Homo sapiens
aaaugugagugaccaaugg

SEQ ID NO: 1534198 - RNA, 19 nt, Homo sapiens
caguuccacuuuacauuca

SEQ ID NO: 1534199 - RNA, 19 nt, Homo sapiens
aaagggaagacauaagaga

SEQ ID NO: 1534200 - RNA, 19 nt, Homo sapiens
aacugaaugucuccguaua

SEQ ID NO: 1534201 - RNA, 19 nt, Homo sapiens
ggucugugcugagguggau

SEQ ID NO: 1534202 - RNA, 19 nt, Homo sapiens
gcaggaugugccuuguuaa

SEQ ID NO: 1534203 - RNA, 19 nt, Homo sapiens
aauuggcaguugauugaaa

SEQ ID NO: 1534204 - RNA, 19 nt, Homo sapiens
uauaaagcccgauuguaca

SEQ ID NO: 1534205 - RNA, 19 nt, Homo sapiens
caauaaaccagaggcacaa

SEQ ID NO: 1534206 - RNA, 19 nt, Homo sapiens
cugagauguuguuaauuug

SEQ ID NO: 1534207 - RNA, 19 nt, Homo sapiens
gauacagcccucaggagau

SEQ ID NO: 1534208 - RNA, 19 nt, Homo sapiens
auaagagacuccauuuuga

SEQ ID NO: 1534209 - RNA, 19 nt, Homo sapiens
aaugaccuuucuuguauuc

SEQ ID NO: 1534210 - RNA, 19 nt, Homo sapiens
gaacaugccagaccaauau

SEQ ID NO: 1534211 - RNA, 19 nt, Homo sapiens
ggaaagagaugccaagacu

SEQ ID NO: 1534212 - RNA, 19 nt, Homo sapiens
guacacagaagguauagua

SEQ ID NO: 1534213 - RNA, 19 nt, Homo sapiens
gaagaagcaaggaagauuu

SEQ ID NO: 1534214 - RNA, 19 nt, Homo sapiens
gaugagaaaucuuuagaag

SEQ ID NO: 1534215 - RNA, 19 nt, Homo sapiens
gagagagcccugauugaua

SEQ ID NO: 1534216 - RNA, 19 nt, Homo sapiens
ccagagccauucuuaacua

SEQ ID NO: 1534217 - RNA, 19 nt, Homo sapiens
gagaaagccucccauggau

SEQ ID NO: 1534218 - RNA, 19 nt, Homo sapiens
cagaagauuuggacaaguu

SEQ ID NO: 1534219 - RNA, 19 nt, Homo sapiens
gaaagccucccauggauga

SEQ ID NO: 1534220 - RNA, 19 nt, Homo sapiens
cagaagguauaguagauuu

SEQ ID NO: 1534221 - RNA, 19 nt, Homo sapiens
gaguagaguuggaagagaa

SEQ ID NO: 1534222 - RNA, 19 nt, Homo sapiens
gcaaauacaaccuuuaugg

SEQ ID NO: 1534223 - RNA, 19 nt, Homo sapiens
gaccaauauucuacaguuu

SEQ ID NO: 1534224 - RNA, 19 nt, Homo sapiens
agagagcccugauugauau

SEQ ID NO: 1534225 - RNA, 19 nt, Homo sapiens
gcaacaaugaagugcuuua

SEQ ID NO: 1534226 - RNA, 19 nt, Homo sapiens
ccaggagacugcuaucaug

SEQ ID NO: 1534227 - RNA, 19 nt, Homo sapiens
cuacuucccugccuuugaa

SEQ ID NO: 1534228 - RNA, 19 nt, Homo sapiens
gaagguauaguagauuuga

SEQ ID NO: 1534229 - RNA, 19 nt, Homo sapiens
gaagugcuuuaccuaagug

SEQ ID NO: 1534230 - RNA, 19 nt, Homo sapiens
ggagagagcccugauugau

SEQ ID NO: 1534231 - RNA, 19 nt, Homo sapiens
gauugugccucuuguaaag

SEQ ID NO: 1534232 - RNA, 19 nt, Homo sapiens
ccacgacagugacagaguu

SEQ ID NO: 1534233 - RNA, 19 nt, Homo sapiens
agaccaauauucuacaguu

SEQ ID NO: 1534234 - RNA, 19 nt, Homo sapiens
caaggaagauuuucagguu

SEQ ID NO: 1534235 - RNA, 19 nt, Homo sapiens
ugauugauauguacacaga

SEQ ID NO: 1534236 - RNA, 19 nt, Homo sapiens
gagcccugauugauaugua

SEQ ID NO: 1534237 - RNA, 19 nt, Homo sapiens
ggaguagaguuggaagaga

SEQ ID NO: 1534238 - RNA, 19 nt, Homo sapiens
cgacagugacagaguuuaa

SEQ ID NO: 1534239 - RNA, 19 nt, Homo sapiens
cacagaagguauaguagau

SEQ ID NO: 1534240 - RNA, 19 nt, Homo sapiens
uaagaaaugaugggaguuu

SEQ ID NO: 1534241 - RNA, 19 nt, Homo sapiens
ugacugaaaugauccuucu

SEQ ID NO: 1534242 - RNA, 19 nt, Homo sapiens
gaaggagagagcccugauu

SEQ ID NO: 1534243 - RNA, 19 nt, Homo sapiens
cagcaaauacaaccuuuau

SEQ ID NO: 1534244 - RNA, 19 nt, Homo sapiens
gaagauuuggacaaguuaa

SEQ ID NO: 1534245 - RNA, 19 nt, Homo sapiens
ggauugugccucuuguaaa

SEQ ID NO: 1534246 - RNA, 19 nt, Homo sapiens
agagaaagccucccaugga

SEQ ID NO: 1534247 - RNA, 19 nt, Homo sapiens
gagccauucuuaacuacau

SEQ ID NO: 1534248 - RNA, 19 nt, Homo sapiens
gagcugggcugacauucac

SEQ ID NO: 1534249 - RNA, 19 nt, Homo sapiens
gccagcaaauacaaccuuu

SEQ ID NO: 1534250 - RNA, 19 nt, Homo sapiens
ugaagugcuuuaccuaagu

SEQ ID NO: 1534251 - RNA, 19 nt, Homo sapiens
gaccagagccauucuuaac

SEQ ID NO: 1534252 - RNA, 19 nt, Homo sapiens
cagaccagagccauucuua

SEQ ID NO: 1534253 - RNA, 19 nt, Homo sapiens
ggaugagaaaucuuuagaa

SEQ ID NO: 1534254 - RNA, 19 nt, Homo sapiens
agacugccuuggucaaaga

SEQ ID NO: 1534255 - RNA, 19 nt, Homo sapiens
auacaaccuuuaugggaaa

SEQ ID NO: 1534256 - RNA, 19 nt, Homo sapiens
gcagaagauuuggacaagu

SEQ ID NO: 1534257 - RNA, 19 nt, Homo sapiens
caaugaagugcuuuaccua

SEQ ID NO: 1534258 - RNA, 19 nt, Homo sapiens
ccauggaugagaaaucuuu

SEQ ID NO: 1534259 - RNA, 19 nt, Homo sapiens
ggaagauuuucagguuuua

SEQ ID NO: 1534260 - RNA, 19 nt, Homo sapiens
gauccuucuucugcucaua

SEQ ID NO: 1534261 - RNA, 19 nt, Homo sapiens
gauauguacacagaaggua

SEQ ID NO: 1534262 - RNA, 19 nt, Homo sapiens
uuggacaaguuaagaaaug

SEQ ID NO: 1534263 - RNA, 19 nt, Homo sapiens
ccaauauucuacaguuugc

SEQ ID NO: 1534264 - RNA, 19 nt, Homo sapiens
acacagaagguauaguaga

SEQ ID NO: 1534265 - RNA, 19 nt, Homo sapiens
ccagcaaauacaaccuuua

SEQ ID NO: 1534266 - RNA, 19 nt, Homo sapiens
acaaugaagugcuuuaccu

SEQ ID NO: 1534267 - RNA, 19 nt, Homo sapiens
agaagaagcaaggaagauu

SEQ ID NO: 1534268 - RNA, 19 nt, Homo sapiens
uauguacacagaagguaua

SEQ ID NO: 1534269 - RNA, 19 nt, Homo sapiens
agaacaugccagaccaaua

SEQ ID NO: 1534270 - RNA, 19 nt, Homo sapiens
gauuuggacaaguuaagaa

SEQ ID NO: 1534271 - RNA, 19 nt, Homo sapiens
aaugaagugcuuuaccuaa

SEQ ID NO: 1534272 - RNA, 19 nt, Homo sapiens
agaguuggaagagaaauuu

SEQ ID NO: 1534273 - RNA, 19 nt, Homo sapiens
uggacaaguuaagaaauga

SEQ ID NO: 1534274 - RNA, 19 nt, Homo sapiens
ggacaaguuaagaaaugau

SEQ ID NO: 1534275 - RNA, 19 nt, Homo sapiens
gaggaaagagaugccaaga

SEQ ID NO: 1534276 - RNA, 19 nt, Homo sapiens
aagaaaugaugggaguuug

SEQ ID NO: 1534277 - RNA, 19 nt, Homo sapiens
ccucuuguaaagcuaauaa

SEQ ID NO: 1534278 - RNA, 19 nt, Homo sapiens
uggauugugccucuuguaa

SEQ ID NO: 1534279 - RNA, 19 nt, Homo sapiens
aaggagagagcccugauug

SEQ ID NO: 1534280 - RNA, 19 nt, Homo sapiens
gacaaguuaagaaaugaug

SEQ ID NO: 1534281 - RNA, 19 nt, Homo sapiens
agaagauuuggacaaguua

SEQ ID NO: 1534282 - RNA, 19 nt, Homo sapiens
uugcaacaaugaagugcuu

SEQ ID NO: 1534283 - RNA, 19 nt, Homo sapiens
gcuacuucccugccuuuga

SEQ ID NO: 1534284 - RNA, 19 nt, Homo sapiens
guauaguagauuugacuga

SEQ ID NO: 1534285 - RNA, 19 nt, Homo sapiens
cagcuggaguagaguugga

SEQ ID NO: 1534286 - RNA, 19 nt, Homo sapiens
uuaccuaaguguggauugu

SEQ ID NO: 1534287 - RNA, 19 nt, Homo sapiens
ggcugcagcuggaguagag

SEQ ID NO: 1534288 - RNA, 19 nt, Homo sapiens
gcugagcugggcugacauu

SEQ ID NO: 1534289 - RNA, 19 nt, Homo sapiens
cuacaguuugcaacaauga

SEQ ID NO: 1534290 - RNA, 19 nt, Homo sapiens
gaaaugaugggaguuugcu

SEQ ID NO: 1534291 - RNA, 19 nt, Homo sapiens
agaccagagccauucuuaa

SEQ ID NO: 1534292 - RNA, 19 nt, Homo sapiens
cauggaugagaaaucuuua

SEQ ID NO: 1534293 - RNA, 19 nt, Homo sapiens
gugcagaccagagccauuc

SEQ ID NO: 1534294 - RNA, 19 nt, Homo sapiens
ugcccacggugaagaaguu

SEQ ID NO: 1534295 - RNA, 19 nt, Homo sapiens
agugacagaguuuaacaaa

SEQ ID NO: 1534296 - RNA, 19 nt, Homo sapiens
gaaagacaugaaggagaga

SEQ ID NO: 1534297 - RNA, 19 nt, Homo sapiens
caacaaugaagugcuuuac

SEQ ID NO: 1534298 - RNA, 19 nt, Homo sapiens
ccagaccaauauucuacag

SEQ ID NO: 1534299 - RNA, 19 nt, Homo sapiens
caagaacaugccagaccaa

SEQ ID NO: 1534300 - RNA, 19 nt, Homo sapiens
uuaauaaagcagcuaugga

SEQ ID NO: 1534301 - RNA, 19 nt, Homo sapiens
gcagaccagagccauucuu

SEQ ID NO: 1534302 - RNA, 19 nt, Homo sapiens
uggaugagaaaucuuuaga

SEQ ID NO: 1534303 - RNA, 19 nt, Homo sapiens
ucccauggaugagaaaucu

SEQ ID NO: 1534304 - RNA, 19 nt, Homo sapiens
ugaaaugauccuucuucug

SEQ ID NO: 1534305 - RNA, 19 nt, Homo sapiens
ugguggaacuuuucuacua

SEQ ID NO: 1534306 - RNA, 19 nt, Homo sapiens
cagagccauucuuaacuac

SEQ ID NO: 1534307 - RNA, 19 nt, Homo sapiens
gaaacaacaucuggaaaua

SEQ ID NO: 1534308 - RNA, 19 nt, Homo sapiens
gaagugaaaugccgcugua

SEQ ID NO: 1534309 - RNA, 19 nt, Homo sapiens
ccagaaagguugcaagaaa

SEQ ID NO: 1534310 - RNA, 19 nt, Homo sapiens
gagaaagcgugccaaauga

SEQ ID NO: 1534311 - RNA, 19 nt, Homo sapiens
gcucaucauuuauggaaua

SEQ ID NO: 1534312 - RNA, 19 nt, Homo sapiens
ggaugcuucuucugaauua

SEQ ID NO: 1534313 - RNA, 19 nt, Homo sapiens
gauccaagauucaccuaaa

SEQ ID NO: 1534314 - RNA, 19 nt, Homo sapiens
gaagagcuauagugaagug

SEQ ID NO: 1534315 - RNA, 19 nt, Homo sapiens
ggagaauguucccacuaua

SEQ ID NO: 1534316 - RNA, 19 nt, Homo sapiens
cauuauggaucacaagaua

SEQ ID NO: 1534317 - RNA, 19 nt, Homo sapiens
ccaaaucgaugaccgacaa

SEQ ID NO: 1534318 - RNA, 19 nt, Homo sapiens
ggacucaacuggugcaucu

SEQ ID NO: 1534319 - RNA, 19 nt, Homo sapiens
uaucauaggcucucacuuu

SEQ ID NO: 1534320 - RNA, 19 nt, Homo sapiens
uaaggaagcuguggccaaa

SEQ ID NO: 1534321 - RNA, 19 nt, Homo sapiens
gaguguagcucaaggaauc

SEQ ID NO: 1534322 - RNA, 19 nt, Homo sapiens
gaucauugcugucacuaca

SEQ ID NO: 1534323 - RNA, 19 nt, Homo sapiens
caucaaaggcccaaguuaa

SEQ ID NO: 1534324 - RNA, 19 nt, Homo sapiens
gagagaagcccacuugcaa

SEQ ID NO: 1534325 - RNA, 19 nt, Homo sapiens
gaaaucaucagaaacaaca

SEQ ID NO: 1534326 - RNA, 19 nt, Homo sapiens
ccugaggccuguuggcuua

SEQ ID NO: 1534327 - RNA, 19 nt, Homo sapiens
uggaauagccacucucaua

SEQ ID NO: 1534328 - RNA, 19 nt, Homo sapiens
gccaaugugugguuuauca

SEQ ID NO: 1534329 - RNA, 19 nt, Homo sapiens
gaacaauaccacagaagau

SEQ ID NO: 1534330 - RNA, 19 nt, Homo sapiens
uggcuuaacugggacaaua

SEQ ID NO: 1534331 - RNA, 19 nt, Homo sapiens
ccaguguggugaugucuuu

SEQ ID NO: 1534332 - RNA, 19 nt, Homo sapiens
ugagaaagcgugccaaaug

SEQ ID NO: 1534333 - RNA, 19 nt, Homo sapiens
ccuaaaagcuggagauaaa

SEQ ID NO: 1534334 - RNA, 19 nt, Homo sapiens
uaaauggucuggugcuauc

SEQ ID NO: 1534335 - RNA, 19 nt, Homo sapiens
caacuccacauccacaaua

SEQ ID NO: 1534336 - RNA, 19 nt, Homo sapiens
gaccuuguauuucuucuuc

SEQ ID NO: 1534337 - RNA, 19 nt, Homo sapiens
ggcucucacuuuaacauua

SEQ ID NO: 1534338 - RNA, 19 nt, Homo sapiens
cagaaagguugcaagaaau

SEQ ID NO: 1534339 - RNA, 19 nt, Homo sapiens
caggauguggucauaauua

SEQ ID NO: 1534340 - RNA, 19 nt, Homo sapiens
uaauguuacucgagagaaa

SEQ ID NO: 1534341 - RNA, 19 nt, Homo sapiens
uaacaaaccaggcuacauc

SEQ ID NO: 1534342 - RNA, 19 nt, Homo sapiens
uaaugaaucgucaaggaua

SEQ ID NO: 1534343 - RNA, 19 nt, Homo sapiens
gaauagccacucucauaga

SEQ ID NO: 1534344 - RNA, 19 nt, Homo sapiens
gaugaagucccgaaugaug

SEQ ID NO: 1534345 - RNA, 19 nt, Homo sapiens
ugacggagauaucauacau

SEQ ID NO: 1534346 - RNA, 19 nt, Homo sapiens
caagauaagagaugcuuug

SEQ ID NO: 1534347 - RNA, 19 nt, Homo sapiens
ggaauagccacucucauag

SEQ ID NO: 1534348 - RNA, 19 nt, Homo sapiens
cgacacagcagccauuuca

SEQ ID NO: 1534349 - RNA, 19 nt, Homo sapiens
gagagaaaaugaagagcua

SEQ ID NO: 1534350 - RNA, 19 nt, Homo sapiens
cacuauagauccaagauuc

SEQ ID NO: 1534351 - RNA, 19 nt, Homo sapiens
ucaaugcuuuccaggguuu

SEQ ID NO: 1534352 - RNA, 19 nt, Homo sapiens
cgacaaaguucuggacuac

SEQ ID NO: 1534353 - RNA, 19 nt, Homo sapiens
gaaaugccgcuguaacuac

SEQ ID NO: 1534354 - RNA, 19 nt, Homo sapiens
gaaagcgugccaaaugaug

SEQ ID NO: 1534355 - RNA, 19 nt, Homo sapiens
ggugaaaucaucagaaaca

SEQ ID NO: 1534356 - RNA, 19 nt, Homo sapiens
gcucaaggaauccguaaga

SEQ ID NO: 1534357 - RNA, 19 nt, Homo sapiens
caaccaauggaucuaaauu

SEQ ID NO: 1534358 - RNA, 19 nt, Homo sapiens
ggacugaccugggguuuug

SEQ ID NO: 1534359 - RNA, 19 nt, Homo sapiens
gguaaauggucuggugcua

SEQ ID NO: 1534360 - RNA, 19 nt, Homo sapiens
ggaaggauccaagagaaau

SEQ ID NO: 1534361 - RNA, 19 nt, Homo sapiens
ucacuaggcccaaccaaug

SEQ ID NO: 1534362 - RNA, 19 nt, Homo sapiens
gaucacaagauaagagaug

SEQ ID NO: 1534363 - RNA, 19 nt, Homo sapiens
aauagccacucucauagaa

SEQ ID NO: 1534364 - RNA, 19 nt, Homo sapiens
gaccugggguuuuggaaua

SEQ ID NO: 1534365 - RNA, 19 nt, Homo sapiens
agagaaaggcuacaugaga

SEQ ID NO: 1534366 - RNA, 19 nt, Homo sapiens
ccagagaaaggcuacauga

SEQ ID NO: 1534367 - RNA, 19 nt, Homo sapiens
aucauaggcucucacuuua

SEQ ID NO: 1534368 - RNA, 19 nt, Homo sapiens
cauaauaccucagagaaaa

SEQ ID NO: 1534369 - RNA, 19 nt, Homo sapiens
cagcagccauuucaaacug

SEQ ID NO: 1534370 - RNA, 19 nt, Homo sapiens
aaaaucagcugaaacaugu

SEQ ID NO: 1534371 - RNA, 19 nt, Homo sapiens
uaaggacuuucauggagaa

SEQ ID NO: 1534372 - RNA, 19 nt, Homo sapiens
gagaauguucccacuauag

SEQ ID NO: 1534373 - RNA, 19 nt, Homo sapiens
gcccaggacuacaacaugu

SEQ ID NO: 1534374 - RNA, 19 nt, Homo sapiens
gaacugccccuuugauuau

SEQ ID NO: 1534375 - RNA, 19 nt, Homo sapiens
agagaugcuuugaggauga

SEQ ID NO: 1534376 - RNA, 19 nt, Homo sapiens
ucacagagccagagaaagg

SEQ ID NO: 1534377 - RNA, 19 nt, Homo sapiens
caaugugugguuuaucaua

SEQ ID NO: 1534378 - RNA, 19 nt, Homo sapiens
acaaaguucuggacuacau

SEQ ID NO: 1534379 - RNA, 19 nt, Homo sapiens
gaugagaaagcgugccaaa

SEQ ID NO: 1534380 - RNA, 19 nt, Homo sapiens
gcauagcuuucccaaccuu

SEQ ID NO: 1534381 - RNA, 19 nt, Homo sapiens
gcagucagugaauuuguuu

SEQ ID NO: 1534382 - RNA, 19 nt, Homo sapiens
aaugaaucgucaaggauaa

SEQ ID NO: 1534383 - RNA, 19 nt, Homo sapiens
uaagagaugcuuugaggau

SEQ ID NO: 1534384 - RNA, 19 nt, Homo sapiens
uaacugggacaauaccaaa

SEQ ID NO: 1534385 - RNA, 19 nt, Homo sapiens
ggaugaggaugucuucacu

SEQ ID NO: 1534386 - RNA, 19 nt, Homo sapiens
gcucagcgucucaauccua

SEQ ID NO: 1534387 - RNA, 19 nt, Homo sapiens
caugaacaauaccacagaa

SEQ ID NO: 1534388 - RNA, 19 nt, Homo sapiens
cagagaccauugagagugu

SEQ ID NO: 1534389 - RNA, 19 nt, Homo sapiens
cauaggcucucacuuuaac

SEQ ID NO: 1534390 - RNA, 19 nt, Homo sapiens
ccgacaaaguucuggacua

SEQ ID NO: 1534391 - RNA, 19 nt, Homo sapiens
ccagacaacuccacaucca

SEQ ID NO: 1534392 - RNA, 19 nt, Homo sapiens
acacagcagccauuucaaa

SEQ ID NO: 1534393 - RNA, 19 nt, Homo sapiens
aaaugaagagcuauaguga

SEQ ID NO: 1534394 - RNA, 19 nt, Homo sapiens
caaggaauccguaagaacu

SEQ ID NO: 1534395 - RNA, 19 nt, Homo sapiens
gaaacauguacaagccuuu

SEQ ID NO: 1534396 - RNA, 19 nt, Homo sapiens
augaugaagucccgaauga

SEQ ID NO: 1534397 - RNA, 19 nt, Homo sapiens
gcauugcucaucauuuaug

SEQ ID NO: 1534398 - RNA, 19 nt, Homo sapiens
guucuuugccugaucauug

SEQ ID NO: 1534399 - RNA, 19 nt, Homo sapiens
uaucaggaacgaagugaaa

SEQ ID NO: 1534400 - RNA, 19 nt, Homo sapiens
caaaaggguuucacaucaa

SEQ ID NO: 1534401 - RNA, 19 nt, Homo sapiens
gggcuuucauucccaacaa

SEQ ID NO: 1534402 - RNA, 19 nt, Homo sapiens
gaaggauccaagagaaaug

SEQ ID NO: 1534403 - RNA, 19 nt, Homo sapiens
aggagaauguucccacuau

SEQ ID NO: 1534404 - RNA, 19 nt, Homo sapiens
caucugggcuuuuaccaaa

SEQ ID NO: 1534405 - RNA, 19 nt, Homo sapiens
ugaaaugccgcuguaacua

SEQ ID NO: 1534406 - RNA, 19 nt, Homo sapiens
caaaggcccaaguuaacaa

SEQ ID NO: 1534407 - RNA, 19 nt, Homo sapiens
gaauaacacugaccaaauu

SEQ ID NO: 1534408 - RNA, 19 nt, Homo sapiens
ggaaaucggugaccaagaa

SEQ ID NO: 1534409 - RNA, 19 nt, Homo sapiens
gcagagagcuuagugauga

SEQ ID NO: 1534410 - RNA, 19 nt, Homo sapiens
gacaagagcuaucuagaaa

SEQ ID NO: 1534411 - RNA, 19 nt, Homo sapiens
gaagugugguugugacaua

SEQ ID NO: 1534412 - RNA, 19 nt, Homo sapiens
gaacauaaccaucacuauu

SEQ ID NO: 1534413 - RNA, 19 nt, Homo sapiens
gaacacuucugcuggaauu

SEQ ID NO: 1534414 - RNA, 19 nt, Homo sapiens
gauggagacuacaaaguua

SEQ ID NO: 1534415 - RNA, 19 nt, Homo sapiens
ccaaguaaauucagaaaug

SEQ ID NO: 1534416 - RNA, 19 nt, Homo sapiens
guacagagccucaaucaga

SEQ ID NO: 1534417 - RNA, 19 nt, Homo sapiens
gaccaucacuuacaaaugu

SEQ ID NO: 1534418 - RNA, 19 nt, Homo sapiens
ggaaaggugucuucacaau

SEQ ID NO: 1534419 - RNA, 19 nt, Homo sapiens
caacaauccuguaucuuug

SEQ ID NO: 1534420 - RNA, 19 nt, Homo sapiens
gaauaugagugcaagaaga

SEQ ID NO: 1534421 - RNA, 19 nt, Homo sapiens
ugaaggaucuuucuauuag

SEQ ID NO: 1534422 - RNA, 19 nt, Homo sapiens
gaaaauaacuuugcagaga

SEQ ID NO: 1534423 - RNA, 19 nt, Homo sapiens
gcugaagaauacacuguua

SEQ ID NO: 1534424 - RNA, 19 nt, Homo sapiens
gaucugcucucaacaguuc

SEQ ID NO: 1534425 - RNA, 19 nt, Homo sapiens
ccagaaaccuaucaacaga

SEQ ID NO: 1534426 - RNA, 19 nt, Homo sapiens
caacagucaucuacacuug

SEQ ID NO: 1534427 - RNA, 19 nt, Homo sapiens
gcagcagauucucgauuua

SEQ ID NO: 1534428 - RNA, 19 nt, Homo sapiens
gaacuggaauuacgagucu

SEQ ID NO: 1534429 - RNA, 19 nt, Homo sapiens
ccaaagacgucauuguuca

SEQ ID NO: 1534430 - RNA, 19 nt, Homo sapiens
caccagaaaucaucuuuga

SEQ ID NO: 1534431 - RNA, 19 nt, Homo sapiens
gcauaaaugugacaacagu

SEQ ID NO: 1534432 - RNA, 19 nt, Homo sapiens
gccaacaccugguucauug

SEQ ID NO: 1534433 - RNA, 19 nt, Homo sapiens
gaacaacagucaucuacac

SEQ ID NO: 1534434 - RNA, 19 nt, Homo sapiens
gcacugaacuggaauuacg

SEQ ID NO: 1534435 - RNA, 19 nt, Homo sapiens
ccaaggcccugcuggcuuu

SEQ ID NO: 1534436 - RNA, 19 nt, Homo sapiens
ccaggacaaucgcuacaua

SEQ ID NO: 1534437 - RNA, 19 nt, Homo sapiens
caacagcaauggaccaauc

SEQ ID NO: 1534438 - RNA, 19 nt, Homo sapiens
cuacauaccugaaggaucu

SEQ ID NO: 1534439 - RNA, 19 nt, Homo sapiens
gauguguguugucacuuua

SEQ ID NO: 1534440 - RNA, 19 nt, Homo sapiens
ggaauaacacugaccaaau

SEQ ID NO: 1534441 - RNA, 19 nt, Homo sapiens
guucacagcuacuacauuc

SEQ ID NO: 1534442 - RNA, 19 nt, Homo sapiens
cagaggcagugcaaacaua

SEQ ID NO: 1534443 - RNA, 19 nt, Homo sapiens
gagcauaaaugugacaaca

SEQ ID NO: 1534444 - RNA, 19 nt, Homo sapiens
ggauggagacuacaaaguu

SEQ ID NO: 1534445 - RNA, 19 nt, Homo sapiens
uaaagccaaugaacaaguu

SEQ ID NO: 1534446 - RNA, 19 nt, Homo sapiens
ggaauuacgagucuacuau

SEQ ID NO: 1534447 - RNA, 19 nt, Homo sapiens
gagaagagcagccuguuuc

SEQ ID NO: 1534448 - RNA, 19 nt, Homo sapiens
cgacaacaauccuguaucu

SEQ ID NO: 1534449 - RNA, 19 nt, Homo sapiens
gacaaucgcuacauacucu

SEQ ID NO: 1534450 - RNA, 19 nt, Homo sapiens
ggaguggaauggaaccuau

SEQ ID NO: 1534451 - RNA, 19 nt, Homo sapiens
caucuacacuugugaguuc

SEQ ID NO: 1534452 - RNA, 19 nt, Homo sapiens
ucuaugaguucuccaauau

SEQ ID NO: 1534453 - RNA, 19 nt, Homo sapiens
caacaucccuggguucauc

SEQ ID NO: 1534454 - RNA, 19 nt, Homo sapiens
gaaccuaucacugcauauu

SEQ ID NO: 1534455 - RNA, 19 nt, Homo sapiens
cagacuaaauguaggcuuu

SEQ ID NO: 1534456 - RNA, 19 nt, Homo sapiens
gccauugccuucugucuug

SEQ ID NO: 1534457 - RNA, 19 nt, Homo sapiens
guaacuaugaugagguuua

SEQ ID NO: 1534458 - RNA, 19 nt, Homo sapiens
gaagaggcacugaggcaaa

SEQ ID NO: 1534459 - RNA, 19 nt, Homo sapiens
ggaccaaccuuguguucca

SEQ ID NO: 1534460 - RNA, 19 nt, Homo sapiens
gaaagccauugccuucugu

SEQ ID NO: 1534461 - RNA, 19 nt, Homo sapiens
gcuacuacauucaguggaa

SEQ ID NO: 1534462 - RNA, 19 nt, Homo sapiens
agacaaagcggaacaugaa

SEQ ID NO: 1534463 - RNA, 19 nt, Homo sapiens
gaguaacuaugaugagguu

SEQ ID NO: 1534464 - RNA, 19 nt, Homo sapiens
ggagcaaaguagaauggaa

SEQ ID NO: 1534465 - RNA, 19 nt, Homo sapiens
acaacaauccuguaucuuu

SEQ ID NO: 1534466 - RNA, 19 nt, Homo sapiens
gcuaaggcuuugaucaaga

SEQ ID NO: 1534467 - RNA, 19 nt, Homo sapiens
caccaucacuugaguuaau

SEQ ID NO: 1534468 - RNA, 19 nt, Homo sapiens
gaggagguaucuugaugga

SEQ ID NO: 1534469 - RNA, 19 nt, Homo sapiens
gcagucaggguaauguuaa

SEQ ID NO: 1534470 - RNA, 19 nt, Homo sapiens
cacgugcucucuacgguua

SEQ ID NO: 1534471 - RNA, 19 nt, Homo sapiens
gaacagcaguuggaaaucc

SEQ ID NO: 1534472 - RNA, 19 nt, Homo sapiens
gaagaacagcaguuggaaa

SEQ ID NO: 1534473 - RNA, 19 nt, Homo sapiens
aaaggugucuucacaaucu

SEQ ID NO: 1534474 - RNA, 19 nt, Homo sapiens
ucagugaugugaguaacua

SEQ ID NO: 1534475 - RNA, 19 nt, Homo sapiens
uaugaguucuccaauauca

SEQ ID NO: 1534476 - RNA, 19 nt, Homo sapiens
ggagaagagcagccuguuu

SEQ ID NO: 1534477 - RNA, 19 nt, Homo sapiens
ggaucuuucuauuagcaua

SEQ ID NO: 1534478 - RNA, 19 nt, Homo sapiens
ccugaaggaucuuucuauu

SEQ ID NO: 1534479 - RNA, 19 nt, Homo sapiens
ggcuauggcugcccacuug

SEQ ID NO: 1534480 - RNA, 19 nt, Homo sapiens
ugacaagagcuaucuagaa

SEQ ID NO: 1534481 - RNA, 19 nt, Homo sapiens
caacccaaguaaauucaga

SEQ ID NO: 1534482 - RNA, 19 nt, Homo sapiens
gaacaugaaaucagcucuu

SEQ ID NO: 1534483 - RNA, 19 nt, Homo sapiens
gaauuacgagucuacuauu

SEQ ID NO: 1534484 - RNA, 19 nt, Homo sapiens
caagaagaccucaugaaca

SEQ ID NO: 1534485 - RNA, 19 nt, Homo sapiens
acaagcagguccacucaga

SEQ ID NO: 1534486 - RNA, 19 nt, Homo sapiens
aaacuaaugugcagaugag

SEQ ID NO: 1534487 - RNA, 19 nt, Homo sapiens
ugauguguguugucacuuu

SEQ ID NO: 1534488 - RNA, 19 nt, Homo sapiens
guuaugcccauccaaauuu

SEQ ID NO: 1534489 - RNA, 19 nt, Homo sapiens
ccggaaggguuacggaauu

SEQ ID NO: 1534490 - RNA, 19 nt, Homo sapiens
uuccagggauuauucauuu

SEQ ID NO: 1534491 - RNA, 19 nt, Homo sapiens
cgccacaccugcauaguga

SEQ ID NO: 1534492 - RNA, 19 nt, Homo sapiens
ccagauggcuaaggcuuug

SEQ ID NO: 1534493 - RNA, 19 nt, Homo sapiens
ccaaugcugcuaauaauuc

SEQ ID NO: 1534494 - RNA, 19 nt, Homo sapiens
uaccaaugcugcuaauaau

SEQ ID NO: 1534495 - RNA, 19 nt, Homo sapiens
aaauguaggcuuucaagaa

SEQ ID NO: 1534496 - RNA, 19 nt, Homo sapiens
ccaauaucaaggagauuua

SEQ ID NO: 1534497 - RNA, 19 nt, Homo sapiens
ggaaagucauccagaagcu

SEQ ID NO: 1534498 - RNA, 19 nt, Homo sapiens
uuaccaaugcugcuaauaa

SEQ ID NO: 1534499 - RNA, 19 nt, Homo sapiens
caaacacaauuucaaugca

SEQ ID NO: 1534500 - RNA, 19 nt, Homo sapiens
aaacaagugugcuacaaac

SEQ ID NO: 1534501 - RNA, 19 nt, Homo sapiens
accuaucacugcauauuua

SEQ ID NO: 1534502 - RNA, 19 nt, Homo sapiens
gcaaacugauauuagacau

SEQ ID NO: 1534503 - RNA, 19 nt, Homo sapiens
ggacuacaacuccuuucaa

SEQ ID NO: 1534504 - RNA, 19 nt, Homo sapiens
gaagaccucaugaacacuu

SEQ ID NO: 1534505 - RNA, 19 nt, Homo sapiens
uaacuuugcagagagcuua

SEQ ID NO: 1534506 - RNA, 19 nt, Homo sapiens
gcagucggauucgucuauu

SEQ ID NO: 1534507 - RNA, 19 nt, Homo sapiens
ggaauggaaucccaaaguu

SEQ ID NO: 1534508 - RNA, 19 nt, Homo sapiens
gcagacagcuggagaaggu

SEQ ID NO: 1534509 - RNA, 19 nt, Homo sapiens
gaauggaaucccaaaguua

SEQ ID NO: 1534510 - RNA, 19 nt, Homo sapiens
gagaggaccuacagugcua

SEQ ID NO: 1534511 - RNA, 19 nt, Homo sapiens
ccacaaagcaggaucaaug

SEQ ID NO: 1534512 - RNA, 19 nt, Homo sapiens
gaaacaggcccaaguguca

SEQ ID NO: 1534513 - RNA, 19 nt, Homo sapiens
ggagaaagaaauacgauau

SEQ ID NO: 1534514 - RNA, 19 nt, Homo sapiens
gcagcaacauccacaccua

SEQ ID NO: 1534515 - RNA, 19 nt, Homo sapiens
gaguaaggcucccguuuag

SEQ ID NO: 1534516 - RNA, 19 nt, Homo sapiens
gaguaaaggcuuccacaaa

SEQ ID NO: 1534517 - RNA, 19 nt, Homo sapiens
gaauucagccugcuuaagu

SEQ ID NO: 1534518 - RNA, 19 nt, Homo sapiens
ggagaaggccaacaguuug

SEQ ID NO: 1534519 - RNA, 19 nt, Homo sapiens
gaaaugucguugccugaag

SEQ ID NO: 1534520 - RNA, 19 nt, Homo sapiens
ggaccuacagugcuaauug

SEQ ID NO: 1534521 - RNA, 19 nt, Homo sapiens
agacaccacugcugacuug

SEQ ID NO: 1534522 - RNA, 19 nt, Homo sapiens
gacaagugcuuugggagaa

SEQ ID NO: 1534523 - RNA, 19 nt, Homo sapiens
ucaugugacuguucuaaau

SEQ ID NO: 1534524 - RNA, 19 nt, Homo sapiens
ucugaucacuccucugaaa

SEQ ID NO: 1534525 - RNA, 19 nt, Homo sapiens
aaacucuccuucucacauu

SEQ ID NO: 1534526 - RNA, 19 nt, Homo sapiens
gcauaaacaggcccacaaa

SEQ ID NO: 1534527 - RNA, 19 nt, Homo sapiens
gcgacaauccauauaugua

SEQ ID NO: 1534528 - RNA, 19 nt, Homo sapiens
gaggaauucagccugcuua

SEQ ID NO: 1534529 - RNA, 19 nt, Homo sapiens
gaucacuccucugaaaugu

SEQ ID NO: 1534530 - RNA, 19 nt, Homo sapiens
guccugcccuccugacuuu

SEQ ID NO: 1534531 - RNA, 19 nt, Homo sapiens
gagaaggccaacaguuuga

SEQ ID NO: 1534532 - RNA, 19 nt, Homo sapiens
agacaauccugagcauaaa

SEQ ID NO: 1534533 - RNA, 19 nt, Homo sapiens
gaaacucuccuucucacau

SEQ ID NO: 1534534 - RNA, 19 nt, Homo sapiens
ucaauagugccuuaugaaa

SEQ ID NO: 1534535 - RNA, 19 nt, Homo sapiens
ucaaugcucccaccaguga

SEQ ID NO: 1534536 - RNA, 19 nt, Homo sapiens
aguaaaggcuuccacaaag

SEQ ID NO: 1534537 - RNA, 19 nt, Homo sapiens
acugauaccuuucuuacga

SEQ ID NO: 1534538 - RNA, 19 nt, Homo sapiens
aagacaauccugagcauaa

SEQ ID NO: 1534539 - RNA, 19 nt, Homo sapiens
uugaggagcuugacaacug

SEQ ID NO: 1534540 - RNA, 19 nt, Homo sapiens
aauggaaucccaaaguuaa

SEQ ID NO: 1534541 - RNA, 19 nt, Homo sapiens
gaaggccaacaguuugaaa

SEQ ID NO: 1534542 - RNA, 19 nt, Homo sapiens
gggagaaagaaauacgaua

SEQ ID NO: 1534543 - RNA, 19 nt, Homo sapiens
uggguugcuucuaauauuu

SEQ ID NO: 1534544 - RNA, 19 nt, Homo sapiens
gcagccagcagugcccuua

SEQ ID NO: 1534545 - RNA, 19 nt, Homo sapiens
ccaagacaauccugagcau

SEQ ID NO: 1534546 - RNA, 19 nt, Homo sapiens
guaaggcucccguuuagag

SEQ ID NO: 1534547 - RNA, 19 nt, Homo sapiens
uuucaauagugccuuauga

SEQ ID NO: 1534548 - RNA, 19 nt, Homo sapiens
ggguugcuucuaauauuua

SEQ ID NO: 1534549 - RNA, 19 nt, Homo sapiens
aggagaaggccaacaguuu

SEQ ID NO: 1534550 - RNA, 19 nt, Homo sapiens
agaggacgguggacaagug

SEQ ID NO: 1534551 - RNA, 19 nt, Homo sapiens
cuggguugcuucuaauauu

SEQ ID NO: 1534552 - RNA, 19 nt, Homo sapiens
cgagggacuuucuuugucu

SEQ ID NO: 1534553 - RNA, 19 nt, Homo sapiens
caagacaauccugagcaua

SEQ ID NO: 1534554 - RNA, 19 nt, Homo sapiens
gauauugaucccaggaaug

SEQ ID NO: 1534555 - RNA, 19 nt, Homo sapiens
cgauauugaucccaggaau

SEQ ID NO: 1534556 - RNA, 19 nt, Homo sapiens
uguucuaaauccaguguuu

SEQ ID NO: 1534557 - RNA, 19 nt, Homo sapiens
cacaacacccucuggcaaa

SEQ ID NO: 1534558 - RNA, 19 nt, Homo sapiens
gaccuacagugcuaauugc

SEQ ID NO: 1534559 - RNA, 19 nt, Homo sapiens
gaucggaaacucuccuucu

SEQ ID NO: 1534560 - RNA, 19 nt, Homo sapiens
ccauauauguacccagaac

SEQ ID NO: 1534561 - RNA, 19 nt, Homo sapiens
gcagugcuucuuuaaugga

SEQ ID NO: 1534562 - RNA, 19 nt, Homo sapiens
gaaggagaaggccaacagu

SEQ ID NO: 1534563 - RNA, 19 nt, Homo sapiens
cgacaauccauauauguac

SEQ ID NO: 1534564 - RNA, 19 nt, Homo sapiens
uuaaguugcagacgaaaga

SEQ ID NO: 1534565 - RNA, 19 nt, Homo sapiens
acaagugcuuugggagaaa

SEQ ID NO: 1534566 - RNA, 19 nt, Homo sapiens
ugacuuggaucggaaacuc

SEQ ID NO: 1534567 - RNA, 19 nt, Homo sapiens
gcacaugcuacaccuuucu

SEQ ID NO: 1534568 - RNA, 19 nt, Homo sapiens
gagccucuuccacaaauuc

SEQ ID NO: 1534569 - RNA, 19 nt, Homo sapiens
caauagugccuuaugaaaa

SEQ ID NO: 1534570 - RNA, 19 nt, Homo sapiens
caccacugcugacuuggau

SEQ ID NO: 1534571 - RNA, 19 nt, Homo sapiens
ugacugauaccuuucuuac

SEQ ID NO: 1534572 - RNA, 19 nt, Homo sapiens
uucgguggcuuguggaauu

SEQ ID NO: 1534573 - RNA, 19 nt, Homo sapiens
aauucagccugcuuaaguu

SEQ ID NO: 1534574 - RNA, 19 nt, Homo sapiens
ucccagggcuuccaaacca

SEQ ID NO: 1534575 - RNA, 19 nt, Homo sapiens
aggcgacaauccauauaug

SEQ ID NO: 1534576 - RNA, 19 nt, Homo sapiens
ccaggcgacaauccauaua

SEQ ID NO: 1534577 - RNA, 19 nt, Homo sapiens
gucucuggguugcuucuaa

SEQ ID NO: 1534578 - RNA, 19 nt, Homo sapiens
ggacgguggacaagugcuu

SEQ ID NO: 1534579 - RNA, 19 nt, Homo sapiens
ggaauucagccugcuuaag

SEQ ID NO: 1534580 - RNA, 19 nt, Homo sapiens
gucguugccugaaguccaa

SEQ ID NO: 1534581 - RNA, 19 nt, Homo sapiens
aaaugucguugccugaagu

SEQ ID NO: 1534582 - RNA, 19 nt, Homo sapiens
aaaagggacucuggcauga

SEQ ID NO: 1534583 - RNA, 19 nt, Homo sapiens
cagcagugcccuuaaugca

SEQ ID NO: 1534584 - RNA, 19 nt, Homo sapiens
cagagaggacgguggacaa

SEQ ID NO: 1534585 - RNA, 19 nt, Homo sapiens
acaccuaccacgucggaaa

SEQ ID NO: 1534586 - RNA, 19 nt, Homo sapiens
ugaaaugucguugccugaa

SEQ ID NO: 1534587 - RNA, 19 nt, Homo sapiens
uuccacaaauucccaacuu

SEQ ID NO: 1534588 - RNA, 19 nt, Homo sapiens
ucucuggguugcuucuaau

SEQ ID NO: 1534589 - RNA, 19 nt, Homo sapiens
uuacgagggacuuucuuug

SEQ ID NO: 1534590 - RNA, 19 nt, Homo sapiens
acaagagguugaggagcuu

SEQ ID NO: 1534591 - RNA, 19 nt, Homo sapiens
uccacaaauucccaacuug

SEQ ID NO: 1534592 - RNA, 19 nt, Homo sapiens
acgagggacuuucuuuguc

SEQ ID NO: 1534593 - RNA, 19 nt, Homo sapiens
caggcgacaauccauauau

SEQ ID NO: 1534594 - RNA, 19 nt, Homo sapiens
ccaggaauggaaucccaaa

SEQ ID NO: 1534595 - RNA, 19 nt, Homo sapiens
ugaucacuccucugaaaug

SEQ ID NO: 1534596 - RNA, 19 nt, Homo sapiens
gcccuuaaugcacaugcua

SEQ ID NO: 1534597 - RNA, 19 nt, Homo sapiens
ggcgacaauccauauaugu

SEQ ID NO: 1534598 - RNA, 19 nt, Homo sapiens
cuucuuuaauggagucuuc

SEQ ID NO: 1534599 - RNA, 19 nt, Homo sapiens
ggaaacucuccuucucaca

SEQ ID NO: 1534600 - RNA, 19 nt, Homo sapiens
gugcuaauugcagugauuu

SEQ ID NO: 1534601 - RNA, 19 nt, Homo sapiens
ugaaggagaaggccaacag

SEQ ID NO: 1534602 - RNA, 19 nt, Homo sapiens
uugagccucuuccacaaau

SEQ ID NO: 1534603 - RNA, 19 nt, Homo sapiens
guacccagaacagaguaaa

SEQ ID NO: 1534604 - RNA, 19 nt, Homo sapiens
ucuggaaucuaagggaugu

SEQ ID NO: 1534605 - RNA, 19 nt, Homo sapiens
agugcuaauugcagugauu

SEQ ID NO: 1534606 - RNA, 19 nt, Homo sapiens
gagaagaaauuacaggauu

SEQ ID NO: 1534607 - RNA, 19 nt, Homo sapiens
gaaggucucugcuggaaga

SEQ ID NO: 1534608 - RNA, 19 nt, Homo sapiens
gagaggcccugaagauaga

SEQ ID NO: 1534609 - RNA, 19 nt, Homo sapiens
gcaggaagacagaguguuu

SEQ ID NO: 1534610 - RNA, 19 nt, Homo sapiens
ugagguggcugcagucaaa

SEQ ID NO: 1534611 - RNA, 19 nt, Homo sapiens
gcacaagcagcccaccuua

SEQ ID NO: 1534612 - RNA, 19 nt, Homo sapiens
gcaaugaguacauggguuu

SEQ ID NO: 1534613 - RNA, 19 nt, Homo sapiens
gagagaggcccugaagaua

SEQ ID NO: 1534614 - RNA, 19 nt, Homo sapiens
ggccaaaguuguugaggaa

SEQ ID NO: 1534615 - RNA, 19 nt, Homo sapiens
gacuagagguugcuugaga

SEQ ID NO: 1534616 - RNA, 19 nt, Homo sapiens
ggucagagcauccagaaga

SEQ ID NO: 1534617 - RNA, 19 nt, Homo sapiens
gacuucagcuguccucaaa

SEQ ID NO: 1534618 - RNA, 19 nt, Homo sapiens
gggacuagguucuuugugu

SEQ ID NO: 1534619 - RNA, 19 nt, Homo sapiens
gaacagcacaagcaaagau

SEQ ID NO: 1534620 - RNA, 19 nt, Homo sapiens
gaaagaacagcacaagcaa

SEQ ID NO: 1534621 - RNA, 19 nt, Homo sapiens
gacuggagcucccugaaga

SEQ ID NO: 1534622 - RNA, 19 nt, Homo sapiens
acagugaggucuauuggaa

SEQ ID NO: 1534623 - RNA, 19 nt, Homo sapiens
gaaacagugaggucuauug

SEQ ID NO: 1534624 - RNA, 19 nt, Homo sapiens
gcucuggccucccauguca

SEQ ID NO: 1534625 - RNA, 19 nt, Homo sapiens
gaggucuauuggaaaguua

SEQ ID NO: 1534626 - RNA, 19 nt, Homo sapiens
cuaggugccuccaguuuga

SEQ ID NO: 1534627 - RNA, 19 nt, Homo sapiens
gaauaugggaggauuaucu

SEQ ID NO: 1534628 - RNA, 19 nt, Homo sapiens
agaagaaauuacaggauug

SEQ ID NO: 1534629 - RNA, 19 nt, Homo sapiens
ggaggaggcccuucagcaa

SEQ ID NO: 1534630 - RNA, 19 nt, Homo sapiens
ggagcucccugaaggcaau

SEQ ID NO: 1534631 - RNA, 19 nt, Homo sapiens
cacccuaucuucuccauca

SEQ ID NO: 1534632 - RNA, 19 nt, Homo sapiens
cagaaacagugaggucuau

SEQ ID NO: 1534633 - RNA, 19 nt, Homo sapiens
gcccgugccuacauccuuu

SEQ ID NO: 1534634 - RNA, 19 nt, Homo sapiens
gagacuagagguugcuuga

SEQ ID NO: 1534635 - RNA, 19 nt, Homo sapiens
gaaggagggaguagaugga

SEQ ID NO: 1534636 - RNA, 19 nt, Homo sapiens
ugagagaggcccugaagau

SEQ ID NO: 1534637 - RNA, 19 nt, Homo sapiens
ucccagacccgcucguuua

SEQ ID NO: 1534638 - RNA, 19 nt, Homo sapiens
caaaguuguugaggaagga

SEQ ID NO: 1534639 - RNA, 19 nt, Homo sapiens
ucagacagauucccaugag

SEQ ID NO: 1534640 - RNA, 19 nt, Homo sapiens
ggagugggccugcauucug

SEQ ID NO: 1534641 - RNA, 19 nt, Homo sapiens
cagacccgcucguuuaaca

SEQ ID NO: 1534642 - RNA, 19 nt, Homo sapiens
cggcuaaugcgcucuaauu

SEQ ID NO: 1534643 - RNA, 19 nt, Homo sapiens
gggaugaagggacuuguga

SEQ ID NO: 1534644 - RNA, 19 nt, Homo sapiens
gaaguccgcccagccagaa

SEQ ID NO: 1534645 - RNA, 19 nt, Homo sapiens
gcccgaaggccagaauuaa

SEQ ID NO: 1534646 - RNA, 19 nt, Homo sapiens
gcacuugaggcacggagaa

SEQ ID NO: 1534647 - RNA, 19 nt, Homo sapiens
ugaggucuauuggaaaguu

SEQ ID NO: 1534648 - RNA, 19 nt, Homo sapiens
agaaagaacagcacaagca

SEQ ID NO: 1534649 - RNA, 19 nt, Homo sapiens
gucagagcauccagaagaa

SEQ ID NO: 1534650 - RNA, 19 nt, Homo sapiens
gguuuuagguugaauguga

SEQ ID NO: 1534651 - RNA, 19 nt, Homo sapiens
gcagaaagaacagcacaag

SEQ ID NO: 1534652 - RNA, 19 nt, Homo sapiens
gggcuucccucagcuucaa

SEQ ID NO: 1534653 - RNA, 19 nt, Homo sapiens
guuuaacaguggcuuuaug

SEQ ID NO: 1534654 - RNA, 19 nt, Homo sapiens
gaggaaggagggaguagau

SEQ ID NO: 1534655 - RNA, 19 nt, Homo sapiens
ggccgugucucccucaaag

SEQ ID NO: 1534656 - RNA, 19 nt, Homo sapiens
gggaauaugggaggauuau

SEQ ID NO: 1534657 - RNA, 19 nt, Homo sapiens
ggacaggugacuccuagag

SEQ ID NO: 1534658 - RNA, 19 nt, Homo sapiens
gcucuccucuaucagcaau

SEQ ID NO: 1534659 - RNA, 19 nt, Homo sapiens
uggaaggucucugcuggaa

SEQ ID NO: 1534660 - RNA, 19 nt, Homo sapiens
gcacggcuaaugcgcucua

SEQ ID NO: 1534661 - RNA, 19 nt, Homo sapiens
ucagggaugguagcuauuu

SEQ ID NO: 1534662 - RNA, 19 nt, Homo sapiens
gaugaagggacuugugaag

SEQ ID NO: 1534663 - RNA, 19 nt, Homo sapiens
ccaggguguugcaaacuca

SEQ ID NO: 1534664 - RNA, 19 nt, Homo sapiens
gccagggaccuauuucguu

SEQ ID NO: 1534665 - RNA, 19 nt, Homo sapiens
aauuggaucucucccuuca

SEQ ID NO: 1534666 - RNA, 19 nt, Homo sapiens
gaucuuaguccccaugauu

SEQ ID NO: 1534667 - RNA, 19 nt, Homo sapiens
gucacgcuuugaugaauga

SEQ ID NO: 1534668 - RNA, 19 nt, Homo sapiens
uuugucaucuugaguuuca

SEQ ID NO: 1534669 - RNA, 19 nt, Homo sapiens
cacaagcaaagaucuggua

SEQ ID NO: 1534670 - RNA, 19 nt, Homo sapiens
acuagagguugcuugagaa

SEQ ID NO: 1534671 - RNA, 19 nt, Homo sapiens
gguccaggguguugcaaac

SEQ ID NO: 1534672 - RNA, 19 nt, Homo sapiens
agagaggcccugaagauag

SEQ ID NO: 1534673 - RNA, 19 nt, Homo sapiens
aaagaacagcacaagcaaa

SEQ ID NO: 1534674 - RNA, 19 nt, Homo sapiens
ggaugaagggacuugugaa

SEQ ID NO: 1534675 - RNA, 19 nt, Homo sapiens
gcagcccaccuuacugaug

SEQ ID NO: 1534676 - RNA, 19 nt, Homo sapiens
aagcagcccaccuuacuga

SEQ ID NO: 1534677 - RNA, 19 nt, Homo sapiens
gucugcauguuucuuggua

SEQ ID NO: 1534678 - RNA, 19 nt, Homo sapiens
gaacaggaaauuggaucuc

SEQ ID NO: 1534679 - RNA, 19 nt, Homo sapiens
gaagaaauuacaggauugc

SEQ ID NO: 1534680 - RNA, 19 nt, Homo sapiens
agagguugcuugagaacag

SEQ ID NO: 1534681 - RNA, 19 nt, Homo sapiens
guggaccucugauuuagac

SEQ ID NO: 1534682 - RNA, 19 nt, Homo sapiens
ggugagagaggcccugaag

SEQ ID NO: 1534683 - RNA, 19 nt, Homo sapiens
acagaaacagugaggucua

SEQ ID NO: 1534684 - RNA, 19 nt, Homo sapiens
cgagcgcgagaagaaauua

SEQ ID NO: 1534685 - RNA, 19 nt, Homo sapiens
aagaacagcacaagcaaag

SEQ ID NO: 1534686 - RNA, 19 nt, Homo sapiens
guaagggugcccagucaag

SEQ ID NO: 1534687 - RNA, 19 nt, Homo sapiens
ccgaaggccagaauuaaag

SEQ ID NO: 1534688 - RNA, 19 nt, Homo sapiens
cccgaaggccagaauuaaa

SEQ ID NO: 1534689 - RNA, 19 nt, Homo sapiens
gggagcuggugaggaguga

SEQ ID NO: 1534690 - RNA, 19 nt, Homo sapiens
caaagcaggaagacagagu

SEQ ID NO: 1534691 - RNA, 19 nt, Homo sapiens
ccucagcgucaggaucuua

SEQ ID NO: 1534692 - RNA, 19 nt, Homo sapiens
uuuaacaguggcuuuauga

SEQ ID NO: 1534693 - RNA, 19 nt, Homo sapiens
cgagaagaaauuacaggau

SEQ ID NO: 1534694 - RNA, 19 nt, Homo sapiens
ugucacgcuuugaugaaug

SEQ ID NO: 1534695 - RNA, 19 nt, Homo sapiens
caggcugggauuucacuaa

SEQ ID NO: 1534696 - RNA, 19 nt, Homo sapiens
ugguaagggugcccaguca

SEQ ID NO: 1534697 - RNA, 19 nt, Homo sapiens
ucagugagguuuuguuugg

SEQ ID NO: 1534698 - RNA, 19 nt, Homo sapiens
aagcaaagaucugguaacc

SEQ ID NO: 1534699 - RNA, 19 nt, Homo sapiens
cuuugugucuucugcauca

SEQ ID NO: 1534700 - RNA, 19 nt, Homo sapiens
aaacagugaggucuauugg

SEQ ID NO: 1534701 - RNA, 19 nt, Homo sapiens
cugcacaugcucccggaua

SEQ ID NO: 1534702 - RNA, 19 nt, Homo sapiens
caugauugcugccccuuug

SEQ ID NO: 1534703 - RNA, 19 nt, Homo sapiens
caacggagugggccugcau

SEQ ID NO: 1534704 - RNA, 19 nt, Homo sapiens
caugucagguagggugaga

SEQ ID NO: 1534705 - RNA, 19 nt, Homo sapiens
acaagcagcccaccuuacu

SEQ ID NO: 1534706 - RNA, 19 nt, Homo sapiens
ccagggagcucauuucuaa

SEQ ID NO: 1534707 - RNA, 19 nt, Homo sapiens
gagaagagcugauguaagg

SEQ ID NO: 1534708 - RNA, 19 nt, Homo sapiens
ggaaauggcugugggagaa

SEQ ID NO: 1534709 - RNA, 19 nt, Homo sapiens
gaacgcaguuucuuggauu

SEQ ID NO: 1534710 - RNA, 19 nt, Homo sapiens
ggaaugugcuaaugaaaga

SEQ ID NO: 1534711 - RNA, 19 nt, Homo sapiens
ugaaagagauucuagacaa

SEQ ID NO: 1534712 - RNA, 19 nt, Homo sapiens
gcaaauccuuucaccaguu

SEQ ID NO: 1534713 - RNA, 19 nt, Homo sapiens
aauaagaccuugcuugaga

SEQ ID NO: 1534714 - RNA, 19 nt, Homo sapiens
gcucacagcugucaugaag

SEQ ID NO: 1534715 - RNA, 19 nt, Homo sapiens
gaaggugaaugaaggugaa

SEQ ID NO: 1534716 - RNA, 19 nt, Homo sapiens
aaacagagucuaaacauga

SEQ ID NO: 1534717 - RNA, 19 nt, Homo sapiens
gcacccagcuggcaaugug

SEQ ID NO: 1534718 - RNA, 19 nt, Homo sapiens
caaauccuuucaccaguuu

SEQ ID NO: 1534719 - RNA, 19 nt, Homo sapiens
ggacuugcccuucaugcua

SEQ ID NO: 1534720 - RNA, 19 nt, Homo sapiens
gaagaaauagugauugaca

SEQ ID NO: 1534721 - RNA, 19 nt, Homo sapiens
ggacaggaguauaguugug

SEQ ID NO: 1534722 - RNA, 19 nt, Homo sapiens
guucuguccuaucuucuua

SEQ ID NO: 1534723 - RNA, 19 nt, Homo sapiens
acacugagcugcagaaggu

SEQ ID NO: 1534724 - RNA, 19 nt, Homo sapiens
gaaagagauucuagacaac

SEQ ID NO: 1534725 - RNA, 19 nt, Homo sapiens
caaagggucugaggcaguu

SEQ ID NO: 1534726 - RNA, 19 nt, Homo sapiens
cuguugagcuaaagaauaa

SEQ ID NO: 1534727 - RNA, 19 nt, Homo sapiens
gaagguuccuguaaauagg

SEQ ID NO: 1534728 - RNA, 19 nt, Homo sapiens
uaaacagagucuaaacaug

SEQ ID NO: 1534729 - RNA, 19 nt, Homo sapiens
ggacccaucauacgaauau

SEQ ID NO: 1534730 - RNA, 19 nt, Homo sapiens
ggaccuguuuggcccauga

SEQ ID NO: 1534731 - RNA, 19 nt, Homo sapiens
ggccaaggguacugaaguu

SEQ ID NO: 1534732 - RNA, 19 nt, Homo sapiens
gaacccaguuuaugacacu

SEQ ID NO: 1534733 - RNA, 19 nt, Homo sapiens
gaagaagaaauagugauug

SEQ ID NO: 1534734 - RNA, 19 nt, Homo sapiens
gagcucauuucuaaaccaa

SEQ ID NO: 1534735 - RNA, 19 nt, Homo sapiens
cugcagcucucccacagua

SEQ ID NO: 1534736 - RNA, 19 nt, Homo sapiens
ggaacgcaguuucuuggau

SEQ ID NO: 1534737 - RNA, 19 nt, Homo sapiens
gagcagaucauuccucucu

SEQ ID NO: 1534738 - RNA, 19 nt, Homo sapiens
cagaugggcugggcucuug

SEQ ID NO: 1534739 - RNA, 19 nt, Homo sapiens
guuggaaugugcuaaugaa

SEQ ID NO: 1534740 - RNA, 19 nt, Homo sapiens
agaauaagaccuugcuuga

SEQ ID NO: 1534741 - RNA, 19 nt, Homo sapiens
caaggguacugaaguuagu

SEQ ID NO: 1534742 - RNA, 19 nt, Homo sapiens
ccaugaacccaguuuauga

SEQ ID NO: 1534743 - RNA, 19 nt, Homo sapiens
ucacagcugucaugaagag

SEQ ID NO: 1534744 - RNA, 19 nt, Homo sapiens
agacaacgauggguggaaa

SEQ ID NO: 1534745 - RNA, 19 nt, Homo sapiens
gaacuauggcuacgucuac

SEQ ID NO: 1534746 - RNA, 19 nt, Homo sapiens
agagaucagugacucaaug

SEQ ID NO: 1534747 - RNA, 19 nt, Homo sapiens
gcucauuucuaaaccaagu

SEQ ID NO: 1534748 - RNA, 19 nt, Homo sapiens
gcgagaagagcugauguaa

SEQ ID NO: 1534749 - RNA, 19 nt, Homo sapiens
gagcaugacauucccaaag

SEQ ID NO: 1534750 - RNA, 19 nt, Homo sapiens
gacuugcccuucaugcuau

SEQ ID NO: 1534751 - RNA, 19 nt, Homo sapiens
gggagccuguugagcuaaa

SEQ ID NO: 1534752 - RNA, 19 nt, Homo sapiens
gcucaugccggcuaggauu

SEQ ID NO: 1534753 - RNA, 19 nt, Homo sapiens
gccucuagcucccagcauu

SEQ ID NO: 1534754 - RNA, 19 nt, Homo sapiens
ggaggaacccauugcucuu

SEQ ID NO: 1534755 - RNA, 19 nt, Homo sapiens
gacuucacguggcuucuga

SEQ ID NO: 1534756 - RNA, 19 nt, Homo sapiens
gcaguuucuuggauucaca

SEQ ID NO: 1534757 - RNA, 19 nt, Homo sapiens
gcgagaagaacauggacuu

SEQ ID NO: 1534758 - RNA, 19 nt, Homo sapiens
gcacugagcauggccuaag

SEQ ID NO: 1534759 - RNA, 19 nt, Homo sapiens
ucgcugcucacgucucuua

SEQ ID NO: 1534760 - RNA, 19 nt, Homo sapiens
gcagucgucuguggugaag

SEQ ID NO: 1534761 - RNA, 19 nt, Homo sapiens
gcccaugaacccaguuuau

SEQ ID NO: 1534762 - RNA, 19 nt, Homo sapiens
uguccuaucuucuuaacuc

SEQ ID NO: 1534763 - RNA, 19 nt, Homo sapiens
ccuguugagcuaaagaaua

SEQ ID NO: 1534764 - RNA, 19 nt, Homo sapiens
gcuaugaucggguucucuu

SEQ ID NO: 1534765 - RNA, 19 nt, Homo sapiens
gccaaggguacugaaguua

SEQ ID NO: 1534766 - RNA, 19 nt, Homo sapiens
caagagaucagugacucaa

SEQ ID NO: 1534767 - RNA, 19 nt, Homo sapiens
gaagaggaugggaccuguu

SEQ ID NO: 1534768 - RNA, 19 nt, Homo sapiens
gaauaagaccuugcuugag

SEQ ID NO: 1534769 - RNA, 19 nt, Homo sapiens
gcucagcuccuacuuccau

SEQ ID NO: 1534770 - RNA, 19 nt, Homo sapiens
ccauugcucuuccccauuu

SEQ ID NO: 1534771 - RNA, 19 nt, Homo sapiens
ggcgagaagagcugaugua

SEQ ID NO: 1534772 - RNA, 19 nt, Homo sapiens
caauguugguguguguuug

SEQ ID NO: 1534773 - RNA, 19 nt, Homo sapiens
auacgaauaugaacacacu

SEQ ID NO: 1534774 - RNA, 19 nt, Homo sapiens
ggagcucauuucuaaacca

SEQ ID NO: 1534775 - RNA, 19 nt, Homo sapiens
ggucugaggcaguuguuca

SEQ ID NO: 1534776 - RNA, 19 nt, Homo sapiens
gcuaaugaaagagauucua

SEQ ID NO: 1534777 - RNA, 19 nt, Homo sapiens
ccaugucaaucggaccuuu

SEQ ID NO: 1534778 - RNA, 19 nt, Homo sapiens
ccuguucuguccuaucuuc

SEQ ID NO: 1534779 - RNA, 19 nt, Homo sapiens
cagagucuaaacaugauuu

SEQ ID NO: 1534780 - RNA, 19 nt, Homo sapiens
auaagaccuugcuugagaa

SEQ ID NO: 1534781 - RNA, 19 nt, Homo sapiens
ucaauguugguguguguuu

SEQ ID NO: 1534782 - RNA, 19 nt, Homo sapiens
cccuugaucuuuguaaaug

SEQ ID NO: 1534783 - RNA, 19 nt, Homo sapiens
caguuucccuuuccugaag

SEQ ID NO: 1534784 - RNA, 19 nt, Homo sapiens
aagaggaugggaccuguuu

SEQ ID NO: 1534785 - RNA, 19 nt, Homo sapiens
ugaggaacgcaguuucuug

SEQ ID NO: 1534786 - RNA, 19 nt, Homo sapiens
gcacuggcgagaagaacau

SEQ ID NO: 1534787 - RNA, 19 nt, Homo sapiens
ccugauaguucccagaaaa

SEQ ID NO: 1534788 - RNA, 19 nt, Homo sapiens
gaggaacccauugcucuuc

SEQ ID NO: 1534789 - RNA, 19 nt, Homo sapiens
ugucaauguuggugugugu

SEQ ID NO: 1534790 - RNA, 19 nt, Homo sapiens
cugcugagcguccuguaaa

SEQ ID NO: 1534791 - RNA, 19 nt, Homo sapiens
ccaaggguacugaaguuag

SEQ ID NO: 1534792 - RNA, 19 nt, Homo sapiens
cgucgccgauuacuacauc

SEQ ID NO: 1534793 - RNA, 19 nt, Homo sapiens
ggguuggaaugugcuaaug

SEQ ID NO: 1534794 - RNA, 19 nt, Homo sapiens
cggcuaggauuggguuuua

SEQ ID NO: 1534795 - RNA, 19 nt, Homo sapiens
gaggaugggaccuguuugg

SEQ ID NO: 1534796 - RNA, 19 nt, Homo sapiens
gagagcggcaaguguguca

SEQ ID NO: 1534797 - RNA, 19 nt, Homo sapiens
gguuggaaugugcuaauga

SEQ ID NO: 1534798 - RNA, 19 nt, Homo sapiens
aacauggacuugcccuuca

SEQ ID NO: 1534799 - RNA, 19 nt, Homo sapiens
cuucugagcaggugugguu

SEQ ID NO: 1534800 - RNA, 19 nt, Homo sapiens
cgucucuuaugcugguuaa

SEQ ID NO: 1534801 - RNA, 19 nt, Homo sapiens
gcccugauaguucccagaa

SEQ ID NO: 1534802 - RNA, 19 nt, Homo sapiens
gcagaaggugaaugaaggu

SEQ ID NO: 1534803 - RNA, 19 nt, Homo sapiens
cagcugucaugaagaggau

SEQ ID NO: 1534804 - RNA, 19 nt, Homo sapiens
cuaaugaaagagauucuag

SEQ ID NO: 1534805 - RNA, 19 nt, Homo sapiens
gccagggagcucauuucua

SEQ ID NO: 1534806 - RNA, 19 nt, Homo sapiens
ggaguuagguggcuugaua

SEQ ID NO: 1534807 - RNA, 19 nt, Homo sapiens
gaagagagaugggcgauau

SEQ ID NO: 1534808 - RNA, 19 nt, Homo sapiens
gaggagggcuugcuuaaga

SEQ ID NO: 1534809 - RNA, 19 nt, Homo sapiens
aaagaaaucuggagaagug

SEQ ID NO: 1534810 - RNA, 19 nt, Homo sapiens
ggaaauagcgacucaguau

SEQ ID NO: 1534811 - RNA, 19 nt, Homo sapiens
caagaaauuuguggugaua

SEQ ID NO: 1534812 - RNA, 19 nt, Homo sapiens
gaagcagaaucacuuaugu

SEQ ID NO: 1534813 - RNA, 19 nt, Homo sapiens
ugacuuggcugaagaaaca

SEQ ID NO: 1534814 - RNA, 19 nt, Homo sapiens
uaagauaugugguuguguu

SEQ ID NO: 1534815 - RNA, 19 nt, Homo sapiens
gaaggaagcagaaucacuu

SEQ ID NO: 1534816 - RNA, 19 nt, Homo sapiens
caugagaaguaguguguuu

SEQ ID NO: 1534817 - RNA, 19 nt, Homo sapiens
uaaugaagauccagaagga

SEQ ID NO: 1534818 - RNA, 19 nt, Homo sapiens
uaugcuaccugauuuguuu

SEQ ID NO: 1534819 - RNA, 19 nt, Homo sapiens
ccaaacaaccgacuccuuu

SEQ ID NO: 1534820 - RNA, 19 nt, Homo sapiens
ccaguaugcuaccugauuu

SEQ ID NO: 1534821 - RNA, 19 nt, Homo sapiens
uuagguggcuugauaauag

SEQ ID NO: 1534822 - RNA, 19 nt, Homo sapiens
gggcaaaccuaccuuaaaa

SEQ ID NO: 1534823 - RNA, 19 nt, Homo sapiens
guauuuggauuaugacugu

SEQ ID NO: 1534824 - RNA, 19 nt, Homo sapiens
gaaaauguaucugcgauga

SEQ ID NO: 1534825 - RNA, 19 nt, Homo sapiens
gcacaagccaacuuaugaa

SEQ ID NO: 1534826 - RNA, 19 nt, Homo sapiens
gaaauuucaggaaggauga

SEQ ID NO: 1534827 - RNA, 19 nt, Homo sapiens
ggaagcagaaucacuuaug

SEQ ID NO: 1534828 - RNA, 19 nt, Homo sapiens
gcaacagacaucaaaauua

SEQ ID NO: 1534829 - RNA, 19 nt, Homo sapiens
gcaaaccuaccuuaaaaua

SEQ ID NO: 1534830 - RNA, 19 nt, Homo sapiens
gaugaucgaggagguauuu

SEQ ID NO: 1534831 - RNA, 19 nt, Homo sapiens
caacagacaucaaaauuac

SEQ ID NO: 1534832 - RNA, 19 nt, Homo sapiens
gaaaagggcuucgcacaag

SEQ ID NO: 1534833 - RNA, 19 nt, Homo sapiens
ccagcagccuuaaugaaga

SEQ ID NO: 1534834 - RNA, 19 nt, Homo sapiens
gggauuggcuccgcguuug

SEQ ID NO: 1534835 - RNA, 19 nt, Homo sapiens
aggaugaucauuccaguua

SEQ ID NO: 1534836 - RNA, 19 nt, Homo sapiens
gaugaucauuccaguuagu

SEQ ID NO: 1534837 - RNA, 19 nt, Homo sapiens
ccaagaaauuuguggugau

SEQ ID NO: 1534838 - RNA, 19 nt, Homo sapiens
gaucauuccaguuaguuug

SEQ ID NO: 1534839 - RNA, 19 nt, Homo sapiens
agacuuugguugcuguauu

SEQ ID NO: 1534840 - RNA, 19 nt, Homo sapiens
gauuggauguggucuugau

SEQ ID NO: 1534841 - RNA, 19 nt, Homo sapiens
cagauugucgggacuauga

SEQ ID NO: 1534842 - RNA, 19 nt, Homo sapiens
ggagggcuugcuuaagaua

SEQ ID NO: 1534843 - RNA, 19 nt, Homo sapiens
ugagaaguaguguguuuaa

SEQ ID NO: 1534844 - RNA, 19 nt, Homo sapiens
gacuuugguugcuguauuc

SEQ ID NO: 1534845 - RNA, 19 nt, Homo sapiens
aaauagcgacucaguauca

SEQ ID NO: 1534846 - RNA, 19 nt, Homo sapiens
ggagguauuugaggcaaca

SEQ ID NO: 1534847 - RNA, 19 nt, Homo sapiens
gaagucucauugucugaag

SEQ ID NO: 1534848 - RNA, 19 nt, Homo sapiens
ccagaaggaagcagaauca

SEQ ID NO: 1534849 - RNA, 19 nt, Homo sapiens
uagaggcaaugaagucuca

SEQ ID NO: 1534850 - RNA, 19 nt, Homo sapiens
gaaauagcgacucaguauc

SEQ ID NO: 1534851 - RNA, 19 nt, Homo sapiens
aaauguaucugcgaugauc

SEQ ID NO: 1534852 - RNA, 19 nt, Homo sapiens
agagaaauuucaggaagga

SEQ ID NO: 1534853 - RNA, 19 nt, Homo sapiens
uaacaagacagacuuuggu

SEQ ID NO: 1534854 - RNA, 19 nt, Homo sapiens
gcugaagaaacacuuaaau

SEQ ID NO: 1534855 - RNA, 19 nt, Homo sapiens
gguucuacuucucugcuuu

SEQ ID NO: 1534856 - RNA, 19 nt, Homo sapiens
gaaguggcuguucugaaga

SEQ ID NO: 1534857 - RNA, 19 nt, Homo sapiens
ucaggaaggaugaucauuc

SEQ ID NO: 1534858 - RNA, 19 nt, Homo sapiens
cagcauugguucuacuucu

SEQ ID NO: 1534859 - RNA, 19 nt, Homo sapiens
guuagguggcuugauaaua

SEQ ID NO: 1534860 - RNA, 19 nt, Homo sapiens
cagcagccuuaaugaagau

SEQ ID NO: 1534861 - RNA, 19 nt, Homo sapiens
ggaugaucauuccaguuag

SEQ ID NO: 1534862 - RNA, 19 nt, Homo sapiens
ugaggcaacagacaucaaa

SEQ ID NO: 1534863 - RNA, 19 nt, Homo sapiens
caaaagaaaucuggagaag

SEQ ID NO: 1534864 - RNA, 19 nt, Homo sapiens
gaguuagguggcuugauaa

SEQ ID NO: 1534865 - RNA, 19 nt, Homo sapiens
gaucgucugcaaugggaaa

SEQ ID NO: 1534866 - RNA, 19 nt, Homo sapiens
ugaagaauggagucacuga

SEQ ID NO: 1534867 - RNA, 19 nt, Homo sapiens
cgcacaagccaacuuauga

SEQ ID NO: 1534868 - RNA, 19 nt, Homo sapiens
ccaguuaguuuggcauuuu

SEQ ID NO: 1534869 - RNA, 19 nt, Homo sapiens
guugcuguauucaaguauu

SEQ ID NO: 1534870 - RNA, 19 nt, Homo sapiens
gccaacuuaugaaaacuua

SEQ ID NO: 1534871 - RNA, 19 nt, Homo sapiens
caaacaaccgacuccuuuc

SEQ ID NO: 1534872 - RNA, 19 nt, Homo sapiens
gccagcagccuuaaugaag

SEQ ID NO: 1534873 - RNA, 19 nt, Homo sapiens
gagaaguaguguguuuaac

SEQ ID NO: 1534874 - RNA, 19 nt, Homo sapiens
uggcuguucugaagagaga

SEQ ID NO: 1534875 - RNA, 19 nt, Homo sapiens
ucgcaugggcgcugggaua

SEQ ID NO: 1534876 - RNA, 19 nt, Homo sapiens
cuuaagauaugugguugug

SEQ ID NO: 1534877 - RNA, 19 nt, Homo sapiens
auccuuaugucaucagauu

SEQ ID NO: 1534878 - RNA, 19 nt, Homo sapiens
gguguuauccuuaugucau

SEQ ID NO: 1534879 - RNA, 19 nt, Homo sapiens
ggccagcagccuuaaugaa

SEQ ID NO: 1534880 - RNA, 19 nt, Homo sapiens
cacaagccaacuuaugaaa

SEQ ID NO: 1534881 - RNA, 19 nt, Homo sapiens
cgacuccuuuccaggugaa

SEQ ID NO: 1534882 - RNA, 19 nt, Homo sapiens
cgggcaaaccuaccuuaaa

SEQ ID NO: 1534883 - RNA, 19 nt, Homo sapiens
gaguuuagaggcaaugaag

SEQ ID NO: 1534884 - RNA, 19 nt, Homo sapiens
uggaggagggcuugcuuaa

SEQ ID NO: 1534885 - RNA, 19 nt, Homo sapiens
guggaggagggcuugcuua

SEQ ID NO: 1534886 - RNA, 19 nt, Homo sapiens
aggauuggauguggucuug

SEQ ID NO: 1534887 - RNA, 19 nt, Homo sapiens
cuagguggcagcauugguu

SEQ ID NO: 1534888 - RNA, 19 nt, Homo sapiens
gggcuugcuuaagauaugu

SEQ ID NO: 1534889 - RNA, 19 nt, Homo sapiens
gaagggugacuuggcugaa

SEQ ID NO: 1534890 - RNA, 19 nt, Homo sapiens
aaggaagcagaaucacuua

SEQ ID NO: 1534891 - RNA, 19 nt, Homo sapiens
ugguugcuguauucaagua

SEQ ID NO: 1534892 - RNA, 19 nt, Homo sapiens
gaucgaggagguauuugag

SEQ ID NO: 1534893 - RNA, 19 nt, Homo sapiens
ugucgggacuaugaccuuu

SEQ ID NO: 1534894 - RNA, 19 nt, Homo sapiens
gauccagaaggaagcagaa

SEQ ID NO: 1534895 - RNA, 19 nt, Homo sapiens
aauaggcagaggaaaguuu

SEQ ID NO: 1534896 - RNA, 19 nt, Homo sapiens
gguggcagcauugguucua

SEQ ID NO: 1534897 - RNA, 19 nt, Homo sapiens
gcagggaaaccagauuguc

SEQ ID NO: 1534898 - RNA, 19 nt, Homo sapiens
aaaguuucaugagaaguag

SEQ ID NO: 1534899 - RNA, 19 nt, Homo sapiens
ucugaaccagugaacauuu

SEQ ID NO: 1534900 - RNA, 19 nt, Homo sapiens
cuucgcacaagccaacuua

SEQ ID NO: 1534901 - RNA, 19 nt, Homo sapiens
guguuauccuuaugucauc

SEQ ID NO: 1534902 - RNA, 19 nt, Homo sapiens
ggaggagggcuugcuuaag

SEQ ID NO: 1534903 - RNA, 19 nt, Homo sapiens
ccaggugaagggugacuug

SEQ ID NO: 1534904 - RNA, 19 nt, Homo sapiens
ugaucgaggagguauuuga

SEQ ID NO: 1534905 - RNA, 19 nt, Homo sapiens
uggaaauagcgacucagua

SEQ ID NO: 1534906 - RNA, 19 nt, Homo sapiens
gaucacaacuggaggaaga

SEQ ID NO: 1534907 - RNA, 19 nt, Homo sapiens
ggaaauauccauccaugaa

SEQ ID NO: 1534908 - RNA, 19 nt, Homo sapiens
gcaaguagcccuaggaauc

SEQ ID NO: 1534909 - RNA, 19 nt, Homo sapiens
gaaaucacccagcggcaua

SEQ ID NO: 1534910 - RNA, 19 nt, Homo sapiens
gggagcaacuagugacuuu

SEQ ID NO: 1534911 - RNA, 19 nt, Homo sapiens
ggucccaacuccucucuaa

SEQ ID NO: 1534912 - RNA, 19 nt, Homo sapiens
ugacugaagugacaaugaa

SEQ ID NO: 1534913 - RNA, 19 nt, Homo sapiens
caacauccuuccugugguu

SEQ ID NO: 1534914 - RNA, 19 nt, Homo sapiens
gggagaaaguauaaaugaa

SEQ ID NO: 1534915 - RNA, 19 nt, Homo sapiens
uaccaucgaugacaacaaa

SEQ ID NO: 1534916 - RNA, 19 nt, Homo sapiens
ucaaggcacuggcagauuc

SEQ ID NO: 1534917 - RNA, 19 nt, Homo sapiens
gaaauauccauccaugaau

SEQ ID NO: 1534918 - RNA, 19 nt, Homo sapiens
ccacacagccagaaacaga

SEQ ID NO: 1534919 - RNA, 19 nt, Homo sapiens
gaagcuacagaaagaguuu

SEQ ID NO: 1534920 - RNA, 19 nt, Homo sapiens
ggacaaagccaaggugaag

SEQ ID NO: 1534921 - RNA, 19 nt, Homo sapiens
ggacuguguuucuuuaagg

SEQ ID NO: 1534922 - RNA, 19 nt, Homo sapiens
gagcaacuagugacuuuga

SEQ ID NO: 1534923 - RNA, 19 nt, Homo sapiens
ggagaaaguauaaaugaag

SEQ ID NO: 1534924 - RNA, 19 nt, Homo sapiens
gcugggaaguccaagauca

SEQ ID NO: 1534925 - RNA, 19 nt, Homo sapiens
gaagaaaagagaagguaua

SEQ ID NO: 1534926 - RNA, 19 nt, Homo sapiens
caacuccucucuaacaaaa

SEQ ID NO: 1534927 - RNA, 19 nt, Homo sapiens
gcaacuagugacuuugauu

SEQ ID NO: 1534928 - RNA, 19 nt, Homo sapiens
ugaaauagcaccaucaaaa

SEQ ID NO: 1534929 - RNA, 19 nt, Homo sapiens
caucaucgccuucaucaag

SEQ ID NO: 1534930 - RNA, 19 nt, Homo sapiens
ggaaugagagaggaaaugu

SEQ ID NO: 1534931 - RNA, 19 nt, Homo sapiens
agaggaugcucacaccaaa

SEQ ID NO: 1534932 - RNA, 19 nt, Homo sapiens
gaagccauuucuccagaca

SEQ ID NO: 1534933 - RNA, 19 nt, Homo sapiens
gaagcaagaaguaaaauug

SEQ ID NO: 1534934 - RNA, 19 nt, Homo sapiens
guguagaucuuuauaagcu

SEQ ID NO: 1534935 - RNA, 19 nt, Homo sapiens
ugacuuugauucccaugga

SEQ ID NO: 1534936 - RNA, 19 nt, Homo sapiens
caacuagugacuuugauuc

SEQ ID NO: 1534937 - RNA, 19 nt, Homo sapiens
gaaugaagcacagaugaag

SEQ ID NO: 1534938 - RNA, 19 nt, Homo sapiens
gaauuaugccagcaagaau

SEQ ID NO: 1534939 - RNA, 19 nt, Homo sapiens
gaaauagcaccaucaaaau

SEQ ID NO: 1534940 - RNA, 19 nt, Homo sapiens
ggacaucaucgccuucauc

SEQ ID NO: 1534941 - RNA, 19 nt, Homo sapiens
gaugacaacaaacagauuc

SEQ ID NO: 1534942 - RNA, 19 nt, Homo sapiens
ugaauuaugccagcaagaa

SEQ ID NO: 1534943 - RNA, 19 nt, Homo sapiens
gaagacagcauccccaaga

SEQ ID NO: 1534944 - RNA, 19 nt, Homo sapiens
uaaauucuccagcagugaa

SEQ ID NO: 1534945 - RNA, 19 nt, Homo sapiens
caaggugaagcuacagaaa

SEQ ID NO: 1534946 - RNA, 19 nt, Homo sapiens
gagaagguauaaaacaaug

SEQ ID NO: 1534947 - RNA, 19 nt, Homo sapiens
cgaugucugugaugugaau

SEQ ID NO: 1534948 - RNA, 19 nt, Homo sapiens
aggugaagcuacagaaaga

SEQ ID NO: 1534949 - RNA, 19 nt, Homo sapiens
ugggagaaaguauaaauga

SEQ ID NO: 1534950 - RNA, 19 nt, Homo sapiens
ugacagcguuaccaucgau

SEQ ID NO: 1534951 - RNA, 19 nt, Homo sapiens
ccaggaggcuuuugaaauc

SEQ ID NO: 1534952 - RNA, 19 nt, Homo sapiens
caagaaugaagcacagaug

SEQ ID NO: 1534953 - RNA, 19 nt, Homo sapiens
gcaagaaugaagcacagau

SEQ ID NO: 1534954 - RNA, 19 nt, Homo sapiens
gggacuguguuucuuuaag

SEQ ID NO: 1534955 - RNA, 19 nt, Homo sapiens
ugaugugaaugccaggaaa

SEQ ID NO: 1534956 - RNA, 19 nt, Homo sapiens
gcccugggagaaaguauaa

SEQ ID NO: 1534957 - RNA, 19 nt, Homo sapiens
gacaucaucgccuucauca

SEQ ID NO: 1534958 - RNA, 19 nt, Homo sapiens
gaucaaggcacuggcagau

SEQ ID NO: 1534959 - RNA, 19 nt, Homo sapiens
cagaaagaguuugaagucu

SEQ ID NO: 1534960 - RNA, 19 nt, Homo sapiens
acagaaagaguuugaaguc

SEQ ID NO: 1534961 - RNA, 19 nt, Homo sapiens
ccaaggcccugggagaaag

SEQ ID NO: 1534962 - RNA, 19 nt, Homo sapiens
caucugacucccagcauga

SEQ ID NO: 1534963 - RNA, 19 nt, Homo sapiens
guagugacguuuuguguag

SEQ ID NO: 1534964 - RNA, 19 nt, Homo sapiens
ggcuucagcucacuguugu

SEQ ID NO: 1534965 - RNA, 19 nt, Homo sapiens
uugagaaugugaaauagca

SEQ ID NO: 1534966 - RNA, 19 nt, Homo sapiens
gacuguguuucuuuaagga

SEQ ID NO: 1534967 - RNA, 19 nt, Homo sapiens
agaaugaagcacagaugaa

SEQ ID NO: 1534968 - RNA, 19 nt, Homo sapiens
aaugagagaggaaauguca

SEQ ID NO: 1534969 - RNA, 19 nt, Homo sapiens
gaucacacgaagccauuuc

SEQ ID NO: 1534970 - RNA, 19 nt, Homo sapiens
gagaagcugcgaucacaac

SEQ ID NO: 1534971 - RNA, 19 nt, Homo sapiens
aggagaagcugcgaucaca

SEQ ID NO: 1534972 - RNA, 19 nt, Homo sapiens
gauucgaugucugugaugu

SEQ ID NO: 1534973 - RNA, 19 nt, Homo sapiens
gcguuaccaucgaugacaa

SEQ ID NO: 1534974 - RNA, 19 nt, Homo sapiens
cagaggaugcucacaccaa

SEQ ID NO: 1534975 - RNA, 19 nt, Homo sapiens
aagaaugaagcacagauga

SEQ ID NO: 1534976 - RNA, 19 nt, Homo sapiens
gcacuggcagauucgaugu

SEQ ID NO: 1534977 - RNA, 19 nt, Homo sapiens
ccaacuccucucuaacaaa

SEQ ID NO: 1534978 - RNA, 19 nt, Homo sapiens
caaguagcccuaggaaucu

SEQ ID NO: 1534979 - RNA, 19 nt, Homo sapiens
uaaaauuggucaccugaag

SEQ ID NO: 1534980 - RNA, 19 nt, Homo sapiens
uuaauaggauccugaugcu

SEQ ID NO: 1534981 - RNA, 19 nt, Homo sapiens
aagccaaggugaagcuaca

SEQ ID NO: 1534982 - RNA, 19 nt, Homo sapiens
gccaaggcccugggagaaa

SEQ ID NO: 1534983 - RNA, 19 nt, Homo sapiens
uaggaugccaggaggcuuu

SEQ ID NO: 1534984 - RNA, 19 nt, Homo sapiens
cagacggacucggacauca

SEQ ID NO: 1534985 - RNA, 19 nt, Homo sapiens
ccaaggugaagcuacagaa

SEQ ID NO: 1534986 - RNA, 19 nt, Homo sapiens
ggagaagcugcgaucacaa

SEQ ID NO: 1534987 - RNA, 19 nt, Homo sapiens
cccaacuccucucuaacaa

SEQ ID NO: 1534988 - RNA, 19 nt, Homo sapiens
guaaauucuccagcaguga

SEQ ID NO: 1534989 - RNA, 19 nt, Homo sapiens
cagcaaguagcccuaggaa

SEQ ID NO: 1534990 - RNA, 19 nt, Homo sapiens
gcacuugcagcugcucaug

SEQ ID NO: 1534991 - RNA, 19 nt, Homo sapiens
cugaagugacaaugaaauu

SEQ ID NO: 1534992 - RNA, 19 nt, Homo sapiens
cggcauauacagcaaguag

SEQ ID NO: 1534993 - RNA, 19 nt, Homo sapiens
uuggucaccugaaggaaga

SEQ ID NO: 1534994 - RNA, 19 nt, Homo sapiens
gaagcugcgaucacaacug

SEQ ID NO: 1534995 - RNA, 19 nt, Homo sapiens
cagaccagcaggaggagaa

SEQ ID NO: 1534996 - RNA, 19 nt, Homo sapiens
gugaaauagcaccaucaaa

SEQ ID NO: 1534997 - RNA, 19 nt, Homo sapiens
aggcaaggccagagugcua

SEQ ID NO: 1534998 - RNA, 19 nt, Homo sapiens
gaaugagagaggaaauguc

SEQ ID NO: 1534999 - RNA, 19 nt, Homo sapiens
cuacagaaagaguuugaag

SEQ ID NO: 1535000 - RNA, 19 nt, Homo sapiens
gcccuaggaaucucggaaa

SEQ ID NO: 1535001 - RNA, 19 nt, Homo sapiens
guauaaaugaagcaagaag

SEQ ID NO: 1535002 - RNA, 19 nt, Homo sapiens
cgaugacaacaaacagauu

SEQ ID NO: 1535003 - RNA, 19 nt, Homo sapiens
ggcccugggagaaaguaua

SEQ ID NO: 1535004 - RNA, 19 nt, Homo sapiens
aaauuggucaccugaagga

SEQ ID NO: 1535005 - RNA, 19 nt, Homo sapiens
ucacccagcggcauauaca

SEQ ID NO: 1535006 - RNA, 19 nt, Homo sapiens
gcacugagaucacaccaaa

SEQ ID NO: 1535007 - RNA, 19 nt, Homo sapiens
ucaagacgcugaguuauuu

SEQ ID NO: 1535008 - RNA, 19 nt, Homo sapiens
gcagugaacuuaugacuac

SEQ ID NO: 1535009 - RNA, 19 nt, Homo sapiens
ccauguggaucaucacuua

SEQ ID NO: 1535010 - RNA, 19 nt, Homo sapiens
agacauguaucucaucuuu

SEQ ID NO: 1535011 - RNA, 19 nt, Homo sapiens
uuacagauguguuguguga

SEQ ID NO: 1535012 - RNA, 19 nt, Homo sapiens
caucaaagaucacuucaag

SEQ ID NO: 1535013 - RNA, 19 nt, Homo sapiens
gcaaacgucguaauacaaa

SEQ ID NO: 1535014 - RNA, 19 nt, Homo sapiens
aggcagagcuuccacacua

SEQ ID NO: 1535015 - RNA, 19 nt, Homo sapiens
acauguaucucaucuuuga

SEQ ID NO: 1535016 - RNA, 19 nt, Homo sapiens
ccacaagaauaucuacaug

SEQ ID NO: 1535017 - RNA, 19 nt, Homo sapiens
gcaucuacguggacucaaa

SEQ ID NO: 1535018 - RNA, 19 nt, Homo sapiens
ucaacgggaucaucaaaga

SEQ ID NO: 1535019 - RNA, 19 nt, Homo sapiens
caucuucucuguccuuaau

SEQ ID NO: 1535020 - RNA, 19 nt, Homo sapiens
agacacacauuugcuauga

SEQ ID NO: 1535021 - RNA, 19 nt, Homo sapiens
gcucaucaacuucuccaua

SEQ ID NO: 1535022 - RNA, 19 nt, Homo sapiens
caauagaugucugcugaga

SEQ ID NO: 1535023 - RNA, 19 nt, Homo sapiens
gaagacacacauuugcuau

SEQ ID NO: 1535024 - RNA, 19 nt, Homo sapiens
ccaaaucucacacauguuc

SEQ ID NO: 1535025 - RNA, 19 nt, Homo sapiens
uaauacaaauccucaccaa

SEQ ID NO: 1535026 - RNA, 19 nt, Homo sapiens
cuuacgagcucaucaacuu

SEQ ID NO: 1535027 - RNA, 19 nt, Homo sapiens
agucggagcuagucacuug

SEQ ID NO: 1535028 - RNA, 19 nt, Homo sapiens
uacaagagacgaauuucua

SEQ ID NO: 1535029 - RNA, 19 nt, Homo sapiens
gcugcuuccuccuuuauug

SEQ ID NO: 1535030 - RNA, 19 nt, Homo sapiens
guagauacacaauagaugu

SEQ ID NO: 1535031 - RNA, 19 nt, Homo sapiens
gcaggaggucucagcauga

SEQ ID NO: 1535032 - RNA, 19 nt, Homo sapiens
gagccagggcaauauaauu

SEQ ID NO: 1535033 - RNA, 19 nt, Homo sapiens
uaucucaucuuugaacaga

SEQ ID NO: 1535034 - RNA, 19 nt, Homo sapiens
ugucagggcuuuugaguuu

SEQ ID NO: 1535035 - RNA, 19 nt, Homo sapiens
gggugcaaguaacaucaua

SEQ ID NO: 1535036 - RNA, 19 nt, Homo sapiens
aagcaugcauacaaccuuu

SEQ ID NO: 1535037 - RNA, 19 nt, Homo sapiens
guagacauguaucucaucu

SEQ ID NO: 1535038 - RNA, 19 nt, Homo sapiens
cuuccacacuagcauauuu

SEQ ID NO: 1535039 - RNA, 19 nt, Homo sapiens
gagcuuccacacuagcaua

SEQ ID NO: 1535040 - RNA, 19 nt, Homo sapiens
caucuacauugucuggauu

SEQ ID NO: 1535041 - RNA, 19 nt, Homo sapiens
uguguugugugacuuguuu

SEQ ID NO: 1535042 - RNA, 19 nt, Homo sapiens
uuccaaaucucacacaugu

SEQ ID NO: 1535043 - RNA, 19 nt, Homo sapiens
uuaaagaggucagaaucau

SEQ ID NO: 1535044 - RNA, 19 nt, Homo sapiens
uacaaauccucaccaacaa

SEQ ID NO: 1535045 - RNA, 19 nt, Homo sapiens
gaaccagaagacacacauu

SEQ ID NO: 1535046 - RNA, 19 nt, Homo sapiens
ccauugcagugaacuuaug

SEQ ID NO: 1535047 - RNA, 19 nt, Homo sapiens
caaauccucaccaacaaug

SEQ ID NO: 1535048 - RNA, 19 nt, Homo sapiens
auacaaauccucaccaaca

SEQ ID NO: 1535049 - RNA, 19 nt, Homo sapiens
caggaggucucagcaugaa

SEQ ID NO: 1535050 - RNA, 19 nt, Homo sapiens
aaugauauguggccuugug

SEQ ID NO: 1535051 - RNA, 19 nt, Homo sapiens
ggaauguuguaccggaagu

SEQ ID NO: 1535052 - RNA, 19 nt, Homo sapiens
ucaaagaucacuucaagac

SEQ ID NO: 1535053 - RNA, 19 nt, Homo sapiens
cagcaguggugugggauga

SEQ ID NO: 1535054 - RNA, 19 nt, Homo sapiens
cugcaaacgucguaauaca

SEQ ID NO: 1535055 - RNA, 19 nt, Homo sapiens
ugaguuauuugcacuggau

SEQ ID NO: 1535056 - RNA, 19 nt, Homo sapiens
ucuuugaccugaaccagaa

SEQ ID NO: 1535057 - RNA, 19 nt, Homo sapiens
ccacccaguucuucaucuu

SEQ ID NO: 1535058 - RNA, 19 nt, Homo sapiens
caccauugcagugaacuua

SEQ ID NO: 1535059 - RNA, 19 nt, Homo sapiens
aaaugaaugucaggauguu

SEQ ID NO: 1535060 - RNA, 19 nt, Homo sapiens
caaacgucguaauacaaau

SEQ ID NO: 1535061 - RNA, 19 nt, Homo sapiens
gugcaaguaacaucauaaa

SEQ ID NO: 1535062 - RNA, 19 nt, Homo sapiens
agaagacacacauuugcua

SEQ ID NO: 1535063 - RNA, 19 nt, Homo sapiens
ggcaucuucucuguccuua

SEQ ID NO: 1535064 - RNA, 19 nt, Homo sapiens
caugccagaugccaggaaa

SEQ ID NO: 1535065 - RNA, 19 nt, Homo sapiens
gaaucccaguacuuugaga

SEQ ID NO: 1535066 - RNA, 19 nt, Homo sapiens
gcuccaccauugcagugaa

SEQ ID NO: 1535067 - RNA, 19 nt, Homo sapiens
uaaagaggucagaaucaug

SEQ ID NO: 1535068 - RNA, 19 nt, Homo sapiens
ucaccaacaaugacuuuga

SEQ ID NO: 1535069 - RNA, 19 nt, Homo sapiens
gaagaagcaggaggucuca

SEQ ID NO: 1535070 - RNA, 19 nt, Homo sapiens
gaugcugcuugguuuguca

SEQ ID NO: 1535071 - RNA, 19 nt, Homo sapiens
gauauguggccuugugcuu

SEQ ID NO: 1535072 - RNA, 19 nt, Homo sapiens
ggaaaggugggagggaaug

SEQ ID NO: 1535073 - RNA, 19 nt, Homo sapiens
aaccagaagacacacauuu

SEQ ID NO: 1535074 - RNA, 19 nt, Homo sapiens
gaggugcucugguaaaaca

SEQ ID NO: 1535075 - RNA, 19 nt, Homo sapiens
uggaaucccaguacuuuga

SEQ ID NO: 1535076 - RNA, 19 nt, Homo sapiens
ucagggcuuuugaguuuua

SEQ ID NO: 1535077 - RNA, 19 nt, Homo sapiens
uguugaugcugcuugguuu

SEQ ID NO: 1535078 - RNA, 19 nt, Homo sapiens
ugaaacugcaaacgucgua

SEQ ID NO: 1535079 - RNA, 19 nt, Homo sapiens
gagaucacaccaaaguaca

SEQ ID NO: 1535080 - RNA, 19 nt, Homo sapiens
agccagggcaauauaauuu

SEQ ID NO: 1535081 - RNA, 19 nt, Homo sapiens
ggagccagggcaauauaau

SEQ ID NO: 1535082 - RNA, 19 nt, Homo sapiens
ggccuggucaucuacauug

SEQ ID NO: 1535083 - RNA, 19 nt, Homo sapiens
ugacuuguuuuagcaguua

SEQ ID NO: 1535084 - RNA, 19 nt, Homo sapiens
uugugcggaucaauuauuu

SEQ ID NO: 1535085 - RNA, 19 nt, Homo sapiens
cgucaagcaugcauacaac

SEQ ID NO: 1535086 - RNA, 19 nt, Homo sapiens
ccauaguccugcuccucaa

SEQ ID NO: 1535087 - RNA, 19 nt, Homo sapiens
cagaagcaccuagggaaug

SEQ ID NO: 1535088 - RNA, 19 nt, Homo sapiens
cucaucaacuucuccauag

SEQ ID NO: 1535089 - RNA, 19 nt, Homo sapiens
gaggccaaguucagcaucu

SEQ ID NO: 1535090 - RNA, 19 nt, Homo sapiens
gaaacugcaaacgucguaa

SEQ ID NO: 1535091 - RNA, 19 nt, Homo sapiens
acagauguguugugugacu

SEQ ID NO: 1535092 - RNA, 19 nt, Homo sapiens
gugcggaucaauuauuuua

SEQ ID NO: 1535093 - RNA, 19 nt, Homo sapiens
ggugcaaguaacaucauaa

SEQ ID NO: 1535094 - RNA, 19 nt, Homo sapiens
ucacuuacgagcucaucaa

SEQ ID NO: 1535095 - RNA, 19 nt, Homo sapiens
caagagacgaauuucuaca

SEQ ID NO: 1535096 - RNA, 19 nt, Homo sapiens
ggcaauauaauuuccuaca

SEQ ID NO: 1535097 - RNA, 19 nt, Homo sapiens
cauuaaagaggucagaauc

SEQ ID NO: 1535098 - RNA, 19 nt, Homo sapiens
ucaucuacauugucuggau

SEQ ID NO: 1535099 - RNA, 19 nt, Homo sapiens
guggccuugugcuuacuua

SEQ ID NO: 1535100 - RNA, 19 nt, Homo sapiens
guugugcggaucaauuauu

SEQ ID NO: 1535101 - RNA, 19 nt, Homo sapiens
caaaaugggcaccguguug

SEQ ID NO: 1535102 - RNA, 19 nt, Homo sapiens
gcuaugaggccaaguucag

SEQ ID NO: 1535103 - RNA, 19 nt, Homo sapiens
ucucaucuuugaacagaag

SEQ ID NO: 1535104 - RNA, 19 nt, Homo sapiens
ggaggucucagcaugaaac

SEQ ID NO: 1535105 - RNA, 19 nt, Homo sapiens
uauguggccuugugcuuac

SEQ ID NO: 1535106 - RNA, 19 nt, Homo sapiens
gcacaaacauggcucacua

SEQ ID NO: 1535107 - RNA, 19 nt, Homo sapiens
ccaaguagcugggauuaua

SEQ ID NO: 1535108 - RNA, 19 nt, Homo sapiens
caagaaagaucagaacaga

SEQ ID NO: 1535109 - RNA, 19 nt, Homo sapiens
gcugauggaugcugaguuu

SEQ ID NO: 1535110 - RNA, 19 nt, Homo sapiens
cgacaagucuccacucuuc

SEQ ID NO: 1535111 - RNA, 19 nt, Homo sapiens
ccacuggagucuaauauau

SEQ ID NO: 1535112 - RNA, 19 nt, Homo sapiens
gaauaaagagagcaaacua

SEQ ID NO: 1535113 - RNA, 19 nt, Homo sapiens
caacaucuccuccaucuau

SEQ ID NO: 1535114 - RNA, 19 nt, Homo sapiens
gaaguaccaccaccgauuu

SEQ ID NO: 1535115 - RNA, 19 nt, Homo sapiens
uaccugggaugaagaauaa

SEQ ID NO: 1535116 - RNA, 19 nt, Homo sapiens
gaagauguacagugaguau

SEQ ID NO: 1535117 - RNA, 19 nt, Homo sapiens
agaaagaucagaacagauu

SEQ ID NO: 1535118 - RNA, 19 nt, Homo sapiens
gaucugggauuagaaaaua

SEQ ID NO: 1535119 - RNA, 19 nt, Homo sapiens
uaauauauagccuggguua

SEQ ID NO: 1535120 - RNA, 19 nt, Homo sapiens
gugaguaugucaagaacuu

SEQ ID NO: 1535121 - RNA, 19 nt, Homo sapiens
gggccgaacugaaauacga

SEQ ID NO: 1535122 - RNA, 19 nt, Homo sapiens
gcagagaauuccacguuac

SEQ ID NO: 1535123 - RNA, 19 nt, Homo sapiens
agacagagcaggccuaugu

SEQ ID NO: 1535124 - RNA, 19 nt, Homo sapiens
ugaacucccugaagaacaa

SEQ ID NO: 1535125 - RNA, 19 nt, Homo sapiens
ucaagugccagucaugaua

SEQ ID NO: 1535126 - RNA, 19 nt, Homo sapiens
agaaagcccuggacaugau

SEQ ID NO: 1535127 - RNA, 19 nt, Homo sapiens
uaccugaacucccugaaga

SEQ ID NO: 1535128 - RNA, 19 nt, Homo sapiens
caaacuaccacaaccaaug

SEQ ID NO: 1535129 - RNA, 19 nt, Homo sapiens
gaggcuuucuucacucuga

SEQ ID NO: 1535130 - RNA, 19 nt, Homo sapiens
ccaaagugcugggauuaca

SEQ ID NO: 1535131 - RNA, 19 nt, Homo sapiens
ucaacaacaugcugcucua

SEQ ID NO: 1535132 - RNA, 19 nt, Homo sapiens
aggagaagcuggcaucugu

SEQ ID NO: 1535133 - RNA, 19 nt, Homo sapiens
aaacaaugccuguacugaa

SEQ ID NO: 1535134 - RNA, 19 nt, Homo sapiens
gaaccagugcagagaauuc

SEQ ID NO: 1535135 - RNA, 19 nt, Homo sapiens
ucacuguguuugagaauag

SEQ ID NO: 1535136 - RNA, 19 nt, Homo sapiens
ccaggccgaugcccagaaa

SEQ ID NO: 1535137 - RNA, 19 nt, Homo sapiens
ucaguuccauucucaguuc

SEQ ID NO: 1535138 - RNA, 19 nt, Homo sapiens
ggacgcaggagccagagaa

SEQ ID NO: 1535139 - RNA, 19 nt, Homo sapiens
ugaaguaccaccaccgauu

SEQ ID NO: 1535140 - RNA, 19 nt, Homo sapiens
gagucugccuccacugcua

SEQ ID NO: 1535141 - RNA, 19 nt, Homo sapiens
ccucgaggacgacauagua

SEQ ID NO: 1535142 - RNA, 19 nt, Homo sapiens
ccaaugcagccaucacuga

SEQ ID NO: 1535143 - RNA, 19 nt, Homo sapiens
ugcagagaauuccacguua

SEQ ID NO: 1535144 - RNA, 19 nt, Homo sapiens
gugcagagaauuccacguu

SEQ ID NO: 1535145 - RNA, 19 nt, Homo sapiens
guaccaccaccgauuuaaa

SEQ ID NO: 1535146 - RNA, 19 nt, Homo sapiens
caugggacuuccagugcua

SEQ ID NO: 1535147 - RNA, 19 nt, Homo sapiens
aagcagccauugaccaaau

SEQ ID NO: 1535148 - RNA, 19 nt, Homo sapiens
cagauucaugggugauuua

SEQ ID NO: 1535149 - RNA, 19 nt, Homo sapiens
gccaagagccgaccuucug

SEQ ID NO: 1535150 - RNA, 19 nt, Homo sapiens
ccgcaucggugacgugauc

SEQ ID NO: 1535151 - RNA, 19 nt, Homo sapiens
caaguggugcuuucagaga

SEQ ID NO: 1535152 - RNA, 19 nt, Homo sapiens
ggccagcucuacaccuuca

SEQ ID NO: 1535153 - RNA, 19 nt, Homo sapiens
ccaagcagccauugaccaa

SEQ ID NO: 1535154 - RNA, 19 nt, Homo sapiens
cagcgaagccuggaggaaa

SEQ ID NO: 1535155 - RNA, 19 nt, Homo sapiens
caaccuggucacuguguuu

SEQ ID NO: 1535156 - RNA, 19 nt, Homo sapiens
cgccucagccucccaagua

SEQ ID NO: 1535157 - RNA, 19 nt, Homo sapiens
cagaaagcccuggacauga

SEQ ID NO: 1535158 - RNA, 19 nt, Homo sapiens
acagauucaugggugauuu

SEQ ID NO: 1535159 - RNA, 19 nt, Homo sapiens
gaaagaucagaacagauuc

SEQ ID NO: 1535160 - RNA, 19 nt, Homo sapiens
uguccaaccuggucacugu

SEQ ID NO: 1535161 - RNA, 19 nt, Homo sapiens
ucuaucaguuccauucuca

SEQ ID NO: 1535162 - RNA, 19 nt, Homo sapiens
gagaagcuggcaucugugu

SEQ ID NO: 1535163 - RNA, 19 nt, Homo sapiens
gaagaauaaagagagcaaa

SEQ ID NO: 1535164 - RNA, 19 nt, Homo sapiens
aacaaugccuguacugaag

SEQ ID NO: 1535165 - RNA, 19 nt, Homo sapiens
caggccagcucuacaccuu

SEQ ID NO: 1535166 - RNA, 19 nt, Homo sapiens
ucaaggaguacauccagaa

SEQ ID NO: 1535167 - RNA, 19 nt, Homo sapiens
caugggugauuuagccuau

SEQ ID NO: 1535168 - RNA, 19 nt, Homo sapiens
cacuggagucuaauauaua

SEQ ID NO: 1535169 - RNA, 19 nt, Homo sapiens
acaacaugcugcucuacug

SEQ ID NO: 1535170 - RNA, 19 nt, Homo sapiens
ccacugugccaagcuaauu

SEQ ID NO: 1535171 - RNA, 19 nt, Homo sapiens
gguccauuccuuucuagaa

SEQ ID NO: 1535172 - RNA, 19 nt, Homo sapiens
caacaugcugcucuacugu

SEQ ID NO: 1535173 - RNA, 19 nt, Homo sapiens
gggccucgaggacgacaua

SEQ ID NO: 1535174 - RNA, 19 nt, Homo sapiens
uccugaagauguacaguga

SEQ ID NO: 1535175 - RNA, 19 nt, Homo sapiens
gcaaacuaccacaaccaau

SEQ ID NO: 1535176 - RNA, 19 nt, Homo sapiens
gggaugaagaauaaagaga

SEQ ID NO: 1535177 - RNA, 19 nt, Homo sapiens
uuaccugggaugaagaaua

SEQ ID NO: 1535178 - RNA, 19 nt, Homo sapiens
ccaagagccgaccuucuga

SEQ ID NO: 1535179 - RNA, 19 nt, Homo sapiens
gauuucaccauguuacuca

SEQ ID NO: 1535180 - RNA, 19 nt, Homo sapiens
cccaaguggugcuuucaga

SEQ ID NO: 1535181 - RNA, 19 nt, Homo sapiens
gucacuguguuugagaaua

SEQ ID NO: 1535182 - RNA, 19 nt, Homo sapiens
gaacagauucaugggugau

SEQ ID NO: 1535183 - RNA, 19 nt, Homo sapiens
guacagugaguaugucaag

SEQ ID NO: 1535184 - RNA, 19 nt, Homo sapiens
ucggugacgugauccagaa

SEQ ID NO: 1535185 - RNA, 19 nt, Homo sapiens
ggacagucagcaggaggua

SEQ ID NO: 1535186 - RNA, 19 nt, Homo sapiens
ggucugagcccaggacagu

SEQ ID NO: 1535187 - RNA, 19 nt, Homo sapiens
acuggagucuaauauauag

SEQ ID NO: 1535188 - RNA, 19 nt, Homo sapiens
aguacccacuggagucuaa

SEQ ID NO: 1535189 - RNA, 19 nt, Homo sapiens
gugccacugugccaagcua

SEQ ID NO: 1535190 - RNA, 19 nt, Homo sapiens
uuaaagaguacuggugaaa

SEQ ID NO: 1535191 - RNA, 19 nt, Homo sapiens
gaugcaggccuuccaagca

SEQ ID NO: 1535192 - RNA, 19 nt, Homo sapiens
gaguaugucaagaacuuug

SEQ ID NO: 1535193 - RNA, 19 nt, Homo sapiens
acagugaguaugucaagaa

SEQ ID NO: 1535194 - RNA, 19 nt, Homo sapiens
ggagacagagcaggccuau

SEQ ID NO: 1535195 - RNA, 19 nt, Homo sapiens
cgcaggagccagagaagaa

SEQ ID NO: 1535196 - RNA, 19 nt, Homo sapiens
uacucaggcuggucucaaa

SEQ ID NO: 1535197 - RNA, 19 nt, Homo sapiens
gauguacagugaguauguc

SEQ ID NO: 1535198 - RNA, 19 nt, Homo sapiens
cugaagauguacagugagu

SEQ ID NO: 1535199 - RNA, 19 nt, Homo sapiens
uccaacaucuccuccaucu

SEQ ID NO: 1535200 - RNA, 19 nt, Homo sapiens
uccaggagcugcugaagac

SEQ ID NO: 1535201 - RNA, 19 nt, Homo sapiens
gagcaaacuaccacaacca

SEQ ID NO: 1535202 - RNA, 19 nt, Homo sapiens
cgauuuaaaugggcugagu

SEQ ID NO: 1535203 - RNA, 19 nt, Homo sapiens
uaccaccaccgauuuaaau

SEQ ID NO: 1535204 - RNA, 19 nt, Homo sapiens
aaguggugcuuucagagaa

SEQ ID NO: 1535205 - RNA, 19 nt, Homo sapiens
ccagucaugauaguaguaa

SEQ ID NO: 1535206 - RNA, 19 nt, Homo sapiens
ggaagaugcucaggauuug

SEQ ID NO: 1535207 - RNA, 19 nt, Homo sapiens
ggagaccaacaucgaauua

SEQ ID NO: 1535208 - RNA, 19 nt, Homo sapiens
caacugaggucccuuccau

SEQ ID NO: 1535209 - RNA, 19 nt, Homo sapiens
gguguuggcuggaaucuuc

SEQ ID NO: 1535210 - RNA, 19 nt, Homo sapiens
gcaagaacucccucuguga

SEQ ID NO: 1535211 - RNA, 19 nt, Homo sapiens
gauuccggcuuucuuggua

SEQ ID NO: 1535212 - RNA, 19 nt, Homo sapiens
gagaaucuguucgccauca

SEQ ID NO: 1535213 - RNA, 19 nt, Homo sapiens
ccaagucccuccccaauuu

SEQ ID NO: 1535214 - RNA, 19 nt, Homo sapiens
gggcacaccuccuccaagu

SEQ ID NO: 1535215 - RNA, 19 nt, Homo sapiens
gggaaggacuuuaaaucca

SEQ ID NO: 1535216 - RNA, 19 nt, Homo sapiens
ugaaggaucuguccacaac

SEQ ID NO: 1535217 - RNA, 19 nt, Homo sapiens
cggaagaugcucaggauuu

SEQ ID NO: 1535218 - RNA, 19 nt, Homo sapiens
caagaacucccucugugaa

SEQ ID NO: 1535219 - RNA, 19 nt, Homo sapiens
acuccugacucuccaauaa

SEQ ID NO: 1535220 - RNA, 19 nt, Homo sapiens
caacuuccuuagcaacgaa

SEQ ID NO: 1535221 - RNA, 19 nt, Homo sapiens
gagaggaucggcugugguu

SEQ ID NO: 1535222 - RNA, 19 nt, Homo sapiens
cagaugaggagaaacguuu

SEQ ID NO: 1535223 - RNA, 19 nt, Homo sapiens
gcacggcuccugcaguuuc

SEQ ID NO: 1535224 - RNA, 19 nt, Homo sapiens
caacggggauuccggcuuu

SEQ ID NO: 1535225 - RNA, 19 nt, Homo sapiens
cagacaaagugacagacaa

SEQ ID NO: 1535226 - RNA, 19 nt, Homo sapiens
gcaguuuccugaugcuucu

SEQ ID NO: 1535227 - RNA, 19 nt, Homo sapiens
gaaaauggguacuccuucu

SEQ ID NO: 1535228 - RNA, 19 nt, Homo sapiens
caacuuaggaacucacaca

SEQ ID NO: 1535229 - RNA, 19 nt, Homo sapiens
aaacaaaagugcccucuag

SEQ ID NO: 1535230 - RNA, 19 nt, Homo sapiens
gagaagcuccaggguguug

SEQ ID NO: 1535231 - RNA, 19 nt, Homo sapiens
ccugagacauugugugagu

SEQ ID NO: 1535232 - RNA, 19 nt, Homo sapiens
agacaaagugacagacaaa

SEQ ID NO: 1535233 - RNA, 19 nt, Homo sapiens
cugcagagguuacugugau

SEQ ID NO: 1535234 - RNA, 19 nt, Homo sapiens
gcagagguuacugugauuu

SEQ ID NO: 1535235 - RNA, 19 nt, Homo sapiens
gcagacaaagugacagaca

SEQ ID NO: 1535236 - RNA, 19 nt, Homo sapiens
ccucagacaugcugcacau

SEQ ID NO: 1535237 - RNA, 19 nt, Homo sapiens
uuggagcccucacagauga

SEQ ID NO: 1535238 - RNA, 19 nt, Homo sapiens
ccaguuaccuuccccaaau

SEQ ID NO: 1535239 - RNA, 19 nt, Homo sapiens
ucgaauuacuggugugcaa

SEQ ID NO: 1535240 - RNA, 19 nt, Homo sapiens
aaggaucuguccacaacuu

SEQ ID NO: 1535241 - RNA, 19 nt, Homo sapiens
caccuugcguaacaacuga

SEQ ID NO: 1535242 - RNA, 19 nt, Homo sapiens
gcaucagacucuaggaaaa

SEQ ID NO: 1535243 - RNA, 19 nt, Homo sapiens
uuacuggugugcaacuaug

SEQ ID NO: 1535244 - RNA, 19 nt, Homo sapiens
gaggagaccaacaucgaau

SEQ ID NO: 1535245 - RNA, 19 nt, Homo sapiens
aaaccuguccaaccugaaa

SEQ ID NO: 1535246 - RNA, 19 nt, Homo sapiens
gaugaggagaaacguuuga

SEQ ID NO: 1535247 - RNA, 19 nt, Homo sapiens
cagcuguccuccugucauc

SEQ ID NO: 1535248 - RNA, 19 nt, Homo sapiens
uaggaacucacacagcuuu

SEQ ID NO: 1535249 - RNA, 19 nt, Homo sapiens
acugaggucccuuccauuu

SEQ ID NO: 1535250 - RNA, 19 nt, Homo sapiens
ggagugggguucuuugagu

SEQ ID NO: 1535251 - RNA, 19 nt, Homo sapiens
agaccaacaucgaauuacu

SEQ ID NO: 1535252 - RNA, 19 nt, Homo sapiens
ugaggucccuuccauuuug

SEQ ID NO: 1535253 - RNA, 19 nt, Homo sapiens
gugcagagggcccugacaa

SEQ ID NO: 1535254 - RNA, 19 nt, Homo sapiens
cagcagacaaagugacaga

SEQ ID NO: 1535255 - RNA, 19 nt, Homo sapiens
gaccaacaucgaauuacug

SEQ ID NO: 1535256 - RNA, 19 nt, Homo sapiens
agagacggcuggccaccau

SEQ ID NO: 1535257 - RNA, 19 nt, Homo sapiens
gugggaaggacuuuaaauc

SEQ ID NO: 1535258 - RNA, 19 nt, Homo sapiens
gaggcuccaccuugcguaa

SEQ ID NO: 1535259 - RNA, 19 nt, Homo sapiens
cagccaggguggugcuugu

SEQ ID NO: 1535260 - RNA, 19 nt, Homo sapiens
ccaacuuccuuagcaacga

SEQ ID NO: 1535261 - RNA, 19 nt, Homo sapiens
ggacuccgugcucccaaug

SEQ ID NO: 1535262 - RNA, 19 nt, Homo sapiens
ugaggagaccaacaucgaa

SEQ ID NO: 1535263 - RNA, 19 nt, Homo sapiens
gguucccacuucugugaga

SEQ ID NO: 1535264 - RNA, 19 nt, Homo sapiens
gcagggacgagggaaggaa

SEQ ID NO: 1535265 - RNA, 19 nt, Homo sapiens
cccggaagaugcucaggau

SEQ ID NO: 1535266 - RNA, 19 nt, Homo sapiens
guccacaacuuaggaacuc

SEQ ID NO: 1535267 - RNA, 19 nt, Homo sapiens
caaagugacagacaaaaca

SEQ ID NO: 1535268 - RNA, 19 nt, Homo sapiens
gcaacagaggcuccaccuu

SEQ ID NO: 1535269 - RNA, 19 nt, Homo sapiens
ugugugggaaggacuuuaa

SEQ ID NO: 1535270 - RNA, 19 nt, Homo sapiens
ugcagagguuacugugauu

SEQ ID NO: 1535271 - RNA, 19 nt, Homo sapiens
ucacagaugaggagaaacg

SEQ ID NO: 1535272 - RNA, 19 nt, Homo sapiens
guuggagcccucacagaug

SEQ ID NO: 1535273 - RNA, 19 nt, Homo sapiens
uaagaugccugaccuauuu

SEQ ID NO: 1535274 - RNA, 19 nt, Homo sapiens
ggaguaagaugcauaagau

SEQ ID NO: 1535275 - RNA, 19 nt, Homo sapiens
gcaguauccucuccuuaua

SEQ ID NO: 1535276 - RNA, 19 nt, Homo sapiens
ccaacgagaucagcauuua

SEQ ID NO: 1535277 - RNA, 19 nt, Homo sapiens
gaucagcauuuaugacaaa

SEQ ID NO: 1535278 - RNA, 19 nt, Homo sapiens
gacaacagcuccaguaaac

SEQ ID NO: 1535279 - RNA, 19 nt, Homo sapiens
ucacagaaccugcagauug

SEQ ID NO: 1535280 - RNA, 19 nt, Homo sapiens
ucucagaacuguaggaaau

SEQ ID NO: 1535281 - RNA, 19 nt, Homo sapiens
ucacucauccaucacauua

SEQ ID NO: 1535282 - RNA, 19 nt, Homo sapiens
aggaggagauucagcauuu

SEQ ID NO: 1535283 - RNA, 19 nt, Homo sapiens
ggacaacagcuccaguaaa

SEQ ID NO: 1535284 - RNA, 19 nt, Homo sapiens
caacagcuccaguaaacaa

SEQ ID NO: 1535285 - RNA, 19 nt, Homo sapiens
gaucuaaaguggagcuucu

SEQ ID NO: 1535286 - RNA, 19 nt, Homo sapiens
ccacacuccuggaacugua

SEQ ID NO: 1535287 - RNA, 19 nt, Homo sapiens
cugaacagaucacaaaugu

SEQ ID NO: 1535288 - RNA, 19 nt, Homo sapiens
gaacaccagagaaagagaa

SEQ ID NO: 1535289 - RNA, 19 nt, Homo sapiens
gaggacaacagcuccagua

SEQ ID NO: 1535290 - RNA, 19 nt, Homo sapiens
ccacuugugucuauugauc

SEQ ID NO: 1535291 - RNA, 19 nt, Homo sapiens
gagcggugguucccauuuc

SEQ ID NO: 1535292 - RNA, 19 nt, Homo sapiens
gagaucagcauuuaugaca

SEQ ID NO: 1535293 - RNA, 19 nt, Homo sapiens
uuucagagacuguugauuu

SEQ ID NO: 1535294 - RNA, 19 nt, Homo sapiens
cagcauuuaugacaaacuu

SEQ ID NO: 1535295 - RNA, 19 nt, Homo sapiens
gcagacaggaguauuaugg

SEQ ID NO: 1535296 - RNA, 19 nt, Homo sapiens
agacaggaguauuauggaa

SEQ ID NO: 1535297 - RNA, 19 nt, Homo sapiens
ugagugaacaugcaaggua

SEQ ID NO: 1535298 - RNA, 19 nt, Homo sapiens
gcuccaggacucuugauuu

SEQ ID NO: 1535299 - RNA, 19 nt, Homo sapiens
gggaguaagaugcauaaga

SEQ ID NO: 1535300 - RNA, 19 nt, Homo sapiens
uuaaacaagugcuccuuuc

SEQ ID NO: 1535301 - RNA, 19 nt, Homo sapiens
ucagagaaggcaauugaaa

SEQ ID NO: 1535302 - RNA, 19 nt, Homo sapiens
ugacaaacuuucagagacu

SEQ ID NO: 1535303 - RNA, 19 nt, Homo sapiens
cacagaaccugcagauugg

SEQ ID NO: 1535304 - RNA, 19 nt, Homo sapiens
aacaagugcuccuuucuuc

SEQ ID NO: 1535305 - RNA, 19 nt, Homo sapiens
uaagggaguuccucugcau

SEQ ID NO: 1535306 - RNA, 19 nt, Homo sapiens
ccaagaaguacaugucaga

SEQ ID NO: 1535307 - RNA, 19 nt, Homo sapiens
ugucaggaaugggaucuaa

SEQ ID NO: 1535308 - RNA, 19 nt, Homo sapiens
ccugaccuauuuaucauug

SEQ ID NO: 1535309 - RNA, 19 nt, Homo sapiens
ugagaacaccagagaaaga

SEQ ID NO: 1535310 - RNA, 19 nt, Homo sapiens
gacagacccuuuccagacu

SEQ ID NO: 1535311 - RNA, 19 nt, Homo sapiens
ugucagagaaggcaauuga

SEQ ID NO: 1535312 - RNA, 19 nt, Homo sapiens
gaucacagaaccugcagau

SEQ ID NO: 1535313 - RNA, 19 nt, Homo sapiens
agaaguacaugucagaaaa

SEQ ID NO: 1535314 - RNA, 19 nt, Homo sapiens
aaacaagugcuccuuucuu

SEQ ID NO: 1535315 - RNA, 19 nt, Homo sapiens
cuuuggagcuuuaaaccuu

SEQ ID NO: 1535316 - RNA, 19 nt, Homo sapiens
ggaagacgccccaaggaaa

SEQ ID NO: 1535317 - RNA, 19 nt, Homo sapiens
gaugaagacagacccuuuc

SEQ ID NO: 1535318 - RNA, 19 nt, Homo sapiens
gcauuuaugacaaacuuuc

SEQ ID NO: 1535319 - RNA, 19 nt, Homo sapiens
cgauggaaccgcuuucuca

SEQ ID NO: 1535320 - RNA, 19 nt, Homo sapiens
aaacgacugugagcagaau

SEQ ID NO: 1535321 - RNA, 19 nt, Homo sapiens
acuggaaggucuacguuau

SEQ ID NO: 1535322 - RNA, 19 nt, Homo sapiens
caccagagaaagagaaaga

SEQ ID NO: 1535323 - RNA, 19 nt, Homo sapiens
ucagaacuguaggaaauag

SEQ ID NO: 1535324 - RNA, 19 nt, Homo sapiens
uauccucuccuuauaguug

SEQ ID NO: 1535325 - RNA, 19 nt, Homo sapiens
caacgagaucagcauuuau

SEQ ID NO: 1535326 - RNA, 19 nt, Homo sapiens
ccagagggguccagccuuu

SEQ ID NO: 1535327 - RNA, 19 nt, Homo sapiens
ggugguucccauuuccuua

SEQ ID NO: 1535328 - RNA, 19 nt, Homo sapiens
gaggaggagauucagcauu

SEQ ID NO: 1535329 - RNA, 19 nt, Homo sapiens
gaaggugaugcuccuggaa

SEQ ID NO: 1535330 - RNA, 19 nt, Homo sapiens
uucagagacuguugauuug

SEQ ID NO: 1535331 - RNA, 19 nt, Homo sapiens
uggaaggucuacguuauag

SEQ ID NO: 1535332 - RNA, 19 nt, Homo sapiens
caaauguuacgugagcuuu

SEQ ID NO: 1535333 - RNA, 19 nt, Homo sapiens
cagagacuguugauuuggu

SEQ ID NO: 1535334 - RNA, 19 nt, Homo sapiens
gggcagacaggaguauuau

SEQ ID NO: 1535335 - RNA, 19 nt, Homo sapiens
aggauccacuugugucuau

SEQ ID NO: 1535336 - RNA, 19 nt, Homo sapiens
cauaagaugccugaccuau

SEQ ID NO: 1535337 - RNA, 19 nt, Homo sapiens
gauccacuugugucuauug

SEQ ID NO: 1535338 - RNA, 19 nt, Homo sapiens
ucacucaccugccauuucc

SEQ ID NO: 1535339 - RNA, 19 nt, Homo sapiens
ugaugaagacagacccuuu

SEQ ID NO: 1535340 - RNA, 19 nt, Homo sapiens
caagugguggcgcugcuuu

SEQ ID NO: 1535341 - RNA, 19 nt, Homo sapiens
cagacccuuuccagacuuu

SEQ ID NO: 1535342 - RNA, 19 nt, Homo sapiens
ccaggacucuugauuuuca

SEQ ID NO: 1535343 - RNA, 19 nt, Homo sapiens
cugauguccuugcccauug

SEQ ID NO: 1535344 - RNA, 19 nt, Homo sapiens
gaacugcuccaggacucuu

SEQ ID NO: 1535345 - RNA, 19 nt, Homo sapiens
uaugacaaacuuucagaga

SEQ ID NO: 1535346 - RNA, 19 nt, Homo sapiens
caaacgacugugagcagaa

SEQ ID NO: 1535347 - RNA, 19 nt, Homo sapiens
ggcgcucacucauccauca

SEQ ID NO: 1535348 - RNA, 19 nt, Homo sapiens
agacagaccggccaucagu

SEQ ID NO: 1535349 - RNA, 19 nt, Homo sapiens
aagaaguacaugucagaaa

SEQ ID NO: 1535350 - RNA, 19 nt, Homo sapiens
caagaaguacaugucagaa

SEQ ID NO: 1535351 - RNA, 19 nt, Homo sapiens
gcugauguccuugcccauu

SEQ ID NO: 1535352 - RNA, 19 nt, Homo sapiens
gaaaagaaugaaccucaga

SEQ ID NO: 1535353 - RNA, 19 nt, Homo sapiens
agagaaagagaaagacugu

SEQ ID NO: 1535354 - RNA, 19 nt, Homo sapiens
gagaacaccagagaaagag

SEQ ID NO: 1535355 - RNA, 19 nt, Homo sapiens
gguccagccuuuggucauc

SEQ ID NO: 1535356 - RNA, 19 nt, Homo sapiens
cuggaaggucuacguuaua

SEQ ID NO: 1535357 - RNA, 19 nt, Homo sapiens
aaagaaugaaccucagaga

SEQ ID NO: 1535358 - RNA, 19 nt, Homo sapiens
ccacuggaaggucuacguu

SEQ ID NO: 1535359 - RNA, 19 nt, Homo sapiens
auaagaugccugaccuauu

SEQ ID NO: 1535360 - RNA, 19 nt, Homo sapiens
cgcaguauccucuccuuau

SEQ ID NO: 1535361 - RNA, 19 nt, Homo sapiens
gccaacgagaucagcauuu

SEQ ID NO: 1535362 - RNA, 19 nt, Homo sapiens
ggaggagauucagcauuuu

SEQ ID NO: 1535363 - RNA, 19 nt, Homo sapiens
gaagacgccccaaggaaau

SEQ ID NO: 1535364 - RNA, 19 nt, Homo sapiens
gugagcagaaugagucaga

SEQ ID NO: 1535365 - RNA, 19 nt, Homo sapiens
caccugagccagugcuuuc

SEQ ID NO: 1535366 - RNA, 19 nt, Homo sapiens
ccaucaguguggcauguca

SEQ ID NO: 1535367 - RNA, 19 nt, Homo sapiens
uaaacaagugcuccuuucu

SEQ ID NO: 1535368 - RNA, 19 nt, Homo sapiens
ucaggaaugggaucuaaag

SEQ ID NO: 1535369 - RNA, 19 nt, Homo sapiens
aaagagaaagacuguccuu

SEQ ID NO: 1535370 - RNA, 19 nt, Homo sapiens
agaacuguaggaaauagaa

SEQ ID NO: 1535371 - RNA, 19 nt, Homo sapiens
agaugccucuuuaaacaag

SEQ ID NO: 1535372 - RNA, 19 nt, Homo sapiens
gguggacaaacgacuguga

SEQ ID NO: 1535373 - RNA, 19 nt, Homo sapiens
gaacugaucuccaccaucu

SEQ ID NO: 1535374 - RNA, 19 nt, Homo sapiens
gggcaacacugaagacaug

SEQ ID NO: 1535375 - RNA, 19 nt, Homo sapiens
gaacagucccugcaugaau

SEQ ID NO: 1535376 - RNA, 19 nt, Homo sapiens
ggaacacuccaucaaagua

SEQ ID NO: 1535377 - RNA, 19 nt, Homo sapiens
caucaaggcuggcauaaaa

SEQ ID NO: 1535378 - RNA, 19 nt, Homo sapiens
gagagccaauaaaugagua

SEQ ID NO: 1535379 - RNA, 19 nt, Homo sapiens
ggugaugccugccuugaug

SEQ ID NO: 1535380 - RNA, 19 nt, Homo sapiens
ugaggaagauguucagauc

SEQ ID NO: 1535381 - RNA, 19 nt, Homo sapiens
gcaugauccugcacaguau

SEQ ID NO: 1535382 - RNA, 19 nt, Homo sapiens
aaggagagccaauaaauga

SEQ ID NO: 1535383 - RNA, 19 nt, Homo sapiens
gcugaggccucugcuugua

SEQ ID NO: 1535384 - RNA, 19 nt, Homo sapiens
gaauacacuuaaagcuuuc

SEQ ID NO: 1535385 - RNA, 19 nt, Homo sapiens
ugagcuaccuggcacagaa

SEQ ID NO: 1535386 - RNA, 19 nt, Homo sapiens
gcccagucguuccuacuuu

SEQ ID NO: 1535387 - RNA, 19 nt, Homo sapiens
cgaucuaccugcucuacaa

SEQ ID NO: 1535388 - RNA, 19 nt, Homo sapiens
caggaacacuccaucaaag

SEQ ID NO: 1535389 - RNA, 19 nt, Homo sapiens
ccaggaacacuccaucaaa

SEQ ID NO: 1535390 - RNA, 19 nt, Homo sapiens
cccagucguuccuacuuua

SEQ ID NO: 1535391 - RNA, 19 nt, Homo sapiens
ucaaaguacucgaacugau

SEQ ID NO: 1535392 - RNA, 19 nt, Homo sapiens
gcuacaugcuggaugacaa

SEQ ID NO: 1535393 - RNA, 19 nt, Homo sapiens
acacggaacugcacauugc

SEQ ID NO: 1535394 - RNA, 19 nt, Homo sapiens
uaaggagagccaauaaaug

SEQ ID NO: 1535395 - RNA, 19 nt, Homo sapiens
caaaguacucgaacugauc

SEQ ID NO: 1535396 - RNA, 19 nt, Homo sapiens
uuaaggagagccaauaaau

SEQ ID NO: 1535397 - RNA, 19 nt, Homo sapiens
gaccuucucuaugacauuc

SEQ ID NO: 1535398 - RNA, 19 nt, Homo sapiens
gaacacuccaucaaaguac

SEQ ID NO: 1535399 - RNA, 19 nt, Homo sapiens
ucuaugacauucucaacug

SEQ ID NO: 1535400 - RNA, 19 nt, Homo sapiens
ggacacggaacugcacauu

SEQ ID NO: 1535401 - RNA, 19 nt, Homo sapiens
gcaacuggacauccgcaaa

SEQ ID NO: 1535402 - RNA, 19 nt, Homo sapiens
caagcucugaauacacuua

SEQ ID NO: 1535403 - RNA, 19 nt, Homo sapiens
ggucauccacccugaggaa

SEQ ID NO: 1535404 - RNA, 19 nt, Homo sapiens
gccaauaaaugaguauagg

SEQ ID NO: 1535405 - RNA, 19 nt, Homo sapiens
ggagagccaauaaaugagu

SEQ ID NO: 1535406 - RNA, 19 nt, Homo sapiens
aaauuaaggagagccaaua

SEQ ID NO: 1535407 - RNA, 19 nt, Homo sapiens
uguaugagguacugguguu

SEQ ID NO: 1535408 - RNA, 19 nt, Homo sapiens
uaaaugaguauaggagaga

SEQ ID NO: 1535409 - RNA, 19 nt, Homo sapiens
cugcaugaaucccucuuug

SEQ ID NO: 1535410 - RNA, 19 nt, Homo sapiens
gaguauaggagagaaacaa

SEQ ID NO: 1535411 - RNA, 19 nt, Homo sapiens
gcaacucacccaucugcau

SEQ ID NO: 1535412 - RNA, 19 nt, Homo sapiens
caucaaaguacucgaacug

SEQ ID NO: 1535413 - RNA, 19 nt, Homo sapiens
ccaacuuccuaaaccuguu

SEQ ID NO: 1535414 - RNA, 19 nt, Homo sapiens
gaaugaccuucucuaugac

SEQ ID NO: 1535415 - RNA, 19 nt, Homo sapiens
ccaauaaaugaguauagga

SEQ ID NO: 1535416 - RNA, 19 nt, Homo sapiens
uguagcaacucacccaucu

SEQ ID NO: 1535417 - RNA, 19 nt, Homo sapiens
gaaaauucaggcucaaaau

SEQ ID NO: 1535418 - RNA, 19 nt, Homo sapiens
gagccaauaaaugaguaua

SEQ ID NO: 1535419 - RNA, 19 nt, Homo sapiens
uggagauccugcagucaga

SEQ ID NO: 1535420 - RNA, 19 nt, Homo sapiens
cugaauacacuuaaagcuu

SEQ ID NO: 1535421 - RNA, 19 nt, Homo sapiens
gcucugaauacacuuaaag

SEQ ID NO: 1535422 - RNA, 19 nt, Homo sapiens
cccaagcucugaauacacu

SEQ ID NO: 1535423 - RNA, 19 nt, Homo sapiens
ugggcuacaugcuggauga

SEQ ID NO: 1535424 - RNA, 19 nt, Homo sapiens
agcaugauccugcacagua

SEQ ID NO: 1535425 - RNA, 19 nt, Homo sapiens
aacagucccugcaugaauc

SEQ ID NO: 1535426 - RNA, 19 nt, Homo sapiens
caacgaacagucccugcau

SEQ ID NO: 1535427 - RNA, 19 nt, Homo sapiens
ccguacgacugcugagcua

SEQ ID NO: 1535428 - RNA, 19 nt, Homo sapiens
ccagucguuccuacuuuaa

SEQ ID NO: 1535429 - RNA, 19 nt, Homo sapiens
cauccacccugaggaagau

SEQ ID NO: 1535430 - RNA, 19 nt, Homo sapiens
gacacggaacugcacauug

SEQ ID NO: 1535431 - RNA, 19 nt, Homo sapiens
uugcugagcggcugaguga

SEQ ID NO: 1535432 - RNA, 19 nt, Homo sapiens
cugcaucgcccgugagugu

SEQ ID NO: 1535433 - RNA, 19 nt, Homo sapiens
aauuaaggagagccaauaa

SEQ ID NO: 1535434 - RNA, 19 nt, Homo sapiens
aggaagauguucagaucca

SEQ ID NO: 1535435 - RNA, 19 nt, Homo sapiens
caacuggacauccgcaaaa

SEQ ID NO: 1535436 - RNA, 19 nt, Homo sapiens
gccucagacuccucaacaa

SEQ ID NO: 1535437 - RNA, 19 nt, Homo sapiens
gugcaaacaggaugaguac

SEQ ID NO: 1535438 - RNA, 19 nt, Homo sapiens
aacccaagcucugaauaca

SEQ ID NO: 1535439 - RNA, 19 nt, Homo sapiens
gcaaaccaccccucuguag

SEQ ID NO: 1535440 - RNA, 19 nt, Homo sapiens
cgaacagucccugcaugaa

SEQ ID NO: 1535441 - RNA, 19 nt, Homo sapiens
aaacccaagcucugaauac

SEQ ID NO: 1535442 - RNA, 19 nt, Homo sapiens
caacuuccuaaaccuguuc

SEQ ID NO: 1535443 - RNA, 19 nt, Homo sapiens
ccaucaaggcuggcauaaa

SEQ ID NO: 1535444 - RNA, 19 nt, Homo sapiens
aaagcuuucucuggcauca

SEQ ID NO: 1535445 - RNA, 19 nt, Homo sapiens
caggaugaguacgccaaga

SEQ ID NO: 1535446 - RNA, 19 nt, Homo sapiens
gagaguaacuugcauagua

SEQ ID NO: 1535447 - RNA, 19 nt, Homo sapiens
gcugaaggcuggagaguaa

SEQ ID NO: 1535448 - RNA, 19 nt, Homo sapiens
gagaauagauacauuaugg

SEQ ID NO: 1535449 - RNA, 19 nt, Homo sapiens
gcaggaaagugguuuauag

SEQ ID NO: 1535450 - RNA, 19 nt, Homo sapiens
gagaagugcugcaaauuca

SEQ ID NO: 1535451 - RNA, 19 nt, Homo sapiens
gaccaccacugauaacuaa

SEQ ID NO: 1535452 - RNA, 19 nt, Homo sapiens
ggaggaagaugaugaugau

SEQ ID NO: 1535453 - RNA, 19 nt, Homo sapiens
gaccauaccucuuccuuuc

SEQ ID NO: 1535454 - RNA, 19 nt, Homo sapiens
uauaggccauucauacuua

SEQ ID NO: 1535455 - RNA, 19 nt, Homo sapiens
gaucagugcucagaaauuc

SEQ ID NO: 1535456 - RNA, 19 nt, Homo sapiens
guagaucagugcucagaaa

SEQ ID NO: 1535457 - RNA, 19 nt, Homo sapiens
gaacuuagggcucauaaag

SEQ ID NO: 1535458 - RNA, 19 nt, Homo sapiens
gaagugaacugggagaagu

SEQ ID NO: 1535459 - RNA, 19 nt, Homo sapiens
ggaaaguucugugaugugu

SEQ ID NO: 1535460 - RNA, 19 nt, Homo sapiens
gagggaaaguucugugaug

SEQ ID NO: 1535461 - RNA, 19 nt, Homo sapiens
ccaagagaauagauacauu

SEQ ID NO: 1535462 - RNA, 19 nt, Homo sapiens
ggaaaccaguggaucuuca

SEQ ID NO: 1535463 - RNA, 19 nt, Homo sapiens
cccaaaaucuucuacauua

SEQ ID NO: 1535464 - RNA, 19 nt, Homo sapiens
gggaagcgguuugcaguga

SEQ ID NO: 1535465 - RNA, 19 nt, Homo sapiens
ggagaagugcugcaaauuc

SEQ ID NO: 1535466 - RNA, 19 nt, Homo sapiens
ggacuugcaguuacuuaaa

SEQ ID NO: 1535467 - RNA, 19 nt, Homo sapiens
guacaguccucugcuucua

SEQ ID NO: 1535468 - RNA, 19 nt, Homo sapiens
aauaaacugugcccugaaa

SEQ ID NO: 1535469 - RNA, 19 nt, Homo sapiens
ggagauggcacuguccuaa

SEQ ID NO: 1535470 - RNA, 19 nt, Homo sapiens
gcacaccagucauggaucu

SEQ ID NO: 1535471 - RNA, 19 nt, Homo sapiens
gagcaaaggaggaaaccaa

SEQ ID NO: 1535472 - RNA, 19 nt, Homo sapiens
ggaagaugaugaugaugag

SEQ ID NO: 1535473 - RNA, 19 nt, Homo sapiens
gauguggaaacucaaauuu

SEQ ID NO: 1535474 - RNA, 19 nt, Homo sapiens
gauaaccacugcugcugau

SEQ ID NO: 1535475 - RNA, 19 nt, Homo sapiens
gagcauuccauguuucauu

SEQ ID NO: 1535476 - RNA, 19 nt, Homo sapiens
gagaagaguuagagcaaaa

SEQ ID NO: 1535477 - RNA, 19 nt, Homo sapiens
gaccucuuguucuuagaua

SEQ ID NO: 1535478 - RNA, 19 nt, Homo sapiens
ggaagcgguuugcagugaa

SEQ ID NO: 1535479 - RNA, 19 nt, Homo sapiens
gagagaagaguuagagcaa

SEQ ID NO: 1535480 - RNA, 19 nt, Homo sapiens
ggacaauccagaucgaguu

SEQ ID NO: 1535481 - RNA, 19 nt, Homo sapiens
ggagcuaggguucuuguug

SEQ ID NO: 1535482 - RNA, 19 nt, Homo sapiens
aaauucagguggaagaaga

SEQ ID NO: 1535483 - RNA, 19 nt, Homo sapiens
acaggaggcuggugcauuc

SEQ ID NO: 1535484 - RNA, 19 nt, Homo sapiens
ccaguggccuucaaaugug

SEQ ID NO: 1535485 - RNA, 19 nt, Homo sapiens
ggaccauaccucuuccuuu

SEQ ID NO: 1535486 - RNA, 19 nt, Homo sapiens
uggcagauguggaaacuca

SEQ ID NO: 1535487 - RNA, 19 nt, Homo sapiens
gcaugggccugugaagcua

SEQ ID NO: 1535488 - RNA, 19 nt, Homo sapiens
ccaccacugauaacuaaua

SEQ ID NO: 1535489 - RNA, 19 nt, Homo sapiens
uagcugagcacuuuaacaa

SEQ ID NO: 1535490 - RNA, 19 nt, Homo sapiens
agucauggaucuuguaauc

SEQ ID NO: 1535491 - RNA, 19 nt, Homo sapiens
gauuguaccuugcuuucuc

SEQ ID NO: 1535492 - RNA, 19 nt, Homo sapiens
uguuguagcugagcacuuu

SEQ ID NO: 1535493 - RNA, 19 nt, Homo sapiens
gaguuggucuccaccuaga

SEQ ID NO: 1535494 - RNA, 19 nt, Homo sapiens
ccacugcugcugauggaua

SEQ ID NO: 1535495 - RNA, 19 nt, Homo sapiens
gaaugugacuagugaucuc

SEQ ID NO: 1535496 - RNA, 19 nt, Homo sapiens
gauuuaagcagaaguccuu

SEQ ID NO: 1535497 - RNA, 19 nt, Homo sapiens
ggaaugauuuaagcagaag

SEQ ID NO: 1535498 - RNA, 19 nt, Homo sapiens
gcagauguggaaacucaaa

SEQ ID NO: 1535499 - RNA, 19 nt, Homo sapiens
caaaggaggaaaccaaagu

SEQ ID NO: 1535500 - RNA, 19 nt, Homo sapiens
guaaucaugccaagagaau

SEQ ID NO: 1535501 - RNA, 19 nt, Homo sapiens
ucauggaucuuguaaucau

SEQ ID NO: 1535502 - RNA, 19 nt, Homo sapiens
ccacugcccacuggacuua

SEQ ID NO: 1535503 - RNA, 19 nt, Homo sapiens
uggcaccacugcucucuga

SEQ ID NO: 1535504 - RNA, 19 nt, Homo sapiens
gagauggcacuguccuaaa

SEQ ID NO: 1535505 - RNA, 19 nt, Homo sapiens
ugacagagcacaugaagac

SEQ ID NO: 1535506 - RNA, 19 nt, Homo sapiens
ggccauucauacuuaaguu

SEQ ID NO: 1535507 - RNA, 19 nt, Homo sapiens
gcagaaguccuuuugugua

SEQ ID NO: 1535508 - RNA, 19 nt, Homo sapiens
uggaaugauuuaagcagaa

SEQ ID NO: 1535509 - RNA, 19 nt, Homo sapiens
agaguaacuugcauaguag

SEQ ID NO: 1535510 - RNA, 19 nt, Homo sapiens
caccacugauaacuaauau

SEQ ID NO: 1535511 - RNA, 19 nt, Homo sapiens
ggugauguccauuaaggaa

SEQ ID NO: 1535512 - RNA, 19 nt, Homo sapiens
uuauggaccucuuguucuu

SEQ ID NO: 1535513 - RNA, 19 nt, Homo sapiens
gaagcgguuugcagugaag

SEQ ID NO: 1535514 - RNA, 19 nt, Homo sapiens
acuggaaugugacuaguga

SEQ ID NO: 1535515 - RNA, 19 nt, Homo sapiens
uaaguaauucagaggcuaa

SEQ ID NO: 1535516 - RNA, 19 nt, Homo sapiens
gccacaggcuagagggaaa

SEQ ID NO: 1535517 - RNA, 19 nt, Homo sapiens
ccaguacaguccucugcuu

SEQ ID NO: 1535518 - RNA, 19 nt, Homo sapiens
ggucagagggacucagguu

SEQ ID NO: 1535519 - RNA, 19 nt, Homo sapiens
uuuaacaaguugagcauuc

SEQ ID NO: 1535520 - RNA, 19 nt, Homo sapiens
ccaccuagagauacauuug

SEQ ID NO: 1535521 - RNA, 19 nt, Homo sapiens
ccacugcccaugacugcua

SEQ ID NO: 1535522 - RNA, 19 nt, Homo sapiens
ugggagaagugcugcaaau

SEQ ID NO: 1535523 - RNA, 19 nt, Homo sapiens
acugugcccugaaaccuaa

SEQ ID NO: 1535524 - RNA, 19 nt, Homo sapiens
ucagagggacucagguuug

SEQ ID NO: 1535525 - RNA, 19 nt, Homo sapiens
agagaagaguuagagcaaa

SEQ ID NO: 1535526 - RNA, 19 nt, Homo sapiens
gcaaauucagguggaagaa

SEQ ID NO: 1535527 - RNA, 19 nt, Homo sapiens
ucaaauguggcagguagua

SEQ ID NO: 1535528 - RNA, 19 nt, Homo sapiens
uagcugcugccucuccuua

SEQ ID NO: 1535529 - RNA, 19 nt, Homo sapiens
guggugauguccauuaagg

SEQ ID NO: 1535530 - RNA, 19 nt, Homo sapiens
cuucuccucuucccaauuc

SEQ ID NO: 1535531 - RNA, 19 nt, Homo sapiens
gggagaagugcugcaaauu

SEQ ID NO: 1535532 - RNA, 19 nt, Homo sapiens
gggacuugcaguuacuuaa

SEQ ID NO: 1535533 - RNA, 19 nt, Homo sapiens
ccacugcucucugaacaac

SEQ ID NO: 1535534 - RNA, 19 nt, Homo sapiens
ugaccaccacugauaacua

SEQ ID NO: 1535535 - RNA, 19 nt, Homo sapiens
aaaagacagugguaaaugu

SEQ ID NO: 1535536 - RNA, 19 nt, Homo sapiens
ggaggaggaagaugaugau

SEQ ID NO: 1535537 - RNA, 19 nt, Homo sapiens
cugaacaacuuaccuuggu

SEQ ID NO: 1535538 - RNA, 19 nt, Homo sapiens
agauggcacuguccuaaag

SEQ ID NO: 1535539 - RNA, 19 nt, Homo sapiens
aaagacagugguaaauguu

SEQ ID NO: 1535540 - RNA, 19 nt, Homo sapiens
gcaaaggaggaaaccaaag

SEQ ID NO: 1535541 - RNA, 19 nt, Homo sapiens
caccacugcucucugaaca

SEQ ID NO: 1535542 - RNA, 19 nt, Homo sapiens
ccaagcccuucuccucuuc

SEQ ID NO: 1535543 - RNA, 19 nt, Homo sapiens
ccauuaaggaaaccagauu

SEQ ID NO: 1535544 - RNA, 19 nt, Homo sapiens
gauacauuauggaccucuu

SEQ ID NO: 1535545 - RNA, 19 nt, Homo sapiens
cugcugaggcuauacacua

SEQ ID NO: 1535546 - RNA, 19 nt, Homo sapiens
guguaaagcugcuguguaa

SEQ ID NO: 1535547 - RNA, 19 nt, Homo sapiens
uaaagcugcuguguaauuu

SEQ ID NO: 1535548 - RNA, 19 nt, Homo sapiens
guaaagcugcuguguaauu

SEQ ID NO: 1535549 - RNA, 19 nt, Homo sapiens
ggaccgaggaccagcuuua

SEQ ID NO: 1535550 - RNA, 19 nt, Homo sapiens
gaauuccaguggccucauu

SEQ ID NO: 1535551 - RNA, 19 nt, Homo sapiens
aagcugcuguguaauuuaa

SEQ ID NO: 1535552 - RNA, 19 nt, Homo sapiens
gccagaaccugacuuaaac

SEQ ID NO: 1535553 - RNA, 19 nt, Homo sapiens
ggacaugguacauucuuuc

SEQ ID NO: 1535554 - RNA, 19 nt, Homo sapiens
ggccggacaugguacauuc

SEQ ID NO: 1535555 - RNA, 19 nt, Homo sapiens
gccuagaggugauuugaag

SEQ ID NO: 1535556 - RNA, 19 nt, Homo sapiens
gugacaaagacgagcauua

SEQ ID NO: 1535557 - RNA, 19 nt, Homo sapiens
gcgguuaccugugccuaga

SEQ ID NO: 1535558 - RNA, 19 nt, Homo sapiens
gagcauuaccggaccuaug

SEQ ID NO: 1535559 - RNA, 19 nt, Homo sapiens
gagauccucaacauacgua

SEQ ID NO: 1535560 - RNA, 19 nt, Homo sapiens
uaugaugccuacuccacuu

SEQ ID NO: 1535561 - RNA, 19 nt, Homo sapiens
cuacaagcgugacaaagac

SEQ ID NO: 1535562 - RNA, 19 nt, Homo sapiens
cgucgguccucccagguuu

SEQ ID NO: 1535563 - RNA, 19 nt, Homo sapiens
acugaugccuucacacuca

SEQ ID NO: 1535564 - RNA, 19 nt, Homo sapiens
ugacaaagacgagcauuac

SEQ ID NO: 1535565 - RNA, 19 nt, Homo sapiens
caugguacauucuuucacu

SEQ ID NO: 1535566 - RNA, 19 nt, Homo sapiens
agccagaaccugacuuaaa

SEQ ID NO: 1535567 - RNA, 19 nt, Homo sapiens
ucuacaagcgugacaaaga

SEQ ID NO: 1535568 - RNA, 19 nt, Homo sapiens
cccaagcucuuccuucagu

SEQ ID NO: 1535569 - RNA, 19 nt, Homo sapiens
gcuguguaauuuaacuugu

SEQ ID NO: 1535570 - RNA, 19 nt, Homo sapiens
caacgccugugaagaagcu

SEQ ID NO: 1535571 - RNA, 19 nt, Homo sapiens
uaugagagacugagacaag

SEQ ID NO: 1535572 - RNA, 19 nt, Homo sapiens
gaggaacaucugucuguca

SEQ ID NO: 1535573 - RNA, 19 nt, Homo sapiens
gcauagcggcugccuggau

SEQ ID NO: 1535574 - RNA, 19 nt, Homo sapiens
ccagcuuccucuccucguu

SEQ ID NO: 1535575 - RNA, 19 nt, Homo sapiens
cggacaugguacauucuuu

SEQ ID NO: 1535576 - RNA, 19 nt, Homo sapiens
agagccagaaccugacuua

SEQ ID NO: 1535577 - RNA, 19 nt, Homo sapiens
cuccaacgccugugaagaa

SEQ ID NO: 1535578 - RNA, 19 nt, Homo sapiens
aaagcugcuguguaauuua

SEQ ID NO: 1535579 - RNA, 19 nt, Homo sapiens
uccagggacucuaccauuc

SEQ ID NO: 1535580 - RNA, 19 nt, Homo sapiens
gguggaggcagccaagaau

SEQ ID NO: 1535581 - RNA, 19 nt, Homo sapiens
caucuucuccucuauucug

SEQ ID NO: 1535582 - RNA, 19 nt, Homo sapiens
caucucaugcuguguaaag

SEQ ID NO: 1535583 - RNA, 19 nt, Homo sapiens
gaccgaggaccagcuuuau

SEQ ID NO: 1535584 - RNA, 19 nt, Homo sapiens
aaacugaugccuucacacu

SEQ ID NO: 1535585 - RNA, 19 nt, Homo sapiens
ggaccuaugaugccuacuc

SEQ ID NO: 1535586 - RNA, 19 nt, Homo sapiens
gacaugguacauucuuuca

SEQ ID NO: 1535587 - RNA, 19 nt, Homo sapiens
gagccagaaccugacuuaa

SEQ ID NO: 1535588 - RNA, 19 nt, Homo sapiens
auaaacugaugccuucaca

SEQ ID NO: 1535589 - RNA, 19 nt, Homo sapiens
guucuacaagcgugacaaa

SEQ ID NO: 1535590 - RNA, 19 nt, Homo sapiens
gccaucgucuagauaaacu

SEQ ID NO: 1535591 - RNA, 19 nt, Homo sapiens
caucgucuagauaaacuga

SEQ ID NO: 1535592 - RNA, 19 nt, Homo sapiens
cccaucuucuccucuauuc

SEQ ID NO: 1535593 - RNA, 19 nt, Homo sapiens
agcauuaccggaccuauga

SEQ ID NO: 1535594 - RNA, 19 nt, Homo sapiens
aggaacaucugucugucau

SEQ ID NO: 1535595 - RNA, 19 nt, Homo sapiens
ccacuaccucucccucaga

SEQ ID NO: 1535596 - RNA, 19 nt, Homo sapiens
cagcuuccucuccucguuu

SEQ ID NO: 1535597 - RNA, 19 nt, Homo sapiens
acuuaaaccuguguuccaa

SEQ ID NO: 1535598 - RNA, 19 nt, Homo sapiens
uucccaagcucuuccuuca

SEQ ID NO: 1535599 - RNA, 19 nt, Homo sapiens
uguguaaagcugcugugua

SEQ ID NO: 1535600 - RNA, 19 nt, Homo sapiens
uggaggaacaucugucugu

SEQ ID NO: 1535601 - RNA, 19 nt, Homo sapiens
gugguucucccuccaggaa

SEQ ID NO: 1535602 - RNA, 19 nt, Homo sapiens
ccugauccuugaccuugga

SEQ ID NO: 1535603 - RNA, 19 nt, Homo sapiens
gguucucccuccaggaaag

SEQ ID NO: 1535604 - RNA, 19 nt, Homo sapiens
guauuuggcggcaguguua

SEQ ID NO: 1535605 - RNA, 19 nt, Homo sapiens
ggcaaugcgucucgcgaua

SEQ ID NO: 1535606 - RNA, 19 nt, Homo sapiens
gauccgcaaugaugaggaa

SEQ ID NO: 1535607 - RNA, 19 nt, Homo sapiens
gcaaugcgucucgcgauaa

SEQ ID NO: 1535608 - RNA, 19 nt, Homo sapiens
gaggaacucaauaagcuuu

SEQ ID NO: 1535609 - RNA, 19 nt, Homo sapiens
uuaagguugucauugguaa

SEQ ID NO: 1535610 - RNA, 19 nt, Homo sapiens
uaacuuaagguugucauug

SEQ ID NO: 1535611 - RNA, 19 nt, Homo sapiens
gagagucaccaccauaaag

SEQ ID NO: 1535612 - RNA, 19 nt, Homo sapiens
uggcggcaguguuagagua

SEQ ID NO: 1535613 - RNA, 19 nt, Homo sapiens
uagagcggguuugcaguuu

SEQ ID NO: 1535614 - RNA, 19 nt, Homo sapiens
gagggaagcagggaggaaa

SEQ ID NO: 1535615 - RNA, 19 nt, Homo sapiens
gcggaguccugccuaacau

SEQ ID NO: 1535616 - RNA, 19 nt, Homo sapiens
ggaguccugccuaacauuc

SEQ ID NO: 1535617 - RNA, 19 nt, Homo sapiens
aaacuaugcagagcggaua

SEQ ID NO: 1535618 - RNA, 19 nt, Homo sapiens
gcagcuagcgauccgcaau

SEQ ID NO: 1535619 - RNA, 19 nt, Homo sapiens
gaguaucucacagcagaaa

SEQ ID NO: 1535620 - RNA, 19 nt, Homo sapiens
uccaucgucugcuucguaa

SEQ ID NO: 1535621 - RNA, 19 nt, Homo sapiens
uaaagcccaaagcaaguaa

SEQ ID NO: 1535622 - RNA, 19 nt, Homo sapiens
cauaaagcccaaagcaagu

SEQ ID NO: 1535623 - RNA, 19 nt, Homo sapiens
ggcaggcgcaccaguguau

SEQ ID NO: 1535624 - RNA, 19 nt, Homo sapiens
gaaaagcacgcgccaaguc

SEQ ID NO: 1535625 - RNA, 19 nt, Homo sapiens
ugagagucaccaccauaaa

SEQ ID NO: 1535626 - RNA, 19 nt, Homo sapiens
cagugcugcugcccaagaa

SEQ ID NO: 1535627 - RNA, 19 nt, Homo sapiens
ucucacagcagaaauccuu

SEQ ID NO: 1535628 - RNA, 19 nt, Homo sapiens
guaacuuaagguugucauu

SEQ ID NO: 1535629 - RNA, 19 nt, Homo sapiens
cuagcgauccgcaaugaug

SEQ ID NO: 1535630 - RNA, 19 nt, Homo sapiens
caaugcgucucgcgauaac

SEQ ID NO: 1535631 - RNA, 19 nt, Homo sapiens
caggcgcaccaguguauuu

SEQ ID NO: 1535632 - RNA, 19 nt, Homo sapiens
cuaagucucgcucuucuag

SEQ ID NO: 1535633 - RNA, 19 nt, Homo sapiens
ccggauccaucgucugcuu

SEQ ID NO: 1535634 - RNA, 19 nt, Homo sapiens
cugagagucaccaccauaa

SEQ ID NO: 1535635 - RNA, 19 nt, Homo sapiens
gcacgcgccaagucuaagu

SEQ ID NO: 1535636 - RNA, 19 nt, Homo sapiens
cuagagcggguuugcaguu

SEQ ID NO: 1535637 - RNA, 19 nt, Homo sapiens
aagcacgcgccaagucuaa

SEQ ID NO: 1535638 - RNA, 19 nt, Homo sapiens
ucacagcagaaauccuuga

SEQ ID NO: 1535639 - RNA, 19 nt, Homo sapiens
auaaagcccaaagcaagua

SEQ ID NO: 1535640 - RNA, 19 nt, Homo sapiens
aacuuaagguugucauugg

SEQ ID NO: 1535641 - RNA, 19 nt, Homo sapiens
aaagcacgcgccaagucua

SEQ ID NO: 1535642 - RNA, 19 nt, Homo sapiens
gagcggguuugcaguuucc

SEQ ID NO: 1535643 - RNA, 19 nt, Homo sapiens
ggagaaagaugugacuuaa

SEQ ID NO: 1535644 - RNA, 19 nt, Homo sapiens
gaaguucccuuuagauuuc

SEQ ID NO: 1535645 - RNA, 19 nt, Homo sapiens
gcacuuagauuuaauugca

SEQ ID NO: 1535646 - RNA, 19 nt, Homo sapiens
gaauguaaguuucaguuga

SEQ ID NO: 1535647 - RNA, 19 nt, Homo sapiens
cugcauaacuuuggaauua

SEQ ID NO: 1535648 - RNA, 19 nt, Homo sapiens
ggaccacaaugaauucuuu

SEQ ID NO: 1535649 - RNA, 19 nt, Homo sapiens
ucaggaagguggaagaaua

SEQ ID NO: 1535650 - RNA, 19 nt, Homo sapiens
gcuccaagaugucccuuua

SEQ ID NO: 1535651 - RNA, 19 nt, Homo sapiens
gcauaaauuuggagaaaga

SEQ ID NO: 1535652 - RNA, 19 nt, Homo sapiens
uaacaacccaguagcauua

SEQ ID NO: 1535653 - RNA, 19 nt, Homo sapiens
ggacccagcuuucuucugu

SEQ ID NO: 1535654 - RNA, 19 nt, Homo sapiens
gaaaggugccauucaguuu

SEQ ID NO: 1535655 - RNA, 19 nt, Homo sapiens
cagaagggcuugacauuca

SEQ ID NO: 1535656 - RNA, 19 nt, Homo sapiens
uaucauugcugaagacauu

SEQ ID NO: 1535657 - RNA, 19 nt, Homo sapiens
uaaggaaucugguauccaa

SEQ ID NO: 1535658 - RNA, 19 nt, Homo sapiens
aaaugaagcuucuagguau

SEQ ID NO: 1535659 - RNA, 19 nt, Homo sapiens
ccuaaggacuaccacaaua

SEQ ID NO: 1535660 - RNA, 19 nt, Homo sapiens
ucaaguaccuuuugugaua

SEQ ID NO: 1535661 - RNA, 19 nt, Homo sapiens
gcaauuuccguauagauuu

SEQ ID NO: 1535662 - RNA, 19 nt, Homo sapiens
agaagaagaugaaggcuau

SEQ ID NO: 1535663 - RNA, 19 nt, Homo sapiens
ggagaaaggauaagacuca

SEQ ID NO: 1535664 - RNA, 19 nt, Homo sapiens
uggaugagcucuaugaguu

SEQ ID NO: 1535665 - RNA, 19 nt, Homo sapiens
gguauuguaucauugagaa

SEQ ID NO: 1535666 - RNA, 19 nt, Homo sapiens
gaauaaagcagaauguaag

SEQ ID NO: 1535667 - RNA, 19 nt, Homo sapiens
ggagaugaagugcagguua

SEQ ID NO: 1535668 - RNA, 19 nt, Homo sapiens
gguacucggugauaauuga

SEQ ID NO: 1535669 - RNA, 19 nt, Homo sapiens
ggucaaggcuucacaagac

SEQ ID NO: 1535670 - RNA, 19 nt, Homo sapiens
uaaggugacuguccuggaa

SEQ ID NO: 1535671 - RNA, 19 nt, Homo sapiens
agacucagcuccaagaugu

SEQ ID NO: 1535672 - RNA, 19 nt, Homo sapiens
uaaaagcacugaccucaaa

SEQ ID NO: 1535673 - RNA, 19 nt, Homo sapiens
ugaauucuuugcccaguuu

SEQ ID NO: 1535674 - RNA, 19 nt, Homo sapiens
ggaacuggaugagcucuau

SEQ ID NO: 1535675 - RNA, 19 nt, Homo sapiens
gcgcauggauuuucauuuu

SEQ ID NO: 1535676 - RNA, 19 nt, Homo sapiens
ucuaugaguuuccagagua

SEQ ID NO: 1535677 - RNA, 19 nt, Homo sapiens
ccagugcaguguauugauu

SEQ ID NO: 1535678 - RNA, 19 nt, Homo sapiens
ggaagaggagcucagauug

SEQ ID NO: 1535679 - RNA, 19 nt, Homo sapiens
gcaaaccuauuucaucacu

SEQ ID NO: 1535680 - RNA, 19 nt, Homo sapiens
aaacaggcauuucccacaa

SEQ ID NO: 1535681 - RNA, 19 nt, Homo sapiens
gaagaggagcucagauugu

SEQ ID NO: 1535682 - RNA, 19 nt, Homo sapiens
gggaagaggagcucagauu

SEQ ID NO: 1535683 - RNA, 19 nt, Homo sapiens
gagaugaagugcagguuac

SEQ ID NO: 1535684 - RNA, 19 nt, Homo sapiens
cuaagaguauuggaaguuu

SEQ ID NO: 1535685 - RNA, 19 nt, Homo sapiens
gucaauggguguauuaaca

SEQ ID NO: 1535686 - RNA, 19 nt, Homo sapiens
ggacuaccacaauaaauca

SEQ ID NO: 1535687 - RNA, 19 nt, Homo sapiens
gcaggaggauugcuuaagc

SEQ ID NO: 1535688 - RNA, 19 nt, Homo sapiens
ggauaagacucagcuccaa

SEQ ID NO: 1535689 - RNA, 19 nt, Homo sapiens
uuaaugcucucuuggaugu

SEQ ID NO: 1535690 - RNA, 19 nt, Homo sapiens
cccuuuagauuucacauuu

SEQ ID NO: 1535691 - RNA, 19 nt, Homo sapiens
ggccgagucugggaugaua

SEQ ID NO: 1535692 - RNA, 19 nt, Homo sapiens
caaucaagcaggaaucauu

SEQ ID NO: 1535693 - RNA, 19 nt, Homo sapiens
gcauaacuuuggaauuaag

SEQ ID NO: 1535694 - RNA, 19 nt, Homo sapiens
cuaggcaacugcauaacuu

SEQ ID NO: 1535695 - RNA, 19 nt, Homo sapiens
guacauauuuccuccuacu

SEQ ID NO: 1535696 - RNA, 19 nt, Homo sapiens
aaaggugccauucaguuua

SEQ ID NO: 1535697 - RNA, 19 nt, Homo sapiens
cuacuacccugacuguguu

SEQ ID NO: 1535698 - RNA, 19 nt, Homo sapiens
uauacuaacugcaaagaag

SEQ ID NO: 1535699 - RNA, 19 nt, Homo sapiens
ggccauggauuugauuguu

SEQ ID NO: 1535700 - RNA, 19 nt, Homo sapiens
cccagaggaucuaagagua

SEQ ID NO: 1535701 - RNA, 19 nt, Homo sapiens
ucccagaucccacaaagua

SEQ ID NO: 1535702 - RNA, 19 nt, Homo sapiens
ccacuggcuuuacuacaga

SEQ ID NO: 1535703 - RNA, 19 nt, Homo sapiens
gaagguggaagaauaacug

SEQ ID NO: 1535704 - RNA, 19 nt, Homo sapiens
cagaggaucuaagaguauu

SEQ ID NO: 1535705 - RNA, 19 nt, Homo sapiens
gcaacugcauaacuuugga

SEQ ID NO: 1535706 - RNA, 19 nt, Homo sapiens
cacaauaaaucagucauca

SEQ ID NO: 1535707 - RNA, 19 nt, Homo sapiens
gcacugugguauacuaacu

SEQ ID NO: 1535708 - RNA, 19 nt, Homo sapiens
caaggcauuuauuaaggaa

SEQ ID NO: 1535709 - RNA, 19 nt, Homo sapiens
accaguaucuucucccuaa

SEQ ID NO: 1535710 - RNA, 19 nt, Homo sapiens
gaaaaggucucaucaacac

SEQ ID NO: 1535711 - RNA, 19 nt, Homo sapiens
uuucuaaggcgauaugaua

SEQ ID NO: 1535712 - RNA, 19 nt, Homo sapiens
caucagcaugcauaaauuu

SEQ ID NO: 1535713 - RNA, 19 nt, Homo sapiens
ggcaaagcccucuguguga

SEQ ID NO: 1535714 - RNA, 19 nt, Homo sapiens
gugcugaugucugugauug

SEQ ID NO: 1535715 - RNA, 19 nt, Homo sapiens
ugaaggcuaucaacagcuu

SEQ ID NO: 1535716 - RNA, 19 nt, Homo sapiens
gaaagaugugacuuaauuc

SEQ ID NO: 1535717 - RNA, 19 nt, Homo sapiens
uaaggacuaccacaauaaa

SEQ ID NO: 1535718 - RNA, 19 nt, Homo sapiens
aaccgucucuacauaguaa

SEQ ID NO: 1535719 - RNA, 19 nt, Homo sapiens
aaggugccauucaguuuaa

SEQ ID NO: 1535720 - RNA, 19 nt, Homo sapiens
gcagaagggcuugacauuc

SEQ ID NO: 1535721 - RNA, 19 nt, Homo sapiens
acaaggcauuuauuaagga

SEQ ID NO: 1535722 - RNA, 19 nt, Homo sapiens
cagcaugcauaaauuugga

SEQ ID NO: 1535723 - RNA, 19 nt, Homo sapiens
gaugagcucuaugaguuuc

SEQ ID NO: 1535724 - RNA, 19 nt, Homo sapiens
cuaaggacuaccacaauaa

SEQ ID NO: 1535725 - RNA, 19 nt, Homo sapiens
caucaacacuggaguucuc

SEQ ID NO: 1535726 - RNA, 19 nt, Homo sapiens
ucaguaucuuuaccaauga

SEQ ID NO: 1535727 - RNA, 19 nt, Homo sapiens
ugagaaaccaagucaauca

SEQ ID NO: 1535728 - RNA, 19 nt, Homo sapiens
cuacaaggcauuuauuaag

SEQ ID NO: 1535729 - RNA, 19 nt, Homo sapiens
uggagaaagaugugacuua

SEQ ID NO: 1535730 - RNA, 19 nt, Homo sapiens
gaaguggagagaauacugu

SEQ ID NO: 1535731 - RNA, 19 nt, Homo sapiens
caagcaggaaucauuuaaa

SEQ ID NO: 1535732 - RNA, 19 nt, Homo sapiens
ucaagcaggaaucauuuaa

SEQ ID NO: 1535733 - RNA, 19 nt, Homo sapiens
cagaauaaagcagaaugua

SEQ ID NO: 1535734 - RNA, 19 nt, Homo sapiens
cuaaggcgauaugauaaug

SEQ ID NO: 1535735 - RNA, 19 nt, Homo sapiens
caggaagguggaagaauaa

SEQ ID NO: 1535736 - RNA, 19 nt, Homo sapiens
caguugaggccauggauuu

SEQ ID NO: 1535737 - RNA, 19 nt, Homo sapiens
augcaaaccuauuucauca

SEQ ID NO: 1535738 - RNA, 19 nt, Homo sapiens
ccagaucccacaaaguauu

SEQ ID NO: 1535739 - RNA, 19 nt, Homo sapiens
gugcuucaguuccaucuca

SEQ ID NO: 1535740 - RNA, 19 nt, Homo sapiens
ggaugagcucuaugaguuu

SEQ ID NO: 1535741 - RNA, 19 nt, Homo sapiens
gaggcaggaggauugcuua

SEQ ID NO: 1535742 - RNA, 19 nt, Homo sapiens
gagaaaccaagucaaucaa

SEQ ID NO: 1535743 - RNA, 19 nt, Homo sapiens
ccaaagagccugaguaaau

SEQ ID NO: 1535744 - RNA, 19 nt, Homo sapiens
caacaagguuacugagauu

SEQ ID NO: 1535745 - RNA, 19 nt, Homo sapiens
ggaaaucaaucccaaagag

SEQ ID NO: 1535746 - RNA, 19 nt, Homo sapiens
gaacaagugauguggaauu

SEQ ID NO: 1535747 - RNA, 19 nt, Homo sapiens
gaauacagagcgagcaaua

SEQ ID NO: 1535748 - RNA, 19 nt, Homo sapiens
guauucaucucauggcaua

SEQ ID NO: 1535749 - RNA, 19 nt, Homo sapiens
caagugauguggaauuaau

SEQ ID NO: 1535750 - RNA, 19 nt, Homo sapiens
gaaaugacgccaggaguaa

SEQ ID NO: 1535751 - RNA, 19 nt, Homo sapiens
caaagagccugaguaaaug

SEQ ID NO: 1535752 - RNA, 19 nt, Homo sapiens
caacagccuucucuuucua

SEQ ID NO: 1535753 - RNA, 19 nt, Homo sapiens
uuacuaugcugcacucuaa

SEQ ID NO: 1535754 - RNA, 19 nt, Homo sapiens
gaaaggccacuacgaaaug

SEQ ID NO: 1535755 - RNA, 19 nt, Homo sapiens
caacggaacuucacuuuug

SEQ ID NO: 1535756 - RNA, 19 nt, Homo sapiens
cuaaagauguugacuugga

SEQ ID NO: 1535757 - RNA, 19 nt, Homo sapiens
gaagacagguuagcauuuu

SEQ ID NO: 1535758 - RNA, 19 nt, Homo sapiens
uugaugagcuugucacauu

SEQ ID NO: 1535759 - RNA, 19 nt, Homo sapiens
gagaaagagguaagaauga

SEQ ID NO: 1535760 - RNA, 19 nt, Homo sapiens
gaaccuggcauacuuagga

SEQ ID NO: 1535761 - RNA, 19 nt, Homo sapiens
gcagaaaggccaacgugaa

SEQ ID NO: 1535762 - RNA, 19 nt, Homo sapiens
gauguugacuuggauuuau

SEQ ID NO: 1535763 - RNA, 19 nt, Homo sapiens
ugaaauaggaucaggcuuu

SEQ ID NO: 1535764 - RNA, 19 nt, Homo sapiens
caacagcuguacagacaau

SEQ ID NO: 1535765 - RNA, 19 nt, Homo sapiens
ggaagacagguuagcauuu

SEQ ID NO: 1535766 - RNA, 19 nt, Homo sapiens
gucuagauguagcguauua

SEQ ID NO: 1535767 - RNA, 19 nt, Homo sapiens
caucucauggcauaaauua

SEQ ID NO: 1535768 - RNA, 19 nt, Homo sapiens
agccuucucuuucuauuua

SEQ ID NO: 1535769 - RNA, 19 nt, Homo sapiens
ccauugugauucuugauuu

SEQ ID NO: 1535770 - RNA, 19 nt, Homo sapiens
guacagacaaucaauaaca

SEQ ID NO: 1535771 - RNA, 19 nt, Homo sapiens
gaaauaggaucaggcuuuu

SEQ ID NO: 1535772 - RNA, 19 nt, Homo sapiens
cgaaaugacgccaggagua

SEQ ID NO: 1535773 - RNA, 19 nt, Homo sapiens
cgggauaccugcccacuau

SEQ ID NO: 1535774 - RNA, 19 nt, Homo sapiens
aaacagccaugcuauugug

SEQ ID NO: 1535775 - RNA, 19 nt, Homo sapiens
caauagaccagccaucuga

SEQ ID NO: 1535776 - RNA, 19 nt, Homo sapiens
agacagaccgaaugcaaua

SEQ ID NO: 1535777 - RNA, 19 nt, Homo sapiens
ggacaggcaccaaagcuau

SEQ ID NO: 1535778 - RNA, 19 nt, Homo sapiens
cgaaagcacugauugucau

SEQ ID NO: 1535779 - RNA, 19 nt, Homo sapiens
cuucauggguuaauuuaga

SEQ ID NO: 1535780 - RNA, 19 nt, Homo sapiens
cagcaauucugauucugaa

SEQ ID NO: 1535781 - RNA, 19 nt, Homo sapiens
aacaagugauguggaauua

SEQ ID NO: 1535782 - RNA, 19 nt, Homo sapiens
gagaguuaacauugacuua

SEQ ID NO: 1535783 - RNA, 19 nt, Homo sapiens
cgagcaauauguagcuuga

SEQ ID NO: 1535784 - RNA, 19 nt, Homo sapiens
gaccagccaucugaucaaa

SEQ ID NO: 1535785 - RNA, 19 nt, Homo sapiens
gcagacagaccgaaugcaa

SEQ ID NO: 1535786 - RNA, 19 nt, Homo sapiens
cuacaacagccuucucuuu

SEQ ID NO: 1535787 - RNA, 19 nt, Homo sapiens
gaguggaacuguggaacaa

SEQ ID NO: 1535788 - RNA, 19 nt, Homo sapiens
ggaagguccuguucuuacu

SEQ ID NO: 1535789 - RNA, 19 nt, Homo sapiens
guguagauuucauucauug

SEQ ID NO: 1535790 - RNA, 19 nt, Homo sapiens
cagguaguguucuagauga

SEQ ID NO: 1535791 - RNA, 19 nt, Homo sapiens
cgaaagggccugcaaggau

SEQ ID NO: 1535792 - RNA, 19 nt, Homo sapiens
acuagacaguguuauguaa

SEQ ID NO: 1535793 - RNA, 19 nt, Homo sapiens
aacuaaagauguugacuug

SEQ ID NO: 1535794 - RNA, 19 nt, Homo sapiens
acaacaagguuacugagau

SEQ ID NO: 1535795 - RNA, 19 nt, Homo sapiens
gcaauucugauucugaaau

SEQ ID NO: 1535796 - RNA, 19 nt, Homo sapiens
gaagguccuguucuuacua

SEQ ID NO: 1535797 - RNA, 19 nt, Homo sapiens
ggaagcaaacugccuuuua

SEQ ID NO: 1535798 - RNA, 19 nt, Homo sapiens
acacacaguucuggaaaga

SEQ ID NO: 1535799 - RNA, 19 nt, Homo sapiens
gaacuucacuuuuguaacg

SEQ ID NO: 1535800 - RNA, 19 nt, Homo sapiens
ugagaaagagguaagaaug

SEQ ID NO: 1535801 - RNA, 19 nt, Homo sapiens
ugauuuccuucauggguua

SEQ ID NO: 1535802 - RNA, 19 nt, Homo sapiens
gcaauauguagcuugaauu

SEQ ID NO: 1535803 - RNA, 19 nt, Homo sapiens
cauuucagaucuucuaauc

SEQ ID NO: 1535804 - RNA, 19 nt, Homo sapiens
aauaaaggcaggcaaaguu

SEQ ID NO: 1535805 - RNA, 19 nt, Homo sapiens
ucacuuaaggccuauagaa

SEQ ID NO: 1535806 - RNA, 19 nt, Homo sapiens
gaaagcacugauugucauu

SEQ ID NO: 1535807 - RNA, 19 nt, Homo sapiens
ccagccaucugaucaaagu

SEQ ID NO: 1535808 - RNA, 19 nt, Homo sapiens
uagacaguguuauguaaug

SEQ ID NO: 1535809 - RNA, 19 nt, Homo sapiens
gggaagacagguuagcauu

SEQ ID NO: 1535810 - RNA, 19 nt, Homo sapiens
auucauaugugcacuguau

SEQ ID NO: 1535811 - RNA, 19 nt, Homo sapiens
uaaagauguugacuuggau

SEQ ID NO: 1535812 - RNA, 19 nt, Homo sapiens
gagacaacaagguuacuga

SEQ ID NO: 1535813 - RNA, 19 nt, Homo sapiens
gaauaaaggcaggcaaagu

SEQ ID NO: 1535814 - RNA, 19 nt, Homo sapiens
gaagcaaacugccuuuuac

SEQ ID NO: 1535815 - RNA, 19 nt, Homo sapiens
uggaacaagugauguggaa

SEQ ID NO: 1535816 - RNA, 19 nt, Homo sapiens
ugacuucuccauugugauu

SEQ ID NO: 1535817 - RNA, 19 nt, Homo sapiens
uugcagaacugucuuaagg

SEQ ID NO: 1535818 - RNA, 19 nt, Homo sapiens
uaagagaguuaacauugac

SEQ ID NO: 1535819 - RNA, 19 nt, Homo sapiens
gauuacaauucuucaaagg

SEQ ID NO: 1535820 - RNA, 19 nt, Homo sapiens
ugcaacagcuguacagaca

SEQ ID NO: 1535821 - RNA, 19 nt, Homo sapiens
cuuaaggccuauagaacuu

SEQ ID NO: 1535822 - RNA, 19 nt, Homo sapiens
gcgaaagcacugauuguca

SEQ ID NO: 1535823 - RNA, 19 nt, Homo sapiens
gagcugcauacgcacaaua

SEQ ID NO: 1535824 - RNA, 19 nt, Homo sapiens
gcuguacagacaaucaaua

SEQ ID NO: 1535825 - RNA, 19 nt, Homo sapiens
ggaauuaaugggugcaaca

SEQ ID NO: 1535826 - RNA, 19 nt, Homo sapiens
caacuucauccagcccuua

SEQ ID NO: 1535827 - RNA, 19 nt, Homo sapiens
ugacucuccugugcaaauu

SEQ ID NO: 1535828 - RNA, 19 nt, Homo sapiens
uacaagggaagacagguua

SEQ ID NO: 1535829 - RNA, 19 nt, Homo sapiens
ucauaugugcacuguauaa

SEQ ID NO: 1535830 - RNA, 19 nt, Homo sapiens
gguuaaugauaaugugguu

SEQ ID NO: 1535831 - RNA, 19 nt, Homo sapiens
ugugucgacucguggcuua

SEQ ID NO: 1535832 - RNA, 19 nt, Homo sapiens
gagcuugucacauucuaau

SEQ ID NO: 1535833 - RNA, 19 nt, Homo sapiens
caccaaagcuauuuucuca

SEQ ID NO: 1535834 - RNA, 19 nt, Homo sapiens
ugaaaggccacuacgaaau

SEQ ID NO: 1535835 - RNA, 19 nt, Homo sapiens
ucacuggauuuacuuuaag

SEQ ID NO: 1535836 - RNA, 19 nt, Homo sapiens
cauccagcccuuauacaaa

SEQ ID NO: 1535837 - RNA, 19 nt, Homo sapiens
uaugugcacuguauaagag

SEQ ID NO: 1535838 - RNA, 19 nt, Homo sapiens
augcugcacucuaaagaaa

SEQ ID NO: 1535839 - RNA, 19 nt, Homo sapiens
caagguuacugagauuaca

SEQ ID NO: 1535840 - RNA, 19 nt, Homo sapiens
acagagcgagcaauaugua

SEQ ID NO: 1535841 - RNA, 19 nt, Homo sapiens
guuagaaaaugcuguuuga

SEQ ID NO: 1535842 - RNA, 19 nt, Homo sapiens
guagcuaauaagagaguua

SEQ ID NO: 1535843 - RNA, 19 nt, Homo sapiens
aaacuaaacuucgggaaua

SEQ ID NO: 1535844 - RNA, 19 nt, Homo sapiens
gagcauggaucccuccuuu

SEQ ID NO: 1535845 - RNA, 19 nt, Homo sapiens
cauguggccuuuauaaaua

SEQ ID NO: 1535846 - RNA, 19 nt, Homo sapiens
gcugagaaccuaaguauuu

SEQ ID NO: 1535847 - RNA, 19 nt, Homo sapiens
gaaaagcacugaggaauuu

SEQ ID NO: 1535848 - RNA, 19 nt, Homo sapiens
caacauccuuguaaacuug

SEQ ID NO: 1535849 - RNA, 19 nt, Homo sapiens
ccaaagugcuggaguguug

SEQ ID NO: 1535850 - RNA, 19 nt, Homo sapiens
ugaguaaauuggugaguua

SEQ ID NO: 1535851 - RNA, 19 nt, Homo sapiens
gcauaagauugcacacaua

SEQ ID NO: 1535852 - RNA, 19 nt, Homo sapiens
gcacgucccugcuguuuca

SEQ ID NO: 1535853 - RNA, 19 nt, Homo sapiens
ccaaaugccucuacaagau

SEQ ID NO: 1535854 - RNA, 19 nt, Homo sapiens
gaggaaaguugcucugaga

SEQ ID NO: 1535855 - RNA, 19 nt, Homo sapiens
gauaugguccaaugaauuu

SEQ ID NO: 1535856 - RNA, 19 nt, Homo sapiens
gaauauguaugcccaaagu

SEQ ID NO: 1535857 - RNA, 19 nt, Homo sapiens
ggacacacauugcccuguu

SEQ ID NO: 1535858 - RNA, 19 nt, Homo sapiens
ugaaaucuuuguuguguga

SEQ ID NO: 1535859 - RNA, 19 nt, Homo sapiens
gagugcagcuuaacauguu

SEQ ID NO: 1535860 - RNA, 19 nt, Homo sapiens
ggaauuagaacccuucaug

SEQ ID NO: 1535861 - RNA, 19 nt, Homo sapiens
uggaauagcaguuugauuu

SEQ ID NO: 1535862 - RNA, 19 nt, Homo sapiens
cuagaaagcucuggacaug

SEQ ID NO: 1535863 - RNA, 19 nt, Homo sapiens
ccauuuguguuuagaguaa

SEQ ID NO: 1535864 - RNA, 19 nt, Homo sapiens
uugcaucgcugccagauuu

SEQ ID NO: 1535865 - RNA, 19 nt, Homo sapiens
guaaguaggaugagaauag

SEQ ID NO: 1535866 - RNA, 19 nt, Homo sapiens
gcaccuccuucuuaacuga

SEQ ID NO: 1535867 - RNA, 19 nt, Homo sapiens
agaguuauaugcagaaguu

SEQ ID NO: 1535868 - RNA, 19 nt, Homo sapiens
uguauaagcucacacuuca

SEQ ID NO: 1535869 - RNA, 19 nt, Homo sapiens
gugcuggaguguugucaua

SEQ ID NO: 1535870 - RNA, 19 nt, Homo sapiens
ccuggaagauuucugguuu

SEQ ID NO: 1535871 - RNA, 19 nt, Homo sapiens
aaacuugugucuccgugua

SEQ ID NO: 1535872 - RNA, 19 nt, Homo sapiens
ucauuugagucuuuccuua

SEQ ID NO: 1535873 - RNA, 19 nt, Homo sapiens
ggacacaagaggaaaguug

SEQ ID NO: 1535874 - RNA, 19 nt, Homo sapiens
ggugugguguguuauacua

SEQ ID NO: 1535875 - RNA, 19 nt, Homo sapiens
guauggcaccuccuucuua

SEQ ID NO: 1535876 - RNA, 19 nt, Homo sapiens
ggaagaaauacuuguguug

SEQ ID NO: 1535877 - RNA, 19 nt, Homo sapiens
caaaguaaguaggaugaga

SEQ ID NO: 1535878 - RNA, 19 nt, Homo sapiens
uaagacgacuuuaacuugu

SEQ ID NO: 1535879 - RNA, 19 nt, Homo sapiens
gaggugaacuguggcaaug

SEQ ID NO: 1535880 - RNA, 19 nt, Homo sapiens
gcacacauaauucaagaug

SEQ ID NO: 1535881 - RNA, 19 nt, Homo sapiens
agacgugccugccagauga

SEQ ID NO: 1535882 - RNA, 19 nt, Homo sapiens
cauguugacuugauugguu

SEQ ID NO: 1535883 - RNA, 19 nt, Homo sapiens
ucaaagccauucuucaaca

SEQ ID NO: 1535884 - RNA, 19 nt, Homo sapiens
ggauaugguccaaugaauu

SEQ ID NO: 1535885 - RNA, 19 nt, Homo sapiens
agggaaaguugaauguaua

SEQ ID NO: 1535886 - RNA, 19 nt, Homo sapiens
gagagcaaucuuuguauga

SEQ ID NO: 1535887 - RNA, 19 nt, Homo sapiens
uagggaaaguugaauguau

SEQ ID NO: 1535888 - RNA, 19 nt, Homo sapiens
cagaaacaguuaaugagau

SEQ ID NO: 1535889 - RNA, 19 nt, Homo sapiens
ggugaacuguggcaaugaa

SEQ ID NO: 1535890 - RNA, 19 nt, Homo sapiens
ugagaagaauggaggagaa

SEQ ID NO: 1535891 - RNA, 19 nt, Homo sapiens
ggaauuugcaucacaguca

SEQ ID NO: 1535892 - RNA, 19 nt, Homo sapiens
agaauugucuucagguguu

SEQ ID NO: 1535893 - RNA, 19 nt, Homo sapiens
uacaaucgauacaaucuga

SEQ ID NO: 1535894 - RNA, 19 nt, Homo sapiens
uauggcaccuccuucuuaa

SEQ ID NO: 1535895 - RNA, 19 nt, Homo sapiens
agaagugccugccagagaa

SEQ ID NO: 1535896 - RNA, 19 nt, Homo sapiens
gggaauauguaugcccaaa

SEQ ID NO: 1535897 - RNA, 19 nt, Homo sapiens
ggauucaaguucuuacaca

SEQ ID NO: 1535898 - RNA, 19 nt, Homo sapiens
cagcuguuauuauugauga

SEQ ID NO: 1535899 - RNA, 19 nt, Homo sapiens
gagcuggccuuggaauuag

SEQ ID NO: 1535900 - RNA, 19 nt, Homo sapiens
gcaggggugugguguguua

SEQ ID NO: 1535901 - RNA, 19 nt, Homo sapiens
cuucuuaacugauaugcaa

SEQ ID NO: 1535902 - RNA, 19 nt, Homo sapiens
cauaagauugcacacauaa

SEQ ID NO: 1535903 - RNA, 19 nt, Homo sapiens
caaagccauucuucaacaa

SEQ ID NO: 1535904 - RNA, 19 nt, Homo sapiens
agaaacaguuaaugagaug

SEQ ID NO: 1535905 - RNA, 19 nt, Homo sapiens
ccuguaggcuggaaguaaa

SEQ ID NO: 1535906 - RNA, 19 nt, Homo sapiens
uuagagagcaaucuuugua

SEQ ID NO: 1535907 - RNA, 19 nt, Homo sapiens
gggauaugguccaaugaau

SEQ ID NO: 1535908 - RNA, 19 nt, Homo sapiens
gaagaauggaggagaagga

SEQ ID NO: 1535909 - RNA, 19 nt, Homo sapiens
caugggauaugguccaaug

SEQ ID NO: 1535910 - RNA, 19 nt, Homo sapiens
cuaagacgacuuuaacuug

SEQ ID NO: 1535911 - RNA, 19 nt, Homo sapiens
gcaagacuuuguguuguag

SEQ ID NO: 1535912 - RNA, 19 nt, Homo sapiens
ggaacacccuagaauuguc

SEQ ID NO: 1535913 - RNA, 19 nt, Homo sapiens
ucauggaggugcagagaga

SEQ ID NO: 1535914 - RNA, 19 nt, Homo sapiens
cugaugagcuggagugcaa

SEQ ID NO: 1535915 - RNA, 19 nt, Homo sapiens
ggcauaagauugcacacau

SEQ ID NO: 1535916 - RNA, 19 nt, Homo sapiens
agacccaccuggcauaaga

SEQ ID NO: 1535917 - RNA, 19 nt, Homo sapiens
caagauacagcuaaauaca

SEQ ID NO: 1535918 - RNA, 19 nt, Homo sapiens
ucucauacagcuguuauua

SEQ ID NO: 1535919 - RNA, 19 nt, Homo sapiens
gagcaaucuuuguaugaca

SEQ ID NO: 1535920 - RNA, 19 nt, Homo sapiens
gaagauguuuugugguuug

SEQ ID NO: 1535921 - RNA, 19 nt, Homo sapiens
cccaagauacagcuaaaua

SEQ ID NO: 1535922 - RNA, 19 nt, Homo sapiens
gaacuucuuuucaugaugu

SEQ ID NO: 1535923 - RNA, 19 nt, Homo sapiens
gaauacaagcauaaucuag

SEQ ID NO: 1535924 - RNA, 19 nt, Homo sapiens
gauucaaguucuuacacaa

SEQ ID NO: 1535925 - RNA, 19 nt, Homo sapiens
ugcaagacuuuguguugua

SEQ ID NO: 1535926 - RNA, 19 nt, Homo sapiens
ccagaaacaguuaaugaga

SEQ ID NO: 1535927 - RNA, 19 nt, Homo sapiens
cugaaaagguuccauuuaa

SEQ ID NO: 1535928 - RNA, 19 nt, Homo sapiens
ccauugagauacuuguuuc

SEQ ID NO: 1535929 - RNA, 19 nt, Homo sapiens
gaucccuccuuucguauuc

SEQ ID NO: 1535930 - RNA, 19 nt, Homo sapiens
uuaguagccugcccgauga

SEQ ID NO: 1535931 - RNA, 19 nt, Homo sapiens
gaauuuaagccccaagaua

SEQ ID NO: 1535932 - RNA, 19 nt, Homo sapiens
uuuagcagauuacaaguug

SEQ ID NO: 1535933 - RNA, 19 nt, Homo sapiens
gaauugucuucagguguuu

SEQ ID NO: 1535934 - RNA, 19 nt, Homo sapiens
gaauuagaacccuucaugu

SEQ ID NO: 1535935 - RNA, 19 nt, Homo sapiens
gacacacauugcccuguuu

SEQ ID NO: 1535936 - RNA, 19 nt, Homo sapiens
gaaauuggacacacauugc

SEQ ID NO: 1535937 - RNA, 19 nt, Homo sapiens
cuucagcuccuuacccuua

SEQ ID NO: 1535938 - RNA, 19 nt, Homo sapiens
gcauuacuaagacgacuuu

SEQ ID NO: 1535939 - RNA, 19 nt, Homo sapiens
aaucaaagccauucuucaa

SEQ ID NO: 1535940 - RNA, 19 nt, Homo sapiens
uugcuucucuguauaaugu

SEQ ID NO: 1535941 - RNA, 19 nt, Homo sapiens
ucauguggccuuuauaaau

SEQ ID NO: 1535942 - RNA, 19 nt, Homo sapiens
gaugagaauaguauacaug

SEQ ID NO: 1535943 - RNA, 19 nt, Homo sapiens
gaaccgagguaauggauuc

SEQ ID NO: 1535944 - RNA, 19 nt, Homo sapiens
ccaaaugugucucugcuaa

SEQ ID NO: 1535945 - RNA, 19 nt, Homo sapiens
caaugagagugaccaaaua

SEQ ID NO: 1535946 - RNA, 19 nt, Homo sapiens
gaagcaaguuugucaagau

SEQ ID NO: 1535947 - RNA, 19 nt, Homo sapiens
cagcaaauguuuaggcaaa

SEQ ID NO: 1535948 - RNA, 19 nt, Homo sapiens
uauagaaggugcuaaugaa

SEQ ID NO: 1535949 - RNA, 19 nt, Homo sapiens
ugagagugaccaaauauua

SEQ ID NO: 1535950 - RNA, 19 nt, Homo sapiens
agagcuagauggaaccuua

SEQ ID NO: 1535951 - RNA, 19 nt, Homo sapiens
ggccacaccuccaaaguga

SEQ ID NO: 1535952 - RNA, 19 nt, Homo sapiens
ggaagcaaguuugucaaga

SEQ ID NO: 1535953 - RNA, 19 nt, Homo sapiens
uaacuggguuucccuacuu

SEQ ID NO: 1535954 - RNA, 19 nt, Homo sapiens
cacagagacuggaauaaau

SEQ ID NO: 1535955 - RNA, 19 nt, Homo sapiens
ucacagagacuggaauaaa

SEQ ID NO: 1535956 - RNA, 19 nt, Homo sapiens
caaagacacauggaccuua

SEQ ID NO: 1535957 - RNA, 19 nt, Homo sapiens
gaagagacaaagacacaug

SEQ ID NO: 1535958 - RNA, 19 nt, Homo sapiens
gaaacaggaaguucauuca

SEQ ID NO: 1535959 - RNA, 19 nt, Homo sapiens
guaauggauucgagugaug

SEQ ID NO: 1535960 - RNA, 19 nt, Homo sapiens
uagcacgugugucuucuuu

SEQ ID NO: 1535961 - RNA, 19 nt, Homo sapiens
guauagaaggugcuaauga

SEQ ID NO: 1535962 - RNA, 19 nt, Homo sapiens
aaagacacauggaccuuau

SEQ ID NO: 1535963 - RNA, 19 nt, Homo sapiens
gcacgugugucuucuuugc

SEQ ID NO: 1535964 - RNA, 19 nt, Homo sapiens
acagagacuggaauaaaua

SEQ ID NO: 1535965 - RNA, 19 nt, Homo sapiens
gggaaagggauauuugaga

SEQ ID NO: 1535966 - RNA, 19 nt, Homo sapiens
gagagugaccaaauauuag

SEQ ID NO: 1535967 - RNA, 19 nt, Homo sapiens
gagacuggaauaaauauag

SEQ ID NO: 1535968 - RNA, 19 nt, Homo sapiens
uugcaguguuugcuaauuu

SEQ ID NO: 1535969 - RNA, 19 nt, Homo sapiens
cauggaccuuauguaauua

SEQ ID NO: 1535970 - RNA, 19 nt, Homo sapiens
ggauucgagugaugaaaca

SEQ ID NO: 1535971 - RNA, 19 nt, Homo sapiens
aaaugugucucugcuaaga

SEQ ID NO: 1535972 - RNA, 19 nt, Homo sapiens
gauauuugagagcuucuuu

SEQ ID NO: 1535973 - RNA, 19 nt, Homo sapiens
gauggaaccuuagugaaaa

SEQ ID NO: 1535974 - RNA, 19 nt, Homo sapiens
ucaaugagagugaccaaau

SEQ ID NO: 1535975 - RNA, 19 nt, Homo sapiens
caugagauuuggugucaca

SEQ ID NO: 1535976 - RNA, 19 nt, Homo sapiens
gauuuagcuuuaacacuca

SEQ ID NO: 1535977 - RNA, 19 nt, Homo sapiens
gguaauggauucgagugau

SEQ ID NO: 1535978 - RNA, 19 nt, Homo sapiens
ugacagagaaccgagguaa

SEQ ID NO: 1535979 - RNA, 19 nt, Homo sapiens
ugucuucuuugcaguguuu

SEQ ID NO: 1535980 - RNA, 19 nt, Homo sapiens
guucuagccucuacugucu

SEQ ID NO: 1535981 - RNA, 19 nt, Homo sapiens
ccucuacugucuacauaug

SEQ ID NO: 1535982 - RNA, 19 nt, Homo sapiens
agauggaaccuuagugaaa

SEQ ID NO: 1535983 - RNA, 19 nt, Homo sapiens
ccacauccacucaccucua

SEQ ID NO: 1535984 - RNA, 19 nt, Homo sapiens
cgaaugcuguauagaaggu

SEQ ID NO: 1535985 - RNA, 19 nt, Homo sapiens
guaccuaaccugcgaaugc

SEQ ID NO: 1535986 - RNA, 19 nt, Homo sapiens
aacaggaaguucauucaug

SEQ ID NO: 1535987 - RNA, 19 nt, Homo sapiens
aagcaaguuugucaagaug

SEQ ID NO: 1535988 - RNA, 19 nt, Homo sapiens
gacauugggaagcaaguuu

SEQ ID NO: 1535989 - RNA, 19 nt, Homo sapiens
cuagauggaaccuuaguga

SEQ ID NO: 1535990 - RNA, 19 nt, Homo sapiens
acagagaaccgagguaaug

SEQ ID NO: 1535991 - RNA, 19 nt, Homo sapiens
cagagccacucagacauug

SEQ ID NO: 1535992 - RNA, 19 nt, Homo sapiens
auaaauagcacgugugucu

SEQ ID NO: 1535993 - RNA, 19 nt, Homo sapiens
gugcuaaugaacaugauuu

SEQ ID NO: 1535994 - RNA, 19 nt, Homo sapiens
agaaggugcuaaugaacau

SEQ ID NO: 1535995 - RNA, 19 nt, Homo sapiens
ccacccagcagcagcguuu

SEQ ID NO: 1535996 - RNA, 19 nt, Homo sapiens
ucagagccacucagacauu

SEQ ID NO: 1535997 - RNA, 19 nt, Homo sapiens
ugagaccgcugaggaucaa

SEQ ID NO: 1535998 - RNA, 19 nt, Homo sapiens
ugccacccauuucaaguuu

SEQ ID NO: 1535999 - RNA, 19 nt, Homo sapiens
gggaaacguuugggaaagg

SEQ ID NO: 1536000 - RNA, 19 nt, Homo sapiens
uucgacugcuccucucuua

SEQ ID NO: 1536001 - RNA, 19 nt, Homo sapiens
ugucacagagacuggaaua

SEQ ID NO: 1536002 - RNA, 19 nt, Homo sapiens
gugguuuaguuauuugaug

SEQ ID NO: 1536003 - RNA, 19 nt, Homo sapiens
gagaaccgagguaauggau

SEQ ID NO: 1536004 - RNA, 19 nt, Homo sapiens
gugacgacuuagccagaaa

SEQ ID NO: 1536005 - RNA, 19 nt, Homo sapiens
aaauagcacgugugucuuc

SEQ ID NO: 1536006 - RNA, 19 nt, Homo sapiens
gauuguuucugagccaugu

SEQ ID NO: 1536007 - RNA, 19 nt, Homo sapiens
cugcgaaugcuguauagaa

SEQ ID NO: 1536008 - RNA, 19 nt, Homo sapiens
aauauuagagcuagaugga

SEQ ID NO: 1536009 - RNA, 19 nt, Homo sapiens
ccaaauauuagagcuagau

SEQ ID NO: 1536010 - RNA, 19 nt, Homo sapiens
cuacuucucuuuuaucauc

SEQ ID NO: 1536011 - RNA, 19 nt, Homo sapiens
cagagacuggaauaaauau

SEQ ID NO: 1536012 - RNA, 19 nt, Homo sapiens
ucuuugcaguguuugcuaa

SEQ ID NO: 1536013 - RNA, 19 nt, Homo sapiens
agagugaccaaauauuaga

SEQ ID NO: 1536014 - RNA, 19 nt, Homo sapiens
uagaaggugcuaaugaaca

SEQ ID NO: 1536015 - RNA, 19 nt, Homo sapiens
ucauaaauagcacgugugu

SEQ ID NO: 1536016 - RNA, 19 nt, Homo sapiens
ugaccaaauauuagagcua

SEQ ID NO: 1536017 - RNA, 19 nt, Homo sapiens
cgacugcuccucucuuagg

SEQ ID NO: 1536018 - RNA, 19 nt, Homo sapiens
gggaagcaaguuugucaag

SEQ ID NO: 1536019 - RNA, 19 nt, Homo sapiens
agccucuacugucuacaua

SEQ ID NO: 1536020 - RNA, 19 nt, Homo sapiens
cacauccacucaccucuac

SEQ ID NO: 1536021 - RNA, 19 nt, Homo sapiens
caaauauuagagcuagaug

SEQ ID NO: 1536022 - RNA, 19 nt, Homo sapiens
aaugagagugaccaaauau

SEQ ID NO: 1536023 - RNA, 19 nt, Homo sapiens
ugagccaugugcuucaaca

SEQ ID NO: 1536024 - RNA, 19 nt, Homo sapiens
aaacaggaaguucauucau

SEQ ID NO: 1536025 - RNA, 19 nt, Homo sapiens
ugcgaaugcuguauagaag

SEQ ID NO: 1536026 - RNA, 19 nt, Homo sapiens
ggguuucccuacuucucuu

SEQ ID NO: 1536027 - RNA, 19 nt, Homo sapiens
gacagagaaccgagguaau

SEQ ID NO: 1536028 - RNA, 19 nt, Homo sapiens
acucagacauugggaagca

SEQ ID NO: 1536029 - RNA, 19 nt, Homo sapiens
agacuuaaaagcacucaua

SEQ ID NO: 1536030 - RNA, 19 nt, Homo sapiens
ucuacugucuacauaugug

SEQ ID NO: 1536031 - RNA, 19 nt, Homo sapiens
uaauggauucgagugauga

SEQ ID NO: 1536032 - RNA, 19 nt, Homo sapiens
uaaugagaccgcugaggau

SEQ ID NO: 1536033 - RNA, 19 nt, Homo sapiens
gugcuucaacaucggauug

SEQ ID NO: 1536034 - RNA, 19 nt, Homo sapiens
uagcuuuaacacucaguuu

SEQ ID NO: 1536035 - RNA, 19 nt, Homo sapiens
uagauggaaccuuagugaa

SEQ ID NO: 1536036 - RNA, 19 nt, Homo sapiens
gaacaaagcugggaguaaa

SEQ ID NO: 1536037 - RNA, 19 nt, Homo sapiens
gagaauaccugaugaagca

SEQ ID NO: 1536038 - RNA, 19 nt, Homo sapiens
ggaaugccguggugaauga

SEQ ID NO: 1536039 - RNA, 19 nt, Homo sapiens
gauggcagcuggguucuuu

SEQ ID NO: 1536040 - RNA, 19 nt, Homo sapiens
ggucauugaugcagucauu

SEQ ID NO: 1536041 - RNA, 19 nt, Homo sapiens
ggucauagcucagacucuu

SEQ ID NO: 1536042 - RNA, 19 nt, Homo sapiens
uauaacaacugucaacaca

SEQ ID NO: 1536043 - RNA, 19 nt, Homo sapiens
gggagaagcccuacaagug

SEQ ID NO: 1536044 - RNA, 19 nt, Homo sapiens
gucaacacaccaacuauua

SEQ ID NO: 1536045 - RNA, 19 nt, Homo sapiens
ggugauggcugcaggaaag

SEQ ID NO: 1536046 - RNA, 19 nt, Homo sapiens
gagaacaucuucccaugac

SEQ ID NO: 1536047 - RNA, 19 nt, Homo sapiens
gcaaggccuggcuuacuua

SEQ ID NO: 1536048 - RNA, 19 nt, Homo sapiens
uaacuugucuccacuugca

SEQ ID NO: 1536049 - RNA, 19 nt, Homo sapiens
ggcaaggccuggcuuacuu

SEQ ID NO: 1536050 - RNA, 19 nt, Homo sapiens
cauuauuccuugcacuaua

SEQ ID NO: 1536051 - RNA, 19 nt, Homo sapiens
ggagaagcccuaccacugu

SEQ ID NO: 1536052 - RNA, 19 nt, Homo sapiens
gggaagcgguucagcaaag

SEQ ID NO: 1536053 - RNA, 19 nt, Homo sapiens
aagaguugcuuccauuuga

SEQ ID NO: 1536054 - RNA, 19 nt, Homo sapiens
uaaaagaguugcuuccauu

SEQ ID NO: 1536055 - RNA, 19 nt, Homo sapiens
ucagcaaguuuguugguuu

SEQ ID NO: 1536056 - RNA, 19 nt, Homo sapiens
gcuuuacccugagagaaua

SEQ ID NO: 1536057 - RNA, 19 nt, Homo sapiens
gcagcuggguucuuuacug

SEQ ID NO: 1536058 - RNA, 19 nt, Homo sapiens
ccaggcaacugugugaauu

SEQ ID NO: 1536059 - RNA, 19 nt, Homo sapiens
caaguggugcuaaacaauu

SEQ ID NO: 1536060 - RNA, 19 nt, Homo sapiens
gcaggcagcaccaucauuc

SEQ ID NO: 1536061 - RNA, 19 nt, Homo sapiens
gagcaagcacuaccuguuc

SEQ ID NO: 1536062 - RNA, 19 nt, Homo sapiens
gcaagagcuucagcaggaa

SEQ ID NO: 1536063 - RNA, 19 nt, Homo sapiens
gucugaagaugcuuaaaga

SEQ ID NO: 1536064 - RNA, 19 nt, Homo sapiens
gcaccaucauucaucuuuc

SEQ ID NO: 1536065 - RNA, 19 nt, Homo sapiens
ggagcaagcacuaccuguu

SEQ ID NO: 1536066 - RNA, 19 nt, Homo sapiens
gagcgcaccaucacaucua

SEQ ID NO: 1536067 - RNA, 19 nt, Homo sapiens
uggugaaacuggagaaaga

SEQ ID NO: 1536068 - RNA, 19 nt, Homo sapiens
uuaaagagcauccagagau

SEQ ID NO: 1536069 - RNA, 19 nt, Homo sapiens
caucacaucuaagccauca

SEQ ID NO: 1536070 - RNA, 19 nt, Homo sapiens
cagcagcaguuggguauuc

SEQ ID NO: 1536071 - RNA, 19 nt, Homo sapiens
aaguggugcuaaacaauuu

SEQ ID NO: 1536072 - RNA, 19 nt, Homo sapiens
gcagcaccaucauucaucu

SEQ ID NO: 1536073 - RNA, 19 nt, Homo sapiens
caggguaucugugcugugu

SEQ ID NO: 1536074 - RNA, 19 nt, Homo sapiens
uggaggaccugacagaaag

SEQ ID NO: 1536075 - RNA, 19 nt, Homo sapiens
uagcugcuuccaucucuua

SEQ ID NO: 1536076 - RNA, 19 nt, Homo sapiens
guggaggaccugacagaaa

SEQ ID NO: 1536077 - RNA, 19 nt, Homo sapiens
cgaacaaagcugggaguaa

SEQ ID NO: 1536078 - RNA, 19 nt, Homo sapiens
cgacaccagagaauccaua

SEQ ID NO: 1536079 - RNA, 19 nt, Homo sapiens
cagcaggaaugccaaucug

SEQ ID NO: 1536080 - RNA, 19 nt, Homo sapiens
gcaaguuuguugguuuuaa

SEQ ID NO: 1536081 - RNA, 19 nt, Homo sapiens
cuuaucaucugcuugaauc

SEQ ID NO: 1536082 - RNA, 19 nt, Homo sapiens
gcccuuaucaucugcuuga

SEQ ID NO: 1536083 - RNA, 19 nt, Homo sapiens
ucucuagaaagaacuguua

SEQ ID NO: 1536084 - RNA, 19 nt, Homo sapiens
gaucacugaauaaacauca

SEQ ID NO: 1536085 - RNA, 19 nt, Homo sapiens
auucuauccucaucuguaa

SEQ ID NO: 1536086 - RNA, 19 nt, Homo sapiens
ggaggaaacagcacuuugc

SEQ ID NO: 1536087 - RNA, 19 nt, Homo sapiens
ggguauuccuguggugaaa

SEQ ID NO: 1536088 - RNA, 19 nt, Homo sapiens
gagggagucugaagaugcu

SEQ ID NO: 1536089 - RNA, 19 nt, Homo sapiens
ccaccacccugaucuaagc

SEQ ID NO: 1536090 - RNA, 19 nt, Homo sapiens
gcccaugacccgaggcauu

SEQ ID NO: 1536091 - RNA, 19 nt, Homo sapiens
ucuaagccaucagcaaguu

SEQ ID NO: 1536092 - RNA, 19 nt, Homo sapiens
uggagcaguuccucacuau

SEQ ID NO: 1536093 - RNA, 19 nt, Homo sapiens
cccaaguggugcuaaacaa

SEQ ID NO: 1536094 - RNA, 19 nt, Homo sapiens
gcgggaagcgguucagcaa

SEQ ID NO: 1536095 - RNA, 19 nt, Homo sapiens
gcagggagagcaggaggaa

SEQ ID NO: 1536096 - RNA, 19 nt, Homo sapiens
gggagucugaagaugcuua

SEQ ID NO: 1536097 - RNA, 19 nt, Homo sapiens
ggaaguuaguauuuugcua

SEQ ID NO: 1536098 - RNA, 19 nt, Homo sapiens
ugagaacaucuucccauga

SEQ ID NO: 1536099 - RNA, 19 nt, Homo sapiens
cauagcugcuuccaucucu

SEQ ID NO: 1536100 - RNA, 19 nt, Homo sapiens
gccaucagcaaguuuguug

SEQ ID NO: 1536101 - RNA, 19 nt, Homo sapiens
gaggaguggaggcauguga

SEQ ID NO: 1536102 - RNA, 19 nt, Homo sapiens
ggagucugaagaugcuuaa

SEQ ID NO: 1536103 - RNA, 19 nt, Homo sapiens
cugcuugaaucacuaacuu

SEQ ID NO: 1536104 - RNA, 19 nt, Homo sapiens
uguaccagcauaugaguuu

SEQ ID NO: 1536105 - RNA, 19 nt, Homo sapiens
aaagaguugcuuccauuug

SEQ ID NO: 1536106 - RNA, 19 nt, Homo sapiens
caacacaccaacuauuagg

SEQ ID NO: 1536107 - RNA, 19 nt, Homo sapiens
gucaggcuauaacauucua

SEQ ID NO: 1536108 - RNA, 19 nt, Homo sapiens
uuacccaaguggugcuaaa

SEQ ID NO: 1536109 - RNA, 19 nt, Homo sapiens
ggaagcgguucagcaaagg

SEQ ID NO: 1536110 - RNA, 19 nt, Homo sapiens
gagagaauaccugaugaag

SEQ ID NO: 1536111 - RNA, 19 nt, Homo sapiens
cauucuauccucaucugua

SEQ ID NO: 1536112 - RNA, 19 nt, Homo sapiens
gauuuugucugacucuuug

SEQ ID NO: 1536113 - RNA, 19 nt, Homo sapiens
acacaccaacuauuaggaa

SEQ ID NO: 1536114 - RNA, 19 nt, Homo sapiens
ccugagagaauaccugaug

SEQ ID NO: 1536115 - RNA, 19 nt, Homo sapiens
gaggaaacagcacuuugca

SEQ ID NO: 1536116 - RNA, 19 nt, Homo sapiens
ccaaguggugcuaaacaau

SEQ ID NO: 1536117 - RNA, 19 nt, Homo sapiens
caccaucauucaucuuucu

SEQ ID NO: 1536118 - RNA, 19 nt, Homo sapiens
ugagagaauaccugaugaa

SEQ ID NO: 1536119 - RNA, 19 nt, Homo sapiens
cugagagaauaccugauga

SEQ ID NO: 1536120 - RNA, 19 nt, Homo sapiens
cuggagcaguuccucacua

SEQ ID NO: 1536121 - RNA, 19 nt, Homo sapiens
ggcccgaguugcacaccaa

SEQ ID NO: 1536122 - RNA, 19 nt, Homo sapiens
ugucaacacaccaacuauu

SEQ ID NO: 1536123 - RNA, 19 nt, Homo sapiens
gugucaggcuauaacauuc

SEQ ID NO: 1536124 - RNA, 19 nt, Homo sapiens
gcugggaccucaucuuccu

SEQ ID NO: 1536125 - RNA, 19 nt, Homo sapiens
cagcaaguuuguugguuuu

SEQ ID NO: 1536126 - RNA, 19 nt, Homo sapiens
ggaggucaagccugaaugg

SEQ ID NO: 1536127 - RNA, 19 nt, Homo sapiens
gagcaguuccucacuaucc

SEQ ID NO: 1536128 - RNA, 19 nt, Homo sapiens
gcaacugugugaauuuuac

SEQ ID NO: 1536129 - RNA, 19 nt, Homo sapiens
uagcugggaccucaucuuc

SEQ ID NO: 1536130 - RNA, 19 nt, Homo sapiens
uugaaucacuaacuugucu

SEQ ID NO: 1536131 - RNA, 19 nt, Homo sapiens
ucccagagaccaagagaug

SEQ ID NO: 1536132 - RNA, 19 nt, Homo sapiens
ugugucaggcuauaacauu

SEQ ID NO: 1536133 - RNA, 19 nt, Homo sapiens
gggaaugccguggugaaug

SEQ ID NO: 1536134 - RNA, 19 nt, Homo sapiens
cagcccagauagacugcuu

SEQ ID NO: 1536135 - RNA, 19 nt, Homo sapiens
ccaaggcgguggguuccau

SEQ ID NO: 1536136 - RNA, 19 nt, Homo sapiens
aaaggaagcucacugaaua

SEQ ID NO: 1536137 - RNA, 19 nt, Homo sapiens
gcacugauauugcaaguug

SEQ ID NO: 1536138 - RNA, 19 nt, Homo sapiens
guaaaggaauuucaaguga

SEQ ID NO: 1536139 - RNA, 19 nt, Homo sapiens
gcagugagcugagauaauc

SEQ ID NO: 1536140 - RNA, 19 nt, Homo sapiens
gcacacccaucacauuaaa

SEQ ID NO: 1536141 - RNA, 19 nt, Homo sapiens
ggaaggaacuuaugaacag

SEQ ID NO: 1536142 - RNA, 19 nt, Homo sapiens
gaggaucucuuauguuguu

SEQ ID NO: 1536143 - RNA, 19 nt, Homo sapiens
gcagaggugucccuggaua

SEQ ID NO: 1536144 - RNA, 19 nt, Homo sapiens
gaaccacacccacuuauug

SEQ ID NO: 1536145 - RNA, 19 nt, Homo sapiens
ggaacgagauuuacauuuu

SEQ ID NO: 1536146 - RNA, 19 nt, Homo sapiens
cagcaaauaugaccggaaa

SEQ ID NO: 1536147 - RNA, 19 nt, Homo sapiens
gaaacaaaguagagucauc

SEQ ID NO: 1536148 - RNA, 19 nt, Homo sapiens
ccuggaaccugaauaauga

SEQ ID NO: 1536149 - RNA, 19 nt, Homo sapiens
gaagagaaauaggcucaau

SEQ ID NO: 1536150 - RNA, 19 nt, Homo sapiens
gcaguauguuguaguuaaa

SEQ ID NO: 1536151 - RNA, 19 nt, Homo sapiens
gagauaaucccacugcauu

SEQ ID NO: 1536152 - RNA, 19 nt, Homo sapiens
caagggauacuacagauuu

SEQ ID NO: 1536153 - RNA, 19 nt, Homo sapiens
aauaaugacuccugaauca

SEQ ID NO: 1536154 - RNA, 19 nt, Homo sapiens
gaugagagcacugauauug

SEQ ID NO: 1536155 - RNA, 19 nt, Homo sapiens
ggaggaagaugaagaagac

SEQ ID NO: 1536156 - RNA, 19 nt, Homo sapiens
caaagaaauuucaccaagu

SEQ ID NO: 1536157 - RNA, 19 nt, Homo sapiens
aaaccuaggucacaaagga

SEQ ID NO: 1536158 - RNA, 19 nt, Homo sapiens
gaagacugcuuaaaagaaa

SEQ ID NO: 1536159 - RNA, 19 nt, Homo sapiens
gaagacgacauuuggguaa

SEQ ID NO: 1536160 - RNA, 19 nt, Homo sapiens
gcugauaaacuaagaacua

SEQ ID NO: 1536161 - RNA, 19 nt, Homo sapiens
gaaggcaucgugauaguga

SEQ ID NO: 1536162 - RNA, 19 nt, Homo sapiens
gaaauuucaccaagucuga

SEQ ID NO: 1536163 - RNA, 19 nt, Homo sapiens
ugagagagccuuauuguca

SEQ ID NO: 1536164 - RNA, 19 nt, Homo sapiens
ggaagaguauauugcuguu

SEQ ID NO: 1536165 - RNA, 19 nt, Homo sapiens
gaugaaagauccauuugcu

SEQ ID NO: 1536166 - RNA, 19 nt, Homo sapiens
ggaaaacacagcagacuua

SEQ ID NO: 1536167 - RNA, 19 nt, Homo sapiens
agaaauaggcucaauagug

SEQ ID NO: 1536168 - RNA, 19 nt, Homo sapiens
uuacuaccauucacaacua

SEQ ID NO: 1536169 - RNA, 19 nt, Homo sapiens
ggaagagaaauuugaauca

SEQ ID NO: 1536170 - RNA, 19 nt, Homo sapiens
uacaauaucucgucgaauc

SEQ ID NO: 1536171 - RNA, 19 nt, Homo sapiens
caucguauuuaguugcaua

SEQ ID NO: 1536172 - RNA, 19 nt, Homo sapiens
aaacagacccuauuuggau

SEQ ID NO: 1536173 - RNA, 19 nt, Homo sapiens
uagccgacuucucgaaaua

SEQ ID NO: 1536174 - RNA, 19 nt, Homo sapiens
ucugauggauguauugaaa

SEQ ID NO: 1536175 - RNA, 19 nt, Homo sapiens
gauggaacagcaaauauga

SEQ ID NO: 1536176 - RNA, 19 nt, Homo sapiens
ggaaagaaacaaaguagag

SEQ ID NO: 1536177 - RNA, 19 nt, Homo sapiens
gaaggaacuuaugaacaga

SEQ ID NO: 1536178 - RNA, 19 nt, Homo sapiens
aaagaaauuucaccaaguc

SEQ ID NO: 1536179 - RNA, 19 nt, Homo sapiens
gacaugguacggacaauuu

SEQ ID NO: 1536180 - RNA, 19 nt, Homo sapiens
gcucuacaacuaugaauga

SEQ ID NO: 1536181 - RNA, 19 nt, Homo sapiens
gcagcucaguucaucauuc

SEQ ID NO: 1536182 - RNA, 19 nt, Homo sapiens
gaaaagcaaucucauuugg

SEQ ID NO: 1536183 - RNA, 19 nt, Homo sapiens
gaagcaacccacaacaaug

SEQ ID NO: 1536184 - RNA, 19 nt, Homo sapiens
aaaggaauuucaagugaug

SEQ ID NO: 1536185 - RNA, 19 nt, Homo sapiens
gaacucaggaacgagauuu

SEQ ID NO: 1536186 - RNA, 19 nt, Homo sapiens
caccaagucugauggaugu

SEQ ID NO: 1536187 - RNA, 19 nt, Homo sapiens
gggcagaucacuugaguuc

SEQ ID NO: 1536188 - RNA, 19 nt, Homo sapiens
uaaccgcccuagcuacuau

SEQ ID NO: 1536189 - RNA, 19 nt, Homo sapiens
ccacacccacuuauuguuu

SEQ ID NO: 1536190 - RNA, 19 nt, Homo sapiens
gagagagccuuauugucau

SEQ ID NO: 1536191 - RNA, 19 nt, Homo sapiens
ggaggaggaagaugaagaa

SEQ ID NO: 1536192 - RNA, 19 nt, Homo sapiens
aagcacacccaucacauua

SEQ ID NO: 1536193 - RNA, 19 nt, Homo sapiens
guucaucauucacacuaaa

SEQ ID NO: 1536194 - RNA, 19 nt, Homo sapiens
gaaguucguuggcuuucuc

SEQ ID NO: 1536195 - RNA, 19 nt, Homo sapiens
uaaaggaagcucacugaau

SEQ ID NO: 1536196 - RNA, 19 nt, Homo sapiens
gucccacacucuugguuua

SEQ ID NO: 1536197 - RNA, 19 nt, Homo sapiens
gaagaguauauugcuguua

SEQ ID NO: 1536198 - RNA, 19 nt, Homo sapiens
ucagauauguguggcaaga

SEQ ID NO: 1536199 - RNA, 19 nt, Homo sapiens
gaaugagagagccuuauug

SEQ ID NO: 1536200 - RNA, 19 nt, Homo sapiens
acacccaucacauuaaaua

SEQ ID NO: 1536201 - RNA, 19 nt, Homo sapiens
caagucugauggauguauu

SEQ ID NO: 1536202 - RNA, 19 nt, Homo sapiens
ugagagcacugauauugca

SEQ ID NO: 1536203 - RNA, 19 nt, Homo sapiens
ugcaguauguuguaguuaa

SEQ ID NO: 1536204 - RNA, 19 nt, Homo sapiens
gaacuuaugaacagacaag

SEQ ID NO: 1536205 - RNA, 19 nt, Homo sapiens
cagcucaguucaucauuca

SEQ ID NO: 1536206 - RNA, 19 nt, Homo sapiens
aaacacagcagacuuacug

SEQ ID NO: 1536207 - RNA, 19 nt, Homo sapiens
cucagucgcucuacaacua

SEQ ID NO: 1536208 - RNA, 19 nt, Homo sapiens
gaaagaaacaaaguagagu

SEQ ID NO: 1536209 - RNA, 19 nt, Homo sapiens
gaagaagaccauuuucaaa

SEQ ID NO: 1536210 - RNA, 19 nt, Homo sapiens
gaaaccccaucucuacuaa

SEQ ID NO: 1536211 - RNA, 19 nt, Homo sapiens
gaggugggcagaucacuug

SEQ ID NO: 1536212 - RNA, 19 nt, Homo sapiens
gaauaaugacuccugaauc

SEQ ID NO: 1536213 - RNA, 19 nt, Homo sapiens
uauaugaacucaggaacga

SEQ ID NO: 1536214 - RNA, 19 nt, Homo sapiens
uuaaagggauuuugcagua

SEQ ID NO: 1536215 - RNA, 19 nt, Homo sapiens
gcaucucacuucuuugucu

SEQ ID NO: 1536216 - RNA, 19 nt, Homo sapiens
caaaggacagcccugcaaa

SEQ ID NO: 1536217 - RNA, 19 nt, Homo sapiens
cuauaccucuuagugauaa

SEQ ID NO: 1536218 - RNA, 19 nt, Homo sapiens
caagcacacccaucacauu

SEQ ID NO: 1536219 - RNA, 19 nt, Homo sapiens
caacuacauauuuguguga

SEQ ID NO: 1536220 - RNA, 19 nt, Homo sapiens
cuaaguaggaagaguauau

SEQ ID NO: 1536221 - RNA, 19 nt, Homo sapiens
cuggaaacauuguaaagga

SEQ ID NO: 1536222 - RNA, 19 nt, Homo sapiens
gagccuuauugucaucgua

SEQ ID NO: 1536223 - RNA, 19 nt, Homo sapiens
aaacuuggagccugaagaa

SEQ ID NO: 1536224 - RNA, 19 nt, Homo sapiens
uguugcaucucacuucuuu

SEQ ID NO: 1536225 - RNA, 19 nt, Homo sapiens
caacauuauugcaacacau

SEQ ID NO: 1536226 - RNA, 19 nt, Homo sapiens
aauacaauaucucgucgaa

SEQ ID NO: 1536227 - RNA, 19 nt, Homo sapiens
ggacaugguacggacaauu

SEQ ID NO: 1536228 - RNA, 19 nt, Homo sapiens
caucgaagagaacauuauu

SEQ ID NO: 1536229 - RNA, 19 nt, Homo sapiens
gaauagccgacuucucgaa

SEQ ID NO: 1536230 - RNA, 19 nt, Homo sapiens
ggaaacauuguaaaggaau

SEQ ID NO: 1536231 - RNA, 19 nt, Homo sapiens
ugaaugagagagccuuauu

SEQ ID NO: 1536232 - RNA, 19 nt, Homo sapiens
cgcccuagcuacuauaugu

SEQ ID NO: 1536233 - RNA, 19 nt, Homo sapiens
aaaguaaccgcccuagcua

SEQ ID NO: 1536234 - RNA, 19 nt, Homo sapiens
ccaaaagacguuauuauug

SEQ ID NO: 1536235 - RNA, 19 nt, Homo sapiens
gccgacuucucgaaauauu

SEQ ID NO: 1536236 - RNA, 19 nt, Homo sapiens
uggaagaacugcauuauug

SEQ ID NO: 1536237 - RNA, 19 nt, Homo sapiens
gcaaauaugcucucuauag

SEQ ID NO: 1536238 - RNA, 19 nt, Homo sapiens
caucaacacugcaugcuuu

SEQ ID NO: 1536239 - RNA, 19 nt, Homo sapiens
gcaagguggugacuaagaa

SEQ ID NO: 1536240 - RNA, 19 nt, Homo sapiens
gaaaucaacgacagucuaa

SEQ ID NO: 1536241 - RNA, 19 nt, Homo sapiens
guucagccauguuccuuua

SEQ ID NO: 1536242 - RNA, 19 nt, Homo sapiens
gaagaaggccaaugaagug

SEQ ID NO: 1536243 - RNA, 19 nt, Homo sapiens
ggaagaaggccaaugaagu

SEQ ID NO: 1536244 - RNA, 19 nt, Homo sapiens
ggaccuacaugcuucucaa

SEQ ID NO: 1536245 - RNA, 19 nt, Homo sapiens
guaauugacaucuccauga

SEQ ID NO: 1536246 - RNA, 19 nt, Homo sapiens
caaccagaguuuaugcuau

SEQ ID NO: 1536247 - RNA, 19 nt, Homo sapiens
cuacaugcuucucaaauuc

SEQ ID NO: 1536248 - RNA, 19 nt, Homo sapiens
gcagaagccauaaggagaa

SEQ ID NO: 1536249 - RNA, 19 nt, Homo sapiens
gccauaaggagaacucaua

SEQ ID NO: 1536250 - RNA, 19 nt, Homo sapiens
ccucgcagcugacaaacuu

SEQ ID NO: 1536251 - RNA, 19 nt, Homo sapiens
gaauguggacuuugcuuug

SEQ ID NO: 1536252 - RNA, 19 nt, Homo sapiens
ccuacaugcuucucaaauu

SEQ ID NO: 1536253 - RNA, 19 nt, Homo sapiens
caaauaugcucucuauagc

SEQ ID NO: 1536254 - RNA, 19 nt, Homo sapiens
uaggcaagguggugacuaa

SEQ ID NO: 1536255 - RNA, 19 nt, Homo sapiens
ucagccauguuccuuuaua

SEQ ID NO: 1536256 - RNA, 19 nt, Homo sapiens
ggacuuugcuuugauucau

SEQ ID NO: 1536257 - RNA, 19 nt, Homo sapiens
caacuguccugaaguggau

SEQ ID NO: 1536258 - RNA, 19 nt, Homo sapiens
gacaggauaagaaggauaa

SEQ ID NO: 1536259 - RNA, 19 nt, Homo sapiens
gauuaaugccugcaagauu

SEQ ID NO: 1536260 - RNA, 19 nt, Homo sapiens
cagccauguuccuuuauaa

SEQ ID NO: 1536261 - RNA, 19 nt, Homo sapiens
ccaauaccauaccucaaga

SEQ ID NO: 1536262 - RNA, 19 nt, Homo sapiens
gcaaccagaguuuaugcua

SEQ ID NO: 1536263 - RNA, 19 nt, Homo sapiens
ccaagacgccgaauaucaa

SEQ ID NO: 1536264 - RNA, 19 nt, Homo sapiens
gacuuugcuuugauucaua

SEQ ID NO: 1536265 - RNA, 19 nt, Homo sapiens
ccaguugaauguggacuuu

SEQ ID NO: 1536266 - RNA, 19 nt, Homo sapiens
uugcaaauaugcucucuau

SEQ ID NO: 1536267 - RNA, 19 nt, Homo sapiens
gaugagaagaugaagcauu

SEQ ID NO: 1536268 - RNA, 19 nt, Homo sapiens
uaucuugacucauggaauc

SEQ ID NO: 1536269 - RNA, 19 nt, Homo sapiens
ccaaugaaguggacugcau

SEQ ID NO: 1536270 - RNA, 19 nt, Homo sapiens
ccaagcuuguugcaaauau

SEQ ID NO: 1536271 - RNA, 19 nt, Homo sapiens
uaugcuaucuugacucaug

SEQ ID NO: 1536272 - RNA, 19 nt, Homo sapiens
cugccaagcuuguugcaaa

SEQ ID NO: 1536273 - RNA, 19 nt, Homo sapiens
uaauugacaucuccaugau

SEQ ID NO: 1536274 - RNA, 19 nt, Homo sapiens
cagaguuuaugcuaucuug

SEQ ID NO: 1536275 - RNA, 19 nt, Homo sapiens
ggacuuaucccagaaaauu

SEQ ID NO: 1536276 - RNA, 19 nt, Homo sapiens
ggaagaacugcauuauugu

SEQ ID NO: 1536277 - RNA, 19 nt, Homo sapiens
augagaagaugaagcauug

SEQ ID NO: 1536278 - RNA, 19 nt, Homo sapiens
auuaaugccugcaagauug

SEQ ID NO: 1536279 - RNA, 19 nt, Homo sapiens
caacacugcaugcuuugaa

SEQ ID NO: 1536280 - RNA, 19 nt, Homo sapiens
cgaaaucaacgacagucua

SEQ ID NO: 1536281 - RNA, 19 nt, Homo sapiens
gccaagacgccgaauauca

SEQ ID NO: 1536282 - RNA, 19 nt, Homo sapiens
ugaaugaucguguggcuau

SEQ ID NO: 1536283 - RNA, 19 nt, Homo sapiens
caaugaaguggacugcaua

SEQ ID NO: 1536284 - RNA, 19 nt, Homo sapiens
gauccuugcagaagccaua

SEQ ID NO: 1536285 - RNA, 19 nt, Homo sapiens
gaagaacugcauuauuguc

SEQ ID NO: 1536286 - RNA, 19 nt, Homo sapiens
gaguggaagaacugcauua

SEQ ID NO: 1536287 - RNA, 19 nt, Homo sapiens
uggcuauccuuguagauga

SEQ ID NO: 1536288 - RNA, 19 nt, Homo sapiens
gguggugacuaagaaauuc

SEQ ID NO: 1536289 - RNA, 19 nt, Homo sapiens
cgacggagugccucuggua

SEQ ID NO: 1536290 - RNA, 19 nt, Homo sapiens
agaccugcguggaaauuga

SEQ ID NO: 1536291 - RNA, 19 nt, Homo sapiens
ugacauggcagacacuugu

SEQ ID NO: 1536292 - RNA, 19 nt, Homo sapiens
ugaaguggacugcauagug

SEQ ID NO: 1536293 - RNA, 19 nt, Homo sapiens
caagcuuguugcaaauaug

SEQ ID NO: 1536294 - RNA, 19 nt, Homo sapiens
auaaggagaacucauaaug

SEQ ID NO: 1536295 - RNA, 19 nt, Homo sapiens
ccauaaggagaacucauaa

SEQ ID NO: 1536296 - RNA, 19 nt, Homo sapiens
caagacgccgaauaucaaa

SEQ ID NO: 1536297 - RNA, 19 nt, Homo sapiens
ugaaguggauaagggagaa

SEQ ID NO: 1536298 - RNA, 19 nt, Homo sapiens
ggagaccugcguggaaauu

SEQ ID NO: 1536299 - RNA, 19 nt, Homo sapiens
cccaaucucugccaagcuu

SEQ ID NO: 1536300 - RNA, 19 nt, Homo sapiens
cggagugccucugguaguu

SEQ ID NO: 1536301 - RNA, 19 nt, Homo sapiens
aauguggacuuugcuuuga

SEQ ID NO: 1536302 - RNA, 19 nt, Homo sapiens
uagagucugugcuucacuu

SEQ ID NO: 1536303 - RNA, 19 nt, Homo sapiens
gaacggaagaaggccaaug

SEQ ID NO: 1536304 - RNA, 19 nt, Homo sapiens
guggaagaacugcauuauu

SEQ ID NO: 1536305 - RNA, 19 nt, Homo sapiens
uaaggagaacucauaaugg

SEQ ID NO: 1536306 - RNA, 19 nt, Homo sapiens
aaccagaguuuaugcuauc

SEQ ID NO: 1536307 - RNA, 19 nt, Homo sapiens
ucguguggcuauccuugua

SEQ ID NO: 1536308 - RNA, 19 nt, Homo sapiens
ugacuaagaaauucagcaa

SEQ ID NO: 1536309 - RNA, 19 nt, Homo sapiens
aaucaacgacagucuaaug

SEQ ID NO: 1536310 - RNA, 19 nt, Homo sapiens
cuucuagguuaugcuauuu

SEQ ID NO: 1536311 - RNA, 19 nt, Homo sapiens
ggagcaaccagaguuuaug

SEQ ID NO: 1536312 - RNA, 19 nt, Homo sapiens
ugaauguggacuuugcuuu

SEQ ID NO: 1536313 - RNA, 19 nt, Homo sapiens
uagcaggugcggaucauau

SEQ ID NO: 1536314 - RNA, 19 nt, Homo sapiens
cgacaggauaagaaggaua

SEQ ID NO: 1536315 - RNA, 19 nt, Homo sapiens
gcuagugggagaugugaau

SEQ ID NO: 1536316 - RNA, 19 nt, Homo sapiens
uaauggagcuuuugaucau

SEQ ID NO: 1536317 - RNA, 19 nt, Homo sapiens
cagagugguuguggcgaaa

SEQ ID NO: 1536318 - RNA, 19 nt, Homo sapiens
caagguggugacuaagaaa

SEQ ID NO: 1536319 - RNA, 19 nt, Homo sapiens
ggcaagguggugacuaaga

SEQ ID NO: 1536320 - RNA, 19 nt, Homo sapiens
gugcuucacuuccguucca

SEQ ID NO: 1536321 - RNA, 19 nt, Homo sapiens
uuuaugcuaucuugacuca

SEQ ID NO: 1536322 - RNA, 19 nt, Homo sapiens
auuauugucucgccagaug

SEQ ID NO: 1536323 - RNA, 19 nt, Homo sapiens
gcaggugcggaucauauca

SEQ ID NO: 1536324 - RNA, 19 nt, Homo sapiens
ccuuaugcccgacaggaua

SEQ ID NO: 1536325 - RNA, 19 nt, Homo sapiens
gagugguuguggcgaaauc

SEQ ID NO: 1536326 - RNA, 19 nt, Homo sapiens
gagugugcguggagaggau

SEQ ID NO: 1536327 - RNA, 19 nt, Homo sapiens
uugcagaccaguugaaugu

SEQ ID NO: 1536328 - RNA, 19 nt, Homo sapiens
agaauaucccugaguggaa

SEQ ID NO: 1536329 - RNA, 19 nt, Homo sapiens
uggccaagacgccgaauau

SEQ ID NO: 1536330 - RNA, 19 nt, Homo sapiens
gccaagcuuguugcaaaua

SEQ ID NO: 1536331 - RNA, 19 nt, Homo sapiens
ccgaguuacugcagucauc

SEQ ID NO: 1536332 - RNA, 19 nt, Homo sapiens
uguggacuuugcuuugauu

SEQ ID NO: 1536333 - RNA, 19 nt, Homo sapiens
ccagccauuucucgcauca

SEQ ID NO: 1536334 - RNA, 19 nt, Homo sapiens
gaccuacaugcuucucaaa

SEQ ID NO: 1536335 - RNA, 19 nt, Homo sapiens
acuucuagguuaugcuauu

SEQ ID NO: 1536336 - RNA, 19 nt, Homo sapiens
caaggcaccuccaaagaug

SEQ ID NO: 1536337 - RNA, 19 nt, Homo sapiens
cagaaacgcuauuuuauga

SEQ ID NO: 1536338 - RNA, 19 nt, Homo sapiens
ggagggcuaguucguauuu

SEQ ID NO: 1536339 - RNA, 19 nt, Homo sapiens
ggccagacaugaccaucuu

SEQ ID NO: 1536340 - RNA, 19 nt, Homo sapiens
caucuugugugacccagaa

SEQ ID NO: 1536341 - RNA, 19 nt, Homo sapiens
gagaaagucguuccagauc

SEQ ID NO: 1536342 - RNA, 19 nt, Homo sapiens
gagaugcccgugcugaaga

SEQ ID NO: 1536343 - RNA, 19 nt, Homo sapiens
cgaaggccguggaggaaca

SEQ ID NO: 1536344 - RNA, 19 nt, Homo sapiens
gaggaacagcugagaaagu

SEQ ID NO: 1536345 - RNA, 19 nt, Homo sapiens
ucaaggcaccuccaaagau

SEQ ID NO: 1536346 - RNA, 19 nt, Homo sapiens
acaugaccaucuuguguga

SEQ ID NO: 1536347 - RNA, 19 nt, Homo sapiens
agacaugaccaucuugugu

SEQ ID NO: 1536348 - RNA, 19 nt, Homo sapiens
ugagaaagucguuccagau

SEQ ID NO: 1536349 - RNA, 19 nt, Homo sapiens
aggaacagcugagaaaguc

SEQ ID NO: 1536350 - RNA, 19 nt, Homo sapiens
cuggagggcuaguucguau

SEQ ID NO: 1536351 - RNA, 19 nt, Homo sapiens
gcaccuccaaagaugauga

SEQ ID NO: 1536352 - RNA, 19 nt, Homo sapiens
uggaggaacagcugagaaa

SEQ ID NO: 1536353 - RNA, 19 nt, Homo sapiens
ggagaugcccgugcugaag

SEQ ID NO: 1536354 - RNA, 19 nt, Homo sapiens
gccgggagccacuuugaug

SEQ ID NO: 1536355 - RNA, 19 nt, Homo sapiens
ccagaaacgcuauuuuaug

SEQ ID NO: 1536356 - RNA, 19 nt, Homo sapiens
ccucaaggcaccuccaaag

SEQ ID NO: 1536357 - RNA, 19 nt, Homo sapiens
ggauauagcuuaaaccuaa

SEQ ID NO: 1536358 - RNA, 19 nt, Homo sapiens
ggagugugguuuccuuaga

SEQ ID NO: 1536359 - RNA, 19 nt, Homo sapiens
gcaaaggucacccggaguu

SEQ ID NO: 1536360 - RNA, 19 nt, Homo sapiens
gagugugguuuccuuagaa

SEQ ID NO: 1536361 - RNA, 19 nt, Homo sapiens
ggacagcaguaugcagaug

SEQ ID NO: 1536362 - RNA, 19 nt, Homo sapiens
guaccggauucccgaguuu

SEQ ID NO: 1536363 - RNA, 19 nt, Homo sapiens
gacugagggugcuugagua

SEQ ID NO: 1536364 - RNA, 19 nt, Homo sapiens
cauauucaauggccuguuc

SEQ ID NO: 1536365 - RNA, 19 nt, Homo sapiens
guguuugaguccauguuua

SEQ ID NO: 1536366 - RNA, 19 nt, Homo sapiens
ugagggugcuugaguagga

SEQ ID NO: 1536367 - RNA, 19 nt, Homo sapiens
ggacugagggugcuugagu

SEQ ID NO: 1536368 - RNA, 19 nt, Homo sapiens
aaugaggaguuuagaguug

SEQ ID NO: 1536369 - RNA, 19 nt, Homo sapiens
gaagaucucggaggguuug

SEQ ID NO: 1536370 - RNA, 19 nt, Homo sapiens
ggacagcggcuccuuucug

SEQ ID NO: 1536371 - RNA, 19 nt, Homo sapiens
ggacuuugcaggugaaugg

SEQ ID NO: 1536372 - RNA, 19 nt, Homo sapiens
ggguggguguucacaauau

SEQ ID NO: 1536373 - RNA, 19 nt, Homo sapiens
gagggagugugguuuccuu

SEQ ID NO: 1536374 - RNA, 19 nt, Homo sapiens
ccuggguucuguugaguuu

SEQ ID NO: 1536375 - RNA, 19 nt, Homo sapiens
ccacauccuucacaaacuc

SEQ ID NO: 1536376 - RNA, 19 nt, Homo sapiens
gguggguguucacaauauu

SEQ ID NO: 1536377 - RNA, 19 nt, Homo sapiens
gcugcgaccucuccugcuu

SEQ ID NO: 1536378 - RNA, 19 nt, Homo sapiens
ccagcacgcccucauauuc

SEQ ID NO: 1536379 - RNA, 19 nt, Homo sapiens
ccacccacauccuucacaa

SEQ ID NO: 1536380 - RNA, 19 nt, Homo sapiens
caaaccauccucauucucu

SEQ ID NO: 1536381 - RNA, 19 nt, Homo sapiens
gcaggacgcggaugaggau

SEQ ID NO: 1536382 - RNA, 19 nt, Homo sapiens
ccuggagacuggaagaaau

SEQ ID NO: 1536383 - RNA, 19 nt, Homo sapiens
gaguacaccugcuguucca

SEQ ID NO: 1536384 - RNA, 19 nt, Homo sapiens
guggguggguguucacaau

SEQ ID NO: 1536385 - RNA, 19 nt, Homo sapiens
ucucggaggguuugaugua

SEQ ID NO: 1536386 - RNA, 19 nt, Homo sapiens
gaugacacccuggcggauu

SEQ ID NO: 1536387 - RNA, 19 nt, Homo sapiens
ugaguaggaugugagacuu

SEQ ID NO: 1536388 - RNA, 19 nt, Homo sapiens
ugauguaccugcaggaaaa

SEQ ID NO: 1536389 - RNA, 19 nt, Homo sapiens
uuaaggugccggugucuga

SEQ ID NO: 1536390 - RNA, 19 nt, Homo sapiens
cgugcucgguauucaguuu

SEQ ID NO: 1536391 - RNA, 19 nt, Homo sapiens
cagcggcuccuuucugguu

SEQ ID NO: 1536392 - RNA, 19 nt, Homo sapiens
gggauauagcuuaaaccua

SEQ ID NO: 1536393 - RNA, 19 nt, Homo sapiens
ccauguuuauucugcaaau

SEQ ID NO: 1536394 - RNA, 19 nt, Homo sapiens
gcucugcuuuccuccuuag

SEQ ID NO: 1536395 - RNA, 19 nt, Homo sapiens
cagagaaaaugaggaguuu

SEQ ID NO: 1536396 - RNA, 19 nt, Homo sapiens
gacagcaguaugcagauga

SEQ ID NO: 1536397 - RNA, 19 nt, Homo sapiens
cagcacgcccucauauuca

SEQ ID NO: 1536398 - RNA, 19 nt, Homo sapiens
gaucucggaggguuugaug

SEQ ID NO: 1536399 - RNA, 19 nt, Homo sapiens
gcccagcacgcccucauau

SEQ ID NO: 1536400 - RNA, 19 nt, Homo sapiens
guagagaagggacuuugca

SEQ ID NO: 1536401 - RNA, 19 nt, Homo sapiens
cagcuaucgugcucgguau

SEQ ID NO: 1536402 - RNA, 19 nt, Homo sapiens
gggcaacuaucuggauggu

SEQ ID NO: 1536403 - RNA, 19 nt, Homo sapiens
gggccuggguucuguugag

SEQ ID NO: 1536404 - RNA, 19 nt, Homo sapiens
gugcuugaguaggauguga

SEQ ID NO: 1536405 - RNA, 19 nt, Homo sapiens
uggguguucacaauauuua

SEQ ID NO: 1536406 - RNA, 19 nt, Homo sapiens
gguguccgcccagguguuu

SEQ ID NO: 1536407 - RNA, 19 nt, Homo sapiens
cugcagagaggguagagaa

SEQ ID NO: 1536408 - RNA, 19 nt, Homo sapiens
augacacccuggcggauuu

SEQ ID NO: 1536409 - RNA, 19 nt, Homo sapiens
gggaagggguuugaaggaa

SEQ ID NO: 1536410 - RNA, 19 nt, Homo sapiens
aaaugaggaguuuagaguu

SEQ ID NO: 1536411 - RNA, 19 nt, Homo sapiens
cacccaaaccauccucauu

SEQ ID NO: 1536412 - RNA, 19 nt, Homo sapiens
cgccuccgccugcagauaa

SEQ ID NO: 1536413 - RNA, 19 nt, Homo sapiens
gagaaaaugaggaguuuag

SEQ ID NO: 1536414 - RNA, 19 nt, Homo sapiens
cccaaaccauccucauucu

SEQ ID NO: 1536415 - RNA, 19 nt, Homo sapiens
gcagugcccgcuacaacca

SEQ ID NO: 1536416 - RNA, 19 nt, Homo sapiens
acuccauguuucaguguuu

SEQ ID NO: 1536417 - RNA, 19 nt, Homo sapiens
gaagggguuugaaggaagu

SEQ ID NO: 1536418 - RNA, 19 nt, Homo sapiens
guccauguuuauucugcaa

SEQ ID NO: 1536419 - RNA, 19 nt, Homo sapiens
guggguguucacaauauuu

SEQ ID NO: 1536420 - RNA, 19 nt, Homo sapiens
cggccgagcaggucaacaa

SEQ ID NO: 1536421 - RNA, 19 nt, Homo sapiens
gcugacggccgaguccauu

SEQ ID NO: 1536422 - RNA, 19 nt, Homo sapiens
ggcucugcuuuccuccuua

SEQ ID NO: 1536423 - RNA, 19 nt, Homo sapiens
caaaggucacccggaguug

SEQ ID NO: 1536424 - RNA, 19 nt, Homo sapiens
gcacagaaaauuugaugag

SEQ ID NO: 1536425 - RNA, 19 nt, Homo sapiens
gaagcaaggucaagaaauc

SEQ ID NO: 1536426 - RNA, 19 nt, Homo sapiens
gggacaagauugcuuccua

SEQ ID NO: 1536427 - RNA, 19 nt, Homo sapiens
gagaagcaaggucaagaaa

SEQ ID NO: 1536428 - RNA, 19 nt, Homo sapiens
gagcagcgaccacguggaa

SEQ ID NO: 1536429 - RNA, 19 nt, Homo sapiens
ucucugugcuguucuggua

SEQ ID NO: 1536430 - RNA, 19 nt, Homo sapiens
gaagucuugugaccuccuu

SEQ ID NO: 1536431 - RNA, 19 nt, Homo sapiens
ucaugcaagucuucacuga

SEQ ID NO: 1536432 - RNA, 19 nt, Homo sapiens
cuccugagcucacccaaga

SEQ ID NO: 1536433 - RNA, 19 nt, Homo sapiens
gcagaugacaccuguuugg

SEQ ID NO: 1536434 - RNA, 19 nt, Homo sapiens
gagagaagcaaggucaaga

SEQ ID NO: 1536435 - RNA, 19 nt, Homo sapiens
gcucuuugacuucgccuuu

SEQ ID NO: 1536436 - RNA, 19 nt, Homo sapiens
gagcagcccucgacuuccu

SEQ ID NO: 1536437 - RNA, 19 nt, Homo sapiens
uggcagaugacaccuguuu

SEQ ID NO: 1536438 - RNA, 19 nt, Homo sapiens
cuucagaugcgcacucuug

SEQ ID NO: 1536439 - RNA, 19 nt, Homo sapiens
guucucccguguucaguuc

SEQ ID NO: 1536440 - RNA, 19 nt, Homo sapiens
gaagcuccuggacugguuu

SEQ ID NO: 1536441 - RNA, 19 nt, Homo sapiens
agaagcuccuggacugguu

SEQ ID NO: 1536442 - RNA, 19 nt, Homo sapiens
gcacauccucuccguagac

SEQ ID NO: 1536443 - RNA, 19 nt, Homo sapiens
acacacuccuggccuccaa

SEQ ID NO: 1536444 - RNA, 19 nt, Homo sapiens
ucauggaucacguugaaga

SEQ ID NO: 1536445 - RNA, 19 nt, Homo sapiens
cgaggccgacugcuacuga

SEQ ID NO: 1536446 - RNA, 19 nt, Homo sapiens
gggaggacaggcugacuuc

SEQ ID NO: 1536447 - RNA, 19 nt, Homo sapiens
cuugugaccuccuucucuu

SEQ ID NO: 1536448 - RNA, 19 nt, Homo sapiens
augcaagucuucacugagu

SEQ ID NO: 1536449 - RNA, 19 nt, Homo sapiens
agagaagcaaggucaagaa

SEQ ID NO: 1536450 - RNA, 19 nt, Homo sapiens
ggagagaagcaaggucaag

SEQ ID NO: 1536451 - RNA, 19 nt, Homo sapiens
gcuccuggacugguuuaaa

SEQ ID NO: 1536452 - RNA, 19 nt, Homo sapiens
gcgcacucuuggcuucaga

SEQ ID NO: 1536453 - RNA, 19 nt, Homo sapiens
gcugucccaugugcugaaa

SEQ ID NO: 1536454 - RNA, 19 nt, Homo sapiens
guuacuaccagggcucuuu

SEQ ID NO: 1536455 - RNA, 19 nt, Homo sapiens
ccugucugcuggagagaga

SEQ ID NO: 1536456 - RNA, 19 nt, Homo sapiens
ugacaccuguuuggagaag

SEQ ID NO: 1536457 - RNA, 19 nt, Homo sapiens
gacaagauugcuuccuaca

SEQ ID NO: 1536458 - RNA, 19 nt, Homo sapiens
gggcggucaugcaagucuu

SEQ ID NO: 1536459 - RNA, 19 nt, Homo sapiens
uggagcugcugucccaugu

SEQ ID NO: 1536460 - RNA, 19 nt, Homo sapiens
gauggaagaugaaggcuua

SEQ ID NO: 1536461 - RNA, 19 nt, Homo sapiens
gaagcagguuuguuucuuu

SEQ ID NO: 1536462 - RNA, 19 nt, Homo sapiens
cagaauugcuuguuacgua

SEQ ID NO: 1536463 - RNA, 19 nt, Homo sapiens
gcaggaagcagguuuguuu

SEQ ID NO: 1536464 - RNA, 19 nt, Homo sapiens
gcaacagugucugcaaaua

SEQ ID NO: 1536465 - RNA, 19 nt, Homo sapiens
ggacacuagauuucaauua

SEQ ID NO: 1536466 - RNA, 19 nt, Homo sapiens
caacagugucugcaaauaa

SEQ ID NO: 1536467 - RNA, 19 nt, Homo sapiens
uaggaagcgugcauuguua

SEQ ID NO: 1536468 - RNA, 19 nt, Homo sapiens
gacacuagauuucaauuag

SEQ ID NO: 1536469 - RNA, 19 nt, Homo sapiens
gaacacagcacacggucaa

SEQ ID NO: 1536470 - RNA, 19 nt, Homo sapiens
gaggacaucugcaacaagu

SEQ ID NO: 1536471 - RNA, 19 nt, Homo sapiens
ggaagcagguuuguuucuu

SEQ ID NO: 1536472 - RNA, 19 nt, Homo sapiens
gaaugaggauccgauggaa

SEQ ID NO: 1536473 - RNA, 19 nt, Homo sapiens
guauuucacuggugcaaug

SEQ ID NO: 1536474 - RNA, 19 nt, Homo sapiens
guaggaagcgugcauuguu

SEQ ID NO: 1536475 - RNA, 19 nt, Homo sapiens
ucugaaauguucucacuug

SEQ ID NO: 1536476 - RNA, 19 nt, Homo sapiens
ggcagaauaagaaguauaa

SEQ ID NO: 1536477 - RNA, 19 nt, Homo sapiens
ucuccagaauugcuuguua

SEQ ID NO: 1536478 - RNA, 19 nt, Homo sapiens
caacuucaucuguuucuga

SEQ ID NO: 1536479 - RNA, 19 nt, Homo sapiens
acaaucaacuccaauaacu

SEQ ID NO: 1536480 - RNA, 19 nt, Homo sapiens
aacagugucugcaaauaaa

SEQ ID NO: 1536481 - RNA, 19 nt, Homo sapiens
ugaaaugaaugcgucuuug

SEQ ID NO: 1536482 - RNA, 19 nt, Homo sapiens
gaagucggcagaugcauca

SEQ ID NO: 1536483 - RNA, 19 nt, Homo sapiens
uaagagaagguguauuuca

SEQ ID NO: 1536484 - RNA, 19 nt, Homo sapiens
aagcaacagugucugcaaa

SEQ ID NO: 1536485 - RNA, 19 nt, Homo sapiens
aagagcaccuucuccaaga

SEQ ID NO: 1536486 - RNA, 19 nt, Homo sapiens
gcaacuuuccggagucuau

SEQ ID NO: 1536487 - RNA, 19 nt, Homo sapiens
ugugucagcucaaguggaa

SEQ ID NO: 1536488 - RNA, 19 nt, Homo sapiens
caaaacagcucugagaaca

SEQ ID NO: 1536489 - RNA, 19 nt, Homo sapiens
ggcagugucuagucaagga

SEQ ID NO: 1536490 - RNA, 19 nt, Homo sapiens
ggcaaggagugacuuacga

SEQ ID NO: 1536491 - RNA, 19 nt, Homo sapiens
uuaagacaaucaacuccaa

SEQ ID NO: 1536492 - RNA, 19 nt, Homo sapiens
gcggaacggaggcaacuuu

SEQ ID NO: 1536493 - RNA, 19 nt, Homo sapiens
uaugggacauguuugugaa

SEQ ID NO: 1536494 - RNA, 19 nt, Homo sapiens
aaucaacuccaauaacuga

SEQ ID NO: 1536495 - RNA, 19 nt, Homo sapiens
agacaaucaacuccaauaa

SEQ ID NO: 1536496 - RNA, 19 nt, Homo sapiens
ggacaucugcaacaaguac

SEQ ID NO: 1536497 - RNA, 19 nt, Homo sapiens
gggcagaauaagaaguaua

SEQ ID NO: 1536498 - RNA, 19 nt, Homo sapiens
gaaaugaaugcgucuuugc

SEQ ID NO: 1536499 - RNA, 19 nt, Homo sapiens
gucccaacuucaucuguuu

SEQ ID NO: 1536500 - RNA, 19 nt, Homo sapiens
guacaugggaaagaugaaa

SEQ ID NO: 1536501 - RNA, 19 nt, Homo sapiens
gaaaggggaucuccaccau

SEQ ID NO: 1536502 - RNA, 19 nt, Homo sapiens
ggaagaugaaggcuuaugg

SEQ ID NO: 1536503 - RNA, 19 nt, Homo sapiens
cacuagauuucaauuagga

SEQ ID NO: 1536504 - RNA, 19 nt, Homo sapiens
gaacugcagcacaggaaag

SEQ ID NO: 1536505 - RNA, 19 nt, Homo sapiens
gaaugcgucuuugcugucu

SEQ ID NO: 1536506 - RNA, 19 nt, Homo sapiens
aggagugacuuacgaguuc

SEQ ID NO: 1536507 - RNA, 19 nt, Homo sapiens
ugaaugaggauccgaugga

SEQ ID NO: 1536508 - RNA, 19 nt, Homo sapiens
ggagaagucggcagaugca

SEQ ID NO: 1536509 - RNA, 19 nt, Homo sapiens
aggauccgauggaagauga

SEQ ID NO: 1536510 - RNA, 19 nt, Homo sapiens
gaaggcuuaugggacaugu

SEQ ID NO: 1536511 - RNA, 19 nt, Homo sapiens
gggacauguuugugaagga

SEQ ID NO: 1536512 - RNA, 19 nt, Homo sapiens
aagacaaucaacuccaaua

SEQ ID NO: 1536513 - RNA, 19 nt, Homo sapiens
gucggcagaugcaucagaa

SEQ ID NO: 1536514 - RNA, 19 nt, Homo sapiens
ggacaacggaggauuugcu

SEQ ID NO: 1536515 - RNA, 19 nt, Homo sapiens
uccaauaacugagcugaag

SEQ ID NO: 1536516 - RNA, 19 nt, Homo sapiens
ugucccaacuucaucuguu

SEQ ID NO: 1536517 - RNA, 19 nt, Homo sapiens
gacaaucaacuccaauaac

SEQ ID NO: 1536518 - RNA, 19 nt, Homo sapiens
ggugguggcugugaaugag

SEQ ID NO: 1536519 - RNA, 19 nt, Homo sapiens
aagagaagguguauuucac

SEQ ID NO: 1536520 - RNA, 19 nt, Homo sapiens
acacuagauuucaauuagg

SEQ ID NO: 1536521 - RNA, 19 nt, Homo sapiens
ccacggacucugacuacga

SEQ ID NO: 1536522 - RNA, 19 nt, Homo sapiens
aaggagaagucggcagaug

SEQ ID NO: 1536523 - RNA, 19 nt, Homo sapiens
ggugcgguccucaggcuuu

SEQ ID NO: 1536524 - RNA, 19 nt, Homo sapiens
aggcuuaugggacauguuu

SEQ ID NO: 1536525 - RNA, 19 nt, Homo sapiens
caacuuuccggagucuauu

SEQ ID NO: 1536526 - RNA, 19 nt, Homo sapiens
ucaagagcaccuucuccaa

SEQ ID NO: 1536527 - RNA, 19 nt, Homo sapiens
ggccaggcagggaugcuaa

SEQ ID NO: 1536528 - RNA, 19 nt, Homo sapiens
uguggacacuagauuucaa

SEQ ID NO: 1536529 - RNA, 19 nt, Homo sapiens
gcuuaugggacauguuugu

SEQ ID NO: 1536530 - RNA, 19 nt, Homo sapiens
gacgaggacaucugcaaca

SEQ ID NO: 1536531 - RNA, 19 nt, Homo sapiens
gcauuguuaaccagaguau

SEQ ID NO: 1536532 - RNA, 19 nt, Homo sapiens
cagcagccgccaccucaau

SEQ ID NO: 1536533 - RNA, 19 nt, Homo sapiens
gggugguggcugugaauga

SEQ ID NO: 1536534 - RNA, 19 nt, Homo sapiens
gugcauuguuaaccagagu

SEQ ID NO: 1536535 - RNA, 19 nt, Homo sapiens
aagcgugcauuguuaacca

SEQ ID NO: 1536536 - RNA, 19 nt, Homo sapiens
gucaaggagucggcuuuca

SEQ ID NO: 1536537 - RNA, 19 nt, Homo sapiens
cuucaagaccaacuaggaa

SEQ ID NO: 1536538 - RNA, 19 nt, Homo sapiens
gcacgggcagaauaagaag

SEQ ID NO: 1536539 - RNA, 19 nt, Homo sapiens
gugaugauuuuaccuacuu

SEQ ID NO: 1536540 - RNA, 19 nt, Homo sapiens
ggugguuccuccuggugau

SEQ ID NO: 1536541 - RNA, 19 nt, Homo sapiens
acgaggacaucugcaacaa

SEQ ID NO: 1536542 - RNA, 19 nt, Homo sapiens
ccuggacaacggaggauuu

SEQ ID NO: 1536543 - RNA, 19 nt, Homo sapiens
ugggaaagaugaaaagcaa

SEQ ID NO: 1536544 - RNA, 19 nt, Homo sapiens
gcagccgccaccucaaugu

SEQ ID NO: 1536545 - RNA, 19 nt, Homo sapiens
gcaaagcucugcaggaaua

SEQ ID NO: 1536546 - RNA, 19 nt, Homo sapiens
gcaauaaacccaaguacaa

SEQ ID NO: 1536547 - RNA, 19 nt, Homo sapiens
gcgaucagcucaacuguca

SEQ ID NO: 1536548 - RNA, 19 nt, Homo sapiens
gaauguccaucaacaggaa

SEQ ID NO: 1536549 - RNA, 19 nt, Homo sapiens
ggagggugcugguuuguuc

SEQ ID NO: 1536550 - RNA, 19 nt, Homo sapiens
gauucaagccaguuacuua

SEQ ID NO: 1536551 - RNA, 19 nt, Homo sapiens
uuacaggcgugguuuguuu

SEQ ID NO: 1536552 - RNA, 19 nt, Homo sapiens
ggaagucauuguggccaua

SEQ ID NO: 1536553 - RNA, 19 nt, Homo sapiens
gagccaagccuucagcauu

SEQ ID NO: 1536554 - RNA, 19 nt, Homo sapiens
ccacagggcugcaguacag

SEQ ID NO: 1536555 - RNA, 19 nt, Homo sapiens
aaacugccaucauuacaug

SEQ ID NO: 1536556 - RNA, 19 nt, Homo sapiens
gcagaaccacagacuauga

SEQ ID NO: 1536557 - RNA, 19 nt, Homo sapiens
ggaagucuaugucuaagcu

SEQ ID NO: 1536558 - RNA, 19 nt, Homo sapiens
ggaaucggaugggaacaga

SEQ ID NO: 1536559 - RNA, 19 nt, Homo sapiens
gaagaucugaagagaagaa

SEQ ID NO: 1536560 - RNA, 19 nt, Homo sapiens
gcucagcaguuacuugauc

SEQ ID NO: 1536561 - RNA, 19 nt, Homo sapiens
gaggacugcuccagaagug

SEQ ID NO: 1536562 - RNA, 19 nt, Homo sapiens
uggaagaucugaagagaag

SEQ ID NO: 1536563 - RNA, 19 nt, Homo sapiens
ggauuggcauucugacguu

SEQ ID NO: 1536564 - RNA, 19 nt, Homo sapiens
ucaagccaguuacuuaaug

SEQ ID NO: 1536565 - RNA, 19 nt, Homo sapiens
ugagaggaacgauuuguaa

SEQ ID NO: 1536566 - RNA, 19 nt, Homo sapiens
gccaguggauucaggaguu

SEQ ID NO: 1536567 - RNA, 19 nt, Homo sapiens
cauaaugguagcagaagua

SEQ ID NO: 1536568 - RNA, 19 nt, Homo sapiens
cgagugcugugguggauug

SEQ ID NO: 1536569 - RNA, 19 nt, Homo sapiens
cagaagaccgugaacaguu

SEQ ID NO: 1536570 - RNA, 19 nt, Homo sapiens
cagcgaauguccaucaaca

SEQ ID NO: 1536571 - RNA, 19 nt, Homo sapiens
ggacucuucucccaaguac

SEQ ID NO: 1536572 - RNA, 19 nt, Homo sapiens
cagcuuccaugacaagguu

SEQ ID NO: 1536573 - RNA, 19 nt, Homo sapiens
gaagcagaaccacagacua

SEQ ID NO: 1536574 - RNA, 19 nt, Homo sapiens
aggaguugcugauugaauu

SEQ ID NO: 1536575 - RNA, 19 nt, Homo sapiens
agaauuccauggucucaau

SEQ ID NO: 1536576 - RNA, 19 nt, Homo sapiens
uuagaaaacugccaucauu

SEQ ID NO: 1536577 - RNA, 19 nt, Homo sapiens
gcuacaagcgugugggaaa

SEQ ID NO: 1536578 - RNA, 19 nt, Homo sapiens
ugucauauguacuguguca

SEQ ID NO: 1536579 - RNA, 19 nt, Homo sapiens
gaucugaagagaagaaucu

SEQ ID NO: 1536580 - RNA, 19 nt, Homo sapiens
acacaaggguauuucucaa

SEQ ID NO: 1536581 - RNA, 19 nt, Homo sapiens
ccaugucucugcaggaugu

SEQ ID NO: 1536582 - RNA, 19 nt, Homo sapiens
gaccaugucucugcaggau

SEQ ID NO: 1536583 - RNA, 19 nt, Homo sapiens
aaacagcgaauguccauca

SEQ ID NO: 1536584 - RNA, 19 nt, Homo sapiens
ccauuaucauugucuuuga

SEQ ID NO: 1536585 - RNA, 19 nt, Homo sapiens
ccgcggaagucuaugucua

SEQ ID NO: 1536586 - RNA, 19 nt, Homo sapiens
gaagcggaauucagcaaaa

SEQ ID NO: 1536587 - RNA, 19 nt, Homo sapiens
caaggcagcucuuuucauc

SEQ ID NO: 1536588 - RNA, 19 nt, Homo sapiens
aagcagaaccacagacuau

SEQ ID NO: 1536589 - RNA, 19 nt, Homo sapiens
gaagucauuguggccauaa

SEQ ID NO: 1536590 - RNA, 19 nt, Homo sapiens
gaaacugucccaggaacga

SEQ ID NO: 1536591 - RNA, 19 nt, Homo sapiens
acucauagguccgaagaug

SEQ ID NO: 1536592 - RNA, 19 nt, Homo sapiens
caacuuggaagaucugaag

SEQ ID NO: 1536593 - RNA, 19 nt, Homo sapiens
agccaagccuucagcauug

SEQ ID NO: 1536594 - RNA, 19 nt, Homo sapiens
gcuguugcauugggaaaga

SEQ ID NO: 1536595 - RNA, 19 nt, Homo sapiens
gaaccacagacuaugacuu

SEQ ID NO: 1536596 - RNA, 19 nt, Homo sapiens
acagugguuuccauuauca

SEQ ID NO: 1536597 - RNA, 19 nt, Homo sapiens
guugucauauguacugugu

SEQ ID NO: 1536598 - RNA, 19 nt, Homo sapiens
caagcugccagauacguuu

SEQ ID NO: 1536599 - RNA, 19 nt, Homo sapiens
caagccaguuacuuaaugg

SEQ ID NO: 1536600 - RNA, 19 nt, Homo sapiens
cgacaggacaguuguaaac

SEQ ID NO: 1536601 - RNA, 19 nt, Homo sapiens
ugucagccaucaugugugu

SEQ ID NO: 1536602 - RNA, 19 nt, Homo sapiens
cuuccuggauguacaaaug

SEQ ID NO: 1536603 - RNA, 19 nt, Homo sapiens
gcuugagcgccgauaauuu

SEQ ID NO: 1536604 - RNA, 19 nt, Homo sapiens
gcucugcugcucacuauag

SEQ ID NO: 1536605 - RNA, 19 nt, Homo sapiens
cuugagcgccgauaauuug

SEQ ID NO: 1536606 - RNA, 19 nt, Homo sapiens
gcucuugugcuguugcauu

SEQ ID NO: 1536607 - RNA, 19 nt, Homo sapiens
ccaccuggauagucaugau

SEQ ID NO: 1536608 - RNA, 19 nt, Homo sapiens
aaaccagaaucaagcucuu

SEQ ID NO: 1536609 - RNA, 19 nt, Homo sapiens
guggucaguuggaucauca

SEQ ID NO: 1536610 - RNA, 19 nt, Homo sapiens
ccuggcaguugucauaugu

SEQ ID NO: 1536611 - RNA, 19 nt, Homo sapiens
gcugauugaauucuugcua

SEQ ID NO: 1536612 - RNA, 19 nt, Homo sapiens
ccaguuguuuguccacauc

SEQ ID NO: 1536613 - RNA, 19 nt, Homo sapiens
gaggaaaccccaacaacuu

SEQ ID NO: 1536614 - RNA, 19 nt, Homo sapiens
gcagaagcagaaccacaga

SEQ ID NO: 1536615 - RNA, 19 nt, Homo sapiens
caaacugggcuuccuggau

SEQ ID NO: 1536616 - RNA, 19 nt, Homo sapiens
gaguucccaugacgccaaa

SEQ ID NO: 1536617 - RNA, 19 nt, Homo sapiens
gcacacaaggguauuucuc

SEQ ID NO: 1536618 - RNA, 19 nt, Homo sapiens
caggaaagagucuguugug

SEQ ID NO: 1536619 - RNA, 19 nt, Homo sapiens
aaccacagacuaugacuug

SEQ ID NO: 1536620 - RNA, 19 nt, Homo sapiens
caucauuacaugcaguuug

SEQ ID NO: 1536621 - RNA, 19 nt, Homo sapiens
caucagcaacaggacaaua

SEQ ID NO: 1536622 - RNA, 19 nt, Homo sapiens
cacagugguuuccauuauc

SEQ ID NO: 1536623 - RNA, 19 nt, Homo sapiens
aaugguagcagaaguagug

SEQ ID NO: 1536624 - RNA, 19 nt, Homo sapiens
cagggccacuggaaacugu

SEQ ID NO: 1536625 - RNA, 19 nt, Homo sapiens
agaucuugcugcacgguuu

SEQ ID NO: 1536626 - RNA, 19 nt, Homo sapiens
ucuccuggcaguugucaua

SEQ ID NO: 1536627 - RNA, 19 nt, Homo sapiens
ccaguggauucaggaguug

SEQ ID NO: 1536628 - RNA, 19 nt, Homo sapiens
gaugcucaccgaccacaug

SEQ ID NO: 1536629 - RNA, 19 nt, Homo sapiens
cugcaggaauauucucaga

SEQ ID NO: 1536630 - RNA, 19 nt, Homo sapiens
auucugacguuguaucuca

SEQ ID NO: 1536631 - RNA, 19 nt, Homo sapiens
ggaccgcggaagucuaugu

SEQ ID NO: 1536632 - RNA, 19 nt, Homo sapiens
guugcugauugaauucuug

SEQ ID NO: 1536633 - RNA, 19 nt, Homo sapiens
uccauggucucaaugacuu

SEQ ID NO: 1536634 - RNA, 19 nt, Homo sapiens
cgaagcggaauucagcaaa

SEQ ID NO: 1536635 - RNA, 19 nt, Homo sapiens
caauaaacccaaguacaag

SEQ ID NO: 1536636 - RNA, 19 nt, Homo sapiens
cuuggaagaucugaagaga

SEQ ID NO: 1536637 - RNA, 19 nt, Homo sapiens
ggaguugcugauugaauuc

SEQ ID NO: 1536638 - RNA, 19 nt, Homo sapiens
ggucacacgaagcggaauu

SEQ ID NO: 1536639 - RNA, 19 nt, Homo sapiens
cagcaugagaggaacgauu

SEQ ID NO: 1536640 - RNA, 19 nt, Homo sapiens
gcaguacagggacuucauc

SEQ ID NO: 1536641 - RNA, 19 nt, Homo sapiens
ggaagcugaucuggaugca

SEQ ID NO: 1536642 - RNA, 19 nt, Homo sapiens
cggcagagcuuuucucaac

SEQ ID NO: 1536643 - RNA, 19 nt, Homo sapiens
cugcucugcugcucacuau

SEQ ID NO: 1536644 - RNA, 19 nt, Homo sapiens
aaacccaaguacaagaucu

SEQ ID NO: 1536645 - RNA, 19 nt, Homo sapiens
aaaugaaacuggaguacua

SEQ ID NO: 1536646 - RNA, 19 nt, Homo sapiens
aaacuggaguacuaacgua

SEQ ID NO: 1536647 - RNA, 19 nt, Homo sapiens
ccaccaaguugcccaucua

SEQ ID NO: 1536648 - RNA, 19 nt, Homo sapiens
ggagcucugucucacugua

SEQ ID NO: 1536649 - RNA, 19 nt, Homo sapiens
ucaugcauguguuaaauug

SEQ ID NO: 1536650 - RNA, 19 nt, Homo sapiens
gcaccucaguuacauaaaa

SEQ ID NO: 1536651 - RNA, 19 nt, Homo sapiens
guucaugcauguguuaaau

SEQ ID NO: 1536652 - RNA, 19 nt, Homo sapiens
gcugagaagugcccaguac

SEQ ID NO: 1536653 - RNA, 19 nt, Homo sapiens
ggacagacagggccuccuu

SEQ ID NO: 1536654 - RNA, 19 nt, Homo sapiens
gaaaguccaauccugagau

SEQ ID NO: 1536655 - RNA, 19 nt, Homo sapiens
gcaggcagcaucccuaugg

SEQ ID NO: 1536656 - RNA, 19 nt, Homo sapiens
acguacaguuuaaagguua

SEQ ID NO: 1536657 - RNA, 19 nt, Homo sapiens
ccaggaaggcugagaagug

SEQ ID NO: 1536658 - RNA, 19 nt, Homo sapiens
ggggugagauucagcagua

SEQ ID NO: 1536659 - RNA, 19 nt, Homo sapiens
uaugggagcugagaaaguc

SEQ ID NO: 1536660 - RNA, 19 nt, Homo sapiens
ggcagcaacuccugagaca

SEQ ID NO: 1536661 - RNA, 19 nt, Homo sapiens
uaacguacaguuuaaaggu

SEQ ID NO: 1536662 - RNA, 19 nt, Homo sapiens
ggaugcaccucaguuacau

SEQ ID NO: 1536663 - RNA, 19 nt, Homo sapiens
agacagggccuccuuacug

SEQ ID NO: 1536664 - RNA, 19 nt, Homo sapiens
gaaacuggaguacuaacgu

SEQ ID NO: 1536665 - RNA, 19 nt, Homo sapiens
cugagacacuacugugauu

SEQ ID NO: 1536666 - RNA, 19 nt, Homo sapiens
gggcuuugguugggucuug

SEQ ID NO: 1536667 - RNA, 19 nt, Homo sapiens
gcugggcccugacaacagu

SEQ ID NO: 1536668 - RNA, 19 nt, Homo sapiens
aaaguccaauccugagaug

SEQ ID NO: 1536669 - RNA, 19 nt, Homo sapiens
gacagacagggccuccuua

SEQ ID NO: 1536670 - RNA, 19 nt, Homo sapiens
guaaggcaaugaggagagu

SEQ ID NO: 1536671 - RNA, 19 nt, Homo sapiens
ugaguucaugcauguguua

SEQ ID NO: 1536672 - RNA, 19 nt, Homo sapiens
gagcugagaaaguccaauc

SEQ ID NO: 1536673 - RNA, 19 nt, Homo sapiens
gagcucugucucacuguaa

SEQ ID NO: 1536674 - RNA, 19 nt, Homo sapiens
ggugacaaagaauaaaguu

SEQ ID NO: 1536675 - RNA, 19 nt, Homo sapiens
gagccugcauagggaagaa

SEQ ID NO: 1536676 - RNA, 19 nt, Homo sapiens
ggugguggcugugguaaaa

SEQ ID NO: 1536677 - RNA, 19 nt, Homo sapiens
cugcagggcuagaguuugg

SEQ ID NO: 1536678 - RNA, 19 nt, Homo sapiens
ugacaacagucuccccaaa

SEQ ID NO: 1536679 - RNA, 19 nt, Homo sapiens
gggugagauucagcaguaa

SEQ ID NO: 1536680 - RNA, 19 nt, Homo sapiens
gaugcaccucaguuacaua

SEQ ID NO: 1536681 - RNA, 19 nt, Homo sapiens
gacacuacugugauucuug

SEQ ID NO: 1536682 - RNA, 19 nt, Homo sapiens
ggaaggaccagccccauuc

SEQ ID NO: 1536683 - RNA, 19 nt, Homo sapiens
cagcaacuccugagacacu

SEQ ID NO: 1536684 - RNA, 19 nt, Homo sapiens
aacguacaguuuaaagguu

SEQ ID NO: 1536685 - RNA, 19 nt, Homo sapiens
agacacuacugugauucuu

SEQ ID NO: 1536686 - RNA, 19 nt, Homo sapiens
guaacuguggccucuccua

SEQ ID NO: 1536687 - RNA, 19 nt, Homo sapiens
gcauguguuaaauugcuuu

SEQ ID NO: 1536688 - RNA, 19 nt, Homo sapiens
gagacacuacugugauucu

SEQ ID NO: 1536689 - RNA, 19 nt, Homo sapiens
acuguggccucuccuagug

SEQ ID NO: 1536690 - RNA, 19 nt, Homo sapiens
ugacaaaguucuccuauua

SEQ ID NO: 1536691 - RNA, 19 nt, Homo sapiens
gaagagugcuuucaaggaa

SEQ ID NO: 1536692 - RNA, 19 nt, Homo sapiens
gaaaugacagcuacacuuu

SEQ ID NO: 1536693 - RNA, 19 nt, Homo sapiens
gaaccaguguuguacauga

SEQ ID NO: 1536694 - RNA, 19 nt, Homo sapiens
caacauuacuguacuuaga

SEQ ID NO: 1536695 - RNA, 19 nt, Homo sapiens
gcucugaccuguacaguga

SEQ ID NO: 1536696 - RNA, 19 nt, Homo sapiens
ccaagaguaucacgguuua

SEQ ID NO: 1536697 - RNA, 19 nt, Homo sapiens
gcacgggaaugaacuaaau

SEQ ID NO: 1536698 - RNA, 19 nt, Homo sapiens
gggaaugaacuaaauguua

SEQ ID NO: 1536699 - RNA, 19 nt, Homo sapiens
gaaggaaaccagauacauu

SEQ ID NO: 1536700 - RNA, 19 nt, Homo sapiens
gguagguacuaaugauuua

SEQ ID NO: 1536701 - RNA, 19 nt, Homo sapiens
aaacaaacaucccagaaau

SEQ ID NO: 1536702 - RNA, 19 nt, Homo sapiens
ccaacaagguggacucauu

SEQ ID NO: 1536703 - RNA, 19 nt, Homo sapiens
guaccuaggugcauauaau

SEQ ID NO: 1536704 - RNA, 19 nt, Homo sapiens
ucaagaaacuauggaauug

SEQ ID NO: 1536705 - RNA, 19 nt, Homo sapiens
ucaagaagaucaaagaagu

SEQ ID NO: 1536706 - RNA, 19 nt, Homo sapiens
acacuagccuauuacauuu

SEQ ID NO: 1536707 - RNA, 19 nt, Homo sapiens
gaccaauggcuaauaauaa

SEQ ID NO: 1536708 - RNA, 19 nt, Homo sapiens
gaagaaaguaccagauuca

SEQ ID NO: 1536709 - RNA, 19 nt, Homo sapiens
ugaaaggcauugaaggaaa

SEQ ID NO: 1536710 - RNA, 19 nt, Homo sapiens
gcacagaaaccggcaugua

SEQ ID NO: 1536711 - RNA, 19 nt, Homo sapiens
uggaugaaauugacucuuu

SEQ ID NO: 1536712 - RNA, 19 nt, Homo sapiens
guauauccauucccacaaa

SEQ ID NO: 1536713 - RNA, 19 nt, Homo sapiens
gguaguaacuuauccaaac

SEQ ID NO: 1536714 - RNA, 19 nt, Homo sapiens
ugguaaaucuuucuaggua

SEQ ID NO: 1536715 - RNA, 19 nt, Homo sapiens
caaagaacagcauggcaua

SEQ ID NO: 1536716 - RNA, 19 nt, Homo sapiens
uuggacagcuguuaaguuu

SEQ ID NO: 1536717 - RNA, 19 nt, Homo sapiens
aaggaaaccagauacauua

SEQ ID NO: 1536718 - RNA, 19 nt, Homo sapiens
ggacagcuguuaaguuuug

SEQ ID NO: 1536719 - RNA, 19 nt, Homo sapiens
acaaacaucccagaaauaa

SEQ ID NO: 1536720 - RNA, 19 nt, Homo sapiens
aaacauguccaucaagaaa

SEQ ID NO: 1536721 - RNA, 19 nt, Homo sapiens
gcuaaauuaucccacuauu

SEQ ID NO: 1536722 - RNA, 19 nt, Homo sapiens
gugaaugacuugcuuaaac

SEQ ID NO: 1536723 - RNA, 19 nt, Homo sapiens
uaaacaaacaucccagaaa

SEQ ID NO: 1536724 - RNA, 19 nt, Homo sapiens
gaaaggcauugaaggaaac

SEQ ID NO: 1536725 - RNA, 19 nt, Homo sapiens
gaaacacacagucuccaaa

SEQ ID NO: 1536726 - RNA, 19 nt, Homo sapiens
ugaagaaaguaccagauuc

SEQ ID NO: 1536727 - RNA, 19 nt, Homo sapiens
ggaaauuugucauauucuc

SEQ ID NO: 1536728 - RNA, 19 nt, Homo sapiens
agggucaacugcaauauaa

SEQ ID NO: 1536729 - RNA, 19 nt, Homo sapiens
ggaaucuggugauacuguu

SEQ ID NO: 1536730 - RNA, 19 nt, Homo sapiens
gaaggggcuugguuuauuu

SEQ ID NO: 1536731 - RNA, 19 nt, Homo sapiens
gaaagugcaacauuacugu

SEQ ID NO: 1536732 - RNA, 19 nt, Homo sapiens
ucagaaggacuuugaggua

SEQ ID NO: 1536733 - RNA, 19 nt, Homo sapiens
ugaaauugguagguacuaa

SEQ ID NO: 1536734 - RNA, 19 nt, Homo sapiens
caacaagguggacucauug

SEQ ID NO: 1536735 - RNA, 19 nt, Homo sapiens
gaacagcauggcauaaaca

SEQ ID NO: 1536736 - RNA, 19 nt, Homo sapiens
gcuggucacuuugaagauu

SEQ ID NO: 1536737 - RNA, 19 nt, Homo sapiens
guaaaucuuucuagguagu

SEQ ID NO: 1536738 - RNA, 19 nt, Homo sapiens
uagggacuguguaccuuua

SEQ ID NO: 1536739 - RNA, 19 nt, Homo sapiens
guacaugaaccaacauugu

SEQ ID NO: 1536740 - RNA, 19 nt, Homo sapiens
ucuagaaguugacaaugaa

SEQ ID NO: 1536741 - RNA, 19 nt, Homo sapiens
guaguaacuuauccaaaca

SEQ ID NO: 1536742 - RNA, 19 nt, Homo sapiens
gagaaaacguauuaggaaa

SEQ ID NO: 1536743 - RNA, 19 nt, Homo sapiens
aaucguggcucuauugcuu

SEQ ID NO: 1536744 - RNA, 19 nt, Homo sapiens
gaaauugguagguacuaau

SEQ ID NO: 1536745 - RNA, 19 nt, Homo sapiens
agaccaauggcuaauaaua

SEQ ID NO: 1536746 - RNA, 19 nt, Homo sapiens
ugaucgaccugccugcuaa

SEQ ID NO: 1536747 - RNA, 19 nt, Homo sapiens
caaagucaccugauucucu

SEQ ID NO: 1536748 - RNA, 19 nt, Homo sapiens
gaauugagggcacauccuu

SEQ ID NO: 1536749 - RNA, 19 nt, Homo sapiens
gcucaucugucaucuucau

SEQ ID NO: 1536750 - RNA, 19 nt, Homo sapiens
gaaugcugcuuggaagaga

SEQ ID NO: 1536751 - RNA, 19 nt, Homo sapiens
agaagaaaguguuggucaa

SEQ ID NO: 1536752 - RNA, 19 nt, Homo sapiens
gaaauaacugaaugcugaa

SEQ ID NO: 1536753 - RNA, 19 nt, Homo sapiens
gaaaaucguggcucuauug

SEQ ID NO: 1536754 - RNA, 19 nt, Homo sapiens
ugaaugacuugcuuaaacu

SEQ ID NO: 1536755 - RNA, 19 nt, Homo sapiens
cagggcacauugacagaaa

SEQ ID NO: 1536756 - RNA, 19 nt, Homo sapiens
gugaagaaaguaccagauu

SEQ ID NO: 1536757 - RNA, 19 nt, Homo sapiens
guuaaagugugccuauuac

SEQ ID NO: 1536758 - RNA, 19 nt, Homo sapiens
uacacuagccuauuacauu

SEQ ID NO: 1536759 - RNA, 19 nt, Homo sapiens
gggaaacugaauauucuuu

SEQ ID NO: 1536760 - RNA, 19 nt, Homo sapiens
cuuaguagauugaaauugg

SEQ ID NO: 1536761 - RNA, 19 nt, Homo sapiens
ggaaaccagauacauuaau

SEQ ID NO: 1536762 - RNA, 19 nt, Homo sapiens
uaaacugggaaacugaaua

SEQ ID NO: 1536763 - RNA, 19 nt, Homo sapiens
gcucauuuauggagagaca

SEQ ID NO: 1536764 - RNA, 19 nt, Homo sapiens
ggccauggguaagaagaaa

SEQ ID NO: 1536765 - RNA, 19 nt, Homo sapiens
uguuaaagugugccuauua

SEQ ID NO: 1536766 - RNA, 19 nt, Homo sapiens
cagcugauuuugaaugaua

SEQ ID NO: 1536767 - RNA, 19 nt, Homo sapiens
ggucaacugcaauauaaau

SEQ ID NO: 1536768 - RNA, 19 nt, Homo sapiens
caaaguucuccuauuacua

SEQ ID NO: 1536769 - RNA, 19 nt, Homo sapiens
aggccuggcuggucacuuu

SEQ ID NO: 1536770 - RNA, 19 nt, Homo sapiens
gcacuggaaaugacaaagu

SEQ ID NO: 1536771 - RNA, 19 nt, Homo sapiens
cacagaaaccggcauguau

SEQ ID NO: 1536772 - RNA, 19 nt, Homo sapiens
gggacuguguaccuuuauu

SEQ ID NO: 1536773 - RNA, 19 nt, Homo sapiens
gaagaaaguguuggucaag

SEQ ID NO: 1536774 - RNA, 19 nt, Homo sapiens
agacagagaaaacguauua

SEQ ID NO: 1536775 - RNA, 19 nt, Homo sapiens
cuuucuagguaguaacuua

SEQ ID NO: 1536776 - RNA, 19 nt, Homo sapiens
agauugaaauugguaggua

SEQ ID NO: 1536777 - RNA, 19 nt, Homo sapiens
aguccuaucucaugccaaa

SEQ ID NO: 1536778 - RNA, 19 nt, Homo sapiens
ucacucagaaggacuuuga

SEQ ID NO: 1536779 - RNA, 19 nt, Homo sapiens
ggacuguguaccuuuauuc

SEQ ID NO: 1536780 - RNA, 19 nt, Homo sapiens
ucuccaaagucaccugauu

SEQ ID NO: 1536781 - RNA, 19 nt, Homo sapiens
aaacugggaaacugaauau

SEQ ID NO: 1536782 - RNA, 19 nt, Homo sapiens
gucauauucucccuucuau

SEQ ID NO: 1536783 - RNA, 19 nt, Homo sapiens
gcaucaaucacaagacaga

SEQ ID NO: 1536784 - RNA, 19 nt, Homo sapiens
cacuggaaaugacaaaguu

SEQ ID NO: 1536785 - RNA, 19 nt, Homo sapiens
caagaaacuauggaauuga

SEQ ID NO: 1536786 - RNA, 19 nt, Homo sapiens
gagguaguccaaaguccua

SEQ ID NO: 1536787 - RNA, 19 nt, Homo sapiens
ggaugaaauugacucuuuu

SEQ ID NO: 1536788 - RNA, 19 nt, Homo sapiens
cccaaaugaucuugcuaaa

SEQ ID NO: 1536789 - RNA, 19 nt, Homo sapiens
aagcaucaaucacaagaca

SEQ ID NO: 1536790 - RNA, 19 nt, Homo sapiens
gaacagaucugauuucuua

SEQ ID NO: 1536791 - RNA, 19 nt, Homo sapiens
ggaagaaagugaaagauga

SEQ ID NO: 1536792 - RNA, 19 nt, Homo sapiens
gagcagaucugaugaugaa

SEQ ID NO: 1536793 - RNA, 19 nt, Homo sapiens
gaauaggcuuugcauguua

SEQ ID NO: 1536794 - RNA, 19 nt, Homo sapiens
ccaaguagccuauuaguaa

SEQ ID NO: 1536795 - RNA, 19 nt, Homo sapiens
caaaggaacugacuguaug

SEQ ID NO: 1536796 - RNA, 19 nt, Homo sapiens
gaaagaguguguguguaua

SEQ ID NO: 1536797 - RNA, 19 nt, Homo sapiens
ucacagacuuacacauuua

SEQ ID NO: 1536798 - RNA, 19 nt, Homo sapiens
ggaauaggcuuugcauguu

SEQ ID NO: 1536799 - RNA, 19 nt, Homo sapiens
uaacagguaugcacaagaa

SEQ ID NO: 1536800 - RNA, 19 nt, Homo sapiens
gaaaguaacgugagagaga

SEQ ID NO: 1536801 - RNA, 19 nt, Homo sapiens
gguguuagcuccaaagaga

SEQ ID NO: 1536802 - RNA, 19 nt, Homo sapiens
ggaacugacuguauguuga

SEQ ID NO: 1536803 - RNA, 19 nt, Homo sapiens
gaacccugcucaucuggua

SEQ ID NO: 1536804 - RNA, 19 nt, Homo sapiens
guagaaagagcacaauuaa

SEQ ID NO: 1536805 - RNA, 19 nt, Homo sapiens
aaacuucucuccuuuauag

SEQ ID NO: 1536806 - RNA, 19 nt, Homo sapiens
guacagugcugacguggaa

SEQ ID NO: 1536807 - RNA, 19 nt, Homo sapiens
ggaaaucauuggugaggaa

SEQ ID NO: 1536808 - RNA, 19 nt, Homo sapiens
gaaagugacagugaaagua

SEQ ID NO: 1536809 - RNA, 19 nt, Homo sapiens
gcaguaagccgcaagaaug

SEQ ID NO: 1536810 - RNA, 19 nt, Homo sapiens
gggauuccauuguguaauu

SEQ ID NO: 1536811 - RNA, 19 nt, Homo sapiens
gaauucaagugccgcuuaa

SEQ ID NO: 1536812 - RNA, 19 nt, Homo sapiens
gaugaaauucucuuccuua

SEQ ID NO: 1536813 - RNA, 19 nt, Homo sapiens
uauaguugcugucaucuuu

SEQ ID NO: 1536814 - RNA, 19 nt, Homo sapiens
gagcagacgucaaggaauc

SEQ ID NO: 1536815 - RNA, 19 nt, Homo sapiens
agaaagagcacaauuaaug

SEQ ID NO: 1536816 - RNA, 19 nt, Homo sapiens
gcagguaaaucacaaagca

SEQ ID NO: 1536817 - RNA, 19 nt, Homo sapiens
agaauuagauuuccagugu

SEQ ID NO: 1536818 - RNA, 19 nt, Homo sapiens
gagagaaagugacagugaa

SEQ ID NO: 1536819 - RNA, 19 nt, Homo sapiens
ggacuuaucucagcuguac

SEQ ID NO: 1536820 - RNA, 19 nt, Homo sapiens
aagaauagcuggaagaaag

SEQ ID NO: 1536821 - RNA, 19 nt, Homo sapiens
ggacuuaauugugguguau

SEQ ID NO: 1536822 - RNA, 19 nt, Homo sapiens
caaguagccuauuaguaaa

SEQ ID NO: 1536823 - RNA, 19 nt, Homo sapiens
gcugucaucuuucauguau

SEQ ID NO: 1536824 - RNA, 19 nt, Homo sapiens
gaauuagauuuccagugua

SEQ ID NO: 1536825 - RNA, 19 nt, Homo sapiens
aggaaaggauaaucacuua

SEQ ID NO: 1536826 - RNA, 19 nt, Homo sapiens
gcucccagcauccaaauua

SEQ ID NO: 1536827 - RNA, 19 nt, Homo sapiens
gcagauaaagauaagagua

SEQ ID NO: 1536828 - RNA, 19 nt, Homo sapiens
gaaaccgucucuagcacaa

SEQ ID NO: 1536829 - RNA, 19 nt, Homo sapiens
agaaaggaaugcuugauug

SEQ ID NO: 1536830 - RNA, 19 nt, Homo sapiens
cagaagccuuuaaguguuu

SEQ ID NO: 1536831 - RNA, 19 nt, Homo sapiens
ggacuaagaggguaagaga

SEQ ID NO: 1536832 - RNA, 19 nt, Homo sapiens
gaauuucacucccgcuuca

SEQ ID NO: 1536833 - RNA, 19 nt, Homo sapiens
agagaggcaugaaggaaua

SEQ ID NO: 1536834 - RNA, 19 nt, Homo sapiens
ggaaaagucucuuauguag

SEQ ID NO: 1536835 - RNA, 19 nt, Homo sapiens
ugagagauguguaggaaga

SEQ ID NO: 1536836 - RNA, 19 nt, Homo sapiens
ggaagugguguauguuuaa

SEQ ID NO: 1536837 - RNA, 19 nt, Homo sapiens
gauugugagcuguauauua

SEQ ID NO: 1536838 - RNA, 19 nt, Homo sapiens
ccagaagccuuuaaguguu

SEQ ID NO: 1536839 - RNA, 19 nt, Homo sapiens
gcauuagcacuucgaaaua

SEQ ID NO: 1536840 - RNA, 19 nt, Homo sapiens
caagugucauuggaauuua

SEQ ID NO: 1536841 - RNA, 19 nt, Homo sapiens
gagaaaggaaugcuugauu

SEQ ID NO: 1536842 - RNA, 19 nt, Homo sapiens
gagaaagagugugugugua

SEQ ID NO: 1536843 - RNA, 19 nt, Homo sapiens
ggacagugauuuccaucug

SEQ ID NO: 1536844 - RNA, 19 nt, Homo sapiens
gauggccgcuuguuaaauc

SEQ ID NO: 1536845 - RNA, 19 nt, Homo sapiens
gauaaucacuuagcuuugg

SEQ ID NO: 1536846 - RNA, 19 nt, Homo sapiens
gcagaggccacagaacuua

SEQ ID NO: 1536847 - RNA, 19 nt, Homo sapiens
ccacugcccucuuuacugu

SEQ ID NO: 1536848 - RNA, 19 nt, Homo sapiens
gggcagaucuucacuaucc

SEQ ID NO: 1536849 - RNA, 19 nt, Homo sapiens
gagaugccauugcugauca

SEQ ID NO: 1536850 - RNA, 19 nt, Homo sapiens
cuagagacauuguucuuau

SEQ ID NO: 1536851 - RNA, 19 nt, Homo sapiens
gaaagaaagagaaaggaau

SEQ ID NO: 1536852 - RNA, 19 nt, Homo sapiens
gagcauauacugcccuuug

SEQ ID NO: 1536853 - RNA, 19 nt, Homo sapiens
ggguaugugugcuuucuuu

SEQ ID NO: 1536854 - RNA, 19 nt, Homo sapiens
uggaagugguguauguuua

SEQ ID NO: 1536855 - RNA, 19 nt, Homo sapiens
gggaaagcauggcagagaa

SEQ ID NO: 1536856 - RNA, 19 nt, Homo sapiens
gguaugaacagaucugauu

SEQ ID NO: 1536857 - RNA, 19 nt, Homo sapiens
gaugagaauucugggcuuu

SEQ ID NO: 1536858 - RNA, 19 nt, Homo sapiens
auacugcuguuaucguuua

SEQ ID NO: 1536859 - RNA, 19 nt, Homo sapiens
gugguuagguguaaauguu

SEQ ID NO: 1536860 - RNA, 19 nt, Homo sapiens
ucauuaaacugcacaagug

SEQ ID NO: 1536861 - RNA, 19 nt, Homo sapiens
guagaugccaggccacaua

SEQ ID NO: 1536862 - RNA, 19 nt, Homo sapiens
gaaaauauaguacccauga

SEQ ID NO: 1536863 - RNA, 19 nt, Homo sapiens
ccaaagagaugccauugcu

SEQ ID NO: 1536864 - RNA, 19 nt, Homo sapiens
gaaaacuucucuccuuuau

SEQ ID NO: 1536865 - RNA, 19 nt, Homo sapiens
cggaaugccuccuuuacaa

SEQ ID NO: 1536866 - RNA, 19 nt, Homo sapiens
ugagauggccgcuuguuaa

SEQ ID NO: 1536867 - RNA, 19 nt, Homo sapiens
aggaauaguuguuggguuu

SEQ ID NO: 1536868 - RNA, 19 nt, Homo sapiens
gcugaagucuuuuagauuu

SEQ ID NO: 1536869 - RNA, 19 nt, Homo sapiens
ggugggaggagaugaauaa

SEQ ID NO: 1536870 - RNA, 19 nt, Homo sapiens
gcaaagcugcagucaguga

SEQ ID NO: 1536871 - RNA, 19 nt, Homo sapiens
gaaauaacuggaaauacug

SEQ ID NO: 1536872 - RNA, 19 nt, Homo sapiens
accauucgcuugcuauuaa

SEQ ID NO: 1536873 - RNA, 19 nt, Homo sapiens
uaaacugccuuucccuguu

SEQ ID NO: 1536874 - RNA, 19 nt, Homo sapiens
ccaaggagaccaacaggaa

SEQ ID NO: 1536875 - RNA, 19 nt, Homo sapiens
gagcacguguggagugaga

SEQ ID NO: 1536876 - RNA, 19 nt, Homo sapiens
uauccgugauccagucuua

SEQ ID NO: 1536877 - RNA, 19 nt, Homo sapiens
gaauaggcacaagcgauua

SEQ ID NO: 1536878 - RNA, 19 nt, Homo sapiens
ggccagcucugaaauccaa

SEQ ID NO: 1536879 - RNA, 19 nt, Homo sapiens
uguagaaagagcacaauua

SEQ ID NO: 1536880 - RNA, 19 nt, Homo sapiens
gggccaaccuccucacugu

SEQ ID NO: 1536881 - RNA, 19 nt, Homo sapiens
gcacuaccuuagaacaugu

SEQ ID NO: 1536882 - RNA, 19 nt, Homo sapiens
gagcaacagucaaggaaac

SEQ ID NO: 1536883 - RNA, 19 nt, Homo sapiens
guccguaagugaaagguuu

SEQ ID NO: 1536884 - RNA, 19 nt, Homo sapiens
guggcugacuauucucuua

SEQ ID NO: 1536885 - RNA, 19 nt, Homo sapiens
gauccagucuuaauuugag

SEQ ID NO: 1536886 - RNA, 19 nt, Homo sapiens
ggagaugaauaagggagaa

SEQ ID NO: 1536887 - RNA, 19 nt, Homo sapiens
ccaguguacuucaacgaaa

SEQ ID NO: 1536888 - RNA, 19 nt, Homo sapiens
caacagucaaggaaacuuu

SEQ ID NO: 1536889 - RNA, 19 nt, Homo sapiens
gaggaggaguguugaccuu

SEQ ID NO: 1536890 - RNA, 19 nt, Homo sapiens
gaagguggcuguuauuuag

SEQ ID NO: 1536891 - RNA, 19 nt, Homo sapiens
ggaggaggguggcauaauu

SEQ ID NO: 1536892 - RNA, 19 nt, Homo sapiens
ggaaaucgcucaccaacag

SEQ ID NO: 1536893 - RNA, 19 nt, Homo sapiens
cacaaugccuucaugauuu

SEQ ID NO: 1536894 - RNA, 19 nt, Homo sapiens
cgaaucacuuggcaaauaa

SEQ ID NO: 1536895 - RNA, 19 nt, Homo sapiens
gaggguggcauaauuauuu

SEQ ID NO: 1536896 - RNA, 19 nt, Homo sapiens
ccgaaucacuuggcaaaua

SEQ ID NO: 1536897 - RNA, 19 nt, Homo sapiens
ugaagaagguggcuguuau

SEQ ID NO: 1536898 - RNA, 19 nt, Homo sapiens
gaggaggguggcauaauua

SEQ ID NO: 1536899 - RNA, 19 nt, Homo sapiens
gaagaagguggcuguuauu

SEQ ID NO: 1536900 - RNA, 19 nt, Homo sapiens
ccaaggaugcauuaaauau

SEQ ID NO: 1536901 - RNA, 19 nt, Homo sapiens
acacaaugccuucaugauu

SEQ ID NO: 1536902 - RNA, 19 nt, Homo sapiens
ucuguagccucucaaauga

SEQ ID NO: 1536903 - RNA, 19 nt, Homo sapiens
agaagguggcuguuauuua

SEQ ID NO: 1536904 - RNA, 19 nt, Homo sapiens
ccaaaccagacaaguuaua

SEQ ID NO: 1536905 - RNA, 19 nt, Homo sapiens
ccugagaaaugcacuuuag

SEQ ID NO: 1536906 - RNA, 19 nt, Homo sapiens
uagcugggcugcgggaauu

SEQ ID NO: 1536907 - RNA, 19 nt, Homo sapiens
cagaauauuuacacaaugc

SEQ ID NO: 1536908 - RNA, 19 nt, Homo sapiens
gugaccgccuccuggguua

SEQ ID NO: 1536909 - RNA, 19 nt, Homo sapiens
cuccaaggaugcauuaaau

SEQ ID NO: 1536910 - RNA, 19 nt, Homo sapiens
auuccgaccuguacacuuu

SEQ ID NO: 1536911 - RNA, 19 nt, Homo sapiens
cagcagcacuugauuuagc

SEQ ID NO: 1536912 - RNA, 19 nt, Homo sapiens
caggugggcagaugucuuu

SEQ ID NO: 1536913 - RNA, 19 nt, Homo sapiens
ggaggguggcauaauuauu

SEQ ID NO: 1536914 - RNA, 19 nt, Homo sapiens
ugacuccaaggaugcauua

SEQ ID NO: 1536915 - RNA, 19 nt, Homo sapiens
guucugguuucccgaauca

SEQ ID NO: 1536916 - RNA, 19 nt, Homo sapiens
cagcagcagcacuugauuu

SEQ ID NO: 1536917 - RNA, 19 nt, Homo sapiens
uuaaaacccuugcacugua

SEQ ID NO: 1536918 - RNA, 19 nt, Homo sapiens
uaaaacccuugcacuguaa

SEQ ID NO: 1536919 - RNA, 19 nt, Homo sapiens
gagaccacguggagaaagg

SEQ ID NO: 1536920 - RNA, 19 nt, Homo sapiens
agcagcagcacuugauuua

SEQ ID NO: 1536921 - RNA, 19 nt, Homo sapiens
gcgaaugaaacacuacuag

SEQ ID NO: 1536922 - RNA, 19 nt, Homo sapiens
caggauugcuuuuaauguu

SEQ ID NO: 1536923 - RNA, 19 nt, Homo sapiens
aaauaaggcaggauugcuu

SEQ ID NO: 1536924 - RNA, 19 nt, Homo sapiens
gguucucaauauuucauga

SEQ ID NO: 1536925 - RNA, 19 nt, Homo sapiens
ccucucaaaugaagaaggu

SEQ ID NO: 1536926 - RNA, 19 nt, Homo sapiens
guuccaaacccgagacuuc

SEQ ID NO: 1536927 - RNA, 19 nt, Homo sapiens
ccuguacacuuuccagaag

SEQ ID NO: 1536928 - RNA, 19 nt, Homo sapiens
gcuuuaaggagaagaggaa

SEQ ID NO: 1536929 - RNA, 19 nt, Homo sapiens
gagaccagcagcagcacuu

SEQ ID NO: 1536930 - RNA, 19 nt, Homo sapiens
gcagcgcgcagcaauugga

SEQ ID NO: 1536931 - RNA, 19 nt, Homo sapiens
ucuggaaauugaaguguca

SEQ ID NO: 1536932 - RNA, 19 nt, Homo sapiens
ugaacucuguagccucuca

SEQ ID NO: 1536933 - RNA, 19 nt, Homo sapiens
caauauuucaugacuccaa

SEQ ID NO: 1536934 - RNA, 19 nt, Homo sapiens
aauaaggcaggauugcuuu

SEQ ID NO: 1536935 - RNA, 19 nt, Homo sapiens
guggaaagcaaaucacagu

SEQ ID NO: 1536936 - RNA, 19 nt, Homo sapiens
agccugaucucuccaaguc

SEQ ID NO: 1536937 - RNA, 19 nt, Homo sapiens
aagaagguggcuguuauuu

SEQ ID NO: 1536938 - RNA, 19 nt, Homo sapiens
uguagccucucaaaugaag

SEQ ID NO: 1536939 - RNA, 19 nt, Homo sapiens
gccagggucccaucucuca

SEQ ID NO: 1536940 - RNA, 19 nt, Homo sapiens
uccaaggaugcauuaaaua

SEQ ID NO: 1536941 - RNA, 19 nt, Homo sapiens
acaaugccuucaugauuuu

SEQ ID NO: 1536942 - RNA, 19 nt, Homo sapiens
caccaacagcagaaagaaa

SEQ ID NO: 1536943 - RNA, 19 nt, Homo sapiens
gcgggaauuccgaccugua

SEQ ID NO: 1536944 - RNA, 19 nt, Homo sapiens
gaccagcagcagcacuuga

SEQ ID NO: 1536945 - RNA, 19 nt, Homo sapiens
cagccagggucccaucucu

SEQ ID NO: 1536946 - RNA, 19 nt, Homo sapiens
uuacacaaugccuucauga

SEQ ID NO: 1536947 - RNA, 19 nt, Homo sapiens
ccuuacgcguugucucauu

SEQ ID NO: 1536948 - RNA, 19 nt, Homo sapiens
gcaggugggcagaugucuu

SEQ ID NO: 1536949 - RNA, 19 nt, Homo sapiens
ggacucuguggaaagcaaa

SEQ ID NO: 1536950 - RNA, 19 nt, Homo sapiens
ccccaaaccagacaaguua

SEQ ID NO: 1536951 - RNA, 19 nt, Homo sapiens
ccggagaccacguggagaa

SEQ ID NO: 1536952 - RNA, 19 nt, Homo sapiens
caaaccagacaaguuauac

SEQ ID NO: 1536953 - RNA, 19 nt, Homo sapiens
uuuaaugccugagaaaugc

SEQ ID NO: 1536954 - RNA, 19 nt, Homo sapiens
ugucucauuccaccaaauu

SEQ ID NO: 1536955 - RNA, 19 nt, Homo sapiens
gcacauggguuuggagcua

SEQ ID NO: 1536956 - RNA, 19 nt, Homo sapiens
gaugggagguggaaucugu

SEQ ID NO: 1536957 - RNA, 19 nt, Homo sapiens
gaucugcucugucacuuca

SEQ ID NO: 1536958 - RNA, 19 nt, Homo sapiens
gcaagcguccuauuccaua

SEQ ID NO: 1536959 - RNA, 19 nt, Homo sapiens
ccaaguagcugggauuaca

SEQ ID NO: 1536960 - RNA, 19 nt, Homo sapiens
gagacaggguuucauuaug

SEQ ID NO: 1536961 - RNA, 19 nt, Homo sapiens
gaaggcaggugucucuaag

SEQ ID NO: 1536962 - RNA, 19 nt, Homo sapiens
agacaggguuucauuaugu

SEQ ID NO: 1536963 - RNA, 19 nt, Homo sapiens
gaacaaagagccguuacga

SEQ ID NO: 1536964 - RNA, 19 nt, Homo sapiens
gcagauaggugaagaaaag

SEQ ID NO: 1536965 - RNA, 19 nt, Homo sapiens
gguggaaucuguaggaaag

SEQ ID NO: 1536966 - RNA, 19 nt, Homo sapiens
ucagggaucucaugaaguc

SEQ ID NO: 1536967 - RNA, 19 nt, Homo sapiens
ggucacaggcauaggauaa

SEQ ID NO: 1536968 - RNA, 19 nt, Homo sapiens
guagagacaggguuucauu

SEQ ID NO: 1536969 - RNA, 19 nt, Homo sapiens
acauggaauuugcaaguaa

SEQ ID NO: 1536970 - RNA, 19 nt, Homo sapiens
caacauggaauuugcaagu

SEQ ID NO: 1536971 - RNA, 19 nt, Homo sapiens
ccaaagugcugggauuaca

SEQ ID NO: 1536972 - RNA, 19 nt, Homo sapiens
caccucagccucccaagua

SEQ ID NO: 1536973 - RNA, 19 nt, Homo sapiens
ggagugcaguggcgcaauc

SEQ ID NO: 1536974 - RNA, 19 nt, Homo sapiens
gacaggguuucauuauguu

SEQ ID NO: 1536975 - RNA, 19 nt, Homo sapiens
gcuaggcaccucacucuug

SEQ ID NO: 1536976 - RNA, 19 nt, Homo sapiens
gcaaaaugaucaacaugga

SEQ ID NO: 1536977 - RNA, 19 nt, Homo sapiens
gagcuagacagaaggaaga

SEQ ID NO: 1536978 - RNA, 19 nt, Homo sapiens
ucccuccacuccucucuua

SEQ ID NO: 1536979 - RNA, 19 nt, Homo sapiens
ccucagggaucucaugaag

SEQ ID NO: 1536980 - RNA, 19 nt, Homo sapiens
ggagguggaaucuguagga

SEQ ID NO: 1536981 - RNA, 19 nt, Homo sapiens
uagagacaggguuucauua

SEQ ID NO: 1536982 - RNA, 19 nt, Homo sapiens
uccaugaucugcucuguca

SEQ ID NO: 1536983 - RNA, 19 nt, Homo sapiens
ggaauuugcaaguaaccaa

SEQ ID NO: 1536984 - RNA, 19 nt, Homo sapiens
cuucugaccucaagugauc

SEQ ID NO: 1536985 - RNA, 19 nt, Homo sapiens
gagguggaaucuguaggaa

SEQ ID NO: 1536986 - RNA, 19 nt, Homo sapiens
cauuugacccugagguuaa

SEQ ID NO: 1536987 - RNA, 19 nt, Homo sapiens
gcucugucacuucaccuua

SEQ ID NO: 1536988 - RNA, 19 nt, Homo sapiens
caaagagccguuacgaaca

SEQ ID NO: 1536989 - RNA, 19 nt, Homo sapiens
cgcccagccucaacaagua

SEQ ID NO: 1536990 - RNA, 19 nt, Homo sapiens
ucaaacuucugaccucaag

SEQ ID NO: 1536991 - RNA, 19 nt, Homo sapiens
uaggauaacaugugcuuug

SEQ ID NO: 1536992 - RNA, 19 nt, Homo sapiens
ccacuccucucuuaucacu

SEQ ID NO: 1536993 - RNA, 19 nt, Homo sapiens
guaccagaguccaugaucu

SEQ ID NO: 1536994 - RNA, 19 nt, Homo sapiens
gagcuaggcaccucacucu

SEQ ID NO: 1536995 - RNA, 19 nt, Homo sapiens
aacauggaauuugcaagua

SEQ ID NO: 1536996 - RNA, 19 nt, Homo sapiens
ucacaggcauaggauaaca

SEQ ID NO: 1536997 - RNA, 19 nt, Homo sapiens
uaaaagggguucaggucaa

SEQ ID NO: 1536998 - RNA, 19 nt, Homo sapiens
guuuggagcuagacagaag

SEQ ID NO: 1536999 - RNA, 19 nt, Homo sapiens
agagacaggguuucauuau

SEQ ID NO: 1537000 - RNA, 19 nt, Homo sapiens
gaauuugcaaguaaccaau

SEQ ID NO: 1537001 - RNA, 19 nt, Homo sapiens
gaagaaaagcaaaaugauc

SEQ ID NO: 1537002 - RNA, 19 nt, Homo sapiens
gaaucuguaggaaagagaa

SEQ ID NO: 1537003 - RNA, 19 nt, Homo sapiens
guagaugggagguggaauc

SEQ ID NO: 1537004 - RNA, 19 nt, Homo sapiens
acaaggagaagccagaugu

SEQ ID NO: 1537005 - RNA, 19 nt, Homo sapiens
agaaggcaggugucucuaa

SEQ ID NO: 1537006 - RNA, 19 nt, Homo sapiens
gaccgucagauuccauuug

SEQ ID NO: 1537007 - RNA, 19 nt, Homo sapiens
cauaggauaacaugugcuu

SEQ ID NO: 1537008 - RNA, 19 nt, Homo sapiens
aaagagccguuacgaacac

SEQ ID NO: 1537009 - RNA, 19 nt, Homo sapiens
agaaggaagaacagccuaa

SEQ ID NO: 1537010 - RNA, 19 nt, Homo sapiens
gauggccuguaaucagcuu

SEQ ID NO: 1537011 - RNA, 19 nt, Homo sapiens
ggaaucuguaggaaagaga

SEQ ID NO: 1537012 - RNA, 19 nt, Homo sapiens
gcgcccagccucaacaagu

SEQ ID NO: 1537013 - RNA, 19 nt, Homo sapiens
caagcguccuauuccauac

SEQ ID NO: 1537014 - RNA, 19 nt, Homo sapiens
gugaagaaaagcaaaauga

SEQ ID NO: 1537015 - RNA, 19 nt, Homo sapiens
gcccagggucacaggcaua

SEQ ID NO: 1537016 - RNA, 19 nt, Homo sapiens
acauuugacccugagguua

SEQ ID NO: 1537017 - RNA, 19 nt, Homo sapiens
gaaggaagaacagccuaac

SEQ ID NO: 1537018 - RNA, 19 nt, Homo sapiens
guacagcacauggguuugg

SEQ ID NO: 1537019 - RNA, 19 nt, Homo sapiens
ccagaugugcugcuucuac

SEQ ID NO: 1537020 - RNA, 19 nt, Homo sapiens
ggacaaggagaagccagau

SEQ ID NO: 1537021 - RNA, 19 nt, Homo sapiens
gaucaacauggaauuugca

SEQ ID NO: 1537022 - RNA, 19 nt, Homo sapiens
ggauaacaugugcuuugga

SEQ ID NO: 1537023 - RNA, 19 nt, Homo sapiens
cagccucaacaaguauuua

SEQ ID NO: 1537024 - RNA, 19 nt, Homo sapiens
ggcgcaaucuccacucacu

SEQ ID NO: 1537025 - RNA, 19 nt, Homo sapiens
caagaggugggagaggaaa

SEQ ID NO: 1537026 - RNA, 19 nt, Homo sapiens
cuagacagaaggaagaaca

SEQ ID NO: 1537027 - RNA, 19 nt, Homo sapiens
gcccgcaagcguccuauuc

SEQ ID NO: 1537028 - RNA, 19 nt, Homo sapiens
cauggaauuugcaaguaac

SEQ ID NO: 1537029 - RNA, 19 nt, Homo sapiens
gaagggaggggaggaaaga

SEQ ID NO: 1537030 - RNA, 19 nt, Homo sapiens
aggcauaggauaacaugug

SEQ ID NO: 1537031 - RNA, 19 nt, Homo sapiens
ucaagaggugggagaggaa

SEQ ID NO: 1537032 - RNA, 19 nt, Homo sapiens
cuggggagcugcauccuuu

SEQ ID NO: 1537033 - RNA, 19 nt, Homo sapiens
gaacagccuaacccuuggu

SEQ ID NO: 1537034 - RNA, 19 nt, Homo sapiens
ugguacagcacauggguuu

SEQ ID NO: 1537035 - RNA, 19 nt, Homo sapiens
ugaucaacauggaauuugc

SEQ ID NO: 1537036 - RNA, 19 nt, Homo sapiens
ggaaggagauugaaacauu

SEQ ID NO: 1537037 - RNA, 19 nt, Homo sapiens
gcacuuggcuuugaauaua

SEQ ID NO: 1537038 - RNA, 19 nt, Homo sapiens
gaagauauguucccaguuc

SEQ ID NO: 1537039 - RNA, 19 nt, Homo sapiens
gaauauaaaugguggaaug

SEQ ID NO: 1537040 - RNA, 19 nt, Homo sapiens
gaaaggagccaaagaaugu

SEQ ID NO: 1537041 - RNA, 19 nt, Homo sapiens
gaaggagauugaaacauuu

SEQ ID NO: 1537042 - RNA, 19 nt, Homo sapiens
aaagaaaccugcucuaguu

SEQ ID NO: 1537043 - RNA, 19 nt, Homo sapiens
gaaaucaggcacaaacaua

SEQ ID NO: 1537044 - RNA, 19 nt, Homo sapiens
gaaagacacagauaaugua

SEQ ID NO: 1537045 - RNA, 19 nt, Homo sapiens
caacaauuauuccuucuga

SEQ ID NO: 1537046 - RNA, 19 nt, Homo sapiens
guacaaaugugguagaauc

SEQ ID NO: 1537047 - RNA, 19 nt, Homo sapiens
gcugaugcaugccauauaa

SEQ ID NO: 1537048 - RNA, 19 nt, Homo sapiens
uaacaagugugauuuggaa

SEQ ID NO: 1537049 - RNA, 19 nt, Homo sapiens
ccaaauauaugaagagaca

SEQ ID NO: 1537050 - RNA, 19 nt, Homo sapiens
uaaagacgacucucaauuu

SEQ ID NO: 1537051 - RNA, 19 nt, Homo sapiens
gcacaaacauacucuacug

SEQ ID NO: 1537052 - RNA, 19 nt, Homo sapiens
ccucauaccugucacauug

SEQ ID NO: 1537053 - RNA, 19 nt, Homo sapiens
gauaauagacgguucauca

SEQ ID NO: 1537054 - RNA, 19 nt, Homo sapiens
gaaggaaagacacagauaa

SEQ ID NO: 1537055 - RNA, 19 nt, Homo sapiens
caugugagcauaugcauua

SEQ ID NO: 1537056 - RNA, 19 nt, Homo sapiens
gcuguagccuugagacuaa

SEQ ID NO: 1537057 - RNA, 19 nt, Homo sapiens
ggaaagacacagauaaugu

SEQ ID NO: 1537058 - RNA, 19 nt, Homo sapiens
gaaggcacaugugagcaua

SEQ ID NO: 1537059 - RNA, 19 nt, Homo sapiens
ggaaggagaagauaaugaa

SEQ ID NO: 1537060 - RNA, 19 nt, Homo sapiens
guaugccagucaacaauua

SEQ ID NO: 1537061 - RNA, 19 nt, Homo sapiens
ggucucaacugaagaugaa

SEQ ID NO: 1537062 - RNA, 19 nt, Homo sapiens
caggaaaccuuguaugugu

SEQ ID NO: 1537063 - RNA, 19 nt, Homo sapiens
caaagaauguagaccaugu

SEQ ID NO: 1537064 - RNA, 19 nt, Homo sapiens
caaagaggcuuguauucca

SEQ ID NO: 1537065 - RNA, 19 nt, Homo sapiens
caacucaggaagagauuua

SEQ ID NO: 1537066 - RNA, 19 nt, Homo sapiens
ucacagaugcuauuagauu

SEQ ID NO: 1537067 - RNA, 19 nt, Homo sapiens
ggucaagccugugcuggua

SEQ ID NO: 1537068 - RNA, 19 nt, Homo sapiens
gcagacaguugugcuauca

SEQ ID NO: 1537069 - RNA, 19 nt, Homo sapiens
gaacuaaucagggucaaga

SEQ ID NO: 1537070 - RNA, 19 nt, Homo sapiens
guaaagacgacucucaauu

SEQ ID NO: 1537071 - RNA, 19 nt, Homo sapiens
gaugcaugccauauaauua

SEQ ID NO: 1537072 - RNA, 19 nt, Homo sapiens
ucaaugacauggugaagau

SEQ ID NO: 1537073 - RNA, 19 nt, Homo sapiens
ucugacagcuccuuaaaug

SEQ ID NO: 1537074 - RNA, 19 nt, Homo sapiens
caagagaggauuucaggaa

SEQ ID NO: 1537075 - RNA, 19 nt, Homo sapiens
gagcaggagugauuucagu

SEQ ID NO: 1537076 - RNA, 19 nt, Homo sapiens
ggagguggcuggagaucau

SEQ ID NO: 1537077 - RNA, 19 nt, Homo sapiens
agacacagauaauguacaa

SEQ ID NO: 1537078 - RNA, 19 nt, Homo sapiens
acaacaacaucuucuuuga

SEQ ID NO: 1537079 - RNA, 19 nt, Homo sapiens
aagaggaaguuguauauuc

SEQ ID NO: 1537080 - RNA, 19 nt, Homo sapiens
gaacuaggaagaauaacau

SEQ ID NO: 1537081 - RNA, 19 nt, Homo sapiens
ccaaauaaaggaaagcaaa

SEQ ID NO: 1537082 - RNA, 19 nt, Homo sapiens
aaacaagcuuacacccaua

SEQ ID NO: 1537083 - RNA, 19 nt, Homo sapiens
ggaaggauccagugagugu

SEQ ID NO: 1537084 - RNA, 19 nt, Homo sapiens
gaggaaggauccagugagu

SEQ ID NO: 1537085 - RNA, 19 nt, Homo sapiens
caauaaacagucacuacua

SEQ ID NO: 1537086 - RNA, 19 nt, Homo sapiens
ccgaucaacugcugugaaa

SEQ ID NO: 1537087 - RNA, 19 nt, Homo sapiens
ggucagaugauuacacaaa

SEQ ID NO: 1537088 - RNA, 19 nt, Homo sapiens
gagguucugacaaugauua

SEQ ID NO: 1537089 - RNA, 19 nt, Homo sapiens
gaagaugaagcucaacuca

SEQ ID NO: 1537090 - RNA, 19 nt, Homo sapiens
ggaauuucuuugccugaga

SEQ ID NO: 1537091 - RNA, 19 nt, Homo sapiens
aaagugcgauggaaugaau

SEQ ID NO: 1537092 - RNA, 19 nt, Homo sapiens
ucucacagaugcuauuaga

SEQ ID NO: 1537093 - RNA, 19 nt, Homo sapiens
gaagaaggaaagacacaga

SEQ ID NO: 1537094 - RNA, 19 nt, Homo sapiens
cgacaacaacaucuucuuu

SEQ ID NO: 1537095 - RNA, 19 nt, Homo sapiens
aaaaugagguguaauccua

SEQ ID NO: 1537096 - RNA, 19 nt, Homo sapiens
gccacuacauugagaaaga

SEQ ID NO: 1537097 - RNA, 19 nt, Homo sapiens
ugacaaugauuaccugauc

SEQ ID NO: 1537098 - RNA, 19 nt, Homo sapiens
caaagaaaccugcucuagu

SEQ ID NO: 1537099 - RNA, 19 nt, Homo sapiens
gaagaggaaguuguauauu

SEQ ID NO: 1537100 - RNA, 19 nt, Homo sapiens
gcucugaccugcuacuucu

SEQ ID NO: 1537101 - RNA, 19 nt, Homo sapiens
gguguaauccuacuaaauc

SEQ ID NO: 1537102 - RNA, 19 nt, Homo sapiens
cuacauaacaagugugauu

SEQ ID NO: 1537103 - RNA, 19 nt, Homo sapiens
ugauuugggucucaacuga

SEQ ID NO: 1537104 - RNA, 19 nt, Homo sapiens
uuuagggucuguccucaua

SEQ ID NO: 1537105 - RNA, 19 nt, Homo sapiens
gaagcuugcccucugugua

SEQ ID NO: 1537106 - RNA, 19 nt, Homo sapiens
gaacuacaggcauccuuau

SEQ ID NO: 1537107 - RNA, 19 nt, Homo sapiens
cuuaucacauggucaagua

SEQ ID NO: 1537108 - RNA, 19 nt, Homo sapiens
uaaugaagaggaaguugua

SEQ ID NO: 1537109 - RNA, 19 nt, Homo sapiens
aaucagaguuugcacuaug

SEQ ID NO: 1537110 - RNA, 19 nt, Homo sapiens
ggaagaauaacauuugucu

SEQ ID NO: 1537111 - RNA, 19 nt, Homo sapiens
gagaaaggagccaaagaau

SEQ ID NO: 1537112 - RNA, 19 nt, Homo sapiens
ugagaaaggagccaaagaa

SEQ ID NO: 1537113 - RNA, 19 nt, Homo sapiens
caacaucuucuuugaguuc

SEQ ID NO: 1537114 - RNA, 19 nt, Homo sapiens
gcuaugucuucuuugagua

SEQ ID NO: 1537115 - RNA, 19 nt, Homo sapiens
gaaaagggaaggagauuga

SEQ ID NO: 1537116 - RNA, 19 nt, Homo sapiens
ugaagaggaaguuguauau

SEQ ID NO: 1537117 - RNA, 19 nt, Homo sapiens
gucaggcuaugucuucuuu

SEQ ID NO: 1537118 - RNA, 19 nt, Homo sapiens
gacaacaacaucuucuuug

SEQ ID NO: 1537119 - RNA, 19 nt, Homo sapiens
ccaacaauauaacagacuu

SEQ ID NO: 1537120 - RNA, 19 nt, Homo sapiens
caggcuaugucuucuuuga

SEQ ID NO: 1537121 - RNA, 19 nt, Homo sapiens
aauagacgguucaucaaug

SEQ ID NO: 1537122 - RNA, 19 nt, Homo sapiens
gaucuaugcugugcaccuu

SEQ ID NO: 1537123 - RNA, 19 nt, Homo sapiens
gaauguauaagguguaaag

SEQ ID NO: 1537124 - RNA, 19 nt, Homo sapiens
aauaaacagucacuacuag

SEQ ID NO: 1537125 - RNA, 19 nt, Homo sapiens
ugagggagccugcaagaga

SEQ ID NO: 1537126 - RNA, 19 nt, Homo sapiens
gagguguaauccuacuaaa

SEQ ID NO: 1537127 - RNA, 19 nt, Homo sapiens
cuaaucagggucaagauaa

SEQ ID NO: 1537128 - RNA, 19 nt, Homo sapiens
cacagaugcuauuagauug

SEQ ID NO: 1537129 - RNA, 19 nt, Homo sapiens
gccaaagaauguauaaggu

SEQ ID NO: 1537130 - RNA, 19 nt, Homo sapiens
ccacuacauugagaaagaa

SEQ ID NO: 1537131 - RNA, 19 nt, Homo sapiens
caugguggauauuaauaga

SEQ ID NO: 1537132 - RNA, 19 nt, Homo sapiens
gauaauguacaaguggaua

SEQ ID NO: 1537133 - RNA, 19 nt, Homo sapiens
acacauaacugaaaaccaa

SEQ ID NO: 1537134 - RNA, 19 nt, Homo sapiens
uaaugacgacuaacucaaa

SEQ ID NO: 1537135 - RNA, 19 nt, Homo sapiens
caucuucuuugaguucuuu

SEQ ID NO: 1537136 - RNA, 19 nt, Homo sapiens
ggacacagcuaacuaacuu

SEQ ID NO: 1537137 - RNA, 19 nt, Homo sapiens
ccacacagauccugaagug

SEQ ID NO: 1537138 - RNA, 19 nt, Homo sapiens
gcaucgugcuccacaagua

SEQ ID NO: 1537139 - RNA, 19 nt, Homo sapiens
acagcuaacuaacuuauuc

SEQ ID NO: 1537140 - RNA, 19 nt, Homo sapiens
gagggugugugaaguggaa

SEQ ID NO: 1537141 - RNA, 19 nt, Homo sapiens
gagcuugaccugucuaaca

SEQ ID NO: 1537142 - RNA, 19 nt, Homo sapiens
caaccaggacuacgaauuc

SEQ ID NO: 1537143 - RNA, 19 nt, Homo sapiens
ccaccgaguuggccuacuu

SEQ ID NO: 1537144 - RNA, 19 nt, Homo sapiens
ggaccagggacacagcuaa

SEQ ID NO: 1537145 - RNA, 19 nt, Homo sapiens
ggauguagccucacaccau

SEQ ID NO: 1537146 - RNA, 19 nt, Homo sapiens
uggaugggcuggcauuugu

SEQ ID NO: 1537147 - RNA, 19 nt, Homo sapiens
uaaggucaauggcaaggau

SEQ ID NO: 1537148 - RNA, 19 nt, Homo sapiens
aaacucuacuguggacaaa

SEQ ID NO: 1537149 - RNA, 19 nt, Homo sapiens
gaggcugugugcguaauug

SEQ ID NO: 1537150 - RNA, 19 nt, Homo sapiens
uggaauucgucuucucuga

SEQ ID NO: 1537151 - RNA, 19 nt, Homo sapiens
ccagggacacagcuaacua

SEQ ID NO: 1537152 - RNA, 19 nt, Homo sapiens
gggugcggaugaucucuga

SEQ ID NO: 1537153 - RNA, 19 nt, Homo sapiens
uggagacgcugccggacaa

SEQ ID NO: 1537154 - RNA, 19 nt, Homo sapiens
cagggacacagcuaacuaa

SEQ ID NO: 1537155 - RNA, 19 nt, Homo sapiens
gcugugugcguaauugauu

SEQ ID NO: 1537156 - RNA, 19 nt, Homo sapiens
gcaaaggaccagggacaca

SEQ ID NO: 1537157 - RNA, 19 nt, Homo sapiens
gacggacuccaacaucgua

SEQ ID NO: 1537158 - RNA, 19 nt, Homo sapiens
gaacacagugguggccaau

SEQ ID NO: 1537159 - RNA, 19 nt, Homo sapiens
ccaaccaggacuacgaauu

SEQ ID NO: 1537160 - RNA, 19 nt, Homo sapiens
ucaaugacaaccugaaagu

SEQ ID NO: 1537161 - RNA, 19 nt, Homo sapiens
acacagugguggccaaugc

SEQ ID NO: 1537162 - RNA, 19 nt, Homo sapiens
gaugggcuggcauuuguga

SEQ ID NO: 1537163 - RNA, 19 nt, Homo sapiens
cauccgagcccacaagaag

SEQ ID NO: 1537164 - RNA, 19 nt, Homo sapiens
gcgaggaguucuuuucugu

SEQ ID NO: 1537165 - RNA, 19 nt, Homo sapiens
ccaaugccuccuucaccua

SEQ ID NO: 1537166 - RNA, 19 nt, Homo sapiens
ccaagaccauggugaacac

SEQ ID NO: 1537167 - RNA, 19 nt, Homo sapiens
uaaacucuacuguggacaa

SEQ ID NO: 1537168 - RNA, 19 nt, Homo sapiens
acacagcuaacuaacuuau

SEQ ID NO: 1537169 - RNA, 19 nt, Homo sapiens
gaggagggugugugaagug

SEQ ID NO: 1537170 - RNA, 19 nt, Homo sapiens
cacacaggcuggccacaag

SEQ ID NO: 1537171 - RNA, 19 nt, Homo sapiens
acaagaagcgcuggagugu

SEQ ID NO: 1537172 - RNA, 19 nt, Homo sapiens
ccgagucccucagcgaguu

SEQ ID NO: 1537173 - RNA, 19 nt, Homo sapiens
gacacagcuaacuaacuua

SEQ ID NO: 1537174 - RNA, 19 nt, Homo sapiens
gaaggcccaggcggacuuu

SEQ ID NO: 1537175 - RNA, 19 nt, Homo sapiens
cugaagaggaggcugagaa

SEQ ID NO: 1537176 - RNA, 19 nt, Homo sapiens
ucacagcucacugggagaa

SEQ ID NO: 1537177 - RNA, 19 nt, Homo sapiens
ggaggcugugugcguaauu

SEQ ID NO: 1537178 - RNA, 19 nt, Homo sapiens
gggaggcugugugcguaau

SEQ ID NO: 1537179 - RNA, 19 nt, Homo sapiens
gaugcguccucaacuuacu

SEQ ID NO: 1537180 - RNA, 19 nt, Homo sapiens
ucacacaggcuggccacaa

SEQ ID NO: 1537181 - RNA, 19 nt, Homo sapiens
agcuugaccugucuaacaa

SEQ ID NO: 1537182 - RNA, 19 nt, Homo sapiens
acuaacuuauucagcuuug

SEQ ID NO: 1537183 - RNA, 19 nt, Homo sapiens
agaccauggugaacacagu

SEQ ID NO: 1537184 - RNA, 19 nt, Homo sapiens
gaguggaugggcuggcauu

SEQ ID NO: 1537185 - RNA, 19 nt, Homo sapiens
acacuggacaccaccucua

SEQ ID NO: 1537186 - RNA, 19 nt, Homo sapiens
gaaaggagauuauacaaag

SEQ ID NO: 1537187 - RNA, 19 nt, Homo sapiens
ggaaagagguugaugugaa

SEQ ID NO: 1537188 - RNA, 19 nt, Homo sapiens
ugacuuacgucuccuauuu

SEQ ID NO: 1537189 - RNA, 19 nt, Homo sapiens
gcagaucugugacuacaaa

SEQ ID NO: 1537190 - RNA, 19 nt, Homo sapiens
uuaaagggcucacuugauu

SEQ ID NO: 1537191 - RNA, 19 nt, Homo sapiens
gaauugaaaucccauaaag

SEQ ID NO: 1537192 - RNA, 19 nt, Homo sapiens
gaauacuggugaacuguuu

SEQ ID NO: 1537193 - RNA, 19 nt, Homo sapiens
ggaaauggcugaaguucgu

SEQ ID NO: 1537194 - RNA, 19 nt, Homo sapiens
gaaaucuacuuccaacuuc

SEQ ID NO: 1537195 - RNA, 19 nt, Homo sapiens
guaaaucccaccauucaua

SEQ ID NO: 1537196 - RNA, 19 nt, Homo sapiens
ccacaaauuuagcagcaua

SEQ ID NO: 1537197 - RNA, 19 nt, Homo sapiens
gaagaugguuugcugaaag

SEQ ID NO: 1537198 - RNA, 19 nt, Homo sapiens
ugacuggacucaugaauca

SEQ ID NO: 1537199 - RNA, 19 nt, Homo sapiens
ggaaaggagauuauacaaa

SEQ ID NO: 1537200 - RNA, 19 nt, Homo sapiens
ggucagaguuuagagcuuu

SEQ ID NO: 1537201 - RNA, 19 nt, Homo sapiens
gggaaguucuguuacugua

SEQ ID NO: 1537202 - RNA, 19 nt, Homo sapiens
ucacaaggcuagaaaucaa

SEQ ID NO: 1537203 - RNA, 19 nt, Homo sapiens
gauauuacauuaggaagug

SEQ ID NO: 1537204 - RNA, 19 nt, Homo sapiens
gaaagagguugaugugaac

SEQ ID NO: 1537205 - RNA, 19 nt, Homo sapiens
gaaguucuguuacuguauc

SEQ ID NO: 1537206 - RNA, 19 nt, Homo sapiens
gggaacaguuuauggaaau

SEQ ID NO: 1537207 - RNA, 19 nt, Homo sapiens
gaacucagaaguccauguu

SEQ ID NO: 1537208 - RNA, 19 nt, Homo sapiens
gauuugaguuggauuuaug

SEQ ID NO: 1537209 - RNA, 19 nt, Homo sapiens
gcaugggacuaguaucuug

SEQ ID NO: 1537210 - RNA, 19 nt, Homo sapiens
gcucucacaugacagguuu

SEQ ID NO: 1537211 - RNA, 19 nt, Homo sapiens
ucaagcucauuuacaguua

SEQ ID NO: 1537212 - RNA, 19 nt, Homo sapiens
ggaacaguuuauggaaaua

SEQ ID NO: 1537213 - RNA, 19 nt, Homo sapiens
gagaaugaauacuggugaa

SEQ ID NO: 1537214 - RNA, 19 nt, Homo sapiens
ucguaaagaugauguugua

SEQ ID NO: 1537215 - RNA, 19 nt, Homo sapiens
uugaauaucugacuucuuc

SEQ ID NO: 1537216 - RNA, 19 nt, Homo sapiens
cuacugcucuguaacaaau

SEQ ID NO: 1537217 - RNA, 19 nt, Homo sapiens
ggaauugaaaucccauaaa

SEQ ID NO: 1537218 - RNA, 19 nt, Homo sapiens
ugacugaggucuccauuuu

SEQ ID NO: 1537219 - RNA, 19 nt, Homo sapiens
ggaaucacaaggcuagaaa

SEQ ID NO: 1537220 - RNA, 19 nt, Homo sapiens
uaggaaguguucaugguaa

SEQ ID NO: 1537221 - RNA, 19 nt, Homo sapiens
gcagggaaguucuguuacu

SEQ ID NO: 1537222 - RNA, 19 nt, Homo sapiens
guauugagggugauaauug

SEQ ID NO: 1537223 - RNA, 19 nt, Homo sapiens
uuacagcuaugucuagguu

SEQ ID NO: 1537224 - RNA, 19 nt, Homo sapiens
gugcuuugcuauuguauuc

SEQ ID NO: 1537225 - RNA, 19 nt, Homo sapiens
acaaaggcauccaucaugu

SEQ ID NO: 1537226 - RNA, 19 nt, Homo sapiens
ucccauaaagguucuauua

SEQ ID NO: 1537227 - RNA, 19 nt, Homo sapiens
gauauucaugcaucagaua

SEQ ID NO: 1537228 - RNA, 19 nt, Homo sapiens
uaaagggcucacuugauua

SEQ ID NO: 1537229 - RNA, 19 nt, Homo sapiens
guuuagagcuuucaaaucc

SEQ ID NO: 1537230 - RNA, 19 nt, Homo sapiens
cgaagaugguuugcugaaa

SEQ ID NO: 1537231 - RNA, 19 nt, Homo sapiens
gcagugaugcgcugaguuc

SEQ ID NO: 1537232 - RNA, 19 nt, Homo sapiens
caagcaagcaaacgugaaa

SEQ ID NO: 1537233 - RNA, 19 nt, Homo sapiens
ggaaguguucaugguaaua

SEQ ID NO: 1537234 - RNA, 19 nt, Homo sapiens
uaacaaugauucgcagauc

SEQ ID NO: 1537235 - RNA, 19 nt, Homo sapiens
agaaguccauguucaggaa

SEQ ID NO: 1537236 - RNA, 19 nt, Homo sapiens
ggucccaucuucacuucaa

SEQ ID NO: 1537237 - RNA, 19 nt, Homo sapiens
ggagauggccauugugucu

SEQ ID NO: 1537238 - RNA, 19 nt, Homo sapiens
gaaaucccauaaagguucu

SEQ ID NO: 1537239 - RNA, 19 nt, Homo sapiens
gaaguguucaugguaauau

SEQ ID NO: 1537240 - RNA, 19 nt, Homo sapiens
aaagugcugugaccauaga

SEQ ID NO: 1537241 - RNA, 19 nt, Homo sapiens
uaaaagugcugugaccaua

SEQ ID NO: 1537242 - RNA, 19 nt, Homo sapiens
gugaugcgcugaguucuuc

SEQ ID NO: 1537243 - RNA, 19 nt, Homo sapiens
ccaacuucauucagauuau

SEQ ID NO: 1537244 - RNA, 19 nt, Homo sapiens
gcuuucaaaucccaacuug

SEQ ID NO: 1537245 - RNA, 19 nt, Homo sapiens
gauuggccguggcaaguga

SEQ ID NO: 1537246 - RNA, 19 nt, Homo sapiens
gcuggaagaauauauacuu

SEQ ID NO: 1537247 - RNA, 19 nt, Homo sapiens
gagcaugggacuaguaucu

SEQ ID NO: 1537248 - RNA, 19 nt, Homo sapiens
aaacagagcaugggacuag

SEQ ID NO: 1537249 - RNA, 19 nt, Homo sapiens
guuuagauaucaagucauc

SEQ ID NO: 1537250 - RNA, 19 nt, Homo sapiens
ucaaggaaaggagauuaua

SEQ ID NO: 1537251 - RNA, 19 nt, Homo sapiens
ggaaaguggaauugaaauc

SEQ ID NO: 1537252 - RNA, 19 nt, Homo sapiens
uggaggagauggccauugu

SEQ ID NO: 1537253 - RNA, 19 nt, Homo sapiens
caaaaggcacuguaaguuu

SEQ ID NO: 1537254 - RNA, 19 nt, Homo sapiens
caagcucauuuacaguuau

SEQ ID NO: 1537255 - RNA, 19 nt, Homo sapiens
gguaacaucacaguagauu

SEQ ID NO: 1537256 - RNA, 19 nt, Homo sapiens
gccauugugucugauacua

SEQ ID NO: 1537257 - RNA, 19 nt, Homo sapiens
ccagcuggaagaauauaua

SEQ ID NO: 1537258 - RNA, 19 nt, Homo sapiens
guucucaucuggagucucu

SEQ ID NO: 1537259 - RNA, 19 nt, Homo sapiens
gcacaguggccaagucgau

SEQ ID NO: 1537260 - RNA, 19 nt, Homo sapiens
guagauucgucuucuggau

SEQ ID NO: 1537261 - RNA, 19 nt, Homo sapiens
aaucaucauuucugucuuc

SEQ ID NO: 1537262 - RNA, 19 nt, Homo sapiens
gaggcaaagugaucugucu

SEQ ID NO: 1537263 - RNA, 19 nt, Homo sapiens
agaaaucuacuuccaacuu

SEQ ID NO: 1537264 - RNA, 19 nt, Homo sapiens
uaaaucccaccauucauau

SEQ ID NO: 1537265 - RNA, 19 nt, Homo sapiens
gaguuuagagcuuucaaau

SEQ ID NO: 1537266 - RNA, 19 nt, Homo sapiens
cugcagggaaguucuguua

SEQ ID NO: 1537267 - RNA, 19 nt, Homo sapiens
ccacccacaugccuucuca

SEQ ID NO: 1537268 - RNA, 19 nt, Homo sapiens
cuaaaagccucaacuaauc

SEQ ID NO: 1537269 - RNA, 19 nt, Homo sapiens
ccauucauauaaagguuga

SEQ ID NO: 1537270 - RNA, 19 nt, Homo sapiens
acucagaaguccauguuca

SEQ ID NO: 1537271 - RNA, 19 nt, Homo sapiens
ugggaacaguuuauggaaa

SEQ ID NO: 1537272 - RNA, 19 nt, Homo sapiens
gaggagauggccauugugu

SEQ ID NO: 1537273 - RNA, 19 nt, Homo sapiens
uggcugaaguucguaaaga

SEQ ID NO: 1537274 - RNA, 19 nt, Homo sapiens
ucugaggacuggcgagaga

SEQ ID NO: 1537275 - RNA, 19 nt, Homo sapiens
guugggagcuuggcugcuu

SEQ ID NO: 1537276 - RNA, 19 nt, Homo sapiens
uaaucagggugccauagau

SEQ ID NO: 1537277 - RNA, 19 nt, Homo sapiens
gugcugugaccauagauaa

SEQ ID NO: 1537278 - RNA, 19 nt, Homo sapiens
ccaaccggcucgcucuugu

SEQ ID NO: 1537279 - RNA, 19 nt, Homo sapiens
caaaguauugagggugaua

SEQ ID NO: 1537280 - RNA, 19 nt, Homo sapiens
acugcucuguaacaaauua

SEQ ID NO: 1537281 - RNA, 19 nt, Homo sapiens
aggcaaaguugguuucagu

SEQ ID NO: 1537282 - RNA, 19 nt, Homo sapiens
aggcguccguggagguuua

SEQ ID NO: 1537283 - RNA, 19 nt, Homo sapiens
gaguucuucucaugcuuug

SEQ ID NO: 1537284 - RNA, 19 nt, Homo sapiens
uggagucucugggaagaaa

SEQ ID NO: 1537285 - RNA, 19 nt, Homo sapiens
aaucccaccauucauauaa

SEQ ID NO: 1537286 - RNA, 19 nt, Homo sapiens
gaacagacaucucuaauga

SEQ ID NO: 1537287 - RNA, 19 nt, Homo sapiens
gaaagaagaugagcugaua

SEQ ID NO: 1537288 - RNA, 19 nt, Homo sapiens
gcacaaauauuuccaagaa

SEQ ID NO: 1537289 - RNA, 19 nt, Homo sapiens
gcaaacagcugcacuggaa

SEQ ID NO: 1537290 - RNA, 19 nt, Homo sapiens
ucaaagcacuggccauuua

SEQ ID NO: 1537291 - RNA, 19 nt, Homo sapiens
gauaauauguggucaaguu

SEQ ID NO: 1537292 - RNA, 19 nt, Homo sapiens
gaaggcagcucaaagaaug

SEQ ID NO: 1537293 - RNA, 19 nt, Homo sapiens
agacauagcucguacaaau

SEQ ID NO: 1537294 - RNA, 19 nt, Homo sapiens
gaagaugagcugauauuaa

SEQ ID NO: 1537295 - RNA, 19 nt, Homo sapiens
gcagugacaugcuacaauu

SEQ ID NO: 1537296 - RNA, 19 nt, Homo sapiens
caaagaaugucaucuaaag

SEQ ID NO: 1537297 - RNA, 19 nt, Homo sapiens
ggaaugaucaugguuauaa

SEQ ID NO: 1537298 - RNA, 19 nt, Homo sapiens
gaugcauccuucaaauuua

SEQ ID NO: 1537299 - RNA, 19 nt, Homo sapiens
gcacuagucaccuaagaua

SEQ ID NO: 1537300 - RNA, 19 nt, Homo sapiens
gcgagaaagugaagucaaa

SEQ ID NO: 1537301 - RNA, 19 nt, Homo sapiens
ugaagacgcugauuagaga

SEQ ID NO: 1537302 - RNA, 19 nt, Homo sapiens
aaacaacuccggauccuua

SEQ ID NO: 1537303 - RNA, 19 nt, Homo sapiens
gaaggaacuuucuguaucu

SEQ ID NO: 1537304 - RNA, 19 nt, Homo sapiens
uuacagagcuugacaacau

SEQ ID NO: 1537305 - RNA, 19 nt, Homo sapiens
ucagaucccuuucaccuuu

SEQ ID NO: 1537306 - RNA, 19 nt, Homo sapiens
ucacugaucuuggaacauu

SEQ ID NO: 1537307 - RNA, 19 nt, Homo sapiens
ucagaaagauccgauuuga

SEQ ID NO: 1537308 - RNA, 19 nt, Homo sapiens
gcauuaaccucacaucucu

SEQ ID NO: 1537309 - RNA, 19 nt, Homo sapiens
ggacuaaagcaauuucuug

SEQ ID NO: 1537310 - RNA, 19 nt, Homo sapiens
caagaaggcagcucaaaga

SEQ ID NO: 1537311 - RNA, 19 nt, Homo sapiens
gcucccagcugucagauau

SEQ ID NO: 1537312 - RNA, 19 nt, Homo sapiens
ccgcauaucuccgauugua

SEQ ID NO: 1537313 - RNA, 19 nt, Homo sapiens
uugcaaagguggcguuuaa

SEQ ID NO: 1537314 - RNA, 19 nt, Homo sapiens
gaagaauguugucagaagu

SEQ ID NO: 1537315 - RNA, 19 nt, Homo sapiens
ugaaggaacuuucuguauc

SEQ ID NO: 1537316 - RNA, 19 nt, Homo sapiens
cuaaagcaauuucuugaug

SEQ ID NO: 1537317 - RNA, 19 nt, Homo sapiens
gcacuggaauuaugcaucu

SEQ ID NO: 1537318 - RNA, 19 nt, Homo sapiens
gcucaaagaaugucaucua

SEQ ID NO: 1537319 - RNA, 19 nt, Homo sapiens
ggauaagagagcuaaauuu

SEQ ID NO: 1537320 - RNA, 19 nt, Homo sapiens
gaaagagcaauauuacaga

SEQ ID NO: 1537321 - RNA, 19 nt, Homo sapiens
ggaacuuucuguaucugaa

SEQ ID NO: 1537322 - RNA, 19 nt, Homo sapiens
ucugagcgcugcccuaauu

SEQ ID NO: 1537323 - RNA, 19 nt, Homo sapiens
gacaagaauuauccaaauc

SEQ ID NO: 1537324 - RNA, 19 nt, Homo sapiens
cguauuacaucgcugguuu

SEQ ID NO: 1537325 - RNA, 19 nt, Homo sapiens
ccucacaucucucagcauu

SEQ ID NO: 1537326 - RNA, 19 nt, Homo sapiens
gccacaagcucaucuaucu

SEQ ID NO: 1537327 - RNA, 19 nt, Homo sapiens
uaaaugugcugcguuugaa

SEQ ID NO: 1537328 - RNA, 19 nt, Homo sapiens
gcaaagguggcguuuaaau

SEQ ID NO: 1537329 - RNA, 19 nt, Homo sapiens
cagcaagacauaagaguaa

SEQ ID NO: 1537330 - RNA, 19 nt, Homo sapiens
ugaagcaacugacuguguu

SEQ ID NO: 1537331 - RNA, 19 nt, Homo sapiens
cagcugcacuggaauuaug

SEQ ID NO: 1537332 - RNA, 19 nt, Homo sapiens
aaucaugccuggauguuga

SEQ ID NO: 1537333 - RNA, 19 nt, Homo sapiens
gagggaaugaucaugguua

SEQ ID NO: 1537334 - RNA, 19 nt, Homo sapiens
gggcugaagacgcugauua

SEQ ID NO: 1537335 - RNA, 19 nt, Homo sapiens
agacuggcauuaugaagaa

SEQ ID NO: 1537336 - RNA, 19 nt, Homo sapiens
guuuaaaugugcugcguuu

SEQ ID NO: 1537337 - RNA, 19 nt, Homo sapiens
ugaagaauguugucagaag

SEQ ID NO: 1537338 - RNA, 19 nt, Homo sapiens
aaaguggucuucagaaucu

SEQ ID NO: 1537339 - RNA, 19 nt, Homo sapiens
ggaaggaaacccuguuaca

SEQ ID NO: 1537340 - RNA, 19 nt, Homo sapiens
ggaacagacaucucuaaug

SEQ ID NO: 1537341 - RNA, 19 nt, Homo sapiens
gagcgcugcccuaauuuaa

SEQ ID NO: 1537342 - RNA, 19 nt, Homo sapiens
ucagauaggcugcaaacaa

SEQ ID NO: 1537343 - RNA, 19 nt, Homo sapiens
ugaaugugcuuuccagaca

SEQ ID NO: 1537344 - RNA, 19 nt, Homo sapiens
caaggaauuggauauauug

SEQ ID NO: 1537345 - RNA, 19 nt, Homo sapiens
gagcuaaauuuaagcaacu

SEQ ID NO: 1537346 - RNA, 19 nt, Homo sapiens
gcagacgguucacagacaa

SEQ ID NO: 1537347 - RNA, 19 nt, Homo sapiens
gagaaagugaagucaaauu

SEQ ID NO: 1537348 - RNA, 19 nt, Homo sapiens
cagcaggaauacaacacua

SEQ ID NO: 1537349 - RNA, 19 nt, Homo sapiens
gcuaagugaugccucuguu

SEQ ID NO: 1537350 - RNA, 19 nt, Homo sapiens
ugaugcauccuucaaauuu

SEQ ID NO: 1537351 - RNA, 19 nt, Homo sapiens
guucacagacaaaggcuua

SEQ ID NO: 1537352 - RNA, 19 nt, Homo sapiens
caaagguggcguuuaaaug

SEQ ID NO: 1537353 - RNA, 19 nt, Homo sapiens
cuacuugaguuuacgaaau

SEQ ID NO: 1537354 - RNA, 19 nt, Homo sapiens
gcccaacauucacagauga

SEQ ID NO: 1537355 - RNA, 19 nt, Homo sapiens
gagcugauauuaaaacaug

SEQ ID NO: 1537356 - RNA, 19 nt, Homo sapiens
gucacaagcuaaccauuau

SEQ ID NO: 1537357 - RNA, 19 nt, Homo sapiens
ugucacaagcuaaccauua

SEQ ID NO: 1537358 - RNA, 19 nt, Homo sapiens
cagauaggcugcaaacaac

SEQ ID NO: 1537359 - RNA, 19 nt, Homo sapiens
gccauuaccugcacauuuu

SEQ ID NO: 1537360 - RNA, 19 nt, Homo sapiens
gaaauaaaaggguuacuga

SEQ ID NO: 1537361 - RNA, 19 nt, Homo sapiens
agaaagauccgauuugaag

SEQ ID NO: 1537362 - RNA, 19 nt, Homo sapiens
cggaauacagcaagacaua

SEQ ID NO: 1537363 - RNA, 19 nt, Homo sapiens
uaugaagaauguugucaga

SEQ ID NO: 1537364 - RNA, 19 nt, Homo sapiens
cucaaagaaugucaucuaa

SEQ ID NO: 1537365 - RNA, 19 nt, Homo sapiens
uguaagaauuggugauaug

SEQ ID NO: 1537366 - RNA, 19 nt, Homo sapiens
ggaauacagcaagacauaa

SEQ ID NO: 1537367 - RNA, 19 nt, Homo sapiens
caagcuaaccauuauccua

SEQ ID NO: 1537368 - RNA, 19 nt, Homo sapiens
cauaacaucaucuaaagga

SEQ ID NO: 1537369 - RNA, 19 nt, Homo sapiens
gauaugggacuaaagcaau

SEQ ID NO: 1537370 - RNA, 19 nt, Homo sapiens
cuaaugaggguuugaaugu

SEQ ID NO: 1537371 - RNA, 19 nt, Homo sapiens
gcagaagaauccaauuuuc

SEQ ID NO: 1537372 - RNA, 19 nt, Homo sapiens
gaauacagcaagacauaag

SEQ ID NO: 1537373 - RNA, 19 nt, Homo sapiens
caacauacagcagugaaga

SEQ ID NO: 1537374 - RNA, 19 nt, Homo sapiens
ugaugccucuguuaugaaa

SEQ ID NO: 1537375 - RNA, 19 nt, Homo sapiens
uguaggaacuugcaagagu

SEQ ID NO: 1537376 - RNA, 19 nt, Homo sapiens
aaagguggcguuuaaaugu

SEQ ID NO: 1537377 - RNA, 19 nt, Homo sapiens
ugacacaacuaaacucacu

SEQ ID NO: 1537378 - RNA, 19 nt, Homo sapiens
ugaagucuuucuuguagau

SEQ ID NO: 1537379 - RNA, 19 nt, Homo sapiens
ucugaagucuuucuuguag

SEQ ID NO: 1537380 - RNA, 19 nt, Homo sapiens
agacaaaggcuuacaguac

SEQ ID NO: 1537381 - RNA, 19 nt, Homo sapiens
gcacuguuaugugguauac

SEQ ID NO: 1537382 - RNA, 19 nt, Homo sapiens
gacaacauaacaucaucua

SEQ ID NO: 1537383 - RNA, 19 nt, Homo sapiens
uacagagcuugacaacaua

SEQ ID NO: 1537384 - RNA, 19 nt, Homo sapiens
gagaaagaagugccagaga

SEQ ID NO: 1537385 - RNA, 19 nt, Homo sapiens
gcgcugcccuaauuuaaac

SEQ ID NO: 1537386 - RNA, 19 nt, Homo sapiens
gaugagcucucccuuauau

SEQ ID NO: 1537387 - RNA, 19 nt, Homo sapiens
ggucuaagcugccaucaau

SEQ ID NO: 1537388 - RNA, 19 nt, Homo sapiens
gaggcuaguugagaaauua

SEQ ID NO: 1537389 - RNA, 19 nt, Homo sapiens
gaagauaugcacuuauuug

SEQ ID NO: 1537390 - RNA, 19 nt, Homo sapiens
ccacaaagcuggucuaagc

SEQ ID NO: 1537391 - RNA, 19 nt, Homo sapiens
uagaugagcucucccuuau

SEQ ID NO: 1537392 - RNA, 19 nt, Homo sapiens
caaaguucaucaugucauu

SEQ ID NO: 1537393 - RNA, 19 nt, Homo sapiens
gagaguaccauuaggaauu

SEQ ID NO: 1537394 - RNA, 19 nt, Homo sapiens
gcacuuauuuggccauuac

SEQ ID NO: 1537395 - RNA, 19 nt, Homo sapiens
gagguuaugaggcuuaaua

SEQ ID NO: 1537396 - RNA, 19 nt, Homo sapiens
caauguagauuuagaagag

SEQ ID NO: 1537397 - RNA, 19 nt, Homo sapiens
gaacagugaggcuaguuga

SEQ ID NO: 1537398 - RNA, 19 nt, Homo sapiens
gaagagcaauggcgacacu

SEQ ID NO: 1537399 - RNA, 19 nt, Homo sapiens
cagaagagacguacaacuu

SEQ ID NO: 1537400 - RNA, 19 nt, Homo sapiens
caagacaacaggagaaaug

SEQ ID NO: 1537401 - RNA, 19 nt, Homo sapiens
cgacuucuaucucguagug

SEQ ID NO: 1537402 - RNA, 19 nt, Homo sapiens
ccacaggcccuugcacaua

SEQ ID NO: 1537403 - RNA, 19 nt, Homo sapiens
uggcuucccuuugcucuua

SEQ ID NO: 1537404 - RNA, 19 nt, Homo sapiens
uaucauggcuacaaagucu

SEQ ID NO: 1537405 - RNA, 19 nt, Homo sapiens
ggacaagcuuccauucacu

SEQ ID NO: 1537406 - RNA, 19 nt, Homo sapiens
ggagcgugacauuucauua

SEQ ID NO: 1537407 - RNA, 19 nt, Homo sapiens
ggaagacuccccuaauuuu

SEQ ID NO: 1537408 - RNA, 19 nt, Homo sapiens
aaaccugaauucaugucua

SEQ ID NO: 1537409 - RNA, 19 nt, Homo sapiens
gucaggaucuaguaaggaa

SEQ ID NO: 1537410 - RNA, 19 nt, Homo sapiens
aaucaaaguucaucauguc

SEQ ID NO: 1537411 - RNA, 19 nt, Homo sapiens
ggagaaagcaagacaacag

SEQ ID NO: 1537412 - RNA, 19 nt, Homo sapiens
cuccgacaauguagauuua

SEQ ID NO: 1537413 - RNA, 19 nt, Homo sapiens
acacugcuccgacaaugua

SEQ ID NO: 1537414 - RNA, 19 nt, Homo sapiens
gcugugcuguuuuaaauaa

SEQ ID NO: 1537415 - RNA, 19 nt, Homo sapiens
guaccauuaggaauucuua

SEQ ID NO: 1537416 - RNA, 19 nt, Homo sapiens
agcauagucucaguuaaua

SEQ ID NO: 1537417 - RNA, 19 nt, Homo sapiens
cuagaugagcucucccuua

SEQ ID NO: 1537418 - RNA, 19 nt, Homo sapiens
caucaugucauucucuuga

SEQ ID NO: 1537419 - RNA, 19 nt, Homo sapiens
gagcgugacauuucauuag

SEQ ID NO: 1537420 - RNA, 19 nt, Homo sapiens
ucagaggacuggcauuguc

SEQ ID NO: 1537421 - RNA, 19 nt, Homo sapiens
uagcauagucucaguuaau

SEQ ID NO: 1537422 - RNA, 19 nt, Homo sapiens
caacaagaaggaagagcaa

SEQ ID NO: 1537423 - RNA, 19 nt, Homo sapiens
gcacgcagaagucagaauc

SEQ ID NO: 1537424 - RNA, 19 nt, Homo sapiens
cagcagagcccugaagugu

SEQ ID NO: 1537425 - RNA, 19 nt, Homo sapiens
gcuccgacaauguagauuu

SEQ ID NO: 1537426 - RNA, 19 nt, Homo sapiens
uugcagauccucucagaaa

SEQ ID NO: 1537427 - RNA, 19 nt, Homo sapiens
gcuggagcgugacauuuca

SEQ ID NO: 1537428 - RNA, 19 nt, Homo sapiens
gccauuacccagcacauga

SEQ ID NO: 1537429 - RNA, 19 nt, Homo sapiens
cgacaauguagauuuagaa

SEQ ID NO: 1537430 - RNA, 19 nt, Homo sapiens
cagugaggcuaguugagaa

SEQ ID NO: 1537431 - RNA, 19 nt, Homo sapiens
ucagacugcaucuuaauga

SEQ ID NO: 1537432 - RNA, 19 nt, Homo sapiens
aagcuggccuucaaaauuu

SEQ ID NO: 1537433 - RNA, 19 nt, Homo sapiens
guaaggaaaugggcuugag

SEQ ID NO: 1537434 - RNA, 19 nt, Homo sapiens
guacaacuucugaaagauc

SEQ ID NO: 1537435 - RNA, 19 nt, Homo sapiens
acguacaacuucugaaaga

SEQ ID NO: 1537436 - RNA, 19 nt, Homo sapiens
gcacaugacgacuucuauc

SEQ ID NO: 1537437 - RNA, 19 nt, Homo sapiens
ccuagcauagucucaguua

SEQ ID NO: 1537438 - RNA, 19 nt, Homo sapiens
cagucaagcuggccuucaa

SEQ ID NO: 1537439 - RNA, 19 nt, Homo sapiens
agacguacaacuucugaaa

SEQ ID NO: 1537440 - RNA, 19 nt, Homo sapiens
ugaggcuaguugagaaauu

SEQ ID NO: 1537441 - RNA, 19 nt, Homo sapiens
ggaacagugaggcuaguug

SEQ ID NO: 1537442 - RNA, 19 nt, Homo sapiens
gcucuuaagcuaaaaguaa

SEQ ID NO: 1537443 - RNA, 19 nt, Homo sapiens
ccuuugcucuuaagcuaaa

SEQ ID NO: 1537444 - RNA, 19 nt, Homo sapiens
gcagaagucagaaucaaaa

SEQ ID NO: 1537445 - RNA, 19 nt, Homo sapiens
agagaagcaucagguguga

SEQ ID NO: 1537446 - RNA, 19 nt, Homo sapiens
cgugacauuucauuaggaa

SEQ ID NO: 1537447 - RNA, 19 nt, Homo sapiens
gccaggcucccuuucauug

SEQ ID NO: 1537448 - RNA, 19 nt, Homo sapiens
ucccuuugcucuuaagcua

SEQ ID NO: 1537449 - RNA, 19 nt, Homo sapiens
gaagucagaaucaaaauca

SEQ ID NO: 1537450 - RNA, 19 nt, Homo sapiens
ucauuaucauggcuacaaa

SEQ ID NO: 1537451 - RNA, 19 nt, Homo sapiens
ggagaguaccauuaggaau

SEQ ID NO: 1537452 - RNA, 19 nt, Homo sapiens
ccgacaauguagauuuaga

SEQ ID NO: 1537453 - RNA, 19 nt, Homo sapiens
gggagguuaugaggcuuaa

SEQ ID NO: 1537454 - RNA, 19 nt, Homo sapiens
gcaaauucgugagcacacu

SEQ ID NO: 1537455 - RNA, 19 nt, Homo sapiens
caucaggugugagaaugga

SEQ ID NO: 1537456 - RNA, 19 nt, Homo sapiens
ccugcuggcugugcuguuu

SEQ ID NO: 1537457 - RNA, 19 nt, Homo sapiens
agaguaccauuaggaauuc

SEQ ID NO: 1537458 - RNA, 19 nt, Homo sapiens
uauaggagaguaccauuag

SEQ ID NO: 1537459 - RNA, 19 nt, Homo sapiens
aaauuauaccucaccagua

SEQ ID NO: 1537460 - RNA, 19 nt, Homo sapiens
gagcucucccuuauauguu

SEQ ID NO: 1537461 - RNA, 19 nt, Homo sapiens
gacaacaggagaaaugaag

SEQ ID NO: 1537462 - RNA, 19 nt, Homo sapiens
caagcuggccuucaaaauu

SEQ ID NO: 1537463 - RNA, 19 nt, Homo sapiens
gcagccaagccauagagaa

SEQ ID NO: 1537464 - RNA, 19 nt, Homo sapiens
agagagcagccaagccaua

SEQ ID NO: 1537465 - RNA, 19 nt, Homo sapiens
cagacugcaucuuaaugau

SEQ ID NO: 1537466 - RNA, 19 nt, Homo sapiens
ccuucagacugcaucuuaa

SEQ ID NO: 1537467 - RNA, 19 nt, Homo sapiens
cacaggcccuugcacauac

SEQ ID NO: 1537468 - RNA, 19 nt, Homo sapiens
gcacugcgggagaaagcaa

SEQ ID NO: 1537469 - RNA, 19 nt, Homo sapiens
gcgugacauuucauuagga

SEQ ID NO: 1537470 - RNA, 19 nt, Homo sapiens
uuacacugcuccgacaaug

SEQ ID NO: 1537471 - RNA, 19 nt, Homo sapiens
agacugcaucuuaaugauu

SEQ ID NO: 1537472 - RNA, 19 nt, Homo sapiens
guucuucucuucauuuuca

SEQ ID NO: 1537473 - RNA, 19 nt, Homo sapiens
aagcuuccauucacugcaa

SEQ ID NO: 1537474 - RNA, 19 nt, Homo sapiens
gccaagccauagagaagca

SEQ ID NO: 1537475 - RNA, 19 nt, Homo sapiens
ugacauuucauuaggaaca

SEQ ID NO: 1537476 - RNA, 19 nt, Homo sapiens
ccucagagccuagcauagu

SEQ ID NO: 1537477 - RNA, 19 nt, Homo sapiens
ugagcucucccuuauaugu

SEQ ID NO: 1537478 - RNA, 19 nt, Homo sapiens
cagcacaugacgacuucua

SEQ ID NO: 1537479 - RNA, 19 nt, Homo sapiens
ugacuuguggcuucccuuu

SEQ ID NO: 1537480 - RNA, 19 nt, Homo sapiens
ucuaagcugccaucaauuc

SEQ ID NO: 1537481 - RNA, 19 nt, Homo sapiens
gagagcagccaagccauag

SEQ ID NO: 1537482 - RNA, 19 nt, Homo sapiens
aauugcagauccucucaga

SEQ ID NO: 1537483 - RNA, 19 nt, Homo sapiens
caagaaggaagagcaaugg

SEQ ID NO: 1537484 - RNA, 19 nt, Homo sapiens
cuagcauagucucaguuaa

SEQ ID NO: 1537485 - RNA, 19 nt, Homo sapiens
gcucucccuuauauguuga

SEQ ID NO: 1537486 - RNA, 19 nt, Homo sapiens
ccagauuucuucaguuaua

SEQ ID NO: 1537487 - RNA, 19 nt, Homo sapiens
gagaaucgcauccagauaa

SEQ ID NO: 1537488 - RNA, 19 nt, Homo sapiens
ucaguucucuucaugguua

SEQ ID NO: 1537489 - RNA, 19 nt, Homo sapiens
gaacagggcuuaccccaaa

SEQ ID NO: 1537490 - RNA, 19 nt, Homo sapiens
aagcaagacuguuaacuuu

SEQ ID NO: 1537491 - RNA, 19 nt, Homo sapiens
gcaggugaauugagacaaa

SEQ ID NO: 1537492 - RNA, 19 nt, Homo sapiens
gaugaacacuaucuuugaa

SEQ ID NO: 1537493 - RNA, 19 nt, Homo sapiens
cuaggaagcucuauucugu

SEQ ID NO: 1537494 - RNA, 19 nt, Homo sapiens
gguuaugucugguuucauu

SEQ ID NO: 1537495 - RNA, 19 nt, Homo sapiens
uaagucaccucaaaucuuc

SEQ ID NO: 1537496 - RNA, 19 nt, Homo sapiens
ggaagaagaugagcugagu

SEQ ID NO: 1537497 - RNA, 19 nt, Homo sapiens
gaaccaucguggccaauau

SEQ ID NO: 1537498 - RNA, 19 nt, Homo sapiens
ccaaguggcccaaaggaua

SEQ ID NO: 1537499 - RNA, 19 nt, Homo sapiens
gcaagacuguuaacuuugg

SEQ ID NO: 1537500 - RNA, 19 nt, Homo sapiens
ggaggauccugaugaugaa

SEQ ID NO: 1537501 - RNA, 19 nt, Homo sapiens
ggucaggaguucaagauca

SEQ ID NO: 1537502 - RNA, 19 nt, Homo sapiens
gaacaaggaaccucugaca

SEQ ID NO: 1537503 - RNA, 19 nt, Homo sapiens
gaaacuauccagaugaaca

SEQ ID NO: 1537504 - RNA, 19 nt, Homo sapiens
uaaacaaguucugcuuuga

SEQ ID NO: 1537505 - RNA, 19 nt, Homo sapiens
cuaaacaaguucugcuuug

SEQ ID NO: 1537506 - RNA, 19 nt, Homo sapiens
ggaaacguaugaauucaac

SEQ ID NO: 1537507 - RNA, 19 nt, Homo sapiens
ggaauuccugacauaaaua

SEQ ID NO: 1537508 - RNA, 19 nt, Homo sapiens
aaguucaccuucagcauua

SEQ ID NO: 1537509 - RNA, 19 nt, Homo sapiens
gcacauguaaucccagcua

SEQ ID NO: 1537510 - RNA, 19 nt, Homo sapiens
cguaugaauucaacucaaa

SEQ ID NO: 1537511 - RNA, 19 nt, Homo sapiens
acaaggaaccucugacaaa

SEQ ID NO: 1537512 - RNA, 19 nt, Homo sapiens
gcaagacuccaucucagaa

SEQ ID NO: 1537513 - RNA, 19 nt, Homo sapiens
acccagauuucuucaguua

SEQ ID NO: 1537514 - RNA, 19 nt, Homo sapiens
ggccaaagccguccacaga

SEQ ID NO: 1537515 - RNA, 19 nt, Homo sapiens
ccagauaaccuucauugug

SEQ ID NO: 1537516 - RNA, 19 nt, Homo sapiens
ccucaaaucuucuucaaaa

SEQ ID NO: 1537517 - RNA, 19 nt, Homo sapiens
gaaauccagccuucaugaa

SEQ ID NO: 1537518 - RNA, 19 nt, Homo sapiens
caaggaaccucugacaaag

SEQ ID NO: 1537519 - RNA, 19 nt, Homo sapiens
cauagaaaguuuguaggaa

SEQ ID NO: 1537520 - RNA, 19 nt, Homo sapiens
caccuccucuacagcauua

SEQ ID NO: 1537521 - RNA, 19 nt, Homo sapiens
gaacuaccugugcuucuga

SEQ ID NO: 1537522 - RNA, 19 nt, Homo sapiens
gaugcugccucacccuaaa

SEQ ID NO: 1537523 - RNA, 19 nt, Homo sapiens
gaaagaagaaaacucagua

SEQ ID NO: 1537524 - RNA, 19 nt, Homo sapiens
guaagucaccucaaaucuu

SEQ ID NO: 1537525 - RNA, 19 nt, Homo sapiens
ccaaagccguccacagaca

SEQ ID NO: 1537526 - RNA, 19 nt, Homo sapiens
gguggcagcugcuucagau

SEQ ID NO: 1537527 - RNA, 19 nt, Homo sapiens
guuaagaguuggucaucug

SEQ ID NO: 1537528 - RNA, 19 nt, Homo sapiens
ugacauaaauagugaagac

SEQ ID NO: 1537529 - RNA, 19 nt, Homo sapiens
cugauaagcaagacuguua

SEQ ID NO: 1537530 - RNA, 19 nt, Homo sapiens
ggaagauugugcugauugg

SEQ ID NO: 1537531 - RNA, 19 nt, Homo sapiens
ugaagacuauccuuacauc

SEQ ID NO: 1537532 - RNA, 19 nt, Homo sapiens
cgucuacguuuauauccua

SEQ ID NO: 1537533 - RNA, 19 nt, Homo sapiens
uaagcaagacuguuaacuu

SEQ ID NO: 1537534 - RNA, 19 nt, Homo sapiens
ggagaaucgcauccagaua

SEQ ID NO: 1537535 - RNA, 19 nt, Homo sapiens
uuaccacuguuagcaaaua

SEQ ID NO: 1537536 - RNA, 19 nt, Homo sapiens
gccagaaaguggaaagauc

SEQ ID NO: 1537537 - RNA, 19 nt, Homo sapiens
uagcagccggcaauaaaua

SEQ ID NO: 1537538 - RNA, 19 nt, Homo sapiens
ccacuguuagcaaauauuu

SEQ ID NO: 1537539 - RNA, 19 nt, Homo sapiens
gcaccaaacaacagauuca

SEQ ID NO: 1537540 - RNA, 19 nt, Homo sapiens
cggaggauccugaugauga

SEQ ID NO: 1537541 - RNA, 19 nt, Homo sapiens
ggaaccaucguggccaaua

SEQ ID NO: 1537542 - RNA, 19 nt, Homo sapiens
cauuaccacuguuagcaaa

SEQ ID NO: 1537543 - RNA, 19 nt, Homo sapiens
guguggaauuguuguguuu

SEQ ID NO: 1537544 - RNA, 19 nt, Homo sapiens
gaacacuaucuuugaagga

SEQ ID NO: 1537545 - RNA, 19 nt, Homo sapiens
caaagaaaggagaaacgaa

SEQ ID NO: 1537546 - RNA, 19 nt, Homo sapiens
aggaaccucugacaaagaa

SEQ ID NO: 1537547 - RNA, 19 nt, Homo sapiens
gcaagacugggaagaacaa

SEQ ID NO: 1537548 - RNA, 19 nt, Homo sapiens
gcagccggcaauaaauaua

SEQ ID NO: 1537549 - RNA, 19 nt, Homo sapiens
gaaaguaaacggggucuaa

SEQ ID NO: 1537550 - RNA, 19 nt, Homo sapiens
agaccgagaugcaggugaa

SEQ ID NO: 1537551 - RNA, 19 nt, Homo sapiens
uggaagacgucaacgacaa

SEQ ID NO: 1537552 - RNA, 19 nt, Homo sapiens
ccuagcagccggcaauaaa

SEQ ID NO: 1537553 - RNA, 19 nt, Homo sapiens
gggaagauugugcugauug

SEQ ID NO: 1537554 - RNA, 19 nt, Homo sapiens
ucacccagauuucuucagu

SEQ ID NO: 1537555 - RNA, 19 nt, Homo sapiens
ggaauuguuguguuucuuc

SEQ ID NO: 1537556 - RNA, 19 nt, Homo sapiens
gguguggaauuguuguguu

SEQ ID NO: 1537557 - RNA, 19 nt, Homo sapiens
guaccuggucguccuauug

SEQ ID NO: 1537558 - RNA, 19 nt, Homo sapiens
caugguacgugccguuugu

SEQ ID NO: 1537559 - RNA, 19 nt, Homo sapiens
aacaacagauucaacuuca

SEQ ID NO: 1537560 - RNA, 19 nt, Homo sapiens
aaaguucaccuucagcauu

SEQ ID NO: 1537561 - RNA, 19 nt, Homo sapiens
guaguucaguucucuucau

SEQ ID NO: 1537562 - RNA, 19 nt, Homo sapiens
augaguaaguuaagaguug

SEQ ID NO: 1537563 - RNA, 19 nt, Homo sapiens
aaacaacagauucaacuuc

SEQ ID NO: 1537564 - RNA, 19 nt, Homo sapiens
cagcggaggauccugauga

SEQ ID NO: 1537565 - RNA, 19 nt, Homo sapiens
gaauuguuguguuucuucu

SEQ ID NO: 1537566 - RNA, 19 nt, Homo sapiens
aaagauccacuaacccaaa

SEQ ID NO: 1537567 - RNA, 19 nt, Homo sapiens
ugaaggagaagccauagau

SEQ ID NO: 1537568 - RNA, 19 nt, Homo sapiens
guagggagaacugcuuaaa

SEQ ID NO: 1537569 - RNA, 19 nt, Homo sapiens
gcucuauucuguucaccau

SEQ ID NO: 1537570 - RNA, 19 nt, Homo sapiens
agaugcaggugaauugaga

SEQ ID NO: 1537571 - RNA, 19 nt, Homo sapiens
gaaacgaagacugcagaga

SEQ ID NO: 1537572 - RNA, 19 nt, Homo sapiens
gacguugcuucuugaccua

SEQ ID NO: 1537573 - RNA, 19 nt, Homo sapiens
ggaagacgucaacgacaau

SEQ ID NO: 1537574 - RNA, 19 nt, Homo sapiens
gaacugaguccaggaacca

SEQ ID NO: 1537575 - RNA, 19 nt, Homo sapiens
aaaagaagcagaacaguga

SEQ ID NO: 1537576 - RNA, 19 nt, Homo sapiens
aggaagcucuauucuguuc

SEQ ID NO: 1537577 - RNA, 19 nt, Homo sapiens
auaguugcguguucugaaa

SEQ ID NO: 1537578 - RNA, 19 nt, Homo sapiens
ucacauaguugcguguucu

SEQ ID NO: 1537579 - RNA, 19 nt, Homo sapiens
gaaggagaagccauagauc

SEQ ID NO: 1537580 - RNA, 19 nt, Homo sapiens
caaaggauagaccgagaug

SEQ ID NO: 1537581 - RNA, 19 nt, Homo sapiens
uaacaagcccagaaaauga

SEQ ID NO: 1537582 - RNA, 19 nt, Homo sapiens
gcauuauggugccggaaag

SEQ ID NO: 1537583 - RNA, 19 nt, Homo sapiens
gaacugcuuaaaccugaga

SEQ ID NO: 1537584 - RNA, 19 nt, Homo sapiens
uaacaucacccagauuucu

SEQ ID NO: 1537585 - RNA, 19 nt, Homo sapiens
caucugguuuccaccuuau

SEQ ID NO: 1537586 - RNA, 19 nt, Homo sapiens
gaacugcugucucacgaaa

SEQ ID NO: 1537587 - RNA, 19 nt, Homo sapiens
gaugaaagcauggaaauaa

SEQ ID NO: 1537588 - RNA, 19 nt, Homo sapiens
ccucagugcucuucuauaa

SEQ ID NO: 1537589 - RNA, 19 nt, Homo sapiens
ccaaagagaugcagguugu

SEQ ID NO: 1537590 - RNA, 19 nt, Homo sapiens
ucagugcucuucuauaauu

SEQ ID NO: 1537591 - RNA, 19 nt, Homo sapiens
ucaaacugcuguacuugua

SEQ ID NO: 1537592 - RNA, 19 nt, Homo sapiens
ucacagaacccaagauuga

SEQ ID NO: 1537593 - RNA, 19 nt, Homo sapiens
gcagagcucuccucagaca

SEQ ID NO: 1537594 - RNA, 19 nt, Homo sapiens
ggaucaaacugcuguacuu

SEQ ID NO: 1537595 - RNA, 19 nt, Homo sapiens
gagagggauucgcaacuuu

SEQ ID NO: 1537596 - RNA, 19 nt, Homo sapiens
ugaacaaccuuaccagaga

SEQ ID NO: 1537597 - RNA, 19 nt, Homo sapiens
gacuuuggcuaacuccuua

SEQ ID NO: 1537598 - RNA, 19 nt, Homo sapiens
gcacugggcggaucuauca

SEQ ID NO: 1537599 - RNA, 19 nt, Homo sapiens
aaagaggacucaaugacaa

SEQ ID NO: 1537600 - RNA, 19 nt, Homo sapiens
cagcaagaguggacugauu

SEQ ID NO: 1537601 - RNA, 19 nt, Homo sapiens
ggaaaggacuagaccaaaa

SEQ ID NO: 1537602 - RNA, 19 nt, Homo sapiens
ccaagucucuuacccuuca

SEQ ID NO: 1537603 - RNA, 19 nt, Homo sapiens
cagcuacacuucaucauca

SEQ ID NO: 1537604 - RNA, 19 nt, Homo sapiens
aaucucagcuggacucuau

SEQ ID NO: 1537605 - RNA, 19 nt, Homo sapiens
agacaacaaccuccaauuu

SEQ ID NO: 1537606 - RNA, 19 nt, Homo sapiens
caaagaaggagagaaacua

SEQ ID NO: 1537607 - RNA, 19 nt, Homo sapiens
ucacaucucuugccucucu

SEQ ID NO: 1537608 - RNA, 19 nt, Homo sapiens
uugcagagcucuccucaga

SEQ ID NO: 1537609 - RNA, 19 nt, Homo sapiens
cagcuaaccauguggauaa

SEQ ID NO: 1537610 - RNA, 19 nt, Homo sapiens
cagcuggacucuauauugu

SEQ ID NO: 1537611 - RNA, 19 nt, Homo sapiens
ugaaggcuuugacguguuu

SEQ ID NO: 1537612 - RNA, 19 nt, Homo sapiens
aauaaacgcuagcgauuca

SEQ ID NO: 1537613 - RNA, 19 nt, Homo sapiens
ggacaguggccuuaucaug

SEQ ID NO: 1537614 - RNA, 19 nt, Homo sapiens
caaauuacagggaugagaa

SEQ ID NO: 1537615 - RNA, 19 nt, Homo sapiens
gacaacaaccuccaauuuc

SEQ ID NO: 1537616 - RNA, 19 nt, Homo sapiens
ucaagaccaugaggaaauu

SEQ ID NO: 1537617 - RNA, 19 nt, Homo sapiens
uuacagggaugagaagauu

SEQ ID NO: 1537618 - RNA, 19 nt, Homo sapiens
gucaauagaucgaccaaag

SEQ ID NO: 1537619 - RNA, 19 nt, Homo sapiens
ccucauaacucaggucuca

SEQ ID NO: 1537620 - RNA, 19 nt, Homo sapiens
caccauucauuccucauaa

SEQ ID NO: 1537621 - RNA, 19 nt, Homo sapiens
gcaccauucauuccucaua

SEQ ID NO: 1537622 - RNA, 19 nt, Homo sapiens
gagagaaacuaaaagaaga

SEQ ID NO: 1537623 - RNA, 19 nt, Homo sapiens
acaacuugcugaaggcuuu

SEQ ID NO: 1537624 - RNA, 19 nt, Homo sapiens
ggauggaucaggagccuuu

SEQ ID NO: 1537625 - RNA, 19 nt, Homo sapiens
gcaagaguggacugauuaa

SEQ ID NO: 1537626 - RNA, 19 nt, Homo sapiens
aaauuaaacuggccagaag

SEQ ID NO: 1537627 - RNA, 19 nt, Homo sapiens
gcuaacuccuuacccaaug

SEQ ID NO: 1537628 - RNA, 19 nt, Homo sapiens
ccugagguuuccaugaaua

SEQ ID NO: 1537629 - RNA, 19 nt, Homo sapiens
ccagagccuuuaucacaga

SEQ ID NO: 1537630 - RNA, 19 nt, Homo sapiens
agaguggacugauuaaagu

SEQ ID NO: 1537631 - RNA, 19 nt, Homo sapiens
caaauuaaacuggccagaa

SEQ ID NO: 1537632 - RNA, 19 nt, Homo sapiens
gcuggacucuauauuguca

SEQ ID NO: 1537633 - RNA, 19 nt, Homo sapiens
caagaacucaagaccauga

SEQ ID NO: 1537634 - RNA, 19 nt, Homo sapiens
ucagcgaguuggcaaagaa

SEQ ID NO: 1537635 - RNA, 19 nt, Homo sapiens
caaccuccaauuucccuua

SEQ ID NO: 1537636 - RNA, 19 nt, Homo sapiens
uacaagaacucaagaccau

SEQ ID NO: 1537637 - RNA, 19 nt, Homo sapiens
gaacuuccaguggugaauu

SEQ ID NO: 1537638 - RNA, 19 nt, Homo sapiens
gagcagaggcaggaccuuu

SEQ ID NO: 1537639 - RNA, 19 nt, Homo sapiens
gaggagagccgcguucuag

SEQ ID NO: 1537640 - RNA, 19 nt, Homo sapiens
gaauucaucagcuggauca

SEQ ID NO: 1537641 - RNA, 19 nt, Homo sapiens
aaagaaggagagaaacuaa

SEQ ID NO: 1537642 - RNA, 19 nt, Homo sapiens
gagaugaaagcauggaaau

SEQ ID NO: 1537643 - RNA, 19 nt, Homo sapiens
gccucucucucugaaauua

SEQ ID NO: 1537644 - RNA, 19 nt, Homo sapiens
ggucucagcuacacuucau

SEQ ID NO: 1537645 - RNA, 19 nt, Homo sapiens
gagccgcguucuaggauuc

SEQ ID NO: 1537646 - RNA, 19 nt, Homo sapiens
gcccaaacccagagccuuu

SEQ ID NO: 1537647 - RNA, 19 nt, Homo sapiens
caauaaaagucuucacaga

SEQ ID NO: 1537648 - RNA, 19 nt, Homo sapiens
guucuaggauucggcauug

SEQ ID NO: 1537649 - RNA, 19 nt, Homo sapiens
ggagagccgcguucuagga

SEQ ID NO: 1537650 - RNA, 19 nt, Homo sapiens
ccuccaauuucccuuauau

SEQ ID NO: 1537651 - RNA, 19 nt, Homo sapiens
gaugucaggcuguuaagau

SEQ ID NO: 1537652 - RNA, 19 nt, Homo sapiens
ggacuagaccaaaauauug

SEQ ID NO: 1537653 - RNA, 19 nt, Homo sapiens
gcaaagaaggagagaaacu

SEQ ID NO: 1537654 - RNA, 19 nt, Homo sapiens
uuaauaaacgcuagcgauu

SEQ ID NO: 1537655 - RNA, 19 nt, Homo sapiens
ggacggcauugcucuacca

SEQ ID NO: 1537656 - RNA, 19 nt, Homo sapiens
ggugguggccucugagcua

SEQ ID NO: 1537657 - RNA, 19 nt, Homo sapiens
uaucacagaacccaagauu

SEQ ID NO: 1537658 - RNA, 19 nt, Homo sapiens
uggcaaagaaggagagaaa

SEQ ID NO: 1537659 - RNA, 19 nt, Homo sapiens
gcaaauuacagggaugaga

SEQ ID NO: 1537660 - RNA, 19 nt, Homo sapiens
uguacuccaugagaauuua

SEQ ID NO: 1537661 - RNA, 19 nt, Homo sapiens
uuccucagauccagaagua

SEQ ID NO: 1537662 - RNA, 19 nt, Homo sapiens
gaucaaacugcuguacuug

SEQ ID NO: 1537663 - RNA, 19 nt, Homo sapiens
ggaggagagccgcguucua

SEQ ID NO: 1537664 - RNA, 19 nt, Homo sapiens
caaacugcuguacuuguaa

SEQ ID NO: 1537665 - RNA, 19 nt, Homo sapiens
uuacagcgcucuccuuucc

SEQ ID NO: 1537666 - RNA, 19 nt, Homo sapiens
agagagggauucgcaacuu

SEQ ID NO: 1537667 - RNA, 19 nt, Homo sapiens
gauucuacaggaucaaauu

SEQ ID NO: 1537668 - RNA, 19 nt, Homo sapiens
ucagcuggacucuauauug

SEQ ID NO: 1537669 - RNA, 19 nt, Homo sapiens
uggaaccucuuacugugaa

SEQ ID NO: 1537670 - RNA, 19 nt, Homo sapiens
ugagaagauugcugaacga

SEQ ID NO: 1537671 - RNA, 19 nt, Homo sapiens
gacaagacuuuggcuaacu

SEQ ID NO: 1537672 - RNA, 19 nt, Homo sapiens
gcaaauucaagcaguugga

SEQ ID NO: 1537673 - RNA, 19 nt, Homo sapiens
gcggaucuaucagcgaguu

SEQ ID NO: 1537674 - RNA, 19 nt, Homo sapiens
gaaucaccuuccucagauc

SEQ ID NO: 1537675 - RNA, 19 nt, Homo sapiens
ucaauagaucgaccaaaga

SEQ ID NO: 1537676 - RNA, 19 nt, Homo sapiens
gucaggcuguuaagauuuc

SEQ ID NO: 1537677 - RNA, 19 nt, Homo sapiens
gaagcugacagacagagau

SEQ ID NO: 1537678 - RNA, 19 nt, Homo sapiens
gaccaugaggaaauuaaug

SEQ ID NO: 1537679 - RNA, 19 nt, Homo sapiens
uaaacgcuagcgauucaaa

SEQ ID NO: 1537680 - RNA, 19 nt, Homo sapiens
agcaagaguggacugauua

SEQ ID NO: 1537681 - RNA, 19 nt, Homo sapiens
gcugacagacagagaugaa

SEQ ID NO: 1537682 - RNA, 19 nt, Homo sapiens
guguguaucacccaucuuu

SEQ ID NO: 1537683 - RNA, 19 nt, Homo sapiens
gagcucuccucagacaaug

SEQ ID NO: 1537684 - RNA, 19 nt, Homo sapiens
gugcagcggugacccuagu

SEQ ID NO: 1537685 - RNA, 19 nt, Homo sapiens
ugacaagacuuuggcuaac

SEQ ID NO: 1537686 - RNA, 19 nt, Homo sapiens
gaacagaccuccuccucuu

SEQ ID NO: 1537687 - RNA, 19 nt, Homo sapiens
caagugaccucuguaauaa

SEQ ID NO: 1537688 - RNA, 19 nt, Homo sapiens
ccacuaagauuguccguuu

SEQ ID NO: 1537689 - RNA, 19 nt, Homo sapiens
ccaaguggcucuucauaaa

SEQ ID NO: 1537690 - RNA, 19 nt, Homo sapiens
gacggaaacuuguucauaa

SEQ ID NO: 1537691 - RNA, 19 nt, Homo sapiens
gaccuagucugccauauuu

SEQ ID NO: 1537692 - RNA, 19 nt, Homo sapiens
ccaauaccaugaaugaaua

SEQ ID NO: 1537693 - RNA, 19 nt, Homo sapiens
ggugauguguugcuaaaua

SEQ ID NO: 1537694 - RNA, 19 nt, Homo sapiens
ggagagagagugaauuuaa

SEQ ID NO: 1537695 - RNA, 19 nt, Homo sapiens
gcacacaaccauucugaua

SEQ ID NO: 1537696 - RNA, 19 nt, Homo sapiens
gcaguaaucuuggcuagaa

SEQ ID NO: 1537697 - RNA, 19 nt, Homo sapiens
aaagagaggugauguguug

SEQ ID NO: 1537698 - RNA, 19 nt, Homo sapiens
aagcagagauugagaauga

SEQ ID NO: 1537699 - RNA, 19 nt, Homo sapiens
ggaauaagauacagcaaca

SEQ ID NO: 1537700 - RNA, 19 nt, Homo sapiens
caacauacuuauccucuga

SEQ ID NO: 1537701 - RNA, 19 nt, Homo sapiens
ggacauacauucugcuaca

SEQ ID NO: 1537702 - RNA, 19 nt, Homo sapiens
cuucauagcugccacgaua

SEQ ID NO: 1537703 - RNA, 19 nt, Homo sapiens
guaaccaacuuugcuauuu

SEQ ID NO: 1537704 - RNA, 19 nt, Homo sapiens
aaacacaccuugacuuuag

SEQ ID NO: 1537705 - RNA, 19 nt, Homo sapiens
gugaacagcuuggcauuaa

SEQ ID NO: 1537706 - RNA, 19 nt, Homo sapiens
gagauuaguuguuucaagu

SEQ ID NO: 1537707 - RNA, 19 nt, Homo sapiens
gcgauuaaacgaaaugaua

SEQ ID NO: 1537708 - RNA, 19 nt, Homo sapiens
gaacuccugcuuauuauga

SEQ ID NO: 1537709 - RNA, 19 nt, Homo sapiens
caacagcacuggacaagag

SEQ ID NO: 1537710 - RNA, 19 nt, Homo sapiens
gcaugucacugauuauuuc

SEQ ID NO: 1537711 - RNA, 19 nt, Homo sapiens
gauuguccguuuauguuua

SEQ ID NO: 1537712 - RNA, 19 nt, Homo sapiens
caacgaaacaccuuugauu

SEQ ID NO: 1537713 - RNA, 19 nt, Homo sapiens
auacaucacugucuguuaa

SEQ ID NO: 1537714 - RNA, 19 nt, Homo sapiens
gaaacaccuuugauuaaca

SEQ ID NO: 1537715 - RNA, 19 nt, Homo sapiens
agaaugaaguggaugauga

SEQ ID NO: 1537716 - RNA, 19 nt, Homo sapiens
guauauuacuguuguguga

SEQ ID NO: 1537717 - RNA, 19 nt, Homo sapiens
ccacuaaccuuugugaguu

SEQ ID NO: 1537718 - RNA, 19 nt, Homo sapiens
gaggugauguguugcuaaa

SEQ ID NO: 1537719 - RNA, 19 nt, Homo sapiens
gagccacucugcacuaguu

SEQ ID NO: 1537720 - RNA, 19 nt, Homo sapiens
ugaaguggaugaugaccua

SEQ ID NO: 1537721 - RNA, 19 nt, Homo sapiens
acaagugaccucuguaaua

SEQ ID NO: 1537722 - RNA, 19 nt, Homo sapiens
gaagaaauaagucugacaa

SEQ ID NO: 1537723 - RNA, 19 nt, Homo sapiens
gaagagaaccacaccaauc

SEQ ID NO: 1537724 - RNA, 19 nt, Homo sapiens
acaaauauccugacugcua

SEQ ID NO: 1537725 - RNA, 19 nt, Homo sapiens
gaucuuacucaguguguua

SEQ ID NO: 1537726 - RNA, 19 nt, Homo sapiens
uguagcaugucacugauua

SEQ ID NO: 1537727 - RNA, 19 nt, Homo sapiens
uaaccaauaccaugaauga

SEQ ID NO: 1537728 - RNA, 19 nt, Homo sapiens
ggagcuugcugcccagauu

SEQ ID NO: 1537729 - RNA, 19 nt, Homo sapiens
cauugaaccugguggcaua

SEQ ID NO: 1537730 - RNA, 19 nt, Homo sapiens
ccucugaacacauaaauaa

SEQ ID NO: 1537731 - RNA, 19 nt, Homo sapiens
uuagaaaccuaguucagaa

SEQ ID NO: 1537732 - RNA, 19 nt, Homo sapiens
cuacuguaaucucucaaua

SEQ ID NO: 1537733 - RNA, 19 nt, Homo sapiens
gaauucagacuuaguuguu

SEQ ID NO: 1537734 - RNA, 19 nt, Homo sapiens
gaaacagucuuccacuaac

SEQ ID NO: 1537735 - RNA, 19 nt, Homo sapiens
gaacagcuuggcauuaaau

SEQ ID NO: 1537736 - RNA, 19 nt, Homo sapiens
ccacuuaguuuaccagaag

SEQ ID NO: 1537737 - RNA, 19 nt, Homo sapiens
uaugaagcaugaccacuuu

SEQ ID NO: 1537738 - RNA, 19 nt, Homo sapiens
guagggaaauuuugaagua

SEQ ID NO: 1537739 - RNA, 19 nt, Homo sapiens
uuucaaaucuugcaucuuc

SEQ ID NO: 1537740 - RNA, 19 nt, Homo sapiens
cgagauggcagaauaaaga

SEQ ID NO: 1537741 - RNA, 19 nt, Homo sapiens
ucagcaaugugucccauaa

SEQ ID NO: 1537742 - RNA, 19 nt, Homo sapiens
gugaugagauggugucugu

SEQ ID NO: 1537743 - RNA, 19 nt, Homo sapiens
gaacagcccaaaagcauua

SEQ ID NO: 1537744 - RNA, 19 nt, Homo sapiens
gaaccugguggcauaauga

SEQ ID NO: 1537745 - RNA, 19 nt, Homo sapiens
cagagaauguauuucagaa

SEQ ID NO: 1537746 - RNA, 19 nt, Homo sapiens
ugggaacuccugcuuauua

SEQ ID NO: 1537747 - RNA, 19 nt, Homo sapiens
gaacaacaagugaugagau

SEQ ID NO: 1537748 - RNA, 19 nt, Homo sapiens
ugacugcuacuuuguuaua

SEQ ID NO: 1537749 - RNA, 19 nt, Homo sapiens
guaggaguauuucuugugu

SEQ ID NO: 1537750 - RNA, 19 nt, Homo sapiens
gggaacuccugcuuauuau

SEQ ID NO: 1537751 - RNA, 19 nt, Homo sapiens
gcacgagauggcagaauaa

SEQ ID NO: 1537752 - RNA, 19 nt, Homo sapiens
gcaacacacugcaucuuac

SEQ ID NO: 1537753 - RNA, 19 nt, Homo sapiens
gucaacaacuacaauauca

SEQ ID NO: 1537754 - RNA, 19 nt, Homo sapiens
ggaagcaguuugauuuuga

SEQ ID NO: 1537755 - RNA, 19 nt, Homo sapiens
uaagauacagcaacaauca

SEQ ID NO: 1537756 - RNA, 19 nt, Homo sapiens
guggaagucuaacacauga

SEQ ID NO: 1537757 - RNA, 19 nt, Homo sapiens
gagaagagauuuuccaagu

SEQ ID NO: 1537758 - RNA, 19 nt, Homo sapiens
cagcgucucuuuccacaug

SEQ ID NO: 1537759 - RNA, 19 nt, Homo sapiens
ccugacugcuacuuuguua

SEQ ID NO: 1537760 - RNA, 19 nt, Homo sapiens
agaccaagcucacauaagg

SEQ ID NO: 1537761 - RNA, 19 nt, Homo sapiens
acacaccaccaccguauua

SEQ ID NO: 1537762 - RNA, 19 nt, Homo sapiens
gcaaugugucccauaacua

SEQ ID NO: 1537763 - RNA, 19 nt, Homo sapiens
caacuacaauaucagcaau

SEQ ID NO: 1537764 - RNA, 19 nt, Homo sapiens
agccauccaucaacaaaua

SEQ ID NO: 1537765 - RNA, 19 nt, Homo sapiens
aaucauugcuacugacuug

SEQ ID NO: 1537766 - RNA, 19 nt, Homo sapiens
gaaauaagucugacaacac

SEQ ID NO: 1537767 - RNA, 19 nt, Homo sapiens
gcaaagcucacccaaacug

SEQ ID NO: 1537768 - RNA, 19 nt, Homo sapiens
aaaguguggugacaugauu

SEQ ID NO: 1537769 - RNA, 19 nt, Homo sapiens
uaaagaaggaaccacauga

SEQ ID NO: 1537770 - RNA, 19 nt, Homo sapiens
guucugugccuucaguuua

SEQ ID NO: 1537771 - RNA, 19 nt, Homo sapiens
aagcaugaccacuuuauuu

SEQ ID NO: 1537772 - RNA, 19 nt, Homo sapiens
cuuauccucugaacacaua

SEQ ID NO: 1537773 - RNA, 19 nt, Homo sapiens
aaucuuggcuagaaauguu

SEQ ID NO: 1537774 - RNA, 19 nt, Homo sapiens
cacaacagccacuuaguuu

SEQ ID NO: 1537775 - RNA, 19 nt, Homo sapiens
ugcaagaagucuaguauuc

SEQ ID NO: 1537776 - RNA, 19 nt, Homo sapiens
gaagcaugaccacuuuauu

SEQ ID NO: 1537777 - RNA, 19 nt, Homo sapiens
gaugaagaaauaagucuga

SEQ ID NO: 1537778 - RNA, 19 nt, Homo sapiens
guggugagcugcccaucuu

SEQ ID NO: 1537779 - RNA, 19 nt, Homo sapiens
gauacaucacugucuguua

SEQ ID NO: 1537780 - RNA, 19 nt, Homo sapiens
ugacggaaacuuguucaua

SEQ ID NO: 1537781 - RNA, 19 nt, Homo sapiens
ugagcaaauuuacaaguga

SEQ ID NO: 1537782 - RNA, 19 nt, Homo sapiens
gaugguaaagcugcacuua

SEQ ID NO: 1537783 - RNA, 19 nt, Homo sapiens
ccaaagugcugggauuaca

SEQ ID NO: 1537784 - RNA, 19 nt, Homo sapiens
gagcagaggaacaaaguca

SEQ ID NO: 1537785 - RNA, 19 nt, Homo sapiens
gagcugcccaucuuuguga

SEQ ID NO: 1537786 - RNA, 19 nt, Homo sapiens
gaacacgccuuuccugaag

SEQ ID NO: 1537787 - RNA, 19 nt, Homo sapiens
gcacggcccugcaauaugg

SEQ ID NO: 1537788 - RNA, 19 nt, Homo sapiens
gcaccucucuggagcuaug

SEQ ID NO: 1537789 - RNA, 19 nt, Homo sapiens
gcucuaaaguuccuauagu

SEQ ID NO: 1537790 - RNA, 19 nt, Homo sapiens
gauacuggcuaaacuacga

SEQ ID NO: 1537791 - RNA, 19 nt, Homo sapiens
ggaagaaccggaagaaggu

SEQ ID NO: 1537792 - RNA, 19 nt, Homo sapiens
cgaggcaggugaugaagga

SEQ ID NO: 1537793 - RNA, 19 nt, Homo sapiens
uugcaaggcucuaaaguuc

SEQ ID NO: 1537794 - RNA, 19 nt, Homo sapiens
ccucaucaccuuccucuuu

SEQ ID NO: 1537795 - RNA, 19 nt, Homo sapiens
gggagagguucaagucaga

SEQ ID NO: 1537796 - RNA, 19 nt, Homo sapiens
ccauccagauccaacuaua

SEQ ID NO: 1537797 - RNA, 19 nt, Homo sapiens
gcaccaacacugcagaaga

SEQ ID NO: 1537798 - RNA, 19 nt, Homo sapiens
gcccugcccucauugcaaa

SEQ ID NO: 1537799 - RNA, 19 nt, Homo sapiens
acaaucgccugguggguuu

SEQ ID NO: 1537800 - RNA, 19 nt, Homo sapiens
uugcagagauacuggcuaa

SEQ ID NO: 1537801 - RNA, 19 nt, Homo sapiens
uuccuggccuucaccauua

SEQ ID NO: 1537802 - RNA, 19 nt, Homo sapiens
ccacuccgcaucucaagaa

SEQ ID NO: 1537803 - RNA, 19 nt, Homo sapiens
guacgacaucuucaacuug

SEQ ID NO: 1537804 - RNA, 19 nt, Homo sapiens
ugaaggcuuugguccagaa

SEQ ID NO: 1537805 - RNA, 19 nt, Homo sapiens
gguccaagaguccacguaa

SEQ ID NO: 1537806 - RNA, 19 nt, Homo sapiens
gugaagggacaaccaugua

SEQ ID NO: 1537807 - RNA, 19 nt, Homo sapiens
gcaaggcucuaaaguuccu

SEQ ID NO: 1537808 - RNA, 19 nt, Homo sapiens
gagaggaugggaccagguu

SEQ ID NO: 1537809 - RNA, 19 nt, Homo sapiens
gucuacaucuuugcacuuu

SEQ ID NO: 1537810 - RNA, 19 nt, Homo sapiens
ccauguacgcccucuauau

SEQ ID NO: 1537811 - RNA, 19 nt, Homo sapiens
caacagcuacggccucuac

SEQ ID NO: 1537812 - RNA, 19 nt, Homo sapiens
gcagagauacuggcuaaac

SEQ ID NO: 1537813 - RNA, 19 nt, Homo sapiens
ccuucaccauuauucuuua

SEQ ID NO: 1537814 - RNA, 19 nt, Homo sapiens
gacccucaccuguguauuc

SEQ ID NO: 1537815 - RNA, 19 nt, Homo sapiens
uguacgacaucuucaacuu

SEQ ID NO: 1537816 - RNA, 19 nt, Homo sapiens
ucacuggccucccacaacu

SEQ ID NO: 1537817 - RNA, 19 nt, Homo sapiens
gcuacuuccucaucaccuu

SEQ ID NO: 1537818 - RNA, 19 nt, Homo sapiens
caccaacacugcagaagac

SEQ ID NO: 1537819 - RNA, 19 nt, Homo sapiens
cagagauacuggcuaaacu

SEQ ID NO: 1537820 - RNA, 19 nt, Homo sapiens
ugaacacgccuuuccugaa

SEQ ID NO: 1537821 - RNA, 19 nt, Homo sapiens
ucaguuuccuucucuguac

SEQ ID NO: 1537822 - RNA, 19 nt, Homo sapiens
gcuuugugcuucaccaagu

SEQ ID NO: 1537823 - RNA, 19 nt, Homo sapiens
cgacuucccaagagccuuu

SEQ ID NO: 1537824 - RNA, 19 nt, Homo sapiens
uggaaaacuugcagagaua

SEQ ID NO: 1537825 - RNA, 19 nt, Homo sapiens
agagauacuggcuaaacua

SEQ ID NO: 1537826 - RNA, 19 nt, Homo sapiens
uccaugcccugcccucauu

SEQ ID NO: 1537827 - RNA, 19 nt, Homo sapiens
uggcauagcccuggaagga

SEQ ID NO: 1537828 - RNA, 19 nt, Homo sapiens
cuccgcaucucaagaauag

SEQ ID NO: 1537829 - RNA, 19 nt, Homo sapiens
cauguacgcccucuauauc

SEQ ID NO: 1537830 - RNA, 19 nt, Homo sapiens
gcuacggccucuacaccau

SEQ ID NO: 1537831 - RNA, 19 nt, Homo sapiens
uuccuucucuguacaaugu

SEQ ID NO: 1537832 - RNA, 19 nt, Homo sapiens
ucucuguacucccucaguu

SEQ ID NO: 1537833 - RNA, 19 nt, Homo sapiens
ccaccgaagggccaagaaa

SEQ ID NO: 1537834 - RNA, 19 nt, Homo sapiens
acaugacccucaccugugu

SEQ ID NO: 1537835 - RNA, 19 nt, Homo sapiens
ccgcuuggccgucaccauu

SEQ ID NO: 1537836 - RNA, 19 nt, Homo sapiens
ggagcaacaacauguacga

SEQ ID NO: 1537837 - RNA, 19 nt, Homo sapiens
ucaccuggaugggccuuga

SEQ ID NO: 1537838 - RNA, 19 nt, Homo sapiens
ucagaggucccauccagau

SEQ ID NO: 1537839 - RNA, 19 nt, Homo sapiens
cucaucaccuuccucuuug

SEQ ID NO: 1537840 - RNA, 19 nt, Homo sapiens
ccgcaccucucuggagcua

SEQ ID NO: 1537841 - RNA, 19 nt, Homo sapiens
gggcugucuuccacuacuu

SEQ ID NO: 1537842 - RNA, 19 nt, Homo sapiens
ucaccauucuggacauugg

SEQ ID NO: 1537843 - RNA, 19 nt, Homo sapiens
gagugcgacuucccaagag

SEQ ID NO: 1537844 - RNA, 19 nt, Homo sapiens
gagauacuggcuaaacuac

SEQ ID NO: 1537845 - RNA, 19 nt, Homo sapiens
gcucuggcucucuguguga

SEQ ID NO: 1537846 - RNA, 19 nt, Homo sapiens
gccuucaccauuauucuuu

SEQ ID NO: 1537847 - RNA, 19 nt, Homo sapiens
cuccgugccucucucugua

SEQ ID NO: 1537848 - RNA, 19 nt, Homo sapiens
guggaaaacuugcagagau

SEQ ID NO: 1537849 - RNA, 19 nt, Homo sapiens
ucaccauuauucuuuaugc

SEQ ID NO: 1537850 - RNA, 19 nt, Homo sapiens
gcaagggaggagagucugu

SEQ ID NO: 1537851 - RNA, 19 nt, Homo sapiens
cagcgacuccugcaaugug

SEQ ID NO: 1537852 - RNA, 19 nt, Homo sapiens
gaaggcacggcccugcaau

SEQ ID NO: 1537853 - RNA, 19 nt, Homo sapiens
caagucagagcaccacagu

SEQ ID NO: 1537854 - RNA, 19 nt, Homo sapiens
aggaagguuugacgcagaa

SEQ ID NO: 1537855 - RNA, 19 nt, Homo sapiens
gagguucaagucagaagau

SEQ ID NO: 1537856 - RNA, 19 nt, Homo sapiens
gcugugaccaccugaccuu

SEQ ID NO: 1537857 - RNA, 19 nt, Homo sapiens
agagucuguugcuggcaua

SEQ ID NO: 1537858 - RNA, 19 nt, Homo sapiens
cacguaagcagguuugcaa

SEQ ID NO: 1537859 - RNA, 19 nt, Homo sapiens
ccacggcuacuuccucauc

SEQ ID NO: 1537860 - RNA, 19 nt, Homo sapiens
cuacuucgggcacuacuuc

SEQ ID NO: 1537861 - RNA, 19 nt, Homo sapiens
ggucuucaacaccuacuuc

SEQ ID NO: 1537862 - RNA, 19 nt, Homo sapiens
ucagggucuucaacaccua

SEQ ID NO: 1537863 - RNA, 19 nt, Homo sapiens
gauggcagcggcguguuga

SEQ ID NO: 1537864 - RNA, 19 nt, Homo sapiens
gaugaaggacgaggacaag

SEQ ID NO: 1537865 - RNA, 19 nt, Homo sapiens
caagggaggagagucuguu

SEQ ID NO: 1537866 - RNA, 19 nt, Homo sapiens
uccuuuaccucccaaguca

SEQ ID NO: 1537867 - RNA, 19 nt, Homo sapiens
ucugggaugugacuaaagg

SEQ ID NO: 1537868 - RNA, 19 nt, Homo sapiens
agagugcgacuucccaaga

SEQ ID NO: 1537869 - RNA, 19 nt, Homo sapiens
cuugcaaggugucuucauc

SEQ ID NO: 1537870 - RNA, 19 nt, Homo sapiens
acaccuacuucgggcacua

SEQ ID NO: 1537871 - RNA, 19 nt, Homo sapiens
gaccaguccacggugcaua

SEQ ID NO: 1537872 - RNA, 19 nt, Homo sapiens
guccaagaguccacguaag

SEQ ID NO: 1537873 - RNA, 19 nt, Homo sapiens
gcuccgugccucucucugu

SEQ ID NO: 1537874 - RNA, 19 nt, Homo sapiens
ccgcaucucaagaauagga

SEQ ID NO: 1537875 - RNA, 19 nt, Homo sapiens
agucagagcaccacagucu

SEQ ID NO: 1537876 - RNA, 19 nt, Homo sapiens
ggagagguucaagucagaa

SEQ ID NO: 1537877 - RNA, 19 nt, Homo sapiens
ggccuucaccauuauucuu

SEQ ID NO: 1537878 - RNA, 19 nt, Homo sapiens
gaucugcacugcuauauau

SEQ ID NO: 1537879 - RNA, 19 nt, Homo sapiens
caucagaacugguauguga

SEQ ID NO: 1537880 - RNA, 19 nt, Homo sapiens
gaacuuugaugcuuuaaca

SEQ ID NO: 1537881 - RNA, 19 nt, Homo sapiens
guugugaacucauaacaua

SEQ ID NO: 1537882 - RNA, 19 nt, Homo sapiens
ccaaagauaugaagcucua

SEQ ID NO: 1537883 - RNA, 19 nt, Homo sapiens
gaaccgauacuucuuacua

SEQ ID NO: 1537884 - RNA, 19 nt, Homo sapiens
agacauaccuggaaagaau

SEQ ID NO: 1537885 - RNA, 19 nt, Homo sapiens
gccugaaucucaagaguua

SEQ ID NO: 1537886 - RNA, 19 nt, Homo sapiens
gaacagaagcuuccacaca

SEQ ID NO: 1537887 - RNA, 19 nt, Homo sapiens
gaaugcagcgggaugcuua

SEQ ID NO: 1537888 - RNA, 19 nt, Homo sapiens
ggaaggagcacucuuaugg

SEQ ID NO: 1537889 - RNA, 19 nt, Homo sapiens
guucagagccauugacuuu

SEQ ID NO: 1537890 - RNA, 19 nt, Homo sapiens
ugagagaaguagauugaaa

SEQ ID NO: 1537891 - RNA, 19 nt, Homo sapiens
agaagaagauggagcaguu

SEQ ID NO: 1537892 - RNA, 19 nt, Homo sapiens
guaguuuacuuaggugaua

SEQ ID NO: 1537893 - RNA, 19 nt, Homo sapiens
gccauugacuuugaucaua

SEQ ID NO: 1537894 - RNA, 19 nt, Homo sapiens
ccauugacuuugaucauaa

SEQ ID NO: 1537895 - RNA, 19 nt, Homo sapiens
gcaacugacuccuuggaau

SEQ ID NO: 1537896 - RNA, 19 nt, Homo sapiens
gauagcagccugaaucuca

SEQ ID NO: 1537897 - RNA, 19 nt, Homo sapiens
ggcagaaucccaggaauua

SEQ ID NO: 1537898 - RNA, 19 nt, Homo sapiens
ccaggaaggagcacucuua

SEQ ID NO: 1537899 - RNA, 19 nt, Homo sapiens
gaacugguaugugauugau

SEQ ID NO: 1537900 - RNA, 19 nt, Homo sapiens
ucagagccauugacuuuga

SEQ ID NO: 1537901 - RNA, 19 nt, Homo sapiens
gugccaagaugaccagaaa

SEQ ID NO: 1537902 - RNA, 19 nt, Homo sapiens
aaggagaucugcacugcua

SEQ ID NO: 1537903 - RNA, 19 nt, Homo sapiens
caacuucucuaauuaaagc

SEQ ID NO: 1537904 - RNA, 19 nt, Homo sapiens
guacgugccucccuuagca

SEQ ID NO: 1537905 - RNA, 19 nt, Homo sapiens
ccaauuaauggguaguuua

SEQ ID NO: 1537906 - RNA, 19 nt, Homo sapiens
gguaugugauugauggauu

SEQ ID NO: 1537907 - RNA, 19 nt, Homo sapiens
ucucaagaguuaucugaaa

SEQ ID NO: 1537908 - RNA, 19 nt, Homo sapiens
caaagcauuuaaucccaaa

SEQ ID NO: 1537909 - RNA, 19 nt, Homo sapiens
guaugugauugauggauuu

SEQ ID NO: 1537910 - RNA, 19 nt, Homo sapiens
ugaggucgccacugaaaua

SEQ ID NO: 1537911 - RNA, 19 nt, Homo sapiens
caacugacuccuuggaauu

SEQ ID NO: 1537912 - RNA, 19 nt, Homo sapiens
ggauggaaaccaaagauau

SEQ ID NO: 1537913 - RNA, 19 nt, Homo sapiens
gcaaaugguggguauggaa

SEQ ID NO: 1537914 - RNA, 19 nt, Homo sapiens
ccugaacuuugaugcuuua

SEQ ID NO: 1537915 - RNA, 19 nt, Homo sapiens
ggagaucugcacugcuaua

SEQ ID NO: 1537916 - RNA, 19 nt, Homo sapiens
gagauuaggcaauauuauc

SEQ ID NO: 1537917 - RNA, 19 nt, Homo sapiens
ugaaagugauagagggaaa

SEQ ID NO: 1537918 - RNA, 19 nt, Homo sapiens
gcaauauuaucaagaacag

SEQ ID NO: 1537919 - RNA, 19 nt, Homo sapiens
ggaauuugcagcagaguuc

SEQ ID NO: 1537920 - RNA, 19 nt, Homo sapiens
gagggaaacugagagaagu

SEQ ID NO: 1537921 - RNA, 19 nt, Homo sapiens
aacagaagcuuccacacaa

SEQ ID NO: 1537922 - RNA, 19 nt, Homo sapiens
gauggaaaccaaagauaug

SEQ ID NO: 1537923 - RNA, 19 nt, Homo sapiens
gaagauggagcaguuuaug

SEQ ID NO: 1537924 - RNA, 19 nt, Homo sapiens
gaaaagucagucucuguua

SEQ ID NO: 1537925 - RNA, 19 nt, Homo sapiens
aaggagcacucuuauggaa

SEQ ID NO: 1537926 - RNA, 19 nt, Homo sapiens
agaguuaucugaaagugau

SEQ ID NO: 1537927 - RNA, 19 nt, Homo sapiens
ucagaaauauagacccaau

SEQ ID NO: 1537928 - RNA, 19 nt, Homo sapiens
cagaaucccaggaauuauu

SEQ ID NO: 1537929 - RNA, 19 nt, Homo sapiens
ggagcacucuuauggaaac

SEQ ID NO: 1537930 - RNA, 19 nt, Homo sapiens
gaacaggguauugcaacuu

SEQ ID NO: 1537931 - RNA, 19 nt, Homo sapiens
gcauugacaaguuauguau

SEQ ID NO: 1537932 - RNA, 19 nt, Homo sapiens
gaacuuugugaacauaaga

SEQ ID NO: 1537933 - RNA, 19 nt, Homo sapiens
gaaggagcacucuuaugga

SEQ ID NO: 1537934 - RNA, 19 nt, Homo sapiens
uauagcacuucaucucaaa

SEQ ID NO: 1537935 - RNA, 19 nt, Homo sapiens
ggugauagcagccugaauc

SEQ ID NO: 1537936 - RNA, 19 nt, Homo sapiens
gaagaagauggagcaguuu

SEQ ID NO: 1537937 - RNA, 19 nt, Homo sapiens
gcagacauaccuggaaaga

SEQ ID NO: 1537938 - RNA, 19 nt, Homo sapiens
gguauugcaacuucucuaa

SEQ ID NO: 1537939 - RNA, 19 nt, Homo sapiens
gaaauacugggaacagaag

SEQ ID NO: 1537940 - RNA, 19 nt, Homo sapiens
caagaguuaucugaaagug

SEQ ID NO: 1537941 - RNA, 19 nt, Homo sapiens
ucccaaagguuccgaauac

SEQ ID NO: 1537942 - RNA, 19 nt, Homo sapiens
ggucgccacugaaauacug

SEQ ID NO: 1537943 - RNA, 19 nt, Homo sapiens
cuauaaggauggaaaccaa

SEQ ID NO: 1537944 - RNA, 19 nt, Homo sapiens
ggagaacccagaauuguac

SEQ ID NO: 1537945 - RNA, 19 nt, Homo sapiens
ucccaggaauuauuugauu

SEQ ID NO: 1537946 - RNA, 19 nt, Homo sapiens
gaaacugagagaaguagau

SEQ ID NO: 1537947 - RNA, 19 nt, Homo sapiens
gcucuuugccugaacuuug

SEQ ID NO: 1537948 - RNA, 19 nt, Homo sapiens
gcacucuuauggaaacaag

SEQ ID NO: 1537949 - RNA, 19 nt, Homo sapiens
gugagauuaggcaauauua

SEQ ID NO: 1537950 - RNA, 19 nt, Homo sapiens
gcauuuaaucccaaagguu

SEQ ID NO: 1537951 - RNA, 19 nt, Homo sapiens
ggaacaggguauugcaacu

SEQ ID NO: 1537952 - RNA, 19 nt, Homo sapiens
ggagucgauucccuaagug

SEQ ID NO: 1537953 - RNA, 19 nt, Homo sapiens
uuggugagauuaggcaaua

SEQ ID NO: 1537954 - RNA, 19 nt, Homo sapiens
aaagucagucucuguuaaa

SEQ ID NO: 1537955 - RNA, 19 nt, Homo sapiens
caaagguuccgaauacaca

SEQ ID NO: 1537956 - RNA, 19 nt, Homo sapiens
ugauggauuucacagcaaa

SEQ ID NO: 1537957 - RNA, 19 nt, Homo sapiens
ugccugcauugacaaguua

SEQ ID NO: 1537958 - RNA, 19 nt, Homo sapiens
gacauaccuggaaagaaua

SEQ ID NO: 1537959 - RNA, 19 nt, Homo sapiens
ugaaauacugggaacagaa

SEQ ID NO: 1537960 - RNA, 19 nt, Homo sapiens
ugggagaauuugaacaguu

SEQ ID NO: 1537961 - RNA, 19 nt, Homo sapiens
aaaagucagucucuguuaa

SEQ ID NO: 1537962 - RNA, 19 nt, Homo sapiens
gaauaaauacaugcagaca

SEQ ID NO: 1537963 - RNA, 19 nt, Homo sapiens
ggugagauuaggcaauauu

SEQ ID NO: 1537964 - RNA, 19 nt, Homo sapiens
aagaagauggagcaguuua

SEQ ID NO: 1537965 - RNA, 19 nt, Homo sapiens
ggaaaccaaagauaugaag

SEQ ID NO: 1537966 - RNA, 19 nt, Homo sapiens
gccugaacuuugaugcuuu

SEQ ID NO: 1537967 - RNA, 19 nt, Homo sapiens
guauugcucuuugccugaa

SEQ ID NO: 1537968 - RNA, 19 nt, Homo sapiens
aaagcugccugcauugaca

SEQ ID NO: 1537969 - RNA, 19 nt, Homo sapiens
uggagaacccagaauugua

SEQ ID NO: 1537970 - RNA, 19 nt, Homo sapiens
cacuucaucucaaagcauu

SEQ ID NO: 1537971 - RNA, 19 nt, Homo sapiens
uaagggaaccgauacuucu

SEQ ID NO: 1537972 - RNA, 19 nt, Homo sapiens
ugugaacuuugugaacaua

SEQ ID NO: 1537973 - RNA, 19 nt, Homo sapiens
guuagaaagcuuuaagaca

SEQ ID NO: 1537974 - RNA, 19 nt, Homo sapiens
gucagucucuguuaaaauu

SEQ ID NO: 1537975 - RNA, 19 nt, Homo sapiens
aaacugagagaaguagauu

SEQ ID NO: 1537976 - RNA, 19 nt, Homo sapiens
ucagaacugguaugugauu

SEQ ID NO: 1537977 - RNA, 19 nt, Homo sapiens
agaaucccaggaauuauuu

SEQ ID NO: 1537978 - RNA, 19 nt, Homo sapiens
gaagugagguugaguauau

SEQ ID NO: 1537979 - RNA, 19 nt, Homo sapiens
caagagcuauuucugauua

SEQ ID NO: 1537980 - RNA, 19 nt, Homo sapiens
gagaagagguggugguauu

SEQ ID NO: 1537981 - RNA, 19 nt, Homo sapiens
ccagagaaauuaaugcuaa

SEQ ID NO: 1537982 - RNA, 19 nt, Homo sapiens
gcaaauucuuucauccuuu

SEQ ID NO: 1537983 - RNA, 19 nt, Homo sapiens
gaagagagacaaggaauau

SEQ ID NO: 1537984 - RNA, 19 nt, Homo sapiens
caaugucuccuguagauua

SEQ ID NO: 1537985 - RNA, 19 nt, Homo sapiens
ggauucagcugccuagugu

SEQ ID NO: 1537986 - RNA, 19 nt, Homo sapiens
ggaagagagacaaggaaua

SEQ ID NO: 1537987 - RNA, 19 nt, Homo sapiens
gugcuucccugcuggauuu

SEQ ID NO: 1537988 - RNA, 19 nt, Homo sapiens
gaaccagcaucuacaccaa

SEQ ID NO: 1537989 - RNA, 19 nt, Homo sapiens
ggaaggagaggaagaacaa

SEQ ID NO: 1537990 - RNA, 19 nt, Homo sapiens
gaaaagagcccagcauauu

SEQ ID NO: 1537991 - RNA, 19 nt, Homo sapiens
gaaaggugguugaaauacu

SEQ ID NO: 1537992 - RNA, 19 nt, Homo sapiens
cauagaagaaucaccauuu

SEQ ID NO: 1537993 - RNA, 19 nt, Homo sapiens
ucacaacucucccuguuag

SEQ ID NO: 1537994 - RNA, 19 nt, Homo sapiens
guacauacgcaguguguga

SEQ ID NO: 1537995 - RNA, 19 nt, Homo sapiens
gacuucagcuauucucaaa

SEQ ID NO: 1537996 - RNA, 19 nt, Homo sapiens
ccacaagagcuauuucuga

SEQ ID NO: 1537997 - RNA, 19 nt, Homo sapiens
cuaaauaaauagcccuuuc

SEQ ID NO: 1537998 - RNA, 19 nt, Homo sapiens
ccaaauauaagaucaguuc

SEQ ID NO: 1537999 - RNA, 19 nt, Homo sapiens
gaaucaaggcauagaagaa

SEQ ID NO: 1538000 - RNA, 19 nt, Homo sapiens
cacaaugucuccuguagau

SEQ ID NO: 1538001 - RNA, 19 nt, Homo sapiens
guggagaaguuccuaaauc

SEQ ID NO: 1538002 - RNA, 19 nt, Homo sapiens
agagagacaaggaauauuu

SEQ ID NO: 1538003 - RNA, 19 nt, Homo sapiens
ccuaauacaugcgaaguga

SEQ ID NO: 1538004 - RNA, 19 nt, Homo sapiens
cacaagagcuauuucugau

SEQ ID NO: 1538005 - RNA, 19 nt, Homo sapiens
gagagcacuuggaaagaug

SEQ ID NO: 1538006 - RNA, 19 nt, Homo sapiens
gcaauuucaugucgucgau

SEQ ID NO: 1538007 - RNA, 19 nt, Homo sapiens
ggagauguuugagagaguu

SEQ ID NO: 1538008 - RNA, 19 nt, Homo sapiens
ugacauuguuccaaaguuc

SEQ ID NO: 1538009 - RNA, 19 nt, Homo sapiens
cagcuauucucaaagaguu

SEQ ID NO: 1538010 - RNA, 19 nt, Homo sapiens
cgcagugugugaccaaaua

SEQ ID NO: 1538011 - RNA, 19 nt, Homo sapiens
ugcuugcgguuuaauauua

SEQ ID NO: 1538012 - RNA, 19 nt, Homo sapiens
aaaggugguugaaauacuu

SEQ ID NO: 1538013 - RNA, 19 nt, Homo sapiens
ccauagacccuaauacaug

SEQ ID NO: 1538014 - RNA, 19 nt, Homo sapiens
ucaauuugcucugaaagga

SEQ ID NO: 1538015 - RNA, 19 nt, Homo sapiens
uuacuuccauguuguaugu

SEQ ID NO: 1538016 - RNA, 19 nt, Homo sapiens
uugagaagcuggccauaga

SEQ ID NO: 1538017 - RNA, 19 nt, Homo sapiens
ucaaccaucuggaaaucaa

SEQ ID NO: 1538018 - RNA, 19 nt, Homo sapiens
agagagaaaugucauguac

SEQ ID NO: 1538019 - RNA, 19 nt, Homo sapiens
ccaaaguucuuguggugau

SEQ ID NO: 1538020 - RNA, 19 nt, Homo sapiens
gaguuagucuuccuuugau

SEQ ID NO: 1538021 - RNA, 19 nt, Homo sapiens
acauugaacuggcccuaaa

SEQ ID NO: 1538022 - RNA, 19 nt, Homo sapiens
agaaaacucuguacugaaa

SEQ ID NO: 1538023 - RNA, 19 nt, Homo sapiens
uuaacagaaucaaggcaua

SEQ ID NO: 1538024 - RNA, 19 nt, Homo sapiens
cuucagcuauucucaaaga

SEQ ID NO: 1538025 - RNA, 19 nt, Homo sapiens
aaaucugccuccaaggaua

SEQ ID NO: 1538026 - RNA, 19 nt, Homo sapiens
caugcgaagugaacacaaa

SEQ ID NO: 1538027 - RNA, 19 nt, Homo sapiens
ucagaccaguagagaaauu

SEQ ID NO: 1538028 - RNA, 19 nt, Homo sapiens
gcagagcuauccaagucau

SEQ ID NO: 1538029 - RNA, 19 nt, Homo sapiens
ccucugucauuacuaaauu

SEQ ID NO: 1538030 - RNA, 19 nt, Homo sapiens
aacaagaucucacaacucu

SEQ ID NO: 1538031 - RNA, 19 nt, Homo sapiens
aauacugguuucacacuaa

SEQ ID NO: 1538032 - RNA, 19 nt, Homo sapiens
gcacuauuguuuucucgua

SEQ ID NO: 1538033 - RNA, 19 nt, Homo sapiens
ugagagcacuuggaaagau

SEQ ID NO: 1538034 - RNA, 19 nt, Homo sapiens
ggaccauggugucacuugu

SEQ ID NO: 1538035 - RNA, 19 nt, Homo sapiens
gagccaaccacaagagcua

SEQ ID NO: 1538036 - RNA, 19 nt, Homo sapiens
cuggaaaggugguugaaau

SEQ ID NO: 1538037 - RNA, 19 nt, Homo sapiens
gugauuugauggugaacuu

SEQ ID NO: 1538038 - RNA, 19 nt, Homo sapiens
gagagugccuagggaaauc

SEQ ID NO: 1538039 - RNA, 19 nt, Homo sapiens
uauaauagccaccucaaag

SEQ ID NO: 1538040 - RNA, 19 nt, Homo sapiens
gaauuugucacccgccauu

SEQ ID NO: 1538041 - RNA, 19 nt, Homo sapiens
gaccaaauauaagaucagu

SEQ ID NO: 1538042 - RNA, 19 nt, Homo sapiens
ucucacaacucucccuguu

SEQ ID NO: 1538043 - RNA, 19 nt, Homo sapiens
aggcagagcuauccaaguc

SEQ ID NO: 1538044 - RNA, 19 nt, Homo sapiens
uauccugucuagugauuug

SEQ ID NO: 1538045 - RNA, 19 nt, Homo sapiens
cauaugagagcacuuggaa

SEQ ID NO: 1538046 - RNA, 19 nt, Homo sapiens
gaagcuguuuacgugcaua

SEQ ID NO: 1538047 - RNA, 19 nt, Homo sapiens
gaccauggugucacuugua

SEQ ID NO: 1538048 - RNA, 19 nt, Homo sapiens
cugaauuggugccaugaaa

SEQ ID NO: 1538049 - RNA, 19 nt, Homo sapiens
gaaguagaggauccaguga

SEQ ID NO: 1538050 - RNA, 19 nt, Homo sapiens
ggccauagacccuaauaca

SEQ ID NO: 1538051 - RNA, 19 nt, Homo sapiens
gaacuggcccuaaaauaau

SEQ ID NO: 1538052 - RNA, 19 nt, Homo sapiens
gcaguaagaaccagcaucu

SEQ ID NO: 1538053 - RNA, 19 nt, Homo sapiens
uaaauuggugccucgcuaa

SEQ ID NO: 1538054 - RNA, 19 nt, Homo sapiens
uaauagccaccucaaagaa

SEQ ID NO: 1538055 - RNA, 19 nt, Homo sapiens
aaauacugguuucacacua

SEQ ID NO: 1538056 - RNA, 19 nt, Homo sapiens
caaaguucuuguggugauu

SEQ ID NO: 1538057 - RNA, 19 nt, Homo sapiens
uggagaaguuccuaaaucu

SEQ ID NO: 1538058 - RNA, 19 nt, Homo sapiens
uggaaaggugguugaaaua

SEQ ID NO: 1538059 - RNA, 19 nt, Homo sapiens
guaagaaccagcaucuaca

SEQ ID NO: 1538060 - RNA, 19 nt, Homo sapiens
gugccucgcuaacaucaga

SEQ ID NO: 1538061 - RNA, 19 nt, Homo sapiens
gcauagaagaaucaccauu

SEQ ID NO: 1538062 - RNA, 19 nt, Homo sapiens
uguaaauacugguuucaca

SEQ ID NO: 1538063 - RNA, 19 nt, Homo sapiens
agaguuagucuuccuuuga

SEQ ID NO: 1538064 - RNA, 19 nt, Homo sapiens
cuagugauuugauggugaa

SEQ ID NO: 1538065 - RNA, 19 nt, Homo sapiens
acucauccaucaaguuguu

SEQ ID NO: 1538066 - RNA, 19 nt, Homo sapiens
ggaaaucaaguauaauagc

SEQ ID NO: 1538067 - RNA, 19 nt, Homo sapiens
caucuggaaaucaaguaua

SEQ ID NO: 1538068 - RNA, 19 nt, Homo sapiens
gguuucacacuaaguaauu

SEQ ID NO: 1538069 - RNA, 19 nt, Homo sapiens
ggaaaggugguugaaauac

SEQ ID NO: 1538070 - RNA, 19 nt, Homo sapiens
agucagaccaguagagaaa

SEQ ID NO: 1538071 - RNA, 19 nt, Homo sapiens
aaucagagucagaccagua

SEQ ID NO: 1538072 - RNA, 19 nt, Homo sapiens
caacagagagaaaugucau

SEQ ID NO: 1538073 - RNA, 19 nt, Homo sapiens
aaugucuccuguagauuaa

SEQ ID NO: 1538074 - RNA, 19 nt, Homo sapiens
ugaacuggcccuaaaauaa

SEQ ID NO: 1538075 - RNA, 19 nt, Homo sapiens
gcuugcgguuuaauauuau

SEQ ID NO: 1538076 - RNA, 19 nt, Homo sapiens
cagcauauuuuaucacaga

SEQ ID NO: 1538077 - RNA, 19 nt, Homo sapiens
aauuugcucugaaaggauu

SEQ ID NO: 1538078 - RNA, 19 nt, Homo sapiens
gaaaggaacuucgucauga

SEQ ID NO: 1538079 - RNA, 19 nt, Homo sapiens
ucacuaagauggcagaaua

SEQ ID NO: 1538080 - RNA, 19 nt, Homo sapiens
gaacuggauuggcaucaua

SEQ ID NO: 1538081 - RNA, 19 nt, Homo sapiens
ccacaagacuucacaugua

SEQ ID NO: 1538082 - RNA, 19 nt, Homo sapiens
caaaugagauagaaacaug

SEQ ID NO: 1538083 - RNA, 19 nt, Homo sapiens
gcacacauaugcagggaaa

SEQ ID NO: 1538084 - RNA, 19 nt, Homo sapiens
cuaauuaccugcuuuguga

SEQ ID NO: 1538085 - RNA, 19 nt, Homo sapiens
gaggagggauccauacuug

SEQ ID NO: 1538086 - RNA, 19 nt, Homo sapiens
gcaaauaacgugugcauag

SEQ ID NO: 1538087 - RNA, 19 nt, Homo sapiens
gauuggcucuuaacacuuu

SEQ ID NO: 1538088 - RNA, 19 nt, Homo sapiens
gaauuacaaugaagccaaa

SEQ ID NO: 1538089 - RNA, 19 nt, Homo sapiens
ggagaucaauggacacaug

SEQ ID NO: 1538090 - RNA, 19 nt, Homo sapiens
uaacaaggcuauagaaagg

SEQ ID NO: 1538091 - RNA, 19 nt, Homo sapiens
ggauggaauucauuucauu

SEQ ID NO: 1538092 - RNA, 19 nt, Homo sapiens
ggaguuacuuggugugcua

SEQ ID NO: 1538093 - RNA, 19 nt, Homo sapiens
uggaauaucucaacuggaa

SEQ ID NO: 1538094 - RNA, 19 nt, Homo sapiens
ucaggaaucuuaagcaaau

SEQ ID NO: 1538095 - RNA, 19 nt, Homo sapiens
aauaugaccuacagaauga

SEQ ID NO: 1538096 - RNA, 19 nt, Homo sapiens
gaauaugaccuacagaaug

SEQ ID NO: 1538097 - RNA, 19 nt, Homo sapiens
caacaauucaacacucuua

SEQ ID NO: 1538098 - RNA, 19 nt, Homo sapiens
cacaagacuucacauguaa

SEQ ID NO: 1538099 - RNA, 19 nt, Homo sapiens
gcagaaauccugagugaca

SEQ ID NO: 1538100 - RNA, 19 nt, Homo sapiens
ugaaucaacugcagaaauc

SEQ ID NO: 1538101 - RNA, 19 nt, Homo sapiens
aauaagauguggauugcua

SEQ ID NO: 1538102 - RNA, 19 nt, Homo sapiens
uuaagagucugcuauguga

SEQ ID NO: 1538103 - RNA, 19 nt, Homo sapiens
gaauauauccucuuuccau

SEQ ID NO: 1538104 - RNA, 19 nt, Homo sapiens
caaggacacugauuugagu

SEQ ID NO: 1538105 - RNA, 19 nt, Homo sapiens
cacaaacucuuacaugaau

SEQ ID NO: 1538106 - RNA, 19 nt, Homo sapiens
cccaaaugcuauguuauua

SEQ ID NO: 1538107 - RNA, 19 nt, Homo sapiens
uaucuaugcuaccacauuu

SEQ ID NO: 1538108 - RNA, 19 nt, Homo sapiens
gaagccaaauucauuacau

SEQ ID NO: 1538109 - RNA, 19 nt, Homo sapiens
gaagaaaacuacaagaagu

SEQ ID NO: 1538110 - RNA, 19 nt, Homo sapiens
ggaacuucgucaugagaaa

SEQ ID NO: 1538111 - RNA, 19 nt, Homo sapiens
uggcaaaguuguaggguuu

SEQ ID NO: 1538112 - RNA, 19 nt, Homo sapiens
gagcggcaaugucacaaug

SEQ ID NO: 1538113 - RNA, 19 nt, Homo sapiens
agcaagagauuaacacaaa

SEQ ID NO: 1538114 - RNA, 19 nt, Homo sapiens
gcauccagguugucauuug

SEQ ID NO: 1538115 - RNA, 19 nt, Homo sapiens
cgaagucucugaaaauuuu

SEQ ID NO: 1538116 - RNA, 19 nt, Homo sapiens
guauucagcuugcaguguu

SEQ ID NO: 1538117 - RNA, 19 nt, Homo sapiens
gagccaggacucauucaua

SEQ ID NO: 1538118 - RNA, 19 nt, Homo sapiens
acaagcauuugcacacaua

SEQ ID NO: 1538119 - RNA, 19 nt, Homo sapiens
gcacaagcauuugcacaca

SEQ ID NO: 1538120 - RNA, 19 nt, Homo sapiens
cauuuggcaugcucauuua

SEQ ID NO: 1538121 - RNA, 19 nt, Homo sapiens
acacaucuguugcuaugaa

SEQ ID NO: 1538122 - RNA, 19 nt, Homo sapiens
gucacaaacucuuacauga

SEQ ID NO: 1538123 - RNA, 19 nt, Homo sapiens
uaucauaauuggagguuug

SEQ ID NO: 1538124 - RNA, 19 nt, Homo sapiens
gaucccaaauuacagaaau

SEQ ID NO: 1538125 - RNA, 19 nt, Homo sapiens
gauaauaccauugaaguca

SEQ ID NO: 1538126 - RNA, 19 nt, Homo sapiens
ugaaaucuaugacacuugu

SEQ ID NO: 1538127 - RNA, 19 nt, Homo sapiens
cagccuuucuuucagauaa

SEQ ID NO: 1538128 - RNA, 19 nt, Homo sapiens
ucuccaggauguugaauuu

SEQ ID NO: 1538129 - RNA, 19 nt, Homo sapiens
ucacauucaucccuaucua

SEQ ID NO: 1538130 - RNA, 19 nt, Homo sapiens
ggccuucauuugcuucaua

SEQ ID NO: 1538131 - RNA, 19 nt, Homo sapiens
uaaauaagauguggauugc

SEQ ID NO: 1538132 - RNA, 19 nt, Homo sapiens
uauggacgauuggcucuua

SEQ ID NO: 1538133 - RNA, 19 nt, Homo sapiens
cugcagaaauccugaguga

SEQ ID NO: 1538134 - RNA, 19 nt, Homo sapiens
acucugagguuucuuucua

SEQ ID NO: 1538135 - RNA, 19 nt, Homo sapiens
gcacgggcauccagguugu

SEQ ID NO: 1538136 - RNA, 19 nt, Homo sapiens
acagguggguuaugaauca

SEQ ID NO: 1538137 - RNA, 19 nt, Homo sapiens
ccaggaguguguuggcuuu

SEQ ID NO: 1538138 - RNA, 19 nt, Homo sapiens
ccaggacucauucauagua

SEQ ID NO: 1538139 - RNA, 19 nt, Homo sapiens
gugcauagccuucaaagag

SEQ ID NO: 1538140 - RNA, 19 nt, Homo sapiens
ggaguguguuggcuuugaa

SEQ ID NO: 1538141 - RNA, 19 nt, Homo sapiens
uauagaccgauccuuauua

SEQ ID NO: 1538142 - RNA, 19 nt, Homo sapiens
guucaggaaucuuaagcaa

SEQ ID NO: 1538143 - RNA, 19 nt, Homo sapiens
gaaaaugccacaaguguau

SEQ ID NO: 1538144 - RNA, 19 nt, Homo sapiens
guuguaggguuugccuuua

SEQ ID NO: 1538145 - RNA, 19 nt, Homo sapiens
ucaacugccaccaagauua

SEQ ID NO: 1538146 - RNA, 19 nt, Homo sapiens
aaccacagaugaugacuau

SEQ ID NO: 1538147 - RNA, 19 nt, Homo sapiens
agcaauggcucaccugauu

SEQ ID NO: 1538148 - RNA, 19 nt, Homo sapiens
ucaaacucuugccaugaua

SEQ ID NO: 1538149 - RNA, 19 nt, Homo sapiens
gcaagagauuaacacaaag

SEQ ID NO: 1538150 - RNA, 19 nt, Homo sapiens
gaccgauccuuauuaucuu

SEQ ID NO: 1538151 - RNA, 19 nt, Homo sapiens
gaauaucucaacuggaaug

SEQ ID NO: 1538152 - RNA, 19 nt, Homo sapiens
gaaguggaauaucucaacu

SEQ ID NO: 1538153 - RNA, 19 nt, Homo sapiens
acacuaaucagacagauau

SEQ ID NO: 1538154 - RNA, 19 nt, Homo sapiens
ucacaaacucuuacaugaa

SEQ ID NO: 1538155 - RNA, 19 nt, Homo sapiens
ccaccaagauuaccaccau

SEQ ID NO: 1538156 - RNA, 19 nt, Homo sapiens
ccagugacuuccaucaaau

SEQ ID NO: 1538157 - RNA, 19 nt, Homo sapiens
gcuaacaaggcuauagaaa

SEQ ID NO: 1538158 - RNA, 19 nt, Homo sapiens
gaguuuaagugugacuauu

SEQ ID NO: 1538159 - RNA, 19 nt, Homo sapiens
gagguuucuuucuaaauuc

SEQ ID NO: 1538160 - RNA, 19 nt, Homo sapiens
uguguuggcuuugaaauau

SEQ ID NO: 1538161 - RNA, 19 nt, Homo sapiens
cuuaggagaugccacauuc

SEQ ID NO: 1538162 - RNA, 19 nt, Homo sapiens
cuucauagcuuggaucaca

SEQ ID NO: 1538163 - RNA, 19 nt, Homo sapiens
ggagguuuguuugcuauuc

SEQ ID NO: 1538164 - RNA, 19 nt, Homo sapiens
uuucugaagugccucuaua

SEQ ID NO: 1538165 - RNA, 19 nt, Homo sapiens
gauuaagagucugcuaugu

SEQ ID NO: 1538166 - RNA, 19 nt, Homo sapiens
uacaagaagucaacacauc

SEQ ID NO: 1538167 - RNA, 19 nt, Homo sapiens
cccagugacuuccaucaaa

SEQ ID NO: 1538168 - RNA, 19 nt, Homo sapiens
gagaugaucaacaauucaa

SEQ ID NO: 1538169 - RNA, 19 nt, Homo sapiens
caugcucauuuacuucaua

SEQ ID NO: 1538170 - RNA, 19 nt, Homo sapiens
gagguuuguuugcuauuca

SEQ ID NO: 1538171 - RNA, 19 nt, Homo sapiens
ggacucauucauaguauuc

SEQ ID NO: 1538172 - RNA, 19 nt, Homo sapiens
ggauugcuagugauaauug

SEQ ID NO: 1538173 - RNA, 19 nt, Homo sapiens
agauguggauugcuaguga

SEQ ID NO: 1538174 - RNA, 19 nt, Homo sapiens
cauaauuggagguuuguuu

SEQ ID NO: 1538175 - RNA, 19 nt, Homo sapiens
cuaugacacuuguacagaa

SEQ ID NO: 1538176 - RNA, 19 nt, Homo sapiens
gagcagcauugcccugagu

SEQ ID NO: 1538177 - RNA, 19 nt, Homo sapiens
acuauggaauccuguauug

SEQ ID NO: 1538178 - RNA, 19 nt, Homo sapiens
agacagagaucaccuauuu

SEQ ID NO: 1538179 - RNA, 19 nt, Homo sapiens
gcaaauuguuuaccucuuu

SEQ ID NO: 1538180 - RNA, 19 nt, Homo sapiens
ucagaugucuucauucaua

SEQ ID NO: 1538181 - RNA, 19 nt, Homo sapiens
caacauaucaacagcaaua

SEQ ID NO: 1538182 - RNA, 19 nt, Homo sapiens
aggcaaagaugcagaguua

SEQ ID NO: 1538183 - RNA, 19 nt, Homo sapiens
gcagaugugugguucauug

SEQ ID NO: 1538184 - RNA, 19 nt, Homo sapiens
gaagugagagccauuguga

SEQ ID NO: 1538185 - RNA, 19 nt, Homo sapiens
cauaucagaugucuucauu

SEQ ID NO: 1538186 - RNA, 19 nt, Homo sapiens
acagauauguugcuacaaa

SEQ ID NO: 1538187 - RNA, 19 nt, Homo sapiens
gaacaucgccauccucaca

SEQ ID NO: 1538188 - RNA, 19 nt, Homo sapiens
gagaauucaugaagauguu

SEQ ID NO: 1538189 - RNA, 19 nt, Homo sapiens
gaucugucuuguguaauua

SEQ ID NO: 1538190 - RNA, 19 nt, Homo sapiens
uaucagaugucuucauuca

SEQ ID NO: 1538191 - RNA, 19 nt, Homo sapiens
cgccaugugugcauuguua

SEQ ID NO: 1538192 - RNA, 19 nt, Homo sapiens
gacagaaacagcagcuaua

SEQ ID NO: 1538193 - RNA, 19 nt, Homo sapiens
uaacuugacucucauccau

SEQ ID NO: 1538194 - RNA, 19 nt, Homo sapiens
caaaagacauggcacaaga

SEQ ID NO: 1538195 - RNA, 19 nt, Homo sapiens
ugagagaauucaugaagau

SEQ ID NO: 1538196 - RNA, 19 nt, Homo sapiens
gcuauauccugcuacauuc

SEQ ID NO: 1538197 - RNA, 19 nt, Homo sapiens
ggccugggcauuucuauuu

SEQ ID NO: 1538198 - RNA, 19 nt, Homo sapiens
gcaaagaugcagaguuaca

SEQ ID NO: 1538199 - RNA, 19 nt, Homo sapiens
ucaugaagauguucuguag

SEQ ID NO: 1538200 - RNA, 19 nt, Homo sapiens
ucccuggccuuccacauua

SEQ ID NO: 1538201 - RNA, 19 nt, Homo sapiens
caagcuguuugcaaaugua

SEQ ID NO: 1538202 - RNA, 19 nt, Homo sapiens
gcauugcauuuccaacuau

SEQ ID NO: 1538203 - RNA, 19 nt, Homo sapiens
gugcagcucuuacacaaca

SEQ ID NO: 1538204 - RNA, 19 nt, Homo sapiens
gcucaaugcauuccaggua

SEQ ID NO: 1538205 - RNA, 19 nt, Homo sapiens
ccaaggaacuuaaaagaau

SEQ ID NO: 1538206 - RNA, 19 nt, Homo sapiens
gagcccagccugugauuug

SEQ ID NO: 1538207 - RNA, 19 nt, Homo sapiens
caccauagccaaccacauu

SEQ ID NO: 1538208 - RNA, 19 nt, Homo sapiens
ucagcagucucccuggaua

SEQ ID NO: 1538209 - RNA, 19 nt, Homo sapiens
ugaggaggauucacguuug

SEQ ID NO: 1538210 - RNA, 19 nt, Homo sapiens
ucccaucucuuucuucuug

SEQ ID NO: 1538211 - RNA, 19 nt, Homo sapiens
gugagagaauucaugaaga

SEQ ID NO: 1538212 - RNA, 19 nt, Homo sapiens
ucagucaacuccuuugcaa

SEQ ID NO: 1538213 - RNA, 19 nt, Homo sapiens
uggaugggcugcaagcaaa

SEQ ID NO: 1538214 - RNA, 19 nt, Homo sapiens
ggacugaccuggggauuug

SEQ ID NO: 1538215 - RNA, 19 nt, Homo sapiens
ugagagccauugugagaau

SEQ ID NO: 1538216 - RNA, 19 nt, Homo sapiens
uaacauugcagccacuuug

SEQ ID NO: 1538217 - RNA, 19 nt, Homo sapiens
guuuaccucuuucucaauu

SEQ ID NO: 1538218 - RNA, 19 nt, Homo sapiens
gagugagucccaucucuuu

SEQ ID NO: 1538219 - RNA, 19 nt, Homo sapiens
ggucaucagcauugcauuu

SEQ ID NO: 1538220 - RNA, 19 nt, Homo sapiens
caggaaacauugccguaau

SEQ ID NO: 1538221 - RNA, 19 nt, Homo sapiens
caaauuguuuaccucuuuc

SEQ ID NO: 1538222 - RNA, 19 nt, Homo sapiens
aaacauugccguaauugug

SEQ ID NO: 1538223 - RNA, 19 nt, Homo sapiens
agaucugucuuguguaauu

SEQ ID NO: 1538224 - RNA, 19 nt, Homo sapiens
uuaaugcccucaacaucuu

SEQ ID NO: 1538225 - RNA, 19 nt, Homo sapiens
uaguaaaccugaucacagu

SEQ ID NO: 1538226 - RNA, 19 nt, Homo sapiens
gcaaauguaggccaagcaa

SEQ ID NO: 1538227 - RNA, 19 nt, Homo sapiens
gaauuaaugauaccagcaa

SEQ ID NO: 1538228 - RNA, 19 nt, Homo sapiens
gcaagaacaucgccauccu

SEQ ID NO: 1538229 - RNA, 19 nt, Homo sapiens
caacuggacuuucauuccu

SEQ ID NO: 1538230 - RNA, 19 nt, Homo sapiens
gcucuuacacaacauauca

SEQ ID NO: 1538231 - RNA, 19 nt, Homo sapiens
ggaaacauugccguaauug

SEQ ID NO: 1538232 - RNA, 19 nt, Homo sapiens
cacaacauaucaacagcaa

SEQ ID NO: 1538233 - RNA, 19 nt, Homo sapiens
cauuguggcuuccuuucuu

SEQ ID NO: 1538234 - RNA, 19 nt, Homo sapiens
caaagacagagaucaccua

SEQ ID NO: 1538235 - RNA, 19 nt, Homo sapiens
uuagagagucugauucuga

SEQ ID NO: 1538236 - RNA, 19 nt, Homo sapiens
gaucagcagagaugaacuu

SEQ ID NO: 1538237 - RNA, 19 nt, Homo sapiens
gaggauggauggguucagu

SEQ ID NO: 1538238 - RNA, 19 nt, Homo sapiens
aaagugagagaauucauga

SEQ ID NO: 1538239 - RNA, 19 nt, Homo sapiens
caaagugagagaauucaug

SEQ ID NO: 1538240 - RNA, 19 nt, Homo sapiens
gacagagaucaccuauuua

SEQ ID NO: 1538241 - RNA, 19 nt, Homo sapiens
gauucugacuuacaucaca

SEQ ID NO: 1538242 - RNA, 19 nt, Homo sapiens
gcaaaagcaucuccaacug

SEQ ID NO: 1538243 - RNA, 19 nt, Homo sapiens
aggaaacauugccguaauu

SEQ ID NO: 1538244 - RNA, 19 nt, Homo sapiens
caacaucuuugaggaggau

SEQ ID NO: 1538245 - RNA, 19 nt, Homo sapiens
gcagaguuacagcaccaua

SEQ ID NO: 1538246 - RNA, 19 nt, Homo sapiens
ggauggauggguucaguug

SEQ ID NO: 1538247 - RNA, 19 nt, Homo sapiens
caucuuagagagucugauu

SEQ ID NO: 1538248 - RNA, 19 nt, Homo sapiens
ccacauucuuaacagcaaa

SEQ ID NO: 1538249 - RNA, 19 nt, Homo sapiens
gaaacauugccguaauugu

SEQ ID NO: 1538250 - RNA, 19 nt, Homo sapiens
gaggaggauucacguuugg

SEQ ID NO: 1538251 - RNA, 19 nt, Homo sapiens
uuaaugauaccagcaauga

SEQ ID NO: 1538252 - RNA, 19 nt, Homo sapiens
ugacagaaacagcagcuau

SEQ ID NO: 1538253 - RNA, 19 nt, Homo sapiens
gagaucugcuggcucaacu

SEQ ID NO: 1538254 - RNA, 19 nt, Homo sapiens
caacugccauccccuaaug

SEQ ID NO: 1538255 - RNA, 19 nt, Homo sapiens
gccauuugaagacaauaua

SEQ ID NO: 1538256 - RNA, 19 nt, Homo sapiens
uguaugcgauggugucugu

SEQ ID NO: 1538257 - RNA, 19 nt, Homo sapiens
cucaaugcauuccagguaa

SEQ ID NO: 1538258 - RNA, 19 nt, Homo sapiens
ccaagcaaauuguuuaccu

SEQ ID NO: 1538259 - RNA, 19 nt, Homo sapiens
gaggagaggaggacacagu

SEQ ID NO: 1538260 - RNA, 19 nt, Homo sapiens
gcagcucuuacacaacaua

SEQ ID NO: 1538261 - RNA, 19 nt, Homo sapiens
acagacuacucccagugua

SEQ ID NO: 1538262 - RNA, 19 nt, Homo sapiens
uauccucuauggaaucaug

SEQ ID NO: 1538263 - RNA, 19 nt, Homo sapiens
aaauguaggccaagcaaau

SEQ ID NO: 1538264 - RNA, 19 nt, Homo sapiens
ugcaagaaggcuauucaua

SEQ ID NO: 1538265 - RNA, 19 nt, Homo sapiens
uagccaaccacauucuuaa

SEQ ID NO: 1538266 - RNA, 19 nt, Homo sapiens
ccaggaaacauugccguaa

SEQ ID NO: 1538267 - RNA, 19 nt, Homo sapiens
ggccauugcugccaucacu

SEQ ID NO: 1538268 - RNA, 19 nt, Homo sapiens
ggaggauucacguuugguu

SEQ ID NO: 1538269 - RNA, 19 nt, Homo sapiens
ggaagugagagccauugug

SEQ ID NO: 1538270 - RNA, 19 nt, Homo sapiens
uggcucaacugggacauga

SEQ ID NO: 1538271 - RNA, 19 nt, Homo sapiens
uggcaaaggcuaucuacga

SEQ ID NO: 1538272 - RNA, 19 nt, Homo sapiens
ggagccaagugacaaagac

SEQ ID NO: 1538273 - RNA, 19 nt, Homo sapiens
gaugucuucauucauacua

SEQ ID NO: 1538274 - RNA, 19 nt, Homo sapiens
gcaauauggacagguguug

SEQ ID NO: 1538275 - RNA, 19 nt, Homo sapiens
gugcaaagugagagaauuc

SEQ ID NO: 1538276 - RNA, 19 nt, Homo sapiens
guaaaccugaucacaguca

SEQ ID NO: 1538277 - RNA, 19 nt, Homo sapiens
ccugguggcaucucuguuu

SEQ ID NO: 1538278 - RNA, 19 nt, Homo sapiens
gaagaauacuggaauauag

SEQ ID NO: 1538279 - RNA, 19 nt, Homo sapiens
gaaauaaaggauagggaua

SEQ ID NO: 1538280 - RNA, 19 nt, Homo sapiens
gcauaugucucuaaaccaa

SEQ ID NO: 1538281 - RNA, 19 nt, Homo sapiens
caaagacuguugaaagaga

SEQ ID NO: 1538282 - RNA, 19 nt, Homo sapiens
ggagagaggauuugauuug

SEQ ID NO: 1538283 - RNA, 19 nt, Homo sapiens
uaacuuccuuugucucuuu

SEQ ID NO: 1538284 - RNA, 19 nt, Homo sapiens
ggagguggguguggcuuua

SEQ ID NO: 1538285 - RNA, 19 nt, Homo sapiens
cauuaaagcugaguagaaa

SEQ ID NO: 1538286 - RNA, 19 nt, Homo sapiens
guucagcacuaaccaauga

SEQ ID NO: 1538287 - RNA, 19 nt, Homo sapiens
gcauugggcuggugucaug

SEQ ID NO: 1538288 - RNA, 19 nt, Homo sapiens
gagcugcacuaccucauga

SEQ ID NO: 1538289 - RNA, 19 nt, Homo sapiens
aguagaaacuucaagauga

SEQ ID NO: 1538290 - RNA, 19 nt, Homo sapiens
caugaagaauacuggaaua

SEQ ID NO: 1538291 - RNA, 19 nt, Homo sapiens
agacagggcuacucuagga

SEQ ID NO: 1538292 - RNA, 19 nt, Homo sapiens
guagaaacuucaagaugau

SEQ ID NO: 1538293 - RNA, 19 nt, Homo sapiens
gagucaagaugugcucaua

SEQ ID NO: 1538294 - RNA, 19 nt, Homo sapiens
gggcuggugucaugaagaa

SEQ ID NO: 1538295 - RNA, 19 nt, Homo sapiens
gaggguggcuggacuuaag

SEQ ID NO: 1538296 - RNA, 19 nt, Homo sapiens
gcccuaaaguauucacuga

SEQ ID NO: 1538297 - RNA, 19 nt, Homo sapiens
ggguguggcuuuaggaguu

SEQ ID NO: 1538298 - RNA, 19 nt, Homo sapiens
aguauucacugagcacuua

SEQ ID NO: 1538299 - RNA, 19 nt, Homo sapiens
ggucaggcccuaaaguauu

SEQ ID NO: 1538300 - RNA, 19 nt, Homo sapiens
gcaacugcguaucuacuuc

SEQ ID NO: 1538301 - RNA, 19 nt, Homo sapiens
ccugaaacccucccucuuu

SEQ ID NO: 1538302 - RNA, 19 nt, Homo sapiens
gccaggagcgggugucuuu

SEQ ID NO: 1538303 - RNA, 19 nt, Homo sapiens
gaguagaaacuucaagaug

SEQ ID NO: 1538304 - RNA, 19 nt, Homo sapiens
gcuggugucaugaagaaua

SEQ ID NO: 1538305 - RNA, 19 nt, Homo sapiens
gagaccaaguauauggaaa

SEQ ID NO: 1538306 - RNA, 19 nt, Homo sapiens
ucaggcauaugucucuaaa

SEQ ID NO: 1538307 - RNA, 19 nt, Homo sapiens
gccuggagcuggacgagaa

SEQ ID NO: 1538308 - RNA, 19 nt, Homo sapiens
cagagaugguugccuucua

SEQ ID NO: 1538309 - RNA, 19 nt, Homo sapiens
ugaggacuguucagcacua

SEQ ID NO: 1538310 - RNA, 19 nt, Homo sapiens
gcaccuacuauguguuuga

SEQ ID NO: 1538311 - RNA, 19 nt, Homo sapiens
guuuaggguugggaaauaa

SEQ ID NO: 1538312 - RNA, 19 nt, Homo sapiens
gcaccuguguuucaguuac

SEQ ID NO: 1538313 - RNA, 19 nt, Homo sapiens
gacaagcacacaguucuuu

SEQ ID NO: 1538314 - RNA, 19 nt, Homo sapiens
gaagcucacguacaucuca

SEQ ID NO: 1538315 - RNA, 19 nt, Homo sapiens
ccaauguuauguaucaaag

SEQ ID NO: 1538316 - RNA, 19 nt, Homo sapiens
gagcagcugcggauguuau

SEQ ID NO: 1538317 - RNA, 19 nt, Homo sapiens
gagagaggauuugauuugc

SEQ ID NO: 1538318 - RNA, 19 nt, Homo sapiens
gcacuaaccaaugagauca

SEQ ID NO: 1538319 - RNA, 19 nt, Homo sapiens
ccaggagaguucauuccaa

SEQ ID NO: 1538320 - RNA, 19 nt, Homo sapiens
cagcaccuacuauguguuu

SEQ ID NO: 1538321 - RNA, 19 nt, Homo sapiens
gccugaagcucacguacau

SEQ ID NO: 1538322 - RNA, 19 nt, Homo sapiens
gcauccaccucucccacuu

SEQ ID NO: 1538323 - RNA, 19 nt, Homo sapiens
auaaaggguuugacuccaa

SEQ ID NO: 1538324 - RNA, 19 nt, Homo sapiens
cuagacggccuuuggcuuu

SEQ ID NO: 1538325 - RNA, 19 nt, Homo sapiens
gcucugcaccuguguuuca

SEQ ID NO: 1538326 - RNA, 19 nt, Homo sapiens
cuacuaacuuccuuugucu

SEQ ID NO: 1538327 - RNA, 19 nt, Homo sapiens
gaccaaguauauggaaauc

SEQ ID NO: 1538328 - RNA, 19 nt, Homo sapiens
gagaauaaaggguuugacu

SEQ ID NO: 1538329 - RNA, 19 nt, Homo sapiens
gcuggguccugaacagaga

SEQ ID NO: 1538330 - RNA, 19 nt, Homo sapiens
gaagaggguggcuggacuu

SEQ ID NO: 1538331 - RNA, 19 nt, Homo sapiens
gucaggcccuaaaguauuc

SEQ ID NO: 1538332 - RNA, 19 nt, Homo sapiens
ccaaguauauggaaauccu

SEQ ID NO: 1538333 - RNA, 19 nt, Homo sapiens
gaggacuguucagcacuaa

SEQ ID NO: 1538334 - RNA, 19 nt, Homo sapiens
gaaaagcagccgaugagaa

SEQ ID NO: 1538335 - RNA, 19 nt, Homo sapiens
guaucuacuuccucaacaa

SEQ ID NO: 1538336 - RNA, 19 nt, Homo sapiens
gcagcgccaccaccuguuu

SEQ ID NO: 1538337 - RNA, 19 nt, Homo sapiens
ggagaccaaguauauggaa

SEQ ID NO: 1538338 - RNA, 19 nt, Homo sapiens
gguccugaacagagaauaa

SEQ ID NO: 1538339 - RNA, 19 nt, Homo sapiens
guugggaaauaaaggauag

SEQ ID NO: 1538340 - RNA, 19 nt, Homo sapiens
ugaguaaccaggcgaaugu

SEQ ID NO: 1538341 - RNA, 19 nt, Homo sapiens
cagcggccauccuggaguu

SEQ ID NO: 1538342 - RNA, 19 nt, Homo sapiens
uaagguaggagccgaaagu

SEQ ID NO: 1538343 - RNA, 19 nt, Homo sapiens
gucagcagauacuuauuca

SEQ ID NO: 1538344 - RNA, 19 nt, Homo sapiens
ucagucagcagauacuuau

SEQ ID NO: 1538345 - RNA, 19 nt, Homo sapiens
gcccugucuuuguguguuu

SEQ ID NO: 1538346 - RNA, 19 nt, Homo sapiens
ggcugcagcuggccguauu

SEQ ID NO: 1538347 - RNA, 19 nt, Homo sapiens
ccuacuauguguuugauac

SEQ ID NO: 1538348 - RNA, 19 nt, Homo sapiens
ucuacuaacuuccuuuguc

SEQ ID NO: 1538349 - RNA, 19 nt, Homo sapiens
guuguucuccuacgccuaa

SEQ ID NO: 1538350 - RNA, 19 nt, Homo sapiens
ccugcuggaugccaaggua

SEQ ID NO: 1538351 - RNA, 19 nt, Homo sapiens
gucaagaugugcucauagg

SEQ ID NO: 1538352 - RNA, 19 nt, Homo sapiens
agagaugguugccuucuac

SEQ ID NO: 1538353 - RNA, 19 nt, Homo sapiens
guugggagaauguggauga

SEQ ID NO: 1538354 - RNA, 19 nt, Homo sapiens
acauuaaagcugaguagaa

SEQ ID NO: 1538355 - RNA, 19 nt, Homo sapiens
gggagagaggauuugauuu

SEQ ID NO: 1538356 - RNA, 19 nt, Homo sapiens
ccuccgccauccagaacua

SEQ ID NO: 1538357 - RNA, 19 nt, Homo sapiens
ucagaggguugggagaaug

SEQ ID NO: 1538358 - RNA, 19 nt, Homo sapiens
cuauguguuugauacugua

SEQ ID NO: 1538359 - RNA, 19 nt, Homo sapiens
cccauucagucagcagaua

SEQ ID NO: 1538360 - RNA, 19 nt, Homo sapiens
aguuuaggguugggaaaua

SEQ ID NO: 1538361 - RNA, 19 nt, Homo sapiens
gggcuacucuaggaaugga

SEQ ID NO: 1538362 - RNA, 19 nt, Homo sapiens
gaaagagacagggcuacuc

SEQ ID NO: 1538363 - RNA, 19 nt, Homo sapiens
ucucuaaaccaauguuaug

SEQ ID NO: 1538364 - RNA, 19 nt, Homo sapiens
gacacugaauggucaagag

SEQ ID NO: 1538365 - RNA, 19 nt, Homo sapiens
cagccacacugccagagau

SEQ ID NO: 1538366 - RNA, 19 nt, Homo sapiens
cgagugguuuggagaucuu

SEQ ID NO: 1538367 - RNA, 19 nt, Homo sapiens
gccaagggcaaacucgaaa

SEQ ID NO: 1538368 - RNA, 19 nt, Homo sapiens
cauaggagccaagggcaaa

SEQ ID NO: 1538369 - RNA, 19 nt, Homo sapiens
ccggucaggcccuaaagua

SEQ ID NO: 1538370 - RNA, 19 nt, Homo sapiens
ccaccacccuucccagaac

SEQ ID NO: 1538371 - RNA, 19 nt, Homo sapiens
aacagagaauaaaggguuu

SEQ ID NO: 1538372 - RNA, 19 nt, Homo sapiens
gagccagcggcauugagua

SEQ ID NO: 1538373 - RNA, 19 nt, Homo sapiens
aaagcugaguagaaacuuc

SEQ ID NO: 1538374 - RNA, 19 nt, Homo sapiens
caggagcgggugucuuuga

SEQ ID NO: 1538375 - RNA, 19 nt, Homo sapiens
gggcuuugcggcaugaaga

SEQ ID NO: 1538376 - RNA, 19 nt, Homo sapiens
ccaauggugugcguuuuaa

SEQ ID NO: 1538377 - RNA, 19 nt, Homo sapiens
ugcacaaacuguugguguu

SEQ ID NO: 1538378 - RNA, 19 nt, Homo sapiens
guaauuagcuaccaucuuu

SEQ ID NO: 1538379 - RNA, 19 nt, Homo sapiens
ggaauuaucucccaguuug

SEQ ID NO: 1538380 - RNA, 19 nt, Homo sapiens
ggacagaaauugcuuacaa

SEQ ID NO: 1538381 - RNA, 19 nt, Homo sapiens
ggucugaagucaucuauaa

SEQ ID NO: 1538382 - RNA, 19 nt, Homo sapiens
gaucacagguuccuucuga

SEQ ID NO: 1538383 - RNA, 19 nt, Homo sapiens
gcaaaucccucacgaaucu

SEQ ID NO: 1538384 - RNA, 19 nt, Homo sapiens
gacaaucucuaacuucuaa

SEQ ID NO: 1538385 - RNA, 19 nt, Homo sapiens
gaacgagagugccacauug

SEQ ID NO: 1538386 - RNA, 19 nt, Homo sapiens
gaaacuaauuggcucauau

SEQ ID NO: 1538387 - RNA, 19 nt, Homo sapiens
gaaauuaagcccagucauu

SEQ ID NO: 1538388 - RNA, 19 nt, Homo sapiens
cuaauuggcucauauuuga

SEQ ID NO: 1538389 - RNA, 19 nt, Homo sapiens
gcuccaagcucuacagauu

SEQ ID NO: 1538390 - RNA, 19 nt, Homo sapiens
caaauuagguuaacaugca

SEQ ID NO: 1538391 - RNA, 19 nt, Homo sapiens
gaacuugaccggcuaaaug

SEQ ID NO: 1538392 - RNA, 19 nt, Homo sapiens
gcauuggaauugaagguua

SEQ ID NO: 1538393 - RNA, 19 nt, Homo sapiens
ggauuaaggguuaggauua

SEQ ID NO: 1538394 - RNA, 19 nt, Homo sapiens
ggaaagaacuagggucuca

SEQ ID NO: 1538395 - RNA, 19 nt, Homo sapiens
gaagaaguacucacuggua

SEQ ID NO: 1538396 - RNA, 19 nt, Homo sapiens
guaagaggcauuuguaauu

SEQ ID NO: 1538397 - RNA, 19 nt, Homo sapiens
gaggaagguuuauuucuau

SEQ ID NO: 1538398 - RNA, 19 nt, Homo sapiens
gaccuuaccaguacauuua

SEQ ID NO: 1538399 - RNA, 19 nt, Homo sapiens
ggaaauuaaugcucuguuc

SEQ ID NO: 1538400 - RNA, 19 nt, Homo sapiens
gguagaagcugacuggaau

SEQ ID NO: 1538401 - RNA, 19 nt, Homo sapiens
gaaugaaacucacaaugca

SEQ ID NO: 1538402 - RNA, 19 nt, Homo sapiens
gcuacucgauuccauuuaa

SEQ ID NO: 1538403 - RNA, 19 nt, Homo sapiens
ucagauuugugucucauua

SEQ ID NO: 1538404 - RNA, 19 nt, Homo sapiens
gaaugaaggugcuuuacuc

SEQ ID NO: 1538405 - RNA, 19 nt, Homo sapiens
ccuaauagcugcucacaca

SEQ ID NO: 1538406 - RNA, 19 nt, Homo sapiens
caggaaggauaauggaaua

SEQ ID NO: 1538407 - RNA, 19 nt, Homo sapiens
gagcucaucuugcccauca

SEQ ID NO: 1538408 - RNA, 19 nt, Homo sapiens
caaauaaguugcccaaagg

SEQ ID NO: 1538409 - RNA, 19 nt, Homo sapiens
agaggaagguuuauuucua

SEQ ID NO: 1538410 - RNA, 19 nt, Homo sapiens
gaaggauaauggaauaaca

SEQ ID NO: 1538411 - RNA, 19 nt, Homo sapiens
cagcagcccugguaacuug

SEQ ID NO: 1538412 - RNA, 19 nt, Homo sapiens
cuaacgacuuucaggauua

SEQ ID NO: 1538413 - RNA, 19 nt, Homo sapiens
ugaauuaccuaguguuugu

SEQ ID NO: 1538414 - RNA, 19 nt, Homo sapiens
gaacuagggucucauucag

SEQ ID NO: 1538415 - RNA, 19 nt, Homo sapiens
cagauuuacugcacaauau

SEQ ID NO: 1538416 - RNA, 19 nt, Homo sapiens
ccagauaauuguuaaaugg

SEQ ID NO: 1538417 - RNA, 19 nt, Homo sapiens
agaaggaccucuccaaauc

SEQ ID NO: 1538418 - RNA, 19 nt, Homo sapiens
caaauugcaucuggaaaga

SEQ ID NO: 1538419 - RNA, 19 nt, Homo sapiens
gcaaagggaccaaacugaa

SEQ ID NO: 1538420 - RNA, 19 nt, Homo sapiens
aagcaguccuuauccuuua

SEQ ID NO: 1538421 - RNA, 19 nt, Homo sapiens
gaccacaggcuuuaaugua

SEQ ID NO: 1538422 - RNA, 19 nt, Homo sapiens
gcaucacuguggaaauuaa

SEQ ID NO: 1538423 - RNA, 19 nt, Homo sapiens
uagcaucacuguggaaauu

SEQ ID NO: 1538424 - RNA, 19 nt, Homo sapiens
cuaaacaaauggaugauuc

SEQ ID NO: 1538425 - RNA, 19 nt, Homo sapiens
uccaugaacugucuaauga

SEQ ID NO: 1538426 - RNA, 19 nt, Homo sapiens
ggaugauacuuuagcugua

SEQ ID NO: 1538427 - RNA, 19 nt, Homo sapiens
cuuaguggaugauacuuua

SEQ ID NO: 1538428 - RNA, 19 nt, Homo sapiens
uaagaaagcaagccagauu

SEQ ID NO: 1538429 - RNA, 19 nt, Homo sapiens
ucuauuagcucuguuauca

SEQ ID NO: 1538430 - RNA, 19 nt, Homo sapiens
gaauagggauguugcaaaa

SEQ ID NO: 1538431 - RNA, 19 nt, Homo sapiens
gguuagauguguuugcaaa

SEQ ID NO: 1538432 - RNA, 19 nt, Homo sapiens
ugaguaagcuggaaaucug

SEQ ID NO: 1538433 - RNA, 19 nt, Homo sapiens
gcucaggcuuucaagauug

SEQ ID NO: 1538434 - RNA, 19 nt, Homo sapiens
gaccuuagauauggcuuaa

SEQ ID NO: 1538435 - RNA, 19 nt, Homo sapiens
gaaguacucacugguaauu

SEQ ID NO: 1538436 - RNA, 19 nt, Homo sapiens
gauuaaggguuaggauuau

SEQ ID NO: 1538437 - RNA, 19 nt, Homo sapiens
gggcaagacgacaguguua

SEQ ID NO: 1538438 - RNA, 19 nt, Homo sapiens
gauaauggaauaacagugu

SEQ ID NO: 1538439 - RNA, 19 nt, Homo sapiens
caaagggaccaaacugaaa

SEQ ID NO: 1538440 - RNA, 19 nt, Homo sapiens
ggaauaagcccaggaaggu

SEQ ID NO: 1538441 - RNA, 19 nt, Homo sapiens
gaagcugacuggaauacag

SEQ ID NO: 1538442 - RNA, 19 nt, Homo sapiens
ggaaugaaacucacaaugc

SEQ ID NO: 1538443 - RNA, 19 nt, Homo sapiens
ccaauggccuggauuaagg

SEQ ID NO: 1538444 - RNA, 19 nt, Homo sapiens
gcagagccagauauaagua

SEQ ID NO: 1538445 - RNA, 19 nt, Homo sapiens
aagaaguacucacugguaa

SEQ ID NO: 1538446 - RNA, 19 nt, Homo sapiens
agaacagugugaugucuaa

SEQ ID NO: 1538447 - RNA, 19 nt, Homo sapiens
agaaagcaagccagauuua

SEQ ID NO: 1538448 - RNA, 19 nt, Homo sapiens
ugagcugaauggaaauuaa

SEQ ID NO: 1538449 - RNA, 19 nt, Homo sapiens
gcuuacaauugcucaguuu

SEQ ID NO: 1538450 - RNA, 19 nt, Homo sapiens
uuaaugcagugaacaauuc

SEQ ID NO: 1538451 - RNA, 19 nt, Homo sapiens
guucaggacucagaaucua

SEQ ID NO: 1538452 - RNA, 19 nt, Homo sapiens
uacccuaccuguaaagaaa

SEQ ID NO: 1538453 - RNA, 19 nt, Homo sapiens
ggaggaccaggagauauua

SEQ ID NO: 1538454 - RNA, 19 nt, Homo sapiens
gaugauacuuuagcuguag

SEQ ID NO: 1538455 - RNA, 19 nt, Homo sapiens
guagaaggaccucuccaaa

SEQ ID NO: 1538456 - RNA, 19 nt, Homo sapiens
gaaacucacaaugcaagua

SEQ ID NO: 1538457 - RNA, 19 nt, Homo sapiens
ccaaucggaugcucauuag

SEQ ID NO: 1538458 - RNA, 19 nt, Homo sapiens
ccaggaagguuagaugugu

SEQ ID NO: 1538459 - RNA, 19 nt, Homo sapiens
acagugugaugucuaauau

SEQ ID NO: 1538460 - RNA, 19 nt, Homo sapiens
ccagguagauguugaaagc

SEQ ID NO: 1538461 - RNA, 19 nt, Homo sapiens
caggagaccuuagauaugg

SEQ ID NO: 1538462 - RNA, 19 nt, Homo sapiens
cuuggaaucuggugugaaa

SEQ ID NO: 1538463 - RNA, 19 nt, Homo sapiens
ugccacagcuaacacuuaa

SEQ ID NO: 1538464 - RNA, 19 nt, Homo sapiens
gaauguaguaagugguuaa

SEQ ID NO: 1538465 - RNA, 19 nt, Homo sapiens
gcacuucaaauuucggauu

SEQ ID NO: 1538466 - RNA, 19 nt, Homo sapiens
uuucucagauggcuucuaa

SEQ ID NO: 1538467 - RNA, 19 nt, Homo sapiens
gaagaccacccuccaccaa

SEQ ID NO: 1538468 - RNA, 19 nt, Homo sapiens
ccagauuuacugcacaaua

SEQ ID NO: 1538469 - RNA, 19 nt, Homo sapiens
ggacaguucaggacucaga

SEQ ID NO: 1538470 - RNA, 19 nt, Homo sapiens
uggccuggauuaaggguua

SEQ ID NO: 1538471 - RNA, 19 nt, Homo sapiens
gaguaucucuuauccaaaa

SEQ ID NO: 1538472 - RNA, 19 nt, Homo sapiens
agggugagcugaauggaaa

SEQ ID NO: 1538473 - RNA, 19 nt, Homo sapiens
ccauaggucuuaacacucu

SEQ ID NO: 1538474 - RNA, 19 nt, Homo sapiens
gaaggaccucuccaaauca

SEQ ID NO: 1538475 - RNA, 19 nt, Homo sapiens
gauggcuucuaacgacuuu

SEQ ID NO: 1538476 - RNA, 19 nt, Homo sapiens
gaaaucggcaagccaagau

SEQ ID NO: 1538477 - RNA, 19 nt, Homo sapiens
cacagcuuauguauuguua

SEQ ID NO: 1538478 - RNA, 19 nt, Homo sapiens
gaggaaaccuugaacauuu

SEQ ID NO: 1538479 - RNA, 19 nt, Homo sapiens
ggaaauaauucacaaguug

SEQ ID NO: 1538480 - RNA, 19 nt, Homo sapiens
gaacaaccauuugcuguaa

SEQ ID NO: 1538481 - RNA, 19 nt, Homo sapiens
gagaugcacuagaucauuu

SEQ ID NO: 1538482 - RNA, 19 nt, Homo sapiens
uaggaaagcuuguuguuau

SEQ ID NO: 1538483 - RNA, 19 nt, Homo sapiens
uguaagaccugaaagaguu

SEQ ID NO: 1538484 - RNA, 19 nt, Homo sapiens
caacaguccugccuucuag

SEQ ID NO: 1538485 - RNA, 19 nt, Homo sapiens
gugaaacauuugucucuaa

SEQ ID NO: 1538486 - RNA, 19 nt, Homo sapiens
ggaacaaccauuugcugua

SEQ ID NO: 1538487 - RNA, 19 nt, Homo sapiens
gaaccucguccucaaacua

SEQ ID NO: 1538488 - RNA, 19 nt, Homo sapiens
ggaaagcuuguuguuauaa

SEQ ID NO: 1538489 - RNA, 19 nt, Homo sapiens
caacauauggcucaucuca

SEQ ID NO: 1538490 - RNA, 19 nt, Homo sapiens
gaauguaagaccugaaaga

SEQ ID NO: 1538491 - RNA, 19 nt, Homo sapiens
ggagcuagcuaugagaugu

SEQ ID NO: 1538492 - RNA, 19 nt, Homo sapiens
ggacaacauugaucauagg

SEQ ID NO: 1538493 - RNA, 19 nt, Homo sapiens
uggcagagaugcacuagau

SEQ ID NO: 1538494 - RNA, 19 nt, Homo sapiens
gcgaucacaucacgguaaa

SEQ ID NO: 1538495 - RNA, 19 nt, Homo sapiens
uagaagaguucagguguug

SEQ ID NO: 1538496 - RNA, 19 nt, Homo sapiens
gggacaacauugaucauag

SEQ ID NO: 1538497 - RNA, 19 nt, Homo sapiens
gaaucuaucacuaggcaaa

SEQ ID NO: 1538498 - RNA, 19 nt, Homo sapiens
ccuguuggcuccacucuug

SEQ ID NO: 1538499 - RNA, 19 nt, Homo sapiens
gcagagaugcacuagauca

SEQ ID NO: 1538500 - RNA, 19 nt, Homo sapiens
gcuccacucuugucacuca

SEQ ID NO: 1538501 - RNA, 19 nt, Homo sapiens
guucagguguugcugcauu

SEQ ID NO: 1538502 - RNA, 19 nt, Homo sapiens
aggaaagcuuguuguuaua

SEQ ID NO: 1538503 - RNA, 19 nt, Homo sapiens
acauauggcucaucucauc

SEQ ID NO: 1538504 - RNA, 19 nt, Homo sapiens
gcucugauucuacaacauu

SEQ ID NO: 1538505 - RNA, 19 nt, Homo sapiens
ccacagaaaugggcacuac

SEQ ID NO: 1538506 - RNA, 19 nt, Homo sapiens
aaacuaaaggccacagaaa

SEQ ID NO: 1538507 - RNA, 19 nt, Homo sapiens
cgguaaagcccaaggagua

SEQ ID NO: 1538508 - RNA, 19 nt, Homo sapiens
uaucuugaguucuucauag

SEQ ID NO: 1538509 - RNA, 19 nt, Homo sapiens
cuacaacauuuacguucuu

SEQ ID NO: 1538510 - RNA, 19 nt, Homo sapiens
guaagaccugaaagaguua

SEQ ID NO: 1538511 - RNA, 19 nt, Homo sapiens
ucaucuaccuucccauuuc

SEQ ID NO: 1538512 - RNA, 19 nt, Homo sapiens
uaggggaaguguuauuuua

SEQ ID NO: 1538513 - RNA, 19 nt, Homo sapiens
gguaaagcccaaggaguaa

SEQ ID NO: 1538514 - RNA, 19 nt, Homo sapiens
acauauguaucuugaguuc

SEQ ID NO: 1538515 - RNA, 19 nt, Homo sapiens
gaggaaauaauucacaagu

SEQ ID NO: 1538516 - RNA, 19 nt, Homo sapiens
ggaaaguaaaggucaagug

SEQ ID NO: 1538517 - RNA, 19 nt, Homo sapiens
caaacuaaaggccacagaa

SEQ ID NO: 1538518 - RNA, 19 nt, Homo sapiens
aagagaaccucguccucaa

SEQ ID NO: 1538519 - RNA, 19 nt, Homo sapiens
ugaggaaaccuugaacauu

SEQ ID NO: 1538520 - RNA, 19 nt, Homo sapiens
uuaggaaagcuuguuguua

SEQ ID NO: 1538521 - RNA, 19 nt, Homo sapiens
aaaggaaaguaaaggucaa

SEQ ID NO: 1538522 - RNA, 19 nt, Homo sapiens
ggggaaguguuauuuuaaa

SEQ ID NO: 1538523 - RNA, 19 nt, Homo sapiens
ucaacaggauggcagagau

SEQ ID NO: 1538524 - RNA, 19 nt, Homo sapiens
cugaaagaguuaugaaucu

SEQ ID NO: 1538525 - RNA, 19 nt, Homo sapiens
ccaacaguccugccuucua

SEQ ID NO: 1538526 - RNA, 19 nt, Homo sapiens
ugagaugucugcgaucaca

SEQ ID NO: 1538527 - RNA, 19 nt, Homo sapiens
gcucugucauccucuuuua

SEQ ID NO: 1538528 - RNA, 19 nt, Homo sapiens
uaaagcccaaggaguaauu

SEQ ID NO: 1538529 - RNA, 19 nt, Homo sapiens
uaugagaugucugcgauca

SEQ ID NO: 1538530 - RNA, 19 nt, Homo sapiens
acacccaguuuguugaaga

SEQ ID NO: 1538531 - RNA, 19 nt, Homo sapiens
uuagaagaguucagguguu

SEQ ID NO: 1538532 - RNA, 19 nt, Homo sapiens
cgacccugcucgaagguau

SEQ ID NO: 1538533 - RNA, 19 nt, Homo sapiens
ucacucauguccagaucug

SEQ ID NO: 1538534 - RNA, 19 nt, Homo sapiens
aagccuugcugcccagaaa

SEQ ID NO: 1538535 - RNA, 19 nt, Homo sapiens
cggaggagcuagcuaugag

SEQ ID NO: 1538536 - RNA, 19 nt, Homo sapiens
ggacagaugggaagaacac

SEQ ID NO: 1538537 - RNA, 19 nt, Homo sapiens
gcccaaggaguaauuagga

SEQ ID NO: 1538538 - RNA, 19 nt, Homo sapiens
aaggucaaguggucaaguu

SEQ ID NO: 1538539 - RNA, 19 nt, Homo sapiens
caacaggauggcagagaug

SEQ ID NO: 1538540 - RNA, 19 nt, Homo sapiens
acuaaaggccacagaaaug

SEQ ID NO: 1538541 - RNA, 19 nt, Homo sapiens
acauuugucucuaauacuc

SEQ ID NO: 1538542 - RNA, 19 nt, Homo sapiens
ccacucuugucacucaugu

SEQ ID NO: 1538543 - RNA, 19 nt, Homo sapiens
acccaucacuguuggucua

SEQ ID NO: 1538544 - RNA, 19 nt, Homo sapiens
gucaaguucuguuuucuuu

SEQ ID NO: 1538545 - RNA, 19 nt, Homo sapiens
guaaaggucaaguggucaa

SEQ ID NO: 1538546 - RNA, 19 nt, Homo sapiens
guuaugaaucuaucacuag

SEQ ID NO: 1538547 - RNA, 19 nt, Homo sapiens
gaccugaaagaguuaugaa

SEQ ID NO: 1538548 - RNA, 19 nt, Homo sapiens
ggucuacacccaguuuguu

SEQ ID NO: 1538549 - RNA, 19 nt, Homo sapiens
uccuauugcuggaugguuu

SEQ ID NO: 1538550 - RNA, 19 nt, Homo sapiens
ccugaaagaguuaugaauc

SEQ ID NO: 1538551 - RNA, 19 nt, Homo sapiens
aagaauguaagaccugaaa

SEQ ID NO: 1538552 - RNA, 19 nt, Homo sapiens
gaagaauguaagaccugaa

SEQ ID NO: 1538553 - RNA, 19 nt, Homo sapiens
uaggaugguucgagaggau

SEQ ID NO: 1538554 - RNA, 19 nt, Homo sapiens
guaucuugaguucuucaua

SEQ ID NO: 1538555 - RNA, 19 nt, Homo sapiens
aggaggaaauaauucacaa

SEQ ID NO: 1538556 - RNA, 19 nt, Homo sapiens
gcuguuaggcaguucuuuc

SEQ ID NO: 1538557 - RNA, 19 nt, Homo sapiens
gcccucuggugaccuguug

SEQ ID NO: 1538558 - RNA, 19 nt, Homo sapiens
agugaaacauuugucucua

SEQ ID NO: 1538559 - RNA, 19 nt, Homo sapiens
cacccaguuuguugaagaa

SEQ ID NO: 1538560 - RNA, 19 nt, Homo sapiens
gcccuuugccuguggaaug

SEQ ID NO: 1538561 - RNA, 19 nt, Homo sapiens
ggauggcagagaugcacua

SEQ ID NO: 1538562 - RNA, 19 nt, Homo sapiens
cugcaugcuucuucuuuua

SEQ ID NO: 1538563 - RNA, 19 nt, Homo sapiens
gugaggaaaccuugaacau

SEQ ID NO: 1538564 - RNA, 19 nt, Homo sapiens
caaguggucaaguucuguu

SEQ ID NO: 1538565 - RNA, 19 nt, Homo sapiens
ccaugcagcugagacacau

SEQ ID NO: 1538566 - RNA, 19 nt, Homo sapiens
uggaauguauuucacucau

SEQ ID NO: 1538567 - RNA, 19 nt, Homo sapiens
guucuuuucucaccuuuga

SEQ ID NO: 1538568 - RNA, 19 nt, Homo sapiens
gaggagcuagcuaugagau

SEQ ID NO: 1538569 - RNA, 19 nt, Homo sapiens
ggaggagcuagcuaugaga

SEQ ID NO: 1538570 - RNA, 19 nt, Homo sapiens
gaagaguucagguguugcu

SEQ ID NO: 1538571 - RNA, 19 nt, Homo sapiens
ucucaucuaccuucccauu

SEQ ID NO: 1538572 - RNA, 19 nt, Homo sapiens
gcagugccagcuucuccuu

SEQ ID NO: 1538573 - RNA, 19 nt, Homo sapiens
gagaaccucguccucaaac

SEQ ID NO: 1538574 - RNA, 19 nt, Homo sapiens
ucgagaggaucuucaacag

SEQ ID NO: 1538575 - RNA, 19 nt, Homo sapiens
gucaaguggucaaguucug

SEQ ID NO: 1538576 - RNA, 19 nt, Homo sapiens
agagaugcacuagaucauu

SEQ ID NO: 1538577 - RNA, 19 nt, Homo sapiens
cgaagugaaacauuugucu

SEQ ID NO: 1538578 - RNA, 19 nt, Homo sapiens
gagaggaacugccaggaua

SEQ ID NO: 1538579 - RNA, 19 nt, Homo sapiens
ggaacucucuccucucuuu

SEQ ID NO: 1538580 - RNA, 19 nt, Homo sapiens
caacgggacuguaaauuga

SEQ ID NO: 1538581 - RNA, 19 nt, Homo sapiens
gcuauaagcuucucaucaa

SEQ ID NO: 1538582 - RNA, 19 nt, Homo sapiens
gcuuugagcuuaccaagaa

SEQ ID NO: 1538583 - RNA, 19 nt, Homo sapiens
ccaggagacucaacacuaa

SEQ ID NO: 1538584 - RNA, 19 nt, Homo sapiens
gaagaaagaaucaaaugga

SEQ ID NO: 1538585 - RNA, 19 nt, Homo sapiens
gaaagaaucaaauggaaga

SEQ ID NO: 1538586 - RNA, 19 nt, Homo sapiens
caacaucccuggcaauuac

SEQ ID NO: 1538587 - RNA, 19 nt, Homo sapiens
ggagagagaccuauguuug

SEQ ID NO: 1538588 - RNA, 19 nt, Homo sapiens
ccuaauaagugcaaucauu

SEQ ID NO: 1538589 - RNA, 19 nt, Homo sapiens
caacgggccuccuucaaga

SEQ ID NO: 1538590 - RNA, 19 nt, Homo sapiens
ggaaugaauugcaugaaca

SEQ ID NO: 1538591 - RNA, 19 nt, Homo sapiens
gaagaagaaucaaguccau

SEQ ID NO: 1538592 - RNA, 19 nt, Homo sapiens
gaaggaagaaagaaucaaa

SEQ ID NO: 1538593 - RNA, 19 nt, Homo sapiens
gaucaaggaugccaaaugc

SEQ ID NO: 1538594 - RNA, 19 nt, Homo sapiens
gcagagcugugucaacaug

SEQ ID NO: 1538595 - RNA, 19 nt, Homo sapiens
ccauaaggguuuacaaaug

SEQ ID NO: 1538596 - RNA, 19 nt, Homo sapiens
gaaaggaucccugaagaug

SEQ ID NO: 1538597 - RNA, 19 nt, Homo sapiens
gcacuggaauggcaaagau

SEQ ID NO: 1538598 - RNA, 19 nt, Homo sapiens
cagaaggcaucagauauuu

SEQ ID NO: 1538599 - RNA, 19 nt, Homo sapiens
ugaauugcaugaacaagaa

SEQ ID NO: 1538600 - RNA, 19 nt, Homo sapiens
uggcaggccuugauuauga

SEQ ID NO: 1538601 - RNA, 19 nt, Homo sapiens
caucugaucugucucuaug

SEQ ID NO: 1538602 - RNA, 19 nt, Homo sapiens
cuauacagauccucucuuu

SEQ ID NO: 1538603 - RNA, 19 nt, Homo sapiens
acaaggagaugcugccaaa

SEQ ID NO: 1538604 - RNA, 19 nt, Homo sapiens
cauccuccauuaccacuua

SEQ ID NO: 1538605 - RNA, 19 nt, Homo sapiens
ugaguucacuggcuauauu

SEQ ID NO: 1538606 - RNA, 19 nt, Homo sapiens
caagaaaggcuauaagcuu

SEQ ID NO: 1538607 - RNA, 19 nt, Homo sapiens
aggaagacgugcaaagaua

SEQ ID NO: 1538608 - RNA, 19 nt, Homo sapiens
gaagacgugcaaagauaua

SEQ ID NO: 1538609 - RNA, 19 nt, Homo sapiens
cagcucagguucauuucua

SEQ ID NO: 1538610 - RNA, 19 nt, Homo sapiens
ggaagaggaccaggacaua

SEQ ID NO: 1538611 - RNA, 19 nt, Homo sapiens
gacaguaagugccaugaug

SEQ ID NO: 1538612 - RNA, 19 nt, Homo sapiens
caagauccuuaucguggua

SEQ ID NO: 1538613 - RNA, 19 nt, Homo sapiens
gcacacauucugcccuuaa

SEQ ID NO: 1538614 - RNA, 19 nt, Homo sapiens
cuaaaggacuagacacaga

SEQ ID NO: 1538615 - RNA, 19 nt, Homo sapiens
gcucuggacuucccacaug

SEQ ID NO: 1538616 - RNA, 19 nt, Homo sapiens
cauaaggguuuacaaaugg

SEQ ID NO: 1538617 - RNA, 19 nt, Homo sapiens
ccaagacugugacaccaaa

SEQ ID NO: 1538618 - RNA, 19 nt, Homo sapiens
gaaggaaugaauugcauga

SEQ ID NO: 1538619 - RNA, 19 nt, Homo sapiens
cugcagugcuguccauuaa

SEQ ID NO: 1538620 - RNA, 19 nt, Homo sapiens
agacagaaggcaucagaua

SEQ ID NO: 1538621 - RNA, 19 nt, Homo sapiens
gaaaggagagagaccuaug

SEQ ID NO: 1538622 - RNA, 19 nt, Homo sapiens
gcaaucauuuugagucuuu

SEQ ID NO: 1538623 - RNA, 19 nt, Homo sapiens
ccuuaaacaugguuauuga

SEQ ID NO: 1538624 - RNA, 19 nt, Homo sapiens
gcccguggcuuccagauuc

SEQ ID NO: 1538625 - RNA, 19 nt, Homo sapiens
agaaucaaauggaagaaga

SEQ ID NO: 1538626 - RNA, 19 nt, Homo sapiens
gagaaaagaguguauguuu

SEQ ID NO: 1538627 - RNA, 19 nt, Homo sapiens
gaaaagccauucaguacug

SEQ ID NO: 1538628 - RNA, 19 nt, Homo sapiens
gagugcaucuggaacauca

SEQ ID NO: 1538629 - RNA, 19 nt, Homo sapiens
ugaaugccguccuggcuuu

SEQ ID NO: 1538630 - RNA, 19 nt, Homo sapiens
ucaaauggaagaagaauca

SEQ ID NO: 1538631 - RNA, 19 nt, Homo sapiens
gcagugcuguccauuaaac

SEQ ID NO: 1538632 - RNA, 19 nt, Homo sapiens
gaaccaacgggacuguaaa

SEQ ID NO: 1538633 - RNA, 19 nt, Homo sapiens
gagacucaacacuaaauaa

SEQ ID NO: 1538634 - RNA, 19 nt, Homo sapiens
gggauuugauggagcagaa

SEQ ID NO: 1538635 - RNA, 19 nt, Homo sapiens
gaagaaggaaugaauugca

SEQ ID NO: 1538636 - RNA, 19 nt, Homo sapiens
ggagacucaacacuaaaua

SEQ ID NO: 1538637 - RNA, 19 nt, Homo sapiens
ucacagaacagcucagguu

SEQ ID NO: 1538638 - RNA, 19 nt, Homo sapiens
cccaaagccugcacacauu

SEQ ID NO: 1538639 - RNA, 19 nt, Homo sapiens
guguggaccucaugauuau

SEQ ID NO: 1538640 - RNA, 19 nt, Homo sapiens
ggaagacgugcaaagauau

SEQ ID NO: 1538641 - RNA, 19 nt, Homo sapiens
gcuagaggcccaucaagga

SEQ ID NO: 1538642 - RNA, 19 nt, Homo sapiens
cccgugagauguaaagaaa

SEQ ID NO: 1538643 - RNA, 19 nt, Homo sapiens
cuaacacacuaccuagaaa

SEQ ID NO: 1538644 - RNA, 19 nt, Homo sapiens
aaacacaagcacagacuuu

SEQ ID NO: 1538645 - RNA, 19 nt, Homo sapiens
caaccggucuggcaagaag

SEQ ID NO: 1538646 - RNA, 19 nt, Homo sapiens
ccaacgggacuguaaauug

SEQ ID NO: 1538647 - RNA, 19 nt, Homo sapiens
cguccuggcuuugagcuua

SEQ ID NO: 1538648 - RNA, 19 nt, Homo sapiens
gauuccaccuggcacauga

SEQ ID NO: 1538649 - RNA, 19 nt, Homo sapiens
uaacucuccugguaacuca

SEQ ID NO: 1538650 - RNA, 19 nt, Homo sapiens
gguuugagcucuggacuuc

SEQ ID NO: 1538651 - RNA, 19 nt, Homo sapiens
gaugagugccgcuuaaaca

SEQ ID NO: 1538652 - RNA, 19 nt, Homo sapiens
gugcaaagauauagaugag

SEQ ID NO: 1538653 - RNA, 19 nt, Homo sapiens
gacagaaggcaucagauau

SEQ ID NO: 1538654 - RNA, 19 nt, Homo sapiens
agagaccuauguuugcuaa

SEQ ID NO: 1538655 - RNA, 19 nt, Homo sapiens
cugcuccgcuccaaaguuu

SEQ ID NO: 1538656 - RNA, 19 nt, Homo sapiens
gcucaucaaggccuucuuu

SEQ ID NO: 1538657 - RNA, 19 nt, Homo sapiens
ggaagaaagaaucaaaugg

SEQ ID NO: 1538658 - RNA, 19 nt, Homo sapiens
acagaaggcaucagauauu

SEQ ID NO: 1538659 - RNA, 19 nt, Homo sapiens
gagccaagaauaagacaga

SEQ ID NO: 1538660 - RNA, 19 nt, Homo sapiens
gcuccaaaguuuccagcuu

SEQ ID NO: 1538661 - RNA, 19 nt, Homo sapiens
cagaagaaggaaugaauug

SEQ ID NO: 1538662 - RNA, 19 nt, Homo sapiens
uguaucaucuaaaggacua

SEQ ID NO: 1538663 - RNA, 19 nt, Homo sapiens
ggccagcuuucuugucuau

SEQ ID NO: 1538664 - RNA, 19 nt, Homo sapiens
ggccaacacucuguagaug

SEQ ID NO: 1538665 - RNA, 19 nt, Homo sapiens
cugaaaggaucccugaaga

SEQ ID NO: 1538666 - RNA, 19 nt, Homo sapiens
aaauugacaugcaacuaug

SEQ ID NO: 1538667 - RNA, 19 nt, Homo sapiens
ccaaagcuguagucccaau

SEQ ID NO: 1538668 - RNA, 19 nt, Homo sapiens
ccacauggccagcuuucuu

SEQ ID NO: 1538669 - RNA, 19 nt, Homo sapiens
ggaacugccaggauauaga

SEQ ID NO: 1538670 - RNA, 19 nt, Homo sapiens
gaggaacugccaggauaua

SEQ ID NO: 1538671 - RNA, 19 nt, Homo sapiens
gaaugaauugcaugaacaa

SEQ ID NO: 1538672 - RNA, 19 nt, Homo sapiens
ccugguaacucacagaaca

SEQ ID NO: 1538673 - RNA, 19 nt, Homo sapiens
gcuacauguuguccuuaaa

SEQ ID NO: 1538674 - RNA, 19 nt, Homo sapiens
cagauccucucuuucuuuc

SEQ ID NO: 1538675 - RNA, 19 nt, Homo sapiens
gaagacauugugcgagaug

SEQ ID NO: 1538676 - RNA, 19 nt, Homo sapiens
ucauccaccuuaaguguga

SEQ ID NO: 1538677 - RNA, 19 nt, Homo sapiens
caucguggcuaccuguugu

SEQ ID NO: 1538678 - RNA, 19 nt, Homo sapiens
gaaacuggcuuuaauguaa

SEQ ID NO: 1538679 - RNA, 19 nt, Homo sapiens
gaacacaucuacucuaaga

SEQ ID NO: 1538680 - RNA, 19 nt, Homo sapiens
gaacuuaucucacuggaau

SEQ ID NO: 1538681 - RNA, 19 nt, Homo sapiens
gcugagaugucuauauaua

SEQ ID NO: 1538682 - RNA, 19 nt, Homo sapiens
caagggaucuuucaauuau

SEQ ID NO: 1538683 - RNA, 19 nt, Homo sapiens
guaaaugguucacuuggua

SEQ ID NO: 1538684 - RNA, 19 nt, Homo sapiens
ggaauuguccucuuaauga

SEQ ID NO: 1538685 - RNA, 19 nt, Homo sapiens
cuagaacgauuacaacaua

SEQ ID NO: 1538686 - RNA, 19 nt, Homo sapiens
gaugugauauggaguagaa

SEQ ID NO: 1538687 - RNA, 19 nt, Homo sapiens
caagacacagguacuauua

SEQ ID NO: 1538688 - RNA, 19 nt, Homo sapiens
gcucuagacuugcacaauu

SEQ ID NO: 1538689 - RNA, 19 nt, Homo sapiens
ucagauaccuuguguagau

SEQ ID NO: 1538690 - RNA, 19 nt, Homo sapiens
gugaacacaucuacucuaa

SEQ ID NO: 1538691 - RNA, 19 nt, Homo sapiens
gaaaugagaacugugcuaa

SEQ ID NO: 1538692 - RNA, 19 nt, Homo sapiens
gaauuguccucuuaaugaa

SEQ ID NO: 1538693 - RNA, 19 nt, Homo sapiens
cugcugagaugucuauaua

SEQ ID NO: 1538694 - RNA, 19 nt, Homo sapiens
gccaagaacucucauucaa

SEQ ID NO: 1538695 - RNA, 19 nt, Homo sapiens
gagaagaaaugagaacugu

SEQ ID NO: 1538696 - RNA, 19 nt, Homo sapiens
gaacucucauucaaaccua

SEQ ID NO: 1538697 - RNA, 19 nt, Homo sapiens
cuaagaagcccaacuaaga

SEQ ID NO: 1538698 - RNA, 19 nt, Homo sapiens
gaaauuaaggcaccgaaga

SEQ ID NO: 1538699 - RNA, 19 nt, Homo sapiens
ggaaacagagcaacagcua

SEQ ID NO: 1538700 - RNA, 19 nt, Homo sapiens
ccaaacaguugcuugaugu

SEQ ID NO: 1538701 - RNA, 19 nt, Homo sapiens
caagaacucucauucaaac

SEQ ID NO: 1538702 - RNA, 19 nt, Homo sapiens
ccacaggcuucuauacuga

SEQ ID NO: 1538703 - RNA, 19 nt, Homo sapiens
aaacaaugauggugaaaca

SEQ ID NO: 1538704 - RNA, 19 nt, Homo sapiens
ggaaacuggcuuuaaugua

SEQ ID NO: 1538705 - RNA, 19 nt, Homo sapiens
cauguuguguuucaaguaa

SEQ ID NO: 1538706 - RNA, 19 nt, Homo sapiens
gaacgauuacaacauauga

SEQ ID NO: 1538707 - RNA, 19 nt, Homo sapiens
caauuuagcccucuccaaa

SEQ ID NO: 1538708 - RNA, 19 nt, Homo sapiens
gagcaacagcuacaacaaa

SEQ ID NO: 1538709 - RNA, 19 nt, Homo sapiens
ggaacuagaacgauuacaa

SEQ ID NO: 1538710 - RNA, 19 nt, Homo sapiens
gaaggaaguaccauagaga

SEQ ID NO: 1538711 - RNA, 19 nt, Homo sapiens
gcuaacagccuacgugugu

SEQ ID NO: 1538712 - RNA, 19 nt, Homo sapiens
ccauacaaaucaaucaaug

SEQ ID NO: 1538713 - RNA, 19 nt, Homo sapiens
aaacagcaguguggaagaa

SEQ ID NO: 1538714 - RNA, 19 nt, Homo sapiens
gaaccauccauuaacaauu

SEQ ID NO: 1538715 - RNA, 19 nt, Homo sapiens
aacaagggaucuuucaauu

SEQ ID NO: 1538716 - RNA, 19 nt, Homo sapiens
cacaaucuguugcauguug

SEQ ID NO: 1538717 - RNA, 19 nt, Homo sapiens
gauaacucguuuacuggaa

SEQ ID NO: 1538718 - RNA, 19 nt, Homo sapiens
auaagggucuucacucuga

SEQ ID NO: 1538719 - RNA, 19 nt, Homo sapiens
gaaguaccauagagaagag

SEQ ID NO: 1538720 - RNA, 19 nt, Homo sapiens
ggaaguaccauagagaaga

SEQ ID NO: 1538721 - RNA, 19 nt, Homo sapiens
uuauggaauuguccucuua

SEQ ID NO: 1538722 - RNA, 19 nt, Homo sapiens
acaagggaucuuucaauua

SEQ ID NO: 1538723 - RNA, 19 nt, Homo sapiens
ugacauauuucacaaucug

SEQ ID NO: 1538724 - RNA, 19 nt, Homo sapiens
gcaaauauagauggaauuc

SEQ ID NO: 1538725 - RNA, 19 nt, Homo sapiens
gaacuugaagccagaaaca

SEQ ID NO: 1538726 - RNA, 19 nt, Homo sapiens
aaccauccauuaacaauug

SEQ ID NO: 1538727 - RNA, 19 nt, Homo sapiens
ccaagaacucucauucaaa

SEQ ID NO: 1538728 - RNA, 19 nt, Homo sapiens
gcaaugcuggcaaauauag

SEQ ID NO: 1538729 - RNA, 19 nt, Homo sapiens
acaguugcuugaugugaua

SEQ ID NO: 1538730 - RNA, 19 nt, Homo sapiens
gaacuagaacgauuacaac

SEQ ID NO: 1538731 - RNA, 19 nt, Homo sapiens
caacugaugcuagaaccua

SEQ ID NO: 1538732 - RNA, 19 nt, Homo sapiens
gauauggaguagaacuugu

SEQ ID NO: 1538733 - RNA, 19 nt, Homo sapiens
cgccuucccuuauugcuaa

SEQ ID NO: 1538734 - RNA, 19 nt, Homo sapiens
cuugauaacucguuuacug

SEQ ID NO: 1538735 - RNA, 19 nt, Homo sapiens
guauuuccauauccugauu

SEQ ID NO: 1538736 - RNA, 19 nt, Homo sapiens
gcacugcugagaugucuau

SEQ ID NO: 1538737 - RNA, 19 nt, Homo sapiens
cagauaccuuguguagaua

SEQ ID NO: 1538738 - RNA, 19 nt, Homo sapiens
uuucagugcucuagacuug

SEQ ID NO: 1538739 - RNA, 19 nt, Homo sapiens
aacauuaccugcuccaaau

SEQ ID NO: 1538740 - RNA, 19 nt, Homo sapiens
aaacauuaccugcuccaaa

SEQ ID NO: 1538741 - RNA, 19 nt, Homo sapiens
acaauugcuucaguugaua

SEQ ID NO: 1538742 - RNA, 19 nt, Homo sapiens
gaugcuagaaccuaauuug

SEQ ID NO: 1538743 - RNA, 19 nt, Homo sapiens
guugaacacuugauaacuc

SEQ ID NO: 1538744 - RNA, 19 nt, Homo sapiens
aaacaagggaucuuucaau

SEQ ID NO: 1538745 - RNA, 19 nt, Homo sapiens
guaaacaagggaucuuuca

SEQ ID NO: 1538746 - RNA, 19 nt, Homo sapiens
gaguagaacuugugaaaag

SEQ ID NO: 1538747 - RNA, 19 nt, Homo sapiens
ccaacuaagauaugguuaa

SEQ ID NO: 1538748 - RNA, 19 nt, Homo sapiens
gauaccuuguguagauaaa

SEQ ID NO: 1538749 - RNA, 19 nt, Homo sapiens
caaacgacuuucuguacuc

SEQ ID NO: 1538750 - RNA, 19 nt, Homo sapiens
uaacaauugcuucaguuga

SEQ ID NO: 1538751 - RNA, 19 nt, Homo sapiens
aaugagaacugugcuaaca

SEQ ID NO: 1538752 - RNA, 19 nt, Homo sapiens
gcaccgaagagaaacuuug

SEQ ID NO: 1538753 - RNA, 19 nt, Homo sapiens
gaacacuugauaacucguu

SEQ ID NO: 1538754 - RNA, 19 nt, Homo sapiens
gaaacagcaguguggaaga

SEQ ID NO: 1538755 - RNA, 19 nt, Homo sapiens
ucuguugcauguuguguuu

SEQ ID NO: 1538756 - RNA, 19 nt, Homo sapiens
ugaaggaaguaccauagag

SEQ ID NO: 1538757 - RNA, 19 nt, Homo sapiens
guacacagaauaguaaaca

SEQ ID NO: 1538758 - RNA, 19 nt, Homo sapiens
ccaguauaauuccaucaau

SEQ ID NO: 1538759 - RNA, 19 nt, Homo sapiens
ccaagacacagguacuauu

SEQ ID NO: 1538760 - RNA, 19 nt, Homo sapiens
uaagaagcccaacuaagau

SEQ ID NO: 1538761 - RNA, 19 nt, Homo sapiens
aaagagaggccaagacuac

SEQ ID NO: 1538762 - RNA, 19 nt, Homo sapiens
ucaccgaggagccaaauga

SEQ ID NO: 1538763 - RNA, 19 nt, Homo sapiens
gacaaaugauacuuuacuc

SEQ ID NO: 1538764 - RNA, 19 nt, Homo sapiens
uuaaggcaccgaagagaaa

SEQ ID NO: 1538765 - RNA, 19 nt, Homo sapiens
gagaggccaagacuacaaa

SEQ ID NO: 1538766 - RNA, 19 nt, Homo sapiens
ggaauuugaaacauggaaa

SEQ ID NO: 1538767 - RNA, 19 nt, Homo sapiens
uaaugaaggaaguaccaua

SEQ ID NO: 1538768 - RNA, 19 nt, Homo sapiens
aaacagagcaacagcuaca

SEQ ID NO: 1538769 - RNA, 19 nt, Homo sapiens
agaccauucucuauucaga

SEQ ID NO: 1538770 - RNA, 19 nt, Homo sapiens
ggagaagaaaugagaacug

SEQ ID NO: 1538771 - RNA, 19 nt, Homo sapiens
aguggaaacuggcuuuaau

SEQ ID NO: 1538772 - RNA, 19 nt, Homo sapiens
aggcuucuauacugacaua

SEQ ID NO: 1538773 - RNA, 19 nt, Homo sapiens
agacacagguacuauuaac

SEQ ID NO: 1538774 - RNA, 19 nt, Homo sapiens
aagaaacuuuaccgacaaa

SEQ ID NO: 1538775 - RNA, 19 nt, Homo sapiens
uggcaaauauagauggaau

SEQ ID NO: 1538776 - RNA, 19 nt, Homo sapiens
cgaggagccaaaugaagua

SEQ ID NO: 1538777 - RNA, 19 nt, Homo sapiens
ugagauucauguuaguuca

SEQ ID NO: 1538778 - RNA, 19 nt, Homo sapiens
gcagagugcuuuauaaaua

SEQ ID NO: 1538779 - RNA, 19 nt, Homo sapiens
gaucauccauccaucugua

SEQ ID NO: 1538780 - RNA, 19 nt, Homo sapiens
ggacuaauacugagugauu

SEQ ID NO: 1538781 - RNA, 19 nt, Homo sapiens
ggacccagauggugacuga

SEQ ID NO: 1538782 - RNA, 19 nt, Homo sapiens
ggacuuggguucccugugu

SEQ ID NO: 1538783 - RNA, 19 nt, Homo sapiens
gaaggaagaagcaggauga

SEQ ID NO: 1538784 - RNA, 19 nt, Homo sapiens
gagaauaucaucagcaaga

SEQ ID NO: 1538785 - RNA, 19 nt, Homo sapiens
ccagagagcuagaaagaag

SEQ ID NO: 1538786 - RNA, 19 nt, Homo sapiens
gcacaucugcuguccauug

SEQ ID NO: 1538787 - RNA, 19 nt, Homo sapiens
gcccauuccucucauauug

SEQ ID NO: 1538788 - RNA, 19 nt, Homo sapiens
gaauauagccaagcauaga

SEQ ID NO: 1538789 - RNA, 19 nt, Homo sapiens
cacuagagcugaaaggaaa

SEQ ID NO: 1538790 - RNA, 19 nt, Homo sapiens
acuaaagguuguacacaua

SEQ ID NO: 1538791 - RNA, 19 nt, Homo sapiens
gagcugaaaggaaauuuga

SEQ ID NO: 1538792 - RNA, 19 nt, Homo sapiens
gaagaagcaggaugacaga

SEQ ID NO: 1538793 - RNA, 19 nt, Homo sapiens
gcacuagagcugaaaggaa

SEQ ID NO: 1538794 - RNA, 19 nt, Homo sapiens
gugcuacacuuaucacugu

SEQ ID NO: 1538795 - RNA, 19 nt, Homo sapiens
uaucgaaacccaucuguga

SEQ ID NO: 1538796 - RNA, 19 nt, Homo sapiens
gaaauuugaccuccaagca

SEQ ID NO: 1538797 - RNA, 19 nt, Homo sapiens
agagagaagugugcaugua

SEQ ID NO: 1538798 - RNA, 19 nt, Homo sapiens
acacacacacacagaaaua

SEQ ID NO: 1538799 - RNA, 19 nt, Homo sapiens
cuagaaagaaggucauaaa

SEQ ID NO: 1538800 - RNA, 19 nt, Homo sapiens
uuaacugacugcugacuug

SEQ ID NO: 1538801 - RNA, 19 nt, Homo sapiens
gauugcagagugcuuuaua

SEQ ID NO: 1538802 - RNA, 19 nt, Homo sapiens
acacacacacagaaauaua

SEQ ID NO: 1538803 - RNA, 19 nt, Homo sapiens
cugaguaccuggaaauugu

SEQ ID NO: 1538804 - RNA, 19 nt, Homo sapiens
ccgagcaacuuccucaaga

SEQ ID NO: 1538805 - RNA, 19 nt, Homo sapiens
gcuccuaucucacuaagac

SEQ ID NO: 1538806 - RNA, 19 nt, Homo sapiens
ugccauuguugcuaaauaa

SEQ ID NO: 1538807 - RNA, 19 nt, Homo sapiens
auacugccauuguugcuaa

SEQ ID NO: 1538808 - RNA, 19 nt, Homo sapiens
guucuugcgcccuuuauaa

SEQ ID NO: 1538809 - RNA, 19 nt, Homo sapiens
ggcuguggcugagacaaua

SEQ ID NO: 1538810 - RNA, 19 nt, Homo sapiens
agaaggucauaaaggguua

SEQ ID NO: 1538811 - RNA, 19 nt, Homo sapiens
acacaucaguaccacaaga

SEQ ID NO: 1538812 - RNA, 19 nt, Homo sapiens
ccgagaauaucaucagcaa

SEQ ID NO: 1538813 - RNA, 19 nt, Homo sapiens
ugaaauacugccauuguug

SEQ ID NO: 1538814 - RNA, 19 nt, Homo sapiens
gguagaagagguugaguca

SEQ ID NO: 1538815 - RNA, 19 nt, Homo sapiens
uaaagguuguacacauaga

SEQ ID NO: 1538816 - RNA, 19 nt, Homo sapiens
gaaaccccgucucuacuaa

SEQ ID NO: 1538817 - RNA, 19 nt, Homo sapiens
aaacccaucugugaaacuu

SEQ ID NO: 1538818 - RNA, 19 nt, Homo sapiens
cgagggcugugaagcagaa

SEQ ID NO: 1538819 - RNA, 19 nt, Homo sapiens
ucacuaagaccguccugaa

SEQ ID NO: 1538820 - RNA, 19 nt, Homo sapiens
ucagcucuguaucugguua

SEQ ID NO: 1538821 - RNA, 19 nt, Homo sapiens
cguggucuauuauaacuau

SEQ ID NO: 1538822 - RNA, 19 nt, Homo sapiens
gcaguucuugcgcccuuua

SEQ ID NO: 1538823 - RNA, 19 nt, Homo sapiens
cuaagaccguccugaaagu

SEQ ID NO: 1538824 - RNA, 19 nt, Homo sapiens
gugcaggacuuugaugcuu

SEQ ID NO: 1538825 - RNA, 19 nt, Homo sapiens
caugaaauacugccauugu

SEQ ID NO: 1538826 - RNA, 19 nt, Homo sapiens
gacuaauacugagugauug

SEQ ID NO: 1538827 - RNA, 19 nt, Homo sapiens
gaugaucagcucuguaucu

SEQ ID NO: 1538828 - RNA, 19 nt, Homo sapiens
ccauccaucuguacaguuc

SEQ ID NO: 1538829 - RNA, 19 nt, Homo sapiens
ugucuuugcuuucccaugu

SEQ ID NO: 1538830 - RNA, 19 nt, Homo sapiens
gcaagacacaucaguacca

SEQ ID NO: 1538831 - RNA, 19 nt, Homo sapiens
cacacacacagaaauauaa

SEQ ID NO: 1538832 - RNA, 19 nt, Homo sapiens
acuccguggucuauuauaa

SEQ ID NO: 1538833 - RNA, 19 nt, Homo sapiens
aauaaugaggccagaagua

SEQ ID NO: 1538834 - RNA, 19 nt, Homo sapiens
acacauagaugggcacacu

SEQ ID NO: 1538835 - RNA, 19 nt, Homo sapiens
acaugggcauuucagauga

SEQ ID NO: 1538836 - RNA, 19 nt, Homo sapiens
cugaauauagccaagcaua

SEQ ID NO: 1538837 - RNA, 19 nt, Homo sapiens
cuugugugcucugaauaua

SEQ ID NO: 1538838 - RNA, 19 nt, Homo sapiens
aaaaggacaugguggagaa

SEQ ID NO: 1538839 - RNA, 19 nt, Homo sapiens
ucagcaagacacaucagua

SEQ ID NO: 1538840 - RNA, 19 nt, Homo sapiens
cugccauuguugcuaaaua

SEQ ID NO: 1538841 - RNA, 19 nt, Homo sapiens
aaggaaauuugaccuccaa

SEQ ID NO: 1538842 - RNA, 19 nt, Homo sapiens
gagagaagugugcauguac

SEQ ID NO: 1538843 - RNA, 19 nt, Homo sapiens
uuagaggcauccaaguguu

SEQ ID NO: 1538844 - RNA, 19 nt, Homo sapiens
uggcccagcuccuaucuca

SEQ ID NO: 1538845 - RNA, 19 nt, Homo sapiens
guacaugacccugcggaau

SEQ ID NO: 1538846 - RNA, 19 nt, Homo sapiens
aagcuugugugcucugaau

SEQ ID NO: 1538847 - RNA, 19 nt, Homo sapiens
uaaagcuugugugcucuga

SEQ ID NO: 1538848 - RNA, 19 nt, Homo sapiens
ucugggcucugucgcugua

SEQ ID NO: 1538849 - RNA, 19 nt, Homo sapiens
ucgaaacccaucugugaaa

SEQ ID NO: 1538850 - RNA, 19 nt, Homo sapiens
ccgcaggccuguaugaacu

SEQ ID NO: 1538851 - RNA, 19 nt, Homo sapiens
acacacacacacacagaaa

SEQ ID NO: 1538852 - RNA, 19 nt, Homo sapiens
ccacugcccauuccucuca

SEQ ID NO: 1538853 - RNA, 19 nt, Homo sapiens
ccuguaaucccagcacuuu

SEQ ID NO: 1538854 - RNA, 19 nt, Homo sapiens
ggcccucccuuugugcuuu

SEQ ID NO: 1538855 - RNA, 19 nt, Homo sapiens
ggugcuuacuggcaagaug

SEQ ID NO: 1538856 - RNA, 19 nt, Homo sapiens
agagaagugugcauguaca

SEQ ID NO: 1538857 - RNA, 19 nt, Homo sapiens
gcuagaaagaaggucauaa

SEQ ID NO: 1538858 - RNA, 19 nt, Homo sapiens
agacacaucaguaccacaa

SEQ ID NO: 1538859 - RNA, 19 nt, Homo sapiens
ucacaugggcauuucagau

SEQ ID NO: 1538860 - RNA, 19 nt, Homo sapiens
agaaagaaggucauaaagg

SEQ ID NO: 1538861 - RNA, 19 nt, Homo sapiens
uggcacaucugcuguccau

SEQ ID NO: 1538862 - RNA, 19 nt, Homo sapiens
gggcccacccuaauucaga

SEQ ID NO: 1538863 - RNA, 19 nt, Homo sapiens
augaaauacugccauuguu

SEQ ID NO: 1538864 - RNA, 19 nt, Homo sapiens
ggaaugccacucagcaaaa

SEQ ID NO: 1538865 - RNA, 19 nt, Homo sapiens
gaauaucaucagcaagaca

SEQ ID NO: 1538866 - RNA, 19 nt, Homo sapiens
ccacgagggcugugaagca

SEQ ID NO: 1538867 - RNA, 19 nt, Homo sapiens
gcuugugugcucugaauau

SEQ ID NO: 1538868 - RNA, 19 nt, Homo sapiens
gguggugggugccuguagu

SEQ ID NO: 1538869 - RNA, 19 nt, Homo sapiens
cacaugggcauuucagaug

SEQ ID NO: 1538870 - RNA, 19 nt, Homo sapiens
ugccagagagcuagaaaga

SEQ ID NO: 1538871 - RNA, 19 nt, Homo sapiens
uacaugacccugcggaaug

SEQ ID NO: 1538872 - RNA, 19 nt, Homo sapiens
aagaugaccgugaccuuga

SEQ ID NO: 1538873 - RNA, 19 nt, Homo sapiens
gcaauggcccaggcagugu

SEQ ID NO: 1538874 - RNA, 19 nt, Homo sapiens
uaacuaaagguuguacaca

SEQ ID NO: 1538875 - RNA, 19 nt, Homo sapiens
caucugaguaccuggaaau

SEQ ID NO: 1538876 - RNA, 19 nt, Homo sapiens
cggaaugccacucagcaaa

SEQ ID NO: 1538877 - RNA, 19 nt, Homo sapiens
cagcaagacacaucaguac

SEQ ID NO: 1538878 - RNA, 19 nt, Homo sapiens
gaagaggugucucccuauu

SEQ ID NO: 1538879 - RNA, 19 nt, Homo sapiens
ggaggaaggugcccacguu

SEQ ID NO: 1538880 - RNA, 19 nt, Homo sapiens
gaaaggaagcggauguuca

SEQ ID NO: 1538881 - RNA, 19 nt, Homo sapiens
gagaagaggaggaggaaga

SEQ ID NO: 1538882 - RNA, 19 nt, Homo sapiens
gucuauaucuccuucauga

SEQ ID NO: 1538883 - RNA, 19 nt, Homo sapiens
cacguuugcuuacgagaaa

SEQ ID NO: 1538884 - RNA, 19 nt, Homo sapiens
ggaagaggagcgcggaaga

SEQ ID NO: 1538885 - RNA, 19 nt, Homo sapiens
ggagagcugugagaagaag

SEQ ID NO: 1538886 - RNA, 19 nt, Homo sapiens
aaaggaagcggauguucaa

SEQ ID NO: 1538887 - RNA, 19 nt, Homo sapiens
agaggugucucccuauuag

SEQ ID NO: 1538888 - RNA, 19 nt, Homo sapiens
acacuacggugcuggacuu

SEQ ID NO: 1538889 - RNA, 19 nt, Homo sapiens
ggaagcggauguucaaccu

SEQ ID NO: 1538890 - RNA, 19 nt, Homo sapiens
ggaagaggugucucccuau

SEQ ID NO: 1538891 - RNA, 19 nt, Homo sapiens
uuggagagcugugagaaga

SEQ ID NO: 1538892 - RNA, 19 nt, Homo sapiens
gaggaaggugcccacguuu

SEQ ID NO: 1538893 - RNA, 19 nt, Homo sapiens
aagaggugucucccuauua

SEQ ID NO: 1538894 - RNA, 19 nt, Homo sapiens
ggaaggugcccacguuugc

SEQ ID NO: 1538895 - RNA, 19 nt, Homo sapiens
gccuggccaucgucuauau

SEQ ID NO: 1538896 - RNA, 19 nt, Homo sapiens
gaagaggagcgcggaagag

SEQ ID NO: 1538897 - RNA, 19 nt, Homo sapiens
gcugugagaagaaggaaag

SEQ ID NO: 1538898 - RNA, 19 nt, Homo sapiens
ccacguuugcuuacgagaa

SEQ ID NO: 1538899 - RNA, 19 nt, Homo sapiens
gcgaaaggaagcggauguu

SEQ ID NO: 1538900 - RNA, 19 nt, Homo sapiens
gccaacauccgcgaaagga

SEQ ID NO: 1538901 - RNA, 19 nt, Homo sapiens
cuacggugcuggacuucgu

SEQ ID NO: 1538902 - RNA, 19 nt, Homo sapiens
agaagaggagugcgaagug

SEQ ID NO: 1538903 - RNA, 19 nt, Homo sapiens
cgaaaggaagcggauguuc

SEQ ID NO: 1538904 - RNA, 19 nt, Homo sapiens
gaagagaugucaggaacuu

SEQ ID NO: 1538905 - RNA, 19 nt, Homo sapiens
gaaucaggcaucuuauuua

SEQ ID NO: 1538906 - RNA, 19 nt, Homo sapiens
ucaggcaucuuauuuaguu

SEQ ID NO: 1538907 - RNA, 19 nt, Homo sapiens
caaaggaguuggacaaggu

SEQ ID NO: 1538908 - RNA, 19 nt, Homo sapiens
ccaagaccauucacaguau

SEQ ID NO: 1538909 - RNA, 19 nt, Homo sapiens
gagagacauugaaagacua

SEQ ID NO: 1538910 - RNA, 19 nt, Homo sapiens
ugaaucaggcaucuuauuu

SEQ ID NO: 1538911 - RNA, 19 nt, Homo sapiens
gagaaucagggccaaguuu

SEQ ID NO: 1538912 - RNA, 19 nt, Homo sapiens
gggcaggguauuuauuuaa

SEQ ID NO: 1538913 - RNA, 19 nt, Homo sapiens
caagaccauucacaguauu

SEQ ID NO: 1538914 - RNA, 19 nt, Homo sapiens
gggaggaggagggaaauuu

SEQ ID NO: 1538915 - RNA, 19 nt, Homo sapiens
aaucaggcaucuuauuuag

SEQ ID NO: 1538916 - RNA, 19 nt, Homo sapiens
gcagagggcccaagaccau

SEQ ID NO: 1538917 - RNA, 19 nt, Homo sapiens
ugagagacauugaaagacu

SEQ ID NO: 1538918 - RNA, 19 nt, Homo sapiens
ggaagcugcuggaggugau

SEQ ID NO: 1538919 - RNA, 19 nt, Homo sapiens
ggaagcagagggcccaaga

SEQ ID NO: 1538920 - RNA, 19 nt, Homo sapiens
gaaagagagggacuagagu

SEQ ID NO: 1538921 - RNA, 19 nt, Homo sapiens
ugggcaggguauuuauuua

SEQ ID NO: 1538922 - RNA, 19 nt, Homo sapiens
cccaagaccauucacagua

SEQ ID NO: 1538923 - RNA, 19 nt, Homo sapiens
ccaccgcaauggagacuuc

SEQ ID NO: 1538924 - RNA, 19 nt, Homo sapiens
ugaaagagagggacuagag

SEQ ID NO: 1538925 - RNA, 19 nt, Homo sapiens
gugggcaggguauuuauuu

SEQ ID NO: 1538926 - RNA, 19 nt, Homo sapiens
ggacaccagaggaggaaga

SEQ ID NO: 1538927 - RNA, 19 nt, Homo sapiens
ggaguggaccgagagaaga

SEQ ID NO: 1538928 - RNA, 19 nt, Homo sapiens
ggagaaucagggccaaguu

SEQ ID NO: 1538929 - RNA, 19 nt, Homo sapiens
ggaggaggguuugcuugag

SEQ ID NO: 1538930 - RNA, 19 nt, Homo sapiens
ccagauggaggagcucuuu

SEQ ID NO: 1538931 - RNA, 19 nt, Homo sapiens
agaauuugguagucagugu

SEQ ID NO: 1538932 - RNA, 19 nt, Homo sapiens
caccagaggaggaagaaga

SEQ ID NO: 1538933 - RNA, 19 nt, Homo sapiens
ggaggaggaggguuugcuu

SEQ ID NO: 1538934 - RNA, 19 nt, Homo sapiens
aaacaaaacagaagagaug

SEQ ID NO: 1538935 - RNA, 19 nt, Homo sapiens
gaguggaccgagagaagaa

SEQ ID NO: 1538936 - RNA, 19 nt, Homo sapiens
gaggaggagggaaauuuua

SEQ ID NO: 1538937 - RNA, 19 nt, Homo sapiens
ccagggaugggcaggauga

SEQ ID NO: 1538938 - RNA, 19 nt, Homo sapiens
ggaagggaugggaggaaga

SEQ ID NO: 1538939 - RNA, 19 nt, Homo sapiens
cuugagagacauugaaaga

SEQ ID NO: 1538940 - RNA, 19 nt, Homo sapiens
gggacuagagugccagaug

SEQ ID NO: 1538941 - RNA, 19 nt, Homo sapiens
aagcaaaggaguuggacaa

SEQ ID NO: 1538942 - RNA, 19 nt, Homo sapiens
uggaggagcucuuuucuag

SEQ ID NO: 1538943 - RNA, 19 nt, Homo sapiens
ggaggaggagggaaauuuu

SEQ ID NO: 1538944 - RNA, 19 nt, Homo sapiens
gagaaaagcaaaggaguug

SEQ ID NO: 1538945 - RNA, 19 nt, Homo sapiens
guacaccccuccuccugaa

SEQ ID NO: 1538946 - RNA, 19 nt, Homo sapiens
cggaggaggaggaggguuu

SEQ ID NO: 1538947 - RNA, 19 nt, Homo sapiens
gaaaagcaaaggaguugga

SEQ ID NO: 1538948 - RNA, 19 nt, Homo sapiens
caaugccaaugccuaaagg

SEQ ID NO: 1538949 - RNA, 19 nt, Homo sapiens
ggagaaaagcaaaggaguu

SEQ ID NO: 1538950 - RNA, 19 nt, Homo sapiens
agaaucagggccaaguuug

SEQ ID NO: 1538951 - RNA, 19 nt, Homo sapiens
gagaaccccugcccuccaa

SEQ ID NO: 1538952 - RNA, 19 nt, Homo sapiens
gggaguggaccgagagaag

SEQ ID NO: 1538953 - RNA, 19 nt, Homo sapiens
ccaaugccaaugccuaaag

SEQ ID NO: 1538954 - RNA, 19 nt, Homo sapiens
gaagggaugggaggaagag

SEQ ID NO: 1538955 - RNA, 19 nt, Homo sapiens
ggugggcaggguauuuauu

SEQ ID NO: 1538956 - RNA, 19 nt, Homo sapiens
agaccauucacaguauuua

SEQ ID NO: 1538957 - RNA, 19 nt, Homo sapiens
gggccuuucugaccuacuc

SEQ ID NO: 1538958 - RNA, 19 nt, Homo sapiens
gggcgauucugggccuuuc

SEQ ID NO: 1538959 - RNA, 19 nt, Homo sapiens
ggaggaggaggaggguuug

SEQ ID NO: 1538960 - RNA, 19 nt, Homo sapiens
aguguggccugcucugaau

SEQ ID NO: 1538961 - RNA, 19 nt, Homo sapiens
gaaucagggccaaguuugc

SEQ ID NO: 1538962 - RNA, 19 nt, Homo sapiens
gggcuuaggaugccaacag

SEQ ID NO: 1538963 - RNA, 19 nt, Homo sapiens
ccauucacaguauuuacaa

SEQ ID NO: 1538964 - RNA, 19 nt, Homo sapiens
gcccaagaccauucacagu

SEQ ID NO: 1538965 - RNA, 19 nt, Homo sapiens
ggacugaaguucugcaaag

SEQ ID NO: 1538966 - RNA, 19 nt, Homo sapiens
ggaccuccaucguguuuga

SEQ ID NO: 1538967 - RNA, 19 nt, Homo sapiens
guaccgcaccggccauuaa

SEQ ID NO: 1538968 - RNA, 19 nt, Homo sapiens
ggaaaccacagcagugaug

SEQ ID NO: 1538969 - RNA, 19 nt, Homo sapiens
cgcuggagcugcuguguuu

SEQ ID NO: 1538970 - RNA, 19 nt, Homo sapiens
ccagcacgcucaucuucuu

SEQ ID NO: 1538971 - RNA, 19 nt, Homo sapiens
gagccucaccuacaucuug

SEQ ID NO: 1538972 - RNA, 19 nt, Homo sapiens
caccgcaggcuaccucuua

SEQ ID NO: 1538973 - RNA, 19 nt, Homo sapiens
ggcugugacugcccuguuu

SEQ ID NO: 1538974 - RNA, 19 nt, Homo sapiens
caucauggcuguguucaac

SEQ ID NO: 1538975 - RNA, 19 nt, Homo sapiens
gcacuguguucugcguuug

SEQ ID NO: 1538976 - RNA, 19 nt, Homo sapiens
gccgugaccuacuucauca

SEQ ID NO: 1538977 - RNA, 19 nt, Homo sapiens
cagcuguccuccugaacaa

SEQ ID NO: 1538978 - RNA, 19 nt, Homo sapiens
gcgucuaccuuccaucugu

SEQ ID NO: 1538979 - RNA, 19 nt, Homo sapiens
gggccuacaugcgcuuuga

SEQ ID NO: 1538980 - RNA, 19 nt, Homo sapiens
gaccguguccuacauguca

SEQ ID NO: 1538981 - RNA, 19 nt, Homo sapiens
ggacguggacuaccugcau

SEQ ID NO: 1538982 - RNA, 19 nt, Homo sapiens
ucacggauacuacauugga

SEQ ID NO: 1538983 - RNA, 19 nt, Homo sapiens
cugcuucucccaaacauaa

SEQ ID NO: 1538984 - RNA, 19 nt, Homo sapiens
gaccaggccuacgccauca

SEQ ID NO: 1538985 - RNA, 19 nt, Homo sapiens
uggacuaccugcaucacaa

SEQ ID NO: 1538986 - RNA, 19 nt, Homo sapiens
gaacucuggagcccugaga

SEQ ID NO: 1538987 - RNA, 19 nt, Homo sapiens
caucagcaacggcuacuuc

SEQ ID NO: 1538988 - RNA, 19 nt, Homo sapiens
gcagcaauccagcuucuac

SEQ ID NO: 1538989 - RNA, 19 nt, Homo sapiens
gcagcuguccuccugaaca

SEQ ID NO: 1538990 - RNA, 19 nt, Homo sapiens
ccauacaacagcuucauca

SEQ ID NO: 1538991 - RNA, 19 nt, Homo sapiens
cagcaagggacucgacaga

SEQ ID NO: 1538992 - RNA, 19 nt, Homo sapiens
uuucacggauacuacauug

SEQ ID NO: 1538993 - RNA, 19 nt, Homo sapiens
ccuucuguccucauucuua

SEQ ID NO: 1538994 - RNA, 19 nt, Homo sapiens
caccuucagagcccuguua

SEQ ID NO: 1538995 - RNA, 19 nt, Homo sapiens
gcuucgugcucuucuauac

SEQ ID NO: 1538996 - RNA, 19 nt, Homo sapiens
gacugaaguucugcaaagu

SEQ ID NO: 1538997 - RNA, 19 nt, Homo sapiens
gugcagcaauccagcuucu

SEQ ID NO: 1538998 - RNA, 19 nt, Homo sapiens
cauccucgcaggccucuga

SEQ ID NO: 1538999 - RNA, 19 nt, Homo sapiens
gggccgacaugcucuccau

SEQ ID NO: 1539000 - RNA, 19 nt, Homo sapiens
uggcagcuguccuccugaa

SEQ ID NO: 1539001 - RNA, 19 nt, Homo sapiens
guuaucacgccaucuacuu

SEQ ID NO: 1539002 - RNA, 19 nt, Homo sapiens
cuaccugcaucacaaguac

SEQ ID NO: 1539003 - RNA, 19 nt, Homo sapiens
gcucuggccagcacugugu

SEQ ID NO: 1539004 - RNA, 19 nt, Homo sapiens
ccaugaccguguccuacau

SEQ ID NO: 1539005 - RNA, 19 nt, Homo sapiens
gccuugggcccucuccuuu

SEQ ID NO: 1539006 - RNA, 19 nt, Homo sapiens
ccgaggaccggaacacguu

SEQ ID NO: 1539007 - RNA, 19 nt, Homo sapiens
uaucacgccaucuacuuug

SEQ ID NO: 1539008 - RNA, 19 nt, Homo sapiens
cuucagagcccuguuacug

SEQ ID NO: 1539009 - RNA, 19 nt, Homo sapiens
ggcgugaugaucucucuga

SEQ ID NO: 1539010 - RNA, 19 nt, Homo sapiens
ggacuaccugcaucacaag

SEQ ID NO: 1539011 - RNA, 19 nt, Homo sapiens
gugcuucaccuucgacagu

SEQ ID NO: 1539012 - RNA, 19 nt, Homo sapiens
ccaucgccgugaccuacuu

SEQ ID NO: 1539013 - RNA, 19 nt, Homo sapiens
gucccagcuuucacggaua

SEQ ID NO: 1539014 - RNA, 19 nt, Homo sapiens
ugcaucagccucugggaaa

SEQ ID NO: 1539015 - RNA, 19 nt, Homo sapiens
uuaucacgccaucuacuuu

SEQ ID NO: 1539016 - RNA, 19 nt, Homo sapiens
uguucaaccugucagacuu

SEQ ID NO: 1539017 - RNA, 19 nt, Homo sapiens
gcuuccugcugccauacaa

SEQ ID NO: 1539018 - RNA, 19 nt, Homo sapiens
cagcuggcccaccuucaga

SEQ ID NO: 1539019 - RNA, 19 nt, Homo sapiens
gauaauaccuuucugauga

SEQ ID NO: 1539020 - RNA, 19 nt, Homo sapiens
gagaauggguuuccaauaa

SEQ ID NO: 1539021 - RNA, 19 nt, Homo sapiens
ccaaaugccugccagauaa

SEQ ID NO: 1539022 - RNA, 19 nt, Homo sapiens
ugaauuaccuccugcauuu

SEQ ID NO: 1539023 - RNA, 19 nt, Homo sapiens
gcauugagcuggaucuaaa

SEQ ID NO: 1539024 - RNA, 19 nt, Homo sapiens
gggaagggcuccauuuauu

SEQ ID NO: 1539025 - RNA, 19 nt, Homo sapiens
gaaagagucuccaaaauga

SEQ ID NO: 1539026 - RNA, 19 nt, Homo sapiens
gguggaauaugccgucuua

SEQ ID NO: 1539027 - RNA, 19 nt, Homo sapiens
gaugaugugucuggaaaua

SEQ ID NO: 1539028 - RNA, 19 nt, Homo sapiens
ugacaaagcuucacuucug

SEQ ID NO: 1539029 - RNA, 19 nt, Homo sapiens
ggaagggcuccauuuauua

SEQ ID NO: 1539030 - RNA, 19 nt, Homo sapiens
ccucaucucucucugauaa

SEQ ID NO: 1539031 - RNA, 19 nt, Homo sapiens
ccaaaugacuaaauccuau

SEQ ID NO: 1539032 - RNA, 19 nt, Homo sapiens
acacacacaugguuucuaa

SEQ ID NO: 1539033 - RNA, 19 nt, Homo sapiens
gaaugcagcucaacgaagu

SEQ ID NO: 1539034 - RNA, 19 nt, Homo sapiens
uaagauuuccugagcauua

SEQ ID NO: 1539035 - RNA, 19 nt, Homo sapiens
ggaauaugccgucuuaaga

SEQ ID NO: 1539036 - RNA, 19 nt, Homo sapiens
gcagacagguuacguagca

SEQ ID NO: 1539037 - RNA, 19 nt, Homo sapiens
ccacauuuaucaugaagaa

SEQ ID NO: 1539038 - RNA, 19 nt, Homo sapiens
caaauuucaucaccacaaa

SEQ ID NO: 1539039 - RNA, 19 nt, Homo sapiens
gcgccgaacugaucagaaa

SEQ ID NO: 1539040 - RNA, 19 nt, Homo sapiens
acacgugggucaauaauau

SEQ ID NO: 1539041 - RNA, 19 nt, Homo sapiens
caucugagagcaagaaaua

SEQ ID NO: 1539042 - RNA, 19 nt, Homo sapiens
gaauaugccgucuuaagaa

SEQ ID NO: 1539043 - RNA, 19 nt, Homo sapiens
ggacacacacacaggcuua

SEQ ID NO: 1539044 - RNA, 19 nt, Homo sapiens
gauggaagaugacgaacug

SEQ ID NO: 1539045 - RNA, 19 nt, Homo sapiens
gaauggguuuccaauaaga

SEQ ID NO: 1539046 - RNA, 19 nt, Homo sapiens
gaagauggaagaugacgaa

SEQ ID NO: 1539047 - RNA, 19 nt, Homo sapiens
caaacuaacucuugcugau

SEQ ID NO: 1539048 - RNA, 19 nt, Homo sapiens
ugacauaccaguugaagaa

SEQ ID NO: 1539049 - RNA, 19 nt, Homo sapiens
ccaaggcaauggugaaaga

SEQ ID NO: 1539050 - RNA, 19 nt, Homo sapiens
gcaagaccaucaccagcaa

SEQ ID NO: 1539051 - RNA, 19 nt, Homo sapiens
ugaagaaugucccgaugaa

SEQ ID NO: 1539052 - RNA, 19 nt, Homo sapiens
ggagaauggguuuccaaua

SEQ ID NO: 1539053 - RNA, 19 nt, Homo sapiens
caagagacaugacuaugag

SEQ ID NO: 1539054 - RNA, 19 nt, Homo sapiens
gaacgggcguguguacgaa

SEQ ID NO: 1539055 - RNA, 19 nt, Homo sapiens
uaagaagaaucuacagcuu

SEQ ID NO: 1539056 - RNA, 19 nt, Homo sapiens
ugaaagucauucuguguug

SEQ ID NO: 1539057 - RNA, 19 nt, Homo sapiens
gauggcacgugcuguaaga

SEQ ID NO: 1539058 - RNA, 19 nt, Homo sapiens
caagaagucuguaagucau

SEQ ID NO: 1539059 - RNA, 19 nt, Homo sapiens
ugaugugucuggaaauaaa

SEQ ID NO: 1539060 - RNA, 19 nt, Homo sapiens
gaauugacagcaacuuuga

SEQ ID NO: 1539061 - RNA, 19 nt, Homo sapiens
ggaauugacagcaacuuug

SEQ ID NO: 1539062 - RNA, 19 nt, Homo sapiens
uaacagcagcuacauuuau

SEQ ID NO: 1539063 - RNA, 19 nt, Homo sapiens
gcacccagccuguguccua

SEQ ID NO: 1539064 - RNA, 19 nt, Homo sapiens
ccaagagacaugacuauga

SEQ ID NO: 1539065 - RNA, 19 nt, Homo sapiens
gaacaucuucaucuugaga

SEQ ID NO: 1539066 - RNA, 19 nt, Homo sapiens
aagcaaggcugaacaucuu

SEQ ID NO: 1539067 - RNA, 19 nt, Homo sapiens
gaggauaaucguuucauau

SEQ ID NO: 1539068 - RNA, 19 nt, Homo sapiens
ucaaggcgguuguaccuau

SEQ ID NO: 1539069 - RNA, 19 nt, Homo sapiens
ggcacgugcuguaagauuu

SEQ ID NO: 1539070 - RNA, 19 nt, Homo sapiens
gaaacaagcagcucugaac

SEQ ID NO: 1539071 - RNA, 19 nt, Homo sapiens
caucagugcuuugaaacaa

SEQ ID NO: 1539072 - RNA, 19 nt, Homo sapiens
aauaagggcagacagguua

SEQ ID NO: 1539073 - RNA, 19 nt, Homo sapiens
caaggaugaucgagaggaa

SEQ ID NO: 1539074 - RNA, 19 nt, Homo sapiens
gaaaucagagcccaagauc

SEQ ID NO: 1539075 - RNA, 19 nt, Homo sapiens
aauaagugcugggagauuu

SEQ ID NO: 1539076 - RNA, 19 nt, Homo sapiens
uaugccgucuuaagaaaua

SEQ ID NO: 1539077 - RNA, 19 nt, Homo sapiens
uaaauuugcuccuggacau

SEQ ID NO: 1539078 - RNA, 19 nt, Homo sapiens
gagggagacuggguacaaa

SEQ ID NO: 1539079 - RNA, 19 nt, Homo sapiens
gcaguucccaguauccuuu

SEQ ID NO: 1539080 - RNA, 19 nt, Homo sapiens
gcauuuggcguaccacauu

SEQ ID NO: 1539081 - RNA, 19 nt, Homo sapiens
ugagcuggaucuaaauuug

SEQ ID NO: 1539082 - RNA, 19 nt, Homo sapiens
ggacaggggacuuauauuu

SEQ ID NO: 1539083 - RNA, 19 nt, Homo sapiens
uagcagaggauaaucguuu

SEQ ID NO: 1539084 - RNA, 19 nt, Homo sapiens
ccccaucucugcaaaauua

SEQ ID NO: 1539085 - RNA, 19 nt, Homo sapiens
gucauccucucaccucaua

SEQ ID NO: 1539086 - RNA, 19 nt, Homo sapiens
ggaagaugacgaacuggaa

SEQ ID NO: 1539087 - RNA, 19 nt, Homo sapiens
guaccacauuuaucaugaa

SEQ ID NO: 1539088 - RNA, 19 nt, Homo sapiens
gcaaauuucaucaccacaa

SEQ ID NO: 1539089 - RNA, 19 nt, Homo sapiens
caagauggcaacaccacua

SEQ ID NO: 1539090 - RNA, 19 nt, Homo sapiens
gaagaggccaagagacaug

SEQ ID NO: 1539091 - RNA, 19 nt, Homo sapiens
gaagcaaggcugaacaucu

SEQ ID NO: 1539092 - RNA, 19 nt, Homo sapiens
uuagaacucucgccugaug

SEQ ID NO: 1539093 - RNA, 19 nt, Homo sapiens
agaggauaaucguuucaua

SEQ ID NO: 1539094 - RNA, 19 nt, Homo sapiens
cggacgcucuacucuauaa

SEQ ID NO: 1539095 - RNA, 19 nt, Homo sapiens
gcccaucccucuucuugug

SEQ ID NO: 1539096 - RNA, 19 nt, Homo sapiens
aauaugccgucuuaagaaa

SEQ ID NO: 1539097 - RNA, 19 nt, Homo sapiens
ggacauguacccugagaca

SEQ ID NO: 1539098 - RNA, 19 nt, Homo sapiens
uauuugggccgauggauua

SEQ ID NO: 1539099 - RNA, 19 nt, Homo sapiens
aagaagcuaucaaggagaa

SEQ ID NO: 1539100 - RNA, 19 nt, Homo sapiens
gagcaagaaauaugagaga

SEQ ID NO: 1539101 - RNA, 19 nt, Homo sapiens
aaucagagcccaagaucaa

SEQ ID NO: 1539102 - RNA, 19 nt, Homo sapiens
gaacucucgccugauguua

SEQ ID NO: 1539103 - RNA, 19 nt, Homo sapiens
ccgauuaacuuucaagaac

SEQ ID NO: 1539104 - RNA, 19 nt, Homo sapiens
gggaguuuguaaauggaua

SEQ ID NO: 1539105 - RNA, 19 nt, Homo sapiens
caucucagguuuccuacau

SEQ ID NO: 1539106 - RNA, 19 nt, Homo sapiens
gcucugaaccaaagaaauc

SEQ ID NO: 1539107 - RNA, 19 nt, Homo sapiens
guauaaacgugaagaagcu

SEQ ID NO: 1539108 - RNA, 19 nt, Homo sapiens
ggaaaucagagcccaagau

SEQ ID NO: 1539109 - RNA, 19 nt, Homo sapiens
ggucauagcagaggauaau

SEQ ID NO: 1539110 - RNA, 19 nt, Homo sapiens
ggauaauaccuuucugaug

SEQ ID NO: 1539111 - RNA, 19 nt, Homo sapiens
cuaaagagaauccgcaguu

SEQ ID NO: 1539112 - RNA, 19 nt, Homo sapiens
acacaugguuucuaaagag

SEQ ID NO: 1539113 - RNA, 19 nt, Homo sapiens
acucaucagugcuuugaaa

SEQ ID NO: 1539114 - RNA, 19 nt, Homo sapiens
gcauucaucuguguuacug

SEQ ID NO: 1539115 - RNA, 19 nt, Homo sapiens
cgagaacauucguccaaau

SEQ ID NO: 1539116 - RNA, 19 nt, Homo sapiens
ggagauuucuaaaagauug

SEQ ID NO: 1539117 - RNA, 19 nt, Homo sapiens
aaaagaagcagguggaaua

SEQ ID NO: 1539118 - RNA, 19 nt, Homo sapiens
gcagugaaagucauucugu

SEQ ID NO: 1539119 - RNA, 19 nt, Homo sapiens
gcacaucccuuaauaguca

SEQ ID NO: 1539120 - RNA, 19 nt, Homo sapiens
gaaauguaaucaagcagua

SEQ ID NO: 1539121 - RNA, 19 nt, Homo sapiens
gcacauguuuggaggauuu

SEQ ID NO: 1539122 - RNA, 19 nt, Homo sapiens
caauaugccuugaagaauu

SEQ ID NO: 1539123 - RNA, 19 nt, Homo sapiens
gcauucaucuguucuuaaa

SEQ ID NO: 1539124 - RNA, 19 nt, Homo sapiens
gagaggaacuuggaauuug

SEQ ID NO: 1539125 - RNA, 19 nt, Homo sapiens
cauaaaggcugcauagaug

SEQ ID NO: 1539126 - RNA, 19 nt, Homo sapiens
aaacaaagacgcaggcaua

SEQ ID NO: 1539127 - RNA, 19 nt, Homo sapiens
gagguuagcauuugauaaa

SEQ ID NO: 1539128 - RNA, 19 nt, Homo sapiens
uuagcaggcuguaaacuua

SEQ ID NO: 1539129 - RNA, 19 nt, Homo sapiens
ccaaagagcaaaucauauu

SEQ ID NO: 1539130 - RNA, 19 nt, Homo sapiens
ggauuuaagugcccuguau

SEQ ID NO: 1539131 - RNA, 19 nt, Homo sapiens
gaucucaaguucuuccauu

SEQ ID NO: 1539132 - RNA, 19 nt, Homo sapiens
gaugaaugguuugaaguaa

SEQ ID NO: 1539133 - RNA, 19 nt, Homo sapiens
cugcauagaugaaugguuu

SEQ ID NO: 1539134 - RNA, 19 nt, Homo sapiens
caagaaauguaaucaagca

SEQ ID NO: 1539135 - RNA, 19 nt, Homo sapiens
ggauuugcaucuuguaaug

SEQ ID NO: 1539136 - RNA, 19 nt, Homo sapiens
gcaguucucucacauuugg

SEQ ID NO: 1539137 - RNA, 19 nt, Homo sapiens
gcagggagauacuauagca

SEQ ID NO: 1539138 - RNA, 19 nt, Homo sapiens
ugaaucaucuugcagcuau

SEQ ID NO: 1539139 - RNA, 19 nt, Homo sapiens
uaccaaacaugcauacaaa

SEQ ID NO: 1539140 - RNA, 19 nt, Homo sapiens
cuccagagcugcacaacua

SEQ ID NO: 1539141 - RNA, 19 nt, Homo sapiens
ggagaggaacuuggaauuu

SEQ ID NO: 1539142 - RNA, 19 nt, Homo sapiens
uaauugggaugccagguuu

SEQ ID NO: 1539143 - RNA, 19 nt, Homo sapiens
ugagcacccuucagauuaa

SEQ ID NO: 1539144 - RNA, 19 nt, Homo sapiens
guccaaagagcaaaucaua

SEQ ID NO: 1539145 - RNA, 19 nt, Homo sapiens
cgccaaaguuaacugauuu

SEQ ID NO: 1539146 - RNA, 19 nt, Homo sapiens
cuacauagguaauacugau

SEQ ID NO: 1539147 - RNA, 19 nt, Homo sapiens
gaacucaguguaccaaaca

SEQ ID NO: 1539148 - RNA, 19 nt, Homo sapiens
gcacgacugccuugucuau

SEQ ID NO: 1539149 - RNA, 19 nt, Homo sapiens
auacagagauggacaaucg

SEQ ID NO: 1539150 - RNA, 19 nt, Homo sapiens
ccacgaauaaccuauaaug

SEQ ID NO: 1539151 - RNA, 19 nt, Homo sapiens
gaugccagguuuauagcaa

SEQ ID NO: 1539152 - RNA, 19 nt, Homo sapiens
agaggaacuuggaauuuga

SEQ ID NO: 1539153 - RNA, 19 nt, Homo sapiens
uaacggguaucuuuuguuu

SEQ ID NO: 1539154 - RNA, 19 nt, Homo sapiens
guaccaaacaugcauacaa

SEQ ID NO: 1539155 - RNA, 19 nt, Homo sapiens
aaaccaagaggauaugaaa

SEQ ID NO: 1539156 - RNA, 19 nt, Homo sapiens
aggcaguucucucacauuu

SEQ ID NO: 1539157 - RNA, 19 nt, Homo sapiens
gcaauaugccuugaagaau

SEQ ID NO: 1539158 - RNA, 19 nt, Homo sapiens
uuaacaaagccacgaauaa

SEQ ID NO: 1539159 - RNA, 19 nt, Homo sapiens
aauaugccuugaagaauug

SEQ ID NO: 1539160 - RNA, 19 nt, Homo sapiens
gugaaaccaagaaauguaa

SEQ ID NO: 1539161 - RNA, 19 nt, Homo sapiens
auagucaucuacauaggua

SEQ ID NO: 1539162 - RNA, 19 nt, Homo sapiens
caaaggacacacagggauu

SEQ ID NO: 1539163 - RNA, 19 nt, Homo sapiens
gaccacagaacucagugua

SEQ ID NO: 1539164 - RNA, 19 nt, Homo sapiens
gcagcagggagauacuaua

SEQ ID NO: 1539165 - RNA, 19 nt, Homo sapiens
uaaugaggauguacugagu

SEQ ID NO: 1539166 - RNA, 19 nt, Homo sapiens
gaauguagaccaugaucuc

SEQ ID NO: 1539167 - RNA, 19 nt, Homo sapiens
ggagguuagcauuugauaa

SEQ ID NO: 1539168 - RNA, 19 nt, Homo sapiens
aaauuuguauccucagaug

SEQ ID NO: 1539169 - RNA, 19 nt, Homo sapiens
gcuguaaacuuaagaaaag

SEQ ID NO: 1539170 - RNA, 19 nt, Homo sapiens
cugcacaacuaguuauguu

SEQ ID NO: 1539171 - RNA, 19 nt, Homo sapiens
guauucagacgccaaaguu

SEQ ID NO: 1539172 - RNA, 19 nt, Homo sapiens
caaacaugcauacaaagga

SEQ ID NO: 1539173 - RNA, 19 nt, Homo sapiens
ucauaaaggcugcauagau

SEQ ID NO: 1539174 - RNA, 19 nt, Homo sapiens
uaacaaagccacgaauaac

SEQ ID NO: 1539175 - RNA, 19 nt, Homo sapiens
ucagaaugcaguccaaaga

SEQ ID NO: 1539176 - RNA, 19 nt, Homo sapiens
gaaaccaagaaauguaauc

SEQ ID NO: 1539177 - RNA, 19 nt, Homo sapiens
cugcauucaucuguucuua

SEQ ID NO: 1539178 - RNA, 19 nt, Homo sapiens
caaagacgcaggcauacuc

SEQ ID NO: 1539179 - RNA, 19 nt, Homo sapiens
ccagguuuauagcaauuug

SEQ ID NO: 1539180 - RNA, 19 nt, Homo sapiens
gcacaacuaguuauguuuu

SEQ ID NO: 1539181 - RNA, 19 nt, Homo sapiens
acgccaaaguuaacugauu

SEQ ID NO: 1539182 - RNA, 19 nt, Homo sapiens
gguuugaaguaaauagauc

SEQ ID NO: 1539183 - RNA, 19 nt, Homo sapiens
gccaaaguuaacugauuua

SEQ ID NO: 1539184 - RNA, 19 nt, Homo sapiens
ugagggagauuuuauauac

SEQ ID NO: 1539185 - RNA, 19 nt, Homo sapiens
aaucagcagugaaucaucu

SEQ ID NO: 1539186 - RNA, 19 nt, Homo sapiens
ggacagugaccacagaacu

SEQ ID NO: 1539187 - RNA, 19 nt, Homo sapiens
gaauugcagcagggagaua

SEQ ID NO: 1539188 - RNA, 19 nt, Homo sapiens
uaaccuauaaugaggaugu

SEQ ID NO: 1539189 - RNA, 19 nt, Homo sapiens
caaagccacgaauaaccua

SEQ ID NO: 1539190 - RNA, 19 nt, Homo sapiens
caguuuguguagaaagaaa

SEQ ID NO: 1539191 - RNA, 19 nt, Homo sapiens
accaugaucucaaguucuu

SEQ ID NO: 1539192 - RNA, 19 nt, Homo sapiens
agaugaaugguuugaagua

SEQ ID NO: 1539193 - RNA, 19 nt, Homo sapiens
uaaaggcugcauagaugaa

SEQ ID NO: 1539194 - RNA, 19 nt, Homo sapiens
agaccaugaucucaaguuc

SEQ ID NO: 1539195 - RNA, 19 nt, Homo sapiens
ugugaaaccaagaaaugua

SEQ ID NO: 1539196 - RNA, 19 nt, Homo sapiens
gagcugcacaacuaguuau

SEQ ID NO: 1539197 - RNA, 19 nt, Homo sapiens
agaggacagugaccacaga

SEQ ID NO: 1539198 - RNA, 19 nt, Homo sapiens
uaucauaaaggcugcauag

SEQ ID NO: 1539199 - RNA, 19 nt, Homo sapiens
uagcacgacugccuugucu

SEQ ID NO: 1539200 - RNA, 19 nt, Homo sapiens
ugcaauaugccuugaagaa

SEQ ID NO: 1539201 - RNA, 19 nt, Homo sapiens
guuaaucagcagugaauca

SEQ ID NO: 1539202 - RNA, 19 nt, Homo sapiens
accaagaaauguaaucaag

SEQ ID NO: 1539203 - RNA, 19 nt, Homo sapiens
guaauacagagauggacaa

SEQ ID NO: 1539204 - RNA, 19 nt, Homo sapiens
gcauagaugaaugguuuga

SEQ ID NO: 1539205 - RNA, 19 nt, Homo sapiens
aaugugaaaccaagaaaug

SEQ ID NO: 1539206 - RNA, 19 nt, Homo sapiens
auagaugaaugguuugaag

SEQ ID NO: 1539207 - RNA, 19 nt, Homo sapiens
aaaauuuucuggagaggaa

SEQ ID NO: 1539208 - RNA, 19 nt, Homo sapiens
gcugaagagaggacaguga

SEQ ID NO: 1539209 - RNA, 19 nt, Homo sapiens
acagagauggacaaucgua

SEQ ID NO: 1539210 - RNA, 19 nt, Homo sapiens
uuugugagacuugguaaua

SEQ ID NO: 1539211 - RNA, 19 nt, Homo sapiens
ugccuugucuaugcauaua

SEQ ID NO: 1539212 - RNA, 19 nt, Homo sapiens
ggaauuugagggagauuuu

SEQ ID NO: 1539213 - RNA, 19 nt, Homo sapiens
ugcugcacaucccuuaaua

SEQ ID NO: 1539214 - RNA, 19 nt, Homo sapiens
ggacacacagggauuuuga

SEQ ID NO: 1539215 - RNA, 19 nt, Homo sapiens
ugugagacuugguaauaca

SEQ ID NO: 1539216 - RNA, 19 nt, Homo sapiens
agccacgaauaaccuauaa

SEQ ID NO: 1539217 - RNA, 19 nt, Homo sapiens
cgacugccuugucuaugca

SEQ ID NO: 1539218 - RNA, 19 nt, Homo sapiens
cagcagggagauacuauag

SEQ ID NO: 1539219 - RNA, 19 nt, Homo sapiens
ugaaagaaauccuguagua

SEQ ID NO: 1539220 - RNA, 19 nt, Homo sapiens
gaauuuaacucaaccuuuc

SEQ ID NO: 1539221 - RNA, 19 nt, Homo sapiens
ccaguacgauguaauguuu

SEQ ID NO: 1539222 - RNA, 19 nt, Homo sapiens
gaagacagcauuagucaug

SEQ ID NO: 1539223 - RNA, 19 nt, Homo sapiens
gauaugcuccuacuucuaa

SEQ ID NO: 1539224 - RNA, 19 nt, Homo sapiens
gauguaauguuucuuggaa

SEQ ID NO: 1539225 - RNA, 19 nt, Homo sapiens
ggaccaacguucaagagaa

SEQ ID NO: 1539226 - RNA, 19 nt, Homo sapiens
gaaaagaauuccuuaccua

SEQ ID NO: 1539227 - RNA, 19 nt, Homo sapiens
ggaaaugcaugcucucgau

SEQ ID NO: 1539228 - RNA, 19 nt, Homo sapiens
gaaacgaaaucgaagacau

SEQ ID NO: 1539229 - RNA, 19 nt, Homo sapiens
ggugugagcucuggaacua

SEQ ID NO: 1539230 - RNA, 19 nt, Homo sapiens
cacaagagaugaaagaaau

SEQ ID NO: 1539231 - RNA, 19 nt, Homo sapiens
ggaagcacaugcaggaaau

SEQ ID NO: 1539232 - RNA, 19 nt, Homo sapiens
gcacagaugcgacacuuau

SEQ ID NO: 1539233 - RNA, 19 nt, Homo sapiens
uguaguauauggagucuuu

SEQ ID NO: 1539234 - RNA, 19 nt, Homo sapiens
gaaggauucugggauguau

SEQ ID NO: 1539235 - RNA, 19 nt, Homo sapiens
caaccuuucuggaauguau

SEQ ID NO: 1539236 - RNA, 19 nt, Homo sapiens
gaaauccuguaguauaugg

SEQ ID NO: 1539237 - RNA, 19 nt, Homo sapiens
gaaaugaagaagaaacgaa

SEQ ID NO: 1539238 - RNA, 19 nt, Homo sapiens
gaaggucaaggaucuauug

SEQ ID NO: 1539239 - RNA, 19 nt, Homo sapiens
ggacaucgaagacagcauu

SEQ ID NO: 1539240 - RNA, 19 nt, Homo sapiens
ccucaaaguugucagcauu

SEQ ID NO: 1539241 - RNA, 19 nt, Homo sapiens
cauuggaacuguccucaaa

SEQ ID NO: 1539242 - RNA, 19 nt, Homo sapiens
gaaagaaauccuguaguau

SEQ ID NO: 1539243 - RNA, 19 nt, Homo sapiens
gaagaaacgaaaucgaaga

SEQ ID NO: 1539244 - RNA, 19 nt, Homo sapiens
gaccaacguucaagagaau

SEQ ID NO: 1539245 - RNA, 19 nt, Homo sapiens
uagugaagcugacuuugaa

SEQ ID NO: 1539246 - RNA, 19 nt, Homo sapiens
gaaaugcaugcucucgaua

SEQ ID NO: 1539247 - RNA, 19 nt, Homo sapiens
cuacacaguucauccauuc

SEQ ID NO: 1539248 - RNA, 19 nt, Homo sapiens
uaacucaaccuuucuggaa

SEQ ID NO: 1539249 - RNA, 19 nt, Homo sapiens
ggcacucugugauguauaa

SEQ ID NO: 1539250 - RNA, 19 nt, Homo sapiens
gaaguuugcagaagaagga

SEQ ID NO: 1539251 - RNA, 19 nt, Homo sapiens
guacauugguucccgagau

SEQ ID NO: 1539252 - RNA, 19 nt, Homo sapiens
gcaguaugaugggagaauu

SEQ ID NO: 1539253 - RNA, 19 nt, Homo sapiens
gcacucaucaaucaucuug

SEQ ID NO: 1539254 - RNA, 19 nt, Homo sapiens
gaagcccgaugaaagaauc

SEQ ID NO: 1539255 - RNA, 19 nt, Homo sapiens
ccaacaagcaacuauuaaa

SEQ ID NO: 1539256 - RNA, 19 nt, Homo sapiens
uauggagucuuuacuacaa

SEQ ID NO: 1539257 - RNA, 19 nt, Homo sapiens
guauauggagucuuuacua

SEQ ID NO: 1539258 - RNA, 19 nt, Homo sapiens
ggaauaugggcuacugauu

SEQ ID NO: 1539259 - RNA, 19 nt, Homo sapiens
acaagcaacuauuaaaugg

SEQ ID NO: 1539260 - RNA, 19 nt, Homo sapiens
aagaauuccuuaccuacaa

SEQ ID NO: 1539261 - RNA, 19 nt, Homo sapiens
uggaggaguugcagauauu

SEQ ID NO: 1539262 - RNA, 19 nt, Homo sapiens
ccacaagagaugaaagaaa

SEQ ID NO: 1539263 - RNA, 19 nt, Homo sapiens
gagaagcggagacagagaa

SEQ ID NO: 1539264 - RNA, 19 nt, Homo sapiens
uacaaagacuacauccaaa

SEQ ID NO: 1539265 - RNA, 19 nt, Homo sapiens
gacuacauccaaauccuua

SEQ ID NO: 1539266 - RNA, 19 nt, Homo sapiens
gagaaugaacagauggaaa

SEQ ID NO: 1539267 - RNA, 19 nt, Homo sapiens
gaagcugacuuugaauguc

SEQ ID NO: 1539268 - RNA, 19 nt, Homo sapiens
ugaagcagcaacaauugua

SEQ ID NO: 1539269 - RNA, 19 nt, Homo sapiens
ccuaugacccacugauuaa

SEQ ID NO: 1539270 - RNA, 19 nt, Homo sapiens
gauuacagacugacacaga

SEQ ID NO: 1539271 - RNA, 19 nt, Homo sapiens
uaaggaaagugcagaccau

SEQ ID NO: 1539272 - RNA, 19 nt, Homo sapiens
gaugaaagaaauccuguag

SEQ ID NO: 1539273 - RNA, 19 nt, Homo sapiens
acaaccagcuccaucuuca

SEQ ID NO: 1539274 - RNA, 19 nt, Homo sapiens
gaagaagaaacgaaaucga

SEQ ID NO: 1539275 - RNA, 19 nt, Homo sapiens
ugcaggaaaugaagaagaa

SEQ ID NO: 1539276 - RNA, 19 nt, Homo sapiens
gcuagacgccaagauguaa

SEQ ID NO: 1539277 - RNA, 19 nt, Homo sapiens
ugucaucaguuucauaaag

SEQ ID NO: 1539278 - RNA, 19 nt, Homo sapiens
cuagagcuguagccacgua

SEQ ID NO: 1539279 - RNA, 19 nt, Homo sapiens
auacaaagacuacauccaa

SEQ ID NO: 1539280 - RNA, 19 nt, Homo sapiens
gcucugcuguuugugugua

SEQ ID NO: 1539281 - RNA, 19 nt, Homo sapiens
aagaagaaacgaaaucgaa

SEQ ID NO: 1539282 - RNA, 19 nt, Homo sapiens
gcacaugcaggaaaugaag

SEQ ID NO: 1539283 - RNA, 19 nt, Homo sapiens
gaccaguacugcgaacaga

SEQ ID NO: 1539284 - RNA, 19 nt, Homo sapiens
gaaagugcagaccaucguu

SEQ ID NO: 1539285 - RNA, 19 nt, Homo sapiens
guugaagcccgaugaaaga

SEQ ID NO: 1539286 - RNA, 19 nt, Homo sapiens
agaauuccuuaccuacaaa

SEQ ID NO: 1539287 - RNA, 19 nt, Homo sapiens
cgaaaucgaagacaucaca

SEQ ID NO: 1539288 - RNA, 19 nt, Homo sapiens
caaagacuacauccaaauc

SEQ ID NO: 1539289 - RNA, 19 nt, Homo sapiens
uccaugcagucuuucauuu

SEQ ID NO: 1539290 - RNA, 19 nt, Homo sapiens
uucaagcacucaucaauca

SEQ ID NO: 1539291 - RNA, 19 nt, Homo sapiens
uucaaaggcucugcuguuu

SEQ ID NO: 1539292 - RNA, 19 nt, Homo sapiens
gagcuagacgccaagaugu

SEQ ID NO: 1539293 - RNA, 19 nt, Homo sapiens
gauauucaagcacucauca

SEQ ID NO: 1539294 - RNA, 19 nt, Homo sapiens
gaauauggaagagguagug

SEQ ID NO: 1539295 - RNA, 19 nt, Homo sapiens
gcaggaggaccaacguuca

SEQ ID NO: 1539296 - RNA, 19 nt, Homo sapiens
ucauaaagcggcacucugu

SEQ ID NO: 1539297 - RNA, 19 nt, Homo sapiens
gaugggagaauuccuuauc

SEQ ID NO: 1539298 - RNA, 19 nt, Homo sapiens
ugggauguauuacugcaaa

SEQ ID NO: 1539299 - RNA, 19 nt, Homo sapiens
ucccaacaagcaacuauua

SEQ ID NO: 1539300 - RNA, 19 nt, Homo sapiens
agacagcauuagucaugaa

SEQ ID NO: 1539301 - RNA, 19 nt, Homo sapiens
uauauggagucuuuacuac

SEQ ID NO: 1539302 - RNA, 19 nt, Homo sapiens
gcuacugauucgaaguuug

SEQ ID NO: 1539303 - RNA, 19 nt, Homo sapiens
uggaauguauaccuaaauc

SEQ ID NO: 1539304 - RNA, 19 nt, Homo sapiens
aacauggaauugucucuga

SEQ ID NO: 1539305 - RNA, 19 nt, Homo sapiens
ugucagcauuucaaaggaa

SEQ ID NO: 1539306 - RNA, 19 nt, Homo sapiens
ucaaaguugucagcauuuc

SEQ ID NO: 1539307 - RNA, 19 nt, Homo sapiens
cagcauuagucaugaaacu

SEQ ID NO: 1539308 - RNA, 19 nt, Homo sapiens
agugguggaucaugucauu

SEQ ID NO: 1539309 - RNA, 19 nt, Homo sapiens
cauucuccaugcagucuuu

SEQ ID NO: 1539310 - RNA, 19 nt, Homo sapiens
aggauucugggauguauua

SEQ ID NO: 1539311 - RNA, 19 nt, Homo sapiens
gagcuguagccacguaguu

SEQ ID NO: 1539312 - RNA, 19 nt, Homo sapiens
gagucacgguugagauaca

SEQ ID NO: 1539313 - RNA, 19 nt, Homo sapiens
ggaaggucaaggaucuauu

SEQ ID NO: 1539314 - RNA, 19 nt, Homo sapiens
ggaguugaagcccgaugaa

SEQ ID NO: 1539315 - RNA, 19 nt, Homo sapiens
uuucuggaauguauaccua

SEQ ID NO: 1539316 - RNA, 19 nt, Homo sapiens
gcagcaacaauuguacauu

SEQ ID NO: 1539317 - RNA, 19 nt, Homo sapiens
gauggccaguacgauguaa

SEQ ID NO: 1539318 - RNA, 19 nt, Homo sapiens
uuacagacugacacagaua

SEQ ID NO: 1539319 - RNA, 19 nt, Homo sapiens
ccacugacuuccuccaaua

SEQ ID NO: 1539320 - RNA, 19 nt, Homo sapiens
uaagacagaugcccagaga

SEQ ID NO: 1539321 - RNA, 19 nt, Homo sapiens
gcuccaaacugcucuccua

SEQ ID NO: 1539322 - RNA, 19 nt, Homo sapiens
ccaccuuccugcaaguuua

SEQ ID NO: 1539323 - RNA, 19 nt, Homo sapiens
acauuuaccugguguuuga

SEQ ID NO: 1539324 - RNA, 19 nt, Homo sapiens
ggacauuuaccugguguuu

SEQ ID NO: 1539325 - RNA, 19 nt, Homo sapiens
ggucguggccaucaagaaa

SEQ ID NO: 1539326 - RNA, 19 nt, Homo sapiens
guaguggacccucgcauug

SEQ ID NO: 1539327 - RNA, 19 nt, Homo sapiens
gaccagaagccguccaaug

SEQ ID NO: 1539328 - RNA, 19 nt, Homo sapiens
agaacgacagggacauuua

SEQ ID NO: 1539329 - RNA, 19 nt, Homo sapiens
gaacgacagggacauuuac

SEQ ID NO: 1539330 - RNA, 19 nt, Homo sapiens
gagaacgacagggacauuu

SEQ ID NO: 1539331 - RNA, 19 nt, Homo sapiens
ccuuagcccucccugcuuu

SEQ ID NO: 1539332 - RNA, 19 nt, Homo sapiens
ccuauggcauuguguggaa

SEQ ID NO: 1539333 - RNA, 19 nt, Homo sapiens
uaccugguguuugaguuua

SEQ ID NO: 1539334 - RNA, 19 nt, Homo sapiens
gacgcuggaugcccuccua

SEQ ID NO: 1539335 - RNA, 19 nt, Homo sapiens
cggaggugcugcucucuuc

SEQ ID NO: 1539336 - RNA, 19 nt, Homo sapiens
cagugaagcugugugacuu

SEQ ID NO: 1539337 - RNA, 19 nt, Homo sapiens
guccggagauaccuacuca

SEQ ID NO: 1539338 - RNA, 19 nt, Homo sapiens
caagauggcagucccaaac

SEQ ID NO: 1539339 - RNA, 19 nt, Homo sapiens
gugaagcugugugacuuug

SEQ ID NO: 1539340 - RNA, 19 nt, Homo sapiens
gaggguggccagcguacaa

SEQ ID NO: 1539341 - RNA, 19 nt, Homo sapiens
gggccaguuuguaccaguu

SEQ ID NO: 1539342 - RNA, 19 nt, Homo sapiens
gaccaucccaacaucauca

SEQ ID NO: 1539343 - RNA, 19 nt, Homo sapiens
guuuguaccaguucagauu

SEQ ID NO: 1539344 - RNA, 19 nt, Homo sapiens
gugacaggguggccuaucu

SEQ ID NO: 1539345 - RNA, 19 nt, Homo sapiens
ccacgugcgcuccaucuuc

SEQ ID NO: 1539346 - RNA, 19 nt, Homo sapiens
gcacaggggcaucuaccua

SEQ ID NO: 1539347 - RNA, 19 nt, Homo sapiens
ccagaagccguccaaugug

SEQ ID NO: 1539348 - RNA, 19 nt, Homo sapiens
caacaucaucagccuccuu

SEQ ID NO: 1539349 - RNA, 19 nt, Homo sapiens
acccucagcugccuucuag

SEQ ID NO: 1539350 - RNA, 19 nt, Homo sapiens
accagaagccguccaaugu

SEQ ID NO: 1539351 - RNA, 19 nt, Homo sapiens
gaccaggccgugacagagu

SEQ ID NO: 1539352 - RNA, 19 nt, Homo sapiens
ugccagggcuuugcuugga

SEQ ID NO: 1539353 - RNA, 19 nt, Homo sapiens
caggguggccuaucucaag

SEQ ID NO: 1539354 - RNA, 19 nt, Homo sapiens
cacgugcgcuccaucuucu

SEQ ID NO: 1539355 - RNA, 19 nt, Homo sapiens
gacgugauccgggcagaga

SEQ ID NO: 1539356 - RNA, 19 nt, Homo sapiens
cguaguggacccucgcauu

SEQ ID NO: 1539357 - RNA, 19 nt, Homo sapiens
ccucagcugccuucuagga

SEQ ID NO: 1539358 - RNA, 19 nt, Homo sapiens
agacagaugcccagagaac

SEQ ID NO: 1539359 - RNA, 19 nt, Homo sapiens
uuaggcgacuccugguguu

SEQ ID NO: 1539360 - RNA, 19 nt, Homo sapiens
ggaccaucccaacaucauc

SEQ ID NO: 1539361 - RNA, 19 nt, Homo sapiens
cagaugcccagagaacauu

SEQ ID NO: 1539362 - RNA, 19 nt, Homo sapiens
uguggagucugggcuguau

SEQ ID NO: 1539363 - RNA, 19 nt, Homo sapiens
accaggccgugacagagua

SEQ ID NO: 1539364 - RNA, 19 nt, Homo sapiens
uuaccugguguuugaguuu

SEQ ID NO: 1539365 - RNA, 19 nt, Homo sapiens
gacauuuaccugguguuug

SEQ ID NO: 1539366 - RNA, 19 nt, Homo sapiens
ccagacuucuucuuucuua

SEQ ID NO: 1539367 - RNA, 19 nt, Homo sapiens
caucaaaugucaucaacuu

SEQ ID NO: 1539368 - RNA, 19 nt, Homo sapiens
caacccggcugcauuaaau

SEQ ID NO: 1539369 - RNA, 19 nt, Homo sapiens
caaccuauuuccaaugaga

SEQ ID NO: 1539370 - RNA, 19 nt, Homo sapiens
caaccagacuucuucuuuc

SEQ ID NO: 1539371 - RNA, 19 nt, Homo sapiens
ucauaaugcucccaucaaa

SEQ ID NO: 1539372 - RNA, 19 nt, Homo sapiens
ugacuucccugguuacuca

SEQ ID NO: 1539373 - RNA, 19 nt, Homo sapiens
ggacugccauagagccaaa

SEQ ID NO: 1539374 - RNA, 19 nt, Homo sapiens
gcaacaccauuaugacauc

SEQ ID NO: 1539375 - RNA, 19 nt, Homo sapiens
ccucaaagacgacucauga

SEQ ID NO: 1539376 - RNA, 19 nt, Homo sapiens
cacaaccuauuuccaauga

SEQ ID NO: 1539377 - RNA, 19 nt, Homo sapiens
ccaaccagacuucuucuuu

SEQ ID NO: 1539378 - RNA, 19 nt, Homo sapiens
uuacucauguccucaaaga

SEQ ID NO: 1539379 - RNA, 19 nt, Homo sapiens
ugucugacuucccugguua

SEQ ID NO: 1539380 - RNA, 19 nt, Homo sapiens
cauuaaauccugccucauu

SEQ ID NO: 1539381 - RNA, 19 nt, Homo sapiens
agaaacgucuacaggcaaa

SEQ ID NO: 1539382 - RNA, 19 nt, Homo sapiens
caucacaaccuauuuccaa

SEQ ID NO: 1539383 - RNA, 19 nt, Homo sapiens
gacuucuucuuucuuauga

SEQ ID NO: 1539384 - RNA, 19 nt, Homo sapiens
ugucaacccggcugcauua

SEQ ID NO: 1539385 - RNA, 19 nt, Homo sapiens
ugucugcccugguggguuu

SEQ ID NO: 1539386 - RNA, 19 nt, Homo sapiens
ucaaagacgacucaugaug

SEQ ID NO: 1539387 - RNA, 19 nt, Homo sapiens
gauuaucauucaccuuaca

SEQ ID NO: 1539388 - RNA, 19 nt, Homo sapiens
gcugguuucuacuguguug

SEQ ID NO: 1539389 - RNA, 19 nt, Homo sapiens
ggauaugaagaacuauuga

SEQ ID NO: 1539390 - RNA, 19 nt, Homo sapiens
gugcugcaguggaaacaga

SEQ ID NO: 1539391 - RNA, 19 nt, Homo sapiens
ggauauaccaaccagacuu

SEQ ID NO: 1539392 - RNA, 19 nt, Homo sapiens
cgacucaugaugcuggaua

SEQ ID NO: 1539393 - RNA, 19 nt, Homo sapiens
caaaugucaucaacuucuc

SEQ ID NO: 1539394 - RNA, 19 nt, Homo sapiens
auuaugacaucacaaccua

SEQ ID NO: 1539395 - RNA, 19 nt, Homo sapiens
gauauaccaaccagacuuc

SEQ ID NO: 1539396 - RNA, 19 nt, Homo sapiens
auaaugcucccaucaaaug

SEQ ID NO: 1539397 - RNA, 19 nt, Homo sapiens
cuauugacuucuugggaaa

SEQ ID NO: 1539398 - RNA, 19 nt, Homo sapiens
ugacaucacaaccuauuuc

SEQ ID NO: 1539399 - RNA, 19 nt, Homo sapiens
auuaaauccugccucauug

SEQ ID NO: 1539400 - RNA, 19 nt, Homo sapiens
caacaccauuaugacauca

SEQ ID NO: 1539401 - RNA, 19 nt, Homo sapiens
gcuggaacucugucucuga

SEQ ID NO: 1539402 - RNA, 19 nt, Homo sapiens
uggaaaaccuaaccauuau

SEQ ID NO: 1539403 - RNA, 19 nt, Homo sapiens
gguuacucauguccucaaa

SEQ ID NO: 1539404 - RNA, 19 nt, Homo sapiens
caucauaaugcucccauca

SEQ ID NO: 1539405 - RNA, 19 nt, Homo sapiens
uaugacaucacaaccuauu

SEQ ID NO: 1539406 - RNA, 19 nt, Homo sapiens
ucaaaugucaucaacuucu

SEQ ID NO: 1539407 - RNA, 19 nt, Homo sapiens
gcaaaagucaaaguuauug

SEQ ID NO: 1539408 - RNA, 19 nt, Homo sapiens
ugcuggauaugaagaacua

SEQ ID NO: 1539409 - RNA, 19 nt, Homo sapiens
aaagacgacucaugaugcu

SEQ ID NO: 1539410 - RNA, 19 nt, Homo sapiens
cauaaugcucccaucaaau

SEQ ID NO: 1539411 - RNA, 19 nt, Homo sapiens
caguguaaguuggacgaaa

SEQ ID NO: 1539412 - RNA, 19 nt, Homo sapiens
ggaaaaccuaaccauuaua

SEQ ID NO: 1539413 - RNA, 19 nt, Homo sapiens
gacucaugaugcuggauau

SEQ ID NO: 1539414 - RNA, 19 nt, Homo sapiens
uuucuacuguguuggaguu

SEQ ID NO: 1539415 - RNA, 19 nt, Homo sapiens
ucacaaccuauuuccaaug

SEQ ID NO: 1539416 - RNA, 19 nt, Homo sapiens
aaccagacuucuucuuucu

SEQ ID NO: 1539417 - RNA, 19 nt, Homo sapiens
ucaacccggcugcauuaaa

SEQ ID NO: 1539418 - RNA, 19 nt, Homo sapiens
acggagaaauauuaauugg

SEQ ID NO: 1539419 - RNA, 19 nt, Homo sapiens
agacuucuucuuucuuaug

SEQ ID NO: 1539420 - RNA, 19 nt, Homo sapiens
ugaguuuccuaaauguaag

SEQ ID NO: 1539421 - RNA, 19 nt, Homo sapiens
uggauaugaagaacuauug

SEQ ID NO: 1539422 - RNA, 19 nt, Homo sapiens
cuggaacucugucucugau

SEQ ID NO: 1539423 - RNA, 19 nt, Homo sapiens
ccucauugcaguguaaguu

SEQ ID NO: 1539424 - RNA, 19 nt, Homo sapiens
cagacuucuucuuucuuau

SEQ ID NO: 1539425 - RNA, 19 nt, Homo sapiens
ggcaacaccauuaugacau

SEQ ID NO: 1539426 - RNA, 19 nt, Homo sapiens
ggaaauaucuguggugaga

SEQ ID NO: 1539427 - RNA, 19 nt, Homo sapiens
gaagaagagacgaacauua

SEQ ID NO: 1539428 - RNA, 19 nt, Homo sapiens
gaagaaauguacaugaagu

SEQ ID NO: 1539429 - RNA, 19 nt, Homo sapiens
gggaagaaauguacaugaa

SEQ ID NO: 1539430 - RNA, 19 nt, Homo sapiens
ggaaggagaguuaaugaaa

SEQ ID NO: 1539431 - RNA, 19 nt, Homo sapiens
gagcaaauccaaagacuga

SEQ ID NO: 1539432 - RNA, 19 nt, Homo sapiens
gggcaaagcugaaggugau

SEQ ID NO: 1539433 - RNA, 19 nt, Homo sapiens
guacaugaagucuccauua

SEQ ID NO: 1539434 - RNA, 19 nt, Homo sapiens
ugagucaggugaugugaua

SEQ ID NO: 1539435 - RNA, 19 nt, Homo sapiens
gaagaaggcagcccagaga

SEQ ID NO: 1539436 - RNA, 19 nt, Homo sapiens
guugaaaacuccagaaaua

SEQ ID NO: 1539437 - RNA, 19 nt, Homo sapiens
gaugugauaucauaagcuu

SEQ ID NO: 1539438 - RNA, 19 nt, Homo sapiens
aagaagagacgaacauuaa

SEQ ID NO: 1539439 - RNA, 19 nt, Homo sapiens
aaagagaagucaauuccuu

SEQ ID NO: 1539440 - RNA, 19 nt, Homo sapiens
accagaaacuagccuauua

SEQ ID NO: 1539441 - RNA, 19 nt, Homo sapiens
gcacuacuacugucagauu

SEQ ID NO: 1539442 - RNA, 19 nt, Homo sapiens
gaaacuagccuauuauucc

SEQ ID NO: 1539443 - RNA, 19 nt, Homo sapiens
aaaugcagcuguuguuaga

SEQ ID NO: 1539444 - RNA, 19 nt, Homo sapiens
gaaguaaagagaagucaau

SEQ ID NO: 1539445 - RNA, 19 nt, Homo sapiens
caaagacugaguuauguuu

SEQ ID NO: 1539446 - RNA, 19 nt, Homo sapiens
gaaggagaguuaaugaaaa

SEQ ID NO: 1539447 - RNA, 19 nt, Homo sapiens
gcccaucccuucccuacaa

SEQ ID NO: 1539448 - RNA, 19 nt, Homo sapiens
guagagaaguaaagagaag

SEQ ID NO: 1539449 - RNA, 19 nt, Homo sapiens
gcugcguccucuucacuua

SEQ ID NO: 1539450 - RNA, 19 nt, Homo sapiens
caauugcacuggguauauu

SEQ ID NO: 1539451 - RNA, 19 nt, Homo sapiens
gaaagagcaaauccaaaga

SEQ ID NO: 1539452 - RNA, 19 nt, Homo sapiens
gaagagacgaacauuaaag

SEQ ID NO: 1539453 - RNA, 19 nt, Homo sapiens
guauuuggcagaacaauug

SEQ ID NO: 1539454 - RNA, 19 nt, Homo sapiens
aaccacaacuacagaaauu

SEQ ID NO: 1539455 - RNA, 19 nt, Homo sapiens
gauuauagcacuacuacug

SEQ ID NO: 1539456 - RNA, 19 nt, Homo sapiens
ccgaaucacuggaaauauc

SEQ ID NO: 1539457 - RNA, 19 nt, Homo sapiens
ggcagagacuucagacuuc

SEQ ID NO: 1539458 - RNA, 19 nt, Homo sapiens
gagacgaacauuaaagaug

SEQ ID NO: 1539459 - RNA, 19 nt, Homo sapiens
gcaauugcacuggguauau

SEQ ID NO: 1539460 - RNA, 19 nt, Homo sapiens
agacugugguagagaagua

SEQ ID NO: 1539461 - RNA, 19 nt, Homo sapiens
cuaagacugugguagagaa

SEQ ID NO: 1539462 - RNA, 19 nt, Homo sapiens
gauaucauaagcuuucuug

SEQ ID NO: 1539463 - RNA, 19 nt, Homo sapiens
ggaagaagagacgaacauu

SEQ ID NO: 1539464 - RNA, 19 nt, Homo sapiens
gauguuauguaccaagucu

SEQ ID NO: 1539465 - RNA, 19 nt, Homo sapiens
ggagaagaacuaggaauca

SEQ ID NO: 1539466 - RNA, 19 nt, Homo sapiens
caaggaacauuuuaugaug

SEQ ID NO: 1539467 - RNA, 19 nt, Homo sapiens
ggccgaaucacuggaaaua

SEQ ID NO: 1539468 - RNA, 19 nt, Homo sapiens
ugaaagagcaaauccaaag

SEQ ID NO: 1539469 - RNA, 19 nt, Homo sapiens
gguggcaguucucaguauu

SEQ ID NO: 1539470 - RNA, 19 nt, Homo sapiens
aucauaagcuuucuuggaa

SEQ ID NO: 1539471 - RNA, 19 nt, Homo sapiens
ugaaggugaugaggaagaa

SEQ ID NO: 1539472 - RNA, 19 nt, Homo sapiens
cgaauucugucccuguauc

SEQ ID NO: 1539473 - RNA, 19 nt, Homo sapiens
gcugaaagagcaaauccaa

SEQ ID NO: 1539474 - RNA, 19 nt, Homo sapiens
gaaggcagcccagagaaag

SEQ ID NO: 1539475 - RNA, 19 nt, Homo sapiens
ggaagaaauguacaugaag

SEQ ID NO: 1539476 - RNA, 19 nt, Homo sapiens
ugagcugucuggauguuau

SEQ ID NO: 1539477 - RNA, 19 nt, Homo sapiens
guuagguagugugauuaua

SEQ ID NO: 1539478 - RNA, 19 nt, Homo sapiens
cagaaacuagccuauuauu

SEQ ID NO: 1539479 - RNA, 19 nt, Homo sapiens
uaucauaagcuuucuugga

SEQ ID NO: 1539480 - RNA, 19 nt, Homo sapiens
gcccaagucuuacuaaaau

SEQ ID NO: 1539481 - RNA, 19 nt, Homo sapiens
cacgaauucugucccugua

SEQ ID NO: 1539482 - RNA, 19 nt, Homo sapiens
aaacuagccuauuauucca

SEQ ID NO: 1539483 - RNA, 19 nt, Homo sapiens
gugaguggcaaguggcuua

SEQ ID NO: 1539484 - RNA, 19 nt, Homo sapiens
guaaagagaagucaauucc

SEQ ID NO: 1539485 - RNA, 19 nt, Homo sapiens
ccacaacuacagaaauuca

SEQ ID NO: 1539486 - RNA, 19 nt, Homo sapiens
gcagagacuucagacuucu

SEQ ID NO: 1539487 - RNA, 19 nt, Homo sapiens
gagaagaacuaggaaucac

SEQ ID NO: 1539488 - RNA, 19 nt, Homo sapiens
cgugguggaugaacauuuc

SEQ ID NO: 1539489 - RNA, 19 nt, Homo sapiens
guagcgagccagcuggauu

SEQ ID NO: 1539490 - RNA, 19 nt, Homo sapiens
ccagaaacuagccuauuau

SEQ ID NO: 1539491 - RNA, 19 nt, Homo sapiens
aauaaguccugcugcugaa

SEQ ID NO: 1539492 - RNA, 19 nt, Homo sapiens
gggaaggagaguuaaugaa

SEQ ID NO: 1539493 - RNA, 19 nt, Homo sapiens
uuuguuagguagugugauu

SEQ ID NO: 1539494 - RNA, 19 nt, Homo sapiens
cccagcagcuacucuccua

SEQ ID NO: 1539495 - RNA, 19 nt, Homo sapiens
gcaaagcugaaggugauga

SEQ ID NO: 1539496 - RNA, 19 nt, Homo sapiens
caagguggcaguucucagu

SEQ ID NO: 1539497 - RNA, 19 nt, Homo sapiens
uccaaagacugaguuaugu

SEQ ID NO: 1539498 - RNA, 19 nt, Homo sapiens
caugaagucuccauuaccu

SEQ ID NO: 1539499 - RNA, 19 nt, Homo sapiens
uacaugaagucuccauuac

SEQ ID NO: 1539500 - RNA, 19 nt, Homo sapiens
gaaauacaucacccaaggu

SEQ ID NO: 1539501 - RNA, 19 nt, Homo sapiens
cagcggcagcuccucauuu

SEQ ID NO: 1539502 - RNA, 19 nt, Homo sapiens
cacuacuacugucagauuu

SEQ ID NO: 1539503 - RNA, 19 nt, Homo sapiens
gcaaauccaaagacugagu

SEQ ID NO: 1539504 - RNA, 19 nt, Homo sapiens
uggcaguucucaguauuug

SEQ ID NO: 1539505 - RNA, 19 nt, Homo sapiens
gguagagaaguaaagagaa

SEQ ID NO: 1539506 - RNA, 19 nt, Homo sapiens
cuacuacugucagauuuua

SEQ ID NO: 1539507 - RNA, 19 nt, Homo sapiens
ccaaagacugaguuauguu

SEQ ID NO: 1539508 - RNA, 19 nt, Homo sapiens
ucagcuccgugguggauga

SEQ ID NO: 1539509 - RNA, 19 nt, Homo sapiens
agaagagacgaacauuaaa

SEQ ID NO: 1539510 - RNA, 19 nt, Homo sapiens
caaauccaaagacugaguu

SEQ ID NO: 1539511 - RNA, 19 nt, Homo sapiens
caugagcugucuggauguu

SEQ ID NO: 1539512 - RNA, 19 nt, Homo sapiens
aagagacgaacauuaaaga

SEQ ID NO: 1539513 - RNA, 19 nt, Homo sapiens
ccauggagaagaacuagga

SEQ ID NO: 1539514 - RNA, 19 nt, Homo sapiens
gccaccugcccaagucuua

SEQ ID NO: 1539515 - RNA, 19 nt, Homo sapiens
ggagagucaugagcugucu

SEQ ID NO: 1539516 - RNA, 19 nt, Homo sapiens
uagcacuacuacugucaga

SEQ ID NO: 1539517 - RNA, 19 nt, Homo sapiens
gcuuugcuccgccugauga

SEQ ID NO: 1539518 - RNA, 19 nt, Homo sapiens
cuggcgagcucgucguuau

SEQ ID NO: 1539519 - RNA, 19 nt, Homo sapiens
agaaggcagcccagagaaa

SEQ ID NO: 1539520 - RNA, 19 nt, Homo sapiens
uaaaaugcagcuguuguua

SEQ ID NO: 1539521 - RNA, 19 nt, Homo sapiens
aaaccacaacuacagaaau

SEQ ID NO: 1539522 - RNA, 19 nt, Homo sapiens
ugugauaucauaagcuuuc

SEQ ID NO: 1539523 - RNA, 19 nt, Homo sapiens
aggcagagacuucagacuu

SEQ ID NO: 1539524 - RNA, 19 nt, Homo sapiens
gcuccgugguggaugaaca

SEQ ID NO: 1539525 - RNA, 19 nt, Homo sapiens
acuagccuauuauuccaaa

SEQ ID NO: 1539526 - RNA, 19 nt, Homo sapiens
gaagaggccuuagagaauu

SEQ ID NO: 1539527 - RNA, 19 nt, Homo sapiens
ucacauaccucaagaagca

SEQ ID NO: 1539528 - RNA, 19 nt, Homo sapiens
uggaguugcugauaauuua

SEQ ID NO: 1539529 - RNA, 19 nt, Homo sapiens
gcuguucucucccaucuaa

SEQ ID NO: 1539530 - RNA, 19 nt, Homo sapiens
ggaggacgaugacacagaa

SEQ ID NO: 1539531 - RNA, 19 nt, Homo sapiens
ugacaguacugaaagcuuu

SEQ ID NO: 1539532 - RNA, 19 nt, Homo sapiens
ggaagagacacgugccuua

SEQ ID NO: 1539533 - RNA, 19 nt, Homo sapiens
gcaagauccuggugaaaca

SEQ ID NO: 1539534 - RNA, 19 nt, Homo sapiens
ggaagaggccuuagagaau

SEQ ID NO: 1539535 - RNA, 19 nt, Homo sapiens
ggaggaguuugaagacauu

SEQ ID NO: 1539536 - RNA, 19 nt, Homo sapiens
cuacuuaagcucaauguaa

SEQ ID NO: 1539537 - RNA, 19 nt, Homo sapiens
ugaaaggccuagugcagaa

SEQ ID NO: 1539538 - RNA, 19 nt, Homo sapiens
gcaaaugcgaaguguguaa

SEQ ID NO: 1539539 - RNA, 19 nt, Homo sapiens
gggcugggauguugaagga

SEQ ID NO: 1539540 - RNA, 19 nt, Homo sapiens
ggcaagcggugauuguuug

SEQ ID NO: 1539541 - RNA, 19 nt, Homo sapiens
gagcggauccuggacuaua

SEQ ID NO: 1539542 - RNA, 19 nt, Homo sapiens
ggccuggaguugcugauaa

SEQ ID NO: 1539543 - RNA, 19 nt, Homo sapiens
gacauucucugcgaucuau

SEQ ID NO: 1539544 - RNA, 19 nt, Homo sapiens
caucuaaccucaggcaaga

SEQ ID NO: 1539545 - RNA, 19 nt, Homo sapiens
gagacaagaugaccaagac

SEQ ID NO: 1539546 - RNA, 19 nt, Homo sapiens
ggaagaggaggaagaggaa

SEQ ID NO: 1539547 - RNA, 19 nt, Homo sapiens
ggaaaggagaucacagaug

SEQ ID NO: 1539548 - RNA, 19 nt, Homo sapiens
uaauuuaggugggauagau

SEQ ID NO: 1539549 - RNA, 19 nt, Homo sapiens
caggaaacuuggacuggaa

SEQ ID NO: 1539550 - RNA, 19 nt, Homo sapiens
gaccauggcaacacugaaa

SEQ ID NO: 1539551 - RNA, 19 nt, Homo sapiens
acccagagcccaccauaua

SEQ ID NO: 1539552 - RNA, 19 nt, Homo sapiens
ugaaggaggaggacgauga

SEQ ID NO: 1539553 - RNA, 19 nt, Homo sapiens
gaaggcaagcggugauugu

SEQ ID NO: 1539554 - RNA, 19 nt, Homo sapiens
ggagacaagaugaccaaga

SEQ ID NO: 1539555 - RNA, 19 nt, Homo sapiens
gauacuuggucuacuuaag

SEQ ID NO: 1539556 - RNA, 19 nt, Homo sapiens
gagcagccccuacaaaauu

SEQ ID NO: 1539557 - RNA, 19 nt, Homo sapiens
gcuagccgccugggaauuu

SEQ ID NO: 1539558 - RNA, 19 nt, Homo sapiens
ggacauucucugcgaucua

SEQ ID NO: 1539559 - RNA, 19 nt, Homo sapiens
cagcaaaugcgaagugugu

SEQ ID NO: 1539560 - RNA, 19 nt, Homo sapiens
uuacagcguuucagagaca

SEQ ID NO: 1539561 - RNA, 19 nt, Homo sapiens
uaggugggauagauacuug

SEQ ID NO: 1539562 - RNA, 19 nt, Homo sapiens
ugaccgagaagaucuuuga

SEQ ID NO: 1539563 - RNA, 19 nt, Homo sapiens
uggaagaggccuuagagaa

SEQ ID NO: 1539564 - RNA, 19 nt, Homo sapiens
ucugcgaucuauauacauu

SEQ ID NO: 1539565 - RNA, 19 nt, Homo sapiens
uuaauuggcagguguaugu

SEQ ID NO: 1539566 - RNA, 19 nt, Homo sapiens
gugagcggauccuggacua

SEQ ID NO: 1539567 - RNA, 19 nt, Homo sapiens
aagaggccuuagagaauuu

SEQ ID NO: 1539568 - RNA, 19 nt, Homo sapiens
ggaggaggacgaugacaca

SEQ ID NO: 1539569 - RNA, 19 nt, Homo sapiens
gcagguguaugugcugaca

SEQ ID NO: 1539570 - RNA, 19 nt, Homo sapiens
ggaucccucuggagcuuug

SEQ ID NO: 1539571 - RNA, 19 nt, Homo sapiens
uaacccagagcccaccaua

SEQ ID NO: 1539572 - RNA, 19 nt, Homo sapiens
ucucugcgaucuauauaca

SEQ ID NO: 1539573 - RNA, 19 nt, Homo sapiens
gauccuggacuauaguguu

SEQ ID NO: 1539574 - RNA, 19 nt, Homo sapiens
ccuuagagaauuuauguga

SEQ ID NO: 1539575 - RNA, 19 nt, Homo sapiens
gaagagacacgugccuuac

SEQ ID NO: 1539576 - RNA, 19 nt, Homo sapiens
cacuggagcugugggcuuu

SEQ ID NO: 1539577 - RNA, 19 nt, Homo sapiens
cuagccgccugggaauuua

SEQ ID NO: 1539578 - RNA, 19 nt, Homo sapiens
ggccuuagagaauuuaugu

SEQ ID NO: 1539579 - RNA, 19 nt, Homo sapiens
gauacaggcaagaggaaga

SEQ ID NO: 1539580 - RNA, 19 nt, Homo sapiens
ggucacauaccucaagaag

SEQ ID NO: 1539581 - RNA, 19 nt, Homo sapiens
aagcuuuccucuuuaacug

SEQ ID NO: 1539582 - RNA, 19 nt, Homo sapiens
caaacuugaccgagaagau

SEQ ID NO: 1539583 - RNA, 19 nt, Homo sapiens
aaacuuggacuggaaagga

SEQ ID NO: 1539584 - RNA, 19 nt, Homo sapiens
ccugugcgguugggaauau

SEQ ID NO: 1539585 - RNA, 19 nt, Homo sapiens
gccuggaguugcugauaau

SEQ ID NO: 1539586 - RNA, 19 nt, Homo sapiens
aagcggugauuguuuguag

SEQ ID NO: 1539587 - RNA, 19 nt, Homo sapiens
ggcuugggcugggauguug

SEQ ID NO: 1539588 - RNA, 19 nt, Homo sapiens
ggaguuugaagacauugug

SEQ ID NO: 1539589 - RNA, 19 nt, Homo sapiens
cuuugacccuugccuuuga

SEQ ID NO: 1539590 - RNA, 19 nt, Homo sapiens
uggaggaguuugaagacau

SEQ ID NO: 1539591 - RNA, 19 nt, Homo sapiens
gcagugugagaccauguug

SEQ ID NO: 1539592 - RNA, 19 nt, Homo sapiens
uacuuaagcucaauguaac

SEQ ID NO: 1539593 - RNA, 19 nt, Homo sapiens
uagcuguucucucccaucu

SEQ ID NO: 1539594 - RNA, 19 nt, Homo sapiens
ccagagcccaccauauagu

SEQ ID NO: 1539595 - RNA, 19 nt, Homo sapiens
gcuuuccucuuuaacugau

SEQ ID NO: 1539596 - RNA, 19 nt, Homo sapiens
aaacuugaccgagaagauc

SEQ ID NO: 1539597 - RNA, 19 nt, Homo sapiens
ggaggaagaggaggaagag

SEQ ID NO: 1539598 - RNA, 19 nt, Homo sapiens
ggaggaggaagaggaggaa

SEQ ID NO: 1539599 - RNA, 19 nt, Homo sapiens
gaaaacagaaggggaggaa

SEQ ID NO: 1539600 - RNA, 19 nt, Homo sapiens
agcaaaccgugaaggagaa

SEQ ID NO: 1539601 - RNA, 19 nt, Homo sapiens
ggaagccaccccaaacuug

SEQ ID NO: 1539602 - RNA, 19 nt, Homo sapiens
ugcugaaacugcaugucua

SEQ ID NO: 1539603 - RNA, 19 nt, Homo sapiens
ggugcucaauuuucuauau

SEQ ID NO: 1539604 - RNA, 19 nt, Homo sapiens
cagagcccaccauauaguu

SEQ ID NO: 1539605 - RNA, 19 nt, Homo sapiens
gcaggaggaggaggaggaa

SEQ ID NO: 1539606 - RNA, 19 nt, Homo sapiens
agagacacgugccuuacag

SEQ ID NO: 1539607 - RNA, 19 nt, Homo sapiens
gaaggaggaggacgaugac

SEQ ID NO: 1539608 - RNA, 19 nt, Homo sapiens
gaggcuacacaccagcaaa

SEQ ID NO: 1539609 - RNA, 19 nt, Homo sapiens
gagcuacaggcggaacuga

SEQ ID NO: 1539610 - RNA, 19 nt, Homo sapiens
gcuuucaggguguguuuau

SEQ ID NO: 1539611 - RNA, 19 nt, Homo sapiens
gaccauguuggaggaguuu

SEQ ID NO: 1539612 - RNA, 19 nt, Homo sapiens
ccuuacagcguuucagaga

SEQ ID NO: 1539613 - RNA, 19 nt, Homo sapiens
cuggaguugcugauaauuu

SEQ ID NO: 1539614 - RNA, 19 nt, Homo sapiens
uuucaggguguguuuauga

SEQ ID NO: 1539615 - RNA, 19 nt, Homo sapiens
gaagccaccccaaacuuga

SEQ ID NO: 1539616 - RNA, 19 nt, Homo sapiens
gaucacagauggggaagag

SEQ ID NO: 1539617 - RNA, 19 nt, Homo sapiens
guuuguagacggcgcuuug

SEQ ID NO: 1539618 - RNA, 19 nt, Homo sapiens
agaccauguuggaggaguu

SEQ ID NO: 1539619 - RNA, 19 nt, Homo sapiens
gcuggaagaggccuuagag

SEQ ID NO: 1539620 - RNA, 19 nt, Homo sapiens
gcuacaggcggaacugagu

SEQ ID NO: 1539621 - RNA, 19 nt, Homo sapiens
gcaagcggugauuguuugu

SEQ ID NO: 1539622 - RNA, 19 nt, Homo sapiens
cagcuuucaggguguguuu

SEQ ID NO: 1539623 - RNA, 19 nt, Homo sapiens
aagaugaccaagacaggaa

SEQ ID NO: 1539624 - RNA, 19 nt, Homo sapiens
cucuggagcuuugggauga

SEQ ID NO: 1539625 - RNA, 19 nt, Homo sapiens
gagaaaugcaacaaacuua

SEQ ID NO: 1539626 - RNA, 19 nt, Homo sapiens
caagaacaauugcgggaaa

SEQ ID NO: 1539627 - RNA, 19 nt, Homo sapiens
ggacaugcaagaacaauug

SEQ ID NO: 1539628 - RNA, 19 nt, Homo sapiens
gugggagcauuauagauua

SEQ ID NO: 1539629 - RNA, 19 nt, Homo sapiens
uacauaaccuagcuucuuu

SEQ ID NO: 1539630 - RNA, 19 nt, Homo sapiens
guaggcagacacuuuaaua

SEQ ID NO: 1539631 - RNA, 19 nt, Homo sapiens
gaugagaaaugcaacaaac

SEQ ID NO: 1539632 - RNA, 19 nt, Homo sapiens
ggacuuuccucuuucucuu

SEQ ID NO: 1539633 - RNA, 19 nt, Homo sapiens
gcuguaggcagacacuuua

SEQ ID NO: 1539634 - RNA, 19 nt, Homo sapiens
agauuuagguuuccagaga

SEQ ID NO: 1539635 - RNA, 19 nt, Homo sapiens
gccgugcucuucuuucuga

SEQ ID NO: 1539636 - RNA, 19 nt, Homo sapiens
gauuuagguuuccagagaa

SEQ ID NO: 1539637 - RNA, 19 nt, Homo sapiens
aaagggacaugcaagaaca

SEQ ID NO: 1539638 - RNA, 19 nt, Homo sapiens
gagaagcauacauaaccua

SEQ ID NO: 1539639 - RNA, 19 nt, Homo sapiens
ugcagaagauuuagguuuc

SEQ ID NO: 1539640 - RNA, 19 nt, Homo sapiens
ugagaaaugcaacaaacuu

SEQ ID NO: 1539641 - RNA, 19 nt, Homo sapiens
ugugggagcauuauagauu

SEQ ID NO: 1539642 - RNA, 19 nt, Homo sapiens
ugggagcauuauagauuaa

SEQ ID NO: 1539643 - RNA, 19 nt, Homo sapiens
uaggcagacacuuuaauaa

SEQ ID NO: 1539644 - RNA, 19 nt, Homo sapiens
uuccagagaagcauacaua

SEQ ID NO: 1539645 - RNA, 19 nt, Homo sapiens
auacauaaccuagcuucuu

SEQ ID NO: 1539646 - RNA, 19 nt, Homo sapiens
aagcauacauaaccuagcu

SEQ ID NO: 1539647 - RNA, 19 nt, Homo sapiens
uaaagggacaugcaagaac

SEQ ID NO: 1539648 - RNA, 19 nt, Homo sapiens
cagagaagcauacauaacc

SEQ ID NO: 1539649 - RNA, 19 nt, Homo sapiens
gcagaagauuuagguuucc

SEQ ID NO: 1539650 - RNA, 19 nt, Homo sapiens
aaacgaagaacuuauugcu

SEQ ID NO: 1539651 - RNA, 19 nt, Homo sapiens
uuaaagggacaugcaagaa

SEQ ID NO: 1539652 - RNA, 19 nt, Homo sapiens
aaacuuaaagggacaugca

SEQ ID NO: 1539653 - RNA, 19 nt, Homo sapiens
gacuuuccucuuucucuuu

SEQ ID NO: 1539654 - RNA, 19 nt, Homo sapiens
caugugggagcauuauaga

SEQ ID NO: 1539655 - RNA, 19 nt, Homo sapiens
ccagagaagcauacauaac

SEQ ID NO: 1539656 - RNA, 19 nt, Homo sapiens
ccaugugggagcauuauag

SEQ ID NO: 1539657 - RNA, 19 nt, Homo sapiens
gaagaacuuauugcucucu

SEQ ID NO: 1539658 - RNA, 19 nt, Homo sapiens
gggacaugcaagaacaauu

SEQ ID NO: 1539659 - RNA, 19 nt, Homo sapiens
augcagaagauuuagguuu

SEQ ID NO: 1539660 - RNA, 19 nt, Homo sapiens
cuuaaagggacaugcaaga

SEQ ID NO: 1539661 - RNA, 19 nt, Homo sapiens
gaacagcccuaccucuauu

SEQ ID NO: 1539662 - RNA, 19 nt, Homo sapiens
gauaagcauuucuggcaaa

SEQ ID NO: 1539663 - RNA, 19 nt, Homo sapiens
cgacuggucuuaugagaag

SEQ ID NO: 1539664 - RNA, 19 nt, Homo sapiens
gguaacaguggaauuugua

SEQ ID NO: 1539665 - RNA, 19 nt, Homo sapiens
ugaaacuucuuuaccuguu

SEQ ID NO: 1539666 - RNA, 19 nt, Homo sapiens
aaauucaugugccugcuaa

SEQ ID NO: 1539667 - RNA, 19 nt, Homo sapiens
gagaagcaguggccaagac

SEQ ID NO: 1539668 - RNA, 19 nt, Homo sapiens
uacaugaggauaagcauuu

SEQ ID NO: 1539669 - RNA, 19 nt, Homo sapiens
ggguaacaguggaauuugu

SEQ ID NO: 1539670 - RNA, 19 nt, Homo sapiens
gaauuuguagggccucuug

SEQ ID NO: 1539671 - RNA, 19 nt, Homo sapiens
ccaugaaacuucuuuaccu

SEQ ID NO: 1539672 - RNA, 19 nt, Homo sapiens
cgaacagcccuaccucuau

SEQ ID NO: 1539673 - RNA, 19 nt, Homo sapiens
cuaccucuauugcagaaau

SEQ ID NO: 1539674 - RNA, 19 nt, Homo sapiens
gaagcaguggccaagacua

SEQ ID NO: 1539675 - RNA, 19 nt, Homo sapiens
aagcauuucuggcaaagag

SEQ ID NO: 1539676 - RNA, 19 nt, Homo sapiens
gaaaauaccgacuggucuu

SEQ ID NO: 1539677 - RNA, 19 nt, Homo sapiens
acgaacagcccuaccucua

SEQ ID NO: 1539678 - RNA, 19 nt, Homo sapiens
aauaccgacuggucuuaug

SEQ ID NO: 1539679 - RNA, 19 nt, Homo sapiens
ccugcugccuccaguccua

SEQ ID NO: 1539680 - RNA, 19 nt, Homo sapiens
cuugagugcuggugauuac

SEQ ID NO: 1539681 - RNA, 19 nt, Homo sapiens
cuacaugaggauaagcauu

SEQ ID NO: 1539682 - RNA, 19 nt, Homo sapiens
cuucuuuaccuguuucuug

SEQ ID NO: 1539683 - RNA, 19 nt, Homo sapiens
cauagaagaaccagugaua

SEQ ID NO: 1539684 - RNA, 19 nt, Homo sapiens
cguaaacggugcuguguuc

SEQ ID NO: 1539685 - RNA, 19 nt, Homo sapiens
gugcaaagauggugaagac

SEQ ID NO: 1539686 - RNA, 19 nt, Homo sapiens
aaacggugcuguguuccua

SEQ ID NO: 1539687 - RNA, 19 nt, Homo sapiens
gauggacacugccgguugu

SEQ ID NO: 1539688 - RNA, 19 nt, Homo sapiens
guuccuagucguuauuuaa

SEQ ID NO: 1539689 - RNA, 19 nt, Homo sapiens
uuaacaauccaaccaguaa

SEQ ID NO: 1539690 - RNA, 19 nt, Homo sapiens
ggacacugccgguuguugu

SEQ ID NO: 1539691 - RNA, 19 nt, Homo sapiens
ugauaucaguagaguguug

SEQ ID NO: 1539692 - RNA, 19 nt, Homo sapiens
caucauacgcugccgaaau

SEQ ID NO: 1539693 - RNA, 19 nt, Homo sapiens
gaaccagugauaucaguag

SEQ ID NO: 1539694 - RNA, 19 nt, Homo sapiens
ggguccacauuucauuaaa

SEQ ID NO: 1539695 - RNA, 19 nt, Homo sapiens
ccaguaacaauucauggaa

SEQ ID NO: 1539696 - RNA, 19 nt, Homo sapiens
ccagugauaucaguagagu

SEQ ID NO: 1539697 - RNA, 19 nt, Homo sapiens
uagaagaaccagugauauc

SEQ ID NO: 1539698 - RNA, 19 nt, Homo sapiens
ccucagauguccacaacag

SEQ ID NO: 1539699 - RNA, 19 nt, Homo sapiens
ggaccacuccucagauguc

SEQ ID NO: 1539700 - RNA, 19 nt, Homo sapiens
agaagaaccagugauauca

SEQ ID NO: 1539701 - RNA, 19 nt, Homo sapiens
uaggguccacauuucauua

SEQ ID NO: 1539702 - RNA, 19 nt, Homo sapiens
caaccaguaacaauucaug

SEQ ID NO: 1539703 - RNA, 19 nt, Homo sapiens
gaagaaccagugauaucag

SEQ ID NO: 1539704 - RNA, 19 nt, Homo sapiens
aauccaaccaguaacaauu

SEQ ID NO: 1539705 - RNA, 19 nt, Homo sapiens
gcuguguuccuagucguua

SEQ ID NO: 1539706 - RNA, 19 nt, Homo sapiens
uugcuuaggguccacauuu

SEQ ID NO: 1539707 - RNA, 19 nt, Homo sapiens
aagaaccagugauaucagu

SEQ ID NO: 1539708 - RNA, 19 nt, Homo sapiens
gguccacauuucauuaaaa

SEQ ID NO: 1539709 - RNA, 19 nt, Homo sapiens
ggugaagacagcaucauac

SEQ ID NO: 1539710 - RNA, 19 nt, Homo sapiens
aucauacgcugccgaaauc

SEQ ID NO: 1539711 - RNA, 19 nt, Homo sapiens
uggugaagacagcaucaua

SEQ ID NO: 1539712 - RNA, 19 nt, Homo sapiens
gcuuaggguccacauuuca

SEQ ID NO: 1539713 - RNA, 19 nt, Homo sapiens
cuggaccacuccucagaug

SEQ ID NO: 1539714 - RNA, 19 nt, Homo sapiens
agugauaucaguagagugu

SEQ ID NO: 1539715 - RNA, 19 nt, Homo sapiens
caauccaaccaguaacaau

SEQ ID NO: 1539716 - RNA, 19 nt, Homo sapiens
uuuaacaauccaaccagua

SEQ ID NO: 1539717 - RNA, 19 nt, Homo sapiens
cuucuuuaccuguuucuug

SEQ ID NO: 1539718 - RNA, 19 nt, Homo sapiens
ggaaagagucuauguuuac

SEQ ID NO: 1539719 - RNA, 19 nt, Homo sapiens
gcaaaugccguuacagaug

SEQ ID NO: 1539720 - RNA, 19 nt, Homo sapiens
aggaaagagucuauguuua

SEQ ID NO: 1539721 - RNA, 19 nt, Homo sapiens
gaaaggugguggccauuuu

SEQ ID NO: 1539722 - RNA, 19 nt, Homo sapiens
gaaggaaagagucuauguu

SEQ ID NO: 1539723 - RNA, 19 nt, Homo sapiens
gcacucuccuucucccauu

SEQ ID NO: 1539724 - RNA, 19 nt, Homo sapiens
gaaagagucuauguuuacu

SEQ ID NO: 1539725 - RNA, 19 nt, Homo sapiens
aaggaaagagucuauguuu

SEQ ID NO: 1539726 - RNA, 19 nt, Homo sapiens
caagaaggaaagagucuau

SEQ ID NO: 1539727 - RNA, 19 nt, Homo sapiens
aaacaccucuggcugaaaa

SEQ ID NO: 1539728 - RNA, 19 nt, Homo sapiens
ugacugugcugcugcucuu

SEQ ID NO: 1539729 - RNA, 19 nt, Homo sapiens
cguuacagaugcuccaaga

SEQ ID NO: 1539730 - RNA, 19 nt, Homo sapiens
caucggacuugcagcuuca

SEQ ID NO: 1539731 - RNA, 19 nt, Homo sapiens
gaaucuuuauggcaaaugc

SEQ ID NO: 1539732 - RNA, 19 nt, Homo sapiens
acccaaagaugcuggaauc

SEQ ID NO: 1539733 - RNA, 19 nt, Homo sapiens
auaaacaccucuggcugaa

SEQ ID NO: 1539734 - RNA, 19 nt, Homo sapiens
uucccacacucuaucaaua

SEQ ID NO: 1539735 - RNA, 19 nt, Homo sapiens
cacacucuaucaauaaaca

SEQ ID NO: 1539736 - RNA, 19 nt, Homo sapiens
gagucuauguuuacugcau

SEQ ID NO: 1539737 - RNA, 19 nt, Homo sapiens
cccacacucuaucaauaaa

SEQ ID NO: 1539738 - RNA, 19 nt, Homo sapiens
uuacagaugcuccaagaag

SEQ ID NO: 1539739 - RNA, 19 nt, Homo sapiens
ggacuugcagcuucauuuu

SEQ ID NO: 1539740 - RNA, 19 nt, Homo sapiens
ucccacacucuaucaauaa

SEQ ID NO: 1539741 - RNA, 19 nt, Homo sapiens
gaagccugaagccaugaaa

SEQ ID NO: 1539742 - RNA, 19 nt, Homo sapiens
ccaaguaccagccaaaaga

SEQ ID NO: 1539743 - RNA, 19 nt, Homo sapiens
gcgugaagcccaaguacca

SEQ ID NO: 1539744 - RNA, 19 nt, Homo sapiens
agaaggaaagagucuaugu

SEQ ID NO: 1539745 - RNA, 19 nt, Homo sapiens
ccaugaaaaugcagaugaa

SEQ ID NO: 1539746 - RNA, 19 nt, Homo sapiens
gccaggcacucuccuucuc

SEQ ID NO: 1539747 - RNA, 19 nt, Homo sapiens
gcuccaagaaggaaagagu

SEQ ID NO: 1539748 - RNA, 19 nt, Homo sapiens
gaugcuggaaucuuuaugg

SEQ ID NO: 1539749 - RNA, 19 nt, Homo sapiens
agaaaggugguggccauuu

SEQ ID NO: 1539750 - RNA, 19 nt, Homo sapiens
cacucuccuucucccauua

SEQ ID NO: 1539751 - RNA, 19 nt, Homo sapiens
ccaagaaggaaagagucua

SEQ ID NO: 1539752 - RNA, 19 nt, Homo sapiens
cggacuugcagcuucauuu

SEQ ID NO: 1539753 - RNA, 19 nt, Homo sapiens
gaugaagcucccaguggau

SEQ ID NO: 1539754 - RNA, 19 nt, Homo sapiens
agacagcucuuacucauaa

SEQ ID NO: 1539755 - RNA, 19 nt, Homo sapiens
agaagacgauguuuagaua

SEQ ID NO: 1539756 - RNA, 19 nt, Homo sapiens
gaaauacugcuggaaauaa

SEQ ID NO: 1539757 - RNA, 19 nt, Homo sapiens
ugacacaacuaaauuugga

SEQ ID NO: 1539758 - RNA, 19 nt, Homo sapiens
caguaucuauguugaauga

SEQ ID NO: 1539759 - RNA, 19 nt, Homo sapiens
auagugauguggacucuuu

SEQ ID NO: 1539760 - RNA, 19 nt, Homo sapiens
gaggauauaacauuggauu

SEQ ID NO: 1539761 - RNA, 19 nt, Homo sapiens
ggaaauaauauccaaagag

SEQ ID NO: 1539762 - RNA, 19 nt, Homo sapiens
uagaaauacugcuggaaau

SEQ ID NO: 1539763 - RNA, 19 nt, Homo sapiens
cgaccagcauuuccuguga

SEQ ID NO: 1539764 - RNA, 19 nt, Homo sapiens
gauaacauuugacacaacu

SEQ ID NO: 1539765 - RNA, 19 nt, Homo sapiens
ccuagaggauauaacauug

SEQ ID NO: 1539766 - RNA, 19 nt, Homo sapiens
ggacauugcagaagacgau

SEQ ID NO: 1539767 - RNA, 19 nt, Homo sapiens
ucagacagcucuuacucau

SEQ ID NO: 1539768 - RNA, 19 nt, Homo sapiens
caucugagacugcuacuuc

SEQ ID NO: 1539769 - RNA, 19 nt, Homo sapiens
gacgauguuuagauacuga

SEQ ID NO: 1539770 - RNA, 19 nt, Homo sapiens
uguaggacauugcagaaga

SEQ ID NO: 1539771 - RNA, 19 nt, Homo sapiens
cagcucuuacucauaauua

SEQ ID NO: 1539772 - RNA, 19 nt, Homo sapiens
gaucugauaacauuugaca

SEQ ID NO: 1539773 - RNA, 19 nt, Homo sapiens
guaucuauguugaaugauc

SEQ ID NO: 1539774 - RNA, 19 nt, Homo sapiens
agaaauacugcuggaaaua

SEQ ID NO: 1539775 - RNA, 19 nt, Homo sapiens
cuagaaauacugcuggaaa

SEQ ID NO: 1539776 - RNA, 19 nt, Homo sapiens
caacuaaauuuggagaaac

SEQ ID NO: 1539777 - RNA, 19 nt, Homo sapiens
uaacucgggugaccaaagg

SEQ ID NO: 1539778 - RNA, 19 nt, Homo sapiens
guuuagauacugaaaggua

SEQ ID NO: 1539779 - RNA, 19 nt, Homo sapiens
gaaaccaugacaccugaga

SEQ ID NO: 1539780 - RNA, 19 nt, Homo sapiens
uagaggauauaacauugga

SEQ ID NO: 1539781 - RNA, 19 nt, Homo sapiens
ugauucaccuagaggauau

SEQ ID NO: 1539782 - RNA, 19 nt, Homo sapiens
acugaaagguacauacuuc

SEQ ID NO: 1539783 - RNA, 19 nt, Homo sapiens
gaccaauacuccugagacu

SEQ ID NO: 1539784 - RNA, 19 nt, Homo sapiens
ccaauacuccugagacuac

SEQ ID NO: 1539785 - RNA, 19 nt, Homo sapiens
cagaagacgauguuuagau

SEQ ID NO: 1539786 - RNA, 19 nt, Homo sapiens
gguauggaacaacuagaaa

SEQ ID NO: 1539787 - RNA, 19 nt, Homo sapiens
guaggaacaagcuaucaug

SEQ ID NO: 1539788 - RNA, 19 nt, Homo sapiens
ucaccuagaggauauaaca

SEQ ID NO: 1539789 - RNA, 19 nt, Homo sapiens
cagcauuuccugugauuca

SEQ ID NO: 1539790 - RNA, 19 nt, Homo sapiens
gaaaauuccaucagggauu

SEQ ID NO: 1539791 - RNA, 19 nt, Homo sapiens
gcagaagacgauguuuaga

SEQ ID NO: 1539792 - RNA, 19 nt, Homo sapiens
ggaacaacuagaaauacug

SEQ ID NO: 1539793 - RNA, 19 nt, Homo sapiens
caugacaccugagaccaau

SEQ ID NO: 1539794 - RNA, 19 nt, Homo sapiens
uugcagaagacgauguuua

SEQ ID NO: 1539795 - RNA, 19 nt, Homo sapiens
gaccagcauuuccugugau

SEQ ID NO: 1539796 - RNA, 19 nt, Homo sapiens
gagacuaugccaccaccuu

SEQ ID NO: 1539797 - RNA, 19 nt, Homo sapiens
cuacuaugccaccaucuga

SEQ ID NO: 1539798 - RNA, 19 nt, Homo sapiens
ccacuacucccgagacuac

SEQ ID NO: 1539799 - RNA, 19 nt, Homo sapiens
guugaaugaucugauaaca

SEQ ID NO: 1539800 - RNA, 19 nt, Homo sapiens
aauccaauuucaccaggaa

SEQ ID NO: 1539801 - RNA, 19 nt, Homo sapiens
guauggaacaacuagaaau

SEQ ID NO: 1539802 - RNA, 19 nt, Homo sapiens
gccaccaccuucucagaca

SEQ ID NO: 1539803 - RNA, 19 nt, Homo sapiens
gauguggacucuuuuacug

SEQ ID NO: 1539804 - RNA, 19 nt, Homo sapiens
cauuaucuguggguugcua

SEQ ID NO: 1539805 - RNA, 19 nt, Homo sapiens
uggaacaacuagaaauacu

SEQ ID NO: 1539806 - RNA, 19 nt, Homo sapiens
ugaaagguacauacuucuu

SEQ ID NO: 1539807 - RNA, 19 nt, Homo sapiens
gaagacgauguuuagauac

SEQ ID NO: 1539808 - RNA, 19 nt, Homo sapiens
cagacagcucuuacucaua

SEQ ID NO: 1539809 - RNA, 19 nt, Homo sapiens
cccaguaucuauguugaau

SEQ ID NO: 1539810 - RNA, 19 nt, Homo sapiens
cugauaacauuugacacaa

SEQ ID NO: 1539811 - RNA, 19 nt, Homo sapiens
guaggacauugcagaagac

SEQ ID NO: 1539812 - RNA, 19 nt, Homo sapiens
ucugauaacauuugacaca

SEQ ID NO: 1539813 - RNA, 19 nt, Homo sapiens
aacauuuacuucugguaug

SEQ ID NO: 1539814 - RNA, 19 nt, Homo sapiens
auacuucuuuguaggaaca

SEQ ID NO: 1539815 - RNA, 19 nt, Homo sapiens
aaagagcugauucuaccaa

SEQ ID NO: 1539816 - RNA, 19 nt, Homo sapiens
aagacgauguuuagauacu

SEQ ID NO: 1539817 - RNA, 19 nt, Homo sapiens
aaauuuggagaaaccauga

SEQ ID NO: 1539818 - RNA, 19 nt, Homo sapiens
ugauaacauuugacacaac

SEQ ID NO: 1539819 - RNA, 19 nt, Homo sapiens
ccaugacaccugagaccaa

SEQ ID NO: 1539820 - RNA, 19 nt, Homo sapiens
aaaauuccaucagggauug

SEQ ID NO: 1539821 - RNA, 19 nt, Homo sapiens
uuggaagaauaauguagga

SEQ ID NO: 1539822 - RNA, 19 nt, Homo sapiens
ugcagaagacgauguuuag

SEQ ID NO: 1539823 - RNA, 19 nt, Homo sapiens
gcacauuucucaccuauau

SEQ ID NO: 1539824 - RNA, 19 nt, Homo sapiens
caaguaagguucucaaaug

SEQ ID NO: 1539825 - RNA, 19 nt, Homo sapiens
gaaguuaugugucccauuc

SEQ ID NO: 1539826 - RNA, 19 nt, Homo sapiens
gcaauaaacuauacaaguc

SEQ ID NO: 1539827 - RNA, 19 nt, Homo sapiens
gagacaggguuucaacaua

SEQ ID NO: 1539828 - RNA, 19 nt, Homo sapiens
gcaguuauaugauagacaa

SEQ ID NO: 1539829 - RNA, 19 nt, Homo sapiens
ccacaugucugucucauuc

SEQ ID NO: 1539830 - RNA, 19 nt, Homo sapiens
gcaaauccauggaaacaca

SEQ ID NO: 1539831 - RNA, 19 nt, Homo sapiens
gccauuagcuccauucuuc

SEQ ID NO: 1539832 - RNA, 19 nt, Homo sapiens
caacaugguucacaagugu

SEQ ID NO: 1539833 - RNA, 19 nt, Homo sapiens
gaacguagcggaucauuac

SEQ ID NO: 1539834 - RNA, 19 nt, Homo sapiens
guggagaauuugaguauuu

SEQ ID NO: 1539835 - RNA, 19 nt, Homo sapiens
ugagaaagcaacacaauuu

SEQ ID NO: 1539836 - RNA, 19 nt, Homo sapiens
ccacuacacucagcuaauu

SEQ ID NO: 1539837 - RNA, 19 nt, Homo sapiens
gcucucagccuccaaagua

SEQ ID NO: 1539838 - RNA, 19 nt, Homo sapiens
gcacugaauugagcaaaga

SEQ ID NO: 1539839 - RNA, 19 nt, Homo sapiens
gacgugcaguuauaugaua

SEQ ID NO: 1539840 - RNA, 19 nt, Homo sapiens
caaauccucuuacuguuuc

SEQ ID NO: 1539841 - RNA, 19 nt, Homo sapiens
gcuguuggcucaagcagaa

SEQ ID NO: 1539842 - RNA, 19 nt, Homo sapiens
aaaguaagccacacuauau

SEQ ID NO: 1539843 - RNA, 19 nt, Homo sapiens
guaagguucucaaauguag

SEQ ID NO: 1539844 - RNA, 19 nt, Homo sapiens
gugcggagcuguacuucaa

SEQ ID NO: 1539845 - RNA, 19 nt, Homo sapiens
aagacuauguggagaauuu

SEQ ID NO: 1539846 - RNA, 19 nt, Homo sapiens
agacaggguuucaacauau

SEQ ID NO: 1539847 - RNA, 19 nt, Homo sapiens
gaaggaacaggaaauuaga

SEQ ID NO: 1539848 - RNA, 19 nt, Homo sapiens
ugcaagcaguguuaaauuu

SEQ ID NO: 1539849 - RNA, 19 nt, Homo sapiens
ucacagaggcaucgaacua

SEQ ID NO: 1539850 - RNA, 19 nt, Homo sapiens
gcaagcaguguuaaauuug

SEQ ID NO: 1539851 - RNA, 19 nt, Homo sapiens
cacuauaucuucaugaguu

SEQ ID NO: 1539852 - RNA, 19 nt, Homo sapiens
acacaaauccucuuacugu

SEQ ID NO: 1539853 - RNA, 19 nt, Homo sapiens
gauguaaucagcuugagaa

SEQ ID NO: 1539854 - RNA, 19 nt, Homo sapiens
gugcugggcuucauuuaca

SEQ ID NO: 1539855 - RNA, 19 nt, Homo sapiens
gacaggguuucaacauauu

SEQ ID NO: 1539856 - RNA, 19 nt, Homo sapiens
gguauuagaucuuguuucc

SEQ ID NO: 1539857 - RNA, 19 nt, Homo sapiens
cuucagaucucuuuaaugc

SEQ ID NO: 1539858 - RNA, 19 nt, Homo sapiens
gcagagacaccuucagauc

SEQ ID NO: 1539859 - RNA, 19 nt, Homo sapiens
caagcaguguuaaauuugu

SEQ ID NO: 1539860 - RNA, 19 nt, Homo sapiens
cugaaugucuccuuuacuu

SEQ ID NO: 1539861 - RNA, 19 nt, Homo sapiens
gaaauccaaagcuguaugu

SEQ ID NO: 1539862 - RNA, 19 nt, Homo sapiens
ccaaagugcugggauuaca

SEQ ID NO: 1539863 - RNA, 19 nt, Homo sapiens
gauagcagaauguauuuca

SEQ ID NO: 1539864 - RNA, 19 nt, Homo sapiens
guggauagcagaauguauu

SEQ ID NO: 1539865 - RNA, 19 nt, Homo sapiens
agucuuaccuugaggcauu

SEQ ID NO: 1539866 - RNA, 19 nt, Homo sapiens
gagcgugagguacaaauga

SEQ ID NO: 1539867 - RNA, 19 nt, Homo sapiens
ugaagaacguagcggauca

SEQ ID NO: 1539868 - RNA, 19 nt, Homo sapiens
cagaagacuuugaccagau

SEQ ID NO: 1539869 - RNA, 19 nt, Homo sapiens
cuagaugaacugaauauug

SEQ ID NO: 1539870 - RNA, 19 nt, Homo sapiens
ucacugggccuuacagguu

SEQ ID NO: 1539871 - RNA, 19 nt, Homo sapiens
gggcuucauuuacauuuua

SEQ ID NO: 1539872 - RNA, 19 nt, Homo sapiens
cuacagguccaaauacuga

SEQ ID NO: 1539873 - RNA, 19 nt, Homo sapiens
caacaguuacauuccaauu

SEQ ID NO: 1539874 - RNA, 19 nt, Homo sapiens
acagaggcaucgaacuaaa

SEQ ID NO: 1539875 - RNA, 19 nt, Homo sapiens
gacauuggaggacguguuu

SEQ ID NO: 1539876 - RNA, 19 nt, Homo sapiens
caacagacaguuccacuac

SEQ ID NO: 1539877 - RNA, 19 nt, Homo sapiens
cagcacauuucucaccuau

SEQ ID NO: 1539878 - RNA, 19 nt, Homo sapiens
acaaauccucuuacuguuu

SEQ ID NO: 1539879 - RNA, 19 nt, Homo sapiens
cuagaugcaagcaguguua

SEQ ID NO: 1539880 - RNA, 19 nt, Homo sapiens
cacugggccuuacagguua

SEQ ID NO: 1539881 - RNA, 19 nt, Homo sapiens
ugaaggaacaggaaauuag

SEQ ID NO: 1539882 - RNA, 19 nt, Homo sapiens
ugaaaaugcucuagaugaa

SEQ ID NO: 1539883 - RNA, 19 nt, Homo sapiens
aaaccagcccugaaacaaa

SEQ ID NO: 1539884 - RNA, 19 nt, Homo sapiens
gaguauuuccggaaucauu

SEQ ID NO: 1539885 - RNA, 19 nt, Homo sapiens
ucacacaaauccucuuacu

SEQ ID NO: 1539886 - RNA, 19 nt, Homo sapiens
ccgaguagcugggauuaca

SEQ ID NO: 1539887 - RNA, 19 nt, Homo sapiens
ccaaagcuguauguaguca

SEQ ID NO: 1539888 - RNA, 19 nt, Homo sapiens
uugccuagauucacagaaa

SEQ ID NO: 1539889 - RNA, 19 nt, Homo sapiens
cggaguauacaaaccuuua

SEQ ID NO: 1539890 - RNA, 19 nt, Homo sapiens
cacaaauccucuuacuguu

SEQ ID NO: 1539891 - RNA, 19 nt, Homo sapiens
gcaccuggccccuuauuuu

SEQ ID NO: 1539892 - RNA, 19 nt, Homo sapiens
gaucuuguuuccacauguc

SEQ ID NO: 1539893 - RNA, 19 nt, Homo sapiens
ccaaguaagguucucaaau

SEQ ID NO: 1539894 - RNA, 19 nt, Homo sapiens
ucagugguauuagaucuug

SEQ ID NO: 1539895 - RNA, 19 nt, Homo sapiens
caaagcauuuccuuguuuu

SEQ ID NO: 1539896 - RNA, 19 nt, Homo sapiens
gcccugaaacaaagcauuu

SEQ ID NO: 1539897 - RNA, 19 nt, Homo sapiens
aaauucaucuccagacuac

SEQ ID NO: 1539898 - RNA, 19 nt, Homo sapiens
uaccuuggcuucaaucucu

SEQ ID NO: 1539899 - RNA, 19 nt, Homo sapiens
gaugcaagcaguguuaaau

SEQ ID NO: 1539900 - RNA, 19 nt, Homo sapiens
ucaacaugguucacaagug

SEQ ID NO: 1539901 - RNA, 19 nt, Homo sapiens
aauacugaaugucuccuuu

SEQ ID NO: 1539902 - RNA, 19 nt, Homo sapiens
gacccuagaagaccugaaa

SEQ ID NO: 1539903 - RNA, 19 nt, Homo sapiens
gaugucacagcagaaguua

SEQ ID NO: 1539904 - RNA, 19 nt, Homo sapiens
ggcauucuauaaauucugu

SEQ ID NO: 1539905 - RNA, 19 nt, Homo sapiens
gauagacaaugugauucug

SEQ ID NO: 1539906 - RNA, 19 nt, Homo sapiens
uggccaggcugaucuugaa

SEQ ID NO: 1539907 - RNA, 19 nt, Homo sapiens
gaaugucuccuuuacuuuu

SEQ ID NO: 1539908 - RNA, 19 nt, Homo sapiens
gcagaauguauuucacaga

SEQ ID NO: 1539909 - RNA, 19 nt, Homo sapiens
cuugaggcauucuauaaau

SEQ ID NO: 1539910 - RNA, 19 nt, Homo sapiens
gaaacgccauuagcuccau

SEQ ID NO: 1539911 - RNA, 19 nt, Homo sapiens
gcacccaccacuacacuca

SEQ ID NO: 1539912 - RNA, 19 nt, Homo sapiens
uaaaccagcccugaaacaa

SEQ ID NO: 1539913 - RNA, 19 nt, Homo sapiens
guaaaccagcccugaaaca

SEQ ID NO: 1539914 - RNA, 19 nt, Homo sapiens
ggaacaggaaauuagaaau

SEQ ID NO: 1539915 - RNA, 19 nt, Homo sapiens
agaagacuuugaccagaug

SEQ ID NO: 1539916 - RNA, 19 nt, Homo sapiens
gaaaagacuauguggagaa

SEQ ID NO: 1539917 - RNA, 19 nt, Homo sapiens
aaucacacaaauccucuua

SEQ ID NO: 1539918 - RNA, 19 nt, Homo sapiens
caguaaaccagcccugaaa

SEQ ID NO: 1539919 - RNA, 19 nt, Homo sapiens
cgacagacgugcuuuuauc

SEQ ID NO: 1539920 - RNA, 19 nt, Homo sapiens
gaucgaaacgccauuagcu

SEQ ID NO: 1539921 - RNA, 19 nt, Homo sapiens
aaguaagguucucaaaugu

SEQ ID NO: 1539922 - RNA, 19 nt, Homo sapiens
gaaauauuguguggauagc

SEQ ID NO: 1539923 - RNA, 19 nt, Homo sapiens
gaacucaggugaaacauuu

SEQ ID NO: 1539924 - RNA, 19 nt, Homo sapiens
guaaaugaauuccagguua

SEQ ID NO: 1539925 - RNA, 19 nt, Homo sapiens
caaccaaacucauuacuga

SEQ ID NO: 1539926 - RNA, 19 nt, Homo sapiens
ccagcuagauuccuuaaua

SEQ ID NO: 1539927 - RNA, 19 nt, Homo sapiens
gcucagaacucaggugaaa

SEQ ID NO: 1539928 - RNA, 19 nt, Homo sapiens
acacaacaguacagaaaua

SEQ ID NO: 1539929 - RNA, 19 nt, Homo sapiens
ggacacaacaguacagaaa

SEQ ID NO: 1539930 - RNA, 19 nt, Homo sapiens
gaaacagccuccaagaaca

SEQ ID NO: 1539931 - RNA, 19 nt, Homo sapiens
gggaggagauggccagauu

SEQ ID NO: 1539932 - RNA, 19 nt, Homo sapiens
gcacuuaaacuugugauaa

SEQ ID NO: 1539933 - RNA, 19 nt, Homo sapiens
guacagaaauaagugcuaa

SEQ ID NO: 1539934 - RNA, 19 nt, Homo sapiens
gaaagccacuguuagaucu

SEQ ID NO: 1539935 - RNA, 19 nt, Homo sapiens
cagguuaaauguucacuuu

SEQ ID NO: 1539936 - RNA, 19 nt, Homo sapiens
guaaccugcugcuguauuu

SEQ ID NO: 1539937 - RNA, 19 nt, Homo sapiens
guucaaaugucuuacagaa

SEQ ID NO: 1539938 - RNA, 19 nt, Homo sapiens
gcagaagaauaaacaacuu

SEQ ID NO: 1539939 - RNA, 19 nt, Homo sapiens
aaagcaaccuuacuacuga

SEQ ID NO: 1539940 - RNA, 19 nt, Homo sapiens
uagaaagccuugaacugua

SEQ ID NO: 1539941 - RNA, 19 nt, Homo sapiens
uaagagagguucuaaacuc

SEQ ID NO: 1539942 - RNA, 19 nt, Homo sapiens
gaaagcaaccuuacuacug

SEQ ID NO: 1539943 - RNA, 19 nt, Homo sapiens
cagcuagauuccuuaauaa

SEQ ID NO: 1539944 - RNA, 19 nt, Homo sapiens
ucaaaugaccaaucaagua

SEQ ID NO: 1539945 - RNA, 19 nt, Homo sapiens
aaacggaguugacuuaaca

SEQ ID NO: 1539946 - RNA, 19 nt, Homo sapiens
gcugaaagccucauaagga

SEQ ID NO: 1539947 - RNA, 19 nt, Homo sapiens
ggaaagacaucuguguauc

SEQ ID NO: 1539948 - RNA, 19 nt, Homo sapiens
acagacaccucuuuccuuu

SEQ ID NO: 1539949 - RNA, 19 nt, Homo sapiens
gagaaugguucaaaugucu

SEQ ID NO: 1539950 - RNA, 19 nt, Homo sapiens
aaacacacacacacauuua

SEQ ID NO: 1539951 - RNA, 19 nt, Homo sapiens
gaaagacaucuguguauca

SEQ ID NO: 1539952 - RNA, 19 nt, Homo sapiens
aguccaaccugucuuauaa

SEQ ID NO: 1539953 - RNA, 19 nt, Homo sapiens
gaaggucaacaucucauuu

SEQ ID NO: 1539954 - RNA, 19 nt, Homo sapiens
caacucaucuuucccuaag

SEQ ID NO: 1539955 - RNA, 19 nt, Homo sapiens
ccaaauauccugucaagca

SEQ ID NO: 1539956 - RNA, 19 nt, Homo sapiens
aaugggacauggccaaaua

SEQ ID NO: 1539957 - RNA, 19 nt, Homo sapiens
cagagaaauugcucacaaa

SEQ ID NO: 1539958 - RNA, 19 nt, Homo sapiens
ucagagaaauugcucacaa

SEQ ID NO: 1539959 - RNA, 19 nt, Homo sapiens
gaggaaagacaucugugua

SEQ ID NO: 1539960 - RNA, 19 nt, Homo sapiens
ucaaaugucuuacagaacu

SEQ ID NO: 1539961 - RNA, 19 nt, Homo sapiens
gcaccucugucucauguuc

SEQ ID NO: 1539962 - RNA, 19 nt, Homo sapiens
caaaugccaugcagcacuu

SEQ ID NO: 1539963 - RNA, 19 nt, Homo sapiens
ccacaucacugaggucaau

SEQ ID NO: 1539964 - RNA, 19 nt, Homo sapiens
aaaccaaacuacucacaau

SEQ ID NO: 1539965 - RNA, 19 nt, Homo sapiens
gacuuaacauccuuuguga

SEQ ID NO: 1539966 - RNA, 19 nt, Homo sapiens
gaccuuggauucccugguu

SEQ ID NO: 1539967 - RNA, 19 nt, Homo sapiens
guaauaaucaggaaagcaa

SEQ ID NO: 1539968 - RNA, 19 nt, Homo sapiens
ucacaucacucaccauuuu

SEQ ID NO: 1539969 - RNA, 19 nt, Homo sapiens
gagcgacucucuggagcua

SEQ ID NO: 1539970 - RNA, 19 nt, Homo sapiens
gaauaucucgucacacuuc

SEQ ID NO: 1539971 - RNA, 19 nt, Homo sapiens
ggcaaacggaguugacuua

SEQ ID NO: 1539972 - RNA, 19 nt, Homo sapiens
gaaagccucauaaggagaa

SEQ ID NO: 1539973 - RNA, 19 nt, Homo sapiens
caaccuuacuacugaaaug

SEQ ID NO: 1539974 - RNA, 19 nt, Homo sapiens
gaaugguucaaaugucuua

SEQ ID NO: 1539975 - RNA, 19 nt, Homo sapiens
gacagaauacgacucaauu

SEQ ID NO: 1539976 - RNA, 19 nt, Homo sapiens
gagaggaugaauacuguaa

SEQ ID NO: 1539977 - RNA, 19 nt, Homo sapiens
guuagugacaguuguauuu

SEQ ID NO: 1539978 - RNA, 19 nt, Homo sapiens
ccaaguccaaccugucuua

SEQ ID NO: 1539979 - RNA, 19 nt, Homo sapiens
gagcccgguuuccauguaa

SEQ ID NO: 1539980 - RNA, 19 nt, Homo sapiens
caaaugucuuacagaacua

SEQ ID NO: 1539981 - RNA, 19 nt, Homo sapiens
uccaaccugucuuauaaua

SEQ ID NO: 1539982 - RNA, 19 nt, Homo sapiens
caggaaagcaaccuuacua

SEQ ID NO: 1539983 - RNA, 19 nt, Homo sapiens
cuaaacaucacucugaauu

SEQ ID NO: 1539984 - RNA, 19 nt, Homo sapiens
agaaagccuugaacuguau

SEQ ID NO: 1539985 - RNA, 19 nt, Homo sapiens
agacaccucuuuccuuuag

SEQ ID NO: 1539986 - RNA, 19 nt, Homo sapiens
ugagugauauugugagcaa

SEQ ID NO: 1539987 - RNA, 19 nt, Homo sapiens
ccaagcaacuggcgcagau

SEQ ID NO: 1539988 - RNA, 19 nt, Homo sapiens
ggccaaauauccugucaag

SEQ ID NO: 1539989 - RNA, 19 nt, Homo sapiens
agacaucuguguaucacuu

SEQ ID NO: 1539990 - RNA, 19 nt, Homo sapiens
ccaccaagcguuuaagaga

SEQ ID NO: 1539991 - RNA, 19 nt, Homo sapiens
gaugagaaggaaauugaaa

SEQ ID NO: 1539992 - RNA, 19 nt, Homo sapiens
caccagggcugaggucuga

SEQ ID NO: 1539993 - RNA, 19 nt, Homo sapiens
gugcuaauuucaaagcuau

SEQ ID NO: 1539994 - RNA, 19 nt, Homo sapiens
cuucguaccuaugauuaua

SEQ ID NO: 1539995 - RNA, 19 nt, Homo sapiens
gagcuacuccugcuacaau

SEQ ID NO: 1539996 - RNA, 19 nt, Homo sapiens
gauaagaagcaacaguaug

SEQ ID NO: 1539997 - RNA, 19 nt, Homo sapiens
caacaguacagaaauaagu

SEQ ID NO: 1539998 - RNA, 19 nt, Homo sapiens
ucacugaggucaaugucau

SEQ ID NO: 1539999 - RNA, 19 nt, Homo sapiens
gcaaacggaguugacuuaa

SEQ ID NO: 1540000 - RNA, 19 nt, Homo sapiens
augaagggaucacauuaaa

SEQ ID NO: 1540001 - RNA, 19 nt, Homo sapiens
agacaaaccuggagaaccu

SEQ ID NO: 1540002 - RNA, 19 nt, Homo sapiens
aaauguaucuuggcuguca

SEQ ID NO: 1540003 - RNA, 19 nt, Homo sapiens
uaagaaacagccuccaaga

SEQ ID NO: 1540004 - RNA, 19 nt, Homo sapiens
cauauugaccuuagucuuc

SEQ ID NO: 1540005 - RNA, 19 nt, Homo sapiens
ggaguugacuuaacauccu

SEQ ID NO: 1540006 - RNA, 19 nt, Homo sapiens
caaaugaccaaucaaguac

SEQ ID NO: 1540007 - RNA, 19 nt, Homo sapiens
gagaugcacaggcucaaga

SEQ ID NO: 1540008 - RNA, 19 nt, Homo sapiens
aaugaccaaucaaguacua

SEQ ID NO: 1540009 - RNA, 19 nt, Homo sapiens
gaauuuaugauguggauac

SEQ ID NO: 1540010 - RNA, 19 nt, Homo sapiens
ggaggaaagacaucugugu

SEQ ID NO: 1540011 - RNA, 19 nt, Homo sapiens
gccagagaaugguucaaau

SEQ ID NO: 1540012 - RNA, 19 nt, Homo sapiens
gcucucacaacucaucuuu

SEQ ID NO: 1540013 - RNA, 19 nt, Homo sapiens
guagagucaucugagugua

SEQ ID NO: 1540014 - RNA, 19 nt, Homo sapiens
gcuacaacaauucauagaa

SEQ ID NO: 1540015 - RNA, 19 nt, Homo sapiens
uuacauaaaugcgaacuac

SEQ ID NO: 1540016 - RNA, 19 nt, Homo sapiens
cgaucaaccaaacucauua

SEQ ID NO: 1540017 - RNA, 19 nt, Homo sapiens
ugacuuaacauccuuugug

SEQ ID NO: 1540018 - RNA, 19 nt, Homo sapiens
caucacaucacucaccauu

SEQ ID NO: 1540019 - RNA, 19 nt, Homo sapiens
ggaaggucaacaucucauu

SEQ ID NO: 1540020 - RNA, 19 nt, Homo sapiens
gagacagcccaaagacaaa

SEQ ID NO: 1540021 - RNA, 19 nt, Homo sapiens
uggagaggaugaauacugu

SEQ ID NO: 1540022 - RNA, 19 nt, Homo sapiens
ggagaucccgggacugcaa

SEQ ID NO: 1540023 - RNA, 19 nt, Homo sapiens
acacauggcuuccaacuua

SEQ ID NO: 1540024 - RNA, 19 nt, Homo sapiens
gugcagaucuuaacucauu

SEQ ID NO: 1540025 - RNA, 19 nt, Homo sapiens
ggaagaaauuguuaacugu

SEQ ID NO: 1540026 - RNA, 19 nt, Homo sapiens
guacaucacuuuggucauu

SEQ ID NO: 1540027 - RNA, 19 nt, Homo sapiens
gaagagaaugagacuaaua

SEQ ID NO: 1540028 - RNA, 19 nt, Homo sapiens
ugacagcgcugcaccuaaa

SEQ ID NO: 1540029 - RNA, 19 nt, Homo sapiens
ggccauggauuacauuaaa

SEQ ID NO: 1540030 - RNA, 19 nt, Homo sapiens
gaacuaggguacaaugagu

SEQ ID NO: 1540031 - RNA, 19 nt, Homo sapiens
gcagauaucauuagucuuc

SEQ ID NO: 1540032 - RNA, 19 nt, Homo sapiens
ggaaauggcugcuguugcu

SEQ ID NO: 1540033 - RNA, 19 nt, Homo sapiens
ccaauuacaccuuugauuu

SEQ ID NO: 1540034 - RNA, 19 nt, Homo sapiens
acaaacagcugcuuauagu

SEQ ID NO: 1540035 - RNA, 19 nt, Homo sapiens
gagcagguaugaagccuau

SEQ ID NO: 1540036 - RNA, 19 nt, Homo sapiens
gcaccuaaaugacaauuac

SEQ ID NO: 1540037 - RNA, 19 nt, Homo sapiens
gauccucgcagaauuuaua

SEQ ID NO: 1540038 - RNA, 19 nt, Homo sapiens
ggaaacagagcaauacuuc

SEQ ID NO: 1540039 - RNA, 19 nt, Homo sapiens
gaagggagaaucacacaug

SEQ ID NO: 1540040 - RNA, 19 nt, Homo sapiens
gcagaagcauacaguggaa

SEQ ID NO: 1540041 - RNA, 19 nt, Homo sapiens
ggagguagccaaugggaaa

SEQ ID NO: 1540042 - RNA, 19 nt, Homo sapiens
uauuagagguccacaaaga

SEQ ID NO: 1540043 - RNA, 19 nt, Homo sapiens
guagaugguugugcaauau

SEQ ID NO: 1540044 - RNA, 19 nt, Homo sapiens
gcguggauaugauggauuu

SEQ ID NO: 1540045 - RNA, 19 nt, Homo sapiens
uacaaugagugucuuauga

SEQ ID NO: 1540046 - RNA, 19 nt, Homo sapiens
uaauagggaugccaaagga

SEQ ID NO: 1540047 - RNA, 19 nt, Homo sapiens
gaaggagcguggauaugau

SEQ ID NO: 1540048 - RNA, 19 nt, Homo sapiens
gagcaauacuucacucucu

SEQ ID NO: 1540049 - RNA, 19 nt, Homo sapiens
guuacaauguguuauguga

SEQ ID NO: 1540050 - RNA, 19 nt, Homo sapiens
cuaaguaugcaccuaaaua

SEQ ID NO: 1540051 - RNA, 19 nt, Homo sapiens
gcauuaaacugggaauaca

SEQ ID NO: 1540052 - RNA, 19 nt, Homo sapiens
cauucacgguuauguguua

SEQ ID NO: 1540053 - RNA, 19 nt, Homo sapiens
gauauugccaagcuucaua

SEQ ID NO: 1540054 - RNA, 19 nt, Homo sapiens
gggcagguguagaaauuau

SEQ ID NO: 1540055 - RNA, 19 nt, Homo sapiens
gguauuagagguccacaaa

SEQ ID NO: 1540056 - RNA, 19 nt, Homo sapiens
gagaaagcauguagauggu

SEQ ID NO: 1540057 - RNA, 19 nt, Homo sapiens
gaacuucagcugcaaugga

SEQ ID NO: 1540058 - RNA, 19 nt, Homo sapiens
ccauaaagacuucaaggaa

SEQ ID NO: 1540059 - RNA, 19 nt, Homo sapiens
ugacaaccauaaagacuuc

SEQ ID NO: 1540060 - RNA, 19 nt, Homo sapiens
ggagagaaagcauguagau

SEQ ID NO: 1540061 - RNA, 19 nt, Homo sapiens
uuacaccaauuacaccuuu

SEQ ID NO: 1540062 - RNA, 19 nt, Homo sapiens
ggaagagaaugagacuaau

SEQ ID NO: 1540063 - RNA, 19 nt, Homo sapiens
ugaacagagugaugacaaa

SEQ ID NO: 1540064 - RNA, 19 nt, Homo sapiens
ugaaggagcguggauauga

SEQ ID NO: 1540065 - RNA, 19 nt, Homo sapiens
gcaauacuucacucucuuu

SEQ ID NO: 1540066 - RNA, 19 nt, Homo sapiens
uguagaugguugugcaaua

SEQ ID NO: 1540067 - RNA, 19 nt, Homo sapiens
uggaagaaauuguuaacug

SEQ ID NO: 1540068 - RNA, 19 nt, Homo sapiens
ggaaacauggugucucuca

SEQ ID NO: 1540069 - RNA, 19 nt, Homo sapiens
ucacugggcagaauuagaa

SEQ ID NO: 1540070 - RNA, 19 nt, Homo sapiens
ucaaggaacuaggguacaa

SEQ ID NO: 1540071 - RNA, 19 nt, Homo sapiens
cuuaagcaauggaggagua

SEQ ID NO: 1540072 - RNA, 19 nt, Homo sapiens
uggugucgcugugguauua

SEQ ID NO: 1540073 - RNA, 19 nt, Homo sapiens
cuuaagagcgccuaugaaa

SEQ ID NO: 1540074 - RNA, 19 nt, Homo sapiens
ucagauggauccgaagcua

SEQ ID NO: 1540075 - RNA, 19 nt, Homo sapiens
guggaauacuuaagcaaug

SEQ ID NO: 1540076 - RNA, 19 nt, Homo sapiens
gaauuuauaccaucauguc

SEQ ID NO: 1540077 - RNA, 19 nt, Homo sapiens
ccagauccucgcagaauuu

SEQ ID NO: 1540078 - RNA, 19 nt, Homo sapiens
caauuacaccuuugauuuc

SEQ ID NO: 1540079 - RNA, 19 nt, Homo sapiens
gacaaacagcugcuuauag

SEQ ID NO: 1540080 - RNA, 19 nt, Homo sapiens
cagaggagguagccaaugg

SEQ ID NO: 1540081 - RNA, 19 nt, Homo sapiens
gcagcuauauggcuauugc

SEQ ID NO: 1540082 - RNA, 19 nt, Homo sapiens
cagcugcaauggaaagaau

SEQ ID NO: 1540083 - RNA, 19 nt, Homo sapiens
caacugcagauccuaauuc

SEQ ID NO: 1540084 - RNA, 19 nt, Homo sapiens
uaucauuagucuucaggaa

SEQ ID NO: 1540085 - RNA, 19 nt, Homo sapiens
gaacuucaugcuugacaau

SEQ ID NO: 1540086 - RNA, 19 nt, Homo sapiens
cagcaucauucacgguuau

SEQ ID NO: 1540087 - RNA, 19 nt, Homo sapiens
gaucugucauccaauaaac

SEQ ID NO: 1540088 - RNA, 19 nt, Homo sapiens
aggaagagaaugagacuaa

SEQ ID NO: 1540089 - RNA, 19 nt, Homo sapiens
guacaaugagugucuuaug

SEQ ID NO: 1540090 - RNA, 19 nt, Homo sapiens
ggcgauggcuaauucagau

SEQ ID NO: 1540091 - RNA, 19 nt, Homo sapiens
gaagcauacaguggaauuu

SEQ ID NO: 1540092 - RNA, 19 nt, Homo sapiens
ggccagaggaagagaauga

SEQ ID NO: 1540093 - RNA, 19 nt, Homo sapiens
ugacgcagauaucauuagu

SEQ ID NO: 1540094 - RNA, 19 nt, Homo sapiens
cagcagaacuaggaaacau

SEQ ID NO: 1540095 - RNA, 19 nt, Homo sapiens
gaaagaauggaagcucaga

SEQ ID NO: 1540096 - RNA, 19 nt, Homo sapiens
agacaaacagcugcuuaua

SEQ ID NO: 1540097 - RNA, 19 nt, Homo sapiens
aagcauacaguggaauuua

SEQ ID NO: 1540098 - RNA, 19 nt, Homo sapiens
gguuauguguuacaaugug

SEQ ID NO: 1540099 - RNA, 19 nt, Homo sapiens
guaugcaccuaaauauaag

SEQ ID NO: 1540100 - RNA, 19 nt, Homo sapiens
gcagguaugaagccuauuc

SEQ ID NO: 1540101 - RNA, 19 nt, Homo sapiens
cagaauuuauaccaucaug

SEQ ID NO: 1540102 - RNA, 19 nt, Homo sapiens
gaguagcugacaaccauaa

SEQ ID NO: 1540103 - RNA, 19 nt, Homo sapiens
gguccacaaagaacuauuu

SEQ ID NO: 1540104 - RNA, 19 nt, Homo sapiens
ugucugagcaggagagaaa

SEQ ID NO: 1540105 - RNA, 19 nt, Homo sapiens
ucagcaucauucacgguua

SEQ ID NO: 1540106 - RNA, 19 nt, Homo sapiens
uaggaaacauggugucucu

SEQ ID NO: 1540107 - RNA, 19 nt, Homo sapiens
uugccaagcuucauaaucu

SEQ ID NO: 1540108 - RNA, 19 nt, Homo sapiens
gugcggagccuaaguacau

SEQ ID NO: 1540109 - RNA, 19 nt, Homo sapiens
aaacugggaauacaggaaa

SEQ ID NO: 1540110 - RNA, 19 nt, Homo sapiens
aaucacacauggcuuccaa

SEQ ID NO: 1540111 - RNA, 19 nt, Homo sapiens
aggaguagcugacaaccau

SEQ ID NO: 1540112 - RNA, 19 nt, Homo sapiens
agauucagguguuguggaa

SEQ ID NO: 1540113 - RNA, 19 nt, Homo sapiens
uuagaaaucucggguagag

SEQ ID NO: 1540114 - RNA, 19 nt, Homo sapiens
uuacauuggugcagaagca

SEQ ID NO: 1540115 - RNA, 19 nt, Homo sapiens
gaaacagagcaauacuuca

SEQ ID NO: 1540116 - RNA, 19 nt, Homo sapiens
cacauggcuuccaacuuaa

SEQ ID NO: 1540117 - RNA, 19 nt, Homo sapiens
ggugcuaugugcagaucuu

SEQ ID NO: 1540118 - RNA, 19 nt, Homo sapiens
agcauacaguggaauuuaa

SEQ ID NO: 1540119 - RNA, 19 nt, Homo sapiens
acgcagauaucauuagucu

SEQ ID NO: 1540120 - RNA, 19 nt, Homo sapiens
ggcuaaguaugcaccuaaa

SEQ ID NO: 1540121 - RNA, 19 nt, Homo sapiens
uugggcagguguagaaauu

SEQ ID NO: 1540122 - RNA, 19 nt, Homo sapiens
uaagagcgccuaugaaaau

SEQ ID NO: 1540123 - RNA, 19 nt, Homo sapiens
ggacagaacuugggagaga

SEQ ID NO: 1540124 - RNA, 19 nt, Homo sapiens
gcacaucccucucacacaa

SEQ ID NO: 1540125 - RNA, 19 nt, Homo sapiens
gaaagagggaggagagaua

SEQ ID NO: 1540126 - RNA, 19 nt, Homo sapiens
ggauggagcuucaguaggu

SEQ ID NO: 1540127 - RNA, 19 nt, Homo sapiens
ugacaaagccauccaagaa

SEQ ID NO: 1540128 - RNA, 19 nt, Homo sapiens
caaccucacuggcuuaauc

SEQ ID NO: 1540129 - RNA, 19 nt, Homo sapiens
ggacugcucuguggaagug

SEQ ID NO: 1540130 - RNA, 19 nt, Homo sapiens
gccauuaccuggacaaaca

SEQ ID NO: 1540131 - RNA, 19 nt, Homo sapiens
gaaggauucccacaucuug

SEQ ID NO: 1540132 - RNA, 19 nt, Homo sapiens
gggacacacugggccauua

SEQ ID NO: 1540133 - RNA, 19 nt, Homo sapiens
gagcaagccaucuacugua

SEQ ID NO: 1540134 - RNA, 19 nt, Homo sapiens
agacauauaccucuucaga

SEQ ID NO: 1540135 - RNA, 19 nt, Homo sapiens
acaugaagcugcuagaagu

SEQ ID NO: 1540136 - RNA, 19 nt, Homo sapiens
ggagcaagccaucuacugu

SEQ ID NO: 1540137 - RNA, 19 nt, Homo sapiens
ggaaggaaaggaggagaaa

SEQ ID NO: 1540138 - RNA, 19 nt, Homo sapiens
caguguaccucgucaggaa

SEQ ID NO: 1540139 - RNA, 19 nt, Homo sapiens
uccaagaggugcugauguu

SEQ ID NO: 1540140 - RNA, 19 nt, Homo sapiens
caaagacuccgagccauug

SEQ ID NO: 1540141 - RNA, 19 nt, Homo sapiens
ucacagacccagccuacaa

SEQ ID NO: 1540142 - RNA, 19 nt, Homo sapiens
caaugucucuaacuucauc

SEQ ID NO: 1540143 - RNA, 19 nt, Homo sapiens
agaacguggugcuguguuu

SEQ ID NO: 1540144 - RNA, 19 nt, Homo sapiens
gccaagggcacccacauga

SEQ ID NO: 1540145 - RNA, 19 nt, Homo sapiens
ucaagucgagugagcagua

SEQ ID NO: 1540146 - RNA, 19 nt, Homo sapiens
gagcuuuccuggugcuaca

SEQ ID NO: 1540147 - RNA, 19 nt, Homo sapiens
ugacaaagccaaggcaugu

SEQ ID NO: 1540148 - RNA, 19 nt, Homo sapiens
caacaugaagcugcuagaa

SEQ ID NO: 1540149 - RNA, 19 nt, Homo sapiens
ccaagagggucccguccau

SEQ ID NO: 1540150 - RNA, 19 nt, Homo sapiens
guccaaggccuaaccaaga

SEQ ID NO: 1540151 - RNA, 19 nt, Homo sapiens
ccaacacccucaucuucau

SEQ ID NO: 1540152 - RNA, 19 nt, Homo sapiens
gcguggcgcuuugguguug

SEQ ID NO: 1540153 - RNA, 19 nt, Homo sapiens
acaaggagcaagccaucua

SEQ ID NO: 1540154 - RNA, 19 nt, Homo sapiens
gcaguucuccauggucaaa

SEQ ID NO: 1540155 - RNA, 19 nt, Homo sapiens
ggccaagggugcguucuuc

SEQ ID NO: 1540156 - RNA, 19 nt, Homo sapiens
ccacaucuuggguucauga

SEQ ID NO: 1540157 - RNA, 19 nt, Homo sapiens
acaaagccauccaagaacu

SEQ ID NO: 1540158 - RNA, 19 nt, Homo sapiens
ucuaugggcuggacaucga

SEQ ID NO: 1540159 - RNA, 19 nt, Homo sapiens
ggucucucaucccaucuug

SEQ ID NO: 1540160 - RNA, 19 nt, Homo sapiens
gaacguggugcuguguuug

SEQ ID NO: 1540161 - RNA, 19 nt, Homo sapiens
aaggaaaggaggagaaaga

SEQ ID NO: 1540162 - RNA, 19 nt, Homo sapiens
ggaaagagggaggagagau

SEQ ID NO: 1540163 - RNA, 19 nt, Homo sapiens
acaaagacuccgagccauu

SEQ ID NO: 1540164 - RNA, 19 nt, Homo sapiens
caucgacgcagccaacuuc

SEQ ID NO: 1540165 - RNA, 19 nt, Homo sapiens
aaagggauaucagcaagag

SEQ ID NO: 1540166 - RNA, 19 nt, Homo sapiens
gaagaacguggugcugugu

SEQ ID NO: 1540167 - RNA, 19 nt, Homo sapiens
gcacccacaugaggaaggu

SEQ ID NO: 1540168 - RNA, 19 nt, Homo sapiens
caaagggauaucagcaaga

SEQ ID NO: 1540169 - RNA, 19 nt, Homo sapiens
caggauggacccucacaga

SEQ ID NO: 1540170 - RNA, 19 nt, Homo sapiens
aagcugagacccaggauuc

SEQ ID NO: 1540171 - RNA, 19 nt, Homo sapiens
gaagcugagacccaggauu

SEQ ID NO: 1540172 - RNA, 19 nt, Homo sapiens
acgccaacguugucacuga

SEQ ID NO: 1540173 - RNA, 19 nt, Homo sapiens
ggccgagacccacagugua

SEQ ID NO: 1540174 - RNA, 19 nt, Homo sapiens
ggaggaggaggaaggaaag

SEQ ID NO: 1540175 - RNA, 19 nt, Homo sapiens
uggaggccaugaaggaaga

SEQ ID NO: 1540176 - RNA, 19 nt, Homo sapiens
ggccaccaccaaagggaua

SEQ ID NO: 1540177 - RNA, 19 nt, Homo sapiens
aagaggugcugauguucga

SEQ ID NO: 1540178 - RNA, 19 nt, Homo sapiens
caggacugcucggcuucua

SEQ ID NO: 1540179 - RNA, 19 nt, Homo sapiens
gcccaagcccagaagauuc

SEQ ID NO: 1540180 - RNA, 19 nt, Homo sapiens
uccaaggccuaaccaagau

SEQ ID NO: 1540181 - RNA, 19 nt, Homo sapiens
ccauugaggccaccaccaa

SEQ ID NO: 1540182 - RNA, 19 nt, Homo sapiens
ggacacacugggccauuac

SEQ ID NO: 1540183 - RNA, 19 nt, Homo sapiens
gcaguauccggccuuucaa

SEQ ID NO: 1540184 - RNA, 19 nt, Homo sapiens
gacaaagccauccaagaac

SEQ ID NO: 1540185 - RNA, 19 nt, Homo sapiens
ugaaguaaggguacaggau

SEQ ID NO: 1540186 - RNA, 19 nt, Homo sapiens
gcaacaugaagcugcuaga

SEQ ID NO: 1540187 - RNA, 19 nt, Homo sapiens
ggacugcucggcuucuacu

SEQ ID NO: 1540188 - RNA, 19 nt, Homo sapiens
agagugggcccaggacaaa

SEQ ID NO: 1540189 - RNA, 19 nt, Homo sapiens
ggaccgggaagccucaaag

SEQ ID NO: 1540190 - RNA, 19 nt, Homo sapiens
ggugcguucuuccaguuca

SEQ ID NO: 1540191 - RNA, 19 nt, Homo sapiens
gguggauggagcuucagua

SEQ ID NO: 1540192 - RNA, 19 nt, Homo sapiens
ccggguggauggagcuuca

SEQ ID NO: 1540193 - RNA, 19 nt, Homo sapiens
gaaccccaccccacaaaga

SEQ ID NO: 1540194 - RNA, 19 nt, Homo sapiens
cagagugggcccaggacaa

SEQ ID NO: 1540195 - RNA, 19 nt, Homo sapiens
ccuguggacuggaagacau

SEQ ID NO: 1540196 - RNA, 19 nt, Homo sapiens
gaaggaaaggaggagaaag

SEQ ID NO: 1540197 - RNA, 19 nt, Homo sapiens
agacaaaucuucugcauga

SEQ ID NO: 1540198 - RNA, 19 nt, Homo sapiens
gaaggaagauguggaaguu

SEQ ID NO: 1540199 - RNA, 19 nt, Homo sapiens
gaaaagagauuaugacugu

SEQ ID NO: 1540200 - RNA, 19 nt, Homo sapiens
gggaacaaaugaucaauga

SEQ ID NO: 1540201 - RNA, 19 nt, Homo sapiens
gaaguacaaaccagauuua

SEQ ID NO: 1540202 - RNA, 19 nt, Homo sapiens
caaaccagauuuagagaau

SEQ ID NO: 1540203 - RNA, 19 nt, Homo sapiens
gcuaaagcuugaugacauu

SEQ ID NO: 1540204 - RNA, 19 nt, Homo sapiens
caacacgccuagagcuaaa

SEQ ID NO: 1540205 - RNA, 19 nt, Homo sapiens
guaagaaacagaaggaaga

SEQ ID NO: 1540206 - RNA, 19 nt, Homo sapiens
guacaaaccagauuuagag

SEQ ID NO: 1540207 - RNA, 19 nt, Homo sapiens
ccaauaaucguucaucuca

SEQ ID NO: 1540208 - RNA, 19 nt, Homo sapiens
ucacuggguuuggcccuua

SEQ ID NO: 1540209 - RNA, 19 nt, Homo sapiens
ccauugggcuuagcaguga

SEQ ID NO: 1540210 - RNA, 19 nt, Homo sapiens
ccaguuggcuuagcaguag

SEQ ID NO: 1540211 - RNA, 19 nt, Homo sapiens
caugauggaagucguagua

SEQ ID NO: 1540212 - RNA, 19 nt, Homo sapiens
gauuaugacuguaccuuuu

SEQ ID NO: 1540213 - RNA, 19 nt, Homo sapiens
ugagauuacugaugcuuca

SEQ ID NO: 1540214 - RNA, 19 nt, Homo sapiens
gauggaagucguaguagga

SEQ ID NO: 1540215 - RNA, 19 nt, Homo sapiens
ggaagauguggaaguugua

SEQ ID NO: 1540216 - RNA, 19 nt, Homo sapiens
aaccagauuuagagaauug

SEQ ID NO: 1540217 - RNA, 19 nt, Homo sapiens
ugaugacauugaagaguuu

SEQ ID NO: 1540218 - RNA, 19 nt, Homo sapiens
ggaagucguaguaggaaau

SEQ ID NO: 1540219 - RNA, 19 nt, Homo sapiens
ugaagaguuugagaacauu

SEQ ID NO: 1540220 - RNA, 19 nt, Homo sapiens
guacacauuuaagaucugu

SEQ ID NO: 1540221 - RNA, 19 nt, Homo sapiens
ggaauggaauaaaaugaug

SEQ ID NO: 1540222 - RNA, 19 nt, Homo sapiens
caagagccgggaacaaaug

SEQ ID NO: 1540223 - RNA, 19 nt, Homo sapiens
gcgcuggaauggaauaaaa

SEQ ID NO: 1540224 - RNA, 19 nt, Homo sapiens
uugaugacauugaagaguu

SEQ ID NO: 1540225 - RNA, 19 nt, Homo sapiens
aaagcuugaugacauugaa

SEQ ID NO: 1540226 - RNA, 19 nt, Homo sapiens
gaaaccaacacgccuagag

SEQ ID NO: 1540227 - RNA, 19 nt, Homo sapiens
caauaaucguucaucucaa

SEQ ID NO: 1540228 - RNA, 19 nt, Homo sapiens
gaaacagaaggaagaugug

SEQ ID NO: 1540229 - RNA, 19 nt, Homo sapiens
ccaacacgccuagagcuaa

SEQ ID NO: 1540230 - RNA, 19 nt, Homo sapiens
aaacugaucugauuuucug

SEQ ID NO: 1540231 - RNA, 19 nt, Homo sapiens
gauuacugaugcuucacuu

SEQ ID NO: 1540232 - RNA, 19 nt, Homo sapiens
agaaguacaaaccagauuu

SEQ ID NO: 1540233 - RNA, 19 nt, Homo sapiens
caagcagucugggaagugu

SEQ ID NO: 1540234 - RNA, 19 nt, Homo sapiens
aaucguucaucucaauuug

SEQ ID NO: 1540235 - RNA, 19 nt, Homo sapiens
ccuagaaccuccaggaaaa

SEQ ID NO: 1540236 - RNA, 19 nt, Homo sapiens
aggaagauguggaaguugu

SEQ ID NO: 1540237 - RNA, 19 nt, Homo sapiens
uugaagaguuugagaacau

SEQ ID NO: 1540238 - RNA, 19 nt, Homo sapiens
cauuuaagaucuguuugga

SEQ ID NO: 1540239 - RNA, 19 nt, Homo sapiens
gcuuagcaguaguuucguu

SEQ ID NO: 1540240 - RNA, 19 nt, Homo sapiens
gcagaaguacaaaccagau

SEQ ID NO: 1540241 - RNA, 19 nt, Homo sapiens
agaaacagaaggaagaugu

SEQ ID NO: 1540242 - RNA, 19 nt, Homo sapiens
auaauccugugaauagcua

SEQ ID NO: 1540243 - RNA, 19 nt, Homo sapiens
ugacguacacauuuaagau

SEQ ID NO: 1540244 - RNA, 19 nt, Homo sapiens
caacccaagcccaauaauc

SEQ ID NO: 1540245 - RNA, 19 nt, Homo sapiens
cccaagagccgggaacaaa

SEQ ID NO: 1540246 - RNA, 19 nt, Homo sapiens
ccaagagccgggaacaaau

SEQ ID NO: 1540247 - RNA, 19 nt, Homo sapiens
agagacaaaucuucugcau

SEQ ID NO: 1540248 - RNA, 19 nt, Homo sapiens
caauuuggaagucuugaau

SEQ ID NO: 1540249 - RNA, 19 nt, Homo sapiens
aggaaaagcucgcggaaga

SEQ ID NO: 1540250 - RNA, 19 nt, Homo sapiens
aaugauggcagaaguacaa

SEQ ID NO: 1540251 - RNA, 19 nt, Homo sapiens
gguuuggcccuuaguguug

SEQ ID NO: 1540252 - RNA, 19 nt, Homo sapiens
acaaaucuucugcaugaga

SEQ ID NO: 1540253 - RNA, 19 nt, Homo sapiens
gcccaauaaucguucaucu

SEQ ID NO: 1540254 - RNA, 19 nt, Homo sapiens
gaucggauugguuauaaac

SEQ ID NO: 1540255 - RNA, 19 nt, Homo sapiens
gagguucugcggagagaga

SEQ ID NO: 1540256 - RNA, 19 nt, Homo sapiens
gaagucguaguaggaaaug

SEQ ID NO: 1540257 - RNA, 19 nt, Homo sapiens
gagauuaugacuguaccuu

SEQ ID NO: 1540258 - RNA, 19 nt, Homo sapiens
augaucggauugguuauaa

SEQ ID NO: 1540259 - RNA, 19 nt, Homo sapiens
aggcagugauggagaagga

SEQ ID NO: 1540260 - RNA, 19 nt, Homo sapiens
gaagauguggaaguuguag

SEQ ID NO: 1540261 - RNA, 19 nt, Homo sapiens
acagaaggaagauguggaa

SEQ ID NO: 1540262 - RNA, 19 nt, Homo sapiens
cagaaguacaaaccagauu

SEQ ID NO: 1540263 - RNA, 19 nt, Homo sapiens
ugaucggauugguuauaaa

SEQ ID NO: 1540264 - RNA, 19 nt, Homo sapiens
gaagaguuugagaacauuc

SEQ ID NO: 1540265 - RNA, 19 nt, Homo sapiens
ccuggagacccguaagaaa

SEQ ID NO: 1540266 - RNA, 19 nt, Homo sapiens
ggguuuggcccuuaguguu

SEQ ID NO: 1540267 - RNA, 19 nt, Homo sapiens
guuuggacgcggaggauaa

SEQ ID NO: 1540268 - RNA, 19 nt, Homo sapiens
augcuucacuugcacucua

SEQ ID NO: 1540269 - RNA, 19 nt, Homo sapiens
uaaaaugauggcagaagua

SEQ ID NO: 1540270 - RNA, 19 nt, Homo sapiens
aaugaucggauugguuaua

SEQ ID NO: 1540271 - RNA, 19 nt, Homo sapiens
gggaaguguaguccaguug

SEQ ID NO: 1540272 - RNA, 19 nt, Homo sapiens
gacguacacauuuaagauc

SEQ ID NO: 1540273 - RNA, 19 nt, Homo sapiens
ucugguuugucucuugaaa

SEQ ID NO: 1540274 - RNA, 19 nt, Homo sapiens
gcagucaagcagaauguac

SEQ ID NO: 1540275 - RNA, 19 nt, Homo sapiens
ucguucaucucaauuugga

SEQ ID NO: 1540276 - RNA, 19 nt, Homo sapiens
gaccuggagacccguaaga

SEQ ID NO: 1540277 - RNA, 19 nt, Homo sapiens
acaaaccagauuuagagaa

SEQ ID NO: 1540278 - RNA, 19 nt, Homo sapiens
aaagagauuaugacuguac

SEQ ID NO: 1540279 - RNA, 19 nt, Homo sapiens
aggaggcagugauggagaa

SEQ ID NO: 1540280 - RNA, 19 nt, Homo sapiens
uugagaacauucgaaagga

SEQ ID NO: 1540281 - RNA, 19 nt, Homo sapiens
uaaagcuugaugacauuga

SEQ ID NO: 1540282 - RNA, 19 nt, Homo sapiens
uuuagagaauugagugcuu

SEQ ID NO: 1540283 - RNA, 19 nt, Homo sapiens
gagccgggaacaaaugauc

SEQ ID NO: 1540284 - RNA, 19 nt, Homo sapiens
guuuggcccuuaguguuga

SEQ ID NO: 1540285 - RNA, 19 nt, Homo sapiens
guguaguccaguuggcuua

SEQ ID NO: 1540286 - RNA, 19 nt, Homo sapiens
uggaagucguaguaggaaa

SEQ ID NO: 1540287 - RNA, 19 nt, Homo sapiens
caagcccaauaaucguuca

SEQ ID NO: 1540288 - RNA, 19 nt, Homo sapiens
ugggaaguguaguccaguu

SEQ ID NO: 1540289 - RNA, 19 nt, Homo sapiens
uaagaaacagaaggaagau

SEQ ID NO: 1540290 - RNA, 19 nt, Homo sapiens
gacauugaagaguuugaga

SEQ ID NO: 1540291 - RNA, 19 nt, Homo sapiens
aguguugacuucaguaugc

SEQ ID NO: 1540292 - RNA, 19 nt, Homo sapiens
acucugguuugucucuuga

SEQ ID NO: 1540293 - RNA, 19 nt, Homo sapiens
gauaauccugugaauagcu

SEQ ID NO: 1540294 - RNA, 19 nt, Homo sapiens
cuaauuguucacuggguuu

SEQ ID NO: 1540295 - RNA, 19 nt, Homo sapiens
gagagagaggcuccaagca

SEQ ID NO: 1540296 - RNA, 19 nt, Homo sapiens
gcaauuacauggauacuuu

SEQ ID NO: 1540297 - RNA, 19 nt, Homo sapiens
gcaauuagaccuacaguua

SEQ ID NO: 1540298 - RNA, 19 nt, Homo sapiens
guaaauagcugucaucauc

SEQ ID NO: 1540299 - RNA, 19 nt, Homo sapiens
gagcuaaacuuauucagaa

SEQ ID NO: 1540300 - RNA, 19 nt, Homo sapiens
cgaauuagcugaggagaua

SEQ ID NO: 1540301 - RNA, 19 nt, Homo sapiens
gaaguagguucauguguuu

SEQ ID NO: 1540302 - RNA, 19 nt, Homo sapiens
gaauguagcuaaaugaugu

SEQ ID NO: 1540303 - RNA, 19 nt, Homo sapiens
gagaagaccuauauagaga

SEQ ID NO: 1540304 - RNA, 19 nt, Homo sapiens
uaaaugaugucccaaacua

SEQ ID NO: 1540305 - RNA, 19 nt, Homo sapiens
gggaagacauuuguaauaa

SEQ ID NO: 1540306 - RNA, 19 nt, Homo sapiens
ucaaugacauguauaggua

SEQ ID NO: 1540307 - RNA, 19 nt, Homo sapiens
gaggacaauuggcugauua

SEQ ID NO: 1540308 - RNA, 19 nt, Homo sapiens
gaaggaaauugggauguuu

SEQ ID NO: 1540309 - RNA, 19 nt, Homo sapiens
gagaagaucuaaccagcaa

SEQ ID NO: 1540310 - RNA, 19 nt, Homo sapiens
aacaagagauuggcuauua

SEQ ID NO: 1540311 - RNA, 19 nt, Homo sapiens
gcacaagacccgugaagaa

SEQ ID NO: 1540312 - RNA, 19 nt, Homo sapiens
gaaggaauguaaacaguag

SEQ ID NO: 1540313 - RNA, 19 nt, Homo sapiens
gaacugacuuccagguguu

SEQ ID NO: 1540314 - RNA, 19 nt, Homo sapiens
gcgcucaguugauaacaua

SEQ ID NO: 1540315 - RNA, 19 nt, Homo sapiens
gggcugggauucugcauuu

SEQ ID NO: 1540316 - RNA, 19 nt, Homo sapiens
uagcugcccuggugcauua

SEQ ID NO: 1540317 - RNA, 19 nt, Homo sapiens
uaauaagggucaaagacua

SEQ ID NO: 1540318 - RNA, 19 nt, Homo sapiens
gagaggcacuucugucuuc

SEQ ID NO: 1540319 - RNA, 19 nt, Homo sapiens
ggaagaagauaacauugag

SEQ ID NO: 1540320 - RNA, 19 nt, Homo sapiens
agauagaacucaaccauga

SEQ ID NO: 1540321 - RNA, 19 nt, Homo sapiens
ucacaucuuugccgguuua

SEQ ID NO: 1540322 - RNA, 19 nt, Homo sapiens
gauacuagcugaguuguag

SEQ ID NO: 1540323 - RNA, 19 nt, Homo sapiens
gguacuugcuguaggauuu

SEQ ID NO: 1540324 - RNA, 19 nt, Homo sapiens
ggucaaagacuacaucaga

SEQ ID NO: 1540325 - RNA, 19 nt, Homo sapiens
gaggagaaauguggaauca

SEQ ID NO: 1540326 - RNA, 19 nt, Homo sapiens
gacaauuggcugauuauuu

SEQ ID NO: 1540327 - RNA, 19 nt, Homo sapiens
caacugaggaagaagauaa

SEQ ID NO: 1540328 - RNA, 19 nt, Homo sapiens
gaaguuucaucagauugua

SEQ ID NO: 1540329 - RNA, 19 nt, Homo sapiens
ucucaaagagcuaaacuua

SEQ ID NO: 1540330 - RNA, 19 nt, Homo sapiens
gcacuucugucuucuccuu

SEQ ID NO: 1540331 - RNA, 19 nt, Homo sapiens
caucagagauucaaauagg

SEQ ID NO: 1540332 - RNA, 19 nt, Homo sapiens
gugagaggcuagauucaaa

SEQ ID NO: 1540333 - RNA, 19 nt, Homo sapiens
gcaaugaccaggcacaaga

SEQ ID NO: 1540334 - RNA, 19 nt, Homo sapiens
ggaauaaucuuggggaaaa

SEQ ID NO: 1540335 - RNA, 19 nt, Homo sapiens
agaaguagguucauguguu

SEQ ID NO: 1540336 - RNA, 19 nt, Homo sapiens
ccaaacuacuuacaaacuu

SEQ ID NO: 1540337 - RNA, 19 nt, Homo sapiens
guaguucccuccacgagaa

SEQ ID NO: 1540338 - RNA, 19 nt, Homo sapiens
gaaacagaaaguauccaua

SEQ ID NO: 1540339 - RNA, 19 nt, Homo sapiens
uauguuaucugaagaguca

SEQ ID NO: 1540340 - RNA, 19 nt, Homo sapiens
guagacaucuuuaaaucuc

SEQ ID NO: 1540341 - RNA, 19 nt, Homo sapiens
ucaaagacccucaguguuc

SEQ ID NO: 1540342 - RNA, 19 nt, Homo sapiens
ggaaacauuuggguugaug

SEQ ID NO: 1540343 - RNA, 19 nt, Homo sapiens
caucgacucugaacauguu

SEQ ID NO: 1540344 - RNA, 19 nt, Homo sapiens
uagcugaguuguaguguau

SEQ ID NO: 1540345 - RNA, 19 nt, Homo sapiens
caugaugacucuauuugga

SEQ ID NO: 1540346 - RNA, 19 nt, Homo sapiens
uaaggugggucucuuguca

SEQ ID NO: 1540347 - RNA, 19 nt, Homo sapiens
gaagaccuauauagagaca

SEQ ID NO: 1540348 - RNA, 19 nt, Homo sapiens
gggauuauuugguacaugu

SEQ ID NO: 1540349 - RNA, 19 nt, Homo sapiens
gucacuagcauacaauuua

SEQ ID NO: 1540350 - RNA, 19 nt, Homo sapiens
gcugaguuguaguguauuu

SEQ ID NO: 1540351 - RNA, 19 nt, Homo sapiens
acaagagauuggcuauuaa

SEQ ID NO: 1540352 - RNA, 19 nt, Homo sapiens
gaaaauggaguaauuguga

SEQ ID NO: 1540353 - RNA, 19 nt, Homo sapiens
ugccagagguccaaauauu

SEQ ID NO: 1540354 - RNA, 19 nt, Homo sapiens
ggagaagaccuauauagag

SEQ ID NO: 1540355 - RNA, 19 nt, Homo sapiens
gaagauccgagcuggguuu

SEQ ID NO: 1540356 - RNA, 19 nt, Homo sapiens
ucagggaaaucacaauaau

SEQ ID NO: 1540357 - RNA, 19 nt, Homo sapiens
uuagaaaucugauggucaa

SEQ ID NO: 1540358 - RNA, 19 nt, Homo sapiens
uguggcaggugcuuuauaa

SEQ ID NO: 1540359 - RNA, 19 nt, Homo sapiens
ggaggacaauuggcugauu

SEQ ID NO: 1540360 - RNA, 19 nt, Homo sapiens
cgucaugugugucagaauu

SEQ ID NO: 1540361 - RNA, 19 nt, Homo sapiens
gaaaaugcccacguaaaua

SEQ ID NO: 1540362 - RNA, 19 nt, Homo sapiens
guagggaagacauuuguaa

SEQ ID NO: 1540363 - RNA, 19 nt, Homo sapiens
cagaauguguuccucauag

SEQ ID NO: 1540364 - RNA, 19 nt, Homo sapiens
caagagauuggcuauuaaa

SEQ ID NO: 1540365 - RNA, 19 nt, Homo sapiens
caaagaaacauugaaggaa

SEQ ID NO: 1540366 - RNA, 19 nt, Homo sapiens
gaggagcgacccuugauga

SEQ ID NO: 1540367 - RNA, 19 nt, Homo sapiens
gggauccggugcaaucuug

SEQ ID NO: 1540368 - RNA, 19 nt, Homo sapiens
acagagaaauacuacaaug

SEQ ID NO: 1540369 - RNA, 19 nt, Homo sapiens
gaagauuuccauucagugu

SEQ ID NO: 1540370 - RNA, 19 nt, Homo sapiens
ggacaacugaggaagaaga

SEQ ID NO: 1540371 - RNA, 19 nt, Homo sapiens
caaggcaucuaaagcaaca

SEQ ID NO: 1540372 - RNA, 19 nt, Homo sapiens
ggcaggugcuuuauaaaca

SEQ ID NO: 1540373 - RNA, 19 nt, Homo sapiens
gaggagggcuucauauucc

SEQ ID NO: 1540374 - RNA, 19 nt, Homo sapiens
gcagaauguguuccucaua

SEQ ID NO: 1540375 - RNA, 19 nt, Homo sapiens
ccacaacugcugucagaaa

SEQ ID NO: 1540376 - RNA, 19 nt, Homo sapiens
ggaaggaaggagugaagaa

SEQ ID NO: 1540377 - RNA, 19 nt, Homo sapiens
uuuaguggcuucgcuauuu

SEQ ID NO: 1540378 - RNA, 19 nt, Homo sapiens
ccaaugaggagaagaccua

SEQ ID NO: 1540379 - RNA, 19 nt, Homo sapiens
caauagcaccguauauguu

SEQ ID NO: 1540380 - RNA, 19 nt, Homo sapiens
gaagaacgccgugggagau

SEQ ID NO: 1540381 - RNA, 19 nt, Homo sapiens
uaaggcaauuacauggaua

SEQ ID NO: 1540382 - RNA, 19 nt, Homo sapiens
gacucuauuuggaaugaua

SEQ ID NO: 1540383 - RNA, 19 nt, Homo sapiens
cagaaggaauguaaacagu

SEQ ID NO: 1540384 - RNA, 19 nt, Homo sapiens
ugaaggaaauugggauguu

SEQ ID NO: 1540385 - RNA, 19 nt, Homo sapiens
gaaaggaaugacuagaaga

SEQ ID NO: 1540386 - RNA, 19 nt, Homo sapiens
gaagaaggaauggaaagga

SEQ ID NO: 1540387 - RNA, 19 nt, Homo sapiens
uaacaucgacucugaacau

SEQ ID NO: 1540388 - RNA, 19 nt, Homo sapiens
gaaauggucaacaauagca

SEQ ID NO: 1540389 - RNA, 19 nt, Homo sapiens
cauuaucccuggaacuuau

SEQ ID NO: 1540390 - RNA, 19 nt, Homo sapiens
ccuauugccuuucuuguag

SEQ ID NO: 1540391 - RNA, 19 nt, Homo sapiens
gaggaaggaugacaguuuu

SEQ ID NO: 1540392 - RNA, 19 nt, Homo sapiens
gaggagaagaccuauauag

SEQ ID NO: 1540393 - RNA, 19 nt, Homo sapiens
gccaugggauguggaguaa

SEQ ID NO: 1540394 - RNA, 19 nt, Homo sapiens
gaaagcaguaaacaagaga

SEQ ID NO: 1540395 - RNA, 19 nt, Homo sapiens
gcugaaagcaguaaacaag

SEQ ID NO: 1540396 - RNA, 19 nt, Homo sapiens
ugaagaagcugacagauua

SEQ ID NO: 1540397 - RNA, 19 nt, Homo sapiens
ggaaagaggugaucaacaa

SEQ ID NO: 1540398 - RNA, 19 nt, Homo sapiens
gacaguauguuuacgauaa

SEQ ID NO: 1540399 - RNA, 19 nt, Homo sapiens
ucaauaaacugguucugua

SEQ ID NO: 1540400 - RNA, 19 nt, Homo sapiens
gaagacaagugcagggaaa

SEQ ID NO: 1540401 - RNA, 19 nt, Homo sapiens
ggauggagauggacaugaa

SEQ ID NO: 1540402 - RNA, 19 nt, Homo sapiens
gagcaggaaucggcguuua

SEQ ID NO: 1540403 - RNA, 19 nt, Homo sapiens
gcgcagagccguaugcaaa

SEQ ID NO: 1540404 - RNA, 19 nt, Homo sapiens
gaacaagcaaagacucaaa

SEQ ID NO: 1540405 - RNA, 19 nt, Homo sapiens
gauggcugcugcuccagua

SEQ ID NO: 1540406 - RNA, 19 nt, Homo sapiens
uaaacaaucggaagacuga

SEQ ID NO: 1540407 - RNA, 19 nt, Homo sapiens
gaaagaggugaucaacaaa

SEQ ID NO: 1540408 - RNA, 19 nt, Homo sapiens
uuaagaaguuugccacaga

SEQ ID NO: 1540409 - RNA, 19 nt, Homo sapiens
agaaggagcuaaacaaucg

SEQ ID NO: 1540410 - RNA, 19 nt, Homo sapiens
ggauggacauucaguggau

SEQ ID NO: 1540411 - RNA, 19 nt, Homo sapiens
ccaaagagcggaaauucau

SEQ ID NO: 1540412 - RNA, 19 nt, Homo sapiens
aaaucaacauggacaagaa

SEQ ID NO: 1540413 - RNA, 19 nt, Homo sapiens
ggaagacugagccauguga

SEQ ID NO: 1540414 - RNA, 19 nt, Homo sapiens
gagcuaaacaaucggaaga

SEQ ID NO: 1540415 - RNA, 19 nt, Homo sapiens
cagauuagccagagaagga

SEQ ID NO: 1540416 - RNA, 19 nt, Homo sapiens
gagaaggagcuaaacaauc

SEQ ID NO: 1540417 - RNA, 19 nt, Homo sapiens
ucugugacauguguuuaua

SEQ ID NO: 1540418 - RNA, 19 nt, Homo sapiens
aagaggugaucaacaaaga

SEQ ID NO: 1540419 - RNA, 19 nt, Homo sapiens
ggccauccuuuaaauguag

SEQ ID NO: 1540420 - RNA, 19 nt, Homo sapiens
caaugaagaagcugacaga

SEQ ID NO: 1540421 - RNA, 19 nt, Homo sapiens
cagagaaggagcuaaacaa

SEQ ID NO: 1540422 - RNA, 19 nt, Homo sapiens
gguucaagguuggaagaaa

SEQ ID NO: 1540423 - RNA, 19 nt, Homo sapiens
caauaaacugguucuguau

SEQ ID NO: 1540424 - RNA, 19 nt, Homo sapiens
caaagccauugaacaagca

SEQ ID NO: 1540425 - RNA, 19 nt, Homo sapiens
gaaguuugccacagaggau

SEQ ID NO: 1540426 - RNA, 19 nt, Homo sapiens
cugcaaagccauugaacaa

SEQ ID NO: 1540427 - RNA, 19 nt, Homo sapiens
ggccuucugugacaugugu

SEQ ID NO: 1540428 - RNA, 19 nt, Homo sapiens
gguaggaccauugcaguga

SEQ ID NO: 1540429 - RNA, 19 nt, Homo sapiens
gcugccagauuuaagaagu

SEQ ID NO: 1540430 - RNA, 19 nt, Homo sapiens
gcagagacacguuuuccua

SEQ ID NO: 1540431 - RNA, 19 nt, Homo sapiens
gaugggcagaugcgucuuu

SEQ ID NO: 1540432 - RNA, 19 nt, Homo sapiens
guaggaccauugcagugau

SEQ ID NO: 1540433 - RNA, 19 nt, Homo sapiens
ugacagauuagccagagaa

SEQ ID NO: 1540434 - RNA, 19 nt, Homo sapiens
uuucugaccuggaaugagu

SEQ ID NO: 1540435 - RNA, 19 nt, Homo sapiens
guucaagguuggaagaaaa

SEQ ID NO: 1540436 - RNA, 19 nt, Homo sapiens
uaaacugguucuguauaca

SEQ ID NO: 1540437 - RNA, 19 nt, Homo sapiens
gaagaagcugacagauuag

SEQ ID NO: 1540438 - RNA, 19 nt, Homo sapiens
ggauuuauaggcaaugaag

SEQ ID NO: 1540439 - RNA, 19 nt, Homo sapiens
cagacaguauguuuacgau

SEQ ID NO: 1540440 - RNA, 19 nt, Homo sapiens
auaaacugguucuguauac

SEQ ID NO: 1540441 - RNA, 19 nt, Homo sapiens
acugagccaugugacuuua

SEQ ID NO: 1540442 - RNA, 19 nt, Homo sapiens
gcuaaacaaucggaagacu

SEQ ID NO: 1540443 - RNA, 19 nt, Homo sapiens
ccuggucauucgggauuua

SEQ ID NO: 1540444 - RNA, 19 nt, Homo sapiens
gcauguuccuggucauucg

SEQ ID NO: 1540445 - RNA, 19 nt, Homo sapiens
caaagagcggaaauucaug

SEQ ID NO: 1540446 - RNA, 19 nt, Homo sapiens
gccacuggauggagaugga

SEQ ID NO: 1540447 - RNA, 19 nt, Homo sapiens
gacugagccaugugacuuu

SEQ ID NO: 1540448 - RNA, 19 nt, Homo sapiens
ugaaagcgcagagccguau

SEQ ID NO: 1540449 - RNA, 19 nt, Homo sapiens
ggucauucgggauuuauag

SEQ ID NO: 1540450 - RNA, 19 nt, Homo sapiens
ugccagauuuaagaaguuu

SEQ ID NO: 1540451 - RNA, 19 nt, Homo sapiens
agagaaggagcuaaacaau

SEQ ID NO: 1540452 - RNA, 19 nt, Homo sapiens
ccagagaaggagcuaaaca

SEQ ID NO: 1540453 - RNA, 19 nt, Homo sapiens
aaaccaaagagcggaaauu

SEQ ID NO: 1540454 - RNA, 19 nt, Homo sapiens
gauggagauggacaugaaa

SEQ ID NO: 1540455 - RNA, 19 nt, Homo sapiens
uauaggcaaugaagaagcu

SEQ ID NO: 1540456 - RNA, 19 nt, Homo sapiens
gggaaagaggugaucaaca

SEQ ID NO: 1540457 - RNA, 19 nt, Homo sapiens
gcaaagacucaaaacauca

SEQ ID NO: 1540458 - RNA, 19 nt, Homo sapiens
gcacagguggaccgguuuc

SEQ ID NO: 1540459 - RNA, 19 nt, Homo sapiens
guuuccugcugccagauuu

SEQ ID NO: 1540460 - RNA, 19 nt, Homo sapiens
augaagaagcugacagauu

SEQ ID NO: 1540461 - RNA, 19 nt, Homo sapiens
auaacuaacuggguucaag

SEQ ID NO: 1540462 - RNA, 19 nt, Homo sapiens
guacuuacugguguggaaa

SEQ ID NO: 1540463 - RNA, 19 nt, Homo sapiens
acaagaaucggaggcgaaa

SEQ ID NO: 1540464 - RNA, 19 nt, Homo sapiens
uguacuuacugguguggaa

SEQ ID NO: 1540465 - RNA, 19 nt, Homo sapiens
cagaagggcaugaaaauca

SEQ ID NO: 1540466 - RNA, 19 nt, Homo sapiens
gcagagccguaugcaaagc

SEQ ID NO: 1540467 - RNA, 19 nt, Homo sapiens
ugagccaugugacuuuagu

SEQ ID NO: 1540468 - RNA, 19 nt, Homo sapiens
agacugagccaugugacuu

SEQ ID NO: 1540469 - RNA, 19 nt, Homo sapiens
agacaguauguuuacgaua

SEQ ID NO: 1540470 - RNA, 19 nt, Homo sapiens
ggcugcugcuccaguaaug

SEQ ID NO: 1540471 - RNA, 19 nt, Homo sapiens
ucggaagacugagccaugu

SEQ ID NO: 1540472 - RNA, 19 nt, Homo sapiens
gguucgggauguucuaugc

SEQ ID NO: 1540473 - RNA, 19 nt, Homo sapiens
uaggaccauugcagugaug

SEQ ID NO: 1540474 - RNA, 19 nt, Homo sapiens
ucugcaagcccggaaguuu

SEQ ID NO: 1540475 - RNA, 19 nt, Homo sapiens
gcaggaaucggcguuuacu

SEQ ID NO: 1540476 - RNA, 19 nt, Homo sapiens
cugccagauuuaagaaguu

SEQ ID NO: 1540477 - RNA, 19 nt, Homo sapiens
gaaggacucuccauguuua

SEQ ID NO: 1540478 - RNA, 19 nt, Homo sapiens
ucaaggaucuaguggauua

SEQ ID NO: 1540479 - RNA, 19 nt, Homo sapiens
gagcaaagcagaauacuga

SEQ ID NO: 1540480 - RNA, 19 nt, Homo sapiens
gcagaauacugauggauga

SEQ ID NO: 1540481 - RNA, 19 nt, Homo sapiens
gaacaguacuggaaugaag

SEQ ID NO: 1540482 - RNA, 19 nt, Homo sapiens
gaagaagcaugucuccuau

SEQ ID NO: 1540483 - RNA, 19 nt, Homo sapiens
ggaagaaugcccuauguuu

SEQ ID NO: 1540484 - RNA, 19 nt, Homo sapiens
gaauacugauggaugauuu

SEQ ID NO: 1540485 - RNA, 19 nt, Homo sapiens
gaagagucauacaguguuu

SEQ ID NO: 1540486 - RNA, 19 nt, Homo sapiens
ucauaacucucaucgauaa

SEQ ID NO: 1540487 - RNA, 19 nt, Homo sapiens
gaucucaaguggucacaaa

SEQ ID NO: 1540488 - RNA, 19 nt, Homo sapiens
aagcaugucuccuauguuu

SEQ ID NO: 1540489 - RNA, 19 nt, Homo sapiens
gagcuaacuuuguaccauu

SEQ ID NO: 1540490 - RNA, 19 nt, Homo sapiens
ucacggaaaugcagacuga

SEQ ID NO: 1540491 - RNA, 19 nt, Homo sapiens
aagaauacaucgccuuaaa

SEQ ID NO: 1540492 - RNA, 19 nt, Homo sapiens
cgaaacauuccgcaauuua

SEQ ID NO: 1540493 - RNA, 19 nt, Homo sapiens
gcuaaaggaugaugaacau

SEQ ID NO: 1540494 - RNA, 19 nt, Homo sapiens
gaagaaugcccuauguuuc

SEQ ID NO: 1540495 - RNA, 19 nt, Homo sapiens
cagaaggacucuccauguu

SEQ ID NO: 1540496 - RNA, 19 nt, Homo sapiens
gaacaucaaagaagaguca

SEQ ID NO: 1540497 - RNA, 19 nt, Homo sapiens
ggacuugaaggaaucauuu

SEQ ID NO: 1540498 - RNA, 19 nt, Homo sapiens
cgaagaagcaugucuccua

SEQ ID NO: 1540499 - RNA, 19 nt, Homo sapiens
ggucgaagauucauaacuc

SEQ ID NO: 1540500 - RNA, 19 nt, Homo sapiens
cuggauaccuucaagcuuu

SEQ ID NO: 1540501 - RNA, 19 nt, Homo sapiens
caagacgucuggauaccuu

SEQ ID NO: 1540502 - RNA, 19 nt, Homo sapiens
gagccaggauucagcagaa

SEQ ID NO: 1540503 - RNA, 19 nt, Homo sapiens
uggauaaguuguuugauga

SEQ ID NO: 1540504 - RNA, 19 nt, Homo sapiens
gccuucagauuucuacaua

SEQ ID NO: 1540505 - RNA, 19 nt, Homo sapiens
gaucucaaggugcguauaa

SEQ ID NO: 1540506 - RNA, 19 nt, Homo sapiens
caaggucgaagauucauaa

SEQ ID NO: 1540507 - RNA, 19 nt, Homo sapiens
guaauacaguccagcuaga

SEQ ID NO: 1540508 - RNA, 19 nt, Homo sapiens
gaauacaucgccuuaaaca

SEQ ID NO: 1540509 - RNA, 19 nt, Homo sapiens
gcauuucagcgcacaauuu

SEQ ID NO: 1540510 - RNA, 19 nt, Homo sapiens
gaaggagacagaaccaaga

SEQ ID NO: 1540511 - RNA, 19 nt, Homo sapiens
gcagaaggacucuccaugu

SEQ ID NO: 1540512 - RNA, 19 nt, Homo sapiens
gagcugcgccugaauaaag

SEQ ID NO: 1540513 - RNA, 19 nt, Homo sapiens
ugggauagauuaccggaaa

SEQ ID NO: 1540514 - RNA, 19 nt, Homo sapiens
caaggggccuguauguuua

SEQ ID NO: 1540515 - RNA, 19 nt, Homo sapiens
aggcagaacuccuuauugu

SEQ ID NO: 1540516 - RNA, 19 nt, Homo sapiens
ccacuucagagacuuauuu

SEQ ID NO: 1540517 - RNA, 19 nt, Homo sapiens
gagacagaaccaagaagua

SEQ ID NO: 1540518 - RNA, 19 nt, Homo sapiens
gaaauuacacgaggaccuu

SEQ ID NO: 1540519 - RNA, 19 nt, Homo sapiens
caaagaagagucauacagu

SEQ ID NO: 1540520 - RNA, 19 nt, Homo sapiens
cuaguggauuaguaaguua

SEQ ID NO: 1540521 - RNA, 19 nt, Homo sapiens
uacgaaacauuccgcaauu

SEQ ID NO: 1540522 - RNA, 19 nt, Homo sapiens
gaagaaaucagcgaagaag

SEQ ID NO: 1540523 - RNA, 19 nt, Homo sapiens
gcaggcagaacuccuuauu

SEQ ID NO: 1540524 - RNA, 19 nt, Homo sapiens
agacagaaccaagaaguaa

SEQ ID NO: 1540525 - RNA, 19 nt, Homo sapiens
gagagcugcgccugaauaa

SEQ ID NO: 1540526 - RNA, 19 nt, Homo sapiens
uagcagucuugaaggaaua

SEQ ID NO: 1540527 - RNA, 19 nt, Homo sapiens
agaagcaugucuccuaugu

SEQ ID NO: 1540528 - RNA, 19 nt, Homo sapiens
auacaucgccuuaaacaga

SEQ ID NO: 1540529 - RNA, 19 nt, Homo sapiens
ugaaagcuuuggccguuug

SEQ ID NO: 1540530 - RNA, 19 nt, Homo sapiens
ccaccugaaugaaccuuga

SEQ ID NO: 1540531 - RNA, 19 nt, Homo sapiens
ggaucuaguggauuaguaa

SEQ ID NO: 1540532 - RNA, 19 nt, Homo sapiens
gcaucaacaucaugacagu

SEQ ID NO: 1540533 - RNA, 19 nt, Homo sapiens
ugucauggauaaguuguuu

SEQ ID NO: 1540534 - RNA, 19 nt, Homo sapiens
uggaggcugucauggauaa

SEQ ID NO: 1540535 - RNA, 19 nt, Homo sapiens
uagauucugggauagauua

SEQ ID NO: 1540536 - RNA, 19 nt, Homo sapiens
ggacauguuuuaugcuuau

SEQ ID NO: 1540537 - RNA, 19 nt, Homo sapiens
caauggugauggacauguu

SEQ ID NO: 1540538 - RNA, 19 nt, Homo sapiens
aaacaauggugauggacau

SEQ ID NO: 1540539 - RNA, 19 nt, Homo sapiens
ccugagaucaaguuuagua

SEQ ID NO: 1540540 - RNA, 19 nt, Homo sapiens
ucagauuucuacauaaugg

SEQ ID NO: 1540541 - RNA, 19 nt, Homo sapiens
ggugguggcauguuagaaa

SEQ ID NO: 1540542 - RNA, 19 nt, Homo sapiens
gcaaagcagaauacugaug

SEQ ID NO: 1540543 - RNA, 19 nt, Homo sapiens
gaaacauuccgcaauuuac

SEQ ID NO: 1540544 - RNA, 19 nt, Homo sapiens
gcugaugccaugauucuga

SEQ ID NO: 1540545 - RNA, 19 nt, Homo sapiens
uaacugaucccuugguucu

SEQ ID NO: 1540546 - RNA, 19 nt, Homo sapiens
uaacucucaucgauaacuu

SEQ ID NO: 1540547 - RNA, 19 nt, Homo sapiens
caauaaaguuuuccucuuc

SEQ ID NO: 1540548 - RNA, 19 nt, Homo sapiens
ucauagcagucuugaagga

SEQ ID NO: 1540549 - RNA, 19 nt, Homo sapiens
ccgaagaaaucagcgaaga

SEQ ID NO: 1540550 - RNA, 19 nt, Homo sapiens
caugcuagaugugcacaaa

SEQ ID NO: 1540551 - RNA, 19 nt, Homo sapiens
uaaaauugcucucaaggau

SEQ ID NO: 1540552 - RNA, 19 nt, Homo sapiens
ggagacagaaccaagaagu

SEQ ID NO: 1540553 - RNA, 19 nt, Homo sapiens
ucaaggugcguauaauuug

SEQ ID NO: 1540554 - RNA, 19 nt, Homo sapiens
auucauaacucucaucgau

SEQ ID NO: 1540555 - RNA, 19 nt, Homo sapiens
gaagauucauaacucucau

SEQ ID NO: 1540556 - RNA, 19 nt, Homo sapiens
gacucaaggucgaagauuc

SEQ ID NO: 1540557 - RNA, 19 nt, Homo sapiens
gcaauuuacucuggcaaac

SEQ ID NO: 1540558 - RNA, 19 nt, Homo sapiens
ucuaguggauuaguaaguu

SEQ ID NO: 1540559 - RNA, 19 nt, Homo sapiens
ucucaaggaucuaguggau

SEQ ID NO: 1540560 - RNA, 19 nt, Homo sapiens
agaaggacucuccauguuu

SEQ ID NO: 1540561 - RNA, 19 nt, Homo sapiens
caccggaagaucucuauaa

SEQ ID NO: 1540562 - RNA, 19 nt, Homo sapiens
uacaguguuugcagaaauu

SEQ ID NO: 1540563 - RNA, 19 nt, Homo sapiens
ccuauacgguucagacauc

SEQ ID NO: 1540564 - RNA, 19 nt, Homo sapiens
gaccaaggauucuaaaagu

SEQ ID NO: 1540565 - RNA, 19 nt, Homo sapiens
ucaaguggucacaaaguuu

SEQ ID NO: 1540566 - RNA, 19 nt, Homo sapiens
ucagagacuuauuugaaag

SEQ ID NO: 1540567 - RNA, 19 nt, Homo sapiens
ucccauagccgaagaaauc

SEQ ID NO: 1540568 - RNA, 19 nt, Homo sapiens
ccuuauuucugcaccauga

SEQ ID NO: 1540569 - RNA, 19 nt, Homo sapiens
aaauugcucucaaggaucu

SEQ ID NO: 1540570 - RNA, 19 nt, Homo sapiens
gacagugaguuggagcaaa

SEQ ID NO: 1540571 - RNA, 19 nt, Homo sapiens
agagagcugcgccugaaua

SEQ ID NO: 1540572 - RNA, 19 nt, Homo sapiens
accggaagaucucuauaaa

SEQ ID NO: 1540573 - RNA, 19 nt, Homo sapiens
cgaagaaaucagcgaagaa

SEQ ID NO: 1540574 - RNA, 19 nt, Homo sapiens
guauguuuauggagauguu

SEQ ID NO: 1540575 - RNA, 19 nt, Homo sapiens
aagaaugcccuauguuuca

SEQ ID NO: 1540576 - RNA, 19 nt, Homo sapiens
gaggucacguucccuaacu

SEQ ID NO: 1540577 - RNA, 19 nt, Homo sapiens
gcuaggaggucuacaaaua

SEQ ID NO: 1540578 - RNA, 19 nt, Homo sapiens
gcaguacgcuugugucaaa

SEQ ID NO: 1540579 - RNA, 19 nt, Homo sapiens
gcaaugauccuguguuuga

SEQ ID NO: 1540580 - RNA, 19 nt, Homo sapiens
gaagacaccugaugacaag

SEQ ID NO: 1540581 - RNA, 19 nt, Homo sapiens
gcagaucacucucaagaag

SEQ ID NO: 1540582 - RNA, 19 nt, Homo sapiens
caacauccaugaacacugu

SEQ ID NO: 1540583 - RNA, 19 nt, Homo sapiens
ugucgaauguugcgaauuu

SEQ ID NO: 1540584 - RNA, 19 nt, Homo sapiens
ucaaagcccuggagaagga

SEQ ID NO: 1540585 - RNA, 19 nt, Homo sapiens
gaaggacgaucuggauuuc

SEQ ID NO: 1540586 - RNA, 19 nt, Homo sapiens
ccagcagucucauuacuuu

SEQ ID NO: 1540587 - RNA, 19 nt, Homo sapiens
caaggaagaggaccaguuu

SEQ ID NO: 1540588 - RNA, 19 nt, Homo sapiens
gagagaagaucacagucau

SEQ ID NO: 1540589 - RNA, 19 nt, Homo sapiens
gagaagaucacagucauug

SEQ ID NO: 1540590 - RNA, 19 nt, Homo sapiens
uaagaaggcugagaagaag

SEQ ID NO: 1540591 - RNA, 19 nt, Homo sapiens
gaucauggcaaacaaggaa

SEQ ID NO: 1540592 - RNA, 19 nt, Homo sapiens
uaaagcaguuacucaggaa

SEQ ID NO: 1540593 - RNA, 19 nt, Homo sapiens
gggcagaucacucucaaga

SEQ ID NO: 1540594 - RNA, 19 nt, Homo sapiens
ccuccaaacuucaucauuc

SEQ ID NO: 1540595 - RNA, 19 nt, Homo sapiens
ggagagaagaucacaguca

SEQ ID NO: 1540596 - RNA, 19 nt, Homo sapiens
ucgcaaugauccuguguuu

SEQ ID NO: 1540597 - RNA, 19 nt, Homo sapiens
gagaagaagacaccugaug

SEQ ID NO: 1540598 - RNA, 19 nt, Homo sapiens
gggcuucgcuguaagaacu

SEQ ID NO: 1540599 - RNA, 19 nt, Homo sapiens
ggacaaaggagauggaacu

SEQ ID NO: 1540600 - RNA, 19 nt, Homo sapiens
aaaccaacauccaugaaca

SEQ ID NO: 1540601 - RNA, 19 nt, Homo sapiens
cuaagcuggucaacgauaa

SEQ ID NO: 1540602 - RNA, 19 nt, Homo sapiens
ggagaaggacgaucuggau

SEQ ID NO: 1540603 - RNA, 19 nt, Homo sapiens
ggcgaacugucgaauguug

SEQ ID NO: 1540604 - RNA, 19 nt, Homo sapiens
ggcaagaucccaccugguu

SEQ ID NO: 1540605 - RNA, 19 nt, Homo sapiens
gcagagacucggcaaagug

SEQ ID NO: 1540606 - RNA, 19 nt, Homo sapiens
aaaguucugugaugucugu

SEQ ID NO: 1540607 - RNA, 19 nt, Homo sapiens
aaacgcguaucuacuagga

SEQ ID NO: 1540608 - RNA, 19 nt, Homo sapiens
auaagaaggcugagaagaa

SEQ ID NO: 1540609 - RNA, 19 nt, Homo sapiens
gggauaagaaggcugagaa

SEQ ID NO: 1540610 - RNA, 19 nt, Homo sapiens
gcaagaucccaccugguuu

SEQ ID NO: 1540611 - RNA, 19 nt, Homo sapiens
caaauucaaagaucacuuc

SEQ ID NO: 1540612 - RNA, 19 nt, Homo sapiens
ggaagaggaagaggaagaa

SEQ ID NO: 1540613 - RNA, 19 nt, Homo sapiens
agaagaagacaccugauga

SEQ ID NO: 1540614 - RNA, 19 nt, Homo sapiens
gcccggacccgaaaccuuu

SEQ ID NO: 1540615 - RNA, 19 nt, Homo sapiens
gagaaggacgaucuggauu

SEQ ID NO: 1540616 - RNA, 19 nt, Homo sapiens
gcaaacaaggaacggaaga

SEQ ID NO: 1540617 - RNA, 19 nt, Homo sapiens
gauaagaaggcugagaaga

SEQ ID NO: 1540618 - RNA, 19 nt, Homo sapiens
gggacaggcagauaagaaa

SEQ ID NO: 1540619 - RNA, 19 nt, Homo sapiens
gaucccaccugguuuccau

SEQ ID NO: 1540620 - RNA, 19 nt, Homo sapiens
agaaggacgaucuggauuu

SEQ ID NO: 1540621 - RNA, 19 nt, Homo sapiens
gcuuccagcagucucauua

SEQ ID NO: 1540622 - RNA, 19 nt, Homo sapiens
gaagggacaggcagauaag

SEQ ID NO: 1540623 - RNA, 19 nt, Homo sapiens
agaagggacaggcagauaa

SEQ ID NO: 1540624 - RNA, 19 nt, Homo sapiens
ccaaaguucugugaugucu

SEQ ID NO: 1540625 - RNA, 19 nt, Homo sapiens
cgaauguugcgaauuuauu

SEQ ID NO: 1540626 - RNA, 19 nt, Homo sapiens
ugacuccaaugaagaaugg

SEQ ID NO: 1540627 - RNA, 19 nt, Homo sapiens
gcucccagcucccucuaca

SEQ ID NO: 1540628 - RNA, 19 nt, Homo sapiens
gaagaagacaccugaugac

SEQ ID NO: 1540629 - RNA, 19 nt, Homo sapiens
cagagaugcuucggcaaga

SEQ ID NO: 1540630 - RNA, 19 nt, Homo sapiens
cuccuaagcuggucaacga

SEQ ID NO: 1540631 - RNA, 19 nt, Homo sapiens
gcccaucuacuacaucuau

SEQ ID NO: 1540632 - RNA, 19 nt, Homo sapiens
gcagucucauuacuuugug

SEQ ID NO: 1540633 - RNA, 19 nt, Homo sapiens
caaugauccuguguuugaa

SEQ ID NO: 1540634 - RNA, 19 nt, Homo sapiens
guacgcuugugucaaagau

SEQ ID NO: 1540635 - RNA, 19 nt, Homo sapiens
caagaucccaccugguuuc

SEQ ID NO: 1540636 - RNA, 19 nt, Homo sapiens
gcggcuacgucaaggucua

SEQ ID NO: 1540637 - RNA, 19 nt, Homo sapiens
aagccaaaguucugugaug

SEQ ID NO: 1540638 - RNA, 19 nt, Homo sapiens
gucgaauguugcgaauuua

SEQ ID NO: 1540639 - RNA, 19 nt, Homo sapiens
ccaaggaagaggaccaguu

SEQ ID NO: 1540640 - RNA, 19 nt, Homo sapiens
guucaaagcccuggagaag

SEQ ID NO: 1540641 - RNA, 19 nt, Homo sapiens
ugaggaagaggaagaggaa

SEQ ID NO: 1540642 - RNA, 19 nt, Homo sapiens
gaagaagggacaggcagau

SEQ ID NO: 1540643 - RNA, 19 nt, Homo sapiens
agaagacaccugaugacaa

SEQ ID NO: 1540644 - RNA, 19 nt, Homo sapiens
gcaaaaccaacauccauga

SEQ ID NO: 1540645 - RNA, 19 nt, Homo sapiens
cuacaucuaugaggaagag

SEQ ID NO: 1540646 - RNA, 19 nt, Homo sapiens
gaggcuaggaggucuacaa

SEQ ID NO: 1540647 - RNA, 19 nt, Homo sapiens
caaacaaggaacggaagaa

SEQ ID NO: 1540648 - RNA, 19 nt, Homo sapiens
agaucacucucaagaagga

SEQ ID NO: 1540649 - RNA, 19 nt, Homo sapiens
ccuaagcuggucaacgaua

SEQ ID NO: 1540650 - RNA, 19 nt, Homo sapiens
uacagcggcuaaagcaguu

SEQ ID NO: 1540651 - RNA, 19 nt, Homo sapiens
gggcccaucuacuacaucu

SEQ ID NO: 1540652 - RNA, 19 nt, Homo sapiens
agggcgaacugucgaaugu

SEQ ID NO: 1540653 - RNA, 19 nt, Homo sapiens
caccgacuuucuagaggaa

SEQ ID NO: 1540654 - RNA, 19 nt, Homo sapiens
uagggcagaucacucucaa

SEQ ID NO: 1540655 - RNA, 19 nt, Homo sapiens
caggagagaagaucacagu

SEQ ID NO: 1540656 - RNA, 19 nt, Homo sapiens
aguuugggcuucgcuguaa

SEQ ID NO: 1540657 - RNA, 19 nt, Homo sapiens
ggacugacuuagggaaucc

SEQ ID NO: 1540658 - RNA, 19 nt, Homo sapiens
ugaugacuccaaugaagaa

SEQ ID NO: 1540659 - RNA, 19 nt, Homo sapiens
cuggguagcuggugugaac

SEQ ID NO: 1540660 - RNA, 19 nt, Homo sapiens
ucaguccuauguggaaaug

SEQ ID NO: 1540661 - RNA, 19 nt, Homo sapiens
gcuguuucccaccgacuuu

SEQ ID NO: 1540662 - RNA, 19 nt, Homo sapiens
cuaggaggucuacaaauag

SEQ ID NO: 1540663 - RNA, 19 nt, Homo sapiens
ggauaagaaggcugagaag

SEQ ID NO: 1540664 - RNA, 19 nt, Homo sapiens
cagcagagacucggcaaag

SEQ ID NO: 1540665 - RNA, 19 nt, Homo sapiens
aagaagggacaggcagaua

SEQ ID NO: 1540666 - RNA, 19 nt, Homo sapiens
cccacaaauucaaagauca

SEQ ID NO: 1540667 - RNA, 19 nt, Homo sapiens
cuacuacaucuaugaggaa

SEQ ID NO: 1540668 - RNA, 19 nt, Homo sapiens
gggugaucauggcaaacaa

SEQ ID NO: 1540669 - RNA, 19 nt, Homo sapiens
cuacagggacaaaggagau

SEQ ID NO: 1540670 - RNA, 19 nt, Homo sapiens
gagaugcuucggcaagauc

SEQ ID NO: 1540671 - RNA, 19 nt, Homo sapiens
ggacaggcagauaagaaaa

SEQ ID NO: 1540672 - RNA, 19 nt, Homo sapiens
cagcaguacgcuuguguca

SEQ ID NO: 1540673 - RNA, 19 nt, Homo sapiens
gauaagccccacaaauuca

SEQ ID NO: 1540674 - RNA, 19 nt, Homo sapiens
gaacgaugacagaaaagga

SEQ ID NO: 1540675 - RNA, 19 nt, Homo sapiens
uguaagaacugcaaaacca

SEQ ID NO: 1540676 - RNA, 19 nt, Homo sapiens
guucucaacaacaaguuug

SEQ ID NO: 1540677 - RNA, 19 nt, Homo sapiens
gcacucagcugcuacaaug

SEQ ID NO: 1540678 - RNA, 19 nt, Homo sapiens
gcgaggagcccaucaagua

SEQ ID NO: 1540679 - RNA, 19 nt, Homo sapiens
gaagcgugcucuauacaga

SEQ ID NO: 1540680 - RNA, 19 nt, Homo sapiens
gaauggugcuggaaggaaa

SEQ ID NO: 1540681 - RNA, 19 nt, Homo sapiens
ccacagagaacaugauuga

SEQ ID NO: 1540682 - RNA, 19 nt, Homo sapiens
gcccuggguuccucuauaa

SEQ ID NO: 1540683 - RNA, 19 nt, Homo sapiens
ggacacagaggcaaucaga

SEQ ID NO: 1540684 - RNA, 19 nt, Homo sapiens
ggaaggaaacccugaagug

SEQ ID NO: 1540685 - RNA, 19 nt, Homo sapiens
cagcacagcaucucguaua

SEQ ID NO: 1540686 - RNA, 19 nt, Homo sapiens
cagagaacaugauugacuu

SEQ ID NO: 1540687 - RNA, 19 nt, Homo sapiens
ucacggaggaggugucaua

SEQ ID NO: 1540688 - RNA, 19 nt, Homo sapiens
acacagacauguuccagau

SEQ ID NO: 1540689 - RNA, 19 nt, Homo sapiens
gugcugaugaugauaauaa

SEQ ID NO: 1540690 - RNA, 19 nt, Homo sapiens
acagacauguuccagauug

SEQ ID NO: 1540691 - RNA, 19 nt, Homo sapiens
cggaggaggugucauagga

SEQ ID NO: 1540692 - RNA, 19 nt, Homo sapiens
uggcaggccucacugguaa

SEQ ID NO: 1540693 - RNA, 19 nt, Homo sapiens
caagggcacucagcugcua

SEQ ID NO: 1540694 - RNA, 19 nt, Homo sapiens
gaugcuggauggaggauuc

SEQ ID NO: 1540695 - RNA, 19 nt, Homo sapiens
caaguauggugaacucauc

SEQ ID NO: 1540696 - RNA, 19 nt, Homo sapiens
ggucaggagucaacaaagg

SEQ ID NO: 1540697 - RNA, 19 nt, Homo sapiens
cauaggagcucagccucaa

SEQ ID NO: 1540698 - RNA, 19 nt, Homo sapiens
ggaaaccgaggcucagaga

SEQ ID NO: 1540699 - RNA, 19 nt, Homo sapiens
uaauaacuacguccauuga

SEQ ID NO: 1540700 - RNA, 19 nt, Homo sapiens
ggccacgucugcucugaga

SEQ ID NO: 1540701 - RNA, 19 nt, Homo sapiens
ggaaggaggugaggaaacc

SEQ ID NO: 1540702 - RNA, 19 nt, Homo sapiens
caucaaguauggugaacuc

SEQ ID NO: 1540703 - RNA, 19 nt, Homo sapiens
gcucgacucugugcuaagu

SEQ ID NO: 1540704 - RNA, 19 nt, Homo sapiens
ggccuuaugugccucuaug

SEQ ID NO: 1540705 - RNA, 19 nt, Homo sapiens
gggcucgacucugugcuaa

SEQ ID NO: 1540706 - RNA, 19 nt, Homo sapiens
ccauugagcacucuccaaa

SEQ ID NO: 1540707 - RNA, 19 nt, Homo sapiens
ucaagagugucggcuguga

SEQ ID NO: 1540708 - RNA, 19 nt, Homo sapiens
acuaugggcucgacucugu

SEQ ID NO: 1540709 - RNA, 19 nt, Homo sapiens
caugauugacuucguggua

SEQ ID NO: 1540710 - RNA, 19 nt, Homo sapiens
gcaggacggcucucucauc

SEQ ID NO: 1540711 - RNA, 19 nt, Homo sapiens
gauggaggauucugaaccu

SEQ ID NO: 1540712 - RNA, 19 nt, Homo sapiens
ggggcaagcugguggaaaa

SEQ ID NO: 1540713 - RNA, 19 nt, Homo sapiens
ccaauggaguccuggugau

SEQ ID NO: 1540714 - RNA, 19 nt, Homo sapiens
ccaaggagguccccaagau

SEQ ID NO: 1540715 - RNA, 19 nt, Homo sapiens
gggaugcugugaggaagga

SEQ ID NO: 1540716 - RNA, 19 nt, Homo sapiens
cacaccagauggacauguu

SEQ ID NO: 1540717 - RNA, 19 nt, Homo sapiens
gaggagcccaucaaguaug

SEQ ID NO: 1540718 - RNA, 19 nt, Homo sapiens
gaggcaaucagaccugguu

SEQ ID NO: 1540719 - RNA, 19 nt, Homo sapiens
gagcgcgaauguccucucu

SEQ ID NO: 1540720 - RNA, 19 nt, Homo sapiens
uggauggacugaccaccaa

SEQ ID NO: 1540721 - RNA, 19 nt, Homo sapiens
ccagaaauccagggacaga

SEQ ID NO: 1540722 - RNA, 19 nt, Homo sapiens
ccacggcacccaugcuuuc

SEQ ID NO: 1540723 - RNA, 19 nt, Homo sapiens
cgcccuggguuccucuaua

SEQ ID NO: 1540724 - RNA, 19 nt, Homo sapiens
acacucauccuucauccuu

SEQ ID NO: 1540725 - RNA, 19 nt, Homo sapiens
caugauagcgacacagaca

SEQ ID NO: 1540726 - RNA, 19 nt, Homo sapiens
ugaggaaggaggugaggaa

SEQ ID NO: 1540727 - RNA, 19 nt, Homo sapiens
gaugggaagcgugcucuau

SEQ ID NO: 1540728 - RNA, 19 nt, Homo sapiens
cgaggagcccaucaaguau

SEQ ID NO: 1540729 - RNA, 19 nt, Homo sapiens
ggugaagccagacgucaug

SEQ ID NO: 1540730 - RNA, 19 nt, Homo sapiens
gccaggaucagaguacaaa

SEQ ID NO: 1540731 - RNA, 19 nt, Homo sapiens
gagagcgagcggccaaaug

SEQ ID NO: 1540732 - RNA, 19 nt, Homo sapiens
gcacagcaucucguauaca

SEQ ID NO: 1540733 - RNA, 19 nt, Homo sapiens
guggcaggccucacuggua

SEQ ID NO: 1540734 - RNA, 19 nt, Homo sapiens
gaggaaggaggugaggaaa

SEQ ID NO: 1540735 - RNA, 19 nt, Homo sapiens
gaggaaaccgaggcucaga

SEQ ID NO: 1540736 - RNA, 19 nt, Homo sapiens
ggagagcgagcggccaaau

SEQ ID NO: 1540737 - RNA, 19 nt, Homo sapiens
gggccaucaucccugaaug

SEQ ID NO: 1540738 - RNA, 19 nt, Homo sapiens
augauugacuucgugguaa

SEQ ID NO: 1540739 - RNA, 19 nt, Homo sapiens
ucuccaaggcacugaguaa

SEQ ID NO: 1540740 - RNA, 19 nt, Homo sapiens
ugggaagcgugcucuauac

SEQ ID NO: 1540741 - RNA, 19 nt, Homo sapiens
ggucauaguggaguauaca

SEQ ID NO: 1540742 - RNA, 19 nt, Homo sapiens
ucaguaagccagaaaucca

SEQ ID NO: 1540743 - RNA, 19 nt, Homo sapiens
acagagaacaugauugacu

SEQ ID NO: 1540744 - RNA, 19 nt, Homo sapiens
cacagcaucucguauacac

SEQ ID NO: 1540745 - RNA, 19 nt, Homo sapiens
ggaagcgugcucuauacag

SEQ ID NO: 1540746 - RNA, 19 nt, Homo sapiens
gggaagcgugcucuauaca

SEQ ID NO: 1540747 - RNA, 19 nt, Homo sapiens
gcaggccucacugguaaug

SEQ ID NO: 1540748 - RNA, 19 nt, Homo sapiens
gauggacugaccaccaaug

SEQ ID NO: 1540749 - RNA, 19 nt, Homo sapiens
gagcaccaucucccgcuau

SEQ ID NO: 1540750 - RNA, 19 nt, Homo sapiens
uagcgacacagacauguuc

SEQ ID NO: 1540751 - RNA, 19 nt, Homo sapiens
auaauaacuacguccauug

SEQ ID NO: 1540752 - RNA, 19 nt, Homo sapiens
ggauucugaaccucauuug

SEQ ID NO: 1540753 - RNA, 19 nt, Homo sapiens
ccacgucugcucugagaag

SEQ ID NO: 1540754 - RNA, 19 nt, Homo sapiens
cuaugccgcuggcuucgau

SEQ ID NO: 1540755 - RNA, 19 nt, Homo sapiens
ugacacaagggccaucauc

SEQ ID NO: 1540756 - RNA, 19 nt, Homo sapiens
caggaucagaguacaaauc

SEQ ID NO: 1540757 - RNA, 19 nt, Homo sapiens
ugguggaguucacagucua

SEQ ID NO: 1540758 - RNA, 19 nt, Homo sapiens
caauggaguccuggugaug

SEQ ID NO: 1540759 - RNA, 19 nt, Homo sapiens
ucucuccucucccggugaa

SEQ ID NO: 1540760 - RNA, 19 nt, Homo sapiens
cacaugauagcgacacaga

SEQ ID NO: 1540761 - RNA, 19 nt, Homo sapiens
auaguggaguauacacaug

SEQ ID NO: 1540762 - RNA, 19 nt, Homo sapiens
gaacaucuccaaguaaaua

SEQ ID NO: 1540763 - RNA, 19 nt, Homo sapiens
gaagggcuauucuguagga

SEQ ID NO: 1540764 - RNA, 19 nt, Homo sapiens
gggauuaaguuucaacaug

SEQ ID NO: 1540765 - RNA, 19 nt, Homo sapiens
ucagacagcccuuucguaa

SEQ ID NO: 1540766 - RNA, 19 nt, Homo sapiens
ccgaaggccucaccucuga

SEQ ID NO: 1540767 - RNA, 19 nt, Homo sapiens
gcucuaauccuacccuuga

SEQ ID NO: 1540768 - RNA, 19 nt, Homo sapiens
gugacugggugacucauaa

SEQ ID NO: 1540769 - RNA, 19 nt, Homo sapiens
cugaacaucuccaaguaaa

SEQ ID NO: 1540770 - RNA, 19 nt, Homo sapiens
guuacuguguccucucaua

SEQ ID NO: 1540771 - RNA, 19 nt, Homo sapiens
ggaggaacacagacauuga

SEQ ID NO: 1540772 - RNA, 19 nt, Homo sapiens
gcucacagcucuggagucu

SEQ ID NO: 1540773 - RNA, 19 nt, Homo sapiens
ucguaaggcucuaauccua

SEQ ID NO: 1540774 - RNA, 19 nt, Homo sapiens
gcugcugcauccacccuua

SEQ ID NO: 1540775 - RNA, 19 nt, Homo sapiens
gaggaacacagacauugaa

SEQ ID NO: 1540776 - RNA, 19 nt, Homo sapiens
gagaggaggcauucacugu

SEQ ID NO: 1540777 - RNA, 19 nt, Homo sapiens
gauuaaguuucaacaugga

SEQ ID NO: 1540778 - RNA, 19 nt, Homo sapiens
cuuccuggcuucugugaaa

SEQ ID NO: 1540779 - RNA, 19 nt, Homo sapiens
gaacacagacauugaaacc

SEQ ID NO: 1540780 - RNA, 19 nt, Homo sapiens
uuacauacuucuacaucug

SEQ ID NO: 1540781 - RNA, 19 nt, Homo sapiens
gagagacacaggagaagga

SEQ ID NO: 1540782 - RNA, 19 nt, Homo sapiens
gcugauuacuuuacauacu

SEQ ID NO: 1540783 - RNA, 19 nt, Homo sapiens
gugcugauuacuuuacaua

SEQ ID NO: 1540784 - RNA, 19 nt, Homo sapiens
ccucaccucugaacacugu

SEQ ID NO: 1540785 - RNA, 19 nt, Homo sapiens
cauaaggagcagaaaugua

SEQ ID NO: 1540786 - RNA, 19 nt, Homo sapiens
ccucaccucucaccucuca

SEQ ID NO: 1540787 - RNA, 19 nt, Homo sapiens
aaacugaacaucuccaagu

SEQ ID NO: 1540788 - RNA, 19 nt, Homo sapiens
ggacugcucucugcuucca

SEQ ID NO: 1540789 - RNA, 19 nt, Homo sapiens
gcuugacccucaccucuca

SEQ ID NO: 1540790 - RNA, 19 nt, Homo sapiens
gcgcuuaggagcagaaaca

SEQ ID NO: 1540791 - RNA, 19 nt, Homo sapiens
aacugaacaucuccaagua

SEQ ID NO: 1540792 - RNA, 19 nt, Homo sapiens
acgaagacguggaaugcuu

SEQ ID NO: 1540793 - RNA, 19 nt, Homo sapiens
ucacaucagccucccaaga

SEQ ID NO: 1540794 - RNA, 19 nt, Homo sapiens
ccuuugugcugcuguaaga

SEQ ID NO: 1540795 - RNA, 19 nt, Homo sapiens
cuacaggaacggaaggaaa

SEQ ID NO: 1540796 - RNA, 19 nt, Homo sapiens
caccacggcugccacagau

SEQ ID NO: 1540797 - RNA, 19 nt, Homo sapiens
ggaggagugucagcaugau

SEQ ID NO: 1540798 - RNA, 19 nt, Homo sapiens
guccugcccuggugaaagu

SEQ ID NO: 1540799 - RNA, 19 nt, Homo sapiens
gaagacguggaaugcuuga

SEQ ID NO: 1540800 - RNA, 19 nt, Homo sapiens
uguaagaagguaccuguga

SEQ ID NO: 1540801 - RNA, 19 nt, Homo sapiens
gugucagcaugaugaaauu

SEQ ID NO: 1540802 - RNA, 19 nt, Homo sapiens
auaaggagcagaaauguac

SEQ ID NO: 1540803 - RNA, 19 nt, Homo sapiens
gcugcggcaucuucacaga

SEQ ID NO: 1540804 - RNA, 19 nt, Homo sapiens
cuggugaaagugcugauua

SEQ ID NO: 1540805 - RNA, 19 nt, Homo sapiens
ucuccuauccggaaaguau

SEQ ID NO: 1540806 - RNA, 19 nt, Homo sapiens
gcggggaucucucacauca

SEQ ID NO: 1540807 - RNA, 19 nt, Homo sapiens
cgacacgcaccaagacaug

SEQ ID NO: 1540808 - RNA, 19 nt, Homo sapiens
gugcugcuguaagaaggua

SEQ ID NO: 1540809 - RNA, 19 nt, Homo sapiens
uggcuucugugaaacugaa

SEQ ID NO: 1540810 - RNA, 19 nt, Homo sapiens
ugaggcagcugcggcaucu

SEQ ID NO: 1540811 - RNA, 19 nt, Homo sapiens
ugacucauaaggagcagaa

SEQ ID NO: 1540812 - RNA, 19 nt, Homo sapiens
ggagugucagcaugaugaa

SEQ ID NO: 1540813 - RNA, 19 nt, Homo sapiens
gcucuggagucugggaagu

SEQ ID NO: 1540814 - RNA, 19 nt, Homo sapiens
cccggcagguuugguguuu

SEQ ID NO: 1540815 - RNA, 19 nt, Homo sapiens
ugacgaagacguggaaugc

SEQ ID NO: 1540816 - RNA, 19 nt, Homo sapiens
ugcagaaccaggugauuga

SEQ ID NO: 1540817 - RNA, 19 nt, Homo sapiens
cggcagguuugguguuugg

SEQ ID NO: 1540818 - RNA, 19 nt, Homo sapiens
cggaggaacacagacauug

SEQ ID NO: 1540819 - RNA, 19 nt, Homo sapiens
gaaggccucaccucugaac

SEQ ID NO: 1540820 - RNA, 19 nt, Homo sapiens
gucagacagcccuuucgua

SEQ ID NO: 1540821 - RNA, 19 nt, Homo sapiens
gcucugccgucccugucau

SEQ ID NO: 1540822 - RNA, 19 nt, Homo sapiens
guucacagguuccaggaua

SEQ ID NO: 1540823 - RNA, 19 nt, Homo sapiens
ugaggaauguugaagauug

SEQ ID NO: 1540824 - RNA, 19 nt, Homo sapiens
caaggcaacacauacauuu

SEQ ID NO: 1540825 - RNA, 19 nt, Homo sapiens
ccagaugacugaggaaugu

SEQ ID NO: 1540826 - RNA, 19 nt, Homo sapiens
gcaaggcaacacauacauu

SEQ ID NO: 1540827 - RNA, 19 nt, Homo sapiens
gaagauugcagugauggaa

SEQ ID NO: 1540828 - RNA, 19 nt, Homo sapiens
ggaagacuguauggaagga

SEQ ID NO: 1540829 - RNA, 19 nt, Homo sapiens
guuuagccaugugcaaaua

SEQ ID NO: 1540830 - RNA, 19 nt, Homo sapiens
guauauacuuuggucuaug

SEQ ID NO: 1540831 - RNA, 19 nt, Homo sapiens
uggucuauguauucuguua

SEQ ID NO: 1540832 - RNA, 19 nt, Homo sapiens
gagguugccuggccacacu

SEQ ID NO: 1540833 - RNA, 19 nt, Homo sapiens
guugaagauugcagugaug

SEQ ID NO: 1540834 - RNA, 19 nt, Homo sapiens
gauggaagugucucaguca

SEQ ID NO: 1540835 - RNA, 19 nt, Homo sapiens
gaggaauguugaagauugc

SEQ ID NO: 1540836 - RNA, 19 nt, Homo sapiens
uuagccaugugcaaauauu

SEQ ID NO: 1540837 - RNA, 19 nt, Homo sapiens
ccuaaaauguucacagguu

SEQ ID NO: 1540838 - RNA, 19 nt, Homo sapiens
ccuggaagacuguauggaa

SEQ ID NO: 1540839 - RNA, 19 nt, Homo sapiens
guuccaggauaaccagaug

SEQ ID NO: 1540840 - RNA, 19 nt, Homo sapiens
gggacacauuugccuuugu

SEQ ID NO: 1540841 - RNA, 19 nt, Homo sapiens
aggauaaccagaugacuga

SEQ ID NO: 1540842 - RNA, 19 nt, Homo sapiens
ggcaacacauacauuuggu

SEQ ID NO: 1540843 - RNA, 19 nt, Homo sapiens
acugaggaauguugaagau

SEQ ID NO: 1540844 - RNA, 19 nt, Homo sapiens
gaugacugaggaauguuga

SEQ ID NO: 1540845 - RNA, 19 nt, Homo sapiens
gugcaaggcaacacauaca

SEQ ID NO: 1540846 - RNA, 19 nt, Homo sapiens
uguugaagauugcagugau

SEQ ID NO: 1540847 - RNA, 19 nt, Homo sapiens
gcgagaagaucaccauuaa

SEQ ID NO: 1540848 - RNA, 19 nt, Homo sapiens
gagaagaucaccauuaaca

SEQ ID NO: 1540849 - RNA, 19 nt, Homo sapiens
uaacaaggacaccaaggua

SEQ ID NO: 1540850 - RNA, 19 nt, Homo sapiens
caacaaagaagaccacaca

SEQ ID NO: 1540851 - RNA, 19 nt, Homo sapiens
gaagaucaccauuaacaag

SEQ ID NO: 1540852 - RNA, 19 nt, Homo sapiens
gguacccaaugccuguuua

SEQ ID NO: 1540853 - RNA, 19 nt, Homo sapiens
ugggaaacaucauuaaauc

SEQ ID NO: 1540854 - RNA, 19 nt, Homo sapiens
ggcgagaagaucaccauua

SEQ ID NO: 1540855 - RNA, 19 nt, Homo sapiens
cccaaugccuguuuauuca

SEQ ID NO: 1540856 - RNA, 19 nt, Homo sapiens
acacugggaaacaucauua

SEQ ID NO: 1540857 - RNA, 19 nt, Homo sapiens
ggaaacaucauuaaaucac

SEQ ID NO: 1540858 - RNA, 19 nt, Homo sapiens
gggaaacaucauuaaauca

SEQ ID NO: 1540859 - RNA, 19 nt, Homo sapiens
cagccacgcuuccuguaca

SEQ ID NO: 1540860 - RNA, 19 nt, Homo sapiens
gcagccacaacaucucuga

SEQ ID NO: 1540861 - RNA, 19 nt, Homo sapiens
ccagagcacaucagcuaug

SEQ ID NO: 1540862 - RNA, 19 nt, Homo sapiens
acaccaagguacccaaugc

SEQ ID NO: 1540863 - RNA, 19 nt, Homo sapiens
ggacaccaagguacccaau

SEQ ID NO: 1540864 - RNA, 19 nt, Homo sapiens
cugccgugauugucaguuu

SEQ ID NO: 1540865 - RNA, 19 nt, Homo sapiens
uauucaccaucaacaaaga

SEQ ID NO: 1540866 - RNA, 19 nt, Homo sapiens
uuaaaucacgugccugcuu

SEQ ID NO: 1540867 - RNA, 19 nt, Homo sapiens
cugggaaacaucauuaaau

SEQ ID NO: 1540868 - RNA, 19 nt, Homo sapiens
agaucaccauuaacaagga

SEQ ID NO: 1540869 - RNA, 19 nt, Homo sapiens
guucagcagccacaacauc

SEQ ID NO: 1540870 - RNA, 19 nt, Homo sapiens
agaagaucaccauuaacaa

SEQ ID NO: 1540871 - RNA, 19 nt, Homo sapiens
gaccacacacugggaaaca

SEQ ID NO: 1540872 - RNA, 19 nt, Homo sapiens
acccaaugccuguuuauuc

SEQ ID NO: 1540873 - RNA, 19 nt, Homo sapiens
gcgagaagaucaccauuaa

SEQ ID NO: 1540874 - RNA, 19 nt, Homo sapiens
gagaagaucaccauuaaca

SEQ ID NO: 1540875 - RNA, 19 nt, Homo sapiens
uaacaaggacaccaaggua

SEQ ID NO: 1540876 - RNA, 19 nt, Homo sapiens
caacaaagaagaccacaca

SEQ ID NO: 1540877 - RNA, 19 nt, Homo sapiens
gaagaucaccauuaacaag

SEQ ID NO: 1540878 - RNA, 19 nt, Homo sapiens
gguacccaaugccuguuua

SEQ ID NO: 1540879 - RNA, 19 nt, Homo sapiens
ugggaaacaucauuaaauc

SEQ ID NO: 1540880 - RNA, 19 nt, Homo sapiens
ggcgagaagaucaccauua

SEQ ID NO: 1540881 - RNA, 19 nt, Homo sapiens
cccaaugccuguuuauuca

SEQ ID NO: 1540882 - RNA, 19 nt, Homo sapiens
acacugggaaacaucauua

SEQ ID NO: 1540883 - RNA, 19 nt, Homo sapiens
cauuaaaucacaacuccua

SEQ ID NO: 1540884 - RNA, 19 nt, Homo sapiens
ggaaacaucauuaaaucac

SEQ ID NO: 1540885 - RNA, 19 nt, Homo sapiens
aaucacaacuccuaaaaga

SEQ ID NO: 1540886 - RNA, 19 nt, Homo sapiens
gggaaacaucauuaaauca

SEQ ID NO: 1540887 - RNA, 19 nt, Homo sapiens
cagccacgcuuccuguaca

SEQ ID NO: 1540888 - RNA, 19 nt, Homo sapiens
gcagccacaacaucucuga

SEQ ID NO: 1540889 - RNA, 19 nt, Homo sapiens
ccagagcacaucagcuaug

SEQ ID NO: 1540890 - RNA, 19 nt, Homo sapiens
acaccaagguacccaaugc

SEQ ID NO: 1540891 - RNA, 19 nt, Homo sapiens
ggacaccaagguacccaau

SEQ ID NO: 1540892 - RNA, 19 nt, Homo sapiens
cugccgugauugucaguuu

SEQ ID NO: 1540893 - RNA, 19 nt, Homo sapiens
uauucaccaucaacaaaga

SEQ ID NO: 1540894 - RNA, 19 nt, Homo sapiens
cugggaaacaucauuaaau

SEQ ID NO: 1540895 - RNA, 19 nt, Homo sapiens
agaucaccauuaacaagga

SEQ ID NO: 1540896 - RNA, 19 nt, Homo sapiens
guucagcagccacaacauc

SEQ ID NO: 1540897 - RNA, 19 nt, Homo sapiens
caucaccgaccucaucagu

SEQ ID NO: 1540898 - RNA, 19 nt, Homo sapiens
gaccacacacugggaaaca

SEQ ID NO: 1540899 - RNA, 19 nt, Homo sapiens
agaagaucaccauuaacaa

SEQ ID NO: 1540900 - RNA, 19 nt, Homo sapiens
acccaaugccuguuuauuc

SEQ ID NO: 1540901 - RNA, 19 nt, Homo sapiens
gcgagaagaucaccauuaa

SEQ ID NO: 1540902 - RNA, 19 nt, Homo sapiens
ggaaagagccacagcaaag

SEQ ID NO: 1540903 - RNA, 19 nt, Homo sapiens
gagaagaucaccauuaaca

SEQ ID NO: 1540904 - RNA, 19 nt, Homo sapiens
uaacaaggacaccaaggua

SEQ ID NO: 1540905 - RNA, 19 nt, Homo sapiens
caacaaagaagaccacaca

SEQ ID NO: 1540906 - RNA, 19 nt, Homo sapiens
gaagaucaccauuaacaag

SEQ ID NO: 1540907 - RNA, 19 nt, Homo sapiens
gaaagagccacagcaaaga

SEQ ID NO: 1540908 - RNA, 19 nt, Homo sapiens
gguacccaaugccuguuua

SEQ ID NO: 1540909 - RNA, 19 nt, Homo sapiens
ugggaaacaucauuaaauc

SEQ ID NO: 1540910 - RNA, 19 nt, Homo sapiens
ggcgagaagaucaccauua

SEQ ID NO: 1540911 - RNA, 19 nt, Homo sapiens
cccaaugccuguuuauuca

SEQ ID NO: 1540912 - RNA, 19 nt, Homo sapiens
gggaaucuagaacaguuua

SEQ ID NO: 1540913 - RNA, 19 nt, Homo sapiens
ccaugggacuucuguagug

SEQ ID NO: 1540914 - RNA, 19 nt, Homo sapiens
acacugggaaacaucauua

SEQ ID NO: 1540915 - RNA, 19 nt, Homo sapiens
cauuaaaucacaacuccua

SEQ ID NO: 1540916 - RNA, 19 nt, Homo sapiens
gggaaagagccacagcaaa

SEQ ID NO: 1540917 - RNA, 19 nt, Homo sapiens
ggaaacaucauuaaaucac

SEQ ID NO: 1540918 - RNA, 19 nt, Homo sapiens
aaucacaacuccuaaaaga

SEQ ID NO: 1540919 - RNA, 19 nt, Homo sapiens
gggaaacaucauuaaauca

SEQ ID NO: 1540920 - RNA, 19 nt, Homo sapiens
cugggaaucuagaacaguu

SEQ ID NO: 1540921 - RNA, 19 nt, Homo sapiens
aaagagccacagcaaagaa

SEQ ID NO: 1540922 - RNA, 19 nt, Homo sapiens
acaccaagguacccaaugc

SEQ ID NO: 1540923 - RNA, 19 nt, Homo sapiens
ggacaccaagguacccaau

SEQ ID NO: 1540924 - RNA, 19 nt, Homo sapiens
uauucaccaucaacaaaga

SEQ ID NO: 1540925 - RNA, 19 nt, Homo sapiens
cugggaaacaucauuaaau

SEQ ID NO: 1540926 - RNA, 19 nt, Homo sapiens
agaucaccauuaacaagga

SEQ ID NO: 1540927 - RNA, 19 nt, Homo sapiens
gcucuucuacgucccuugu

SEQ ID NO: 1540928 - RNA, 19 nt, Homo sapiens
agaagaucaccauuaacaa

SEQ ID NO: 1540929 - RNA, 19 nt, Homo sapiens
gaccacacacugggaaaca

SEQ ID NO: 1540930 - RNA, 19 nt, Homo sapiens
acccaaugccuguuuauuc

SEQ ID NO: 1540931 - RNA, 19 nt, Homo sapiens
gaaccaagcuucacaggua

SEQ ID NO: 1540932 - RNA, 19 nt, Homo sapiens
ccaaguacuuuaagaguua

SEQ ID NO: 1540933 - RNA, 19 nt, Homo sapiens
ggaagacagucaagaguuu

SEQ ID NO: 1540934 - RNA, 19 nt, Homo sapiens
gagcuaaacuaggguauaa

SEQ ID NO: 1540935 - RNA, 19 nt, Homo sapiens
gaagacaugucaguaauug

SEQ ID NO: 1540936 - RNA, 19 nt, Homo sapiens
gaagacagauuagaggaaa

SEQ ID NO: 1540937 - RNA, 19 nt, Homo sapiens
gagcgucacuauacgguua

SEQ ID NO: 1540938 - RNA, 19 nt, Homo sapiens
gaaaucaccucuugaacca

SEQ ID NO: 1540939 - RNA, 19 nt, Homo sapiens
aaacugaacuccuuagaau

SEQ ID NO: 1540940 - RNA, 19 nt, Homo sapiens
gagcugagauugagaaugg

SEQ ID NO: 1540941 - RNA, 19 nt, Homo sapiens
ggagaaaugagauggaaua

SEQ ID NO: 1540942 - RNA, 19 nt, Homo sapiens
ccauagagcuacugaaaug

SEQ ID NO: 1540943 - RNA, 19 nt, Homo sapiens
gaaaccaaguacuuuaaga

SEQ ID NO: 1540944 - RNA, 19 nt, Homo sapiens
gagaagacaugucaguaau

SEQ ID NO: 1540945 - RNA, 19 nt, Homo sapiens
ucaacuaguucaccgguua

SEQ ID NO: 1540946 - RNA, 19 nt, Homo sapiens
gcugacaaguccacacaua

SEQ ID NO: 1540947 - RNA, 19 nt, Homo sapiens
ggacauuccuauccauuca

SEQ ID NO: 1540948 - RNA, 19 nt, Homo sapiens
guuaaacccugauugaaug

SEQ ID NO: 1540949 - RNA, 19 nt, Homo sapiens
gaacuuaacagggcacauu

SEQ ID NO: 1540950 - RNA, 19 nt, Homo sapiens
guugaacccuuauaacuug

SEQ ID NO: 1540951 - RNA, 19 nt, Homo sapiens
ccaaacaugccaaggaaua

SEQ ID NO: 1540952 - RNA, 19 nt, Homo sapiens
gaagggaauccuacagaaa

SEQ ID NO: 1540953 - RNA, 19 nt, Homo sapiens
ucuaauaucuugguucuga

SEQ ID NO: 1540954 - RNA, 19 nt, Homo sapiens
gagaaaccaaguacuuuaa

SEQ ID NO: 1540955 - RNA, 19 nt, Homo sapiens
uuacugaaaucaccucuug

SEQ ID NO: 1540956 - RNA, 19 nt, Homo sapiens
ggacacuagugccaucuug

SEQ ID NO: 1540957 - RNA, 19 nt, Homo sapiens
ucacaaagaggaggaauuu

SEQ ID NO: 1540958 - RNA, 19 nt, Homo sapiens
ccacacauauucugaaguc

SEQ ID NO: 1540959 - RNA, 19 nt, Homo sapiens
gcacagggccuagcaugaa

SEQ ID NO: 1540960 - RNA, 19 nt, Homo sapiens
gcacauucugucucuaaua

SEQ ID NO: 1540961 - RNA, 19 nt, Homo sapiens
gauaaggcaagaugcauuu

SEQ ID NO: 1540962 - RNA, 19 nt, Homo sapiens
gaagacagucaagaguuua

SEQ ID NO: 1540963 - RNA, 19 nt, Homo sapiens
cuuaagcugugaacucaua

SEQ ID NO: 1540964 - RNA, 19 nt, Homo sapiens
gaaaaccaaucccagauga

SEQ ID NO: 1540965 - RNA, 19 nt, Homo sapiens
ugagaaaccaaguacuuua

SEQ ID NO: 1540966 - RNA, 19 nt, Homo sapiens
gaaucagaauuguguuuca

SEQ ID NO: 1540967 - RNA, 19 nt, Homo sapiens
gugagaagcaccagaauug

SEQ ID NO: 1540968 - RNA, 19 nt, Homo sapiens
gucaagaguuuaaccagaa

SEQ ID NO: 1540969 - RNA, 19 nt, Homo sapiens
uauaaggccuuccacacaa

SEQ ID NO: 1540970 - RNA, 19 nt, Homo sapiens
uaucaacccugacccauag

SEQ ID NO: 1540971 - RNA, 19 nt, Homo sapiens
ugagaccuguacugaauaa

SEQ ID NO: 1540972 - RNA, 19 nt, Homo sapiens
gaagugagggagccuguga

SEQ ID NO: 1540973 - RNA, 19 nt, Homo sapiens
gcaagaugcauuuggaaga

SEQ ID NO: 1540974 - RNA, 19 nt, Homo sapiens
ccuuauaacuuggaaacua

SEQ ID NO: 1540975 - RNA, 19 nt, Homo sapiens
cacauucugucucuaauau

SEQ ID NO: 1540976 - RNA, 19 nt, Homo sapiens
ucagggaguuugauugguu

SEQ ID NO: 1540977 - RNA, 19 nt, Homo sapiens
ugagggagccugugacuga

SEQ ID NO: 1540978 - RNA, 19 nt, Homo sapiens
gauuuccuauucccuguaa

SEQ ID NO: 1540979 - RNA, 19 nt, Homo sapiens
ugaagggaauccuacagaa

SEQ ID NO: 1540980 - RNA, 19 nt, Homo sapiens
gcacagugacccuugaaau

SEQ ID NO: 1540981 - RNA, 19 nt, Homo sapiens
ggauggaaccugcaggaaa

SEQ ID NO: 1540982 - RNA, 19 nt, Homo sapiens
gagcaucucauauguguag

SEQ ID NO: 1540983 - RNA, 19 nt, Homo sapiens
guccaugaguuacauaaug

SEQ ID NO: 1540984 - RNA, 19 nt, Homo sapiens
cagaugaacaggaguacua

SEQ ID NO: 1540985 - RNA, 19 nt, Homo sapiens
gcagugagaagcaccagaa

SEQ ID NO: 1540986 - RNA, 19 nt, Homo sapiens
ccuauucccuguaauuugu

SEQ ID NO: 1540987 - RNA, 19 nt, Homo sapiens
gugagucccuuaaauucuu

SEQ ID NO: 1540988 - RNA, 19 nt, Homo sapiens
aaaguucugccucccauua

SEQ ID NO: 1540989 - RNA, 19 nt, Homo sapiens
gaaaugcccacaguauaga

SEQ ID NO: 1540990 - RNA, 19 nt, Homo sapiens
gagagacacacuugaguug

SEQ ID NO: 1540991 - RNA, 19 nt, Homo sapiens
gauggaaccugcaggaaaa

SEQ ID NO: 1540992 - RNA, 19 nt, Homo sapiens
gacaagagaaacucaguga

SEQ ID NO: 1540993 - RNA, 19 nt, Homo sapiens
ugacaaguccacacauauu

SEQ ID NO: 1540994 - RNA, 19 nt, Homo sapiens
uaggauggaagacagauua

SEQ ID NO: 1540995 - RNA, 19 nt, Homo sapiens
ggaguuugauugguucaga

SEQ ID NO: 1540996 - RNA, 19 nt, Homo sapiens
caacauguagaucaauuug

SEQ ID NO: 1540997 - RNA, 19 nt, Homo sapiens
gaggaaaugcgaguggaua

SEQ ID NO: 1540998 - RNA, 19 nt, Homo sapiens
gcaacauguagaucaauuu

SEQ ID NO: 1540999 - RNA, 19 nt, Homo sapiens
guagaggagcugagauuga

SEQ ID NO: 1541000 - RNA, 19 nt, Homo sapiens
uggaagaguugguauucaa

SEQ ID NO: 1541001 - RNA, 19 nt, Homo sapiens
aaacugggccacagaauca

SEQ ID NO: 1541002 - RNA, 19 nt, Homo sapiens
ggugcaauuucugauuaua

SEQ ID NO: 1541003 - RNA, 19 nt, Homo sapiens
ggaagacagauuagaggaa

SEQ ID NO: 1541004 - RNA, 19 nt, Homo sapiens
gggcacauucugucucuaa

SEQ ID NO: 1541005 - RNA, 19 nt, Homo sapiens
ucagaauuguguuucaaga

SEQ ID NO: 1541006 - RNA, 19 nt, Homo sapiens
agaaagagaagacauguca

SEQ ID NO: 1541007 - RNA, 19 nt, Homo sapiens
ggauaaggcaagaugcauu

SEQ ID NO: 1541008 - RNA, 19 nt, Homo sapiens
acagugagcgccaaggaua

SEQ ID NO: 1541009 - RNA, 19 nt, Homo sapiens
gcuggaggcuuggugagaa

SEQ ID NO: 1541010 - RNA, 19 nt, Homo sapiens
ucaagaguuuaaccagaaa

SEQ ID NO: 1541011 - RNA, 19 nt, Homo sapiens
agagaagacaugucaguaa

SEQ ID NO: 1541012 - RNA, 19 nt, Homo sapiens
ugaaaugcccacaguauag

SEQ ID NO: 1541013 - RNA, 19 nt, Homo sapiens
uuggugcaauuucugauua

SEQ ID NO: 1541014 - RNA, 19 nt, Homo sapiens
uaacuuggaaacuaacuga

SEQ ID NO: 1541015 - RNA, 19 nt, Homo sapiens
gaacucauaggacuuggau

SEQ ID NO: 1541016 - RNA, 19 nt, Homo sapiens
acugagaccuguacugaau

SEQ ID NO: 1541017 - RNA, 19 nt, Homo sapiens
gagaaaugagauggaauaa

SEQ ID NO: 1541018 - RNA, 19 nt, Homo sapiens
gaacccuuauaacuuggaa

SEQ ID NO: 1541019 - RNA, 19 nt, Homo sapiens
ugaguuacauaaugaugga

SEQ ID NO: 1541020 - RNA, 19 nt, Homo sapiens
uccaugaguuacauaauga

SEQ ID NO: 1541021 - RNA, 19 nt, Homo sapiens
cuugcuagcugguccauga

SEQ ID NO: 1541022 - RNA, 19 nt, Homo sapiens
uaucagcugugucuuacug

SEQ ID NO: 1541023 - RNA, 19 nt, Homo sapiens
cgagaaaacugaacuccuu

SEQ ID NO: 1541024 - RNA, 19 nt, Homo sapiens
uaacugaaugggagaaaug

SEQ ID NO: 1541025 - RNA, 19 nt, Homo sapiens
gagcuacugaaauguauga

SEQ ID NO: 1541026 - RNA, 19 nt, Homo sapiens
ucauauguguaguucugua

SEQ ID NO: 1541027 - RNA, 19 nt, Homo sapiens
uggagcaucucauaugugu

SEQ ID NO: 1541028 - RNA, 19 nt, Homo sapiens
gaguuuaaccagaaagaga

SEQ ID NO: 1541029 - RNA, 19 nt, Homo sapiens
gggaaucagaauuguguuu

SEQ ID NO: 1541030 - RNA, 19 nt, Homo sapiens
ucucauauguguaguucug

SEQ ID NO: 1541031 - RNA, 19 nt, Homo sapiens
uaacaaagcugauuuaagc

SEQ ID NO: 1541032 - RNA, 19 nt, Homo sapiens
gagagucacagccuuauua

SEQ ID NO: 1541033 - RNA, 19 nt, Homo sapiens
ccagagaguuggaauaaug

SEQ ID NO: 1541034 - RNA, 19 nt, Homo sapiens
gagcaaaacuugaaucauu

SEQ ID NO: 1541035 - RNA, 19 nt, Homo sapiens
ccaagaauguugccaguug

SEQ ID NO: 1541036 - RNA, 19 nt, Homo sapiens
gcagaggaaccuuauauug

SEQ ID NO: 1541037 - RNA, 19 nt, Homo sapiens
gaaagcacccagagaguug

SEQ ID NO: 1541038 - RNA, 19 nt, Homo sapiens
agaggaaccuuauauugaa

SEQ ID NO: 1541039 - RNA, 19 nt, Homo sapiens
gauaagagcacuggcauug

SEQ ID NO: 1541040 - RNA, 19 nt, Homo sapiens
gugaagaaacuacaacuuu

SEQ ID NO: 1541041 - RNA, 19 nt, Homo sapiens
uaaccaauccuaucaguga

SEQ ID NO: 1541042 - RNA, 19 nt, Homo sapiens
ggagccaggucgugagaaa

SEQ ID NO: 1541043 - RNA, 19 nt, Homo sapiens
guaggacgaacaaguaaua

SEQ ID NO: 1541044 - RNA, 19 nt, Homo sapiens
caaagcugauuuaagcaaa

SEQ ID NO: 1541045 - RNA, 19 nt, Homo sapiens
cagaggaaccuuauauuga

SEQ ID NO: 1541046 - RNA, 19 nt, Homo sapiens
gaggaaccuuauauugaaa

SEQ ID NO: 1541047 - RNA, 19 nt, Homo sapiens
uuaaggagcuaguuacaca

SEQ ID NO: 1541048 - RNA, 19 nt, Homo sapiens
ccaguaggacgaacaagua

SEQ ID NO: 1541049 - RNA, 19 nt, Homo sapiens
ggaaagcacccagagaguu

SEQ ID NO: 1541050 - RNA, 19 nt, Homo sapiens
cuuuaugugucauguguua

SEQ ID NO: 1541051 - RNA, 19 nt, Homo sapiens
ccauaacaaagcugauuua

SEQ ID NO: 1541052 - RNA, 19 nt, Homo sapiens
caacccagcauauagagaa

SEQ ID NO: 1541053 - RNA, 19 nt, Homo sapiens
ggagacgcuucaacugaga

SEQ ID NO: 1541054 - RNA, 19 nt, Homo sapiens
ccucagcucucaggugaaa

SEQ ID NO: 1541055 - RNA, 19 nt, Homo sapiens
ggagcuaguuacacaugga

SEQ ID NO: 1541056 - RNA, 19 nt, Homo sapiens
gaaccuaguacgaaguguu

SEQ ID NO: 1541057 - RNA, 19 nt, Homo sapiens
gcagcagaacauaaauuaa

SEQ ID NO: 1541058 - RNA, 19 nt, Homo sapiens
ggacgaacaaguaauaaaa

SEQ ID NO: 1541059 - RNA, 19 nt, Homo sapiens
aaacgaagccuugcucuag

SEQ ID NO: 1541060 - RNA, 19 nt, Homo sapiens
caagaauguugccaguugu

SEQ ID NO: 1541061 - RNA, 19 nt, Homo sapiens
gauuuaagcaaacugcauu

SEQ ID NO: 1541062 - RNA, 19 nt, Homo sapiens
cacaggagaaauaaucaua

SEQ ID NO: 1541063 - RNA, 19 nt, Homo sapiens
ugacaucgaaacuguuauu

SEQ ID NO: 1541064 - RNA, 19 nt, Homo sapiens
gcaacaggcacuucuuagu

SEQ ID NO: 1541065 - RNA, 19 nt, Homo sapiens
uauccgagcauaacuguga

SEQ ID NO: 1541066 - RNA, 19 nt, Homo sapiens
gauauuccauaacaaagcu

SEQ ID NO: 1541067 - RNA, 19 nt, Homo sapiens
ucauacaagucaccuguca

SEQ ID NO: 1541068 - RNA, 19 nt, Homo sapiens
guuacugaaucaucuacaa

SEQ ID NO: 1541069 - RNA, 19 nt, Homo sapiens
gcccuuaguccuucuaguu

SEQ ID NO: 1541070 - RNA, 19 nt, Homo sapiens
aaacugaggcaccaagaau

SEQ ID NO: 1541071 - RNA, 19 nt, Homo sapiens
ggagccagcugcaaaacaa

SEQ ID NO: 1541072 - RNA, 19 nt, Homo sapiens
caacugagaaugauguuuu

SEQ ID NO: 1541073 - RNA, 19 nt, Homo sapiens
ggacgguacuccgcugaca

SEQ ID NO: 1541074 - RNA, 19 nt, Homo sapiens
cagcagcagcagaacauaa

SEQ ID NO: 1541075 - RNA, 19 nt, Homo sapiens
cuucgucugugccggcuua

SEQ ID NO: 1541076 - RNA, 19 nt, Homo sapiens
gcugacaccuucccuuucg

SEQ ID NO: 1541077 - RNA, 19 nt, Homo sapiens
ccuacuugauauuccauaa

SEQ ID NO: 1541078 - RNA, 19 nt, Homo sapiens
gacaucgaaacuguuauua

SEQ ID NO: 1541079 - RNA, 19 nt, Homo sapiens
uuaacaugcuguguaauuc

SEQ ID NO: 1541080 - RNA, 19 nt, Homo sapiens
uauugaagccucuaaagau

SEQ ID NO: 1541081 - RNA, 19 nt, Homo sapiens
cagcaacccagcauauaga

SEQ ID NO: 1541082 - RNA, 19 nt, Homo sapiens
ggugaaacugcgauagaaa

SEQ ID NO: 1541083 - RNA, 19 nt, Homo sapiens
uaacugugacaccugauga

SEQ ID NO: 1541084 - RNA, 19 nt, Homo sapiens
gauauugaagccucuaaag

SEQ ID NO: 1541085 - RNA, 19 nt, Homo sapiens
agucaccugucaccacuuu

SEQ ID NO: 1541086 - RNA, 19 nt, Homo sapiens
ccaauccuaucagugaaga

SEQ ID NO: 1541087 - RNA, 19 nt, Homo sapiens
cuacggacgacgccuauga

SEQ ID NO: 1541088 - RNA, 19 nt, Homo sapiens
ggagagucacagccuuauu

SEQ ID NO: 1541089 - RNA, 19 nt, Homo sapiens
aacaugcuguguaauucua

SEQ ID NO: 1541090 - RNA, 19 nt, Homo sapiens
agcagcagaacauaaauua

SEQ ID NO: 1541091 - RNA, 19 nt, Homo sapiens
ugucaccacuuuagauaag

SEQ ID NO: 1541092 - RNA, 19 nt, Homo sapiens
caauguauaagucccaguu

SEQ ID NO: 1541093 - RNA, 19 nt, Homo sapiens
cagcagcagaacauaaauu

SEQ ID NO: 1541094 - RNA, 19 nt, Homo sapiens
ccgaagaguuuggaaagca

SEQ ID NO: 1541095 - RNA, 19 nt, Homo sapiens
caaacugaggcaccaagaa

SEQ ID NO: 1541096 - RNA, 19 nt, Homo sapiens
agaguuggaauaaugauga

SEQ ID NO: 1541097 - RNA, 19 nt, Homo sapiens
ccugucaccacuuuagaua

SEQ ID NO: 1541098 - RNA, 19 nt, Homo sapiens
uuagagaaccuaguacgaa

SEQ ID NO: 1541099 - RNA, 19 nt, Homo sapiens
gaagauauugaagccucua

SEQ ID NO: 1541100 - RNA, 19 nt, Homo sapiens
ugugacaccugaugaagag

SEQ ID NO: 1541101 - RNA, 19 nt, Homo sapiens
caccggaaauaggaaagaa

SEQ ID NO: 1541102 - RNA, 19 nt, Homo sapiens
gagaaccuaguacgaagug

SEQ ID NO: 1541103 - RNA, 19 nt, Homo sapiens
ccagcaacccagcauauag

SEQ ID NO: 1541104 - RNA, 19 nt, Homo sapiens
cagagaguuggaauaauga

SEQ ID NO: 1541105 - RNA, 19 nt, Homo sapiens
uacagaaucagaagauguu

SEQ ID NO: 1541106 - RNA, 19 nt, Homo sapiens
ccgcugacaccuucccuuu

SEQ ID NO: 1541107 - RNA, 19 nt, Homo sapiens
aaaccuacuugauauucca

SEQ ID NO: 1541108 - RNA, 19 nt, Homo sapiens
caccagagaugagagaaaa

SEQ ID NO: 1541109 - RNA, 19 nt, Homo sapiens
caggugaaacugcgauaga

SEQ ID NO: 1541110 - RNA, 19 nt, Homo sapiens
gaucucuacagaaucagaa

SEQ ID NO: 1541111 - RNA, 19 nt, Homo sapiens
cgaucaaaccaaacaaugu

SEQ ID NO: 1541112 - RNA, 19 nt, Homo sapiens
cuacagaaucagaagaugu

SEQ ID NO: 1541113 - RNA, 19 nt, Homo sapiens
agaauguugccaguuguua

SEQ ID NO: 1541114 - RNA, 19 nt, Homo sapiens
uaugaagcccuuaguccuu

SEQ ID NO: 1541115 - RNA, 19 nt, Homo sapiens
agagucacagccuuauuaa

SEQ ID NO: 1541116 - RNA, 19 nt, Homo sapiens
gcuguguaauucuagaucu

SEQ ID NO: 1541117 - RNA, 19 nt, Homo sapiens
caguaggacgaacaaguaa

SEQ ID NO: 1541118 - RNA, 19 nt, Homo sapiens
caucaaagggaucaaaauu

SEQ ID NO: 1541119 - RNA, 19 nt, Homo sapiens
acaaagcugauuuaagcaa

SEQ ID NO: 1541120 - RNA, 19 nt, Homo sapiens
agucacagccuuauuaaaa

SEQ ID NO: 1541121 - RNA, 19 nt, Homo sapiens
gagucacagccuuauuaaa

SEQ ID NO: 1541122 - RNA, 19 nt, Homo sapiens
gcagcagcagcagaacaua

SEQ ID NO: 1541123 - RNA, 19 nt, Homo sapiens
ccucuaaagaucaccuaaa

SEQ ID NO: 1541124 - RNA, 19 nt, Homo sapiens
gagaguuggaauaaugaug

SEQ ID NO: 1541125 - RNA, 19 nt, Homo sapiens
gaauguugccaguuguuac

SEQ ID NO: 1541126 - RNA, 19 nt, Homo sapiens
ccaccagagaugagagaaa

SEQ ID NO: 1541127 - RNA, 19 nt, Homo sapiens
uaacaugcuguguaauucu

SEQ ID NO: 1541128 - RNA, 19 nt, Homo sapiens
caccagcaacccagcauau

SEQ ID NO: 1541129 - RNA, 19 nt, Homo sapiens
auugaagccucuaaagauc

SEQ ID NO: 1541130 - RNA, 19 nt, Homo sapiens
acccagagaguuggaauaa

SEQ ID NO: 1541131 - RNA, 19 nt, Homo sapiens
gaccuuggcuggcgucuca

SEQ ID NO: 1541132 - RNA, 19 nt, Homo sapiens
ggaccaacauggagaggau

SEQ ID NO: 1541133 - RNA, 19 nt, Homo sapiens
gagcgucucugcuucaucu

SEQ ID NO: 1541134 - RNA, 19 nt, Homo sapiens
ggugcuggcugcaggauuc

SEQ ID NO: 1541135 - RNA, 19 nt, Homo sapiens
ccuuggagcucgucuuauc

SEQ ID NO: 1541136 - RNA, 19 nt, Homo sapiens
guccaaggcugggcacuca

SEQ ID NO: 1541137 - RNA, 19 nt, Homo sapiens
gcagcucccugauguuucc

SEQ ID NO: 1541138 - RNA, 19 nt, Homo sapiens
cggagggaguucacaguca

SEQ ID NO: 1541139 - RNA, 19 nt, Homo sapiens
gaagcugcucuccgagguu

SEQ ID NO: 1541140 - RNA, 19 nt, Homo sapiens
ggaggaggaggaggaggaa

SEQ ID NO: 1541141 - RNA, 19 nt, Homo sapiens
gcaugaagcucuuaucuuu

SEQ ID NO: 1541142 - RNA, 19 nt, Homo sapiens
gaagauauccggugcaaau

SEQ ID NO: 1541143 - RNA, 19 nt, Homo sapiens
caacaagaguucugaagau

SEQ ID NO: 1541144 - RNA, 19 nt, Homo sapiens
guacuuggguugccucuug

SEQ ID NO: 1541145 - RNA, 19 nt, Homo sapiens
caaggaagccaucauuaaa

SEQ ID NO: 1541146 - RNA, 19 nt, Homo sapiens
caagaguucugaagauauc

SEQ ID NO: 1541147 - RNA, 19 nt, Homo sapiens
ucaaggaagccaucauuaa

SEQ ID NO: 1541148 - RNA, 19 nt, Homo sapiens
guuccagucuucccuuuaa

SEQ ID NO: 1541149 - RNA, 19 nt, Homo sapiens
gaucuccguugucuucuug

SEQ ID NO: 1541150 - RNA, 19 nt, Homo sapiens
uagaugggcuggugugguu

SEQ ID NO: 1541151 - RNA, 19 nt, Homo sapiens
guacuuggcuauuuugauu

SEQ ID NO: 1541152 - RNA, 19 nt, Homo sapiens
aggaagccaucauuaaauu

SEQ ID NO: 1541153 - RNA, 19 nt, Homo sapiens
aaacaucagugggcacauu

SEQ ID NO: 1541154 - RNA, 19 nt, Homo sapiens
ggcacaagaugcucagcua

SEQ ID NO: 1541155 - RNA, 19 nt, Homo sapiens
aacaagaguucugaagaua

SEQ ID NO: 1541156 - RNA, 19 nt, Homo sapiens
cugagcaacugcacaauga

SEQ ID NO: 1541157 - RNA, 19 nt, Homo sapiens
acaaugaggaggagaauga

SEQ ID NO: 1541158 - RNA, 19 nt, Homo sapiens
cuacauggccuuccugaug

SEQ ID NO: 1541159 - RNA, 19 nt, Homo sapiens
gaagccaucauuaaauugu

SEQ ID NO: 1541160 - RNA, 19 nt, Homo sapiens
gaaagcauggcccagcauu

SEQ ID NO: 1541161 - RNA, 19 nt, Homo sapiens
cagcaagccugauaagcau

SEQ ID NO: 1541162 - RNA, 19 nt, Homo sapiens
gaaagccggaugcauauac

SEQ ID NO: 1541163 - RNA, 19 nt, Homo sapiens
ccaucaaggucaucauugu

SEQ ID NO: 1541164 - RNA, 19 nt, Homo sapiens
ggucaucauugucaucuac

SEQ ID NO: 1541165 - RNA, 19 nt, Homo sapiens
agauaaagcugggucuuca

SEQ ID NO: 1541166 - RNA, 19 nt, Homo sapiens
uuucugcagugguucuuua

SEQ ID NO: 1541167 - RNA, 19 nt, Homo sapiens
aaagcugggucuucaggaa

SEQ ID NO: 1541168 - RNA, 19 nt, Homo sapiens
ggaagccaucauuaaauug

SEQ ID NO: 1541169 - RNA, 19 nt, Homo sapiens
ucuccuggcuccacucuug

SEQ ID NO: 1541170 - RNA, 19 nt, Homo sapiens
ccaacaagaguucugaaga

SEQ ID NO: 1541171 - RNA, 19 nt, Homo sapiens
gcaagccugauaagcauga

SEQ ID NO: 1541172 - RNA, 19 nt, Homo sapiens
cugcagugguucuuuauca

SEQ ID NO: 1541173 - RNA, 19 nt, Homo sapiens
cagcauguguuccuuucug

SEQ ID NO: 1541174 - RNA, 19 nt, Homo sapiens
ggaugcauauacugagcaa

SEQ ID NO: 1541175 - RNA, 19 nt, Homo sapiens
gcacauuuacaaccagaau

SEQ ID NO: 1541176 - RNA, 19 nt, Homo sapiens
aaaugcaucuguccaccuu

SEQ ID NO: 1541177 - RNA, 19 nt, Homo sapiens
ugaggaugcucgcucuaug

SEQ ID NO: 1541178 - RNA, 19 nt, Homo sapiens
ccagcaagccugauaagca

SEQ ID NO: 1541179 - RNA, 19 nt, Homo sapiens
agaguuguguguaaaucaa

SEQ ID NO: 1541180 - RNA, 19 nt, Homo sapiens
gaauguuguuacccuugga

SEQ ID NO: 1541181 - RNA, 19 nt, Homo sapiens
acaagaugcucagcuagau

SEQ ID NO: 1541182 - RNA, 19 nt, Homo sapiens
ucagugggcacauuuacaa

SEQ ID NO: 1541183 - RNA, 19 nt, Homo sapiens
gagaaaauuuuguccucuu

SEQ ID NO: 1541184 - RNA, 19 nt, Homo sapiens
gggauguggucucugaucu

SEQ ID NO: 1541185 - RNA, 19 nt, Homo sapiens
aaucaaggaagccaucauu

SEQ ID NO: 1541186 - RNA, 19 nt, Homo sapiens
gucuuagaguuguguguaa

SEQ ID NO: 1541187 - RNA, 19 nt, Homo sapiens
gacggucgguuggaacaug

SEQ ID NO: 1541188 - RNA, 19 nt, Homo sapiens
uuaaaagccuguggcauuu

SEQ ID NO: 1541189 - RNA, 19 nt, Homo sapiens
guuccuuucugcagugguu

SEQ ID NO: 1541190 - RNA, 19 nt, Homo sapiens
gcacaaugaggaggagaau

SEQ ID NO: 1541191 - RNA, 19 nt, Homo sapiens
ugauaagcaugaagcucuu

SEQ ID NO: 1541192 - RNA, 19 nt, Homo sapiens
gccagacggucgguuggaa

SEQ ID NO: 1541193 - RNA, 19 nt, Homo sapiens
ccgaaagccggaugcauau

SEQ ID NO: 1541194 - RNA, 19 nt, Homo sapiens
cuccuucucccuaacuuua

SEQ ID NO: 1541195 - RNA, 19 nt, Homo sapiens
cacaagaugcucagcuaga

SEQ ID NO: 1541196 - RNA, 19 nt, Homo sapiens
cgaaagccggaugcauaua

SEQ ID NO: 1541197 - RNA, 19 nt, Homo sapiens
augaagcucuuaucuuugg

SEQ ID NO: 1541198 - RNA, 19 nt, Homo sapiens
gcaucuguccaccuuauag

SEQ ID NO: 1541199 - RNA, 19 nt, Homo sapiens
aaggaagccaucauuaaau

SEQ ID NO: 1541200 - RNA, 19 nt, Homo sapiens
gcucugagucuugggaaug

SEQ ID NO: 1541201 - RNA, 19 nt, Homo sapiens
ggucucugaucuccguugu

SEQ ID NO: 1541202 - RNA, 19 nt, Homo sapiens
acaagaguucugaagauau

SEQ ID NO: 1541203 - RNA, 19 nt, Homo sapiens
ucuuagaguuguguguaaa

SEQ ID NO: 1541204 - RNA, 19 nt, Homo sapiens
gcugaagccaacaagaguu

SEQ ID NO: 1541205 - RNA, 19 nt, Homo sapiens
ucucugaucuccguugucu

SEQ ID NO: 1541206 - RNA, 19 nt, Homo sapiens
caagaugcucagcuagaug

SEQ ID NO: 1541207 - RNA, 19 nt, Homo sapiens
caccaucaaggucaucauu

SEQ ID NO: 1541208 - RNA, 19 nt, Homo sapiens
gcaccaccaccaucaaggu

SEQ ID NO: 1541209 - RNA, 19 nt, Homo sapiens
cugaagauauccggugcaa

SEQ ID NO: 1541210 - RNA, 19 nt, Homo sapiens
guugucuucuugggucuuu

SEQ ID NO: 1541211 - RNA, 19 nt, Homo sapiens
ugggugcccuguugcucua

SEQ ID NO: 1541212 - RNA, 19 nt, Homo sapiens
cagcugaagccaacaagag

SEQ ID NO: 1541213 - RNA, 19 nt, Homo sapiens
gcacuggaagcugguguuc

SEQ ID NO: 1541214 - RNA, 19 nt, Homo sapiens
ggcccagcauucagcaugu

SEQ ID NO: 1541215 - RNA, 19 nt, Homo sapiens
cgacagaaggggauuaaga

SEQ ID NO: 1541216 - RNA, 19 nt, Homo sapiens
gaggaugcucgcucuaugg

SEQ ID NO: 1541217 - RNA, 19 nt, Homo sapiens
caugaagcucuuaucuuug

SEQ ID NO: 1541218 - RNA, 19 nt, Homo sapiens
ggggacaacugggucuuuu

SEQ ID NO: 1541219 - RNA, 19 nt, Homo sapiens
aagcauggcccagcauuca

SEQ ID NO: 1541220 - RNA, 19 nt, Homo sapiens
ucugaucuccguugucuuc

SEQ ID NO: 1541221 - RNA, 19 nt, Homo sapiens
gguuccagucuucccuuua

SEQ ID NO: 1541222 - RNA, 19 nt, Homo sapiens
accagugcauggagagaaa

SEQ ID NO: 1541223 - RNA, 19 nt, Homo sapiens
uguuacccuuggaagauaa

SEQ ID NO: 1541224 - RNA, 19 nt, Homo sapiens
uuguuacccuuggaagaua

SEQ ID NO: 1541225 - RNA, 19 nt, Homo sapiens
gcugcgagaagacgacaga

SEQ ID NO: 1541226 - RNA, 19 nt, Homo sapiens
guuguuacccuuggaagau

SEQ ID NO: 1541227 - RNA, 19 nt, Homo sapiens
auacugagcaacugcacaa

SEQ ID NO: 1541228 - RNA, 19 nt, Homo sapiens
uggcuguggucggguguuu

SEQ ID NO: 1541229 - RNA, 19 nt, Homo sapiens
augcaucuguccaccuuau

SEQ ID NO: 1541230 - RNA, 19 nt, Homo sapiens
gcagcaccaccaccaucaa

SEQ ID NO: 1541231 - RNA, 19 nt, Homo sapiens
uuagaguuguguguaaauc

SEQ ID NO: 1541232 - RNA, 19 nt, Homo sapiens
ggaaagcauggcccagcau

SEQ ID NO: 1541233 - RNA, 19 nt, Homo sapiens
caucuguccaccuuauaga

SEQ ID NO: 1541234 - RNA, 19 nt, Homo sapiens
ggaggagaaugaggaugcu

SEQ ID NO: 1541235 - RNA, 19 nt, Homo sapiens
gaagccaacaagaguucug

SEQ ID NO: 1541236 - RNA, 19 nt, Homo sapiens
uggacccucugauccgaaa

SEQ ID NO: 1541237 - RNA, 19 nt, Homo sapiens
ggaaauaagucaauggaaa

SEQ ID NO: 1541238 - RNA, 19 nt, Homo sapiens
gaacaaaccaucuauugaa

SEQ ID NO: 1541239 - RNA, 19 nt, Homo sapiens
ggaagagacucauaguaaa

SEQ ID NO: 1541240 - RNA, 19 nt, Homo sapiens
ccucagagauguauauauu

SEQ ID NO: 1541241 - RNA, 19 nt, Homo sapiens
gggaagagacucauaguaa

SEQ ID NO: 1541242 - RNA, 19 nt, Homo sapiens
gcaaacaucagaaaucaaa

SEQ ID NO: 1541243 - RNA, 19 nt, Homo sapiens
aaagaaaccuuaugcaugu

SEQ ID NO: 1541244 - RNA, 19 nt, Homo sapiens
uaacaguacugagcuauuu

SEQ ID NO: 1541245 - RNA, 19 nt, Homo sapiens
gaggagaagugaauguaaa

SEQ ID NO: 1541246 - RNA, 19 nt, Homo sapiens
gaaccuaaccauuauaguu

SEQ ID NO: 1541247 - RNA, 19 nt, Homo sapiens
ccacugcagucccuuauaa

SEQ ID NO: 1541248 - RNA, 19 nt, Homo sapiens
caaaaugucugcaaaauug

SEQ ID NO: 1541249 - RNA, 19 nt, Homo sapiens
caacagaaaugugaugaau

SEQ ID NO: 1541250 - RNA, 19 nt, Homo sapiens
uagaggagcuccaaauaug

SEQ ID NO: 1541251 - RNA, 19 nt, Homo sapiens
gaaaaugacugcuugucua

SEQ ID NO: 1541252 - RNA, 19 nt, Homo sapiens
ugaacaagaugguagguuu

SEQ ID NO: 1541253 - RNA, 19 nt, Homo sapiens
gaauauguuucaagcauca

SEQ ID NO: 1541254 - RNA, 19 nt, Homo sapiens
ugaauaagauggcagaauc

SEQ ID NO: 1541255 - RNA, 19 nt, Homo sapiens
agaaaucacugaggaauug

SEQ ID NO: 1541256 - RNA, 19 nt, Homo sapiens
ggaacaaaccaucuauuga

SEQ ID NO: 1541257 - RNA, 19 nt, Homo sapiens
gugcuacaguuacacaaua

SEQ ID NO: 1541258 - RNA, 19 nt, Homo sapiens
ggagucagcuaaacauaag

SEQ ID NO: 1541259 - RNA, 19 nt, Homo sapiens
cacaagagccuccauacua

SEQ ID NO: 1541260 - RNA, 19 nt, Homo sapiens
acagaaaugugaugaaugu

SEQ ID NO: 1541261 - RNA, 19 nt, Homo sapiens
uaaagggugucucugugua

SEQ ID NO: 1541262 - RNA, 19 nt, Homo sapiens
agucagagcucagcccuua

SEQ ID NO: 1541263 - RNA, 19 nt, Homo sapiens
ccaaccauaucuuagagua

SEQ ID NO: 1541264 - RNA, 19 nt, Homo sapiens
gaacccauacugauucaaa

SEQ ID NO: 1541265 - RNA, 19 nt, Homo sapiens
gcuagcaccuucagaaauc

SEQ ID NO: 1541266 - RNA, 19 nt, Homo sapiens
caaaccaucuauugaaaca

SEQ ID NO: 1541267 - RNA, 19 nt, Homo sapiens
gaagcgcaauucugauuca

SEQ ID NO: 1541268 - RNA, 19 nt, Homo sapiens
caucaacuuuguaagauug

SEQ ID NO: 1541269 - RNA, 19 nt, Homo sapiens
ggauuaaagccuaacagua

SEQ ID NO: 1541270 - RNA, 19 nt, Homo sapiens
ggacaaaucacugaaguuc

SEQ ID NO: 1541271 - RNA, 19 nt, Homo sapiens
uaccacagcuuaacuggaa

SEQ ID NO: 1541272 - RNA, 19 nt, Homo sapiens
aaacaagacugauguacca

SEQ ID NO: 1541273 - RNA, 19 nt, Homo sapiens
uaaaggccuuaucuuauga

SEQ ID NO: 1541274 - RNA, 19 nt, Homo sapiens
uuccagagauucuugauaa

SEQ ID NO: 1541275 - RNA, 19 nt, Homo sapiens
acaagagccuccauacuau

SEQ ID NO: 1541276 - RNA, 19 nt, Homo sapiens
ggacaugauugcagagaag

SEQ ID NO: 1541277 - RNA, 19 nt, Homo sapiens
caucaucacuccuaacaca

SEQ ID NO: 1541278 - RNA, 19 nt, Homo sapiens
gaaaucaaaguccuuggaa

SEQ ID NO: 1541279 - RNA, 19 nt, Homo sapiens
gcacacaagagccuccaua

SEQ ID NO: 1541280 - RNA, 19 nt, Homo sapiens
ucaggaggcagauaaauaa

SEQ ID NO: 1541281 - RNA, 19 nt, Homo sapiens
ggaaagaaaccuuaugcau

SEQ ID NO: 1541282 - RNA, 19 nt, Homo sapiens
aaucaaaguccuuggaaua

SEQ ID NO: 1541283 - RNA, 19 nt, Homo sapiens
uaagaugaguuucuagaca

SEQ ID NO: 1541284 - RNA, 19 nt, Homo sapiens
gagcucagcccuuauuuua

SEQ ID NO: 1541285 - RNA, 19 nt, Homo sapiens
ucccagaguuccacauaua

SEQ ID NO: 1541286 - RNA, 19 nt, Homo sapiens
caugggagcuucaguccuu

SEQ ID NO: 1541287 - RNA, 19 nt, Homo sapiens
gauuaaagccuaacaguac

SEQ ID NO: 1541288 - RNA, 19 nt, Homo sapiens
gagaggaaacugugacuau

SEQ ID NO: 1541289 - RNA, 19 nt, Homo sapiens
agagucuucuguauucuua

SEQ ID NO: 1541290 - RNA, 19 nt, Homo sapiens
uuucuuagguucuauguga

SEQ ID NO: 1541291 - RNA, 19 nt, Homo sapiens
caaguuaauuucccguguu

SEQ ID NO: 1541292 - RNA, 19 nt, Homo sapiens
ggaggcagauaaauaaagg

SEQ ID NO: 1541293 - RNA, 19 nt, Homo sapiens
ugaaucauaucgucuaagu

SEQ ID NO: 1541294 - RNA, 19 nt, Homo sapiens
cgacgaacccauacugauu

SEQ ID NO: 1541295 - RNA, 19 nt, Homo sapiens
gaacaagaugguagguuug

SEQ ID NO: 1541296 - RNA, 19 nt, Homo sapiens
ggagagagagcuugaugga

SEQ ID NO: 1541297 - RNA, 19 nt, Homo sapiens
ugacuaugcuggaggaugu

SEQ ID NO: 1541298 - RNA, 19 nt, Homo sapiens
ggaggagaagugaauguaa

SEQ ID NO: 1541299 - RNA, 19 nt, Homo sapiens
uagaguaucuccagaaacu

SEQ ID NO: 1541300 - RNA, 19 nt, Homo sapiens
ucagccagauucccuguuu

SEQ ID NO: 1541301 - RNA, 19 nt, Homo sapiens
gcacccaucuucacuuggu

SEQ ID NO: 1541302 - RNA, 19 nt, Homo sapiens
gaaauaagucaauggaaac

SEQ ID NO: 1541303 - RNA, 19 nt, Homo sapiens
cagcaucgacgaacccaua

SEQ ID NO: 1541304 - RNA, 19 nt, Homo sapiens
ugacagagaagauggaaga

SEQ ID NO: 1541305 - RNA, 19 nt, Homo sapiens
gcucauugucuuuguaauu

SEQ ID NO: 1541306 - RNA, 19 nt, Homo sapiens
ggauaucuuauuuggcuua

SEQ ID NO: 1541307 - RNA, 19 nt, Homo sapiens
ggcagaaucuaaaucaagu

SEQ ID NO: 1541308 - RNA, 19 nt, Homo sapiens
gagaggaacaaaccaucua

SEQ ID NO: 1541309 - RNA, 19 nt, Homo sapiens
acacucugcuuaguuagua

SEQ ID NO: 1541310 - RNA, 19 nt, Homo sapiens
ggccuuaucuuaugaaagc

SEQ ID NO: 1541311 - RNA, 19 nt, Homo sapiens
uaugggugcuucuguaaga

SEQ ID NO: 1541312 - RNA, 19 nt, Homo sapiens
ggcaaaaucuuuagucaga

SEQ ID NO: 1541313 - RNA, 19 nt, Homo sapiens
caagaugguagguuugaaa

SEQ ID NO: 1541314 - RNA, 19 nt, Homo sapiens
ugaguuguguguaucuuga

SEQ ID NO: 1541315 - RNA, 19 nt, Homo sapiens
guuaguaugcugauaaaug

SEQ ID NO: 1541316 - RNA, 19 nt, Homo sapiens
caagacugauguaccacaa

SEQ ID NO: 1541317 - RNA, 19 nt, Homo sapiens
aggaaacccuucuuggaaa

SEQ ID NO: 1541318 - RNA, 19 nt, Homo sapiens
gaagcaucauccagagaau

SEQ ID NO: 1541319 - RNA, 19 nt, Homo sapiens
acaggaaagugguaugaau

SEQ ID NO: 1541320 - RNA, 19 nt, Homo sapiens
ccaaauauguggaauuacc

SEQ ID NO: 1541321 - RNA, 19 nt, Homo sapiens
ucuguaagauggaugauca

SEQ ID NO: 1541322 - RNA, 19 nt, Homo sapiens
uagaggaaccuaugaacaa

SEQ ID NO: 1541323 - RNA, 19 nt, Homo sapiens
gaagagacucauaguaaac

SEQ ID NO: 1541324 - RNA, 19 nt, Homo sapiens
gagugaaugguacuaguuu

SEQ ID NO: 1541325 - RNA, 19 nt, Homo sapiens
gggugucucuguguacuuu

SEQ ID NO: 1541326 - RNA, 19 nt, Homo sapiens
gauggcagaaucuaaauca

SEQ ID NO: 1541327 - RNA, 19 nt, Homo sapiens
agagauguaccacagcuua

SEQ ID NO: 1541328 - RNA, 19 nt, Homo sapiens
cagcuaaacauaaggaaug

SEQ ID NO: 1541329 - RNA, 19 nt, Homo sapiens
acugaggaauugccaagua

SEQ ID NO: 1541330 - RNA, 19 nt, Homo sapiens
gaaggaaggacaugauugc

SEQ ID NO: 1541331 - RNA, 19 nt, Homo sapiens
ccaucaacuuuguaagauu

SEQ ID NO: 1541332 - RNA, 19 nt, Homo sapiens
cagccagauucccuguuua

SEQ ID NO: 1541333 - RNA, 19 nt, Homo sapiens
gagcuucaguccuuaagac

SEQ ID NO: 1541334 - RNA, 19 nt, Homo sapiens
caacaagugccucagagau

SEQ ID NO: 1541335 - RNA, 19 nt, Homo sapiens
accacacucugcuuaguua

SEQ ID NO: 1541336 - RNA, 19 nt, Homo sapiens
aaacuucagaggaguguaa

SEQ ID NO: 1541337 - RNA, 19 nt, Homo sapiens
caacauagcuuugcagaug

SEQ ID NO: 1541338 - RNA, 19 nt, Homo sapiens
gaaacucccucauguuguu

SEQ ID NO: 1541339 - RNA, 19 nt, Homo sapiens
ggaaagcaguggucuuaga

SEQ ID NO: 1541340 - RNA, 19 nt, Homo sapiens
ccagcuagcuccuguguuu

SEQ ID NO: 1541341 - RNA, 19 nt, Homo sapiens
aaagaaagccuaugggaaa

SEQ ID NO: 1541342 - RNA, 19 nt, Homo sapiens
gagaaacucccucauguug

SEQ ID NO: 1541343 - RNA, 19 nt, Homo sapiens
gaaguuccaucgaggacaa

SEQ ID NO: 1541344 - RNA, 19 nt, Homo sapiens
guacagagcugggauccau

SEQ ID NO: 1541345 - RNA, 19 nt, Homo sapiens
gauuugaucuagaugaaga

SEQ ID NO: 1541346 - RNA, 19 nt, Homo sapiens
aaauaaagcucacuguuac

SEQ ID NO: 1541347 - RNA, 19 nt, Homo sapiens
gaaugaagccuuguacaga

SEQ ID NO: 1541348 - RNA, 19 nt, Homo sapiens
ggacuacaggcaugugaua

SEQ ID NO: 1541349 - RNA, 19 nt, Homo sapiens
acacacaggucuaccagaa

SEQ ID NO: 1541350 - RNA, 19 nt, Homo sapiens
ggucagaggugccaguagu

SEQ ID NO: 1541351 - RNA, 19 nt, Homo sapiens
uagggaacaucauuaagaa

SEQ ID NO: 1541352 - RNA, 19 nt, Homo sapiens
cuacaggcaugugauauga

SEQ ID NO: 1541353 - RNA, 19 nt, Homo sapiens
caucucagccuccagagua

SEQ ID NO: 1541354 - RNA, 19 nt, Homo sapiens
ugaucuagaugaagaaaug

SEQ ID NO: 1541355 - RNA, 19 nt, Homo sapiens
ccagguccauggaaagaaa

SEQ ID NO: 1541356 - RNA, 19 nt, Homo sapiens
gaugaaggcuuuuccagaa

SEQ ID NO: 1541357 - RNA, 19 nt, Homo sapiens
gcagaagacccuugaugga

SEQ ID NO: 1541358 - RNA, 19 nt, Homo sapiens
uggcugugcucccaacaua

SEQ ID NO: 1541359 - RNA, 19 nt, Homo sapiens
gaauugcaccaucgugaaa

SEQ ID NO: 1541360 - RNA, 19 nt, Homo sapiens
gaaagccuaugggaaaugg

SEQ ID NO: 1541361 - RNA, 19 nt, Homo sapiens
cgaggaugauucugaguau

SEQ ID NO: 1541362 - RNA, 19 nt, Homo sapiens
gaaccugacgucuaagugu

SEQ ID NO: 1541363 - RNA, 19 nt, Homo sapiens
ggaugauucugaguauuug

SEQ ID NO: 1541364 - RNA, 19 nt, Homo sapiens
ugucagcuuugguuuguuu

SEQ ID NO: 1541365 - RNA, 19 nt, Homo sapiens
gggcuagggaacaucauua

SEQ ID NO: 1541366 - RNA, 19 nt, Homo sapiens
gcgaggaugauucugagua

SEQ ID NO: 1541367 - RNA, 19 nt, Homo sapiens
gaagagaacggcggagaca

SEQ ID NO: 1541368 - RNA, 19 nt, Homo sapiens
ggacuuggugcauuucaga

SEQ ID NO: 1541369 - RNA, 19 nt, Homo sapiens
gcugcuuguuuacuccuua

SEQ ID NO: 1541370 - RNA, 19 nt, Homo sapiens
ucaguuaauucauccuguu

SEQ ID NO: 1541371 - RNA, 19 nt, Homo sapiens
cuagggaacaucauuaaga

SEQ ID NO: 1541372 - RNA, 19 nt, Homo sapiens
ugggaaagcaguggucuua

SEQ ID NO: 1541373 - RNA, 19 nt, Homo sapiens
gaggaugauucugaguauu

SEQ ID NO: 1541374 - RNA, 19 nt, Homo sapiens
gaaaauaaagcucacuguu

SEQ ID NO: 1541375 - RNA, 19 nt, Homo sapiens
acacaggucuaccagaaag

SEQ ID NO: 1541376 - RNA, 19 nt, Homo sapiens
gggagguccugguggauca

SEQ ID NO: 1541377 - RNA, 19 nt, Homo sapiens
ggugacuguugauuuguug

SEQ ID NO: 1541378 - RNA, 19 nt, Homo sapiens
agaggugccaguaguauaa

SEQ ID NO: 1541379 - RNA, 19 nt, Homo sapiens
gcagugccaguucuccuaa

SEQ ID NO: 1541380 - RNA, 19 nt, Homo sapiens
ucaggcauccaacugguua

SEQ ID NO: 1541381 - RNA, 19 nt, Homo sapiens
caagggcuguggagaaacu

SEQ ID NO: 1541382 - RNA, 19 nt, Homo sapiens
gguuugaacuccuacaacu

SEQ ID NO: 1541383 - RNA, 19 nt, Homo sapiens
acacccagguccauggaaa

SEQ ID NO: 1541384 - RNA, 19 nt, Homo sapiens
cuaguucaguuaauucauc

SEQ ID NO: 1541385 - RNA, 19 nt, Homo sapiens
acaggcaugugauaugaug

SEQ ID NO: 1541386 - RNA, 19 nt, Homo sapiens
gggcagcaguaagaagcua

SEQ ID NO: 1541387 - RNA, 19 nt, Homo sapiens
gccaccaggucaugaagga

SEQ ID NO: 1541388 - RNA, 19 nt, Homo sapiens
ccaagaaagccaacaagag

SEQ ID NO: 1541389 - RNA, 19 nt, Homo sapiens
gggcagaagacccuugaug

SEQ ID NO: 1541390 - RNA, 19 nt, Homo sapiens
gauguuaaggcccuccauu

SEQ ID NO: 1541391 - RNA, 19 nt, Homo sapiens
ccaccuguccaucuccaua

SEQ ID NO: 1541392 - RNA, 19 nt, Homo sapiens
gcagaccgcagcacacaca

SEQ ID NO: 1541393 - RNA, 19 nt, Homo sapiens
cuccuuaagucaauguauu

SEQ ID NO: 1541394 - RNA, 19 nt, Homo sapiens
cagaggugccaguaguaua

SEQ ID NO: 1541395 - RNA, 19 nt, Homo sapiens
gccaagaaagccaacaaga

SEQ ID NO: 1541396 - RNA, 19 nt, Homo sapiens
aggaugauucugaguauuu

SEQ ID NO: 1541397 - RNA, 19 nt, Homo sapiens
ggccguuggugaggaaauu

SEQ ID NO: 1541398 - RNA, 19 nt, Homo sapiens
ccggugguguguagagaaa

SEQ ID NO: 1541399 - RNA, 19 nt, Homo sapiens
aaaucgugaugauggguaa

SEQ ID NO: 1541400 - RNA, 19 nt, Homo sapiens
ccaucgaggacaagccuua

SEQ ID NO: 1541401 - RNA, 19 nt, Homo sapiens
cauccugucugagaaguuc

SEQ ID NO: 1541402 - RNA, 19 nt, Homo sapiens
aaucaagggcuguggagaa

SEQ ID NO: 1541403 - RNA, 19 nt, Homo sapiens
ucaagcagucuucaucuca

SEQ ID NO: 1541404 - RNA, 19 nt, Homo sapiens
gccaguaguauaauauuca

SEQ ID NO: 1541405 - RNA, 19 nt, Homo sapiens
gcucagccugucugcuaua

SEQ ID NO: 1541406 - RNA, 19 nt, Homo sapiens
cgagguugguccugcacuu

SEQ ID NO: 1541407 - RNA, 19 nt, Homo sapiens
gagccaagaaagccaacaa

SEQ ID NO: 1541408 - RNA, 19 nt, Homo sapiens
cgugucagcuuugguuugu

SEQ ID NO: 1541409 - RNA, 19 nt, Homo sapiens
cugaguauuuggagagaga

SEQ ID NO: 1541410 - RNA, 19 nt, Homo sapiens
cagaagacccuugauggau

SEQ ID NO: 1541411 - RNA, 19 nt, Homo sapiens
ccagagcagugccaguucu

SEQ ID NO: 1541412 - RNA, 19 nt, Homo sapiens
auaauugucaguugucuug

SEQ ID NO: 1541413 - RNA, 19 nt, Homo sapiens
aagaaagccuaugggaaau

SEQ ID NO: 1541414 - RNA, 19 nt, Homo sapiens
ggcuagggaacaucauuaa

SEQ ID NO: 1541415 - RNA, 19 nt, Homo sapiens
cuuggugcauuucagauga

SEQ ID NO: 1541416 - RNA, 19 nt, Homo sapiens
gagguugguccugcacuuu

SEQ ID NO: 1541417 - RNA, 19 nt, Homo sapiens
auuggugacuguugauuug

SEQ ID NO: 1541418 - RNA, 19 nt, Homo sapiens
uuaagaaugaagccuugua

SEQ ID NO: 1541419 - RNA, 19 nt, Homo sapiens
caccagagccuccacaaaa

SEQ ID NO: 1541420 - RNA, 19 nt, Homo sapiens
aacauagcuuugcagauga

SEQ ID NO: 1541421 - RNA, 19 nt, Homo sapiens
gaggauagugugggucaga

SEQ ID NO: 1541422 - RNA, 19 nt, Homo sapiens
uggaucacgugguggaguu

SEQ ID NO: 1541423 - RNA, 19 nt, Homo sapiens
uuucaggacuuggugcauu

SEQ ID NO: 1541424 - RNA, 19 nt, Homo sapiens
uucaggacuuggugcauuu

SEQ ID NO: 1541425 - RNA, 19 nt, Homo sapiens
uaugaugcucggcugauuu

SEQ ID NO: 1541426 - RNA, 19 nt, Homo sapiens
ugaauugcaccaucgugaa

SEQ ID NO: 1541427 - RNA, 19 nt, Homo sapiens
ccacguguccggagauuuu

SEQ ID NO: 1541428 - RNA, 19 nt, Homo sapiens
guuuacuccuuaagucaau

SEQ ID NO: 1541429 - RNA, 19 nt, Homo sapiens
ggaaccugacgucuaagug

SEQ ID NO: 1541430 - RNA, 19 nt, Homo sapiens
ccauggaaagaaauuauuc

SEQ ID NO: 1541431 - RNA, 19 nt, Homo sapiens
aucaagggcuguggagaaa

SEQ ID NO: 1541432 - RNA, 19 nt, Homo sapiens
uccuacaacucaagcauuc

SEQ ID NO: 1541433 - RNA, 19 nt, Homo sapiens
uggggaaccugacgucuaa

SEQ ID NO: 1541434 - RNA, 19 nt, Homo sapiens
gcccgaagauggguuacag

SEQ ID NO: 1541435 - RNA, 19 nt, Homo sapiens
ucccuggaguuauguugaa

SEQ ID NO: 1541436 - RNA, 19 nt, Homo sapiens
ggucaugaaggaggcguuu

SEQ ID NO: 1541437 - RNA, 19 nt, Homo sapiens
ggaaguaucucuuggaguu

SEQ ID NO: 1541438 - RNA, 19 nt, Homo sapiens
gaaggaggcugcacuacaa

SEQ ID NO: 1541439 - RNA, 19 nt, Homo sapiens
agaaggcuauucacaauua

SEQ ID NO: 1541440 - RNA, 19 nt, Homo sapiens
ggaagguacugguccaauu

SEQ ID NO: 1541441 - RNA, 19 nt, Homo sapiens
caagaaggcuauucacaau

SEQ ID NO: 1541442 - RNA, 19 nt, Homo sapiens
guacugguccaauuuauuu

SEQ ID NO: 1541443 - RNA, 19 nt, Homo sapiens
gaacaaagaugagguaacc

SEQ ID NO: 1541444 - RNA, 19 nt, Homo sapiens
gcaagaaggcuauucacaa

SEQ ID NO: 1541445 - RNA, 19 nt, Homo sapiens
gcagaugucagcaauacua

SEQ ID NO: 1541446 - RNA, 19 nt, Homo sapiens
gaagguacugguccaauuu

SEQ ID NO: 1541447 - RNA, 19 nt, Homo sapiens
ggacuggcuuccucuuuga

SEQ ID NO: 1541448 - RNA, 19 nt, Homo sapiens
gauguuaccugguuugucu

SEQ ID NO: 1541449 - RNA, 19 nt, Homo sapiens
gcaagcguguaagauguua

SEQ ID NO: 1541450 - RNA, 19 nt, Homo sapiens
ggacauguuugugguguga

SEQ ID NO: 1541451 - RNA, 19 nt, Homo sapiens
gaagacagacaguagagaa

SEQ ID NO: 1541452 - RNA, 19 nt, Homo sapiens
gguagacucuucccuagga

SEQ ID NO: 1541453 - RNA, 19 nt, Homo sapiens
cagaagccaucaccuaaug

SEQ ID NO: 1541454 - RNA, 19 nt, Homo sapiens
gggaagagguggacaucug

SEQ ID NO: 1541455 - RNA, 19 nt, Homo sapiens
gcacaaagcccugggagau

SEQ ID NO: 1541456 - RNA, 19 nt, Homo sapiens
agaagcaccucaacaaugu

SEQ ID NO: 1541457 - RNA, 19 nt, Homo sapiens
gaagauggccuccaagaac

SEQ ID NO: 1541458 - RNA, 19 nt, Homo sapiens
caaacaagcccucagugaa

SEQ ID NO: 1541459 - RNA, 19 nt, Homo sapiens
gggauguucuggaggauga

SEQ ID NO: 1541460 - RNA, 19 nt, Homo sapiens
caucacagcuggcauucug

SEQ ID NO: 1541461 - RNA, 19 nt, Homo sapiens
gcacaaggacugacucaag

SEQ ID NO: 1541462 - RNA, 19 nt, Homo sapiens
gcugaaggcuggguuugaa

SEQ ID NO: 1541463 - RNA, 19 nt, Homo sapiens
acaaugaacccaauaacaa

SEQ ID NO: 1541464 - RNA, 19 nt, Homo sapiens
gaaagaucaucaguuugga

SEQ ID NO: 1541465 - RNA, 19 nt, Homo sapiens
acaaagcccugggagauga

SEQ ID NO: 1541466 - RNA, 19 nt, Homo sapiens
caagaacaaagaugaggua

SEQ ID NO: 1541467 - RNA, 19 nt, Homo sapiens
cauccaggguuccaugaaa

SEQ ID NO: 1541468 - RNA, 19 nt, Homo sapiens
gcacuacaaacccaaauuc

SEQ ID NO: 1541469 - RNA, 19 nt, Homo sapiens
gaugaugauuauccaacaa

SEQ ID NO: 1541470 - RNA, 19 nt, Homo sapiens
uuagagcaauaaccacuuu

SEQ ID NO: 1541471 - RNA, 19 nt, Homo sapiens
gggcagaugucagcaauac

SEQ ID NO: 1541472 - RNA, 19 nt, Homo sapiens
cccuaggacugacgaguua

SEQ ID NO: 1541473 - RNA, 19 nt, Homo sapiens
guccucauguccuuccuua

SEQ ID NO: 1541474 - RNA, 19 nt, Homo sapiens
ccaaacaagcccucaguga

SEQ ID NO: 1541475 - RNA, 19 nt, Homo sapiens
gagguaaccaugaaagaga

SEQ ID NO: 1541476 - RNA, 19 nt, Homo sapiens
gagaagauggccuccaaga

SEQ ID NO: 1541477 - RNA, 19 nt, Homo sapiens
gccagaagccaucaccuaa

SEQ ID NO: 1541478 - RNA, 19 nt, Homo sapiens
gaaaugcuagcuuggacaa

SEQ ID NO: 1541479 - RNA, 19 nt, Homo sapiens
cauccucuaucuucuuuga

SEQ ID NO: 1541480 - RNA, 19 nt, Homo sapiens
caaggacaaugaacccaau

SEQ ID NO: 1541481 - RNA, 19 nt, Homo sapiens
gaucaucaguuuggaaggu

SEQ ID NO: 1541482 - RNA, 19 nt, Homo sapiens
aagaugagguaaccaugaa

SEQ ID NO: 1541483 - RNA, 19 nt, Homo sapiens
uuaccugguuugucucuuu

SEQ ID NO: 1541484 - RNA, 19 nt, Homo sapiens
cuacaucucuucccuccau

SEQ ID NO: 1541485 - RNA, 19 nt, Homo sapiens
gacagacaguagagaaugu

SEQ ID NO: 1541486 - RNA, 19 nt, Homo sapiens
gggaggagagacaggauaa

SEQ ID NO: 1541487 - RNA, 19 nt, Homo sapiens
ugaaagaucaucaguuugg

SEQ ID NO: 1541488 - RNA, 19 nt, Homo sapiens
ugacucaagcugugucuuu

SEQ ID NO: 1541489 - RNA, 19 nt, Homo sapiens
cagaagcaccucaacaaug

SEQ ID NO: 1541490 - RNA, 19 nt, Homo sapiens
gguccaauuuauuuaggaa

SEQ ID NO: 1541491 - RNA, 19 nt, Homo sapiens
ccuuaugacugaaagauca

SEQ ID NO: 1541492 - RNA, 19 nt, Homo sapiens
guggugagcugggauguuc

SEQ ID NO: 1541493 - RNA, 19 nt, Homo sapiens
gagaugacaagcacaagga

SEQ ID NO: 1541494 - RNA, 19 nt, Homo sapiens
gaugaaggaggcugcacua

SEQ ID NO: 1541495 - RNA, 19 nt, Homo sapiens
gacaaugaacccaauaaca

SEQ ID NO: 1541496 - RNA, 19 nt, Homo sapiens
gcuaagaagacagacagua

SEQ ID NO: 1541497 - RNA, 19 nt, Homo sapiens
acaguucucucuucuccuu

SEQ ID NO: 1541498 - RNA, 19 nt, Homo sapiens
gaaggcuauucacaauuag

SEQ ID NO: 1541499 - RNA, 19 nt, Homo sapiens
ugaagccucuuauuaacuc

SEQ ID NO: 1541500 - RNA, 19 nt, Homo sapiens
aaacaccccuucuggagua

SEQ ID NO: 1541501 - RNA, 19 nt, Homo sapiens
gaccaaggaacaucagaga

SEQ ID NO: 1541502 - RNA, 19 nt, Homo sapiens
gggagaaccacaccuagug

SEQ ID NO: 1541503 - RNA, 19 nt, Homo sapiens
ucacaucacagcuggcauu

SEQ ID NO: 1541504 - RNA, 19 nt, Homo sapiens
gcugcucccuuccuucuuc

SEQ ID NO: 1541505 - RNA, 19 nt, Homo sapiens
uaagaagacagacaguaga

SEQ ID NO: 1541506 - RNA, 19 nt, Homo sapiens
ccaaggaacaucagagaag

SEQ ID NO: 1541507 - RNA, 19 nt, Homo sapiens
ggauaaagggcagauguca

SEQ ID NO: 1541508 - RNA, 19 nt, Homo sapiens
ccucauguccuuccuuaga

SEQ ID NO: 1541509 - RNA, 19 nt, Homo sapiens
cuucauaucuugccaucuc

SEQ ID NO: 1541510 - RNA, 19 nt, Homo sapiens
ggaggauacggaguacaua

SEQ ID NO: 1541511 - RNA, 19 nt, Homo sapiens
uggacuggcuuccucuuug

SEQ ID NO: 1541512 - RNA, 19 nt, Homo sapiens
gaggaucucaugguucuga

SEQ ID NO: 1541513 - RNA, 19 nt, Homo sapiens
aaagaugagguaaccauga

SEQ ID NO: 1541514 - RNA, 19 nt, Homo sapiens
cugagaagauggccuccaa

SEQ ID NO: 1541515 - RNA, 19 nt, Homo sapiens
ccaggcagggcuucucuuu

SEQ ID NO: 1541516 - RNA, 19 nt, Homo sapiens
uaacucccaucuccagaag

SEQ ID NO: 1541517 - RNA, 19 nt, Homo sapiens
uuccugaagccucuuauua

SEQ ID NO: 1541518 - RNA, 19 nt, Homo sapiens
ccuuguacccucuggcuua

SEQ ID NO: 1541519 - RNA, 19 nt, Homo sapiens
gacaguagagaaugugaga

SEQ ID NO: 1541520 - RNA, 19 nt, Homo sapiens
gggcuucuccgcagcaaga

SEQ ID NO: 1541521 - RNA, 19 nt, Homo sapiens
aaaccaagagugcaucaga

SEQ ID NO: 1541522 - RNA, 19 nt, Homo sapiens
ccacuuagagcaauaacca

SEQ ID NO: 1541523 - RNA, 19 nt, Homo sapiens
caggguuccaugaaaguua

SEQ ID NO: 1541524 - RNA, 19 nt, Homo sapiens
gaaguaucucuuggaguuu

SEQ ID NO: 1541525 - RNA, 19 nt, Homo sapiens
aagauggccuccaagaaca

SEQ ID NO: 1541526 - RNA, 19 nt, Homo sapiens
gguacugguccaauuuauu

SEQ ID NO: 1541527 - RNA, 19 nt, Homo sapiens
uaucuucuuugacccuuau

SEQ ID NO: 1541528 - RNA, 19 nt, Homo sapiens
gcgugaggcugagaagaug

SEQ ID NO: 1541529 - RNA, 19 nt, Homo sapiens
ccacaagggacaagagcuu

SEQ ID NO: 1541530 - RNA, 19 nt, Homo sapiens
cuaagaagacagacaguag

SEQ ID NO: 1541531 - RNA, 19 nt, Homo sapiens
aaccaagagugcaucagaa

SEQ ID NO: 1541532 - RNA, 19 nt, Homo sapiens
ccaggguccucauguccuu

SEQ ID NO: 1541533 - RNA, 19 nt, Homo sapiens
gcagggagaaggauuccau

SEQ ID NO: 1541534 - RNA, 19 nt, Homo sapiens
aaacaagcccucagugaac

SEQ ID NO: 1541535 - RNA, 19 nt, Homo sapiens
ccugaagccucuuauuaac

SEQ ID NO: 1541536 - RNA, 19 nt, Homo sapiens
gaggagagacaggauaaag

SEQ ID NO: 1541537 - RNA, 19 nt, Homo sapiens
ggacagaucccaaaguaua

SEQ ID NO: 1541538 - RNA, 19 nt, Homo sapiens
gaagaaggaguuuaguuua

SEQ ID NO: 1541539 - RNA, 19 nt, Homo sapiens
gaagagauauauaccaaca

SEQ ID NO: 1541540 - RNA, 19 nt, Homo sapiens
caaagaaagucucacagau

SEQ ID NO: 1541541 - RNA, 19 nt, Homo sapiens
gcauggaagcuacauauaa

SEQ ID NO: 1541542 - RNA, 19 nt, Homo sapiens
gaaggaguuuaguuuagaa

SEQ ID NO: 1541543 - RNA, 19 nt, Homo sapiens
ccgagaagcuauccauauu

SEQ ID NO: 1541544 - RNA, 19 nt, Homo sapiens
gcagaguccuauccauuug

SEQ ID NO: 1541545 - RNA, 19 nt, Homo sapiens
cuaagcaguuucucucuuu

SEQ ID NO: 1541546 - RNA, 19 nt, Homo sapiens
uaaagauacuaaccacuga

SEQ ID NO: 1541547 - RNA, 19 nt, Homo sapiens
gaaaucucuucucuucauu

SEQ ID NO: 1541548 - RNA, 19 nt, Homo sapiens
cgaaaucucuucucuucau

SEQ ID NO: 1541549 - RNA, 19 nt, Homo sapiens
gagaagcuauccauauugg

SEQ ID NO: 1541550 - RNA, 19 nt, Homo sapiens
ucugaaaucuucccaguau

SEQ ID NO: 1541551 - RNA, 19 nt, Homo sapiens
gagaaagacucgccuaagc

SEQ ID NO: 1541552 - RNA, 19 nt, Homo sapiens
gagaagaggccaaagaaag

SEQ ID NO: 1541553 - RNA, 19 nt, Homo sapiens
ggaagacacuggcguccau

SEQ ID NO: 1541554 - RNA, 19 nt, Homo sapiens
aagaaagucucacagauuc

SEQ ID NO: 1541555 - RNA, 19 nt, Homo sapiens
ccaguauccuuucauguga

SEQ ID NO: 1541556 - RNA, 19 nt, Homo sapiens
aaagaaagucucacagauu

SEQ ID NO: 1541557 - RNA, 19 nt, Homo sapiens
agaagaaggaguuuaguuu

SEQ ID NO: 1541558 - RNA, 19 nt, Homo sapiens
cagaaccacuccuuaagau

SEQ ID NO: 1541559 - RNA, 19 nt, Homo sapiens
gcagaagaaucgcuugaac

SEQ ID NO: 1541560 - RNA, 19 nt, Homo sapiens
gaaaucauccagcucagau

SEQ ID NO: 1541561 - RNA, 19 nt, Homo sapiens
gaaccacuccuuaagaucu

SEQ ID NO: 1541562 - RNA, 19 nt, Homo sapiens
gcccugggauggcaacauu

SEQ ID NO: 1541563 - RNA, 19 nt, Homo sapiens
ccaaagaaagucucacaga

SEQ ID NO: 1541564 - RNA, 19 nt, Homo sapiens
gcccucgucuccaaauaaa

SEQ ID NO: 1541565 - RNA, 19 nt, Homo sapiens
gaguuuaguuuagaagaga

SEQ ID NO: 1541566 - RNA, 19 nt, Homo sapiens
gggcagaguccuauccauu

SEQ ID NO: 1541567 - RNA, 19 nt, Homo sapiens
gacaaggucuucuguucuc

SEQ ID NO: 1541568 - RNA, 19 nt, Homo sapiens
agaaggaguuuaguuuaga

SEQ ID NO: 1541569 - RNA, 19 nt, Homo sapiens
ggcagaguccuauccauuu

SEQ ID NO: 1541570 - RNA, 19 nt, Homo sapiens
cagcuccucuccaagacua

SEQ ID NO: 1541571 - RNA, 19 nt, Homo sapiens
ggaguuuaguuuagaagag

SEQ ID NO: 1541572 - RNA, 19 nt, Homo sapiens
ugagcuggauggugugaaa

SEQ ID NO: 1541573 - RNA, 19 nt, Homo sapiens
ccuaaguggucuuccuaaa

SEQ ID NO: 1541574 - RNA, 19 nt, Homo sapiens
aagaaggaguuuaguuuag

SEQ ID NO: 1541575 - RNA, 19 nt, Homo sapiens
cauggaagcuacauauaac

SEQ ID NO: 1541576 - RNA, 19 nt, Homo sapiens
ggaggcugcuaguccuuug

SEQ ID NO: 1541577 - RNA, 19 nt, Homo sapiens
cagagaagaggccaaagaa

SEQ ID NO: 1541578 - RNA, 19 nt, Homo sapiens
gcuguuugguucugaaauc

SEQ ID NO: 1541579 - RNA, 19 nt, Homo sapiens
gccacaccauguuaccaua

SEQ ID NO: 1541580 - RNA, 19 nt, Homo sapiens
ucacacacuucuagcacuu

SEQ ID NO: 1541581 - RNA, 19 nt, Homo sapiens
agagauauauaccaacaag

SEQ ID NO: 1541582 - RNA, 19 nt, Homo sapiens
ccagagaagaggccaaaga

SEQ ID NO: 1541583 - RNA, 19 nt, Homo sapiens
ugucagaaccacuccuuaa

SEQ ID NO: 1541584 - RNA, 19 nt, Homo sapiens
cugaaacacugcaaacaca

SEQ ID NO: 1541585 - RNA, 19 nt, Homo sapiens
ucagaaccacuccuuaaga

SEQ ID NO: 1541586 - RNA, 19 nt, Homo sapiens
gggagaaagacucgccuaa

SEQ ID NO: 1541587 - RNA, 19 nt, Homo sapiens
gguuaaagaagaaggaguu

SEQ ID NO: 1541588 - RNA, 19 nt, Homo sapiens
ccaaaagguuaaagaagaa

SEQ ID NO: 1541589 - RNA, 19 nt, Homo sapiens
uccauucccugccuuggua

SEQ ID NO: 1541590 - RNA, 19 nt, Homo sapiens
ugaaauggucgcugaaaca

SEQ ID NO: 1541591 - RNA, 19 nt, Homo sapiens
auaaaucuccuccugcaaa

SEQ ID NO: 1541592 - RNA, 19 nt, Homo sapiens
acacuggcguccauaguca

SEQ ID NO: 1541593 - RNA, 19 nt, Homo sapiens
ggagaaagacucgccuaag

SEQ ID NO: 1541594 - RNA, 19 nt, Homo sapiens
gggagggucacgugguuaa

SEQ ID NO: 1541595 - RNA, 19 nt, Homo sapiens
uucgaaaucucuucucuuc

SEQ ID NO: 1541596 - RNA, 19 nt, Homo sapiens
gagcuucuccagccacaug

SEQ ID NO: 1541597 - RNA, 19 nt, Homo sapiens
gaagacacuggcguccaua

SEQ ID NO: 1541598 - RNA, 19 nt, Homo sapiens
aagcagccacaccauguua

SEQ ID NO: 1541599 - RNA, 19 nt, Homo sapiens
ccuaagcaguuucucucuu

SEQ ID NO: 1541600 - RNA, 19 nt, Homo sapiens
ggaagcugaggcagaagaa

SEQ ID NO: 1541601 - RNA, 19 nt, Homo sapiens
cgagaagcuauccauauug

SEQ ID NO: 1541602 - RNA, 19 nt, Homo sapiens
ucauagauuugagcaacaa

SEQ ID NO: 1541603 - RNA, 19 nt, Homo sapiens
ggcauggaagcuacauaua

SEQ ID NO: 1541604 - RNA, 19 nt, Homo sapiens
ucgggaagcugaggcagaa

SEQ ID NO: 1541605 - RNA, 19 nt, Homo sapiens
gggccuuccucgacccaaa

SEQ ID NO: 1541606 - RNA, 19 nt, Homo sapiens
agacucgccuaagcaguuu

SEQ ID NO: 1541607 - RNA, 19 nt, Homo sapiens
agaagaggccaaagaaagu

SEQ ID NO: 1541608 - RNA, 19 nt, Homo sapiens
acacacuucuagcacuuug

SEQ ID NO: 1541609 - RNA, 19 nt, Homo sapiens
gaccuuuucuuucuucuug

SEQ ID NO: 1541610 - RNA, 19 nt, Homo sapiens
ccaaguggaccuuuucuuu

SEQ ID NO: 1541611 - RNA, 19 nt, Homo sapiens
gggcggaucacuugagaca

SEQ ID NO: 1541612 - RNA, 19 nt, Homo sapiens
uaaaucuccuccugcaaac

SEQ ID NO: 1541613 - RNA, 19 nt, Homo sapiens
cccaaaagguuaaagaaga

SEQ ID NO: 1541614 - RNA, 19 nt, Homo sapiens
ggguugcccucgucuccaa

SEQ ID NO: 1541615 - RNA, 19 nt, Homo sapiens
caguuucucucuuuucuuu

SEQ ID NO: 1541616 - RNA, 19 nt, Homo sapiens
ccuguaaucccagcacuuu

SEQ ID NO: 1541617 - RNA, 19 nt, Homo sapiens
gaagaggccaaagaaaguc

SEQ ID NO: 1541618 - RNA, 19 nt, Homo sapiens
ccucgucuccaaauaaaga

SEQ ID NO: 1541619 - RNA, 19 nt, Homo sapiens
guuugguucugaaaucuuc

SEQ ID NO: 1541620 - RNA, 19 nt, Homo sapiens
aagaagaaggaguuuaguu

SEQ ID NO: 1541621 - RNA, 19 nt, Homo sapiens
aaucuucccaguauccuuu

SEQ ID NO: 1541622 - RNA, 19 nt, Homo sapiens
gggaagcugaggcagaaga

SEQ ID NO: 1541623 - RNA, 19 nt, Homo sapiens
cacaccauguuaccauaug

SEQ ID NO: 1541624 - RNA, 19 nt, Homo sapiens
acaagcagccacaccaugu

SEQ ID NO: 1541625 - RNA, 19 nt, Homo sapiens
cccaggauguuaccgaauc

SEQ ID NO: 1541626 - RNA, 19 nt, Homo sapiens
gacagaucccaaaguauag

SEQ ID NO: 1541627 - RNA, 19 nt, Homo sapiens
ccuggugacucuacuaaaa

SEQ ID NO: 1541628 - RNA, 19 nt, Homo sapiens
caaccuggugacucuacua

SEQ ID NO: 1541629 - RNA, 19 nt, Homo sapiens
gagggucacgugguuaaga

SEQ ID NO: 1541630 - RNA, 19 nt, Homo sapiens
guagcagaaucagcuguca

SEQ ID NO: 1541631 - RNA, 19 nt, Homo sapiens
agaagaaucgcuugaacuc

SEQ ID NO: 1541632 - RNA, 19 nt, Homo sapiens
agagaagaggccaaagaaa

SEQ ID NO: 1541633 - RNA, 19 nt, Homo sapiens
gagccagcaugguccuucu

SEQ ID NO: 1541634 - RNA, 19 nt, Homo sapiens
uaaguggucuuccuaaaac

SEQ ID NO: 1541635 - RNA, 19 nt, Homo sapiens
gaaauggucgcugaaacac

SEQ ID NO: 1541636 - RNA, 19 nt, Homo sapiens
agaaagacucgccuaagca

SEQ ID NO: 1541637 - RNA, 19 nt, Homo sapiens
gagcaaacccucuucauuu

SEQ ID NO: 1541638 - RNA, 19 nt, Homo sapiens
gcaagguucuucugcaauu

SEQ ID NO: 1541639 - RNA, 19 nt, Homo sapiens
ucaaggaaaucgagcuuaa

SEQ ID NO: 1541640 - RNA, 19 nt, Homo sapiens
uaaaguaacuccuuauagg

SEQ ID NO: 1541641 - RNA, 19 nt, Homo sapiens
gaaacccugucucuacaaa

SEQ ID NO: 1541642 - RNA, 19 nt, Homo sapiens
ggaaaucgagcuuaaugaa

SEQ ID NO: 1541643 - RNA, 19 nt, Homo sapiens
acaaggcccugucugauuu

SEQ ID NO: 1541644 - RNA, 19 nt, Homo sapiens
guaaugcguuguuguuguu

SEQ ID NO: 1541645 - RNA, 19 nt, Homo sapiens
ugaauuaccucuuauuggu

SEQ ID NO: 1541646 - RNA, 19 nt, Homo sapiens
aaaucgagcuuaaugaaug

SEQ ID NO: 1541647 - RNA, 19 nt, Homo sapiens
ccucuaaaguaacuccuua

SEQ ID NO: 1541648 - RNA, 19 nt, Homo sapiens
cuugaugaauuaccucuua

SEQ ID NO: 1541649 - RNA, 19 nt, Homo sapiens
gcacauauagauagauuca

SEQ ID NO: 1541650 - RNA, 19 nt, Homo sapiens
caugucagcuugucaggaa

SEQ ID NO: 1541651 - RNA, 19 nt, Homo sapiens
guauucauguugacccaua

SEQ ID NO: 1541652 - RNA, 19 nt, Homo sapiens
ccaaggacauagaacauuc

SEQ ID NO: 1541653 - RNA, 19 nt, Homo sapiens
gggauaguauugcaagguu

SEQ ID NO: 1541654 - RNA, 19 nt, Homo sapiens
guccacaugucaucaguuu

SEQ ID NO: 1541655 - RNA, 19 nt, Homo sapiens
uuguguagcuuuccagaua

SEQ ID NO: 1541656 - RNA, 19 nt, Homo sapiens
gaaaucgagcuuaaugaau

SEQ ID NO: 1541657 - RNA, 19 nt, Homo sapiens
gaucucuguuccucucuuu

SEQ ID NO: 1541658 - RNA, 19 nt, Homo sapiens
gcaggcagucaccuucuua

SEQ ID NO: 1541659 - RNA, 19 nt, Homo sapiens
caaaugggauaguauugca

SEQ ID NO: 1541660 - RNA, 19 nt, Homo sapiens
auucacagcuucucauuug

SEQ ID NO: 1541661 - RNA, 19 nt, Homo sapiens
gcgaaacccugucucuaca

SEQ ID NO: 1541662 - RNA, 19 nt, Homo sapiens
guacugugccuugcauaua

SEQ ID NO: 1541663 - RNA, 19 nt, Homo sapiens
gguaaugcguuguuguugu

SEQ ID NO: 1541664 - RNA, 19 nt, Homo sapiens
gaugaauuaccucuuauug

SEQ ID NO: 1541665 - RNA, 19 nt, Homo sapiens
gaguuugacuucuaaggau

SEQ ID NO: 1541666 - RNA, 19 nt, Homo sapiens
aaucagccaccaugucuua

SEQ ID NO: 1541667 - RNA, 19 nt, Homo sapiens
aauaagagcucaguguauc

SEQ ID NO: 1541668 - RNA, 19 nt, Homo sapiens
uacugugccuugcauauaa

SEQ ID NO: 1541669 - RNA, 19 nt, Homo sapiens
uuaaaccucuugggauaaa

SEQ ID NO: 1541670 - RNA, 19 nt, Homo sapiens
ccuccagacucuuucauga

SEQ ID NO: 1541671 - RNA, 19 nt, Homo sapiens
auaaauuccuggcaacgaa

SEQ ID NO: 1541672 - RNA, 19 nt, Homo sapiens
caagguucuucugcaauuu

SEQ ID NO: 1541673 - RNA, 19 nt, Homo sapiens
gucccuaauuccuucuuua

SEQ ID NO: 1541674 - RNA, 19 nt, Homo sapiens
gaucucggcuccaguuucg

SEQ ID NO: 1541675 - RNA, 19 nt, Homo sapiens
ucagugaaugcucuuguua

SEQ ID NO: 1541676 - RNA, 19 nt, Homo sapiens
gcauuuguugccauuauuu

SEQ ID NO: 1541677 - RNA, 19 nt, Homo sapiens
caggaaggguccaucaauc

SEQ ID NO: 1541678 - RNA, 19 nt, Homo sapiens
cagaucggauugcucuuug

SEQ ID NO: 1541679 - RNA, 19 nt, Homo sapiens
ggccaggaaugaucucugu

SEQ ID NO: 1541680 - RNA, 19 nt, Homo sapiens
ccacucaucugcugcuucu

SEQ ID NO: 1541681 - RNA, 19 nt, Homo sapiens
cuacaaaugggauaguauu

SEQ ID NO: 1541682 - RNA, 19 nt, Homo sapiens
gacauuccagucucugaua

SEQ ID NO: 1541683 - RNA, 19 nt, Homo sapiens
cuaaggauacauuugguaa

SEQ ID NO: 1541684 - RNA, 19 nt, Homo sapiens
gcauacuuguaaaucugua

SEQ ID NO: 1541685 - RNA, 19 nt, Homo sapiens
ccauggcgcuccugcuuuc

SEQ ID NO: 1541686 - RNA, 19 nt, Homo sapiens
uccagucucugauagcuuu

SEQ ID NO: 1541687 - RNA, 19 nt, Homo sapiens
acacacacacacacacaua

SEQ ID NO: 1541688 - RNA, 19 nt, Homo sapiens
uguaagauaggaaguacua

SEQ ID NO: 1541689 - RNA, 19 nt, Homo sapiens
ccuaauuccuucuuuaacu

SEQ ID NO: 1541690 - RNA, 19 nt, Homo sapiens
auucaaagcaguagagaaa

SEQ ID NO: 1541691 - RNA, 19 nt, Homo sapiens
uaauaagagcucaguguau

SEQ ID NO: 1541692 - RNA, 19 nt, Homo sapiens
ccuacuacguguccaccua

SEQ ID NO: 1541693 - RNA, 19 nt, Homo sapiens
uugcugaguuugacuucua

SEQ ID NO: 1541694 - RNA, 19 nt, Homo sapiens
ucggauugcucuuugauag

SEQ ID NO: 1541695 - RNA, 19 nt, Homo sapiens
ggaaaaugccggucuccua

SEQ ID NO: 1541696 - RNA, 19 nt, Homo sapiens
agaagcagaguauucguuu

SEQ ID NO: 1541697 - RNA, 19 nt, Homo sapiens
uaaaaguccccuagugaua

SEQ ID NO: 1541698 - RNA, 19 nt, Homo sapiens
gccaucaccuccacuguac

SEQ ID NO: 1541699 - RNA, 19 nt, Homo sapiens
cuucugcuguugcuggaua

SEQ ID NO: 1541700 - RNA, 19 nt, Homo sapiens
ccacccaauucaacuuaau

SEQ ID NO: 1541701 - RNA, 19 nt, Homo sapiens
guugacccauaagacauua

SEQ ID NO: 1541702 - RNA, 19 nt, Homo sapiens
gagcggauggucagagaug

SEQ ID NO: 1541703 - RNA, 19 nt, Homo sapiens
ggucccuaauuccuucuuu

SEQ ID NO: 1541704 - RNA, 19 nt, Homo sapiens
aaucgagcuuaaugaauga

SEQ ID NO: 1541705 - RNA, 19 nt, Homo sapiens
auaauaagagcucagugua

SEQ ID NO: 1541706 - RNA, 19 nt, Homo sapiens
cacccucacuuccucuaaa

SEQ ID NO: 1541707 - RNA, 19 nt, Homo sapiens
uaaguuaguucuucuucac

SEQ ID NO: 1541708 - RNA, 19 nt, Homo sapiens
ugacuucuaaggauacauu

SEQ ID NO: 1541709 - RNA, 19 nt, Homo sapiens
guaccaaggacauagaaca

SEQ ID NO: 1541710 - RNA, 19 nt, Homo sapiens
ugucuuaccugccuuuagg

SEQ ID NO: 1541711 - RNA, 19 nt, Homo sapiens
caccuccacuguaccaaga

SEQ ID NO: 1541712 - RNA, 19 nt, Homo sapiens
uauaauaagagcucagugu

SEQ ID NO: 1541713 - RNA, 19 nt, Homo sapiens
ccccaaaaguugaauauug

SEQ ID NO: 1541714 - RNA, 19 nt, Homo sapiens
caacacacacacacacaca

SEQ ID NO: 1541715 - RNA, 19 nt, Homo sapiens
uacaaggcccugucugauu

SEQ ID NO: 1541716 - RNA, 19 nt, Homo sapiens
guguagcuuuccagauauu

SEQ ID NO: 1541717 - RNA, 19 nt, Homo sapiens
guacuagccugggcaacgu

SEQ ID NO: 1541718 - RNA, 19 nt, Homo sapiens
gagcucaguguaucagaug

SEQ ID NO: 1541719 - RNA, 19 nt, Homo sapiens
ggauugcucuuugauagcu

SEQ ID NO: 1541720 - RNA, 19 nt, Homo sapiens
cuaaaguaacuccuuauag

SEQ ID NO: 1541721 - RNA, 19 nt, Homo sapiens
gaauguucccuggauguug

SEQ ID NO: 1541722 - RNA, 19 nt, Homo sapiens
gaagcagaguauucguuuu

SEQ ID NO: 1541723 - RNA, 19 nt, Homo sapiens
cagugaaugcucuuguuaa

SEQ ID NO: 1541724 - RNA, 19 nt, Homo sapiens
ucgggagacugaaguggaa

SEQ ID NO: 1541725 - RNA, 19 nt, Homo sapiens
ucaaguguuucugagauuc

SEQ ID NO: 1541726 - RNA, 19 nt, Homo sapiens
ucagaucggauugcucuuu

SEQ ID NO: 1541727 - RNA, 19 nt, Homo sapiens
uuucuuggcuggcaacaca

SEQ ID NO: 1541728 - RNA, 19 nt, Homo sapiens
gcugcagccucugggauga

SEQ ID NO: 1541729 - RNA, 19 nt, Homo sapiens
cuuaaugaaugagagcaaa

SEQ ID NO: 1541730 - RNA, 19 nt, Homo sapiens
cuacugaugggcauuuguu

SEQ ID NO: 1541731 - RNA, 19 nt, Homo sapiens
ucuuauuggucccuaauuc

SEQ ID NO: 1541732 - RNA, 19 nt, Homo sapiens
cacccaauucaacuuaaua

SEQ ID NO: 1541733 - RNA, 19 nt, Homo sapiens
ccaggaaugaucucuguuc

SEQ ID NO: 1541734 - RNA, 19 nt, Homo sapiens
ccuacaaggcccugucuga

SEQ ID NO: 1541735 - RNA, 19 nt, Homo sapiens
gauaaaacccaaaguccuu

SEQ ID NO: 1541736 - RNA, 19 nt, Homo sapiens
aagguucuucugcaauuua

SEQ ID NO: 1541737 - RNA, 19 nt, Homo sapiens
gaucaaggauucaggguua

SEQ ID NO: 1541738 - RNA, 19 nt, Homo sapiens
cagaggaucuugaagcuua

SEQ ID NO: 1541739 - RNA, 19 nt, Homo sapiens
gaaagaggcaaaccacuua

SEQ ID NO: 1541740 - RNA, 19 nt, Homo sapiens
gaaauggugaugaagcuua

SEQ ID NO: 1541741 - RNA, 19 nt, Homo sapiens
gcaaauguguucuuauugg

SEQ ID NO: 1541742 - RNA, 19 nt, Homo sapiens
ugaagggucuguaaugaaa

SEQ ID NO: 1541743 - RNA, 19 nt, Homo sapiens
uaacuucccucauccaaau

SEQ ID NO: 1541744 - RNA, 19 nt, Homo sapiens
gcauuaaguggcccaauua

SEQ ID NO: 1541745 - RNA, 19 nt, Homo sapiens
gugaugaagcuuauuguua

SEQ ID NO: 1541746 - RNA, 19 nt, Homo sapiens
gcacuggcauuggaagaaa

SEQ ID NO: 1541747 - RNA, 19 nt, Homo sapiens
agaaacagaugcucccauu

SEQ ID NO: 1541748 - RNA, 19 nt, Homo sapiens
uaaauauccugacaaaugg

SEQ ID NO: 1541749 - RNA, 19 nt, Homo sapiens
gcacuggauuugagagguu

SEQ ID NO: 1541750 - RNA, 19 nt, Homo sapiens
ugagauggcugaagucaca

SEQ ID NO: 1541751 - RNA, 19 nt, Homo sapiens
gcaagaccaaccugacaua

SEQ ID NO: 1541752 - RNA, 19 nt, Homo sapiens
ucacagcacuggcauugga

SEQ ID NO: 1541753 - RNA, 19 nt, Homo sapiens
caugauugcuuggcuaauu

SEQ ID NO: 1541754 - RNA, 19 nt, Homo sapiens
gcugaagucacaaagauuu

SEQ ID NO: 1541755 - RNA, 19 nt, Homo sapiens
ggugaccacuccaacacua

SEQ ID NO: 1541756 - RNA, 19 nt, Homo sapiens
uaugaagggucuguaauga

SEQ ID NO: 1541757 - RNA, 19 nt, Homo sapiens
agaccaaccugacauagug

SEQ ID NO: 1541758 - RNA, 19 nt, Homo sapiens
ggauucaggguuaagauuu

SEQ ID NO: 1541759 - RNA, 19 nt, Homo sapiens
gugaacaaauugauaugga

SEQ ID NO: 1541760 - RNA, 19 nt, Homo sapiens
gucauuggcuucagcaaga

SEQ ID NO: 1541761 - RNA, 19 nt, Homo sapiens
ggguuaagauuucacuaug

SEQ ID NO: 1541762 - RNA, 19 nt, Homo sapiens
ugacauagugaacaaauug

SEQ ID NO: 1541763 - RNA, 19 nt, Homo sapiens
agaaaaggaugccaauuaa

SEQ ID NO: 1541764 - RNA, 19 nt, Homo sapiens
aaacagaugcucccauuca

SEQ ID NO: 1541765 - RNA, 19 nt, Homo sapiens
gagagguuauggagaaaca

SEQ ID NO: 1541766 - RNA, 19 nt, Homo sapiens
gcaucugccuuaaaauaua

SEQ ID NO: 1541767 - RNA, 19 nt, Homo sapiens
caauuaaccauuaccgaaa

SEQ ID NO: 1541768 - RNA, 19 nt, Homo sapiens
agacaagcaucugccuuaa

SEQ ID NO: 1541769 - RNA, 19 nt, Homo sapiens
gauucaggguuaagauuuc

SEQ ID NO: 1541770 - RNA, 19 nt, Homo sapiens
uaccaugguucccagaauu

SEQ ID NO: 1541771 - RNA, 19 nt, Homo sapiens
cugcucagcuguugaaauc

SEQ ID NO: 1541772 - RNA, 19 nt, Homo sapiens
caucuguuauccugaaaug

SEQ ID NO: 1541773 - RNA, 19 nt, Homo sapiens
uuugagagguuauggagaa

SEQ ID NO: 1541774 - RNA, 19 nt, Homo sapiens
gguuaagauuucacuaugu

SEQ ID NO: 1541775 - RNA, 19 nt, Homo sapiens
ccugacaaaugguauugaa

SEQ ID NO: 1541776 - RNA, 19 nt, Homo sapiens
uaacaacagaggaucuuga

SEQ ID NO: 1541777 - RNA, 19 nt, Homo sapiens
aagugaauaucgaguugua

SEQ ID NO: 1541778 - RNA, 19 nt, Homo sapiens
acaagcaucugccuuaaaa

SEQ ID NO: 1541779 - RNA, 19 nt, Homo sapiens
gcuaauugccaucuguuau

SEQ ID NO: 1541780 - RNA, 19 nt, Homo sapiens
uggauugucuaauuacaga

SEQ ID NO: 1541781 - RNA, 19 nt, Homo sapiens
guggcccaauuaaccauua

SEQ ID NO: 1541782 - RNA, 19 nt, Homo sapiens
aagaaaaggaugccaauua

SEQ ID NO: 1541783 - RNA, 19 nt, Homo sapiens
guuaccaacugagagaauu

SEQ ID NO: 1541784 - RNA, 19 nt, Homo sapiens
gacaagcaucugccuuaaa

SEQ ID NO: 1541785 - RNA, 19 nt, Homo sapiens
uggcugaagucacaaagau

SEQ ID NO: 1541786 - RNA, 19 nt, Homo sapiens
guucaucaacuucuuuaug

SEQ ID NO: 1541787 - RNA, 19 nt, Homo sapiens
gcucagcuguugaaaucca

SEQ ID NO: 1541788 - RNA, 19 nt, Homo sapiens
gcugcugcuucauggauuu

SEQ ID NO: 1541789 - RNA, 19 nt, Homo sapiens
ggguauagcaaauguguuc

SEQ ID NO: 1541790 - RNA, 19 nt, Homo sapiens
agaaagaggcaaaccacuu

SEQ ID NO: 1541791 - RNA, 19 nt, Homo sapiens
cuauguugcugcuggagaa

SEQ ID NO: 1541792 - RNA, 19 nt, Homo sapiens
ggucuguaaugaaaucucu

SEQ ID NO: 1541793 - RNA, 19 nt, Homo sapiens
ccaauuaacaacagaggau

SEQ ID NO: 1541794 - RNA, 19 nt, Homo sapiens
aaauggugaugaagcuuau

SEQ ID NO: 1541795 - RNA, 19 nt, Homo sapiens
agcauuaaguggcccaauu

SEQ ID NO: 1541796 - RNA, 19 nt, Homo sapiens
cuguugaaauccaguuauu

SEQ ID NO: 1541797 - RNA, 19 nt, Homo sapiens
gaaacagaugcucccauuc

SEQ ID NO: 1541798 - RNA, 19 nt, Homo sapiens
ccaacugagagaauuuaaa

SEQ ID NO: 1541799 - RNA, 19 nt, Homo sapiens
gaugccaauuaacaacaga

SEQ ID NO: 1541800 - RNA, 19 nt, Homo sapiens
aaaggaugccaauuaacaa

SEQ ID NO: 1541801 - RNA, 19 nt, Homo sapiens
ggugaugaagcuuauuguu

SEQ ID NO: 1541802 - RNA, 19 nt, Homo sapiens
ccaugguucccagaauuua

SEQ ID NO: 1541803 - RNA, 19 nt, Homo sapiens
gagguuauggagaaacaga

SEQ ID NO: 1541804 - RNA, 19 nt, Homo sapiens
gacauagugaacaaauuga

SEQ ID NO: 1541805 - RNA, 19 nt, Homo sapiens
aaccugacauagugaacaa

SEQ ID NO: 1541806 - RNA, 19 nt, Homo sapiens
ggaugccaauuaacaacag

SEQ ID NO: 1541807 - RNA, 19 nt, Homo sapiens
ggcuaauugccaucuguua

SEQ ID NO: 1541808 - RNA, 19 nt, Homo sapiens
cuaugaagggucuguaaug

SEQ ID NO: 1541809 - RNA, 19 nt, Homo sapiens
ggucccuggucuacugcua

SEQ ID NO: 1541810 - RNA, 19 nt, Homo sapiens
aaaagugaauaucgaguug

SEQ ID NO: 1541811 - RNA, 19 nt, Homo sapiens
uaccaacugagagaauuua

SEQ ID NO: 1541812 - RNA, 19 nt, Homo sapiens
cugacauagugaacaaauu

SEQ ID NO: 1541813 - RNA, 19 nt, Homo sapiens
ggaucuugaagcuuauauu

SEQ ID NO: 1541814 - RNA, 19 nt, Homo sapiens
ugccaucuguuauccugaa

SEQ ID NO: 1541815 - RNA, 19 nt, Homo sapiens
cuaauugccaucuguuauc

SEQ ID NO: 1541816 - RNA, 19 nt, Homo sapiens
cacuggauuugagagguua

SEQ ID NO: 1541817 - RNA, 19 nt, Homo sapiens
gaagggucuguaaugaaau

SEQ ID NO: 1541818 - RNA, 19 nt, Homo sapiens
cagcaagaccaaccugaca

SEQ ID NO: 1541819 - RNA, 19 nt, Homo sapiens
ggcaugauugcuuggcuaa

SEQ ID NO: 1541820 - RNA, 19 nt, Homo sapiens
aagcaucugccuuaaaaua

SEQ ID NO: 1541821 - RNA, 19 nt, Homo sapiens
augauugcuuggcuaauug

SEQ ID NO: 1541822 - RNA, 19 nt, Homo sapiens
caaggauucaggguuaaga

SEQ ID NO: 1541823 - RNA, 19 nt, Homo sapiens
ugucagaagccagucauug

SEQ ID NO: 1541824 - RNA, 19 nt, Homo sapiens
ccauccaccugcucaaacu

SEQ ID NO: 1541825 - RNA, 19 nt, Homo sapiens
ucagcugccugccucucaa

SEQ ID NO: 1541826 - RNA, 19 nt, Homo sapiens
gaggaucuugaagcuuaua

SEQ ID NO: 1541827 - RNA, 19 nt, Homo sapiens
guauagcaaauguguucuu

SEQ ID NO: 1541828 - RNA, 19 nt, Homo sapiens
acgcauucauggagguuga

SEQ ID NO: 1541829 - RNA, 19 nt, Homo sapiens
gccugccucucaaacauca

SEQ ID NO: 1541830 - RNA, 19 nt, Homo sapiens
uuuaggguauagcaaaugu

SEQ ID NO: 1541831 - RNA, 19 nt, Homo sapiens
ggauuugagagguuaugga

SEQ ID NO: 1541832 - RNA, 19 nt, Homo sapiens
gaccaaccugacauaguga

SEQ ID NO: 1541833 - RNA, 19 nt, Homo sapiens
ucuggucccuggucuacug

SEQ ID NO: 1541834 - RNA, 19 nt, Homo sapiens
gccaucuguuauccugaaa

SEQ ID NO: 1541835 - RNA, 19 nt, Homo sapiens
cgaguuguagcacuggauu

SEQ ID NO: 1541836 - RNA, 19 nt, Homo sapiens
aagggucuguaaugaaauc

SEQ ID NO: 1541837 - RNA, 19 nt, Homo sapiens
cauauuaccuccagacuuu

SEQ ID NO: 1541838 - RNA, 19 nt, Homo sapiens
gcccaggugucccauauua

SEQ ID NO: 1541839 - RNA, 19 nt, Homo sapiens
gaagagcaauagccacuug

SEQ ID NO: 1541840 - RNA, 19 nt, Homo sapiens
gaacagcauugacuucauc

SEQ ID NO: 1541841 - RNA, 19 nt, Homo sapiens
ggacaggccucacuagucu

SEQ ID NO: 1541842 - RNA, 19 nt, Homo sapiens
ggagcgagauuccaacuuc

SEQ ID NO: 1541843 - RNA, 19 nt, Homo sapiens
ucaaagcaguccacggaua

SEQ ID NO: 1541844 - RNA, 19 nt, Homo sapiens
ccacaggucugguucugaa

SEQ ID NO: 1541845 - RNA, 19 nt, Homo sapiens
gaugaaauccacccucaaa

SEQ ID NO: 1541846 - RNA, 19 nt, Homo sapiens
caacaucugugaccucaag

SEQ ID NO: 1541847 - RNA, 19 nt, Homo sapiens
ucaaagagcaguuccaguu

SEQ ID NO: 1541848 - RNA, 19 nt, Homo sapiens
cagaugaaauggagaacuu

SEQ ID NO: 1541849 - RNA, 19 nt, Homo sapiens
uaucaucagcuccuucuua

SEQ ID NO: 1541850 - RNA, 19 nt, Homo sapiens
cugcagagguuacugaaga

SEQ ID NO: 1541851 - RNA, 19 nt, Homo sapiens
aaagagcaguuccaguuug

SEQ ID NO: 1541852 - RNA, 19 nt, Homo sapiens
ggacgagagcgaugaguga

SEQ ID NO: 1541853 - RNA, 19 nt, Homo sapiens
gagaugguggauaaacuua

SEQ ID NO: 1541854 - RNA, 19 nt, Homo sapiens
caaagagcaguuccaguuu

SEQ ID NO: 1541855 - RNA, 19 nt, Homo sapiens
ccaacuggauggaaaauaa

SEQ ID NO: 1541856 - RNA, 19 nt, Homo sapiens
gaaauccacccucaaagag

SEQ ID NO: 1541857 - RNA, 19 nt, Homo sapiens
gcacguggccaguaucauc

SEQ ID NO: 1541858 - RNA, 19 nt, Homo sapiens
cgagagcgaugagugagaa

SEQ ID NO: 1541859 - RNA, 19 nt, Homo sapiens
ugaaauccacccucaaaga

SEQ ID NO: 1541860 - RNA, 19 nt, Homo sapiens
caaagcaguccacggauau

SEQ ID NO: 1541861 - RNA, 19 nt, Homo sapiens
gcuuucuccuggcuaauaa

SEQ ID NO: 1541862 - RNA, 19 nt, Homo sapiens
ucuccuggcuaauaauaaa

SEQ ID NO: 1541863 - RNA, 19 nt, Homo sapiens
gcagagaacagcauugacu

SEQ ID NO: 1541864 - RNA, 19 nt, Homo sapiens
gagcgagauuccaacuuca

SEQ ID NO: 1541865 - RNA, 19 nt, Homo sapiens
agaacuugcugaccuacaa

SEQ ID NO: 1541866 - RNA, 19 nt, Homo sapiens
gagaacagcauugacuuca

SEQ ID NO: 1541867 - RNA, 19 nt, Homo sapiens
gggcagagaacagcauuga

SEQ ID NO: 1541868 - RNA, 19 nt, Homo sapiens
cagcccaggugucccauau

SEQ ID NO: 1541869 - RNA, 19 nt, Homo sapiens
gcaagacuuuuauuacguu

SEQ ID NO: 1541870 - RNA, 19 nt, Homo sapiens
ccacggauauuuugauuca

SEQ ID NO: 1541871 - RNA, 19 nt, Homo sapiens
gagcuucuccugcaaagag

SEQ ID NO: 1541872 - RNA, 19 nt, Homo sapiens
gcugcuuucuccuggcuaa

SEQ ID NO: 1541873 - RNA, 19 nt, Homo sapiens
gcccauguccuguugauca

SEQ ID NO: 1541874 - RNA, 19 nt, Homo sapiens
gauuccaacuucaacaucu

SEQ ID NO: 1541875 - RNA, 19 nt, Homo sapiens
gcucugggccuggaacuau

SEQ ID NO: 1541876 - RNA, 19 nt, Homo sapiens
uggagaacuugcugaccua

SEQ ID NO: 1541877 - RNA, 19 nt, Homo sapiens
ugagugagauccgaagagu

SEQ ID NO: 1541878 - RNA, 19 nt, Homo sapiens
ugauagacacgaugaaauc

SEQ ID NO: 1541879 - RNA, 19 nt, Homo sapiens
caugauagacacgaugaaa

SEQ ID NO: 1541880 - RNA, 19 nt, Homo sapiens
cgucgugggcggaauguuu

SEQ ID NO: 1541881 - RNA, 19 nt, Homo sapiens
cuggaacuaugaagaccua

SEQ ID NO: 1541882 - RNA, 19 nt, Homo sapiens
agugagauccgaagaguug

SEQ ID NO: 1541883 - RNA, 19 nt, Homo sapiens
aagagcaguuccaguuugu

SEQ ID NO: 1541884 - RNA, 19 nt, Homo sapiens
agaauuacucugagaagga

SEQ ID NO: 1541885 - RNA, 19 nt, Homo sapiens
ccuggaaucagaugaaaug

SEQ ID NO: 1541886 - RNA, 19 nt, Homo sapiens
agaaggagucccugucguu

SEQ ID NO: 1541887 - RNA, 19 nt, Homo sapiens
agagguuacugaagagcaa

SEQ ID NO: 1541888 - RNA, 19 nt, Homo sapiens
cgagaugguggauaaacuu

SEQ ID NO: 1541889 - RNA, 19 nt, Homo sapiens
gacagacucaucccucuuc

SEQ ID NO: 1541890 - RNA, 19 nt, Homo sapiens
uggcagccuugaaauggaa

SEQ ID NO: 1541891 - RNA, 19 nt, Homo sapiens
aaagguucuuguauucuca

SEQ ID NO: 1541892 - RNA, 19 nt, Homo sapiens
uuuauuacguugccaugga

SEQ ID NO: 1541893 - RNA, 19 nt, Homo sapiens
caucagcuccuucuuacag

SEQ ID NO: 1541894 - RNA, 19 nt, Homo sapiens
ggaagcugcaggcccaugu

SEQ ID NO: 1541895 - RNA, 19 nt, Homo sapiens
gagauuccaacuucaacau

SEQ ID NO: 1541896 - RNA, 19 nt, Homo sapiens
gggacaggccucacuaguc

SEQ ID NO: 1541897 - RNA, 19 nt, Homo sapiens
gagucccugucguucauga

SEQ ID NO: 1541898 - RNA, 19 nt, Homo sapiens
gagcaauagccacuugagu

SEQ ID NO: 1541899 - RNA, 19 nt, Homo sapiens
gccuugaaauggaaucgau

SEQ ID NO: 1541900 - RNA, 19 nt, Homo sapiens
cugcccaacuggauggaaa

SEQ ID NO: 1541901 - RNA, 19 nt, Homo sapiens
caacaaggccagggauggu

SEQ ID NO: 1541902 - RNA, 19 nt, Homo sapiens
ggagugacagcagcgcauu

SEQ ID NO: 1541903 - RNA, 19 nt, Homo sapiens
guggcagccuugaaaugga

SEQ ID NO: 1541904 - RNA, 19 nt, Homo sapiens
cagagaacagcauugacuu

SEQ ID NO: 1541905 - RNA, 19 nt, Homo sapiens
cuacaagcggagagccaua

SEQ ID NO: 1541906 - RNA, 19 nt, Homo sapiens
gucccugucguucaugaua

SEQ ID NO: 1541907 - RNA, 19 nt, Homo sapiens
ggccacaggucugguucug

SEQ ID NO: 1541908 - RNA, 19 nt, Homo sapiens
aaucagaugaaauggagaa

SEQ ID NO: 1541909 - RNA, 19 nt, Homo sapiens
ggacacgccgcucuuucuc

SEQ ID NO: 1541910 - RNA, 19 nt, Homo sapiens
ggcccagccuaggauggua

SEQ ID NO: 1541911 - RNA, 19 nt, Homo sapiens
gggccuggaacuaugaaga

SEQ ID NO: 1541912 - RNA, 19 nt, Homo sapiens
cccagcacguggccaguau

SEQ ID NO: 1541913 - RNA, 19 nt, Homo sapiens
aaagaggaaccacgaaggu

SEQ ID NO: 1541914 - RNA, 19 nt, Homo sapiens
ccauauuaccuccagacuu

SEQ ID NO: 1541915 - RNA, 19 nt, Homo sapiens
ccgagaugguggauaaacu

SEQ ID NO: 1541916 - RNA, 19 nt, Homo sapiens
cauguccuguugaucaaag

SEQ ID NO: 1541917 - RNA, 19 nt, Homo sapiens
agaacagcauugacuucau

SEQ ID NO: 1541918 - RNA, 19 nt, Homo sapiens
aagcaguccacggauauuu

SEQ ID NO: 1541919 - RNA, 19 nt, Homo sapiens
cccauguccuguugaucaa

SEQ ID NO: 1541920 - RNA, 19 nt, Homo sapiens
gguaggaacuuuaauauuc

SEQ ID NO: 1541921 - RNA, 19 nt, Homo sapiens
ggaauaaacuggcacuguu

SEQ ID NO: 1541922 - RNA, 19 nt, Homo sapiens
uuacuaagcuucuuuguga

SEQ ID NO: 1541923 - RNA, 19 nt, Homo sapiens
gaaagaugauuacugugaa

SEQ ID NO: 1541924 - RNA, 19 nt, Homo sapiens
ggagucagcuuaaaucaag

SEQ ID NO: 1541925 - RNA, 19 nt, Homo sapiens
gagcaugcauugccauuau

SEQ ID NO: 1541926 - RNA, 19 nt, Homo sapiens
ucagaaagaugauuacugu

SEQ ID NO: 1541927 - RNA, 19 nt, Homo sapiens
gcgagcugauguagaauua

SEQ ID NO: 1541928 - RNA, 19 nt, Homo sapiens
gcacuucgauuagucagaa

SEQ ID NO: 1541929 - RNA, 19 nt, Homo sapiens
gacacaagcacuucgauua

SEQ ID NO: 1541930 - RNA, 19 nt, Homo sapiens
gaaccaaauuagaguacaa

SEQ ID NO: 1541931 - RNA, 19 nt, Homo sapiens
ggacuaaacaccaucuuga

SEQ ID NO: 1541932 - RNA, 19 nt, Homo sapiens
gagcugauguagaauuaga

SEQ ID NO: 1541933 - RNA, 19 nt, Homo sapiens
aaacugggcuuucacuaug

SEQ ID NO: 1541934 - RNA, 19 nt, Homo sapiens
gaaagaaagcauguaugua

SEQ ID NO: 1541935 - RNA, 19 nt, Homo sapiens
gcauugccauuaucuguga

SEQ ID NO: 1541936 - RNA, 19 nt, Homo sapiens
gugaccaacucauuaauug

SEQ ID NO: 1541937 - RNA, 19 nt, Homo sapiens
ucugauaacuuaagagaga

SEQ ID NO: 1541938 - RNA, 19 nt, Homo sapiens
ggaagcacuuuguuagcaa

SEQ ID NO: 1541939 - RNA, 19 nt, Homo sapiens
gaaaugauggacuucaaga

SEQ ID NO: 1541940 - RNA, 19 nt, Homo sapiens
ugugaaugcuuccuuguuu

SEQ ID NO: 1541941 - RNA, 19 nt, Homo sapiens
cagggaguaucaaauauga

SEQ ID NO: 1541942 - RNA, 19 nt, Homo sapiens
ggacugaauugaaaacauu

SEQ ID NO: 1541943 - RNA, 19 nt, Homo sapiens
ggaauccugugggaauaaa

SEQ ID NO: 1541944 - RNA, 19 nt, Homo sapiens
gaacuagcacuucagaauc

SEQ ID NO: 1541945 - RNA, 19 nt, Homo sapiens
ccuaauaagugauuucaag

SEQ ID NO: 1541946 - RNA, 19 nt, Homo sapiens
ggagguuggaacagaauua

SEQ ID NO: 1541947 - RNA, 19 nt, Homo sapiens
cauaauuuguuugcgguua

SEQ ID NO: 1541948 - RNA, 19 nt, Homo sapiens
gaauaaacuggcacuguug

SEQ ID NO: 1541949 - RNA, 19 nt, Homo sapiens
ugaaagaaagcauguaugu

SEQ ID NO: 1541950 - RNA, 19 nt, Homo sapiens
gagguaggaacuuuaauau

SEQ ID NO: 1541951 - RNA, 19 nt, Homo sapiens
uaaaugaggcccuaauuac

SEQ ID NO: 1541952 - RNA, 19 nt, Homo sapiens
auaaaugaggcccuaauua

SEQ ID NO: 1541953 - RNA, 19 nt, Homo sapiens
ugugcgagcugauguagaa

SEQ ID NO: 1541954 - RNA, 19 nt, Homo sapiens
gccauuaucugugaacuag

SEQ ID NO: 1541955 - RNA, 19 nt, Homo sapiens
agaaagaugauuacuguga

SEQ ID NO: 1541956 - RNA, 19 nt, Homo sapiens
ggacacaagcacuucgauu

SEQ ID NO: 1541957 - RNA, 19 nt, Homo sapiens
uaaacuggcacuguugaua

SEQ ID NO: 1541958 - RNA, 19 nt, Homo sapiens
uuacagaucauucaguuug

SEQ ID NO: 1541959 - RNA, 19 nt, Homo sapiens
agagguaggaacuuuaaua

SEQ ID NO: 1541960 - RNA, 19 nt, Homo sapiens
uaauugcaguuggaaauga

SEQ ID NO: 1541961 - RNA, 19 nt, Homo sapiens
cugaauaacuuuacuaagc

SEQ ID NO: 1541962 - RNA, 19 nt, Homo sapiens
uuuaguacauuguguguga

SEQ ID NO: 1541963 - RNA, 19 nt, Homo sapiens
gacugaaacccgucaauau

SEQ ID NO: 1541964 - RNA, 19 nt, Homo sapiens
gcagggaguaucaaauaug

SEQ ID NO: 1541965 - RNA, 19 nt, Homo sapiens
uccaaagacucgacaguau

SEQ ID NO: 1541966 - RNA, 19 nt, Homo sapiens
gaauaaaugaggcccuaau

SEQ ID NO: 1541967 - RNA, 19 nt, Homo sapiens
caagaaagagacagaaugg

SEQ ID NO: 1541968 - RNA, 19 nt, Homo sapiens
gcuacgagcgcuucgauau

SEQ ID NO: 1541969 - RNA, 19 nt, Homo sapiens
ugauggacuucaagaaaga

SEQ ID NO: 1541970 - RNA, 19 nt, Homo sapiens
gcaccacauuaauuaucaa

SEQ ID NO: 1541971 - RNA, 19 nt, Homo sapiens
caaagacucgacaguaugu

SEQ ID NO: 1541972 - RNA, 19 nt, Homo sapiens
aagcuaggccaucugaaua

SEQ ID NO: 1541973 - RNA, 19 nt, Homo sapiens
gcauuguuguccuuugaau

SEQ ID NO: 1541974 - RNA, 19 nt, Homo sapiens
ugagaaagcuaggccaucu

SEQ ID NO: 1541975 - RNA, 19 nt, Homo sapiens
uuuaauagcuaggugcauu

SEQ ID NO: 1541976 - RNA, 19 nt, Homo sapiens
gggaguaucaaauaugaga

SEQ ID NO: 1541977 - RNA, 19 nt, Homo sapiens
gggcuacuguauaccuuau

SEQ ID NO: 1541978 - RNA, 19 nt, Homo sapiens
ugauguagaauuagaggua

SEQ ID NO: 1541979 - RNA, 19 nt, Homo sapiens
gaagaaccuccgaguacga

SEQ ID NO: 1541980 - RNA, 19 nt, Homo sapiens
gauauuggccacagugaag

SEQ ID NO: 1541981 - RNA, 19 nt, Homo sapiens
aaacuggcacuguugauau

SEQ ID NO: 1541982 - RNA, 19 nt, Homo sapiens
aaugaggcccuaauuacua

SEQ ID NO: 1541983 - RNA, 19 nt, Homo sapiens
ugcagcaccacauuaauua

SEQ ID NO: 1541984 - RNA, 19 nt, Homo sapiens
aauuagagguaggaacuuu

SEQ ID NO: 1541985 - RNA, 19 nt, Homo sapiens
gaucugacccgagaaccuu

SEQ ID NO: 1541986 - RNA, 19 nt, Homo sapiens
uugcagggaguaucaaaua

SEQ ID NO: 1541987 - RNA, 19 nt, Homo sapiens
ccaaagacucgacaguaug

SEQ ID NO: 1541988 - RNA, 19 nt, Homo sapiens
aaugauggacuucaagaaa

SEQ ID NO: 1541989 - RNA, 19 nt, Homo sapiens
guacauugugugugaauag

SEQ ID NO: 1541990 - RNA, 19 nt, Homo sapiens
gacuaaacaccaucuugaa

SEQ ID NO: 1541991 - RNA, 19 nt, Homo sapiens
cauccaagacuccaguauu

SEQ ID NO: 1541992 - RNA, 19 nt, Homo sapiens
uucgauaucucauccaaga

SEQ ID NO: 1541993 - RNA, 19 nt, Homo sapiens
guauuuggagucagcuuaa

SEQ ID NO: 1541994 - RNA, 19 nt, Homo sapiens
uuuaaggccuuuaguacau

SEQ ID NO: 1541995 - RNA, 19 nt, Homo sapiens
uagaugcagcaccacauua

SEQ ID NO: 1541996 - RNA, 19 nt, Homo sapiens
ucaagaaagagacagaaug

SEQ ID NO: 1541997 - RNA, 19 nt, Homo sapiens
gugaaugcuuccuuguuuc

SEQ ID NO: 1541998 - RNA, 19 nt, Homo sapiens
uaggccaucugaauaacuu

SEQ ID NO: 1541999 - RNA, 19 nt, Homo sapiens
ggauuuguuuguauuuagg

SEQ ID NO: 1542000 - RNA, 19 nt, Homo sapiens
gcacuguauuauaguuucu

SEQ ID NO: 1542001 - RNA, 19 nt, Homo sapiens
ggccaucugaauaacuuua

SEQ ID NO: 1542002 - RNA, 19 nt, Homo sapiens
guacgagggcggaaugaca

SEQ ID NO: 1542003 - RNA, 19 nt, Homo sapiens
ggaaaugauggacuucaag

SEQ ID NO: 1542004 - RNA, 19 nt, Homo sapiens
gggaauaaacuggcacugu

SEQ ID NO: 1542005 - RNA, 19 nt, Homo sapiens
uggaaaugauggacuucaa

SEQ ID NO: 1542006 - RNA, 19 nt, Homo sapiens
cgauuagucagaaagauga

SEQ ID NO: 1542007 - RNA, 19 nt, Homo sapiens
aguuuggacugaauugaaa

SEQ ID NO: 1542008 - RNA, 19 nt, Homo sapiens
uagccgacacuaauuuauu

SEQ ID NO: 1542009 - RNA, 19 nt, Homo sapiens
cauuaucugugaacuagca

SEQ ID NO: 1542010 - RNA, 19 nt, Homo sapiens
uaaggccuuuaguacauug

SEQ ID NO: 1542011 - RNA, 19 nt, Homo sapiens
agaugcagcaccacauuaa

SEQ ID NO: 1542012 - RNA, 19 nt, Homo sapiens
uuagagguaggaacuuuaa

SEQ ID NO: 1542013 - RNA, 19 nt, Homo sapiens
gaccaacucauuaauugca

SEQ ID NO: 1542014 - RNA, 19 nt, Homo sapiens
cacaagcacuucgauuagu

SEQ ID NO: 1542015 - RNA, 19 nt, Homo sapiens
gaaacuuaaguguucuguu

SEQ ID NO: 1542016 - RNA, 19 nt, Homo sapiens
aagcuucuuugugauauug

SEQ ID NO: 1542017 - RNA, 19 nt, Homo sapiens
agaaagcuaggccaucuga

SEQ ID NO: 1542018 - RNA, 19 nt, Homo sapiens
guauugcauuguuguccuu

SEQ ID NO: 1542019 - RNA, 19 nt, Homo sapiens
gcagcaccacauuaauuau

SEQ ID NO: 1542020 - RNA, 19 nt, Homo sapiens
caagagagcuggaauucua

SEQ ID NO: 1542021 - RNA, 19 nt, Homo sapiens
gagcuggaauucuauaaua

SEQ ID NO: 1542022 - RNA, 19 nt, Homo sapiens
gaugugacccauaaauuua

SEQ ID NO: 1542023 - RNA, 19 nt, Homo sapiens
ggaagaagcuuaacaaaag

SEQ ID NO: 1542024 - RNA, 19 nt, Homo sapiens
ugacagaacuuuggcagaa

SEQ ID NO: 1542025 - RNA, 19 nt, Homo sapiens
ccaagagauugcugaagua

SEQ ID NO: 1542026 - RNA, 19 nt, Homo sapiens
cauaauggguacugcuuaa

SEQ ID NO: 1542027 - RNA, 19 nt, Homo sapiens
uggaagaugugacccauaa

SEQ ID NO: 1542028 - RNA, 19 nt, Homo sapiens
gcaaguucauuacucuuug

SEQ ID NO: 1542029 - RNA, 19 nt, Homo sapiens
gaagugcgaaugauagauu

SEQ ID NO: 1542030 - RNA, 19 nt, Homo sapiens
agagauugcugaaguagaa

SEQ ID NO: 1542031 - RNA, 19 nt, Homo sapiens
ccaaacgauuuauaccuaa

SEQ ID NO: 1542032 - RNA, 19 nt, Homo sapiens
gaaguagaagugcgaauga

SEQ ID NO: 1542033 - RNA, 19 nt, Homo sapiens
gccaagagauugcugaagu

SEQ ID NO: 1542034 - RNA, 19 nt, Homo sapiens
caaaguggguauacugcaa

SEQ ID NO: 1542035 - RNA, 19 nt, Homo sapiens
gaagaugugacccauaaau

SEQ ID NO: 1542036 - RNA, 19 nt, Homo sapiens
cacaauagaugagggauau

SEQ ID NO: 1542037 - RNA, 19 nt, Homo sapiens
gcaagacaauggguggaaa

SEQ ID NO: 1542038 - RNA, 19 nt, Homo sapiens
ggucagcaaguacccauua

SEQ ID NO: 1542039 - RNA, 19 nt, Homo sapiens
ggacaaaguggguauacug

SEQ ID NO: 1542040 - RNA, 19 nt, Homo sapiens
aauaagcccuguauaaugg

SEQ ID NO: 1542041 - RNA, 19 nt, Homo sapiens
uaauaagcccuguauaaug

SEQ ID NO: 1542042 - RNA, 19 nt, Homo sapiens
gaugagggauauguuuaug

SEQ ID NO: 1542043 - RNA, 19 nt, Homo sapiens
ccacugcaccaaacgauuu

SEQ ID NO: 1542044 - RNA, 19 nt, Homo sapiens
gcucauguguucccuagca

SEQ ID NO: 1542045 - RNA, 19 nt, Homo sapiens
gacagaacuuuggcagaaa

SEQ ID NO: 1542046 - RNA, 19 nt, Homo sapiens
uagaugagggauauguuua

SEQ ID NO: 1542047 - RNA, 19 nt, Homo sapiens
gaagaagcuuaacaaaaga

SEQ ID NO: 1542048 - RNA, 19 nt, Homo sapiens
gcauuacggaagaagcuua

SEQ ID NO: 1542049 - RNA, 19 nt, Homo sapiens
aaaccagcauuacggaaga

SEQ ID NO: 1542050 - RNA, 19 nt, Homo sapiens
agaugugacccauaaauuu

SEQ ID NO: 1542051 - RNA, 19 nt, Homo sapiens
accaaacgauuuauaccua

SEQ ID NO: 1542052 - RNA, 19 nt, Homo sapiens
cagcaaguacccauuaaug

SEQ ID NO: 1542053 - RNA, 19 nt, Homo sapiens
ggauauguuuaugggcuaa

SEQ ID NO: 1542054 - RNA, 19 nt, Homo sapiens
gaaggacaaaguggguaua

SEQ ID NO: 1542055 - RNA, 19 nt, Homo sapiens
caaguucauuacucuuugu

SEQ ID NO: 1542056 - RNA, 19 nt, Homo sapiens
guagaagugcgaaugauag

SEQ ID NO: 1542057 - RNA, 19 nt, Homo sapiens
guguuaaguuccacagcua

SEQ ID NO: 1542058 - RNA, 19 nt, Homo sapiens
ggaaggacaaaguggguau

SEQ ID NO: 1542059 - RNA, 19 nt, Homo sapiens
gguuuaugcugcugacugu

SEQ ID NO: 1542060 - RNA, 19 nt, Homo sapiens
gugcuuggcaugaggguuu

SEQ ID NO: 1542061 - RNA, 19 nt, Homo sapiens
gucagcaaguacccauuaa

SEQ ID NO: 1542062 - RNA, 19 nt, Homo sapiens
aauggguacugcuuaagaa

SEQ ID NO: 1542063 - RNA, 19 nt, Homo sapiens
gagagcuggaauucuauaa

SEQ ID NO: 1542064 - RNA, 19 nt, Homo sapiens
cgauagcuaugagacagaa

SEQ ID NO: 1542065 - RNA, 19 nt, Homo sapiens
gcuggaauucuauaauaug

SEQ ID NO: 1542066 - RNA, 19 nt, Homo sapiens
agcaacaggucagcaagua

SEQ ID NO: 1542067 - RNA, 19 nt, Homo sapiens
ggguuuaucauguucauuc

SEQ ID NO: 1542068 - RNA, 19 nt, Homo sapiens
aaauguacuuucccaacug

SEQ ID NO: 1542069 - RNA, 19 nt, Homo sapiens
guauucagaagauugagaa

SEQ ID NO: 1542070 - RNA, 19 nt, Homo sapiens
uaauggguacugcuuaaga

SEQ ID NO: 1542071 - RNA, 19 nt, Homo sapiens
ucauaauggguacugcuua

SEQ ID NO: 1542072 - RNA, 19 nt, Homo sapiens
agacagaaaaccagcauua

SEQ ID NO: 1542073 - RNA, 19 nt, Homo sapiens
ccaguauucagaagauuga

SEQ ID NO: 1542074 - RNA, 19 nt, Homo sapiens
aagaugugacccauaaauu

SEQ ID NO: 1542075 - RNA, 19 nt, Homo sapiens
caauagaugagggauaugu

SEQ ID NO: 1542076 - RNA, 19 nt, Homo sapiens
aguagaagugcgaaugaua

SEQ ID NO: 1542077 - RNA, 19 nt, Homo sapiens
uaauggauguaaagauagg

SEQ ID NO: 1542078 - RNA, 19 nt, Homo sapiens
ggaagaugugacccauaaa

SEQ ID NO: 1542079 - RNA, 19 nt, Homo sapiens
gacaauggguggaaaagca

SEQ ID NO: 1542080 - RNA, 19 nt, Homo sapiens
guaugcgcgucacaggaaa

SEQ ID NO: 1542081 - RNA, 19 nt, Homo sapiens
uuacgcaaguucauuacuc

SEQ ID NO: 1542082 - RNA, 19 nt, Homo sapiens
guacgggaaggacaaagug

SEQ ID NO: 1542083 - RNA, 19 nt, Homo sapiens
ugaaguagaagugcgaaug

SEQ ID NO: 1542084 - RNA, 19 nt, Homo sapiens
gaggguuuaucauguucau

SEQ ID NO: 1542085 - RNA, 19 nt, Homo sapiens
acacaauagaugagggaua

SEQ ID NO: 1542086 - RNA, 19 nt, Homo sapiens
gucagacacagaaguacua

SEQ ID NO: 1542087 - RNA, 19 nt, Homo sapiens
gccaaccacuacaaaauug

SEQ ID NO: 1542088 - RNA, 19 nt, Homo sapiens
gauguaaagauagggcaaa

SEQ ID NO: 1542089 - RNA, 19 nt, Homo sapiens
auagaugagggauauguuu

SEQ ID NO: 1542090 - RNA, 19 nt, Homo sapiens
aagugcgaaugauagauuu

SEQ ID NO: 1542091 - RNA, 19 nt, Homo sapiens
auucugcagugguuugaaa

SEQ ID NO: 1542092 - RNA, 19 nt, Homo sapiens
ccuguauaauggauguaaa

SEQ ID NO: 1542093 - RNA, 19 nt, Homo sapiens
uugaaaaucuggagcaaga

SEQ ID NO: 1542094 - RNA, 19 nt, Homo sapiens
cgcaaguucauuacucuuu

SEQ ID NO: 1542095 - RNA, 19 nt, Homo sapiens
gcccaagagagcuggaauu

SEQ ID NO: 1542096 - RNA, 19 nt, Homo sapiens
ugucacaggaacauuuaaa

SEQ ID NO: 1542097 - RNA, 19 nt, Homo sapiens
gaaaagcaugucacaggaa

SEQ ID NO: 1542098 - RNA, 19 nt, Homo sapiens
agacacagaaguacuagag

SEQ ID NO: 1542099 - RNA, 19 nt, Homo sapiens
gccaguauucagaagauug

SEQ ID NO: 1542100 - RNA, 19 nt, Homo sapiens
ccuagcaacacaauagaug

SEQ ID NO: 1542101 - RNA, 19 nt, Homo sapiens
uagaagugcgaaugauaga

SEQ ID NO: 1542102 - RNA, 19 nt, Homo sapiens
caagagauugcugaaguag

SEQ ID NO: 1542103 - RNA, 19 nt, Homo sapiens
caucucagccaaccacuac

SEQ ID NO: 1542104 - RNA, 19 nt, Homo sapiens
agagagcuggaauucuaua

SEQ ID NO: 1542105 - RNA, 19 nt, Homo sapiens
cuagcaacacaauagauga

SEQ ID NO: 1542106 - RNA, 19 nt, Homo sapiens
uguaugcgcgucacaggaa

SEQ ID NO: 1542107 - RNA, 19 nt, Homo sapiens
cuggaauucuauaauaugg

SEQ ID NO: 1542108 - RNA, 19 nt, Homo sapiens
uaaguuccacagcuaaugg

SEQ ID NO: 1542109 - RNA, 19 nt, Homo sapiens
uuuaugcugcugacuguuu

SEQ ID NO: 1542110 - RNA, 19 nt, Homo sapiens
cggaagaagcuuaacaaaa

SEQ ID NO: 1542111 - RNA, 19 nt, Homo sapiens
cauuacggaagaagcuuaa

SEQ ID NO: 1542112 - RNA, 19 nt, Homo sapiens
uugaugguguucuucuaga

SEQ ID NO: 1542113 - RNA, 19 nt, Homo sapiens
gcacauagcuaaaucacaa

SEQ ID NO: 1542114 - RNA, 19 nt, Homo sapiens
ggaacgagcugcaguuuga

SEQ ID NO: 1542115 - RNA, 19 nt, Homo sapiens
guacgugaauguuuaaugu

SEQ ID NO: 1542116 - RNA, 19 nt, Homo sapiens
gcaauagguuccaauaugc

SEQ ID NO: 1542117 - RNA, 19 nt, Homo sapiens
gugcguagccuccguguaa

SEQ ID NO: 1542118 - RNA, 19 nt, Homo sapiens
gcuguuaaaucaccuuaug

SEQ ID NO: 1542119 - RNA, 19 nt, Homo sapiens
ccacucccauggcuuaauu

SEQ ID NO: 1542120 - RNA, 19 nt, Homo sapiens
acauucagcuguuugguuu

SEQ ID NO: 1542121 - RNA, 19 nt, Homo sapiens
gaagauacauguguuugac

SEQ ID NO: 1542122 - RNA, 19 nt, Homo sapiens
ucacgaagauacauguguu

SEQ ID NO: 1542123 - RNA, 19 nt, Homo sapiens
ccacaucacaugaccuuaa

SEQ ID NO: 1542124 - RNA, 19 nt, Homo sapiens
aagcuuguauucaguguuu

SEQ ID NO: 1542125 - RNA, 19 nt, Homo sapiens
gaguuacugugaagaaguu

SEQ ID NO: 1542126 - RNA, 19 nt, Homo sapiens
cguuguacgugaauguuua

SEQ ID NO: 1542127 - RNA, 19 nt, Homo sapiens
ugcaauagguuccaauaug

SEQ ID NO: 1542128 - RNA, 19 nt, Homo sapiens
caacagugcgucugaggaa

SEQ ID NO: 1542129 - RNA, 19 nt, Homo sapiens
guuagugguuggauucuau

SEQ ID NO: 1542130 - RNA, 19 nt, Homo sapiens
gaccuuaacaugaucaaug

SEQ ID NO: 1542131 - RNA, 19 nt, Homo sapiens
cagcagaagucccuauuuu

SEQ ID NO: 1542132 - RNA, 19 nt, Homo sapiens
gacaucuguuuaaauggua

SEQ ID NO: 1542133 - RNA, 19 nt, Homo sapiens
guauuucucugccuugaca

SEQ ID NO: 1542134 - RNA, 19 nt, Homo sapiens
ugaaagccaggaucgguua

SEQ ID NO: 1542135 - RNA, 19 nt, Homo sapiens
gaaagggaacauagaugga

SEQ ID NO: 1542136 - RNA, 19 nt, Homo sapiens
gauagugaagcuuguauuc

SEQ ID NO: 1542137 - RNA, 19 nt, Homo sapiens
gcagcagaagucccuauuu

SEQ ID NO: 1542138 - RNA, 19 nt, Homo sapiens
uuucagugguccagcuuua

SEQ ID NO: 1542139 - RNA, 19 nt, Homo sapiens
caauggcccugccgucugu

SEQ ID NO: 1542140 - RNA, 19 nt, Homo sapiens
uuaaacagauggaguuacu

SEQ ID NO: 1542141 - RNA, 19 nt, Homo sapiens
agacaucuguuuaaauggu

SEQ ID NO: 1542142 - RNA, 19 nt, Homo sapiens
gggcuaauuacccggaaua

SEQ ID NO: 1542143 - RNA, 19 nt, Homo sapiens
cagauggaguuacugugaa

SEQ ID NO: 1542144 - RNA, 19 nt, Homo sapiens
acauguguuugacuguuua

SEQ ID NO: 1542145 - RNA, 19 nt, Homo sapiens
guguggaggugaucacgaa

SEQ ID NO: 1542146 - RNA, 19 nt, Homo sapiens
ucucugccuugacauuuaa

SEQ ID NO: 1542147 - RNA, 19 nt, Homo sapiens
caaccucucauuucacaga

SEQ ID NO: 1542148 - RNA, 19 nt, Homo sapiens
gcuuuguguugguguguaa

SEQ ID NO: 1542149 - RNA, 19 nt, Homo sapiens
cgaagauacauguguuuga

SEQ ID NO: 1542150 - RNA, 19 nt, Homo sapiens
uacauguguuugacuguuu

SEQ ID NO: 1542151 - RNA, 19 nt, Homo sapiens
gaggaacgagcugcaguuu

SEQ ID NO: 1542152 - RNA, 19 nt, Homo sapiens
uguuuaaugugcucucaaa

SEQ ID NO: 1542153 - RNA, 19 nt, Homo sapiens
gaggugaucacgaagauac

SEQ ID NO: 1542154 - RNA, 19 nt, Homo sapiens
gaaauugugagauguuuug

SEQ ID NO: 1542155 - RNA, 19 nt, Homo sapiens
gucaaccucucauuucaca

SEQ ID NO: 1542156 - RNA, 19 nt, Homo sapiens
gccuugacauuuaaauaca

SEQ ID NO: 1542157 - RNA, 19 nt, Homo sapiens
caugaucaauguauuucuc

SEQ ID NO: 1542158 - RNA, 19 nt, Homo sapiens
gcggacgcguggguuguaa

SEQ ID NO: 1542159 - RNA, 19 nt, Homo sapiens
gguacaagccaaccuaguc

SEQ ID NO: 1542160 - RNA, 19 nt, Homo sapiens
gcauuuauuagacaucugu

SEQ ID NO: 1542161 - RNA, 19 nt, Homo sapiens
caacuauuuaugcugguaa

SEQ ID NO: 1542162 - RNA, 19 nt, Homo sapiens
gguuagugguuggauucua

SEQ ID NO: 1542163 - RNA, 19 nt, Homo sapiens
ggccuucuuuccuuucugu

SEQ ID NO: 1542164 - RNA, 19 nt, Homo sapiens
gcauuggguuggacguucu

SEQ ID NO: 1542165 - RNA, 19 nt, Homo sapiens
ucagugguccagcuuuauu

SEQ ID NO: 1542166 - RNA, 19 nt, Homo sapiens
uauguacauucagcuguuu

SEQ ID NO: 1542167 - RNA, 19 nt, Homo sapiens
acaacuauuuaugcuggua

SEQ ID NO: 1542168 - RNA, 19 nt, Homo sapiens
ggaguuacugugaagaagu

SEQ ID NO: 1542169 - RNA, 19 nt, Homo sapiens
gguuggauucuauugguuu

SEQ ID NO: 1542170 - RNA, 19 nt, Homo sapiens
gugcagccacccagccuuu

SEQ ID NO: 1542171 - RNA, 19 nt, Homo sapiens
aaagggaacauagauggaa

SEQ ID NO: 1542172 - RNA, 19 nt, Homo sapiens
gugguuggauucuauuggu

SEQ ID NO: 1542173 - RNA, 19 nt, Homo sapiens
auacauguguuugacuguu

SEQ ID NO: 1542174 - RNA, 19 nt, Homo sapiens
ggaggugaucacgaagaua

SEQ ID NO: 1542175 - RNA, 19 nt, Homo sapiens
uguccacucccauggcuua

SEQ ID NO: 1542176 - RNA, 19 nt, Homo sapiens
ucacaaaacauccaauuuc

SEQ ID NO: 1542177 - RNA, 19 nt, Homo sapiens
gugagaaugcuguuauugg

SEQ ID NO: 1542178 - RNA, 19 nt, Homo sapiens
auauguacauucagcuguu

SEQ ID NO: 1542179 - RNA, 19 nt, Homo sapiens
gugcaauagguuccaauau

SEQ ID NO: 1542180 - RNA, 19 nt, Homo sapiens
ccagacgaaagcaauguug

SEQ ID NO: 1542181 - RNA, 19 nt, Homo sapiens
uuacugcgccaccacauca

SEQ ID NO: 1542182 - RNA, 19 nt, Homo sapiens
aaccuagucccacguugua

SEQ ID NO: 1542183 - RNA, 19 nt, Homo sapiens
gccucugccucucgucuga

SEQ ID NO: 1542184 - RNA, 19 nt, Homo sapiens
uagguuccaauaugcauuu

SEQ ID NO: 1542185 - RNA, 19 nt, Homo sapiens
uggaggugaucacgaagau

SEQ ID NO: 1542186 - RNA, 19 nt, Homo sapiens
uuaaugugcucucaaaaca

SEQ ID NO: 1542187 - RNA, 19 nt, Homo sapiens
guucacagcgauucaaagg

SEQ ID NO: 1542188 - RNA, 19 nt, Homo sapiens
ggucucaccgaugcaguuu

SEQ ID NO: 1542189 - RNA, 19 nt, Homo sapiens
uucucugccuugacauuua

SEQ ID NO: 1542190 - RNA, 19 nt, Homo sapiens
aaauugaaagggaacauag

SEQ ID NO: 1542191 - RNA, 19 nt, Homo sapiens
cugucaaccucucauuuca

SEQ ID NO: 1542192 - RNA, 19 nt, Homo sapiens
caucacaugaccuuaacau

SEQ ID NO: 1542193 - RNA, 19 nt, Homo sapiens
cacaucacaugaccuuaac

SEQ ID NO: 1542194 - RNA, 19 nt, Homo sapiens
aagggaacauagauggaau

SEQ ID NO: 1542195 - RNA, 19 nt, Homo sapiens
cagugguccagcuuuauuu

SEQ ID NO: 1542196 - RNA, 19 nt, Homo sapiens
gaagcuuguauucaguguu

SEQ ID NO: 1542197 - RNA, 19 nt, Homo sapiens
ugaggaacgagcugcaguu

SEQ ID NO: 1542198 - RNA, 19 nt, Homo sapiens
caccacaucacaugaccuu

SEQ ID NO: 1542199 - RNA, 19 nt, Homo sapiens
cacaaaacauccaauuucu

SEQ ID NO: 1542200 - RNA, 19 nt, Homo sapiens
gucugaccuugcagccuua

SEQ ID NO: 1542201 - RNA, 19 nt, Homo sapiens
gguccagcuuuauuuacag

SEQ ID NO: 1542202 - RNA, 19 nt, Homo sapiens
ugguccagcuuuauuuaca

SEQ ID NO: 1542203 - RNA, 19 nt, Homo sapiens
gguuagagguuuacaauua

SEQ ID NO: 1542204 - RNA, 19 nt, Homo sapiens
ggaaacauauguccuagaa

SEQ ID NO: 1542205 - RNA, 19 nt, Homo sapiens
ggacagcuuucacaaguaa

SEQ ID NO: 1542206 - RNA, 19 nt, Homo sapiens
guacaccuguucuuuauuu

SEQ ID NO: 1542207 - RNA, 19 nt, Homo sapiens
ucauagaccuuaucaguuu

SEQ ID NO: 1542208 - RNA, 19 nt, Homo sapiens
uggcaugaauugaguauua

SEQ ID NO: 1542209 - RNA, 19 nt, Homo sapiens
cuacaugucugucuucaaa

SEQ ID NO: 1542210 - RNA, 19 nt, Homo sapiens
uaaaggagcugaagaugca

SEQ ID NO: 1542211 - RNA, 19 nt, Homo sapiens
gaaauacacuauacaccau

SEQ ID NO: 1542212 - RNA, 19 nt, Homo sapiens
guaaagcuguaucgauuug

SEQ ID NO: 1542213 - RNA, 19 nt, Homo sapiens
caagggcaguuuccacuaa

SEQ ID NO: 1542214 - RNA, 19 nt, Homo sapiens
aauaguggcuguaguugua

SEQ ID NO: 1542215 - RNA, 19 nt, Homo sapiens
gaauguaaccguuguugaa

SEQ ID NO: 1542216 - RNA, 19 nt, Homo sapiens
gcacaauguuauaaggaaa

SEQ ID NO: 1542217 - RNA, 19 nt, Homo sapiens
gacaaaggauggcggagaa

SEQ ID NO: 1542218 - RNA, 19 nt, Homo sapiens
gagaagggaccaugauuug

SEQ ID NO: 1542219 - RNA, 19 nt, Homo sapiens
ucagagauccuaaugcuuu

SEQ ID NO: 1542220 - RNA, 19 nt, Homo sapiens
guagggagcuaaacauucu

SEQ ID NO: 1542221 - RNA, 19 nt, Homo sapiens
gcaaaucgcaagacauuca

SEQ ID NO: 1542222 - RNA, 19 nt, Homo sapiens
caaaacaucugguaguaaa

SEQ ID NO: 1542223 - RNA, 19 nt, Homo sapiens
gaauauacagccuuaacaa

SEQ ID NO: 1542224 - RNA, 19 nt, Homo sapiens
gcuaucaucuuucagaagu

SEQ ID NO: 1542225 - RNA, 19 nt, Homo sapiens
gaagguggaacugcaauuu

SEQ ID NO: 1542226 - RNA, 19 nt, Homo sapiens
ggagccauguguacgaauu

SEQ ID NO: 1542227 - RNA, 19 nt, Homo sapiens
gcuugaauauacagccuua

SEQ ID NO: 1542228 - RNA, 19 nt, Homo sapiens
ccaaagcagugcggaauau

SEQ ID NO: 1542229 - RNA, 19 nt, Homo sapiens
gaucacgaaucccucaaug

SEQ ID NO: 1542230 - RNA, 19 nt, Homo sapiens
cauuauaucccuuuaggua

SEQ ID NO: 1542231 - RNA, 19 nt, Homo sapiens
ggaauauguucucauugug

SEQ ID NO: 1542232 - RNA, 19 nt, Homo sapiens
cggaauauguucucauugu

SEQ ID NO: 1542233 - RNA, 19 nt, Homo sapiens
ggauucucaucaccaguua

SEQ ID NO: 1542234 - RNA, 19 nt, Homo sapiens
gaagggaccaugauuugga

SEQ ID NO: 1542235 - RNA, 19 nt, Homo sapiens
gaagcacaauguuauaagg

SEQ ID NO: 1542236 - RNA, 19 nt, Homo sapiens
caauggaagcacaauguua

SEQ ID NO: 1542237 - RNA, 19 nt, Homo sapiens
ugguaaagcuguaucgauu

SEQ ID NO: 1542238 - RNA, 19 nt, Homo sapiens
ccacuaacacagaauguaa

SEQ ID NO: 1542239 - RNA, 19 nt, Homo sapiens
guagcuucauuuaccaaua

SEQ ID NO: 1542240 - RNA, 19 nt, Homo sapiens
cacaaccacuguagccaua

SEQ ID NO: 1542241 - RNA, 19 nt, Homo sapiens
ucaccugccuaaacaauau

SEQ ID NO: 1542242 - RNA, 19 nt, Homo sapiens
caccaucaguuaagauuau

SEQ ID NO: 1542243 - RNA, 19 nt, Homo sapiens
caguacaccuguucuuuau

SEQ ID NO: 1542244 - RNA, 19 nt, Homo sapiens
agucaaugcugaagagaaa

SEQ ID NO: 1542245 - RNA, 19 nt, Homo sapiens
aaaggauggcggagaauua

SEQ ID NO: 1542246 - RNA, 19 nt, Homo sapiens
auacagugcuugaauauac

SEQ ID NO: 1542247 - RNA, 19 nt, Homo sapiens
uaacauacagugcuugaau

SEQ ID NO: 1542248 - RNA, 19 nt, Homo sapiens
ggacagccuuuaauuuuga

SEQ ID NO: 1542249 - RNA, 19 nt, Homo sapiens
uuccagagcugcuuaccua

SEQ ID NO: 1542250 - RNA, 19 nt, Homo sapiens
uauacagccuuaacaaugu

SEQ ID NO: 1542251 - RNA, 19 nt, Homo sapiens
ggaggagaagaaacuauuu

SEQ ID NO: 1542252 - RNA, 19 nt, Homo sapiens
gaauugaguauuaguguca

SEQ ID NO: 1542253 - RNA, 19 nt, Homo sapiens
guacuuugacgacaagaaa

SEQ ID NO: 1542254 - RNA, 19 nt, Homo sapiens
aagaauaagugaagguuag

SEQ ID NO: 1542255 - RNA, 19 nt, Homo sapiens
aggccaagauucugaguuu

SEQ ID NO: 1542256 - RNA, 19 nt, Homo sapiens
caucagagauccuaaugcu

SEQ ID NO: 1542257 - RNA, 19 nt, Homo sapiens
gcaacaaccagcagcauca

SEQ ID NO: 1542258 - RNA, 19 nt, Homo sapiens
aacauacagugcuugaaua

SEQ ID NO: 1542259 - RNA, 19 nt, Homo sapiens
acaaucagcuguugaaagc

SEQ ID NO: 1542260 - RNA, 19 nt, Homo sapiens
ggaccggagugaugaugga

SEQ ID NO: 1542261 - RNA, 19 nt, Homo sapiens
guacgaauugcaaucauga

SEQ ID NO: 1542262 - RNA, 19 nt, Homo sapiens
ugaccaugcucucauagga

SEQ ID NO: 1542263 - RNA, 19 nt, Homo sapiens
cagagcugcuuaccuaugu

SEQ ID NO: 1542264 - RNA, 19 nt, Homo sapiens
cuuauuaacucccauacug

SEQ ID NO: 1542265 - RNA, 19 nt, Homo sapiens
ggagaaaacuggcuaucau

SEQ ID NO: 1542266 - RNA, 19 nt, Homo sapiens
cacuauacaccaucaguua

SEQ ID NO: 1542267 - RNA, 19 nt, Homo sapiens
gcggucaucugcagaguag

SEQ ID NO: 1542268 - RNA, 19 nt, Homo sapiens
ccaagucaaugcugaagag

SEQ ID NO: 1542269 - RNA, 19 nt, Homo sapiens
cagaguagaucacgaaucc

SEQ ID NO: 1542270 - RNA, 19 nt, Homo sapiens
ccauugcucuuuuaacaua

SEQ ID NO: 1542271 - RNA, 19 nt, Homo sapiens
gaaggcagccaagucaaug

SEQ ID NO: 1542272 - RNA, 19 nt, Homo sapiens
aaacggauaaugguacaua

SEQ ID NO: 1542273 - RNA, 19 nt, Homo sapiens
ggaugcaaaucgcaagaca

SEQ ID NO: 1542274 - RNA, 19 nt, Homo sapiens
ggucaaauccagcucaaca

SEQ ID NO: 1542275 - RNA, 19 nt, Homo sapiens
gguaaagcuguaucgauuu

SEQ ID NO: 1542276 - RNA, 19 nt, Homo sapiens
caacaugcuuuggaaacau

SEQ ID NO: 1542277 - RNA, 19 nt, Homo sapiens
ggauauuguagcuucauuu

SEQ ID NO: 1542278 - RNA, 19 nt, Homo sapiens
aaaacuggcuaucaucuuu

SEQ ID NO: 1542279 - RNA, 19 nt, Homo sapiens
ccaugcaggugcuagaaau

SEQ ID NO: 1542280 - RNA, 19 nt, Homo sapiens
uaaagauucaccugccuaa

SEQ ID NO: 1542281 - RNA, 19 nt, Homo sapiens
guaucgauuugcuauugaa

SEQ ID NO: 1542282 - RNA, 19 nt, Homo sapiens
ucaucuccuuggaucauua

SEQ ID NO: 1542283 - RNA, 19 nt, Homo sapiens
ucagauuaguggauucuca

SEQ ID NO: 1542284 - RNA, 19 nt, Homo sapiens
uuuggaauguuggagauua

SEQ ID NO: 1542285 - RNA, 19 nt, Homo sapiens
ggcauaaaggaacguauuu

SEQ ID NO: 1542286 - RNA, 19 nt, Homo sapiens
acacuuugcuucccacuac

SEQ ID NO: 1542287 - RNA, 19 nt, Homo sapiens
gaggaaggcaagcuccaaa

SEQ ID NO: 1542288 - RNA, 19 nt, Homo sapiens
aacaugcuuuggaaacaua

SEQ ID NO: 1542289 - RNA, 19 nt, Homo sapiens
aagacaacaugcuuuggaa

SEQ ID NO: 1542290 - RNA, 19 nt, Homo sapiens
cuccuuggaucauuauauu

SEQ ID NO: 1542291 - RNA, 19 nt, Homo sapiens
gccuaaauuucacaccauu

SEQ ID NO: 1542292 - RNA, 19 nt, Homo sapiens
agagaagggaccaugauuu

SEQ ID NO: 1542293 - RNA, 19 nt, Homo sapiens
gaauaguggcuguaguugu

SEQ ID NO: 1542294 - RNA, 19 nt, Homo sapiens
gaacaaaacggauaauggu

SEQ ID NO: 1542295 - RNA, 19 nt, Homo sapiens
gacaaagagauuaaagaug

SEQ ID NO: 1542296 - RNA, 19 nt, Homo sapiens
uauggagggugacuugaug

SEQ ID NO: 1542297 - RNA, 19 nt, Homo sapiens
uaagaugcaggccaagauu

SEQ ID NO: 1542298 - RNA, 19 nt, Homo sapiens
caaaggauggcggagaauu

SEQ ID NO: 1542299 - RNA, 19 nt, Homo sapiens
uaaaccugcagcugauaua

SEQ ID NO: 1542300 - RNA, 19 nt, Homo sapiens
ggaagcacaauguuauaag

SEQ ID NO: 1542301 - RNA, 19 nt, Homo sapiens
agugaagguuagagguuua

SEQ ID NO: 1542302 - RNA, 19 nt, Homo sapiens
uaagugaagguuagagguu

SEQ ID NO: 1542303 - RNA, 19 nt, Homo sapiens
ucacagagauggacaguua

SEQ ID NO: 1542304 - RNA, 19 nt, Homo sapiens
gcagagagcugucagauac

SEQ ID NO: 1542305 - RNA, 19 nt, Homo sapiens
gauggacaguuacaauuua

SEQ ID NO: 1542306 - RNA, 19 nt, Homo sapiens
gagaagaacaucuauauug

SEQ ID NO: 1542307 - RNA, 19 nt, Homo sapiens
ugaagaagaugaagaagaa

SEQ ID NO: 1542308 - RNA, 19 nt, Homo sapiens
gauagacaauuuagcaguu

SEQ ID NO: 1542309 - RNA, 19 nt, Homo sapiens
gaacagccuaugaagauaa

SEQ ID NO: 1542310 - RNA, 19 nt, Homo sapiens
ggaugaagaugaauauaag

SEQ ID NO: 1542311 - RNA, 19 nt, Homo sapiens
gaacauggcagaagaagag

SEQ ID NO: 1542312 - RNA, 19 nt, Homo sapiens
ggaacagccuaugaagaua

SEQ ID NO: 1542313 - RNA, 19 nt, Homo sapiens
agaaggagaucucagaaga

SEQ ID NO: 1542314 - RNA, 19 nt, Homo sapiens
gcagaacaguuucgaaugc

SEQ ID NO: 1542315 - RNA, 19 nt, Homo sapiens
agaccuaucuucaaauugu

SEQ ID NO: 1542316 - RNA, 19 nt, Homo sapiens
caacagguaacuucuuauu

SEQ ID NO: 1542317 - RNA, 19 nt, Homo sapiens
uaagcaagaugaaaugaag

SEQ ID NO: 1542318 - RNA, 19 nt, Homo sapiens
gagauggacaguuacaauu

SEQ ID NO: 1542319 - RNA, 19 nt, Homo sapiens
gauuuaagcguacuggaaa

SEQ ID NO: 1542320 - RNA, 19 nt, Homo sapiens
gaaggagaucucagaagaa

SEQ ID NO: 1542321 - RNA, 19 nt, Homo sapiens
accaacagguaacuucuua

SEQ ID NO: 1542322 - RNA, 19 nt, Homo sapiens
cagaucaugacuaagauua

SEQ ID NO: 1542323 - RNA, 19 nt, Homo sapiens
gaagaagaggacuauaugu

SEQ ID NO: 1542324 - RNA, 19 nt, Homo sapiens
cagaagaagaggacuauau

SEQ ID NO: 1542325 - RNA, 19 nt, Homo sapiens
gaagcaugguacugguuga

SEQ ID NO: 1542326 - RNA, 19 nt, Homo sapiens
agaacaggaugaagaugaa

SEQ ID NO: 1542327 - RNA, 19 nt, Homo sapiens
acacaaguaucacagagau

SEQ ID NO: 1542328 - RNA, 19 nt, Homo sapiens
caacuucugcagaucauga

SEQ ID NO: 1542329 - RNA, 19 nt, Homo sapiens
aagaugaaaugaagcuaga

SEQ ID NO: 1542330 - RNA, 19 nt, Homo sapiens
agaggagacugaagaagau

SEQ ID NO: 1542331 - RNA, 19 nt, Homo sapiens
gcuagaaggagaucucaga

SEQ ID NO: 1542332 - RNA, 19 nt, Homo sapiens
ucugauuccuucauuaaug

SEQ ID NO: 1542333 - RNA, 19 nt, Homo sapiens
gaagauaaagaagaccuau

SEQ ID NO: 1542334 - RNA, 19 nt, Homo sapiens
uuaaggacaccaacaggua

SEQ ID NO: 1542335 - RNA, 19 nt, Homo sapiens
gauacuauagccauaugaa

SEQ ID NO: 1542336 - RNA, 19 nt, Homo sapiens
ccagcgagccugucaacaa

SEQ ID NO: 1542337 - RNA, 19 nt, Homo sapiens
uaaggacaccaacagguaa

SEQ ID NO: 1542338 - RNA, 19 nt, Homo sapiens
agagagcugucagauacua

SEQ ID NO: 1542339 - RNA, 19 nt, Homo sapiens
cagauacuauagccauaug

SEQ ID NO: 1542340 - RNA, 19 nt, Homo sapiens
aaaguggcauuggucauga

SEQ ID NO: 1542341 - RNA, 19 nt, Homo sapiens
agaagaagaggacuauaug

SEQ ID NO: 1542342 - RNA, 19 nt, Homo sapiens
uggaacagccuaugaagau

SEQ ID NO: 1542343 - RNA, 19 nt, Homo sapiens
gcauuucagaacacaagua

SEQ ID NO: 1542344 - RNA, 19 nt, Homo sapiens
cugcagaucaugacuaaga

SEQ ID NO: 1542345 - RNA, 19 nt, Homo sapiens
ggaccaacuucugcagauc

SEQ ID NO: 1542346 - RNA, 19 nt, Homo sapiens
gucagauacuauagccaua

SEQ ID NO: 1542347 - RNA, 19 nt, Homo sapiens
gcagaucaugacuaagauu

SEQ ID NO: 1542348 - RNA, 19 nt, Homo sapiens
gacugaagaagaugaagaa

SEQ ID NO: 1542349 - RNA, 19 nt, Homo sapiens
aagaggagacugaagaaga

SEQ ID NO: 1542350 - RNA, 19 nt, Homo sapiens
ugaaaugaagcuagaagga

SEQ ID NO: 1542351 - RNA, 19 nt, Homo sapiens
acagguaacuucuuauucc

SEQ ID NO: 1542352 - RNA, 19 nt, Homo sapiens
agauggacaguuacaauuu

SEQ ID NO: 1542353 - RNA, 19 nt, Homo sapiens
gcaguuggaaaucucaaau

SEQ ID NO: 1542354 - RNA, 19 nt, Homo sapiens
aagaacaggaugaagauga

SEQ ID NO: 1542355 - RNA, 19 nt, Homo sapiens
caguuucgaaugcgacuua

SEQ ID NO: 1542356 - RNA, 19 nt, Homo sapiens
uuucagaacacaaguauca

SEQ ID NO: 1542357 - RNA, 19 nt, Homo sapiens
uccuagggauagacaauuu

SEQ ID NO: 1542358 - RNA, 19 nt, Homo sapiens
gaagaagaugaagaagaaa

SEQ ID NO: 1542359 - RNA, 19 nt, Homo sapiens
ugucugauuccuucauuaa

SEQ ID NO: 1542360 - RNA, 19 nt, Homo sapiens
gagcagagagcugucagau

SEQ ID NO: 1542361 - RNA, 19 nt, Homo sapiens
cagcgagccugucaacaac

SEQ ID NO: 1542362 - RNA, 19 nt, Homo sapiens
gaagccagcgagccuguca

SEQ ID NO: 1542363 - RNA, 19 nt, Homo sapiens
uaugucugauuccuucauu

SEQ ID NO: 1542364 - RNA, 19 nt, Homo sapiens
gcagaagaagaggacuaua

SEQ ID NO: 1542365 - RNA, 19 nt, Homo sapiens
ggagacugaagaagaugaa

SEQ ID NO: 1542366 - RNA, 19 nt, Homo sapiens
aaggagaucucagaagaag

SEQ ID NO: 1542367 - RNA, 19 nt, Homo sapiens
uauuguauuugguguggaa

SEQ ID NO: 1542368 - RNA, 19 nt, Homo sapiens
gaaguugaacauggcagaa

SEQ ID NO: 1542369 - RNA, 19 nt, Homo sapiens
aggacuauaugucugauuc

SEQ ID NO: 1542370 - RNA, 19 nt, Homo sapiens
ugaagaggagacugaagaa

SEQ ID NO: 1542371 - RNA, 19 nt, Homo sapiens
gaagcuagaaggagaucuc

SEQ ID NO: 1542372 - RNA, 19 nt, Homo sapiens
cuucauuaauguccaggaa

SEQ ID NO: 1542373 - RNA, 19 nt, Homo sapiens
ccuagggauagacaauuua

SEQ ID NO: 1542374 - RNA, 19 nt, Homo sapiens
gaccaacuucugcagauca

SEQ ID NO: 1542375 - RNA, 19 nt, Homo sapiens
ccuaugaagauaaagaaga

SEQ ID NO: 1542376 - RNA, 19 nt, Homo sapiens
cugauuccuucauuaaugu

SEQ ID NO: 1542377 - RNA, 19 nt, Homo sapiens
gcgagccugucaacaacug

SEQ ID NO: 1542378 - RNA, 19 nt, Homo sapiens
gaacaggaugaagaugaau

SEQ ID NO: 1542379 - RNA, 19 nt, Homo sapiens
gaugaaaugaagcuagaag

SEQ ID NO: 1542380 - RNA, 19 nt, Homo sapiens
cuaugaagauaaagaagac

SEQ ID NO: 1542381 - RNA, 19 nt, Homo sapiens
aacagccuaugaagauaaa

SEQ ID NO: 1542382 - RNA, 19 nt, Homo sapiens
agaagaggacuauaugucu

SEQ ID NO: 1542383 - RNA, 19 nt, Homo sapiens
gguguggaacagccuauga

SEQ ID NO: 1542384 - RNA, 19 nt, Homo sapiens
gaagaggagacugaagaag

SEQ ID NO: 1542385 - RNA, 19 nt, Homo sapiens
gguacugguugaggcuuga

SEQ ID NO: 1542386 - RNA, 19 nt, Homo sapiens
ucauuaauguccaggaaaa

SEQ ID NO: 1542387 - RNA, 19 nt, Homo sapiens
gcaagaugaaaugaagcua

SEQ ID NO: 1542388 - RNA, 19 nt, Homo sapiens
ggacaccaacagguaacuu

SEQ ID NO: 1542389 - RNA, 19 nt, Homo sapiens
agagauggacaguuacaau

SEQ ID NO: 1542390 - RNA, 19 nt, Homo sapiens
auagacaauuuagcaguug

SEQ ID NO: 1542391 - RNA, 19 nt, Homo sapiens
gacaccaacagguaacuuc

SEQ ID NO: 1542392 - RNA, 19 nt, Homo sapiens
agagcugucagauacuaua

SEQ ID NO: 1542393 - RNA, 19 nt, Homo sapiens
cuauagccauaugaaguug

SEQ ID NO: 1542394 - RNA, 19 nt, Homo sapiens
aaacggaaagcagaggaaa

SEQ ID NO: 1542395 - RNA, 19 nt, Homo sapiens
aagaagaggacuauauguc

SEQ ID NO: 1542396 - RNA, 19 nt, Homo sapiens
guggaacagccuaugaaga

SEQ ID NO: 1542397 - RNA, 19 nt, Homo sapiens
cugaagaagaugaagaaga

SEQ ID NO: 1542398 - RNA, 19 nt, Homo sapiens
auagccauaugaaguugaa

SEQ ID NO: 1542399 - RNA, 19 nt, Homo sapiens
acuauagccauaugaaguu

SEQ ID NO: 1542400 - RNA, 19 nt, Homo sapiens
ggcagaagaagaggacuau

SEQ ID NO: 1542401 - RNA, 19 nt, Homo sapiens
agauuuaagcguacuggaa

SEQ ID NO: 1542402 - RNA, 19 nt, Homo sapiens
uugaagaggagacugaaga

SEQ ID NO: 1542403 - RNA, 19 nt, Homo sapiens
guauagaacucaacagaaa

SEQ ID NO: 1542404 - RNA, 19 nt, Homo sapiens
agucuaagcugcacuauuu

SEQ ID NO: 1542405 - RNA, 19 nt, Homo sapiens
agaaggaacucacacuuaa

SEQ ID NO: 1542406 - RNA, 19 nt, Homo sapiens
gaacauccuuaucaucuuc

SEQ ID NO: 1542407 - RNA, 19 nt, Homo sapiens
agaaacagcggaugaaaua

SEQ ID NO: 1542408 - RNA, 19 nt, Homo sapiens
gguuacaacugaauuagaa

SEQ ID NO: 1542409 - RNA, 19 nt, Homo sapiens
gaacagcucccucaguuuc

SEQ ID NO: 1542410 - RNA, 19 nt, Homo sapiens
ucaaauaacugcaagaacu

SEQ ID NO: 1542411 - RNA, 19 nt, Homo sapiens
gaaacauccuuaucacauc

SEQ ID NO: 1542412 - RNA, 19 nt, Homo sapiens
gaacucacacuuaaagaug

SEQ ID NO: 1542413 - RNA, 19 nt, Homo sapiens
ggagcuccaugcccucaua

SEQ ID NO: 1542414 - RNA, 19 nt, Homo sapiens
gaacucgggcugugagaaa

SEQ ID NO: 1542415 - RNA, 19 nt, Homo sapiens
gcuucuagcuucacuguug

SEQ ID NO: 1542416 - RNA, 19 nt, Homo sapiens
agaguuaccuuguguugaa

SEQ ID NO: 1542417 - RNA, 19 nt, Homo sapiens
gaaccagaguuaccuugug

SEQ ID NO: 1542418 - RNA, 19 nt, Homo sapiens
cgagcaagcuuaucugauc

SEQ ID NO: 1542419 - RNA, 19 nt, Homo sapiens
caggguaucauauguguua

SEQ ID NO: 1542420 - RNA, 19 nt, Homo sapiens
ggaacauccuuaucaucuu

SEQ ID NO: 1542421 - RNA, 19 nt, Homo sapiens
ggacuucauugaugcacuu

SEQ ID NO: 1542422 - RNA, 19 nt, Homo sapiens
ccacagacuucaaauaacu

SEQ ID NO: 1542423 - RNA, 19 nt, Homo sapiens
gcagugaaagcuaacaauu

SEQ ID NO: 1542424 - RNA, 19 nt, Homo sapiens
gcaccuguaucuggaugua

SEQ ID NO: 1542425 - RNA, 19 nt, Homo sapiens
gggcuaaggcaucaaguaa

SEQ ID NO: 1542426 - RNA, 19 nt, Homo sapiens
uggaacagcucccucaguu

SEQ ID NO: 1542427 - RNA, 19 nt, Homo sapiens
cauaagaauuccuacuuca

SEQ ID NO: 1542428 - RNA, 19 nt, Homo sapiens
gaaggaacucacacuuaaa

SEQ ID NO: 1542429 - RNA, 19 nt, Homo sapiens
augaagagguuacaacuga

SEQ ID NO: 1542430 - RNA, 19 nt, Homo sapiens
aaacagcggaugaaauauu

SEQ ID NO: 1542431 - RNA, 19 nt, Homo sapiens
caggagcagugaaagcuaa

SEQ ID NO: 1542432 - RNA, 19 nt, Homo sapiens
gcagaaacauccuuaucac

SEQ ID NO: 1542433 - RNA, 19 nt, Homo sapiens
ccuguuagcuuccuucauc

SEQ ID NO: 1542434 - RNA, 19 nt, Homo sapiens
aagaaggaacucacacuua

SEQ ID NO: 1542435 - RNA, 19 nt, Homo sapiens
ccaccugacugcagaaaca

SEQ ID NO: 1542436 - RNA, 19 nt, Homo sapiens
gcucaucucacucugguaa

SEQ ID NO: 1542437 - RNA, 19 nt, Homo sapiens
ccauaagaauuccuacuuc

SEQ ID NO: 1542438 - RNA, 19 nt, Homo sapiens
gcuaaggcaucaaguaagg

SEQ ID NO: 1542439 - RNA, 19 nt, Homo sapiens
gaaaacugcuuaugaagag

SEQ ID NO: 1542440 - RNA, 19 nt, Homo sapiens
gcucagagggcaccuguau

SEQ ID NO: 1542441 - RNA, 19 nt, Homo sapiens
aacagcggaugaaauauuu

SEQ ID NO: 1542442 - RNA, 19 nt, Homo sapiens
gaucagcaccaagcucuuu

SEQ ID NO: 1542443 - RNA, 19 nt, Homo sapiens
gaccuggugcucaacuuua

SEQ ID NO: 1542444 - RNA, 19 nt, Homo sapiens
gagaaacagcggaugaaau

SEQ ID NO: 1542445 - RNA, 19 nt, Homo sapiens
aagcugcacuauuugguaa

SEQ ID NO: 1542446 - RNA, 19 nt, Homo sapiens
ggccucaucuguccuguuc

SEQ ID NO: 1542447 - RNA, 19 nt, Homo sapiens
uaaaggagaacagcaagaa

SEQ ID NO: 1542448 - RNA, 19 nt, Homo sapiens
gcucccgucuacuuucuuu

SEQ ID NO: 1542449 - RNA, 19 nt, Homo sapiens
ggaccguguagaacaaaua

SEQ ID NO: 1542450 - RNA, 19 nt, Homo sapiens
ggagaaacagcggaugaaa

SEQ ID NO: 1542451 - RNA, 19 nt, Homo sapiens
aagcuuaucugaucuucug

SEQ ID NO: 1542452 - RNA, 19 nt, Homo sapiens
ggacaucaaccacauucug

SEQ ID NO: 1542453 - RNA, 19 nt, Homo sapiens
caaauaacugcaagaacuu

SEQ ID NO: 1542454 - RNA, 19 nt, Homo sapiens
ggaacucacacuuaaagau

SEQ ID NO: 1542455 - RNA, 19 nt, Homo sapiens
ucacucugguaaugucuuu

SEQ ID NO: 1542456 - RNA, 19 nt, Homo sapiens
ucugggaucucuacuagga

SEQ ID NO: 1542457 - RNA, 19 nt, Homo sapiens
gcuaacaauuccaugucaa

SEQ ID NO: 1542458 - RNA, 19 nt, Homo sapiens
cuacugagcagcaagcuau

SEQ ID NO: 1542459 - RNA, 19 nt, Homo sapiens
gaagagguuacaacugaau

SEQ ID NO: 1542460 - RNA, 19 nt, Homo sapiens
gacaucaaccacauucuga

SEQ ID NO: 1542461 - RNA, 19 nt, Homo sapiens
ggagcuggaccguguagaa

SEQ ID NO: 1542462 - RNA, 19 nt, Homo sapiens
ggaacagcucccucaguuu

SEQ ID NO: 1542463 - RNA, 19 nt, Homo sapiens
gcacaggucaggccauucu

SEQ ID NO: 1542464 - RNA, 19 nt, Homo sapiens
ucaaccacauucugaggaa

SEQ ID NO: 1542465 - RNA, 19 nt, Homo sapiens
guaauaaaccuguguugcu

SEQ ID NO: 1542466 - RNA, 19 nt, Homo sapiens
ccucccagcgcuaugauua

SEQ ID NO: 1542467 - RNA, 19 nt, Homo sapiens
gccuuacccuguaggaauu

SEQ ID NO: 1542468 - RNA, 19 nt, Homo sapiens
gcuggaccguguagaacaa

SEQ ID NO: 1542469 - RNA, 19 nt, Homo sapiens
gcaccugcuucuagcuuca

SEQ ID NO: 1542470 - RNA, 19 nt, Homo sapiens
gagcaagcuuaucugaucu

SEQ ID NO: 1542471 - RNA, 19 nt, Homo sapiens
ugggagagguuacuguuag

SEQ ID NO: 1542472 - RNA, 19 nt, Homo sapiens
gggcaccacugaggaagga

SEQ ID NO: 1542473 - RNA, 19 nt, Homo sapiens
agagagaagugugcucaga

SEQ ID NO: 1542474 - RNA, 19 nt, Homo sapiens
gaccguguagaacaaauaa

SEQ ID NO: 1542475 - RNA, 19 nt, Homo sapiens
gagcagcaagcuauacugu

SEQ ID NO: 1542476 - RNA, 19 nt, Homo sapiens
ugaagagguuacaacugaa

SEQ ID NO: 1542477 - RNA, 19 nt, Homo sapiens
acccacagacuucaaauaa

SEQ ID NO: 1542478 - RNA, 19 nt, Homo sapiens
gccauaagaauuccuacuu

SEQ ID NO: 1542479 - RNA, 19 nt, Homo sapiens
gcaagcuuaucugaucuuc

SEQ ID NO: 1542480 - RNA, 19 nt, Homo sapiens
guaaugugguccugagacu

SEQ ID NO: 1542481 - RNA, 19 nt, Homo sapiens
ccacugagagcaggacaaa

SEQ ID NO: 1542482 - RNA, 19 nt, Homo sapiens
uaagcugcacuauuuggua

SEQ ID NO: 1542483 - RNA, 19 nt, Homo sapiens
agagguuacuguuagucua

SEQ ID NO: 1542484 - RNA, 19 nt, Homo sapiens
gcaggagcagugaaagcua

SEQ ID NO: 1542485 - RNA, 19 nt, Homo sapiens
caaacccacagacuucaaa

SEQ ID NO: 1542486 - RNA, 19 nt, Homo sapiens
ucagguugcugcucaaagg

SEQ ID NO: 1542487 - RNA, 19 nt, Homo sapiens
uccaugcccucauagugua

SEQ ID NO: 1542488 - RNA, 19 nt, Homo sapiens
gaacuucuugacugagaug

SEQ ID NO: 1542489 - RNA, 19 nt, Homo sapiens
agaaacauccuuaucacau

SEQ ID NO: 1542490 - RNA, 19 nt, Homo sapiens
agagguuacaacugaauua

SEQ ID NO: 1542491 - RNA, 19 nt, Homo sapiens
caaggcagagucagagguu

SEQ ID NO: 1542492 - RNA, 19 nt, Homo sapiens
caaaacggccauaagaauu

SEQ ID NO: 1542493 - RNA, 19 nt, Homo sapiens
ucucagcacucuuccuaca

SEQ ID NO: 1542494 - RNA, 19 nt, Homo sapiens
ccauaaaggagaacagcaa

SEQ ID NO: 1542495 - RNA, 19 nt, Homo sapiens
caccguggcucuucauugc

SEQ ID NO: 1542496 - RNA, 19 nt, Homo sapiens
cuucugggaucucuacuag

SEQ ID NO: 1542497 - RNA, 19 nt, Homo sapiens
accauggacugaacacuug

SEQ ID NO: 1542498 - RNA, 19 nt, Homo sapiens
cuaacaauuccaugucaaa

SEQ ID NO: 1542499 - RNA, 19 nt, Homo sapiens
gaaacagcggaugaaauau

SEQ ID NO: 1542500 - RNA, 19 nt, Homo sapiens
gaguuaccuuguguugaaa

SEQ ID NO: 1542501 - RNA, 19 nt, Homo sapiens
gggagagguuacuguuagu

SEQ ID NO: 1542502 - RNA, 19 nt, Homo sapiens
ccauggacccugcguggaa

SEQ ID NO: 1542503 - RNA, 19 nt, Homo sapiens
gaaauacacugcuaauguu

SEQ ID NO: 1542504 - RNA, 19 nt, Homo sapiens
cagaggagccgaugaguua

SEQ ID NO: 1542505 - RNA, 19 nt, Homo sapiens
ucacagccguuucuucaua

SEQ ID NO: 1542506 - RNA, 19 nt, Homo sapiens
acacaucacucuuuacauu

SEQ ID NO: 1542507 - RNA, 19 nt, Homo sapiens
gaaaugcaguuguuuaucg

SEQ ID NO: 1542508 - RNA, 19 nt, Homo sapiens
uaacggaggucugcucuga

SEQ ID NO: 1542509 - RNA, 19 nt, Homo sapiens
uaauugaggucacagaaug

SEQ ID NO: 1542510 - RNA, 19 nt, Homo sapiens
gaaauaacguagguacaca

SEQ ID NO: 1542511 - RNA, 19 nt, Homo sapiens
gccgaugaguuacuuaauu

SEQ ID NO: 1542512 - RNA, 19 nt, Homo sapiens
aaugggagauacaacuuua

SEQ ID NO: 1542513 - RNA, 19 nt, Homo sapiens
gaaaauaggucagucuuag

SEQ ID NO: 1542514 - RNA, 19 nt, Homo sapiens
gagaacggcaacuccaaua

SEQ ID NO: 1542515 - RNA, 19 nt, Homo sapiens
gagauaaugcucuguacuu

SEQ ID NO: 1542516 - RNA, 19 nt, Homo sapiens
ccgaugaguuacuuaauug

SEQ ID NO: 1542517 - RNA, 19 nt, Homo sapiens
agaaugaccugcugacauc

SEQ ID NO: 1542518 - RNA, 19 nt, Homo sapiens
cagaaugaauuagcaagaa

SEQ ID NO: 1542519 - RNA, 19 nt, Homo sapiens
ggauguuuaugcuguuuga

SEQ ID NO: 1542520 - RNA, 19 nt, Homo sapiens
agaaauacacugcuaaugu

SEQ ID NO: 1542521 - RNA, 19 nt, Homo sapiens
gaggugugauuuacccauu

SEQ ID NO: 1542522 - RNA, 19 nt, Homo sapiens
gaggucacagaaugaauua

SEQ ID NO: 1542523 - RNA, 19 nt, Homo sapiens
gugacaaccuuuucaauaa

SEQ ID NO: 1542524 - RNA, 19 nt, Homo sapiens
gaaugggagauacaacuuu

SEQ ID NO: 1542525 - RNA, 19 nt, Homo sapiens
ggaccacgcugaggaacga

SEQ ID NO: 1542526 - RNA, 19 nt, Homo sapiens
ccaauaaggcccaguucaa

SEQ ID NO: 1542527 - RNA, 19 nt, Homo sapiens
gaacggcaacuccaauaag

SEQ ID NO: 1542528 - RNA, 19 nt, Homo sapiens
guacacaucacucuuuaca

SEQ ID NO: 1542529 - RNA, 19 nt, Homo sapiens
gagaaugaaugggagauac

SEQ ID NO: 1542530 - RNA, 19 nt, Homo sapiens
gaacagccacccuucugau

SEQ ID NO: 1542531 - RNA, 19 nt, Homo sapiens
ggaauuguauuagauagcu

SEQ ID NO: 1542532 - RNA, 19 nt, Homo sapiens
uacaucauccuaagagaua

SEQ ID NO: 1542533 - RNA, 19 nt, Homo sapiens
cgauuaaugugacaaccuu

SEQ ID NO: 1542534 - RNA, 19 nt, Homo sapiens
acaccaacgugauugagaa

SEQ ID NO: 1542535 - RNA, 19 nt, Homo sapiens
ggaacagccacccuucuga

SEQ ID NO: 1542536 - RNA, 19 nt, Homo sapiens
aaaaggcacucgauuaaug

SEQ ID NO: 1542537 - RNA, 19 nt, Homo sapiens
uaggucagucuuagaaaua

SEQ ID NO: 1542538 - RNA, 19 nt, Homo sapiens
ucccauaccucagaauuau

SEQ ID NO: 1542539 - RNA, 19 nt, Homo sapiens
gagccgaugaguuacuuaa

SEQ ID NO: 1542540 - RNA, 19 nt, Homo sapiens
gcuaccagguguucuacga

SEQ ID NO: 1542541 - RNA, 19 nt, Homo sapiens
uuaccgaaaugcaguuguu

SEQ ID NO: 1542542 - RNA, 19 nt, Homo sapiens
cauauaauccgaccacagu

SEQ ID NO: 1542543 - RNA, 19 nt, Homo sapiens
ucaauaagcagaaauaacg

SEQ ID NO: 1542544 - RNA, 19 nt, Homo sapiens
acccaucccucgguucuua

SEQ ID NO: 1542545 - RNA, 19 nt, Homo sapiens
guuaugugguccuuauugu

SEQ ID NO: 1542546 - RNA, 19 nt, Homo sapiens
uguggaauauucugagaga

SEQ ID NO: 1542547 - RNA, 19 nt, Homo sapiens
aaauaggucagucuuagaa

SEQ ID NO: 1542548 - RNA, 19 nt, Homo sapiens
gauaaugcucuguacuuca

SEQ ID NO: 1542549 - RNA, 19 nt, Homo sapiens
gaaggucgccgugagucaa

SEQ ID NO: 1542550 - RNA, 19 nt, Homo sapiens
cuacugcgccuuccagaau

SEQ ID NO: 1542551 - RNA, 19 nt, Homo sapiens
ugacucuccuggcaaugaa

SEQ ID NO: 1542552 - RNA, 19 nt, Homo sapiens
ugagagacccugugaaggu

SEQ ID NO: 1542553 - RNA, 19 nt, Homo sapiens
agguacacaucacucuuua

SEQ ID NO: 1542554 - RNA, 19 nt, Homo sapiens
uaacguagguacacaucac

SEQ ID NO: 1542555 - RNA, 19 nt, Homo sapiens
ucaaaaggcacucgauuaa

SEQ ID NO: 1542556 - RNA, 19 nt, Homo sapiens
ccacggcgcugggaauuuu

SEQ ID NO: 1542557 - RNA, 19 nt, Homo sapiens
aagcagaaauaacguaggu

SEQ ID NO: 1542558 - RNA, 19 nt, Homo sapiens
gcacucgauuaaugugaca

SEQ ID NO: 1542559 - RNA, 19 nt, Homo sapiens
ccucgguucuuaacucuuc

SEQ ID NO: 1542560 - RNA, 19 nt, Homo sapiens
gaucgugcgcuaccagaga

SEQ ID NO: 1542561 - RNA, 19 nt, Homo sapiens
ugaggucacagaaugaauu

SEQ ID NO: 1542562 - RNA, 19 nt, Homo sapiens
gaaugaaugggagauacaa

SEQ ID NO: 1542563 - RNA, 19 nt, Homo sapiens
ccgguuaugugguccuuau

SEQ ID NO: 1542564 - RNA, 19 nt, Homo sapiens
auaaugcucuguacuucau

SEQ ID NO: 1542565 - RNA, 19 nt, Homo sapiens
ucuuagaaauacacugcua

SEQ ID NO: 1542566 - RNA, 19 nt, Homo sapiens
ccgaaaugcaguuguuuau

SEQ ID NO: 1542567 - RNA, 19 nt, Homo sapiens
agauaaugcucuguacuuc

SEQ ID NO: 1542568 - RNA, 19 nt, Homo sapiens
uagguacacaucacucuuu

SEQ ID NO: 1542569 - RNA, 19 nt, Homo sapiens
cacagccguuucuucauau

SEQ ID NO: 1542570 - RNA, 19 nt, Homo sapiens
ucugugagaucgagaaggu

SEQ ID NO: 1542571 - RNA, 19 nt, Homo sapiens
caacgugagccacagcaau

SEQ ID NO: 1542572 - RNA, 19 nt, Homo sapiens
gguuaugugguccuuauug

SEQ ID NO: 1542573 - RNA, 19 nt, Homo sapiens
ccagaggagccgaugaguu

SEQ ID NO: 1542574 - RNA, 19 nt, Homo sapiens
gauuuacccauuacacaau

SEQ ID NO: 1542575 - RNA, 19 nt, Homo sapiens
cgaccgcgcucuugaugcu

SEQ ID NO: 1542576 - RNA, 19 nt, Homo sapiens
caauaaggcccaguucaag

SEQ ID NO: 1542577 - RNA, 19 nt, Homo sapiens
cacaucacucuuuacauuu

SEQ ID NO: 1542578 - RNA, 19 nt, Homo sapiens
ggaaggucgccgugaguca

SEQ ID NO: 1542579 - RNA, 19 nt, Homo sapiens
uaccagguguucuacgaau

SEQ ID NO: 1542580 - RNA, 19 nt, Homo sapiens
cagucagggugcucuguga

SEQ ID NO: 1542581 - RNA, 19 nt, Homo sapiens
cagaaugaccugcugacau

SEQ ID NO: 1542582 - RNA, 19 nt, Homo sapiens
auaggucagucuuagaaau

SEQ ID NO: 1542583 - RNA, 19 nt, Homo sapiens
gggaacagccacccuucug

SEQ ID NO: 1542584 - RNA, 19 nt, Homo sapiens
ggugugauuuacccauuac

SEQ ID NO: 1542585 - RNA, 19 nt, Homo sapiens
aggugugauuuacccauua

SEQ ID NO: 1542586 - RNA, 19 nt, Homo sapiens
acagccguuucuucauaua

SEQ ID NO: 1542587 - RNA, 19 nt, Homo sapiens
guggauguuuaugcuguuu

SEQ ID NO: 1542588 - RNA, 19 nt, Homo sapiens
ucuugaugcucuuucgaaa

SEQ ID NO: 1542589 - RNA, 19 nt, Homo sapiens
cuuaacucuucaagccuua

SEQ ID NO: 1542590 - RNA, 19 nt, Homo sapiens
agaacggcaacuccaauaa

SEQ ID NO: 1542591 - RNA, 19 nt, Homo sapiens
acacauacaccaacgugau

SEQ ID NO: 1542592 - RNA, 19 nt, Homo sapiens
cccaucaccuucagcuuca

SEQ ID NO: 1542593 - RNA, 19 nt, Homo sapiens
ccauaccucagaauuauag

SEQ ID NO: 1542594 - RNA, 19 nt, Homo sapiens
ggacccucaugcagagcaa

SEQ ID NO: 1542595 - RNA, 19 nt, Homo sapiens
ggucagucuuagaaauaca

SEQ ID NO: 1542596 - RNA, 19 nt, Homo sapiens
ucagcuaccagguguucua

SEQ ID NO: 1542597 - RNA, 19 nt, Homo sapiens
ugggagauacaacuuuaaa

SEQ ID NO: 1542598 - RNA, 19 nt, Homo sapiens
cacauacaccaacgugauu

SEQ ID NO: 1542599 - RNA, 19 nt, Homo sapiens
uuacuuaauugaggucaca

SEQ ID NO: 1542600 - RNA, 19 nt, Homo sapiens
ugauuuacccauuacacaa

SEQ ID NO: 1542601 - RNA, 19 nt, Homo sapiens
ugaaugggagauacaacuu

SEQ ID NO: 1542602 - RNA, 19 nt, Homo sapiens
cgaaaauaggucagucuua

SEQ ID NO: 1542603 - RNA, 19 nt, Homo sapiens
gaagaaagcuauuagguau

SEQ ID NO: 1542604 - RNA, 19 nt, Homo sapiens
caacugguauugauuauug

SEQ ID NO: 1542605 - RNA, 19 nt, Homo sapiens
gcacugcuaucaauggaaa

SEQ ID NO: 1542606 - RNA, 19 nt, Homo sapiens
ccaaagagcagcugcagua

SEQ ID NO: 1542607 - RNA, 19 nt, Homo sapiens
gggaacaaauuuacuugaa

SEQ ID NO: 1542608 - RNA, 19 nt, Homo sapiens
gguauagucuuucucaguu

SEQ ID NO: 1542609 - RNA, 19 nt, Homo sapiens
gaaguacaguuuaguuugg

SEQ ID NO: 1542610 - RNA, 19 nt, Homo sapiens
gaaacuaugccaaaccaaa

SEQ ID NO: 1542611 - RNA, 19 nt, Homo sapiens
guacaugacugcaaaugag

SEQ ID NO: 1542612 - RNA, 19 nt, Homo sapiens
auaaagaccgccuguaaua

SEQ ID NO: 1542613 - RNA, 19 nt, Homo sapiens
caugugagaucuuucaguu

SEQ ID NO: 1542614 - RNA, 19 nt, Homo sapiens
aauccuagccugugacuua

SEQ ID NO: 1542615 - RNA, 19 nt, Homo sapiens
aaauaaagaccgccuguaa

SEQ ID NO: 1542616 - RNA, 19 nt, Homo sapiens
caaauuaggagacuugguu

SEQ ID NO: 1542617 - RNA, 19 nt, Homo sapiens
ugaagaaagcuauuaggua

SEQ ID NO: 1542618 - RNA, 19 nt, Homo sapiens
gacuuaauguugaugcuuu

SEQ ID NO: 1542619 - RNA, 19 nt, Homo sapiens
guaaggugguuuaaaucaa

SEQ ID NO: 1542620 - RNA, 19 nt, Homo sapiens
gaaaagauggacacuauuu

SEQ ID NO: 1542621 - RNA, 19 nt, Homo sapiens
augaagcccugucaaauuu

SEQ ID NO: 1542622 - RNA, 19 nt, Homo sapiens
ugugagaucuuucaguuau

SEQ ID NO: 1542623 - RNA, 19 nt, Homo sapiens
ccauaagccuuguguuugu

SEQ ID NO: 1542624 - RNA, 19 nt, Homo sapiens
gcacuuucaugguauaguc

SEQ ID NO: 1542625 - RNA, 19 nt, Homo sapiens
gaaauguucuccugguacu

SEQ ID NO: 1542626 - RNA, 19 nt, Homo sapiens
gauccaaugugucaugagu

SEQ ID NO: 1542627 - RNA, 19 nt, Homo sapiens
uugaauaggcaguaacuua

SEQ ID NO: 1542628 - RNA, 19 nt, Homo sapiens
uacaggacgguuuaaauua

SEQ ID NO: 1542629 - RNA, 19 nt, Homo sapiens
uuacaggacgguuuaaauu

SEQ ID NO: 1542630 - RNA, 19 nt, Homo sapiens
uuuggcaguuugcauauua

SEQ ID NO: 1542631 - RNA, 19 nt, Homo sapiens
guauaauccuagccuguga

SEQ ID NO: 1542632 - RNA, 19 nt, Homo sapiens
uaaagaccgccuguaauaa

SEQ ID NO: 1542633 - RNA, 19 nt, Homo sapiens
gaagcccugucaaauuuua

SEQ ID NO: 1542634 - RNA, 19 nt, Homo sapiens
uuugguaucucaacuggua

SEQ ID NO: 1542635 - RNA, 19 nt, Homo sapiens
gcauuucuacauucagaua

SEQ ID NO: 1542636 - RNA, 19 nt, Homo sapiens
ugucugaaauccauauguu

SEQ ID NO: 1542637 - RNA, 19 nt, Homo sapiens
gcauaaagaagcaaggaau

SEQ ID NO: 1542638 - RNA, 19 nt, Homo sapiens
uagcacagcaaacaucuuu

SEQ ID NO: 1542639 - RNA, 19 nt, Homo sapiens
uaccauaagccuuguguuu

SEQ ID NO: 1542640 - RNA, 19 nt, Homo sapiens
gaagcaaggaauuguacuu

SEQ ID NO: 1542641 - RNA, 19 nt, Homo sapiens
acuguaaggugguuuaaau

SEQ ID NO: 1542642 - RNA, 19 nt, Homo sapiens
uagcaaaggccuacaagug

SEQ ID NO: 1542643 - RNA, 19 nt, Homo sapiens
ggucagggguucgagauua

SEQ ID NO: 1542644 - RNA, 19 nt, Homo sapiens
ggccuaaccuacauugaca

SEQ ID NO: 1542645 - RNA, 19 nt, Homo sapiens
ggucuugccauugccauua

SEQ ID NO: 1542646 - RNA, 19 nt, Homo sapiens
gugaugacaccuuaagaaa

SEQ ID NO: 1542647 - RNA, 19 nt, Homo sapiens
uagcucaacugauucauac

SEQ ID NO: 1542648 - RNA, 19 nt, Homo sapiens
gcaggagaaucacuugaac

SEQ ID NO: 1542649 - RNA, 19 nt, Homo sapiens
gcaguacauucguuauuuu

SEQ ID NO: 1542650 - RNA, 19 nt, Homo sapiens
ugcaguacauucguuauuu

SEQ ID NO: 1542651 - RNA, 19 nt, Homo sapiens
auuaugcacuuucauggua

SEQ ID NO: 1542652 - RNA, 19 nt, Homo sapiens
caacugauucauacguauu

SEQ ID NO: 1542653 - RNA, 19 nt, Homo sapiens
uaauuuacagccagcauuu

SEQ ID NO: 1542654 - RNA, 19 nt, Homo sapiens
ucacuauuaugcacuuuca

SEQ ID NO: 1542655 - RNA, 19 nt, Homo sapiens
auacaugucugaaauccau

SEQ ID NO: 1542656 - RNA, 19 nt, Homo sapiens
aaagaccgccuguaauaau

SEQ ID NO: 1542657 - RNA, 19 nt, Homo sapiens
cuucuaacauucugugaug

SEQ ID NO: 1542658 - RNA, 19 nt, Homo sapiens
ucaggcaugugagaucuuu

SEQ ID NO: 1542659 - RNA, 19 nt, Homo sapiens
aaugaagcccugucaaauu

SEQ ID NO: 1542660 - RNA, 19 nt, Homo sapiens
auacuugacuacuuucaga

SEQ ID NO: 1542661 - RNA, 19 nt, Homo sapiens
aagaaaagauggacacuau

SEQ ID NO: 1542662 - RNA, 19 nt, Homo sapiens
aaagaagcaaggaauugua

SEQ ID NO: 1542663 - RNA, 19 nt, Homo sapiens
cauaaagaagcaaggaauu

SEQ ID NO: 1542664 - RNA, 19 nt, Homo sapiens
aagagcagcugcaguacau

SEQ ID NO: 1542665 - RNA, 19 nt, Homo sapiens
ugaaguacaguuuaguuug

SEQ ID NO: 1542666 - RNA, 19 nt, Homo sapiens
guucaggucuugccauugc

SEQ ID NO: 1542667 - RNA, 19 nt, Homo sapiens
cagcaaacaucuuuucaga

SEQ ID NO: 1542668 - RNA, 19 nt, Homo sapiens
gcaguuugcauauuauaag

SEQ ID NO: 1542669 - RNA, 19 nt, Homo sapiens
gccugugacuuaauguuga

SEQ ID NO: 1542670 - RNA, 19 nt, Homo sapiens
uaaagaagcaaggaauugu

SEQ ID NO: 1542671 - RNA, 19 nt, Homo sapiens
uccaaugugucaugaguga

SEQ ID NO: 1542672 - RNA, 19 nt, Homo sapiens
gccacguucuaaauaauau

SEQ ID NO: 1542673 - RNA, 19 nt, Homo sapiens
auucugugaugccuaauuu

SEQ ID NO: 1542674 - RNA, 19 nt, Homo sapiens
guuaugauccaauguguca

SEQ ID NO: 1542675 - RNA, 19 nt, Homo sapiens
ugccauuacagacaaauua

SEQ ID NO: 1542676 - RNA, 19 nt, Homo sapiens
uaauguugaugcuuugcuu

SEQ ID NO: 1542677 - RNA, 19 nt, Homo sapiens
gagauuagccuggucaaaa

SEQ ID NO: 1542678 - RNA, 19 nt, Homo sapiens
gagcagcugcaguacauuc

SEQ ID NO: 1542679 - RNA, 19 nt, Homo sapiens
aacauucugugaugccuaa

SEQ ID NO: 1542680 - RNA, 19 nt, Homo sapiens
agacaaauuaggagacuug

SEQ ID NO: 1542681 - RNA, 19 nt, Homo sapiens
ggagguggaggcaggagaa

SEQ ID NO: 1542682 - RNA, 19 nt, Homo sapiens
cauaagccuuguguuuguu

SEQ ID NO: 1542683 - RNA, 19 nt, Homo sapiens
uuuguuagguugcauaaag

SEQ ID NO: 1542684 - RNA, 19 nt, Homo sapiens
cgccuguaauaaucuguua

SEQ ID NO: 1542685 - RNA, 19 nt, Homo sapiens
ggcauugaauaggcaguaa

SEQ ID NO: 1542686 - RNA, 19 nt, Homo sapiens
gguggaggcaggagaauca

SEQ ID NO: 1542687 - RNA, 19 nt, Homo sapiens
cagcugcaguacauucguu

SEQ ID NO: 1542688 - RNA, 19 nt, Homo sapiens
ucaacugauucauacguau

SEQ ID NO: 1542689 - RNA, 19 nt, Homo sapiens
gaucuaaacuguauuuucc

SEQ ID NO: 1542690 - RNA, 19 nt, Homo sapiens
ccauugccauuacagacaa

SEQ ID NO: 1542691 - RNA, 19 nt, Homo sapiens
guauagucuuucucaguuc

SEQ ID NO: 1542692 - RNA, 19 nt, Homo sapiens
ccuagccugugacuuaaug

SEQ ID NO: 1542693 - RNA, 19 nt, Homo sapiens
uaccuaacaaguaccauaa

SEQ ID NO: 1542694 - RNA, 19 nt, Homo sapiens
caguuuggcaguuugcaua

SEQ ID NO: 1542695 - RNA, 19 nt, Homo sapiens
augagucuaugcccguuua

SEQ ID NO: 1542696 - RNA, 19 nt, Homo sapiens
ggaggcaggagaaucacuu

SEQ ID NO: 1542697 - RNA, 19 nt, Homo sapiens
ggcaggagaaucacuugaa

SEQ ID NO: 1542698 - RNA, 19 nt, Homo sapiens
aaaugaagcccugucaaau

SEQ ID NO: 1542699 - RNA, 19 nt, Homo sapiens
gaugcuuugcuuugucuuu

SEQ ID NO: 1542700 - RNA, 19 nt, Homo sapiens
ggcaguuugcauauuauaa

SEQ ID NO: 1542701 - RNA, 19 nt, Homo sapiens
agccuuguguuuguucuua

SEQ ID NO: 1542702 - RNA, 19 nt, Homo sapiens
ccuguaaucccagcacuuu

SEQ ID NO: 1542703 - RNA, 19 nt, Homo sapiens
cuaaaccucuccucauaaa

SEQ ID NO: 1542704 - RNA, 19 nt, Homo sapiens
gccaguauuucccauagua

SEQ ID NO: 1542705 - RNA, 19 nt, Homo sapiens
ccaagugaaugaaugaaug

SEQ ID NO: 1542706 - RNA, 19 nt, Homo sapiens
gggcagaaauucacacagu

SEQ ID NO: 1542707 - RNA, 19 nt, Homo sapiens
gcaccaugcuuccuauaca

SEQ ID NO: 1542708 - RNA, 19 nt, Homo sapiens
guucauauguguucagcuu

SEQ ID NO: 1542709 - RNA, 19 nt, Homo sapiens
cacgagaucugguuguuga

SEQ ID NO: 1542710 - RNA, 19 nt, Homo sapiens
ggaaauccacgaacaaugg

SEQ ID NO: 1542711 - RNA, 19 nt, Homo sapiens
gcugugcgcuucuuguuca

SEQ ID NO: 1542712 - RNA, 19 nt, Homo sapiens
ggguggccgugaacacuua

SEQ ID NO: 1542713 - RNA, 19 nt, Homo sapiens
gagaucugguuguugagaa

SEQ ID NO: 1542714 - RNA, 19 nt, Homo sapiens
gcaaguucaaggugguuua

SEQ ID NO: 1542715 - RNA, 19 nt, Homo sapiens
ggaccaagugaaugaauga

SEQ ID NO: 1542716 - RNA, 19 nt, Homo sapiens
gcagacacccugagaugga

SEQ ID NO: 1542717 - RNA, 19 nt, Homo sapiens
ggaaggaccaucugauucu

SEQ ID NO: 1542718 - RNA, 19 nt, Homo sapiens
gcuaaaccucuccucauaa

SEQ ID NO: 1542719 - RNA, 19 nt, Homo sapiens
ugccaugacuguaagcuuu

SEQ ID NO: 1542720 - RNA, 19 nt, Homo sapiens
ugcaagaccugacuaauac

SEQ ID NO: 1542721 - RNA, 19 nt, Homo sapiens
gaccucagcuuccucaacu

SEQ ID NO: 1542722 - RNA, 19 nt, Homo sapiens
gggaggguuucuuggguuu

SEQ ID NO: 1542723 - RNA, 19 nt, Homo sapiens
gggcgagguugagggcuua

SEQ ID NO: 1542724 - RNA, 19 nt, Homo sapiens
gaagccaguauuucccaua

SEQ ID NO: 1542725 - RNA, 19 nt, Homo sapiens
agcuaaaccucuccucaua

SEQ ID NO: 1542726 - RNA, 19 nt, Homo sapiens
ucauauguguucagcuuug

SEQ ID NO: 1542727 - RNA, 19 nt, Homo sapiens
gcagaaauucacacaguca

SEQ ID NO: 1542728 - RNA, 19 nt, Homo sapiens
gaacacgccaugacgaucu

SEQ ID NO: 1542729 - RNA, 19 nt, Homo sapiens
cuccaaagcucguguuaag

SEQ ID NO: 1542730 - RNA, 19 nt, Homo sapiens
augcaagaccugacuaaua

SEQ ID NO: 1542731 - RNA, 19 nt, Homo sapiens
caagugaaugaaugaauga

SEQ ID NO: 1542732 - RNA, 19 nt, Homo sapiens
cagaggaccaagugaauga

SEQ ID NO: 1542733 - RNA, 19 nt, Homo sapiens
gcucagaggaccaagugaa

SEQ ID NO: 1542734 - RNA, 19 nt, Homo sapiens
gggcagacacccugagaug

SEQ ID NO: 1542735 - RNA, 19 nt, Homo sapiens
gaaggaccaucugauucug

SEQ ID NO: 1542736 - RNA, 19 nt, Homo sapiens
cagcagaggccuccacugu

SEQ ID NO: 1542737 - RNA, 19 nt, Homo sapiens
ugaaugacucgaucaauca

SEQ ID NO: 1542738 - RNA, 19 nt, Homo sapiens
gaaugaaugacucgaucaa

SEQ ID NO: 1542739 - RNA, 19 nt, Homo sapiens
gaagccgcguucauaugug

SEQ ID NO: 1542740 - RNA, 19 nt, Homo sapiens
ccacaacucucugucuuuu

SEQ ID NO: 1542741 - RNA, 19 nt, Homo sapiens
ucaccucucuucggccuuu

SEQ ID NO: 1542742 - RNA, 19 nt, Homo sapiens
gggaaggaccaucugauuc

SEQ ID NO: 1542743 - RNA, 19 nt, Homo sapiens
gcaaugcaagaccugacua

SEQ ID NO: 1542744 - RNA, 19 nt, Homo sapiens
aaaccucuccucauaaauc

SEQ ID NO: 1542745 - RNA, 19 nt, Homo sapiens
gguacaggguggccgugaa

SEQ ID NO: 1542746 - RNA, 19 nt, Homo sapiens
gagcucagaggaccaagug

SEQ ID NO: 1542747 - RNA, 19 nt, Homo sapiens
guaaguagaggcacaugca

SEQ ID NO: 1542748 - RNA, 19 nt, Homo sapiens
gaaccgugagccagcuaaa

SEQ ID NO: 1542749 - RNA, 19 nt, Homo sapiens
agucagcgguggcuugaug

SEQ ID NO: 1542750 - RNA, 19 nt, Homo sapiens
caaugcaagaccugacuaa

SEQ ID NO: 1542751 - RNA, 19 nt, Homo sapiens
uuuaaggcgugaaugaaug

SEQ ID NO: 1542752 - RNA, 19 nt, Homo sapiens
gaccagaagcccagcagau

SEQ ID NO: 1542753 - RNA, 19 nt, Homo sapiens
caaguucaaggugguuuaa

SEQ ID NO: 1542754 - RNA, 19 nt, Homo sapiens
gagggcugcucccacuuca

SEQ ID NO: 1542755 - RNA, 19 nt, Homo sapiens
gaaugacucgaucaaucaa

SEQ ID NO: 1542756 - RNA, 19 nt, Homo sapiens
gaccaucugauucuggauu

SEQ ID NO: 1542757 - RNA, 19 nt, Homo sapiens
ccugggauuuggguaagua

SEQ ID NO: 1542758 - RNA, 19 nt, Homo sapiens
augaaugacucgaucaauc

SEQ ID NO: 1542759 - RNA, 19 nt, Homo sapiens
agguuuaucuuuacagcaa

SEQ ID NO: 1542760 - RNA, 19 nt, Homo sapiens
ucaccgagccccagguuua

SEQ ID NO: 1542761 - RNA, 19 nt, Homo sapiens
guugagaagugugucauac

SEQ ID NO: 1542762 - RNA, 19 nt, Homo sapiens
cgggaaggaccaucugauu

SEQ ID NO: 1542763 - RNA, 19 nt, Homo sapiens
gguggggccugguguguuu

SEQ ID NO: 1542764 - RNA, 19 nt, Homo sapiens
cacccgagcugucccuagu

SEQ ID NO: 1542765 - RNA, 19 nt, Homo sapiens
ccacaauuccuuggcauuc

SEQ ID NO: 1542766 - RNA, 19 nt, Homo sapiens
aaugaaggagcaagcagua

SEQ ID NO: 1542767 - RNA, 19 nt, Homo sapiens
gggcugcucccacuucauc

SEQ ID NO: 1542768 - RNA, 19 nt, Homo sapiens
ugaacccacucaccacagu

SEQ ID NO: 1542769 - RNA, 19 nt, Homo sapiens
gggcugugcgcuucuuguu

SEQ ID NO: 1542770 - RNA, 19 nt, Homo sapiens
gcaccuggcaccccucuuu

SEQ ID NO: 1542771 - RNA, 19 nt, Homo sapiens
guuuaaggcgugaaugaau

SEQ ID NO: 1542772 - RNA, 19 nt, Homo sapiens
caccagcuccccaaaauaa

SEQ ID NO: 1542773 - RNA, 19 nt, Homo sapiens
ugagaagugugucauaccu

SEQ ID NO: 1542774 - RNA, 19 nt, Homo sapiens
gccuggcagucccuugaaa

SEQ ID NO: 1542775 - RNA, 19 nt, Homo sapiens
uuucuuggguuucuugaag

SEQ ID NO: 1542776 - RNA, 19 nt, Homo sapiens
gaggguuucuuggguuucu

SEQ ID NO: 1542777 - RNA, 19 nt, Homo sapiens
cagcuaaaccucuccucau

SEQ ID NO: 1542778 - RNA, 19 nt, Homo sapiens
gagguugagggcuuauuca

SEQ ID NO: 1542779 - RNA, 19 nt, Homo sapiens
gguuuaaggcgugaaugaa

SEQ ID NO: 1542780 - RNA, 19 nt, Homo sapiens
ugaaggagcaagcaguaag

SEQ ID NO: 1542781 - RNA, 19 nt, Homo sapiens
gcaccagcuccccaaaaua

SEQ ID NO: 1542782 - RNA, 19 nt, Homo sapiens
aaccucuccucauaaauca

SEQ ID NO: 1542783 - RNA, 19 nt, Homo sapiens
ggaguucaccacacaagcu

SEQ ID NO: 1542784 - RNA, 19 nt, Homo sapiens
aagccaguauuucccauag

SEQ ID NO: 1542785 - RNA, 19 nt, Homo sapiens
caacugauccaugaaucca

SEQ ID NO: 1542786 - RNA, 19 nt, Homo sapiens
gaaggagcaagcaguaagc

SEQ ID NO: 1542787 - RNA, 19 nt, Homo sapiens
gaggaccaagugaaugaau

SEQ ID NO: 1542788 - RNA, 19 nt, Homo sapiens
guuuaucuuuacagcaaug

SEQ ID NO: 1542789 - RNA, 19 nt, Homo sapiens
cauauguguucagcuuugu

SEQ ID NO: 1542790 - RNA, 19 nt, Homo sapiens
uuaaggcgugaaugaauga

SEQ ID NO: 1542791 - RNA, 19 nt, Homo sapiens
uuucuugaagccaguauuu

SEQ ID NO: 1542792 - RNA, 19 nt, Homo sapiens
cgagguugagggcuuauuc

SEQ ID NO: 1542793 - RNA, 19 nt, Homo sapiens
gcccugccacccacaauuc

SEQ ID NO: 1542794 - RNA, 19 nt, Homo sapiens
cagccuggcagucccuuga

SEQ ID NO: 1542795 - RNA, 19 nt, Homo sapiens
gcucccagcagaggacuga

SEQ ID NO: 1542796 - RNA, 19 nt, Homo sapiens
aagccgcguucauaugugu

SEQ ID NO: 1542797 - RNA, 19 nt, Homo sapiens
uaucgugggcagaaauuca

SEQ ID NO: 1542798 - RNA, 19 nt, Homo sapiens
ggacguguguuuauaauua

SEQ ID NO: 1542799 - RNA, 19 nt, Homo sapiens
ucaaagauguucccaauaa

SEQ ID NO: 1542800 - RNA, 19 nt, Homo sapiens
gaagauguccuguuaaauu

SEQ ID NO: 1542801 - RNA, 19 nt, Homo sapiens
guaugaagauguccuguua

SEQ ID NO: 1542802 - RNA, 19 nt, Homo sapiens
gaaguuaaauggaucuuug

SEQ ID NO: 1542803 - RNA, 19 nt, Homo sapiens
gaaaggcccacucuauuua

SEQ ID NO: 1542804 - RNA, 19 nt, Homo sapiens
ggagagaaauagaaacaaa

SEQ ID NO: 1542805 - RNA, 19 nt, Homo sapiens
gcauuugucugaggaauua

SEQ ID NO: 1542806 - RNA, 19 nt, Homo sapiens
ggaaaugccuaauaaguca

SEQ ID NO: 1542807 - RNA, 19 nt, Homo sapiens
ggaaaggcccacucuauuu

SEQ ID NO: 1542808 - RNA, 19 nt, Homo sapiens
gaauggacguguguuuaua

SEQ ID NO: 1542809 - RNA, 19 nt, Homo sapiens
gggcaaauuugaaguuaaa

SEQ ID NO: 1542810 - RNA, 19 nt, Homo sapiens
guacugagcaugguaauaa

SEQ ID NO: 1542811 - RNA, 19 nt, Homo sapiens
ugacauacaucguuccauu

SEQ ID NO: 1542812 - RNA, 19 nt, Homo sapiens
acacaaaguucugcuuaua

SEQ ID NO: 1542813 - RNA, 19 nt, Homo sapiens
aaaguugacucuucucgua

SEQ ID NO: 1542814 - RNA, 19 nt, Homo sapiens
gaacauuucccuugucuuc

SEQ ID NO: 1542815 - RNA, 19 nt, Homo sapiens
cagcgcaucugcccuuaua

SEQ ID NO: 1542816 - RNA, 19 nt, Homo sapiens
ugacaucuuugaacacuuu

SEQ ID NO: 1542817 - RNA, 19 nt, Homo sapiens
caaagaagacguauuaaag

SEQ ID NO: 1542818 - RNA, 19 nt, Homo sapiens
caacacaaaguucugcuua

SEQ ID NO: 1542819 - RNA, 19 nt, Homo sapiens
uaacagcuauccaccaaug

SEQ ID NO: 1542820 - RNA, 19 nt, Homo sapiens
ccuaauaagucaaagaaga

SEQ ID NO: 1542821 - RNA, 19 nt, Homo sapiens
uaaaggccauaaacaacua

SEQ ID NO: 1542822 - RNA, 19 nt, Homo sapiens
uggagaacaucacuauaua

SEQ ID NO: 1542823 - RNA, 19 nt, Homo sapiens
gaagaauggacguguguuu

SEQ ID NO: 1542824 - RNA, 19 nt, Homo sapiens
agucaaagaagacguauua

SEQ ID NO: 1542825 - RNA, 19 nt, Homo sapiens
gauguagacuuuggaaaug

SEQ ID NO: 1542826 - RNA, 19 nt, Homo sapiens
caaacacacuugagaacug

SEQ ID NO: 1542827 - RNA, 19 nt, Homo sapiens
uaaauguaccucagucuaa

SEQ ID NO: 1542828 - RNA, 19 nt, Homo sapiens
acagaagacugaaugaaug

SEQ ID NO: 1542829 - RNA, 19 nt, Homo sapiens
cgacauauucgcuuagaaa

SEQ ID NO: 1542830 - RNA, 19 nt, Homo sapiens
gggaaaggcccacucuauu

SEQ ID NO: 1542831 - RNA, 19 nt, Homo sapiens
gagcaggcuucaaccagaa

SEQ ID NO: 1542832 - RNA, 19 nt, Homo sapiens
gacaaccuauggacaaaug

SEQ ID NO: 1542833 - RNA, 19 nt, Homo sapiens
aaagcaaccuuaagcucua

SEQ ID NO: 1542834 - RNA, 19 nt, Homo sapiens
gcaaaauaaucaugccaua

SEQ ID NO: 1542835 - RNA, 19 nt, Homo sapiens
ugccauaucugacaaccua

SEQ ID NO: 1542836 - RNA, 19 nt, Homo sapiens
ggauuuccauauucucuug

SEQ ID NO: 1542837 - RNA, 19 nt, Homo sapiens
caaaucagaguaacagcua

SEQ ID NO: 1542838 - RNA, 19 nt, Homo sapiens
gaagggcaaauuugaaguu

SEQ ID NO: 1542839 - RNA, 19 nt, Homo sapiens
guaccucagucuaaucaga

SEQ ID NO: 1542840 - RNA, 19 nt, Homo sapiens
cacuaacgauguagacuuu

SEQ ID NO: 1542841 - RNA, 19 nt, Homo sapiens
ugucaaagauguucccaau

SEQ ID NO: 1542842 - RNA, 19 nt, Homo sapiens
gggcugccauugccagaaa

SEQ ID NO: 1542843 - RNA, 19 nt, Homo sapiens
gacauacaucguuccauua

SEQ ID NO: 1542844 - RNA, 19 nt, Homo sapiens
ccagcagccucagccauua

SEQ ID NO: 1542845 - RNA, 19 nt, Homo sapiens
guaaauguaccucagucua

SEQ ID NO: 1542846 - RNA, 19 nt, Homo sapiens
accaguaucugcugucuuu

SEQ ID NO: 1542847 - RNA, 19 nt, Homo sapiens
ugaagaaugucagccacua

SEQ ID NO: 1542848 - RNA, 19 nt, Homo sapiens
caacaugaauauuggaacu

SEQ ID NO: 1542849 - RNA, 19 nt, Homo sapiens
aaaccucaaccgaaacuua

SEQ ID NO: 1542850 - RNA, 19 nt, Homo sapiens
uuacuaugcuccauccauu

SEQ ID NO: 1542851 - RNA, 19 nt, Homo sapiens
auccauacaugccuaguua

SEQ ID NO: 1542852 - RNA, 19 nt, Homo sapiens
gaguucaagucuaaauguu

SEQ ID NO: 1542853 - RNA, 19 nt, Homo sapiens
gggcaaggaaauaaaguuu

SEQ ID NO: 1542854 - RNA, 19 nt, Homo sapiens
guaccaccaccuccuauaa

SEQ ID NO: 1542855 - RNA, 19 nt, Homo sapiens
ugccaaaccucaaccgaaa

SEQ ID NO: 1542856 - RNA, 19 nt, Homo sapiens
aggcaugacuggacugaaa

SEQ ID NO: 1542857 - RNA, 19 nt, Homo sapiens
ggacaaucaacacaaaguu

SEQ ID NO: 1542858 - RNA, 19 nt, Homo sapiens
acaaaugaguaauggagaa

SEQ ID NO: 1542859 - RNA, 19 nt, Homo sapiens
uagaagugguucaaugaug

SEQ ID NO: 1542860 - RNA, 19 nt, Homo sapiens
gcacagaagacugaaugaa

SEQ ID NO: 1542861 - RNA, 19 nt, Homo sapiens
gcaguguccuggcauccuu

SEQ ID NO: 1542862 - RNA, 19 nt, Homo sapiens
gaagugguucaaugaugua

SEQ ID NO: 1542863 - RNA, 19 nt, Homo sapiens
uauuuacucuucaguguga

SEQ ID NO: 1542864 - RNA, 19 nt, Homo sapiens
acacaaaguugacucuucu

SEQ ID NO: 1542865 - RNA, 19 nt, Homo sapiens
cuuuggaaaugccuaauaa

SEQ ID NO: 1542866 - RNA, 19 nt, Homo sapiens
caagggcaaugugggaauu

SEQ ID NO: 1542867 - RNA, 19 nt, Homo sapiens
acaaaguucugcuuauagu

SEQ ID NO: 1542868 - RNA, 19 nt, Homo sapiens
cagggacaaucaacacaaa

SEQ ID NO: 1542869 - RNA, 19 nt, Homo sapiens
cuaaagggcaaggaaauaa

SEQ ID NO: 1542870 - RNA, 19 nt, Homo sapiens
gugguucaaugauguaaga

SEQ ID NO: 1542871 - RNA, 19 nt, Homo sapiens
augaagauguccuguuaaa

SEQ ID NO: 1542872 - RNA, 19 nt, Homo sapiens
guagggagagaaauagaaa

SEQ ID NO: 1542873 - RNA, 19 nt, Homo sapiens
uaaguggaagggcaaauuu

SEQ ID NO: 1542874 - RNA, 19 nt, Homo sapiens
gagcagcagugguaugacu

SEQ ID NO: 1542875 - RNA, 19 nt, Homo sapiens
agaagugguucaaugaugu

SEQ ID NO: 1542876 - RNA, 19 nt, Homo sapiens
caucugcccuuauacucuu

SEQ ID NO: 1542877 - RNA, 19 nt, Homo sapiens
ugacuagcauugcaaccaa

SEQ ID NO: 1542878 - RNA, 19 nt, Homo sapiens
gcagugguaugacuagcau

SEQ ID NO: 1542879 - RNA, 19 nt, Homo sapiens
ggaguucaagucuaaaugu

SEQ ID NO: 1542880 - RNA, 19 nt, Homo sapiens
gcuuugagcagcaguggua

SEQ ID NO: 1542881 - RNA, 19 nt, Homo sapiens
uaaagggcaaggaaauaaa

SEQ ID NO: 1542882 - RNA, 19 nt, Homo sapiens
ggguugcggugaagaaugu

SEQ ID NO: 1542883 - RNA, 19 nt, Homo sapiens
aagggcaaauuugaaguua

SEQ ID NO: 1542884 - RNA, 19 nt, Homo sapiens
ccugacagcugcagugaca

SEQ ID NO: 1542885 - RNA, 19 nt, Homo sapiens
uuaaguagccagacaaauc

SEQ ID NO: 1542886 - RNA, 19 nt, Homo sapiens
aacaauaaccguaugaaga

SEQ ID NO: 1542887 - RNA, 19 nt, Homo sapiens
uaaguagccagacaaauca

SEQ ID NO: 1542888 - RNA, 19 nt, Homo sapiens
acaauaaccguaugaagau

SEQ ID NO: 1542889 - RNA, 19 nt, Homo sapiens
caaaguucugcuuauagua

SEQ ID NO: 1542890 - RNA, 19 nt, Homo sapiens
gaugguguauuuagucaac

SEQ ID NO: 1542891 - RNA, 19 nt, Homo sapiens
uaauggagaacaucacuau

SEQ ID NO: 1542892 - RNA, 19 nt, Homo sapiens
gcaagcauauguuguuccu

SEQ ID NO: 1542893 - RNA, 19 nt, Homo sapiens
cugaaugaaugcaaggauu

SEQ ID NO: 1542894 - RNA, 19 nt, Homo sapiens
gaacuguaacuucgucaag

SEQ ID NO: 1542895 - RNA, 19 nt, Homo sapiens
ugcuuaaggugacaucuuu

SEQ ID NO: 1542896 - RNA, 19 nt, Homo sapiens
gauguccuguuaaauuuac

SEQ ID NO: 1542897 - RNA, 19 nt, Homo sapiens
uggcugaaaugaagucugu

SEQ ID NO: 1542898 - RNA, 19 nt, Homo sapiens
ggagaagaauuaaacauug

SEQ ID NO: 1542899 - RNA, 19 nt, Homo sapiens
gcacaaagugguagaauau

SEQ ID NO: 1542900 - RNA, 19 nt, Homo sapiens
gaaauccaguugcggcuuu

SEQ ID NO: 1542901 - RNA, 19 nt, Homo sapiens
gaggacaacugugauguaa

SEQ ID NO: 1542902 - RNA, 19 nt, Homo sapiens
cagcaaagcuagagucaga

SEQ ID NO: 1542903 - RNA, 19 nt, Homo sapiens
caccaugccuggcuaauuu

SEQ ID NO: 1542904 - RNA, 19 nt, Homo sapiens
ucaaagugcuuccaaguau

SEQ ID NO: 1542905 - RNA, 19 nt, Homo sapiens
gcaguggucuucucuuguu

SEQ ID NO: 1542906 - RNA, 19 nt, Homo sapiens
gaucuuggccaaugacaua

SEQ ID NO: 1542907 - RNA, 19 nt, Homo sapiens
gaauggcuauuacacuaaa

SEQ ID NO: 1542908 - RNA, 19 nt, Homo sapiens
ggacaacugugauguaacu

SEQ ID NO: 1542909 - RNA, 19 nt, Homo sapiens
caacugugauguaacuuug

SEQ ID NO: 1542910 - RNA, 19 nt, Homo sapiens
gccaagcccugucuaggua

SEQ ID NO: 1542911 - RNA, 19 nt, Homo sapiens
gguggcagcauuuaauuua

SEQ ID NO: 1542912 - RNA, 19 nt, Homo sapiens
uagcuucuaucucugcuua

SEQ ID NO: 1542913 - RNA, 19 nt, Homo sapiens
ugaacagacugaauccuuu

SEQ ID NO: 1542914 - RNA, 19 nt, Homo sapiens
ucauguaacugguucugua

SEQ ID NO: 1542915 - RNA, 19 nt, Homo sapiens
uuuaaccgcugaaggaaua

SEQ ID NO: 1542916 - RNA, 19 nt, Homo sapiens
gaugaagaccuugcagaua

SEQ ID NO: 1542917 - RNA, 19 nt, Homo sapiens
cagaguagcugggauuuua

SEQ ID NO: 1542918 - RNA, 19 nt, Homo sapiens
acacaucucuaucugcauu

SEQ ID NO: 1542919 - RNA, 19 nt, Homo sapiens
caacagaacauugacagaa

SEQ ID NO: 1542920 - RNA, 19 nt, Homo sapiens
gcagauagucuucaucagu

SEQ ID NO: 1542921 - RNA, 19 nt, Homo sapiens
cauuguagcuggaucuguu

SEQ ID NO: 1542922 - RNA, 19 nt, Homo sapiens
uguaacugguucuguauuu

SEQ ID NO: 1542923 - RNA, 19 nt, Homo sapiens
ggaauggcuauuacacuaa

SEQ ID NO: 1542924 - RNA, 19 nt, Homo sapiens
acaaagugguagaauauuc

SEQ ID NO: 1542925 - RNA, 19 nt, Homo sapiens
gaauugaacagacugaauc

SEQ ID NO: 1542926 - RNA, 19 nt, Homo sapiens
aggaauggcuauuacacua

SEQ ID NO: 1542927 - RNA, 19 nt, Homo sapiens
cuauagaacucgaguacug

SEQ ID NO: 1542928 - RNA, 19 nt, Homo sapiens
gacacacccuuguucauuc

SEQ ID NO: 1542929 - RNA, 19 nt, Homo sapiens
guuuggaucugacucuaaa

SEQ ID NO: 1542930 - RNA, 19 nt, Homo sapiens
caaagugcuuccaaguaug

SEQ ID NO: 1542931 - RNA, 19 nt, Homo sapiens
agucagagguuccgguuga

SEQ ID NO: 1542932 - RNA, 19 nt, Homo sapiens
cgagggcggugucagcaaa

SEQ ID NO: 1542933 - RNA, 19 nt, Homo sapiens
gaacucgaguacugauugg

SEQ ID NO: 1542934 - RNA, 19 nt, Homo sapiens
ccggaaauguaaagcauga

SEQ ID NO: 1542935 - RNA, 19 nt, Homo sapiens
gagaagcagcuauuaucaa

SEQ ID NO: 1542936 - RNA, 19 nt, Homo sapiens
gguagaauauucacuuuug

SEQ ID NO: 1542937 - RNA, 19 nt, Homo sapiens
uagagcccuuugcauguua

SEQ ID NO: 1542938 - RNA, 19 nt, Homo sapiens
gugguagaauauucacuuu

SEQ ID NO: 1542939 - RNA, 19 nt, Homo sapiens
gcuauuacacuaaauugug

SEQ ID NO: 1542940 - RNA, 19 nt, Homo sapiens
gggaguggauguggagcua

SEQ ID NO: 1542941 - RNA, 19 nt, Homo sapiens
gcugaaggaauaugauuau

SEQ ID NO: 1542942 - RNA, 19 nt, Homo sapiens
gauacucuccaguuuaaug

SEQ ID NO: 1542943 - RNA, 19 nt, Homo sapiens
aagcaguggucuucucuug

SEQ ID NO: 1542944 - RNA, 19 nt, Homo sapiens
gauggagucucagcucugu

SEQ ID NO: 1542945 - RNA, 19 nt, Homo sapiens
ugcacaaagugguagaaua

SEQ ID NO: 1542946 - RNA, 19 nt, Homo sapiens
uucagaggcuuaaucauug

SEQ ID NO: 1542947 - RNA, 19 nt, Homo sapiens
ccaauuauacacaucucua

SEQ ID NO: 1542948 - RNA, 19 nt, Homo sapiens
caaagugguagaauauuca

SEQ ID NO: 1542949 - RNA, 19 nt, Homo sapiens
augaagaccuugcagauag

SEQ ID NO: 1542950 - RNA, 19 nt, Homo sapiens
uaaaaugucugccauaacu

SEQ ID NO: 1542951 - RNA, 19 nt, Homo sapiens
ccaaagugcuaggauuaca

SEQ ID NO: 1542952 - RNA, 19 nt, Homo sapiens
agaagcagcuauuaucaac

SEQ ID NO: 1542953 - RNA, 19 nt, Homo sapiens
ggagacacacccuuguuca

SEQ ID NO: 1542954 - RNA, 19 nt, Homo sapiens
guaacugguucuguauuuc

SEQ ID NO: 1542955 - RNA, 19 nt, Homo sapiens
gucaaagugcuuccaagua

SEQ ID NO: 1542956 - RNA, 19 nt, Homo sapiens
uaagugggaccuuguuguu

SEQ ID NO: 1542957 - RNA, 19 nt, Homo sapiens
uuacuucuaucacuuccuu

SEQ ID NO: 1542958 - RNA, 19 nt, Homo sapiens
ugucucagccuccagagua

SEQ ID NO: 1542959 - RNA, 19 nt, Homo sapiens
caggcgagcccuaugcuuu

SEQ ID NO: 1542960 - RNA, 19 nt, Homo sapiens
gacacagcauucagcauca

SEQ ID NO: 1542961 - RNA, 19 nt, Homo sapiens
gaauuuggaacaagauaag

SEQ ID NO: 1542962 - RNA, 19 nt, Homo sapiens
ucccaaagugcuaggauua

SEQ ID NO: 1542963 - RNA, 19 nt, Homo sapiens
uuucuaugcaugccaauua

SEQ ID NO: 1542964 - RNA, 19 nt, Homo sapiens
gagaucaaguugggagaca

SEQ ID NO: 1542965 - RNA, 19 nt, Homo sapiens
gaggagaacacugaaguca

SEQ ID NO: 1542966 - RNA, 19 nt, Homo sapiens
agacacacccuuguucauu

SEQ ID NO: 1542967 - RNA, 19 nt, Homo sapiens
uuagagcccuuugcauguu

SEQ ID NO: 1542968 - RNA, 19 nt, Homo sapiens
auucagaggcuuaaucauu

SEQ ID NO: 1542969 - RNA, 19 nt, Homo sapiens
gugcuuccaaguaugaaua

SEQ ID NO: 1542970 - RNA, 19 nt, Homo sapiens
gccuugaacucugggcuuu

SEQ ID NO: 1542971 - RNA, 19 nt, Homo sapiens
ggaucugacucuaaaaguu

SEQ ID NO: 1542972 - RNA, 19 nt, Homo sapiens
gauaagugggaccuuguug

SEQ ID NO: 1542973 - RNA, 19 nt, Homo sapiens
caaaacagaagaagacuau

SEQ ID NO: 1542974 - RNA, 19 nt, Homo sapiens
ugaggacaacugugaugua

SEQ ID NO: 1542975 - RNA, 19 nt, Homo sapiens
gaucugacucuaaaaguuu

SEQ ID NO: 1542976 - RNA, 19 nt, Homo sapiens
aaagugcuuccaaguauga

SEQ ID NO: 1542977 - RNA, 19 nt, Homo sapiens
gaguggauguggagcuaca

SEQ ID NO: 1542978 - RNA, 19 nt, Homo sapiens
gcuauuaucaacagaacau

SEQ ID NO: 1542979 - RNA, 19 nt, Homo sapiens
ccaucauucuugcguguug

SEQ ID NO: 1542980 - RNA, 19 nt, Homo sapiens
cugcuuacgucacccauca

SEQ ID NO: 1542981 - RNA, 19 nt, Homo sapiens
ugagaagcagcuauuauca

SEQ ID NO: 1542982 - RNA, 19 nt, Homo sapiens
cagcaucaccugcacaaag

SEQ ID NO: 1542983 - RNA, 19 nt, Homo sapiens
gaacagacugaauccuuuu

SEQ ID NO: 1542984 - RNA, 19 nt, Homo sapiens
gcagcuauuaucaacagaa

SEQ ID NO: 1542985 - RNA, 19 nt, Homo sapiens
gcacugcagccuugaacuc

SEQ ID NO: 1542986 - RNA, 19 nt, Homo sapiens
gcaugccaauuauacacau

SEQ ID NO: 1542987 - RNA, 19 nt, Homo sapiens
ugaagaccuugcagauagu

SEQ ID NO: 1542988 - RNA, 19 nt, Homo sapiens
gcccuuugcauguuaauca

SEQ ID NO: 1542989 - RNA, 19 nt, Homo sapiens
acugauggcuuugagucua

SEQ ID NO: 1542990 - RNA, 19 nt, Homo sapiens
aggcgagcccuaugcuuua

SEQ ID NO: 1542991 - RNA, 19 nt, Homo sapiens
gagucuagguuggaaagca

SEQ ID NO: 1542992 - RNA, 19 nt, Homo sapiens
aagcagcuauuaucaacag

SEQ ID NO: 1542993 - RNA, 19 nt, Homo sapiens
ggaaagcacacaggaacca

SEQ ID NO: 1542994 - RNA, 19 nt, Homo sapiens
ccaccaugccuggcuaauu

SEQ ID NO: 1542995 - RNA, 19 nt, Homo sapiens
gggagacacacccuuguuc

SEQ ID NO: 1542996 - RNA, 19 nt, Homo sapiens
ggaucuguuucuguaguug

SEQ ID NO: 1542997 - RNA, 19 nt, Homo sapiens
gauccuuacugggcaaucu

SEQ ID NO: 1542998 - RNA, 19 nt, Homo sapiens
ccaguuggcucaaggauaa

SEQ ID NO: 1542999 - RNA, 19 nt, Homo sapiens
uaaaggaggugaugguaaa

SEQ ID NO: 1543000 - RNA, 19 nt, Homo sapiens
gaaacuggcuguuagcaau

SEQ ID NO: 1543001 - RNA, 19 nt, Homo sapiens
caagaagggucaaggagaa

SEQ ID NO: 1543002 - RNA, 19 nt, Homo sapiens
gcagacagaugaagaacga

SEQ ID NO: 1543003 - RNA, 19 nt, Homo sapiens
gaacaagggcccuccaguu

SEQ ID NO: 1543004 - RNA, 19 nt, Homo sapiens
gaacuaugugucuccauua

SEQ ID NO: 1543005 - RNA, 19 nt, Homo sapiens
uagcaaguaucaugaguaa

SEQ ID NO: 1543006 - RNA, 19 nt, Homo sapiens
gcaccuaaacccaaaguaa

SEQ ID NO: 1543007 - RNA, 19 nt, Homo sapiens
gaaaucggauacucuugug

SEQ ID NO: 1543008 - RNA, 19 nt, Homo sapiens
agaugucucugaacaauuu

SEQ ID NO: 1543009 - RNA, 19 nt, Homo sapiens
acacauucuucaagucuua

SEQ ID NO: 1543010 - RNA, 19 nt, Homo sapiens
gaacuaggcccugucauuc

SEQ ID NO: 1543011 - RNA, 19 nt, Homo sapiens
gcuaugaguuagaaccaaa

SEQ ID NO: 1543012 - RNA, 19 nt, Homo sapiens
aaacugaaacuggcuguua

SEQ ID NO: 1543013 - RNA, 19 nt, Homo sapiens
ggacauugaguuacagcua

SEQ ID NO: 1543014 - RNA, 19 nt, Homo sapiens
caagccagauucacacuuc

SEQ ID NO: 1543015 - RNA, 19 nt, Homo sapiens
ccaaauugcagacagauga

SEQ ID NO: 1543016 - RNA, 19 nt, Homo sapiens
ccaggaugaucguuuaaga

SEQ ID NO: 1543017 - RNA, 19 nt, Homo sapiens
ggagaaaucggauacucuu

SEQ ID NO: 1543018 - RNA, 19 nt, Homo sapiens
uaacacaaguaacaaaggu

SEQ ID NO: 1543019 - RNA, 19 nt, Homo sapiens
gaacauccgaggcccaaga

SEQ ID NO: 1543020 - RNA, 19 nt, Homo sapiens
gaucugaagaggaugauga

SEQ ID NO: 1543021 - RNA, 19 nt, Homo sapiens
ugucaugccugaacagcua

SEQ ID NO: 1543022 - RNA, 19 nt, Homo sapiens
ccaaauugcugccucuucu

SEQ ID NO: 1543023 - RNA, 19 nt, Homo sapiens
gaaagccggaguguucaua

SEQ ID NO: 1543024 - RNA, 19 nt, Homo sapiens
caaagaaaccccaggauuu

SEQ ID NO: 1543025 - RNA, 19 nt, Homo sapiens
guaaaggaggugaugguaa

SEQ ID NO: 1543026 - RNA, 19 nt, Homo sapiens
gccacuagcuacucccaaa

SEQ ID NO: 1543027 - RNA, 19 nt, Homo sapiens
ccagucugcugaagauuau

SEQ ID NO: 1543028 - RNA, 19 nt, Homo sapiens
uauguaaccuuguugagau

SEQ ID NO: 1543029 - RNA, 19 nt, Homo sapiens
gcaaugucaugccugaaca

SEQ ID NO: 1543030 - RNA, 19 nt, Homo sapiens
uaaaacgucugaagaaguu

SEQ ID NO: 1543031 - RNA, 19 nt, Homo sapiens
gcaaguaucaugaguaagc

SEQ ID NO: 1543032 - RNA, 19 nt, Homo sapiens
cacuggaucuuguuucuga

SEQ ID NO: 1543033 - RNA, 19 nt, Homo sapiens
aaauggaucugaagaggau

SEQ ID NO: 1543034 - RNA, 19 nt, Homo sapiens
gaugaucguuuaagagaac

SEQ ID NO: 1543035 - RNA, 19 nt, Homo sapiens
uguccaggaugaucguuua

SEQ ID NO: 1543036 - RNA, 19 nt, Homo sapiens
cugaagaaguuacaucuca

SEQ ID NO: 1543037 - RNA, 19 nt, Homo sapiens
agaacuaugugucuccauu

SEQ ID NO: 1543038 - RNA, 19 nt, Homo sapiens
gggaugcuaugaguuagaa

SEQ ID NO: 1543039 - RNA, 19 nt, Homo sapiens
gccagucugcugaagauua

SEQ ID NO: 1543040 - RNA, 19 nt, Homo sapiens
ccacugggaugacacuauc

SEQ ID NO: 1543041 - RNA, 19 nt, Homo sapiens
ggaugaucguuuaagagaa

SEQ ID NO: 1543042 - RNA, 19 nt, Homo sapiens
gaagaaguuacaucucaau

SEQ ID NO: 1543043 - RNA, 19 nt, Homo sapiens
auucagaacccuaaaguuu

SEQ ID NO: 1543044 - RNA, 19 nt, Homo sapiens
gaucaaauugggaugcuau

SEQ ID NO: 1543045 - RNA, 19 nt, Homo sapiens
agaggaugaugaugagaaa

SEQ ID NO: 1543046 - RNA, 19 nt, Homo sapiens
ugaagaaguuacaucucaa

SEQ ID NO: 1543047 - RNA, 19 nt, Homo sapiens
caccuaaacccaaaguaaa

SEQ ID NO: 1543048 - RNA, 19 nt, Homo sapiens
ugaagaggaugaugaugag

SEQ ID NO: 1543049 - RNA, 19 nt, Homo sapiens
cauaggaccaagaaagaaa

SEQ ID NO: 1543050 - RNA, 19 nt, Homo sapiens
caaaggugcaccagcauuc

SEQ ID NO: 1543051 - RNA, 19 nt, Homo sapiens
ucacacuucuuccucuuca

SEQ ID NO: 1543052 - RNA, 19 nt, Homo sapiens
aaggaaagccggaguguuc

SEQ ID NO: 1543053 - RNA, 19 nt, Homo sapiens
caagcuaagugugccaaau

SEQ ID NO: 1543054 - RNA, 19 nt, Homo sapiens
uuacaggccaccaucagua

SEQ ID NO: 1543055 - RNA, 19 nt, Homo sapiens
acacagggccaguaccaaa

SEQ ID NO: 1543056 - RNA, 19 nt, Homo sapiens
gccggaguguucauaauca

SEQ ID NO: 1543057 - RNA, 19 nt, Homo sapiens
ccauucaccuucacuggau

SEQ ID NO: 1543058 - RNA, 19 nt, Homo sapiens
cgacgacucacuagaugaa

SEQ ID NO: 1543059 - RNA, 19 nt, Homo sapiens
agaacuaggcccugucauu

SEQ ID NO: 1543060 - RNA, 19 nt, Homo sapiens
aaagaaaccccaggauuua

SEQ ID NO: 1543061 - RNA, 19 nt, Homo sapiens
cuacucagacuacacauuc

SEQ ID NO: 1543062 - RNA, 19 nt, Homo sapiens
ucuuguuucugaagcuuua

SEQ ID NO: 1543063 - RNA, 19 nt, Homo sapiens
aaauugggaugcuaugagu

SEQ ID NO: 1543064 - RNA, 19 nt, Homo sapiens
ggaugacacuaucagaacu

SEQ ID NO: 1543065 - RNA, 19 nt, Homo sapiens
ugaguuacagcuacaagaa

SEQ ID NO: 1543066 - RNA, 19 nt, Homo sapiens
gacuacacauucuucaagu

SEQ ID NO: 1543067 - RNA, 19 nt, Homo sapiens
gaucuuguuucugaagcuu

SEQ ID NO: 1543068 - RNA, 19 nt, Homo sapiens
caccuucacuggaucuugu

SEQ ID NO: 1543069 - RNA, 19 nt, Homo sapiens
gccaugcaauaaagaaaca

SEQ ID NO: 1543070 - RNA, 19 nt, Homo sapiens
cugaagaggaugaugauga

SEQ ID NO: 1543071 - RNA, 19 nt, Homo sapiens
uugcuuaucugcugagaca

SEQ ID NO: 1543072 - RNA, 19 nt, Homo sapiens
agaccuuucuuuccauuca

SEQ ID NO: 1543073 - RNA, 19 nt, Homo sapiens
caaaguaaaggaggugaug

SEQ ID NO: 1543074 - RNA, 19 nt, Homo sapiens
gacacuaucagaacuuugu

SEQ ID NO: 1543075 - RNA, 19 nt, Homo sapiens
gcaauaaagaaacacuagu

SEQ ID NO: 1543076 - RNA, 19 nt, Homo sapiens
gaccccagcuacacauuaa

SEQ ID NO: 1543077 - RNA, 19 nt, Homo sapiens
ggccuugccuuagagaugu

SEQ ID NO: 1543078 - RNA, 19 nt, Homo sapiens
gugccaaauugcagacaga

SEQ ID NO: 1543079 - RNA, 19 nt, Homo sapiens
aagcuaagugugccaaauu

SEQ ID NO: 1543080 - RNA, 19 nt, Homo sapiens
caagaacuaggcccuguca

SEQ ID NO: 1543081 - RNA, 19 nt, Homo sapiens
aacaagggcccuccaguug

SEQ ID NO: 1543082 - RNA, 19 nt, Homo sapiens
acucccaccuugaagcuuu

SEQ ID NO: 1543083 - RNA, 19 nt, Homo sapiens
caaauugcagacagaugaa

SEQ ID NO: 1543084 - RNA, 19 nt, Homo sapiens
ugccugaacagcuauuuaa

SEQ ID NO: 1543085 - RNA, 19 nt, Homo sapiens
cuuuagcgguuaucaacaa

SEQ ID NO: 1543086 - RNA, 19 nt, Homo sapiens
cuuaaggaguguaguccaa

SEQ ID NO: 1543087 - RNA, 19 nt, Homo sapiens
gucauaggaccaagaaaga

SEQ ID NO: 1543088 - RNA, 19 nt, Homo sapiens
caaauugggaugcuaugag

SEQ ID NO: 1543089 - RNA, 19 nt, Homo sapiens
gagaaaucggauacucuug

SEQ ID NO: 1543090 - RNA, 19 nt, Homo sapiens
gaagggucaaggagaaauc

SEQ ID NO: 1543091 - RNA, 19 nt, Homo sapiens
caggcuacuucaacaagga

SEQ ID NO: 1543092 - RNA, 19 nt, Homo sapiens
aagccagucugcugaagau

SEQ ID NO: 1543093 - RNA, 19 nt, Homo sapiens
ccugaacagcuauuuaaau

SEQ ID NO: 1543094 - RNA, 19 nt, Homo sapiens
uaucaacaaugggaacaag

SEQ ID NO: 1543095 - RNA, 19 nt, Homo sapiens
ucugaagcuuuagcgguua

SEQ ID NO: 1543096 - RNA, 19 nt, Homo sapiens
gaugacacuaucagaacuu

SEQ ID NO: 1543097 - RNA, 19 nt, Homo sapiens
agaaaucggauacucuugu

SEQ ID NO: 1543098 - RNA, 19 nt, Homo sapiens
cagaagagcuggccaaguu

SEQ ID NO: 1543099 - RNA, 19 nt, Homo sapiens
ggaaggugcugaagaagaa

SEQ ID NO: 1543100 - RNA, 19 nt, Homo sapiens
auaaagaccuccugaaauu

SEQ ID NO: 1543101 - RNA, 19 nt, Homo sapiens
gauaauaagucgcgcuuuc

SEQ ID NO: 1543102 - RNA, 19 nt, Homo sapiens
ggauaaagaccuccugaaa

SEQ ID NO: 1543103 - RNA, 19 nt, Homo sapiens
gaagaaggcgaaaugaaug

SEQ ID NO: 1543104 - RNA, 19 nt, Homo sapiens
gaacaacucgaaugcagaa

SEQ ID NO: 1543105 - RNA, 19 nt, Homo sapiens
gauaaagaccuccugaaau

SEQ ID NO: 1543106 - RNA, 19 nt, Homo sapiens
guacugagcgccaaucgaa

SEQ ID NO: 1543107 - RNA, 19 nt, Homo sapiens
gcaaugagaucagcagcau

SEQ ID NO: 1543108 - RNA, 19 nt, Homo sapiens
ugacagaccugcagagcau

SEQ ID NO: 1543109 - RNA, 19 nt, Homo sapiens
ucgaagacauuguugaaga

SEQ ID NO: 1543110 - RNA, 19 nt, Homo sapiens
acuauuacgugaccuauga

SEQ ID NO: 1543111 - RNA, 19 nt, Homo sapiens
uugaagagguuacugaaga

SEQ ID NO: 1543112 - RNA, 19 nt, Homo sapiens
ucacagacaccuucuucua

SEQ ID NO: 1543113 - RNA, 19 nt, Homo sapiens
cugaagaggucguggaaga

SEQ ID NO: 1543114 - RNA, 19 nt, Homo sapiens
ugaagaaggcgaaaugaau

SEQ ID NO: 1543115 - RNA, 19 nt, Homo sapiens
ucaaggugcuggagcucua

SEQ ID NO: 1543116 - RNA, 19 nt, Homo sapiens
gaagagcuggccaaguuga

SEQ ID NO: 1543117 - RNA, 19 nt, Homo sapiens
uggaagacgucaucgaaga

SEQ ID NO: 1543118 - RNA, 19 nt, Homo sapiens
gaucacagacaccuucuuc

SEQ ID NO: 1543119 - RNA, 19 nt, Homo sapiens
gaacuuggagggagcuugu

SEQ ID NO: 1543120 - RNA, 19 nt, Homo sapiens
gggauucaaagaagauuaa

SEQ ID NO: 1543121 - RNA, 19 nt, Homo sapiens
ggccagggauucaaagaag

SEQ ID NO: 1543122 - RNA, 19 nt, Homo sapiens
gaaacccacuggccuuggu

SEQ ID NO: 1543123 - RNA, 19 nt, Homo sapiens
agaagacaguuuccugaga

SEQ ID NO: 1543124 - RNA, 19 nt, Homo sapiens
ccucaaacuuggcgaacuu

SEQ ID NO: 1543125 - RNA, 19 nt, Homo sapiens
agacauuguugaagagguu

SEQ ID NO: 1543126 - RNA, 19 nt, Homo sapiens
aguggaaggugcugaagaa

SEQ ID NO: 1543127 - RNA, 19 nt, Homo sapiens
gcacaggaggcgcaguuug

SEQ ID NO: 1543128 - RNA, 19 nt, Homo sapiens
uaaagaccuccugaaauuu

SEQ ID NO: 1543129 - RNA, 19 nt, Homo sapiens
cgagcacgcaagauaauaa

SEQ ID NO: 1543130 - RNA, 19 nt, Homo sapiens
agaaagggaaggagaaaga

SEQ ID NO: 1543131 - RNA, 19 nt, Homo sapiens
caagaaagggaaggagaaa

SEQ ID NO: 1543132 - RNA, 19 nt, Homo sapiens
caucgaagacauuguugaa

SEQ ID NO: 1543133 - RNA, 19 nt, Homo sapiens
aagggucucuggagucuga

SEQ ID NO: 1543134 - RNA, 19 nt, Homo sapiens
cgaagacauuguugaagag

SEQ ID NO: 1543135 - RNA, 19 nt, Homo sapiens
gcacgcaagauaauaaguc

SEQ ID NO: 1543136 - RNA, 19 nt, Homo sapiens
gagcgccaaucgaaucaag

SEQ ID NO: 1543137 - RNA, 19 nt, Homo sapiens
aaagaccuccugaaauuuc

SEQ ID NO: 1543138 - RNA, 19 nt, Homo sapiens
gaaugcagaagacaguuuc

SEQ ID NO: 1543139 - RNA, 19 nt, Homo sapiens
gaugaagaaggcgaaauga

SEQ ID NO: 1543140 - RNA, 19 nt, Homo sapiens
caacucgaaugcagaagac

SEQ ID NO: 1543141 - RNA, 19 nt, Homo sapiens
gccagggauucaaagaaga

SEQ ID NO: 1543142 - RNA, 19 nt, Homo sapiens
ccugggcucugcugaacaa

SEQ ID NO: 1543143 - RNA, 19 nt, Homo sapiens
cgaagggucucuggagucu

SEQ ID NO: 1543144 - RNA, 19 nt, Homo sapiens
ucucccagcuuagaauuau

SEQ ID NO: 1543145 - RNA, 19 nt, Homo sapiens
gaccuaugauuuugugaaa

SEQ ID NO: 1543146 - RNA, 19 nt, Homo sapiens
gcccuuucaucacuuacaa

SEQ ID NO: 1543147 - RNA, 19 nt, Homo sapiens
cgaaugcagaagacaguuu

SEQ ID NO: 1543148 - RNA, 19 nt, Homo sapiens
gauuaagaaaguugccaaa

SEQ ID NO: 1543149 - RNA, 19 nt, Homo sapiens
gagagucggagcugucugu

SEQ ID NO: 1543150 - RNA, 19 nt, Homo sapiens
uucuaaagcuggaggaguu

SEQ ID NO: 1543151 - RNA, 19 nt, Homo sapiens
ugaagagguuacugaagag

SEQ ID NO: 1543152 - RNA, 19 nt, Homo sapiens
acaguuuccugagagaauu

SEQ ID NO: 1543153 - RNA, 19 nt, Homo sapiens
gaucuacgaaggcgauuac

SEQ ID NO: 1543154 - RNA, 19 nt, Homo sapiens
gggcucugcugaacaacuc

SEQ ID NO: 1543155 - RNA, 19 nt, Homo sapiens
ucccagcuuagaauuauua

SEQ ID NO: 1543156 - RNA, 19 nt, Homo sapiens
gaccaucggaaacaucaga

SEQ ID NO: 1543157 - RNA, 19 nt, Homo sapiens
acagacaccuucuucuacu

SEQ ID NO: 1543158 - RNA, 19 nt, Homo sapiens
ggaacccgcugacgaucac

SEQ ID NO: 1543159 - RNA, 19 nt, Homo sapiens
acaagaaagggaaggagaa

SEQ ID NO: 1543160 - RNA, 19 nt, Homo sapiens
cuucagcacugcccacaag

SEQ ID NO: 1543161 - RNA, 19 nt, Homo sapiens
gacaguuuccugagagaau

SEQ ID NO: 1543162 - RNA, 19 nt, Homo sapiens
gaagacgucaucgaagaca

SEQ ID NO: 1543163 - RNA, 19 nt, Homo sapiens
cagcauggagugucugugu

SEQ ID NO: 1543164 - RNA, 19 nt, Homo sapiens
uaauaagucgcgcuuucuu

SEQ ID NO: 1543165 - RNA, 19 nt, Homo sapiens
cgucaucgaagacauuguu

SEQ ID NO: 1543166 - RNA, 19 nt, Homo sapiens
ggaccaccgugaccaucgu

SEQ ID NO: 1543167 - RNA, 19 nt, Homo sapiens
agucggagcugucugucau

SEQ ID NO: 1543168 - RNA, 19 nt, Homo sapiens
cguggaagacgucaucgaa

SEQ ID NO: 1543169 - RNA, 19 nt, Homo sapiens
ccucaauggcgaucucuug

SEQ ID NO: 1543170 - RNA, 19 nt, Homo sapiens
caucugacaggcugacguu

SEQ ID NO: 1543171 - RNA, 19 nt, Homo sapiens
ggugcuaccugcuguugac

SEQ ID NO: 1543172 - RNA, 19 nt, Homo sapiens
caaacuuggcgaacuugga

SEQ ID NO: 1543173 - RNA, 19 nt, Homo sapiens
ugucgagcacgcaagauaa

SEQ ID NO: 1543174 - RNA, 19 nt, Homo sapiens
gaaggcgaaaugaaugagu

SEQ ID NO: 1543175 - RNA, 19 nt, Homo sapiens
cacaggaggcgcaguuugu

SEQ ID NO: 1543176 - RNA, 19 nt, Homo sapiens
uguagggcgugggcaguaa

SEQ ID NO: 1543177 - RNA, 19 nt, Homo sapiens
ggcgugguccgcacauuga

SEQ ID NO: 1543178 - RNA, 19 nt, Homo sapiens
gggagaaagacaagaaagg

SEQ ID NO: 1543179 - RNA, 19 nt, Homo sapiens
ugaccaucguggaggagaa

SEQ ID NO: 1543180 - RNA, 19 nt, Homo sapiens
caaguugaggcugcguaua

SEQ ID NO: 1543181 - RNA, 19 nt, Homo sapiens
agaugaagaaggcgaaaug

SEQ ID NO: 1543182 - RNA, 19 nt, Homo sapiens
ccuaugauuuugugaaaga

SEQ ID NO: 1543183 - RNA, 19 nt, Homo sapiens
gcgccaaucgaaucaagga

SEQ ID NO: 1543184 - RNA, 19 nt, Homo sapiens
gaguggaaggugcugaaga

SEQ ID NO: 1543185 - RNA, 19 nt, Homo sapiens
agacgucaucgaagacauu

SEQ ID NO: 1543186 - RNA, 19 nt, Homo sapiens
caccgugucucccaaugag

SEQ ID NO: 1543187 - RNA, 19 nt, Homo sapiens
aagccgugauuccgaucua

SEQ ID NO: 1543188 - RNA, 19 nt, Homo sapiens
aagaaggcgaaaugaauga

SEQ ID NO: 1543189 - RNA, 19 nt, Homo sapiens
ucacuuacaacuauuacgu

SEQ ID NO: 1543190 - RNA, 19 nt, Homo sapiens
gcucuacggcaaugagauc

SEQ ID NO: 1543191 - RNA, 19 nt, Homo sapiens
gaccuccugaaauuucuaa

SEQ ID NO: 1543192 - RNA, 19 nt, Homo sapiens
gagcacgcaagauaauaag

SEQ ID NO: 1543193 - RNA, 19 nt, Homo sapiens
gcagaagagcuggccaagu

SEQ ID NO: 1543194 - RNA, 19 nt, Homo sapiens
ggaagacgucaucgaagac

SEQ ID NO: 1543195 - RNA, 19 nt, Homo sapiens
caacuauuacgugaccuau

SEQ ID NO: 1543196 - RNA, 19 nt, Homo sapiens
uggccuuggugcccuacua

SEQ ID NO: 1543197 - RNA, 19 nt, Homo sapiens
gcgcauguucgccguguag

SEQ ID NO: 1543198 - RNA, 19 nt, Homo sapiens
gaaaggaacuggcagauug

SEQ ID NO: 1543199 - RNA, 19 nt, Homo sapiens
gcgauuaucugccuuauuu

SEQ ID NO: 1543200 - RNA, 19 nt, Homo sapiens
cagcugaucuucuuucuua

SEQ ID NO: 1543201 - RNA, 19 nt, Homo sapiens
gaacaagaccugagacuaa

SEQ ID NO: 1543202 - RNA, 19 nt, Homo sapiens
gaagagugguggucaauga

SEQ ID NO: 1543203 - RNA, 19 nt, Homo sapiens
ggacaggaaucaagagaaa

SEQ ID NO: 1543204 - RNA, 19 nt, Homo sapiens
ggugauagauuccgcagua

SEQ ID NO: 1543205 - RNA, 19 nt, Homo sapiens
gcaaggacaugaagcuuau

SEQ ID NO: 1543206 - RNA, 19 nt, Homo sapiens
gcaaacgucagcauacuua

SEQ ID NO: 1543207 - RNA, 19 nt, Homo sapiens
gaacugccuuuccagauga

SEQ ID NO: 1543208 - RNA, 19 nt, Homo sapiens
gagaauaucagcauuaaug

SEQ ID NO: 1543209 - RNA, 19 nt, Homo sapiens
gcaagaguuuguuaagauu

SEQ ID NO: 1543210 - RNA, 19 nt, Homo sapiens
gaacgaaacaguacugaug

SEQ ID NO: 1543211 - RNA, 19 nt, Homo sapiens
ggauauagccgaaguggaa

SEQ ID NO: 1543212 - RNA, 19 nt, Homo sapiens
caacugaccucaauaccau

SEQ ID NO: 1543213 - RNA, 19 nt, Homo sapiens
gcagauuggugauagauuc

SEQ ID NO: 1543214 - RNA, 19 nt, Homo sapiens
caacauagagcauaauuca

SEQ ID NO: 1543215 - RNA, 19 nt, Homo sapiens
gaagaaaggaggacugguu

SEQ ID NO: 1543216 - RNA, 19 nt, Homo sapiens
gcaggaaacuaugaucuau

SEQ ID NO: 1543217 - RNA, 19 nt, Homo sapiens
gagcaagaguuuguuaaga

SEQ ID NO: 1543218 - RNA, 19 nt, Homo sapiens
gcaaaccaaugaccaagau

SEQ ID NO: 1543219 - RNA, 19 nt, Homo sapiens
gauagauuccgcaguauaa

SEQ ID NO: 1543220 - RNA, 19 nt, Homo sapiens
ucacaggcaucaugucaaa

SEQ ID NO: 1543221 - RNA, 19 nt, Homo sapiens
gcagaagaacgaaacagua

SEQ ID NO: 1543222 - RNA, 19 nt, Homo sapiens
ucagggagcugcagagaga

SEQ ID NO: 1543223 - RNA, 19 nt, Homo sapiens
gaugagagcauucuugaug

SEQ ID NO: 1543224 - RNA, 19 nt, Homo sapiens
ccagacaguccuauaguua

SEQ ID NO: 1543225 - RNA, 19 nt, Homo sapiens
agaauugacugcuuugcua

SEQ ID NO: 1543226 - RNA, 19 nt, Homo sapiens
cagcagcucugaugaggaa

SEQ ID NO: 1543227 - RNA, 19 nt, Homo sapiens
gaccugagacuaauuaaug

SEQ ID NO: 1543228 - RNA, 19 nt, Homo sapiens
caagaccugagacuaauua

SEQ ID NO: 1543229 - RNA, 19 nt, Homo sapiens
gguagaggauccuguuguu

SEQ ID NO: 1543230 - RNA, 19 nt, Homo sapiens
ggacaauaaugagagagaa

SEQ ID NO: 1543231 - RNA, 19 nt, Homo sapiens
gaagaaaccuaagcagacu

SEQ ID NO: 1543232 - RNA, 19 nt, Homo sapiens
gguccaacauagagcauaa

SEQ ID NO: 1543233 - RNA, 19 nt, Homo sapiens
caaacacgguccaacauag

SEQ ID NO: 1543234 - RNA, 19 nt, Homo sapiens
cugauauacuggauacuua

SEQ ID NO: 1543235 - RNA, 19 nt, Homo sapiens
ccagaaagacaacaagauu

SEQ ID NO: 1543236 - RNA, 19 nt, Homo sapiens
gaagggcuuucacuauauc

SEQ ID NO: 1543237 - RNA, 19 nt, Homo sapiens
aaaugaaguugcagccuaa

SEQ ID NO: 1543238 - RNA, 19 nt, Homo sapiens
gaacauaaugccaggacuu

SEQ ID NO: 1543239 - RNA, 19 nt, Homo sapiens
ggagguacgcuauauugaa

SEQ ID NO: 1543240 - RNA, 19 nt, Homo sapiens
guacugauauacuggauac

SEQ ID NO: 1543241 - RNA, 19 nt, Homo sapiens
gagcuguacugauauacug

SEQ ID NO: 1543242 - RNA, 19 nt, Homo sapiens
gaugacgccuggugguuug

SEQ ID NO: 1543243 - RNA, 19 nt, Homo sapiens
gacagucuuuaaaguguaa

SEQ ID NO: 1543244 - RNA, 19 nt, Homo sapiens
agacaguccuauaguuaaa

SEQ ID NO: 1543245 - RNA, 19 nt, Homo sapiens
aagaugagcccaugggaua

SEQ ID NO: 1543246 - RNA, 19 nt, Homo sapiens
gaagaaaggcagaagaaac

SEQ ID NO: 1543247 - RNA, 19 nt, Homo sapiens
gcagaagagugguggucaa

SEQ ID NO: 1543248 - RNA, 19 nt, Homo sapiens
agacauaguagucaaauug

SEQ ID NO: 1543249 - RNA, 19 nt, Homo sapiens
cacuauaucuacuugauga

SEQ ID NO: 1543250 - RNA, 19 nt, Homo sapiens
agacaguucuucagaggaa

SEQ ID NO: 1543251 - RNA, 19 nt, Homo sapiens
ccaaacacgguccaacaua

SEQ ID NO: 1543252 - RNA, 19 nt, Homo sapiens
caaaaugacuggagaaucu

SEQ ID NO: 1543253 - RNA, 19 nt, Homo sapiens
ggacccaauuucaggcaaa

SEQ ID NO: 1543254 - RNA, 19 nt, Homo sapiens
gcagaugcuggaauaaauu

SEQ ID NO: 1543255 - RNA, 19 nt, Homo sapiens
agaggaagaugaaacuguu

SEQ ID NO: 1543256 - RNA, 19 nt, Homo sapiens
gguggucaaugaacuaaau

SEQ ID NO: 1543257 - RNA, 19 nt, Homo sapiens
guuccacauuuaccaguua

SEQ ID NO: 1543258 - RNA, 19 nt, Homo sapiens
gaauauaagucagcaaucc

SEQ ID NO: 1543259 - RNA, 19 nt, Homo sapiens
agaggaggauacagaaauu

SEQ ID NO: 1543260 - RNA, 19 nt, Homo sapiens
ggcaaggacaugaagcuua

SEQ ID NO: 1543261 - RNA, 19 nt, Homo sapiens
gaaaucagucuuuauacag

SEQ ID NO: 1543262 - RNA, 19 nt, Homo sapiens
gagacuaauuaaugaagga

SEQ ID NO: 1543263 - RNA, 19 nt, Homo sapiens
gguguuagacaaaugcaua

SEQ ID NO: 1543264 - RNA, 19 nt, Homo sapiens
gacuagcucuccuuucuca

SEQ ID NO: 1543265 - RNA, 19 nt, Homo sapiens
ccacauuuaccaguuaaua

SEQ ID NO: 1543266 - RNA, 19 nt, Homo sapiens
cagcagcaguucauuaucu

SEQ ID NO: 1543267 - RNA, 19 nt, Homo sapiens
gaagaaugugaacggguua

SEQ ID NO: 1543268 - RNA, 19 nt, Homo sapiens
cuacucaaaggaaugauua

SEQ ID NO: 1543269 - RNA, 19 nt, Homo sapiens
ccagauggccacugaaaga

SEQ ID NO: 1543270 - RNA, 19 nt, Homo sapiens
gagcauacucuguuaaugg

SEQ ID NO: 1543271 - RNA, 19 nt, Homo sapiens
uaauggugauggugaggua

SEQ ID NO: 1543272 - RNA, 19 nt, Homo sapiens
caggugagccuaaugaaga

SEQ ID NO: 1543273 - RNA, 19 nt, Homo sapiens
aaggaggacugguuucuau

SEQ ID NO: 1543274 - RNA, 19 nt, Homo sapiens
gaaggccacgguacagaaa

SEQ ID NO: 1543275 - RNA, 19 nt, Homo sapiens
gccagacaguccuauaguu

SEQ ID NO: 1543276 - RNA, 19 nt, Homo sapiens
gagguacgcuauauugaac

SEQ ID NO: 1543277 - RNA, 19 nt, Homo sapiens
caggagaauaucagcauua

SEQ ID NO: 1543278 - RNA, 19 nt, Homo sapiens
aaauucagguguacaggaa

SEQ ID NO: 1543279 - RNA, 19 nt, Homo sapiens
ucaaaggaaugauuaugag

SEQ ID NO: 1543280 - RNA, 19 nt, Homo sapiens
ggaagcagaaacaaaugaa

SEQ ID NO: 1543281 - RNA, 19 nt, Homo sapiens
gauuaucugccuuauuuga

SEQ ID NO: 1543282 - RNA, 19 nt, Homo sapiens
gguaguagaacagguaauu

SEQ ID NO: 1543283 - RNA, 19 nt, Homo sapiens
auaguucuuuccaguguua

SEQ ID NO: 1543284 - RNA, 19 nt, Homo sapiens
caguggaucuuggauacua

SEQ ID NO: 1543285 - RNA, 19 nt, Homo sapiens
gaaaggcagaagaaaccua

SEQ ID NO: 1543286 - RNA, 19 nt, Homo sapiens
ccaaacaucaggcuucgaa

SEQ ID NO: 1543287 - RNA, 19 nt, Homo sapiens
gcaguucauuaucuaguag

SEQ ID NO: 1543288 - RNA, 19 nt, Homo sapiens
cuaagaagcagcagcaguu

SEQ ID NO: 1543289 - RNA, 19 nt, Homo sapiens
gaggauacagaaauuguug

SEQ ID NO: 1543290 - RNA, 19 nt, Homo sapiens
aggaagaauugacugcuuu

SEQ ID NO: 1543291 - RNA, 19 nt, Homo sapiens
ugaccaagaugagagcauu

SEQ ID NO: 1543292 - RNA, 19 nt, Homo sapiens
gaagaacgaaacaguacug

SEQ ID NO: 1543293 - RNA, 19 nt, Homo sapiens
ugacugcuuugcuauacaa

SEQ ID NO: 1543294 - RNA, 19 nt, Homo sapiens
agaaacaaaugaaguugca

SEQ ID NO: 1543295 - RNA, 19 nt, Homo sapiens
caagugaauauucugauug

SEQ ID NO: 1543296 - RNA, 19 nt, Homo sapiens
uagaggauccuguuguuga

SEQ ID NO: 1543297 - RNA, 19 nt, Homo sapiens
gacauagaaaucagucuuu

SEQ ID NO: 1543298 - RNA, 19 nt, Homo sapiens
gaacugccuugguguguuu

SEQ ID NO: 1543299 - RNA, 19 nt, Homo sapiens
caaauagugucuggcauua

SEQ ID NO: 1543300 - RNA, 19 nt, Homo sapiens
ucaaguuuguugugaguua

SEQ ID NO: 1543301 - RNA, 19 nt, Homo sapiens
caagaaagacaaagagauu

SEQ ID NO: 1543302 - RNA, 19 nt, Homo sapiens
gaagggcagucccagaaga

SEQ ID NO: 1543303 - RNA, 19 nt, Homo sapiens
aaugaaggguagaaacuua

SEQ ID NO: 1543304 - RNA, 19 nt, Homo sapiens
ucacuuuccucuuugguaa

SEQ ID NO: 1543305 - RNA, 19 nt, Homo sapiens
ggguuucacuuuccucuuu

SEQ ID NO: 1543306 - RNA, 19 nt, Homo sapiens
gcauauccuuguucaaugu

SEQ ID NO: 1543307 - RNA, 19 nt, Homo sapiens
gcucuuguacucacaguua

SEQ ID NO: 1543308 - RNA, 19 nt, Homo sapiens
gagcaucgguuuuguugua

SEQ ID NO: 1543309 - RNA, 19 nt, Homo sapiens
ucuauuaguuccaguuuga

SEQ ID NO: 1543310 - RNA, 19 nt, Homo sapiens
acauagaauuugccgauuu

SEQ ID NO: 1543311 - RNA, 19 nt, Homo sapiens
uuaguugccuguccaauau

SEQ ID NO: 1543312 - RNA, 19 nt, Homo sapiens
cuuaaacucugcacacuug

SEQ ID NO: 1543313 - RNA, 19 nt, Homo sapiens
guaaaugccaguaaauuag

SEQ ID NO: 1543314 - RNA, 19 nt, Homo sapiens
gaaaugaaggguagaaacu

SEQ ID NO: 1543315 - RNA, 19 nt, Homo sapiens
uagaagagcagacuuacuu

SEQ ID NO: 1543316 - RNA, 19 nt, Homo sapiens
gaagcaacauggcauuagg

SEQ ID NO: 1543317 - RNA, 19 nt, Homo sapiens
ggaaaucgugcuagagaga

SEQ ID NO: 1543318 - RNA, 19 nt, Homo sapiens
guacuugggacuaaacauu

SEQ ID NO: 1543319 - RNA, 19 nt, Homo sapiens
gagaagcaacauggcauua

SEQ ID NO: 1543320 - RNA, 19 nt, Homo sapiens
uguagcagcuggucuugaa

SEQ ID NO: 1543321 - RNA, 19 nt, Homo sapiens
ccaaauagugucuggcauu

SEQ ID NO: 1543322 - RNA, 19 nt, Homo sapiens
cuaaagugcucuuguacuc

SEQ ID NO: 1543323 - RNA, 19 nt, Homo sapiens
ugagguuggugaugauauu

SEQ ID NO: 1543324 - RNA, 19 nt, Homo sapiens
gcaagaaagacaaagagau

SEQ ID NO: 1543325 - RNA, 19 nt, Homo sapiens
ucucaagaguccaguagaa

SEQ ID NO: 1543326 - RNA, 19 nt, Homo sapiens
gggcauauccuuguucaau

SEQ ID NO: 1543327 - RNA, 19 nt, Homo sapiens
ggaacugccuugguguguu

SEQ ID NO: 1543328 - RNA, 19 nt, Homo sapiens
gagauugcuugggauuuga

SEQ ID NO: 1543329 - RNA, 19 nt, Homo sapiens
gcuugugacuucucuacuu

SEQ ID NO: 1543330 - RNA, 19 nt, Homo sapiens
uguccaauaugaaguagaa

SEQ ID NO: 1543331 - RNA, 19 nt, Homo sapiens
guagaaacuuagccacauc

SEQ ID NO: 1543332 - RNA, 19 nt, Homo sapiens
cugaguggguuauugauga

SEQ ID NO: 1543333 - RNA, 19 nt, Homo sapiens
uugguaaacugaagaguga

SEQ ID NO: 1543334 - RNA, 19 nt, Homo sapiens
cugcauggguagaaguaua

SEQ ID NO: 1543335 - RNA, 19 nt, Homo sapiens
ucguguauauccauuauga

SEQ ID NO: 1543336 - RNA, 19 nt, Homo sapiens
agagauugcuugggauuug

SEQ ID NO: 1543337 - RNA, 19 nt, Homo sapiens
gguagaaacuuagccacau

SEQ ID NO: 1543338 - RNA, 19 nt, Homo sapiens
ggcauauccuuguucaaug

SEQ ID NO: 1543339 - RNA, 19 nt, Homo sapiens
gggauuugaugaagagaca

SEQ ID NO: 1543340 - RNA, 19 nt, Homo sapiens
gcccauguaauaauuguuu

SEQ ID NO: 1543341 - RNA, 19 nt, Homo sapiens
gaguuuccaucaaguuugu

SEQ ID NO: 1543342 - RNA, 19 nt, Homo sapiens
gagaggcuuugguaaacug

SEQ ID NO: 1543343 - RNA, 19 nt, Homo sapiens
uaugagaggcuuugguaaa

SEQ ID NO: 1543344 - RNA, 19 nt, Homo sapiens
gauuuagaguuuccaucaa

SEQ ID NO: 1543345 - RNA, 19 nt, Homo sapiens
caagaguccaguagaaaug

SEQ ID NO: 1543346 - RNA, 19 nt, Homo sapiens
ugucaggcuucacauugua

SEQ ID NO: 1543347 - RNA, 19 nt, Homo sapiens
guagggaagauaaaguaaa

SEQ ID NO: 1543348 - RNA, 19 nt, Homo sapiens
uuauagaagagcagacuua

SEQ ID NO: 1543349 - RNA, 19 nt, Homo sapiens
ggauguguguacuguguuc

SEQ ID NO: 1543350 - RNA, 19 nt, Homo sapiens
caaagagauuuagaguuuc

SEQ ID NO: 1543351 - RNA, 19 nt, Homo sapiens
gagcccauguaauaauugu

SEQ ID NO: 1543352 - RNA, 19 nt, Homo sapiens
guacucacaguuaggcuuu

SEQ ID NO: 1543353 - RNA, 19 nt, Homo sapiens
gaaagacaaagagauuuag

SEQ ID NO: 1543354 - RNA, 19 nt, Homo sapiens
aaauguacgugcuuguuuc

SEQ ID NO: 1543355 - RNA, 19 nt, Homo sapiens
caucaaguuuguugugagu

SEQ ID NO: 1543356 - RNA, 19 nt, Homo sapiens
aauagugucuggcauuaca

SEQ ID NO: 1543357 - RNA, 19 nt, Homo sapiens
gacaaagagauuuagaguu

SEQ ID NO: 1543358 - RNA, 19 nt, Homo sapiens
ggauuacaguauuugucaa

SEQ ID NO: 1543359 - RNA, 19 nt, Homo sapiens
guaagaugaauaugcuuga

SEQ ID NO: 1543360 - RNA, 19 nt, Homo sapiens
uggagcccauguaauaauu

SEQ ID NO: 1543361 - RNA, 19 nt, Homo sapiens
cagaugcacagauguagaa

SEQ ID NO: 1543362 - RNA, 19 nt, Homo sapiens
acccuaaagugcucuugua

SEQ ID NO: 1543363 - RNA, 19 nt, Homo sapiens
uaggaaaucgugcuagaga

SEQ ID NO: 1543364 - RNA, 19 nt, Homo sapiens
ccucguguauauccauuau

SEQ ID NO: 1543365 - RNA, 19 nt, Homo sapiens
uaguagggaagauaaagua

SEQ ID NO: 1543366 - RNA, 19 nt, Homo sapiens
ugacuucucuacuucaaaa

SEQ ID NO: 1543367 - RNA, 19 nt, Homo sapiens
uguucaaugugacuacuuu

SEQ ID NO: 1543368 - RNA, 19 nt, Homo sapiens
ugucauagaagcuuuguca

SEQ ID NO: 1543369 - RNA, 19 nt, Homo sapiens
ccucaugcccuggagauaa

SEQ ID NO: 1543370 - RNA, 19 nt, Homo sapiens
ccucaaaugauuaaacugu

SEQ ID NO: 1543371 - RNA, 19 nt, Homo sapiens
gcccacuucucaucucugu

SEQ ID NO: 1543372 - RNA, 19 nt, Homo sapiens
caguauuugucaacauaga

SEQ ID NO: 1543373 - RNA, 19 nt, Homo sapiens
acucugcacacuugaauuu

SEQ ID NO: 1543374 - RNA, 19 nt, Homo sapiens
ucaagaguccaguagaaau

SEQ ID NO: 1543375 - RNA, 19 nt, Homo sapiens
caucccauguuucauugga

SEQ ID NO: 1543376 - RNA, 19 nt, Homo sapiens
uuuaguugccuguccaaua

SEQ ID NO: 1543377 - RNA, 19 nt, Homo sapiens
gauauugucauagaagcuu

SEQ ID NO: 1543378 - RNA, 19 nt, Homo sapiens
gcagacuuacuugguguuu

SEQ ID NO: 1543379 - RNA, 19 nt, Homo sapiens
agacaaagagauuuagagu

SEQ ID NO: 1543380 - RNA, 19 nt, Homo sapiens
aguaggaaaucgugcuaga

SEQ ID NO: 1543381 - RNA, 19 nt, Homo sapiens
uagaguuuccaucaaguuu

SEQ ID NO: 1543382 - RNA, 19 nt, Homo sapiens
guagaaaugaaggguagaa

SEQ ID NO: 1543383 - RNA, 19 nt, Homo sapiens
gugcauauuggauuucuuc

SEQ ID NO: 1543384 - RNA, 19 nt, Homo sapiens
gcuugggauuugaugaaga

SEQ ID NO: 1543385 - RNA, 19 nt, Homo sapiens
ggagguagugccagagaag

SEQ ID NO: 1543386 - RNA, 19 nt, Homo sapiens
gccaguaaauuagaaucau

SEQ ID NO: 1543387 - RNA, 19 nt, Homo sapiens
agacuuacuugguguuugc

SEQ ID NO: 1543388 - RNA, 19 nt, Homo sapiens
gaucucaagaguccaguag

SEQ ID NO: 1543389 - RNA, 19 nt, Homo sapiens
gcuccugcuuccucuuguu

SEQ ID NO: 1543390 - RNA, 19 nt, Homo sapiens
cgccagcccagcaucaaua

SEQ ID NO: 1543391 - RNA, 19 nt, Homo sapiens
acacugagaugaggagacu

SEQ ID NO: 1543392 - RNA, 19 nt, Homo sapiens
cauauguaaaugccaguaa

SEQ ID NO: 1543393 - RNA, 19 nt, Homo sapiens
gguuucacuuuccucuuug

SEQ ID NO: 1543394 - RNA, 19 nt, Homo sapiens
caguuuaucagucaauuuc

SEQ ID NO: 1543395 - RNA, 19 nt, Homo sapiens
uaaacugaagagugaugua

SEQ ID NO: 1543396 - RNA, 19 nt, Homo sapiens
uuuaugagaggcuuuggua

SEQ ID NO: 1543397 - RNA, 19 nt, Homo sapiens
guucaaugugacuacuuua

SEQ ID NO: 1543398 - RNA, 19 nt, Homo sapiens
ggagguggaugacuucuuu

SEQ ID NO: 1543399 - RNA, 19 nt, Homo sapiens
ggagagcgauggagacgua

SEQ ID NO: 1543400 - RNA, 19 nt, Homo sapiens
ccaagucacugucaaagaa

SEQ ID NO: 1543401 - RNA, 19 nt, Homo sapiens
caaggacaccgaacaguua

SEQ ID NO: 1543402 - RNA, 19 nt, Homo sapiens
caaggcaagucacuaguuu

SEQ ID NO: 1543403 - RNA, 19 nt, Homo sapiens
gggaaaagcuacagaaauu

SEQ ID NO: 1543404 - RNA, 19 nt, Homo sapiens
gcucucagccuuuggauaa

SEQ ID NO: 1543405 - RNA, 19 nt, Homo sapiens
ggaccuuccuguuggagua

SEQ ID NO: 1543406 - RNA, 19 nt, Homo sapiens
gggaagaguuugccaagau

SEQ ID NO: 1543407 - RNA, 19 nt, Homo sapiens
gguguaggcucuccuguug

SEQ ID NO: 1543408 - RNA, 19 nt, Homo sapiens
ggacacaaccucagaaugg

SEQ ID NO: 1543409 - RNA, 19 nt, Homo sapiens
caccagaacugcuuaauac

SEQ ID NO: 1543410 - RNA, 19 nt, Homo sapiens
ggaagaguuugccaagaug

SEQ ID NO: 1543411 - RNA, 19 nt, Homo sapiens
ucaaggagguggaugacuu

SEQ ID NO: 1543412 - RNA, 19 nt, Homo sapiens
ccaaacaccugagccaaga

SEQ ID NO: 1543413 - RNA, 19 nt, Homo sapiens
caaauuggcagagcucuuu

SEQ ID NO: 1543414 - RNA, 19 nt, Homo sapiens
gggcgugccuuguuguuug

SEQ ID NO: 1543415 - RNA, 19 nt, Homo sapiens
gaagucaaccagcuaagga

SEQ ID NO: 1543416 - RNA, 19 nt, Homo sapiens
ccaccagaacugcuuaaua

SEQ ID NO: 1543417 - RNA, 19 nt, Homo sapiens
aaaugugaacccagaauua

SEQ ID NO: 1543418 - RNA, 19 nt, Homo sapiens
gagcagggcgugccuuguu

SEQ ID NO: 1543419 - RNA, 19 nt, Homo sapiens
ugaggaauauugugaaguc

SEQ ID NO: 1543420 - RNA, 19 nt, Homo sapiens
gaggguuucugaggaauau

SEQ ID NO: 1543421 - RNA, 19 nt, Homo sapiens
uaaggacccugcccgacaa

SEQ ID NO: 1543422 - RNA, 19 nt, Homo sapiens
uaggagacaugccacguau

SEQ ID NO: 1543423 - RNA, 19 nt, Homo sapiens
agcaagagcucauggacuu

SEQ ID NO: 1543424 - RNA, 19 nt, Homo sapiens
gaauauggacaggaucuga

SEQ ID NO: 1543425 - RNA, 19 nt, Homo sapiens
caacaaacccaccagaacu

SEQ ID NO: 1543426 - RNA, 19 nt, Homo sapiens
ggagacaugccacguauac

SEQ ID NO: 1543427 - RNA, 19 nt, Homo sapiens
cggaguaccuggccaucuu

SEQ ID NO: 1543428 - RNA, 19 nt, Homo sapiens
ccaaggacaccgaacaguu

SEQ ID NO: 1543429 - RNA, 19 nt, Homo sapiens
gaacacaggaagucaacca

SEQ ID NO: 1543430 - RNA, 19 nt, Homo sapiens
gaagaguuugccaagauga

SEQ ID NO: 1543431 - RNA, 19 nt, Homo sapiens
ggagacguaugcggagguu

SEQ ID NO: 1543432 - RNA, 19 nt, Homo sapiens
cauggccucugaucaccua

SEQ ID NO: 1543433 - RNA, 19 nt, Homo sapiens
cagacaugcugagguacua

SEQ ID NO: 1543434 - RNA, 19 nt, Homo sapiens
ggaggguuucugaggaaua

SEQ ID NO: 1543435 - RNA, 19 nt, Homo sapiens
guacuugcucucagccuuu

SEQ ID NO: 1543436 - RNA, 19 nt, Homo sapiens
aaauuaacaugccaaacuc

SEQ ID NO: 1543437 - RNA, 19 nt, Homo sapiens
guucccagcuaggcucuuu

SEQ ID NO: 1543438 - RNA, 19 nt, Homo sapiens
gcagaaccuugaccaaaau

SEQ ID NO: 1543439 - RNA, 19 nt, Homo sapiens
ggaguaccuggccaucuuu

SEQ ID NO: 1543440 - RNA, 19 nt, Homo sapiens
ggacaccgaacaguuacaa

SEQ ID NO: 1543441 - RNA, 19 nt, Homo sapiens
ccuuacagguggagauuuc

SEQ ID NO: 1543442 - RNA, 19 nt, Homo sapiens
aaugugaacccagaauuaa

SEQ ID NO: 1543443 - RNA, 19 nt, Homo sapiens
ccaaggcaagucacuaguu

SEQ ID NO: 1543444 - RNA, 19 nt, Homo sapiens
caacaaggcgcuggacaag

SEQ ID NO: 1543445 - RNA, 19 nt, Homo sapiens
cuacgagaaugccaacaag

SEQ ID NO: 1543446 - RNA, 19 nt, Homo sapiens
gagaggcuuugagcuguuc

SEQ ID NO: 1543447 - RNA, 19 nt, Homo sapiens
ccaaccaagacaagaauug

SEQ ID NO: 1543448 - RNA, 19 nt, Homo sapiens
ccaacaaggcgcuggacaa

SEQ ID NO: 1543449 - RNA, 19 nt, Homo sapiens
ccaaggagaggcugagaca

SEQ ID NO: 1543450 - RNA, 19 nt, Homo sapiens
gggaugguguugggaagga

SEQ ID NO: 1543451 - RNA, 19 nt, Homo sapiens
cccgacaacucccuucuuc

SEQ ID NO: 1543452 - RNA, 19 nt, Homo sapiens
aagcagaaccuugaccaaa

SEQ ID NO: 1543453 - RNA, 19 nt, Homo sapiens
ggauagaaaugcaaaacuc

SEQ ID NO: 1543454 - RNA, 19 nt, Homo sapiens
ggccucugaucaccuaguu

SEQ ID NO: 1543455 - RNA, 19 nt, Homo sapiens
gaugggacacaaccucaga

SEQ ID NO: 1543456 - RNA, 19 nt, Homo sapiens
caccuccucuggcguugaa

SEQ ID NO: 1543457 - RNA, 19 nt, Homo sapiens
aaggagaggcugagacaga

SEQ ID NO: 1543458 - RNA, 19 nt, Homo sapiens
gaguaccuggccaucuuua

SEQ ID NO: 1543459 - RNA, 19 nt, Homo sapiens
ccacccaagucacugucaa

SEQ ID NO: 1543460 - RNA, 19 nt, Homo sapiens
gcugagacagagaggcuuu

SEQ ID NO: 1543461 - RNA, 19 nt, Homo sapiens
guaccuggccaucuuuaag

SEQ ID NO: 1543462 - RNA, 19 nt, Homo sapiens
caaacacgccaaggcagaa

SEQ ID NO: 1543463 - RNA, 19 nt, Homo sapiens
ucggaggguuucugaggaa

SEQ ID NO: 1543464 - RNA, 19 nt, Homo sapiens
accgaacaguuacaacaaa

SEQ ID NO: 1543465 - RNA, 19 nt, Homo sapiens
gcaaaacucgugaaaagca

SEQ ID NO: 1543466 - RNA, 19 nt, Homo sapiens
cuaggagacaugccacgua

SEQ ID NO: 1543467 - RNA, 19 nt, Homo sapiens
ccucuggcguugaagacuu

SEQ ID NO: 1543468 - RNA, 19 nt, Homo sapiens
augccuacguggagaauga

SEQ ID NO: 1543469 - RNA, 19 nt, Homo sapiens
ugagugagcgggacaaggu

SEQ ID NO: 1543470 - RNA, 19 nt, Homo sapiens
agaagacaguugcgaugca

SEQ ID NO: 1543471 - RNA, 19 nt, Homo sapiens
ccccagaagucgcugauaa

SEQ ID NO: 1543472 - RNA, 19 nt, Homo sapiens
ucaugucguugaacaccuu

SEQ ID NO: 1543473 - RNA, 19 nt, Homo sapiens
agagaggcuuugagcuguu

SEQ ID NO: 1543474 - RNA, 19 nt, Homo sapiens
caggaagucaaccagcuaa

SEQ ID NO: 1543475 - RNA, 19 nt, Homo sapiens
gugaaaagcagaaccuuga

SEQ ID NO: 1543476 - RNA, 19 nt, Homo sapiens
caugaggggucacucugua

SEQ ID NO: 1543477 - RNA, 19 nt, Homo sapiens
caaggagguggaugacuuc

SEQ ID NO: 1543478 - RNA, 19 nt, Homo sapiens
cccagaagucgcugauaaa

SEQ ID NO: 1543479 - RNA, 19 nt, Homo sapiens
gaacccagaauuaaaagau

SEQ ID NO: 1543480 - RNA, 19 nt, Homo sapiens
caagagcucauggacuuca

SEQ ID NO: 1543481 - RNA, 19 nt, Homo sapiens
ggaugguguugggaaggaa

SEQ ID NO: 1543482 - RNA, 19 nt, Homo sapiens
ggaagucaaccagcuaagg

SEQ ID NO: 1543483 - RNA, 19 nt, Homo sapiens
gcugagcagucugggaaca

SEQ ID NO: 1543484 - RNA, 19 nt, Homo sapiens
gagcugccucccucacuuc

SEQ ID NO: 1543485 - RNA, 19 nt, Homo sapiens
caguugcgaugcacgaagu

SEQ ID NO: 1543486 - RNA, 19 nt, Homo sapiens
agacuuacgcaccuucaug

SEQ ID NO: 1543487 - RNA, 19 nt, Homo sapiens
gcucuaggugggaggugua

SEQ ID NO: 1543488 - RNA, 19 nt, Homo sapiens
ccuguaauaccaugucuuc

SEQ ID NO: 1543489 - RNA, 19 nt, Homo sapiens
ucacacccguauccgagau

SEQ ID NO: 1543490 - RNA, 19 nt, Homo sapiens
gaaaagcuacagaaauugg

SEQ ID NO: 1543491 - RNA, 19 nt, Homo sapiens
ccagaacugcuuaauacag

SEQ ID NO: 1543492 - RNA, 19 nt, Homo sapiens
ggauauggaggacccaaac

SEQ ID NO: 1543493 - RNA, 19 nt, Homo sapiens
cugaucaccuaguucaaca

SEQ ID NO: 1543494 - RNA, 19 nt, Homo sapiens
ccucugaucaccuaguuca

SEQ ID NO: 1543495 - RNA, 19 nt, Homo sapiens
cucuggcguugaagacuua

SEQ ID NO: 1543496 - RNA, 19 nt, Homo sapiens
guacuacaugcgugacuca

SEQ ID NO: 1543497 - RNA, 19 nt, Homo sapiens
agagcugccucccucacuu

SEQ ID NO: 1543498 - RNA, 19 nt, Homo sapiens
ggacaaugcuaauguauga

SEQ ID NO: 1543499 - RNA, 19 nt, Homo sapiens
caagcaagcucaaaugaaa

SEQ ID NO: 1543500 - RNA, 19 nt, Homo sapiens
guaaagguauucugaaauc

SEQ ID NO: 1543501 - RNA, 19 nt, Homo sapiens
gguacaagauccuuacaaa

SEQ ID NO: 1543502 - RNA, 19 nt, Homo sapiens
ggaugaugcuugcaaacua

SEQ ID NO: 1543503 - RNA, 19 nt, Homo sapiens
gaugaugcuugcaaacuaa

SEQ ID NO: 1543504 - RNA, 19 nt, Homo sapiens
uaacagcuggcgcaaauua

SEQ ID NO: 1543505 - RNA, 19 nt, Homo sapiens
gcagcggaauucuauguaa

SEQ ID NO: 1543506 - RNA, 19 nt, Homo sapiens
gcuugucugucuauaaaua

SEQ ID NO: 1543507 - RNA, 19 nt, Homo sapiens
ccaggacaaugcuaaugua

SEQ ID NO: 1543508 - RNA, 19 nt, Homo sapiens
gcaagaucauuacuaucaa

SEQ ID NO: 1543509 - RNA, 19 nt, Homo sapiens
aauaacagcuggcgcaaau

SEQ ID NO: 1543510 - RNA, 19 nt, Homo sapiens
gaaacaagcgauuacuuca

SEQ ID NO: 1543511 - RNA, 19 nt, Homo sapiens
uauggaagaugaacguauu

SEQ ID NO: 1543512 - RNA, 19 nt, Homo sapiens
ccucaaauguaccacguaa

SEQ ID NO: 1543513 - RNA, 19 nt, Homo sapiens
caugcaagauuauguacaa

SEQ ID NO: 1543514 - RNA, 19 nt, Homo sapiens
guauuaaugccgucaagua

SEQ ID NO: 1543515 - RNA, 19 nt, Homo sapiens
aacaagcgauuacuucauu

SEQ ID NO: 1543516 - RNA, 19 nt, Homo sapiens
aauaugcuguguccuuuaa

SEQ ID NO: 1543517 - RNA, 19 nt, Homo sapiens
caaguaaggcaguggauga

SEQ ID NO: 1543518 - RNA, 19 nt, Homo sapiens
aaggaaauuucaccguaua

SEQ ID NO: 1543519 - RNA, 19 nt, Homo sapiens
cacaugaaauacugaagaa

SEQ ID NO: 1543520 - RNA, 19 nt, Homo sapiens
cuaauaugcuguguccuuu

SEQ ID NO: 1543521 - RNA, 19 nt, Homo sapiens
gaguauguguaauaaagga

SEQ ID NO: 1543522 - RNA, 19 nt, Homo sapiens
cugcuugucugucuauaaa

SEQ ID NO: 1543523 - RNA, 19 nt, Homo sapiens
aaaggaaauuucaccguau

SEQ ID NO: 1543524 - RNA, 19 nt, Homo sapiens
ccacguaaagguauucuga

SEQ ID NO: 1543525 - RNA, 19 nt, Homo sapiens
guuaagaaacaagcgauua

SEQ ID NO: 1543526 - RNA, 19 nt, Homo sapiens
uaacgcaagagauccauaa

SEQ ID NO: 1543527 - RNA, 19 nt, Homo sapiens
caaaccgucuacgaaauga

SEQ ID NO: 1543528 - RNA, 19 nt, Homo sapiens
cgcaagagauccauaagca

SEQ ID NO: 1543529 - RNA, 19 nt, Homo sapiens
aaugauauuucgacuccua

SEQ ID NO: 1543530 - RNA, 19 nt, Homo sapiens
gaaucguuccucaaaugua

SEQ ID NO: 1543531 - RNA, 19 nt, Homo sapiens
gcagaguacauuucgcaaa

SEQ ID NO: 1543532 - RNA, 19 nt, Homo sapiens
caucagguacaaaggauaa

SEQ ID NO: 1543533 - RNA, 19 nt, Homo sapiens
uggcgcaaauuaaaucuug

SEQ ID NO: 1543534 - RNA, 19 nt, Homo sapiens
aaagacauuucagcucaaa

SEQ ID NO: 1543535 - RNA, 19 nt, Homo sapiens
uaaagacauuucagcucaa

SEQ ID NO: 1543536 - RNA, 19 nt, Homo sapiens
gaacaguuaauugacagaa

SEQ ID NO: 1543537 - RNA, 19 nt, Homo sapiens
gaacguauuuucccgaagu

SEQ ID NO: 1543538 - RNA, 19 nt, Homo sapiens
ggccaugguuacaaguauu

SEQ ID NO: 1543539 - RNA, 19 nt, Homo sapiens
caccuuucaucguguuuaa

SEQ ID NO: 1543540 - RNA, 19 nt, Homo sapiens
acagagggcuugguuaucu

SEQ ID NO: 1543541 - RNA, 19 nt, Homo sapiens
aaaugaaucguuccucaaa

SEQ ID NO: 1543542 - RNA, 19 nt, Homo sapiens
gauccaagcaagcucaaau

SEQ ID NO: 1543543 - RNA, 19 nt, Homo sapiens
uauuaaugccgucaaguaa

SEQ ID NO: 1543544 - RNA, 19 nt, Homo sapiens
uguaacacaugaaauacug

SEQ ID NO: 1543545 - RNA, 19 nt, Homo sapiens
ccaagcaagcucaaaugaa

SEQ ID NO: 1543546 - RNA, 19 nt, Homo sapiens
ggaaauuucaccguauaau

SEQ ID NO: 1543547 - RNA, 19 nt, Homo sapiens
uauuaaggauccuacuaug

SEQ ID NO: 1543548 - RNA, 19 nt, Homo sapiens
acguaaagguauucugaaa

SEQ ID NO: 1543549 - RNA, 19 nt, Homo sapiens
ucaaauguaccacguaaag

SEQ ID NO: 1543550 - RNA, 19 nt, Homo sapiens
gaaaauauucccaggacaa

SEQ ID NO: 1543551 - RNA, 19 nt, Homo sapiens
auuuagaggugaaacguuu

SEQ ID NO: 1543552 - RNA, 19 nt, Homo sapiens
agaaacaagcgauuacuuc

SEQ ID NO: 1543553 - RNA, 19 nt, Homo sapiens
caccagcuacggauuguuu

SEQ ID NO: 1543554 - RNA, 19 nt, Homo sapiens
gauucuccaucaugauaau

SEQ ID NO: 1543555 - RNA, 19 nt, Homo sapiens
ucaaaccgucuacgaaaug

SEQ ID NO: 1543556 - RNA, 19 nt, Homo sapiens
ucucaaaccgucuacgaaa

SEQ ID NO: 1543557 - RNA, 19 nt, Homo sapiens
guccaaaguaacugauaua

SEQ ID NO: 1543558 - RNA, 19 nt, Homo sapiens
uaauaugcuguguccuuua

SEQ ID NO: 1543559 - RNA, 19 nt, Homo sapiens
gaucucaaaccgucuacga

SEQ ID NO: 1543560 - RNA, 19 nt, Homo sapiens
uuacuucauuggagggaaa

SEQ ID NO: 1543561 - RNA, 19 nt, Homo sapiens
auacugauggccaugguua

SEQ ID NO: 1543562 - RNA, 19 nt, Homo sapiens
caugaaauacugaagaaag

SEQ ID NO: 1543563 - RNA, 19 nt, Homo sapiens
ugcaagaucauuacuauca

SEQ ID NO: 1543564 - RNA, 19 nt, Homo sapiens
agucuggagugaucucaaa

SEQ ID NO: 1543565 - RNA, 19 nt, Homo sapiens
gguuaucucauacaaacaa

SEQ ID NO: 1543566 - RNA, 19 nt, Homo sapiens
cuaaggaaucuaugucaga

SEQ ID NO: 1543567 - RNA, 19 nt, Homo sapiens
uaacuguccaaccucuaua

SEQ ID NO: 1543568 - RNA, 19 nt, Homo sapiens
augaaucguuccucaaaug

SEQ ID NO: 1543569 - RNA, 19 nt, Homo sapiens
gcgcugggaaacugucuuu

SEQ ID NO: 1543570 - RNA, 19 nt, Homo sapiens
auacuuaacuguccaaccu

SEQ ID NO: 1543571 - RNA, 19 nt, Homo sapiens
gcgcaaauuaaaucuugaa

SEQ ID NO: 1543572 - RNA, 19 nt, Homo sapiens
uagaggcuaagcuuauuaa

SEQ ID NO: 1543573 - RNA, 19 nt, Homo sapiens
acacaugaaauacugaaga

SEQ ID NO: 1543574 - RNA, 19 nt, Homo sapiens
gggcuugguuaucucauac

SEQ ID NO: 1543575 - RNA, 19 nt, Homo sapiens
ggacucauuuuccugguau

SEQ ID NO: 1543576 - RNA, 19 nt, Homo sapiens
ugaggugacugaaccaaaa

SEQ ID NO: 1543577 - RNA, 19 nt, Homo sapiens
aauuagggguccauacuua

SEQ ID NO: 1543578 - RNA, 19 nt, Homo sapiens
caccaugcaagauuaugua

SEQ ID NO: 1543579 - RNA, 19 nt, Homo sapiens
uaauacagagggcuugguu

SEQ ID NO: 1543580 - RNA, 19 nt, Homo sapiens
caagcucaaaugaaaguug

SEQ ID NO: 1543581 - RNA, 19 nt, Homo sapiens
uauaucggcccuacaaaca

SEQ ID NO: 1543582 - RNA, 19 nt, Homo sapiens
gcuacggauuguuucugaa

SEQ ID NO: 1543583 - RNA, 19 nt, Homo sapiens
uuaaugccgucaaguaagg

SEQ ID NO: 1543584 - RNA, 19 nt, Homo sapiens
gccaugguuacaaguauuu

SEQ ID NO: 1543585 - RNA, 19 nt, Homo sapiens
gauccuacuaugcagugua

SEQ ID NO: 1543586 - RNA, 19 nt, Homo sapiens
uuaaggauccuacuaugca

SEQ ID NO: 1543587 - RNA, 19 nt, Homo sapiens
auacagagggcuugguuau

SEQ ID NO: 1543588 - RNA, 19 nt, Homo sapiens
ucuacgaaaugaaaugaag

SEQ ID NO: 1543589 - RNA, 19 nt, Homo sapiens
uauguacaauaucgcaguu

SEQ ID NO: 1543590 - RNA, 19 nt, Homo sapiens
gcacgaaaugcaagaucau

SEQ ID NO: 1543591 - RNA, 19 nt, Homo sapiens
ugaaaucagguacaagauc

SEQ ID NO: 1543592 - RNA, 19 nt, Homo sapiens
cgaaguccaaaguaacuga

SEQ ID NO: 1543593 - RNA, 19 nt, Homo sapiens
gcuugguuaucucauacaa

SEQ ID NO: 1543594 - RNA, 19 nt, Homo sapiens
aaucguuccucaaauguac

SEQ ID NO: 1543595 - RNA, 19 nt, Homo sapiens
gauauaauggauguuguca

SEQ ID NO: 1543596 - RNA, 19 nt, Homo sapiens
caaucugcuugucugucua

SEQ ID NO: 1543597 - RNA, 19 nt, Homo sapiens
aaacuaaggaaucuauguc

SEQ ID NO: 1543598 - RNA, 19 nt, Homo sapiens
cagcgucucugcucacuua

SEQ ID NO: 1543599 - RNA, 19 nt, Homo sapiens
cccaaacucucucuuaauu

SEQ ID NO: 1543600 - RNA, 19 nt, Homo sapiens
aaacagcccuagcagcaaa

SEQ ID NO: 1543601 - RNA, 19 nt, Homo sapiens
cggcugcgcugaaguguga

SEQ ID NO: 1543602 - RNA, 19 nt, Homo sapiens
cgacgcagauggacacugu

SEQ ID NO: 1543603 - RNA, 19 nt, Homo sapiens
caaacucucucuuaauugc

SEQ ID NO: 1543604 - RNA, 19 nt, Homo sapiens
gcgguggaguguccuaauu

SEQ ID NO: 1543605 - RNA, 19 nt, Homo sapiens
ccacagaggguccugagaa

SEQ ID NO: 1543606 - RNA, 19 nt, Homo sapiens
gaugaaacccagauaugga

SEQ ID NO: 1543607 - RNA, 19 nt, Homo sapiens
ccaaccaguucaugcagaa

SEQ ID NO: 1543608 - RNA, 19 nt, Homo sapiens
caucagcuccuacugcaaa

SEQ ID NO: 1543609 - RNA, 19 nt, Homo sapiens
gaacaucucaaccgcuaca

SEQ ID NO: 1543610 - RNA, 19 nt, Homo sapiens
gcaccaggcacacagaugu

SEQ ID NO: 1543611 - RNA, 19 nt, Homo sapiens
gaaguggugugaggucaag

SEQ ID NO: 1543612 - RNA, 19 nt, Homo sapiens
cagcucggcuucagugaca

SEQ ID NO: 1543613 - RNA, 19 nt, Homo sapiens
ccacaaucaucagcuccua

SEQ ID NO: 1543614 - RNA, 19 nt, Homo sapiens
gcuccuaccugcucauugc

SEQ ID NO: 1543615 - RNA, 19 nt, Homo sapiens
uguaccagcuucccaacaa

SEQ ID NO: 1543616 - RNA, 19 nt, Homo sapiens
ccucacaucucccaaacuc

SEQ ID NO: 1543617 - RNA, 19 nt, Homo sapiens
gcaccacacccuacaugau

SEQ ID NO: 1543618 - RNA, 19 nt, Homo sapiens
cucccaaacucucucuuaa

SEQ ID NO: 1543619 - RNA, 19 nt, Homo sapiens
gggcuuggccgaaggacuu

SEQ ID NO: 1543620 - RNA, 19 nt, Homo sapiens
cacagaggguccugagaau

SEQ ID NO: 1543621 - RNA, 19 nt, Homo sapiens
caucucaaccgcuacauca

SEQ ID NO: 1543622 - RNA, 19 nt, Homo sapiens
uaugcucgccucacccuua

SEQ ID NO: 1543623 - RNA, 19 nt, Homo sapiens
gggcccuucuucuacauug

SEQ ID NO: 1543624 - RNA, 19 nt, Homo sapiens
ccaguuacuuuccucacau

SEQ ID NO: 1543625 - RNA, 19 nt, Homo sapiens
ccacuugaccaaccaguuc

SEQ ID NO: 1543626 - RNA, 19 nt, Homo sapiens
gccaaggacugggucuuca

SEQ ID NO: 1543627 - RNA, 19 nt, Homo sapiens
ccaaacucucucuuaauug

SEQ ID NO: 1543628 - RNA, 19 nt, Homo sapiens
gagcauggaacaucucaac

SEQ ID NO: 1543629 - RNA, 19 nt, Homo sapiens
gcagcgcggugugaaacug

SEQ ID NO: 1543630 - RNA, 19 nt, Homo sapiens
ggugugaaacugggauaaa

SEQ ID NO: 1543631 - RNA, 19 nt, Homo sapiens
cagacucggaugacacuaa

SEQ ID NO: 1543632 - RNA, 19 nt, Homo sapiens
cacccuacaugaucuucuu

SEQ ID NO: 1543633 - RNA, 19 nt, Homo sapiens
ggaccucaaacacgagaga

SEQ ID NO: 1543634 - RNA, 19 nt, Homo sapiens
gguggaguguccuaauuuu

SEQ ID NO: 1543635 - RNA, 19 nt, Homo sapiens
uguacaugcugcugaagga

SEQ ID NO: 1543636 - RNA, 19 nt, Homo sapiens
cgauaauucacagaacaua

SEQ ID NO: 1543637 - RNA, 19 nt, Homo sapiens
ucucccaaacucucucuua

SEQ ID NO: 1543638 - RNA, 19 nt, Homo sapiens
cagaggguccugagaaugg

SEQ ID NO: 1543639 - RNA, 19 nt, Homo sapiens
ggauaccucaggccacaga

SEQ ID NO: 1543640 - RNA, 19 nt, Homo sapiens
ccugagaauggaagaguuu

SEQ ID NO: 1543641 - RNA, 19 nt, Homo sapiens
ccgaaggacuuuuaucugu

SEQ ID NO: 1543642 - RNA, 19 nt, Homo sapiens
gguggacgggagaaaguuu

SEQ ID NO: 1543643 - RNA, 19 nt, Homo sapiens
gaaggacuuuuaucugucu

SEQ ID NO: 1543644 - RNA, 19 nt, Homo sapiens
cccggacucucccuagcua

SEQ ID NO: 1543645 - RNA, 19 nt, Homo sapiens
gccucacccuuagccuuua

SEQ ID NO: 1543646 - RNA, 19 nt, Homo sapiens
caccacacccuacaugauc

SEQ ID NO: 1543647 - RNA, 19 nt, Homo sapiens
uugcaggguuccuuucugu

SEQ ID NO: 1543648 - RNA, 19 nt, Homo sapiens
ugacagccaccaugugaag

SEQ ID NO: 1543649 - RNA, 19 nt, Homo sapiens
ucaagagccgagacagcua

SEQ ID NO: 1543650 - RNA, 19 nt, Homo sapiens
caaacagcccuagcagcaa

SEQ ID NO: 1543651 - RNA, 19 nt, Homo sapiens
acaagcuccucaccaccaa

SEQ ID NO: 1543652 - RNA, 19 nt, Homo sapiens
gagcagcgcggugugaaac

SEQ ID NO: 1543653 - RNA, 19 nt, Homo sapiens
cgguggaguguccuaauuu

SEQ ID NO: 1543654 - RNA, 19 nt, Homo sapiens
ccuuucagauccuccacuu

SEQ ID NO: 1543655 - RNA, 19 nt, Homo sapiens
gcagagguacauccagaac

SEQ ID NO: 1543656 - RNA, 19 nt, Homo sapiens
agugacagccaccauguga

SEQ ID NO: 1543657 - RNA, 19 nt, Homo sapiens
cgccucacccuuagccuuu

SEQ ID NO: 1543658 - RNA, 19 nt, Homo sapiens
guaccagcuucccaacaac

SEQ ID NO: 1543659 - RNA, 19 nt, Homo sapiens
gcgauaauucacagaacau

SEQ ID NO: 1543660 - RNA, 19 nt, Homo sapiens
ugcgauaauucacagaaca

SEQ ID NO: 1543661 - RNA, 19 nt, Homo sapiens
gugugaaacugggauaaaa

SEQ ID NO: 1543662 - RNA, 19 nt, Homo sapiens
agucuuuguuccuuucaga

SEQ ID NO: 1543663 - RNA, 19 nt, Homo sapiens
caggaaagguggacagaga

SEQ ID NO: 1543664 - RNA, 19 nt, Homo sapiens
cuaaauaccuaccaacagu
